United States Patent 10,968,269 (MHC MULTIMERS IN BORRELIA DIAGNOSTICS AND DISEASE) - sequence listing, part 3

SEQ ID NO: 47506 - protein, 8 aa, Borrelia burgdorferi B31
DLVNTTTN

SEQ ID NO: 47507 - protein, 8 aa, Borrelia burgdorferi B31
LVNTTTNI

SEQ ID NO: 47508 - protein, 8 aa, Borrelia burgdorferi B31
VNTTTNIL

SEQ ID NO: 47509 - protein, 8 aa, Borrelia burgdorferi B31
NTTTNILA

SEQ ID NO: 47510 - protein, 8 aa, Borrelia burgdorferi B31
TTTNILAP

SEQ ID NO: 47511 - protein, 8 aa, Borrelia burgdorferi B31
TTNILAPI

SEQ ID NO: 47512 - protein, 8 aa, Borrelia burgdorferi B31
TNILAPIQ

SEQ ID NO: 47513 - protein, 9 aa, Borrelia burgdorferi B31
MKDNILKNN

SEQ ID NO: 47514 - protein, 9 aa, Borrelia burgdorferi B31
KDNILKNNK

SEQ ID NO: 47515 - protein, 9 aa, Borrelia burgdorferi B31
DNILKNNKL

SEQ ID NO: 47516 - protein, 9 aa, Borrelia burgdorferi B31
NILKNNKLI

SEQ ID NO: 47517 - protein, 9 aa, Borrelia burgdorferi B31
ILKNNKLIA

SEQ ID NO: 47518 - protein, 9 aa, Borrelia burgdorferi B31
LKNNKLIAI

SEQ ID NO: 47519 - protein, 9 aa, Borrelia burgdorferi B31
KNNKLIAIF

SEQ ID NO: 47520 - protein, 9 aa, Borrelia burgdorferi B31
NNKLIAIFL

SEQ ID NO: 47521 - protein, 9 aa, Borrelia burgdorferi B31
NKLIAIFLL

SEQ ID NO: 47522 - protein, 9 aa, Borrelia burgdorferi B31
KLIAIFLLH

SEQ ID NO: 47523 - protein, 9 aa, Borrelia burgdorferi B31
LIAIFLLHV

SEQ ID NO: 47524 - protein, 9 aa, Borrelia burgdorferi B31
IAIFLLHVL

SEQ ID NO: 47525 - protein, 9 aa, Borrelia burgdorferi B31
AIFLLHVLT

SEQ ID NO: 47526 - protein, 9 aa, Borrelia burgdorferi B31
IFLLHVLTV

SEQ ID NO: 47527 - protein, 9 aa, Borrelia burgdorferi B31
FLLHVLTVL

SEQ ID NO: 47528 - protein, 9 aa, Borrelia burgdorferi B31
LLHVLTVLI

SEQ ID NO: 47529 - protein, 9 aa, Borrelia burgdorferi B31
LHVLTVLIL

SEQ ID NO: 47530 - protein, 9 aa, Borrelia burgdorferi B31
HVLTVLILI

SEQ ID NO: 47531 - protein, 9 aa, Borrelia burgdorferi B31
VLTVLILIS

SEQ ID NO: 47532 - protein, 9 aa, Borrelia burgdorferi B31
LTVLILISC

SEQ ID NO: 47533 - protein, 9 aa, Borrelia burgdorferi B31
TVLILISCS

SEQ ID NO: 47534 - protein, 9 aa, Borrelia burgdorferi B31
VLILISCSL

SEQ ID NO: 47535 - protein, 9 aa, Borrelia burgdorferi B31
LILISCSLE

SEQ ID NO: 47536 - protein, 9 aa, Borrelia burgdorferi B31
ILISCSLEV

SEQ ID NO: 47537 - protein, 9 aa, Borrelia burgdorferi B31
LISCSLEVK

SEQ ID NO: 47538 - protein, 9 aa, Borrelia burgdorferi B31
ISCSLEVKD

SEQ ID NO: 47539 - protein, 9 aa, Borrelia burgdorferi B31
SCSLEVKDS

SEQ ID NO: 47540 - protein, 9 aa, Borrelia burgdorferi B31
CSLEVKDSN

SEQ ID NO: 47541 - protein, 9 aa, Borrelia burgdorferi B31
SLEVKDSNE

SEQ ID NO: 47542 - protein, 9 aa, Borrelia burgdorferi B31
LEVKDSNES

SEQ ID NO: 47543 - protein, 9 aa, Borrelia burgdorferi B31
EVKDSNESK

SEQ ID NO: 47544 - protein, 9 aa, Borrelia burgdorferi B31
VKDSNESKK

SEQ ID NO: 47545 - protein, 9 aa, Borrelia burgdorferi B31
KDSNESKKH

SEQ ID NO: 47546 - protein, 9 aa, Borrelia burgdorferi B31
DSNESKKHK

SEQ ID NO: 47547 - protein, 9 aa, Borrelia burgdorferi B31
SNESKKHKK

SEQ ID NO: 47548 - protein, 9 aa, Borrelia burgdorferi B31
NESKKHKKE

SEQ ID NO: 47549 - protein, 9 aa, Borrelia burgdorferi B31
ESKKHKKEK

SEQ ID NO: 47550 - protein, 9 aa, Borrelia burgdorferi B31
SKKHKKEKR

SEQ ID NO: 47551 - protein, 9 aa, Borrelia burgdorferi B31
KKHKKEKRK

SEQ ID NO: 47552 - protein, 9 aa, Borrelia burgdorferi B31
KHKKEKRKG

SEQ ID NO: 47553 - protein, 9 aa, Borrelia burgdorferi B31
HKKEKRKGK

SEQ ID NO: 47554 - protein, 9 aa, Borrelia burgdorferi B31
KKEKRKGKV

SEQ ID NO: 47555 - protein, 9 aa, Borrelia burgdorferi B31
KEKRKGKVE

SEQ ID NO: 47556 - protein, 9 aa, Borrelia burgdorferi B31
EKRKGKVEN

SEQ ID NO: 47557 - protein, 9 aa, Borrelia burgdorferi B31
KRKGKVENL

SEQ ID NO: 47558 - protein, 9 aa, Borrelia burgdorferi B31
RKGKVENLL

SEQ ID NO: 47559 - protein, 9 aa, Borrelia burgdorferi B31
KGKVENLLV

SEQ ID NO: 47560 - protein, 9 aa, Borrelia burgdorferi B31
GKVENLLVA

SEQ ID NO: 47561 - protein, 9 aa, Borrelia burgdorferi B31
KVENLLVAI

SEQ ID NO: 47562 - protein, 9 aa, Borrelia burgdorferi B31
VENLLVAIN

SEQ ID NO: 47563 - protein, 9 aa, Borrelia burgdorferi B31
ENLLVAINN

SEQ ID NO: 47564 - protein, 9 aa, Borrelia burgdorferi B31
NLLVAINNL

SEQ ID NO: 47565 - protein, 9 aa, Borrelia burgdorferi B31
LLVAINNLK

SEQ ID NO: 47566 - protein, 9 aa, Borrelia burgdorferi B31
LVAINNLKN

SEQ ID NO: 47567 - protein, 9 aa, Borrelia burgdorferi B31
VAINNLKNP

SEQ ID NO: 47568 - protein, 9 aa, Borrelia burgdorferi B31
AINNLKNPT

SEQ ID NO: 47569 - protein, 9 aa, Borrelia burgdorferi B31
INNLKNPTK

SEQ ID NO: 47570 - protein, 9 aa, Borrelia burgdorferi B31
NNLKNPTKP

SEQ ID NO: 47571 - protein, 9 aa, Borrelia burgdorferi B31
NLKNPTKPA

SEQ ID NO: 47572 - protein, 9 aa, Borrelia burgdorferi B31
LKNPTKPAA

SEQ ID NO: 47573 - protein, 9 aa, Borrelia burgdorferi B31
KNPTKPAAG

SEQ ID NO: 47574 - protein, 9 aa, Borrelia burgdorferi B31
NPTKPAAGK

SEQ ID NO: 47575 - protein, 9 aa, Borrelia burgdorferi B31
PTKPAAGKN

SEQ ID NO: 47576 - protein, 9 aa, Borrelia burgdorferi B31
TKPAAGKNK

SEQ ID NO: 47577 - protein, 9 aa, Borrelia burgdorferi B31
KPAAGKNKA

SEQ ID NO: 47578 - protein, 9 aa, Borrelia burgdorferi B31
PAAGKNKAN

SEQ ID NO: 47579 - protein, 9 aa, Borrelia burgdorferi B31
AAGKNKANS

SEQ ID NO: 47580 - protein, 9 aa, Borrelia burgdorferi B31
AGKNKANSK

SEQ ID NO: 47581 - protein, 9 aa, Borrelia burgdorferi B31
GKNKANSKA

SEQ ID NO: 47582 - protein, 9 aa, Borrelia burgdorferi B31
KNKANSKAS

SEQ ID NO: 47583 - protein, 9 aa, Borrelia burgdorferi B31
NKANSKASK

SEQ ID NO: 47584 - protein, 9 aa, Borrelia burgdorferi B31
KANSKASKQ

SEQ ID NO: 47585 - protein, 9 aa, Borrelia burgdorferi B31
ANSKASKQK

SEQ ID NO: 47586 - protein, 9 aa, Borrelia burgdorferi B31
NSKASKQKN

SEQ ID NO: 47587 - protein, 9 aa, Borrelia burgdorferi B31
SKASKQKNN

SEQ ID NO: 47588 - protein, 9 aa, Borrelia burgdorferi B31
KASKQKNNP

SEQ ID NO: 47589 - protein, 9 aa, Borrelia burgdorferi B31
ASKQKNNPN

SEQ ID NO: 47590 - protein, 9 aa, Borrelia burgdorferi B31
SKQKNNPNA

SEQ ID NO: 47591 - protein, 9 aa, Borrelia burgdorferi B31
KQKNNPNAN

SEQ ID NO: 47592 - protein, 9 aa, Borrelia burgdorferi B31
QKNNPNANA

SEQ ID NO: 47593 - protein, 9 aa, Borrelia burgdorferi B31
KNNPNANAN

SEQ ID NO: 47594 - protein, 9 aa, Borrelia burgdorferi B31
NNPNANANN

SEQ ID NO: 47595 - protein, 9 aa, Borrelia burgdorferi B31
NPNANANNA

SEQ ID NO: 47596 - protein, 9 aa, Borrelia burgdorferi B31
PNANANNAP

SEQ ID NO: 47597 - protein, 9 aa, Borrelia burgdorferi B31
NANANNAPK

SEQ ID NO: 47598 - protein, 9 aa, Borrelia burgdorferi B31
ANANNAPKK

SEQ ID NO: 47599 - protein, 9 aa, Borrelia burgdorferi B31
NANNAPKKI

SEQ ID NO: 47600 - protein, 9 aa, Borrelia burgdorferi B31
ANNAPKKIL

SEQ ID NO: 47601 - protein, 9 aa, Borrelia burgdorferi B31
NNAPKKILD

SEQ ID NO: 47602 - protein, 9 aa, Borrelia burgdorferi B31
NAPKKILDP

SEQ ID NO: 47603 - protein, 9 aa, Borrelia burgdorferi B31
APKKILDPE

SEQ ID NO: 47604 - protein, 9 aa, Borrelia burgdorferi B31
PKKILDPEV

SEQ ID NO: 47605 - protein, 9 aa, Borrelia burgdorferi B31
KKILDPEVA

SEQ ID NO: 47606 - protein, 9 aa, Borrelia burgdorferi B31
KILDPEVAK

SEQ ID NO: 47607 - protein, 9 aa, Borrelia burgdorferi B31
ILDPEVAKL

SEQ ID NO: 47608 - protein, 9 aa, Borrelia burgdorferi B31
LDPEVAKLI

SEQ ID NO: 47609 - protein, 9 aa, Borrelia burgdorferi B31
DPEVAKLIQ

SEQ ID NO: 47610 - protein, 9 aa, Borrelia burgdorferi B31
PEVAKLIQK

SEQ ID NO: 47611 - protein, 9 aa, Borrelia burgdorferi B31
EVAKLIQKI

SEQ ID NO: 47612 - protein, 9 aa, Borrelia burgdorferi B31
VAKLIQKIL

SEQ ID NO: 47613 - protein, 9 aa, Borrelia burgdorferi B31
AKLIQKILD

SEQ ID NO: 47614 - protein, 9 aa, Borrelia burgdorferi B31
KLIQKILDR

SEQ ID NO: 47615 - protein, 9 aa, Borrelia burgdorferi B31
LIQKILDRS

SEQ ID NO: 47616 - protein, 9 aa, Borrelia burgdorferi B31
IQKILDRSE

SEQ ID NO: 47617 - protein, 9 aa, Borrelia burgdorferi B31
QKILDRSEN

SEQ ID NO: 47618 - protein, 9 aa, Borrelia burgdorferi B31
KILDRSENI

SEQ ID NO: 47619 - protein, 9 aa, Borrelia burgdorferi B31
ILDRSENII

SEQ ID NO: 47620 - protein, 9 aa, Borrelia burgdorferi B31
LDRSENIIQ

SEQ ID NO: 47621 - protein, 9 aa, Borrelia burgdorferi B31
DRSENIIQI

SEQ ID NO: 47622 - protein, 9 aa, Borrelia burgdorferi B31
RSENIIQIS

SEQ ID NO: 47623 - protein, 9 aa, Borrelia burgdorferi B31
SENIIQISE

SEQ ID NO: 47624 - protein, 9 aa, Borrelia burgdorferi B31
ENIIQISEM

SEQ ID NO: 47625 - protein, 9 aa, Borrelia burgdorferi B31
NIIQISEMD

SEQ ID NO: 47626 - protein, 9 aa, Borrelia burgdorferi B31
IIQISEMDS

SEQ ID NO: 47627 - protein, 9 aa, Borrelia burgdorferi B31
IQISEMDSS

SEQ ID NO: 47628 - protein, 9 aa, Borrelia burgdorferi B31
QISEMDSSR

SEQ ID NO: 47629 - protein, 9 aa, Borrelia burgdorferi B31
ISEMDSSRG

SEQ ID NO: 47630 - protein, 9 aa, Borrelia burgdorferi B31
SEMDSSRGE

SEQ ID NO: 47631 - protein, 9 aa, Borrelia burgdorferi B31
EMDSSRGEP

SEQ ID NO: 47632 - protein, 9 aa, Borrelia burgdorferi B31
MDSSRGEPN

SEQ ID NO: 47633 - protein, 9 aa, Borrelia burgdorferi B31
DSSRGEPND

SEQ ID NO: 47634 - protein, 9 aa, Borrelia burgdorferi B31
SSRGEPNDQ

SEQ ID NO: 47635 - protein, 9 aa, Borrelia burgdorferi B31
SRGEPNDQF

SEQ ID NO: 47636 - protein, 9 aa, Borrelia burgdorferi B31
RGEPNDQFG

SEQ ID NO: 47637 - protein, 9 aa, Borrelia burgdorferi B31
GEPNDQFGM

SEQ ID NO: 47638 - protein, 9 aa, Borrelia burgdorferi B31
EPNDQFGMR

SEQ ID NO: 47639 - protein, 9 aa, Borrelia burgdorferi B31
PNDQFGMRA

SEQ ID NO: 47640 - protein, 9 aa, Borrelia burgdorferi B31
NDQFGMRAE

SEQ ID NO: 47641 - protein, 9 aa, Borrelia burgdorferi B31
DQFGMRAEI

SEQ ID NO: 47642 - protein, 9 aa, Borrelia burgdorferi B31
QFGMRAEIF

SEQ ID NO: 47643 - protein, 9 aa, Borrelia burgdorferi B31
FGMRAEIFS

SEQ ID NO: 47644 - protein, 9 aa, Borrelia burgdorferi B31
GMRAEIFSK

SEQ ID NO: 47645 - protein, 9 aa, Borrelia burgdorferi B31
MRAEIFSKI

SEQ ID NO: 47646 - protein, 9 aa, Borrelia burgdorferi B31
RAEIFSKIF

SEQ ID NO: 47647 - protein, 9 aa, Borrelia burgdorferi B31
AEIFSKIFF

SEQ ID NO: 47648 - protein, 9 aa, Borrelia burgdorferi B31
EIFSKIFFN

SEQ ID NO: 47649 - protein, 9 aa, Borrelia burgdorferi B31
IFSKIFFNA

SEQ ID NO: 47650 - protein, 9 aa, Borrelia burgdorferi B31
FSKIFFNAN

SEQ ID NO: 47651 - protein, 9 aa, Borrelia burgdorferi B31
SKIFFNANS

SEQ ID NO: 47652 - protein, 9 aa, Borrelia burgdorferi B31
KIFFNANST

SEQ ID NO: 47653 - protein, 9 aa, Borrelia burgdorferi B31
IFFNANSTV

SEQ ID NO: 47654 - protein, 9 aa, Borrelia burgdorferi B31
FFNANSTVH

SEQ ID NO: 47655 - protein, 9 aa, Borrelia burgdorferi B31
FNANSTVHF

SEQ ID NO: 47656 - protein, 9 aa, Borrelia burgdorferi B31
NANSTVHFD

SEQ ID NO: 47657 - protein, 9 aa, Borrelia burgdorferi B31
ANSTVHFDS

SEQ ID NO: 47658 - protein, 9 aa, Borrelia burgdorferi B31
NSTVHFDSH

SEQ ID NO: 47659 - protein, 9 aa, Borrelia burgdorferi B31
STVHFDSHE

SEQ ID NO: 47660 - protein, 9 aa, Borrelia burgdorferi B31
TVHFDSHEY

SEQ ID NO: 47661 - protein, 9 aa, Borrelia burgdorferi B31
VHFDSHEYT

SEQ ID NO: 47662 - protein, 9 aa, Borrelia burgdorferi B31
HFDSHEYTE

SEQ ID NO: 47663 - protein, 9 aa, Borrelia burgdorferi B31
FDSHEYTEE

SEQ ID NO: 47664 - protein, 9 aa, Borrelia burgdorferi B31
DSHEYTEER

SEQ ID NO: 47665 - protein, 9 aa, Borrelia burgdorferi B31
SHEYTEERR

SEQ ID NO: 47666 - protein, 9 aa, Borrelia burgdorferi B31
HEYTEERRM

SEQ ID NO: 47667 - protein, 9 aa, Borrelia burgdorferi B31
EYTEERRML

SEQ ID NO: 47668 - protein, 9 aa, Borrelia burgdorferi B31
YTEERRMLY

SEQ ID NO: 47669 - protein, 9 aa, Borrelia burgdorferi B31
TEERRMLYT

SEQ ID NO: 47670 - protein, 9 aa, Borrelia burgdorferi B31
EERRMLYTS

SEQ ID NO: 47671 - protein, 9 aa, Borrelia burgdorferi B31
ERRMLYTSL

SEQ ID NO: 47672 - protein, 9 aa, Borrelia burgdorferi B31
RRMLYTSLN

SEQ ID NO: 47673 - protein, 9 aa, Borrelia burgdorferi B31
RMLYTSLNF

SEQ ID NO: 47674 - protein, 9 aa, Borrelia burgdorferi B31
MLYTSLNFN

SEQ ID NO: 47675 - protein, 9 aa, Borrelia burgdorferi B31
LYTSLNFNE

SEQ ID NO: 47676 - protein, 9 aa, Borrelia burgdorferi B31
YTSLNFNEG

SEQ ID NO: 47677 - protein, 9 aa, Borrelia burgdorferi B31
TSLNFNEGK

SEQ ID NO: 47678 - protein, 9 aa, Borrelia burgdorferi B31
SLNFNEGKI

SEQ ID NO: 47679 - protein, 9 aa, Borrelia burgdorferi B31
LNFNEGKIF

SEQ ID NO: 47680 - protein, 9 aa, Borrelia burgdorferi B31
NFNEGKIFN

SEQ ID NO: 47681 - protein, 9 aa, Borrelia burgdorferi B31
FNEGKIFNL

SEQ ID NO: 47682 - protein, 9 aa, Borrelia burgdorferi B31
NEGKIFNLG

SEQ ID NO: 47683 - protein, 9 aa, Borrelia burgdorferi B31
EGKIFNLGQ

SEQ ID NO: 47684 - protein, 9 aa, Borrelia burgdorferi B31
GKIFNLGQI

SEQ ID NO: 47685 - protein, 9 aa, Borrelia burgdorferi B31
KIFNLGQIL

SEQ ID NO: 47686 - protein, 9 aa, Borrelia burgdorferi B31
IFNLGQILS

SEQ ID NO: 47687 - protein, 9 aa, Borrelia burgdorferi B31
FNLGQILSK

SEQ ID NO: 47688 - protein, 9 aa, Borrelia burgdorferi B31
NLGQILSKL

SEQ ID NO: 47689 - protein, 9 aa, Borrelia burgdorferi B31
LGQILSKLS

SEQ ID NO: 47690 - protein, 9 aa, Borrelia burgdorferi B31
GQILSKLSQ

SEQ ID NO: 47691 - protein, 9 aa, Borrelia burgdorferi B31
QILSKLSQD

SEQ ID NO: 47692 - protein, 9 aa, Borrelia burgdorferi B31
ILSKLSQDS

SEQ ID NO: 47693 - protein, 9 aa, Borrelia burgdorferi B31
LSKLSQDSN

SEQ ID NO: 47694 - protein, 9 aa, Borrelia burgdorferi B31
SKLSQDSNY

SEQ ID NO: 47695 - protein, 9 aa, Borrelia burgdorferi B31
KLSQDSNYR

SEQ ID NO: 47696 - protein, 9 aa, Borrelia burgdorferi B31
LSQDSNYRG

SEQ ID NO: 47697 - protein, 9 aa, Borrelia burgdorferi B31
SQDSNYRGL

SEQ ID NO: 47698 - protein, 9 aa, Borrelia burgdorferi B31
QDSNYRGLV

SEQ ID NO: 47699 - protein, 9 aa, Borrelia burgdorferi B31
DSNYRGLVK

SEQ ID NO: 47700 - protein, 9 aa, Borrelia burgdorferi B31
SNYRGLVKE

SEQ ID NO: 47701 - protein, 9 aa, Borrelia burgdorferi B31
NYRGLVKET

SEQ ID NO: 47702 - protein, 9 aa, Borrelia burgdorferi B31
YRGLVKETL

SEQ ID NO: 47703 - protein, 9 aa, Borrelia burgdorferi B31
RGLVKETLI

SEQ ID NO: 47704 - protein, 9 aa, Borrelia burgdorferi B31
GLVKETLIN

SEQ ID NO: 47705 - protein, 9 aa, Borrelia burgdorferi B31
LVKETLINR

SEQ ID NO: 47706 - protein, 9 aa, Borrelia burgdorferi B31
VKETLINRG

SEQ ID NO: 47707 - protein, 9 aa, Borrelia burgdorferi B31
KETLINRGF

SEQ ID NO: 47708 - protein, 9 aa, Borrelia burgdorferi B31
ETLINRGFS

SEQ ID NO: 47709 - protein, 9 aa, Borrelia burgdorferi B31
TLINRGFSI

SEQ ID NO: 47710 - protein, 9 aa, Borrelia burgdorferi B31
LINRGFSIQ

SEQ ID NO: 47711 - protein, 9 aa, Borrelia burgdorferi B31
INRGFSIQL

SEQ ID NO: 47712 - protein, 9 aa, Borrelia burgdorferi B31
NRGFSIQLA

SEQ ID NO: 47713 - protein, 9 aa, Borrelia burgdorferi B31
RGFSIQLAM

SEQ ID NO: 47714 - protein, 9 aa, Borrelia burgdorferi B31
GFSIQLAME

SEQ ID NO: 47715 - protein, 9 aa, Borrelia burgdorferi B31
FSIQLAMEE

SEQ ID NO: 47716 - protein, 9 aa, Borrelia burgdorferi B31
SIQLAMEEI

SEQ ID NO: 47717 - protein, 9 aa, Borrelia burgdorferi B31
IQLAMEEIS

SEQ ID NO: 47718 - protein, 9 aa, Borrelia burgdorferi B31
QLAMEEISA

SEQ ID NO: 47719 - protein, 9 aa, Borrelia burgdorferi B31
LAMEEISAK

SEQ ID NO: 47720 - protein, 9 aa, Borrelia burgdorferi B31
AMEEISAKI

SEQ ID NO: 47721 - protein, 9 aa, Borrelia burgdorferi B31
MEEISAKIL

SEQ ID NO: 47722 - protein, 9 aa, Borrelia burgdorferi B31
EEISAKILN

SEQ ID NO: 47723 - protein, 9 aa, Borrelia burgdorferi B31
EISAKILNV

SEQ ID NO: 47724 - protein, 9 aa, Borrelia burgdorferi B31
ISAKILNVK

SEQ ID NO: 47725 - protein, 9 aa, Borrelia burgdorferi B31
SAKILNVKD

SEQ ID NO: 47726 - protein, 9 aa, Borrelia burgdorferi B31
AKILNVKDK

SEQ ID NO: 47727 - protein, 9 aa, Borrelia burgdorferi B31
KILNVKDKL

SEQ ID NO: 47728 - protein, 9 aa, Borrelia burgdorferi B31
ILNVKDKLQ

SEQ ID NO: 47729 - protein, 9 aa, Borrelia burgdorferi B31
LNVKDKLQQ

SEQ ID NO: 47730 - protein, 9 aa, Borrelia burgdorferi B31
NVKDKLQQL

SEQ ID NO: 47731 - protein, 9 aa, Borrelia burgdorferi B31
VKDKLQQLN

SEQ ID NO: 47732 - protein, 9 aa, Borrelia burgdorferi B31
KDKLQQLNK

SEQ ID NO: 47733 - protein, 9 aa, Borrelia burgdorferi B31
DKLQQLNKP

SEQ ID NO: 47734 - protein, 9 aa, Borrelia burgdorferi B31
KLQQLNKPN

SEQ ID NO: 47735 - protein, 9 aa, Borrelia burgdorferi B31
LQQLNKPNL

SEQ ID NO: 47736 - protein, 9 aa, Borrelia burgdorferi B31
QQLNKPNLE

SEQ ID NO: 47737 - protein, 9 aa, Borrelia burgdorferi B31
QLNKPNLET

SEQ ID NO: 47738 - protein, 9 aa, Borrelia burgdorferi B31
LNKPNLETL

SEQ ID NO: 47739 - protein, 9 aa, Borrelia burgdorferi B31
NKPNLETLY

SEQ ID NO: 47740 - protein, 9 aa, Borrelia burgdorferi B31
KPNLETLYN

SEQ ID NO: 47741 - protein, 9 aa, Borrelia burgdorferi B31
PNLETLYND

SEQ ID NO: 47742 - protein, 9 aa, Borrelia burgdorferi B31
NLETLYNDF

SEQ ID NO: 47743 - protein, 9 aa, Borrelia burgdorferi B31
LETLYNDFE

SEQ ID NO: 47744 - protein, 9 aa, Borrelia burgdorferi B31
ETLYNDFEK

SEQ ID NO: 47745 - protein, 9 aa, Borrelia burgdorferi B31
TLYNDFEKL

SEQ ID NO: 47746 - protein, 9 aa, Borrelia burgdorferi B31
LYNDFEKLT

SEQ ID NO: 47747 - protein, 9 aa, Borrelia burgdorferi B31
YNDFEKLTS

SEQ ID NO: 47748 - protein, 9 aa, Borrelia burgdorferi B31
NDFEKLTSL

SEQ ID NO: 47749 - protein, 9 aa, Borrelia burgdorferi B31
DFEKLTSLK

SEQ ID NO: 47750 - protein, 9 aa, Borrelia burgdorferi B31
FEKLTSLKE

SEQ ID NO: 47751 - protein, 9 aa, Borrelia burgdorferi B31
EKLTSLKEK

SEQ ID NO: 47752 - protein, 9 aa, Borrelia burgdorferi B31
KLTSLKEKW

SEQ ID NO: 47753 - protein, 9 aa, Borrelia burgdorferi B31
LTSLKEKWL

SEQ ID NO: 47754 - protein, 9 aa, Borrelia burgdorferi B31
TSLKEKWLK

SEQ ID NO: 47755 - protein, 9 aa, Borrelia burgdorferi B31
SLKEKWLKD

SEQ ID NO: 47756 - protein, 9 aa, Borrelia burgdorferi B31
LKEKWLKDT

SEQ ID NO: 47757 - protein, 9 aa, Borrelia burgdorferi B31
KEKWLKDTD

SEQ ID NO: 47758 - protein, 9 aa, Borrelia burgdorferi B31
EKWLKDTDD

SEQ ID NO: 47759 - protein, 9 aa, Borrelia burgdorferi B31
KWLKDTDDL

SEQ ID NO: 47760 - protein, 9 aa, Borrelia burgdorferi B31
WLKDTDDLI

SEQ ID NO: 47761 - protein, 9 aa, Borrelia burgdorferi B31
LKDTDDLID

SEQ ID NO: 47762 - protein, 9 aa, Borrelia burgdorferi B31
KDTDDLIDE

SEQ ID NO: 47763 - protein, 9 aa, Borrelia burgdorferi B31
DTDDLIDEY

SEQ ID NO: 47764 - protein, 9 aa, Borrelia burgdorferi B31
TDDLIDEYN

SEQ ID NO: 47765 - protein, 9 aa, Borrelia burgdorferi B31
DDLIDEYNT

SEQ ID NO: 47766 - protein, 9 aa, Borrelia burgdorferi B31
DLIDEYNTN

SEQ ID NO: 47767 - protein, 9 aa, Borrelia burgdorferi B31
LIDEYNTNP

SEQ ID NO: 47768 - protein, 9 aa, Borrelia burgdorferi B31
IDEYNTNPD

SEQ ID NO: 47769 - protein, 9 aa, Borrelia burgdorferi B31
DEYNTNPDL

SEQ ID NO: 47770 - protein, 9 aa, Borrelia burgdorferi B31
EYNTNPDLQ

SEQ ID NO: 47771 - protein, 9 aa, Borrelia burgdorferi B31
YNTNPDLQT

SEQ ID NO: 47772 - protein, 9 aa, Borrelia burgdorferi B31
NTNPDLQTD

SEQ ID NO: 47773 - protein, 9 aa, Borrelia burgdorferi B31
TNPDLQTDV

SEQ ID NO: 47774 - protein, 9 aa, Borrelia burgdorferi B31
NPDLQTDVS

SEQ ID NO: 47775 - protein, 9 aa, Borrelia burgdorferi B31
PDLQTDVSK

SEQ ID NO: 47776 - protein, 9 aa, Borrelia burgdorferi B31
DLQTDVSKL

SEQ ID NO: 47777 - protein, 9 aa, Borrelia burgdorferi B31
LQTDVSKLN

SEQ ID NO: 47778 - protein, 9 aa, Borrelia burgdorferi B31
QTDVSKLND

SEQ ID NO: 47779 - protein, 9 aa, Borrelia burgdorferi B31
TDVSKLNDT

SEQ ID NO: 47780 - protein, 9 aa, Borrelia burgdorferi B31
DVSKLNDTL

SEQ ID NO: 47781 - protein, 9 aa, Borrelia burgdorferi B31
VSKLNDTLR

SEQ ID NO: 47782 - protein, 9 aa, Borrelia burgdorferi B31
SKLNDTLRS

SEQ ID NO: 47783 - protein, 9 aa, Borrelia burgdorferi B31
KLNDTLRSK

SEQ ID NO: 47784 - protein, 9 aa, Borrelia burgdorferi B31
LNDTLRSKN

SEQ ID NO: 47785 - protein, 9 aa, Borrelia burgdorferi B31
NDTLRSKNS

SEQ ID NO: 47786 - protein, 9 aa, Borrelia burgdorferi B31
DTLRSKNSR

SEQ ID NO: 47787 - protein, 9 aa, Borrelia burgdorferi B31
TLRSKNSRA

SEQ ID NO: 47788 - protein, 9 aa, Borrelia burgdorferi B31
LRSKNSRAQ

SEQ ID NO: 47789 - protein, 9 aa, Borrelia burgdorferi B31
RSKNSRAQF

SEQ ID NO: 47790 - protein, 9 aa, Borrelia burgdorferi B31
SKNSRAQFA

SEQ ID NO: 47791 - protein, 9 aa, Borrelia burgdorferi B31
KNSRAQFAN

SEQ ID NO: 47792 - protein, 9 aa, Borrelia burgdorferi B31
NSRAQFANI

SEQ ID NO: 47793 - protein, 9 aa, Borrelia burgdorferi B31
SRAQFANIH

SEQ ID NO: 47794 - protein, 9 aa, Borrelia burgdorferi B31
RAQFANIHD

SEQ ID NO: 47795 - protein, 9 aa, Borrelia burgdorferi B31
AQFANIHDI

SEQ ID NO: 47796 - protein, 9 aa, Borrelia burgdorferi B31
QFANIHDII

SEQ ID NO: 47797 - protein, 9 aa, Borrelia burgdorferi B31
FANIHDIIL

SEQ ID NO: 47798 - protein, 9 aa, Borrelia burgdorferi B31
ANIHDIILD

SEQ ID NO: 47799 - protein, 9 aa, Borrelia burgdorferi B31
NIHDIILDL

SEQ ID NO: 47800 - protein, 9 aa, Borrelia burgdorferi B31
IHDIILDLV

SEQ ID NO: 47801 - protein, 9 aa, Borrelia burgdorferi B31
HDIILDLVN

SEQ ID NO: 47802 - protein, 9 aa, Borrelia burgdorferi B31
DIILDLVNT

SEQ ID NO: 47803 - protein, 9 aa, Borrelia burgdorferi B31
IILDLVNTT

SEQ ID NO: 47804 - protein, 9 aa, Borrelia burgdorferi B31
ILDLVNTTT

SEQ ID NO: 47805 - protein, 9 aa, Borrelia burgdorferi B31
LDLVNTTTN

SEQ ID NO: 47806 - protein, 9 aa, Borrelia burgdorferi B31
DLVNTTTNI

SEQ ID NO: 47807 - protein, 9 aa, Borrelia burgdorferi B31
LVNTTTNIL

SEQ ID NO: 47808 - protein, 9 aa, Borrelia burgdorferi B31
VNTTTNILA

SEQ ID NO: 47809 - protein, 9 aa, Borrelia burgdorferi B31
NTTTNILAP

SEQ ID NO: 47810 - protein, 9 aa, Borrelia burgdorferi B31
TTTNILAPI

SEQ ID NO: 47811 - protein, 9 aa, Borrelia burgdorferi B31
TTNILAPIQ

SEQ ID NO: 47812 - protein, 10 aa, Borrelia burgdorferi B31
MKDNILKNNK

SEQ ID NO: 47813 - protein, 10 aa, Borrelia burgdorferi B31
KDNILKNNKL

SEQ ID NO: 47814 - protein, 10 aa, Borrelia burgdorferi B31
DNILKNNKLI

SEQ ID NO: 47815 - protein, 10 aa, Borrelia burgdorferi B31
NILKNNKLIA

SEQ ID NO: 47816 - protein, 10 aa, Borrelia burgdorferi B31
ILKNNKLIAI

SEQ ID NO: 47817 - protein, 10 aa, Borrelia burgdorferi B31
LKNNKLIAIF

SEQ ID NO: 47818 - protein, 10 aa, Borrelia burgdorferi B31
KNNKLIAIFL

SEQ ID NO: 47819 - protein, 10 aa, Borrelia burgdorferi B31
NNKLIAIFLL

SEQ ID NO: 47820 - protein, 10 aa, Borrelia burgdorferi B31
NKLIAIFLLH

SEQ ID NO: 47821 - protein, 10 aa, Borrelia burgdorferi B31
KLIAIFLLHV

SEQ ID NO: 47822 - protein, 10 aa, Borrelia burgdorferi B31
LIAIFLLHVL

SEQ ID NO: 47823 - protein, 10 aa, Borrelia burgdorferi B31
IAIFLLHVLT

SEQ ID NO: 47824 - protein, 10 aa, Borrelia burgdorferi B31
AIFLLHVLTV

SEQ ID NO: 47825 - protein, 10 aa, Borrelia burgdorferi B31
IFLLHVLTVL

SEQ ID NO: 47826 - protein, 10 aa, Borrelia burgdorferi B31
FLLHVLTVLI

SEQ ID NO: 47827 - protein, 10 aa, Borrelia burgdorferi B31
LLHVLTVLIL

SEQ ID NO: 47828 - protein, 10 aa, Borrelia burgdorferi B31
LHVLTVLILI

SEQ ID NO: 47829 - protein, 10 aa, Borrelia burgdorferi B31
HVLTVLILIS

SEQ ID NO: 47830 - protein, 10 aa, Borrelia burgdorferi B31
VLTVLILISC

SEQ ID NO: 47831 - protein, 10 aa, Borrelia burgdorferi B31
LTVLILISCS

SEQ ID NO: 47832 - protein, 10 aa, Borrelia burgdorferi B31
TVLILISCSL

SEQ ID NO: 47833 - protein, 10 aa, Borrelia burgdorferi B31
VLILISCSLE

SEQ ID NO: 47834 - protein, 10 aa, Borrelia burgdorferi B31
LILISCSLEV

SEQ ID NO: 47835 - protein, 10 aa, Borrelia burgdorferi B31
ILISCSLEVK

SEQ ID NO: 47836 - protein, 10 aa, Borrelia burgdorferi B31
LISCSLEVKD

SEQ ID NO: 47837 - protein, 10 aa, Borrelia burgdorferi B31
ISCSLEVKDS

SEQ ID NO: 47838 - protein, 10 aa, Borrelia burgdorferi B31
SCSLEVKDSN

SEQ ID NO: 47839 - protein, 10 aa, Borrelia burgdorferi B31
CSLEVKDSNE

SEQ ID NO: 47840 - protein, 10 aa, Borrelia burgdorferi B31
SLEVKDSNES

SEQ ID NO: 47841 - protein, 10 aa, Borrelia burgdorferi B31
LEVKDSNESK

SEQ ID NO: 47842 - protein, 10 aa, Borrelia burgdorferi B31
EVKDSNESKK

SEQ ID NO: 47843 - protein, 10 aa, Borrelia burgdorferi B31
VKDSNESKKH

SEQ ID NO: 47844 - protein, 10 aa, Borrelia burgdorferi B31
KDSNESKKHK

SEQ ID NO: 47845 - protein, 10 aa, Borrelia burgdorferi B31
DSNESKKHKK

SEQ ID NO: 47846 - protein, 10 aa, Borrelia burgdorferi B31
SNESKKHKKE

SEQ ID NO: 47847 - protein, 10 aa, Borrelia burgdorferi B31
NESKKHKKEK

SEQ ID NO: 47848 - protein, 10 aa, Borrelia burgdorferi B31
ESKKHKKEKR

SEQ ID NO: 47849 - protein, 10 aa, Borrelia burgdorferi B31
SKKHKKEKRK

SEQ ID NO: 47850 - protein, 10 aa, Borrelia burgdorferi B31
KKHKKEKRKG

SEQ ID NO: 47851 - protein, 10 aa, Borrelia burgdorferi B31
KHKKEKRKGK

SEQ ID NO: 47852 - protein, 10 aa, Borrelia burgdorferi B31
HKKEKRKGKV

SEQ ID NO: 47853 - protein, 10 aa, Borrelia burgdorferi B31
KKEKRKGKVE

SEQ ID NO: 47854 - protein, 10 aa, Borrelia burgdorferi B31
KEKRKGKVEN

SEQ ID NO: 47855 - protein, 10 aa, Borrelia burgdorferi B31
EKRKGKVENL

SEQ ID NO: 47856 - protein, 10 aa, Borrelia burgdorferi B31
KRKGKVENLL

SEQ ID NO: 47857 - protein, 10 aa, Borrelia burgdorferi B31
RKGKVENLLV

SEQ ID NO: 47858 - protein, 10 aa, Borrelia burgdorferi B31
KGKVENLLVA

SEQ ID NO: 47859 - protein, 10 aa, Borrelia burgdorferi B31
GKVENLLVAI

SEQ ID NO: 47860 - protein, 10 aa, Borrelia burgdorferi B31
KVENLLVAIN

SEQ ID NO: 47861 - protein, 10 aa, Borrelia burgdorferi B31
VENLLVAINN

SEQ ID NO: 47862 - protein, 10 aa, Borrelia burgdorferi B31
ENLLVAINNL

SEQ ID NO: 47863 - protein, 10 aa, Borrelia burgdorferi B31
NLLVAINNLK

SEQ ID NO: 47864 - protein, 10 aa, Borrelia burgdorferi B31
LLVAINNLKN

SEQ ID NO: 47865 - protein, 10 aa, Borrelia burgdorferi B31
LVAINNLKNP

SEQ ID NO: 47866 - protein, 10 aa, Borrelia burgdorferi B31
VAINNLKNPT

SEQ ID NO: 47867 - protein, 10 aa, Borrelia burgdorferi B31
AINNLKNPTK

SEQ ID NO: 47868 - protein, 10 aa, Borrelia burgdorferi B31
INNLKNPTKP

SEQ ID NO: 47869 - protein, 10 aa, Borrelia burgdorferi B31
NNLKNPTKPA

SEQ ID NO: 47870 - protein, 10 aa, Borrelia burgdorferi B31
NLKNPTKPAA

SEQ ID NO: 47871 - protein, 10 aa, Borrelia burgdorferi B31
LKNPTKPAAG

SEQ ID NO: 47872 - protein, 10 aa, Borrelia burgdorferi B31
KNPTKPAAGK

SEQ ID NO: 47873 - protein, 10 aa, Borrelia burgdorferi B31
NPTKPAAGKN

SEQ ID NO: 47874 - protein, 10 aa, Borrelia burgdorferi B31
PTKPAAGKNK

SEQ ID NO: 47875 - protein, 10 aa, Borrelia burgdorferi B31
TKPAAGKNKA

SEQ ID NO: 47876 - protein, 10 aa, Borrelia burgdorferi B31
KPAAGKNKAN

SEQ ID NO: 47877 - protein, 10 aa, Borrelia burgdorferi B31
PAAGKNKANS

SEQ ID NO: 47878 - protein, 10 aa, Borrelia burgdorferi B31
AAGKNKANSK

SEQ ID NO: 47879 - protein, 10 aa, Borrelia burgdorferi B31
AGKNKANSKA

SEQ ID NO: 47880 - protein, 10 aa, Borrelia burgdorferi B31
GKNKANSKAS

SEQ ID NO: 47881 - protein, 10 aa, Borrelia burgdorferi B31
KNKANSKASK

SEQ ID NO: 47882 - protein, 10 aa, Borrelia burgdorferi B31
NKANSKASKQ

SEQ ID NO: 47883 - protein, 10 aa, Borrelia burgdorferi B31
KANSKASKQK

SEQ ID NO: 47884 - protein, 10 aa, Borrelia burgdorferi B31
ANSKASKQKN

SEQ ID NO: 47885 - protein, 10 aa, Borrelia burgdorferi B31
NSKASKQKNN

SEQ ID NO: 47886 - protein, 10 aa, Borrelia burgdorferi B31
SKASKQKNNP

SEQ ID NO: 47887 - protein, 10 aa, Borrelia burgdorferi B31
KASKQKNNPN

SEQ ID NO: 47888 - protein, 10 aa, Borrelia burgdorferi B31
ASKQKNNPNA

SEQ ID NO: 47889 - protein, 10 aa, Borrelia burgdorferi B31
SKQKNNPNAN

SEQ ID NO: 47890 - protein, 10 aa, Borrelia burgdorferi B31
KQKNNPNANA

SEQ ID NO: 47891 - protein, 10 aa, Borrelia burgdorferi B31
QKNNPNANAN

SEQ ID NO: 47892 - protein, 10 aa, Borrelia burgdorferi B31
KNNPNANANN

SEQ ID NO: 47893 - protein, 10 aa, Borrelia burgdorferi B31
NNPNANANNA

SEQ ID NO: 47894 - protein, 10 aa, Borrelia burgdorferi B31
NPNANANNAP

SEQ ID NO: 47895 - protein, 10 aa, Borrelia burgdorferi B31
PNANANNAPK

SEQ ID NO: 47896 - protein, 10 aa, Borrelia burgdorferi B31
NANANNAPKK

SEQ ID NO: 47897 - protein, 10 aa, Borrelia burgdorferi B31
ANANNAPKKI

SEQ ID NO: 47898 - protein, 10 aa, Borrelia burgdorferi B31
NANNAPKKIL

SEQ ID NO: 47899 - protein, 10 aa, Borrelia burgdorferi B31
ANNAPKKILD

SEQ ID NO: 47900 - protein, 10 aa, Borrelia burgdorferi B31
NNAPKKILDP

SEQ ID NO: 47901 - protein, 10 aa, Borrelia burgdorferi B31
NAPKKILDPE

SEQ ID NO: 47902 - protein, 10 aa, Borrelia burgdorferi B31
APKKILDPEV

SEQ ID NO: 47903 - protein, 10 aa, Borrelia burgdorferi B31
PKKILDPEVA

SEQ ID NO: 47904 - protein, 10 aa, Borrelia burgdorferi B31
KKILDPEVAK

SEQ ID NO: 47905 - protein, 10 aa, Borrelia burgdorferi B31
KILDPEVAKL

SEQ ID NO: 47906 - protein, 10 aa, Borrelia burgdorferi B31
ILDPEVAKLI

SEQ ID NO: 47907 - protein, 10 aa, Borrelia burgdorferi B31
LDPEVAKLIQ

SEQ ID NO: 47908 - protein, 10 aa, Borrelia burgdorferi B31
DPEVAKLIQK

SEQ ID NO: 47909 - protein, 10 aa, Borrelia burgdorferi B31
PEVAKLIQKI

SEQ ID NO: 47910 - protein, 10 aa, Borrelia burgdorferi B31
EVAKLIQKIL

SEQ ID NO: 47911 - protein, 10 aa, Borrelia burgdorferi B31
VAKLIQKILD

SEQ ID NO: 47912 - protein, 10 aa, Borrelia burgdorferi B31
AKLIQKILDR

SEQ ID NO: 47913 - protein, 10 aa, Borrelia burgdorferi B31
KLIQKILDRS

SEQ ID NO: 47914 - protein, 10 aa, Borrelia burgdorferi B31
LIQKILDRSE

SEQ ID NO: 47915 - protein, 10 aa, Borrelia burgdorferi B31
IQKILDRSEN

SEQ ID NO: 47916 - protein, 10 aa, Borrelia burgdorferi B31
QKILDRSENI

SEQ ID NO: 47917 - protein, 10 aa, Borrelia burgdorferi B31
KILDRSENII

SEQ ID NO: 47918 - protein, 10 aa, Borrelia burgdorferi B31
ILDRSENIIQ

SEQ ID NO: 47919 - protein, 10 aa, Borrelia burgdorferi B31
LDRSENIIQI

SEQ ID NO: 47920 - protein, 10 aa, Borrelia burgdorferi B31
DRSENIIQIS

SEQ ID NO: 47921 - protein, 10 aa, Borrelia burgdorferi B31
RSENIIQISE

SEQ ID NO: 47922 - protein, 10 aa, Borrelia burgdorferi B31
SENIIQISEM

SEQ ID NO: 47923 - protein, 10 aa, Borrelia burgdorferi B31
ENIIQISEMD

SEQ ID NO: 47924 - protein, 10 aa, Borrelia burgdorferi B31
NIIQISEMDS

SEQ ID NO: 47925 - protein, 10 aa, Borrelia burgdorferi B31
IIQISEMDSS

SEQ ID NO: 47926 - protein, 10 aa, Borrelia burgdorferi B31
IQISEMDSSR

SEQ ID NO: 47927 - protein, 10 aa, Borrelia burgdorferi B31
QISEMDSSRG

SEQ ID NO: 47928 - protein, 10 aa, Borrelia burgdorferi B31
ISEMDSSRGE

SEQ ID NO: 47929 - protein, 10 aa, Borrelia burgdorferi B31
SEMDSSRGEP

SEQ ID NO: 47930 - protein, 10 aa, Borrelia burgdorferi B31
EMDSSRGEPN

SEQ ID NO: 47931 - protein, 10 aa, Borrelia burgdorferi B31
MDSSRGEPND

SEQ ID NO: 47932 - protein, 10 aa, Borrelia burgdorferi B31
DSSRGEPNDQ

SEQ ID NO: 47933 - protein, 10 aa, Borrelia burgdorferi B31
SSRGEPNDQF

SEQ ID NO: 47934 - protein, 10 aa, Borrelia burgdorferi B31
SRGEPNDQFG

SEQ ID NO: 47935 - protein, 10 aa, Borrelia burgdorferi B31
RGEPNDQFGM

SEQ ID NO: 47936 - protein, 10 aa, Borrelia burgdorferi B31
GEPNDQFGMR

SEQ ID NO: 47937 - protein, 10 aa, Borrelia burgdorferi B31
EPNDQFGMRA

SEQ ID NO: 47938 - protein, 10 aa, Borrelia burgdorferi B31
PNDQFGMRAE

SEQ ID NO: 47939 - protein, 10 aa, Borrelia burgdorferi B31
NDQFGMRAEI

SEQ ID NO: 47940 - protein, 10 aa, Borrelia burgdorferi B31
DQFGMRAEIF

SEQ ID NO: 47941 - protein, 10 aa, Borrelia burgdorferi B31
QFGMRAEIFS

SEQ ID NO: 47942 - protein, 10 aa, Borrelia burgdorferi B31
FGMRAEIFSK

SEQ ID NO: 47943 - protein, 10 aa, Borrelia burgdorferi B31
GMRAEIFSKI

SEQ ID NO: 47944 - protein, 10 aa, Borrelia burgdorferi B31
MRAEIFSKIF

SEQ ID NO: 47945 - protein, 10 aa, Borrelia burgdorferi B31
RAEIFSKIFF

SEQ ID NO: 47946 - protein, 10 aa, Borrelia burgdorferi B31
AEIFSKIFFN

SEQ ID NO: 47947 - protein, 10 aa, Borrelia burgdorferi B31
EIFSKIFFNA

SEQ ID NO: 47948 - protein, 10 aa, Borrelia burgdorferi B31
IFSKIFFNAN

SEQ ID NO: 47949 - protein, 10 aa, Borrelia burgdorferi B31
FSKIFFNANS

SEQ ID NO: 47950 - protein, 10 aa, Borrelia burgdorferi B31
SKIFFNANST

SEQ ID NO: 47951 - protein, 10 aa, Borrelia burgdorferi B31
KIFFNANSTV

SEQ ID NO: 47952 - protein, 10 aa, Borrelia burgdorferi B31
IFFNANSTVH

SEQ ID NO: 47953 - protein, 10 aa, Borrelia burgdorferi B31
FFNANSTVHF

SEQ ID NO: 47954 - protein, 10 aa, Borrelia burgdorferi B31
FNANSTVHFD

SEQ ID NO: 47955 - protein, 10 aa, Borrelia burgdorferi B31
NANSTVHFDS

SEQ ID NO: 47956 - protein, 10 aa, Borrelia burgdorferi B31
ANSTVHFDSH

SEQ ID NO: 47957 - protein, 10 aa, Borrelia burgdorferi B31
NSTVHFDSHE

SEQ ID NO: 47958 - protein, 10 aa, Borrelia burgdorferi B31
STVHFDSHEY

SEQ ID NO: 47959 - protein, 10 aa, Borrelia burgdorferi B31
TVHFDSHEYT

SEQ ID NO: 47960 - protein, 10 aa, Borrelia burgdorferi B31
VHFDSHEYTE

SEQ ID NO: 47961 - protein, 10 aa, Borrelia burgdorferi B31
HFDSHEYTEE

SEQ ID NO: 47962 - protein, 10 aa, Borrelia burgdorferi B31
FDSHEYTEER

SEQ ID NO: 47963 - protein, 10 aa, Borrelia burgdorferi B31
DSHEYTEERR

SEQ ID NO: 47964 - protein, 10 aa, Borrelia burgdorferi B31
SHEYTEERRM

SEQ ID NO: 47965 - protein, 10 aa, Borrelia burgdorferi B31
HEYTEERRML

SEQ ID NO: 47966 - protein, 10 aa, Borrelia burgdorferi B31
EYTEERRMLY

SEQ ID NO: 47967 - protein, 10 aa, Borrelia burgdorferi B31
YTEERRMLYT

SEQ ID NO: 47968 - protein, 10 aa, Borrelia burgdorferi B31
TEERRMLYTS

SEQ ID NO: 47969 - protein, 10 aa, Borrelia burgdorferi B31
EERRMLYTSL

SEQ ID NO: 47970 - protein, 10 aa, Borrelia burgdorferi B31
ERRMLYTSLN

SEQ ID NO: 47971 - protein, 10 aa, Borrelia burgdorferi B31
RRMLYTSLNF

SEQ ID NO: 47972 - protein, 10 aa, Borrelia burgdorferi B31
RMLYTSLNFN

SEQ ID NO: 47973 - protein, 10 aa, Borrelia burgdorferi B31
MLYTSLNFNE

SEQ ID NO: 47974 - protein, 10 aa, Borrelia burgdorferi B31
LYTSLNFNEG

SEQ ID NO: 47975 - protein, 10 aa, Borrelia burgdorferi B31
YTSLNFNEGK

SEQ ID NO: 47976 - protein, 10 aa, Borrelia burgdorferi B31
TSLNFNEGKI

SEQ ID NO: 47977 - protein, 10 aa, Borrelia burgdorferi B31
SLNFNEGKIF

SEQ ID NO: 47978 - protein, 10 aa, Borrelia burgdorferi B31
LNFNEGKIFN

SEQ ID NO: 47979 - protein, 10 aa, Borrelia burgdorferi B31
NFNEGKIFNL

SEQ ID NO: 47980 - protein, 10 aa, Borrelia burgdorferi B31
FNEGKIFNLG

SEQ ID NO: 47981 - protein, 10 aa, Borrelia burgdorferi B31
NEGKIFNLGQ

SEQ ID NO: 47982 - protein, 10 aa, Borrelia burgdorferi B31
EGKIFNLGQI

SEQ ID NO: 47983 - protein, 10 aa, Borrelia burgdorferi B31
GKIFNLGQIL

SEQ ID NO: 47984 - protein, 10 aa, Borrelia burgdorferi B31
KIFNLGQILS

SEQ ID NO: 47985 - protein, 10 aa, Borrelia burgdorferi B31
IFNLGQILSK

SEQ ID NO: 47986 - protein, 10 aa, Borrelia burgdorferi B31
FNLGQILSKL

SEQ ID NO: 47987 - protein, 10 aa, Borrelia burgdorferi B31
NLGQILSKLS

SEQ ID NO: 47988 - protein, 10 aa, Borrelia burgdorferi B31
LGQILSKLSQ

SEQ ID NO: 47989 - protein, 10 aa, Borrelia burgdorferi B31
GQILSKLSQD

SEQ ID NO: 47990 - protein, 10 aa, Borrelia burgdorferi B31
QILSKLSQDS

SEQ ID NO: 47991 - protein, 10 aa, Borrelia burgdorferi B31
ILSKLSQDSN

SEQ ID NO: 47992 - protein, 10 aa, Borrelia burgdorferi B31
LSKLSQDSNY

SEQ ID NO: 47993 - protein, 10 aa, Borrelia burgdorferi B31
SKLSQDSNYR

SEQ ID NO: 47994 - protein, 10 aa, Borrelia burgdorferi B31
KLSQDSNYRG

SEQ ID NO: 47995 - protein, 10 aa, Borrelia burgdorferi B31
LSQDSNYRGL

SEQ ID NO: 47996 - protein, 10 aa, Borrelia burgdorferi B31
SQDSNYRGLV

SEQ ID NO: 47997 - protein, 10 aa, Borrelia burgdorferi B31
QDSNYRGLVK

SEQ ID NO: 47998 - protein, 10 aa, Borrelia burgdorferi B31
DSNYRGLVKE

SEQ ID NO: 47999 - protein, 10 aa, Borrelia burgdorferi B31
SNYRGLVKET

SEQ ID NO: 48000 - protein, 10 aa, Borrelia burgdorferi B31
NYRGLVKETL

SEQ ID NO: 48001 - protein, 10 aa, Borrelia burgdorferi B31
YRGLVKETLI

SEQ ID NO: 48002 - protein, 10 aa, Borrelia burgdorferi B31
RGLVKETLIN

SEQ ID NO: 48003 - protein, 10 aa, Borrelia burgdorferi B31
GLVKETLINR

SEQ ID NO: 48004 - protein, 10 aa, Borrelia burgdorferi B31
LVKETLINRG

SEQ ID NO: 48005 - protein, 10 aa, Borrelia burgdorferi B31
VKETLINRGF

SEQ ID NO: 48006 - protein, 10 aa, Borrelia burgdorferi B31
KETLINRGFS

SEQ ID NO: 48007 - protein, 10 aa, Borrelia burgdorferi B31
ETLINRGFSI

SEQ ID NO: 48008 - protein, 10 aa, Borrelia burgdorferi B31
TLINRGFSIQ

SEQ ID NO: 48009 - protein, 10 aa, Borrelia burgdorferi B31
LINRGFSIQL

SEQ ID NO: 48010 - protein, 10 aa, Borrelia burgdorferi B31
INRGFSIQLA

SEQ ID NO: 48011 - protein, 10 aa, Borrelia burgdorferi B31
NRGFSIQLAM

SEQ ID NO: 48012 - protein, 10 aa, Borrelia burgdorferi B31
RGFSIQLAME

SEQ ID NO: 48013 - protein, 10 aa, Borrelia burgdorferi B31
GFSIQLAMEE

SEQ ID NO: 48014 - protein, 10 aa, Borrelia burgdorferi B31
FSIQLAMEEI

SEQ ID NO: 48015 - protein, 10 aa, Borrelia burgdorferi B31
SIQLAMEEIS

SEQ ID NO: 48016 - protein, 10 aa, Borrelia burgdorferi B31
IQLAMEEISA

SEQ ID NO: 48017 - protein, 10 aa, Borrelia burgdorferi B31
QLAMEEISAK

SEQ ID NO: 48018 - protein, 10 aa, Borrelia burgdorferi B31
LAMEEISAKI

SEQ ID NO: 48019 - protein, 10 aa, Borrelia burgdorferi B31
AMEEISAKIL

SEQ ID NO: 48020 - protein, 10 aa, Borrelia burgdorferi B31
MEEISAKILN

SEQ ID NO: 48021 - protein, 10 aa, Borrelia burgdorferi B31
EEISAKILNV

SEQ ID NO: 48022 - protein, 10 aa, Borrelia burgdorferi B31
EISAKILNVK

SEQ ID NO: 48023 - protein, 10 aa, Borrelia burgdorferi B31
ISAKILNVKD

SEQ ID NO: 48024 - protein, 10 aa, Borrelia burgdorferi B31
SAKILNVKDK

SEQ ID NO: 48025 - protein, 10 aa, Borrelia burgdorferi B31
AKILNVKDKL

SEQ ID NO: 48026 - protein, 10 aa, Borrelia burgdorferi B31
KILNVKDKLQ

SEQ ID NO: 48027 - protein, 10 aa, Borrelia burgdorferi B31
ILNVKDKLQQ

SEQ ID NO: 48028 - protein, 10 aa, Borrelia burgdorferi B31
LNVKDKLQQL

SEQ ID NO: 48029 - protein, 10 aa, Borrelia burgdorferi B31
NVKDKLQQLN

SEQ ID NO: 48030 - protein, 10 aa, Borrelia burgdorferi B31
VKDKLQQLNK

SEQ ID NO: 48031 - protein, 10 aa, Borrelia burgdorferi B31
KDKLQQLNKP

SEQ ID NO: 48032 - protein, 10 aa, Borrelia burgdorferi B31
DKLQQLNKPN

SEQ ID NO: 48033 - protein, 10 aa, Borrelia burgdorferi B31
KLQQLNKPNL

SEQ ID NO: 48034 - protein, 10 aa, Borrelia burgdorferi B31
LQQLNKPNLE

SEQ ID NO: 48035 - protein, 10 aa, Borrelia burgdorferi B31
QQLNKPNLET

SEQ ID NO: 48036 - protein, 10 aa, Borrelia burgdorferi B31
QLNKPNLETL

SEQ ID NO: 48037 - protein, 10 aa, Borrelia burgdorferi B31
LNKPNLETLY

SEQ ID NO: 48038 - protein, 10 aa, Borrelia burgdorferi B31
NKPNLETLYN

SEQ ID NO: 48039 - protein, 10 aa, Borrelia burgdorferi B31
KPNLETLYND

SEQ ID NO: 48040 - protein, 10 aa, Borrelia burgdorferi B31
PNLETLYNDF

SEQ ID NO: 48041 - protein, 10 aa, Borrelia burgdorferi B31
NLETLYNDFE

SEQ ID NO: 48042 - protein, 10 aa, Borrelia burgdorferi B31
LETLYNDFEK

SEQ ID NO: 48043 - protein, 10 aa, Borrelia burgdorferi B31
ETLYNDFEKL

SEQ ID NO: 48044 - protein, 10 aa, Borrelia burgdorferi B31
TLYNDFEKLT

SEQ ID NO: 48045 - protein, 10 aa, Borrelia burgdorferi B31
LYNDFEKLTS

SEQ ID NO: 48046 - protein, 10 aa, Borrelia burgdorferi B31
YNDFEKLTSL

SEQ ID NO: 48047 - protein, 10 aa, Borrelia burgdorferi B31
NDFEKLTSLK

SEQ ID NO: 48048 - protein, 10 aa, Borrelia burgdorferi B31
DFEKLTSLKE

SEQ ID NO: 48049 - protein, 10 aa, Borrelia burgdorferi B31
FEKLTSLKEK

SEQ ID NO: 48050 - protein, 10 aa, Borrelia burgdorferi B31
EKLTSLKEKW

SEQ ID NO: 48051 - protein, 10 aa, Borrelia burgdorferi B31
KLTSLKEKWL

SEQ ID NO: 48052 - protein, 10 aa, Borrelia burgdorferi B31
LTSLKEKWLK

SEQ ID NO: 48053 - protein, 10 aa, Borrelia burgdorferi B31
TSLKEKWLKD

SEQ ID NO: 48054 - protein, 10 aa, Borrelia burgdorferi B31
SLKEKWLKDT

SEQ ID NO: 48055 - protein, 10 aa, Borrelia burgdorferi B31
LKEKWLKDTD

SEQ ID NO: 48056 - protein, 10 aa, Borrelia burgdorferi B31
KEKWLKDTDD

SEQ ID NO: 48057 - protein, 10 aa, Borrelia burgdorferi B31
EKWLKDTDDL

SEQ ID NO: 48058 - protein, 10 aa, Borrelia burgdorferi B31
KWLKDTDDLI

SEQ ID NO: 48059 - protein, 10 aa, Borrelia burgdorferi B31
WLKDTDDLID

SEQ ID NO: 48060 - protein, 10 aa, Borrelia burgdorferi B31
LKDTDDLIDE

SEQ ID NO: 48061 - protein, 10 aa, Borrelia burgdorferi B31
KDTDDLIDEY

SEQ ID NO: 48062 - protein, 10 aa, Borrelia burgdorferi B31
DTDDLIDEYN

SEQ ID NO: 48063 - protein, 10 aa, Borrelia burgdorferi B31
TDDLIDEYNT

SEQ ID NO: 48064 - protein, 10 aa, Borrelia burgdorferi B31
DDLIDEYNTN

SEQ ID NO: 48065 - protein, 10 aa, Borrelia burgdorferi B31
DLIDEYNTNP

SEQ ID NO: 48066 - protein, 10 aa, Borrelia burgdorferi B31
LIDEYNTNPD

SEQ ID NO: 48067 - protein, 10 aa, Borrelia burgdorferi B31
IDEYNTNPDL

SEQ ID NO: 48068 - protein, 10 aa, Borrelia burgdorferi B31
DEYNTNPDLQ

SEQ ID NO: 48069 - protein, 10 aa, Borrelia burgdorferi B31
EYNTNPDLQT

SEQ ID NO: 48070 - protein, 10 aa, Borrelia burgdorferi B31
YNTNPDLQTD

SEQ ID NO: 48071 - protein, 10 aa, Borrelia burgdorferi B31
NTNPDLQTDV

SEQ ID NO: 48072 - protein, 10 aa, Borrelia burgdorferi B31
TNPDLQTDVS

SEQ ID NO: 48073 - protein, 10 aa, Borrelia burgdorferi B31
NPDLQTDVSK

SEQ ID NO: 48074 - protein, 10 aa, Borrelia burgdorferi B31
PDLQTDVSKL

SEQ ID NO: 48075 - protein, 10 aa, Borrelia burgdorferi B31
DLQTDVSKLN

SEQ ID NO: 48076 - protein, 10 aa, Borrelia burgdorferi B31
LQTDVSKLND

SEQ ID NO: 48077 - protein, 10 aa, Borrelia burgdorferi B31
QTDVSKLNDT

SEQ ID NO: 48078 - protein, 10 aa, Borrelia burgdorferi B31
TDVSKLNDTL

SEQ ID NO: 48079 - protein, 10 aa, Borrelia burgdorferi B31
DVSKLNDTLR

SEQ ID NO: 48080 - protein, 10 aa, Borrelia burgdorferi B31
VSKLNDTLRS

SEQ ID NO: 48081 - protein, 10 aa, Borrelia burgdorferi B31
SKLNDTLRSK

SEQ ID NO: 48082 - protein, 10 aa, Borrelia burgdorferi B31
KLNDTLRSKN

SEQ ID NO: 48083 - protein, 10 aa, Borrelia burgdorferi B31
LNDTLRSKNS

SEQ ID NO: 48084 - protein, 10 aa, Borrelia burgdorferi B31
NDTLRSKNSR

SEQ ID NO: 48085 - protein, 10 aa, Borrelia burgdorferi B31
DTLRSKNSRA

SEQ ID NO: 48086 - protein, 10 aa, Borrelia burgdorferi B31
TLRSKNSRAQ

SEQ ID NO: 48087 - protein, 10 aa, Borrelia burgdorferi B31
LRSKNSRAQF

SEQ ID NO: 48088 - protein, 10 aa, Borrelia burgdorferi B31
RSKNSRAQFA

SEQ ID NO: 48089 - protein, 10 aa, Borrelia burgdorferi B31
SKNSRAQFAN

SEQ ID NO: 48090 - protein, 10 aa, Borrelia burgdorferi B31
KNSRAQFANI

SEQ ID NO: 48091 - protein, 10 aa, Borrelia burgdorferi B31
NSRAQFANIH

SEQ ID NO: 48092 - protein, 10 aa, Borrelia burgdorferi B31
SRAQFANIHD

SEQ ID NO: 48093 - protein, 10 aa, Borrelia burgdorferi B31
RAQFANIHDI

SEQ ID NO: 48094 - protein, 10 aa, Borrelia burgdorferi B31
AQFANIHDII

SEQ ID NO: 48095 - protein, 10 aa, Borrelia burgdorferi B31
QFANIHDIIL

SEQ ID NO: 48096 - protein, 10 aa, Borrelia burgdorferi B31
FANIHDIILD

SEQ ID NO: 48097 - protein, 10 aa, Borrelia burgdorferi B31
ANIHDIILDL

SEQ ID NO: 48098 - protein, 10 aa, Borrelia burgdorferi B31
NIHDIILDLV

SEQ ID NO: 48099 - protein, 10 aa, Borrelia burgdorferi B31
IHDIILDLVN

SEQ ID NO: 48100 - protein, 10 aa, Borrelia burgdorferi B31
HDIILDLVNT

SEQ ID NO: 48101 - protein, 10 aa, Borrelia burgdorferi B31
DIILDLVNTT

SEQ ID NO: 48102 - protein, 10 aa, Borrelia burgdorferi B31
IILDLVNTTT

SEQ ID NO: 48103 - protein, 10 aa, Borrelia burgdorferi B31
ILDLVNTTTN

SEQ ID NO: 48104 - protein, 10 aa, Borrelia burgdorferi B31
LDLVNTTTNI

SEQ ID NO: 48105 - protein, 10 aa, Borrelia burgdorferi B31
DLVNTTTNIL

SEQ ID NO: 48106 - protein, 10 aa, Borrelia burgdorferi B31
LVNTTTNILA

SEQ ID NO: 48107 - protein, 10 aa, Borrelia burgdorferi B31
VNTTTNILAP

SEQ ID NO: 48108 - protein, 10 aa, Borrelia burgdorferi B31
NTTTNILAPI

SEQ ID NO: 48109 - protein, 10 aa, Borrelia burgdorferi B31
TTTNILAPIQ

SEQ ID NO: 48110 - protein, 11 aa, Borrelia burgdorferi B31
MKDNILKNNKL

SEQ ID NO: 48111 - protein, 11 aa, Borrelia burgdorferi B31
KDNILKNNKLI

SEQ ID NO: 48112 - protein, 11 aa, Borrelia burgdorferi B31
DNILKNNKLIA

SEQ ID NO: 48113 - protein, 11 aa, Borrelia burgdorferi B31
NILKNNKLIAI

SEQ ID NO: 48114 - protein, 11 aa, Borrelia burgdorferi B31
ILKNNKLIAIF

SEQ ID NO: 48115 - protein, 11 aa, Borrelia burgdorferi B31
LKNNKLIAIFL

SEQ ID NO: 48116 - protein, 11 aa, Borrelia burgdorferi B31
KNNKLIAIFLL

SEQ ID NO: 48117 - protein, 11 aa, Borrelia burgdorferi B31
NNKLIAIFLLH

SEQ ID NO: 48118 - protein, 11 aa, Borrelia burgdorferi B31
NKLIAIFLLHV

SEQ ID NO: 48119 - protein, 11 aa, Borrelia burgdorferi B31
KLIAIFLLHVL

SEQ ID NO: 48120 - protein, 11 aa, Borrelia burgdorferi B31
LIAIFLLHVLT

SEQ ID NO: 48121 - protein, 11 aa, Borrelia burgdorferi B31
IAIFLLHVLTV

SEQ ID NO: 48122 - protein, 11 aa, Borrelia burgdorferi B31
AIFLLHVLTVL

SEQ ID NO: 48123 - protein, 11 aa, Borrelia burgdorferi B31
IFLLHVLTVLI

SEQ ID NO: 48124 - protein, 11 aa, Borrelia burgdorferi B31
FLLHVLTVLIL

SEQ ID NO: 48125 - protein, 11 aa, Borrelia burgdorferi B31
LLHVLTVLILI

SEQ ID NO: 48126 - protein, 11 aa, Borrelia burgdorferi B31
LHVLTVLILIS

SEQ ID NO: 48127 - protein, 11 aa, Borrelia burgdorferi B31
HVLTVLILISC

SEQ ID NO: 48128 - protein, 11 aa, Borrelia burgdorferi B31
VLTVLILISCS

SEQ ID NO: 48129 - protein, 11 aa, Borrelia burgdorferi B31
LTVLILISCSL

SEQ ID NO: 48130 - protein, 11 aa, Borrelia burgdorferi B31
TVLILISCSLE

SEQ ID NO: 48131 - protein, 11 aa, Borrelia burgdorferi B31
VLILISCSLEV

SEQ ID NO: 48132 - protein, 11 aa, Borrelia burgdorferi B31
LILISCSLEVK

SEQ ID NO: 48133 - protein, 11 aa, Borrelia burgdorferi B31
ILISCSLEVKD

SEQ ID NO: 48134 - protein, 11 aa, Borrelia burgdorferi B31
LISCSLEVKDS

SEQ ID NO: 48135 - protein, 11 aa, Borrelia burgdorferi B31
ISCSLEVKDSN

SEQ ID NO: 48136 - protein, 11 aa, Borrelia burgdorferi B31
SCSLEVKDSNE

SEQ ID NO: 48137 - protein, 11 aa, Borrelia burgdorferi B31
CSLEVKDSNES

SEQ ID NO: 48138 - protein, 11 aa, Borrelia burgdorferi B31
SLEVKDSNESK

SEQ ID NO: 48139 - protein, 11 aa, Borrelia burgdorferi B31
LEVKDSNESKK

SEQ ID NO: 48140 - protein, 11 aa, Borrelia burgdorferi B31
EVKDSNESKKH

SEQ ID NO: 48141 - protein, 11 aa, Borrelia burgdorferi B31
VKDSNESKKHK

SEQ ID NO: 48142 - protein, 11 aa, Borrelia burgdorferi B31
KDSNESKKHKK

SEQ ID NO: 48143 - protein, 11 aa, Borrelia burgdorferi B31
DSNESKKHKKE

SEQ ID NO: 48144 - protein, 11 aa, Borrelia burgdorferi B31
SNESKKHKKEK

SEQ ID NO: 48145 - protein, 11 aa, Borrelia burgdorferi B31
NESKKHKKEKR

SEQ ID NO: 48146 - protein, 11 aa, Borrelia burgdorferi B31
ESKKHKKEKRK

SEQ ID NO: 48147 - protein, 11 aa, Borrelia burgdorferi B31
SKKHKKEKRKG

SEQ ID NO: 48148 - protein, 11 aa, Borrelia burgdorferi B31
KKHKKEKRKGK

SEQ ID NO: 48149 - protein, 11 aa, Borrelia burgdorferi B31
KHKKEKRKGKV

SEQ ID NO: 48150 - protein, 11 aa, Borrelia burgdorferi B31
HKKEKRKGKVE

SEQ ID NO: 48151 - protein, 11 aa, Borrelia burgdorferi B31
KKEKRKGKVEN

SEQ ID NO: 48152 - protein, 11 aa, Borrelia burgdorferi B31
KEKRKGKVENL

SEQ ID NO: 48153 - protein, 11 aa, Borrelia burgdorferi B31
EKRKGKVENLL

SEQ ID NO: 48154 - protein, 11 aa, Borrelia burgdorferi B31
KRKGKVENLLV

SEQ ID NO: 48155 - protein, 11 aa, Borrelia burgdorferi B31
RKGKVENLLVA

SEQ ID NO: 48156 - protein, 11 aa, Borrelia burgdorferi B31
KGKVENLLVAI

SEQ ID NO: 48157 - protein, 11 aa, Borrelia burgdorferi B31
GKVENLLVAIN

SEQ ID NO: 48158 - protein, 11 aa, Borrelia burgdorferi B31
KVENLLVAINN

SEQ ID NO: 48159 - protein, 11 aa, Borrelia burgdorferi B31
VENLLVAINNL

SEQ ID NO: 48160 - protein, 11 aa, Borrelia burgdorferi B31
ENLLVAINNLK

SEQ ID NO: 48161 - protein, 11 aa, Borrelia burgdorferi B31
NLLVAINNLKN

SEQ ID NO: 48162 - protein, 11 aa, Borrelia burgdorferi B31
LLVAINNLKNP

SEQ ID NO: 48163 - protein, 11 aa, Borrelia burgdorferi B31
LVAINNLKNPT

SEQ ID NO: 48164 - protein, 11 aa, Borrelia burgdorferi B31
VAINNLKNPTK

SEQ ID NO: 48165 - protein, 11 aa, Borrelia burgdorferi B31
AINNLKNPTKP

SEQ ID NO: 48166 - protein, 11 aa, Borrelia burgdorferi B31
INNLKNPTKPA

SEQ ID NO: 48167 - protein, 11 aa, Borrelia burgdorferi B31
NNLKNPTKPAA

SEQ ID NO: 48168 - protein, 11 aa, Borrelia burgdorferi B31
NLKNPTKPAAG

SEQ ID NO: 48169 - protein, 11 aa, Borrelia burgdorferi B31
LKNPTKPAAGK

SEQ ID NO: 48170 - protein, 11 aa, Borrelia burgdorferi B31
KNPTKPAAGKN

SEQ ID NO: 48171 - protein, 11 aa, Borrelia burgdorferi B31
NPTKPAAGKNK

SEQ ID NO: 48172 - protein, 11 aa, Borrelia burgdorferi B31
PTKPAAGKNKA

SEQ ID NO: 48173 - protein, 11 aa, Borrelia burgdorferi B31
TKPAAGKNKAN

SEQ ID NO: 48174 - protein, 11 aa, Borrelia burgdorferi B31
KPAAGKNKANS

SEQ ID NO: 48175 - protein, 11 aa, Borrelia burgdorferi B31
PAAGKNKANSK

SEQ ID NO: 48176 - protein, 11 aa, Borrelia burgdorferi B31
AAGKNKANSKA

SEQ ID NO: 48177 - protein, 11 aa, Borrelia burgdorferi B31
AGKNKANSKAS

SEQ ID NO: 48178 - protein, 11 aa, Borrelia burgdorferi B31
GKNKANSKASK

SEQ ID NO: 48179 - protein, 11 aa, Borrelia burgdorferi B31
KNKANSKASKQ

SEQ ID NO: 48180 - protein, 11 aa, Borrelia burgdorferi B31
NKANSKASKQK

SEQ ID NO: 48181 - protein, 11 aa, Borrelia burgdorferi B31
KANSKASKQKN

SEQ ID NO: 48182 - protein, 11 aa, Borrelia burgdorferi B31
ANSKASKQKNN

SEQ ID NO: 48183 - protein, 11 aa, Borrelia burgdorferi B31
NSKASKQKNNP

SEQ ID NO: 48184 - protein, 11 aa, Borrelia burgdorferi B31
SKASKQKNNPN

SEQ ID NO: 48185 - protein, 11 aa, Borrelia burgdorferi B31
KASKQKNNPNA

SEQ ID NO: 48186 - protein, 11 aa, Borrelia burgdorferi B31
ASKQKNNPNAN

SEQ ID NO: 48187 - protein, 11 aa, Borrelia burgdorferi B31
SKQKNNPNANA

SEQ ID NO: 48188 - protein, 11 aa, Borrelia burgdorferi B31
KQKNNPNANAN

SEQ ID NO: 48189 - protein, 11 aa, Borrelia burgdorferi B31
QKNNPNANANN

SEQ ID NO: 48190 - protein, 11 aa, Borrelia burgdorferi B31
KNNPNANANNA

SEQ ID NO: 48191 - protein, 11 aa, Borrelia burgdorferi B31
NNPNANANNAP

SEQ ID NO: 48192 - protein, 11 aa, Borrelia burgdorferi B31
NPNANANNAPK

SEQ ID NO: 48193 - protein, 11 aa, Borrelia burgdorferi B31
PNANANNAPKK

SEQ ID NO: 48194 - protein, 11 aa, Borrelia burgdorferi B31
NANANNAPKKI

SEQ ID NO: 48195 - protein, 11 aa, Borrelia burgdorferi B31
ANANNAPKKIL

SEQ ID NO: 48196 - protein, 11 aa, Borrelia burgdorferi B31
NANNAPKKILD

SEQ ID NO: 48197 - protein, 11 aa, Borrelia burgdorferi B31
ANNAPKKILDP

SEQ ID NO: 48198 - protein, 11 aa, Borrelia burgdorferi B31
NNAPKKILDPE

SEQ ID NO: 48199 - protein, 11 aa, Borrelia burgdorferi B31
NAPKKILDPEV

SEQ ID NO: 48200 - protein, 11 aa, Borrelia burgdorferi B31
APKKILDPEVA

SEQ ID NO: 48201 - protein, 11 aa, Borrelia burgdorferi B31
PKKILDPEVAK

SEQ ID NO: 48202 - protein, 11 aa, Borrelia burgdorferi B31
KKILDPEVAKL

SEQ ID NO: 48203 - protein, 11 aa, Borrelia burgdorferi B31
KILDPEVAKLI

SEQ ID NO: 48204 - protein, 11 aa, Borrelia burgdorferi B31
ILDPEVAKLIQ

SEQ ID NO: 48205 - protein, 11 aa, Borrelia burgdorferi B31
LDPEVAKLIQK

SEQ ID NO: 48206 - protein, 11 aa, Borrelia burgdorferi B31
DPEVAKLIQKI

SEQ ID NO: 48207 - protein, 11 aa, Borrelia burgdorferi B31
PEVAKLIQKIL

SEQ ID NO: 48208 - protein, 11 aa, Borrelia burgdorferi B31
EVAKLIQKILD

SEQ ID NO: 48209 - protein, 11 aa, Borrelia burgdorferi B31
VAKLIQKILDR

SEQ ID NO: 48210 - protein, 11 aa, Borrelia burgdorferi B31
AKLIQKILDRS

SEQ ID NO: 48211 - protein, 11 aa, Borrelia burgdorferi B31
KLIQKILDRSE

SEQ ID NO: 48212 - protein, 11 aa, Borrelia burgdorferi B31
LIQKILDRSEN

SEQ ID NO: 48213 - protein, 11 aa, Borrelia burgdorferi B31
IQKILDRSENI

SEQ ID NO: 48214 - protein, 11 aa, Borrelia burgdorferi B31
QKILDRSENII

SEQ ID NO: 48215 - protein, 11 aa, Borrelia burgdorferi B31
KILDRSENIIQ

SEQ ID NO: 48216 - protein, 11 aa, Borrelia burgdorferi B31
ILDRSENIIQI

SEQ ID NO: 48217 - protein, 11 aa, Borrelia burgdorferi B31
LDRSENIIQIS

SEQ ID NO: 48218 - protein, 11 aa, Borrelia burgdorferi B31
DRSENIIQISE

SEQ ID NO: 48219 - protein, 11 aa, Borrelia burgdorferi B31
RSENIIQISEM

SEQ ID NO: 48220 - protein, 11 aa, Borrelia burgdorferi B31
SENIIQISEMD

SEQ ID NO: 48221 - protein, 11 aa, Borrelia burgdorferi B31
ENIIQISEMDS

SEQ ID NO: 48222 - protein, 11 aa, Borrelia burgdorferi B31
NIIQISEMDSS

SEQ ID NO: 48223 - protein, 11 aa, Borrelia burgdorferi B31
IIQISEMDSSR

SEQ ID NO: 48224 - protein, 11 aa, Borrelia burgdorferi B31
IQISEMDSSRG

SEQ ID NO: 48225 - protein, 11 aa, Borrelia burgdorferi B31
QISEMDSSRGE

SEQ ID NO: 48226 - protein, 11 aa, Borrelia burgdorferi B31
ISEMDSSRGEP

SEQ ID NO: 48227 - protein, 11 aa, Borrelia burgdorferi B31
SEMDSSRGEPN

SEQ ID NO: 48228 - protein, 11 aa, Borrelia burgdorferi B31
EMDSSRGEPND

SEQ ID NO: 48229 - protein, 11 aa, Borrelia burgdorferi B31
MDSSRGEPNDQ

SEQ ID NO: 48230 - protein, 11 aa, Borrelia burgdorferi B31
DSSRGEPNDQF

SEQ ID NO: 48231 - protein, 11 aa, Borrelia burgdorferi B31
SSRGEPNDQFG

SEQ ID NO: 48232 - protein, 11 aa, Borrelia burgdorferi B31
SRGEPNDQFGM

SEQ ID NO: 48233 - protein, 11 aa, Borrelia burgdorferi B31
RGEPNDQFGMR

SEQ ID NO: 48234 - protein, 11 aa, Borrelia burgdorferi B31
GEPNDQFGMRA

SEQ ID NO: 48235 - protein, 11 aa, Borrelia burgdorferi B31
EPNDQFGMRAE

SEQ ID NO: 48236 - protein, 11 aa, Borrelia burgdorferi B31
PNDQFGMRAEI

SEQ ID NO: 48237 - protein, 11 aa, Borrelia burgdorferi B31
NDQFGMRAEIF

SEQ ID NO: 48238 - protein, 11 aa, Borrelia burgdorferi B31
DQFGMRAEIFS

SEQ ID NO: 48239 - protein, 11 aa, Borrelia burgdorferi B31
QFGMRAEIFSK

SEQ ID NO: 48240 - protein, 11 aa, Borrelia burgdorferi B31
FGMRAEIFSKI

SEQ ID NO: 48241 - protein, 11 aa, Borrelia burgdorferi B31
GMRAEIFSKIF

SEQ ID NO: 48242 - protein, 11 aa, Borrelia burgdorferi B31
MRAEIFSKIFF

SEQ ID NO: 48243 - protein, 11 aa, Borrelia burgdorferi B31
RAEIFSKIFFN

SEQ ID NO: 48244 - protein, 11 aa, Borrelia burgdorferi B31
AEIFSKIFFNA

SEQ ID NO: 48245 - protein, 11 aa, Borrelia burgdorferi B31
EIFSKIFFNAN

SEQ ID NO: 48246 - protein, 11 aa, Borrelia burgdorferi B31
IFSKIFFNANS

SEQ ID NO: 48247 - protein, 11 aa, Borrelia burgdorferi B31
FSKIFFNANST

SEQ ID NO: 48248 - protein, 11 aa, Borrelia burgdorferi B31
SKIFFNANSTV

SEQ ID NO: 48249 - protein, 11 aa, Borrelia burgdorferi B31
KIFFNANSTVH

SEQ ID NO: 48250 - protein, 11 aa, Borrelia burgdorferi B31
IFFNANSTVHF

SEQ ID NO: 48251 - protein, 11 aa, Borrelia burgdorferi B31
FFNANSTVHFD

SEQ ID NO: 48252 - protein, 11 aa, Borrelia burgdorferi B31
FNANSTVHFDS

SEQ ID NO: 48253 - protein, 11 aa, Borrelia burgdorferi B31
NANSTVHFDSH

SEQ ID NO: 48254 - protein, 11 aa, Borrelia burgdorferi B31
ANSTVHFDSHE

SEQ ID NO: 48255 - protein, 11 aa, Borrelia burgdorferi B31
NSTVHFDSHEY

SEQ ID NO: 48256 - protein, 11 aa, Borrelia burgdorferi B31
STVHFDSHEYT

SEQ ID NO: 48257 - protein, 11 aa, Borrelia burgdorferi B31
TVHFDSHEYTE

SEQ ID NO: 48258 - protein, 11 aa, Borrelia burgdorferi B31
VHFDSHEYTEE

SEQ ID NO: 48259 - protein, 11 aa, Borrelia burgdorferi B31
HFDSHEYTEER

SEQ ID NO: 48260 - protein, 11 aa, Borrelia burgdorferi B31
FDSHEYTEERR

SEQ ID NO: 48261 - protein, 11 aa, Borrelia burgdorferi B31
DSHEYTEERRM

SEQ ID NO: 48262 - protein, 11 aa, Borrelia burgdorferi B31
SHEYTEERRML

SEQ ID NO: 48263 - protein, 11 aa, Borrelia burgdorferi B31
HEYTEERRMLY

SEQ ID NO: 48264 - protein, 11 aa, Borrelia burgdorferi B31
EYTEERRMLYT

SEQ ID NO: 48265 - protein, 11 aa, Borrelia burgdorferi B31
YTEERRMLYTS

SEQ ID NO: 48266 - protein, 11 aa, Borrelia burgdorferi B31
TEERRMLYTSL

SEQ ID NO: 48267 - protein, 11 aa, Borrelia burgdorferi B31
EERRMLYTSLN

SEQ ID NO: 48268 - protein, 11 aa, Borrelia burgdorferi B31
ERRMLYTSLNF

SEQ ID NO: 48269 - protein, 11 aa, Borrelia burgdorferi B31
RRMLYTSLNFN

SEQ ID NO: 48270 - protein, 11 aa, Borrelia burgdorferi B31
RMLYTSLNFNE

SEQ ID NO: 48271 - protein, 11 aa, Borrelia burgdorferi B31
MLYTSLNFNEG

SEQ ID NO: 48272 - protein, 11 aa, Borrelia burgdorferi B31
LYTSLNFNEGK

SEQ ID NO: 48273 - protein, 11 aa, Borrelia burgdorferi B31
YTSLNFNEGKI

SEQ ID NO: 48274 - protein, 11 aa, Borrelia burgdorferi B31
TSLNFNEGKIF

SEQ ID NO: 48275 - protein, 11 aa, Borrelia burgdorferi B31
SLNFNEGKIFN

SEQ ID NO: 48276 - protein, 11 aa, Borrelia burgdorferi B31
LNFNEGKIFNL

SEQ ID NO: 48277 - protein, 11 aa, Borrelia burgdorferi B31
NFNEGKIFNLG

SEQ ID NO: 48278 - protein, 11 aa, Borrelia burgdorferi B31
FNEGKIFNLGQ

SEQ ID NO: 48279 - protein, 11 aa, Borrelia burgdorferi B31
NEGKIFNLGQI

SEQ ID NO: 48280 - protein, 11 aa, Borrelia burgdorferi B31
EGKIFNLGQIL

SEQ ID NO: 48281 - protein, 11 aa, Borrelia burgdorferi B31
GKIFNLGQILS

SEQ ID NO: 48282 - protein, 11 aa, Borrelia burgdorferi B31
KIFNLGQILSK

SEQ ID NO: 48283 - protein, 11 aa, Borrelia burgdorferi B31
IFNLGQILSKL

SEQ ID NO: 48284 - protein, 11 aa, Borrelia burgdorferi B31
FNLGQILSKLS

SEQ ID NO: 48285 - protein, 11 aa, Borrelia burgdorferi B31
NLGQILSKLSQ

SEQ ID NO: 48286 - protein, 11 aa, Borrelia burgdorferi B31
LGQILSKLSQD

SEQ ID NO: 48287 - protein, 11 aa, Borrelia burgdorferi B31
GQILSKLSQDS

SEQ ID NO: 48288 - protein, 11 aa, Borrelia burgdorferi B31
QILSKLSQDSN

SEQ ID NO: 48289 - protein, 11 aa, Borrelia burgdorferi B31
ILSKLSQDSNY

SEQ ID NO: 48290 - protein, 11 aa, Borrelia burgdorferi B31
LSKLSQDSNYR

SEQ ID NO: 48291 - protein, 11 aa, Borrelia burgdorferi B31
SKLSQDSNYRG

SEQ ID NO: 48292 - protein, 11 aa, Borrelia burgdorferi B31
KLSQDSNYRGL

SEQ ID NO: 48293 - protein, 11 aa, Borrelia burgdorferi B31
LSQDSNYRGLV

SEQ ID NO: 48294 - protein, 11 aa, Borrelia burgdorferi B31
SQDSNYRGLVK

SEQ ID NO: 48295 - protein, 11 aa, Borrelia burgdorferi B31
QDSNYRGLVKE

SEQ ID NO: 48296 - protein, 11 aa, Borrelia burgdorferi B31
DSNYRGLVKET

SEQ ID NO: 48297 - protein, 11 aa, Borrelia burgdorferi B31
SNYRGLVKETL

SEQ ID NO: 48298 - protein, 11 aa, Borrelia burgdorferi B31
NYRGLVKETLI

SEQ ID NO: 48299 - protein, 11 aa, Borrelia burgdorferi B31
YRGLVKETLIN

SEQ ID NO: 48300 - protein, 11 aa, Borrelia burgdorferi B31
RGLVKETLINR

SEQ ID NO: 48301 - protein, 11 aa, Borrelia burgdorferi B31
GLVKETLINRG

SEQ ID NO: 48302 - protein, 11 aa, Borrelia burgdorferi B31
LVKETLINRGF

SEQ ID NO: 48303 - protein, 11 aa, Borrelia burgdorferi B31
VKETLINRGFS

SEQ ID NO: 48304 - protein, 11 aa, Borrelia burgdorferi B31
KETLINRGFSI

SEQ ID NO: 48305 - protein, 11 aa, Borrelia burgdorferi B31
ETLINRGFSIQ

SEQ ID NO: 48306 - protein, 11 aa, Borrelia burgdorferi B31
TLINRGFSIQL

SEQ ID NO: 48307 - protein, 11 aa, Borrelia burgdorferi B31
LINRGFSIQLA

SEQ ID NO: 48308 - protein, 11 aa, Borrelia burgdorferi B31
INRGFSIQLAM

SEQ ID NO: 48309 - protein, 11 aa, Borrelia burgdorferi B31
NRGFSIQLAME

SEQ ID NO: 48310 - protein, 11 aa, Borrelia burgdorferi B31
RGFSIQLAMEE

SEQ ID NO: 48311 - protein, 11 aa, Borrelia burgdorferi B31
GFSIQLAMEEI

SEQ ID NO: 48312 - protein, 11 aa, Borrelia burgdorferi B31
FSIQLAMEEIS

SEQ ID NO: 48313 - protein, 11 aa, Borrelia burgdorferi B31
SIQLAMEEISA

SEQ ID NO: 48314 - protein, 11 aa, Borrelia burgdorferi B31
IQLAMEEISAK

SEQ ID NO: 48315 - protein, 11 aa, Borrelia burgdorferi B31
QLAMEEISAKI

SEQ ID NO: 48316 - protein, 11 aa, Borrelia burgdorferi B31
LAMEEISAKIL

SEQ ID NO: 48317 - protein, 11 aa, Borrelia burgdorferi B31
AMEEISAKILN

SEQ ID NO: 48318 - protein, 11 aa, Borrelia burgdorferi B31
MEEISAKILNV

SEQ ID NO: 48319 - protein, 11 aa, Borrelia burgdorferi B31
EEISAKILNVK

SEQ ID NO: 48320 - protein, 11 aa, Borrelia burgdorferi B31
EISAKILNVKD

SEQ ID NO: 48321 - protein, 11 aa, Borrelia burgdorferi B31
ISAKILNVKDK

SEQ ID NO: 48322 - protein, 11 aa, Borrelia burgdorferi B31
SAKILNVKDKL

SEQ ID NO: 48323 - protein, 11 aa, Borrelia burgdorferi B31
AKILNVKDKLQ

SEQ ID NO: 48324 - protein, 11 aa, Borrelia burgdorferi B31
KILNVKDKLQQ

SEQ ID NO: 48325 - protein, 11 aa, Borrelia burgdorferi B31
ILNVKDKLQQL

SEQ ID NO: 48326 - protein, 11 aa, Borrelia burgdorferi B31
LNVKDKLQQLN

SEQ ID NO: 48327 - protein, 11 aa, Borrelia burgdorferi B31
NVKDKLQQLNK

SEQ ID NO: 48328 - protein, 11 aa, Borrelia burgdorferi B31
VKDKLQQLNKP

SEQ ID NO: 48329 - protein, 11 aa, Borrelia burgdorferi B31
KDKLQQLNKPN

SEQ ID NO: 48330 - protein, 11 aa, Borrelia burgdorferi B31
DKLQQLNKPNL

SEQ ID NO: 48331 - protein, 11 aa, Borrelia burgdorferi B31
KLQQLNKPNLE

SEQ ID NO: 48332 - protein, 11 aa, Borrelia burgdorferi B31
LQQLNKPNLET

SEQ ID NO: 48333 - protein, 11 aa, Borrelia burgdorferi B31
QQLNKPNLETL

SEQ ID NO: 48334 - protein, 11 aa, Borrelia burgdorferi B31
QLNKPNLETLY

SEQ ID NO: 48335 - protein, 11 aa, Borrelia burgdorferi B31
LNKPNLETLYN

SEQ ID NO: 48336 - protein, 11 aa, Borrelia burgdorferi B31
NKPNLETLYND

SEQ ID NO: 48337 - protein, 11 aa, Borrelia burgdorferi B31
KPNLETLYNDF

SEQ ID NO: 48338 - protein, 11 aa, Borrelia burgdorferi B31
PNLETLYNDFE

SEQ ID NO: 48339 - protein, 11 aa, Borrelia burgdorferi B31
NLETLYNDFEK

SEQ ID NO: 48340 - protein, 11 aa, Borrelia burgdorferi B31
LETLYNDFEKL

SEQ ID NO: 48341 - protein, 11 aa, Borrelia burgdorferi B31
ETLYNDFEKLT

SEQ ID NO: 48342 - protein, 11 aa, Borrelia burgdorferi B31
TLYNDFEKLTS

SEQ ID NO: 48343 - protein, 11 aa, Borrelia burgdorferi B31
LYNDFEKLTSL

SEQ ID NO: 48344 - protein, 11 aa, Borrelia burgdorferi B31
YNDFEKLTSLK

SEQ ID NO: 48345 - protein, 11 aa, Borrelia burgdorferi B31
NDFEKLTSLKE

SEQ ID NO: 48346 - protein, 11 aa, Borrelia burgdorferi B31
DFEKLTSLKEK

SEQ ID NO: 48347 - protein, 11 aa, Borrelia burgdorferi B31
FEKLTSLKEKW

SEQ ID NO: 48348 - protein, 11 aa, Borrelia burgdorferi B31
EKLTSLKEKWL

SEQ ID NO: 48349 - protein, 11 aa, Borrelia burgdorferi B31
KLTSLKEKWLK

SEQ ID NO: 48350 - protein, 11 aa, Borrelia burgdorferi B31
LTSLKEKWLKD

SEQ ID NO: 48351 - protein, 11 aa, Borrelia burgdorferi B31
TSLKEKWLKDT

SEQ ID NO: 48352 - protein, 11 aa, Borrelia burgdorferi B31
SLKEKWLKDTD

SEQ ID NO: 48353 - protein, 11 aa, Borrelia burgdorferi B31
LKEKWLKDTDD

SEQ ID NO: 48354 - protein, 11 aa, Borrelia burgdorferi B31
KEKWLKDTDDL

SEQ ID NO: 48355 - protein, 11 aa, Borrelia burgdorferi B31
EKWLKDTDDLI

SEQ ID NO: 48356 - protein, 11 aa, Borrelia burgdorferi B31
KWLKDTDDLID

SEQ ID NO: 48357 - protein, 11 aa, Borrelia burgdorferi B31
WLKDTDDLIDE

SEQ ID NO: 48358 - protein, 11 aa, Borrelia burgdorferi B31
LKDTDDLIDEY

SEQ ID NO: 48359 - protein, 11 aa, Borrelia burgdorferi B31
KDTDDLIDEYN

SEQ ID NO: 48360 - protein, 11 aa, Borrelia burgdorferi B31
DTDDLIDEYNT

SEQ ID NO: 48361 - protein, 11 aa, Borrelia burgdorferi B31
TDDLIDEYNTN

SEQ ID NO: 48362 - protein, 11 aa, Borrelia burgdorferi B31
DDLIDEYNTNP

SEQ ID NO: 48363 - protein, 11 aa, Borrelia burgdorferi B31
DLIDEYNTNPD

SEQ ID NO: 48364 - protein, 11 aa, Borrelia burgdorferi B31
LIDEYNTNPDL

SEQ ID NO: 48365 - protein, 11 aa, Borrelia burgdorferi B31
IDEYNTNPDLQ

SEQ ID NO: 48366 - protein, 11 aa, Borrelia burgdorferi B31
DEYNTNPDLQT

SEQ ID NO: 48367 - protein, 11 aa, Borrelia burgdorferi B31
EYNTNPDLQTD

SEQ ID NO: 48368 - protein, 11 aa, Borrelia burgdorferi B31
YNTNPDLQTDV

SEQ ID NO: 48369 - protein, 11 aa, Borrelia burgdorferi B31
NTNPDLQTDVS

SEQ ID NO: 48370 - protein, 11 aa, Borrelia burgdorferi B31
TNPDLQTDVSK

SEQ ID NO: 48371 - protein, 11 aa, Borrelia burgdorferi B31
NPDLQTDVSKL

SEQ ID NO: 48372 - protein, 11 aa, Borrelia burgdorferi B31
PDLQTDVSKLN

SEQ ID NO: 48373 - protein, 11 aa, Borrelia burgdorferi B31
DLQTDVSKLND

SEQ ID NO: 48374 - protein, 11 aa, Borrelia burgdorferi B31
LQTDVSKLNDT

SEQ ID NO: 48375 - protein, 11 aa, Borrelia burgdorferi B31
QTDVSKLNDTL

SEQ ID NO: 48376 - protein, 11 aa, Borrelia burgdorferi B31
TDVSKLNDTLR

SEQ ID NO: 48377 - protein, 11 aa, Borrelia burgdorferi B31
DVSKLNDTLRS

SEQ ID NO: 48378 - protein, 11 aa, Borrelia burgdorferi B31
VSKLNDTLRSK

SEQ ID NO: 48379 - protein, 11 aa, Borrelia burgdorferi B31
SKLNDTLRSKN

SEQ ID NO: 48380 - protein, 11 aa, Borrelia burgdorferi B31
KLNDTLRSKNS

SEQ ID NO: 48381 - protein, 11 aa, Borrelia burgdorferi B31
LNDTLRSKNSR

SEQ ID NO: 48382 - protein, 11 aa, Borrelia burgdorferi B31
NDTLRSKNSRA

SEQ ID NO: 48383 - protein, 11 aa, Borrelia burgdorferi B31
DTLRSKNSRAQ

SEQ ID NO: 48384 - protein, 11 aa, Borrelia burgdorferi B31
TLRSKNSRAQF

SEQ ID NO: 48385 - protein, 11 aa, Borrelia burgdorferi B31
LRSKNSRAQFA

SEQ ID NO: 48386 - protein, 11 aa, Borrelia burgdorferi B31
RSKNSRAQFAN

SEQ ID NO: 48387 - protein, 11 aa, Borrelia burgdorferi B31
SKNSRAQFANI

SEQ ID NO: 48388 - protein, 11 aa, Borrelia burgdorferi B31
KNSRAQFANIH

SEQ ID NO: 48389 - protein, 11 aa, Borrelia burgdorferi B31
NSRAQFANIHD

SEQ ID NO: 48390 - protein, 11 aa, Borrelia burgdorferi B31
SRAQFANIHDI

SEQ ID NO: 48391 - protein, 11 aa, Borrelia burgdorferi B31
RAQFANIHDII

SEQ ID NO: 48392 - protein, 11 aa, Borrelia burgdorferi B31
AQFANIHDIIL

SEQ ID NO: 48393 - protein, 11 aa, Borrelia burgdorferi B31
QFANIHDIILD

SEQ ID NO: 48394 - protein, 11 aa, Borrelia burgdorferi B31
FANIHDIILDL

SEQ ID NO: 48395 - protein, 11 aa, Borrelia burgdorferi B31
ANIHDIILDLV

SEQ ID NO: 48396 - protein, 11 aa, Borrelia burgdorferi B31
NIHDIILDLVN

SEQ ID NO: 48397 - protein, 11 aa, Borrelia burgdorferi B31
IHDIILDLVNT

SEQ ID NO: 48398 - protein, 11 aa, Borrelia burgdorferi B31
HDIILDLVNTT

SEQ ID NO: 48399 - protein, 11 aa, Borrelia burgdorferi B31
DIILDLVNTTT

SEQ ID NO: 48400 - protein, 11 aa, Borrelia burgdorferi B31
IILDLVNTTTN

SEQ ID NO: 48401 - protein, 11 aa, Borrelia burgdorferi B31
ILDLVNTTTNI

SEQ ID NO: 48402 - protein, 11 aa, Borrelia burgdorferi B31
LDLVNTTTNIL

SEQ ID NO: 48403 - protein, 11 aa, Borrelia burgdorferi B31
DLVNTTTNILA

SEQ ID NO: 48404 - protein, 11 aa, Borrelia burgdorferi B31
LVNTTTNILAP

SEQ ID NO: 48405 - protein, 11 aa, Borrelia burgdorferi B31
VNTTTNILAPI

SEQ ID NO: 48406 - protein, 11 aa, Borrelia burgdorferi B31
NTTTNILAPIQ

SEQ ID NO: 48407 - protein, 8 aa, Borrelia garinii PBi
MKNNKLIA

SEQ ID NO: 48408 - protein, 8 aa, Borrelia garinii PBi
KNNKLIAI

SEQ ID NO: 48409 - protein, 8 aa, Borrelia garinii PBi
NNKLIAIF

SEQ ID NO: 48410 - protein, 8 aa, Borrelia garinii PBi
NKLIAIFL

SEQ ID NO: 48411 - protein, 8 aa, Borrelia garinii PBi
KLIAIFLL

SEQ ID NO: 48412 - protein, 8 aa, Borrelia garinii PBi
LIAIFLLH

SEQ ID NO: 48413 - protein, 8 aa, Borrelia garinii PBi
IAIFLLHI

SEQ ID NO: 48414 - protein, 8 aa, Borrelia garinii PBi
AIFLLHIL

SEQ ID NO: 48415 - protein, 8 aa, Borrelia garinii PBi
IFLLHILT

SEQ ID NO: 48416 - protein, 8 aa, Borrelia garinii PBi
FLLHILTG

SEQ ID NO: 48417 - protein, 8 aa, Borrelia garinii PBi
LLHILTGL

SEQ ID NO: 48418 - protein, 8 aa, Borrelia garinii PBi
LHILTGLI

SEQ ID NO: 48419 - protein, 8 aa, Borrelia garinii PBi
HILTGLIL

SEQ ID NO: 48420 - protein, 8 aa, Borrelia garinii PBi
ILTGLILL

SEQ ID NO: 48421 - protein, 8 aa, Borrelia garinii PBi
LTGLILLS

SEQ ID NO: 48422 - protein, 8 aa, Borrelia garinii PBi
TGLILLSC

SEQ ID NO: 48423 - protein, 8 aa, Borrelia garinii PBi
GLILLSCS

SEQ ID NO: 48424 - protein, 8 aa, Borrelia garinii PBi
LILLSCSL

SEQ ID NO: 48425 - protein, 8 aa, Borrelia garinii PBi
ILLSCSLE

SEQ ID NO: 48426 - protein, 8 aa, Borrelia garinii PBi
LLSCSLEV

SEQ ID NO: 48427 - protein, 8 aa, Borrelia garinii PBi
LSCSLEVN

SEQ ID NO: 48428 - protein, 8 aa, Borrelia garinii PBi
SCSLEVNQ

SEQ ID NO: 48429 - protein, 8 aa, Borrelia garinii PBi
CSLEVNQD

SEQ ID NO: 48430 - protein, 8 aa, Borrelia garinii PBi
SLEVNQDD

SEQ ID NO: 48431 - protein, 8 aa, Borrelia garinii PBi
LEVNQDDN

SEQ ID NO: 48432 - protein, 8 aa, Borrelia garinii PBi
EVNQDDNQ

SEQ ID NO: 48433 - protein, 8 aa, Borrelia garinii PBi
VNQDDNQE

SEQ ID NO: 48434 - protein, 8 aa, Borrelia garinii PBi
NQDDNQEK

SEQ ID NO: 48435 - protein, 8 aa, Borrelia garinii PBi
QDDNQEKQ

SEQ ID NO: 48436 - protein, 8 aa, Borrelia garinii PBi
DDNQEKQK

SEQ ID NO: 48437 - protein, 8 aa, Borrelia garinii PBi
DNQEKQKK

SEQ ID NO: 48438 - protein, 8 aa, Borrelia garinii PBi
NQEKQKKA

SEQ ID NO: 48439 - protein, 8 aa, Borrelia garinii PBi
QEKQKKAK

SEQ ID NO: 48440 - protein, 8 aa, Borrelia garinii PBi
EKQKKAKT

SEQ ID NO: 48441 - protein, 8 aa, Borrelia garinii PBi
KQKKAKTK

SEQ ID NO: 48442 - protein, 8 aa, Borrelia garinii PBi
QKKAKTKT

SEQ ID NO: 48443 - protein, 8 aa, Borrelia garinii PBi
KKAKTKTS

SEQ ID NO: 48444 - protein, 8 aa, Borrelia garinii PBi
KAKTKTSK

SEQ ID NO: 48445 - protein, 8 aa, Borrelia garinii PBi
AKTKTSKS

SEQ ID NO: 48446 - protein, 8 aa, Borrelia garinii PBi
KTKTSKSE

SEQ ID NO: 48447 - protein, 8 aa, Borrelia garinii PBi
TKTSKSEN

SEQ ID NO: 48448 - protein, 8 aa, Borrelia garinii PBi
KTSKSENN

SEQ ID NO: 48449 - protein, 8 aa, Borrelia garinii PBi
TSKSENNS

SEQ ID NO: 48450 - protein, 8 aa, Borrelia garinii PBi
SKSENNSS

SEQ ID NO: 48451 - protein, 8 aa, Borrelia garinii PBi
KSENNSSK

SEQ ID NO: 48452 - protein, 8 aa, Borrelia garinii PBi
SENNSSKM

SEQ ID NO: 48453 - protein, 8 aa, Borrelia garinii PBi
ENNSSKMK

SEQ ID NO: 48454 - protein, 8 aa, Borrelia garinii PBi
NNSSKMKK

SEQ ID NO: 48455 - protein, 8 aa, Borrelia garinii PBi
NSSKMKKL

SEQ ID NO: 48456 - protein, 8 aa, Borrelia garinii PBi
SSKMKKLS

SEQ ID NO: 48457 - protein, 8 aa, Borrelia garinii PBi
SKMKKLSK

SEQ ID NO: 48458 - protein, 8 aa, Borrelia garinii PBi
KMKKLSKN

SEQ ID NO: 48459 - protein, 8 aa, Borrelia garinii PBi
MKKLSKNA

SEQ ID NO: 48460 - protein, 8 aa, Borrelia garinii PBi
KKLSKNAK

SEQ ID NO: 48461 - protein, 8 aa, Borrelia garinii PBi
KLSKNAKN

SEQ ID NO: 48462 - protein, 8 aa, Borrelia garinii PBi
LSKNAKNK

SEQ ID NO: 48463 - protein, 8 aa, Borrelia garinii PBi
SKNAKNKK

SEQ ID NO: 48464 - protein, 8 aa, Borrelia garinii PBi
KNAKNKKP

SEQ ID NO: 48465 - protein, 8 aa, Borrelia garinii PBi
NAKNKKPT

SEQ ID NO: 48466 - protein, 8 aa, Borrelia garinii PBi
AKNKKPTV

SEQ ID NO: 48467 - protein, 8 aa, Borrelia garinii PBi
KNKKPTVD

SEQ ID NO: 48468 - protein, 8 aa, Borrelia garinii PBi
NKKPTVDN

SEQ ID NO: 48469 - protein, 8 aa, Borrelia garinii PBi
KKPTVDNL

SEQ ID NO: 48470 - protein, 8 aa, Borrelia garinii PBi
KPTVDNLL

SEQ ID NO: 48471 - protein, 8 aa, Borrelia garinii PBi
PTVDNLLV

SEQ ID NO: 48472 - protein, 8 aa, Borrelia garinii PBi
TVDNLLVA

SEQ ID NO: 48473 - protein, 8 aa, Borrelia garinii PBi
VDNLLVAI

SEQ ID NO: 48474 - protein, 8 aa, Borrelia garinii PBi
DNLLVAIN

SEQ ID NO: 48475 - protein, 8 aa, Borrelia garinii PBi
NLLVAINT

SEQ ID NO: 48476 - protein, 8 aa, Borrelia garinii PBi
LLVAINTL

SEQ ID NO: 48477 - protein, 8 aa, Borrelia garinii PBi
LVAINTLK

SEQ ID NO: 48478 - protein, 8 aa, Borrelia garinii PBi
VAINTLKN

SEQ ID NO: 48479 - protein, 8 aa, Borrelia garinii PBi
AINTLKNP

SEQ ID NO: 48480 - protein, 8 aa, Borrelia garinii PBi
INTLKNPP

SEQ ID NO: 48481 - protein, 8 aa, Borrelia garinii PBi
NTLKNPPK

SEQ ID NO: 48482 - protein, 8 aa, Borrelia garinii PBi
TLKNPPKT

SEQ ID NO: 48483 - protein, 8 aa, Borrelia garinii PBi
LKNPPKTA

SEQ ID NO: 48484 - protein, 8 aa, Borrelia garinii PBi
KNPPKTAG

SEQ ID NO: 48485 - protein, 8 aa, Borrelia garinii PBi
NPPKTAGK

SEQ ID NO: 48486 - protein, 8 aa, Borrelia garinii PBi
PPKTAGKN

SEQ ID NO: 48487 - protein, 8 aa, Borrelia garinii PBi
PKTAGKNK

SEQ ID NO: 48488 - protein, 8 aa, Borrelia garinii PBi
KTAGKNKS

SEQ ID NO: 48489 - protein, 8 aa, Borrelia garinii PBi
TAGKNKSN

SEQ ID NO: 48490 - protein, 8 aa, Borrelia garinii PBi
AGKNKSNS

SEQ ID NO: 48491 - protein, 8 aa, Borrelia garinii PBi
GKNKSNSA

SEQ ID NO: 48492 - protein, 8 aa, Borrelia garinii PBi
KNKSNSAA

SEQ ID NO: 48493 - protein, 8 aa, Borrelia garinii PBi
NKSNSAAA

SEQ ID NO: 48494 - protein, 8 aa, Borrelia garinii PBi
KSNSAAAL

SEQ ID NO: 48495 - protein, 8 aa, Borrelia garinii PBi
SNSAAALK

SEQ ID NO: 48496 - protein, 8 aa, Borrelia garinii PBi
NSAAALKQ

SEQ ID NO: 48497 - protein, 8 aa, Borrelia garinii PBi
SAAALKQP

SEQ ID NO: 48498 - protein, 8 aa, Borrelia garinii PBi
AAALKQPN

SEQ ID NO: 48499 - protein, 8 aa, Borrelia garinii PBi
AALKQPNN

SEQ ID NO: 48500 - protein, 8 aa, Borrelia garinii PBi
ALKQPNNA

SEQ ID NO: 48501 - protein, 8 aa, Borrelia garinii PBi
LKQPNNAN

SEQ ID NO: 48502 - protein, 8 aa, Borrelia garinii PBi
KQPNNANA

SEQ ID NO: 48503 - protein, 8 aa, Borrelia garinii PBi
QPNNANAL

SEQ ID NO: 48504 - protein, 8 aa, Borrelia garinii PBi
PNNANALK

SEQ ID NO: 48505 - protein, 8 aa, Borrelia garinii PBi
NNANALKQ

SEQ ID NO: 48506 - protein, 8 aa, Borrelia garinii PBi
NANALKQI

SEQ ID NO: 48507 - protein, 8 aa, Borrelia garinii PBi
ANALKQID

SEQ ID NO: 48508 - protein, 8 aa, Borrelia garinii PBi
NALKQIDP

SEQ ID NO: 48509 - protein, 8 aa, Borrelia garinii PBi
ALKQIDPE

SEQ ID NO: 48510 - protein, 8 aa, Borrelia garinii PBi
LKQIDPEA

SEQ ID NO: 48511 - protein, 8 aa, Borrelia garinii PBi
KQIDPEAK

SEQ ID NO: 48512 - protein, 8 aa, Borrelia garinii PBi
QIDPEAKE

SEQ ID NO: 48513 - protein, 8 aa, Borrelia garinii PBi
IDPEAKEL

SEQ ID NO: 48514 - protein, 8 aa, Borrelia garinii PBi
DPEAKELI

SEQ ID NO: 48515 - protein, 8 aa, Borrelia garinii PBi
PEAKELIQ

SEQ ID NO: 48516 - protein, 8 aa, Borrelia garinii PBi
EAKELIQK

SEQ ID NO: 48517 - protein, 8 aa, Borrelia garinii PBi
AKELIQKI

SEQ ID NO: 48518 - protein, 8 aa, Borrelia garinii PBi
KELIQKIL

SEQ ID NO: 48519 - protein, 8 aa, Borrelia garinii PBi
ELIQKILE

SEQ ID NO: 48520 - protein, 8 aa, Borrelia garinii PBi
LIQKILER

SEQ ID NO: 48521 - protein, 8 aa, Borrelia garinii PBi
IQKILERS

SEQ ID NO: 48522 - protein, 8 aa, Borrelia garinii PBi
QKILERSE

SEQ ID NO: 48523 - protein, 8 aa, Borrelia garinii PBi
KILERSED

SEQ ID NO: 48524 - protein, 8 aa, Borrelia garinii PBi
ILERSEDI

SEQ ID NO: 48525 - protein, 8 aa, Borrelia garinii PBi
LERSEDIV

SEQ ID NO: 48526 - protein, 8 aa, Borrelia garinii PBi
ERSEDIVQ

SEQ ID NO: 48527 - protein, 8 aa, Borrelia garinii PBi
RSEDIVQI

SEQ ID NO: 48528 - protein, 8 aa, Borrelia garinii PBi
SEDIVQIS

SEQ ID NO: 48529 - protein, 8 aa, Borrelia garinii PBi
EDIVQISE

SEQ ID NO: 48530 - protein, 8 aa, Borrelia garinii PBi
DIVQISEI

SEQ ID NO: 48531 - protein, 8 aa, Borrelia garinii PBi
IVQISEID

SEQ ID NO: 48532 - protein, 8 aa, Borrelia garinii PBi
VQISEIDA

SEQ ID NO: 48533 - protein, 8 aa, Borrelia garinii PBi
QISEIDAN

SEQ ID NO: 48534 - protein, 8 aa, Borrelia garinii PBi
ISEIDANK

SEQ ID NO: 48535 - protein, 8 aa, Borrelia garinii PBi
SEIDANKG

SEQ ID NO: 48536 - protein, 8 aa, Borrelia garinii PBi
EIDANKGE

SEQ ID NO: 48537 - protein, 8 aa, Borrelia garinii PBi
IDANKGEP

SEQ ID NO: 48538 - protein, 8 aa, Borrelia garinii PBi
DANKGEPD

SEQ ID NO: 48539 - protein, 8 aa, Borrelia garinii PBi
ANKGEPDD

SEQ ID NO: 48540 - protein, 8 aa, Borrelia garinii PBi
NKGEPDDQ

SEQ ID NO: 48541 - protein, 8 aa, Borrelia garinii PBi
KGEPDDQF

SEQ ID NO: 48542 - protein, 8 aa, Borrelia garinii PBi
GEPDDQFE

SEQ ID NO: 48543 - protein, 8 aa, Borrelia garinii PBi
EPDDQFEM

SEQ ID NO: 48544 - protein, 8 aa, Borrelia garinii PBi
PDDQFEMK

SEQ ID NO: 48545 - protein, 8 aa, Borrelia garinii PBi
DDQFEMKA

SEQ ID NO: 48546 - protein, 8 aa, Borrelia garinii PBi
DQFEMKAE

SEQ ID NO: 48547 - protein, 8 aa, Borrelia garinii PBi
QFEMKAEI

SEQ ID NO: 48548 - protein, 8 aa, Borrelia garinii PBi
FEMKAEIF

SEQ ID NO: 48549 - protein, 8 aa, Borrelia garinii PBi
EMKAEIFS

SEQ ID NO: 48550 - protein, 8 aa, Borrelia garinii PBi
MKAEIFSK

SEQ ID NO: 48551 - protein, 8 aa, Borrelia garinii PBi
KAEIFSKI

SEQ ID NO: 48552 - protein, 8 aa, Borrelia garinii PBi
AEIFSKIF

SEQ ID NO: 48553 - protein, 8 aa, Borrelia garinii PBi
EIFSKIFF

SEQ ID NO: 48554 - protein, 8 aa, Borrelia garinii PBi
IFSKIFFN

SEQ ID NO: 48555 - protein, 8 aa, Borrelia garinii PBi
FSKIFFNA

SEQ ID NO: 48556 - protein, 8 aa, Borrelia garinii PBi
SKIFFNAG

SEQ ID NO: 48557 - protein, 8 aa, Borrelia garinii PBi
KIFFNAGS

SEQ ID NO: 48558 - protein, 8 aa, Borrelia garinii PBi
IFFNAGST

SEQ ID NO: 48559 - protein, 8 aa, Borrelia garinii PBi
FFNAGSTV

SEQ ID NO: 48560 - protein, 8 aa, Borrelia garinii PBi
FNAGSTVT

SEQ ID NO: 48561 - protein, 8 aa, Borrelia garinii PBi
NAGSTVTF

SEQ ID NO: 48562 - protein, 8 aa, Borrelia garinii PBi
AGSTVTFD

SEQ ID NO: 48563 - protein, 8 aa, Borrelia garinii PBi
GSTVTFDD

SEQ ID NO: 48564 - protein, 8 aa, Borrelia garinii PBi
STVTFDDN

SEQ ID NO: 48565 - protein, 8 aa, Borrelia garinii PBi
TVTFDDNE

SEQ ID NO: 48566 - protein, 8 aa, Borrelia garinii PBi
VTFDDNEY

SEQ ID NO: 48567 - protein, 8 aa, Borrelia garinii PBi
TFDDNEYV

SEQ ID NO: 48568 - protein, 8 aa, Borrelia garinii PBi
FDDNEYVN

SEQ ID NO: 48569 - protein, 8 aa, Borrelia garinii PBi
DDNEYVNE

SEQ ID NO: 48570 - protein, 8 aa, Borrelia garinii PBi
DNEYVNER

SEQ ID NO: 48571 - protein, 8 aa, Borrelia garinii PBi
NEYVNERR

SEQ ID NO: 48572 - protein, 8 aa, Borrelia garinii PBi
EYVNERRI

SEQ ID NO: 48573 - protein, 8 aa, Borrelia garinii PBi
YVNERRIL

SEQ ID NO: 48574 - protein, 8 aa, Borrelia garinii PBi
VNERRILY

SEQ ID NO: 48575 - protein, 8 aa, Borrelia garinii PBi
NERRILYT

SEQ ID NO: 48576 - protein, 8 aa, Borrelia garinii PBi
ERRILYTS

SEQ ID NO: 48577 - protein, 8 aa, Borrelia garinii PBi
RRILYTSL

SEQ ID NO: 48578 - protein, 8 aa, Borrelia garinii PBi
RILYTSLN

SEQ ID NO: 48579 - protein, 8 aa, Borrelia garinii PBi
ILYTSLNF

SEQ ID NO: 48580 - protein, 8 aa, Borrelia garinii PBi
LYTSLNFN

SEQ ID NO: 48581 - protein, 8 aa, Borrelia garinii PBi
YTSLNFNE

SEQ ID NO: 48582 - protein, 8 aa, Borrelia garinii PBi
TSLNFNEN

SEQ ID NO: 48583 - protein, 8 aa, Borrelia garinii PBi
SLNFNENK

SEQ ID NO: 48584 - protein, 8 aa, Borrelia garinii PBi
LNFNENKI

SEQ ID NO: 48585 - protein, 8 aa, Borrelia garinii PBi
NFNENKIL

SEQ ID NO: 48586 - protein, 8 aa, Borrelia garinii PBi
FNENKILN

SEQ ID NO: 48587 - protein, 8 aa, Borrelia garinii PBi
NENKILNL

SEQ ID NO: 48588 - protein, 8 aa, Borrelia garinii PBi
ENKILNLG

SEQ ID NO: 48589 - protein, 8 aa, Borrelia garinii PBi
NKILNLGK

SEQ ID NO: 48590 - protein, 8 aa, Borrelia garinii PBi
KILNLGKI

SEQ ID NO: 48591 - protein, 8 aa, Borrelia garinii PBi
ILNLGKIL

SEQ ID NO: 48592 - protein, 8 aa, Borrelia garinii PBi
LNLGKILS

SEQ ID NO: 48593 - protein, 8 aa, Borrelia garinii PBi
NLGKILSK

SEQ ID NO: 48594 - protein, 8 aa, Borrelia garinii PBi
LGKILSKL

SEQ ID NO: 48595 - protein, 8 aa, Borrelia garinii PBi
GKILSKLS

SEQ ID NO: 48596 - protein, 8 aa, Borrelia garinii PBi
KILSKLSQ

SEQ ID NO: 48597 - protein, 8 aa, Borrelia garinii PBi
ILSKLSQD

SEQ ID NO: 48598 - protein, 8 aa, Borrelia garinii PBi
LSKLSQDS

SEQ ID NO: 48599 - protein, 8 aa, Borrelia garinii PBi
SKLSQDSN

SEQ ID NO: 48600 - protein, 8 aa, Borrelia garinii PBi
KLSQDSNY

SEQ ID NO: 48601 - protein, 8 aa, Borrelia garinii PBi
LSQDSNYR

SEQ ID NO: 48602 - protein, 8 aa, Borrelia garinii PBi
SQDSNYRS

SEQ ID NO: 48603 - protein, 8 aa, Borrelia garinii PBi
QDSNYRSL

SEQ ID NO: 48604 - protein, 8 aa, Borrelia garinii PBi
DSNYRSLV

SEQ ID NO: 48605 - protein, 8 aa, Borrelia garinii PBi
SNYRSLVK

SEQ ID NO: 48606 - protein, 8 aa, Borrelia garinii PBi
NYRSLVKE

SEQ ID NO: 48607 - protein, 8 aa, Borrelia garinii PBi
YRSLVKEI

SEQ ID NO: 48608 - protein, 8 aa, Borrelia garinii PBi
RSLVKEIL

SEQ ID NO: 48609 - protein, 8 aa, Borrelia garinii PBi
SLVKEILI

SEQ ID NO: 48610 - protein, 8 aa, Borrelia garinii PBi
LVKEILIN

SEQ ID NO: 48611 - protein, 8 aa, Borrelia garinii PBi
VKEILINR

SEQ ID NO: 48612 - protein, 8 aa, Borrelia garinii PBi
KEILINRG

SEQ ID NO: 48613 - protein, 8 aa, Borrelia garinii PBi
EILINRGF

SEQ ID NO: 48614 - protein, 8 aa, Borrelia garinii PBi
ILINRGFS

SEQ ID NO: 48615 - protein, 8 aa, Borrelia garinii PBi
LINRGFSI

SEQ ID NO: 48616 - protein, 8 aa, Borrelia garinii PBi
INRGFSIQ

SEQ ID NO: 48617 - protein, 8 aa, Borrelia garinii PBi
NRGFSIQL

SEQ ID NO: 48618 - protein, 8 aa, Borrelia garinii PBi
RGFSIQLA

SEQ ID NO: 48619 - protein, 8 aa, Borrelia garinii PBi
GFSIQLAI

SEQ ID NO: 48620 - protein, 8 aa, Borrelia garinii PBi
FSIQLAIE

SEQ ID NO: 48621 - protein, 8 aa, Borrelia garinii PBi
SIQLAIEE

SEQ ID NO: 48622 - protein, 8 aa, Borrelia garinii PBi
IQLAIEEI

SEQ ID NO: 48623 - protein, 8 aa, Borrelia garinii PBi
QLAIEEIS

SEQ ID NO: 48624 - protein, 8 aa, Borrelia garinii PBi
LAIEEISL

SEQ ID NO: 48625 - protein, 8 aa, Borrelia garinii PBi
AIEEISLR

SEQ ID NO: 48626 - protein, 8 aa, Borrelia garinii PBi
IEEISLRT

SEQ ID NO: 48627 - protein, 8 aa, Borrelia garinii PBi
EEISLRTL

SEQ ID NO: 48628 - protein, 8 aa, Borrelia garinii PBi
EISLRTLN

SEQ ID NO: 48629 - protein, 8 aa, Borrelia garinii PBi
ISLRTLNV

SEQ ID NO: 48630 - protein, 8 aa, Borrelia garinii PBi
SLRTLNVK

SEQ ID NO: 48631 - protein, 8 aa, Borrelia garinii PBi
LRTLNVKD

SEQ ID NO: 48632 - protein, 8 aa, Borrelia garinii PBi
RTLNVKDK

SEQ ID NO: 48633 - protein, 8 aa, Borrelia garinii PBi
TLNVKDKI

SEQ ID NO: 48634 - protein, 8 aa, Borrelia garinii PBi
LNVKDKIQ

SEQ ID NO: 48635 - protein, 8 aa, Borrelia garinii PBi
NVKDKIQH

SEQ ID NO: 48636 - protein, 8 aa, Borrelia garinii PBi
VKDKIQHL

SEQ ID NO: 48637 - protein, 8 aa, Borrelia garinii PBi
KDKIQHLN

SEQ ID NO: 48638 - protein, 8 aa, Borrelia garinii PBi
DKIQHLNK

SEQ ID NO: 48639 - protein, 8 aa, Borrelia garinii PBi
KIQHLNKP

SEQ ID NO: 48640 - protein, 8 aa, Borrelia garinii PBi
IQHLNKPN

SEQ ID NO: 48641 - protein, 8 aa, Borrelia garinii PBi
QHLNKPNL

SEQ ID NO: 48642 - protein, 8 aa, Borrelia garinii PBi
HLNKPNLK

SEQ ID NO: 48643 - protein, 8 aa, Borrelia garinii PBi
LNKPNLKT

SEQ ID NO: 48644 - protein, 8 aa, Borrelia garinii PBi
NKPNLKTL

SEQ ID NO: 48645 - protein, 8 aa, Borrelia garinii PBi
KPNLKTLY

SEQ ID NO: 48646 - protein, 8 aa, Borrelia garinii PBi
PNLKTLYH

SEQ ID NO: 48647 - protein, 8 aa, Borrelia garinii PBi
NLKTLYHD

SEQ ID NO: 48648 - protein, 8 aa, Borrelia garinii PBi
LKTLYHDF

SEQ ID NO: 48649 - protein, 8 aa, Borrelia garinii PBi
KTLYHDFN

SEQ ID NO: 48650 - protein, 8 aa, Borrelia garinii PBi
TLYHDFNK

SEQ ID NO: 48651 - protein, 8 aa, Borrelia garinii PBi
LYHDFNKL

SEQ ID NO: 48652 - protein, 8 aa, Borrelia garinii PBi
YHDFNKLI

SEQ ID NO: 48653 - protein, 8 aa, Borrelia garinii PBi
HDFNKLIP

SEQ ID NO: 48654 - protein, 8 aa, Borrelia garinii PBi
DFNKLIPL

SEQ ID NO: 48655 - protein, 8 aa, Borrelia garinii PBi
FNKLIPLK

SEQ ID NO: 48656 - protein, 8 aa, Borrelia garinii PBi
NKLIPLKE

SEQ ID NO: 48657 - protein, 8 aa, Borrelia garinii PBi
KLIPLKEK

SEQ ID NO: 48658 - protein, 8 aa, Borrelia garinii PBi
LIPLKEKW

SEQ ID NO: 48659 - protein, 8 aa, Borrelia garinii PBi
IPLKEKWL

SEQ ID NO: 48660 - protein, 8 aa, Borrelia garinii PBi
PLKEKWLK

SEQ ID NO: 48661 - protein, 8 aa, Borrelia garinii PBi
LKEKWLKD

SEQ ID NO: 48662 - protein, 8 aa, Borrelia garinii PBi
KEKWLKDV

SEQ ID NO: 48663 - protein, 8 aa, Borrelia garinii PBi
EKWLKDVD

SEQ ID NO: 48664 - protein, 8 aa, Borrelia garinii PBi
KWLKDVDD

SEQ ID NO: 48665 - protein, 8 aa, Borrelia garinii PBi
WLKDVDDI

SEQ ID NO: 48666 - protein, 8 aa, Borrelia garinii PBi
LKDVDDII

SEQ ID NO: 48667 - protein, 8 aa, Borrelia garinii PBi
KDVDDIIK

SEQ ID NO: 48668 - protein, 8 aa, Borrelia garinii PBi
DVDDIIKD

SEQ ID NO: 48669 - protein, 8 aa, Borrelia garinii PBi
VDDIIKDY

SEQ ID NO: 48670 - protein, 8 aa, Borrelia garinii PBi
DDIIKDYN

SEQ ID NO: 48671 - protein, 8 aa, Borrelia garinii PBi
DIIKDYNA

SEQ ID NO: 48672 - protein, 8 aa, Borrelia garinii PBi
IIKDYNAN

SEQ ID NO: 48673 - protein, 8 aa, Borrelia garinii PBi
IKDYNANP

SEQ ID NO: 48674 - protein, 8 aa, Borrelia garinii PBi
KDYNANPE

SEQ ID NO: 48675 - protein, 8 aa, Borrelia garinii PBi
DYNANPEL

SEQ ID NO: 48676 - protein, 8 aa, Borrelia garinii PBi
YNANPELR

SEQ ID NO: 48677 - protein, 8 aa, Borrelia garinii PBi
NANPELRT

SEQ ID NO: 48678 - protein, 8 aa, Borrelia garinii PBi
ANPELRTD

SEQ ID NO: 48679 - protein, 8 aa, Borrelia garinii PBi
NPELRTDI

SEQ ID NO: 48680 - protein, 8 aa, Borrelia garinii PBi
PELRTDIS

SEQ ID NO: 48681 - protein, 8 aa, Borrelia garinii PBi
ELRTDISK

SEQ ID NO: 48682 - protein, 8 aa, Borrelia garinii PBi
LRTDISKL

SEQ ID NO: 48683 - protein, 8 aa, Borrelia garinii PBi
RTDISKLN

SEQ ID NO: 48684 - protein, 8 aa, Borrelia garinii PBi
TDISKLND

SEQ ID NO: 48685 - protein, 8 aa, Borrelia garinii PBi
DISKLNDY

SEQ ID NO: 48686 - protein, 8 aa, Borrelia garinii PBi
ISKLNDYI

SEQ ID NO: 48687 - protein, 8 aa, Borrelia garinii PBi
SKLNDYII

SEQ ID NO: 48688 - protein, 8 aa, Borrelia garinii PBi
KLNDYIIS

SEQ ID NO: 48689 - protein, 8 aa, Borrelia garinii PBi
LNDYIISK

SEQ ID NO: 48690 - protein, 8 aa, Borrelia garinii PBi
NDYIISKN

SEQ ID NO: 48691 - protein, 8 aa, Borrelia garinii PBi
DYIISKNS

SEQ ID NO: 48692 - protein, 8 aa, Borrelia garinii PBi
YIISKNSK

SEQ ID NO: 48693 - protein, 8 aa, Borrelia garinii PBi
IISKNSKA

SEQ ID NO: 48694 - protein, 8 aa, Borrelia garinii PBi
ISKNSKAQ

SEQ ID NO: 48695 - protein, 8 aa, Borrelia garinii PBi
SKNSKAQF

SEQ ID NO: 48696 - protein, 8 aa, Borrelia garinii PBi
KNSKAQFT

SEQ ID NO: 48697 - protein, 8 aa, Borrelia garinii PBi
NSKAQFTD

SEQ ID NO: 48698 - protein, 8 aa, Borrelia garinii PBi
SKAQFTDI

SEQ ID NO: 48699 - protein, 8 aa, Borrelia garinii PBi
KAQFTDIH

SEQ ID NO: 48700 - protein, 8 aa, Borrelia garinii PBi
AQFTDIHN

SEQ ID NO: 48701 - protein, 8 aa, Borrelia garinii PBi
QFTDIHNI

SEQ ID NO: 48702 - protein, 8 aa, Borrelia garinii PBi
FTDIHNII

SEQ ID NO: 48703 - protein, 8 aa, Borrelia garinii PBi
TDIHNIIL

SEQ ID NO: 48704 - protein, 8 aa, Borrelia garinii PBi
DIHNIILN

SEQ ID NO: 48705 - protein, 8 aa, Borrelia garinii PBi
IHNIILNL

SEQ ID NO: 48706 - protein, 8 aa, Borrelia garinii PBi
HNIILNLI

SEQ ID NO: 48707 - protein, 8 aa, Borrelia garinii PBi
NIILNLIN

SEQ ID NO: 48708 - protein, 8 aa, Borrelia garinii PBi
IILNLINT

SEQ ID NO: 48709 - protein, 8 aa, Borrelia garinii PBi
ILNLINTT

SEQ ID NO: 48710 - protein, 8 aa, Borrelia garinii PBi
LNLINTTT

SEQ ID NO: 48711 - protein, 8 aa, Borrelia garinii PBi
NLINTTTN

SEQ ID NO: 48712 - protein, 8 aa, Borrelia garinii PBi
LINTTTNI

SEQ ID NO: 48713 - protein, 8 aa, Borrelia garinii PBi
INTTTNIL

SEQ ID NO: 48714 - protein, 8 aa, Borrelia garinii PBi
NTTTNILA

SEQ ID NO: 48715 - protein, 8 aa, Borrelia garinii PBi
TTTNILAP

SEQ ID NO: 48716 - protein, 8 aa, Borrelia garinii PBi
TTNILAPI

SEQ ID NO: 48717 - protein, 8 aa, Borrelia garinii PBi
TNILAPIQ

SEQ ID NO: 48718 - protein, 9 aa, Borrelia garinii PBi
MKNNKLIAI

SEQ ID NO: 48719 - protein, 9 aa, Borrelia garinii PBi
KNNKLIAIF

SEQ ID NO: 48720 - protein, 9 aa, Borrelia garinii PBi
NNKLIAIFL

SEQ ID NO: 48721 - protein, 9 aa, Borrelia garinii PBi
NKLIAIFLL

SEQ ID NO: 48722 - protein, 9 aa, Borrelia garinii PBi
KLIAIFLLH

SEQ ID NO: 48723 - protein, 9 aa, Borrelia garinii PBi
LIAIFLLHI

SEQ ID NO: 48724 - protein, 9 aa, Borrelia garinii PBi
IAIFLLHIL

SEQ ID NO: 48725 - protein, 9 aa, Borrelia garinii PBi
AIFLLHILT

SEQ ID NO: 48726 - protein, 9 aa, Borrelia garinii PBi
IFLLHILTG

SEQ ID NO: 48727 - protein, 9 aa, Borrelia garinii PBi
FLLHILTGL

SEQ ID NO: 48728 - protein, 9 aa, Borrelia garinii PBi
LLHILTGLI

SEQ ID NO: 48729 - protein, 9 aa, Borrelia garinii PBi
LHILTGLIL

SEQ ID NO: 48730 - protein, 9 aa, Borrelia garinii PBi
HILTGLILL

SEQ ID NO: 48731 - protein, 9 aa, Borrelia garinii PBi
ILTGLILLS

SEQ ID NO: 48732 - protein, 9 aa, Borrelia garinii PBi
LTGLILLSC

SEQ ID NO: 48733 - protein, 9 aa, Borrelia garinii PBi
TGLILLSCS

SEQ ID NO: 48734 - protein, 9 aa, Borrelia garinii PBi
GLILLSCSL

SEQ ID NO: 48735 - protein, 9 aa, Borrelia garinii PBi
LILLSCSLE

SEQ ID NO: 48736 - protein, 9 aa, Borrelia garinii PBi
ILLSCSLEV

SEQ ID NO: 48737 - protein, 9 aa, Borrelia garinii PBi
LLSCSLEVN

SEQ ID NO: 48738 - protein, 9 aa, Borrelia garinii PBi
LSCSLEVNQ

SEQ ID NO: 48739 - protein, 9 aa, Borrelia garinii PBi
SCSLEVNQD

SEQ ID NO: 48740 - protein, 9 aa, Borrelia garinii PBi
CSLEVNQDD

SEQ ID NO: 48741 - protein, 9 aa, Borrelia garinii PBi
SLEVNQDDN

SEQ ID NO: 48742 - protein, 9 aa, Borrelia garinii PBi
LEVNQDDNQ

SEQ ID NO: 48743 - protein, 9 aa, Borrelia garinii PBi
EVNQDDNQE

SEQ ID NO: 48744 - protein, 9 aa, Borrelia garinii PBi
VNQDDNQEK

SEQ ID NO: 48745 - protein, 9 aa, Borrelia garinii PBi
NQDDNQEKQ

SEQ ID NO: 48746 - protein, 9 aa, Borrelia garinii PBi
QDDNQEKQK

SEQ ID NO: 48747 - protein, 9 aa, Borrelia garinii PBi
DDNQEKQKK

SEQ ID NO: 48748 - protein, 9 aa, Borrelia garinii PBi
DNQEKQKKA

SEQ ID NO: 48749 - protein, 9 aa, Borrelia garinii PBi
NQEKQKKAK

SEQ ID NO: 48750 - protein, 9 aa, Borrelia garinii PBi
QEKQKKAKT

SEQ ID NO: 48751 - protein, 9 aa, Borrelia garinii PBi
EKQKKAKTK

SEQ ID NO: 48752 - protein, 9 aa, Borrelia garinii PBi
KQKKAKTKT

SEQ ID NO: 48753 - protein, 9 aa, Borrelia garinii PBi
QKKAKTKTS

SEQ ID NO: 48754 - protein, 9 aa, Borrelia garinii PBi
KKAKTKTSK

SEQ ID NO: 48755 - protein, 9 aa, Borrelia garinii PBi
KAKTKTSKS

SEQ ID NO: 48756 - protein, 9 aa, Borrelia garinii PBi
AKTKTSKSE

SEQ ID NO: 48757 - protein, 9 aa, Borrelia garinii PBi
KTKTSKSEN

SEQ ID NO: 48758 - protein, 9 aa, Borrelia garinii PBi
TKTSKSENN

SEQ ID NO: 48759 - protein, 9 aa, Borrelia garinii PBi
KTSKSENNS

SEQ ID NO: 48760 - protein, 9 aa, Borrelia garinii PBi
TSKSENNSS

SEQ ID NO: 48761 - protein, 9 aa, Borrelia garinii PBi
SKSENNSSK

SEQ ID NO: 48762 - protein, 9 aa, Borrelia garinii PBi
KSENNSSKM

SEQ ID NO: 48763 - protein, 9 aa, Borrelia garinii PBi
SENNSSKMK

SEQ ID NO: 48764 - protein, 9 aa, Borrelia garinii PBi
ENNSSKMKK

SEQ ID NO: 48765 - protein, 9 aa, Borrelia garinii PBi
NNSSKMKKL

SEQ ID NO: 48766 - protein, 9 aa, Borrelia garinii PBi
NSSKMKKLS

SEQ ID NO: 48767 - protein, 9 aa, Borrelia garinii PBi
SSKMKKLSK

SEQ ID NO: 48768 - protein, 9 aa, Borrelia garinii PBi
SKMKKLSKN

SEQ ID NO: 48769 - protein, 9 aa, Borrelia garinii PBi
KMKKLSKNA

SEQ ID NO: 48770 - protein, 9 aa, Borrelia garinii PBi
MKKLSKNAK

SEQ ID NO: 48771 - protein, 9 aa, Borrelia garinii PBi
KKLSKNAKN

SEQ ID NO: 48772 - protein, 9 aa, Borrelia garinii PBi
KLSKNAKNK

SEQ ID NO: 48773 - protein, 9 aa, Borrelia garinii PBi
LSKNAKNKK

SEQ ID NO: 48774 - protein, 9 aa, Borrelia garinii PBi
SKNAKNKKP

SEQ ID NO: 48775 - protein, 9 aa, Borrelia garinii PBi
KNAKNKKPT

SEQ ID NO: 48776 - protein, 9 aa, Borrelia garinii PBi
NAKNKKPTV

SEQ ID NO: 48777 - protein, 9 aa, Borrelia garinii PBi
AKNKKPTVD

SEQ ID NO: 48778 - protein, 9 aa, Borrelia garinii PBi
KNKKPTVDN

SEQ ID NO: 48779 - protein, 9 aa, Borrelia garinii PBi
NKKPTVDNL

SEQ ID NO: 48780 - protein, 9 aa, Borrelia garinii PBi
KKPTVDNLL

SEQ ID NO: 48781 - protein, 9 aa, Borrelia garinii PBi
KPTVDNLLV

SEQ ID NO: 48782 - protein, 9 aa, Borrelia garinii PBi
PTVDNLLVA

SEQ ID NO: 48783 - protein, 9 aa, Borrelia garinii PBi
TVDNLLVAI

SEQ ID NO: 48784 - protein, 9 aa, Borrelia garinii PBi
VDNLLVAIN

SEQ ID NO: 48785 - protein, 9 aa, Borrelia garinii PBi
DNLLVAINT

SEQ ID NO: 48786 - protein, 9 aa, Borrelia garinii PBi
NLLVAINTL

SEQ ID NO: 48787 - protein, 9 aa, Borrelia garinii PBi
LLVAINTLK

SEQ ID NO: 48788 - protein, 9 aa, Borrelia garinii PBi
LVAINTLKN

SEQ ID NO: 48789 - protein, 9 aa, Borrelia garinii PBi
VAINTLKNP

SEQ ID NO: 48790 - protein, 9 aa, Borrelia garinii PBi
AINTLKNPP

SEQ ID NO: 48791 - protein, 9 aa, Borrelia garinii PBi
INTLKNPPK

SEQ ID NO: 48792 - protein, 9 aa, Borrelia garinii PBi
NTLKNPPKT

SEQ ID NO: 48793 - protein, 9 aa, Borrelia garinii PBi
TLKNPPKTA

SEQ ID NO: 48794 - protein, 9 aa, Borrelia garinii PBi
LKNPPKTAG

SEQ ID NO: 48795 - protein, 9 aa, Borrelia garinii PBi
KNPPKTAGK

SEQ ID NO: 48796 - protein, 9 aa, Borrelia garinii PBi
NPPKTAGKN

SEQ ID NO: 48797 - protein, 9 aa, Borrelia garinii PBi
PPKTAGKNK

SEQ ID NO: 48798 - protein, 9 aa, Borrelia garinii PBi
PKTAGKNKS

SEQ ID NO: 48799 - protein, 9 aa, Borrelia garinii PBi
KTAGKNKSN

SEQ ID NO: 48800 - protein, 9 aa, Borrelia garinii PBi
TAGKNKSNS

SEQ ID NO: 48801 - protein, 9 aa, Borrelia garinii PBi
AGKNKSNSA

SEQ ID NO: 48802 - protein, 9 aa, Borrelia garinii PBi
GKNKSNSAA

SEQ ID NO: 48803 - protein, 9 aa, Borrelia garinii PBi
KNKSNSAAA

SEQ ID NO: 48804 - protein, 9 aa, Borrelia garinii PBi
NKSNSAAAL

SEQ ID NO: 48805 - protein, 9 aa, Borrelia garinii PBi
KSNSAAALK

SEQ ID NO: 48806 - protein, 9 aa, Borrelia garinii PBi
SNSAAALKQ

SEQ ID NO: 48807 - protein, 9 aa, Borrelia garinii PBi
NSAAALKQP

SEQ ID NO: 48808 - protein, 9 aa, Borrelia garinii PBi
SAAALKQPN

SEQ ID NO: 48809 - protein, 9 aa, Borrelia garinii PBi
AAALKQPNN

SEQ ID NO: 48810 - protein, 9 aa, Borrelia garinii PBi
AALKQPNNA

SEQ ID NO: 48811 - protein, 9 aa, Borrelia garinii PBi
ALKQPNNAN

SEQ ID NO: 48812 - protein, 9 aa, Borrelia garinii PBi
LKQPNNANA

SEQ ID NO: 48813 - protein, 9 aa, Borrelia garinii PBi
KQPNNANAL

SEQ ID NO: 48814 - protein, 9 aa, Borrelia garinii PBi
QPNNANALK

SEQ ID NO: 48815 - protein, 9 aa, Borrelia garinii PBi
PNNANALKQ

SEQ ID NO: 48816 - protein, 9 aa, Borrelia garinii PBi
NNANALKQI

SEQ ID NO: 48817 - protein, 9 aa, Borrelia garinii PBi
NANALKQID

SEQ ID NO: 48818 - protein, 9 aa, Borrelia garinii PBi
ANALKQIDP

SEQ ID NO: 48819 - protein, 9 aa, Borrelia garinii PBi
NALKQIDPE

SEQ ID NO: 48820 - protein, 9 aa, Borrelia garinii PBi
ALKQIDPEA

SEQ ID NO: 48821 - protein, 9 aa, Borrelia garinii PBi
LKQIDPEAK

SEQ ID NO: 48822 - protein, 9 aa, Borrelia garinii PBi
KQIDPEAKE

SEQ ID NO: 48823 - protein, 9 aa, Borrelia garinii PBi
QIDPEAKEL

SEQ ID NO: 48824 - protein, 9 aa, Borrelia garinii PBi
IDPEAKELI

SEQ ID NO: 48825 - protein, 9 aa, Borrelia garinii PBi
DPEAKELIQ

SEQ ID NO: 48826 - protein, 9 aa, Borrelia garinii PBi
PEAKELIQK

SEQ ID NO: 48827 - protein, 9 aa, Borrelia garinii PBi
EAKELIQKI

SEQ ID NO: 48828 - protein, 9 aa, Borrelia garinii PBi
AKELIQKIL

SEQ ID NO: 48829 - protein, 9 aa, Borrelia garinii PBi
KELIQKILE

SEQ ID NO: 48830 - protein, 9 aa, Borrelia garinii PBi
ELIQKILER

SEQ ID NO: 48831 - protein, 9 aa, Borrelia garinii PBi
LIQKILERS

SEQ ID NO: 48832 - protein, 9 aa, Borrelia garinii PBi
IQKILERSE

SEQ ID NO: 48833 - protein, 9 aa, Borrelia garinii PBi
QKILERSED

SEQ ID NO: 48834 - protein, 9 aa, Borrelia garinii PBi
KILERSEDI

SEQ ID NO: 48835 - protein, 9 aa, Borrelia garinii PBi
ILERSEDIV

SEQ ID NO: 48836 - protein, 9 aa, Borrelia garinii PBi
LERSEDIVQ

SEQ ID NO: 48837 - protein, 9 aa, Borrelia garinii PBi
ERSEDIVQI

SEQ ID NO: 48838 - protein, 9 aa, Borrelia garinii PBi
RSEDIVQIS

SEQ ID NO: 48839 - protein, 9 aa, Borrelia garinii PBi
SEDIVQISE

SEQ ID NO: 48840 - protein, 9 aa, Borrelia garinii PBi
EDIVQISEI

SEQ ID NO: 48841 - protein, 9 aa, Borrelia garinii PBi
DIVQISEID

SEQ ID NO: 48842 - protein, 9 aa, Borrelia garinii PBi
IVQISEIDA

SEQ ID NO: 48843 - protein, 9 aa, Borrelia garinii PBi
VQISEIDAN

SEQ ID NO: 48844 - protein, 9 aa, Borrelia garinii PBi
QISEIDANK

SEQ ID NO: 48845 - protein, 9 aa, Borrelia garinii PBi
ISEIDANKG

SEQ ID NO: 48846 - protein, 9 aa, Borrelia garinii PBi
SEIDANKGE

SEQ ID NO: 48847 - protein, 9 aa, Borrelia garinii PBi
EIDANKGEP

SEQ ID NO: 48848 - protein, 9 aa, Borrelia garinii PBi
IDANKGEPD

SEQ ID NO: 48849 - protein, 9 aa, Borrelia garinii PBi
DANKGEPDD

SEQ ID NO: 48850 - protein, 9 aa, Borrelia garinii PBi
ANKGEPDDQ

SEQ ID NO: 48851 - protein, 9 aa, Borrelia garinii PBi
NKGEPDDQF

SEQ ID NO: 48852 - protein, 9 aa, Borrelia garinii PBi
KGEPDDQFE

SEQ ID NO: 48853 - protein, 9 aa, Borrelia garinii PBi
GEPDDQFEM

SEQ ID NO: 48854 - protein, 9 aa, Borrelia garinii PBi
EPDDQFEMK

SEQ ID NO: 48855 - protein, 9 aa, Borrelia garinii PBi
PDDQFEMKA

SEQ ID NO: 48856 - protein, 9 aa, Borrelia garinii PBi
DDQFEMKAE

SEQ ID NO: 48857 - protein, 9 aa, Borrelia garinii PBi
DQFEMKAEI

SEQ ID NO: 48858 - protein, 9 aa, Borrelia garinii PBi
QFEMKAEIF

SEQ ID NO: 48859 - protein, 9 aa, Borrelia garinii PBi
FEMKAEIFS

SEQ ID NO: 48860 - protein, 9 aa, Borrelia garinii PBi
EMKAEIFSK

SEQ ID NO: 48861 - protein, 9 aa, Borrelia garinii PBi
MKAEIFSKI

SEQ ID NO: 48862 - protein, 9 aa, Borrelia garinii PBi
KAEIFSKIF

SEQ ID NO: 48863 - protein, 9 aa, Borrelia garinii PBi
AEIFSKIFF

SEQ ID NO: 48864 - protein, 9 aa, Borrelia garinii PBi
EIFSKIFFN

SEQ ID NO: 48865 - protein, 9 aa, Borrelia garinii PBi
IFSKIFFNA

SEQ ID NO: 48866 - protein, 9 aa, Borrelia garinii PBi
FSKIFFNAG

SEQ ID NO: 48867 - protein, 9 aa, Borrelia garinii PBi
SKIFFNAGS

SEQ ID NO: 48868 - protein, 9 aa, Borrelia garinii PBi
KIFFNAGST

SEQ ID NO: 48869 - protein, 9 aa, Borrelia garinii PBi
IFFNAGSTV

SEQ ID NO: 48870 - protein, 9 aa, Borrelia garinii PBi
FFNAGSTVT

SEQ ID NO: 48871 - protein, 9 aa, Borrelia garinii PBi
FNAGSTVTF

SEQ ID NO: 48872 - protein, 9 aa, Borrelia garinii PBi
NAGSTVTFD

SEQ ID NO: 48873 - protein, 9 aa, Borrelia garinii PBi
AGSTVTFDD

SEQ ID NO: 48874 - protein, 9 aa, Borrelia garinii PBi
GSTVTFDDN

SEQ ID NO: 48875 - protein, 9 aa, Borrelia garinii PBi
STVTFDDNE

SEQ ID NO: 48876 - protein, 9 aa, Borrelia garinii PBi
TVTFDDNEY

SEQ ID NO: 48877 - protein, 9 aa, Borrelia garinii PBi
VTFDDNEYV

SEQ ID NO: 48878 - protein, 9 aa, Borrelia garinii PBi
TFDDNEYVN

SEQ ID NO: 48879 - protein, 9 aa, Borrelia garinii PBi
FDDNEYVNE

SEQ ID NO: 48880 - protein, 9 aa, Borrelia garinii PBi
DDNEYVNER

SEQ ID NO: 48881 - protein, 9 aa, Borrelia garinii PBi
DNEYVNERR

SEQ ID NO: 48882 - protein, 9 aa, Borrelia garinii PBi
NEYVNERRI

SEQ ID NO: 48883 - protein, 9 aa, Borrelia garinii PBi
EYVNERRIL

SEQ ID NO: 48884 - protein, 9 aa, Borrelia garinii PBi
YVNERRILY

SEQ ID NO: 48885 - protein, 9 aa, Borrelia garinii PBi
VNERRILYT

SEQ ID NO: 48886 - protein, 9 aa, Borrelia garinii PBi
NERRILYTS

SEQ ID NO: 48887 - protein, 9 aa, Borrelia garinii PBi
ERRILYTSL

SEQ ID NO: 48888 - protein, 9 aa, Borrelia garinii PBi
RRILYTSLN

SEQ ID NO: 48889 - protein, 9 aa, Borrelia garinii PBi
RILYTSLNF

SEQ ID NO: 48890 - protein, 9 aa, Borrelia garinii PBi
ILYTSLNFN

SEQ ID NO: 48891 - protein, 9 aa, Borrelia garinii PBi
LYTSLNFNE

SEQ ID NO: 48892 - protein, 9 aa, Borrelia garinii PBi
YTSLNFNEN

SEQ ID NO: 48893 - protein, 9 aa, Borrelia garinii PBi
TSLNFNENK

SEQ ID NO: 48894 - protein, 9 aa, Borrelia garinii PBi
SLNFNENKI

SEQ ID NO: 48895 - protein, 9 aa, Borrelia garinii PBi
LNFNENKIL

SEQ ID NO: 48896 - protein, 9 aa, Borrelia garinii PBi
NFNENKILN

SEQ ID NO: 48897 - protein, 9 aa, Borrelia garinii PBi
FNENKILNL

SEQ ID NO: 48898 - protein, 9 aa, Borrelia garinii PBi
NENKILNLG

SEQ ID NO: 48899 - protein, 9 aa, Borrelia garinii PBi
ENKILNLGK

SEQ ID NO: 48900 - protein, 9 aa, Borrelia garinii PBi
NKILNLGKI

SEQ ID NO: 48901 - protein, 9 aa, Borrelia garinii PBi
KILNLGKIL

SEQ ID NO: 48902 - protein, 9 aa, Borrelia garinii PBi
ILNLGKILS

SEQ ID NO: 48903 - protein, 9 aa, Borrelia garinii PBi
LNLGKILSK

SEQ ID NO: 48904 - protein, 9 aa, Borrelia garinii PBi
NLGKILSKL

SEQ ID NO: 48905 - protein, 9 aa, Borrelia garinii PBi
LGKILSKLS

SEQ ID NO: 48906 - protein, 9 aa, Borrelia garinii PBi
GKILSKLSQ

SEQ ID NO: 48907 - protein, 9 aa, Borrelia garinii PBi
KILSKLSQD

SEQ ID NO: 48908 - protein, 9 aa, Borrelia garinii PBi
ILSKLSQDS

SEQ ID NO: 48909 - protein, 9 aa, Borrelia garinii PBi
LSKLSQDSN

SEQ ID NO: 48910 - protein, 9 aa, Borrelia garinii PBi
SKLSQDSNY

SEQ ID NO: 48911 - protein, 9 aa, Borrelia garinii PBi
KLSQDSNYR

SEQ ID NO: 48912 - protein, 9 aa, Borrelia garinii PBi
LSQDSNYRS

SEQ ID NO: 48913 - protein, 9 aa, Borrelia garinii PBi
SQDSNYRSL

SEQ ID NO: 48914 - protein, 9 aa, Borrelia garinii PBi
QDSNYRSLV

SEQ ID NO: 48915 - protein, 9 aa, Borrelia garinii PBi
DSNYRSLVK

SEQ ID NO: 48916 - protein, 9 aa, Borrelia garinii PBi
SNYRSLVKE

SEQ ID NO: 48917 - protein, 9 aa, Borrelia garinii PBi
NYRSLVKEI

SEQ ID NO: 48918 - protein, 9 aa, Borrelia garinii PBi
YRSLVKEIL

SEQ ID NO: 48919 - protein, 9 aa, Borrelia garinii PBi
RSLVKEILI

SEQ ID NO: 48920 - protein, 9 aa, Borrelia garinii PBi
SLVKEILIN

SEQ ID NO: 48921 - protein, 9 aa, Borrelia garinii PBi
LVKEILINR

SEQ ID NO: 48922 - protein, 9 aa, Borrelia garinii PBi
VKEILINRG

SEQ ID NO: 48923 - protein, 9 aa, Borrelia garinii PBi
KEILINRGF

SEQ ID NO: 48924 - protein, 9 aa, Borrelia garinii PBi
EILINRGFS

SEQ ID NO: 48925 - protein, 9 aa, Borrelia garinii PBi
ILINRGFSI

SEQ ID NO: 48926 - protein, 9 aa, Borrelia garinii PBi
LINRGFSIQ

SEQ ID NO: 48927 - protein, 9 aa, Borrelia garinii PBi
INRGFSIQL

SEQ ID NO: 48928 - protein, 9 aa, Borrelia garinii PBi
NRGFSIQLA

SEQ ID NO: 48929 - protein, 9 aa, Borrelia garinii PBi
RGFSIQLAI

SEQ ID NO: 48930 - protein, 9 aa, Borrelia garinii PBi
GFSIQLAIE

SEQ ID NO: 48931 - protein, 9 aa, Borrelia garinii PBi
FSIQLAIEE

SEQ ID NO: 48932 - protein, 9 aa, Borrelia garinii PBi
SIQLAIEEI

SEQ ID NO: 48933 - protein, 9 aa, Borrelia garinii PBi
IQLAIEEIS

SEQ ID NO: 48934 - protein, 9 aa, Borrelia garinii PBi
QLAIEEISL

SEQ ID NO: 48935 - protein, 9 aa, Borrelia garinii PBi
LAIEEISLR

SEQ ID NO: 48936 - protein, 9 aa, Borrelia garinii PBi
AIEEISLRT

SEQ ID NO: 48937 - protein, 9 aa, Borrelia garinii PBi
IEEISLRTL

SEQ ID NO: 48938 - protein, 9 aa, Borrelia garinii PBi
EEISLRTLN

SEQ ID NO: 48939 - protein, 9 aa, Borrelia garinii PBi
EISLRTLNV

SEQ ID NO: 48940 - protein, 9 aa, Borrelia garinii PBi
ISLRTLNVK

SEQ ID NO: 48941 - protein, 9 aa, Borrelia garinii PBi
SLRTLNVKD

SEQ ID NO: 48942 - protein, 9 aa, Borrelia garinii PBi
LRTLNVKDK

SEQ ID NO: 48943 - protein, 9 aa, Borrelia garinii PBi
RTLNVKDKI

SEQ ID NO: 48944 - protein, 9 aa, Borrelia garinii PBi
TLNVKDKIQ

SEQ ID NO: 48945 - protein, 9 aa, Borrelia garinii PBi
LNVKDKIQH

SEQ ID NO: 48946 - protein, 9 aa, Borrelia garinii PBi
NVKDKIQHL

SEQ ID NO: 48947 - protein, 9 aa, Borrelia garinii PBi
VKDKIQHLN

SEQ ID NO: 48948 - protein, 9 aa, Borrelia garinii PBi
KDKIQHLNK

SEQ ID NO: 48949 - protein, 9 aa, Borrelia garinii PBi
DKIQHLNKP

SEQ ID NO: 48950 - protein, 9 aa, Borrelia garinii PBi
KIQHLNKPN

SEQ ID NO: 48951 - protein, 9 aa, Borrelia garinii PBi
IQHLNKPNL

SEQ ID NO: 48952 - protein, 9 aa, Borrelia garinii PBi
QHLNKPNLK

SEQ ID NO: 48953 - protein, 9 aa, Borrelia garinii PBi
HLNKPNLKT

SEQ ID NO: 48954 - protein, 9 aa, Borrelia garinii PBi
LNKPNLKTL

SEQ ID NO: 48955 - protein, 9 aa, Borrelia garinii PBi
NKPNLKTLY

SEQ ID NO: 48956 - protein, 9 aa, Borrelia garinii PBi
KPNLKTLYH

SEQ ID NO: 48957 - protein, 9 aa, Borrelia garinii PBi
PNLKTLYHD

SEQ ID NO: 48958 - protein, 9 aa, Borrelia garinii PBi
NLKTLYHDF

SEQ ID NO: 48959 - protein, 9 aa, Borrelia garinii PBi
LKTLYHDFN

SEQ ID NO: 48960 - protein, 9 aa, Borrelia garinii PBi
KTLYHDFNK

SEQ ID NO: 48961 - protein, 9 aa, Borrelia garinii PBi
TLYHDFNKL

SEQ ID NO: 48962 - protein, 9 aa, Borrelia garinii PBi
LYHDFNKLI

SEQ ID NO: 48963 - protein, 9 aa, Borrelia garinii PBi
YHDFNKLIP

SEQ ID NO: 48964 - protein, 9 aa, Borrelia garinii PBi
HDFNKLIPL

SEQ ID NO: 48965 - protein, 9 aa, Borrelia garinii PBi
DFNKLIPLK

SEQ ID NO: 48966 - protein, 9 aa, Borrelia garinii PBi
FNKLIPLKE

SEQ ID NO: 48967 - protein, 9 aa, Borrelia garinii PBi
NKLIPLKEK

SEQ ID NO: 48968 - protein, 9 aa, Borrelia garinii PBi
KLIPLKEKW

SEQ ID NO: 48969 - protein, 9 aa, Borrelia garinii PBi
LIPLKEKWL

SEQ ID NO: 48970 - protein, 9 aa, Borrelia garinii PBi
IPLKEKWLK

SEQ ID NO: 48971 - protein, 9 aa, Borrelia garinii PBi
PLKEKWLKD

SEQ ID NO: 48972 - protein, 9 aa, Borrelia garinii PBi
LKEKWLKDV

SEQ ID NO: 48973 - protein, 9 aa, Borrelia garinii PBi
KEKWLKDVD

SEQ ID NO: 48974 - protein, 9 aa, Borrelia garinii PBi
EKWLKDVDD

SEQ ID NO: 48975 - protein, 9 aa, Borrelia garinii PBi
KWLKDVDDI

SEQ ID NO: 48976 - protein, 9 aa, Borrelia garinii PBi
WLKDVDDII

SEQ ID NO: 48977 - protein, 9 aa, Borrelia garinii PBi
LKDVDDIIK

SEQ ID NO: 48978 - protein, 9 aa, Borrelia garinii PBi
KDVDDIIKD

SEQ ID NO: 48979 - protein, 9 aa, Borrelia garinii PBi
DVDDIIKDY

SEQ ID NO: 48980 - protein, 9 aa, Borrelia garinii PBi
VDDIIKDYN

SEQ ID NO: 48981 - protein, 9 aa, Borrelia garinii PBi
DDIIKDYNA

SEQ ID NO: 48982 - protein, 9 aa, Borrelia garinii PBi
DIIKDYNAN

SEQ ID NO: 48983 - protein, 9 aa, Borrelia garinii PBi
IIKDYNANP

SEQ ID NO: 48984 - protein, 9 aa, Borrelia garinii PBi
IKDYNANPE

SEQ ID NO: 48985 - protein, 9 aa, Borrelia garinii PBi
KDYNANPEL

SEQ ID NO: 48986 - protein, 9 aa, Borrelia garinii PBi
DYNANPELR

SEQ ID NO: 48987 - protein, 9 aa, Borrelia garinii PBi
YNANPELRT

SEQ ID NO: 48988 - protein, 9 aa, Borrelia garinii PBi
NANPELRTD

SEQ ID NO: 48989 - protein, 9 aa, Borrelia garinii PBi
ANPELRTDI

SEQ ID NO: 48990 - protein, 9 aa, Borrelia garinii PBi
NPELRTDIS

SEQ ID NO: 48991 - protein, 9 aa, Borrelia garinii PBi
PELRTDISK

SEQ ID NO: 48992 - protein, 9 aa, Borrelia garinii PBi
ELRTDISKL

SEQ ID NO: 48993 - protein, 9 aa, Borrelia garinii PBi
LRTDISKLN

SEQ ID NO: 48994 - protein, 9 aa, Borrelia garinii PBi
RTDISKLND

SEQ ID NO: 48995 - protein, 9 aa, Borrelia garinii PBi
TDISKLNDY

SEQ ID NO: 48996 - protein, 9 aa, Borrelia garinii PBi
DISKLNDYI

SEQ ID NO: 48997 - protein, 9 aa, Borrelia garinii PBi
ISKLNDYII

SEQ ID NO: 48998 - protein, 9 aa, Borrelia garinii PBi
SKLNDYIIS

SEQ ID NO: 48999 - protein, 9 aa, Borrelia garinii PBi
KLNDYIISK

SEQ ID NO: 49000 - protein, 9 aa, Borrelia garinii PBi
LNDYIISKN

SEQ ID NO: 49001 - protein, 9 aa, Borrelia garinii PBi
NDYIISKNS

SEQ ID NO: 49002 - protein, 9 aa, Borrelia garinii PBi
DYIISKNSK

SEQ ID NO: 49003 - protein, 9 aa, Borrelia garinii PBi
YIISKNSKA

SEQ ID NO: 49004 - protein, 9 aa, Borrelia garinii PBi
IISKNSKAQ

SEQ ID NO: 49005 - protein, 9 aa, Borrelia garinii PBi
ISKNSKAQF

SEQ ID NO: 49006 - protein, 9 aa, Borrelia garinii PBi
SKNSKAQFT

SEQ ID NO: 49007 - protein, 9 aa, Borrelia garinii PBi
KNSKAQFTD

SEQ ID NO: 49008 - protein, 9 aa, Borrelia garinii PBi
NSKAQFTDI

SEQ ID NO: 49009 - protein, 9 aa, Borrelia garinii PBi
SKAQFTDIH

SEQ ID NO: 49010 - protein, 9 aa, Borrelia garinii PBi
KAQFTDIHN

SEQ ID NO: 49011 - protein, 9 aa, Borrelia garinii PBi
AQFTDIHNI

SEQ ID NO: 49012 - protein, 9 aa, Borrelia garinii PBi
QFTDIHNII

SEQ ID NO: 49013 - protein, 9 aa, Borrelia garinii PBi
FTDIHNIIL

SEQ ID NO: 49014 - protein, 9 aa, Borrelia garinii PBi
TDIHNIILN

SEQ ID NO: 49015 - protein, 9 aa, Borrelia garinii PBi
DIHNIILNL

SEQ ID NO: 49016 - protein, 9 aa, Borrelia garinii PBi
IHNIILNLI

SEQ ID NO: 49017 - protein, 9 aa, Borrelia garinii PBi
HNIILNLIN

SEQ ID NO: 49018 - protein, 9 aa, Borrelia garinii PBi
NIILNLINT

SEQ ID NO: 49019 - protein, 9 aa, Borrelia garinii PBi
IILNLINTT

SEQ ID NO: 49020 - protein, 9 aa, Borrelia garinii PBi
ILNLINTTT

SEQ ID NO: 49021 - protein, 9 aa, Borrelia garinii PBi
LNLINTTTN

SEQ ID NO: 49022 - protein, 9 aa, Borrelia garinii PBi
NLINTTTNI

SEQ ID NO: 49023 - protein, 9 aa, Borrelia garinii PBi
LINTTTNIL

SEQ ID NO: 49024 - protein, 9 aa, Borrelia garinii PBi
INTTTNILA

SEQ ID NO: 49025 - protein, 9 aa, Borrelia garinii PBi
NTTTNILAP

SEQ ID NO: 49026 - protein, 9 aa, Borrelia garinii PBi
TTTNILAPI

SEQ ID NO: 49027 - protein, 9 aa, Borrelia garinii PBi
TTNILAPIQ

SEQ ID NO: 49028 - protein, 10 aa, Borrelia garinii PBi
MKNNKLIAIF

SEQ ID NO: 49029 - protein, 10 aa, Borrelia garinii PBi
KNNKLIAIFL

SEQ ID NO: 49030 - protein, 10 aa, Borrelia garinii PBi
NNKLIAIFLL

SEQ ID NO: 49031 - protein, 10 aa, Borrelia garinii PBi
NKLIAIFLLH

SEQ ID NO: 49032 - protein, 10 aa, Borrelia garinii PBi
KLIAIFLLHI

SEQ ID NO: 49033 - protein, 10 aa, Borrelia garinii PBi
LIAIFLLHIL

SEQ ID NO: 49034 - protein, 10 aa, Borrelia garinii PBi
IAIFLLHILT

SEQ ID NO: 49035 - protein, 10 aa, Borrelia garinii PBi
AIFLLHILTG

SEQ ID NO: 49036 - protein, 10 aa, Borrelia garinii PBi
IFLLHILTGL

SEQ ID NO: 49037 - protein, 10 aa, Borrelia garinii PBi
FLLHILTGLI

SEQ ID NO: 49038 - protein, 10 aa, Borrelia garinii PBi
LLHILTGLIL

SEQ ID NO: 49039 - protein, 10 aa, Borrelia garinii PBi
LHILTGLILL

SEQ ID NO: 49040 - protein, 10 aa, Borrelia garinii PBi
HILTGLILLS

SEQ ID NO: 49041 - protein, 10 aa, Borrelia garinii PBi
ILTGLILLSC

SEQ ID NO: 49042 - protein, 10 aa, Borrelia garinii PBi
LTGLILLSCS

SEQ ID NO: 49043 - protein, 10 aa, Borrelia garinii PBi
TGLILLSCSL

SEQ ID NO: 49044 - protein, 10 aa, Borrelia garinii PBi
GLILLSCSLE

SEQ ID NO: 49045 - protein, 10 aa, Borrelia garinii PBi
LILLSCSLEV

SEQ ID NO: 49046 - protein, 10 aa, Borrelia garinii PBi
ILLSCSLEVN

SEQ ID NO: 49047 - protein, 10 aa, Borrelia garinii PBi
LLSCSLEVNQ

SEQ ID NO: 49048 - protein, 10 aa, Borrelia garinii PBi
LSCSLEVNQD

SEQ ID NO: 49049 - protein, 10 aa, Borrelia garinii PBi
SCSLEVNQDD

SEQ ID NO: 49050 - protein, 10 aa, Borrelia garinii PBi
CSLEVNQDDN

SEQ ID NO: 49051 - protein, 10 aa, Borrelia garinii PBi
SLEVNQDDNQ

SEQ ID NO: 49052 - protein, 10 aa, Borrelia garinii PBi
LEVNQDDNQE

SEQ ID NO: 49053 - protein, 10 aa, Borrelia garinii PBi
EVNQDDNQEK

SEQ ID NO: 49054 - protein, 10 aa, Borrelia garinii PBi
VNQDDNQEKQ

SEQ ID NO: 49055 - protein, 10 aa, Borrelia garinii PBi
NQDDNQEKQK

SEQ ID NO: 49056 - protein, 10 aa, Borrelia garinii PBi
QDDNQEKQKK

SEQ ID NO: 49057 - protein, 10 aa, Borrelia garinii PBi
DDNQEKQKKA

SEQ ID NO: 49058 - protein, 10 aa, Borrelia garinii PBi
DNQEKQKKAK

SEQ ID NO: 49059 - protein, 10 aa, Borrelia garinii PBi
NQEKQKKAKT

SEQ ID NO: 49060 - protein, 10 aa, Borrelia garinii PBi
QEKQKKAKTK

SEQ ID NO: 49061 - protein, 10 aa, Borrelia garinii PBi
EKQKKAKTKT

SEQ ID NO: 49062 - protein, 10 aa, Borrelia garinii PBi
KQKKAKTKTS

SEQ ID NO: 49063 - protein, 10 aa, Borrelia garinii PBi
QKKAKTKTSK

SEQ ID NO: 49064 - protein, 10 aa, Borrelia garinii PBi
KKAKTKTSKS

SEQ ID NO: 49065 - protein, 10 aa, Borrelia garinii PBi
KAKTKTSKSE

SEQ ID NO: 49066 - protein, 10 aa, Borrelia garinii PBi
AKTKTSKSEN

SEQ ID NO: 49067 - protein, 10 aa, Borrelia garinii PBi
KTKTSKSENN

SEQ ID NO: 49068 - protein, 10 aa, Borrelia garinii PBi
TKTSKSENNS

SEQ ID NO: 49069 - protein, 10 aa, Borrelia garinii PBi
KTSKSENNSS

SEQ ID NO: 49070 - protein, 10 aa, Borrelia garinii PBi
TSKSENNSSK

SEQ ID NO: 49071 - protein, 10 aa, Borrelia garinii PBi
SKSENNSSKM

SEQ ID NO: 49072 - protein, 10 aa, Borrelia garinii PBi
KSENNSSKMK

SEQ ID NO: 49073 - protein, 10 aa, Borrelia garinii PBi
SENNSSKMKK

SEQ ID NO: 49074 - protein, 10 aa, Borrelia garinii PBi
ENNSSKMKKL

SEQ ID NO: 49075 - protein, 10 aa, Borrelia garinii PBi
NNSSKMKKLS

SEQ ID NO: 49076 - protein, 10 aa, Borrelia garinii PBi
NSSKMKKLSK

SEQ ID NO: 49077 - protein, 10 aa, Borrelia garinii PBi
SSKMKKLSKN

SEQ ID NO: 49078 - protein, 10 aa, Borrelia garinii PBi
SKMKKLSKNA

SEQ ID NO: 49079 - protein, 10 aa, Borrelia garinii PBi
KMKKLSKNAK

SEQ ID NO: 49080 - protein, 10 aa, Borrelia garinii PBi
MKKLSKNAKN

SEQ ID NO: 49081 - protein, 10 aa, Borrelia garinii PBi
KKLSKNAKNK

SEQ ID NO: 49082 - protein, 10 aa, Borrelia garinii PBi
KLSKNAKNKK

SEQ ID NO: 49083 - protein, 10 aa, Borrelia garinii PBi
LSKNAKNKKP

SEQ ID NO: 49084 - protein, 10 aa, Borrelia garinii PBi
SKNAKNKKPT

SEQ ID NO: 49085 - protein, 10 aa, Borrelia garinii PBi
KNAKNKKPTV

SEQ ID NO: 49086 - protein, 10 aa, Borrelia garinii PBi
NAKNKKPTVD

SEQ ID NO: 49087 - protein, 10 aa, Borrelia garinii PBi
AKNKKPTVDN

SEQ ID NO: 49088 - protein, 10 aa, Borrelia garinii PBi
KNKKPTVDNL

SEQ ID NO: 49089 - protein, 10 aa, Borrelia garinii PBi
NKKPTVDNLL

SEQ ID NO: 49090 - protein, 10 aa, Borrelia garinii PBi
KKPTVDNLLV

SEQ ID NO: 49091 - protein, 10 aa, Borrelia garinii PBi
KPTVDNLLVA

SEQ ID NO: 49092 - protein, 10 aa, Borrelia garinii PBi
PTVDNLLVAI

SEQ ID NO: 49093 - protein, 10 aa, Borrelia garinii PBi
TVDNLLVAIN

SEQ ID NO: 49094 - protein, 10 aa, Borrelia garinii PBi
VDNLLVAINT

SEQ ID NO: 49095 - protein, 10 aa, Borrelia garinii PBi
DNLLVAINTL

SEQ ID NO: 49096 - protein, 10 aa, Borrelia garinii PBi
NLLVAINTLK

SEQ ID NO: 49097 - protein, 10 aa, Borrelia garinii PBi
LLVAINTLKN

SEQ ID NO: 49098 - protein, 10 aa, Borrelia garinii PBi
LVAINTLKNP

SEQ ID NO: 49099 - protein, 10 aa, Borrelia garinii PBi
VAINTLKNPP

SEQ ID NO: 49100 - protein, 10 aa, Borrelia garinii PBi
AINTLKNPPK

SEQ ID NO: 49101 - protein, 10 aa, Borrelia garinii PBi
INTLKNPPKT

SEQ ID NO: 49102 - protein, 10 aa, Borrelia garinii PBi
NTLKNPPKTA

SEQ ID NO: 49103 - protein, 10 aa, Borrelia garinii PBi
TLKNPPKTAG

SEQ ID NO: 49104 - protein, 10 aa, Borrelia garinii PBi
LKNPPKTAGK

SEQ ID NO: 49105 - protein, 10 aa, Borrelia garinii PBi
KNPPKTAGKN

SEQ ID NO: 49106 - protein, 10 aa, Borrelia garinii PBi
NPPKTAGKNK

SEQ ID NO: 49107 - protein, 10 aa, Borrelia garinii PBi
PPKTAGKNKS

SEQ ID NO: 49108 - protein, 10 aa, Borrelia garinii PBi
PKTAGKNKSN

SEQ ID NO: 49109 - protein, 10 aa, Borrelia garinii PBi
KTAGKNKSNS

SEQ ID NO: 49110 - protein, 10 aa, Borrelia garinii PBi
TAGKNKSNSA

SEQ ID NO: 49111 - protein, 10 aa, Borrelia garinii PBi
AGKNKSNSAA

SEQ ID NO: 49112 - protein, 10 aa, Borrelia garinii PBi
GKNKSNSAAA

SEQ ID NO: 49113 - protein, 10 aa, Borrelia garinii PBi
KNKSNSAAAL

SEQ ID NO: 49114 - protein, 10 aa, Borrelia garinii PBi
NKSNSAAALK

SEQ ID NO: 49115 - protein, 10 aa, Borrelia garinii PBi
KSNSAAALKQ

SEQ ID NO: 49116 - protein, 10 aa, Borrelia garinii PBi
SNSAAALKQP

SEQ ID NO: 49117 - protein, 10 aa, Borrelia garinii PBi
NSAAALKQPN

SEQ ID NO: 49118 - protein, 10 aa, Borrelia garinii PBi
SAAALKQPNN

SEQ ID NO: 49119 - protein, 10 aa, Borrelia garinii PBi
AAALKQPNNA

SEQ ID NO: 49120 - protein, 10 aa, Borrelia garinii PBi
AALKQPNNAN

SEQ ID NO: 49121 - protein, 10 aa, Borrelia garinii PBi
ALKQPNNANA

SEQ ID NO: 49122 - protein, 10 aa, Borrelia garinii PBi
LKQPNNANAL

SEQ ID NO: 49123 - protein, 10 aa, Borrelia garinii PBi
KQPNNANALK

SEQ ID NO: 49124 - protein, 10 aa, Borrelia garinii PBi
QPNNANALKQ

SEQ ID NO: 49125 - protein, 10 aa, Borrelia garinii PBi
PNNANALKQI

SEQ ID NO: 49126 - protein, 10 aa, Borrelia garinii PBi
NNANALKQID

SEQ ID NO: 49127 - protein, 10 aa, Borrelia garinii PBi
NANALKQIDP

SEQ ID NO: 49128 - protein, 10 aa, Borrelia garinii PBi
ANALKQIDPE

SEQ ID NO: 49129 - protein, 10 aa, Borrelia garinii PBi
NALKQIDPEA

SEQ ID NO: 49130 - protein, 10 aa, Borrelia garinii PBi
ALKQIDPEAK

SEQ ID NO: 49131 - protein, 10 aa, Borrelia garinii PBi
LKQIDPEAKE

SEQ ID NO: 49132 - protein, 10 aa, Borrelia garinii PBi
KQIDPEAKEL

SEQ ID NO: 49133 - protein, 10 aa, Borrelia garinii PBi
QIDPEAKELI

SEQ ID NO: 49134 - protein, 10 aa, Borrelia garinii PBi
IDPEAKELIQ

SEQ ID NO: 49135 - protein, 10 aa, Borrelia garinii PBi
DPEAKELIQK

SEQ ID NO: 49136 - protein, 10 aa, Borrelia garinii PBi
PEAKELIQKI

SEQ ID NO: 49137 - protein, 10 aa, Borrelia garinii PBi
EAKELIQKIL

SEQ ID NO: 49138 - protein, 10 aa, Borrelia garinii PBi
AKELIQKILE

SEQ ID NO: 49139 - protein, 10 aa, Borrelia garinii PBi
KELIQKILER

SEQ ID NO: 49140 - protein, 10 aa, Borrelia garinii PBi
ELIQKILERS

SEQ ID NO: 49141 - protein, 10 aa, Borrelia garinii PBi
LIQKILERSE

SEQ ID NO: 49142 - protein, 10 aa, Borrelia garinii PBi
IQKILERSED

SEQ ID NO: 49143 - protein, 10 aa, Borrelia garinii PBi
QKILERSEDI

SEQ ID NO: 49144 - protein, 10 aa, Borrelia garinii PBi
KILERSEDIV

SEQ ID NO: 49145 - protein, 10 aa, Borrelia garinii PBi
ILERSEDIVQ

SEQ ID NO: 49146 - protein, 10 aa, Borrelia garinii PBi
LERSEDIVQI

SEQ ID NO: 49147 - protein, 10 aa, Borrelia garinii PBi
ERSEDIVQIS

SEQ ID NO: 49148 - protein, 10 aa, Borrelia garinii PBi
RSEDIVQISE

SEQ ID NO: 49149 - protein, 10 aa, Borrelia garinii PBi
SEDIVQISEI

SEQ ID NO: 49150 - protein, 10 aa, Borrelia garinii PBi
EDIVQISEID

SEQ ID NO: 49151 - protein, 10 aa, Borrelia garinii PBi
DIVQISEIDA

SEQ ID NO: 49152 - protein, 10 aa, Borrelia garinii PBi
IVQISEIDAN

SEQ ID NO: 49153 - protein, 10 aa, Borrelia garinii PBi
VQISEIDANK

SEQ ID NO: 49154 - protein, 10 aa, Borrelia garinii PBi
QISEIDANKG

SEQ ID NO: 49155 - protein, 10 aa, Borrelia garinii PBi
ISEIDANKGE

SEQ ID NO: 49156 - protein, 10 aa, Borrelia garinii PBi
SEIDANKGEP

SEQ ID NO: 49157 - protein, 10 aa, Borrelia garinii PBi
EIDANKGEPD

SEQ ID NO: 49158 - protein, 10 aa, Borrelia garinii PBi
IDANKGEPDD

SEQ ID NO: 49159 - protein, 10 aa, Borrelia garinii PBi
DANKGEPDDQ

SEQ ID NO: 49160 - protein, 10 aa, Borrelia garinii PBi
ANKGEPDDQF

SEQ ID NO: 49161 - protein, 10 aa, Borrelia garinii PBi
NKGEPDDQFE

SEQ ID NO: 49162 - protein, 10 aa, Borrelia garinii PBi
KGEPDDQFEM

SEQ ID NO: 49163 - protein, 10 aa, Borrelia garinii PBi
GEPDDQFEMK

SEQ ID NO: 49164 - protein, 10 aa, Borrelia garinii PBi
EPDDQFEMKA

SEQ ID NO: 49165 - protein, 10 aa, Borrelia garinii PBi
PDDQFEMKAE

SEQ ID NO: 49166 - protein, 10 aa, Borrelia garinii PBi
DDQFEMKAEI

SEQ ID NO: 49167 - protein, 10 aa, Borrelia garinii PBi
DQFEMKAEIF

SEQ ID NO: 49168 - protein, 10 aa, Borrelia garinii PBi
QFEMKAEIFS

SEQ ID NO: 49169 - protein, 10 aa, Borrelia garinii PBi
FEMKAEIFSK

SEQ ID NO: 49170 - protein, 10 aa, Borrelia garinii PBi
EMKAEIFSKI

SEQ ID NO: 49171 - protein, 10 aa, Borrelia garinii PBi
MKAEIFSKIF

SEQ ID NO: 49172 - protein, 10 aa, Borrelia garinii PBi
KAEIFSKIFF

SEQ ID NO: 49173 - protein, 10 aa, Borrelia garinii PBi
AEIFSKIFFN

SEQ ID NO: 49174 - protein, 10 aa, Borrelia garinii PBi
EIFSKIFFNA

SEQ ID NO: 49175 - protein, 10 aa, Borrelia garinii PBi
IFSKIFFNAG

SEQ ID NO: 49176 - protein, 10 aa, Borrelia garinii PBi
FSKIFFNAGS

SEQ ID NO: 49177 - protein, 10 aa, Borrelia garinii PBi
SKIFFNAGST

SEQ ID NO: 49178 - protein, 10 aa, Borrelia garinii PBi
KIFFNAGSTV

SEQ ID NO: 49179 - protein, 10 aa, Borrelia garinii PBi
IFFNAGSTVT

SEQ ID NO: 49180 - protein, 10 aa, Borrelia garinii PBi
FFNAGSTVTF

SEQ ID NO: 49181 - protein, 10 aa, Borrelia garinii PBi
FNAGSTVTFD

SEQ ID NO: 49182 - protein, 10 aa, Borrelia garinii PBi
NAGSTVTFDD

SEQ ID NO: 49183 - protein, 10 aa, Borrelia garinii PBi
AGSTVTFDDN

SEQ ID NO: 49184 - protein, 10 aa, Borrelia garinii PBi
GSTVTFDDNE

SEQ ID NO: 49185 - protein, 10 aa, Borrelia garinii PBi
STVTFDDNEY

SEQ ID NO: 49186 - protein, 10 aa, Borrelia garinii PBi
TVTFDDNEYV

SEQ ID NO: 49187 - protein, 10 aa, Borrelia garinii PBi
VTFDDNEYVN

SEQ ID NO: 49188 - protein, 10 aa, Borrelia garinii PBi
TFDDNEYVNE

SEQ ID NO: 49189 - protein, 10 aa, Borrelia garinii PBi
FDDNEYVNER

SEQ ID NO: 49190 - protein, 10 aa, Borrelia garinii PBi
DDNEYVNERR

SEQ ID NO: 49191 - protein, 10 aa, Borrelia garinii PBi
DNEYVNERRI

SEQ ID NO: 49192 - protein, 10 aa, Borrelia garinii PBi
NEYVNERRIL

SEQ ID NO: 49193 - protein, 10 aa, Borrelia garinii PBi
EYVNERRILY

SEQ ID NO: 49194 - protein, 10 aa, Borrelia garinii PBi
YVNERRILYT

SEQ ID NO: 49195 - protein, 10 aa, Borrelia garinii PBi
VNERRILYTS

SEQ ID NO: 49196 - protein, 10 aa, Borrelia garinii PBi
NERRILYTSL

SEQ ID NO: 49197 - protein, 10 aa, Borrelia garinii PBi
ERRILYTSLN

SEQ ID NO: 49198 - protein, 10 aa, Borrelia garinii PBi
RRILYTSLNF

SEQ ID NO: 49199 - protein, 10 aa, Borrelia garinii PBi
RILYTSLNFN

SEQ ID NO: 49200 - protein, 10 aa, Borrelia garinii PBi
ILYTSLNFNE

SEQ ID NO: 49201 - protein, 10 aa, Borrelia garinii PBi
LYTSLNFNEN

SEQ ID NO: 49202 - protein, 10 aa, Borrelia garinii PBi
YTSLNFNENK

SEQ ID NO: 49203 - protein, 10 aa, Borrelia garinii PBi
TSLNFNENKI

SEQ ID NO: 49204 - protein, 10 aa, Borrelia garinii PBi
SLNFNENKIL

SEQ ID NO: 49205 - protein, 10 aa, Borrelia garinii PBi
LNFNENKILN

SEQ ID NO: 49206 - protein, 10 aa, Borrelia garinii PBi
NFNENKILNL

SEQ ID NO: 49207 - protein, 10 aa, Borrelia garinii PBi
FNENKILNLG

SEQ ID NO: 49208 - protein, 10 aa, Borrelia garinii PBi
NENKILNLGK

SEQ ID NO: 49209 - protein, 10 aa, Borrelia garinii PBi
ENKILNLGKI

SEQ ID NO: 49210 - protein, 10 aa, Borrelia garinii PBi
NKILNLGKIL

SEQ ID NO: 49211 - protein, 10 aa, Borrelia garinii PBi
KILNLGKILS

SEQ ID NO: 49212 - protein, 10 aa, Borrelia garinii PBi
ILNLGKILSK

SEQ ID NO: 49213 - protein, 10 aa, Borrelia garinii PBi
LNLGKILSKL

SEQ ID NO: 49214 - protein, 10 aa, Borrelia garinii PBi
NLGKILSKLS

SEQ ID NO: 49215 - protein, 10 aa, Borrelia garinii PBi
LGKILSKLSQ

SEQ ID NO: 49216 - protein, 10 aa, Borrelia garinii PBi
GKILSKLSQD

SEQ ID NO: 49217 - protein, 10 aa, Borrelia garinii PBi
KILSKLSQDS

SEQ ID NO: 49218 - protein, 10 aa, Borrelia garinii PBi
ILSKLSQDSN

SEQ ID NO: 49219 - protein, 10 aa, Borrelia garinii PBi
LSKLSQDSNY

SEQ ID NO: 49220 - protein, 10 aa, Borrelia garinii PBi
SKLSQDSNYR

SEQ ID NO: 49221 - protein, 10 aa, Borrelia garinii PBi
KLSQDSNYRS

SEQ ID NO: 49222 - protein, 10 aa, Borrelia garinii PBi
LSQDSNYRSL

SEQ ID NO: 49223 - protein, 10 aa, Borrelia garinii PBi
SQDSNYRSLV

SEQ ID NO: 49224 - protein, 10 aa, Borrelia garinii PBi
QDSNYRSLVK

SEQ ID NO: 49225 - protein, 10 aa, Borrelia garinii PBi
DSNYRSLVKE

SEQ ID NO: 49226 - protein, 10 aa, Borrelia garinii PBi
SNYRSLVKEI

SEQ ID NO: 49227 - protein, 10 aa, Borrelia garinii PBi
NYRSLVKEIL

SEQ ID NO: 49228 - protein, 10 aa, Borrelia garinii PBi
YRSLVKEILI

SEQ ID NO: 49229 - protein, 10 aa, Borrelia garinii PBi
RSLVKEILIN

SEQ ID NO: 49230 - protein, 10 aa, Borrelia garinii PBi
SLVKEILINR

SEQ ID NO: 49231 - protein, 10 aa, Borrelia garinii PBi
LVKEILINRG

SEQ ID NO: 49232 - protein, 10 aa, Borrelia garinii PBi
VKEILINRGF

SEQ ID NO: 49233 - protein, 10 aa, Borrelia garinii PBi
KEILINRGFS

SEQ ID NO: 49234 - protein, 10 aa, Borrelia garinii PBi
EILINRGFSI

SEQ ID NO: 49235 - protein, 10 aa, Borrelia garinii PBi
ILINRGFSIQ

SEQ ID NO: 49236 - protein, 10 aa, Borrelia garinii PBi
LINRGFSIQL

SEQ ID NO: 49237 - protein, 10 aa, Borrelia garinii PBi
INRGFSIQLA

SEQ ID NO: 49238 - protein, 10 aa, Borrelia garinii PBi
NRGFSIQLAI

SEQ ID NO: 49239 - protein, 10 aa, Borrelia garinii PBi
RGFSIQLAIE

SEQ ID NO: 49240 - protein, 10 aa, Borrelia garinii PBi
GFSIQLAIEE

SEQ ID NO: 49241 - protein, 10 aa, Borrelia garinii PBi
FSIQLAIEEI

SEQ ID NO: 49242 - protein, 10 aa, Borrelia garinii PBi
SIQLAIEEIS

SEQ ID NO: 49243 - protein, 10 aa, Borrelia garinii PBi
IQLAIEEISL

SEQ ID NO: 49244 - protein, 10 aa, Borrelia garinii PBi
QLAIEEISLR

SEQ ID NO: 49245 - protein, 10 aa, Borrelia garinii PBi
LAIEEISLRT

SEQ ID NO: 49246 - protein, 10 aa, Borrelia garinii PBi
AIEEISLRTL

SEQ ID NO: 49247 - protein, 10 aa, Borrelia garinii PBi
IEEISLRTLN

SEQ ID NO: 49248 - protein, 10 aa, Borrelia garinii PBi
EEISLRTLNV

SEQ ID NO: 49249 - protein, 10 aa, Borrelia garinii PBi
EISLRTLNVK

SEQ ID NO: 49250 - protein, 10 aa, Borrelia garinii PBi
ISLRTLNVKD

SEQ ID NO: 49251 - protein, 10 aa, Borrelia garinii PBi
SLRTLNVKDK

SEQ ID NO: 49252 - protein, 10 aa, Borrelia garinii PBi
LRTLNVKDKI

SEQ ID NO: 49253 - protein, 10 aa, Borrelia garinii PBi
RTLNVKDKIQ

SEQ ID NO: 49254 - protein, 10 aa, Borrelia garinii PBi
TLNVKDKIQH

SEQ ID NO: 49255 - protein, 10 aa, Borrelia garinii PBi
LNVKDKIQHL

SEQ ID NO: 49256 - protein, 10 aa, Borrelia garinii PBi
NVKDKIQHLN

SEQ ID NO: 49257 - protein, 10 aa, Borrelia garinii PBi
VKDKIQHLNK

SEQ ID NO: 49258 - protein, 10 aa, Borrelia garinii PBi
KDKIQHLNKP

SEQ ID NO: 49259 - protein, 10 aa, Borrelia garinii PBi
DKIQHLNKPN

SEQ ID NO: 49260 - protein, 10 aa, Borrelia garinii PBi
KIQHLNKPNL

SEQ ID NO: 49261 - protein, 10 aa, Borrelia garinii PBi
IQHLNKPNLK

SEQ ID NO: 49262 - protein, 10 aa, Borrelia garinii PBi
QHLNKPNLKT

SEQ ID NO: 49263 - protein, 10 aa, Borrelia garinii PBi
HLNKPNLKTL

SEQ ID NO: 49264 - protein, 10 aa, Borrelia garinii PBi
LNKPNLKTLY

SEQ ID NO: 49265 - protein, 10 aa, Borrelia garinii PBi
NKPNLKTLYH

SEQ ID NO: 49266 - protein, 10 aa, Borrelia garinii PBi
KPNLKTLYHD

SEQ ID NO: 49267 - protein, 10 aa, Borrelia garinii PBi
PNLKTLYHDF

SEQ ID NO: 49268 - protein, 10 aa, Borrelia garinii PBi
NLKTLYHDFN

SEQ ID NO: 49269 - protein, 10 aa, Borrelia garinii PBi
LKTLYHDFNK

SEQ ID NO: 49270 - protein, 10 aa, Borrelia garinii PBi
KTLYHDFNKL

SEQ ID NO: 49271 - protein, 10 aa, Borrelia garinii PBi
TLYHDFNKLI

SEQ ID NO: 49272 - protein, 10 aa, Borrelia garinii PBi
LYHDFNKLIP

SEQ ID NO: 49273 - protein, 10 aa, Borrelia garinii PBi
YHDFNKLIPL

SEQ ID NO: 49274 - protein, 10 aa, Borrelia garinii PBi
HDFNKLIPLK

SEQ ID NO: 49275 - protein, 10 aa, Borrelia garinii PBi
DFNKLIPLKE

SEQ ID NO: 49276 - protein, 10 aa, Borrelia garinii PBi
FNKLIPLKEK

SEQ ID NO: 49277 - protein, 10 aa, Borrelia garinii PBi
NKLIPLKEKW

SEQ ID NO: 49278 - protein, 10 aa, Borrelia garinii PBi
KLIPLKEKWL

SEQ ID NO: 49279 - protein, 10 aa, Borrelia garinii PBi
LIPLKEKWLK

SEQ ID NO: 49280 - protein, 10 aa, Borrelia garinii PBi
IPLKEKWLKD

SEQ ID NO: 49281 - protein, 10 aa, Borrelia garinii PBi
PLKEKWLKDV

SEQ ID NO: 49282 - protein, 10 aa, Borrelia garinii PBi
LKEKWLKDVD

SEQ ID NO: 49283 - protein, 10 aa, Borrelia garinii PBi
KEKWLKDVDD

SEQ ID NO: 49284 - protein, 10 aa, Borrelia garinii PBi
EKWLKDVDDI

SEQ ID NO: 49285 - protein, 10 aa, Borrelia garinii PBi
KWLKDVDDII

SEQ ID NO: 49286 - protein, 10 aa, Borrelia garinii PBi
WLKDVDDIIK

SEQ ID NO: 49287 - protein, 10 aa, Borrelia garinii PBi
LKDVDDIIKD

SEQ ID NO: 49288 - protein, 10 aa, Borrelia garinii PBi
KDVDDIIKDY

SEQ ID NO: 49289 - protein, 10 aa, Borrelia garinii PBi
DVDDIIKDYN

SEQ ID NO: 49290 - protein, 10 aa, Borrelia garinii PBi
VDDIIKDYNA

SEQ ID NO: 49291 - protein, 10 aa, Borrelia garinii PBi
DDIIKDYNAN

SEQ ID NO: 49292 - protein, 10 aa, Borrelia garinii PBi
DIIKDYNANP

SEQ ID NO: 49293 - protein, 10 aa, Borrelia garinii PBi
IIKDYNANPE

SEQ ID NO: 49294 - protein, 10 aa, Borrelia garinii PBi
IKDYNANPEL

SEQ ID NO: 49295 - protein, 10 aa, Borrelia garinii PBi
KDYNANPELR

SEQ ID NO: 49296 - protein, 10 aa, Borrelia garinii PBi
DYNANPELRT

SEQ ID NO: 49297 - protein, 10 aa, Borrelia garinii PBi
YNANPELRTD

SEQ ID NO: 49298 - protein, 10 aa, Borrelia garinii PBi
NANPELRTDI

SEQ ID NO: 49299 - protein, 10 aa, Borrelia garinii PBi
ANPELRTDIS

SEQ ID NO: 49300 - protein, 10 aa, Borrelia garinii PBi
NPELRTDISK

SEQ ID NO: 49301 - protein, 10 aa, Borrelia garinii PBi
PELRTDISKL

SEQ ID NO: 49302 - protein, 10 aa, Borrelia garinii PBi
ELRTDISKLN

SEQ ID NO: 49303 - protein, 10 aa, Borrelia garinii PBi
LRTDISKLND

SEQ ID NO: 49304 - protein, 10 aa, Borrelia garinii PBi
RTDISKLNDY

SEQ ID NO: 49305 - protein, 10 aa, Borrelia garinii PBi
TDISKLNDYI

SEQ ID NO: 49306 - protein, 10 aa, Borrelia garinii PBi
DISKLNDYII

SEQ ID NO: 49307 - protein, 10 aa, Borrelia garinii PBi
ISKLNDYIIS

SEQ ID NO: 49308 - protein, 10 aa, Borrelia garinii PBi
SKLNDYIISK

SEQ ID NO: 49309 - protein, 10 aa, Borrelia garinii PBi
KLNDYIISKN

SEQ ID NO: 49310 - protein, 10 aa, Borrelia garinii PBi
LNDYIISKNS

SEQ ID NO: 49311 - protein, 10 aa, Borrelia garinii PBi
NDYIISKNSK

SEQ ID NO: 49312 - protein, 10 aa, Borrelia garinii PBi
DYIISKNSKA

SEQ ID NO: 49313 - protein, 10 aa, Borrelia garinii PBi
YIISKNSKAQ

SEQ ID NO: 49314 - protein, 10 aa, Borrelia garinii PBi
IISKNSKAQF

SEQ ID NO: 49315 - protein, 10 aa, Borrelia garinii PBi
ISKNSKAQFT

SEQ ID NO: 49316 - protein, 10 aa, Borrelia garinii PBi
SKNSKAQFTD

SEQ ID NO: 49317 - protein, 10 aa, Borrelia garinii PBi
KNSKAQFTDI

SEQ ID NO: 49318 - protein, 10 aa, Borrelia garinii PBi
NSKAQFTDIH

SEQ ID NO: 49319 - protein, 10 aa, Borrelia garinii PBi
SKAQFTDIHN

SEQ ID NO: 49320 - protein, 10 aa, Borrelia garinii PBi
KAQFTDIHNI

SEQ ID NO: 49321 - protein, 10 aa, Borrelia garinii PBi
AQFTDIHNII

SEQ ID NO: 49322 - protein, 10 aa, Borrelia garinii PBi
QFTDIHNIIL

SEQ ID NO: 49323 - protein, 10 aa, Borrelia garinii PBi
FTDIHNIILN

SEQ ID NO: 49324 - protein, 10 aa, Borrelia garinii PBi
TDIHNIILNL

SEQ ID NO: 49325 - protein, 10 aa, Borrelia garinii PBi
DIHNIILNLI

SEQ ID NO: 49326 - protein, 10 aa, Borrelia garinii PBi
IHNIILNLIN

SEQ ID NO: 49327 - protein, 10 aa, Borrelia garinii PBi
HNIILNLINT

SEQ ID NO: 49328 - protein, 10 aa, Borrelia garinii PBi
NIILNLINTT

SEQ ID NO: 49329 - protein, 10 aa, Borrelia garinii PBi
IILNLINTTT

SEQ ID NO: 49330 - protein, 10 aa, Borrelia garinii PBi
ILNLINTTTN

SEQ ID NO: 49331 - protein, 10 aa, Borrelia garinii PBi
LNLINTTTNI

SEQ ID NO: 49332 - protein, 10 aa, Borrelia garinii PBi
NLINTTTNIL

SEQ ID NO: 49333 - protein, 10 aa, Borrelia garinii PBi
LINTTTNILA

SEQ ID NO: 49334 - protein, 10 aa, Borrelia garinii PBi
INTTTNILAP

SEQ ID NO: 49335 - protein, 10 aa, Borrelia garinii PBi
NTTTNILAPI

SEQ ID NO: 49336 - protein, 10 aa, Borrelia garinii PBi
TTTNILAPIQ

SEQ ID NO: 49337 - protein, 11 aa, Borrelia garinii PBi
MKNNKLIAIFL

SEQ ID NO: 49338 - protein, 11 aa, Borrelia garinii PBi
KNNKLIAIFLL

SEQ ID NO: 49339 - protein, 11 aa, Borrelia garinii PBi
NNKLIAIFLLH

SEQ ID NO: 49340 - protein, 11 aa, Borrelia garinii PBi
NKLIAIFLLHI

SEQ ID NO: 49341 - protein, 11 aa, Borrelia garinii PBi
KLIAIFLLHIL

SEQ ID NO: 49342 - protein, 11 aa, Borrelia garinii PBi
LIAIFLLHILT

SEQ ID NO: 49343 - protein, 11 aa, Borrelia garinii PBi
IAIFLLHILTG

SEQ ID NO: 49344 - protein, 11 aa, Borrelia garinii PBi
AIFLLHILTGL

SEQ ID NO: 49345 - protein, 11 aa, Borrelia garinii PBi
IFLLHILTGLI

SEQ ID NO: 49346 - protein, 11 aa, Borrelia garinii PBi
FLLHILTGLIL

SEQ ID NO: 49347 - protein, 11 aa, Borrelia garinii PBi
LLHILTGLILL

SEQ ID NO: 49348 - protein, 11 aa, Borrelia garinii PBi
LHILTGLILLS

SEQ ID NO: 49349 - protein, 11 aa, Borrelia garinii PBi
HILTGLILLSC

SEQ ID NO: 49350 - protein, 11 aa, Borrelia garinii PBi
ILTGLILLSCS

SEQ ID NO: 49351 - protein, 11 aa, Borrelia garinii PBi
LTGLILLSCSL

SEQ ID NO: 49352 - protein, 11 aa, Borrelia garinii PBi
TGLILLSCSLE

SEQ ID NO: 49353 - protein, 11 aa, Borrelia garinii PBi
GLILLSCSLEV

SEQ ID NO: 49354 - protein, 11 aa, Borrelia garinii PBi
LILLSCSLEVN

SEQ ID NO: 49355 - protein, 11 aa, Borrelia garinii PBi
ILLSCSLEVNQ

SEQ ID NO: 49356 - protein, 11 aa, Borrelia garinii PBi
LLSCSLEVNQD

SEQ ID NO: 49357 - protein, 11 aa, Borrelia garinii PBi
LSCSLEVNQDD

SEQ ID NO: 49358 - protein, 11 aa, Borrelia garinii PBi
SCSLEVNQDDN

SEQ ID NO: 49359 - protein, 11 aa, Borrelia garinii PBi
CSLEVNQDDNQ

SEQ ID NO: 49360 - protein, 11 aa, Borrelia garinii PBi
SLEVNQDDNQE

SEQ ID NO: 49361 - protein, 11 aa, Borrelia garinii PBi
LEVNQDDNQEK

SEQ ID NO: 49362 - protein, 11 aa, Borrelia garinii PBi
EVNQDDNQEKQ

SEQ ID NO: 49363 - protein, 11 aa, Borrelia garinii PBi
VNQDDNQEKQK

SEQ ID NO: 49364 - protein, 11 aa, Borrelia garinii PBi
NQDDNQEKQKK

SEQ ID NO: 49365 - protein, 11 aa, Borrelia garinii PBi
QDDNQEKQKKA

SEQ ID NO: 49366 - protein, 11 aa, Borrelia garinii PBi
DDNQEKQKKAK

SEQ ID NO: 49367 - protein, 11 aa, Borrelia garinii PBi
DNQEKQKKAKT

SEQ ID NO: 49368 - protein, 11 aa, Borrelia garinii PBi
NQEKQKKAKTK

SEQ ID NO: 49369 - protein, 11 aa, Borrelia garinii PBi
QEKQKKAKTKT

SEQ ID NO: 49370 - protein, 11 aa, Borrelia garinii PBi
EKQKKAKTKTS

SEQ ID NO: 49371 - protein, 11 aa, Borrelia garinii PBi
KQKKAKTKTSK

SEQ ID NO: 49372 - protein, 11 aa, Borrelia garinii PBi
QKKAKTKTSKS

SEQ ID NO: 49373 - protein, 11 aa, Borrelia garinii PBi
KKAKTKTSKSE

SEQ ID NO: 49374 - protein, 11 aa, Borrelia garinii PBi
KAKTKTSKSEN

SEQ ID NO: 49375 - protein, 11 aa, Borrelia garinii PBi
AKTKTSKSENN

SEQ ID NO: 49376 - protein, 11 aa, Borrelia garinii PBi
KTKTSKSENNS

SEQ ID NO: 49377 - protein, 11 aa, Borrelia garinii PBi
TKTSKSENNSS

SEQ ID NO: 49378 - protein, 11 aa, Borrelia garinii PBi
KTSKSENNSSK

SEQ ID NO: 49379 - protein, 11 aa, Borrelia garinii PBi
TSKSENNSSKM

SEQ ID NO: 49380 - protein, 11 aa, Borrelia garinii PBi
SKSENNSSKMK

SEQ ID NO: 49381 - protein, 11 aa, Borrelia garinii PBi
KSENNSSKMKK

SEQ ID NO: 49382 - protein, 11 aa, Borrelia garinii PBi
SENNSSKMKKL

SEQ ID NO: 49383 - protein, 11 aa, Borrelia garinii PBi
ENNSSKMKKLS

SEQ ID NO: 49384 - protein, 11 aa, Borrelia garinii PBi
NNSSKMKKLSK

SEQ ID NO: 49385 - protein, 11 aa, Borrelia garinii PBi
NSSKMKKLSKN

SEQ ID NO: 49386 - protein, 11 aa, Borrelia garinii PBi
SSKMKKLSKNA

SEQ ID NO: 49387 - protein, 11 aa, Borrelia garinii PBi
SKMKKLSKNAK

SEQ ID NO: 49388 - protein, 11 aa, Borrelia garinii PBi
KMKKLSKNAKN

SEQ ID NO: 49389 - protein, 11 aa, Borrelia garinii PBi
MKKLSKNAKNK

SEQ ID NO: 49390 - protein, 11 aa, Borrelia garinii PBi
KKLSKNAKNKK

SEQ ID NO: 49391 - protein, 11 aa, Borrelia garinii PBi
KLSKNAKNKKP

SEQ ID NO: 49392 - protein, 11 aa, Borrelia garinii PBi
LSKNAKNKKPT

SEQ ID NO: 49393 - protein, 11 aa, Borrelia garinii PBi
SKNAKNKKPTV

SEQ ID NO: 49394 - protein, 11 aa, Borrelia garinii PBi
KNAKNKKPTVD

SEQ ID NO: 49395 - protein, 11 aa, Borrelia garinii PBi
NAKNKKPTVDN

SEQ ID NO: 49396 - protein, 11 aa, Borrelia garinii PBi
AKNKKPTVDNL

SEQ ID NO: 49397 - protein, 11 aa, Borrelia garinii PBi
KNKKPTVDNLL

SEQ ID NO: 49398 - protein, 11 aa, Borrelia garinii PBi
NKKPTVDNLLV

SEQ ID NO: 49399 - protein, 11 aa, Borrelia garinii PBi
KKPTVDNLLVA

SEQ ID NO: 49400 - protein, 11 aa, Borrelia garinii PBi
KPTVDNLLVAI

SEQ ID NO: 49401 - protein, 11 aa, Borrelia garinii PBi
PTVDNLLVAIN

SEQ ID NO: 49402 - protein, 11 aa, Borrelia garinii PBi
TVDNLLVAINT

SEQ ID NO: 49403 - protein, 11 aa, Borrelia garinii PBi
VDNLLVAINTL

SEQ ID NO: 49404 - protein, 11 aa, Borrelia garinii PBi
DNLLVAINTLK

SEQ ID NO: 49405 - protein, 11 aa, Borrelia garinii PBi
NLLVAINTLKN

SEQ ID NO: 49406 - protein, 11 aa, Borrelia garinii PBi
LLVAINTLKNP

SEQ ID NO: 49407 - protein, 11 aa, Borrelia garinii PBi
LVAINTLKNPP

SEQ ID NO: 49408 - protein, 11 aa, Borrelia garinii PBi
VAINTLKNPPK

SEQ ID NO: 49409 - protein, 11 aa, Borrelia garinii PBi
AINTLKNPPKT

SEQ ID NO: 49410 - protein, 11 aa, Borrelia garinii PBi
INTLKNPPKTA

SEQ ID NO: 49411 - protein, 11 aa, Borrelia garinii PBi
NTLKNPPKTAG

SEQ ID NO: 49412 - protein, 11 aa, Borrelia garinii PBi
TLKNPPKTAGK

SEQ ID NO: 49413 - protein, 11 aa, Borrelia garinii PBi
LKNPPKTAGKN

SEQ ID NO: 49414 - protein, 11 aa, Borrelia garinii PBi
KNPPKTAGKNK

SEQ ID NO: 49415 - protein, 11 aa, Borrelia garinii PBi
NPPKTAGKNKS

SEQ ID NO: 49416 - protein, 11 aa, Borrelia garinii PBi
PPKTAGKNKSN

SEQ ID NO: 49417 - protein, 11 aa, Borrelia garinii PBi
PKTAGKNKSNS

SEQ ID NO: 49418 - protein, 11 aa, Borrelia garinii PBi
KTAGKNKSNSA

SEQ ID NO: 49419 - protein, 11 aa, Borrelia garinii PBi
TAGKNKSNSAA

SEQ ID NO: 49420 - protein, 11 aa, Borrelia garinii PBi
AGKNKSNSAAA

SEQ ID NO: 49421 - protein, 11 aa, Borrelia garinii PBi
GKNKSNSAAAL

SEQ ID NO: 49422 - protein, 11 aa, Borrelia garinii PBi
KNKSNSAAALK

SEQ ID NO: 49423 - protein, 11 aa, Borrelia garinii PBi
NKSNSAAALKQ

SEQ ID NO: 49424 - protein, 11 aa, Borrelia garinii PBi
KSNSAAALKQP

SEQ ID NO: 49425 - protein, 11 aa, Borrelia garinii PBi
SNSAAALKQPN

SEQ ID NO: 49426 - protein, 11 aa, Borrelia garinii PBi
NSAAALKQPNN

SEQ ID NO: 49427 - protein, 11 aa, Borrelia garinii PBi
SAAALKQPNNA

SEQ ID NO: 49428 - protein, 11 aa, Borrelia garinii PBi
AAALKQPNNAN

SEQ ID NO: 49429 - protein, 11 aa, Borrelia garinii PBi
AALKQPNNANA

SEQ ID NO: 49430 - protein, 11 aa, Borrelia garinii PBi
ALKQPNNANAL

SEQ ID NO: 49431 - protein, 11 aa, Borrelia garinii PBi
LKQPNNANALK

SEQ ID NO: 49432 - protein, 11 aa, Borrelia garinii PBi
KQPNNANALKQ

SEQ ID NO: 49433 - protein, 11 aa, Borrelia garinii PBi
QPNNANALKQI

SEQ ID NO: 49434 - protein, 11 aa, Borrelia garinii PBi
PNNANALKQID

SEQ ID NO: 49435 - protein, 11 aa, Borrelia garinii PBi
NNANALKQIDP

SEQ ID NO: 49436 - protein, 11 aa, Borrelia garinii PBi
NANALKQIDPE

SEQ ID NO: 49437 - protein, 11 aa, Borrelia garinii PBi
ANALKQIDPEA

SEQ ID NO: 49438 - protein, 11 aa, Borrelia garinii PBi
NALKQIDPEAK

SEQ ID NO: 49439 - protein, 11 aa, Borrelia garinii PBi
ALKQIDPEAKE

SEQ ID NO: 49440 - protein, 11 aa, Borrelia garinii PBi
LKQIDPEAKEL

SEQ ID NO: 49441 - protein, 11 aa, Borrelia garinii PBi
KQIDPEAKELI

SEQ ID NO: 49442 - protein, 11 aa, Borrelia garinii PBi
QIDPEAKELIQ

SEQ ID NO: 49443 - protein, 11 aa, Borrelia garinii PBi
IDPEAKELIQK

SEQ ID NO: 49444 - protein, 11 aa, Borrelia garinii PBi
DPEAKELIQKI

SEQ ID NO: 49445 - protein, 11 aa, Borrelia garinii PBi
PEAKELIQKIL

SEQ ID NO: 49446 - protein, 11 aa, Borrelia garinii PBi
EAKELIQKILE

SEQ ID NO: 49447 - protein, 11 aa, Borrelia garinii PBi
AKELIQKILER

SEQ ID NO: 49448 - protein, 11 aa, Borrelia garinii PBi
KELIQKILERS

SEQ ID NO: 49449 - protein, 11 aa, Borrelia garinii PBi
ELIQKILERSE

SEQ ID NO: 49450 - protein, 11 aa, Borrelia garinii PBi
LIQKILERSED

SEQ ID NO: 49451 - protein, 11 aa, Borrelia garinii PBi
IQKILERSEDI

SEQ ID NO: 49452 - protein, 11 aa, Borrelia garinii PBi
QKILERSEDIV

SEQ ID NO: 49453 - protein, 11 aa, Borrelia garinii PBi
KILERSEDIVQ

SEQ ID NO: 49454 - protein, 11 aa, Borrelia garinii PBi
ILERSEDIVQI

SEQ ID NO: 49455 - protein, 11 aa, Borrelia garinii PBi
LERSEDIVQIS

SEQ ID NO: 49456 - protein, 11 aa, Borrelia garinii PBi
ERSEDIVQISE

SEQ ID NO: 49457 - protein, 11 aa, Borrelia garinii PBi
RSEDIVQISEI

SEQ ID NO: 49458 - protein, 11 aa, Borrelia garinii PBi
SEDIVQISEID

SEQ ID NO: 49459 - protein, 11 aa, Borrelia garinii PBi
EDIVQISEIDA

SEQ ID NO: 49460 - protein, 11 aa, Borrelia garinii PBi
DIVQISEIDAN

SEQ ID NO: 49461 - protein, 11 aa, Borrelia garinii PBi
IVQISEIDANK

SEQ ID NO: 49462 - protein, 11 aa, Borrelia garinii PBi
VQISEIDANKG

SEQ ID NO: 49463 - protein, 11 aa, Borrelia garinii PBi
QISEIDANKGE

SEQ ID NO: 49464 - protein, 11 aa, Borrelia garinii PBi
ISEIDANKGEP

SEQ ID NO: 49465 - protein, 11 aa, Borrelia garinii PBi
SEIDANKGEPD

SEQ ID NO: 49466 - protein, 11 aa, Borrelia garinii PBi
EIDANKGEPDD

SEQ ID NO: 49467 - protein, 11 aa, Borrelia garinii PBi
IDANKGEPDDQ

SEQ ID NO: 49468 - protein, 11 aa, Borrelia garinii PBi
DANKGEPDDQF

SEQ ID NO: 49469 - protein, 11 aa, Borrelia garinii PBi
ANKGEPDDQFE

SEQ ID NO: 49470 - protein, 11 aa, Borrelia garinii PBi
NKGEPDDQFEM

SEQ ID NO: 49471 - protein, 11 aa, Borrelia garinii PBi
KGEPDDQFEMK

SEQ ID NO: 49472 - protein, 11 aa, Borrelia garinii PBi
GEPDDQFEMKA

SEQ ID NO: 49473 - protein, 11 aa, Borrelia garinii PBi
EPDDQFEMKAE

SEQ ID NO: 49474 - protein, 11 aa, Borrelia garinii PBi
PDDQFEMKAEI

SEQ ID NO: 49475 - protein, 11 aa, Borrelia garinii PBi
DDQFEMKAEIF

SEQ ID NO: 49476 - protein, 11 aa, Borrelia garinii PBi
DQFEMKAEIFS

SEQ ID NO: 49477 - protein, 11 aa, Borrelia garinii PBi
QFEMKAEIFSK

SEQ ID NO: 49478 - protein, 11 aa, Borrelia garinii PBi
FEMKAEIFSKI

SEQ ID NO: 49479 - protein, 11 aa, Borrelia garinii PBi
EMKAEIFSKIF

SEQ ID NO: 49480 - protein, 11 aa, Borrelia garinii PBi
MKAEIFSKIFF

SEQ ID NO: 49481 - protein, 11 aa, Borrelia garinii PBi
KAEIFSKIFFN

SEQ ID NO: 49482 - protein, 11 aa, Borrelia garinii PBi
AEIFSKIFFNA

SEQ ID NO: 49483 - protein, 11 aa, Borrelia garinii PBi
EIFSKIFFNAG

SEQ ID NO: 49484 - protein, 11 aa, Borrelia garinii PBi
IFSKIFFNAGS

SEQ ID NO: 49485 - protein, 11 aa, Borrelia garinii PBi
FSKIFFNAGST

SEQ ID NO: 49486 - protein, 11 aa, Borrelia garinii PBi
SKIFFNAGSTV

SEQ ID NO: 49487 - protein, 11 aa, Borrelia garinii PBi
KIFFNAGSTVT

SEQ ID NO: 49488 - protein, 11 aa, Borrelia garinii PBi
IFFNAGSTVTF

SEQ ID NO: 49489 - protein, 11 aa, Borrelia garinii PBi
FFNAGSTVTFD

SEQ ID NO: 49490 - protein, 11 aa, Borrelia garinii PBi
FNAGSTVTFDD

SEQ ID NO: 49491 - protein, 11 aa, Borrelia garinii PBi
NAGSTVTFDDN

SEQ ID NO: 49492 - protein, 11 aa, Borrelia garinii PBi
AGSTVTFDDNE

SEQ ID NO: 49493 - protein, 11 aa, Borrelia garinii PBi
GSTVTFDDNEY

SEQ ID NO: 49494 - protein, 11 aa, Borrelia garinii PBi
STVTFDDNEYV

SEQ ID NO: 49495 - protein, 11 aa, Borrelia garinii PBi
TVTFDDNEYVN

SEQ ID NO: 49496 - protein, 11 aa, Borrelia garinii PBi
VTFDDNEYVNE

SEQ ID NO: 49497 - protein, 11 aa, Borrelia garinii PBi
TFDDNEYVNER

SEQ ID NO: 49498 - protein, 11 aa, Borrelia garinii PBi
FDDNEYVNERR

SEQ ID NO: 49499 - protein, 11 aa, Borrelia garinii PBi
DDNEYVNERRI

SEQ ID NO: 49500 - protein, 11 aa, Borrelia garinii PBi
DNEYVNERRIL

SEQ ID NO: 49501 - protein, 11 aa, Borrelia garinii PBi
NEYVNERRILY

SEQ ID NO: 49502 - protein, 11 aa, Borrelia garinii PBi
EYVNERRILYT

SEQ ID NO: 49503 - protein, 11 aa, Borrelia garinii PBi
YVNERRILYTS

SEQ ID NO: 49504 - protein, 11 aa, Borrelia garinii PBi
VNERRILYTSL

SEQ ID NO: 49505 - protein, 11 aa, Borrelia garinii PBi
NERRILYTSLN

SEQ ID NO: 49506 - protein, 11 aa, Borrelia garinii PBi
ERRILYTSLNF

SEQ ID NO: 49507 - protein, 11 aa, Borrelia garinii PBi
RRILYTSLNFN

SEQ ID NO: 49508 - protein, 11 aa, Borrelia garinii PBi
RILYTSLNFNE

SEQ ID NO: 49509 - protein, 11 aa, Borrelia garinii PBi
ILYTSLNFNEN

SEQ ID NO: 49510 - protein, 11 aa, Borrelia garinii PBi
LYTSLNFNENK

SEQ ID NO: 49511 - protein, 11 aa, Borrelia garinii PBi
YTSLNFNENKI

SEQ ID NO: 49512 - protein, 11 aa, Borrelia garinii PBi
TSLNFNENKIL

SEQ ID NO: 49513 - protein, 11 aa, Borrelia garinii PBi
SLNFNENKILN

SEQ ID NO: 49514 - protein, 11 aa, Borrelia garinii PBi
LNFNENKILNL

SEQ ID NO: 49515 - protein, 11 aa, Borrelia garinii PBi
NFNENKILNLG

SEQ ID NO: 49516 - protein, 11 aa, Borrelia garinii PBi
FNENKILNLGK

SEQ ID NO: 49517 - protein, 11 aa, Borrelia garinii PBi
NENKILNLGKI

SEQ ID NO: 49518 - protein, 11 aa, Borrelia garinii PBi
ENKILNLGKIL

SEQ ID NO: 49519 - protein, 11 aa, Borrelia garinii PBi
NKILNLGKILS

SEQ ID NO: 49520 - protein, 11 aa, Borrelia garinii PBi
KILNLGKILSK

SEQ ID NO: 49521 - protein, 11 aa, Borrelia garinii PBi
ILNLGKILSKL

SEQ ID NO: 49522 - protein, 11 aa, Borrelia garinii PBi
LNLGKILSKLS

SEQ ID NO: 49523 - protein, 11 aa, Borrelia garinii PBi
NLGKILSKLSQ

SEQ ID NO: 49524 - protein, 11 aa, Borrelia garinii PBi
LGKILSKLSQD

SEQ ID NO: 49525 - protein, 11 aa, Borrelia garinii PBi
GKILSKLSQDS

SEQ ID NO: 49526 - protein, 11 aa, Borrelia garinii PBi
KILSKLSQDSN

SEQ ID NO: 49527 - protein, 11 aa, Borrelia garinii PBi
ILSKLSQDSNY

SEQ ID NO: 49528 - protein, 11 aa, Borrelia garinii PBi
LSKLSQDSNYR

SEQ ID NO: 49529 - protein, 11 aa, Borrelia garinii PBi
SKLSQDSNYRS

SEQ ID NO: 49530 - protein, 11 aa, Borrelia garinii PBi
KLSQDSNYRSL

SEQ ID NO: 49531 - protein, 11 aa, Borrelia garinii PBi
LSQDSNYRSLV

SEQ ID NO: 49532 - protein, 11 aa, Borrelia garinii PBi
SQDSNYRSLVK

SEQ ID NO: 49533 - protein, 11 aa, Borrelia garinii PBi
QDSNYRSLVKE

SEQ ID NO: 49534 - protein, 11 aa, Borrelia garinii PBi
DSNYRSLVKEI

SEQ ID NO: 49535 - protein, 11 aa, Borrelia garinii PBi
SNYRSLVKEIL

SEQ ID NO: 49536 - protein, 11 aa, Borrelia garinii PBi
NYRSLVKEILI

SEQ ID NO: 49537 - protein, 11 aa, Borrelia garinii PBi
YRSLVKEILIN

SEQ ID NO: 49538 - protein, 11 aa, Borrelia garinii PBi
RSLVKEILINR

SEQ ID NO: 49539 - protein, 11 aa, Borrelia garinii PBi
SLVKEILINRG

SEQ ID NO: 49540 - protein, 11 aa, Borrelia garinii PBi
LVKEILINRGF

SEQ ID NO: 49541 - protein, 11 aa, Borrelia garinii PBi
VKEILINRGFS

SEQ ID NO: 49542 - protein, 11 aa, Borrelia garinii PBi
KEILINRGFSI

SEQ ID NO: 49543 - protein, 11 aa, Borrelia garinii PBi
EILINRGFSIQ

SEQ ID NO: 49544 - protein, 11 aa, Borrelia garinii PBi
ILINRGFSIQL

SEQ ID NO: 49545 - protein, 11 aa, Borrelia garinii PBi
LINRGFSIQLA

SEQ ID NO: 49546 - protein, 11 aa, Borrelia garinii PBi
INRGFSIQLAI

SEQ ID NO: 49547 - protein, 11 aa, Borrelia garinii PBi
NRGFSIQLAIE

SEQ ID NO: 49548 - protein, 11 aa, Borrelia garinii PBi
RGFSIQLAIEE

SEQ ID NO: 49549 - protein, 11 aa, Borrelia garinii PBi
GFSIQLAIEEI

SEQ ID NO: 49550 - protein, 11 aa, Borrelia garinii PBi
FSIQLAIEEIS

SEQ ID NO: 49551 - protein, 11 aa, Borrelia garinii PBi
SIQLAIEEISL

SEQ ID NO: 49552 - protein, 11 aa, Borrelia garinii PBi
IQLAIEEISLR

SEQ ID NO: 49553 - protein, 11 aa, Borrelia garinii PBi
QLAIEEISLRT

SEQ ID NO: 49554 - protein, 11 aa, Borrelia garinii PBi
LAIEEISLRTL

SEQ ID NO: 49555 - protein, 11 aa, Borrelia garinii PBi
AIEEISLRTLN

SEQ ID NO: 49556 - protein, 11 aa, Borrelia garinii PBi
IEEISLRTLNV

SEQ ID NO: 49557 - protein, 11 aa, Borrelia garinii PBi
EEISLRTLNVK

SEQ ID NO: 49558 - protein, 11 aa, Borrelia garinii PBi
EISLRTLNVKD

SEQ ID NO: 49559 - protein, 11 aa, Borrelia garinii PBi
ISLRTLNVKDK

SEQ ID NO: 49560 - protein, 11 aa, Borrelia garinii PBi
SLRTLNVKDKI

SEQ ID NO: 49561 - protein, 11 aa, Borrelia garinii PBi
LRTLNVKDKIQ

SEQ ID NO: 49562 - protein, 11 aa, Borrelia garinii PBi
RTLNVKDKIQH

SEQ ID NO: 49563 - protein, 11 aa, Borrelia garinii PBi
TLNVKDKIQHL

SEQ ID NO: 49564 - protein, 11 aa, Borrelia garinii PBi
LNVKDKIQHLN

SEQ ID NO: 49565 - protein, 11 aa, Borrelia garinii PBi
NVKDKIQHLNK

SEQ ID NO: 49566 - protein, 11 aa, Borrelia garinii PBi
VKDKIQHLNKP

SEQ ID NO: 49567 - protein, 11 aa, Borrelia garinii PBi
KDKIQHLNKPN

SEQ ID NO: 49568 - protein, 11 aa, Borrelia garinii PBi
DKIQHLNKPNL

SEQ ID NO: 49569 - protein, 11 aa, Borrelia garinii PBi
KIQHLNKPNLK

SEQ ID NO: 49570 - protein, 11 aa, Borrelia garinii PBi
IQHLNKPNLKT

SEQ ID NO: 49571 - protein, 11 aa, Borrelia garinii PBi
QHLNKPNLKTL

SEQ ID NO: 49572 - protein, 11 aa, Borrelia garinii PBi
HLNKPNLKTLY

SEQ ID NO: 49573 - protein, 11 aa, Borrelia garinii PBi
LNKPNLKTLYH

SEQ ID NO: 49574 - protein, 11 aa, Borrelia garinii PBi
NKPNLKTLYHD

SEQ ID NO: 49575 - protein, 11 aa, Borrelia garinii PBi
KPNLKTLYHDF

SEQ ID NO: 49576 - protein, 11 aa, Borrelia garinii PBi
PNLKTLYHDFN

SEQ ID NO: 49577 - protein, 11 aa, Borrelia garinii PBi
NLKTLYHDFNK

SEQ ID NO: 49578 - protein, 11 aa, Borrelia garinii PBi
LKTLYHDFNKL

SEQ ID NO: 49579 - protein, 11 aa, Borrelia garinii PBi
KTLYHDFNKLI

SEQ ID NO: 49580 - protein, 11 aa, Borrelia garinii PBi
TLYHDFNKLIP

SEQ ID NO: 49581 - protein, 11 aa, Borrelia garinii PBi
LYHDFNKLIPL

SEQ ID NO: 49582 - protein, 11 aa, Borrelia garinii PBi
YHDFNKLIPLK

SEQ ID NO: 49583 - protein, 11 aa, Borrelia garinii PBi
HDFNKLIPLKE

SEQ ID NO: 49584 - protein, 11 aa, Borrelia garinii PBi
DFNKLIPLKEK

SEQ ID NO: 49585 - protein, 11 aa, Borrelia garinii PBi
FNKLIPLKEKW

SEQ ID NO: 49586 - protein, 11 aa, Borrelia garinii PBi
NKLIPLKEKWL

SEQ ID NO: 49587 - protein, 11 aa, Borrelia garinii PBi
KLIPLKEKWLK

SEQ ID NO: 49588 - protein, 11 aa, Borrelia garinii PBi
LIPLKEKWLKD

SEQ ID NO: 49589 - protein, 11 aa, Borrelia garinii PBi
IPLKEKWLKDV

SEQ ID NO: 49590 - protein, 11 aa, Borrelia garinii PBi
PLKEKWLKDVD

SEQ ID NO: 49591 - protein, 11 aa, Borrelia garinii PBi
LKEKWLKDVDD

SEQ ID NO: 49592 - protein, 11 aa, Borrelia garinii PBi
KEKWLKDVDDI

SEQ ID NO: 49593 - protein, 11 aa, Borrelia garinii PBi
EKWLKDVDDII

SEQ ID NO: 49594 - protein, 11 aa, Borrelia garinii PBi
KWLKDVDDIIK

SEQ ID NO: 49595 - protein, 11 aa, Borrelia garinii PBi
WLKDVDDIIKD

SEQ ID NO: 49596 - protein, 11 aa, Borrelia garinii PBi
LKDVDDIIKDY

SEQ ID NO: 49597 - protein, 11 aa, Borrelia garinii PBi
KDVDDIIKDYN

SEQ ID NO: 49598 - protein, 11 aa, Borrelia garinii PBi
DVDDIIKDYNA

SEQ ID NO: 49599 - protein, 11 aa, Borrelia garinii PBi
VDDIIKDYNAN

SEQ ID NO: 49600 - protein, 11 aa, Borrelia garinii PBi
DDIIKDYNANP

SEQ ID NO: 49601 - protein, 11 aa, Borrelia garinii PBi
DIIKDYNANPE

SEQ ID NO: 49602 - protein, 11 aa, Borrelia garinii PBi
IIKDYNANPEL

SEQ ID NO: 49603 - protein, 11 aa, Borrelia garinii PBi
IKDYNANPELR

SEQ ID NO: 49604 - protein, 11 aa, Borrelia garinii PBi
KDYNANPELRT

SEQ ID NO: 49605 - protein, 11 aa, Borrelia garinii PBi
DYNANPELRTD

SEQ ID NO: 49606 - protein, 11 aa, Borrelia garinii PBi
YNANPELRTDI

SEQ ID NO: 49607 - protein, 11 aa, Borrelia garinii PBi
NANPELRTDIS

SEQ ID NO: 49608 - protein, 11 aa, Borrelia garinii PBi
ANPELRTDISK

SEQ ID NO: 49609 - protein, 11 aa, Borrelia garinii PBi
NPELRTDISKL

SEQ ID NO: 49610 - protein, 11 aa, Borrelia garinii PBi
PELRTDISKLN

SEQ ID NO: 49611 - protein, 11 aa, Borrelia garinii PBi
ELRTDISKLND

SEQ ID NO: 49612 - protein, 11 aa, Borrelia garinii PBi
LRTDISKLNDY

SEQ ID NO: 49613 - protein, 11 aa, Borrelia garinii PBi
RTDISKLNDYI

SEQ ID NO: 49614 - protein, 11 aa, Borrelia garinii PBi
TDISKLNDYII

SEQ ID NO: 49615 - protein, 11 aa, Borrelia garinii PBi
DISKLNDYIIS

SEQ ID NO: 49616 - protein, 11 aa, Borrelia garinii PBi
ISKLNDYIISK

SEQ ID NO: 49617 - protein, 11 aa, Borrelia garinii PBi
SKLNDYIISKN

SEQ ID NO: 49618 - protein, 11 aa, Borrelia garinii PBi
KLNDYIISKNS

SEQ ID NO: 49619 - protein, 11 aa, Borrelia garinii PBi
LNDYIISKNSK

SEQ ID NO: 49620 - protein, 11 aa, Borrelia garinii PBi
NDYIISKNSKA

SEQ ID NO: 49621 - protein, 11 aa, Borrelia garinii PBi
DYIISKNSKAQ

SEQ ID NO: 49622 - protein, 11 aa, Borrelia garinii PBi
YIISKNSKAQF

SEQ ID NO: 49623 - protein, 11 aa, Borrelia garinii PBi
IISKNSKAQFT

SEQ ID NO: 49624 - protein, 11 aa, Borrelia garinii PBi
ISKNSKAQFTD

SEQ ID NO: 49625 - protein, 11 aa, Borrelia garinii PBi
SKNSKAQFTDI

SEQ ID NO: 49626 - protein, 11 aa, Borrelia garinii PBi
KNSKAQFTDIH

SEQ ID NO: 49627 - protein, 11 aa, Borrelia garinii PBi
NSKAQFTDIHN

SEQ ID NO: 49628 - protein, 11 aa, Borrelia garinii PBi
SKAQFTDIHNI

SEQ ID NO: 49629 - protein, 11 aa, Borrelia garinii PBi
KAQFTDIHNII

SEQ ID NO: 49630 - protein, 11 aa, Borrelia garinii PBi
AQFTDIHNIIL

SEQ ID NO: 49631 - protein, 11 aa, Borrelia garinii PBi
QFTDIHNIILN

SEQ ID NO: 49632 - protein, 11 aa, Borrelia garinii PBi
FTDIHNIILNL

SEQ ID NO: 49633 - protein, 11 aa, Borrelia garinii PBi
TDIHNIILNLI

SEQ ID NO: 49634 - protein, 11 aa, Borrelia garinii PBi
DIHNIILNLIN

SEQ ID NO: 49635 - protein, 11 aa, Borrelia garinii PBi
IHNIILNLINT

SEQ ID NO: 49636 - protein, 11 aa, Borrelia garinii PBi
HNIILNLINTT

SEQ ID NO: 49637 - protein, 11 aa, Borrelia garinii PBi
NIILNLINTTT

SEQ ID NO: 49638 - protein, 11 aa, Borrelia garinii PBi
IILNLINTTTN

SEQ ID NO: 49639 - protein, 11 aa, Borrelia garinii PBi
ILNLINTTTNI

SEQ ID NO: 49640 - protein, 11 aa, Borrelia garinii PBi
LNLINTTTNIL

SEQ ID NO: 49641 - protein, 11 aa, Borrelia garinii PBi
NLINTTTNILA

SEQ ID NO: 49642 - protein, 11 aa, Borrelia garinii PBi
LINTTTNILAP

SEQ ID NO: 49643 - protein, 11 aa, Borrelia garinii PBi
INTTTNILAPI

SEQ ID NO: 49644 - protein, 11 aa, Borrelia garinii PBi
NTTTNILAPIQ

SEQ ID NO: 49645 - protein, 8 aa, Borrelia burgdorferi
MKKVKSKY

SEQ ID NO: 49646 - protein, 8 aa, Borrelia burgdorferi
KKVKSKYL

SEQ ID NO: 49647 - protein, 8 aa, Borrelia burgdorferi
KVKSKYLA

SEQ ID NO: 49648 - protein, 8 aa, Borrelia burgdorferi
VKSKYLAL

SEQ ID NO: 49649 - protein, 8 aa, Borrelia burgdorferi
KSKYLALG

SEQ ID NO: 49650 - protein, 8 aa, Borrelia burgdorferi
SKYLALGL

SEQ ID NO: 49651 - protein, 8 aa, Borrelia burgdorferi
KYLALGLL

SEQ ID NO: 49652 - protein, 8 aa, Borrelia burgdorferi
YLALGLLF

SEQ ID NO: 49653 - protein, 8 aa, Borrelia burgdorferi
LALGLLFG

SEQ ID NO: 49654 - protein, 8 aa, Borrelia burgdorferi
ALGLLFGF

SEQ ID NO: 49655 - protein, 8 aa, Borrelia burgdorferi
LGLLFGFI

SEQ ID NO: 49656 - protein, 8 aa, Borrelia burgdorferi
GLLFGFIS

SEQ ID NO: 49657 - protein, 8 aa, Borrelia burgdorferi
LLFGFISC

SEQ ID NO: 49658 - protein, 8 aa, Borrelia burgdorferi
LFGFISCD

SEQ ID NO: 49659 - protein, 8 aa, Borrelia burgdorferi
FGFISCDL

SEQ ID NO: 49660 - protein, 8 aa, Borrelia burgdorferi
GFISCDLF

SEQ ID NO: 49661 - protein, 8 aa, Borrelia burgdorferi
FISCDLFI

SEQ ID NO: 49662 - protein, 8 aa, Borrelia burgdorferi
ISCDLFIR

SEQ ID NO: 49663 - protein, 8 aa, Borrelia burgdorferi
SCDLFIRY

SEQ ID NO: 49664 - protein, 8 aa, Borrelia burgdorferi
CDLFIRYE

SEQ ID NO: 49665 - protein, 8 aa, Borrelia burgdorferi
DLFIRYEM

SEQ ID NO: 49666 - protein, 8 aa, Borrelia burgdorferi
LFIRYEMK

SEQ ID NO: 49667 - protein, 8 aa, Borrelia burgdorferi
FIRYEMKE

SEQ ID NO: 49668 - protein, 8 aa, Borrelia burgdorferi
IRYEMKEE

SEQ ID NO: 49669 - protein, 8 aa, Borrelia burgdorferi
RYEMKEES

SEQ ID NO: 49670 - protein, 8 aa, Borrelia burgdorferi
YEMKEESP

SEQ ID NO: 49671 - protein, 8 aa, Borrelia burgdorferi
EMKEESPG

SEQ ID NO: 49672 - protein, 8 aa, Borrelia burgdorferi
MKEESPGL

SEQ ID NO: 49673 - protein, 8 aa, Borrelia burgdorferi
KEESPGLF

SEQ ID NO: 49674 - protein, 8 aa, Borrelia burgdorferi
EESPGLFD

SEQ ID NO: 49675 - protein, 8 aa, Borrelia burgdorferi
ESPGLFDK

SEQ ID NO: 49676 - protein, 8 aa, Borrelia burgdorferi
SPGLFDKG

SEQ ID NO: 49677 - protein, 8 aa, Borrelia burgdorferi
PGLFDKGN

SEQ ID NO: 49678 - protein, 8 aa, Borrelia burgdorferi
GLFDKGNS

SEQ ID NO: 49679 - protein, 8 aa, Borrelia burgdorferi
LFDKGNSI

SEQ ID NO: 49680 - protein, 8 aa, Borrelia burgdorferi
FDKGNSIL

SEQ ID NO: 49681 - protein, 8 aa, Borrelia burgdorferi
DKGNSILE

SEQ ID NO: 49682 - protein, 8 aa, Borrelia burgdorferi
KGNSILET

SEQ ID NO: 49683 - protein, 8 aa, Borrelia burgdorferi
GNSILETS

SEQ ID NO: 49684 - protein, 8 aa, Borrelia burgdorferi
NSILETSE

SEQ ID NO: 49685 - protein, 8 aa, Borrelia burgdorferi
SILETSEE

SEQ ID NO: 49686 - protein, 8 aa, Borrelia burgdorferi
ILETSEES

SEQ ID NO: 49687 - protein, 8 aa, Borrelia burgdorferi
LETSEESI

SEQ ID NO: 49688 - protein, 8 aa, Borrelia burgdorferi
ETSEESIK

SEQ ID NO: 49689 - protein, 8 aa, Borrelia burgdorferi
TSEESIKK

SEQ ID NO: 49690 - protein, 8 aa, Borrelia burgdorferi
SEESIKKP

SEQ ID NO: 49691 - protein, 8 aa, Borrelia burgdorferi
EESIKKPM

SEQ ID NO: 49692 - protein, 8 aa, Borrelia burgdorferi
ESIKKPMN

SEQ ID NO: 49693 - protein, 8 aa, Borrelia burgdorferi
SIKKPMNK

SEQ ID NO: 49694 - protein, 8 aa, Borrelia burgdorferi
IKKPMNKK

SEQ ID NO: 49695 - protein, 8 aa, Borrelia burgdorferi
KKPMNKKG

SEQ ID NO: 49696 - protein, 8 aa, Borrelia burgdorferi
KPMNKKGK

SEQ ID NO: 49697 - protein, 8 aa, Borrelia burgdorferi
PMNKKGKG

SEQ ID NO: 49698 - protein, 8 aa, Borrelia burgdorferi
MNKKGKGK

SEQ ID NO: 49699 - protein, 8 aa, Borrelia burgdorferi
NKKGKGKI

SEQ ID NO: 49700 - protein, 8 aa, Borrelia burgdorferi
KKGKGKIA

SEQ ID NO: 49701 - protein, 8 aa, Borrelia burgdorferi
KGKGKIAR

SEQ ID NO: 49702 - protein, 8 aa, Borrelia burgdorferi
GKGKIARK

SEQ ID NO: 49703 - protein, 8 aa, Borrelia burgdorferi
KGKIARKK

SEQ ID NO: 49704 - protein, 8 aa, Borrelia burgdorferi
GKIARKKG

SEQ ID NO: 49705 - protein, 8 aa, Borrelia burgdorferi
KIARKKGK

SEQ ID NO: 49706 - protein, 8 aa, Borrelia burgdorferi
IARKKGKS

SEQ ID NO: 49707 - protein, 8 aa, Borrelia burgdorferi
ARKKGKSK

SEQ ID NO: 49708 - protein, 8 aa, Borrelia burgdorferi
RKKGKSKV

SEQ ID NO: 49709 - protein, 8 aa, Borrelia burgdorferi
KKGKSKVS

SEQ ID NO: 49710 - protein, 8 aa, Borrelia burgdorferi
KGKSKVSR

SEQ ID NO: 49711 - protein, 8 aa, Borrelia burgdorferi
GKSKVSRK

SEQ ID NO: 49712 - protein, 8 aa, Borrelia burgdorferi
KSKVSRKE

SEQ ID NO: 49713 - protein, 8 aa, Borrelia burgdorferi
SKVSRKEP

SEQ ID NO: 49714 - protein, 8 aa, Borrelia burgdorferi
KVSRKEPY

SEQ ID NO: 49715 - protein, 8 aa, Borrelia burgdorferi
VSRKEPYI

SEQ ID NO: 49716 - protein, 8 aa, Borrelia burgdorferi
SRKEPYIH

SEQ ID NO: 49717 - protein, 8 aa, Borrelia burgdorferi
RKEPYIHS

SEQ ID NO: 49718 - protein, 8 aa, Borrelia burgdorferi
KEPYIHSL

SEQ ID NO: 49719 - protein, 8 aa, Borrelia burgdorferi
EPYIHSLK

SEQ ID NO: 49720 - protein, 8 aa, Borrelia burgdorferi
PYIHSLKR

SEQ ID NO: 49721 - protein, 8 aa, Borrelia burgdorferi
YIHSLKRD

SEQ ID NO: 49722 - protein, 8 aa, Borrelia burgdorferi
IHSLKRDS

SEQ ID NO: 49723 - protein, 8 aa, Borrelia burgdorferi
HSLKRDSA

SEQ ID NO: 49724 - protein, 8 aa, Borrelia burgdorferi
SLKRDSAN

SEQ ID NO: 49725 - protein, 8 aa, Borrelia burgdorferi
LKRDSANK

SEQ ID NO: 49726 - protein, 8 aa, Borrelia burgdorferi
KRDSANKS

SEQ ID NO: 49727 - protein, 8 aa, Borrelia burgdorferi
RDSANKSN

SEQ ID NO: 49728 - protein, 8 aa, Borrelia burgdorferi
DSANKSNF

SEQ ID NO: 49729 - protein, 8 aa, Borrelia burgdorferi
SANKSNFL

SEQ ID NO: 49730 - protein, 8 aa, Borrelia burgdorferi
ANKSNFLQ

SEQ ID NO: 49731 - protein, 8 aa, Borrelia burgdorferi
NKSNFLQK

SEQ ID NO: 49732 - protein, 8 aa, Borrelia burgdorferi
KSNFLQKN

SEQ ID NO: 49733 - protein, 8 aa, Borrelia burgdorferi
SNFLQKNV

SEQ ID NO: 49734 - protein, 8 aa, Borrelia burgdorferi
NFLQKNVI

SEQ ID NO: 49735 - protein, 8 aa, Borrelia burgdorferi
FLQKNVIL

SEQ ID NO: 49736 - protein, 8 aa, Borrelia burgdorferi
LQKNVILE

SEQ ID NO: 49737 - protein, 8 aa, Borrelia burgdorferi
QKNVILEE

SEQ ID NO: 49738 - protein, 8 aa, Borrelia burgdorferi
KNVILEEE

SEQ ID NO: 49739 - protein, 8 aa, Borrelia burgdorferi
NVILEEES

SEQ ID NO: 49740 - protein, 8 aa, Borrelia burgdorferi
VILEEESL

SEQ ID NO: 49741 - protein, 8 aa, Borrelia burgdorferi
ILEEESLK

SEQ ID NO: 49742 - protein, 8 aa, Borrelia burgdorferi
LEEESLKT

SEQ ID NO: 49743 - protein, 8 aa, Borrelia burgdorferi
EEESLKTE

SEQ ID NO: 49744 - protein, 8 aa, Borrelia burgdorferi
EESLKTEL

SEQ ID NO: 49745 - protein, 8 aa, Borrelia burgdorferi
ESLKTELL

SEQ ID NO: 49746 - protein, 8 aa, Borrelia burgdorferi
SLKTELLK

SEQ ID NO: 49747 - protein, 8 aa, Borrelia burgdorferi
LKTELLKE

SEQ ID NO: 49748 - protein, 8 aa, Borrelia burgdorferi
KTELLKEQ

SEQ ID NO: 49749 - protein, 8 aa, Borrelia burgdorferi
TELLKEQS

SEQ ID NO: 49750 - protein, 8 aa, Borrelia burgdorferi
ELLKEQSE

SEQ ID NO: 49751 - protein, 8 aa, Borrelia burgdorferi
LLKEQSET

SEQ ID NO: 49752 - protein, 8 aa, Borrelia burgdorferi
LKEQSETR

SEQ ID NO: 49753 - protein, 8 aa, Borrelia burgdorferi
KEQSETRK

SEQ ID NO: 49754 - protein, 8 aa, Borrelia burgdorferi
EQSETRKE

SEQ ID NO: 49755 - protein, 8 aa, Borrelia burgdorferi
QSETRKEK

SEQ ID NO: 49756 - protein, 8 aa, Borrelia burgdorferi
SETRKEKI

SEQ ID NO: 49757 - protein, 8 aa, Borrelia burgdorferi
ETRKEKIQ

SEQ ID NO: 49758 - protein, 8 aa, Borrelia burgdorferi
TRKEKIQK

SEQ ID NO: 49759 - protein, 8 aa, Borrelia burgdorferi
RKEKIQKQ

SEQ ID NO: 49760 - protein, 8 aa, Borrelia burgdorferi
KEKIQKQQ

SEQ ID NO: 49761 - protein, 8 aa, Borrelia burgdorferi
EKIQKQQD

SEQ ID NO: 49762 - protein, 8 aa, Borrelia burgdorferi
KIQKQQDE

SEQ ID NO: 49763 - protein, 8 aa, Borrelia burgdorferi
IQKQQDEY

SEQ ID NO: 49764 - protein, 8 aa, Borrelia burgdorferi
QKQQDEYK

SEQ ID NO: 49765 - protein, 8 aa, Borrelia burgdorferi
KQQDEYKG

SEQ ID NO: 49766 - protein, 8 aa, Borrelia burgdorferi
QQDEYKGM

SEQ ID NO: 49767 - protein, 8 aa, Borrelia burgdorferi
QDEYKGMT

SEQ ID NO: 49768 - protein, 8 aa, Borrelia burgdorferi
DEYKGMTQ

SEQ ID NO: 49769 - protein, 8 aa, Borrelia burgdorferi
EYKGMTQG

SEQ ID NO: 49770 - protein, 8 aa, Borrelia burgdorferi
YKGMTQGS

SEQ ID NO: 49771 - protein, 8 aa, Borrelia burgdorferi
KGMTQGSL

SEQ ID NO: 49772 - protein, 8 aa, Borrelia burgdorferi
GMTQGSLN

SEQ ID NO: 49773 - protein, 8 aa, Borrelia burgdorferi
MTQGSLNS

SEQ ID NO: 49774 - protein, 8 aa, Borrelia burgdorferi
TQGSLNSL

SEQ ID NO: 49775 - protein, 8 aa, Borrelia burgdorferi
QGSLNSLS

SEQ ID NO: 49776 - protein, 8 aa, Borrelia burgdorferi
GSLNSLSG

SEQ ID NO: 49777 - protein, 8 aa, Borrelia burgdorferi
SLNSLSGE

SEQ ID NO: 49778 - protein, 8 aa, Borrelia burgdorferi
LNSLSGES

SEQ ID NO: 49779 - protein, 8 aa, Borrelia burgdorferi
NSLSGESG

SEQ ID NO: 49780 - protein, 8 aa, Borrelia burgdorferi
SLSGESGE

SEQ ID NO: 49781 - protein, 8 aa, Borrelia burgdorferi
LSGESGEL

SEQ ID NO: 49782 - protein, 8 aa, Borrelia burgdorferi
SGESGELK

SEQ ID NO: 49783 - protein, 8 aa, Borrelia burgdorferi
GESGELKE

SEQ ID NO: 49784 - protein, 8 aa, Borrelia burgdorferi
ESGELKET

SEQ ID NO: 49785 - protein, 8 aa, Borrelia burgdorferi
SGELKETI

SEQ ID NO: 49786 - protein, 8 aa, Borrelia burgdorferi
GELKETIE

SEQ ID NO: 49787 - protein, 8 aa, Borrelia burgdorferi
ELKETIES

SEQ ID NO: 49788 - protein, 8 aa, Borrelia burgdorferi
LKETIESN

SEQ ID NO: 49789 - protein, 8 aa, Borrelia burgdorferi
KETIESNE

SEQ ID NO: 49790 - protein, 8 aa, Borrelia burgdorferi
ETIESNEI

SEQ ID NO: 49791 - protein, 8 aa, Borrelia burgdorferi
TIESNEID

SEQ ID NO: 49792 - protein, 8 aa, Borrelia burgdorferi
IESNEIDI

SEQ ID NO: 49793 - protein, 8 aa, Borrelia burgdorferi
ESNEIDIT

SEQ ID NO: 49794 - protein, 8 aa, Borrelia burgdorferi
SNEIDITI

SEQ ID NO: 49795 - protein, 8 aa, Borrelia burgdorferi
NEIDITID

SEQ ID NO: 49796 - protein, 8 aa, Borrelia burgdorferi
EIDITIDS

SEQ ID NO: 49797 - protein, 8 aa, Borrelia burgdorferi
IDITIDSD

SEQ ID NO: 49798 - protein, 8 aa, Borrelia burgdorferi
DITIDSDL

SEQ ID NO: 49799 - protein, 8 aa, Borrelia burgdorferi
ITIDSDLR

SEQ ID NO: 49800 - protein, 8 aa, Borrelia burgdorferi
TIDSDLRP

SEQ ID NO: 49801 - protein, 8 aa, Borrelia burgdorferi
IDSDLRPK

SEQ ID NO: 49802 - protein, 8 aa, Borrelia burgdorferi
DSDLRPKS

SEQ ID NO: 49803 - protein, 8 aa, Borrelia burgdorferi
SDLRPKSS

SEQ ID NO: 49804 - protein, 8 aa, Borrelia burgdorferi
DLRPKSSL

SEQ ID NO: 49805 - protein, 8 aa, Borrelia burgdorferi
LRPKSSLQ

SEQ ID NO: 49806 - protein, 8 aa, Borrelia burgdorferi
RPKSSLQD

SEQ ID NO: 49807 - protein, 8 aa, Borrelia burgdorferi
PKSSLQDI

SEQ ID NO: 49808 - protein, 8 aa, Borrelia burgdorferi
KSSLQDIA

SEQ ID NO: 49809 - protein, 8 aa, Borrelia burgdorferi
SSLQDIAG

SEQ ID NO: 49810 - protein, 8 aa, Borrelia burgdorferi
SLQDIAGS

SEQ ID NO: 49811 - protein, 8 aa, Borrelia burgdorferi
LQDIAGSN

SEQ ID NO: 49812 - protein, 8 aa, Borrelia burgdorferi
QDIAGSNS

SEQ ID NO: 49813 - protein, 8 aa, Borrelia burgdorferi
DIAGSNSI

SEQ ID NO: 49814 - protein, 8 aa, Borrelia burgdorferi
IAGSNSIS

SEQ ID NO: 49815 - protein, 8 aa, Borrelia burgdorferi
AGSNSISY

SEQ ID NO: 49816 - protein, 8 aa, Borrelia burgdorferi
GSNSISYT

SEQ ID NO: 49817 - protein, 8 aa, Borrelia burgdorferi
SNSISYTD

SEQ ID NO: 49818 - protein, 8 aa, Borrelia burgdorferi
NSISYTDE

SEQ ID NO: 49819 - protein, 8 aa, Borrelia burgdorferi
SISYTDEI

SEQ ID NO: 49820 - protein, 8 aa, Borrelia burgdorferi
ISYTDEIE

SEQ ID NO: 49821 - protein, 8 aa, Borrelia burgdorferi
SYTDEIEE

SEQ ID NO: 49822 - protein, 8 aa, Borrelia burgdorferi
YTDEIEEE

SEQ ID NO: 49823 - protein, 8 aa, Borrelia burgdorferi
TDEIEEED

SEQ ID NO: 49824 - protein, 8 aa, Borrelia burgdorferi
DEIEEEDY

SEQ ID NO: 49825 - protein, 8 aa, Borrelia burgdorferi
EIEEEDYA

SEQ ID NO: 49826 - protein, 8 aa, Borrelia burgdorferi
IEEEDYAR

SEQ ID NO: 49827 - protein, 8 aa, Borrelia burgdorferi
EEEDYARY

SEQ ID NO: 49828 - protein, 8 aa, Borrelia burgdorferi
EEDYARYY

SEQ ID NO: 49829 - protein, 8 aa, Borrelia burgdorferi
EDYARYYL

SEQ ID NO: 49830 - protein, 8 aa, Borrelia burgdorferi
DYARYYLD

SEQ ID NO: 49831 - protein, 8 aa, Borrelia burgdorferi
YARYYLDE

SEQ ID NO: 49832 - protein, 8 aa, Borrelia burgdorferi
ARYYLDED

SEQ ID NO: 49833 - protein, 8 aa, Borrelia burgdorferi
RYYLDEDD

SEQ ID NO: 49834 - protein, 8 aa, Borrelia burgdorferi
YYLDEDDE

SEQ ID NO: 49835 - protein, 8 aa, Borrelia burgdorferi
YLDEDDED

SEQ ID NO: 49836 - protein, 8 aa, Borrelia burgdorferi
LDEDDEDD

SEQ ID NO: 49837 - protein, 8 aa, Borrelia burgdorferi
DEDDEDDE

SEQ ID NO: 49838 - protein, 8 aa, Borrelia burgdorferi
EDDEDDEY

SEQ ID NO: 49839 - protein, 8 aa, Borrelia burgdorferi
DDEDDEYY

SEQ ID NO: 49840 - protein, 8 aa, Borrelia burgdorferi
DEDDEYYE

SEQ ID NO: 49841 - protein, 8 aa, Borrelia burgdorferi
EDDEYYED

SEQ ID NO: 49842 - protein, 8 aa, Borrelia burgdorferi
DDEYYEDD

SEQ ID NO: 49843 - protein, 8 aa, Borrelia burgdorferi
DEYYEDDY

SEQ ID NO: 49844 - protein, 8 aa, Borrelia burgdorferi
EYYEDDYE

SEQ ID NO: 49845 - protein, 8 aa, Borrelia burgdorferi
YYEDDYEE

SEQ ID NO: 49846 - protein, 8 aa, Borrelia burgdorferi
YEDDYEEI

SEQ ID NO: 49847 - protein, 8 aa, Borrelia burgdorferi
EDDYEEIR

SEQ ID NO: 49848 - protein, 8 aa, Borrelia burgdorferi
DDYEEIRL

SEQ ID NO: 49849 - protein, 8 aa, Borrelia burgdorferi
DYEEIRLS

SEQ ID NO: 49850 - protein, 8 aa, Borrelia burgdorferi
YEEIRLSN

SEQ ID NO: 49851 - protein, 8 aa, Borrelia burgdorferi
EEIRLSNR

SEQ ID NO: 49852 - protein, 8 aa, Borrelia burgdorferi
EIRLSNRY

SEQ ID NO: 49853 - protein, 8 aa, Borrelia burgdorferi
IRLSNRYQ

SEQ ID NO: 49854 - protein, 8 aa, Borrelia burgdorferi
RLSNRYQS

SEQ ID NO: 49855 - protein, 8 aa, Borrelia burgdorferi
LSNRYQSY

SEQ ID NO: 49856 - protein, 8 aa, Borrelia burgdorferi
SNRYQSYL

SEQ ID NO: 49857 - protein, 8 aa, Borrelia burgdorferi
NRYQSYLE

SEQ ID NO: 49858 - protein, 8 aa, Borrelia burgdorferi
RYQSYLEG

SEQ ID NO: 49859 - protein, 8 aa, Borrelia burgdorferi
YQSYLEGV

SEQ ID NO: 49860 - protein, 8 aa, Borrelia burgdorferi
QSYLEGVK

SEQ ID NO: 49861 - protein, 8 aa, Borrelia burgdorferi
SYLEGVKY

SEQ ID NO: 49862 - protein, 8 aa, Borrelia burgdorferi
YLEGVKYN

SEQ ID NO: 49863 - protein, 8 aa, Borrelia burgdorferi
LEGVKYNV

SEQ ID NO: 49864 - protein, 8 aa, Borrelia burgdorferi
EGVKYNVD

SEQ ID NO: 49865 - protein, 8 aa, Borrelia burgdorferi
GVKYNVDS

SEQ ID NO: 49866 - protein, 8 aa, Borrelia burgdorferi
VKYNVDSA

SEQ ID NO: 49867 - protein, 8 aa, Borrelia burgdorferi
KYNVDSAI

SEQ ID NO: 49868 - protein, 8 aa, Borrelia burgdorferi
YNVDSAIN

SEQ ID NO: 49869 - protein, 8 aa, Borrelia burgdorferi
NVDSAINT

SEQ ID NO: 49870 - protein, 8 aa, Borrelia burgdorferi
VDSAINTI

SEQ ID NO: 49871 - protein, 8 aa, Borrelia burgdorferi
DSAINTIN

SEQ ID NO: 49872 - protein, 8 aa, Borrelia burgdorferi
SAINTINK

SEQ ID NO: 49873 - protein, 8 aa, Borrelia burgdorferi
AINTINKI

SEQ ID NO: 49874 - protein, 8 aa, Borrelia burgdorferi
INTINKIY

SEQ ID NO: 49875 - protein, 8 aa, Borrelia burgdorferi
NTINKIYD

SEQ ID NO: 49876 - protein, 8 aa, Borrelia burgdorferi
TINKIYDT

SEQ ID NO: 49877 - protein, 8 aa, Borrelia burgdorferi
INKIYDTY

SEQ ID NO: 49878 - protein, 8 aa, Borrelia burgdorferi
NKIYDTYT

SEQ ID NO: 49879 - protein, 8 aa, Borrelia burgdorferi
KIYDTYTL

SEQ ID NO: 49880 - protein, 8 aa, Borrelia burgdorferi
IYDTYTLF

SEQ ID NO: 49881 - protein, 8 aa, Borrelia burgdorferi
YDTYTLFS

SEQ ID NO: 49882 - protein, 8 aa, Borrelia burgdorferi
DTYTLFST

SEQ ID NO: 49883 - protein, 8 aa, Borrelia burgdorferi
TYTLFSTK

SEQ ID NO: 49884 - protein, 8 aa, Borrelia burgdorferi
YTLFSTKL

SEQ ID NO: 49885 - protein, 8 aa, Borrelia burgdorferi
TLFSTKLT

SEQ ID NO: 49886 - protein, 8 aa, Borrelia burgdorferi
LFSTKLTQ

SEQ ID NO: 49887 - protein, 8 aa, Borrelia burgdorferi
FSTKLTQM

SEQ ID NO: 49888 - protein, 8 aa, Borrelia burgdorferi
STKLTQMY

SEQ ID NO: 49889 - protein, 8 aa, Borrelia burgdorferi
TKLTQMYS

SEQ ID NO: 49890 - protein, 8 aa, Borrelia burgdorferi
KLTQMYST

SEQ ID NO: 49891 - protein, 8 aa, Borrelia burgdorferi
LTQMYSTR

SEQ ID NO: 49892 - protein, 8 aa, Borrelia burgdorferi
TQMYSTRL

SEQ ID NO: 49893 - protein, 8 aa, Borrelia burgdorferi
QMYSTRLD

SEQ ID NO: 49894 - protein, 8 aa, Borrelia burgdorferi
MYSTRLDN

SEQ ID NO: 49895 - protein, 8 aa, Borrelia burgdorferi
YSTRLDNL

SEQ ID NO: 49896 - protein, 8 aa, Borrelia burgdorferi
STRLDNLA

SEQ ID NO: 49897 - protein, 8 aa, Borrelia burgdorferi
TRLDNLAK

SEQ ID NO: 49898 - protein, 8 aa, Borrelia burgdorferi
RLDNLAKA

SEQ ID NO: 49899 - protein, 8 aa, Borrelia burgdorferi
LDNLAKAK

SEQ ID NO: 49900 - protein, 8 aa, Borrelia burgdorferi
DNLAKAKA

SEQ ID NO: 49901 - protein, 8 aa, Borrelia burgdorferi
NLAKAKAK

SEQ ID NO: 49902 - protein, 8 aa, Borrelia burgdorferi
LAKAKAKE

SEQ ID NO: 49903 - protein, 8 aa, Borrelia burgdorferi
AKAKAKEE

SEQ ID NO: 49904 - protein, 8 aa, Borrelia burgdorferi
KAKAKEEA

SEQ ID NO: 49905 - protein, 8 aa, Borrelia burgdorferi
AKAKEEAA

SEQ ID NO: 49906 - protein, 8 aa, Borrelia burgdorferi
KAKEEAAK

SEQ ID NO: 49907 - protein, 8 aa, Borrelia burgdorferi
AKEEAAKF

SEQ ID NO: 49908 - protein, 8 aa, Borrelia burgdorferi
KEEAAKFT

SEQ ID NO: 49909 - protein, 8 aa, Borrelia burgdorferi
EEAAKFTK

SEQ ID NO: 49910 - protein, 8 aa, Borrelia burgdorferi
EAAKFTKE

SEQ ID NO: 49911 - protein, 8 aa, Borrelia burgdorferi
AAKFTKED

SEQ ID NO: 49912 - protein, 8 aa, Borrelia burgdorferi
AKFTKEDL

SEQ ID NO: 49913 - protein, 8 aa, Borrelia burgdorferi
KFTKEDLE

SEQ ID NO: 49914 - protein, 8 aa, Borrelia burgdorferi
FTKEDLEK

SEQ ID NO: 49915 - protein, 8 aa, Borrelia burgdorferi
TKEDLEKN

SEQ ID NO: 49916 - protein, 8 aa, Borrelia burgdorferi
KEDLEKNF

SEQ ID NO: 49917 - protein, 8 aa, Borrelia burgdorferi
EDLEKNFK

SEQ ID NO: 49918 - protein, 8 aa, Borrelia burgdorferi
DLEKNFKT

SEQ ID NO: 49919 - protein, 8 aa, Borrelia burgdorferi
LEKNFKTL

SEQ ID NO: 49920 - protein, 8 aa, Borrelia burgdorferi
EKNFKTLL

SEQ ID NO: 49921 - protein, 8 aa, Borrelia burgdorferi
KNFKTLLN

SEQ ID NO: 49922 - protein, 8 aa, Borrelia burgdorferi
NFKTLLNY

SEQ ID NO: 49923 - protein, 8 aa, Borrelia burgdorferi
FKTLLNYI

SEQ ID NO: 49924 - protein, 8 aa, Borrelia burgdorferi
KTLLNYIQ

SEQ ID NO: 49925 - protein, 8 aa, Borrelia burgdorferi
TLLNYIQV

SEQ ID NO: 49926 - protein, 8 aa, Borrelia burgdorferi
LLNYIQVS

SEQ ID NO: 49927 - protein, 8 aa, Borrelia burgdorferi
LNYIQVSV

SEQ ID NO: 49928 - protein, 8 aa, Borrelia burgdorferi
NYIQVSVK

SEQ ID NO: 49929 - protein, 8 aa, Borrelia burgdorferi
YIQVSVKT

SEQ ID NO: 49930 - protein, 8 aa, Borrelia burgdorferi
IQVSVKTA

SEQ ID NO: 49931 - protein, 8 aa, Borrelia burgdorferi
QVSVKTAA

SEQ ID NO: 49932 - protein, 8 aa, Borrelia burgdorferi
VSVKTAAN

SEQ ID NO: 49933 - protein, 8 aa, Borrelia burgdorferi
SVKTAANF

SEQ ID NO: 49934 - protein, 8 aa, Borrelia burgdorferi
VKTAANFV

SEQ ID NO: 49935 - protein, 8 aa, Borrelia burgdorferi
KTAANFVY

SEQ ID NO: 49936 - protein, 8 aa, Borrelia burgdorferi
TAANFVYI

SEQ ID NO: 49937 - protein, 8 aa, Borrelia burgdorferi
AANFVYIN

SEQ ID NO: 49938 - protein, 8 aa, Borrelia burgdorferi
ANFVYIND

SEQ ID NO: 49939 - protein, 8 aa, Borrelia burgdorferi
NFVYINDT

SEQ ID NO: 49940 - protein, 8 aa, Borrelia burgdorferi
FVYINDTH

SEQ ID NO: 49941 - protein, 8 aa, Borrelia burgdorferi
VYINDTHA

SEQ ID NO: 49942 - protein, 8 aa, Borrelia burgdorferi
YINDTHAK

SEQ ID NO: 49943 - protein, 8 aa, Borrelia burgdorferi
INDTHAKR

SEQ ID NO: 49944 - protein, 8 aa, Borrelia burgdorferi
NDTHAKRK

SEQ ID NO: 49945 - protein, 8 aa, Borrelia burgdorferi
DTHAKRKL

SEQ ID NO: 49946 - protein, 8 aa, Borrelia burgdorferi
THAKRKLE

SEQ ID NO: 49947 - protein, 8 aa, Borrelia burgdorferi
HAKRKLEN

SEQ ID NO: 49948 - protein, 8 aa, Borrelia burgdorferi
AKRKLENI

SEQ ID NO: 49949 - protein, 8 aa, Borrelia burgdorferi
KRKLENIE

SEQ ID NO: 49950 - protein, 8 aa, Borrelia burgdorferi
RKLENIEA

SEQ ID NO: 49951 - protein, 8 aa, Borrelia burgdorferi
KLENIEAE

SEQ ID NO: 49952 - protein, 8 aa, Borrelia burgdorferi
LENIEAEI

SEQ ID NO: 49953 - protein, 8 aa, Borrelia burgdorferi
ENIEAEIK

SEQ ID NO: 49954 - protein, 8 aa, Borrelia burgdorferi
NIEAEIKT

SEQ ID NO: 49955 - protein, 8 aa, Borrelia burgdorferi
IEAEIKTL

SEQ ID NO: 49956 - protein, 8 aa, Borrelia burgdorferi
EAEIKTLI

SEQ ID NO: 49957 - protein, 8 aa, Borrelia burgdorferi
AEIKTLIA

SEQ ID NO: 49958 - protein, 8 aa, Borrelia burgdorferi
EIKTLIAK

SEQ ID NO: 49959 - protein, 8 aa, Borrelia burgdorferi
IKTLIAKI

SEQ ID NO: 49960 - protein, 8 aa, Borrelia burgdorferi
KTLIAKIK

SEQ ID NO: 49961 - protein, 8 aa, Borrelia burgdorferi
TLIAKIKE

SEQ ID NO: 49962 - protein, 8 aa, Borrelia burgdorferi
LIAKIKEQ

SEQ ID NO: 49963 - protein, 8 aa, Borrelia burgdorferi
IAKIKEQS

SEQ ID NO: 49964 - protein, 8 aa, Borrelia burgdorferi
AKIKEQSN

SEQ ID NO: 49965 - protein, 8 aa, Borrelia burgdorferi
KIKEQSNL

SEQ ID NO: 49966 - protein, 8 aa, Borrelia burgdorferi
IKEQSNLY

SEQ ID NO: 49967 - protein, 8 aa, Borrelia burgdorferi
KEQSNLYE

SEQ ID NO: 49968 - protein, 8 aa, Borrelia burgdorferi
EQSNLYEA

SEQ ID NO: 49969 - protein, 8 aa, Borrelia burgdorferi
QSNLYEAY

SEQ ID NO: 49970 - protein, 8 aa, Borrelia burgdorferi
SNLYEAYK

SEQ ID NO: 49971 - protein, 8 aa, Borrelia burgdorferi
NLYEAYKA

SEQ ID NO: 49972 - protein, 8 aa, Borrelia burgdorferi
LYEAYKAI

SEQ ID NO: 49973 - protein, 8 aa, Borrelia burgdorferi
YEAYKAIV

SEQ ID NO: 49974 - protein, 8 aa, Borrelia burgdorferi
EAYKAIVT

SEQ ID NO: 49975 - protein, 8 aa, Borrelia burgdorferi
AYKAIVTS

SEQ ID NO: 49976 - protein, 8 aa, Borrelia burgdorferi
YKAIVTSI

SEQ ID NO: 49977 - protein, 8 aa, Borrelia burgdorferi
KAIVTSIL

SEQ ID NO: 49978 - protein, 8 aa, Borrelia burgdorferi
AIVTSILL

SEQ ID NO: 49979 - protein, 8 aa, Borrelia burgdorferi
IVTSILLM

SEQ ID NO: 49980 - protein, 8 aa, Borrelia burgdorferi
VTSILLMR

SEQ ID NO: 49981 - protein, 8 aa, Borrelia burgdorferi
TSILLMRD

SEQ ID NO: 49982 - protein, 8 aa, Borrelia burgdorferi
SILLMRDS

SEQ ID NO: 49983 - protein, 8 aa, Borrelia burgdorferi
ILLMRDSL

SEQ ID NO: 49984 - protein, 8 aa, Borrelia burgdorferi
LLMRDSLK

SEQ ID NO: 49985 - protein, 8 aa, Borrelia burgdorferi
LMRDSLKE

SEQ ID NO: 49986 - protein, 8 aa, Borrelia burgdorferi
MRDSLKEV

SEQ ID NO: 49987 - protein, 8 aa, Borrelia burgdorferi
RDSLKEVQ

SEQ ID NO: 49988 - protein, 8 aa, Borrelia burgdorferi
DSLKEVQG

SEQ ID NO: 49989 - protein, 8 aa, Borrelia burgdorferi
SLKEVQGI

SEQ ID NO: 49990 - protein, 8 aa, Borrelia burgdorferi
LKEVQGII

SEQ ID NO: 49991 - protein, 8 aa, Borrelia burgdorferi
KEVQGIID

SEQ ID NO: 49992 - protein, 8 aa, Borrelia burgdorferi
EVQGIIDK

SEQ ID NO: 49993 - protein, 8 aa, Borrelia burgdorferi
VQGIIDKN

SEQ ID NO: 49994 - protein, 8 aa, Borrelia burgdorferi
QGIIDKNG

SEQ ID NO: 49995 - protein, 8 aa, Borrelia burgdorferi
GIIDKNGV

SEQ ID NO: 49996 - protein, 8 aa, Borrelia burgdorferi
IIDKNGVW

SEQ ID NO: 49997 - protein, 8 aa, Borrelia burgdorferi
IDKNGVWY

SEQ ID NO: 49998 - protein, 9 aa, Borrelia burgdorferi
MKKVKSKYL

SEQ ID NO: 49999 - protein, 9 aa, Borrelia burgdorferi
KKVKSKYLA

SEQ ID NO: 50000 - protein, 9 aa, Borrelia burgdorferi
KVKSKYLAL

SEQ ID NO: 50001 - protein, 9 aa, Borrelia burgdorferi
VKSKYLALG

SEQ ID NO: 50002 - protein, 9 aa, Borrelia burgdorferi
KSKYLALGL

SEQ ID NO: 50003 - protein, 9 aa, Borrelia burgdorferi
SKYLALGLL

SEQ ID NO: 50004 - protein, 9 aa, Borrelia burgdorferi
KYLALGLLF

SEQ ID NO: 50005 - protein, 9 aa, Borrelia burgdorferi
YLALGLLFG

SEQ ID NO: 50006 - protein, 9 aa, Borrelia burgdorferi
LALGLLFGF

SEQ ID NO: 50007 - protein, 9 aa, Borrelia burgdorferi
ALGLLFGFI

SEQ ID NO: 50008 - protein, 9 aa, Borrelia burgdorferi
LGLLFGFIS

SEQ ID NO: 50009 - protein, 9 aa, Borrelia burgdorferi
GLLFGFISC

SEQ ID NO: 50010 - protein, 9 aa, Borrelia burgdorferi
LLFGFISCD

SEQ ID NO: 50011 - protein, 9 aa, Borrelia burgdorferi
LFGFISCDL

SEQ ID NO: 50012 - protein, 9 aa, Borrelia burgdorferi
FGFISCDLF

SEQ ID NO: 50013 - protein, 9 aa, Borrelia burgdorferi
GFISCDLFI

SEQ ID NO: 50014 - protein, 9 aa, Borrelia burgdorferi
FISCDLFIR

SEQ ID NO: 50015 - protein, 9 aa, Borrelia burgdorferi
ISCDLFIRY

SEQ ID NO: 50016 - protein, 9 aa, Borrelia burgdorferi
SCDLFIRYE

SEQ ID NO: 50017 - protein, 9 aa, Borrelia burgdorferi
CDLFIRYEM

SEQ ID NO: 50018 - protein, 9 aa, Borrelia burgdorferi
DLFIRYEMK

SEQ ID NO: 50019 - protein, 9 aa, Borrelia burgdorferi
LFIRYEMKE

SEQ ID NO: 50020 - protein, 9 aa, Borrelia burgdorferi
FIRYEMKEE

SEQ ID NO: 50021 - protein, 9 aa, Borrelia burgdorferi
IRYEMKEES

SEQ ID NO: 50022 - protein, 9 aa, Borrelia burgdorferi
RYEMKEESP

SEQ ID NO: 50023 - protein, 9 aa, Borrelia burgdorferi
YEMKEESPG

SEQ ID NO: 50024 - protein, 9 aa, Borrelia burgdorferi
EMKEESPGL

SEQ ID NO: 50025 - protein, 9 aa, Borrelia burgdorferi
MKEESPGLF

SEQ ID NO: 50026 - protein, 9 aa, Borrelia burgdorferi
KEESPGLFD

SEQ ID NO: 50027 - protein, 9 aa, Borrelia burgdorferi
EESPGLFDK

SEQ ID NO: 50028 - protein, 9 aa, Borrelia burgdorferi
ESPGLFDKG

SEQ ID NO: 50029 - protein, 9 aa, Borrelia burgdorferi
SPGLFDKGN

SEQ ID NO: 50030 - protein, 9 aa, Borrelia burgdorferi
PGLFDKGNS

SEQ ID NO: 50031 - protein, 9 aa, Borrelia burgdorferi
GLFDKGNSI

SEQ ID NO: 50032 - protein, 9 aa, Borrelia burgdorferi
LFDKGNSIL

SEQ ID NO: 50033 - protein, 9 aa, Borrelia burgdorferi
FDKGNSILE

SEQ ID NO: 50034 - protein, 9 aa, Borrelia burgdorferi
DKGNSILET

SEQ ID NO: 50035 - protein, 9 aa, Borrelia burgdorferi
KGNSILETS

SEQ ID NO: 50036 - protein, 9 aa, Borrelia burgdorferi
GNSILETSE

SEQ ID NO: 50037 - protein, 9 aa, Borrelia burgdorferi
NSILETSEE

SEQ ID NO: 50038 - protein, 9 aa, Borrelia burgdorferi
SILETSEES

SEQ ID NO: 50039 - protein, 9 aa, Borrelia burgdorferi
ILETSEESI

SEQ ID NO: 50040 - protein, 9 aa, Borrelia burgdorferi
LETSEESIK

SEQ ID NO: 50041 - protein, 9 aa, Borrelia burgdorferi
ETSEESIKK

SEQ ID NO: 50042 - protein, 9 aa, Borrelia burgdorferi
TSEESIKKP

SEQ ID NO: 50043 - protein, 9 aa, Borrelia burgdorferi
SEESIKKPM

SEQ ID NO: 50044 - protein, 9 aa, Borrelia burgdorferi
EESIKKPMN

SEQ ID NO: 50045 - protein, 9 aa, Borrelia burgdorferi
ESIKKPMNK

SEQ ID NO: 50046 - protein, 9 aa, Borrelia burgdorferi
SIKKPMNKK

SEQ ID NO: 50047 - protein, 9 aa, Borrelia burgdorferi
IKKPMNKKG

SEQ ID NO: 50048 - protein, 9 aa, Borrelia burgdorferi
KKPMNKKGK

SEQ ID NO: 50049 - protein, 9 aa, Borrelia burgdorferi
KPMNKKGKG

SEQ ID NO: 50050 - protein, 9 aa, Borrelia burgdorferi
PMNKKGKGK

SEQ ID NO: 50051 - protein, 9 aa, Borrelia burgdorferi
MNKKGKGKI

SEQ ID NO: 50052 - protein, 9 aa, Borrelia burgdorferi
NKKGKGKIA

SEQ ID NO: 50053 - protein, 9 aa, Borrelia burgdorferi
KKGKGKIAR

SEQ ID NO: 50054 - protein, 9 aa, Borrelia burgdorferi
KGKGKIARK

SEQ ID NO: 50055 - protein, 9 aa, Borrelia burgdorferi
GKGKIARKK

SEQ ID NO: 50056 - protein, 9 aa, Borrelia burgdorferi
KGKIARKKG

SEQ ID NO: 50057 - protein, 9 aa, Borrelia burgdorferi
GKIARKKGK

SEQ ID NO: 50058 - protein, 9 aa, Borrelia burgdorferi
KIARKKGKS

SEQ ID NO: 50059 - protein, 9 aa, Borrelia burgdorferi
IARKKGKSK

SEQ ID NO: 50060 - protein, 9 aa, Borrelia burgdorferi
ARKKGKSKV

SEQ ID NO: 50061 - protein, 9 aa, Borrelia burgdorferi
RKKGKSKVS

SEQ ID NO: 50062 - protein, 9 aa, Borrelia burgdorferi
KKGKSKVSR

SEQ ID NO: 50063 - protein, 9 aa, Borrelia burgdorferi
KGKSKVSRK

SEQ ID NO: 50064 - protein, 9 aa, Borrelia burgdorferi
GKSKVSRKE

SEQ ID NO: 50065 - protein, 9 aa, Borrelia burgdorferi
KSKVSRKEP

SEQ ID NO: 50066 - protein, 9 aa, Borrelia burgdorferi
SKVSRKEPY

SEQ ID NO: 50067 - protein, 9 aa, Borrelia burgdorferi
KVSRKEPYI

SEQ ID NO: 50068 - protein, 9 aa, Borrelia burgdorferi
VSRKEPYIH

SEQ ID NO: 50069 - protein, 9 aa, Borrelia burgdorferi
SRKEPYIHS

SEQ ID NO: 50070 - protein, 9 aa, Borrelia burgdorferi
RKEPYIHSL

SEQ ID NO: 50071 - protein, 9 aa, Borrelia burgdorferi
KEPYIHSLK

SEQ ID NO: 50072 - protein, 9 aa, Borrelia burgdorferi
EPYIHSLKR

SEQ ID NO: 50073 - protein, 9 aa, Borrelia burgdorferi
PYIHSLKRD

SEQ ID NO: 50074 - protein, 9 aa, Borrelia burgdorferi
YIHSLKRDS

SEQ ID NO: 50075 - protein, 9 aa, Borrelia burgdorferi
IHSLKRDSA

SEQ ID NO: 50076 - protein, 9 aa, Borrelia burgdorferi
HSLKRDSAN

SEQ ID NO: 50077 - protein, 9 aa, Borrelia burgdorferi
SLKRDSANK

SEQ ID NO: 50078 - protein, 9 aa, Borrelia burgdorferi
LKRDSANKS

SEQ ID NO: 50079 - protein, 9 aa, Borrelia burgdorferi
KRDSANKSN

SEQ ID NO: 50080 - protein, 9 aa, Borrelia burgdorferi
RDSANKSNF

SEQ ID NO: 50081 - protein, 9 aa, Borrelia burgdorferi
DSANKSNFL

SEQ ID NO: 50082 - protein, 9 aa, Borrelia burgdorferi
SANKSNFLQ

SEQ ID NO: 50083 - protein, 9 aa, Borrelia burgdorferi
ANKSNFLQK

SEQ ID NO: 50084 - protein, 9 aa, Borrelia burgdorferi
NKSNFLQKN

SEQ ID NO: 50085 - protein, 9 aa, Borrelia burgdorferi
KSNFLQKNV

SEQ ID NO: 50086 - protein, 9 aa, Borrelia burgdorferi
SNFLQKNVI

SEQ ID NO: 50087 - protein, 9 aa, Borrelia burgdorferi
NFLQKNVIL

SEQ ID NO: 50088 - protein, 9 aa, Borrelia burgdorferi
FLQKNVILE

SEQ ID NO: 50089 - protein, 9 aa, Borrelia burgdorferi
LQKNVILEE

SEQ ID NO: 50090 - protein, 9 aa, Borrelia burgdorferi
QKNVILEEE

SEQ ID NO: 50091 - protein, 9 aa, Borrelia burgdorferi
KNVILEEES

SEQ ID NO: 50092 - protein, 9 aa, Borrelia burgdorferi
NVILEEESL

SEQ ID NO: 50093 - protein, 9 aa, Borrelia burgdorferi
VILEEESLK

SEQ ID NO: 50094 - protein, 9 aa, Borrelia burgdorferi
ILEEESLKT

SEQ ID NO: 50095 - protein, 9 aa, Borrelia burgdorferi
LEEESLKTE

SEQ ID NO: 50096 - protein, 9 aa, Borrelia burgdorferi
EEESLKTEL

SEQ ID NO: 50097 - protein, 9 aa, Borrelia burgdorferi
EESLKTELL

SEQ ID NO: 50098 - protein, 9 aa, Borrelia burgdorferi
ESLKTELLK

SEQ ID NO: 50099 - protein, 9 aa, Borrelia burgdorferi
SLKTELLKE

SEQ ID NO: 50100 - protein, 9 aa, Borrelia burgdorferi
LKTELLKEQ

SEQ ID NO: 50101 - protein, 9 aa, Borrelia burgdorferi
KTELLKEQS

SEQ ID NO: 50102 - protein, 9 aa, Borrelia burgdorferi
TELLKEQSE

SEQ ID NO: 50103 - protein, 9 aa, Borrelia burgdorferi
ELLKEQSET

SEQ ID NO: 50104 - protein, 9 aa, Borrelia burgdorferi
LLKEQSETR

SEQ ID NO: 50105 - protein, 9 aa, Borrelia burgdorferi
LKEQSETRK

SEQ ID NO: 50106 - protein, 9 aa, Borrelia burgdorferi
KEQSETRKE

SEQ ID NO: 50107 - protein, 9 aa, Borrelia burgdorferi
EQSETRKEK

SEQ ID NO: 50108 - protein, 9 aa, Borrelia burgdorferi
QSETRKEKI

SEQ ID NO: 50109 - protein, 9 aa, Borrelia burgdorferi
SETRKEKIQ

SEQ ID NO: 50110 - protein, 9 aa, Borrelia burgdorferi
ETRKEKIQK

SEQ ID NO: 50111 - protein, 9 aa, Borrelia burgdorferi
TRKEKIQKQ

SEQ ID NO: 50112 - protein, 9 aa, Borrelia burgdorferi
RKEKIQKQQ

SEQ ID NO: 50113 - protein, 9 aa, Borrelia burgdorferi
KEKIQKQQD

SEQ ID NO: 50114 - protein, 9 aa, Borrelia burgdorferi
EKIQKQQDE

SEQ ID NO: 50115 - protein, 9 aa, Borrelia burgdorferi
KIQKQQDEY

SEQ ID NO: 50116 - protein, 9 aa, Borrelia burgdorferi
IQKQQDEYK

SEQ ID NO: 50117 - protein, 9 aa, Borrelia burgdorferi
QKQQDEYKG

SEQ ID NO: 50118 - protein, 9 aa, Borrelia burgdorferi
KQQDEYKGM

SEQ ID NO: 50119 - protein, 9 aa, Borrelia burgdorferi
QQDEYKGMT

SEQ ID NO: 50120 - protein, 9 aa, Borrelia burgdorferi
QDEYKGMTQ

SEQ ID NO: 50121 - protein, 9 aa, Borrelia burgdorferi
DEYKGMTQG

SEQ ID NO: 50122 - protein, 9 aa, Borrelia burgdorferi
EYKGMTQGS

SEQ ID NO: 50123 - protein, 9 aa, Borrelia burgdorferi
YKGMTQGSL

SEQ ID NO: 50124 - protein, 9 aa, Borrelia burgdorferi
KGMTQGSLN

SEQ ID NO: 50125 - protein, 9 aa, Borrelia burgdorferi
GMTQGSLNS

SEQ ID NO: 50126 - protein, 9 aa, Borrelia burgdorferi
MTQGSLNSL

SEQ ID NO: 50127 - protein, 9 aa, Borrelia burgdorferi
TQGSLNSLS

SEQ ID NO: 50128 - protein, 9 aa, Borrelia burgdorferi
QGSLNSLSG

SEQ ID NO: 50129 - protein, 9 aa, Borrelia burgdorferi
GSLNSLSGE

SEQ ID NO: 50130 - protein, 9 aa, Borrelia burgdorferi
SLNSLSGES

SEQ ID NO: 50131 - protein, 9 aa, Borrelia burgdorferi
LNSLSGESG

SEQ ID NO: 50132 - protein, 9 aa, Borrelia burgdorferi
NSLSGESGE

SEQ ID NO: 50133 - protein, 9 aa, Borrelia burgdorferi
SLSGESGEL

SEQ ID NO: 50134 - protein, 9 aa, Borrelia burgdorferi
LSGESGELK

SEQ ID NO: 50135 - protein, 9 aa, Borrelia burgdorferi
SGESGELKE

SEQ ID NO: 50136 - protein, 9 aa, Borrelia burgdorferi
GESGELKET

SEQ ID NO: 50137 - protein, 9 aa, Borrelia burgdorferi
ESGELKETI

SEQ ID NO: 50138 - protein, 9 aa, Borrelia burgdorferi
SGELKETIE

SEQ ID NO: 50139 - protein, 9 aa, Borrelia burgdorferi
GELKETIES

SEQ ID NO: 50140 - protein, 9 aa, Borrelia burgdorferi
ELKETIESN

SEQ ID NO: 50141 - protein, 9 aa, Borrelia burgdorferi
LKETIESNE

SEQ ID NO: 50142 - protein, 9 aa, Borrelia burgdorferi
KETIESNEI

SEQ ID NO: 50143 - protein, 9 aa, Borrelia burgdorferi
ETIESNEID

SEQ ID NO: 50144 - protein, 9 aa, Borrelia burgdorferi
TIESNEIDI

SEQ ID NO: 50145 - protein, 9 aa, Borrelia burgdorferi
IESNEIDIT

SEQ ID NO: 50146 - protein, 9 aa, Borrelia burgdorferi
ESNEIDITI

SEQ ID NO: 50147 - protein, 9 aa, Borrelia burgdorferi
SNEIDITID

SEQ ID NO: 50148 - protein, 9 aa, Borrelia burgdorferi
NEIDITIDS

SEQ ID NO: 50149 - protein, 9 aa, Borrelia burgdorferi
EIDITIDSD

SEQ ID NO: 50150 - protein, 9 aa, Borrelia burgdorferi
IDITIDSDL

SEQ ID NO: 50151 - protein, 9 aa, Borrelia burgdorferi
DITIDSDLR

SEQ ID NO: 50152 - protein, 9 aa, Borrelia burgdorferi
ITIDSDLRP

SEQ ID NO: 50153 - protein, 9 aa, Borrelia burgdorferi
TIDSDLRPK

SEQ ID NO: 50154 - protein, 9 aa, Borrelia burgdorferi
IDSDLRPKS

SEQ ID NO: 50155 - protein, 9 aa, Borrelia burgdorferi
DSDLRPKSS

SEQ ID NO: 50156 - protein, 9 aa, Borrelia burgdorferi
SDLRPKSSL

SEQ ID NO: 50157 - protein, 9 aa, Borrelia burgdorferi
DLRPKSSLQ

SEQ ID NO: 50158 - protein, 9 aa, Borrelia burgdorferi
LRPKSSLQD

SEQ ID NO: 50159 - protein, 9 aa, Borrelia burgdorferi
RPKSSLQDI

SEQ ID NO: 50160 - protein, 9 aa, Borrelia burgdorferi
PKSSLQDIA

SEQ ID NO: 50161 - protein, 9 aa, Borrelia burgdorferi
KSSLQDIAG

SEQ ID NO: 50162 - protein, 9 aa, Borrelia burgdorferi
SSLQDIAGS

SEQ ID NO: 50163 - protein, 9 aa, Borrelia burgdorferi
SLQDIAGSN

SEQ ID NO: 50164 - protein, 9 aa, Borrelia burgdorferi
LQDIAGSNS

SEQ ID NO: 50165 - protein, 9 aa, Borrelia burgdorferi
QDIAGSNSI

SEQ ID NO: 50166 - protein, 9 aa, Borrelia burgdorferi
DIAGSNSIS

SEQ ID NO: 50167 - protein, 9 aa, Borrelia burgdorferi
IAGSNSISY

SEQ ID NO: 50168 - protein, 9 aa, Borrelia burgdorferi
AGSNSISYT

SEQ ID NO: 50169 - protein, 9 aa, Borrelia burgdorferi
GSNSISYTD

SEQ ID NO: 50170 - protein, 9 aa, Borrelia burgdorferi
SNSISYTDE

SEQ ID NO: 50171 - protein, 9 aa, Borrelia burgdorferi
NSISYTDEI

SEQ ID NO: 50172 - protein, 9 aa, Borrelia burgdorferi
SISYTDEIE

SEQ ID NO: 50173 - protein, 9 aa, Borrelia burgdorferi
ISYTDEIEE

SEQ ID NO: 50174 - protein, 9 aa, Borrelia burgdorferi
SYTDEIEEE

SEQ ID NO: 50175 - protein, 9 aa, Borrelia burgdorferi
YTDEIEEED

SEQ ID NO: 50176 - protein, 9 aa, Borrelia burgdorferi
TDEIEEEDY

SEQ ID NO: 50177 - protein, 9 aa, Borrelia burgdorferi
DEIEEEDYA

SEQ ID NO: 50178 - protein, 9 aa, Borrelia burgdorferi
EIEEEDYAR

SEQ ID NO: 50179 - protein, 9 aa, Borrelia burgdorferi
IEEEDYARY

SEQ ID NO: 50180 - protein, 9 aa, Borrelia burgdorferi
EEEDYARYY

SEQ ID NO: 50181 - protein, 9 aa, Borrelia burgdorferi
EEDYARYYL

SEQ ID NO: 50182 - protein, 9 aa, Borrelia burgdorferi
EDYARYYLD

SEQ ID NO: 50183 - protein, 9 aa, Borrelia burgdorferi
DYARYYLDE

SEQ ID NO: 50184 - protein, 9 aa, Borrelia burgdorferi
YARYYLDED

SEQ ID NO: 50185 - protein, 9 aa, Borrelia burgdorferi
ARYYLDEDD

SEQ ID NO: 50186 - protein, 9 aa, Borrelia burgdorferi
RYYLDEDDE

SEQ ID NO: 50187 - protein, 9 aa, Borrelia burgdorferi
YYLDEDDED

SEQ ID NO: 50188 - protein, 9 aa, Borrelia burgdorferi
YLDEDDEDD

SEQ ID NO: 50189 - protein, 9 aa, Borrelia burgdorferi
LDEDDEDDE

SEQ ID NO: 50190 - protein, 9 aa, Borrelia burgdorferi
DEDDEDDEY

SEQ ID NO: 50191 - protein, 9 aa, Borrelia burgdorferi
EDDEDDEYY

SEQ ID NO: 50192 - protein, 9 aa, Borrelia burgdorferi
DDEDDEYYE

SEQ ID NO: 50193 - protein, 9 aa, Borrelia burgdorferi
DEDDEYYED

SEQ ID NO: 50194 - protein, 9 aa, Borrelia burgdorferi
EDDEYYEDD

SEQ ID NO: 50195 - protein, 9 aa, Borrelia burgdorferi
DDEYYEDDY

SEQ ID NO: 50196 - protein, 9 aa, Borrelia burgdorferi
DEYYEDDYE

SEQ ID NO: 50197 - protein, 9 aa, Borrelia burgdorferi
EYYEDDYEE

SEQ ID NO: 50198 - protein, 9 aa, Borrelia burgdorferi
YYEDDYEEI

SEQ ID NO: 50199 - protein, 9 aa, Borrelia burgdorferi
YEDDYEEIR

SEQ ID NO: 50200 - protein, 9 aa, Borrelia burgdorferi
EDDYEEIRL

SEQ ID NO: 50201 - protein, 9 aa, Borrelia burgdorferi
DDYEEIRLS

SEQ ID NO: 50202 - protein, 9 aa, Borrelia burgdorferi
DYEEIRLSN

SEQ ID NO: 50203 - protein, 9 aa, Borrelia burgdorferi
YEEIRLSNR

SEQ ID NO: 50204 - protein, 9 aa, Borrelia burgdorferi
EEIRLSNRY

SEQ ID NO: 50205 - protein, 9 aa, Borrelia burgdorferi
EIRLSNRYQ

SEQ ID NO: 50206 - protein, 9 aa, Borrelia burgdorferi
IRLSNRYQS

SEQ ID NO: 50207 - protein, 9 aa, Borrelia burgdorferi
RLSNRYQSY

SEQ ID NO: 50208 - protein, 9 aa, Borrelia burgdorferi
LSNRYQSYL

SEQ ID NO: 50209 - protein, 9 aa, Borrelia burgdorferi
SNRYQSYLE

SEQ ID NO: 50210 - protein, 9 aa, Borrelia burgdorferi
NRYQSYLEG

SEQ ID NO: 50211 - protein, 9 aa, Borrelia burgdorferi
RYQSYLEGV

SEQ ID NO: 50212 - protein, 9 aa, Borrelia burgdorferi
YQSYLEGVK

SEQ ID NO: 50213 - protein, 9 aa, Borrelia burgdorferi
QSYLEGVKY

SEQ ID NO: 50214 - protein, 9 aa, Borrelia burgdorferi
SYLEGVKYN

SEQ ID NO: 50215 - protein, 9 aa, Borrelia burgdorferi
YLEGVKYNV

SEQ ID NO: 50216 - protein, 9 aa, Borrelia burgdorferi
LEGVKYNVD

SEQ ID NO: 50217 - protein, 9 aa, Borrelia burgdorferi
EGVKYNVDS

SEQ ID NO: 50218 - protein, 9 aa, Borrelia burgdorferi
GVKYNVDSA

SEQ ID NO: 50219 - protein, 9 aa, Borrelia burgdorferi
VKYNVDSAI

SEQ ID NO: 50220 - protein, 9 aa, Borrelia burgdorferi
KYNVDSAIN

SEQ ID NO: 50221 - protein, 9 aa, Borrelia burgdorferi
YNVDSAINT

SEQ ID NO: 50222 - protein, 9 aa, Borrelia burgdorferi
NVDSAINTI

SEQ ID NO: 50223 - protein, 9 aa, Borrelia burgdorferi
VDSAINTIN

SEQ ID NO: 50224 - protein, 9 aa, Borrelia burgdorferi
DSAINTINK

SEQ ID NO: 50225 - protein, 9 aa, Borrelia burgdorferi
SAINTINKI

SEQ ID NO: 50226 - protein, 9 aa, Borrelia burgdorferi
AINTINKIY

SEQ ID NO: 50227 - protein, 9 aa, Borrelia burgdorferi
INTINKIYD

SEQ ID NO: 50228 - protein, 9 aa, Borrelia burgdorferi
NTINKIYDT

SEQ ID NO: 50229 - protein, 9 aa, Borrelia burgdorferi
TINKIYDTY

SEQ ID NO: 50230 - protein, 9 aa, Borrelia burgdorferi
INKIYDTYT

SEQ ID NO: 50231 - protein, 9 aa, Borrelia burgdorferi
NKIYDTYTL

SEQ ID NO: 50232 - protein, 9 aa, Borrelia burgdorferi
KIYDTYTLF

SEQ ID NO: 50233 - protein, 9 aa, Borrelia burgdorferi
IYDTYTLFS

SEQ ID NO: 50234 - protein, 9 aa, Borrelia burgdorferi
YDTYTLFST

SEQ ID NO: 50235 - protein, 9 aa, Borrelia burgdorferi
DTYTLFSTK

SEQ ID NO: 50236 - protein, 9 aa, Borrelia burgdorferi
TYTLFSTKL

SEQ ID NO: 50237 - protein, 9 aa, Borrelia burgdorferi
YTLFSTKLT

SEQ ID NO: 50238 - protein, 9 aa, Borrelia burgdorferi
TLFSTKLTQ

SEQ ID NO: 50239 - protein, 9 aa, Borrelia burgdorferi
LFSTKLTQM

SEQ ID NO: 50240 - protein, 9 aa, Borrelia burgdorferi
FSTKLTQMY

SEQ ID NO: 50241 - protein, 9 aa, Borrelia burgdorferi
STKLTQMYS

SEQ ID NO: 50242 - protein, 9 aa, Borrelia burgdorferi
TKLTQMYST

SEQ ID NO: 50243 - protein, 9 aa, Borrelia burgdorferi
KLTQMYSTR

SEQ ID NO: 50244 - protein, 9 aa, Borrelia burgdorferi
LTQMYSTRL

SEQ ID NO: 50245 - protein, 9 aa, Borrelia burgdorferi
TQMYSTRLD

SEQ ID NO: 50246 - protein, 9 aa, Borrelia burgdorferi
QMYSTRLDN

SEQ ID NO: 50247 - protein, 9 aa, Borrelia burgdorferi
MYSTRLDNL

SEQ ID NO: 50248 - protein, 9 aa, Borrelia burgdorferi
YSTRLDNLA

SEQ ID NO: 50249 - protein, 9 aa, Borrelia burgdorferi
STRLDNLAK

SEQ ID NO: 50250 - protein, 9 aa, Borrelia burgdorferi
TRLDNLAKA

SEQ ID NO: 50251 - protein, 9 aa, Borrelia burgdorferi
RLDNLAKAK

SEQ ID NO: 50252 - protein, 9 aa, Borrelia burgdorferi
LDNLAKAKA

SEQ ID NO: 50253 - protein, 9 aa, Borrelia burgdorferi
DNLAKAKAK

SEQ ID NO: 50254 - protein, 9 aa, Borrelia burgdorferi
NLAKAKAKE

SEQ ID NO: 50255 - protein, 9 aa, Borrelia burgdorferi
LAKAKAKEE

SEQ ID NO: 50256 - protein, 9 aa, Borrelia burgdorferi
AKAKAKEEA

SEQ ID NO: 50257 - protein, 9 aa, Borrelia burgdorferi
KAKAKEEAA

SEQ ID NO: 50258 - protein, 9 aa, Borrelia burgdorferi
AKAKEEAAK

SEQ ID NO: 50259 - protein, 9 aa, Borrelia burgdorferi
KAKEEAAKF

SEQ ID NO: 50260 - protein, 9 aa, Borrelia burgdorferi
AKEEAAKFT

SEQ ID NO: 50261 - protein, 9 aa, Borrelia burgdorferi
KEEAAKFTK

SEQ ID NO: 50262 - protein, 9 aa, Borrelia burgdorferi
EEAAKFTKE

SEQ ID NO: 50263 - protein, 9 aa, Borrelia burgdorferi
EAAKFTKED

SEQ ID NO: 50264 - protein, 9 aa, Borrelia burgdorferi
AAKFTKEDL

SEQ ID NO: 50265 - protein, 9 aa, Borrelia burgdorferi
AKFTKEDLE

SEQ ID NO: 50266 - protein, 9 aa, Borrelia burgdorferi
KFTKEDLEK

SEQ ID NO: 50267 - protein, 9 aa, Borrelia burgdorferi
FTKEDLEKN

SEQ ID NO: 50268 - protein, 9 aa, Borrelia burgdorferi
TKEDLEKNF

SEQ ID NO: 50269 - protein, 9 aa, Borrelia burgdorferi
KEDLEKNFK

SEQ ID NO: 50270 - protein, 9 aa, Borrelia burgdorferi
EDLEKNFKT

SEQ ID NO: 50271 - protein, 9 aa, Borrelia burgdorferi
DLEKNFKTL

SEQ ID NO: 50272 - protein, 9 aa, Borrelia burgdorferi
LEKNFKTLL

SEQ ID NO: 50273 - protein, 9 aa, Borrelia burgdorferi
EKNFKTLLN

SEQ ID NO: 50274 - protein, 9 aa, Borrelia burgdorferi
KNFKTLLNY

SEQ ID NO: 50275 - protein, 9 aa, Borrelia burgdorferi
NFKTLLNYI

SEQ ID NO: 50276 - protein, 9 aa, Borrelia burgdorferi
FKTLLNYIQ

SEQ ID NO: 50277 - protein, 9 aa, Borrelia burgdorferi
KTLLNYIQV

SEQ ID NO: 50278 - protein, 9 aa, Borrelia burgdorferi
TLLNYIQVS

SEQ ID NO: 50279 - protein, 9 aa, Borrelia burgdorferi
LLNYIQVSV

SEQ ID NO: 50280 - protein, 9 aa, Borrelia burgdorferi
LNYIQVSVK

SEQ ID NO: 50281 - protein, 9 aa, Borrelia burgdorferi
NYIQVSVKT

SEQ ID NO: 50282 - protein, 9 aa, Borrelia burgdorferi
YIQVSVKTA

SEQ ID NO: 50283 - protein, 9 aa, Borrelia burgdorferi
IQVSVKTAA

SEQ ID NO: 50284 - protein, 9 aa, Borrelia burgdorferi
QVSVKTAAN

SEQ ID NO: 50285 - protein, 9 aa, Borrelia burgdorferi
VSVKTAANF

SEQ ID NO: 50286 - protein, 9 aa, Borrelia burgdorferi
SVKTAANFV

SEQ ID NO: 50287 - protein, 9 aa, Borrelia burgdorferi
VKTAANFVY

SEQ ID NO: 50288 - protein, 9 aa, Borrelia burgdorferi
KTAANFVYI

SEQ ID NO: 50289 - protein, 9 aa, Borrelia burgdorferi
TAANFVYIN

SEQ ID NO: 50290 - protein, 9 aa, Borrelia burgdorferi
AANFVYIND

SEQ ID NO: 50291 - protein, 9 aa, Borrelia burgdorferi
ANFVYINDT

SEQ ID NO: 50292 - protein, 9 aa, Borrelia burgdorferi
NFVYINDTH

SEQ ID NO: 50293 - protein, 9 aa, Borrelia burgdorferi
FVYINDTHA

SEQ ID NO: 50294 - protein, 9 aa, Borrelia burgdorferi
VYINDTHAK

SEQ ID NO: 50295 - protein, 9 aa, Borrelia burgdorferi
YINDTHAKR

SEQ ID NO: 50296 - protein, 9 aa, Borrelia burgdorferi
INDTHAKRK

SEQ ID NO: 50297 - protein, 9 aa, Borrelia burgdorferi
NDTHAKRKL

SEQ ID NO: 50298 - protein, 9 aa, Borrelia burgdorferi
DTHAKRKLE

SEQ ID NO: 50299 - protein, 9 aa, Borrelia burgdorferi
THAKRKLEN

SEQ ID NO: 50300 - protein, 9 aa, Borrelia burgdorferi
HAKRKLENI

SEQ ID NO: 50301 - protein, 9 aa, Borrelia burgdorferi
AKRKLENIE

SEQ ID NO: 50302 - protein, 9 aa, Borrelia burgdorferi
KRKLENIEA

SEQ ID NO: 50303 - protein, 9 aa, Borrelia burgdorferi
RKLENIEAE

SEQ ID NO: 50304 - protein, 9 aa, Borrelia burgdorferi
KLENIEAEI

SEQ ID NO: 50305 - protein, 9 aa, Borrelia burgdorferi
LENIEAEIK

SEQ ID NO: 50306 - protein, 9 aa, Borrelia burgdorferi
ENIEAEIKT

SEQ ID NO: 50307 - protein, 9 aa, Borrelia burgdorferi
NIEAEIKTL

SEQ ID NO: 50308 - protein, 9 aa, Borrelia burgdorferi
IEAEIKTLI

SEQ ID NO: 50309 - protein, 9 aa, Borrelia burgdorferi
EAEIKTLIA

SEQ ID NO: 50310 - protein, 9 aa, Borrelia burgdorferi
AEIKTLIAK

SEQ ID NO: 50311 - protein, 9 aa, Borrelia burgdorferi
EIKTLIAKI

SEQ ID NO: 50312 - protein, 9 aa, Borrelia burgdorferi
IKTLIAKIK

SEQ ID NO: 50313 - protein, 9 aa, Borrelia burgdorferi
KTLIAKIKE

SEQ ID NO: 50314 - protein, 9 aa, Borrelia burgdorferi
TLIAKIKEQ

SEQ ID NO: 50315 - protein, 9 aa, Borrelia burgdorferi
LIAKIKEQS

SEQ ID NO: 50316 - protein, 9 aa, Borrelia burgdorferi
IAKIKEQSN

SEQ ID NO: 50317 - protein, 9 aa, Borrelia burgdorferi
AKIKEQSNL

SEQ ID NO: 50318 - protein, 9 aa, Borrelia burgdorferi
KIKEQSNLY

SEQ ID NO: 50319 - protein, 9 aa, Borrelia burgdorferi
IKEQSNLYE

SEQ ID NO: 50320 - protein, 9 aa, Borrelia burgdorferi
KEQSNLYEA

SEQ ID NO: 50321 - protein, 9 aa, Borrelia burgdorferi
EQSNLYEAY

SEQ ID NO: 50322 - protein, 9 aa, Borrelia burgdorferi
QSNLYEAYK

SEQ ID NO: 50323 - protein, 9 aa, Borrelia burgdorferi
SNLYEAYKA

SEQ ID NO: 50324 - protein, 9 aa, Borrelia burgdorferi
NLYEAYKAI

SEQ ID NO: 50325 - protein, 9 aa, Borrelia burgdorferi
LYEAYKAIV

SEQ ID NO: 50326 - protein, 9 aa, Borrelia burgdorferi
YEAYKAIVT

SEQ ID NO: 50327 - protein, 9 aa, Borrelia burgdorferi
EAYKAIVTS

SEQ ID NO: 50328 - protein, 9 aa, Borrelia burgdorferi
AYKAIVTSI

SEQ ID NO: 50329 - protein, 9 aa, Borrelia burgdorferi
YKAIVTSIL

SEQ ID NO: 50330 - protein, 9 aa, Borrelia burgdorferi
KAIVTSILL

SEQ ID NO: 50331 - protein, 9 aa, Borrelia burgdorferi
AIVTSILLM

SEQ ID NO: 50332 - protein, 9 aa, Borrelia burgdorferi
IVTSILLMR

SEQ ID NO: 50333 - protein, 9 aa, Borrelia burgdorferi
VTSILLMRD

SEQ ID NO: 50334 - protein, 9 aa, Borrelia burgdorferi
TSILLMRDS

SEQ ID NO: 50335 - protein, 9 aa, Borrelia burgdorferi
SILLMRDSL

SEQ ID NO: 50336 - protein, 9 aa, Borrelia burgdorferi
ILLMRDSLK

SEQ ID NO: 50337 - protein, 9 aa, Borrelia burgdorferi
LLMRDSLKE

SEQ ID NO: 50338 - protein, 9 aa, Borrelia burgdorferi
LMRDSLKEV

SEQ ID NO: 50339 - protein, 9 aa, Borrelia burgdorferi
MRDSLKEVQ

SEQ ID NO: 50340 - protein, 9 aa, Borrelia burgdorferi
RDSLKEVQG

SEQ ID NO: 50341 - protein, 9 aa, Borrelia burgdorferi
DSLKEVQGI

SEQ ID NO: 50342 - protein, 9 aa, Borrelia burgdorferi
SLKEVQGII

SEQ ID NO: 50343 - protein, 9 aa, Borrelia burgdorferi
LKEVQGIID

SEQ ID NO: 50344 - protein, 9 aa, Borrelia burgdorferi
KEVQGIIDK

SEQ ID NO: 50345 - protein, 9 aa, Borrelia burgdorferi
EVQGIIDKN

SEQ ID NO: 50346 - protein, 9 aa, Borrelia burgdorferi
VQGIIDKNG

SEQ ID NO: 50347 - protein, 9 aa, Borrelia burgdorferi
QGIIDKNGV

SEQ ID NO: 50348 - protein, 9 aa, Borrelia burgdorferi
GIIDKNGVW

SEQ ID NO: 50349 - protein, 9 aa, Borrelia burgdorferi
IIDKNGVWY

SEQ ID NO: 50350 - protein, 10 aa, Borrelia burgdorferi
MKKVKSKYLA

SEQ ID NO: 50351 - protein, 10 aa, Borrelia burgdorferi
KKVKSKYLAL

SEQ ID NO: 50352 - protein, 10 aa, Borrelia burgdorferi
KVKSKYLALG

SEQ ID NO: 50353 - protein, 10 aa, Borrelia burgdorferi
VKSKYLALGL

SEQ ID NO: 50354 - protein, 10 aa, Borrelia burgdorferi
KSKYLALGLL

SEQ ID NO: 50355 - protein, 10 aa, Borrelia burgdorferi
SKYLALGLLF

SEQ ID NO: 50356 - protein, 10 aa, Borrelia burgdorferi
KYLALGLLFG

SEQ ID NO: 50357 - protein, 10 aa, Borrelia burgdorferi
YLALGLLFGF

SEQ ID NO: 50358 - protein, 10 aa, Borrelia burgdorferi
LALGLLFGFI

SEQ ID NO: 50359 - protein, 10 aa, Borrelia burgdorferi
ALGLLFGFIS

SEQ ID NO: 50360 - protein, 10 aa, Borrelia burgdorferi
LGLLFGFISC

SEQ ID NO: 50361 - protein, 10 aa, Borrelia burgdorferi
GLLFGFISCD

SEQ ID NO: 50362 - protein, 10 aa, Borrelia burgdorferi
LLFGFISCDL

SEQ ID NO: 50363 - protein, 10 aa, Borrelia burgdorferi
LFGFISCDLF

SEQ ID NO: 50364 - protein, 10 aa, Borrelia burgdorferi
FGFISCDLFI

SEQ ID NO: 50365 - protein, 10 aa, Borrelia burgdorferi
GFISCDLFIR

SEQ ID NO: 50366 - protein, 10 aa, Borrelia burgdorferi
FISCDLFIRY

SEQ ID NO: 50367 - protein, 10 aa, Borrelia burgdorferi
ISCDLFIRYE

SEQ ID NO: 50368 - protein, 10 aa, Borrelia burgdorferi
SCDLFIRYEM

SEQ ID NO: 50369 - protein, 10 aa, Borrelia burgdorferi
CDLFIRYEMK

SEQ ID NO: 50370 - protein, 10 aa, Borrelia burgdorferi
DLFIRYEMKE

SEQ ID NO: 50371 - protein, 10 aa, Borrelia burgdorferi
LFIRYEMKEE

SEQ ID NO: 50372 - protein, 10 aa, Borrelia burgdorferi
FIRYEMKEES

SEQ ID NO: 50373 - protein, 10 aa, Borrelia burgdorferi
IRYEMKEESP

SEQ ID NO: 50374 - protein, 10 aa, Borrelia burgdorferi
RYEMKEESPG

SEQ ID NO: 50375 - protein, 10 aa, Borrelia burgdorferi
YEMKEESPGL

SEQ ID NO: 50376 - protein, 10 aa, Borrelia burgdorferi
EMKEESPGLF

SEQ ID NO: 50377 - protein, 10 aa, Borrelia burgdorferi
MKEESPGLFD

SEQ ID NO: 50378 - protein, 10 aa, Borrelia burgdorferi
KEESPGLFDK

SEQ ID NO: 50379 - protein, 10 aa, Borrelia burgdorferi
EESPGLFDKG

SEQ ID NO: 50380 - protein, 10 aa, Borrelia burgdorferi
ESPGLFDKGN

SEQ ID NO: 50381 - protein, 10 aa, Borrelia burgdorferi
SPGLFDKGNS

SEQ ID NO: 50382 - protein, 10 aa, Borrelia burgdorferi
PGLFDKGNSI

SEQ ID NO: 50383 - protein, 10 aa, Borrelia burgdorferi
GLFDKGNSIL

SEQ ID NO: 50384 - protein, 10 aa, Borrelia burgdorferi
LFDKGNSILE

SEQ ID NO: 50385 - protein, 10 aa, Borrelia burgdorferi
FDKGNSILET

SEQ ID NO: 50386 - protein, 10 aa, Borrelia burgdorferi
DKGNSILETS

SEQ ID NO: 50387 - protein, 10 aa, Borrelia burgdorferi
KGNSILETSE

SEQ ID NO: 50388 - protein, 10 aa, Borrelia burgdorferi
GNSILETSEE

SEQ ID NO: 50389 - protein, 10 aa, Borrelia burgdorferi
NSILETSEES

SEQ ID NO: 50390 - protein, 10 aa, Borrelia burgdorferi
SILETSEESI

SEQ ID NO: 50391 - protein, 10 aa, Borrelia burgdorferi
ILETSEESIK

SEQ ID NO: 50392 - protein, 10 aa, Borrelia burgdorferi
LETSEESIKK

SEQ ID NO: 50393 - protein, 10 aa, Borrelia burgdorferi
ETSEESIKKP

SEQ ID NO: 50394 - protein, 10 aa, Borrelia burgdorferi
TSEESIKKPM

SEQ ID NO: 50395 - protein, 10 aa, Borrelia burgdorferi
SEESIKKPMN

SEQ ID NO: 50396 - protein, 10 aa, Borrelia burgdorferi
EESIKKPMNK

SEQ ID NO: 50397 - protein, 10 aa, Borrelia burgdorferi
ESIKKPMNKK

SEQ ID NO: 50398 - protein, 10 aa, Borrelia burgdorferi
SIKKPMNKKG

SEQ ID NO: 50399 - protein, 10 aa, Borrelia burgdorferi
IKKPMNKKGK

SEQ ID NO: 50400 - protein, 10 aa, Borrelia burgdorferi
KKPMNKKGKG

SEQ ID NO: 50401 - protein, 10 aa, Borrelia burgdorferi
KPMNKKGKGK

SEQ ID NO: 50402 - protein, 10 aa, Borrelia burgdorferi
PMNKKGKGKI

SEQ ID NO: 50403 - protein, 10 aa, Borrelia burgdorferi
MNKKGKGKIA

SEQ ID NO: 50404 - protein, 10 aa, Borrelia burgdorferi
NKKGKGKIAR

SEQ ID NO: 50405 - protein, 10 aa, Borrelia burgdorferi
KKGKGKIARK

SEQ ID NO: 50406 - protein, 10 aa, Borrelia burgdorferi
KGKGKIARKK

SEQ ID NO: 50407 - protein, 10 aa, Borrelia burgdorferi
GKGKIARKKG

SEQ ID NO: 50408 - protein, 10 aa, Borrelia burgdorferi
KGKIARKKGK

SEQ ID NO: 50409 - protein, 10 aa, Borrelia burgdorferi
GKIARKKGKS

SEQ ID NO: 50410 - protein, 10 aa, Borrelia burgdorferi
KIARKKGKSK

SEQ ID NO: 50411 - protein, 10 aa, Borrelia burgdorferi
IARKKGKSKV

SEQ ID NO: 50412 - protein, 10 aa, Borrelia burgdorferi
ARKKGKSKVS

SEQ ID NO: 50413 - protein, 10 aa, Borrelia burgdorferi
RKKGKSKVSR

SEQ ID NO: 50414 - protein, 10 aa, Borrelia burgdorferi
KKGKSKVSRK

SEQ ID NO: 50415 - protein, 10 aa, Borrelia burgdorferi
KGKSKVSRKE

SEQ ID NO: 50416 - protein, 10 aa, Borrelia burgdorferi
GKSKVSRKEP

SEQ ID NO: 50417 - protein, 10 aa, Borrelia burgdorferi
KSKVSRKEPY

SEQ ID NO: 50418 - protein, 10 aa, Borrelia burgdorferi
SKVSRKEPYI

SEQ ID NO: 50419 - protein, 10 aa, Borrelia burgdorferi
KVSRKEPYIH

SEQ ID NO: 50420 - protein, 10 aa, Borrelia burgdorferi
VSRKEPYIHS

SEQ ID NO: 50421 - protein, 10 aa, Borrelia burgdorferi
SRKEPYIHSL

SEQ ID NO: 50422 - protein, 10 aa, Borrelia burgdorferi
RKEPYIHSLK

SEQ ID NO: 50423 - protein, 10 aa, Borrelia burgdorferi
KEPYIHSLKR

SEQ ID NO: 50424 - protein, 10 aa, Borrelia burgdorferi
EPYIHSLKRD

SEQ ID NO: 50425 - protein, 10 aa, Borrelia burgdorferi
PYIHSLKRDS

SEQ ID NO: 50426 - protein, 10 aa, Borrelia burgdorferi
YIHSLKRDSA

SEQ ID NO: 50427 - protein, 10 aa, Borrelia burgdorferi
IHSLKRDSAN

SEQ ID NO: 50428 - protein, 10 aa, Borrelia burgdorferi
HSLKRDSANK

SEQ ID NO: 50429 - protein, 10 aa, Borrelia burgdorferi
SLKRDSANKS

SEQ ID NO: 50430 - protein, 10 aa, Borrelia burgdorferi
LKRDSANKSN

SEQ ID NO: 50431 - protein, 10 aa, Borrelia burgdorferi
KRDSANKSNF

SEQ ID NO: 50432 - protein, 10 aa, Borrelia burgdorferi
RDSANKSNFL

SEQ ID NO: 50433 - protein, 10 aa, Borrelia burgdorferi
DSANKSNFLQ

SEQ ID NO: 50434 - protein, 10 aa, Borrelia burgdorferi
SANKSNFLQK

SEQ ID NO: 50435 - protein, 10 aa, Borrelia burgdorferi
ANKSNFLQKN

SEQ ID NO: 50436 - protein, 10 aa, Borrelia burgdorferi
NKSNFLQKNV

SEQ ID NO: 50437 - protein, 10 aa, Borrelia burgdorferi
KSNFLQKNVI

SEQ ID NO: 50438 - protein, 10 aa, Borrelia burgdorferi
SNFLQKNVIL

SEQ ID NO: 50439 - protein, 10 aa, Borrelia burgdorferi
NFLQKNVILE

SEQ ID NO: 50440 - protein, 10 aa, Borrelia burgdorferi
FLQKNVILEE

SEQ ID NO: 50441 - protein, 10 aa, Borrelia burgdorferi
LQKNVILEEE

SEQ ID NO: 50442 - protein, 10 aa, Borrelia burgdorferi
QKNVILEEES

SEQ ID NO: 50443 - protein, 10 aa, Borrelia burgdorferi
KNVILEEESL

SEQ ID NO: 50444 - protein, 10 aa, Borrelia burgdorferi
NVILEEESLK

SEQ ID NO: 50445 - protein, 10 aa, Borrelia burgdorferi
VILEEESLKT

SEQ ID NO: 50446 - protein, 10 aa, Borrelia burgdorferi
ILEEESLKTE

SEQ ID NO: 50447 - protein, 10 aa, Borrelia burgdorferi
LEEESLKTEL

SEQ ID NO: 50448 - protein, 10 aa, Borrelia burgdorferi
EEESLKTELL

SEQ ID NO: 50449 - protein, 10 aa, Borrelia burgdorferi
EESLKTELLK

SEQ ID NO: 50450 - protein, 10 aa, Borrelia burgdorferi
ESLKTELLKE

SEQ ID NO: 50451 - protein, 10 aa, Borrelia burgdorferi
SLKTELLKEQ

SEQ ID NO: 50452 - protein, 10 aa, Borrelia burgdorferi
LKTELLKEQS

SEQ ID NO: 50453 - protein, 10 aa, Borrelia burgdorferi
KTELLKEQSE

SEQ ID NO: 50454 - protein, 10 aa, Borrelia burgdorferi
TELLKEQSET

SEQ ID NO: 50455 - protein, 10 aa, Borrelia burgdorferi
ELLKEQSETR

SEQ ID NO: 50456 - protein, 10 aa, Borrelia burgdorferi
LLKEQSETRK

SEQ ID NO: 50457 - protein, 10 aa, Borrelia burgdorferi
LKEQSETRKE

SEQ ID NO: 50458 - protein, 10 aa, Borrelia burgdorferi
KEQSETRKEK

SEQ ID NO: 50459 - protein, 10 aa, Borrelia burgdorferi
EQSETRKEKI

SEQ ID NO: 50460 - protein, 10 aa, Borrelia burgdorferi
QSETRKEKIQ

SEQ ID NO: 50461 - protein, 10 aa, Borrelia burgdorferi
SETRKEKIQK

SEQ ID NO: 50462 - protein, 10 aa, Borrelia burgdorferi
ETRKEKIQKQ

SEQ ID NO: 50463 - protein, 10 aa, Borrelia burgdorferi
TRKEKIQKQQ

SEQ ID NO: 50464 - protein, 10 aa, Borrelia burgdorferi
RKEKIQKQQD

SEQ ID NO: 50465 - protein, 10 aa, Borrelia burgdorferi
KEKIQKQQDE

SEQ ID NO: 50466 - protein, 10 aa, Borrelia burgdorferi
EKIQKQQDEY

SEQ ID NO: 50467 - protein, 10 aa, Borrelia burgdorferi
KIQKQQDEYK

SEQ ID NO: 50468 - protein, 10 aa, Borrelia burgdorferi
IQKQQDEYKG

SEQ ID NO: 50469 - protein, 10 aa, Borrelia burgdorferi
QKQQDEYKGM

SEQ ID NO: 50470 - protein, 10 aa, Borrelia burgdorferi
KQQDEYKGMT

SEQ ID NO: 50471 - protein, 10 aa, Borrelia burgdorferi
QQDEYKGMTQ

SEQ ID NO: 50472 - protein, 10 aa, Borrelia burgdorferi
QDEYKGMTQG

SEQ ID NO: 50473 - protein, 10 aa, Borrelia burgdorferi
DEYKGMTQGS

SEQ ID NO: 50474 - protein, 10 aa, Borrelia burgdorferi
EYKGMTQGSL

SEQ ID NO: 50475 - protein, 10 aa, Borrelia burgdorferi
YKGMTQGSLN

SEQ ID NO: 50476 - protein, 10 aa, Borrelia burgdorferi
KGMTQGSLNS

SEQ ID NO: 50477 - protein, 10 aa, Borrelia burgdorferi
GMTQGSLNSL

SEQ ID NO: 50478 - protein, 10 aa, Borrelia burgdorferi
MTQGSLNSLS

SEQ ID NO: 50479 - protein, 10 aa, Borrelia burgdorferi
TQGSLNSLSG

SEQ ID NO: 50480 - protein, 10 aa, Borrelia burgdorferi
QGSLNSLSGE

SEQ ID NO: 50481 - protein, 10 aa, Borrelia burgdorferi
GSLNSLSGES

SEQ ID NO: 50482 - protein, 10 aa, Borrelia burgdorferi
SLNSLSGESG

SEQ ID NO: 50483 - protein, 10 aa, Borrelia burgdorferi
LNSLSGESGE

SEQ ID NO: 50484 - protein, 10 aa, Borrelia burgdorferi
NSLSGESGEL

SEQ ID NO: 50485 - protein, 10 aa, Borrelia burgdorferi
SLSGESGELK

SEQ ID NO: 50486 - protein, 10 aa, Borrelia burgdorferi
LSGESGELKE

SEQ ID NO: 50487 - protein, 10 aa, Borrelia burgdorferi
SGESGELKET

SEQ ID NO: 50488 - protein, 10 aa, Borrelia burgdorferi
GESGELKETI

SEQ ID NO: 50489 - protein, 10 aa, Borrelia burgdorferi
ESGELKETIE

SEQ ID NO: 50490 - protein, 10 aa, Borrelia burgdorferi
SGELKETIES

SEQ ID NO: 50491 - protein, 10 aa, Borrelia burgdorferi
GELKETIESN

SEQ ID NO: 50492 - protein, 10 aa, Borrelia burgdorferi
ELKETIESNE

SEQ ID NO: 50493 - protein, 10 aa, Borrelia burgdorferi
LKETIESNEI

SEQ ID NO: 50494 - protein, 10 aa, Borrelia burgdorferi
KETIESNEID

SEQ ID NO: 50495 - protein, 10 aa, Borrelia burgdorferi
ETIESNEIDI

SEQ ID NO: 50496 - protein, 10 aa, Borrelia burgdorferi
TIESNEIDIT

SEQ ID NO: 50497 - protein, 10 aa, Borrelia burgdorferi
IESNEIDITI

SEQ ID NO: 50498 - protein, 10 aa, Borrelia burgdorferi
ESNEIDITID

SEQ ID NO: 50499 - protein, 10 aa, Borrelia burgdorferi
SNEIDITIDS

SEQ ID NO: 50500 - protein, 10 aa, Borrelia burgdorferi
NEIDITIDSD

SEQ ID NO: 50501 - protein, 10 aa, Borrelia burgdorferi
EIDITIDSDL

SEQ ID NO: 50502 - protein, 10 aa, Borrelia burgdorferi
IDITIDSDLR

SEQ ID NO: 50503 - protein, 10 aa, Borrelia burgdorferi
DITIDSDLRP

SEQ ID NO: 50504 - protein, 10 aa, Borrelia burgdorferi
ITIDSDLRPK

SEQ ID NO: 50505 - protein, 10 aa, Borrelia burgdorferi
TIDSDLRPKS

SEQ ID NO: 50506 - protein, 10 aa, Borrelia burgdorferi
IDSDLRPKSS

SEQ ID NO: 50507 - protein, 10 aa, Borrelia burgdorferi
DSDLRPKSSL

SEQ ID NO: 50508 - protein, 10 aa, Borrelia burgdorferi
SDLRPKSSLQ

SEQ ID NO: 50509 - protein, 10 aa, Borrelia burgdorferi
DLRPKSSLQD

SEQ ID NO: 50510 - protein, 10 aa, Borrelia burgdorferi
LRPKSSLQDI

SEQ ID NO: 50511 - protein, 10 aa, Borrelia burgdorferi
RPKSSLQDIA

SEQ ID NO: 50512 - protein, 10 aa, Borrelia burgdorferi
PKSSLQDIAG

SEQ ID NO: 50513 - protein, 10 aa, Borrelia burgdorferi
KSSLQDIAGS

SEQ ID NO: 50514 - protein, 10 aa, Borrelia burgdorferi
SSLQDIAGSN

SEQ ID NO: 50515 - protein, 10 aa, Borrelia burgdorferi
SLQDIAGSNS

SEQ ID NO: 50516 - protein, 10 aa, Borrelia burgdorferi
LQDIAGSNSI

SEQ ID NO: 50517 - protein, 10 aa, Borrelia burgdorferi
QDIAGSNSIS

SEQ ID NO: 50518 - protein, 10 aa, Borrelia burgdorferi
DIAGSNSISY

SEQ ID NO: 50519 - protein, 10 aa, Borrelia burgdorferi
IAGSNSISYT

SEQ ID NO: 50520 - protein, 10 aa, Borrelia burgdorferi
AGSNSISYTD

SEQ ID NO: 50521 - protein, 10 aa, Borrelia burgdorferi
GSNSISYTDE

SEQ ID NO: 50522 - protein, 10 aa, Borrelia burgdorferi
SNSISYTDEI

SEQ ID NO: 50523 - protein, 10 aa, Borrelia burgdorferi
NSISYTDEIE

SEQ ID NO: 50524 - protein, 10 aa, Borrelia burgdorferi
SISYTDEIEE

SEQ ID NO: 50525 - protein, 10 aa, Borrelia burgdorferi
ISYTDEIEEE

SEQ ID NO: 50526 - protein, 10 aa, Borrelia burgdorferi
SYTDEIEEED

SEQ ID NO: 50527 - protein, 10 aa, Borrelia burgdorferi
YTDEIEEEDY

SEQ ID NO: 50528 - protein, 10 aa, Borrelia burgdorferi
TDEIEEEDYA

SEQ ID NO: 50529 - protein, 10 aa, Borrelia burgdorferi
DEIEEEDYAR

SEQ ID NO: 50530 - protein, 10 aa, Borrelia burgdorferi
EIEEEDYARY

SEQ ID NO: 50531 - protein, 10 aa, Borrelia burgdorferi
IEEEDYARYY

SEQ ID NO: 50532 - protein, 10 aa, Borrelia burgdorferi
EEEDYARYYL

SEQ ID NO: 50533 - protein, 10 aa, Borrelia burgdorferi
EEDYARYYLD

SEQ ID NO: 50534 - protein, 10 aa, Borrelia burgdorferi
EDYARYYLDE

SEQ ID NO: 50535 - protein, 10 aa, Borrelia burgdorferi
DYARYYLDED

SEQ ID NO: 50536 - protein, 10 aa, Borrelia burgdorferi
YARYYLDEDD

SEQ ID NO: 50537 - protein, 10 aa, Borrelia burgdorferi
ARYYLDEDDE

SEQ ID NO: 50538 - protein, 10 aa, Borrelia burgdorferi
RYYLDEDDED

SEQ ID NO: 50539 - protein, 10 aa, Borrelia burgdorferi
YYLDEDDEDD

SEQ ID NO: 50540 - protein, 10 aa, Borrelia burgdorferi
YLDEDDEDDE

SEQ ID NO: 50541 - protein, 10 aa, Borrelia burgdorferi
LDEDDEDDEY

SEQ ID NO: 50542 - protein, 10 aa, Borrelia burgdorferi
DEDDEDDEYY

SEQ ID NO: 50543 - protein, 10 aa, Borrelia burgdorferi
EDDEDDEYYE

SEQ ID NO: 50544 - protein, 10 aa, Borrelia burgdorferi
DDEDDEYYED

SEQ ID NO: 50545 - protein, 10 aa, Borrelia burgdorferi
DEDDEYYEDD

SEQ ID NO: 50546 - protein, 10 aa, Borrelia burgdorferi
EDDEYYEDDY

SEQ ID NO: 50547 - protein, 10 aa, Borrelia burgdorferi
DDEYYEDDYE

SEQ ID NO: 50548 - protein, 10 aa, Borrelia burgdorferi
DEYYEDDYEE

SEQ ID NO: 50549 - protein, 10 aa, Borrelia burgdorferi
EYYEDDYEEI

SEQ ID NO: 50550 - protein, 10 aa, Borrelia burgdorferi
YYEDDYEEIR

SEQ ID NO: 50551 - protein, 10 aa, Borrelia burgdorferi
YEDDYEEIRL

SEQ ID NO: 50552 - protein, 10 aa, Borrelia burgdorferi
EDDYEEIRLS

SEQ ID NO: 50553 - protein, 10 aa, Borrelia burgdorferi
DDYEEIRLSN

SEQ ID NO: 50554 - protein, 10 aa, Borrelia burgdorferi
DYEEIRLSNR

SEQ ID NO: 50555 - protein, 10 aa, Borrelia burgdorferi
YEEIRLSNRY

SEQ ID NO: 50556 - protein, 10 aa, Borrelia burgdorferi
EEIRLSNRYQ

SEQ ID NO: 50557 - protein, 10 aa, Borrelia burgdorferi
EIRLSNRYQS

SEQ ID NO: 50558 - protein, 10 aa, Borrelia burgdorferi
IRLSNRYQSY

SEQ ID NO: 50559 - protein, 10 aa, Borrelia burgdorferi
RLSNRYQSYL

SEQ ID NO: 50560 - protein, 10 aa, Borrelia burgdorferi
LSNRYQSYLE

SEQ ID NO: 50561 - protein, 10 aa, Borrelia burgdorferi
SNRYQSYLEG

SEQ ID NO: 50562 - protein, 10 aa, Borrelia burgdorferi
NRYQSYLEGV

SEQ ID NO: 50563 - protein, 10 aa, Borrelia burgdorferi
RYQSYLEGVK

SEQ ID NO: 50564 - protein, 10 aa, Borrelia burgdorferi
YQSYLEGVKY

SEQ ID NO: 50565 - protein, 10 aa, Borrelia burgdorferi
QSYLEGVKYN

SEQ ID NO: 50566 - protein, 10 aa, Borrelia burgdorferi
SYLEGVKYNV

SEQ ID NO: 50567 - protein, 10 aa, Borrelia burgdorferi
YLEGVKYNVD

SEQ ID NO: 50568 - protein, 10 aa, Borrelia burgdorferi
LEGVKYNVDS

SEQ ID NO: 50569 - protein, 10 aa, Borrelia burgdorferi
EGVKYNVDSA

SEQ ID NO: 50570 - protein, 10 aa, Borrelia burgdorferi
GVKYNVDSAI

SEQ ID NO: 50571 - protein, 10 aa, Borrelia burgdorferi
VKYNVDSAIN

SEQ ID NO: 50572 - protein, 10 aa, Borrelia burgdorferi
KYNVDSAINT

SEQ ID NO: 50573 - protein, 10 aa, Borrelia burgdorferi
YNVDSAINTI

SEQ ID NO: 50574 - protein, 10 aa, Borrelia burgdorferi
NVDSAINTIN

SEQ ID NO: 50575 - protein, 10 aa, Borrelia burgdorferi
VDSAINTINK

SEQ ID NO: 50576 - protein, 10 aa, Borrelia burgdorferi
DSAINTINKI

SEQ ID NO: 50577 - protein, 10 aa, Borrelia burgdorferi
SAINTINKIY

SEQ ID NO: 50578 - protein, 10 aa, Borrelia burgdorferi
AINTINKIYD

SEQ ID NO: 50579 - protein, 10 aa, Borrelia burgdorferi
INTINKIYDT

SEQ ID NO: 50580 - protein, 10 aa, Borrelia burgdorferi
NTINKIYDTY

SEQ ID NO: 50581 - protein, 10 aa, Borrelia burgdorferi
TINKIYDTYT

SEQ ID NO: 50582 - protein, 10 aa, Borrelia burgdorferi
INKIYDTYTL

SEQ ID NO: 50583 - protein, 10 aa, Borrelia burgdorferi
NKIYDTYTLF

SEQ ID NO: 50584 - protein, 10 aa, Borrelia burgdorferi
KIYDTYTLFS

SEQ ID NO: 50585 - protein, 10 aa, Borrelia burgdorferi
IYDTYTLFST

SEQ ID NO: 50586 - protein, 10 aa, Borrelia burgdorferi
YDTYTLFSTK

SEQ ID NO: 50587 - protein, 10 aa, Borrelia burgdorferi
DTYTLFSTKL

SEQ ID NO: 50588 - protein, 10 aa, Borrelia burgdorferi
TYTLFSTKLT

SEQ ID NO: 50589 - protein, 10 aa, Borrelia burgdorferi
YTLFSTKLTQ

SEQ ID NO: 50590 - protein, 10 aa, Borrelia burgdorferi
TLFSTKLTQM

SEQ ID NO: 50591 - protein, 10 aa, Borrelia burgdorferi
LFSTKLTQMY

SEQ ID NO: 50592 - protein, 10 aa, Borrelia burgdorferi
FSTKLTQMYS

SEQ ID NO: 50593 - protein, 10 aa, Borrelia burgdorferi
STKLTQMYST

SEQ ID NO: 50594 - protein, 10 aa, Borrelia burgdorferi
TKLTQMYSTR

SEQ ID NO: 50595 - protein, 10 aa, Borrelia burgdorferi
KLTQMYSTRL

SEQ ID NO: 50596 - protein, 10 aa, Borrelia burgdorferi
LTQMYSTRLD

SEQ ID NO: 50597 - protein, 10 aa, Borrelia burgdorferi
TQMYSTRLDN

SEQ ID NO: 50598 - protein, 10 aa, Borrelia burgdorferi
QMYSTRLDNL

SEQ ID NO: 50599 - protein, 10 aa, Borrelia burgdorferi
MYSTRLDNLA

SEQ ID NO: 50600 - protein, 10 aa, Borrelia burgdorferi
YSTRLDNLAK

SEQ ID NO: 50601 - protein, 10 aa, Borrelia burgdorferi
STRLDNLAKA

SEQ ID NO: 50602 - protein, 10 aa, Borrelia burgdorferi
TRLDNLAKAK

SEQ ID NO: 50603 - protein, 10 aa, Borrelia burgdorferi
RLDNLAKAKA

SEQ ID NO: 50604 - protein, 10 aa, Borrelia burgdorferi
LDNLAKAKAK

SEQ ID NO: 50605 - protein, 10 aa, Borrelia burgdorferi
DNLAKAKAKE

SEQ ID NO: 50606 - protein, 10 aa, Borrelia burgdorferi
NLAKAKAKEE

SEQ ID NO: 50607 - protein, 10 aa, Borrelia burgdorferi
LAKAKAKEEA

SEQ ID NO: 50608 - protein, 10 aa, Borrelia burgdorferi
AKAKAKEEAA

SEQ ID NO: 50609 - protein, 10 aa, Borrelia burgdorferi
KAKAKEEAAK

SEQ ID NO: 50610 - protein, 10 aa, Borrelia burgdorferi
AKAKEEAAKF

SEQ ID NO: 50611 - protein, 10 aa, Borrelia burgdorferi
KAKEEAAKFT

SEQ ID NO: 50612 - protein, 10 aa, Borrelia burgdorferi
AKEEAAKFTK

SEQ ID NO: 50613 - protein, 10 aa, Borrelia burgdorferi
KEEAAKFTKE

SEQ ID NO: 50614 - protein, 10 aa, Borrelia burgdorferi
EEAAKFTKED

SEQ ID NO: 50615 - protein, 10 aa, Borrelia burgdorferi
EAAKFTKEDL

SEQ ID NO: 50616 - protein, 10 aa, Borrelia burgdorferi
AAKFTKEDLE

SEQ ID NO: 50617 - protein, 10 aa, Borrelia burgdorferi
AKFTKEDLEK

SEQ ID NO: 50618 - protein, 10 aa, Borrelia burgdorferi
KFTKEDLEKN

SEQ ID NO: 50619 - protein, 10 aa, Borrelia burgdorferi
FTKEDLEKNF

SEQ ID NO: 50620 - protein, 10 aa, Borrelia burgdorferi
TKEDLEKNFK

SEQ ID NO: 50621 - protein, 10 aa, Borrelia burgdorferi
KEDLEKNFKT

SEQ ID NO: 50622 - protein, 10 aa, Borrelia burgdorferi
EDLEKNFKTL

SEQ ID NO: 50623 - protein, 10 aa, Borrelia burgdorferi
DLEKNFKTLL

SEQ ID NO: 50624 - protein, 10 aa, Borrelia burgdorferi
LEKNFKTLLN

SEQ ID NO: 50625 - protein, 10 aa, Borrelia burgdorferi
EKNFKTLLNY

SEQ ID NO: 50626 - protein, 10 aa, Borrelia burgdorferi
KNFKTLLNYI

SEQ ID NO: 50627 - protein, 10 aa, Borrelia burgdorferi
NFKTLLNYIQ

SEQ ID NO: 50628 - protein, 10 aa, Borrelia burgdorferi
FKTLLNYIQV

SEQ ID NO: 50629 - protein, 10 aa, Borrelia burgdorferi
KTLLNYIQVS

SEQ ID NO: 50630 - protein, 10 aa, Borrelia burgdorferi
TLLNYIQVSV

SEQ ID NO: 50631 - protein, 10 aa, Borrelia burgdorferi
LLNYIQVSVK

SEQ ID NO: 50632 - protein, 10 aa, Borrelia burgdorferi
LNYIQVSVKT

SEQ ID NO: 50633 - protein, 10 aa, Borrelia burgdorferi
NYIQVSVKTA

SEQ ID NO: 50634 - protein, 10 aa, Borrelia burgdorferi
YIQVSVKTAA

SEQ ID NO: 50635 - protein, 10 aa, Borrelia burgdorferi
IQVSVKTAAN

SEQ ID NO: 50636 - protein, 10 aa, Borrelia burgdorferi
QVSVKTAANF

SEQ ID NO: 50637 - protein, 10 aa, Borrelia burgdorferi
VSVKTAANFV

SEQ ID NO: 50638 - protein, 10 aa, Borrelia burgdorferi
SVKTAANFVY

SEQ ID NO: 50639 - protein, 10 aa, Borrelia burgdorferi
VKTAANFVYI

SEQ ID NO: 50640 - protein, 10 aa, Borrelia burgdorferi
KTAANFVYIN

SEQ ID NO: 50641 - protein, 10 aa, Borrelia burgdorferi
TAANFVYIND

SEQ ID NO: 50642 - protein, 10 aa, Borrelia burgdorferi
AANFVYINDT

SEQ ID NO: 50643 - protein, 10 aa, Borrelia burgdorferi
ANFVYINDTH

SEQ ID NO: 50644 - protein, 10 aa, Borrelia burgdorferi
NFVYINDTHA

SEQ ID NO: 50645 - protein, 10 aa, Borrelia burgdorferi
FVYINDTHAK

SEQ ID NO: 50646 - protein, 10 aa, Borrelia burgdorferi
VYINDTHAKR

SEQ ID NO: 50647 - protein, 10 aa, Borrelia burgdorferi
YINDTHAKRK

SEQ ID NO: 50648 - protein, 10 aa, Borrelia burgdorferi
INDTHAKRKL

SEQ ID NO: 50649 - protein, 10 aa, Borrelia burgdorferi
NDTHAKRKLE

SEQ ID NO: 50650 - protein, 10 aa, Borrelia burgdorferi
DTHAKRKLEN

SEQ ID NO: 50651 - protein, 10 aa, Borrelia burgdorferi
THAKRKLENI

SEQ ID NO: 50652 - protein, 10 aa, Borrelia burgdorferi
HAKRKLENIE

SEQ ID NO: 50653 - protein, 10 aa, Borrelia burgdorferi
AKRKLENIEA

SEQ ID NO: 50654 - protein, 10 aa, Borrelia burgdorferi
KRKLENIEAE

SEQ ID NO: 50655 - protein, 10 aa, Borrelia burgdorferi
RKLENIEAEI

SEQ ID NO: 50656 - protein, 10 aa, Borrelia burgdorferi
KLENIEAEIK

SEQ ID NO: 50657 - protein, 10 aa, Borrelia burgdorferi
LENIEAEIKT

SEQ ID NO: 50658 - protein, 10 aa, Borrelia burgdorferi
ENIEAEIKTL

SEQ ID NO: 50659 - protein, 10 aa, Borrelia burgdorferi
NIEAEIKTLI

SEQ ID NO: 50660 - protein, 10 aa, Borrelia burgdorferi
IEAEIKTLIA

SEQ ID NO: 50661 - protein, 10 aa, Borrelia burgdorferi
EAEIKTLIAK

SEQ ID NO: 50662 - protein, 10 aa, Borrelia burgdorferi
AEIKTLIAKI

SEQ ID NO: 50663 - protein, 10 aa, Borrelia burgdorferi
EIKTLIAKIK

SEQ ID NO: 50664 - protein, 10 aa, Borrelia burgdorferi
IKTLIAKIKE

SEQ ID NO: 50665 - protein, 10 aa, Borrelia burgdorferi
KTLIAKIKEQ

SEQ ID NO: 50666 - protein, 10 aa, Borrelia burgdorferi
TLIAKIKEQS

SEQ ID NO: 50667 - protein, 10 aa, Borrelia burgdorferi
LIAKIKEQSN

SEQ ID NO: 50668 - protein, 10 aa, Borrelia burgdorferi
IAKIKEQSNL

SEQ ID NO: 50669 - protein, 10 aa, Borrelia burgdorferi
AKIKEQSNLY

SEQ ID NO: 50670 - protein, 10 aa, Borrelia burgdorferi
KIKEQSNLYE

SEQ ID NO: 50671 - protein, 10 aa, Borrelia burgdorferi
IKEQSNLYEA

SEQ ID NO: 50672 - protein, 10 aa, Borrelia burgdorferi
KEQSNLYEAY

SEQ ID NO: 50673 - protein, 10 aa, Borrelia burgdorferi
EQSNLYEAYK

SEQ ID NO: 50674 - protein, 10 aa, Borrelia burgdorferi
QSNLYEAYKA

SEQ ID NO: 50675 - protein, 10 aa, Borrelia burgdorferi
SNLYEAYKAI

SEQ ID NO: 50676 - protein, 10 aa, Borrelia burgdorferi
NLYEAYKAIV

SEQ ID NO: 50677 - protein, 10 aa, Borrelia burgdorferi
LYEAYKAIVT

SEQ ID NO: 50678 - protein, 10 aa, Borrelia burgdorferi
YEAYKAIVTS

SEQ ID NO: 50679 - protein, 10 aa, Borrelia burgdorferi
EAYKAIVTSI

SEQ ID NO: 50680 - protein, 10 aa, Borrelia burgdorferi
AYKAIVTSIL

SEQ ID NO: 50681 - protein, 10 aa, Borrelia burgdorferi
YKAIVTSILL

SEQ ID NO: 50682 - protein, 10 aa, Borrelia burgdorferi
KAIVTSILLM

SEQ ID NO: 50683 - protein, 10 aa, Borrelia burgdorferi
AIVTSILLMR

SEQ ID NO: 50684 - protein, 10 aa, Borrelia burgdorferi
IVTSILLMRD

SEQ ID NO: 50685 - protein, 10 aa, Borrelia burgdorferi
VTSILLMRDS

SEQ ID NO: 50686 - protein, 10 aa, Borrelia burgdorferi
TSILLMRDSL

SEQ ID NO: 50687 - protein, 10 aa, Borrelia burgdorferi
SILLMRDSLK

SEQ ID NO: 50688 - protein, 10 aa, Borrelia burgdorferi
ILLMRDSLKE

SEQ ID NO: 50689 - protein, 10 aa, Borrelia burgdorferi
LLMRDSLKEV

SEQ ID NO: 50690 - protein, 10 aa, Borrelia burgdorferi
LMRDSLKEVQ

SEQ ID NO: 50691 - protein, 10 aa, Borrelia burgdorferi
MRDSLKEVQG

SEQ ID NO: 50692 - protein, 10 aa, Borrelia burgdorferi
RDSLKEVQGI

SEQ ID NO: 50693 - protein, 10 aa, Borrelia burgdorferi
DSLKEVQGII

SEQ ID NO: 50694 - protein, 10 aa, Borrelia burgdorferi
SLKEVQGIID

SEQ ID NO: 50695 - protein, 10 aa, Borrelia burgdorferi
LKEVQGIIDK

SEQ ID NO: 50696 - protein, 10 aa, Borrelia burgdorferi
KEVQGIIDKN

SEQ ID NO: 50697 - protein, 10 aa, Borrelia burgdorferi
EVQGIIDKNG

SEQ ID NO: 50698 - protein, 10 aa, Borrelia burgdorferi
VQGIIDKNGV

SEQ ID NO: 50699 - protein, 10 aa, Borrelia burgdorferi
QGIIDKNGVW

SEQ ID NO: 50700 - protein, 10 aa, Borrelia burgdorferi
GIIDKNGVWY

SEQ ID NO: 50701 - protein, 11 aa, Borrelia burgdorferi
MKKVKSKYLAL

SEQ ID NO: 50702 - protein, 11 aa, Borrelia burgdorferi
KKVKSKYLALG

SEQ ID NO: 50703 - protein, 11 aa, Borrelia burgdorferi
KVKSKYLALGL

SEQ ID NO: 50704 - protein, 11 aa, Borrelia burgdorferi
VKSKYLALGLL

SEQ ID NO: 50705 - protein, 11 aa, Borrelia burgdorferi
KSKYLALGLLF

SEQ ID NO: 50706 - protein, 11 aa, Borrelia burgdorferi
SKYLALGLLFG

SEQ ID NO: 50707 - protein, 11 aa, Borrelia burgdorferi
KYLALGLLFGF

SEQ ID NO: 50708 - protein, 11 aa, Borrelia burgdorferi
YLALGLLFGFI

SEQ ID NO: 50709 - protein, 11 aa, Borrelia burgdorferi
LALGLLFGFIS

SEQ ID NO: 50710 - protein, 11 aa, Borrelia burgdorferi
ALGLLFGFISC

SEQ ID NO: 50711 - protein, 11 aa, Borrelia burgdorferi
LGLLFGFISCD

SEQ ID NO: 50712 - protein, 11 aa, Borrelia burgdorferi
GLLFGFISCDL

SEQ ID NO: 50713 - protein, 11 aa, Borrelia burgdorferi
LLFGFISCDLF

SEQ ID NO: 50714 - protein, 11 aa, Borrelia burgdorferi
LFGFISCDLFI

SEQ ID NO: 50715 - protein, 11 aa, Borrelia burgdorferi
FGFISCDLFIR

SEQ ID NO: 50716 - protein, 11 aa, Borrelia burgdorferi
GFISCDLFIRY

SEQ ID NO: 50717 - protein, 11 aa, Borrelia burgdorferi
FISCDLFIRYE

SEQ ID NO: 50718 - protein, 11 aa, Borrelia burgdorferi
ISCDLFIRYEM

SEQ ID NO: 50719 - protein, 11 aa, Borrelia burgdorferi
SCDLFIRYEMK

SEQ ID NO: 50720 - protein, 11 aa, Borrelia burgdorferi
CDLFIRYEMKE

SEQ ID NO: 50721 - protein, 11 aa, Borrelia burgdorferi
DLFIRYEMKEE

SEQ ID NO: 50722 - protein, 11 aa, Borrelia burgdorferi
LFIRYEMKEES

SEQ ID NO: 50723 - protein, 11 aa, Borrelia burgdorferi
FIRYEMKEESP

SEQ ID NO: 50724 - protein, 11 aa, Borrelia burgdorferi
IRYEMKEESPG

SEQ ID NO: 50725 - protein, 11 aa, Borrelia burgdorferi
RYEMKEESPGL

SEQ ID NO: 50726 - protein, 11 aa, Borrelia burgdorferi
YEMKEESPGLF

SEQ ID NO: 50727 - protein, 11 aa, Borrelia burgdorferi
EMKEESPGLFD

SEQ ID NO: 50728 - protein, 11 aa, Borrelia burgdorferi
MKEESPGLFDK

SEQ ID NO: 50729 - protein, 11 aa, Borrelia burgdorferi
KEESPGLFDKG

SEQ ID NO: 50730 - protein, 11 aa, Borrelia burgdorferi
EESPGLFDKGN

SEQ ID NO: 50731 - protein, 11 aa, Borrelia burgdorferi
ESPGLFDKGNS

SEQ ID NO: 50732 - protein, 11 aa, Borrelia burgdorferi
SPGLFDKGNSI

SEQ ID NO: 50733 - protein, 11 aa, Borrelia burgdorferi
PGLFDKGNSIL

SEQ ID NO: 50734 - protein, 11 aa, Borrelia burgdorferi
GLFDKGNSILE

SEQ ID NO: 50735 - protein, 11 aa, Borrelia burgdorferi
LFDKGNSILET

SEQ ID NO: 50736 - protein, 11 aa, Borrelia burgdorferi
FDKGNSILETS

SEQ ID NO: 50737 - protein, 11 aa, Borrelia burgdorferi
DKGNSILETSE

SEQ ID NO: 50738 - protein, 11 aa, Borrelia burgdorferi
KGNSILETSEE

SEQ ID NO: 50739 - protein, 11 aa, Borrelia burgdorferi
GNSILETSEES

SEQ ID NO: 50740 - protein, 11 aa, Borrelia burgdorferi
NSILETSEESI

SEQ ID NO: 50741 - protein, 11 aa, Borrelia burgdorferi
SILETSEESIK

SEQ ID NO: 50742 - protein, 11 aa, Borrelia burgdorferi
ILETSEESIKK

SEQ ID NO: 50743 - protein, 11 aa, Borrelia burgdorferi
LETSEESIKKP

SEQ ID NO: 50744 - protein, 11 aa, Borrelia burgdorferi
ETSEESIKKPM

SEQ ID NO: 50745 - protein, 11 aa, Borrelia burgdorferi
TSEESIKKPMN

SEQ ID NO: 50746 - protein, 11 aa, Borrelia burgdorferi
SEESIKKPMNK

SEQ ID NO: 50747 - protein, 11 aa, Borrelia burgdorferi
EESIKKPMNKK

SEQ ID NO: 50748 - protein, 11 aa, Borrelia burgdorferi
ESIKKPMNKKG

SEQ ID NO: 50749 - protein, 11 aa, Borrelia burgdorferi
SIKKPMNKKGK

SEQ ID NO: 50750 - protein, 11 aa, Borrelia burgdorferi
IKKPMNKKGKG

SEQ ID NO: 50751 - protein, 11 aa, Borrelia burgdorferi
KKPMNKKGKGK

SEQ ID NO: 50752 - protein, 11 aa, Borrelia burgdorferi
KPMNKKGKGKI

SEQ ID NO: 50753 - protein, 11 aa, Borrelia burgdorferi
PMNKKGKGKIA

SEQ ID NO: 50754 - protein, 11 aa, Borrelia burgdorferi
MNKKGKGKIAR

SEQ ID NO: 50755 - protein, 11 aa, Borrelia burgdorferi
NKKGKGKIARK

SEQ ID NO: 50756 - protein, 11 aa, Borrelia burgdorferi
KKGKGKIARKK

SEQ ID NO: 50757 - protein, 11 aa, Borrelia burgdorferi
KGKGKIARKKG

SEQ ID NO: 50758 - protein, 11 aa, Borrelia burgdorferi
GKGKIARKKGK

SEQ ID NO: 50759 - protein, 11 aa, Borrelia burgdorferi
KGKIARKKGKS

SEQ ID NO: 50760 - protein, 11 aa, Borrelia burgdorferi
GKIARKKGKSK

SEQ ID NO: 50761 - protein, 11 aa, Borrelia burgdorferi
KIARKKGKSKV

SEQ ID NO: 50762 - protein, 11 aa, Borrelia burgdorferi
IARKKGKSKVS

SEQ ID NO: 50763 - protein, 11 aa, Borrelia burgdorferi
ARKKGKSKVSR

SEQ ID NO: 50764 - protein, 11 aa, Borrelia burgdorferi
RKKGKSKVSRK

SEQ ID NO: 50765 - protein, 11 aa, Borrelia burgdorferi
KKGKSKVSRKE

SEQ ID NO: 50766 - protein, 11 aa, Borrelia burgdorferi
KGKSKVSRKEP

SEQ ID NO: 50767 - protein, 11 aa, Borrelia burgdorferi
GKSKVSRKEPY

SEQ ID NO: 50768 - protein, 11 aa, Borrelia burgdorferi
KSKVSRKEPYI

SEQ ID NO: 50769 - protein, 11 aa, Borrelia burgdorferi
SKVSRKEPYIH

SEQ ID NO: 50770 - protein, 11 aa, Borrelia burgdorferi
KVSRKEPYIHS

SEQ ID NO: 50771 - protein, 11 aa, Borrelia burgdorferi
VSRKEPYIHSL

SEQ ID NO: 50772 - protein, 11 aa, Borrelia burgdorferi
SRKEPYIHSLK

SEQ ID NO: 50773 - protein, 11 aa, Borrelia burgdorferi
RKEPYIHSLKR

SEQ ID NO: 50774 - protein, 11 aa, Borrelia burgdorferi
KEPYIHSLKRD

SEQ ID NO: 50775 - protein, 11 aa, Borrelia burgdorferi
EPYIHSLKRDS

SEQ ID NO: 50776 - protein, 11 aa, Borrelia burgdorferi
PYIHSLKRDSA

SEQ ID NO: 50777 - protein, 11 aa, Borrelia burgdorferi
YIHSLKRDSAN

SEQ ID NO: 50778 - protein, 11 aa, Borrelia burgdorferi
IHSLKRDSANK

SEQ ID NO: 50779 - protein, 11 aa, Borrelia burgdorferi
HSLKRDSANKS

SEQ ID NO: 50780 - protein, 11 aa, Borrelia burgdorferi
SLKRDSANKSN

SEQ ID NO: 50781 - protein, 11 aa, Borrelia burgdorferi
LKRDSANKSNF

SEQ ID NO: 50782 - protein, 11 aa, Borrelia burgdorferi
KRDSANKSNFL

SEQ ID NO: 50783 - protein, 11 aa, Borrelia burgdorferi
RDSANKSNFLQ

SEQ ID NO: 50784 - protein, 11 aa, Borrelia burgdorferi
DSANKSNFLQK

SEQ ID NO: 50785 - protein, 11 aa, Borrelia burgdorferi
SANKSNFLQKN

SEQ ID NO: 50786 - protein, 11 aa, Borrelia burgdorferi
ANKSNFLQKNV

SEQ ID NO: 50787 - protein, 11 aa, Borrelia burgdorferi
NKSNFLQKNVI

SEQ ID NO: 50788 - protein, 11 aa, Borrelia burgdorferi
KSNFLQKNVIL

SEQ ID NO: 50789 - protein, 11 aa, Borrelia burgdorferi
SNFLQKNVILE

SEQ ID NO: 50790 - protein, 11 aa, Borrelia burgdorferi
NFLQKNVILEE

SEQ ID NO: 50791 - protein, 11 aa, Borrelia burgdorferi
FLQKNVILEEE

SEQ ID NO: 50792 - protein, 11 aa, Borrelia burgdorferi
LQKNVILEEES

SEQ ID NO: 50793 - protein, 11 aa, Borrelia burgdorferi
QKNVILEEESL

SEQ ID NO: 50794 - protein, 11 aa, Borrelia burgdorferi
KNVILEEESLK

SEQ ID NO: 50795 - protein, 11 aa, Borrelia burgdorferi
NVILEEESLKT

SEQ ID NO: 50796 - protein, 11 aa, Borrelia burgdorferi
VILEEESLKTE

SEQ ID NO: 50797 - protein, 11 aa, Borrelia burgdorferi
ILEEESLKTEL

SEQ ID NO: 50798 - protein, 11 aa, Borrelia burgdorferi
LEEESLKTELL

SEQ ID NO: 50799 - protein, 11 aa, Borrelia burgdorferi
EEESLKTELLK

SEQ ID NO: 50800 - protein, 11 aa, Borrelia burgdorferi
EESLKTELLKE

SEQ ID NO: 50801 - protein, 11 aa, Borrelia burgdorferi
ESLKTELLKEQ

SEQ ID NO: 50802 - protein, 11 aa, Borrelia burgdorferi
SLKTELLKEQS

SEQ ID NO: 50803 - protein, 11 aa, Borrelia burgdorferi
LKTELLKEQSE

SEQ ID NO: 50804 - protein, 11 aa, Borrelia burgdorferi
KTELLKEQSET

SEQ ID NO: 50805 - protein, 11 aa, Borrelia burgdorferi
TELLKEQSETR

SEQ ID NO: 50806 - protein, 11 aa, Borrelia burgdorferi
ELLKEQSETRK

SEQ ID NO: 50807 - protein, 11 aa, Borrelia burgdorferi
LLKEQSETRKE

SEQ ID NO: 50808 - protein, 11 aa, Borrelia burgdorferi
LKEQSETRKEK

SEQ ID NO: 50809 - protein, 11 aa, Borrelia burgdorferi
KEQSETRKEKI

SEQ ID NO: 50810 - protein, 11 aa, Borrelia burgdorferi
EQSETRKEKIQ

SEQ ID NO: 50811 - protein, 11 aa, Borrelia burgdorferi
QSETRKEKIQK

SEQ ID NO: 50812 - protein, 11 aa, Borrelia burgdorferi
SETRKEKIQKQ

SEQ ID NO: 50813 - protein, 11 aa, Borrelia burgdorferi
ETRKEKIQKQQ

SEQ ID NO: 50814 - protein, 11 aa, Borrelia burgdorferi
TRKEKIQKQQD

SEQ ID NO: 50815 - protein, 11 aa, Borrelia burgdorferi
RKEKIQKQQDE

SEQ ID NO: 50816 - protein, 11 aa, Borrelia burgdorferi
KEKIQKQQDEY

SEQ ID NO: 50817 - protein, 11 aa, Borrelia burgdorferi
EKIQKQQDEYK

SEQ ID NO: 50818 - protein, 11 aa, Borrelia burgdorferi
KIQKQQDEYKG

SEQ ID NO: 50819 - protein, 11 aa, Borrelia burgdorferi
IQKQQDEYKGM

SEQ ID NO: 50820 - protein, 11 aa, Borrelia burgdorferi
QKQQDEYKGMT

SEQ ID NO: 50821 - protein, 11 aa, Borrelia burgdorferi
KQQDEYKGMTQ

SEQ ID NO: 50822 - protein, 11 aa, Borrelia burgdorferi
QQDEYKGMTQG

SEQ ID NO: 50823 - protein, 11 aa, Borrelia burgdorferi
QDEYKGMTQGS

SEQ ID NO: 50824 - protein, 11 aa, Borrelia burgdorferi
DEYKGMTQGSL

SEQ ID NO: 50825 - protein, 11 aa, Borrelia burgdorferi
EYKGMTQGSLN

SEQ ID NO: 50826 - protein, 11 aa, Borrelia burgdorferi
YKGMTQGSLNS

SEQ ID NO: 50827 - protein, 11 aa, Borrelia burgdorferi
KGMTQGSLNSL

SEQ ID NO: 50828 - protein, 11 aa, Borrelia burgdorferi
GMTQGSLNSLS

SEQ ID NO: 50829 - protein, 11 aa, Borrelia burgdorferi
MTQGSLNSLSG

SEQ ID NO: 50830 - protein, 11 aa, Borrelia burgdorferi
TQGSLNSLSGE

SEQ ID NO: 50831 - protein, 11 aa, Borrelia burgdorferi
QGSLNSLSGES

SEQ ID NO: 50832 - protein, 11 aa, Borrelia burgdorferi
GSLNSLSGESG

SEQ ID NO: 50833 - protein, 11 aa, Borrelia burgdorferi
SLNSLSGESGE

SEQ ID NO: 50834 - protein, 11 aa, Borrelia burgdorferi
LNSLSGESGEL

SEQ ID NO: 50835 - protein, 11 aa, Borrelia burgdorferi
NSLSGESGELK

SEQ ID NO: 50836 - protein, 11 aa, Borrelia burgdorferi
SLSGESGELKE

SEQ ID NO: 50837 - protein, 11 aa, Borrelia burgdorferi
LSGESGELKET

SEQ ID NO: 50838 - protein, 11 aa, Borrelia burgdorferi
SGESGELKETI

SEQ ID NO: 50839 - protein, 11 aa, Borrelia burgdorferi
GESGELKETIE

SEQ ID NO: 50840 - protein, 11 aa, Borrelia burgdorferi
ESGELKETIES

SEQ ID NO: 50841 - protein, 11 aa, Borrelia burgdorferi
SGELKETIESN

SEQ ID NO: 50842 - protein, 11 aa, Borrelia burgdorferi
GELKETIESNE

SEQ ID NO: 50843 - protein, 11 aa, Borrelia burgdorferi
ELKETIESNEI

SEQ ID NO: 50844 - protein, 11 aa, Borrelia burgdorferi
LKETIESNEID

SEQ ID NO: 50845 - protein, 11 aa, Borrelia burgdorferi
KETIESNEIDI

SEQ ID NO: 50846 - protein, 11 aa, Borrelia burgdorferi
ETIESNEIDIT

SEQ ID NO: 50847 - protein, 11 aa, Borrelia burgdorferi
TIESNEIDITI

SEQ ID NO: 50848 - protein, 11 aa, Borrelia burgdorferi
IESNEIDITID

SEQ ID NO: 50849 - protein, 11 aa, Borrelia burgdorferi
ESNEIDITIDS

SEQ ID NO: 50850 - protein, 11 aa, Borrelia burgdorferi
SNEIDITIDSD

SEQ ID NO: 50851 - protein, 11 aa, Borrelia burgdorferi
NEIDITIDSDL

SEQ ID NO: 50852 - protein, 11 aa, Borrelia burgdorferi
EIDITIDSDLR

SEQ ID NO: 50853 - protein, 11 aa, Borrelia burgdorferi
IDITIDSDLRP

SEQ ID NO: 50854 - protein, 11 aa, Borrelia burgdorferi
DITIDSDLRPK

SEQ ID NO: 50855 - protein, 11 aa, Borrelia burgdorferi
ITIDSDLRPKS

SEQ ID NO: 50856 - protein, 11 aa, Borrelia burgdorferi
TIDSDLRPKSS

SEQ ID NO: 50857 - protein, 11 aa, Borrelia burgdorferi
IDSDLRPKSSL

SEQ ID NO: 50858 - protein, 11 aa, Borrelia burgdorferi
DSDLRPKSSLQ

SEQ ID NO: 50859 - protein, 11 aa, Borrelia burgdorferi
SDLRPKSSLQD

SEQ ID NO: 50860 - protein, 11 aa, Borrelia burgdorferi
DLRPKSSLQDI

SEQ ID NO: 50861 - protein, 11 aa, Borrelia burgdorferi
LRPKSSLQDIA

SEQ ID NO: 50862 - protein, 11 aa, Borrelia burgdorferi
RPKSSLQDIAG

SEQ ID NO: 50863 - protein, 11 aa, Borrelia burgdorferi
PKSSLQDIAGS

SEQ ID NO: 50864 - protein, 11 aa, Borrelia burgdorferi
KSSLQDIAGSN

SEQ ID NO: 50865 - protein, 11 aa, Borrelia burgdorferi
SSLQDIAGSNS

SEQ ID NO: 50866 - protein, 11 aa, Borrelia burgdorferi
SLQDIAGSNSI

SEQ ID NO: 50867 - protein, 11 aa, Borrelia burgdorferi
LQDIAGSNSIS

SEQ ID NO: 50868 - protein, 11 aa, Borrelia burgdorferi
QDIAGSNSISY

SEQ ID NO: 50869 - protein, 11 aa, Borrelia burgdorferi
DIAGSNSISYT

SEQ ID NO: 50870 - protein, 11 aa, Borrelia burgdorferi
IAGSNSISYTD

SEQ ID NO: 50871 - protein, 11 aa, Borrelia burgdorferi
AGSNSISYTDE

SEQ ID NO: 50872 - protein, 11 aa, Borrelia burgdorferi
GSNSISYTDEI

SEQ ID NO: 50873 - protein, 11 aa, Borrelia burgdorferi
SNSISYTDEIE

SEQ ID NO: 50874 - protein, 11 aa, Borrelia burgdorferi
NSISYTDEIEE

SEQ ID NO: 50875 - protein, 11 aa, Borrelia burgdorferi
SISYTDEIEEE

SEQ ID NO: 50876 - protein, 11 aa, Borrelia burgdorferi
ISYTDEIEEED

SEQ ID NO: 50877 - protein, 11 aa, Borrelia burgdorferi
SYTDEIEEEDY

SEQ ID NO: 50878 - protein, 11 aa, Borrelia burgdorferi
YTDEIEEEDYA

SEQ ID NO: 50879 - protein, 11 aa, Borrelia burgdorferi
TDEIEEEDYAR

SEQ ID NO: 50880 - protein, 11 aa, Borrelia burgdorferi
DEIEEEDYARY

SEQ ID NO: 50881 - protein, 11 aa, Borrelia burgdorferi
EIEEEDYARYY

SEQ ID NO: 50882 - protein, 11 aa, Borrelia burgdorferi
IEEEDYARYYL

SEQ ID NO: 50883 - protein, 11 aa, Borrelia burgdorferi
EEEDYARYYLD

SEQ ID NO: 50884 - protein, 11 aa, Borrelia burgdorferi
EEDYARYYLDE

SEQ ID NO: 50885 - protein, 11 aa, Borrelia burgdorferi
EDYARYYLDED

SEQ ID NO: 50886 - protein, 11 aa, Borrelia burgdorferi
DYARYYLDEDD

SEQ ID NO: 50887 - protein, 11 aa, Borrelia burgdorferi
YARYYLDEDDE

SEQ ID NO: 50888 - protein, 11 aa, Borrelia burgdorferi
ARYYLDEDDED

SEQ ID NO: 50889 - protein, 11 aa, Borrelia burgdorferi
RYYLDEDDEDD

SEQ ID NO: 50890 - protein, 11 aa, Borrelia burgdorferi
YYLDEDDEDDE

SEQ ID NO: 50891 - protein, 11 aa, Borrelia burgdorferi
YLDEDDEDDEY

SEQ ID NO: 50892 - protein, 11 aa, Borrelia burgdorferi
LDEDDEDDEYY

SEQ ID NO: 50893 - protein, 11 aa, Borrelia burgdorferi
DEDDEDDEYYE

SEQ ID NO: 50894 - protein, 11 aa, Borrelia burgdorferi
EDDEDDEYYED

SEQ ID NO: 50895 - protein, 11 aa, Borrelia burgdorferi
DDEDDEYYEDD

SEQ ID NO: 50896 - protein, 11 aa, Borrelia burgdorferi
DEDDEYYEDDY

SEQ ID NO: 50897 - protein, 11 aa, Borrelia burgdorferi
EDDEYYEDDYE

SEQ ID NO: 50898 - protein, 11 aa, Borrelia burgdorferi
DDEYYEDDYEE

SEQ ID NO: 50899 - protein, 11 aa, Borrelia burgdorferi
DEYYEDDYEEI

SEQ ID NO: 50900 - protein, 11 aa, Borrelia burgdorferi
EYYEDDYEEIR

SEQ ID NO: 50901 - protein, 11 aa, Borrelia burgdorferi
YYEDDYEEIRL

SEQ ID NO: 50902 - protein, 11 aa, Borrelia burgdorferi
YEDDYEEIRLS

SEQ ID NO: 50903 - protein, 11 aa, Borrelia burgdorferi
EDDYEEIRLSN

SEQ ID NO: 50904 - protein, 11 aa, Borrelia burgdorferi
DDYEEIRLSNR

SEQ ID NO: 50905 - protein, 11 aa, Borrelia burgdorferi
DYEEIRLSNRY

SEQ ID NO: 50906 - protein, 11 aa, Borrelia burgdorferi
YEEIRLSNRYQ

SEQ ID NO: 50907 - protein, 11 aa, Borrelia burgdorferi
EEIRLSNRYQS

SEQ ID NO: 50908 - protein, 11 aa, Borrelia burgdorferi
EIRLSNRYQSY

SEQ ID NO: 50909 - protein, 11 aa, Borrelia burgdorferi
IRLSNRYQSYL

SEQ ID NO: 50910 - protein, 11 aa, Borrelia burgdorferi
RLSNRYQSYLE

SEQ ID NO: 50911 - protein, 11 aa, Borrelia burgdorferi
LSNRYQSYLEG

SEQ ID NO: 50912 - protein, 11 aa, Borrelia burgdorferi
SNRYQSYLEGV

SEQ ID NO: 50913 - protein, 11 aa, Borrelia burgdorferi
NRYQSYLEGVK

SEQ ID NO: 50914 - protein, 11 aa, Borrelia burgdorferi
RYQSYLEGVKY

SEQ ID NO: 50915 - protein, 11 aa, Borrelia burgdorferi
YQSYLEGVKYN

SEQ ID NO: 50916 - protein, 11 aa, Borrelia burgdorferi
QSYLEGVKYNV

SEQ ID NO: 50917 - protein, 11 aa, Borrelia burgdorferi
SYLEGVKYNVD

SEQ ID NO: 50918 - protein, 11 aa, Borrelia burgdorferi
YLEGVKYNVDS

SEQ ID NO: 50919 - protein, 11 aa, Borrelia burgdorferi
LEGVKYNVDSA

SEQ ID NO: 50920 - protein, 11 aa, Borrelia burgdorferi
EGVKYNVDSAI

SEQ ID NO: 50921 - protein, 11 aa, Borrelia burgdorferi
GVKYNVDSAIN

SEQ ID NO: 50922 - protein, 11 aa, Borrelia burgdorferi
VKYNVDSAINT

SEQ ID NO: 50923 - protein, 11 aa, Borrelia burgdorferi
KYNVDSAINTI

SEQ ID NO: 50924 - protein, 11 aa, Borrelia burgdorferi
YNVDSAINTIN

SEQ ID NO: 50925 - protein, 11 aa, Borrelia burgdorferi
NVDSAINTINK

SEQ ID NO: 50926 - protein, 11 aa, Borrelia burgdorferi
VDSAINTINKI

SEQ ID NO: 50927 - protein, 11 aa, Borrelia burgdorferi
DSAINTINKIY

SEQ ID NO: 50928 - protein, 11 aa, Borrelia burgdorferi
SAINTINKIYD

SEQ ID NO: 50929 - protein, 11 aa, Borrelia burgdorferi
AINTINKIYDT

SEQ ID NO: 50930 - protein, 11 aa, Borrelia burgdorferi
INTINKIYDTY

SEQ ID NO: 50931 - protein, 11 aa, Borrelia burgdorferi
NTINKIYDTYT

SEQ ID NO: 50932 - protein, 11 aa, Borrelia burgdorferi
TINKIYDTYTL

SEQ ID NO: 50933 - protein, 11 aa, Borrelia burgdorferi
INKIYDTYTLF

SEQ ID NO: 50934 - protein, 11 aa, Borrelia burgdorferi
NKIYDTYTLFS

SEQ ID NO: 50935 - protein, 11 aa, Borrelia burgdorferi
KIYDTYTLFST

SEQ ID NO: 50936 - protein, 11 aa, Borrelia burgdorferi
IYDTYTLFSTK

SEQ ID NO: 50937 - protein, 11 aa, Borrelia burgdorferi
YDTYTLFSTKL

SEQ ID NO: 50938 - protein, 11 aa, Borrelia burgdorferi
DTYTLFSTKLT

SEQ ID NO: 50939 - protein, 11 aa, Borrelia burgdorferi
TYTLFSTKLTQ

SEQ ID NO: 50940 - protein, 11 aa, Borrelia burgdorferi
YTLFSTKLTQM

SEQ ID NO: 50941 - protein, 11 aa, Borrelia burgdorferi
TLFSTKLTQMY

SEQ ID NO: 50942 - protein, 11 aa, Borrelia burgdorferi
LFSTKLTQMYS

SEQ ID NO: 50943 - protein, 11 aa, Borrelia burgdorferi
FSTKLTQMYST

SEQ ID NO: 50944 - protein, 11 aa, Borrelia burgdorferi
STKLTQMYSTR

SEQ ID NO: 50945 - protein, 11 aa, Borrelia burgdorferi
TKLTQMYSTRL

SEQ ID NO: 50946 - protein, 11 aa, Borrelia burgdorferi
KLTQMYSTRLD

SEQ ID NO: 50947 - protein, 11 aa, Borrelia burgdorferi
LTQMYSTRLDN

SEQ ID NO: 50948 - protein, 11 aa, Borrelia burgdorferi
TQMYSTRLDNL

SEQ ID NO: 50949 - protein, 11 aa, Borrelia burgdorferi
QMYSTRLDNLA

SEQ ID NO: 50950 - protein, 11 aa, Borrelia burgdorferi
MYSTRLDNLAK

SEQ ID NO: 50951 - protein, 11 aa, Borrelia burgdorferi
YSTRLDNLAKA

SEQ ID NO: 50952 - protein, 11 aa, Borrelia burgdorferi
STRLDNLAKAK

SEQ ID NO: 50953 - protein, 11 aa, Borrelia burgdorferi
TRLDNLAKAKA

SEQ ID NO: 50954 - protein, 11 aa, Borrelia burgdorferi
RLDNLAKAKAK

SEQ ID NO: 50955 - protein, 11 aa, Borrelia burgdorferi
LDNLAKAKAKE

SEQ ID NO: 50956 - protein, 11 aa, Borrelia burgdorferi
DNLAKAKAKEE

SEQ ID NO: 50957 - protein, 11 aa, Borrelia burgdorferi
NLAKAKAKEEA

SEQ ID NO: 50958 - protein, 11 aa, Borrelia burgdorferi
LAKAKAKEEAA

SEQ ID NO: 50959 - protein, 11 aa, Borrelia burgdorferi
AKAKAKEEAAK

SEQ ID NO: 50960 - protein, 11 aa, Borrelia burgdorferi
KAKAKEEAAKF

SEQ ID NO: 50961 - protein, 11 aa, Borrelia burgdorferi
AKAKEEAAKFT

SEQ ID NO: 50962 - protein, 11 aa, Borrelia burgdorferi
KAKEEAAKFTK

SEQ ID NO: 50963 - protein, 11 aa, Borrelia burgdorferi
AKEEAAKFTKE

SEQ ID NO: 50964 - protein, 11 aa, Borrelia burgdorferi
KEEAAKFTKED

SEQ ID NO: 50965 - protein, 11 aa, Borrelia burgdorferi
EEAAKFTKEDL

SEQ ID NO: 50966 - protein, 11 aa, Borrelia burgdorferi
EAAKFTKEDLE

SEQ ID NO: 50967 - protein, 11 aa, Borrelia burgdorferi
AAKFTKEDLEK

SEQ ID NO: 50968 - protein, 11 aa, Borrelia burgdorferi
AKFTKEDLEKN

SEQ ID NO: 50969 - protein, 11 aa, Borrelia burgdorferi
KFTKEDLEKNF

SEQ ID NO: 50970 - protein, 11 aa, Borrelia burgdorferi
FTKEDLEKNFK

SEQ ID NO: 50971 - protein, 11 aa, Borrelia burgdorferi
TKEDLEKNFKT

SEQ ID NO: 50972 - protein, 11 aa, Borrelia burgdorferi
KEDLEKNFKTL

SEQ ID NO: 50973 - protein, 11 aa, Borrelia burgdorferi
EDLEKNFKTLL

SEQ ID NO: 50974 - protein, 11 aa, Borrelia burgdorferi
DLEKNFKTLLN

SEQ ID NO: 50975 - protein, 11 aa, Borrelia burgdorferi
LEKNFKTLLNY

SEQ ID NO: 50976 - protein, 11 aa, Borrelia burgdorferi
EKNFKTLLNYI

SEQ ID NO: 50977 - protein, 11 aa, Borrelia burgdorferi
KNFKTLLNYIQ

SEQ ID NO: 50978 - protein, 11 aa, Borrelia burgdorferi
NFKTLLNYIQV

SEQ ID NO: 50979 - protein, 11 aa, Borrelia burgdorferi
FKTLLNYIQVS

SEQ ID NO: 50980 - protein, 11 aa, Borrelia burgdorferi
KTLLNYIQVSV

SEQ ID NO: 50981 - protein, 11 aa, Borrelia burgdorferi
TLLNYIQVSVK

SEQ ID NO: 50982 - protein, 11 aa, Borrelia burgdorferi
LLNYIQVSVKT

SEQ ID NO: 50983 - protein, 11 aa, Borrelia burgdorferi
LNYIQVSVKTA

SEQ ID NO: 50984 - protein, 11 aa, Borrelia burgdorferi
NYIQVSVKTAA

SEQ ID NO: 50985 - protein, 11 aa, Borrelia burgdorferi
YIQVSVKTAAN

SEQ ID NO: 50986 - protein, 11 aa, Borrelia burgdorferi
IQVSVKTAANF

SEQ ID NO: 50987 - protein, 11 aa, Borrelia burgdorferi
QVSVKTAANFV

SEQ ID NO: 50988 - protein, 11 aa, Borrelia burgdorferi
VSVKTAANFVY

SEQ ID NO: 50989 - protein, 11 aa, Borrelia burgdorferi
SVKTAANFVYI

SEQ ID NO: 50990 - protein, 11 aa, Borrelia burgdorferi
VKTAANFVYIN

SEQ ID NO: 50991 - protein, 11 aa, Borrelia burgdorferi
KTAANFVYIND

SEQ ID NO: 50992 - protein, 11 aa, Borrelia burgdorferi
TAANFVYINDT

SEQ ID NO: 50993 - protein, 11 aa, Borrelia burgdorferi
AANFVYINDTH

SEQ ID NO: 50994 - protein, 11 aa, Borrelia burgdorferi
ANFVYINDTHA

SEQ ID NO: 50995 - protein, 11 aa, Borrelia burgdorferi
NFVYINDTHAK

SEQ ID NO: 50996 - protein, 11 aa, Borrelia burgdorferi
FVYINDTHAKR

SEQ ID NO: 50997 - protein, 11 aa, Borrelia burgdorferi
VYINDTHAKRK

SEQ ID NO: 50998 - protein, 11 aa, Borrelia burgdorferi
YINDTHAKRKL

SEQ ID NO: 50999 - protein, 11 aa, Borrelia burgdorferi
INDTHAKRKLE

SEQ ID NO: 51000 - protein, 11 aa, Borrelia burgdorferi
NDTHAKRKLEN

SEQ ID NO: 51001 - protein, 11 aa, Borrelia burgdorferi
DTHAKRKLENI

SEQ ID NO: 51002 - protein, 11 aa, Borrelia burgdorferi
THAKRKLENIE

SEQ ID NO: 51003 - protein, 11 aa, Borrelia burgdorferi
HAKRKLENIEA

SEQ ID NO: 51004 - protein, 11 aa, Borrelia burgdorferi
AKRKLENIEAE

SEQ ID NO: 51005 - protein, 11 aa, Borrelia burgdorferi
KRKLENIEAEI

SEQ ID NO: 51006 - protein, 11 aa, Borrelia burgdorferi
RKLENIEAEIK

SEQ ID NO: 51007 - protein, 11 aa, Borrelia burgdorferi
KLENIEAEIKT

SEQ ID NO: 51008 - protein, 11 aa, Borrelia burgdorferi
LENIEAEIKTL

SEQ ID NO: 51009 - protein, 11 aa, Borrelia burgdorferi
ENIEAEIKTLI

SEQ ID NO: 51010 - protein, 11 aa, Borrelia burgdorferi
NIEAEIKTLIA

SEQ ID NO: 51011 - protein, 11 aa, Borrelia burgdorferi
IEAEIKTLIAK

SEQ ID NO: 51012 - protein, 11 aa, Borrelia burgdorferi
EAEIKTLIAKI

SEQ ID NO: 51013 - protein, 11 aa, Borrelia burgdorferi
AEIKTLIAKIK

SEQ ID NO: 51014 - protein, 11 aa, Borrelia burgdorferi
EIKTLIAKIKE

SEQ ID NO: 51015 - protein, 11 aa, Borrelia burgdorferi
IKTLIAKIKEQ

SEQ ID NO: 51016 - protein, 11 aa, Borrelia burgdorferi
KTLIAKIKEQS

SEQ ID NO: 51017 - protein, 11 aa, Borrelia burgdorferi
TLIAKIKEQSN

SEQ ID NO: 51018 - protein, 11 aa, Borrelia burgdorferi
LIAKIKEQSNL

SEQ ID NO: 51019 - protein, 11 aa, Borrelia burgdorferi
IAKIKEQSNLY

SEQ ID NO: 51020 - protein, 11 aa, Borrelia burgdorferi
AKIKEQSNLYE

SEQ ID NO: 51021 - protein, 11 aa, Borrelia burgdorferi
KIKEQSNLYEA

SEQ ID NO: 51022 - protein, 11 aa, Borrelia burgdorferi
IKEQSNLYEAY

SEQ ID NO: 51023 - protein, 11 aa, Borrelia burgdorferi
KEQSNLYEAYK

SEQ ID NO: 51024 - protein, 11 aa, Borrelia burgdorferi
EQSNLYEAYKA

SEQ ID NO: 51025 - protein, 11 aa, Borrelia burgdorferi
QSNLYEAYKAI

SEQ ID NO: 51026 - protein, 11 aa, Borrelia burgdorferi
SNLYEAYKAIV

SEQ ID NO: 51027 - protein, 11 aa, Borrelia burgdorferi
NLYEAYKAIVT

SEQ ID NO: 51028 - protein, 11 aa, Borrelia burgdorferi
LYEAYKAIVTS

SEQ ID NO: 51029 - protein, 11 aa, Borrelia burgdorferi
YEAYKAIVTSI

SEQ ID NO: 51030 - protein, 11 aa, Borrelia burgdorferi
EAYKAIVTSIL

SEQ ID NO: 51031 - protein, 11 aa, Borrelia burgdorferi
AYKAIVTSILL

SEQ ID NO: 51032 - protein, 11 aa, Borrelia burgdorferi
YKAIVTSILLM

SEQ ID NO: 51033 - protein, 11 aa, Borrelia burgdorferi
KAIVTSILLMR

SEQ ID NO: 51034 - protein, 11 aa, Borrelia burgdorferi
AIVTSILLMRD

SEQ ID NO: 51035 - protein, 11 aa, Borrelia burgdorferi
IVTSILLMRDS

SEQ ID NO: 51036 - protein, 11 aa, Borrelia burgdorferi
VTSILLMRDSL

SEQ ID NO: 51037 - protein, 11 aa, Borrelia burgdorferi
TSILLMRDSLK

SEQ ID NO: 51038 - protein, 11 aa, Borrelia burgdorferi
SILLMRDSLKE

SEQ ID NO: 51039 - protein, 11 aa, Borrelia burgdorferi
ILLMRDSLKEV

SEQ ID NO: 51040 - protein, 11 aa, Borrelia burgdorferi
LLMRDSLKEVQ

SEQ ID NO: 51041 - protein, 11 aa, Borrelia burgdorferi
LMRDSLKEVQG

SEQ ID NO: 51042 - protein, 11 aa, Borrelia burgdorferi
MRDSLKEVQGI

SEQ ID NO: 51043 - protein, 11 aa, Borrelia burgdorferi
RDSLKEVQGII

SEQ ID NO: 51044 - protein, 11 aa, Borrelia burgdorferi
DSLKEVQGIID

SEQ ID NO: 51045 - protein, 11 aa, Borrelia burgdorferi
SLKEVQGIIDK

SEQ ID NO: 51046 - protein, 11 aa, Borrelia burgdorferi
LKEVQGIIDKN

SEQ ID NO: 51047 - protein, 11 aa, Borrelia burgdorferi
KEVQGIIDKNG

SEQ ID NO: 51048 - protein, 11 aa, Borrelia burgdorferi
EVQGIIDKNGV

SEQ ID NO: 51049 - protein, 11 aa, Borrelia burgdorferi
VQGIIDKNGVW

SEQ ID NO: 51050 - protein, 11 aa, Borrelia burgdorferi
QGIIDKNGVWY

SEQ ID NO: 51051 - protein, 8 aa, Borrelia afzelii
MKIKSKCL

SEQ ID NO: 51052 - protein, 8 aa, Borrelia afzelii
KIKSKCLA

SEQ ID NO: 51053 - protein, 8 aa, Borrelia afzelii
IKSKCLAL

SEQ ID NO: 51054 - protein, 8 aa, Borrelia afzelii
KSKCLALG

SEQ ID NO: 51055 - protein, 8 aa, Borrelia afzelii
SKCLALGL

SEQ ID NO: 51056 - protein, 8 aa, Borrelia afzelii
KCLALGLL

SEQ ID NO: 51057 - protein, 8 aa, Borrelia afzelii
CLALGLLF

SEQ ID NO: 51058 - protein, 8 aa, Borrelia afzelii
LALGLLFG

SEQ ID NO: 51059 - protein, 8 aa, Borrelia afzelii
ALGLLFGF

SEQ ID NO: 51060 - protein, 8 aa, Borrelia afzelii
LGLLFGFI

SEQ ID NO: 51061 - protein, 8 aa, Borrelia afzelii
GLLFGFIS

SEQ ID NO: 51062 - protein, 8 aa, Borrelia afzelii
LLFGFISC

SEQ ID NO: 51063 - protein, 8 aa, Borrelia afzelii
LFGFISCD

SEQ ID NO: 51064 - protein, 8 aa, Borrelia afzelii
FGFISCDL

SEQ ID NO: 51065 - protein, 8 aa, Borrelia afzelii
GFISCDLF

SEQ ID NO: 51066 - protein, 8 aa, Borrelia afzelii
FISCDLFI

SEQ ID NO: 51067 - protein, 8 aa, Borrelia afzelii
ISCDLFIR

SEQ ID NO: 51068 - protein, 8 aa, Borrelia afzelii
SCDLFIRD

SEQ ID NO: 51069 - protein, 8 aa, Borrelia afzelii
CDLFIRDE

SEQ ID NO: 51070 - protein, 8 aa, Borrelia afzelii
DLFIRDEI

SEQ ID NO: 51071 - protein, 8 aa, Borrelia afzelii
LFIRDEIK

SEQ ID NO: 51072 - protein, 8 aa, Borrelia afzelii
FIRDEIKE

SEQ ID NO: 51073 - protein, 8 aa, Borrelia afzelii
IRDEIKEK

SEQ ID NO: 51074 - protein, 8 aa, Borrelia afzelii
RDEIKEKS

SEQ ID NO: 51075 - protein, 8 aa, Borrelia afzelii
DEIKEKSL

SEQ ID NO: 51076 - protein, 8 aa, Borrelia afzelii
EIKEKSLG

SEQ ID NO: 51077 - protein, 8 aa, Borrelia afzelii
IKEKSLGL

SEQ ID NO: 51078 - protein, 8 aa, Borrelia afzelii
KEKSLGLC

SEQ ID NO: 51079 - protein, 8 aa, Borrelia afzelii
EKSLGLCD

SEQ ID NO: 51080 - protein, 8 aa, Borrelia afzelii
KSLGLCDE

SEQ ID NO: 51081 - protein, 8 aa, Borrelia afzelii
SLGLCDEE

SEQ ID NO: 51082 - protein, 8 aa, Borrelia afzelii
LGLCDEES

SEQ ID NO: 51083 - protein, 8 aa, Borrelia afzelii
GLCDEESS

SEQ ID NO: 51084 - protein, 8 aa, Borrelia afzelii
LCDEESSI

SEQ ID NO: 51085 - protein, 8 aa, Borrelia afzelii
CDEESSIL

SEQ ID NO: 51086 - protein, 8 aa, Borrelia afzelii
DEESSILE

SEQ ID NO: 51087 - protein, 8 aa, Borrelia afzelii
EESSILET

SEQ ID NO: 51088 - protein, 8 aa, Borrelia afzelii
ESSILETG

SEQ ID NO: 51089 - protein, 8 aa, Borrelia afzelii
SSILETGD

SEQ ID NO: 51090 - protein, 8 aa, Borrelia afzelii
SILETGDK

SEQ ID NO: 51091 - protein, 8 aa, Borrelia afzelii
ILETGDKS

SEQ ID NO: 51092 - protein, 8 aa, Borrelia afzelii
LETGDKSV

SEQ ID NO: 51093 - protein, 8 aa, Borrelia afzelii
ETGDKSVK

SEQ ID NO: 51094 - protein, 8 aa, Borrelia afzelii
TGDKSVKK

SEQ ID NO: 51095 - protein, 8 aa, Borrelia afzelii
GDKSVKKS

SEQ ID NO: 51096 - protein, 8 aa, Borrelia afzelii
DKSVKKSL

SEQ ID NO: 51097 - protein, 8 aa, Borrelia afzelii
KSVKKSLN

SEQ ID NO: 51098 - protein, 8 aa, Borrelia afzelii
SVKKSLNK

SEQ ID NO: 51099 - protein, 8 aa, Borrelia afzelii
VKKSLNKK

SEQ ID NO: 51100 - protein, 8 aa, Borrelia afzelii
KKSLNKKG

SEQ ID NO: 51101 - protein, 8 aa, Borrelia afzelii
KSLNKKGK

SEQ ID NO: 51102 - protein, 8 aa, Borrelia afzelii
SLNKKGKD

SEQ ID NO: 51103 - protein, 8 aa, Borrelia afzelii
LNKKGKDK

SEQ ID NO: 51104 - protein, 8 aa, Borrelia afzelii
NKKGKDKV

SEQ ID NO: 51105 - protein, 8 aa, Borrelia afzelii
KKGKDKVA

SEQ ID NO: 51106 - protein, 8 aa, Borrelia afzelii
KGKDKVAR

SEQ ID NO: 51107 - protein, 8 aa, Borrelia afzelii
GKDKVARK

SEQ ID NO: 51108 - protein, 8 aa, Borrelia afzelii
KDKVARKK

SEQ ID NO: 51109 - protein, 8 aa, Borrelia afzelii
DKVARKKV

SEQ ID NO: 51110 - protein, 8 aa, Borrelia afzelii
KVARKKVE

SEQ ID NO: 51111 - protein, 8 aa, Borrelia afzelii
VARKKVEG

SEQ ID NO: 51112 - protein, 8 aa, Borrelia afzelii
ARKKVEGN

SEQ ID NO: 51113 - protein, 8 aa, Borrelia afzelii
RKKVEGNA

SEQ ID NO: 51114 - protein, 8 aa, Borrelia afzelii
KKVEGNAV

SEQ ID NO: 51115 - protein, 8 aa, Borrelia afzelii
KVEGNAVK

SEQ ID NO: 51116 - protein, 8 aa, Borrelia afzelii
VEGNAVKK

SEQ ID NO: 51117 - protein, 8 aa, Borrelia afzelii
EGNAVKKD

SEQ ID NO: 51118 - protein, 8 aa, Borrelia afzelii
GNAVKKDP

SEQ ID NO: 51119 - protein, 8 aa, Borrelia afzelii
NAVKKDPF

SEQ ID NO: 51120 - protein, 8 aa, Borrelia afzelii
AVKKDPFN

SEQ ID NO: 51121 - protein, 8 aa, Borrelia afzelii
VKKDPFNH

SEQ ID NO: 51122 - protein, 8 aa, Borrelia afzelii
KKDPFNHH

SEQ ID NO: 51123 - protein, 8 aa, Borrelia afzelii
KDPFNHHV

SEQ ID NO: 51124 - protein, 8 aa, Borrelia afzelii
DPFNHHVK

SEQ ID NO: 51125 - protein, 8 aa, Borrelia afzelii
PFNHHVKR

SEQ ID NO: 51126 - protein, 8 aa, Borrelia afzelii
FNHHVKRE

SEQ ID NO: 51127 - protein, 8 aa, Borrelia afzelii
NHHVKRES

SEQ ID NO: 51128 - protein, 8 aa, Borrelia afzelii
HHVKRESV

SEQ ID NO: 51129 - protein, 8 aa, Borrelia afzelii
HVKRESVN

SEQ ID NO: 51130 - protein, 8 aa, Borrelia afzelii
VKRESVNN

SEQ ID NO: 51131 - protein, 8 aa, Borrelia afzelii
KRESVNNS

SEQ ID NO: 51132 - protein, 8 aa, Borrelia afzelii
RESVNNSN

SEQ ID NO: 51133 - protein, 8 aa, Borrelia afzelii
ESVNNSNL

SEQ ID NO: 51134 - protein, 8 aa, Borrelia afzelii
SVNNSNLS

SEQ ID NO: 51135 - protein, 8 aa, Borrelia afzelii
VNNSNLSQ

SEQ ID NO: 51136 - protein, 8 aa, Borrelia afzelii
NNSNLSQK

SEQ ID NO: 51137 - protein, 8 aa, Borrelia afzelii
NSNLSQKN

SEQ ID NO: 51138 - protein, 8 aa, Borrelia afzelii
SNLSQKNV

SEQ ID NO: 51139 - protein, 8 aa, Borrelia afzelii
NLSQKNVI

SEQ ID NO: 51140 - protein, 8 aa, Borrelia afzelii
LSQKNVIS

SEQ ID NO: 51141 - protein, 8 aa, Borrelia afzelii
SQKNVISE

SEQ ID NO: 51142 - protein, 8 aa, Borrelia afzelii
QKNVISEE

SEQ ID NO: 51143 - protein, 8 aa, Borrelia afzelii
KNVISEEE

SEQ ID NO: 51144 - protein, 8 aa, Borrelia afzelii
NVISEEEI

SEQ ID NO: 51145 - protein, 8 aa, Borrelia afzelii
VISEEEIL

SEQ ID NO: 51146 - protein, 8 aa, Borrelia afzelii
ISEEEILK

SEQ ID NO: 51147 - protein, 8 aa, Borrelia afzelii
SEEEILKT

SEQ ID NO: 51148 - protein, 8 aa, Borrelia afzelii
EEEILKTK

SEQ ID NO: 51149 - protein, 8 aa, Borrelia afzelii
EEILKTKL

SEQ ID NO: 51150 - protein, 8 aa, Borrelia afzelii
EILKTKLL

SEQ ID NO: 51151 - protein, 8 aa, Borrelia afzelii
ILKTKLLR

SEQ ID NO: 51152 - protein, 8 aa, Borrelia afzelii
LKTKLLRE

SEQ ID NO: 51153 - protein, 8 aa, Borrelia afzelii
KTKLLRER

SEQ ID NO: 51154 - protein, 8 aa, Borrelia afzelii
TKLLRERP

SEQ ID NO: 51155 - protein, 8 aa, Borrelia afzelii
KLLRERPE

SEQ ID NO: 51156 - protein, 8 aa, Borrelia afzelii
LLRERPET

SEQ ID NO: 51157 - protein, 8 aa, Borrelia afzelii
LRERPETR

SEQ ID NO: 51158 - protein, 8 aa, Borrelia afzelii
RERPETRK

SEQ ID NO: 51159 - protein, 8 aa, Borrelia afzelii
ERPETRKE

SEQ ID NO: 51160 - protein, 8 aa, Borrelia afzelii
RPETRKEE

SEQ ID NO: 51161 - protein, 8 aa, Borrelia afzelii
PETRKEEI

SEQ ID NO: 51162 - protein, 8 aa, Borrelia afzelii
ETRKEEIQ

SEQ ID NO: 51163 - protein, 8 aa, Borrelia afzelii
TRKEEIQK

SEQ ID NO: 51164 - protein, 8 aa, Borrelia afzelii
RKEEIQKQ

SEQ ID NO: 51165 - protein, 8 aa, Borrelia afzelii
KEEIQKQQ

SEQ ID NO: 51166 - protein, 8 aa, Borrelia afzelii
EEIQKQQD

SEQ ID NO: 51167 - protein, 8 aa, Borrelia afzelii
EIQKQQDE

SEQ ID NO: 51168 - protein, 8 aa, Borrelia afzelii
IQKQQDEH

SEQ ID NO: 51169 - protein, 8 aa, Borrelia afzelii
QKQQDEHK

SEQ ID NO: 51170 - protein, 8 aa, Borrelia afzelii
KQQDEHKR

SEQ ID NO: 51171 - protein, 8 aa, Borrelia afzelii
QQDEHKRM

SEQ ID NO: 51172 - protein, 8 aa, Borrelia afzelii
QDEHKRML

SEQ ID NO: 51173 - protein, 8 aa, Borrelia afzelii
DEHKRMLQ

SEQ ID NO: 51174 - protein, 8 aa, Borrelia afzelii
EHKRMLQG

SEQ ID NO: 51175 - protein, 8 aa, Borrelia afzelii
HKRMLQGS

SEQ ID NO: 51176 - protein, 8 aa, Borrelia afzelii
KRMLQGSL

SEQ ID NO: 51177 - protein, 8 aa, Borrelia afzelii
RMLQGSLS

SEQ ID NO: 51178 - protein, 8 aa, Borrelia afzelii
MLQGSLSF

SEQ ID NO: 51179 - protein, 8 aa, Borrelia afzelii
LQGSLSFL

SEQ ID NO: 51180 - protein, 8 aa, Borrelia afzelii
QGSLSFLS

SEQ ID NO: 51181 - protein, 8 aa, Borrelia afzelii
GSLSFLSG

SEQ ID NO: 51182 - protein, 8 aa, Borrelia afzelii
SLSFLSGE

SEQ ID NO: 51183 - protein, 8 aa, Borrelia afzelii
LSFLSGES

SEQ ID NO: 51184 - protein, 8 aa, Borrelia afzelii
SFLSGESG

SEQ ID NO: 51185 - protein, 8 aa, Borrelia afzelii
FLSGESGE

SEQ ID NO: 51186 - protein, 8 aa, Borrelia afzelii
LSGESGEL

SEQ ID NO: 51187 - protein, 8 aa, Borrelia afzelii
SGESGELK

SEQ ID NO: 51188 - protein, 8 aa, Borrelia afzelii
GESGELKD

SEQ ID NO: 51189 - protein, 8 aa, Borrelia afzelii
ESGELKDT

SEQ ID NO: 51190 - protein, 8 aa, Borrelia afzelii
SGELKDTI

SEQ ID NO: 51191 - protein, 8 aa, Borrelia afzelii
GELKDTIE

SEQ ID NO: 51192 - protein, 8 aa, Borrelia afzelii
ELKDTIES

SEQ ID NO: 51193 - protein, 8 aa, Borrelia afzelii
LKDTIESN

SEQ ID NO: 51194 - protein, 8 aa, Borrelia afzelii
KDTIESNE

SEQ ID NO: 51195 - protein, 8 aa, Borrelia afzelii
DTIESNEI

SEQ ID NO: 51196 - protein, 8 aa, Borrelia afzelii
TIESNEID

SEQ ID NO: 51197 - protein, 8 aa, Borrelia afzelii
IESNEIDF

SEQ ID NO: 51198 - protein, 8 aa, Borrelia afzelii
ESNEIDFT

SEQ ID NO: 51199 - protein, 8 aa, Borrelia afzelii
SNEIDFTI

SEQ ID NO: 51200 - protein, 8 aa, Borrelia afzelii
NEIDFTID

SEQ ID NO: 51201 - protein, 8 aa, Borrelia afzelii
EIDFTIDS

SEQ ID NO: 51202 - protein, 8 aa, Borrelia afzelii
IDFTIDSD

SEQ ID NO: 51203 - protein, 8 aa, Borrelia afzelii
DFTIDSDL

SEQ ID NO: 51204 - protein, 8 aa, Borrelia afzelii
FTIDSDLR

SEQ ID NO: 51205 - protein, 8 aa, Borrelia afzelii
TIDSDLRL

SEQ ID NO: 51206 - protein, 8 aa, Borrelia afzelii
IDSDLRLK

SEQ ID NO: 51207 - protein, 8 aa, Borrelia afzelii
DSDLRLKS

SEQ ID NO: 51208 - protein, 8 aa, Borrelia afzelii
SDLRLKSD

SEQ ID NO: 51209 - protein, 8 aa, Borrelia afzelii
DLRLKSDL

SEQ ID NO: 51210 - protein, 8 aa, Borrelia afzelii
LRLKSDLQ

SEQ ID NO: 51211 - protein, 8 aa, Borrelia afzelii
RLKSDLQA

SEQ ID NO: 51212 - protein, 8 aa, Borrelia afzelii
LKSDLQAI

SEQ ID NO: 51213 - protein, 8 aa, Borrelia afzelii
KSDLQAIS

SEQ ID NO: 51214 - protein, 8 aa, Borrelia afzelii
SDLQAISG

SEQ ID NO: 51215 - protein, 8 aa, Borrelia afzelii
DLQAISGS

SEQ ID NO: 51216 - protein, 8 aa, Borrelia afzelii
LQAISGSN

SEQ ID NO: 51217 - protein, 8 aa, Borrelia afzelii
QAISGSNS

SEQ ID NO: 51218 - protein, 8 aa, Borrelia afzelii
AISGSNSI

SEQ ID NO: 51219 - protein, 8 aa, Borrelia afzelii
ISGSNSIS

SEQ ID NO: 51220 - protein, 8 aa, Borrelia afzelii
SGSNSISY

SEQ ID NO: 51221 - protein, 8 aa, Borrelia afzelii
GSNSISYT

SEQ ID NO: 51222 - protein, 8 aa, Borrelia afzelii
SNSISYTD

SEQ ID NO: 51223 - protein, 8 aa, Borrelia afzelii
NSISYTDE

SEQ ID NO: 51224 - protein, 8 aa, Borrelia afzelii
SISYTDEI

SEQ ID NO: 51225 - protein, 8 aa, Borrelia afzelii
ISYTDEIE

SEQ ID NO: 51226 - protein, 8 aa, Borrelia afzelii
SYTDEIEE

SEQ ID NO: 51227 - protein, 8 aa, Borrelia afzelii
YTDEIEEE

SEQ ID NO: 51228 - protein, 8 aa, Borrelia afzelii
TDEIEEED

SEQ ID NO: 51229 - protein, 8 aa, Borrelia afzelii
DEIEEEDY

SEQ ID NO: 51230 - protein, 8 aa, Borrelia afzelii
EIEEEDYD

SEQ ID NO: 51231 - protein, 8 aa, Borrelia afzelii
IEEEDYDQ

SEQ ID NO: 51232 - protein, 8 aa, Borrelia afzelii
EEEDYDQY

SEQ ID NO: 51233 - protein, 8 aa, Borrelia afzelii
EEDYDQYS

SEQ ID NO: 51234 - protein, 8 aa, Borrelia afzelii
EDYDQYSL

SEQ ID NO: 51235 - protein, 8 aa, Borrelia afzelii
DYDQYSLE

SEQ ID NO: 51236 - protein, 8 aa, Borrelia afzelii
YDQYSLEE

SEQ ID NO: 51237 - protein, 8 aa, Borrelia afzelii
DQYSLEED

SEQ ID NO: 51238 - protein, 8 aa, Borrelia afzelii
QYSLEEDY

SEQ ID NO: 51239 - protein, 8 aa, Borrelia afzelii
YSLEEDYY

SEQ ID NO: 51240 - protein, 8 aa, Borrelia afzelii
SLEEDYYY

SEQ ID NO: 51241 - protein, 8 aa, Borrelia afzelii
LEEDYYYD

SEQ ID NO: 51242 - protein, 8 aa, Borrelia afzelii
EEDYYYDG

SEQ ID NO: 51243 - protein, 8 aa, Borrelia afzelii
EDYYYDGE

SEQ ID NO: 51244 - protein, 8 aa, Borrelia afzelii
DYYYDGET

SEQ ID NO: 51245 - protein, 8 aa, Borrelia afzelii
YYYDGETR

SEQ ID NO: 51246 - protein, 8 aa, Borrelia afzelii
YYDGETRL

SEQ ID NO: 51247 - protein, 8 aa, Borrelia afzelii
YDGETRLS

SEQ ID NO: 51248 - protein, 8 aa, Borrelia afzelii
DGETRLSN

SEQ ID NO: 51249 - protein, 8 aa, Borrelia afzelii
GETRLSNR

SEQ ID NO: 51250 - protein, 8 aa, Borrelia afzelii
ETRLSNRY

SEQ ID NO: 51251 - protein, 8 aa, Borrelia afzelii
TRLSNRYE

SEQ ID NO: 51252 - protein, 8 aa, Borrelia afzelii
RLSNRYES

SEQ ID NO: 51253 - protein, 8 aa, Borrelia afzelii
LSNRYESY

SEQ ID NO: 51254 - protein, 8 aa, Borrelia afzelii
SNRYESYL

SEQ ID NO: 51255 - protein, 8 aa, Borrelia afzelii
NRYESYLE

SEQ ID NO: 51256 - protein, 8 aa, Borrelia afzelii
RYESYLEG

SEQ ID NO: 51257 - protein, 8 aa, Borrelia afzelii
YESYLEGV

SEQ ID NO: 51258 - protein, 8 aa, Borrelia afzelii
ESYLEGVK

SEQ ID NO: 51259 - protein, 8 aa, Borrelia afzelii
SYLEGVKY

SEQ ID NO: 51260 - protein, 8 aa, Borrelia afzelii
YLEGVKYN

SEQ ID NO: 51261 - protein, 8 aa, Borrelia afzelii
LEGVKYNV

SEQ ID NO: 51262 - protein, 8 aa, Borrelia afzelii
EGVKYNVS

SEQ ID NO: 51263 - protein, 8 aa, Borrelia afzelii
GVKYNVSS

SEQ ID NO: 51264 - protein, 8 aa, Borrelia afzelii
VKYNVSSA

SEQ ID NO: 51265 - protein, 8 aa, Borrelia afzelii
KYNVSSAI

SEQ ID NO: 51266 - protein, 8 aa, Borrelia afzelii
YNVSSAIK

SEQ ID NO: 51267 - protein, 8 aa, Borrelia afzelii
NVSSAIKT

SEQ ID NO: 51268 - protein, 8 aa, Borrelia afzelii
VSSAIKTI

SEQ ID NO: 51269 - protein, 8 aa, Borrelia afzelii
SSAIKTIV

SEQ ID NO: 51270 - protein, 8 aa, Borrelia afzelii
SAIKTIVK

SEQ ID NO: 51271 - protein, 8 aa, Borrelia afzelii
AIKTIVKI

SEQ ID NO: 51272 - protein, 8 aa, Borrelia afzelii
IKTIVKIY

SEQ ID NO: 51273 - protein, 8 aa, Borrelia afzelii
KTIVKIYD

SEQ ID NO: 51274 - protein, 8 aa, Borrelia afzelii
TIVKIYDN

SEQ ID NO: 51275 - protein, 8 aa, Borrelia afzelii
IVKIYDNY

SEQ ID NO: 51276 - protein, 8 aa, Borrelia afzelii
VKIYDNYT

SEQ ID NO: 51277 - protein, 8 aa, Borrelia afzelii
KIYDNYTL

SEQ ID NO: 51278 - protein, 8 aa, Borrelia afzelii
IYDNYTLL

SEQ ID NO: 51279 - protein, 8 aa, Borrelia afzelii
YDNYTLLS

SEQ ID NO: 51280 - protein, 8 aa, Borrelia afzelii
DNYTLLST

SEQ ID NO: 51281 - protein, 8 aa, Borrelia afzelii
NYTLLSTK

SEQ ID NO: 51282 - protein, 8 aa, Borrelia afzelii
YTLLSTKQ

SEQ ID NO: 51283 - protein, 8 aa, Borrelia afzelii
TLLSTKQT

SEQ ID NO: 51284 - protein, 8 aa, Borrelia afzelii
LLSTKQTQ

SEQ ID NO: 51285 - protein, 8 aa, Borrelia afzelii
LSTKQTQM

SEQ ID NO: 51286 - protein, 8 aa, Borrelia afzelii
STKQTQMY

SEQ ID NO: 51287 - protein, 8 aa, Borrelia afzelii
TKQTQMYS

SEQ ID NO: 51288 - protein, 8 aa, Borrelia afzelii
KQTQMYST

SEQ ID NO: 51289 - protein, 8 aa, Borrelia afzelii
QTQMYSTR

SEQ ID NO: 51290 - protein, 8 aa, Borrelia afzelii
TQMYSTRL

SEQ ID NO: 51291 - protein, 8 aa, Borrelia afzelii
QMYSTRLD

SEQ ID NO: 51292 - protein, 8 aa, Borrelia afzelii
MYSTRLDN

SEQ ID NO: 51293 - protein, 8 aa, Borrelia afzelii
YSTRLDNL

SEQ ID NO: 51294 - protein, 8 aa, Borrelia afzelii
STRLDNLA

SEQ ID NO: 51295 - protein, 8 aa, Borrelia afzelii
TRLDNLAK

SEQ ID NO: 51296 - protein, 8 aa, Borrelia afzelii
RLDNLAKA

SEQ ID NO: 51297 - protein, 8 aa, Borrelia afzelii
LDNLAKAK

SEQ ID NO: 51298 - protein, 8 aa, Borrelia afzelii
DNLAKAKA

SEQ ID NO: 51299 - protein, 8 aa, Borrelia afzelii
NLAKAKAR

SEQ ID NO: 51300 - protein, 8 aa, Borrelia afzelii
LAKAKARE

SEQ ID NO: 51301 - protein, 8 aa, Borrelia afzelii
AKAKAREE

SEQ ID NO: 51302 - protein, 8 aa, Borrelia afzelii
KAKAREEA

SEQ ID NO: 51303 - protein, 8 aa, Borrelia afzelii
AKAREEAK

SEQ ID NO: 51304 - protein, 8 aa, Borrelia afzelii
KAREEAKK

SEQ ID NO: 51305 - protein, 8 aa, Borrelia afzelii
AREEAKKF

SEQ ID NO: 51306 - protein, 8 aa, Borrelia afzelii
REEAKKFT

SEQ ID NO: 51307 - protein, 8 aa, Borrelia afzelii
EEAKKFTK

SEQ ID NO: 51308 - protein, 8 aa, Borrelia afzelii
EAKKFTKE

SEQ ID NO: 51309 - protein, 8 aa, Borrelia afzelii
AKKFTKEE

SEQ ID NO: 51310 - protein, 8 aa, Borrelia afzelii
KKFTKEEL

SEQ ID NO: 51311 - protein, 8 aa, Borrelia afzelii
KFTKEELE

SEQ ID NO: 51312 - protein, 8 aa, Borrelia afzelii
FTKEELEK

SEQ ID NO: 51313 - protein, 8 aa, Borrelia afzelii
TKEELEKD

SEQ ID NO: 51314 - protein, 8 aa, Borrelia afzelii
KEELEKDL

SEQ ID NO: 51315 - protein, 8 aa, Borrelia afzelii
EELEKDLK

SEQ ID NO: 51316 - protein, 8 aa, Borrelia afzelii
ELEKDLKT

SEQ ID NO: 51317 - protein, 8 aa, Borrelia afzelii
LEKDLKTL

SEQ ID NO: 51318 - protein, 8 aa, Borrelia afzelii
EKDLKTLL

SEQ ID NO: 51319 - protein, 8 aa, Borrelia afzelii
KDLKTLLN

SEQ ID NO: 51320 - protein, 8 aa, Borrelia afzelii
DLKTLLNY

SEQ ID NO: 51321 - protein, 8 aa, Borrelia afzelii
LKTLLNYI

SEQ ID NO: 51322 - protein, 8 aa, Borrelia afzelii
KTLLNYIQ

SEQ ID NO: 51323 - protein, 8 aa, Borrelia afzelii
TLLNYIQV

SEQ ID NO: 51324 - protein, 8 aa, Borrelia afzelii
LLNYIQVS

SEQ ID NO: 51325 - protein, 8 aa, Borrelia afzelii
LNYIQVSA

SEQ ID NO: 51326 - protein, 8 aa, Borrelia afzelii
NYIQVSAR

SEQ ID NO: 51327 - protein, 8 aa, Borrelia afzelii
YIQVSART

SEQ ID NO: 51328 - protein, 8 aa, Borrelia afzelii
IQVSARTA

SEQ ID NO: 51329 - protein, 8 aa, Borrelia afzelii
QVSARTAT

SEQ ID NO: 51330 - protein, 8 aa, Borrelia afzelii
VSARTATN

SEQ ID NO: 51331 - protein, 8 aa, Borrelia afzelii
SARTATNF

SEQ ID NO: 51332 - protein, 8 aa, Borrelia afzelii
ARTATNFV

SEQ ID NO: 51333 - protein, 8 aa, Borrelia afzelii
RTATNFVY

SEQ ID NO: 51334 - protein, 8 aa, Borrelia afzelii
TATNFVYA

SEQ ID NO: 51335 - protein, 8 aa, Borrelia afzelii
ATNFVYAR

SEQ ID NO: 51336 - protein, 8 aa, Borrelia afzelii
TNFVYARE

SEQ ID NO: 51337 - protein, 8 aa, Borrelia afzelii
NFVYAREI

SEQ ID NO: 51338 - protein, 8 aa, Borrelia afzelii
FVYAREIY

SEQ ID NO: 51339 - protein, 8 aa, Borrelia afzelii
VYAREIYS

SEQ ID NO: 51340 - protein, 8 aa, Borrelia afzelii
YAREIYSK

SEQ ID NO: 51341 - protein, 8 aa, Borrelia afzelii
AREIYSKR

SEQ ID NO: 51342 - protein, 8 aa, Borrelia afzelii
REIYSKRK

SEQ ID NO: 51343 - protein, 8 aa, Borrelia afzelii
EIYSKRKL

SEQ ID NO: 51344 - protein, 8 aa, Borrelia afzelii
IYSKRKLD

SEQ ID NO: 51345 - protein, 8 aa, Borrelia afzelii
YSKRKLDA

SEQ ID NO: 51346 - protein, 8 aa, Borrelia afzelii
SKRKLDAI

SEQ ID NO: 51347 - protein, 8 aa, Borrelia afzelii
KRKLDAIE

SEQ ID NO: 51348 - protein, 8 aa, Borrelia afzelii
RKLDAIET

SEQ ID NO: 51349 - protein, 8 aa, Borrelia afzelii
KLDAIETE

SEQ ID NO: 51350 - protein, 8 aa, Borrelia afzelii
LDAIETEI

SEQ ID NO: 51351 - protein, 8 aa, Borrelia afzelii
DAIETEIK

SEQ ID NO: 51352 - protein, 8 aa, Borrelia afzelii
AIETEIKN

SEQ ID NO: 51353 - protein, 8 aa, Borrelia afzelii
IETEIKNL

SEQ ID NO: 51354 - protein, 8 aa, Borrelia afzelii
ETEIKNLI

SEQ ID NO: 51355 - protein, 8 aa, Borrelia afzelii
TEIKNLIL

SEQ ID NO: 51356 - protein, 8 aa, Borrelia afzelii
EIKNLILK

SEQ ID NO: 51357 - protein, 8 aa, Borrelia afzelii
IKNLILKI

SEQ ID NO: 51358 - protein, 8 aa, Borrelia afzelii
KNLILKIK

SEQ ID NO: 51359 - protein, 8 aa, Borrelia afzelii
NLILKIKG

SEQ ID NO: 51360 - protein, 8 aa, Borrelia afzelii
LILKIKGQ

SEQ ID NO: 51361 - protein, 8 aa, Borrelia afzelii
ILKIKGQS

SEQ ID NO: 51362 - protein, 8 aa, Borrelia afzelii
LKIKGQSD

SEQ ID NO: 51363 - protein, 8 aa, Borrelia afzelii
KIKGQSDL

SEQ ID NO: 51364 - protein, 8 aa, Borrelia afzelii
IKGQSDLY

SEQ ID NO: 51365 - protein, 8 aa, Borrelia afzelii
KGQSDLYE

SEQ ID NO: 51366 - protein, 8 aa, Borrelia afzelii
GQSDLYEA

SEQ ID NO: 51367 - protein, 8 aa, Borrelia afzelii
QSDLYEAY

SEQ ID NO: 51368 - protein, 8 aa, Borrelia afzelii
SDLYEAYK

SEQ ID NO: 51369 - protein, 8 aa, Borrelia afzelii
DLYEAYKA

SEQ ID NO: 51370 - protein, 8 aa, Borrelia afzelii
LYEAYKAI

SEQ ID NO: 51371 - protein, 8 aa, Borrelia afzelii
YEAYKAIV

SEQ ID NO: 51372 - protein, 8 aa, Borrelia afzelii
EAYKAIVR

SEQ ID NO: 51373 - protein, 8 aa, Borrelia afzelii
AYKAIVRS

SEQ ID NO: 51374 - protein, 8 aa, Borrelia afzelii
YKAIVRSI

SEQ ID NO: 51375 - protein, 8 aa, Borrelia afzelii
KAIVRSIL

SEQ ID NO: 51376 - protein, 8 aa, Borrelia afzelii
AIVRSILL

SEQ ID NO: 51377 - protein, 8 aa, Borrelia afzelii
IVRSILLM

SEQ ID NO: 51378 - protein, 8 aa, Borrelia afzelii
VRSILLMK

SEQ ID NO: 51379 - protein, 8 aa, Borrelia afzelii
RSILLMKD

SEQ ID NO: 51380 - protein, 8 aa, Borrelia afzelii
SILLMKDS

SEQ ID NO: 51381 - protein, 8 aa, Borrelia afzelii
ILLMKDSL

SEQ ID NO: 51382 - protein, 8 aa, Borrelia afzelii
LLMKDSLK

SEQ ID NO: 51383 - protein, 8 aa, Borrelia afzelii
LMKDSLKI

SEQ ID NO: 51384 - protein, 8 aa, Borrelia afzelii
MKDSLKII

SEQ ID NO: 51385 - protein, 8 aa, Borrelia afzelii
KDSLKIIE

SEQ ID NO: 51386 - protein, 8 aa, Borrelia afzelii
DSLKIIEI

SEQ ID NO: 51387 - protein, 8 aa, Borrelia afzelii
SLKIIEIV

SEQ ID NO: 51388 - protein, 8 aa, Borrelia afzelii
LKIIEIVI

SEQ ID NO: 51389 - protein, 8 aa, Borrelia afzelii
KIIEIVID

SEQ ID NO: 51390 - protein, 8 aa, Borrelia afzelii
IIEIVIDK

SEQ ID NO: 51391 - protein, 8 aa, Borrelia afzelii
IEIVIDKN

SEQ ID NO: 51392 - protein, 8 aa, Borrelia afzelii
EIVIDKNG

SEQ ID NO: 51393 - protein, 8 aa, Borrelia afzelii
IVIDKNGV

SEQ ID NO: 51394 - protein, 8 aa, Borrelia afzelii
VIDKNGVW

SEQ ID NO: 51395 - protein, 8 aa, Borrelia afzelii
IDKNGVWY

SEQ ID NO: 51396 - protein, 9 aa, Borrelia afzelii
MKIKSKCLA

SEQ ID NO: 51397 - protein, 9 aa, Borrelia afzelii
KIKSKCLAL

SEQ ID NO: 51398 - protein, 9 aa, Borrelia afzelii
IKSKCLALG

SEQ ID NO: 51399 - protein, 9 aa, Borrelia afzelii
KSKCLALGL

SEQ ID NO: 51400 - protein, 9 aa, Borrelia afzelii
SKCLALGLL

SEQ ID NO: 51401 - protein, 9 aa, Borrelia afzelii
KCLALGLLF

SEQ ID NO: 51402 - protein, 9 aa, Borrelia afzelii
CLALGLLFG

SEQ ID NO: 51403 - protein, 9 aa, Borrelia afzelii
LALGLLFGF

SEQ ID NO: 51404 - protein, 9 aa, Borrelia afzelii
ALGLLFGFI

SEQ ID NO: 51405 - protein, 9 aa, Borrelia afzelii
LGLLFGFIS

SEQ ID NO: 51406 - protein, 9 aa, Borrelia afzelii
GLLFGFISC

SEQ ID NO: 51407 - protein, 9 aa, Borrelia afzelii
LLFGFISCD

SEQ ID NO: 51408 - protein, 9 aa, Borrelia afzelii
LFGFISCDL

SEQ ID NO: 51409 - protein, 9 aa, Borrelia afzelii
FGFISCDLF

SEQ ID NO: 51410 - protein, 9 aa, Borrelia afzelii
GFISCDLFI

SEQ ID NO: 51411 - protein, 9 aa, Borrelia afzelii
FISCDLFIR

SEQ ID NO: 51412 - protein, 9 aa, Borrelia afzelii
ISCDLFIRD

SEQ ID NO: 51413 - protein, 9 aa, Borrelia afzelii
SCDLFIRDE

SEQ ID NO: 51414 - protein, 9 aa, Borrelia afzelii
CDLFIRDEI

SEQ ID NO: 51415 - protein, 9 aa, Borrelia afzelii
DLFIRDEIK

SEQ ID NO: 51416 - protein, 9 aa, Borrelia afzelii
LFIRDEIKE

SEQ ID NO: 51417 - protein, 9 aa, Borrelia afzelii
FIRDEIKEK

SEQ ID NO: 51418 - protein, 9 aa, Borrelia afzelii
IRDEIKEKS

SEQ ID NO: 51419 - protein, 9 aa, Borrelia afzelii
RDEIKEKSL

SEQ ID NO: 51420 - protein, 9 aa, Borrelia afzelii
DEIKEKSLG

SEQ ID NO: 51421 - protein, 9 aa, Borrelia afzelii
EIKEKSLGL

SEQ ID NO: 51422 - protein, 9 aa, Borrelia afzelii
IKEKSLGLC

SEQ ID NO: 51423 - protein, 9 aa, Borrelia afzelii
KEKSLGLCD

SEQ ID NO: 51424 - protein, 9 aa, Borrelia afzelii
EKSLGLCDE

SEQ ID NO: 51425 - protein, 9 aa, Borrelia afzelii
KSLGLCDEE

SEQ ID NO: 51426 - protein, 9 aa, Borrelia afzelii
SLGLCDEES

SEQ ID NO: 51427 - protein, 9 aa, Borrelia afzelii
LGLCDEESS

SEQ ID NO: 51428 - protein, 9 aa, Borrelia afzelii
GLCDEESSI

SEQ ID NO: 51429 - protein, 9 aa, Borrelia afzelii
LCDEESSIL

SEQ ID NO: 51430 - protein, 9 aa, Borrelia afzelii
CDEESSILE

SEQ ID NO: 51431 - protein, 9 aa, Borrelia afzelii
DEESSILET

SEQ ID NO: 51432 - protein, 9 aa, Borrelia afzelii
EESSILETG

SEQ ID NO: 51433 - protein, 9 aa, Borrelia afzelii
ESSILETGD

SEQ ID NO: 51434 - protein, 9 aa, Borrelia afzelii
SSILETGDK

SEQ ID NO: 51435 - protein, 9 aa, Borrelia afzelii
SILETGDKS

SEQ ID NO: 51436 - protein, 9 aa, Borrelia afzelii
ILETGDKSV

SEQ ID NO: 51437 - protein, 9 aa, Borrelia afzelii
LETGDKSVK

SEQ ID NO: 51438 - protein, 9 aa, Borrelia afzelii
ETGDKSVKK

SEQ ID NO: 51439 - protein, 9 aa, Borrelia afzelii
TGDKSVKKS

SEQ ID NO: 51440 - protein, 9 aa, Borrelia afzelii
GDKSVKKSL

SEQ ID NO: 51441 - protein, 9 aa, Borrelia afzelii
DKSVKKSLN

SEQ ID NO: 51442 - protein, 9 aa, Borrelia afzelii
KSVKKSLNK

SEQ ID NO: 51443 - protein, 9 aa, Borrelia afzelii
SVKKSLNKK

SEQ ID NO: 51444 - protein, 9 aa, Borrelia afzelii
VKKSLNKKG

SEQ ID NO: 51445 - protein, 9 aa, Borrelia afzelii
KKSLNKKGK

SEQ ID NO: 51446 - protein, 9 aa, Borrelia afzelii
KSLNKKGKD

SEQ ID NO: 51447 - protein, 9 aa, Borrelia afzelii
SLNKKGKDK

SEQ ID NO: 51448 - protein, 9 aa, Borrelia afzelii
LNKKGKDKV

SEQ ID NO: 51449 - protein, 9 aa, Borrelia afzelii
NKKGKDKVA

SEQ ID NO: 51450 - protein, 9 aa, Borrelia afzelii
KKGKDKVAR

SEQ ID NO: 51451 - protein, 9 aa, Borrelia afzelii
KGKDKVARK

SEQ ID NO: 51452 - protein, 9 aa, Borrelia afzelii
GKDKVARKK

SEQ ID NO: 51453 - protein, 9 aa, Borrelia afzelii
KDKVARKKV

SEQ ID NO: 51454 - protein, 9 aa, Borrelia afzelii
DKVARKKVE

SEQ ID NO: 51455 - protein, 9 aa, Borrelia afzelii
KVARKKVEG

SEQ ID NO: 51456 - protein, 9 aa, Borrelia afzelii
VARKKVEGN

SEQ ID NO: 51457 - protein, 9 aa, Borrelia afzelii
ARKKVEGNA

SEQ ID NO: 51458 - protein, 9 aa, Borrelia afzelii
RKKVEGNAV

SEQ ID NO: 51459 - protein, 9 aa, Borrelia afzelii
KKVEGNAVK

SEQ ID NO: 51460 - protein, 9 aa, Borrelia afzelii
KVEGNAVKK

SEQ ID NO: 51461 - protein, 9 aa, Borrelia afzelii
VEGNAVKKD

SEQ ID NO: 51462 - protein, 9 aa, Borrelia afzelii
EGNAVKKDP

SEQ ID NO: 51463 - protein, 9 aa, Borrelia afzelii
GNAVKKDPF

SEQ ID NO: 51464 - protein, 9 aa, Borrelia afzelii
NAVKKDPFN

SEQ ID NO: 51465 - protein, 9 aa, Borrelia afzelii
AVKKDPFNH

SEQ ID NO: 51466 - protein, 9 aa, Borrelia afzelii
VKKDPFNHH

SEQ ID NO: 51467 - protein, 9 aa, Borrelia afzelii
KKDPFNHHV

SEQ ID NO: 51468 - protein, 9 aa, Borrelia afzelii
KDPFNHHVK

SEQ ID NO: 51469 - protein, 9 aa, Borrelia afzelii
DPFNHHVKR

SEQ ID NO: 51470 - protein, 9 aa, Borrelia afzelii
PFNHHVKRE

SEQ ID NO: 51471 - protein, 9 aa, Borrelia afzelii
FNHHVKRES

SEQ ID NO: 51472 - protein, 9 aa, Borrelia afzelii
NHHVKRESV

SEQ ID NO: 51473 - protein, 9 aa, Borrelia afzelii
HHVKRESVN

SEQ ID NO: 51474 - protein, 9 aa, Borrelia afzelii
HVKRESVNN

SEQ ID NO: 51475 - protein, 9 aa, Borrelia afzelii
VKRESVNNS

SEQ ID NO: 51476 - protein, 9 aa, Borrelia afzelii
KRESVNNSN

SEQ ID NO: 51477 - protein, 9 aa, Borrelia afzelii
RESVNNSNL

SEQ ID NO: 51478 - protein, 9 aa, Borrelia afzelii
ESVNNSNLS

SEQ ID NO: 51479 - protein, 9 aa, Borrelia afzelii
SVNNSNLSQ

SEQ ID NO: 51480 - protein, 9 aa, Borrelia afzelii
VNNSNLSQK

SEQ ID NO: 51481 - protein, 9 aa, Borrelia afzelii
NNSNLSQKN

SEQ ID NO: 51482 - protein, 9 aa, Borrelia afzelii
NSNLSQKNV

SEQ ID NO: 51483 - protein, 9 aa, Borrelia afzelii
SNLSQKNVI

SEQ ID NO: 51484 - protein, 9 aa, Borrelia afzelii
NLSQKNVIS

SEQ ID NO: 51485 - protein, 9 aa, Borrelia afzelii
LSQKNVISE

SEQ ID NO: 51486 - protein, 9 aa, Borrelia afzelii
SQKNVISEE

SEQ ID NO: 51487 - protein, 9 aa, Borrelia afzelii
QKNVISEEE

SEQ ID NO: 51488 - protein, 9 aa, Borrelia afzelii
KNVISEEEI

SEQ ID NO: 51489 - protein, 9 aa, Borrelia afzelii
NVISEEEIL

SEQ ID NO: 51490 - protein, 9 aa, Borrelia afzelii
VISEEEILK

SEQ ID NO: 51491 - protein, 9 aa, Borrelia afzelii
ISEEEILKT

SEQ ID NO: 51492 - protein, 9 aa, Borrelia afzelii
SEEEILKTK

SEQ ID NO: 51493 - protein, 9 aa, Borrelia afzelii
EEEILKTKL

SEQ ID NO: 51494 - protein, 9 aa, Borrelia afzelii
EEILKTKLL

SEQ ID NO: 51495 - protein, 9 aa, Borrelia afzelii
EILKTKLLR

SEQ ID NO: 51496 - protein, 9 aa, Borrelia afzelii
ILKTKLLRE

SEQ ID NO: 51497 - protein, 9 aa, Borrelia afzelii
LKTKLLRER

SEQ ID NO: 51498 - protein, 9 aa, Borrelia afzelii
KTKLLRERP

SEQ ID NO: 51499 - protein, 9 aa, Borrelia afzelii
TKLLRERPE

SEQ ID NO: 51500 - protein, 9 aa, Borrelia afzelii
KLLRERPET

SEQ ID NO: 51501 - protein, 9 aa, Borrelia afzelii
LLRERPETR

SEQ ID NO: 51502 - protein, 9 aa, Borrelia afzelii
LRERPETRK

SEQ ID NO: 51503 - protein, 9 aa, Borrelia afzelii
RERPETRKE

SEQ ID NO: 51504 - protein, 9 aa, Borrelia afzelii
ERPETRKEE

SEQ ID NO: 51505 - protein, 9 aa, Borrelia afzelii
RPETRKEEI

SEQ ID NO: 51506 - protein, 9 aa, Borrelia afzelii
PETRKEEIQ

SEQ ID NO: 51507 - protein, 9 aa, Borrelia afzelii
ETRKEEIQK

SEQ ID NO: 51508 - protein, 9 aa, Borrelia afzelii
TRKEEIQKQ

SEQ ID NO: 51509 - protein, 9 aa, Borrelia afzelii
RKEEIQKQQ

SEQ ID NO: 51510 - protein, 9 aa, Borrelia afzelii
KEEIQKQQD

SEQ ID NO: 51511 - protein, 9 aa, Borrelia afzelii
EEIQKQQDE

SEQ ID NO: 51512 - protein, 9 aa, Borrelia afzelii
EIQKQQDEH

SEQ ID NO: 51513 - protein, 9 aa, Borrelia afzelii
IQKQQDEHK

SEQ ID NO: 51514 - protein, 9 aa, Borrelia afzelii
QKQQDEHKR

SEQ ID NO: 51515 - protein, 9 aa, Borrelia afzelii
KQQDEHKRM

SEQ ID NO: 51516 - protein, 9 aa, Borrelia afzelii
QQDEHKRML

SEQ ID NO: 51517 - protein, 9 aa, Borrelia afzelii
QDEHKRMLQ

SEQ ID NO: 51518 - protein, 9 aa, Borrelia afzelii
DEHKRMLQG

SEQ ID NO: 51519 - protein, 9 aa, Borrelia afzelii
EHKRMLQGS

SEQ ID NO: 51520 - protein, 9 aa, Borrelia afzelii
HKRMLQGSL

SEQ ID NO: 51521 - protein, 9 aa, Borrelia afzelii
KRMLQGSLS

SEQ ID NO: 51522 - protein, 9 aa, Borrelia afzelii
RMLQGSLSF

SEQ ID NO: 51523 - protein, 9 aa, Borrelia afzelii
MLQGSLSFL

SEQ ID NO: 51524 - protein, 9 aa, Borrelia afzelii
LQGSLSFLS

SEQ ID NO: 51525 - protein, 9 aa, Borrelia afzelii
QGSLSFLSG

SEQ ID NO: 51526 - protein, 9 aa, Borrelia afzelii
GSLSFLSGE

SEQ ID NO: 51527 - protein, 9 aa, Borrelia afzelii
SLSFLSGES

SEQ ID NO: 51528 - protein, 9 aa, Borrelia afzelii
LSFLSGESG

SEQ ID NO: 51529 - protein, 9 aa, Borrelia afzelii
SFLSGESGE

SEQ ID NO: 51530 - protein, 9 aa, Borrelia afzelii
FLSGESGEL

SEQ ID NO: 51531 - protein, 9 aa, Borrelia afzelii
LSGESGELK

SEQ ID NO: 51532 - protein, 9 aa, Borrelia afzelii
SGESGELKD

SEQ ID NO: 51533 - protein, 9 aa, Borrelia afzelii
GESGELKDT

SEQ ID NO: 51534 - protein, 9 aa, Borrelia afzelii
ESGELKDTI

SEQ ID NO: 51535 - protein, 9 aa, Borrelia afzelii
SGELKDTIE

SEQ ID NO: 51536 - protein, 9 aa, Borrelia afzelii
GELKDTIES

SEQ ID NO: 51537 - protein, 9 aa, Borrelia afzelii
ELKDTIESN

SEQ ID NO: 51538 - protein, 9 aa, Borrelia afzelii
LKDTIESNE

SEQ ID NO: 51539 - protein, 9 aa, Borrelia afzelii
KDTIESNEI

SEQ ID NO: 51540 - protein, 9 aa, Borrelia afzelii
DTIESNEID

SEQ ID NO: 51541 - protein, 9 aa, Borrelia afzelii
TIESNEIDF

SEQ ID NO: 51542 - protein, 9 aa, Borrelia afzelii
IESNEIDFT

SEQ ID NO: 51543 - protein, 9 aa, Borrelia afzelii
ESNEIDFTI

SEQ ID NO: 51544 - protein, 9 aa, Borrelia afzelii
SNEIDFTID

SEQ ID NO: 51545 - protein, 9 aa, Borrelia afzelii
NEIDFTIDS

SEQ ID NO: 51546 - protein, 9 aa, Borrelia afzelii
EIDFTIDSD

SEQ ID NO: 51547 - protein, 9 aa, Borrelia afzelii
IDFTIDSDL

SEQ ID NO: 51548 - protein, 9 aa, Borrelia afzelii
DFTIDSDLR

SEQ ID NO: 51549 - protein, 9 aa, Borrelia afzelii
FTIDSDLRL

SEQ ID NO: 51550 - protein, 9 aa, Borrelia afzelii
TIDSDLRLK

SEQ ID NO: 51551 - protein, 9 aa, Borrelia afzelii
IDSDLRLKS

SEQ ID NO: 51552 - protein, 9 aa, Borrelia afzelii
DSDLRLKSD

SEQ ID NO: 51553 - protein, 9 aa, Borrelia afzelii
SDLRLKSDL

SEQ ID NO: 51554 - protein, 9 aa, Borrelia afzelii
DLRLKSDLQ

SEQ ID NO: 51555 - protein, 9 aa, Borrelia afzelii
LRLKSDLQA

SEQ ID NO: 51556 - protein, 9 aa, Borrelia afzelii
RLKSDLQAI

SEQ ID NO: 51557 - protein, 9 aa, Borrelia afzelii
LKSDLQAIS

SEQ ID NO: 51558 - protein, 9 aa, Borrelia afzelii
KSDLQAISG

SEQ ID NO: 51559 - protein, 9 aa, Borrelia afzelii
SDLQAISGS

SEQ ID NO: 51560 - protein, 9 aa, Borrelia afzelii
DLQAISGSN

SEQ ID NO: 51561 - protein, 9 aa, Borrelia afzelii
LQAISGSNS

SEQ ID NO: 51562 - protein, 9 aa, Borrelia afzelii
QAISGSNSI

SEQ ID NO: 51563 - protein, 9 aa, Borrelia afzelii
AISGSNSIS

SEQ ID NO: 51564 - protein, 9 aa, Borrelia afzelii
ISGSNSISY

SEQ ID NO: 51565 - protein, 9 aa, Borrelia afzelii
SGSNSISYT

SEQ ID NO: 51566 - protein, 9 aa, Borrelia afzelii
GSNSISYTD

SEQ ID NO: 51567 - protein, 9 aa, Borrelia afzelii
SNSISYTDE

SEQ ID NO: 51568 - protein, 9 aa, Borrelia afzelii
NSISYTDEI

SEQ ID NO: 51569 - protein, 9 aa, Borrelia afzelii
SISYTDEIE

SEQ ID NO: 51570 - protein, 9 aa, Borrelia afzelii
ISYTDEIEE

SEQ ID NO: 51571 - protein, 9 aa, Borrelia afzelii
SYTDEIEEE

SEQ ID NO: 51572 - protein, 9 aa, Borrelia afzelii
YTDEIEEED

SEQ ID NO: 51573 - protein, 9 aa, Borrelia afzelii
TDEIEEEDY

SEQ ID NO: 51574 - protein, 9 aa, Borrelia afzelii
DEIEEEDYD

SEQ ID NO: 51575 - protein, 9 aa, Borrelia afzelii
EIEEEDYDQ

SEQ ID NO: 51576 - protein, 9 aa, Borrelia afzelii
IEEEDYDQY

SEQ ID NO: 51577 - protein, 9 aa, Borrelia afzelii
EEEDYDQYS

SEQ ID NO: 51578 - protein, 9 aa, Borrelia afzelii
EEDYDQYSL

SEQ ID NO: 51579 - protein, 9 aa, Borrelia afzelii
EDYDQYSLE

SEQ ID NO: 51580 - protein, 9 aa, Borrelia afzelii
DYDQYSLEE

SEQ ID NO: 51581 - protein, 9 aa, Borrelia afzelii
YDQYSLEED

SEQ ID NO: 51582 - protein, 9 aa, Borrelia afzelii
DQYSLEEDY

SEQ ID NO: 51583 - protein, 9 aa, Borrelia afzelii
QYSLEEDYY

SEQ ID NO: 51584 - protein, 9 aa, Borrelia afzelii
YSLEEDYYY

SEQ ID NO: 51585 - protein, 9 aa, Borrelia afzelii
SLEEDYYYD

SEQ ID NO: 51586 - protein, 9 aa, Borrelia afzelii
LEEDYYYDG

SEQ ID NO: 51587 - protein, 9 aa, Borrelia afzelii
EEDYYYDGE

SEQ ID NO: 51588 - protein, 9 aa, Borrelia afzelii
EDYYYDGET

SEQ ID NO: 51589 - protein, 9 aa, Borrelia afzelii
DYYYDGETR

SEQ ID NO: 51590 - protein, 9 aa, Borrelia afzelii
YYYDGETRL

SEQ ID NO: 51591 - protein, 9 aa, Borrelia afzelii
YYDGETRLS

SEQ ID NO: 51592 - protein, 9 aa, Borrelia afzelii
YDGETRLSN

SEQ ID NO: 51593 - protein, 9 aa, Borrelia afzelii
DGETRLSNR

SEQ ID NO: 51594 - protein, 9 aa, Borrelia afzelii
GETRLSNRY

SEQ ID NO: 51595 - protein, 9 aa, Borrelia afzelii
ETRLSNRYE

SEQ ID NO: 51596 - protein, 9 aa, Borrelia afzelii
TRLSNRYES

SEQ ID NO: 51597 - protein, 9 aa, Borrelia afzelii
RLSNRYESY

SEQ ID NO: 51598 - protein, 9 aa, Borrelia afzelii
LSNRYESYL

SEQ ID NO: 51599 - protein, 9 aa, Borrelia afzelii
SNRYESYLE

SEQ ID NO: 51600 - protein, 9 aa, Borrelia afzelii
NRYESYLEG

SEQ ID NO: 51601 - protein, 9 aa, Borrelia afzelii
RYESYLEGV

SEQ ID NO: 51602 - protein, 9 aa, Borrelia afzelii
YESYLEGVK

SEQ ID NO: 51603 - protein, 9 aa, Borrelia afzelii
ESYLEGVKY

SEQ ID NO: 51604 - protein, 9 aa, Borrelia afzelii
SYLEGVKYN

SEQ ID NO: 51605 - protein, 9 aa, Borrelia afzelii
YLEGVKYNV

SEQ ID NO: 51606 - protein, 9 aa, Borrelia afzelii
LEGVKYNVS

SEQ ID NO: 51607 - protein, 9 aa, Borrelia afzelii
EGVKYNVSS

SEQ ID NO: 51608 - protein, 9 aa, Borrelia afzelii
GVKYNVSSA

SEQ ID NO: 51609 - protein, 9 aa, Borrelia afzelii
VKYNVSSAI

SEQ ID NO: 51610 - protein, 9 aa, Borrelia afzelii
KYNVSSAIK

SEQ ID NO: 51611 - protein, 9 aa, Borrelia afzelii
YNVSSAIKT

SEQ ID NO: 51612 - protein, 9 aa, Borrelia afzelii
NVSSAIKTI

SEQ ID NO: 51613 - protein, 9 aa, Borrelia afzelii
VSSAIKTIV

SEQ ID NO: 51614 - protein, 9 aa, Borrelia afzelii
SSAIKTIVK

SEQ ID NO: 51615 - protein, 9 aa, Borrelia afzelii
SAIKTIVKI

SEQ ID NO: 51616 - protein, 9 aa, Borrelia afzelii
AIKTIVKIY

SEQ ID NO: 51617 - protein, 9 aa, Borrelia afzelii
IKTIVKIYD

SEQ ID NO: 51618 - protein, 9 aa, Borrelia afzelii
KTIVKIYDN

SEQ ID NO: 51619 - protein, 9 aa, Borrelia afzelii
TIVKIYDNY

SEQ ID NO: 51620 - protein, 9 aa, Borrelia afzelii
IVKIYDNYT

SEQ ID NO: 51621 - protein, 9 aa, Borrelia afzelii
VKIYDNYTL

SEQ ID NO: 51622 - protein, 9 aa, Borrelia afzelii
KIYDNYTLL

SEQ ID NO: 51623 - protein, 9 aa, Borrelia afzelii
IYDNYTLLS

SEQ ID NO: 51624 - protein, 9 aa, Borrelia afzelii
YDNYTLLST

SEQ ID NO: 51625 - protein, 9 aa, Borrelia afzelii
DNYTLLSTK

SEQ ID NO: 51626 - protein, 9 aa, Borrelia afzelii
NYTLLSTKQ

SEQ ID NO: 51627 - protein, 9 aa, Borrelia afzelii
YTLLSTKQT

SEQ ID NO: 51628 - protein, 9 aa, Borrelia afzelii
TLLSTKQTQ

SEQ ID NO: 51629 - protein, 9 aa, Borrelia afzelii
LLSTKQTQM

SEQ ID NO: 51630 - protein, 9 aa, Borrelia afzelii
LSTKQTQMY

SEQ ID NO: 51631 - protein, 9 aa, Borrelia afzelii
STKQTQMYS

SEQ ID NO: 51632 - protein, 9 aa, Borrelia afzelii
TKQTQMYST

SEQ ID NO: 51633 - protein, 9 aa, Borrelia afzelii
KQTQMYSTR

SEQ ID NO: 51634 - protein, 9 aa, Borrelia afzelii
QTQMYSTRL

SEQ ID NO: 51635 - protein, 9 aa, Borrelia afzelii
TQMYSTRLD

SEQ ID NO: 51636 - protein, 9 aa, Borrelia afzelii
QMYSTRLDN

SEQ ID NO: 51637 - protein, 9 aa, Borrelia afzelii
MYSTRLDNL

SEQ ID NO: 51638 - protein, 9 aa, Borrelia afzelii
YSTRLDNLA

SEQ ID NO: 51639 - protein, 9 aa, Borrelia afzelii
STRLDNLAK

SEQ ID NO: 51640 - protein, 9 aa, Borrelia afzelii
TRLDNLAKA

SEQ ID NO: 51641 - protein, 9 aa, Borrelia afzelii
RLDNLAKAK

SEQ ID NO: 51642 - protein, 9 aa, Borrelia afzelii
LDNLAKAKA

SEQ ID NO: 51643 - protein, 9 aa, Borrelia afzelii
DNLAKAKAR

SEQ ID NO: 51644 - protein, 9 aa, Borrelia afzelii
NLAKAKARE

SEQ ID NO: 51645 - protein, 9 aa, Borrelia afzelii
LAKAKAREE

SEQ ID NO: 51646 - protein, 9 aa, Borrelia afzelii
AKAKAREEA

SEQ ID NO: 51647 - protein, 9 aa, Borrelia afzelii
KAKAREEAK

SEQ ID NO: 51648 - protein, 9 aa, Borrelia afzelii
AKAREEAKK

SEQ ID NO: 51649 - protein, 9 aa, Borrelia afzelii
KAREEAKKF

SEQ ID NO: 51650 - protein, 9 aa, Borrelia afzelii
AREEAKKFT

SEQ ID NO: 51651 - protein, 9 aa, Borrelia afzelii
REEAKKFTK

SEQ ID NO: 51652 - protein, 9 aa, Borrelia afzelii
EEAKKFTKE

SEQ ID NO: 51653 - protein, 9 aa, Borrelia afzelii
EAKKFTKEE

SEQ ID NO: 51654 - protein, 9 aa, Borrelia afzelii
AKKFTKEEL

SEQ ID NO: 51655 - protein, 9 aa, Borrelia afzelii
KKFTKEELE

SEQ ID NO: 51656 - protein, 9 aa, Borrelia afzelii
KFTKEELEK

SEQ ID NO: 51657 - protein, 9 aa, Borrelia afzelii
FTKEELEKD

SEQ ID NO: 51658 - protein, 9 aa, Borrelia afzelii
TKEELEKDL

SEQ ID NO: 51659 - protein, 9 aa, Borrelia afzelii
KEELEKDLK

SEQ ID NO: 51660 - protein, 9 aa, Borrelia afzelii
EELEKDLKT

SEQ ID NO: 51661 - protein, 9 aa, Borrelia afzelii
ELEKDLKTL

SEQ ID NO: 51662 - protein, 9 aa, Borrelia afzelii
LEKDLKTLL

SEQ ID NO: 51663 - protein, 9 aa, Borrelia afzelii
EKDLKTLLN

SEQ ID NO: 51664 - protein, 9 aa, Borrelia afzelii
KDLKTLLNY

SEQ ID NO: 51665 - protein, 9 aa, Borrelia afzelii
DLKTLLNYI

SEQ ID NO: 51666 - protein, 9 aa, Borrelia afzelii
LKTLLNYIQ

SEQ ID NO: 51667 - protein, 9 aa, Borrelia afzelii
KTLLNYIQV

SEQ ID NO: 51668 - protein, 9 aa, Borrelia afzelii
TLLNYIQVS

SEQ ID NO: 51669 - protein, 9 aa, Borrelia afzelii
LLNYIQVSA

SEQ ID NO: 51670 - protein, 9 aa, Borrelia afzelii
LNYIQVSAR

SEQ ID NO: 51671 - protein, 9 aa, Borrelia afzelii
NYIQVSART

SEQ ID NO: 51672 - protein, 9 aa, Borrelia afzelii
YIQVSARTA

SEQ ID NO: 51673 - protein, 9 aa, Borrelia afzelii
IQVSARTAT

SEQ ID NO: 51674 - protein, 9 aa, Borrelia afzelii
QVSARTATN

SEQ ID NO: 51675 - protein, 9 aa, Borrelia afzelii
VSARTATNF

SEQ ID NO: 51676 - protein, 9 aa, Borrelia afzelii
SARTATNFV

SEQ ID NO: 51677 - protein, 9 aa, Borrelia afzelii
ARTATNFVY

SEQ ID NO: 51678 - protein, 9 aa, Borrelia afzelii
RTATNFVYA

SEQ ID NO: 51679 - protein, 9 aa, Borrelia afzelii
TATNFVYAR

SEQ ID NO: 51680 - protein, 9 aa, Borrelia afzelii
ATNFVYARE

SEQ ID NO: 51681 - protein, 9 aa, Borrelia afzelii
TNFVYAREI

SEQ ID NO: 51682 - protein, 9 aa, Borrelia afzelii
NFVYAREIY

SEQ ID NO: 51683 - protein, 9 aa, Borrelia afzelii
FVYAREIYS

SEQ ID NO: 51684 - protein, 9 aa, Borrelia afzelii
VYAREIYSK

SEQ ID NO: 51685 - protein, 9 aa, Borrelia afzelii
YAREIYSKR

SEQ ID NO: 51686 - protein, 9 aa, Borrelia afzelii
AREIYSKRK

SEQ ID NO: 51687 - protein, 9 aa, Borrelia afzelii
REIYSKRKL

SEQ ID NO: 51688 - protein, 9 aa, Borrelia afzelii
EIYSKRKLD

SEQ ID NO: 51689 - protein, 9 aa, Borrelia afzelii
IYSKRKLDA

SEQ ID NO: 51690 - protein, 9 aa, Borrelia afzelii
YSKRKLDAI

SEQ ID NO: 51691 - protein, 9 aa, Borrelia afzelii
SKRKLDAIE

SEQ ID NO: 51692 - protein, 9 aa, Borrelia afzelii
KRKLDAIET

SEQ ID NO: 51693 - protein, 9 aa, Borrelia afzelii
RKLDAIETE

SEQ ID NO: 51694 - protein, 9 aa, Borrelia afzelii
KLDAIETEI

SEQ ID NO: 51695 - protein, 9 aa, Borrelia afzelii
LDAIETEIK

SEQ ID NO: 51696 - protein, 9 aa, Borrelia afzelii
DAIETEIKN

SEQ ID NO: 51697 - protein, 9 aa, Borrelia afzelii
AIETEIKNL

SEQ ID NO: 51698 - protein, 9 aa, Borrelia afzelii
IETEIKNLI

SEQ ID NO: 51699 - protein, 9 aa, Borrelia afzelii
ETEIKNLIL

SEQ ID NO: 51700 - protein, 9 aa, Borrelia afzelii
TEIKNLILK

SEQ ID NO: 51701 - protein, 9 aa, Borrelia afzelii
EIKNLILKI

SEQ ID NO: 51702 - protein, 9 aa, Borrelia afzelii
IKNLILKIK

SEQ ID NO: 51703 - protein, 9 aa, Borrelia afzelii
KNLILKIKG

SEQ ID NO: 51704 - protein, 9 aa, Borrelia afzelii
NLILKIKGQ

SEQ ID NO: 51705 - protein, 9 aa, Borrelia afzelii
LILKIKGQS

SEQ ID NO: 51706 - protein, 9 aa, Borrelia afzelii
ILKIKGQSD

SEQ ID NO: 51707 - protein, 9 aa, Borrelia afzelii
LKIKGQSDL

SEQ ID NO: 51708 - protein, 9 aa, Borrelia afzelii
KIKGQSDLY

SEQ ID NO: 51709 - protein, 9 aa, Borrelia afzelii
IKGQSDLYE

SEQ ID NO: 51710 - protein, 9 aa, Borrelia afzelii
KGQSDLYEA

SEQ ID NO: 51711 - protein, 9 aa, Borrelia afzelii
GQSDLYEAY

SEQ ID NO: 51712 - protein, 9 aa, Borrelia afzelii
QSDLYEAYK

SEQ ID NO: 51713 - protein, 9 aa, Borrelia afzelii
SDLYEAYKA

SEQ ID NO: 51714 - protein, 9 aa, Borrelia afzelii
DLYEAYKAI

SEQ ID NO: 51715 - protein, 9 aa, Borrelia afzelii
LYEAYKAIV

SEQ ID NO: 51716 - protein, 9 aa, Borrelia afzelii
YEAYKAIVR

SEQ ID NO: 51717 - protein, 9 aa, Borrelia afzelii
EAYKAIVRS

SEQ ID NO: 51718 - protein, 9 aa, Borrelia afzelii
AYKAIVRSI

SEQ ID NO: 51719 - protein, 9 aa, Borrelia afzelii
YKAIVRSIL

SEQ ID NO: 51720 - protein, 9 aa, Borrelia afzelii
KAIVRSILL

SEQ ID NO: 51721 - protein, 9 aa, Borrelia afzelii
AIVRSILLM

SEQ ID NO: 51722 - protein, 9 aa, Borrelia afzelii
IVRSILLMK

SEQ ID NO: 51723 - protein, 9 aa, Borrelia afzelii
VRSILLMKD

SEQ ID NO: 51724 - protein, 9 aa, Borrelia afzelii
RSILLMKDS

SEQ ID NO: 51725 - protein, 9 aa, Borrelia afzelii
SILLMKDSL

SEQ ID NO: 51726 - protein, 9 aa, Borrelia afzelii
ILLMKDSLK

SEQ ID NO: 51727 - protein, 9 aa, Borrelia afzelii
LLMKDSLKI

SEQ ID NO: 51728 - protein, 9 aa, Borrelia afzelii
LMKDSLKII

SEQ ID NO: 51729 - protein, 9 aa, Borrelia afzelii
MKDSLKIIE

SEQ ID NO: 51730 - protein, 9 aa, Borrelia afzelii
KDSLKIIEI

SEQ ID NO: 51731 - protein, 9 aa, Borrelia afzelii
DSLKIIEIV

SEQ ID NO: 51732 - protein, 9 aa, Borrelia afzelii
SLKIIEIVI

SEQ ID NO: 51733 - protein, 9 aa, Borrelia afzelii
LKIIEIVID

SEQ ID NO: 51734 - protein, 9 aa, Borrelia afzelii
KIIEIVIDK

SEQ ID NO: 51735 - protein, 9 aa, Borrelia afzelii
IIEIVIDKN

SEQ ID NO: 51736 - protein, 9 aa, Borrelia afzelii
IEIVIDKNG

SEQ ID NO: 51737 - protein, 9 aa, Borrelia afzelii
EIVIDKNGV

SEQ ID NO: 51738 - protein, 9 aa, Borrelia afzelii
IVIDKNGVW

SEQ ID NO: 51739 - protein, 9 aa, Borrelia afzelii
VIDKNGVWY

SEQ ID NO: 51740 - protein, 10 aa, Borrelia afzelii
MKIKSKCLAL

SEQ ID NO: 51741 - protein, 10 aa, Borrelia afzelii
KIKSKCLALG

SEQ ID NO: 51742 - protein, 10 aa, Borrelia afzelii
IKSKCLALGL

SEQ ID NO: 51743 - protein, 10 aa, Borrelia afzelii
KSKCLALGLL

SEQ ID NO: 51744 - protein, 10 aa, Borrelia afzelii
SKCLALGLLF

SEQ ID NO: 51745 - protein, 10 aa, Borrelia afzelii
KCLALGLLFG

SEQ ID NO: 51746 - protein, 10 aa, Borrelia afzelii
CLALGLLFGF

SEQ ID NO: 51747 - protein, 10 aa, Borrelia afzelii
LALGLLFGFI

SEQ ID NO: 51748 - protein, 10 aa, Borrelia afzelii
ALGLLFGFIS

SEQ ID NO: 51749 - protein, 10 aa, Borrelia afzelii
LGLLFGFISC

SEQ ID NO: 51750 - protein, 10 aa, Borrelia afzelii
GLLFGFISCD

SEQ ID NO: 51751 - protein, 10 aa, Borrelia afzelii
LLFGFISCDL

SEQ ID NO: 51752 - protein, 10 aa, Borrelia afzelii
LFGFISCDLF

SEQ ID NO: 51753 - protein, 10 aa, Borrelia afzelii
FGFISCDLFI

SEQ ID NO: 51754 - protein, 10 aa, Borrelia afzelii
GFISCDLFIR

SEQ ID NO: 51755 - protein, 10 aa, Borrelia afzelii
FISCDLFIRD

SEQ ID NO: 51756 - protein, 10 aa, Borrelia afzelii
ISCDLFIRDE

SEQ ID NO: 51757 - protein, 10 aa, Borrelia afzelii
SCDLFIRDEI

SEQ ID NO: 51758 - protein, 10 aa, Borrelia afzelii
CDLFIRDEIK

SEQ ID NO: 51759 - protein, 10 aa, Borrelia afzelii
DLFIRDEIKE

SEQ ID NO: 51760 - protein, 10 aa, Borrelia afzelii
LFIRDEIKEK

SEQ ID NO: 51761 - protein, 10 aa, Borrelia afzelii
FIRDEIKEKS

SEQ ID NO: 51762 - protein, 10 aa, Borrelia afzelii
IRDEIKEKSL

SEQ ID NO: 51763 - protein, 10 aa, Borrelia afzelii
RDEIKEKSLG

SEQ ID NO: 51764 - protein, 10 aa, Borrelia afzelii
DEIKEKSLGL

SEQ ID NO: 51765 - protein, 10 aa, Borrelia afzelii
EIKEKSLGLC

SEQ ID NO: 51766 - protein, 10 aa, Borrelia afzelii
IKEKSLGLCD

SEQ ID NO: 51767 - protein, 10 aa, Borrelia afzelii
KEKSLGLCDE

SEQ ID NO: 51768 - protein, 10 aa, Borrelia afzelii
EKSLGLCDEE

SEQ ID NO: 51769 - protein, 10 aa, Borrelia afzelii
KSLGLCDEES

SEQ ID NO: 51770 - protein, 10 aa, Borrelia afzelii
SLGLCDEESS

SEQ ID NO: 51771 - protein, 10 aa, Borrelia afzelii
LGLCDEESSI

SEQ ID NO: 51772 - protein, 10 aa, Borrelia afzelii
GLCDEESSIL

SEQ ID NO: 51773 - protein, 10 aa, Borrelia afzelii
LCDEESSILE

SEQ ID NO: 51774 - protein, 10 aa, Borrelia afzelii
CDEESSILET

SEQ ID NO: 51775 - protein, 10 aa, Borrelia afzelii
DEESSILETG

SEQ ID NO: 51776 - protein, 10 aa, Borrelia afzelii
EESSILETGD

SEQ ID NO: 51777 - protein, 10 aa, Borrelia afzelii
ESSILETGDK

SEQ ID NO: 51778 - protein, 10 aa, Borrelia afzelii
SSILETGDKS

SEQ ID NO: 51779 - protein, 10 aa, Borrelia afzelii
SILETGDKSV

SEQ ID NO: 51780 - protein, 10 aa, Borrelia afzelii
ILETGDKSVK

SEQ ID NO: 51781 - protein, 10 aa, Borrelia afzelii
LETGDKSVKK

SEQ ID NO: 51782 - protein, 10 aa, Borrelia afzelii
ETGDKSVKKS

SEQ ID NO: 51783 - protein, 10 aa, Borrelia afzelii
TGDKSVKKSL

SEQ ID NO: 51784 - protein, 10 aa, Borrelia afzelii
GDKSVKKSLN

SEQ ID NO: 51785 - protein, 10 aa, Borrelia afzelii
DKSVKKSLNK

SEQ ID NO: 51786 - protein, 10 aa, Borrelia afzelii
KSVKKSLNKK

SEQ ID NO: 51787 - protein, 10 aa, Borrelia afzelii
SVKKSLNKKG

SEQ ID NO: 51788 - protein, 10 aa, Borrelia afzelii
VKKSLNKKGK

SEQ ID NO: 51789 - protein, 10 aa, Borrelia afzelii
KKSLNKKGKD

SEQ ID NO: 51790 - protein, 10 aa, Borrelia afzelii
KSLNKKGKDK

SEQ ID NO: 51791 - protein, 10 aa, Borrelia afzelii
SLNKKGKDKV

SEQ ID NO: 51792 - protein, 10 aa, Borrelia afzelii
LNKKGKDKVA

SEQ ID NO: 51793 - protein, 10 aa, Borrelia afzelii
NKKGKDKVAR

SEQ ID NO: 51794 - protein, 10 aa, Borrelia afzelii
KKGKDKVARK

SEQ ID NO: 51795 - protein, 10 aa, Borrelia afzelii
KGKDKVARKK

SEQ ID NO: 51796 - protein, 10 aa, Borrelia afzelii
GKDKVARKKV

SEQ ID NO: 51797 - protein, 10 aa, Borrelia afzelii
KDKVARKKVE

SEQ ID NO: 51798 - protein, 10 aa, Borrelia afzelii
DKVARKKVEG

SEQ ID NO: 51799 - protein, 10 aa, Borrelia afzelii
KVARKKVEGN

SEQ ID NO: 51800 - protein, 10 aa, Borrelia afzelii
VARKKVEGNA

SEQ ID NO: 51801 - protein, 10 aa, Borrelia afzelii
ARKKVEGNAV

SEQ ID NO: 51802 - protein, 10 aa, Borrelia afzelii
RKKVEGNAVK

SEQ ID NO: 51803 - protein, 10 aa, Borrelia afzelii
KKVEGNAVKK

SEQ ID NO: 51804 - protein, 10 aa, Borrelia afzelii
KVEGNAVKKD

SEQ ID NO: 51805 - protein, 10 aa, Borrelia afzelii
VEGNAVKKDP

SEQ ID NO: 51806 - protein, 10 aa, Borrelia afzelii
EGNAVKKDPF

SEQ ID NO: 51807 - protein, 10 aa, Borrelia afzelii
GNAVKKDPFN

SEQ ID NO: 51808 - protein, 10 aa, Borrelia afzelii
NAVKKDPFNH

SEQ ID NO: 51809 - protein, 10 aa, Borrelia afzelii
AVKKDPFNHH

SEQ ID NO: 51810 - protein, 10 aa, Borrelia afzelii
VKKDPFNHHV

SEQ ID NO: 51811 - protein, 10 aa, Borrelia afzelii
KKDPFNHHVK

SEQ ID NO: 51812 - protein, 10 aa, Borrelia afzelii
KDPFNHHVKR

SEQ ID NO: 51813 - protein, 10 aa, Borrelia afzelii
DPFNHHVKRE

SEQ ID NO: 51814 - protein, 10 aa, Borrelia afzelii
PFNHHVKRES

SEQ ID NO: 51815 - protein, 10 aa, Borrelia afzelii
FNHHVKRESV

SEQ ID NO: 51816 - protein, 10 aa, Borrelia afzelii
NHHVKRESVN

SEQ ID NO: 51817 - protein, 10 aa, Borrelia afzelii
HHVKRESVNN

SEQ ID NO: 51818 - protein, 10 aa, Borrelia afzelii
HVKRESVNNS

SEQ ID NO: 51819 - protein, 10 aa, Borrelia afzelii
VKRESVNNSN

SEQ ID NO: 51820 - protein, 10 aa, Borrelia afzelii
KRESVNNSNL

SEQ ID NO: 51821 - protein, 10 aa, Borrelia afzelii
RESVNNSNLS

SEQ ID NO: 51822 - protein, 10 aa, Borrelia afzelii
ESVNNSNLSQ

SEQ ID NO: 51823 - protein, 10 aa, Borrelia afzelii
SVNNSNLSQK

SEQ ID NO: 51824 - protein, 10 aa, Borrelia afzelii
VNNSNLSQKN

SEQ ID NO: 51825 - protein, 10 aa, Borrelia afzelii
NNSNLSQKNV

SEQ ID NO: 51826 - protein, 10 aa, Borrelia afzelii
NSNLSQKNVI

SEQ ID NO: 51827 - protein, 10 aa, Borrelia afzelii
SNLSQKNVIS

SEQ ID NO: 51828 - protein, 10 aa, Borrelia afzelii
NLSQKNVISE

SEQ ID NO: 51829 - protein, 10 aa, Borrelia afzelii
LSQKNVISEE

SEQ ID NO: 51830 - protein, 10 aa, Borrelia afzelii
SQKNVISEEE

SEQ ID NO: 51831 - protein, 10 aa, Borrelia afzelii
QKNVISEEEI

SEQ ID NO: 51832 - protein, 10 aa, Borrelia afzelii
KNVISEEEIL

SEQ ID NO: 51833 - protein, 10 aa, Borrelia afzelii
NVISEEEILK

SEQ ID NO: 51834 - protein, 10 aa, Borrelia afzelii
VISEEEILKT

SEQ ID NO: 51835 - protein, 10 aa, Borrelia afzelii
ISEEEILKTK

SEQ ID NO: 51836 - protein, 10 aa, Borrelia afzelii
SEEEILKTKL

SEQ ID NO: 51837 - protein, 10 aa, Borrelia afzelii
EEEILKTKLL

SEQ ID NO: 51838 - protein, 10 aa, Borrelia afzelii
EEILKTKLLR

SEQ ID NO: 51839 - protein, 10 aa, Borrelia afzelii
EILKTKLLRE

SEQ ID NO: 51840 - protein, 10 aa, Borrelia afzelii
ILKTKLLRER

SEQ ID NO: 51841 - protein, 10 aa, Borrelia afzelii
LKTKLLRERP

SEQ ID NO: 51842 - protein, 10 aa, Borrelia afzelii
KTKLLRERPE

SEQ ID NO: 51843 - protein, 10 aa, Borrelia afzelii
TKLLRERPET

SEQ ID NO: 51844 - protein, 10 aa, Borrelia afzelii
KLLRERPETR

SEQ ID NO: 51845 - protein, 10 aa, Borrelia afzelii
LLRERPETRK

SEQ ID NO: 51846 - protein, 10 aa, Borrelia afzelii
LRERPETRKE

SEQ ID NO: 51847 - protein, 10 aa, Borrelia afzelii
RERPETRKEE

SEQ ID NO: 51848 - protein, 10 aa, Borrelia afzelii
ERPETRKEEI

SEQ ID NO: 51849 - protein, 10 aa, Borrelia afzelii
RPETRKEEIQ

SEQ ID NO: 51850 - protein, 10 aa, Borrelia afzelii
PETRKEEIQK

SEQ ID NO: 51851 - protein, 10 aa, Borrelia afzelii
ETRKEEIQKQ

SEQ ID NO: 51852 - protein, 10 aa, Borrelia afzelii
TRKEEIQKQQ

SEQ ID NO: 51853 - protein, 10 aa, Borrelia afzelii
RKEEIQKQQD

SEQ ID NO: 51854 - protein, 10 aa, Borrelia afzelii
KEEIQKQQDE

SEQ ID NO: 51855 - protein, 10 aa, Borrelia afzelii
EEIQKQQDEH

SEQ ID NO: 51856 - protein, 10 aa, Borrelia afzelii
EIQKQQDEHK

SEQ ID NO: 51857 - protein, 10 aa, Borrelia afzelii
IQKQQDEHKR

SEQ ID NO: 51858 - protein, 10 aa, Borrelia afzelii
QKQQDEHKRM

SEQ ID NO: 51859 - protein, 10 aa, Borrelia afzelii
KQQDEHKRML

SEQ ID NO: 51860 - protein, 10 aa, Borrelia afzelii
QQDEHKRMLQ

SEQ ID NO: 51861 - protein, 10 aa, Borrelia afzelii
QDEHKRMLQG

SEQ ID NO: 51862 - protein, 10 aa, Borrelia afzelii
DEHKRMLQGS

SEQ ID NO: 51863 - protein, 10 aa, Borrelia afzelii
EHKRMLQGSL

SEQ ID NO: 51864 - protein, 10 aa, Borrelia afzelii
HKRMLQGSLS

SEQ ID NO: 51865 - protein, 10 aa, Borrelia afzelii
KRMLQGSLSF

SEQ ID NO: 51866 - protein, 10 aa, Borrelia afzelii
RMLQGSLSFL

SEQ ID NO: 51867 - protein, 10 aa, Borrelia afzelii
MLQGSLSFLS

SEQ ID NO: 51868 - protein, 10 aa, Borrelia afzelii
LQGSLSFLSG

SEQ ID NO: 51869 - protein, 10 aa, Borrelia afzelii
QGSLSFLSGE

SEQ ID NO: 51870 - protein, 10 aa, Borrelia afzelii
GSLSFLSGES

SEQ ID NO: 51871 - protein, 10 aa, Borrelia afzelii
SLSFLSGESG

SEQ ID NO: 51872 - protein, 10 aa, Borrelia afzelii
LSFLSGESGE

SEQ ID NO: 51873 - protein, 10 aa, Borrelia afzelii
SFLSGESGEL

SEQ ID NO: 51874 - protein, 10 aa, Borrelia afzelii
FLSGESGELK

SEQ ID NO: 51875 - protein, 10 aa, Borrelia afzelii
LSGESGELKD

SEQ ID NO: 51876 - protein, 10 aa, Borrelia afzelii
SGESGELKDT

SEQ ID NO: 51877 - protein, 10 aa, Borrelia afzelii
GESGELKDTI

SEQ ID NO: 51878 - protein, 10 aa, Borrelia afzelii
ESGELKDTIE

SEQ ID NO: 51879 - protein, 10 aa, Borrelia afzelii
SGELKDTIES

SEQ ID NO: 51880 - protein, 10 aa, Borrelia afzelii
GELKDTIESN

SEQ ID NO: 51881 - protein, 10 aa, Borrelia afzelii
ELKDTIESNE

SEQ ID NO: 51882 - protein, 10 aa, Borrelia afzelii
LKDTIESNEI

SEQ ID NO: 51883 - protein, 10 aa, Borrelia afzelii
KDTIESNEID

SEQ ID NO: 51884 - protein, 10 aa, Borrelia afzelii
DTIESNEIDF

SEQ ID NO: 51885 - protein, 10 aa, Borrelia afzelii
TIESNEIDFT

SEQ ID NO: 51886 - protein, 10 aa, Borrelia afzelii
IESNEIDFTI

SEQ ID NO: 51887 - protein, 10 aa, Borrelia afzelii
ESNEIDFTID

SEQ ID NO: 51888 - protein, 10 aa, Borrelia afzelii
SNEIDFTIDS

SEQ ID NO: 51889 - protein, 10 aa, Borrelia afzelii
NEIDFTIDSD

SEQ ID NO: 51890 - protein, 10 aa, Borrelia afzelii
EIDFTIDSDL

SEQ ID NO: 51891 - protein, 10 aa, Borrelia afzelii
IDFTIDSDLR

SEQ ID NO: 51892 - protein, 10 aa, Borrelia afzelii
DFTIDSDLRL

SEQ ID NO: 51893 - protein, 10 aa, Borrelia afzelii
FTIDSDLRLK

SEQ ID NO: 51894 - protein, 10 aa, Borrelia afzelii
TIDSDLRLKS

SEQ ID NO: 51895 - protein, 10 aa, Borrelia afzelii
IDSDLRLKSD

SEQ ID NO: 51896 - protein, 10 aa, Borrelia afzelii
DSDLRLKSDL

SEQ ID NO: 51897 - protein, 10 aa, Borrelia afzelii
SDLRLKSDLQ

SEQ ID NO: 51898 - protein, 10 aa, Borrelia afzelii
DLRLKSDLQA

SEQ ID NO: 51899 - protein, 10 aa, Borrelia afzelii
LRLKSDLQAI

SEQ ID NO: 51900 - protein, 10 aa, Borrelia afzelii
RLKSDLQAIS

SEQ ID NO: 51901 - protein, 10 aa, Borrelia afzelii
LKSDLQAISG

SEQ ID NO: 51902 - protein, 10 aa, Borrelia afzelii
KSDLQAISGS

SEQ ID NO: 51903 - protein, 10 aa, Borrelia afzelii
SDLQAISGSN

SEQ ID NO: 51904 - protein, 10 aa, Borrelia afzelii
DLQAISGSNS

SEQ ID NO: 51905 - protein, 10 aa, Borrelia afzelii
LQAISGSNSI

SEQ ID NO: 51906 - protein, 10 aa, Borrelia afzelii
QAISGSNSIS

SEQ ID NO: 51907 - protein, 10 aa, Borrelia afzelii
AISGSNSISY

SEQ ID NO: 51908 - protein, 10 aa, Borrelia afzelii
ISGSNSISYT

SEQ ID NO: 51909 - protein, 10 aa, Borrelia afzelii
SGSNSISYTD

SEQ ID NO: 51910 - protein, 10 aa, Borrelia afzelii
GSNSISYTDE

SEQ ID NO: 51911 - protein, 10 aa, Borrelia afzelii
SNSISYTDEI

SEQ ID NO: 51912 - protein, 10 aa, Borrelia afzelii
NSISYTDEIE

SEQ ID NO: 51913 - protein, 10 aa, Borrelia afzelii
SISYTDEIEE

SEQ ID NO: 51914 - protein, 10 aa, Borrelia afzelii
ISYTDEIEEE

SEQ ID NO: 51915 - protein, 10 aa, Borrelia afzelii
SYTDEIEEED

SEQ ID NO: 51916 - protein, 10 aa, Borrelia afzelii
YTDEIEEEDY

SEQ ID NO: 51917 - protein, 10 aa, Borrelia afzelii
TDEIEEEDYD

SEQ ID NO: 51918 - protein, 10 aa, Borrelia afzelii
DEIEEEDYDQ

SEQ ID NO: 51919 - protein, 10 aa, Borrelia afzelii
EIEEEDYDQY

SEQ ID NO: 51920 - protein, 10 aa, Borrelia afzelii
IEEEDYDQYS

SEQ ID NO: 51921 - protein, 10 aa, Borrelia afzelii
EEEDYDQYSL

SEQ ID NO: 51922 - protein, 10 aa, Borrelia afzelii
EEDYDQYSLE

SEQ ID NO: 51923 - protein, 10 aa, Borrelia afzelii
EDYDQYSLEE

SEQ ID NO: 51924 - protein, 10 aa, Borrelia afzelii
DYDQYSLEED

SEQ ID NO: 51925 - protein, 10 aa, Borrelia afzelii
YDQYSLEEDY

SEQ ID NO: 51926 - protein, 10 aa, Borrelia afzelii
DQYSLEEDYY

SEQ ID NO: 51927 - protein, 10 aa, Borrelia afzelii
QYSLEEDYYY

SEQ ID NO: 51928 - protein, 10 aa, Borrelia afzelii
YSLEEDYYYD

SEQ ID NO: 51929 - protein, 10 aa, Borrelia afzelii
SLEEDYYYDG

SEQ ID NO: 51930 - protein, 10 aa, Borrelia afzelii
LEEDYYYDGE

SEQ ID NO: 51931 - protein, 10 aa, Borrelia afzelii
EEDYYYDGET

SEQ ID NO: 51932 - protein, 10 aa, Borrelia afzelii
EDYYYDGETR

SEQ ID NO: 51933 - protein, 10 aa, Borrelia afzelii
DYYYDGETRL

SEQ ID NO: 51934 - protein, 10 aa, Borrelia afzelii
YYYDGETRLS

SEQ ID NO: 51935 - protein, 10 aa, Borrelia afzelii
YYDGETRLSN

SEQ ID NO: 51936 - protein, 10 aa, Borrelia afzelii
YDGETRLSNR

SEQ ID NO: 51937 - protein, 10 aa, Borrelia afzelii
DGETRLSNRY

SEQ ID NO: 51938 - protein, 10 aa, Borrelia afzelii
GETRLSNRYE

SEQ ID NO: 51939 - protein, 10 aa, Borrelia afzelii
ETRLSNRYES

SEQ ID NO: 51940 - protein, 10 aa, Borrelia afzelii
TRLSNRYESY

SEQ ID NO: 51941 - protein, 10 aa, Borrelia afzelii
RLSNRYESYL

SEQ ID NO: 51942 - protein, 10 aa, Borrelia afzelii
LSNRYESYLE

SEQ ID NO: 51943 - protein, 10 aa, Borrelia afzelii
SNRYESYLEG

SEQ ID NO: 51944 - protein, 10 aa, Borrelia afzelii
NRYESYLEGV

SEQ ID NO: 51945 - protein, 10 aa, Borrelia afzelii
RYESYLEGVK

SEQ ID NO: 51946 - protein, 10 aa, Borrelia afzelii
YESYLEGVKY

SEQ ID NO: 51947 - protein, 10 aa, Borrelia afzelii
ESYLEGVKYN

SEQ ID NO: 51948 - protein, 10 aa, Borrelia afzelii
SYLEGVKYNV

SEQ ID NO: 51949 - protein, 10 aa, Borrelia afzelii
YLEGVKYNVS

SEQ ID NO: 51950 - protein, 10 aa, Borrelia afzelii
LEGVKYNVSS

SEQ ID NO: 51951 - protein, 10 aa, Borrelia afzelii
EGVKYNVSSA

SEQ ID NO: 51952 - protein, 10 aa, Borrelia afzelii
GVKYNVSSAI

SEQ ID NO: 51953 - protein, 10 aa, Borrelia afzelii
VKYNVSSAIK

SEQ ID NO: 51954 - protein, 10 aa, Borrelia afzelii
KYNVSSAIKT

SEQ ID NO: 51955 - protein, 10 aa, Borrelia afzelii
YNVSSAIKTI

SEQ ID NO: 51956 - protein, 10 aa, Borrelia afzelii
NVSSAIKTIV

SEQ ID NO: 51957 - protein, 10 aa, Borrelia afzelii
VSSAIKTIVK

SEQ ID NO: 51958 - protein, 10 aa, Borrelia afzelii
SSAIKTIVKI

SEQ ID NO: 51959 - protein, 10 aa, Borrelia afzelii
SAIKTIVKIY

SEQ ID NO: 51960 - protein, 10 aa, Borrelia afzelii
AIKTIVKIYD

SEQ ID NO: 51961 - protein, 10 aa, Borrelia afzelii
IKTIVKIYDN

SEQ ID NO: 51962 - protein, 10 aa, Borrelia afzelii
KTIVKIYDNY

SEQ ID NO: 51963 - protein, 10 aa, Borrelia afzelii
TIVKIYDNYT

SEQ ID NO: 51964 - protein, 10 aa, Borrelia afzelii
IVKIYDNYTL

SEQ ID NO: 51965 - protein, 10 aa, Borrelia afzelii
VKIYDNYTLL

SEQ ID NO: 51966 - protein, 10 aa, Borrelia afzelii
KIYDNYTLLS

SEQ ID NO: 51967 - protein, 10 aa, Borrelia afzelii
IYDNYTLLST

SEQ ID NO: 51968 - protein, 10 aa, Borrelia afzelii
YDNYTLLSTK

SEQ ID NO: 51969 - protein, 10 aa, Borrelia afzelii
DNYTLLSTKQ

SEQ ID NO: 51970 - protein, 10 aa, Borrelia afzelii
NYTLLSTKQT

SEQ ID NO: 51971 - protein, 10 aa, Borrelia afzelii
YTLLSTKQTQ

SEQ ID NO: 51972 - protein, 10 aa, Borrelia afzelii
TLLSTKQTQM

SEQ ID NO: 51973 - protein, 10 aa, Borrelia afzelii
LLSTKQTQMY

SEQ ID NO: 51974 - protein, 10 aa, Borrelia afzelii
LSTKQTQMYS

SEQ ID NO: 51975 - protein, 10 aa, Borrelia afzelii
STKQTQMYST

SEQ ID NO: 51976 - protein, 10 aa, Borrelia afzelii
TKQTQMYSTR

SEQ ID NO: 51977 - protein, 10 aa, Borrelia afzelii
KQTQMYSTRL

SEQ ID NO: 51978 - protein, 10 aa, Borrelia afzelii
QTQMYSTRLD

SEQ ID NO: 51979 - protein, 10 aa, Borrelia afzelii
TQMYSTRLDN

SEQ ID NO: 51980 - protein, 10 aa, Borrelia afzelii
QMYSTRLDNL

SEQ ID NO: 51981 - protein, 10 aa, Borrelia afzelii
MYSTRLDNLA

SEQ ID NO: 51982 - protein, 10 aa, Borrelia afzelii
YSTRLDNLAK

SEQ ID NO: 51983 - protein, 10 aa, Borrelia afzelii
STRLDNLAKA

SEQ ID NO: 51984 - protein, 10 aa, Borrelia afzelii
TRLDNLAKAK

SEQ ID NO: 51985 - protein, 10 aa, Borrelia afzelii
RLDNLAKAKA

SEQ ID NO: 51986 - protein, 10 aa, Borrelia afzelii
LDNLAKAKAR

SEQ ID NO: 51987 - protein, 10 aa, Borrelia afzelii
DNLAKAKARE

SEQ ID NO: 51988 - protein, 10 aa, Borrelia afzelii
NLAKAKAREE

SEQ ID NO: 51989 - protein, 10 aa, Borrelia afzelii
LAKAKAREEA

SEQ ID NO: 51990 - protein, 10 aa, Borrelia afzelii
AKAKAREEAK

SEQ ID NO: 51991 - protein, 10 aa, Borrelia afzelii
KAKAREEAKK

SEQ ID NO: 51992 - protein, 10 aa, Borrelia afzelii
AKAREEAKKF

SEQ ID NO: 51993 - protein, 10 aa, Borrelia afzelii
KAREEAKKFT

SEQ ID NO: 51994 - protein, 10 aa, Borrelia afzelii
AREEAKKFTK

SEQ ID NO: 51995 - protein, 10 aa, Borrelia afzelii
REEAKKFTKE

SEQ ID NO: 51996 - protein, 10 aa, Borrelia afzelii
EEAKKFTKEE

SEQ ID NO: 51997 - protein, 10 aa, Borrelia afzelii
EAKKFTKEEL

SEQ ID NO: 51998 - protein, 10 aa, Borrelia afzelii
AKKFTKEELE

SEQ ID NO: 51999 - protein, 10 aa, Borrelia afzelii
KKFTKEELEK

SEQ ID NO: 52000 - protein, 10 aa, Borrelia afzelii
KFTKEELEKD

SEQ ID NO: 52001 - protein, 10 aa, Borrelia afzelii
FTKEELEKDL

SEQ ID NO: 52002 - protein, 10 aa, Borrelia afzelii
TKEELEKDLK

SEQ ID NO: 52003 - protein, 10 aa, Borrelia afzelii
KEELEKDLKT

SEQ ID NO: 52004 - protein, 10 aa, Borrelia afzelii
EELEKDLKTL

SEQ ID NO: 52005 - protein, 10 aa, Borrelia afzelii
ELEKDLKTLL

SEQ ID NO: 52006 - protein, 10 aa, Borrelia afzelii
LEKDLKTLLN

SEQ ID NO: 52007 - protein, 10 aa, Borrelia afzelii
EKDLKTLLNY

SEQ ID NO: 52008 - protein, 10 aa, Borrelia afzelii
KDLKTLLNYI

SEQ ID NO: 52009 - protein, 10 aa, Borrelia afzelii
DLKTLLNYIQ

SEQ ID NO: 52010 - protein, 10 aa, Borrelia afzelii
LKTLLNYIQV

SEQ ID NO: 52011 - protein, 10 aa, Borrelia afzelii
KTLLNYIQVS

SEQ ID NO: 52012 - protein, 10 aa, Borrelia afzelii
TLLNYIQVSA

SEQ ID NO: 52013 - protein, 10 aa, Borrelia afzelii
LLNYIQVSAR

SEQ ID NO: 52014 - protein, 10 aa, Borrelia afzelii
LNYIQVSART

SEQ ID NO: 52015 - protein, 10 aa, Borrelia afzelii
NYIQVSARTA

SEQ ID NO: 52016 - protein, 10 aa, Borrelia afzelii
YIQVSARTAT

SEQ ID NO: 52017 - protein, 10 aa, Borrelia afzelii
IQVSARTATN

SEQ ID NO: 52018 - protein, 10 aa, Borrelia afzelii
QVSARTATNF

SEQ ID NO: 52019 - protein, 10 aa, Borrelia afzelii
VSARTATNFV

SEQ ID NO: 52020 - protein, 10 aa, Borrelia afzelii
SARTATNFVY

SEQ ID NO: 52021 - protein, 10 aa, Borrelia afzelii
ARTATNFVYA

SEQ ID NO: 52022 - protein, 10 aa, Borrelia afzelii
RTATNFVYAR

SEQ ID NO: 52023 - protein, 10 aa, Borrelia afzelii
TATNFVYARE

SEQ ID NO: 52024 - protein, 10 aa, Borrelia afzelii
ATNFVYAREI

SEQ ID NO: 52025 - protein, 10 aa, Borrelia afzelii
TNFVYAREIY

SEQ ID NO: 52026 - protein, 10 aa, Borrelia afzelii
NFVYAREIYS

SEQ ID NO: 52027 - protein, 10 aa, Borrelia afzelii
FVYAREIYSK

SEQ ID NO: 52028 - protein, 10 aa, Borrelia afzelii
VYAREIYSKR

SEQ ID NO: 52029 - protein, 10 aa, Borrelia afzelii
YAREIYSKRK

SEQ ID NO: 52030 - protein, 10 aa, Borrelia afzelii
AREIYSKRKL

SEQ ID NO: 52031 - protein, 10 aa, Borrelia afzelii
REIYSKRKLD

SEQ ID NO: 52032 - protein, 10 aa, Borrelia afzelii
EIYSKRKLDA

SEQ ID NO: 52033 - protein, 10 aa, Borrelia afzelii
IYSKRKLDAI

SEQ ID NO: 52034 - protein, 10 aa, Borrelia afzelii
YSKRKLDAIE

SEQ ID NO: 52035 - protein, 10 aa, Borrelia afzelii
SKRKLDAIET

SEQ ID NO: 52036 - protein, 10 aa, Borrelia afzelii
KRKLDAIETE

SEQ ID NO: 52037 - protein, 10 aa, Borrelia afzelii
RKLDAIETEI

SEQ ID NO: 52038 - protein, 10 aa, Borrelia afzelii
KLDAIETEIK

SEQ ID NO: 52039 - protein, 10 aa, Borrelia afzelii
LDAIETEIKN

SEQ ID NO: 52040 - protein, 10 aa, Borrelia afzelii
DAIETEIKNL

SEQ ID NO: 52041 - protein, 10 aa, Borrelia afzelii
AIETEIKNLI

SEQ ID NO: 52042 - protein, 10 aa, Borrelia afzelii
IETEIKNLIL

SEQ ID NO: 52043 - protein, 10 aa, Borrelia afzelii
ETEIKNLILK

SEQ ID NO: 52044 - protein, 10 aa, Borrelia afzelii
TEIKNLILKI

SEQ ID NO: 52045 - protein, 10 aa, Borrelia afzelii
EIKNLILKIK

SEQ ID NO: 52046 - protein, 10 aa, Borrelia afzelii
IKNLILKIKG

SEQ ID NO: 52047 - protein, 10 aa, Borrelia afzelii
KNLILKIKGQ

SEQ ID NO: 52048 - protein, 10 aa, Borrelia afzelii
NLILKIKGQS

SEQ ID NO: 52049 - protein, 10 aa, Borrelia afzelii
LILKIKGQSD

SEQ ID NO: 52050 - protein, 10 aa, Borrelia afzelii
ILKIKGQSDL

SEQ ID NO: 52051 - protein, 10 aa, Borrelia afzelii
LKIKGQSDLY

SEQ ID NO: 52052 - protein, 10 aa, Borrelia afzelii
KIKGQSDLYE

SEQ ID NO: 52053 - protein, 10 aa, Borrelia afzelii
IKGQSDLYEA

SEQ ID NO: 52054 - protein, 10 aa, Borrelia afzelii
KGQSDLYEAY

SEQ ID NO: 52055 - protein, 10 aa, Borrelia afzelii
GQSDLYEAYK

SEQ ID NO: 52056 - protein, 10 aa, Borrelia afzelii
QSDLYEAYKA

SEQ ID NO: 52057 - protein, 10 aa, Borrelia afzelii
SDLYEAYKAI

SEQ ID NO: 52058 - protein, 10 aa, Borrelia afzelii
DLYEAYKAIV

SEQ ID NO: 52059 - protein, 10 aa, Borrelia afzelii
LYEAYKAIVR

SEQ ID NO: 52060 - protein, 10 aa, Borrelia afzelii
YEAYKAIVRS

SEQ ID NO: 52061 - protein, 10 aa, Borrelia afzelii
EAYKAIVRSI

SEQ ID NO: 52062 - protein, 10 aa, Borrelia afzelii
AYKAIVRSIL

SEQ ID NO: 52063 - protein, 10 aa, Borrelia afzelii
YKAIVRSILL

SEQ ID NO: 52064 - protein, 10 aa, Borrelia afzelii
KAIVRSILLM

SEQ ID NO: 52065 - protein, 10 aa, Borrelia afzelii
AIVRSILLMK

SEQ ID NO: 52066 - protein, 10 aa, Borrelia afzelii
IVRSILLMKD

SEQ ID NO: 52067 - protein, 10 aa, Borrelia afzelii
VRSILLMKDS

SEQ ID NO: 52068 - protein, 10 aa, Borrelia afzelii
RSILLMKDSL

SEQ ID NO: 52069 - protein, 10 aa, Borrelia afzelii
SILLMKDSLK

SEQ ID NO: 52070 - protein, 10 aa, Borrelia afzelii
ILLMKDSLKI

SEQ ID NO: 52071 - protein, 10 aa, Borrelia afzelii
LLMKDSLKII

SEQ ID NO: 52072 - protein, 10 aa, Borrelia afzelii
LMKDSLKIIE

SEQ ID NO: 52073 - protein, 10 aa, Borrelia afzelii
MKDSLKIIEI

SEQ ID NO: 52074 - protein, 10 aa, Borrelia afzelii
KDSLKIIEIV

SEQ ID NO: 52075 - protein, 10 aa, Borrelia afzelii
DSLKIIEIVI

SEQ ID NO: 52076 - protein, 10 aa, Borrelia afzelii
SLKIIEIVID

SEQ ID NO: 52077 - protein, 10 aa, Borrelia afzelii
LKIIEIVIDK

SEQ ID NO: 52078 - protein, 10 aa, Borrelia afzelii
KIIEIVIDKN

SEQ ID NO: 52079 - protein, 10 aa, Borrelia afzelii
IIEIVIDKNG

SEQ ID NO: 52080 - protein, 10 aa, Borrelia afzelii
IEIVIDKNGV

SEQ ID NO: 52081 - protein, 10 aa, Borrelia afzelii
EIVIDKNGVW

SEQ ID NO: 52082 - protein, 10 aa, Borrelia afzelii
IVIDKNGVWY

SEQ ID NO: 52083 - protein, 11 aa, Borrelia afzelii
MKIKSKCLALG

SEQ ID NO: 52084 - protein, 11 aa, Borrelia afzelii
KIKSKCLALGL

SEQ ID NO: 52085 - protein, 11 aa, Borrelia afzelii
IKSKCLALGLL

SEQ ID NO: 52086 - protein, 11 aa, Borrelia afzelii
KSKCLALGLLF

SEQ ID NO: 52087 - protein, 11 aa, Borrelia afzelii
SKCLALGLLFG

SEQ ID NO: 52088 - protein, 11 aa, Borrelia afzelii
KCLALGLLFGF

SEQ ID NO: 52089 - protein, 11 aa, Borrelia afzelii
CLALGLLFGFI

SEQ ID NO: 52090 - protein, 11 aa, Borrelia afzelii
LALGLLFGFIS

SEQ ID NO: 52091 - protein, 11 aa, Borrelia afzelii
ALGLLFGFISC

SEQ ID NO: 52092 - protein, 11 aa, Borrelia afzelii
LGLLFGFISCD

SEQ ID NO: 52093 - protein, 11 aa, Borrelia afzelii
GLLFGFISCDL

SEQ ID NO: 52094 - protein, 11 aa, Borrelia afzelii
LLFGFISCDLF

SEQ ID NO: 52095 - protein, 11 aa, Borrelia afzelii
LFGFISCDLFI

SEQ ID NO: 52096 - protein, 11 aa, Borrelia afzelii
FGFISCDLFIR

SEQ ID NO: 52097 - protein, 11 aa, Borrelia afzelii
GFISCDLFIRD

SEQ ID NO: 52098 - protein, 11 aa, Borrelia afzelii
FISCDLFIRDE

SEQ ID NO: 52099 - protein, 11 aa, Borrelia afzelii
ISCDLFIRDEI

SEQ ID NO: 52100 - protein, 11 aa, Borrelia afzelii
SCDLFIRDEIK

SEQ ID NO: 52101 - protein, 11 aa, Borrelia afzelii
CDLFIRDEIKE

SEQ ID NO: 52102 - protein, 11 aa, Borrelia afzelii
DLFIRDEIKEK

SEQ ID NO: 52103 - protein, 11 aa, Borrelia afzelii
LFIRDEIKEKS

SEQ ID NO: 52104 - protein, 11 aa, Borrelia afzelii
FIRDEIKEKSL

SEQ ID NO: 52105 - protein, 11 aa, Borrelia afzelii
IRDEIKEKSLG

SEQ ID NO: 52106 - protein, 11 aa, Borrelia afzelii
RDEIKEKSLGL

SEQ ID NO: 52107 - protein, 11 aa, Borrelia afzelii
DEIKEKSLGLC

SEQ ID NO: 52108 - protein, 11 aa, Borrelia afzelii
EIKEKSLGLCD

SEQ ID NO: 52109 - protein, 11 aa, Borrelia afzelii
IKEKSLGLCDE

SEQ ID NO: 52110 - protein, 11 aa, Borrelia afzelii
KEKSLGLCDEE

SEQ ID NO: 52111 - protein, 11 aa, Borrelia afzelii
EKSLGLCDEES

SEQ ID NO: 52112 - protein, 11 aa, Borrelia afzelii
KSLGLCDEESS

SEQ ID NO: 52113 - protein, 11 aa, Borrelia afzelii
SLGLCDEESSI

SEQ ID NO: 52114 - protein, 11 aa, Borrelia afzelii
LGLCDEESSIL

SEQ ID NO: 52115 - protein, 11 aa, Borrelia afzelii
GLCDEESSILE

SEQ ID NO: 52116 - protein, 11 aa, Borrelia afzelii
LCDEESSILET

SEQ ID NO: 52117 - protein, 11 aa, Borrelia afzelii
CDEESSILETG

SEQ ID NO: 52118 - protein, 11 aa, Borrelia afzelii
DEESSILETGD

SEQ ID NO: 52119 - protein, 11 aa, Borrelia afzelii
EESSILETGDK

SEQ ID NO: 52120 - protein, 11 aa, Borrelia afzelii
ESSILETGDKS

SEQ ID NO: 52121 - protein, 11 aa, Borrelia afzelii
SSILETGDKSV

SEQ ID NO: 52122 - protein, 11 aa, Borrelia afzelii
SILETGDKSVK

SEQ ID NO: 52123 - protein, 11 aa, Borrelia afzelii
ILETGDKSVKK

SEQ ID NO: 52124 - protein, 11 aa, Borrelia afzelii
LETGDKSVKKS

SEQ ID NO: 52125 - protein, 11 aa, Borrelia afzelii
ETGDKSVKKSL

SEQ ID NO: 52126 - protein, 11 aa, Borrelia afzelii
TGDKSVKKSLN

SEQ ID NO: 52127 - protein, 11 aa, Borrelia afzelii
GDKSVKKSLNK

SEQ ID NO: 52128 - protein, 11 aa, Borrelia afzelii
DKSVKKSLNKK

SEQ ID NO: 52129 - protein, 11 aa, Borrelia afzelii
KSVKKSLNKKG

SEQ ID NO: 52130 - protein, 11 aa, Borrelia afzelii
SVKKSLNKKGK

SEQ ID NO: 52131 - protein, 11 aa, Borrelia afzelii
VKKSLNKKGKD

SEQ ID NO: 52132 - protein, 11 aa, Borrelia afzelii
KKSLNKKGKDK

SEQ ID NO: 52133 - protein, 11 aa, Borrelia afzelii
KSLNKKGKDKV

SEQ ID NO: 52134 - protein, 11 aa, Borrelia afzelii
SLNKKGKDKVA

SEQ ID NO: 52135 - protein, 11 aa, Borrelia afzelii
LNKKGKDKVAR

SEQ ID NO: 52136 - protein, 11 aa, Borrelia afzelii
NKKGKDKVARK

SEQ ID NO: 52137 - protein, 11 aa, Borrelia afzelii
KKGKDKVARKK

SEQ ID NO: 52138 - protein, 11 aa, Borrelia afzelii
KGKDKVARKKV

SEQ ID NO: 52139 - protein, 11 aa, Borrelia afzelii
GKDKVARKKVE

SEQ ID NO: 52140 - protein, 11 aa, Borrelia afzelii
KDKVARKKVEG

SEQ ID NO: 52141 - protein, 11 aa, Borrelia afzelii
DKVARKKVEGN

SEQ ID NO: 52142 - protein, 11 aa, Borrelia afzelii
KVARKKVEGNA

SEQ ID NO: 52143 - protein, 11 aa, Borrelia afzelii
VARKKVEGNAV

SEQ ID NO: 52144 - protein, 11 aa, Borrelia afzelii
ARKKVEGNAVK

SEQ ID NO: 52145 - protein, 11 aa, Borrelia afzelii
RKKVEGNAVKK

SEQ ID NO: 52146 - protein, 11 aa, Borrelia afzelii
KKVEGNAVKKD

SEQ ID NO: 52147 - protein, 11 aa, Borrelia afzelii
KVEGNAVKKDP

SEQ ID NO: 52148 - protein, 11 aa, Borrelia afzelii
VEGNAVKKDPF

SEQ ID NO: 52149 - protein, 11 aa, Borrelia afzelii
EGNAVKKDPFN

SEQ ID NO: 52150 - protein, 11 aa, Borrelia afzelii
GNAVKKDPFNH

SEQ ID NO: 52151 - protein, 11 aa, Borrelia afzelii
NAVKKDPFNHH

SEQ ID NO: 52152 - protein, 11 aa, Borrelia afzelii
AVKKDPFNHHV

SEQ ID NO: 52153 - protein, 11 aa, Borrelia afzelii
VKKDPFNHHVK

SEQ ID NO: 52154 - protein, 11 aa, Borrelia afzelii
KKDPFNHHVKR

SEQ ID NO: 52155 - protein, 11 aa, Borrelia afzelii
KDPFNHHVKRE

SEQ ID NO: 52156 - protein, 11 aa, Borrelia afzelii
DPFNHHVKRES

SEQ ID NO: 52157 - protein, 11 aa, Borrelia afzelii
PFNHHVKRESV

SEQ ID NO: 52158 - protein, 11 aa, Borrelia afzelii
FNHHVKRESVN

SEQ ID NO: 52159 - protein, 11 aa, Borrelia afzelii
NHHVKRESVNN

SEQ ID NO: 52160 - protein, 11 aa, Borrelia afzelii
HHVKRESVNNS

SEQ ID NO: 52161 - protein, 11 aa, Borrelia afzelii
HVKRESVNNSN

SEQ ID NO: 52162 - protein, 11 aa, Borrelia afzelii
VKRESVNNSNL

SEQ ID NO: 52163 - protein, 11 aa, Borrelia afzelii
KRESVNNSNLS

SEQ ID NO: 52164 - protein, 11 aa, Borrelia afzelii
RESVNNSNLSQ

SEQ ID NO: 52165 - protein, 11 aa, Borrelia afzelii
ESVNNSNLSQK

SEQ ID NO: 52166 - protein, 11 aa, Borrelia afzelii
SVNNSNLSQKN

SEQ ID NO: 52167 - protein, 11 aa, Borrelia afzelii
VNNSNLSQKNV

SEQ ID NO: 52168 - protein, 11 aa, Borrelia afzelii
NNSNLSQKNVI

SEQ ID NO: 52169 - protein, 11 aa, Borrelia afzelii
NSNLSQKNVIS

SEQ ID NO: 52170 - protein, 11 aa, Borrelia afzelii
SNLSQKNVISE

SEQ ID NO: 52171 - protein, 11 aa, Borrelia afzelii
NLSQKNVISEE

SEQ ID NO: 52172 - protein, 11 aa, Borrelia afzelii
LSQKNVISEEE

SEQ ID NO: 52173 - protein, 11 aa, Borrelia afzelii
SQKNVISEEEI

SEQ ID NO: 52174 - protein, 11 aa, Borrelia afzelii
QKNVISEEEIL

SEQ ID NO: 52175 - protein, 11 aa, Borrelia afzelii
KNVISEEEILK

SEQ ID NO: 52176 - protein, 11 aa, Borrelia afzelii
NVISEEEILKT

SEQ ID NO: 52177 - protein, 11 aa, Borrelia afzelii
VISEEEILKTK

SEQ ID NO: 52178 - protein, 11 aa, Borrelia afzelii
ISEEEILKTKL

SEQ ID NO: 52179 - protein, 11 aa, Borrelia afzelii
SEEEILKTKLL

SEQ ID NO: 52180 - protein, 11 aa, Borrelia afzelii
EEEILKTKLLR

SEQ ID NO: 52181 - protein, 11 aa, Borrelia afzelii
EEILKTKLLRE

SEQ ID NO: 52182 - protein, 11 aa, Borrelia afzelii
EILKTKLLRER

SEQ ID NO: 52183 - protein, 11 aa, Borrelia afzelii
ILKTKLLRERP

SEQ ID NO: 52184 - protein, 11 aa, Borrelia afzelii
LKTKLLRERPE

SEQ ID NO: 52185 - protein, 11 aa, Borrelia afzelii
KTKLLRERPET

SEQ ID NO: 52186 - protein, 11 aa, Borrelia afzelii
TKLLRERPETR

SEQ ID NO: 52187 - protein, 11 aa, Borrelia afzelii
KLLRERPETRK

SEQ ID NO: 52188 - protein, 11 aa, Borrelia afzelii
LLRERPETRKE

SEQ ID NO: 52189 - protein, 11 aa, Borrelia afzelii
LRERPETRKEE

SEQ ID NO: 52190 - protein, 11 aa, Borrelia afzelii
RERPETRKEEI

SEQ ID NO: 52191 - protein, 11 aa, Borrelia afzelii
ERPETRKEEIQ

SEQ ID NO: 52192 - protein, 11 aa, Borrelia afzelii
RPETRKEEIQK

SEQ ID NO: 52193 - protein, 11 aa, Borrelia afzelii
PETRKEEIQKQ

SEQ ID NO: 52194 - protein, 11 aa, Borrelia afzelii
ETRKEEIQKQQ

SEQ ID NO: 52195 - protein, 11 aa, Borrelia afzelii
TRKEEIQKQQD

SEQ ID NO: 52196 - protein, 11 aa, Borrelia afzelii
RKEEIQKQQDE

SEQ ID NO: 52197 - protein, 11 aa, Borrelia afzelii
KEEIQKQQDEH

SEQ ID NO: 52198 - protein, 11 aa, Borrelia afzelii
EEIQKQQDEHK

SEQ ID NO: 52199 - protein, 11 aa, Borrelia afzelii
EIQKQQDEHKR

SEQ ID NO: 52200 - protein, 11 aa, Borrelia afzelii
IQKQQDEHKRM

SEQ ID NO: 52201 - protein, 11 aa, Borrelia afzelii
QKQQDEHKRML

SEQ ID NO: 52202 - protein, 11 aa, Borrelia afzelii
KQQDEHKRMLQ

SEQ ID NO: 52203 - protein, 11 aa, Borrelia afzelii
QQDEHKRMLQG

SEQ ID NO: 52204 - protein, 11 aa, Borrelia afzelii
QDEHKRMLQGS

SEQ ID NO: 52205 - protein, 11 aa, Borrelia afzelii
DEHKRMLQGSL

SEQ ID NO: 52206 - protein, 11 aa, Borrelia afzelii
EHKRMLQGSLS

SEQ ID NO: 52207 - protein, 11 aa, Borrelia afzelii
HKRMLQGSLSF

SEQ ID NO: 52208 - protein, 11 aa, Borrelia afzelii
KRMLQGSLSFL

SEQ ID NO: 52209 - protein, 11 aa, Borrelia afzelii
RMLQGSLSFLS

SEQ ID NO: 52210 - protein, 11 aa, Borrelia afzelii
MLQGSLSFLSG

SEQ ID NO: 52211 - protein, 11 aa, Borrelia afzelii
LQGSLSFLSGE

SEQ ID NO: 52212 - protein, 11 aa, Borrelia afzelii
QGSLSFLSGES

SEQ ID NO: 52213 - protein, 11 aa, Borrelia afzelii
GSLSFLSGESG

SEQ ID NO: 52214 - protein, 11 aa, Borrelia afzelii
SLSFLSGESGE

SEQ ID NO: 52215 - protein, 11 aa, Borrelia afzelii
LSFLSGESGEL

SEQ ID NO: 52216 - protein, 11 aa, Borrelia afzelii
SFLSGESGELK

SEQ ID NO: 52217 - protein, 11 aa, Borrelia afzelii
FLSGESGELKD

SEQ ID NO: 52218 - protein, 11 aa, Borrelia afzelii
LSGESGELKDT

SEQ ID NO: 52219 - protein, 11 aa, Borrelia afzelii
SGESGELKDTI

SEQ ID NO: 52220 - protein, 11 aa, Borrelia afzelii
GESGELKDTIE

SEQ ID NO: 52221 - protein, 11 aa, Borrelia afzelii
ESGELKDTIES

SEQ ID NO: 52222 - protein, 11 aa, Borrelia afzelii
SGELKDTIESN

SEQ ID NO: 52223 - protein, 11 aa, Borrelia afzelii
GELKDTIESNE

SEQ ID NO: 52224 - protein, 11 aa, Borrelia afzelii
ELKDTIESNEI

SEQ ID NO: 52225 - protein, 11 aa, Borrelia afzelii
LKDTIESNEID

SEQ ID NO: 52226 - protein, 11 aa, Borrelia afzelii
KDTIESNEIDF

SEQ ID NO: 52227 - protein, 11 aa, Borrelia afzelii
DTIESNEIDFT

SEQ ID NO: 52228 - protein, 11 aa, Borrelia afzelii
TIESNEIDFTI

SEQ ID NO: 52229 - protein, 11 aa, Borrelia afzelii
IESNEIDFTID

SEQ ID NO: 52230 - protein, 11 aa, Borrelia afzelii
ESNEIDFTIDS

SEQ ID NO: 52231 - protein, 11 aa, Borrelia afzelii
SNEIDFTIDSD

SEQ ID NO: 52232 - protein, 11 aa, Borrelia afzelii
NEIDFTIDSDL

SEQ ID NO: 52233 - protein, 11 aa, Borrelia afzelii
EIDFTIDSDLR

SEQ ID NO: 52234 - protein, 11 aa, Borrelia afzelii
IDFTIDSDLRL

SEQ ID NO: 52235 - protein, 11 aa, Borrelia afzelii
DFTIDSDLRLK

SEQ ID NO: 52236 - protein, 11 aa, Borrelia afzelii
FTIDSDLRLKS

SEQ ID NO: 52237 - protein, 11 aa, Borrelia afzelii
TIDSDLRLKSD

SEQ ID NO: 52238 - protein, 11 aa, Borrelia afzelii
IDSDLRLKSDL

SEQ ID NO: 52239 - protein, 11 aa, Borrelia afzelii
DSDLRLKSDLQ

SEQ ID NO: 52240 - protein, 11 aa, Borrelia afzelii
SDLRLKSDLQA

SEQ ID NO: 52241 - protein, 11 aa, Borrelia afzelii
DLRLKSDLQAI

SEQ ID NO: 52242 - protein, 11 aa, Borrelia afzelii
LRLKSDLQAIS

SEQ ID NO: 52243 - protein, 11 aa, Borrelia afzelii
RLKSDLQAISG

SEQ ID NO: 52244 - protein, 11 aa, Borrelia afzelii
LKSDLQAISGS

SEQ ID NO: 52245 - protein, 11 aa, Borrelia afzelii
KSDLQAISGSN

SEQ ID NO: 52246 - protein, 11 aa, Borrelia afzelii
SDLQAISGSNS

SEQ ID NO: 52247 - protein, 11 aa, Borrelia afzelii
DLQAISGSNSI

SEQ ID NO: 52248 - protein, 11 aa, Borrelia afzelii
LQAISGSNSIS

SEQ ID NO: 52249 - protein, 11 aa, Borrelia afzelii
QAISGSNSISY

SEQ ID NO: 52250 - protein, 11 aa, Borrelia afzelii
AISGSNSISYT

SEQ ID NO: 52251 - protein, 11 aa, Borrelia afzelii
ISGSNSISYTD

SEQ ID NO: 52252 - protein, 11 aa, Borrelia afzelii
SGSNSISYTDE

SEQ ID NO: 52253 - protein, 11 aa, Borrelia afzelii
GSNSISYTDEI

SEQ ID NO: 52254 - protein, 11 aa, Borrelia afzelii
SNSISYTDEIE

SEQ ID NO: 52255 - protein, 11 aa, Borrelia afzelii
NSISYTDEIEE

SEQ ID NO: 52256 - protein, 11 aa, Borrelia afzelii
SISYTDEIEEE

SEQ ID NO: 52257 - protein, 11 aa, Borrelia afzelii
ISYTDEIEEED

SEQ ID NO: 52258 - protein, 11 aa, Borrelia afzelii
SYTDEIEEEDY

SEQ ID NO: 52259 - protein, 11 aa, Borrelia afzelii
YTDEIEEEDYD

SEQ ID NO: 52260 - protein, 11 aa, Borrelia afzelii
TDEIEEEDYDQ

SEQ ID NO: 52261 - protein, 11 aa, Borrelia afzelii
DEIEEEDYDQY

SEQ ID NO: 52262 - protein, 11 aa, Borrelia afzelii
EIEEEDYDQYS

SEQ ID NO: 52263 - protein, 11 aa, Borrelia afzelii
IEEEDYDQYSL

SEQ ID NO: 52264 - protein, 11 aa, Borrelia afzelii
EEEDYDQYSLE

SEQ ID NO: 52265 - protein, 11 aa, Borrelia afzelii
EEDYDQYSLEE

SEQ ID NO: 52266 - protein, 11 aa, Borrelia afzelii
EDYDQYSLEED

SEQ ID NO: 52267 - protein, 11 aa, Borrelia afzelii
DYDQYSLEEDY

SEQ ID NO: 52268 - protein, 11 aa, Borrelia afzelii
YDQYSLEEDYY

SEQ ID NO: 52269 - protein, 11 aa, Borrelia afzelii
DQYSLEEDYYY

SEQ ID NO: 52270 - protein, 11 aa, Borrelia afzelii
QYSLEEDYYYD

SEQ ID NO: 52271 - protein, 11 aa, Borrelia afzelii
YSLEEDYYYDG

SEQ ID NO: 52272 - protein, 11 aa, Borrelia afzelii
SLEEDYYYDGE

SEQ ID NO: 52273 - protein, 11 aa, Borrelia afzelii
LEEDYYYDGET

SEQ ID NO: 52274 - protein, 11 aa, Borrelia afzelii
EEDYYYDGETR

SEQ ID NO: 52275 - protein, 11 aa, Borrelia afzelii
EDYYYDGETRL

SEQ ID NO: 52276 - protein, 11 aa, Borrelia afzelii
DYYYDGETRLS

SEQ ID NO: 52277 - protein, 11 aa, Borrelia afzelii
YYYDGETRLSN

SEQ ID NO: 52278 - protein, 11 aa, Borrelia afzelii
YYDGETRLSNR

SEQ ID NO: 52279 - protein, 11 aa, Borrelia afzelii
YDGETRLSNRY

SEQ ID NO: 52280 - protein, 11 aa, Borrelia afzelii
DGETRLSNRYE

SEQ ID NO: 52281 - protein, 11 aa, Borrelia afzelii
GETRLSNRYES

SEQ ID NO: 52282 - protein, 11 aa, Borrelia afzelii
ETRLSNRYESY

SEQ ID NO: 52283 - protein, 11 aa, Borrelia afzelii
TRLSNRYESYL

SEQ ID NO: 52284 - protein, 11 aa, Borrelia afzelii
RLSNRYESYLE

SEQ ID NO: 52285 - protein, 11 aa, Borrelia afzelii
LSNRYESYLEG

SEQ ID NO: 52286 - protein, 11 aa, Borrelia afzelii
SNRYESYLEGV

SEQ ID NO: 52287 - protein, 11 aa, Borrelia afzelii
NRYESYLEGVK

SEQ ID NO: 52288 - protein, 11 aa, Borrelia afzelii
RYESYLEGVKY

SEQ ID NO: 52289 - protein, 11 aa, Borrelia afzelii
YESYLEGVKYN

SEQ ID NO: 52290 - protein, 11 aa, Borrelia afzelii
ESYLEGVKYNV

SEQ ID NO: 52291 - protein, 11 aa, Borrelia afzelii
SYLEGVKYNVS

SEQ ID NO: 52292 - protein, 11 aa, Borrelia afzelii
YLEGVKYNVSS

SEQ ID NO: 52293 - protein, 11 aa, Borrelia afzelii
LEGVKYNVSSA

SEQ ID NO: 52294 - protein, 11 aa, Borrelia afzelii
EGVKYNVSSAI

SEQ ID NO: 52295 - protein, 11 aa, Borrelia afzelii
GVKYNVSSAIK

SEQ ID NO: 52296 - protein, 11 aa, Borrelia afzelii
VKYNVSSAIKT

SEQ ID NO: 52297 - protein, 11 aa, Borrelia afzelii
KYNVSSAIKTI

SEQ ID NO: 52298 - protein, 11 aa, Borrelia afzelii
YNVSSAIKTIV

SEQ ID NO: 52299 - protein, 11 aa, Borrelia afzelii
NVSSAIKTIVK

SEQ ID NO: 52300 - protein, 11 aa, Borrelia afzelii
VSSAIKTIVKI

SEQ ID NO: 52301 - protein, 11 aa, Borrelia afzelii
SSAIKTIVKIY

SEQ ID NO: 52302 - protein, 11 aa, Borrelia afzelii
SAIKTIVKIYD

SEQ ID NO: 52303 - protein, 11 aa, Borrelia afzelii
AIKTIVKIYDN

SEQ ID NO: 52304 - protein, 11 aa, Borrelia afzelii
IKTIVKIYDNY

SEQ ID NO: 52305 - protein, 11 aa, Borrelia afzelii
KTIVKIYDNYT

SEQ ID NO: 52306 - protein, 11 aa, Borrelia afzelii
TIVKIYDNYTL

SEQ ID NO: 52307 - protein, 11 aa, Borrelia afzelii
IVKIYDNYTLL

SEQ ID NO: 52308 - protein, 11 aa, Borrelia afzelii
VKIYDNYTLLS

SEQ ID NO: 52309 - protein, 11 aa, Borrelia afzelii
KIYDNYTLLST

SEQ ID NO: 52310 - protein, 11 aa, Borrelia afzelii
IYDNYTLLSTK

SEQ ID NO: 52311 - protein, 11 aa, Borrelia afzelii
YDNYTLLSTKQ

SEQ ID NO: 52312 - protein, 11 aa, Borrelia afzelii
DNYTLLSTKQT

SEQ ID NO: 52313 - protein, 11 aa, Borrelia afzelii
NYTLLSTKQTQ

SEQ ID NO: 52314 - protein, 11 aa, Borrelia afzelii
YTLLSTKQTQM

SEQ ID NO: 52315 - protein, 11 aa, Borrelia afzelii
TLLSTKQTQMY

SEQ ID NO: 52316 - protein, 11 aa, Borrelia afzelii
LLSTKQTQMYS

SEQ ID NO: 52317 - protein, 11 aa, Borrelia afzelii
LSTKQTQMYST

SEQ ID NO: 52318 - protein, 11 aa, Borrelia afzelii
STKQTQMYSTR

SEQ ID NO: 52319 - protein, 11 aa, Borrelia afzelii
TKQTQMYSTRL

SEQ ID NO: 52320 - protein, 11 aa, Borrelia afzelii
KQTQMYSTRLD

SEQ ID NO: 52321 - protein, 11 aa, Borrelia afzelii
QTQMYSTRLDN

SEQ ID NO: 52322 - protein, 11 aa, Borrelia afzelii
TQMYSTRLDNL

SEQ ID NO: 52323 - protein, 11 aa, Borrelia afzelii
QMYSTRLDNLA

SEQ ID NO: 52324 - protein, 11 aa, Borrelia afzelii
MYSTRLDNLAK

SEQ ID NO: 52325 - protein, 11 aa, Borrelia afzelii
YSTRLDNLAKA

SEQ ID NO: 52326 - protein, 11 aa, Borrelia afzelii
STRLDNLAKAK

SEQ ID NO: 52327 - protein, 11 aa, Borrelia afzelii
TRLDNLAKAKA

SEQ ID NO: 52328 - protein, 11 aa, Borrelia afzelii
RLDNLAKAKAR

SEQ ID NO: 52329 - protein, 11 aa, Borrelia afzelii
LDNLAKAKARE

SEQ ID NO: 52330 - protein, 11 aa, Borrelia afzelii
DNLAKAKAREE

SEQ ID NO: 52331 - protein, 11 aa, Borrelia afzelii
NLAKAKAREEA

SEQ ID NO: 52332 - protein, 11 aa, Borrelia afzelii
LAKAKAREEAK

SEQ ID NO: 52333 - protein, 11 aa, Borrelia afzelii
AKAKAREEAKK

SEQ ID NO: 52334 - protein, 11 aa, Borrelia afzelii
KAKAREEAKKF

SEQ ID NO: 52335 - protein, 11 aa, Borrelia afzelii
AKAREEAKKFT

SEQ ID NO: 52336 - protein, 11 aa, Borrelia afzelii
KAREEAKKFTK

SEQ ID NO: 52337 - protein, 11 aa, Borrelia afzelii
AREEAKKFTKE

SEQ ID NO: 52338 - protein, 11 aa, Borrelia afzelii
REEAKKFTKEE

SEQ ID NO: 52339 - protein, 11 aa, Borrelia afzelii
EEAKKFTKEEL

SEQ ID NO: 52340 - protein, 11 aa, Borrelia afzelii
EAKKFTKEELE

SEQ ID NO: 52341 - protein, 11 aa, Borrelia afzelii
AKKFTKEELEK

SEQ ID NO: 52342 - protein, 11 aa, Borrelia afzelii
KKFTKEELEKD

SEQ ID NO: 52343 - protein, 11 aa, Borrelia afzelii
KFTKEELEKDL

SEQ ID NO: 52344 - protein, 11 aa, Borrelia afzelii
FTKEELEKDLK

SEQ ID NO: 52345 - protein, 11 aa, Borrelia afzelii
TKEELEKDLKT

SEQ ID NO: 52346 - protein, 11 aa, Borrelia afzelii
KEELEKDLKTL

SEQ ID NO: 52347 - protein, 11 aa, Borrelia afzelii
EELEKDLKTLL

SEQ ID NO: 52348 - protein, 11 aa, Borrelia afzelii
ELEKDLKTLLN

SEQ ID NO: 52349 - protein, 11 aa, Borrelia afzelii
LEKDLKTLLNY

SEQ ID NO: 52350 - protein, 11 aa, Borrelia afzelii
EKDLKTLLNYI

SEQ ID NO: 52351 - protein, 11 aa, Borrelia afzelii
KDLKTLLNYIQ

SEQ ID NO: 52352 - protein, 11 aa, Borrelia afzelii
DLKTLLNYIQV

SEQ ID NO: 52353 - protein, 11 aa, Borrelia afzelii
LKTLLNYIQVS

SEQ ID NO: 52354 - protein, 11 aa, Borrelia afzelii
KTLLNYIQVSA

SEQ ID NO: 52355 - protein, 11 aa, Borrelia afzelii
TLLNYIQVSAR

SEQ ID NO: 52356 - protein, 11 aa, Borrelia afzelii
LLNYIQVSART

SEQ ID NO: 52357 - protein, 11 aa, Borrelia afzelii
LNYIQVSARTA

SEQ ID NO: 52358 - protein, 11 aa, Borrelia afzelii
NYIQVSARTAT

SEQ ID NO: 52359 - protein, 11 aa, Borrelia afzelii
YIQVSARTATN

SEQ ID NO: 52360 - protein, 11 aa, Borrelia afzelii
IQVSARTATNF

SEQ ID NO: 52361 - protein, 11 aa, Borrelia afzelii
QVSARTATNFV

SEQ ID NO: 52362 - protein, 11 aa, Borrelia afzelii
VSARTATNFVY

SEQ ID NO: 52363 - protein, 11 aa, Borrelia afzelii
SARTATNFVYA

SEQ ID NO: 52364 - protein, 11 aa, Borrelia afzelii
ARTATNFVYAR

SEQ ID NO: 52365 - protein, 11 aa, Borrelia afzelii
RTATNFVYARE

SEQ ID NO: 52366 - protein, 11 aa, Borrelia afzelii
TATNFVYAREI

SEQ ID NO: 52367 - protein, 11 aa, Borrelia afzelii
ATNFVYAREIY

SEQ ID NO: 52368 - protein, 11 aa, Borrelia afzelii
TNFVYAREIYS

SEQ ID NO: 52369 - protein, 11 aa, Borrelia afzelii
NFVYAREIYSK

SEQ ID NO: 52370 - protein, 11 aa, Borrelia afzelii
FVYAREIYSKR

SEQ ID NO: 52371 - protein, 11 aa, Borrelia afzelii
VYAREIYSKRK

SEQ ID NO: 52372 - protein, 11 aa, Borrelia afzelii
YAREIYSKRKL

SEQ ID NO: 52373 - protein, 11 aa, Borrelia afzelii
AREIYSKRKLD

SEQ ID NO: 52374 - protein, 11 aa, Borrelia afzelii
REIYSKRKLDA

SEQ ID NO: 52375 - protein, 11 aa, Borrelia afzelii
EIYSKRKLDAI

SEQ ID NO: 52376 - protein, 11 aa, Borrelia afzelii
IYSKRKLDAIE

SEQ ID NO: 52377 - protein, 11 aa, Borrelia afzelii
YSKRKLDAIET

SEQ ID NO: 52378 - protein, 11 aa, Borrelia afzelii
SKRKLDAIETE

SEQ ID NO: 52379 - protein, 11 aa, Borrelia afzelii
KRKLDAIETEI

SEQ ID NO: 52380 - protein, 11 aa, Borrelia afzelii
RKLDAIETEIK

SEQ ID NO: 52381 - protein, 11 aa, Borrelia afzelii
KLDAIETEIKN

SEQ ID NO: 52382 - protein, 11 aa, Borrelia afzelii
LDAIETEIKNL

SEQ ID NO: 52383 - protein, 11 aa, Borrelia afzelii
DAIETEIKNLI

SEQ ID NO: 52384 - protein, 11 aa, Borrelia afzelii
AIETEIKNLIL

SEQ ID NO: 52385 - protein, 11 aa, Borrelia afzelii
IETEIKNLILK

SEQ ID NO: 52386 - protein, 11 aa, Borrelia afzelii
ETEIKNLILKI

SEQ ID NO: 52387 - protein, 11 aa, Borrelia afzelii
TEIKNLILKIK

SEQ ID NO: 52388 - protein, 11 aa, Borrelia afzelii
EIKNLILKIKG

SEQ ID NO: 52389 - protein, 11 aa, Borrelia afzelii
IKNLILKIKGQ

SEQ ID NO: 52390 - protein, 11 aa, Borrelia afzelii
KNLILKIKGQS

SEQ ID NO: 52391 - protein, 11 aa, Borrelia afzelii
NLILKIKGQSD

SEQ ID NO: 52392 - protein, 11 aa, Borrelia afzelii
LILKIKGQSDL

SEQ ID NO: 52393 - protein, 11 aa, Borrelia afzelii
ILKIKGQSDLY

SEQ ID NO: 52394 - protein, 11 aa, Borrelia afzelii
LKIKGQSDLYE

SEQ ID NO: 52395 - protein, 11 aa, Borrelia afzelii
KIKGQSDLYEA

SEQ ID NO: 52396 - protein, 11 aa, Borrelia afzelii
IKGQSDLYEAY

SEQ ID NO: 52397 - protein, 11 aa, Borrelia afzelii
KGQSDLYEAYK

SEQ ID NO: 52398 - protein, 11 aa, Borrelia afzelii
GQSDLYEAYKA

SEQ ID NO: 52399 - protein, 11 aa, Borrelia afzelii
QSDLYEAYKAI

SEQ ID NO: 52400 - protein, 11 aa, Borrelia afzelii
SDLYEAYKAIV

SEQ ID NO: 52401 - protein, 11 aa, Borrelia afzelii
DLYEAYKAIVR

SEQ ID NO: 52402 - protein, 11 aa, Borrelia afzelii
LYEAYKAIVRS

SEQ ID NO: 52403 - protein, 11 aa, Borrelia afzelii
YEAYKAIVRSI

SEQ ID NO: 52404 - protein, 11 aa, Borrelia afzelii
EAYKAIVRSIL

SEQ ID NO: 52405 - protein, 11 aa, Borrelia afzelii
AYKAIVRSILL

SEQ ID NO: 52406 - protein, 11 aa, Borrelia afzelii
YKAIVRSILLM

SEQ ID NO: 52407 - protein, 11 aa, Borrelia afzelii
KAIVRSILLMK

SEQ ID NO: 52408 - protein, 11 aa, Borrelia afzelii
AIVRSILLMKD

SEQ ID NO: 52409 - protein, 11 aa, Borrelia afzelii
IVRSILLMKDS

SEQ ID NO: 52410 - protein, 11 aa, Borrelia afzelii
VRSILLMKDSL

SEQ ID NO: 52411 - protein, 11 aa, Borrelia afzelii
RSILLMKDSLK

SEQ ID NO: 52412 - protein, 11 aa, Borrelia afzelii
SILLMKDSLKI

SEQ ID NO: 52413 - protein, 11 aa, Borrelia afzelii
ILLMKDSLKII

SEQ ID NO: 52414 - protein, 11 aa, Borrelia afzelii
LLMKDSLKIIE

SEQ ID NO: 52415 - protein, 11 aa, Borrelia afzelii
LMKDSLKIIEI

SEQ ID NO: 52416 - protein, 11 aa, Borrelia afzelii
MKDSLKIIEIV

SEQ ID NO: 52417 - protein, 11 aa, Borrelia afzelii
KDSLKIIEIVI

SEQ ID NO: 52418 - protein, 11 aa, Borrelia afzelii
DSLKIIEIVID

SEQ ID NO: 52419 - protein, 11 aa, Borrelia afzelii
SLKIIEIVIDK

SEQ ID NO: 52420 - protein, 11 aa, Borrelia afzelii
LKIIEIVIDKN

SEQ ID NO: 52421 - protein, 11 aa, Borrelia afzelii
KIIEIVIDKNG

SEQ ID NO: 52422 - protein, 11 aa, Borrelia afzelii
IIEIVIDKNGV

SEQ ID NO: 52423 - protein, 11 aa, Borrelia afzelii
IEIVIDKNGVW

SEQ ID NO: 52424 - protein, 11 aa, Borrelia afzelii
EIVIDKNGVWY

SEQ ID NO: 52425 - protein, 8 aa, Borrelia garinii
MKKVKSKY

SEQ ID NO: 52426 - protein, 8 aa, Borrelia garinii
KKVKSKYL

SEQ ID NO: 52427 - protein, 8 aa, Borrelia garinii
KVKSKYLA

SEQ ID NO: 52428 - protein, 8 aa, Borrelia garinii
VKSKYLAL

SEQ ID NO: 52429 - protein, 8 aa, Borrelia garinii
KSKYLALG

SEQ ID NO: 52430 - protein, 8 aa, Borrelia garinii
SKYLALGL

SEQ ID NO: 52431 - protein, 8 aa, Borrelia garinii
KYLALGLL

SEQ ID NO: 52432 - protein, 8 aa, Borrelia garinii
YLALGLLF

SEQ ID NO: 52433 - protein, 8 aa, Borrelia garinii
LALGLLFG

SEQ ID NO: 52434 - protein, 8 aa, Borrelia garinii
ALGLLFGF

SEQ ID NO: 52435 - protein, 8 aa, Borrelia garinii
LGLLFGFI

SEQ ID NO: 52436 - protein, 8 aa, Borrelia garinii
GLLFGFIS

SEQ ID NO: 52437 - protein, 8 aa, Borrelia garinii
LLFGFISC

SEQ ID NO: 52438 - protein, 8 aa, Borrelia garinii
LFGFISCD

SEQ ID NO: 52439 - protein, 8 aa, Borrelia garinii
FGFISCDL

SEQ ID NO: 52440 - protein, 8 aa, Borrelia garinii
GFISCDLF

SEQ ID NO: 52441 - protein, 8 aa, Borrelia garinii
FISCDLFI

SEQ ID NO: 52442 - protein, 8 aa, Borrelia garinii
ISCDLFIR

SEQ ID NO: 52443 - protein, 8 aa, Borrelia garinii
SCDLFIRY

SEQ ID NO: 52444 - protein, 8 aa, Borrelia garinii
CDLFIRYE

SEQ ID NO: 52445 - protein, 8 aa, Borrelia garinii
DLFIRYEM

SEQ ID NO: 52446 - protein, 8 aa, Borrelia garinii
LFIRYEMK

SEQ ID NO: 52447 - protein, 8 aa, Borrelia garinii
FIRYEMKE

SEQ ID NO: 52448 - protein, 8 aa, Borrelia garinii
IRYEMKEE

SEQ ID NO: 52449 - protein, 8 aa, Borrelia garinii
RYEMKEES

SEQ ID NO: 52450 - protein, 8 aa, Borrelia garinii
YEMKEESP

SEQ ID NO: 52451 - protein, 8 aa, Borrelia garinii
EMKEESPG

SEQ ID NO: 52452 - protein, 8 aa, Borrelia garinii
MKEESPGL

SEQ ID NO: 52453 - protein, 8 aa, Borrelia garinii
KEESPGLF

SEQ ID NO: 52454 - protein, 8 aa, Borrelia garinii
EESPGLFD

SEQ ID NO: 52455 - protein, 8 aa, Borrelia garinii
ESPGLFDK

SEQ ID NO: 52456 - protein, 8 aa, Borrelia garinii
SPGLFDKG

SEQ ID NO: 52457 - protein, 8 aa, Borrelia garinii
PGLFDKGN

SEQ ID NO: 52458 - protein, 8 aa, Borrelia garinii
GLFDKGNS

SEQ ID NO: 52459 - protein, 8 aa, Borrelia garinii
LFDKGNSI

SEQ ID NO: 52460 - protein, 8 aa, Borrelia garinii
FDKGNSIL

SEQ ID NO: 52461 - protein, 8 aa, Borrelia garinii
DKGNSILE

SEQ ID NO: 52462 - protein, 8 aa, Borrelia garinii
KGNSILET

SEQ ID NO: 52463 - protein, 8 aa, Borrelia garinii
GNSILETS

SEQ ID NO: 52464 - protein, 8 aa, Borrelia garinii
NSILETSE

SEQ ID NO: 52465 - protein, 8 aa, Borrelia garinii
SILETSEE

SEQ ID NO: 52466 - protein, 8 aa, Borrelia garinii
ILETSEES

SEQ ID NO: 52467 - protein, 8 aa, Borrelia garinii
LETSEESI

SEQ ID NO: 52468 - protein, 8 aa, Borrelia garinii
ETSEESIK

SEQ ID NO: 52469 - protein, 8 aa, Borrelia garinii
TSEESIKK

SEQ ID NO: 52470 - protein, 8 aa, Borrelia garinii
SEESIKKP

SEQ ID NO: 52471 - protein, 8 aa, Borrelia garinii
EESIKKPM

SEQ ID NO: 52472 - protein, 8 aa, Borrelia garinii
ESIKKPMN

SEQ ID NO: 52473 - protein, 8 aa, Borrelia garinii
SIKKPMNK

SEQ ID NO: 52474 - protein, 8 aa, Borrelia garinii
IKKPMNKK

SEQ ID NO: 52475 - protein, 8 aa, Borrelia garinii
KKPMNKKG

SEQ ID NO: 52476 - protein, 8 aa, Borrelia garinii
KPMNKKGK

SEQ ID NO: 52477 - protein, 8 aa, Borrelia garinii
PMNKKGKG

SEQ ID NO: 52478 - protein, 8 aa, Borrelia garinii
MNKKGKGK

SEQ ID NO: 52479 - protein, 8 aa, Borrelia garinii
NKKGKGKI

SEQ ID NO: 52480 - protein, 8 aa, Borrelia garinii
KKGKGKIA

SEQ ID NO: 52481 - protein, 8 aa, Borrelia garinii
KGKGKIAR

SEQ ID NO: 52482 - protein, 8 aa, Borrelia garinii
GKGKIARK

SEQ ID NO: 52483 - protein, 8 aa, Borrelia garinii
KGKIARKN

SEQ ID NO: 52484 - protein, 8 aa, Borrelia garinii
GKIARKNG

SEQ ID NO: 52485 - protein, 8 aa, Borrelia garinii
KIARKNGK

SEQ ID NO: 52486 - protein, 8 aa, Borrelia garinii
IARKNGKS

SEQ ID NO: 52487 - protein, 8 aa, Borrelia garinii
ARKNGKSK

SEQ ID NO: 52488 - protein, 8 aa, Borrelia garinii
RKNGKSKV

SEQ ID NO: 52489 - protein, 8 aa, Borrelia garinii
KNGKSKVS

SEQ ID NO: 52490 - protein, 8 aa, Borrelia garinii
NGKSKVSG

SEQ ID NO: 52491 - protein, 8 aa, Borrelia garinii
GKSKVSGK

SEQ ID NO: 52492 - protein, 8 aa, Borrelia garinii
KSKVSGKE

SEQ ID NO: 52493 - protein, 8 aa, Borrelia garinii
SKVSGKEP

SEQ ID NO: 52494 - protein, 8 aa, Borrelia garinii
KVSGKEPF

SEQ ID NO: 52495 - protein, 8 aa, Borrelia garinii
VSGKEPFI

SEQ ID NO: 52496 - protein, 8 aa, Borrelia garinii
SGKEPFIH

SEQ ID NO: 52497 - protein, 8 aa, Borrelia garinii
GKEPFIHS

SEQ ID NO: 52498 - protein, 8 aa, Borrelia garinii
KEPFIHSF

SEQ ID NO: 52499 - protein, 8 aa, Borrelia garinii
EPFIHSFK

SEQ ID NO: 52500 - protein, 8 aa, Borrelia garinii
PFIHSFKR

SEQ ID NO: 52501 - protein, 8 aa, Borrelia garinii
FIHSFKRD

SEQ ID NO: 52502 - protein, 8 aa, Borrelia garinii
IHSFKRDA

SEQ ID NO: 52503 - protein, 8 aa, Borrelia garinii
HSFKRDAA

SEQ ID NO: 52504 - protein, 8 aa, Borrelia garinii
SFKRDAAN

SEQ ID NO: 52505 - protein, 8 aa, Borrelia garinii
FKRDAANK

SEQ ID NO: 52506 - protein, 8 aa, Borrelia garinii
KRDAANKS

SEQ ID NO: 52507 - protein, 8 aa, Borrelia garinii
RDAANKSN

SEQ ID NO: 52508 - protein, 8 aa, Borrelia garinii
DAANKSNF

SEQ ID NO: 52509 - protein, 8 aa, Borrelia garinii
AANKSNFL

SEQ ID NO: 52510 - protein, 8 aa, Borrelia garinii
ANKSNFLQ

SEQ ID NO: 52511 - protein, 8 aa, Borrelia garinii
NKSNFLQK

SEQ ID NO: 52512 - protein, 8 aa, Borrelia garinii
KSNFLQKN

SEQ ID NO: 52513 - protein, 8 aa, Borrelia garinii
SNFLQKNV

SEQ ID NO: 52514 - protein, 8 aa, Borrelia garinii
NFLQKNVM

SEQ ID NO: 52515 - protein, 8 aa, Borrelia garinii
FLQKNVML

SEQ ID NO: 52516 - protein, 8 aa, Borrelia garinii
LQKNVMLE

SEQ ID NO: 52517 - protein, 8 aa, Borrelia garinii
QKNVMLEE

SEQ ID NO: 52518 - protein, 8 aa, Borrelia garinii
KNVMLEEE

SEQ ID NO: 52519 - protein, 8 aa, Borrelia garinii
NVMLEEES

SEQ ID NO: 52520 - protein, 8 aa, Borrelia garinii
VMLEEESL

SEQ ID NO: 52521 - protein, 8 aa, Borrelia garinii
MLEEESLK

SEQ ID NO: 52522 - protein, 8 aa, Borrelia garinii
LEEESLKT

SEQ ID NO: 52523 - protein, 8 aa, Borrelia garinii
EEESLKTE

SEQ ID NO: 52524 - protein, 8 aa, Borrelia garinii
EESLKTEL

SEQ ID NO: 52525 - protein, 8 aa, Borrelia garinii
ESLKTELL

SEQ ID NO: 52526 - protein, 8 aa, Borrelia garinii
SLKTELLK

SEQ ID NO: 52527 - protein, 8 aa, Borrelia garinii
LKTELLKE

SEQ ID NO: 52528 - protein, 8 aa, Borrelia garinii
KTELLKEQ

SEQ ID NO: 52529 - protein, 8 aa, Borrelia garinii
TELLKEQS

SEQ ID NO: 52530 - protein, 8 aa, Borrelia garinii
ELLKEQSE

SEQ ID NO: 52531 - protein, 8 aa, Borrelia garinii
LLKEQSET

SEQ ID NO: 52532 - protein, 8 aa, Borrelia garinii
LKEQSETR

SEQ ID NO: 52533 - protein, 8 aa, Borrelia garinii
KEQSETRK

SEQ ID NO: 52534 - protein, 8 aa, Borrelia garinii
EQSETRKE

SEQ ID NO: 52535 - protein, 8 aa, Borrelia garinii
QSETRKEK

SEQ ID NO: 52536 - protein, 8 aa, Borrelia garinii
SETRKEKI

SEQ ID NO: 52537 - protein, 8 aa, Borrelia garinii
ETRKEKIQ

SEQ ID NO: 52538 - protein, 8 aa, Borrelia garinii
TRKEKIQK

SEQ ID NO: 52539 - protein, 8 aa, Borrelia garinii
RKEKIQKQ

SEQ ID NO: 52540 - protein, 8 aa, Borrelia garinii
KEKIQKQQ

SEQ ID NO: 52541 - protein, 8 aa, Borrelia garinii
EKIQKQQD

SEQ ID NO: 52542 - protein, 8 aa, Borrelia garinii
KIQKQQDE

SEQ ID NO: 52543 - protein, 8 aa, Borrelia garinii
IQKQQDEY

SEQ ID NO: 52544 - protein, 8 aa, Borrelia garinii
QKQQDEYK

SEQ ID NO: 52545 - protein, 8 aa, Borrelia garinii
KQQDEYKG

SEQ ID NO: 52546 - protein, 8 aa, Borrelia garinii
QQDEYKGM

SEQ ID NO: 52547 - protein, 8 aa, Borrelia garinii
QDEYKGMT

SEQ ID NO: 52548 - protein, 8 aa, Borrelia garinii
DEYKGMTK

SEQ ID NO: 52549 - protein, 8 aa, Borrelia garinii
EYKGMTKG

SEQ ID NO: 52550 - protein, 8 aa, Borrelia garinii
YKGMTKGS

SEQ ID NO: 52551 - protein, 8 aa, Borrelia garinii
KGMTKGSL

SEQ ID NO: 52552 - protein, 8 aa, Borrelia garinii
GMTKGSLN

SEQ ID NO: 52553 - protein, 8 aa, Borrelia garinii
MTKGSLNS

SEQ ID NO: 52554 - protein, 8 aa, Borrelia garinii
TKGSLNSL

SEQ ID NO: 52555 - protein, 8 aa, Borrelia garinii
KGSLNSLS

SEQ ID NO: 52556 - protein, 8 aa, Borrelia garinii
GSLNSLSG

SEQ ID NO: 52557 - protein, 8 aa, Borrelia garinii
SLNSLSGE

SEQ ID NO: 52558 - protein, 8 aa, Borrelia garinii
LNSLSGES

SEQ ID NO: 52559 - protein, 8 aa, Borrelia garinii
NSLSGESG

SEQ ID NO: 52560 - protein, 8 aa, Borrelia garinii
SLSGESGE

SEQ ID NO: 52561 - protein, 8 aa, Borrelia garinii
LSGESGEL

SEQ ID NO: 52562 - protein, 8 aa, Borrelia garinii
SGESGELK

SEQ ID NO: 52563 - protein, 8 aa, Borrelia garinii
GESGELKE

SEQ ID NO: 52564 - protein, 8 aa, Borrelia garinii
ESGELKET

SEQ ID NO: 52565 - protein, 8 aa, Borrelia garinii
SGELKETI

SEQ ID NO: 52566 - protein, 8 aa, Borrelia garinii
GELKETIE

SEQ ID NO: 52567 - protein, 8 aa, Borrelia garinii
ELKETIES

SEQ ID NO: 52568 - protein, 8 aa, Borrelia garinii
LKETIESN

SEQ ID NO: 52569 - protein, 8 aa, Borrelia garinii
KETIESNE

SEQ ID NO: 52570 - protein, 8 aa, Borrelia garinii
ETIESNEI

SEQ ID NO: 52571 - protein, 8 aa, Borrelia garinii
TIESNEID

SEQ ID NO: 52572 - protein, 8 aa, Borrelia garinii
IESNEIDI

SEQ ID NO: 52573 - protein, 8 aa, Borrelia garinii
ESNEIDIT

SEQ ID NO: 52574 - protein, 8 aa, Borrelia garinii
SNEIDITI

SEQ ID NO: 52575 - protein, 8 aa, Borrelia garinii
NEIDITID

SEQ ID NO: 52576 - protein, 8 aa, Borrelia garinii
EIDITIDS

SEQ ID NO: 52577 - protein, 8 aa, Borrelia garinii
IDITIDSD

SEQ ID NO: 52578 - protein, 8 aa, Borrelia garinii
DITIDSDL

SEQ ID NO: 52579 - protein, 8 aa, Borrelia garinii
ITIDSDLR

SEQ ID NO: 52580 - protein, 8 aa, Borrelia garinii
TIDSDLRP

SEQ ID NO: 52581 - protein, 8 aa, Borrelia garinii
IDSDLRPK

SEQ ID NO: 52582 - protein, 8 aa, Borrelia garinii
DSDLRPKS

SEQ ID NO: 52583 - protein, 8 aa, Borrelia garinii
SDLRPKSS

SEQ ID NO: 52584 - protein, 8 aa, Borrelia garinii
DLRPKSSL

SEQ ID NO: 52585 - protein, 8 aa, Borrelia garinii
LRPKSSLQ

SEQ ID NO: 52586 - protein, 8 aa, Borrelia garinii
RPKSSLQD

SEQ ID NO: 52587 - protein, 8 aa, Borrelia garinii
PKSSLQDI

SEQ ID NO: 52588 - protein, 8 aa, Borrelia garinii
KSSLQDIA

SEQ ID NO: 52589 - protein, 8 aa, Borrelia garinii
SSLQDIAG

SEQ ID NO: 52590 - protein, 8 aa, Borrelia garinii
SLQDIAGS

SEQ ID NO: 52591 - protein, 8 aa, Borrelia garinii
LQDIAGSN

SEQ ID NO: 52592 - protein, 8 aa, Borrelia garinii
QDIAGSNS

SEQ ID NO: 52593 - protein, 8 aa, Borrelia garinii
DIAGSNSI

SEQ ID NO: 52594 - protein, 8 aa, Borrelia garinii
IAGSNSIS

SEQ ID NO: 52595 - protein, 8 aa, Borrelia garinii
AGSNSISY

SEQ ID NO: 52596 - protein, 8 aa, Borrelia garinii
GSNSISYT

SEQ ID NO: 52597 - protein, 8 aa, Borrelia garinii
SNSISYTD

SEQ ID NO: 52598 - protein, 8 aa, Borrelia garinii
NSISYTDE

SEQ ID NO: 52599 - protein, 8 aa, Borrelia garinii
SISYTDEI

SEQ ID NO: 52600 - protein, 8 aa, Borrelia garinii
ISYTDEIE

SEQ ID NO: 52601 - protein, 8 aa, Borrelia garinii
SYTDEIEE

SEQ ID NO: 52602 - protein, 8 aa, Borrelia garinii
YTDEIEEE

SEQ ID NO: 52603 - protein, 8 aa, Borrelia garinii
TDEIEEED

SEQ ID NO: 52604 - protein, 8 aa, Borrelia garinii
DEIEEEDY

SEQ ID NO: 52605 - protein, 8 aa, Borrelia garinii
EIEEEDYA

SEQ ID NO: 52606 - protein, 8 aa, Borrelia garinii
IEEEDYAR

SEQ ID NO: 52607 - protein, 8 aa, Borrelia garinii
EEEDYARY

SEQ ID NO: 52608 - protein, 8 aa, Borrelia garinii
EEDYARYY

SEQ ID NO: 52609 - protein, 8 aa, Borrelia garinii
EDYARYYL

SEQ ID NO: 52610 - protein, 8 aa, Borrelia garinii
DYARYYLD

SEQ ID NO: 52611 - protein, 8 aa, Borrelia garinii
YARYYLDE

SEQ ID NO: 52612 - protein, 8 aa, Borrelia garinii
ARYYLDED

SEQ ID NO: 52613 - protein, 8 aa, Borrelia garinii
RYYLDEDD

SEQ ID NO: 52614 - protein, 8 aa, Borrelia garinii
YYLDEDDE

SEQ ID NO: 52615 - protein, 8 aa, Borrelia garinii
YLDEDDED

SEQ ID NO: 52616 - protein, 8 aa, Borrelia garinii
LDEDDEDD

SEQ ID NO: 52617 - protein, 8 aa, Borrelia garinii
DEDDEDDE

SEQ ID NO: 52618 - protein, 8 aa, Borrelia garinii
EDDEDDEY

SEQ ID NO: 52619 - protein, 8 aa, Borrelia garinii
DDEDDEYY

SEQ ID NO: 52620 - protein, 8 aa, Borrelia garinii
DEDDEYYE

SEQ ID NO: 52621 - protein, 8 aa, Borrelia garinii
EDDEYYED

SEQ ID NO: 52622 - protein, 8 aa, Borrelia garinii
DDEYYEDD

SEQ ID NO: 52623 - protein, 8 aa, Borrelia garinii
DEYYEDDY

SEQ ID NO: 52624 - protein, 8 aa, Borrelia garinii
EYYEDDYE

SEQ ID NO: 52625 - protein, 8 aa, Borrelia garinii
YYEDDYEE

SEQ ID NO: 52626 - protein, 8 aa, Borrelia garinii
YEDDYEEI

SEQ ID NO: 52627 - protein, 8 aa, Borrelia garinii
EDDYEEIR

SEQ ID NO: 52628 - protein, 8 aa, Borrelia garinii
DDYEEIRL

SEQ ID NO: 52629 - protein, 8 aa, Borrelia garinii
DYEEIRLS

SEQ ID NO: 52630 - protein, 8 aa, Borrelia garinii
YEEIRLSN

SEQ ID NO: 52631 - protein, 8 aa, Borrelia garinii
EEIRLSNR

SEQ ID NO: 52632 - protein, 8 aa, Borrelia garinii
EIRLSNRY

SEQ ID NO: 52633 - protein, 8 aa, Borrelia garinii
IRLSNRYQ

SEQ ID NO: 52634 - protein, 8 aa, Borrelia garinii
RLSNRYQS

SEQ ID NO: 52635 - protein, 8 aa, Borrelia garinii
LSNRYQSY

SEQ ID NO: 52636 - protein, 8 aa, Borrelia garinii
SNRYQSYL

SEQ ID NO: 52637 - protein, 8 aa, Borrelia garinii
NRYQSYLE

SEQ ID NO: 52638 - protein, 8 aa, Borrelia garinii
RYQSYLEG

SEQ ID NO: 52639 - protein, 8 aa, Borrelia garinii
YQSYLEGV

SEQ ID NO: 52640 - protein, 8 aa, Borrelia garinii
QSYLEGVK

SEQ ID NO: 52641 - protein, 8 aa, Borrelia garinii
SYLEGVKY

SEQ ID NO: 52642 - protein, 8 aa, Borrelia garinii
YLEGVKYN

SEQ ID NO: 52643 - protein, 8 aa, Borrelia garinii
LEGVKYNV

SEQ ID NO: 52644 - protein, 8 aa, Borrelia garinii
EGVKYNVD

SEQ ID NO: 52645 - protein, 8 aa, Borrelia garinii
GVKYNVDS

SEQ ID NO: 52646 - protein, 8 aa, Borrelia garinii
VKYNVDSA

SEQ ID NO: 52647 - protein, 8 aa, Borrelia garinii
KYNVDSAI

SEQ ID NO: 52648 - protein, 8 aa, Borrelia garinii
YNVDSAIN

SEQ ID NO: 52649 - protein, 8 aa, Borrelia garinii
NVDSAINT

SEQ ID NO: 52650 - protein, 8 aa, Borrelia garinii
VDSAINTI

SEQ ID NO: 52651 - protein, 8 aa, Borrelia garinii
DSAINTIN

SEQ ID NO: 52652 - protein, 8 aa, Borrelia garinii
SAINTINK

SEQ ID NO: 52653 - protein, 8 aa, Borrelia garinii
AINTINKI

SEQ ID NO: 52654 - protein, 8 aa, Borrelia garinii
INTINKIY

SEQ ID NO: 52655 - protein, 8 aa, Borrelia garinii
NTINKIYD

SEQ ID NO: 52656 - protein, 8 aa, Borrelia garinii
TINKIYDT

SEQ ID NO: 52657 - protein, 8 aa, Borrelia garinii
INKIYDTY

SEQ ID NO: 52658 - protein, 8 aa, Borrelia garinii
NKIYDTYT

SEQ ID NO: 52659 - protein, 8 aa, Borrelia garinii
KIYDTYTL

SEQ ID NO: 52660 - protein, 8 aa, Borrelia garinii
IYDTYTLF

SEQ ID NO: 52661 - protein, 8 aa, Borrelia garinii
YDTYTLFS

SEQ ID NO: 52662 - protein, 8 aa, Borrelia garinii
DTYTLFST

SEQ ID NO: 52663 - protein, 8 aa, Borrelia garinii
TYTLFSTK

SEQ ID NO: 52664 - protein, 8 aa, Borrelia garinii
YTLFSTKL

SEQ ID NO: 52665 - protein, 8 aa, Borrelia garinii
TLFSTKLT

SEQ ID NO: 52666 - protein, 8 aa, Borrelia garinii
LFSTKLTQ

SEQ ID NO: 52667 - protein, 8 aa, Borrelia garinii
FSTKLTQM

SEQ ID NO: 52668 - protein, 8 aa, Borrelia garinii
STKLTQMY

SEQ ID NO: 52669 - protein, 8 aa, Borrelia garinii
TKLTQMYS

SEQ ID NO: 52670 - protein, 8 aa, Borrelia garinii
KLTQMYST

SEQ ID NO: 52671 - protein, 8 aa, Borrelia garinii
LTQMYSTR

SEQ ID NO: 52672 - protein, 8 aa, Borrelia garinii
TQMYSTRL

SEQ ID NO: 52673 - protein, 8 aa, Borrelia garinii
QMYSTRLD

SEQ ID NO: 52674 - protein, 8 aa, Borrelia garinii
MYSTRLDN

SEQ ID NO: 52675 - protein, 8 aa, Borrelia garinii
YSTRLDNL

SEQ ID NO: 52676 - protein, 8 aa, Borrelia garinii
STRLDNLA

SEQ ID NO: 52677 - protein, 8 aa, Borrelia garinii
TRLDNLAK

SEQ ID NO: 52678 - protein, 8 aa, Borrelia garinii
RLDNLAKA

SEQ ID NO: 52679 - protein, 8 aa, Borrelia garinii
LDNLAKAK

SEQ ID NO: 52680 - protein, 8 aa, Borrelia garinii
DNLAKAKA

SEQ ID NO: 52681 - protein, 8 aa, Borrelia garinii
NLAKAKAK

SEQ ID NO: 52682 - protein, 8 aa, Borrelia garinii
LAKAKAKE

SEQ ID NO: 52683 - protein, 8 aa, Borrelia garinii
AKAKAKEE

SEQ ID NO: 52684 - protein, 8 aa, Borrelia garinii
KAKAKEEA

SEQ ID NO: 52685 - protein, 8 aa, Borrelia garinii
AKAKEEAA

SEQ ID NO: 52686 - protein, 8 aa, Borrelia garinii
KAKEEAAK

SEQ ID NO: 52687 - protein, 8 aa, Borrelia garinii
AKEEAAKF

SEQ ID NO: 52688 - protein, 8 aa, Borrelia garinii
KEEAAKFT

SEQ ID NO: 52689 - protein, 8 aa, Borrelia garinii
EEAAKFTK

SEQ ID NO: 52690 - protein, 8 aa, Borrelia garinii
EAAKFTKE

SEQ ID NO: 52691 - protein, 8 aa, Borrelia garinii
AAKFTKED

SEQ ID NO: 52692 - protein, 8 aa, Borrelia garinii
AKFTKEDL

SEQ ID NO: 52693 - protein, 8 aa, Borrelia garinii
KFTKEDLE

SEQ ID NO: 52694 - protein, 8 aa, Borrelia garinii
FTKEDLEK

SEQ ID NO: 52695 - protein, 8 aa, Borrelia garinii
TKEDLEKN

SEQ ID NO: 52696 - protein, 8 aa, Borrelia garinii
KEDLEKNF

SEQ ID NO: 52697 - protein, 8 aa, Borrelia garinii
EDLEKNFK

SEQ ID NO: 52698 - protein, 8 aa, Borrelia garinii
DLEKNFKT

SEQ ID NO: 52699 - protein, 8 aa, Borrelia garinii
LEKNFKTL

SEQ ID NO: 52700 - protein, 8 aa, Borrelia garinii
EKNFKTLL

SEQ ID NO: 52701 - protein, 8 aa, Borrelia garinii
KNFKTLLN

SEQ ID NO: 52702 - protein, 8 aa, Borrelia garinii
NFKTLLNY

SEQ ID NO: 52703 - protein, 8 aa, Borrelia garinii
FKTLLNYI

SEQ ID NO: 52704 - protein, 8 aa, Borrelia garinii
KTLLNYIQ

SEQ ID NO: 52705 - protein, 8 aa, Borrelia garinii
TLLNYIQV

SEQ ID NO: 52706 - protein, 8 aa, Borrelia garinii
LLNYIQVS

SEQ ID NO: 52707 - protein, 8 aa, Borrelia garinii
LNYIQVSV

SEQ ID NO: 52708 - protein, 8 aa, Borrelia garinii
NYIQVSVK

SEQ ID NO: 52709 - protein, 8 aa, Borrelia garinii
YIQVSVKT

SEQ ID NO: 52710 - protein, 8 aa, Borrelia garinii
IQVSVKTA

SEQ ID NO: 52711 - protein, 8 aa, Borrelia garinii
QVSVKTAT

SEQ ID NO: 52712 - protein, 8 aa, Borrelia garinii
VSVKTATN

SEQ ID NO: 52713 - protein, 8 aa, Borrelia garinii
SVKTATNF

SEQ ID NO: 52714 - protein, 8 aa, Borrelia garinii
VKTATNFV

SEQ ID NO: 52715 - protein, 8 aa, Borrelia garinii
KTATNFVY

SEQ ID NO: 52716 - protein, 8 aa, Borrelia garinii
TATNFVYI

SEQ ID NO: 52717 - protein, 8 aa, Borrelia garinii
ATNFVYIN

SEQ ID NO: 52718 - protein, 8 aa, Borrelia garinii
TNFVYINE

SEQ ID NO: 52719 - protein, 8 aa, Borrelia garinii
NFVYINEM

SEQ ID NO: 52720 - protein, 8 aa, Borrelia garinii
FVYINEMH

SEQ ID NO: 52721 - protein, 8 aa, Borrelia garinii
VYINEMHA

SEQ ID NO: 52722 - protein, 8 aa, Borrelia garinii
YINEMHAK

SEQ ID NO: 52723 - protein, 8 aa, Borrelia garinii
INEMHAKR

SEQ ID NO: 52724 - protein, 8 aa, Borrelia garinii
NEMHAKRK

SEQ ID NO: 52725 - protein, 8 aa, Borrelia garinii
EMHAKRKL

SEQ ID NO: 52726 - protein, 8 aa, Borrelia garinii
MHAKRKLE

SEQ ID NO: 52727 - protein, 8 aa, Borrelia garinii
HAKRKLEN

SEQ ID NO: 52728 - protein, 8 aa, Borrelia garinii
AKRKLENI

SEQ ID NO: 52729 - protein, 8 aa, Borrelia garinii
KRKLENIE

SEQ ID NO: 52730 - protein, 8 aa, Borrelia garinii
RKLENIEA

SEQ ID NO: 52731 - protein, 8 aa, Borrelia garinii
KLENIEAK

SEQ ID NO: 52732 - protein, 8 aa, Borrelia garinii
LENIEAKI

SEQ ID NO: 52733 - protein, 8 aa, Borrelia garinii
ENIEAKIK

SEQ ID NO: 52734 - protein, 8 aa, Borrelia garinii
NIEAKIKT

SEQ ID NO: 52735 - protein, 8 aa, Borrelia garinii
IEAKIKTL

SEQ ID NO: 52736 - protein, 8 aa, Borrelia garinii
EAKIKTLI

SEQ ID NO: 52737 - protein, 8 aa, Borrelia garinii
AKIKTLIA

SEQ ID NO: 52738 - protein, 8 aa, Borrelia garinii
KIKTLIAK

SEQ ID NO: 52739 - protein, 8 aa, Borrelia garinii
IKTLIAKI

SEQ ID NO: 52740 - protein, 8 aa, Borrelia garinii
KTLIAKIK

SEQ ID NO: 52741 - protein, 8 aa, Borrelia garinii
TLIAKIKE

SEQ ID NO: 52742 - protein, 8 aa, Borrelia garinii
LIAKIKEK

SEQ ID NO: 52743 - protein, 8 aa, Borrelia garinii
IAKIKEKS

SEQ ID NO: 52744 - protein, 8 aa, Borrelia garinii
AKIKEKSN

SEQ ID NO: 52745 - protein, 8 aa, Borrelia garinii
KIKEKSNL

SEQ ID NO: 52746 - protein, 8 aa, Borrelia garinii
IKEKSNLY

SEQ ID NO: 52747 - protein, 8 aa, Borrelia garinii
KEKSNLYS

SEQ ID NO: 52748 - protein, 8 aa, Borrelia garinii
EKSNLYSA

SEQ ID NO: 52749 - protein, 8 aa, Borrelia garinii
KSNLYSAY

SEQ ID NO: 52750 - protein, 8 aa, Borrelia garinii
SNLYSAYK

SEQ ID NO: 52751 - protein, 8 aa, Borrelia garinii
NLYSAYKA

SEQ ID NO: 52752 - protein, 8 aa, Borrelia garinii
LYSAYKAI

SEQ ID NO: 52753 - protein, 8 aa, Borrelia garinii
YSAYKAIV

SEQ ID NO: 52754 - protein, 8 aa, Borrelia garinii
SAYKAIVS

SEQ ID NO: 52755 - protein, 8 aa, Borrelia garinii
AYKAIVSS

SEQ ID NO: 52756 - protein, 8 aa, Borrelia garinii
YKAIVSSI

SEQ ID NO: 52757 - protein, 8 aa, Borrelia garinii
KAIVSSIL

SEQ ID NO: 52758 - protein, 8 aa, Borrelia garinii
AIVSSILL

SEQ ID NO: 52759 - protein, 8 aa, Borrelia garinii
IVSSILLM

SEQ ID NO: 52760 - protein, 8 aa, Borrelia garinii
VSSILLMR

SEQ ID NO: 52761 - protein, 8 aa, Borrelia garinii
SSILLMRD

SEQ ID NO: 52762 - protein, 8 aa, Borrelia garinii
SILLMRDS

SEQ ID NO: 52763 - protein, 8 aa, Borrelia garinii
ILLMRDSL

SEQ ID NO: 52764 - protein, 8 aa, Borrelia garinii
LLMRDSLK

SEQ ID NO: 52765 - protein, 8 aa, Borrelia garinii
LMRDSLKE

SEQ ID NO: 52766 - protein, 8 aa, Borrelia garinii
MRDSLKEV

SEQ ID NO: 52767 - protein, 8 aa, Borrelia garinii
RDSLKEVQ

SEQ ID NO: 52768 - protein, 8 aa, Borrelia garinii
DSLKEVQY

SEQ ID NO: 52769 - protein, 8 aa, Borrelia garinii
SLKEVQYA

SEQ ID NO: 52770 - protein, 8 aa, Borrelia garinii
LKEVQYAI

SEQ ID NO: 52771 - protein, 8 aa, Borrelia garinii
KEVQYAID

SEQ ID NO: 52772 - protein, 8 aa, Borrelia garinii
EVQYAIDK

SEQ ID NO: 52773 - protein, 8 aa, Borrelia garinii
VQYAIDKN

SEQ ID NO: 52774 - protein, 8 aa, Borrelia garinii
QYAIDKNG

SEQ ID NO: 52775 - protein, 8 aa, Borrelia garinii
YAIDKNGI

SEQ ID NO: 52776 - protein, 8 aa, Borrelia garinii
AIDKNGIW

SEQ ID NO: 52777 - protein, 8 aa, Borrelia garinii
IDKNGIWY

SEQ ID NO: 52778 - protein, 8 aa, Borrelia garinii
DKNGIWYR

SEQ ID NO: 52779 - protein, 8 aa, Borrelia garinii
KNGIWYRK

SEQ ID NO: 52780 - protein, 8 aa, Borrelia garinii
NGIWYRKL

SEQ ID NO: 52781 - protein, 8 aa, Borrelia garinii
GIWYRKLD

SEQ ID NO: 52782 - protein, 8 aa, Borrelia garinii
IWYRKLDA

SEQ ID NO: 52783 - protein, 8 aa, Borrelia garinii
WYRKLDAI

SEQ ID NO: 52784 - protein, 8 aa, Borrelia garinii
YRKLDAIE

SEQ ID NO: 52785 - protein, 8 aa, Borrelia garinii
RKLDAIET

SEQ ID NO: 52786 - protein, 8 aa, Borrelia garinii
KLDAIETE

SEQ ID NO: 52787 - protein, 8 aa, Borrelia garinii
LDAIETEI

SEQ ID NO: 52788 - protein, 8 aa, Borrelia garinii
DAIETEIK

SEQ ID NO: 52789 - protein, 8 aa, Borrelia garinii
AIETEIKN

SEQ ID NO: 52790 - protein, 8 aa, Borrelia garinii
IETEIKNL

SEQ ID NO: 52791 - protein, 8 aa, Borrelia garinii
ETEIKNLI

SEQ ID NO: 52792 - protein, 8 aa, Borrelia garinii
TEIKNLIL

SEQ ID NO: 52793 - protein, 8 aa, Borrelia garinii
EIKNLILK

SEQ ID NO: 52794 - protein, 8 aa, Borrelia garinii
IKNLILKI

SEQ ID NO: 52795 - protein, 8 aa, Borrelia garinii
KNLILKIK

SEQ ID NO: 52796 - protein, 8 aa, Borrelia garinii
NLILKIKG

SEQ ID NO: 52797 - protein, 8 aa, Borrelia garinii
LILKIKGQ

SEQ ID NO: 52798 - protein, 8 aa, Borrelia garinii
ILKIKGQS

SEQ ID NO: 52799 - protein, 8 aa, Borrelia garinii
LKIKGQSD

SEQ ID NO: 52800 - protein, 8 aa, Borrelia garinii
KIKGQSDL

SEQ ID NO: 52801 - protein, 8 aa, Borrelia garinii
IKGQSDLY

SEQ ID NO: 52802 - protein, 8 aa, Borrelia garinii
KGQSDLYE

SEQ ID NO: 52803 - protein, 8 aa, Borrelia garinii
GQSDLYEA

SEQ ID NO: 52804 - protein, 8 aa, Borrelia garinii
QSDLYEAY

SEQ ID NO: 52805 - protein, 8 aa, Borrelia garinii
SDLYEAYK

SEQ ID NO: 52806 - protein, 8 aa, Borrelia garinii
DLYEAYKA

SEQ ID NO: 52807 - protein, 8 aa, Borrelia garinii
LYEAYKAI

SEQ ID NO: 52808 - protein, 8 aa, Borrelia garinii
YEAYKAIV

SEQ ID NO: 52809 - protein, 8 aa, Borrelia garinii
EAYKAIVR

SEQ ID NO: 52810 - protein, 8 aa, Borrelia garinii
AYKAIVRS

SEQ ID NO: 52811 - protein, 8 aa, Borrelia garinii
YKAIVRSI

SEQ ID NO: 52812 - protein, 8 aa, Borrelia garinii
KAIVRSIL

SEQ ID NO: 52813 - protein, 8 aa, Borrelia garinii
AIVRSILL

SEQ ID NO: 52814 - protein, 8 aa, Borrelia garinii
IVRSILLM

SEQ ID NO: 52815 - protein, 8 aa, Borrelia garinii
VRSILLMK

SEQ ID NO: 52816 - protein, 8 aa, Borrelia garinii
RSILLMKD

SEQ ID NO: 52817 - protein, 8 aa, Borrelia garinii
SILLMKDS

SEQ ID NO: 52818 - protein, 8 aa, Borrelia garinii
ILLMKDSL

SEQ ID NO: 52819 - protein, 8 aa, Borrelia garinii
LLMKDSLK

SEQ ID NO: 52820 - protein, 8 aa, Borrelia garinii
LMKDSLKI

SEQ ID NO: 52821 - protein, 8 aa, Borrelia garinii
MKDSLKII

SEQ ID NO: 52822 - protein, 8 aa, Borrelia garinii
KDSLKIIE

SEQ ID NO: 52823 - protein, 8 aa, Borrelia garinii
DSLKIIEI

SEQ ID NO: 52824 - protein, 8 aa, Borrelia garinii
SLKIIEIV

SEQ ID NO: 52825 - protein, 8 aa, Borrelia garinii
LKIIEIVI

SEQ ID NO: 52826 - protein, 8 aa, Borrelia garinii
KIIEIVID

SEQ ID NO: 52827 - protein, 8 aa, Borrelia garinii
IIEIVIDK

SEQ ID NO: 52828 - protein, 8 aa, Borrelia garinii
IEIVIDKN

SEQ ID NO: 52829 - protein, 8 aa, Borrelia garinii
EIVIDKNG

SEQ ID NO: 52830 - protein, 8 aa, Borrelia garinii
IVIDKNGV

SEQ ID NO: 52831 - protein, 8 aa, Borrelia garinii
VIDKNGVW

SEQ ID NO: 52832 - protein, 8 aa, Borrelia garinii
IDKNGVWY

SEQ ID NO: 52833 - protein, 9 aa, Borrelia garinii
MKKVKSKYL

SEQ ID NO: 52834 - protein, 9 aa, Borrelia garinii
KKVKSKYLA

SEQ ID NO: 52835 - protein, 9 aa, Borrelia garinii
KVKSKYLAL

SEQ ID NO: 52836 - protein, 9 aa, Borrelia garinii
VKSKYLALG

SEQ ID NO: 52837 - protein, 9 aa, Borrelia garinii
KSKYLALGL

SEQ ID NO: 52838 - protein, 9 aa, Borrelia garinii
SKYLALGLL

SEQ ID NO: 52839 - protein, 9 aa, Borrelia garinii
KYLALGLLF

SEQ ID NO: 52840 - protein, 9 aa, Borrelia garinii
YLALGLLFG

SEQ ID NO: 52841 - protein, 9 aa, Borrelia garinii
LALGLLFGF

SEQ ID NO: 52842 - protein, 9 aa, Borrelia garinii
ALGLLFGFI

SEQ ID NO: 52843 - protein, 9 aa, Borrelia garinii
LGLLFGFIS

SEQ ID NO: 52844 - protein, 9 aa, Borrelia garinii
GLLFGFISC

SEQ ID NO: 52845 - protein, 9 aa, Borrelia garinii
LLFGFISCD

SEQ ID NO: 52846 - protein, 9 aa, Borrelia garinii
LFGFISCDL

SEQ ID NO: 52847 - protein, 9 aa, Borrelia garinii
FGFISCDLF

SEQ ID NO: 52848 - protein, 9 aa, Borrelia garinii
GFISCDLFI

SEQ ID NO: 52849 - protein, 9 aa, Borrelia garinii
FISCDLFIR

SEQ ID NO: 52850 - protein, 9 aa, Borrelia garinii
ISCDLFIRY

SEQ ID NO: 52851 - protein, 9 aa, Borrelia garinii
SCDLFIRYE

SEQ ID NO: 52852 - protein, 9 aa, Borrelia garinii
CDLFIRYEM

SEQ ID NO: 52853 - protein, 9 aa, Borrelia garinii
DLFIRYEMK

SEQ ID NO: 52854 - protein, 9 aa, Borrelia garinii
LFIRYEMKE

SEQ ID NO: 52855 - protein, 9 aa, Borrelia garinii
FIRYEMKEE

SEQ ID NO: 52856 - protein, 9 aa, Borrelia garinii
IRYEMKEES

SEQ ID NO: 52857 - protein, 9 aa, Borrelia garinii
RYEMKEESP

SEQ ID NO: 52858 - protein, 9 aa, Borrelia garinii
YEMKEESPG

SEQ ID NO: 52859 - protein, 9 aa, Borrelia garinii
EMKEESPGL

SEQ ID NO: 52860 - protein, 9 aa, Borrelia garinii
MKEESPGLF

SEQ ID NO: 52861 - protein, 9 aa, Borrelia garinii
KEESPGLFD

SEQ ID NO: 52862 - protein, 9 aa, Borrelia garinii
EESPGLFDK

SEQ ID NO: 52863 - protein, 9 aa, Borrelia garinii
ESPGLFDKG

SEQ ID NO: 52864 - protein, 9 aa, Borrelia garinii
SPGLFDKGN

SEQ ID NO: 52865 - protein, 9 aa, Borrelia garinii
PGLFDKGNS

SEQ ID NO: 52866 - protein, 9 aa, Borrelia garinii
GLFDKGNSI

SEQ ID NO: 52867 - protein, 9 aa, Borrelia garinii
LFDKGNSIL

SEQ ID NO: 52868 - protein, 9 aa, Borrelia garinii
FDKGNSILE

SEQ ID NO: 52869 - protein, 9 aa, Borrelia garinii
DKGNSILET

SEQ ID NO: 52870 - protein, 9 aa, Borrelia garinii
KGNSILETS

SEQ ID NO: 52871 - protein, 9 aa, Borrelia garinii
GNSILETSE

SEQ ID NO: 52872 - protein, 9 aa, Borrelia garinii
NSILETSEE

SEQ ID NO: 52873 - protein, 9 aa, Borrelia garinii
SILETSEES

SEQ ID NO: 52874 - protein, 9 aa, Borrelia garinii
ILETSEESI

SEQ ID NO: 52875 - protein, 9 aa, Borrelia garinii
LETSEESIK

SEQ ID NO: 52876 - protein, 9 aa, Borrelia garinii
ETSEESIKK

SEQ ID NO: 52877 - protein, 9 aa, Borrelia garinii
TSEESIKKP

SEQ ID NO: 52878 - protein, 9 aa, Borrelia garinii
SEESIKKPM

SEQ ID NO: 52879 - protein, 9 aa, Borrelia garinii
EESIKKPMN

SEQ ID NO: 52880 - protein, 9 aa, Borrelia garinii
ESIKKPMNK

SEQ ID NO: 52881 - protein, 9 aa, Borrelia garinii
SIKKPMNKK

SEQ ID NO: 52882 - protein, 9 aa, Borrelia garinii
IKKPMNKKG

SEQ ID NO: 52883 - protein, 9 aa, Borrelia garinii
KKPMNKKGK

SEQ ID NO: 52884 - protein, 9 aa, Borrelia garinii
KPMNKKGKG

SEQ ID NO: 52885 - protein, 9 aa, Borrelia garinii
PMNKKGKGK

SEQ ID NO: 52886 - protein, 9 aa, Borrelia garinii
MNKKGKGKI

SEQ ID NO: 52887 - protein, 9 aa, Borrelia garinii
NKKGKGKIA

SEQ ID NO: 52888 - protein, 9 aa, Borrelia garinii
KKGKGKIAR

SEQ ID NO: 52889 - protein, 9 aa, Borrelia garinii
KGKGKIARK

SEQ ID NO: 52890 - protein, 9 aa, Borrelia garinii
GKGKIARKN

SEQ ID NO: 52891 - protein, 9 aa, Borrelia garinii
KGKIARKNG

SEQ ID NO: 52892 - protein, 9 aa, Borrelia garinii
GKIARKNGK

SEQ ID NO: 52893 - protein, 9 aa, Borrelia garinii
KIARKNGKS

SEQ ID NO: 52894 - protein, 9 aa, Borrelia garinii
IARKNGKSK

SEQ ID NO: 52895 - protein, 9 aa, Borrelia garinii
ARKNGKSKV

SEQ ID NO: 52896 - protein, 9 aa, Borrelia garinii
RKNGKSKVS

SEQ ID NO: 52897 - protein, 9 aa, Borrelia garinii
KNGKSKVSG

SEQ ID NO: 52898 - protein, 9 aa, Borrelia garinii
NGKSKVSGK

SEQ ID NO: 52899 - protein, 9 aa, Borrelia garinii
GKSKVSGKE

SEQ ID NO: 52900 - protein, 9 aa, Borrelia garinii
KSKVSGKEP

SEQ ID NO: 52901 - protein, 9 aa, Borrelia garinii
SKVSGKEPF

SEQ ID NO: 52902 - protein, 9 aa, Borrelia garinii
KVSGKEPFI

SEQ ID NO: 52903 - protein, 9 aa, Borrelia garinii
VSGKEPFIH

SEQ ID NO: 52904 - protein, 9 aa, Borrelia garinii
SGKEPFIHS

SEQ ID NO: 52905 - protein, 9 aa, Borrelia garinii
GKEPFIHSF

SEQ ID NO: 52906 - protein, 9 aa, Borrelia garinii
KEPFIHSFK

SEQ ID NO: 52907 - protein, 9 aa, Borrelia garinii
EPFIHSFKR

SEQ ID NO: 52908 - protein, 9 aa, Borrelia garinii
PFIHSFKRD

SEQ ID NO: 52909 - protein, 9 aa, Borrelia garinii
FIHSFKRDA

SEQ ID NO: 52910 - protein, 9 aa, Borrelia garinii
IHSFKRDAA

SEQ ID NO: 52911 - protein, 9 aa, Borrelia garinii
HSFKRDAAN

SEQ ID NO: 52912 - protein, 9 aa, Borrelia garinii
SFKRDAANK

SEQ ID NO: 52913 - protein, 9 aa, Borrelia garinii
FKRDAANKS

SEQ ID NO: 52914 - protein, 9 aa, Borrelia garinii
KRDAANKSN

SEQ ID NO: 52915 - protein, 9 aa, Borrelia garinii
RDAANKSNF

SEQ ID NO: 52916 - protein, 9 aa, Borrelia garinii
DAANKSNFL

SEQ ID NO: 52917 - protein, 9 aa, Borrelia garinii
AANKSNFLQ

SEQ ID NO: 52918 - protein, 9 aa, Borrelia garinii
ANKSNFLQK

SEQ ID NO: 52919 - protein, 9 aa, Borrelia garinii
NKSNFLQKN

SEQ ID NO: 52920 - protein, 9 aa, Borrelia garinii
KSNFLQKNV

SEQ ID NO: 52921 - protein, 9 aa, Borrelia garinii
SNFLQKNVM

SEQ ID NO: 52922 - protein, 9 aa, Borrelia garinii
NFLQKNVML

SEQ ID NO: 52923 - protein, 9 aa, Borrelia garinii
FLQKNVMLE

SEQ ID NO: 52924 - protein, 9 aa, Borrelia garinii
LQKNVMLEE

SEQ ID NO: 52925 - protein, 9 aa, Borrelia garinii
QKNVMLEEE

SEQ ID NO: 52926 - protein, 9 aa, Borrelia garinii
KNVMLEEES

SEQ ID NO: 52927 - protein, 9 aa, Borrelia garinii
NVMLEEESL

SEQ ID NO: 52928 - protein, 9 aa, Borrelia garinii
VMLEEESLK

SEQ ID NO: 52929 - protein, 9 aa, Borrelia garinii
MLEEESLKT

SEQ ID NO: 52930 - protein, 9 aa, Borrelia garinii
LEEESLKTE

SEQ ID NO: 52931 - protein, 9 aa, Borrelia garinii
EEESLKTEL

SEQ ID NO: 52932 - protein, 9 aa, Borrelia garinii
EESLKTELL

SEQ ID NO: 52933 - protein, 9 aa, Borrelia garinii
ESLKTELLK

SEQ ID NO: 52934 - protein, 9 aa, Borrelia garinii
SLKTELLKE

SEQ ID NO: 52935 - protein, 9 aa, Borrelia garinii
LKTELLKEQ

SEQ ID NO: 52936 - protein, 9 aa, Borrelia garinii
KTELLKEQS

SEQ ID NO: 52937 - protein, 9 aa, Borrelia garinii
TELLKEQSE

SEQ ID NO: 52938 - protein, 9 aa, Borrelia garinii
ELLKEQSET

SEQ ID NO: 52939 - protein, 9 aa, Borrelia garinii
LLKEQSETR

SEQ ID NO: 52940 - protein, 9 aa, Borrelia garinii
LKEQSETRK

SEQ ID NO: 52941 - protein, 9 aa, Borrelia garinii
KEQSETRKE

SEQ ID NO: 52942 - protein, 9 aa, Borrelia garinii
EQSETRKEK

SEQ ID NO: 52943 - protein, 9 aa, Borrelia garinii
QSETRKEKI

SEQ ID NO: 52944 - protein, 9 aa, Borrelia garinii
SETRKEKIQ

SEQ ID NO: 52945 - protein, 9 aa, Borrelia garinii
ETRKEKIQK

SEQ ID NO: 52946 - protein, 9 aa, Borrelia garinii
TRKEKIQKQ

SEQ ID NO: 52947 - protein, 9 aa, Borrelia garinii
RKEKIQKQQ

SEQ ID NO: 52948 - protein, 9 aa, Borrelia garinii
KEKIQKQQD

SEQ ID NO: 52949 - protein, 9 aa, Borrelia garinii
EKIQKQQDE

SEQ ID NO: 52950 - protein, 9 aa, Borrelia garinii
KIQKQQDEY

SEQ ID NO: 52951 - protein, 9 aa, Borrelia garinii
IQKQQDEYK

SEQ ID NO: 52952 - protein, 9 aa, Borrelia garinii
QKQQDEYKG

SEQ ID NO: 52953 - protein, 9 aa, Borrelia garinii
KQQDEYKGM

SEQ ID NO: 52954 - protein, 9 aa, Borrelia garinii
QQDEYKGMT

SEQ ID NO: 52955 - protein, 9 aa, Borrelia garinii
QDEYKGMTK

SEQ ID NO: 52956 - protein, 9 aa, Borrelia garinii
DEYKGMTKG

SEQ ID NO: 52957 - protein, 9 aa, Borrelia garinii
EYKGMTKGS

SEQ ID NO: 52958 - protein, 9 aa, Borrelia garinii
YKGMTKGSL

SEQ ID NO: 52959 - protein, 9 aa, Borrelia garinii
KGMTKGSLN

SEQ ID NO: 52960 - protein, 9 aa, Borrelia garinii
GMTKGSLNS

SEQ ID NO: 52961 - protein, 9 aa, Borrelia garinii
MTKGSLNSL

SEQ ID NO: 52962 - protein, 9 aa, Borrelia garinii
TKGSLNSLS

SEQ ID NO: 52963 - protein, 9 aa, Borrelia garinii
KGSLNSLSG

SEQ ID NO: 52964 - protein, 9 aa, Borrelia garinii
GSLNSLSGE

SEQ ID NO: 52965 - protein, 9 aa, Borrelia garinii
SLNSLSGES

SEQ ID NO: 52966 - protein, 9 aa, Borrelia garinii
LNSLSGESG

SEQ ID NO: 52967 - protein, 9 aa, Borrelia garinii
NSLSGESGE

SEQ ID NO: 52968 - protein, 9 aa, Borrelia garinii
SLSGESGEL

SEQ ID NO: 52969 - protein, 9 aa, Borrelia garinii
LSGESGELK

SEQ ID NO: 52970 - protein, 9 aa, Borrelia garinii
SGESGELKE

SEQ ID NO: 52971 - protein, 9 aa, Borrelia garinii
GESGELKET

SEQ ID NO: 52972 - protein, 9 aa, Borrelia garinii
ESGELKETI

SEQ ID NO: 52973 - protein, 9 aa, Borrelia garinii
SGELKETIE

SEQ ID NO: 52974 - protein, 9 aa, Borrelia garinii
GELKETIES

SEQ ID NO: 52975 - protein, 9 aa, Borrelia garinii
ELKETIESN

SEQ ID NO: 52976 - protein, 9 aa, Borrelia garinii
LKETIESNE

SEQ ID NO: 52977 - protein, 9 aa, Borrelia garinii
KETIESNEI

SEQ ID NO: 52978 - protein, 9 aa, Borrelia garinii
ETIESNEID

SEQ ID NO: 52979 - protein, 9 aa, Borrelia garinii
TIESNEIDI

SEQ ID NO: 52980 - protein, 9 aa, Borrelia garinii
IESNEIDIT

SEQ ID NO: 52981 - protein, 9 aa, Borrelia garinii
ESNEIDITI

SEQ ID NO: 52982 - protein, 9 aa, Borrelia garinii
SNEIDITID

SEQ ID NO: 52983 - protein, 9 aa, Borrelia garinii
NEIDITIDS

SEQ ID NO: 52984 - protein, 9 aa, Borrelia garinii
EIDITIDSD

SEQ ID NO: 52985 - protein, 9 aa, Borrelia garinii
IDITIDSDL

SEQ ID NO: 52986 - protein, 9 aa, Borrelia garinii
DITIDSDLR

SEQ ID NO: 52987 - protein, 9 aa, Borrelia garinii
ITIDSDLRP

SEQ ID NO: 52988 - protein, 9 aa, Borrelia garinii
TIDSDLRPK

SEQ ID NO: 52989 - protein, 9 aa, Borrelia garinii
IDSDLRPKS

SEQ ID NO: 52990 - protein, 9 aa, Borrelia garinii
DSDLRPKSS

SEQ ID NO: 52991 - protein, 9 aa, Borrelia garinii
SDLRPKSSL

SEQ ID NO: 52992 - protein, 9 aa, Borrelia garinii
DLRPKSSLQ

SEQ ID NO: 52993 - protein, 9 aa, Borrelia garinii
LRPKSSLQD

SEQ ID NO: 52994 - protein, 9 aa, Borrelia garinii
RPKSSLQDI

SEQ ID NO: 52995 - protein, 9 aa, Borrelia garinii
PKSSLQDIA

SEQ ID NO: 52996 - protein, 9 aa, Borrelia garinii
KSSLQDIAG

SEQ ID NO: 52997 - protein, 9 aa, Borrelia garinii
SSLQDIAGS

SEQ ID NO: 52998 - protein, 9 aa, Borrelia garinii
SLQDIAGSN

SEQ ID NO: 52999 - protein, 9 aa, Borrelia garinii
LQDIAGSNS

SEQ ID NO: 53000 - protein, 9 aa, Borrelia garinii
QDIAGSNSI

SEQ ID NO: 53001 - protein, 9 aa, Borrelia garinii
DIAGSNSIS

SEQ ID NO: 53002 - protein, 9 aa, Borrelia garinii
IAGSNSISY

SEQ ID NO: 53003 - protein, 9 aa, Borrelia garinii
AGSNSISYT

SEQ ID NO: 53004 - protein, 9 aa, Borrelia garinii
GSNSISYTD

SEQ ID NO: 53005 - protein, 9 aa, Borrelia garinii
SNSISYTDE

SEQ ID NO: 53006 - protein, 9 aa, Borrelia garinii
NSISYTDEI

SEQ ID NO: 53007 - protein, 9 aa, Borrelia garinii
SISYTDEIE

SEQ ID NO: 53008 - protein, 9 aa, Borrelia garinii
ISYTDEIEE

SEQ ID NO: 53009 - protein, 9 aa, Borrelia garinii
SYTDEIEEE

SEQ ID NO: 53010 - protein, 9 aa, Borrelia garinii
YTDEIEEED

SEQ ID NO: 53011 - protein, 9 aa, Borrelia garinii
TDEIEEEDY

SEQ ID NO: 53012 - protein, 9 aa, Borrelia garinii
DEIEEEDYA

SEQ ID NO: 53013 - protein, 9 aa, Borrelia garinii
EIEEEDYAR

SEQ ID NO: 53014 - protein, 9 aa, Borrelia garinii
IEEEDYARY

SEQ ID NO: 53015 - protein, 9 aa, Borrelia garinii
EEEDYARYY

SEQ ID NO: 53016 - protein, 9 aa, Borrelia garinii
EEDYARYYL

SEQ ID NO: 53017 - protein, 9 aa, Borrelia garinii
EDYARYYLD

SEQ ID NO: 53018 - protein, 9 aa, Borrelia garinii
DYARYYLDE

SEQ ID NO: 53019 - protein, 9 aa, Borrelia garinii
YARYYLDED

SEQ ID NO: 53020 - protein, 9 aa, Borrelia garinii
ARYYLDEDD

SEQ ID NO: 53021 - protein, 9 aa, Borrelia garinii
RYYLDEDDE

SEQ ID NO: 53022 - protein, 9 aa, Borrelia garinii
YYLDEDDED

SEQ ID NO: 53023 - protein, 9 aa, Borrelia garinii
YLDEDDEDD

SEQ ID NO: 53024 - protein, 9 aa, Borrelia garinii
LDEDDEDDE

SEQ ID NO: 53025 - protein, 9 aa, Borrelia garinii
DEDDEDDEY

SEQ ID NO: 53026 - protein, 9 aa, Borrelia garinii
EDDEDDEYY

SEQ ID NO: 53027 - protein, 9 aa, Borrelia garinii
DDEDDEYYE

SEQ ID NO: 53028 - protein, 9 aa, Borrelia garinii
DEDDEYYED

SEQ ID NO: 53029 - protein, 9 aa, Borrelia garinii
EDDEYYEDD

SEQ ID NO: 53030 - protein, 9 aa, Borrelia garinii
DDEYYEDDY

SEQ ID NO: 53031 - protein, 9 aa, Borrelia garinii
DEYYEDDYE

SEQ ID NO: 53032 - protein, 9 aa, Borrelia garinii
EYYEDDYEE

SEQ ID NO: 53033 - protein, 9 aa, Borrelia garinii
YYEDDYEEI

SEQ ID NO: 53034 - protein, 9 aa, Borrelia garinii
YEDDYEEIR

SEQ ID NO: 53035 - protein, 9 aa, Borrelia garinii
EDDYEEIRL

SEQ ID NO: 53036 - protein, 9 aa, Borrelia garinii
DDYEEIRLS

SEQ ID NO: 53037 - protein, 9 aa, Borrelia garinii
DYEEIRLSN

SEQ ID NO: 53038 - protein, 9 aa, Borrelia garinii
YEEIRLSNR

SEQ ID NO: 53039 - protein, 9 aa, Borrelia garinii
EEIRLSNRY

SEQ ID NO: 53040 - protein, 9 aa, Borrelia garinii
EIRLSNRYQ

SEQ ID NO: 53041 - protein, 9 aa, Borrelia garinii
IRLSNRYQS

SEQ ID NO: 53042 - protein, 9 aa, Borrelia garinii
RLSNRYQSY

SEQ ID NO: 53043 - protein, 9 aa, Borrelia garinii
LSNRYQSYL

SEQ ID NO: 53044 - protein, 9 aa, Borrelia garinii
SNRYQSYLE

SEQ ID NO: 53045 - protein, 9 aa, Borrelia garinii
NRYQSYLEG

SEQ ID NO: 53046 - protein, 9 aa, Borrelia garinii
RYQSYLEGV

SEQ ID NO: 53047 - protein, 9 aa, Borrelia garinii
YQSYLEGVK

SEQ ID NO: 53048 - protein, 9 aa, Borrelia garinii
QSYLEGVKY

SEQ ID NO: 53049 - protein, 9 aa, Borrelia garinii
SYLEGVKYN

SEQ ID NO: 53050 - protein, 9 aa, Borrelia garinii
YLEGVKYNV

SEQ ID NO: 53051 - protein, 9 aa, Borrelia garinii
LEGVKYNVD

SEQ ID NO: 53052 - protein, 9 aa, Borrelia garinii
EGVKYNVDS

SEQ ID NO: 53053 - protein, 9 aa, Borrelia garinii
GVKYNVDSA

SEQ ID NO: 53054 - protein, 9 aa, Borrelia garinii
VKYNVDSAI

SEQ ID NO: 53055 - protein, 9 aa, Borrelia garinii
KYNVDSAIN

SEQ ID NO: 53056 - protein, 9 aa, Borrelia garinii
YNVDSAINT

SEQ ID NO: 53057 - protein, 9 aa, Borrelia garinii
NVDSAINTI

SEQ ID NO: 53058 - protein, 9 aa, Borrelia garinii
VDSAINTIN

SEQ ID NO: 53059 - protein, 9 aa, Borrelia garinii
DSAINTINK

SEQ ID NO: 53060 - protein, 9 aa, Borrelia garinii
SAINTINKI

SEQ ID NO: 53061 - protein, 9 aa, Borrelia garinii
AINTINKIY

SEQ ID NO: 53062 - protein, 9 aa, Borrelia garinii
INTINKIYD

SEQ ID NO: 53063 - protein, 9 aa, Borrelia garinii
NTINKIYDT

SEQ ID NO: 53064 - protein, 9 aa, Borrelia garinii
TINKIYDTY

SEQ ID NO: 53065 - protein, 9 aa, Borrelia garinii
INKIYDTYT

SEQ ID NO: 53066 - protein, 9 aa, Borrelia garinii
NKIYDTYTL

SEQ ID NO: 53067 - protein, 9 aa, Borrelia garinii
KIYDTYTLF

SEQ ID NO: 53068 - protein, 9 aa, Borrelia garinii
IYDTYTLFS

SEQ ID NO: 53069 - protein, 9 aa, Borrelia garinii
YDTYTLFST

SEQ ID NO: 53070 - protein, 9 aa, Borrelia garinii
DTYTLFSTK

SEQ ID NO: 53071 - protein, 9 aa, Borrelia garinii
TYTLFSTKL

SEQ ID NO: 53072 - protein, 9 aa, Borrelia garinii
YTLFSTKLT

SEQ ID NO: 53073 - protein, 9 aa, Borrelia garinii
TLFSTKLTQ

SEQ ID NO: 53074 - protein, 9 aa, Borrelia garinii
LFSTKLTQM

SEQ ID NO: 53075 - protein, 9 aa, Borrelia garinii
FSTKLTQMY

SEQ ID NO: 53076 - protein, 9 aa, Borrelia garinii
STKLTQMYS

SEQ ID NO: 53077 - protein, 9 aa, Borrelia garinii
TKLTQMYST

SEQ ID NO: 53078 - protein, 9 aa, Borrelia garinii
KLTQMYSTR

SEQ ID NO: 53079 - protein, 9 aa, Borrelia garinii
LTQMYSTRL

SEQ ID NO: 53080 - protein, 9 aa, Borrelia garinii
TQMYSTRLD

SEQ ID NO: 53081 - protein, 9 aa, Borrelia garinii
QMYSTRLDN

SEQ ID NO: 53082 - protein, 9 aa, Borrelia garinii
MYSTRLDNL

SEQ ID NO: 53083 - protein, 9 aa, Borrelia garinii
YSTRLDNLA

SEQ ID NO: 53084 - protein, 9 aa, Borrelia garinii
STRLDNLAK

SEQ ID NO: 53085 - protein, 9 aa, Borrelia garinii
TRLDNLAKA

SEQ ID NO: 53086 - protein, 9 aa, Borrelia garinii
RLDNLAKAK

SEQ ID NO: 53087 - protein, 9 aa, Borrelia garinii
LDNLAKAKA

SEQ ID NO: 53088 - protein, 9 aa, Borrelia garinii
DNLAKAKAK

SEQ ID NO: 53089 - protein, 9 aa, Borrelia garinii
NLAKAKAKE

SEQ ID NO: 53090 - protein, 9 aa, Borrelia garinii
LAKAKAKEE

SEQ ID NO: 53091 - protein, 9 aa, Borrelia garinii
AKAKAKEEA

SEQ ID NO: 53092 - protein, 9 aa, Borrelia garinii
KAKAKEEAA

SEQ ID NO: 53093 - protein, 9 aa, Borrelia garinii
AKAKEEAAK

SEQ ID NO: 53094 - protein, 9 aa, Borrelia garinii
KAKEEAAKF

SEQ ID NO: 53095 - protein, 9 aa, Borrelia garinii
AKEEAAKFT

SEQ ID NO: 53096 - protein, 9 aa, Borrelia garinii
KEEAAKFTK

SEQ ID NO: 53097 - protein, 9 aa, Borrelia garinii
EEAAKFTKE

SEQ ID NO: 53098 - protein, 9 aa, Borrelia garinii
EAAKFTKED

SEQ ID NO: 53099 - protein, 9 aa, Borrelia garinii
AAKFTKEDL

SEQ ID NO: 53100 - protein, 9 aa, Borrelia garinii
AKFTKEDLE

SEQ ID NO: 53101 - protein, 9 aa, Borrelia garinii
KFTKEDLEK

SEQ ID NO: 53102 - protein, 9 aa, Borrelia garinii
FTKEDLEKN

SEQ ID NO: 53103 - protein, 9 aa, Borrelia garinii
TKEDLEKNF

SEQ ID NO: 53104 - protein, 9 aa, Borrelia garinii
KEDLEKNFK

SEQ ID NO: 53105 - protein, 9 aa, Borrelia garinii
EDLEKNFKT

SEQ ID NO: 53106 - protein, 9 aa, Borrelia garinii
DLEKNFKTL

SEQ ID NO: 53107 - protein, 9 aa, Borrelia garinii
LEKNFKTLL

SEQ ID NO: 53108 - protein, 9 aa, Borrelia garinii
EKNFKTLLN

SEQ ID NO: 53109 - protein, 9 aa, Borrelia garinii
KNFKTLLNY

SEQ ID NO: 53110 - protein, 9 aa, Borrelia garinii
NFKTLLNYI

SEQ ID NO: 53111 - protein, 9 aa, Borrelia garinii
FKTLLNYIQ

SEQ ID NO: 53112 - protein, 9 aa, Borrelia garinii
KTLLNYIQV

SEQ ID NO: 53113 - protein, 9 aa, Borrelia garinii
TLLNYIQVS

SEQ ID NO: 53114 - protein, 9 aa, Borrelia garinii
LLNYIQVSV

SEQ ID NO: 53115 - protein, 9 aa, Borrelia garinii
LNYIQVSVK

SEQ ID NO: 53116 - protein, 9 aa, Borrelia garinii
NYIQVSVKT

SEQ ID NO: 53117 - protein, 9 aa, Borrelia garinii
YIQVSVKTA

SEQ ID NO: 53118 - protein, 9 aa, Borrelia garinii
IQVSVKTAT

SEQ ID NO: 53119 - protein, 9 aa, Borrelia garinii
QVSVKTATN

SEQ ID NO: 53120 - protein, 9 aa, Borrelia garinii
VSVKTATNF

SEQ ID NO: 53121 - protein, 9 aa, Borrelia garinii
SVKTATNFV

SEQ ID NO: 53122 - protein, 9 aa, Borrelia garinii
VKTATNFVY

SEQ ID NO: 53123 - protein, 9 aa, Borrelia garinii
KTATNFVYI

SEQ ID NO: 53124 - protein, 9 aa, Borrelia garinii
TATNFVYIN

SEQ ID NO: 53125 - protein, 9 aa, Borrelia garinii
ATNFVYINE

SEQ ID NO: 53126 - protein, 9 aa, Borrelia garinii
TNFVYINEM

SEQ ID NO: 53127 - protein, 9 aa, Borrelia garinii
NFVYINEMH

SEQ ID NO: 53128 - protein, 9 aa, Borrelia garinii
FVYINEMHA

SEQ ID NO: 53129 - protein, 9 aa, Borrelia garinii
VYINEMHAK

SEQ ID NO: 53130 - protein, 9 aa, Borrelia garinii
YINEMHAKR

SEQ ID NO: 53131 - protein, 9 aa, Borrelia garinii
INEMHAKRK

SEQ ID NO: 53132 - protein, 9 aa, Borrelia garinii
NEMHAKRKL

SEQ ID NO: 53133 - protein, 9 aa, Borrelia garinii
EMHAKRKLE

SEQ ID NO: 53134 - protein, 9 aa, Borrelia garinii
MHAKRKLEN

SEQ ID NO: 53135 - protein, 9 aa, Borrelia garinii
HAKRKLENI

SEQ ID NO: 53136 - protein, 9 aa, Borrelia garinii
AKRKLENIE

SEQ ID NO: 53137 - protein, 9 aa, Borrelia garinii
KRKLENIEA

SEQ ID NO: 53138 - protein, 9 aa, Borrelia garinii
RKLENIEAK

SEQ ID NO: 53139 - protein, 9 aa, Borrelia garinii
KLENIEAKI

SEQ ID NO: 53140 - protein, 9 aa, Borrelia garinii
LENIEAKIK

SEQ ID NO: 53141 - protein, 9 aa, Borrelia garinii
ENIEAKIKT

SEQ ID NO: 53142 - protein, 9 aa, Borrelia garinii
NIEAKIKTL

SEQ ID NO: 53143 - protein, 9 aa, Borrelia garinii
IEAKIKTLI

SEQ ID NO: 53144 - protein, 9 aa, Borrelia garinii
EAKIKTLIA

SEQ ID NO: 53145 - protein, 9 aa, Borrelia garinii
AKIKTLIAK

SEQ ID NO: 53146 - protein, 9 aa, Borrelia garinii
KIKTLIAKI

SEQ ID NO: 53147 - protein, 9 aa, Borrelia garinii
IKTLIAKIK

SEQ ID NO: 53148 - protein, 9 aa, Borrelia garinii
KTLIAKIKE

SEQ ID NO: 53149 - protein, 9 aa, Borrelia garinii
TLIAKIKEK

SEQ ID NO: 53150 - protein, 9 aa, Borrelia garinii
LIAKIKEKS

SEQ ID NO: 53151 - protein, 9 aa, Borrelia garinii
IAKIKEKSN

SEQ ID NO: 53152 - protein, 9 aa, Borrelia garinii
AKIKEKSNL

SEQ ID NO: 53153 - protein, 9 aa, Borrelia garinii
KIKEKSNLY

SEQ ID NO: 53154 - protein, 9 aa, Borrelia garinii
IKEKSNLYS

SEQ ID NO: 53155 - protein, 9 aa, Borrelia garinii
KEKSNLYSA

SEQ ID NO: 53156 - protein, 9 aa, Borrelia garinii
EKSNLYSAY

SEQ ID NO: 53157 - protein, 9 aa, Borrelia garinii
KSNLYSAYK

SEQ ID NO: 53158 - protein, 9 aa, Borrelia garinii
SNLYSAYKA

SEQ ID NO: 53159 - protein, 9 aa, Borrelia garinii
NLYSAYKAI

SEQ ID NO: 53160 - protein, 9 aa, Borrelia garinii
LYSAYKAIV

SEQ ID NO: 53161 - protein, 9 aa, Borrelia garinii
YSAYKAIVS

SEQ ID NO: 53162 - protein, 9 aa, Borrelia garinii
SAYKAIVSS

SEQ ID NO: 53163 - protein, 9 aa, Borrelia garinii
AYKAIVSSI

SEQ ID NO: 53164 - protein, 9 aa, Borrelia garinii
YKAIVSSIL

SEQ ID NO: 53165 - protein, 9 aa, Borrelia garinii
KAIVSSILL

SEQ ID NO: 53166 - protein, 9 aa, Borrelia garinii
AIVSSILLM

SEQ ID NO: 53167 - protein, 9 aa, Borrelia garinii
IVSSILLMR

SEQ ID NO: 53168 - protein, 9 aa, Borrelia garinii
VSSILLMRD

SEQ ID NO: 53169 - protein, 9 aa, Borrelia garinii
SSILLMRDS

SEQ ID NO: 53170 - protein, 9 aa, Borrelia garinii
SILLMRDSL

SEQ ID NO: 53171 - protein, 9 aa, Borrelia garinii
ILLMRDSLK

SEQ ID NO: 53172 - protein, 9 aa, Borrelia garinii
LLMRDSLKE

SEQ ID NO: 53173 - protein, 9 aa, Borrelia garinii
LMRDSLKEV

SEQ ID NO: 53174 - protein, 9 aa, Borrelia garinii
MRDSLKEVQ

SEQ ID NO: 53175 - protein, 9 aa, Borrelia garinii
RDSLKEVQY

SEQ ID NO: 53176 - protein, 9 aa, Borrelia garinii
DSLKEVQYA

SEQ ID NO: 53177 - protein, 9 aa, Borrelia garinii
SLKEVQYAI

SEQ ID NO: 53178 - protein, 9 aa, Borrelia garinii
LKEVQYAID

SEQ ID NO: 53179 - protein, 9 aa, Borrelia garinii
KEVQYAIDK

SEQ ID NO: 53180 - protein, 9 aa, Borrelia garinii
EVQYAIDKN

SEQ ID NO: 53181 - protein, 9 aa, Borrelia garinii
VQYAIDKNG

SEQ ID NO: 53182 - protein, 9 aa, Borrelia garinii
QYAIDKNGI

SEQ ID NO: 53183 - protein, 9 aa, Borrelia garinii
YAIDKNGIW

SEQ ID NO: 53184 - protein, 9 aa, Borrelia garinii
AIDKNGIWY

SEQ ID NO: 53185 - protein, 9 aa, Borrelia garinii
IDKNGIWYR

SEQ ID NO: 53186 - protein, 9 aa, Borrelia garinii
DKNGIWYRK

SEQ ID NO: 53187 - protein, 9 aa, Borrelia garinii
KNGIWYRKL

SEQ ID NO: 53188 - protein, 9 aa, Borrelia garinii
NGIWYRKLD

SEQ ID NO: 53189 - protein, 9 aa, Borrelia garinii
GIWYRKLDA

SEQ ID NO: 53190 - protein, 9 aa, Borrelia garinii
IWYRKLDAI

SEQ ID NO: 53191 - protein, 9 aa, Borrelia garinii
WYRKLDAIE

SEQ ID NO: 53192 - protein, 9 aa, Borrelia garinii
YRKLDAIET

SEQ ID NO: 53193 - protein, 9 aa, Borrelia garinii
RKLDAIETE

SEQ ID NO: 53194 - protein, 9 aa, Borrelia garinii
KLDAIETEI

SEQ ID NO: 53195 - protein, 9 aa, Borrelia garinii
LDAIETEIK

SEQ ID NO: 53196 - protein, 9 aa, Borrelia garinii
DAIETEIKN

SEQ ID NO: 53197 - protein, 9 aa, Borrelia garinii
AIETEIKNL

SEQ ID NO: 53198 - protein, 9 aa, Borrelia garinii
IETEIKNLI

SEQ ID NO: 53199 - protein, 9 aa, Borrelia garinii
ETEIKNLIL

SEQ ID NO: 53200 - protein, 9 aa, Borrelia garinii
TEIKNLILK

SEQ ID NO: 53201 - protein, 9 aa, Borrelia garinii
EIKNLILKI

SEQ ID NO: 53202 - protein, 9 aa, Borrelia garinii
IKNLILKIK

SEQ ID NO: 53203 - protein, 9 aa, Borrelia garinii
KNLILKIKG

SEQ ID NO: 53204 - protein, 9 aa, Borrelia garinii
NLILKIKGQ

SEQ ID NO: 53205 - protein, 9 aa, Borrelia garinii
LILKIKGQS

SEQ ID NO: 53206 - protein, 9 aa, Borrelia garinii
ILKIKGQSD

SEQ ID NO: 53207 - protein, 9 aa, Borrelia garinii
LKIKGQSDL

SEQ ID NO: 53208 - protein, 9 aa, Borrelia garinii
KIKGQSDLY

SEQ ID NO: 53209 - protein, 9 aa, Borrelia garinii
IKGQSDLYE

SEQ ID NO: 53210 - protein, 9 aa, Borrelia garinii
KGQSDLYEA

SEQ ID NO: 53211 - protein, 9 aa, Borrelia garinii
GQSDLYEAY

SEQ ID NO: 53212 - protein, 9 aa, Borrelia garinii
QSDLYEAYK

SEQ ID NO: 53213 - protein, 9 aa, Borrelia garinii
SDLYEAYKA

SEQ ID NO: 53214 - protein, 9 aa, Borrelia garinii
DLYEAYKAI

SEQ ID NO: 53215 - protein, 9 aa, Borrelia garinii
LYEAYKAIV

SEQ ID NO: 53216 - protein, 9 aa, Borrelia garinii
YEAYKAIVR

SEQ ID NO: 53217 - protein, 9 aa, Borrelia garinii
EAYKAIVRS

SEQ ID NO: 53218 - protein, 9 aa, Borrelia garinii
AYKAIVRSI

SEQ ID NO: 53219 - protein, 9 aa, Borrelia garinii
YKAIVRSIL

SEQ ID NO: 53220 - protein, 9 aa, Borrelia garinii
KAIVRSILL

SEQ ID NO: 53221 - protein, 9 aa, Borrelia garinii
AIVRSILLM

SEQ ID NO: 53222 - protein, 9 aa, Borrelia garinii
IVRSILLMK

SEQ ID NO: 53223 - protein, 9 aa, Borrelia garinii
VRSILLMKD

SEQ ID NO: 53224 - protein, 9 aa, Borrelia garinii
RSILLMKDS

SEQ ID NO: 53225 - protein, 9 aa, Borrelia garinii
SILLMKDSL

SEQ ID NO: 53226 - protein, 9 aa, Borrelia garinii
ILLMKDSLK

SEQ ID NO: 53227 - protein, 9 aa, Borrelia garinii
LLMKDSLKI

SEQ ID NO: 53228 - protein, 9 aa, Borrelia garinii
LMKDSLKII

SEQ ID NO: 53229 - protein, 9 aa, Borrelia garinii
MKDSLKIIE

SEQ ID NO: 53230 - protein, 9 aa, Borrelia garinii
KDSLKIIEI

SEQ ID NO: 53231 - protein, 9 aa, Borrelia garinii
DSLKIIEIV

SEQ ID NO: 53232 - protein, 9 aa, Borrelia garinii
SLKIIEIVI

SEQ ID NO: 53233 - protein, 9 aa, Borrelia garinii
LKIIEIVID

SEQ ID NO: 53234 - protein, 9 aa, Borrelia garinii
KIIEIVIDK

SEQ ID NO: 53235 - protein, 9 aa, Borrelia garinii
IIEIVIDKN

SEQ ID NO: 53236 - protein, 9 aa, Borrelia garinii
IEIVIDKNG

SEQ ID NO: 53237 - protein, 9 aa, Borrelia garinii
EIVIDKNGV

SEQ ID NO: 53238 - protein, 9 aa, Borrelia garinii
IVIDKNGVW

SEQ ID NO: 53239 - protein, 9 aa, Borrelia garinii
VIDKNGVWY

SEQ ID NO: 53240 - protein, 10 aa, Borrelia garinii
MKKVKSKYLA

SEQ ID NO: 53241 - protein, 10 aa, Borrelia garinii
KKVKSKYLAL

SEQ ID NO: 53242 - protein, 10 aa, Borrelia garinii
KVKSKYLALG

SEQ ID NO: 53243 - protein, 10 aa, Borrelia garinii
VKSKYLALGL

SEQ ID NO: 53244 - protein, 10 aa, Borrelia garinii
KSKYLALGLL

SEQ ID NO: 53245 - protein, 10 aa, Borrelia garinii
SKYLALGLLF

SEQ ID NO: 53246 - protein, 10 aa, Borrelia garinii
KYLALGLLFG

SEQ ID NO: 53247 - protein, 10 aa, Borrelia garinii
YLALGLLFGF

SEQ ID NO: 53248 - protein, 10 aa, Borrelia garinii
LALGLLFGFI

SEQ ID NO: 53249 - protein, 10 aa, Borrelia garinii
ALGLLFGFIS

SEQ ID NO: 53250 - protein, 10 aa, Borrelia garinii
LGLLFGFISC

SEQ ID NO: 53251 - protein, 10 aa, Borrelia garinii
GLLFGFISCD

SEQ ID NO: 53252 - protein, 10 aa, Borrelia garinii
LLFGFISCDL

SEQ ID NO: 53253 - protein, 10 aa, Borrelia garinii
LFGFISCDLF

SEQ ID NO: 53254 - protein, 10 aa, Borrelia garinii
FGFISCDLFI

SEQ ID NO: 53255 - protein, 10 aa, Borrelia garinii
GFISCDLFIR

SEQ ID NO: 53256 - protein, 10 aa, Borrelia garinii
FISCDLFIRY

SEQ ID NO: 53257 - protein, 10 aa, Borrelia garinii
ISCDLFIRYE

SEQ ID NO: 53258 - protein, 10 aa, Borrelia garinii
SCDLFIRYEM

SEQ ID NO: 53259 - protein, 10 aa, Borrelia garinii
CDLFIRYEMK

SEQ ID NO: 53260 - protein, 10 aa, Borrelia garinii
DLFIRYEMKE

SEQ ID NO: 53261 - protein, 10 aa, Borrelia garinii
LFIRYEMKEE

SEQ ID NO: 53262 - protein, 10 aa, Borrelia garinii
FIRYEMKEES

SEQ ID NO: 53263 - protein, 10 aa, Borrelia garinii
IRYEMKEESP

SEQ ID NO: 53264 - protein, 10 aa, Borrelia garinii
RYEMKEESPG

SEQ ID NO: 53265 - protein, 10 aa, Borrelia garinii
YEMKEESPGL

SEQ ID NO: 53266 - protein, 10 aa, Borrelia garinii
EMKEESPGLF

SEQ ID NO: 53267 - protein, 10 aa, Borrelia garinii
MKEESPGLFD

SEQ ID NO: 53268 - protein, 10 aa, Borrelia garinii
KEESPGLFDK

SEQ ID NO: 53269 - protein, 10 aa, Borrelia garinii
EESPGLFDKG

SEQ ID NO: 53270 - protein, 10 aa, Borrelia garinii
ESPGLFDKGN

SEQ ID NO: 53271 - protein, 10 aa, Borrelia garinii
SPGLFDKGNS

SEQ ID NO: 53272 - protein, 10 aa, Borrelia garinii
PGLFDKGNSI

SEQ ID NO: 53273 - protein, 10 aa, Borrelia garinii
GLFDKGNSIL

SEQ ID NO: 53274 - protein, 10 aa, Borrelia garinii
LFDKGNSILE

SEQ ID NO: 53275 - protein, 10 aa, Borrelia garinii
FDKGNSILET

SEQ ID NO: 53276 - protein, 10 aa, Borrelia garinii
DKGNSILETS

SEQ ID NO: 53277 - protein, 10 aa, Borrelia garinii
KGNSILETSE

SEQ ID NO: 53278 - protein, 10 aa, Borrelia garinii
GNSILETSEE

SEQ ID NO: 53279 - protein, 10 aa, Borrelia garinii
NSILETSEES

SEQ ID NO: 53280 - protein, 10 aa, Borrelia garinii
SILETSEESI

SEQ ID NO: 53281 - protein, 10 aa, Borrelia garinii
ILETSEESIK

SEQ ID NO: 53282 - protein, 10 aa, Borrelia garinii
LETSEESIKK

SEQ ID NO: 53283 - protein, 10 aa, Borrelia garinii
ETSEESIKKP

SEQ ID NO: 53284 - protein, 10 aa, Borrelia garinii
TSEESIKKPM

SEQ ID NO: 53285 - protein, 10 aa, Borrelia garinii
SEESIKKPMN

SEQ ID NO: 53286 - protein, 10 aa, Borrelia garinii
EESIKKPMNK

SEQ ID NO: 53287 - protein, 10 aa, Borrelia garinii
ESIKKPMNKK

SEQ ID NO: 53288 - protein, 10 aa, Borrelia garinii
SIKKPMNKKG

SEQ ID NO: 53289 - protein, 10 aa, Borrelia garinii
IKKPMNKKGK

SEQ ID NO: 53290 - protein, 10 aa, Borrelia garinii
KKPMNKKGKG

SEQ ID NO: 53291 - protein, 10 aa, Borrelia garinii
KPMNKKGKGK

SEQ ID NO: 53292 - protein, 10 aa, Borrelia garinii
PMNKKGKGKI

SEQ ID NO: 53293 - protein, 10 aa, Borrelia garinii
MNKKGKGKIA

SEQ ID NO: 53294 - protein, 10 aa, Borrelia garinii
NKKGKGKIAR

SEQ ID NO: 53295 - protein, 10 aa, Borrelia garinii
KKGKGKIARK

SEQ ID NO: 53296 - protein, 10 aa, Borrelia garinii
KGKGKIARKN

SEQ ID NO: 53297 - protein, 10 aa, Borrelia garinii
GKGKIARKNG

SEQ ID NO: 53298 - protein, 10 aa, Borrelia garinii
KGKIARKNGK

SEQ ID NO: 53299 - protein, 10 aa, Borrelia garinii
GKIARKNGKS

SEQ ID NO: 53300 - protein, 10 aa, Borrelia garinii
KIARKNGKSK

SEQ ID NO: 53301 - protein, 10 aa, Borrelia garinii
IARKNGKSKV

SEQ ID NO: 53302 - protein, 10 aa, Borrelia garinii
ARKNGKSKVS

SEQ ID NO: 53303 - protein, 10 aa, Borrelia garinii
RKNGKSKVSG

SEQ ID NO: 53304 - protein, 10 aa, Borrelia garinii
KNGKSKVSGK

SEQ ID NO: 53305 - protein, 10 aa, Borrelia garinii
NGKSKVSGKE

SEQ ID NO: 53306 - protein, 10 aa, Borrelia garinii
GKSKVSGKEP

SEQ ID NO: 53307 - protein, 10 aa, Borrelia garinii
KSKVSGKEPF

SEQ ID NO: 53308 - protein, 10 aa, Borrelia garinii
SKVSGKEPFI

SEQ ID NO: 53309 - protein, 10 aa, Borrelia garinii
KVSGKEPFIH

SEQ ID NO: 53310 - protein, 10 aa, Borrelia garinii
VSGKEPFIHS

SEQ ID NO: 53311 - protein, 10 aa, Borrelia garinii
SGKEPFIHSF

SEQ ID NO: 53312 - protein, 10 aa, Borrelia garinii
GKEPFIHSFK

SEQ ID NO: 53313 - protein, 10 aa, Borrelia garinii
KEPFIHSFKR

SEQ ID NO: 53314 - protein, 10 aa, Borrelia garinii
EPFIHSFKRD

SEQ ID NO: 53315 - protein, 10 aa, Borrelia garinii
PFIHSFKRDA

SEQ ID NO: 53316 - protein, 10 aa, Borrelia garinii
FIHSFKRDAA

SEQ ID NO: 53317 - protein, 10 aa, Borrelia garinii
IHSFKRDAAN

SEQ ID NO: 53318 - protein, 10 aa, Borrelia garinii
HSFKRDAANK

SEQ ID NO: 53319 - protein, 10 aa, Borrelia garinii
SFKRDAANKS

SEQ ID NO: 53320 - protein, 10 aa, Borrelia garinii
FKRDAANKSN

SEQ ID NO: 53321 - protein, 10 aa, Borrelia garinii
KRDAANKSNF

SEQ ID NO: 53322 - protein, 10 aa, Borrelia garinii
RDAANKSNFL

SEQ ID NO: 53323 - protein, 10 aa, Borrelia garinii
DAANKSNFLQ

SEQ ID NO: 53324 - protein, 10 aa, Borrelia garinii
AANKSNFLQK

SEQ ID NO: 53325 - protein, 10 aa, Borrelia garinii
ANKSNFLQKN

SEQ ID NO: 53326 - protein, 10 aa, Borrelia garinii
NKSNFLQKNV

SEQ ID NO: 53327 - protein, 10 aa, Borrelia garinii
KSNFLQKNVM

SEQ ID NO: 53328 - protein, 10 aa, Borrelia garinii
SNFLQKNVML

SEQ ID NO: 53329 - protein, 10 aa, Borrelia garinii
NFLQKNVMLE

SEQ ID NO: 53330 - protein, 10 aa, Borrelia garinii
FLQKNVMLEE

SEQ ID NO: 53331 - protein, 10 aa, Borrelia garinii
LQKNVMLEEE

SEQ ID NO: 53332 - protein, 10 aa, Borrelia garinii
QKNVMLEEES

SEQ ID NO: 53333 - protein, 10 aa, Borrelia garinii
KNVMLEEESL

SEQ ID NO: 53334 - protein, 10 aa, Borrelia garinii
NVMLEEESLK

SEQ ID NO: 53335 - protein, 10 aa, Borrelia garinii
VMLEEESLKT

SEQ ID NO: 53336 - protein, 10 aa, Borrelia garinii
MLEEESLKTE

SEQ ID NO: 53337 - protein, 10 aa, Borrelia garinii
LEEESLKTEL

SEQ ID NO: 53338 - protein, 10 aa, Borrelia garinii
EEESLKTELL

SEQ ID NO: 53339 - protein, 10 aa, Borrelia garinii
EESLKTELLK

SEQ ID NO: 53340 - protein, 10 aa, Borrelia garinii
ESLKTELLKE

SEQ ID NO: 53341 - protein, 10 aa, Borrelia garinii
SLKTELLKEQ

SEQ ID NO: 53342 - protein, 10 aa, Borrelia garinii
LKTELLKEQS

SEQ ID NO: 53343 - protein, 10 aa, Borrelia garinii
KTELLKEQSE

SEQ ID NO: 53344 - protein, 10 aa, Borrelia garinii
TELLKEQSET

SEQ ID NO: 53345 - protein, 10 aa, Borrelia garinii
ELLKEQSETR

SEQ ID NO: 53346 - protein, 10 aa, Borrelia garinii
LLKEQSETRK

SEQ ID NO: 53347 - protein, 10 aa, Borrelia garinii
LKEQSETRKE

SEQ ID NO: 53348 - protein, 10 aa, Borrelia garinii
KEQSETRKEK

SEQ ID NO: 53349 - protein, 10 aa, Borrelia garinii
EQSETRKEKI

SEQ ID NO: 53350 - protein, 10 aa, Borrelia garinii
QSETRKEKIQ

SEQ ID NO: 53351 - protein, 10 aa, Borrelia garinii
SETRKEKIQK

SEQ ID NO: 53352 - protein, 10 aa, Borrelia garinii
ETRKEKIQKQ

SEQ ID NO: 53353 - protein, 10 aa, Borrelia garinii
TRKEKIQKQQ

SEQ ID NO: 53354 - protein, 10 aa, Borrelia garinii
RKEKIQKQQD

SEQ ID NO: 53355 - protein, 10 aa, Borrelia garinii
KEKIQKQQDE

SEQ ID NO: 53356 - protein, 10 aa, Borrelia garinii
EKIQKQQDEY

SEQ ID NO: 53357 - protein, 10 aa, Borrelia garinii
KIQKQQDEYK

SEQ ID NO: 53358 - protein, 10 aa, Borrelia garinii
IQKQQDEYKG

SEQ ID NO: 53359 - protein, 10 aa, Borrelia garinii
QKQQDEYKGM

SEQ ID NO: 53360 - protein, 10 aa, Borrelia garinii
KQQDEYKGMT

SEQ ID NO: 53361 - protein, 10 aa, Borrelia garinii
QQDEYKGMTK

SEQ ID NO: 53362 - protein, 10 aa, Borrelia garinii
QDEYKGMTKG

SEQ ID NO: 53363 - protein, 10 aa, Borrelia garinii
DEYKGMTKGS

SEQ ID NO: 53364 - protein, 10 aa, Borrelia garinii
EYKGMTKGSL

SEQ ID NO: 53365 - protein, 10 aa, Borrelia garinii
YKGMTKGSLN

SEQ ID NO: 53366 - protein, 10 aa, Borrelia garinii
KGMTKGSLNS

SEQ ID NO: 53367 - protein, 10 aa, Borrelia garinii
GMTKGSLNSL

SEQ ID NO: 53368 - protein, 10 aa, Borrelia garinii
MTKGSLNSLS

SEQ ID NO: 53369 - protein, 10 aa, Borrelia garinii
TKGSLNSLSG

SEQ ID NO: 53370 - protein, 10 aa, Borrelia garinii
KGSLNSLSGE

SEQ ID NO: 53371 - protein, 10 aa, Borrelia garinii
GSLNSLSGES

SEQ ID NO: 53372 - protein, 10 aa, Borrelia garinii
SLNSLSGESG

SEQ ID NO: 53373 - protein, 10 aa, Borrelia garinii
LNSLSGESGE

SEQ ID NO: 53374 - protein, 10 aa, Borrelia garinii
NSLSGESGEL

SEQ ID NO: 53375 - protein, 10 aa, Borrelia garinii
SLSGESGELK

SEQ ID NO: 53376 - protein, 10 aa, Borrelia garinii
LSGESGELKE

SEQ ID NO: 53377 - protein, 10 aa, Borrelia garinii
SGESGELKET

SEQ ID NO: 53378 - protein, 10 aa, Borrelia garinii
GESGELKETI

SEQ ID NO: 53379 - protein, 10 aa, Borrelia garinii
ESGELKETIE

SEQ ID NO: 53380 - protein, 10 aa, Borrelia garinii
SGELKETIES

SEQ ID NO: 53381 - protein, 10 aa, Borrelia garinii
GELKETIESN

SEQ ID NO: 53382 - protein, 10 aa, Borrelia garinii
ELKETIESNE

SEQ ID NO: 53383 - protein, 10 aa, Borrelia garinii
LKETIESNEI

SEQ ID NO: 53384 - protein, 10 aa, Borrelia garinii
KETIESNEID

SEQ ID NO: 53385 - protein, 10 aa, Borrelia garinii
ETIESNEIDI

SEQ ID NO: 53386 - protein, 10 aa, Borrelia garinii
TIESNEIDIT

SEQ ID NO: 53387 - protein, 10 aa, Borrelia garinii
IESNEIDITI

SEQ ID NO: 53388 - protein, 10 aa, Borrelia garinii
ESNEIDITID

SEQ ID NO: 53389 - protein, 10 aa, Borrelia garinii
SNEIDITIDS

SEQ ID NO: 53390 - protein, 10 aa, Borrelia garinii
NEIDITIDSD

SEQ ID NO: 53391 - protein, 10 aa, Borrelia garinii
EIDITIDSDL

SEQ ID NO: 53392 - protein, 10 aa, Borrelia garinii
IDITIDSDLR

SEQ ID NO: 53393 - protein, 10 aa, Borrelia garinii
DITIDSDLRP

SEQ ID NO: 53394 - protein, 10 aa, Borrelia garinii
ITIDSDLRPK

SEQ ID NO: 53395 - protein, 10 aa, Borrelia garinii
TIDSDLRPKS

SEQ ID NO: 53396 - protein, 10 aa, Borrelia garinii
IDSDLRPKSS

SEQ ID NO: 53397 - protein, 10 aa, Borrelia garinii
DSDLRPKSSL

SEQ ID NO: 53398 - protein, 10 aa, Borrelia garinii
SDLRPKSSLQ

SEQ ID NO: 53399 - protein, 10 aa, Borrelia garinii
DLRPKSSLQD

SEQ ID NO: 53400 - protein, 10 aa, Borrelia garinii
LRPKSSLQDI

SEQ ID NO: 53401 - protein, 10 aa, Borrelia garinii
RPKSSLQDIA

SEQ ID NO: 53402 - protein, 10 aa, Borrelia garinii
PKSSLQDIAG

SEQ ID NO: 53403 - protein, 10 aa, Borrelia garinii
KSSLQDIAGS

SEQ ID NO: 53404 - protein, 10 aa, Borrelia garinii
SSLQDIAGSN

SEQ ID NO: 53405 - protein, 10 aa, Borrelia garinii
SLQDIAGSNS

SEQ ID NO: 53406 - protein, 10 aa, Borrelia garinii
LQDIAGSNSI

SEQ ID NO: 53407 - protein, 10 aa, Borrelia garinii
QDIAGSNSIS

SEQ ID NO: 53408 - protein, 10 aa, Borrelia garinii
DIAGSNSISY

SEQ ID NO: 53409 - protein, 10 aa, Borrelia garinii
IAGSNSISYT

SEQ ID NO: 53410 - protein, 10 aa, Borrelia garinii
AGSNSISYTD

SEQ ID NO: 53411 - protein, 10 aa, Borrelia garinii
GSNSISYTDE

SEQ ID NO: 53412 - protein, 10 aa, Borrelia garinii
SNSISYTDEI

SEQ ID NO: 53413 - protein, 10 aa, Borrelia garinii
NSISYTDEIE

SEQ ID NO: 53414 - protein, 10 aa, Borrelia garinii
SISYTDEIEE

SEQ ID NO: 53415 - protein, 10 aa, Borrelia garinii
ISYTDEIEEE

SEQ ID NO: 53416 - protein, 10 aa, Borrelia garinii
SYTDEIEEED

SEQ ID NO: 53417 - protein, 10 aa, Borrelia garinii
YTDEIEEEDY

SEQ ID NO: 53418 - protein, 10 aa, Borrelia garinii
TDEIEEEDYA

SEQ ID NO: 53419 - protein, 10 aa, Borrelia garinii
DEIEEEDYAR

SEQ ID NO: 53420 - protein, 10 aa, Borrelia garinii
EIEEEDYARY

SEQ ID NO: 53421 - protein, 10 aa, Borrelia garinii
IEEEDYARYY

SEQ ID NO: 53422 - protein, 10 aa, Borrelia garinii
EEEDYARYYL

SEQ ID NO: 53423 - protein, 10 aa, Borrelia garinii
EEDYARYYLD

SEQ ID NO: 53424 - protein, 10 aa, Borrelia garinii
EDYARYYLDE

SEQ ID NO: 53425 - protein, 10 aa, Borrelia garinii
DYARYYLDED

SEQ ID NO: 53426 - protein, 10 aa, Borrelia garinii
YARYYLDEDD

SEQ ID NO: 53427 - protein, 10 aa, Borrelia garinii
ARYYLDEDDE

SEQ ID NO: 53428 - protein, 10 aa, Borrelia garinii
RYYLDEDDED

SEQ ID NO: 53429 - protein, 10 aa, Borrelia garinii
YYLDEDDEDD

SEQ ID NO: 53430 - protein, 10 aa, Borrelia garinii
YLDEDDEDDE

SEQ ID NO: 53431 - protein, 10 aa, Borrelia garinii
LDEDDEDDEY

SEQ ID NO: 53432 - protein, 10 aa, Borrelia garinii
DEDDEDDEYY

SEQ ID NO: 53433 - protein, 10 aa, Borrelia garinii
EDDEDDEYYE

SEQ ID NO: 53434 - protein, 10 aa, Borrelia garinii
DDEDDEYYED

SEQ ID NO: 53435 - protein, 10 aa, Borrelia garinii
DEDDEYYEDD

SEQ ID NO: 53436 - protein, 10 aa, Borrelia garinii
EDDEYYEDDY

SEQ ID NO: 53437 - protein, 10 aa, Borrelia garinii
DDEYYEDDYE

SEQ ID NO: 53438 - protein, 10 aa, Borrelia garinii
DEYYEDDYEE

SEQ ID NO: 53439 - protein, 10 aa, Borrelia garinii
EYYEDDYEEI

SEQ ID NO: 53440 - protein, 10 aa, Borrelia garinii
YYEDDYEEIR

SEQ ID NO: 53441 - protein, 10 aa, Borrelia garinii
YEDDYEEIRL

SEQ ID NO: 53442 - protein, 10 aa, Borrelia garinii
EDDYEEIRLS

SEQ ID NO: 53443 - protein, 10 aa, Borrelia garinii
DDYEEIRLSN

SEQ ID NO: 53444 - protein, 10 aa, Borrelia garinii
DYEEIRLSNR

SEQ ID NO: 53445 - protein, 10 aa, Borrelia garinii
YEEIRLSNRY

SEQ ID NO: 53446 - protein, 10 aa, Borrelia garinii
EEIRLSNRYQ

SEQ ID NO: 53447 - protein, 10 aa, Borrelia garinii
EIRLSNRYQS

SEQ ID NO: 53448 - protein, 10 aa, Borrelia garinii
IRLSNRYQSY

SEQ ID NO: 53449 - protein, 10 aa, Borrelia garinii
RLSNRYQSYL

SEQ ID NO: 53450 - protein, 10 aa, Borrelia garinii
LSNRYQSYLE

SEQ ID NO: 53451 - protein, 10 aa, Borrelia garinii
SNRYQSYLEG

SEQ ID NO: 53452 - protein, 10 aa, Borrelia garinii
NRYQSYLEGV

SEQ ID NO: 53453 - protein, 10 aa, Borrelia garinii
RYQSYLEGVK

SEQ ID NO: 53454 - protein, 10 aa, Borrelia garinii
YQSYLEGVKY

SEQ ID NO: 53455 - protein, 10 aa, Borrelia garinii
QSYLEGVKYN

SEQ ID NO: 53456 - protein, 10 aa, Borrelia garinii
SYLEGVKYNV

SEQ ID NO: 53457 - protein, 10 aa, Borrelia garinii
YLEGVKYNVD

SEQ ID NO: 53458 - protein, 10 aa, Borrelia garinii
LEGVKYNVDS

SEQ ID NO: 53459 - protein, 10 aa, Borrelia garinii
EGVKYNVDSA

SEQ ID NO: 53460 - protein, 10 aa, Borrelia garinii
GVKYNVDSAI

SEQ ID NO: 53461 - protein, 10 aa, Borrelia garinii
VKYNVDSAIN

SEQ ID NO: 53462 - protein, 10 aa, Borrelia garinii
KYNVDSAINT

SEQ ID NO: 53463 - protein, 10 aa, Borrelia garinii
YNVDSAINTI

SEQ ID NO: 53464 - protein, 10 aa, Borrelia garinii
NVDSAINTIN

SEQ ID NO: 53465 - protein, 10 aa, Borrelia garinii
VDSAINTINK

SEQ ID NO: 53466 - protein, 10 aa, Borrelia garinii
DSAINTINKI

SEQ ID NO: 53467 - protein, 10 aa, Borrelia garinii
SAINTINKIY

SEQ ID NO: 53468 - protein, 10 aa, Borrelia garinii
AINTINKIYD

SEQ ID NO: 53469 - protein, 10 aa, Borrelia garinii
INTINKIYDT

SEQ ID NO: 53470 - protein, 10 aa, Borrelia garinii
NTINKIYDTY

SEQ ID NO: 53471 - protein, 10 aa, Borrelia garinii
TINKIYDTYT

SEQ ID NO: 53472 - protein, 10 aa, Borrelia garinii
INKIYDTYTL

SEQ ID NO: 53473 - protein, 10 aa, Borrelia garinii
NKIYDTYTLF

SEQ ID NO: 53474 - protein, 10 aa, Borrelia garinii
KIYDTYTLFS

SEQ ID NO: 53475 - protein, 10 aa, Borrelia garinii
IYDTYTLFST

SEQ ID NO: 53476 - protein, 10 aa, Borrelia garinii
YDTYTLFSTK

SEQ ID NO: 53477 - protein, 10 aa, Borrelia garinii
DTYTLFSTKL

SEQ ID NO: 53478 - protein, 10 aa, Borrelia garinii
TYTLFSTKLT

SEQ ID NO: 53479 - protein, 10 aa, Borrelia garinii
YTLFSTKLTQ

SEQ ID NO: 53480 - protein, 10 aa, Borrelia garinii
TLFSTKLTQM

SEQ ID NO: 53481 - protein, 10 aa, Borrelia garinii
LFSTKLTQMY

SEQ ID NO: 53482 - protein, 10 aa, Borrelia garinii
FSTKLTQMYS

SEQ ID NO: 53483 - protein, 10 aa, Borrelia garinii
STKLTQMYST

SEQ ID NO: 53484 - protein, 10 aa, Borrelia garinii
TKLTQMYSTR

SEQ ID NO: 53485 - protein, 10 aa, Borrelia garinii
KLTQMYSTRL

SEQ ID NO: 53486 - protein, 10 aa, Borrelia garinii
LTQMYSTRLD

SEQ ID NO: 53487 - protein, 10 aa, Borrelia garinii
TQMYSTRLDN

SEQ ID NO: 53488 - protein, 10 aa, Borrelia garinii
QMYSTRLDNL

SEQ ID NO: 53489 - protein, 10 aa, Borrelia garinii
MYSTRLDNLA

SEQ ID NO: 53490 - protein, 10 aa, Borrelia garinii
YSTRLDNLAK

SEQ ID NO: 53491 - protein, 10 aa, Borrelia garinii
STRLDNLAKA

SEQ ID NO: 53492 - protein, 10 aa, Borrelia garinii
TRLDNLAKAK

SEQ ID NO: 53493 - protein, 10 aa, Borrelia garinii
RLDNLAKAKA

SEQ ID NO: 53494 - protein, 10 aa, Borrelia garinii
LDNLAKAKAK

SEQ ID NO: 53495 - protein, 10 aa, Borrelia garinii
DNLAKAKAKE

SEQ ID NO: 53496 - protein, 10 aa, Borrelia garinii
NLAKAKAKEE

SEQ ID NO: 53497 - protein, 10 aa, Borrelia garinii
LAKAKAKEEA

SEQ ID NO: 53498 - protein, 10 aa, Borrelia garinii
AKAKAKEEAA

SEQ ID NO: 53499 - protein, 10 aa, Borrelia garinii
KAKAKEEAAK

SEQ ID NO: 53500 - protein, 10 aa, Borrelia garinii
AKAKEEAAKF

SEQ ID NO: 53501 - protein, 10 aa, Borrelia garinii
KAKEEAAKFT

SEQ ID NO: 53502 - protein, 10 aa, Borrelia garinii
AKEEAAKFTK

SEQ ID NO: 53503 - protein, 10 aa, Borrelia garinii
KEEAAKFTKE

SEQ ID NO: 53504 - protein, 10 aa, Borrelia garinii
EEAAKFTKED

SEQ ID NO: 53505 - protein, 10 aa, Borrelia garinii
EAAKFTKEDL

SEQ ID NO: 53506 - protein, 10 aa, Borrelia garinii
AAKFTKEDLE

SEQ ID NO: 53507 - protein, 10 aa, Borrelia garinii
AKFTKEDLEK

SEQ ID NO: 53508 - protein, 10 aa, Borrelia garinii
KFTKEDLEKN

SEQ ID NO: 53509 - protein, 10 aa, Borrelia garinii
FTKEDLEKNF

SEQ ID NO: 53510 - protein, 10 aa, Borrelia garinii
TKEDLEKNFK

SEQ ID NO: 53511 - protein, 10 aa, Borrelia garinii
KEDLEKNFKT

SEQ ID NO: 53512 - protein, 10 aa, Borrelia garinii
EDLEKNFKTL

SEQ ID NO: 53513 - protein, 10 aa, Borrelia garinii
DLEKNFKTLL

SEQ ID NO: 53514 - protein, 10 aa, Borrelia garinii
LEKNFKTLLN

SEQ ID NO: 53515 - protein, 10 aa, Borrelia garinii
EKNFKTLLNY

SEQ ID NO: 53516 - protein, 10 aa, Borrelia garinii
KNFKTLLNYI

SEQ ID NO: 53517 - protein, 10 aa, Borrelia garinii
NFKTLLNYIQ

SEQ ID NO: 53518 - protein, 10 aa, Borrelia garinii
FKTLLNYIQV

SEQ ID NO: 53519 - protein, 10 aa, Borrelia garinii
KTLLNYIQVS

SEQ ID NO: 53520 - protein, 10 aa, Borrelia garinii
TLLNYIQVSV

SEQ ID NO: 53521 - protein, 10 aa, Borrelia garinii
LLNYIQVSVK

SEQ ID NO: 53522 - protein, 10 aa, Borrelia garinii
LNYIQVSVKT

SEQ ID NO: 53523 - protein, 10 aa, Borrelia garinii
NYIQVSVKTA

SEQ ID NO: 53524 - protein, 10 aa, Borrelia garinii
YIQVSVKTAT

SEQ ID NO: 53525 - protein, 10 aa, Borrelia garinii
IQVSVKTATN

SEQ ID NO: 53526 - protein, 10 aa, Borrelia garinii
QVSVKTATNF

SEQ ID NO: 53527 - protein, 10 aa, Borrelia garinii
VSVKTATNFV

SEQ ID NO: 53528 - protein, 10 aa, Borrelia garinii
SVKTATNFVY

SEQ ID NO: 53529 - protein, 10 aa, Borrelia garinii
VKTATNFVYI

SEQ ID NO: 53530 - protein, 10 aa, Borrelia garinii
KTATNFVYIN

SEQ ID NO: 53531 - protein, 10 aa, Borrelia garinii
TATNFVYINE

SEQ ID NO: 53532 - protein, 10 aa, Borrelia garinii
ATNFVYINEM

SEQ ID NO: 53533 - protein, 10 aa, Borrelia garinii
TNFVYINEMH

SEQ ID NO: 53534 - protein, 10 aa, Borrelia garinii
NFVYINEMHA

SEQ ID NO: 53535 - protein, 10 aa, Borrelia garinii
FVYINEMHAK

SEQ ID NO: 53536 - protein, 10 aa, Borrelia garinii
VYINEMHAKR

SEQ ID NO: 53537 - protein, 10 aa, Borrelia garinii
YINEMHAKRK

SEQ ID NO: 53538 - protein, 10 aa, Borrelia garinii
INEMHAKRKL

SEQ ID NO: 53539 - protein, 10 aa, Borrelia garinii
NEMHAKRKLE

SEQ ID NO: 53540 - protein, 10 aa, Borrelia garinii
EMHAKRKLEN

SEQ ID NO: 53541 - protein, 10 aa, Borrelia garinii
MHAKRKLENI

SEQ ID NO: 53542 - protein, 10 aa, Borrelia garinii
HAKRKLENIE

SEQ ID NO: 53543 - protein, 10 aa, Borrelia garinii
AKRKLENIEA

SEQ ID NO: 53544 - protein, 10 aa, Borrelia garinii
KRKLENIEAK

SEQ ID NO: 53545 - protein, 10 aa, Borrelia garinii
RKLENIEAKI

SEQ ID NO: 53546 - protein, 10 aa, Borrelia garinii
KLENIEAKIK

SEQ ID NO: 53547 - protein, 10 aa, Borrelia garinii
LENIEAKIKT

SEQ ID NO: 53548 - protein, 10 aa, Borrelia garinii
ENIEAKIKTL

SEQ ID NO: 53549 - protein, 10 aa, Borrelia garinii
NIEAKIKTLI

SEQ ID NO: 53550 - protein, 10 aa, Borrelia garinii
IEAKIKTLIA

SEQ ID NO: 53551 - protein, 10 aa, Borrelia garinii
EAKIKTLIAK

SEQ ID NO: 53552 - protein, 10 aa, Borrelia garinii
AKIKTLIAKI

SEQ ID NO: 53553 - protein, 10 aa, Borrelia garinii
KIKTLIAKIK

SEQ ID NO: 53554 - protein, 10 aa, Borrelia garinii
IKTLIAKIKE

SEQ ID NO: 53555 - protein, 10 aa, Borrelia garinii
KTLIAKIKEK

SEQ ID NO: 53556 - protein, 10 aa, Borrelia garinii
TLIAKIKEKS

SEQ ID NO: 53557 - protein, 10 aa, Borrelia garinii
LIAKIKEKSN

SEQ ID NO: 53558 - protein, 10 aa, Borrelia garinii
IAKIKEKSNL

SEQ ID NO: 53559 - protein, 10 aa, Borrelia garinii
AKIKEKSNLY

SEQ ID NO: 53560 - protein, 10 aa, Borrelia garinii
KIKEKSNLYS

SEQ ID NO: 53561 - protein, 10 aa, Borrelia garinii
IKEKSNLYSA

SEQ ID NO: 53562 - protein, 10 aa, Borrelia garinii
KEKSNLYSAY

SEQ ID NO: 53563 - protein, 10 aa, Borrelia garinii
EKSNLYSAYK

SEQ ID NO: 53564 - protein, 10 aa, Borrelia garinii
KSNLYSAYKA

SEQ ID NO: 53565 - protein, 10 aa, Borrelia garinii
SNLYSAYKAI

SEQ ID NO: 53566 - protein, 10 aa, Borrelia garinii
NLYSAYKAIV

SEQ ID NO: 53567 - protein, 10 aa, Borrelia garinii
LYSAYKAIVS

SEQ ID NO: 53568 - protein, 10 aa, Borrelia garinii
YSAYKAIVSS

SEQ ID NO: 53569 - protein, 10 aa, Borrelia garinii
SAYKAIVSSI

SEQ ID NO: 53570 - protein, 10 aa, Borrelia garinii
AYKAIVSSIL

SEQ ID NO: 53571 - protein, 10 aa, Borrelia garinii
YKAIVSSILL

SEQ ID NO: 53572 - protein, 10 aa, Borrelia garinii
KAIVSSILLM

SEQ ID NO: 53573 - protein, 10 aa, Borrelia garinii
AIVSSILLMR

SEQ ID NO: 53574 - protein, 10 aa, Borrelia garinii
IVSSILLMRD

SEQ ID NO: 53575 - protein, 10 aa, Borrelia garinii
VSSILLMRDS

SEQ ID NO: 53576 - protein, 10 aa, Borrelia garinii
SSILLMRDSL

SEQ ID NO: 53577 - protein, 10 aa, Borrelia garinii
SILLMRDSLK

SEQ ID NO: 53578 - protein, 10 aa, Borrelia garinii
ILLMRDSLKE

SEQ ID NO: 53579 - protein, 10 aa, Borrelia garinii
LLMRDSLKEV

SEQ ID NO: 53580 - protein, 10 aa, Borrelia garinii
LMRDSLKEVQ

SEQ ID NO: 53581 - protein, 10 aa, Borrelia garinii
MRDSLKEVQY

SEQ ID NO: 53582 - protein, 10 aa, Borrelia garinii
RDSLKEVQYA

SEQ ID NO: 53583 - protein, 10 aa, Borrelia garinii
DSLKEVQYAI

SEQ ID NO: 53584 - protein, 10 aa, Borrelia garinii
SLKEVQYAID

SEQ ID NO: 53585 - protein, 10 aa, Borrelia garinii
LKEVQYAIDK

SEQ ID NO: 53586 - protein, 10 aa, Borrelia garinii
KEVQYAIDKN

SEQ ID NO: 53587 - protein, 10 aa, Borrelia garinii
EVQYAIDKNG

SEQ ID NO: 53588 - protein, 10 aa, Borrelia garinii
VQYAIDKNGI

SEQ ID NO: 53589 - protein, 10 aa, Borrelia garinii
QYAIDKNGIW

SEQ ID NO: 53590 - protein, 10 aa, Borrelia garinii
YAIDKNGIWY

SEQ ID NO: 53591 - protein, 10 aa, Borrelia garinii
AIDKNGIWYR

SEQ ID NO: 53592 - protein, 10 aa, Borrelia garinii
IDKNGIWYRK

SEQ ID NO: 53593 - protein, 10 aa, Borrelia garinii
DKNGIWYRKL

SEQ ID NO: 53594 - protein, 10 aa, Borrelia garinii
KNGIWYRKLD

SEQ ID NO: 53595 - protein, 10 aa, Borrelia garinii
NGIWYRKLDA

SEQ ID NO: 53596 - protein, 10 aa, Borrelia garinii
GIWYRKLDAI

SEQ ID NO: 53597 - protein, 10 aa, Borrelia garinii
IWYRKLDAIE

SEQ ID NO: 53598 - protein, 10 aa, Borrelia garinii
WYRKLDAIET

SEQ ID NO: 53599 - protein, 10 aa, Borrelia garinii
YRKLDAIETE

SEQ ID NO: 53600 - protein, 10 aa, Borrelia garinii
RKLDAIETEI

SEQ ID NO: 53601 - protein, 10 aa, Borrelia garinii
KLDAIETEIK

SEQ ID NO: 53602 - protein, 10 aa, Borrelia garinii
LDAIETEIKN

SEQ ID NO: 53603 - protein, 10 aa, Borrelia garinii
DAIETEIKNL

SEQ ID NO: 53604 - protein, 10 aa, Borrelia garinii
AIETEIKNLI

SEQ ID NO: 53605 - protein, 10 aa, Borrelia garinii
IETEIKNLIL

SEQ ID NO: 53606 - protein, 10 aa, Borrelia garinii
ETEIKNLILK

SEQ ID NO: 53607 - protein, 10 aa, Borrelia garinii
TEIKNLILKI

SEQ ID NO: 53608 - protein, 10 aa, Borrelia garinii
EIKNLILKIK

SEQ ID NO: 53609 - protein, 10 aa, Borrelia garinii
IKNLILKIKG

SEQ ID NO: 53610 - protein, 10 aa, Borrelia garinii
KNLILKIKGQ

SEQ ID NO: 53611 - protein, 10 aa, Borrelia garinii
NLILKIKGQS

SEQ ID NO: 53612 - protein, 10 aa, Borrelia garinii
LILKIKGQSD

SEQ ID NO: 53613 - protein, 10 aa, Borrelia garinii
ILKIKGQSDL

SEQ ID NO: 53614 - protein, 10 aa, Borrelia garinii
LKIKGQSDLY

SEQ ID NO: 53615 - protein, 10 aa, Borrelia garinii
KIKGQSDLYE

SEQ ID NO: 53616 - protein, 10 aa, Borrelia garinii
IKGQSDLYEA

SEQ ID NO: 53617 - protein, 10 aa, Borrelia garinii
KGQSDLYEAY

SEQ ID NO: 53618 - protein, 10 aa, Borrelia garinii
GQSDLYEAYK

SEQ ID NO: 53619 - protein, 10 aa, Borrelia garinii
QSDLYEAYKA

SEQ ID NO: 53620 - protein, 10 aa, Borrelia garinii
SDLYEAYKAI

SEQ ID NO: 53621 - protein, 10 aa, Borrelia garinii
DLYEAYKAIV

SEQ ID NO: 53622 - protein, 10 aa, Borrelia garinii
LYEAYKAIVR

SEQ ID NO: 53623 - protein, 10 aa, Borrelia garinii
YEAYKAIVRS

SEQ ID NO: 53624 - protein, 10 aa, Borrelia garinii
EAYKAIVRSI

SEQ ID NO: 53625 - protein, 10 aa, Borrelia garinii
AYKAIVRSIL

SEQ ID NO: 53626 - protein, 10 aa, Borrelia garinii
YKAIVRSILL

SEQ ID NO: 53627 - protein, 10 aa, Borrelia garinii
KAIVRSILLM

SEQ ID NO: 53628 - protein, 10 aa, Borrelia garinii
AIVRSILLMK

SEQ ID NO: 53629 - protein, 10 aa, Borrelia garinii
IVRSILLMKD

SEQ ID NO: 53630 - protein, 10 aa, Borrelia garinii
VRSILLMKDS

SEQ ID NO: 53631 - protein, 10 aa, Borrelia garinii
RSILLMKDSL

SEQ ID NO: 53632 - protein, 10 aa, Borrelia garinii
SILLMKDSLK

SEQ ID NO: 53633 - protein, 10 aa, Borrelia garinii
ILLMKDSLKI

SEQ ID NO: 53634 - protein, 10 aa, Borrelia garinii
LLMKDSLKII

SEQ ID NO: 53635 - protein, 10 aa, Borrelia garinii
LMKDSLKIIE

SEQ ID NO: 53636 - protein, 10 aa, Borrelia garinii
MKDSLKIIEI

SEQ ID NO: 53637 - protein, 10 aa, Borrelia garinii
KDSLKIIEIV

SEQ ID NO: 53638 - protein, 10 aa, Borrelia garinii
DSLKIIEIVI

SEQ ID NO: 53639 - protein, 10 aa, Borrelia garinii
SLKIIEIVID

SEQ ID NO: 53640 - protein, 10 aa, Borrelia garinii
LKIIEIVIDK

SEQ ID NO: 53641 - protein, 10 aa, Borrelia garinii
KIIEIVIDKN

SEQ ID NO: 53642 - protein, 10 aa, Borrelia garinii
IIEIVIDKNG

SEQ ID NO: 53643 - protein, 10 aa, Borrelia garinii
IEIVIDKNGV

SEQ ID NO: 53644 - protein, 10 aa, Borrelia garinii
EIVIDKNGVW

SEQ ID NO: 53645 - protein, 10 aa, Borrelia garinii
IVIDKNGVWY

SEQ ID NO: 53646 - protein, 11 aa, Borrelia garinii
MKKVKSKYLAL

SEQ ID NO: 53647 - protein, 11 aa, Borrelia garinii
KKVKSKYLALG

SEQ ID NO: 53648 - protein, 11 aa, Borrelia garinii
KVKSKYLALGL

SEQ ID NO: 53649 - protein, 11 aa, Borrelia garinii
VKSKYLALGLL

SEQ ID NO: 53650 - protein, 11 aa, Borrelia garinii
KSKYLALGLLF

SEQ ID NO: 53651 - protein, 11 aa, Borrelia garinii
SKYLALGLLFG

SEQ ID NO: 53652 - protein, 11 aa, Borrelia garinii
KYLALGLLFGF

SEQ ID NO: 53653 - protein, 11 aa, Borrelia garinii
YLALGLLFGFI

SEQ ID NO: 53654 - protein, 11 aa, Borrelia garinii
LALGLLFGFIS

SEQ ID NO: 53655 - protein, 11 aa, Borrelia garinii
ALGLLFGFISC

SEQ ID NO: 53656 - protein, 11 aa, Borrelia garinii
LGLLFGFISCD

SEQ ID NO: 53657 - protein, 11 aa, Borrelia garinii
GLLFGFISCDL

SEQ ID NO: 53658 - protein, 11 aa, Borrelia garinii
LLFGFISCDLF

SEQ ID NO: 53659 - protein, 11 aa, Borrelia garinii
LFGFISCDLFI

SEQ ID NO: 53660 - protein, 11 aa, Borrelia garinii
FGFISCDLFIR

SEQ ID NO: 53661 - protein, 11 aa, Borrelia garinii
GFISCDLFIRY

SEQ ID NO: 53662 - protein, 11 aa, Borrelia garinii
FISCDLFIRYE

SEQ ID NO: 53663 - protein, 11 aa, Borrelia garinii
ISCDLFIRYEM

SEQ ID NO: 53664 - protein, 11 aa, Borrelia garinii
SCDLFIRYEMK

SEQ ID NO: 53665 - protein, 11 aa, Borrelia garinii
CDLFIRYEMKE

SEQ ID NO: 53666 - protein, 11 aa, Borrelia garinii
DLFIRYEMKEE

SEQ ID NO: 53667 - protein, 11 aa, Borrelia garinii
LFIRYEMKEES

SEQ ID NO: 53668 - protein, 11 aa, Borrelia garinii
FIRYEMKEESP

SEQ ID NO: 53669 - protein, 11 aa, Borrelia garinii
IRYEMKEESPG

SEQ ID NO: 53670 - protein, 11 aa, Borrelia garinii
RYEMKEESPGL

SEQ ID NO: 53671 - protein, 11 aa, Borrelia garinii
YEMKEESPGLF

SEQ ID NO: 53672 - protein, 11 aa, Borrelia garinii
EMKEESPGLFD

SEQ ID NO: 53673 - protein, 11 aa, Borrelia garinii
MKEESPGLFDK

SEQ ID NO: 53674 - protein, 11 aa, Borrelia garinii
KEESPGLFDKG

SEQ ID NO: 53675 - protein, 11 aa, Borrelia garinii
EESPGLFDKGN

SEQ ID NO: 53676 - protein, 11 aa, Borrelia garinii
ESPGLFDKGNS

SEQ ID NO: 53677 - protein, 11 aa, Borrelia garinii
SPGLFDKGNSI

SEQ ID NO: 53678 - protein, 11 aa, Borrelia garinii
PGLFDKGNSIL

SEQ ID NO: 53679 - protein, 11 aa, Borrelia garinii
GLFDKGNSILE

SEQ ID NO: 53680 - protein, 11 aa, Borrelia garinii
LFDKGNSILET

SEQ ID NO: 53681 - protein, 11 aa, Borrelia garinii
FDKGNSILETS

SEQ ID NO: 53682 - protein, 11 aa, Borrelia garinii
DKGNSILETSE

SEQ ID NO: 53683 - protein, 11 aa, Borrelia garinii
KGNSILETSEE

SEQ ID NO: 53684 - protein, 11 aa, Borrelia garinii
GNSILETSEES

SEQ ID NO: 53685 - protein, 11 aa, Borrelia garinii
NSILETSEESI

SEQ ID NO: 53686 - protein, 11 aa, Borrelia garinii
SILETSEESIK

SEQ ID NO: 53687 - protein, 11 aa, Borrelia garinii
ILETSEESIKK

SEQ ID NO: 53688 - protein, 11 aa, Borrelia garinii
LETSEESIKKP

SEQ ID NO: 53689 - protein, 11 aa, Borrelia garinii
ETSEESIKKPM

SEQ ID NO: 53690 - protein, 11 aa, Borrelia garinii
TSEESIKKPMN

SEQ ID NO: 53691 - protein, 11 aa, Borrelia garinii
SEESIKKPMNK

SEQ ID NO: 53692 - protein, 11 aa, Borrelia garinii
EESIKKPMNKK

SEQ ID NO: 53693 - protein, 11 aa, Borrelia garinii
ESIKKPMNKKG

SEQ ID NO: 53694 - protein, 11 aa, Borrelia garinii
SIKKPMNKKGK

SEQ ID NO: 53695 - protein, 11 aa, Borrelia garinii
IKKPMNKKGKG

SEQ ID NO: 53696 - protein, 11 aa, Borrelia garinii
KKPMNKKGKGK

SEQ ID NO: 53697 - protein, 11 aa, Borrelia garinii
KPMNKKGKGKI

SEQ ID NO: 53698 - protein, 11 aa, Borrelia garinii
PMNKKGKGKIA

SEQ ID NO: 53699 - protein, 11 aa, Borrelia garinii
MNKKGKGKIAR

SEQ ID NO: 53700 - protein, 11 aa, Borrelia garinii
NKKGKGKIARK

SEQ ID NO: 53701 - protein, 11 aa, Borrelia garinii
KKGKGKIARKN

SEQ ID NO: 53702 - protein, 11 aa, Borrelia garinii
KGKGKIARKNG

SEQ ID NO: 53703 - protein, 11 aa, Borrelia garinii
GKGKIARKNGK

SEQ ID NO: 53704 - protein, 11 aa, Borrelia garinii
KGKIARKNGKS

SEQ ID NO: 53705 - protein, 11 aa, Borrelia garinii
GKIARKNGKSK

SEQ ID NO: 53706 - protein, 11 aa, Borrelia garinii
KIARKNGKSKV

SEQ ID NO: 53707 - protein, 11 aa, Borrelia garinii
IARKNGKSKVS

SEQ ID NO: 53708 - protein, 11 aa, Borrelia garinii
ARKNGKSKVSG

SEQ ID NO: 53709 - protein, 11 aa, Borrelia garinii
RKNGKSKVSGK

SEQ ID NO: 53710 - protein, 11 aa, Borrelia garinii
KNGKSKVSGKE

SEQ ID NO: 53711 - protein, 11 aa, Borrelia garinii
NGKSKVSGKEP

SEQ ID NO: 53712 - protein, 11 aa, Borrelia garinii
GKSKVSGKEPF

SEQ ID NO: 53713 - protein, 11 aa, Borrelia garinii
KSKVSGKEPFI

SEQ ID NO: 53714 - protein, 11 aa, Borrelia garinii
SKVSGKEPFIH

SEQ ID NO: 53715 - protein, 11 aa, Borrelia garinii
KVSGKEPFIHS

SEQ ID NO: 53716 - protein, 11 aa, Borrelia garinii
VSGKEPFIHSF

SEQ ID NO: 53717 - protein, 11 aa, Borrelia garinii
SGKEPFIHSFK

SEQ ID NO: 53718 - protein, 11 aa, Borrelia garinii
GKEPFIHSFKR

SEQ ID NO: 53719 - protein, 11 aa, Borrelia garinii
KEPFIHSFKRD

SEQ ID NO: 53720 - protein, 11 aa, Borrelia garinii
EPFIHSFKRDA

SEQ ID NO: 53721 - protein, 11 aa, Borrelia garinii
PFIHSFKRDAA

SEQ ID NO: 53722 - protein, 11 aa, Borrelia garinii
FIHSFKRDAAN

SEQ ID NO: 53723 - protein, 11 aa, Borrelia garinii
IHSFKRDAANK

SEQ ID NO: 53724 - protein, 11 aa, Borrelia garinii
HSFKRDAANKS

SEQ ID NO: 53725 - protein, 11 aa, Borrelia garinii
SFKRDAANKSN

SEQ ID NO: 53726 - protein, 11 aa, Borrelia garinii
FKRDAANKSNF

SEQ ID NO: 53727 - protein, 11 aa, Borrelia garinii
KRDAANKSNFL

SEQ ID NO: 53728 - protein, 11 aa, Borrelia garinii
RDAANKSNFLQ

SEQ ID NO: 53729 - protein, 11 aa, Borrelia garinii
DAANKSNFLQK

SEQ ID NO: 53730 - protein, 11 aa, Borrelia garinii
AANKSNFLQKN

SEQ ID NO: 53731 - protein, 11 aa, Borrelia garinii
ANKSNFLQKNV

SEQ ID NO: 53732 - protein, 11 aa, Borrelia garinii
NKSNFLQKNVM

SEQ ID NO: 53733 - protein, 11 aa, Borrelia garinii
KSNFLQKNVML

SEQ ID NO: 53734 - protein, 11 aa, Borrelia garinii
SNFLQKNVMLE

SEQ ID NO: 53735 - protein, 11 aa, Borrelia garinii
NFLQKNVMLEE

SEQ ID NO: 53736 - protein, 11 aa, Borrelia garinii
FLQKNVMLEEE

SEQ ID NO: 53737 - protein, 11 aa, Borrelia garinii
LQKNVMLEEES

SEQ ID NO: 53738 - protein, 11 aa, Borrelia garinii
QKNVMLEEESL

SEQ ID NO: 53739 - protein, 11 aa, Borrelia garinii
KNVMLEEESLK

SEQ ID NO: 53740 - protein, 11 aa, Borrelia garinii
NVMLEEESLKT

SEQ ID NO: 53741 - protein, 11 aa, Borrelia garinii
VMLEEESLKTE

SEQ ID NO: 53742 - protein, 11 aa, Borrelia garinii
MLEEESLKTEL

SEQ ID NO: 53743 - protein, 11 aa, Borrelia garinii
LEEESLKTELL

SEQ ID NO: 53744 - protein, 11 aa, Borrelia garinii
EEESLKTELLK

SEQ ID NO: 53745 - protein, 11 aa, Borrelia garinii
EESLKTELLKE

SEQ ID NO: 53746 - protein, 11 aa, Borrelia garinii
ESLKTELLKEQ

SEQ ID NO: 53747 - protein, 11 aa, Borrelia garinii
SLKTELLKEQS

SEQ ID NO: 53748 - protein, 11 aa, Borrelia garinii
LKTELLKEQSE

SEQ ID NO: 53749 - protein, 11 aa, Borrelia garinii
KTELLKEQSET

SEQ ID NO: 53750 - protein, 11 aa, Borrelia garinii
TELLKEQSETR

SEQ ID NO: 53751 - protein, 11 aa, Borrelia garinii
ELLKEQSETRK

SEQ ID NO: 53752 - protein, 11 aa, Borrelia garinii
LLKEQSETRKE

SEQ ID NO: 53753 - protein, 11 aa, Borrelia garinii
LKEQSETRKEK

SEQ ID NO: 53754 - protein, 11 aa, Borrelia garinii
KEQSETRKEKI

SEQ ID NO: 53755 - protein, 11 aa, Borrelia garinii
EQSETRKEKIQ

SEQ ID NO: 53756 - protein, 11 aa, Borrelia garinii
QSETRKEKIQK

SEQ ID NO: 53757 - protein, 11 aa, Borrelia garinii
SETRKEKIQKQ

SEQ ID NO: 53758 - protein, 11 aa, Borrelia garinii
ETRKEKIQKQQ

SEQ ID NO: 53759 - protein, 11 aa, Borrelia garinii
TRKEKIQKQQD

SEQ ID NO: 53760 - protein, 11 aa, Borrelia garinii
RKEKIQKQQDE

SEQ ID NO: 53761 - protein, 11 aa, Borrelia garinii
KEKIQKQQDEY

SEQ ID NO: 53762 - protein, 11 aa, Borrelia garinii
EKIQKQQDEYK

SEQ ID NO: 53763 - protein, 11 aa, Borrelia garinii
KIQKQQDEYKG

SEQ ID NO: 53764 - protein, 11 aa, Borrelia garinii
IQKQQDEYKGM

SEQ ID NO: 53765 - protein, 11 aa, Borrelia garinii
QKQQDEYKGMT

SEQ ID NO: 53766 - protein, 11 aa, Borrelia garinii
KQQDEYKGMTK

SEQ ID NO: 53767 - protein, 11 aa, Borrelia garinii
QQDEYKGMTKG

SEQ ID NO: 53768 - protein, 11 aa, Borrelia garinii
QDEYKGMTKGS

SEQ ID NO: 53769 - protein, 11 aa, Borrelia garinii
DEYKGMTKGSL

SEQ ID NO: 53770 - protein, 11 aa, Borrelia garinii
EYKGMTKGSLN

SEQ ID NO: 53771 - protein, 11 aa, Borrelia garinii
YKGMTKGSLNS

SEQ ID NO: 53772 - protein, 11 aa, Borrelia garinii
KGMTKGSLNSL

SEQ ID NO: 53773 - protein, 11 aa, Borrelia garinii
GMTKGSLNSLS

SEQ ID NO: 53774 - protein, 11 aa, Borrelia garinii
MTKGSLNSLSG

SEQ ID NO: 53775 - protein, 11 aa, Borrelia garinii
TKGSLNSLSGE

SEQ ID NO: 53776 - protein, 11 aa, Borrelia garinii
KGSLNSLSGES

SEQ ID NO: 53777 - protein, 11 aa, Borrelia garinii
GSLNSLSGESG

SEQ ID NO: 53778 - protein, 11 aa, Borrelia garinii
SLNSLSGESGE

SEQ ID NO: 53779 - protein, 11 aa, Borrelia garinii
LNSLSGESGEL

SEQ ID NO: 53780 - protein, 11 aa, Borrelia garinii
NSLSGESGELK

SEQ ID NO: 53781 - protein, 11 aa, Borrelia garinii
SLSGESGELKE

SEQ ID NO: 53782 - protein, 11 aa, Borrelia garinii
LSGESGELKET

SEQ ID NO: 53783 - protein, 11 aa, Borrelia garinii
SGESGELKETI

SEQ ID NO: 53784 - protein, 11 aa, Borrelia garinii
GESGELKETIE

SEQ ID NO: 53785 - protein, 11 aa, Borrelia garinii
ESGELKETIES

SEQ ID NO: 53786 - protein, 11 aa, Borrelia garinii
SGELKETIESN

SEQ ID NO: 53787 - protein, 11 aa, Borrelia garinii
GELKETIESNE

SEQ ID NO: 53788 - protein, 11 aa, Borrelia garinii
ELKETIESNEI

SEQ ID NO: 53789 - protein, 11 aa, Borrelia garinii
LKETIESNEID

SEQ ID NO: 53790 - protein, 11 aa, Borrelia garinii
KETIESNEIDI

SEQ ID NO: 53791 - protein, 11 aa, Borrelia garinii
ETIESNEIDIT

SEQ ID NO: 53792 - protein, 11 aa, Borrelia garinii
TIESNEIDITI

SEQ ID NO: 53793 - protein, 11 aa, Borrelia garinii
IESNEIDITID

SEQ ID NO: 53794 - protein, 11 aa, Borrelia garinii
ESNEIDITIDS

SEQ ID NO: 53795 - protein, 11 aa, Borrelia garinii
SNEIDITIDSD

SEQ ID NO: 53796 - protein, 11 aa, Borrelia garinii
NEIDITIDSDL

SEQ ID NO: 53797 - protein, 11 aa, Borrelia garinii
EIDITIDSDLR

SEQ ID NO: 53798 - protein, 11 aa, Borrelia garinii
IDITIDSDLRP

SEQ ID NO: 53799 - protein, 11 aa, Borrelia garinii
DITIDSDLRPK

SEQ ID NO: 53800 - protein, 11 aa, Borrelia garinii
ITIDSDLRPKS

SEQ ID NO: 53801 - protein, 11 aa, Borrelia garinii
TIDSDLRPKSS

SEQ ID NO: 53802 - protein, 11 aa, Borrelia garinii
IDSDLRPKSSL

SEQ ID NO: 53803 - protein, 11 aa, Borrelia garinii
DSDLRPKSSLQ

SEQ ID NO: 53804 - protein, 11 aa, Borrelia garinii
SDLRPKSSLQD

SEQ ID NO: 53805 - protein, 11 aa, Borrelia garinii
DLRPKSSLQDI

SEQ ID NO: 53806 - protein, 11 aa, Borrelia garinii
LRPKSSLQDIA

SEQ ID NO: 53807 - protein, 11 aa, Borrelia garinii
RPKSSLQDIAG

SEQ ID NO: 53808 - protein, 11 aa, Borrelia garinii
PKSSLQDIAGS

SEQ ID NO: 53809 - protein, 11 aa, Borrelia garinii
KSSLQDIAGSN

SEQ ID NO: 53810 - protein, 11 aa, Borrelia garinii
SSLQDIAGSNS

SEQ ID NO: 53811 - protein, 11 aa, Borrelia garinii
SLQDIAGSNSI

SEQ ID NO: 53812 - protein, 11 aa, Borrelia garinii
LQDIAGSNSIS

SEQ ID NO: 53813 - protein, 11 aa, Borrelia garinii
QDIAGSNSISY

SEQ ID NO: 53814 - protein, 11 aa, Borrelia garinii
DIAGSNSISYT

SEQ ID NO: 53815 - protein, 11 aa, Borrelia garinii
IAGSNSISYTD

SEQ ID NO: 53816 - protein, 11 aa, Borrelia garinii
AGSNSISYTDE

SEQ ID NO: 53817 - protein, 11 aa, Borrelia garinii
GSNSISYTDEI

SEQ ID NO: 53818 - protein, 11 aa, Borrelia garinii
SNSISYTDEIE

SEQ ID NO: 53819 - protein, 11 aa, Borrelia garinii
NSISYTDEIEE

SEQ ID NO: 53820 - protein, 11 aa, Borrelia garinii
SISYTDEIEEE

SEQ ID NO: 53821 - protein, 11 aa, Borrelia garinii
ISYTDEIEEED

SEQ ID NO: 53822 - protein, 11 aa, Borrelia garinii
SYTDEIEEEDY

SEQ ID NO: 53823 - protein, 11 aa, Borrelia garinii
YTDEIEEEDYA

SEQ ID NO: 53824 - protein, 11 aa, Borrelia garinii
TDEIEEEDYAR

SEQ ID NO: 53825 - protein, 11 aa, Borrelia garinii
DEIEEEDYARY

SEQ ID NO: 53826 - protein, 11 aa, Borrelia garinii
EIEEEDYARYY

SEQ ID NO: 53827 - protein, 11 aa, Borrelia garinii
IEEEDYARYYL

SEQ ID NO: 53828 - protein, 11 aa, Borrelia garinii
EEEDYARYYLD

SEQ ID NO: 53829 - protein, 11 aa, Borrelia garinii
EEDYARYYLDE

SEQ ID NO: 53830 - protein, 11 aa, Borrelia garinii
EDYARYYLDED

SEQ ID NO: 53831 - protein, 11 aa, Borrelia garinii
DYARYYLDEDD

SEQ ID NO: 53832 - protein, 11 aa, Borrelia garinii
YARYYLDEDDE

SEQ ID NO: 53833 - protein, 11 aa, Borrelia garinii
ARYYLDEDDED

SEQ ID NO: 53834 - protein, 11 aa, Borrelia garinii
RYYLDEDDEDD

SEQ ID NO: 53835 - protein, 11 aa, Borrelia garinii
YYLDEDDEDDE

SEQ ID NO: 53836 - protein, 11 aa, Borrelia garinii
YLDEDDEDDEY

SEQ ID NO: 53837 - protein, 11 aa, Borrelia garinii
LDEDDEDDEYY

SEQ ID NO: 53838 - protein, 11 aa, Borrelia garinii
DEDDEDDEYYE

SEQ ID NO: 53839 - protein, 11 aa, Borrelia garinii
EDDEDDEYYED

SEQ ID NO: 53840 - protein, 11 aa, Borrelia garinii
DDEDDEYYEDD

SEQ ID NO: 53841 - protein, 11 aa, Borrelia garinii
DEDDEYYEDDY

SEQ ID NO: 53842 - protein, 11 aa, Borrelia garinii
EDDEYYEDDYE

SEQ ID NO: 53843 - protein, 11 aa, Borrelia garinii
DDEYYEDDYEE

SEQ ID NO: 53844 - protein, 11 aa, Borrelia garinii
DEYYEDDYEEI

SEQ ID NO: 53845 - protein, 11 aa, Borrelia garinii
EYYEDDYEEIR

SEQ ID NO: 53846 - protein, 11 aa, Borrelia garinii
YYEDDYEEIRL

SEQ ID NO: 53847 - protein, 11 aa, Borrelia garinii
YEDDYEEIRLS

SEQ ID NO: 53848 - protein, 11 aa, Borrelia garinii
EDDYEEIRLSN

SEQ ID NO: 53849 - protein, 11 aa, Borrelia garinii
DDYEEIRLSNR

SEQ ID NO: 53850 - protein, 11 aa, Borrelia garinii
DYEEIRLSNRY

SEQ ID NO: 53851 - protein, 11 aa, Borrelia garinii
YEEIRLSNRYQ

SEQ ID NO: 53852 - protein, 11 aa, Borrelia garinii
EEIRLSNRYQS

SEQ ID NO: 53853 - protein, 11 aa, Borrelia garinii
EIRLSNRYQSY

SEQ ID NO: 53854 - protein, 11 aa, Borrelia garinii
IRLSNRYQSYL

SEQ ID NO: 53855 - protein, 11 aa, Borrelia garinii
RLSNRYQSYLE

SEQ ID NO: 53856 - protein, 11 aa, Borrelia garinii
LSNRYQSYLEG

SEQ ID NO: 53857 - protein, 11 aa, Borrelia garinii
SNRYQSYLEGV

SEQ ID NO: 53858 - protein, 11 aa, Borrelia garinii
NRYQSYLEGVK

SEQ ID NO: 53859 - protein, 11 aa, Borrelia garinii
RYQSYLEGVKY

SEQ ID NO: 53860 - protein, 11 aa, Borrelia garinii
YQSYLEGVKYN

SEQ ID NO: 53861 - protein, 11 aa, Borrelia garinii
QSYLEGVKYNV

SEQ ID NO: 53862 - protein, 11 aa, Borrelia garinii
SYLEGVKYNVD

SEQ ID NO: 53863 - protein, 11 aa, Borrelia garinii
YLEGVKYNVDS

SEQ ID NO: 53864 - protein, 11 aa, Borrelia garinii
LEGVKYNVDSA

SEQ ID NO: 53865 - protein, 11 aa, Borrelia garinii
EGVKYNVDSAI

SEQ ID NO: 53866 - protein, 11 aa, Borrelia garinii
GVKYNVDSAIN

SEQ ID NO: 53867 - protein, 11 aa, Borrelia garinii
VKYNVDSAINT

SEQ ID NO: 53868 - protein, 11 aa, Borrelia garinii
KYNVDSAINTI

SEQ ID NO: 53869 - protein, 11 aa, Borrelia garinii
YNVDSAINTIN

SEQ ID NO: 53870 - protein, 11 aa, Borrelia garinii
NVDSAINTINK

SEQ ID NO: 53871 - protein, 11 aa, Borrelia garinii
VDSAINTINKI

SEQ ID NO: 53872 - protein, 11 aa, Borrelia garinii
DSAINTINKIY

SEQ ID NO: 53873 - protein, 11 aa, Borrelia garinii
SAINTINKIYD

SEQ ID NO: 53874 - protein, 11 aa, Borrelia garinii
AINTINKIYDT

SEQ ID NO: 53875 - protein, 11 aa, Borrelia garinii
INTINKIYDTY

SEQ ID NO: 53876 - protein, 11 aa, Borrelia garinii
NTINKIYDTYT

SEQ ID NO: 53877 - protein, 11 aa, Borrelia garinii
TINKIYDTYTL

SEQ ID NO: 53878 - protein, 11 aa, Borrelia garinii
INKIYDTYTLF

SEQ ID NO: 53879 - protein, 11 aa, Borrelia garinii
NKIYDTYTLFS

SEQ ID NO: 53880 - protein, 11 aa, Borrelia garinii
KIYDTYTLFST

SEQ ID NO: 53881 - protein, 11 aa, Borrelia garinii
IYDTYTLFSTK

SEQ ID NO: 53882 - protein, 11 aa, Borrelia garinii
YDTYTLFSTKL

SEQ ID NO: 53883 - protein, 11 aa, Borrelia garinii
DTYTLFSTKLT

SEQ ID NO: 53884 - protein, 11 aa, Borrelia garinii
TYTLFSTKLTQ

SEQ ID NO: 53885 - protein, 11 aa, Borrelia garinii
YTLFSTKLTQM

SEQ ID NO: 53886 - protein, 11 aa, Borrelia garinii
TLFSTKLTQMY

SEQ ID NO: 53887 - protein, 11 aa, Borrelia garinii
LFSTKLTQMYS

SEQ ID NO: 53888 - protein, 11 aa, Borrelia garinii
FSTKLTQMYST

SEQ ID NO: 53889 - protein, 11 aa, Borrelia garinii
STKLTQMYSTR

SEQ ID NO: 53890 - protein, 11 aa, Borrelia garinii
TKLTQMYSTRL

SEQ ID NO: 53891 - protein, 11 aa, Borrelia garinii
KLTQMYSTRLD

SEQ ID NO: 53892 - protein, 11 aa, Borrelia garinii
LTQMYSTRLDN

SEQ ID NO: 53893 - protein, 11 aa, Borrelia garinii
TQMYSTRLDNL

SEQ ID NO: 53894 - protein, 11 aa, Borrelia garinii
QMYSTRLDNLA

SEQ ID NO: 53895 - protein, 11 aa, Borrelia garinii
MYSTRLDNLAK

SEQ ID NO: 53896 - protein, 11 aa, Borrelia garinii
YSTRLDNLAKA

SEQ ID NO: 53897 - protein, 11 aa, Borrelia garinii
STRLDNLAKAK

SEQ ID NO: 53898 - protein, 11 aa, Borrelia garinii
TRLDNLAKAKA

SEQ ID NO: 53899 - protein, 11 aa, Borrelia garinii
RLDNLAKAKAK

SEQ ID NO: 53900 - protein, 11 aa, Borrelia garinii
LDNLAKAKAKE

SEQ ID NO: 53901 - protein, 11 aa, Borrelia garinii
DNLAKAKAKEE

SEQ ID NO: 53902 - protein, 11 aa, Borrelia garinii
NLAKAKAKEEA

SEQ ID NO: 53903 - protein, 11 aa, Borrelia garinii
LAKAKAKEEAA

SEQ ID NO: 53904 - protein, 11 aa, Borrelia garinii
AKAKAKEEAAK

SEQ ID NO: 53905 - protein, 11 aa, Borrelia garinii
KAKAKEEAAKF

SEQ ID NO: 53906 - protein, 11 aa, Borrelia garinii
AKAKEEAAKFT

SEQ ID NO: 53907 - protein, 11 aa, Borrelia garinii
KAKEEAAKFTK

SEQ ID NO: 53908 - protein, 11 aa, Borrelia garinii
AKEEAAKFTKE

SEQ ID NO: 53909 - protein, 11 aa, Borrelia garinii
KEEAAKFTKED

SEQ ID NO: 53910 - protein, 11 aa, Borrelia garinii
EEAAKFTKEDL

SEQ ID NO: 53911 - protein, 11 aa, Borrelia garinii
EAAKFTKEDLE

SEQ ID NO: 53912 - protein, 11 aa, Borrelia garinii
AAKFTKEDLEK

SEQ ID NO: 53913 - protein, 11 aa, Borrelia garinii
AKFTKEDLEKN

SEQ ID NO: 53914 - protein, 11 aa, Borrelia garinii
KFTKEDLEKNF

SEQ ID NO: 53915 - protein, 11 aa, Borrelia garinii
FTKEDLEKNFK

SEQ ID NO: 53916 - protein, 11 aa, Borrelia garinii
TKEDLEKNFKT

SEQ ID NO: 53917 - protein, 11 aa, Borrelia garinii
KEDLEKNFKTL

SEQ ID NO: 53918 - protein, 11 aa, Borrelia garinii
EDLEKNFKTLL

SEQ ID NO: 53919 - protein, 11 aa, Borrelia garinii
DLEKNFKTLLN

SEQ ID NO: 53920 - protein, 11 aa, Borrelia garinii
LEKNFKTLLNY

SEQ ID NO: 53921 - protein, 11 aa, Borrelia garinii
EKNFKTLLNYI

SEQ ID NO: 53922 - protein, 11 aa, Borrelia garinii
KNFKTLLNYIQ

SEQ ID NO: 53923 - protein, 11 aa, Borrelia garinii
NFKTLLNYIQV

SEQ ID NO: 53924 - protein, 11 aa, Borrelia garinii
FKTLLNYIQVS

SEQ ID NO: 53925 - protein, 11 aa, Borrelia garinii
KTLLNYIQVSV

SEQ ID NO: 53926 - protein, 11 aa, Borrelia garinii
TLLNYIQVSVK

SEQ ID NO: 53927 - protein, 11 aa, Borrelia garinii
LLNYIQVSVKT

SEQ ID NO: 53928 - protein, 11 aa, Borrelia garinii
LNYIQVSVKTA

SEQ ID NO: 53929 - protein, 11 aa, Borrelia garinii
NYIQVSVKTAT

SEQ ID NO: 53930 - protein, 11 aa, Borrelia garinii
YIQVSVKTATN

SEQ ID NO: 53931 - protein, 11 aa, Borrelia garinii
IQVSVKTATNF

SEQ ID NO: 53932 - protein, 11 aa, Borrelia garinii
QVSVKTATNFV

SEQ ID NO: 53933 - protein, 11 aa, Borrelia garinii
VSVKTATNFVY

SEQ ID NO: 53934 - protein, 11 aa, Borrelia garinii
SVKTATNFVYI

SEQ ID NO: 53935 - protein, 11 aa, Borrelia garinii
VKTATNFVYIN

SEQ ID NO: 53936 - protein, 11 aa, Borrelia garinii
KTATNFVYINE

SEQ ID NO: 53937 - protein, 11 aa, Borrelia garinii
TATNFVYINEM

SEQ ID NO: 53938 - protein, 11 aa, Borrelia garinii
ATNFVYINEMH

SEQ ID NO: 53939 - protein, 11 aa, Borrelia garinii
TNFVYINEMHA

SEQ ID NO: 53940 - protein, 11 aa, Borrelia garinii
NFVYINEMHAK

SEQ ID NO: 53941 - protein, 11 aa, Borrelia garinii
FVYINEMHAKR

SEQ ID NO: 53942 - protein, 11 aa, Borrelia garinii
VYINEMHAKRK

SEQ ID NO: 53943 - protein, 11 aa, Borrelia garinii
YINEMHAKRKL

SEQ ID NO: 53944 - protein, 11 aa, Borrelia garinii
INEMHAKRKLE

SEQ ID NO: 53945 - protein, 11 aa, Borrelia garinii
NEMHAKRKLEN

SEQ ID NO: 53946 - protein, 11 aa, Borrelia garinii
EMHAKRKLENI

SEQ ID NO: 53947 - protein, 11 aa, Borrelia garinii
MHAKRKLENIE

SEQ ID NO: 53948 - protein, 11 aa, Borrelia garinii
HAKRKLENIEA

SEQ ID NO: 53949 - protein, 11 aa, Borrelia garinii
AKRKLENIEAK

SEQ ID NO: 53950 - protein, 11 aa, Borrelia garinii
KRKLENIEAKI

SEQ ID NO: 53951 - protein, 11 aa, Borrelia garinii
RKLENIEAKIK

SEQ ID NO: 53952 - protein, 11 aa, Borrelia garinii
KLENIEAKIKT

SEQ ID NO: 53953 - protein, 11 aa, Borrelia garinii
LENIEAKIKTL

SEQ ID NO: 53954 - protein, 11 aa, Borrelia garinii
ENIEAKIKTLI

SEQ ID NO: 53955 - protein, 11 aa, Borrelia garinii
NIEAKIKTLIA

SEQ ID NO: 53956 - protein, 11 aa, Borrelia garinii
IEAKIKTLIAK

SEQ ID NO: 53957 - protein, 11 aa, Borrelia garinii
EAKIKTLIAKI

SEQ ID NO: 53958 - protein, 11 aa, Borrelia garinii
AKIKTLIAKIK

SEQ ID NO: 53959 - protein, 11 aa, Borrelia garinii
KIKTLIAKIKE

SEQ ID NO: 53960 - protein, 11 aa, Borrelia garinii
IKTLIAKIKEK

SEQ ID NO: 53961 - protein, 11 aa, Borrelia garinii
KTLIAKIKEKS

SEQ ID NO: 53962 - protein, 11 aa, Borrelia garinii
TLIAKIKEKSN

SEQ ID NO: 53963 - protein, 11 aa, Borrelia garinii
LIAKIKEKSNL

SEQ ID NO: 53964 - protein, 11 aa, Borrelia garinii
IAKIKEKSNLY

SEQ ID NO: 53965 - protein, 11 aa, Borrelia garinii
AKIKEKSNLYS

SEQ ID NO: 53966 - protein, 11 aa, Borrelia garinii
KIKEKSNLYSA

SEQ ID NO: 53967 - protein, 11 aa, Borrelia garinii
IKEKSNLYSAY

SEQ ID NO: 53968 - protein, 11 aa, Borrelia garinii
KEKSNLYSAYK

SEQ ID NO: 53969 - protein, 11 aa, Borrelia garinii
EKSNLYSAYKA

SEQ ID NO: 53970 - protein, 11 aa, Borrelia garinii
KSNLYSAYKAI

SEQ ID NO: 53971 - protein, 11 aa, Borrelia garinii
SNLYSAYKAIV

SEQ ID NO: 53972 - protein, 11 aa, Borrelia garinii
NLYSAYKAIVS

SEQ ID NO: 53973 - protein, 11 aa, Borrelia garinii
LYSAYKAIVSS

SEQ ID NO: 53974 - protein, 11 aa, Borrelia garinii
YSAYKAIVSSI

SEQ ID NO: 53975 - protein, 11 aa, Borrelia garinii
SAYKAIVSSIL

SEQ ID NO: 53976 - protein, 11 aa, Borrelia garinii
AYKAIVSSILL

SEQ ID NO: 53977 - protein, 11 aa, Borrelia garinii
YKAIVSSILLM

SEQ ID NO: 53978 - protein, 11 aa, Borrelia garinii
KAIVSSILLMR

SEQ ID NO: 53979 - protein, 11 aa, Borrelia garinii
AIVSSILLMRD

SEQ ID NO: 53980 - protein, 11 aa, Borrelia garinii
IVSSILLMRDS

SEQ ID NO: 53981 - protein, 11 aa, Borrelia garinii
VSSILLMRDSL

SEQ ID NO: 53982 - protein, 11 aa, Borrelia garinii
SSILLMRDSLK

SEQ ID NO: 53983 - protein, 11 aa, Borrelia garinii
SILLMRDSLKE

SEQ ID NO: 53984 - protein, 11 aa, Borrelia garinii
ILLMRDSLKEV

SEQ ID NO: 53985 - protein, 11 aa, Borrelia garinii
LLMRDSLKEVQ

SEQ ID NO: 53986 - protein, 11 aa, Borrelia garinii
LMRDSLKEVQY

SEQ ID NO: 53987 - protein, 11 aa, Borrelia garinii
MRDSLKEVQYA

SEQ ID NO: 53988 - protein, 11 aa, Borrelia garinii
RDSLKEVQYAI

SEQ ID NO: 53989 - protein, 11 aa, Borrelia garinii
DSLKEVQYAID

SEQ ID NO: 53990 - protein, 11 aa, Borrelia garinii
SLKEVQYAIDK

SEQ ID NO: 53991 - protein, 11 aa, Borrelia garinii
LKEVQYAIDKN

SEQ ID NO: 53992 - protein, 11 aa, Borrelia garinii
KEVQYAIDKNG

SEQ ID NO: 53993 - protein, 11 aa, Borrelia garinii
EVQYAIDKNGI

SEQ ID NO: 53994 - protein, 11 aa, Borrelia garinii
VQYAIDKNGIW

SEQ ID NO: 53995 - protein, 11 aa, Borrelia garinii
QYAIDKNGIWY

SEQ ID NO: 53996 - protein, 11 aa, Borrelia garinii
YAIDKNGIWYR

SEQ ID NO: 53997 - protein, 11 aa, Borrelia garinii
AIDKNGIWYRK

SEQ ID NO: 53998 - protein, 11 aa, Borrelia garinii
IDKNGIWYRKL

SEQ ID NO: 53999 - protein, 11 aa, Borrelia garinii
DKNGIWYRKLD

SEQ ID NO: 54000 - protein, 11 aa, Borrelia garinii
KNGIWYRKLDA

SEQ ID NO: 54001 - protein, 11 aa, Borrelia garinii
NGIWYRKLDAI

SEQ ID NO: 54002 - protein, 11 aa, Borrelia garinii
GIWYRKLDAIE

SEQ ID NO: 54003 - protein, 11 aa, Borrelia garinii
IWYRKLDAIET

SEQ ID NO: 54004 - protein, 11 aa, Borrelia garinii
WYRKLDAIETE

SEQ ID NO: 54005 - protein, 11 aa, Borrelia garinii
YRKLDAIETEI

SEQ ID NO: 54006 - protein, 11 aa, Borrelia garinii
RKLDAIETEIK

SEQ ID NO: 54007 - protein, 11 aa, Borrelia garinii
KLDAIETEIKN

SEQ ID NO: 54008 - protein, 11 aa, Borrelia garinii
LDAIETEIKNL

SEQ ID NO: 54009 - protein, 11 aa, Borrelia garinii
DAIETEIKNLI

SEQ ID NO: 54010 - protein, 11 aa, Borrelia garinii
AIETEIKNLIL

SEQ ID NO: 54011 - protein, 11 aa, Borrelia garinii
IETEIKNLILK

SEQ ID NO: 54012 - protein, 11 aa, Borrelia garinii
ETEIKNLILKI

SEQ ID NO: 54013 - protein, 11 aa, Borrelia garinii
TEIKNLILKIK

SEQ ID NO: 54014 - protein, 11 aa, Borrelia garinii
EIKNLILKIKG

SEQ ID NO: 54015 - protein, 11 aa, Borrelia garinii
IKNLILKIKGQ

SEQ ID NO: 54016 - protein, 11 aa, Borrelia garinii
KNLILKIKGQS

SEQ ID NO: 54017 - protein, 11 aa, Borrelia garinii
NLILKIKGQSD

SEQ ID NO: 54018 - protein, 11 aa, Borrelia garinii
LILKIKGQSDL

SEQ ID NO: 54019 - protein, 11 aa, Borrelia garinii
ILKIKGQSDLY

SEQ ID NO: 54020 - protein, 11 aa, Borrelia garinii
LKIKGQSDLYE

SEQ ID NO: 54021 - protein, 11 aa, Borrelia garinii
KIKGQSDLYEA

SEQ ID NO: 54022 - protein, 11 aa, Borrelia garinii
IKGQSDLYEAY

SEQ ID NO: 54023 - protein, 11 aa, Borrelia garinii
KGQSDLYEAYK

SEQ ID NO: 54024 - protein, 11 aa, Borrelia garinii
GQSDLYEAYKA

SEQ ID NO: 54025 - protein, 11 aa, Borrelia garinii
QSDLYEAYKAI

SEQ ID NO: 54026 - protein, 11 aa, Borrelia garinii
SDLYEAYKAIV

SEQ ID NO: 54027 - protein, 11 aa, Borrelia garinii
DLYEAYKAIVR

SEQ ID NO: 54028 - protein, 11 aa, Borrelia garinii
LYEAYKAIVRS

SEQ ID NO: 54029 - protein, 11 aa, Borrelia garinii
YEAYKAIVRSI

SEQ ID NO: 54030 - protein, 11 aa, Borrelia garinii
EAYKAIVRSIL

SEQ ID NO: 54031 - protein, 11 aa, Borrelia garinii
AYKAIVRSILL

SEQ ID NO: 54032 - protein, 11 aa, Borrelia garinii
YKAIVRSILLM

SEQ ID NO: 54033 - protein, 11 aa, Borrelia garinii
KAIVRSILLMK

SEQ ID NO: 54034 - protein, 11 aa, Borrelia garinii
AIVRSILLMKD

SEQ ID NO: 54035 - protein, 11 aa, Borrelia garinii
IVRSILLMKDS

SEQ ID NO: 54036 - protein, 11 aa, Borrelia garinii
VRSILLMKDSL

SEQ ID NO: 54037 - protein, 11 aa, Borrelia garinii
RSILLMKDSLK

SEQ ID NO: 54038 - protein, 11 aa, Borrelia garinii
SILLMKDSLKI

SEQ ID NO: 54039 - protein, 11 aa, Borrelia garinii
ILLMKDSLKII

SEQ ID NO: 54040 - protein, 11 aa, Borrelia garinii
LLMKDSLKIIE

SEQ ID NO: 54041 - protein, 11 aa, Borrelia garinii
LMKDSLKIIEI

SEQ ID NO: 54042 - protein, 11 aa, Borrelia garinii
MKDSLKIIEIV

SEQ ID NO: 54043 - protein, 11 aa, Borrelia garinii
KDSLKIIEIVI

SEQ ID NO: 54044 - protein, 11 aa, Borrelia garinii
DSLKIIEIVID

SEQ ID NO: 54045 - protein, 11 aa, Borrelia garinii
SLKIIEIVIDK

SEQ ID NO: 54046 - protein, 11 aa, Borrelia garinii
LKIIEIVIDKN

SEQ ID NO: 54047 - protein, 11 aa, Borrelia garinii
KIIEIVIDKNG

SEQ ID NO: 54048 - protein, 11 aa, Borrelia garinii
IIEIVIDKNGV

SEQ ID NO: 54049 - protein, 11 aa, Borrelia garinii
IEIVIDKNGVW

SEQ ID NO: 54050 - protein, 11 aa, Borrelia garinii
EIVIDKNGVWY

SEQ ID NO: 54051 - protein, 9 aa, Borrelia burgdorferi B31
YSDEIDIIH

SEQ ID NO: 54052 - protein, 9 aa, Borrelia burgdorferi B31
IVDAFRYGY

SEQ ID NO: 54053 - protein, 10 aa, Borrelia burgdorferi B31
GSDLIWLIGY

SEQ ID NO: 54054 - protein, 10 aa, Borrelia burgdorferi B31
YSDEIDIIHH

SEQ ID NO: 54055 - protein, 11 aa, Borrelia burgdorferi B31
YSDEIDIIHHA

SEQ ID NO: 54056 - protein, 11 aa, Borrelia burgdorferi B31
FTSNHLKTNTF

SEQ ID NO: 54057 - protein, 9 aa, Borrelia burgdorferi B31
ILLESIVFL

SEQ ID NO: 54058 - protein, 9 aa, Borrelia burgdorferi B31
SLGSEIPKV

SEQ ID NO: 54059 - protein, 9 aa, Borrelia burgdorferi B31
LLLILLESI

SEQ ID NO: 54060 - protein, 9 aa, Borrelia burgdorferi B31
NLVGMTFRA

SEQ ID NO: 54061 - protein, 9 aa, Borrelia burgdorferi B31
YLAPDNVIT

SEQ ID NO: 54062 - protein, 9 aa, Borrelia burgdorferi B31
RMYSDEIDI

SEQ ID NO: 54063 - protein, 9 aa, Borrelia burgdorferi B31
GVDEDQAYL

SEQ ID NO: 54064 - protein, 9 aa, Borrelia burgdorferi B31
KIINKEIIV

SEQ ID NO: 54065 - protein, 9 aa, Borrelia burgdorferi B31
FLGGIEGEI

SEQ ID NO: 54066 - protein, 9 aa, Borrelia burgdorferi B31
LLILLESIV

SEQ ID NO: 54067 - protein, 9 aa, Borrelia burgdorferi B31
ILLLILLES

SEQ ID NO: 54068 - protein, 9 aa, Borrelia burgdorferi B31
FLTGYIAAK

SEQ ID NO: 54069 - protein, 9 aa, Borrelia burgdorferi B31
LLESIVFLS

SEQ ID NO: 54070 - protein, 9 aa, Borrelia burgdorferi B31
GSGHYIIGV

SEQ ID NO: 54071 - protein, 9 aa, Borrelia burgdorferi B31
YIAAKLSKT

SEQ ID NO: 54072 - protein, 9 aa, Borrelia burgdorferi B31
LIGYRFSDV

SEQ ID NO: 54073 - protein, 10 aa, Borrelia burgdorferi B31
FLTGYIAAKL

SEQ ID NO: 54074 - protein, 10 aa, Borrelia burgdorferi B31
ILLLILLESI

SEQ ID NO: 54075 - protein, 10 aa, Borrelia burgdorferi B31
RMYSDEIDII

SEQ ID NO: 54076 - protein, 10 aa, Borrelia burgdorferi B31
FLGGIEGEIV

SEQ ID NO: 54077 - protein, 10 aa, Borrelia burgdorferi B31
WLIGYRFSDV

SEQ ID NO: 54078 - protein, 10 aa, Borrelia burgdorferi B31
LLLILLESIV

SEQ ID NO: 54079 - protein, 10 aa, Borrelia burgdorferi B31
ILLESIVFLS

SEQ ID NO: 54080 - protein, 10 aa, Borrelia burgdorferi B31
GLGGIGAIEV

SEQ ID NO: 54081 - protein, 10 aa, Borrelia burgdorferi B31
YLAPDNVITS

SEQ ID NO: 54082 - protein, 10 aa, Borrelia burgdorferi B31
LILLESIVFL

SEQ ID NO: 54083 - protein, 10 aa, Borrelia burgdorferi B31
FLSCSGKGSL

SEQ ID NO: 54084 - protein, 10 aa, Borrelia burgdorferi B31
YIGSFADLEA

SEQ ID NO: 54085 - protein, 10 aa, Borrelia burgdorferi B31
GLKEGVVGFV

SEQ ID NO: 54086 - protein, 10 aa, Borrelia burgdorferi B31
ALNIFTSNHL

SEQ ID NO: 54087 - protein, 10 aa, Borrelia burgdorferi B31
LINYGLKEGV

SEQ ID NO: 54088 - protein, 10 aa, Borrelia burgdorferi B31
YIIGVDEDQA

SEQ ID NO: 54089 - protein, 10 aa, Borrelia burgdorferi B31
ALQNPDMKYA

SEQ ID NO: 54090 - protein, 10 aa, Borrelia burgdorferi B31
MISFELEKEI

SEQ ID NO: 54091 - protein, 10 aa, Borrelia burgdorferi B31
GVDEDQAYLA

SEQ ID NO: 54092 - protein, 11 aa, Borrelia burgdorferi B31
YLAPDNVITST

SEQ ID NO: 54093 - protein, 11 aa, Borrelia burgdorferi B31
KLINYGLKEGV

SEQ ID NO: 54094 - protein, 11 aa, Borrelia burgdorferi B31
ILLLILLESIV

SEQ ID NO: 54095 - protein, 11 aa, Borrelia burgdorferi B31
KMISFELEKEI

SEQ ID NO: 54096 - protein, 11 aa, Borrelia burgdorferi B31
KILLLILLESI

SEQ ID NO: 54097 - protein, 11 aa, Borrelia burgdorferi B31
LLILLESIVFL

SEQ ID NO: 54098 - protein, 11 aa, Borrelia burgdorferi B31
SLGSEIPKVSL

SEQ ID NO: 54099 - protein, 11 aa, Borrelia burgdorferi B31
WLIGYRFSDVA

SEQ ID NO: 54100 - protein, 11 aa, Borrelia burgdorferi B31
YLSDLEGLKDA

SEQ ID NO: 54101 - protein, 11 aa, Borrelia burgdorferi B31
ILLESIVFLSC

SEQ ID NO: 54102 - protein, 11 aa, Borrelia burgdorferi B31
VLKESSSNSYL

SEQ ID NO: 54103 - protein, 11 aa, Borrelia burgdorferi B31
IIDPIYSNDPI

SEQ ID NO: 54104 - protein, 11 aa, Borrelia burgdorferi B31
NLSSKIINKEI

SEQ ID NO: 54105 - protein, 11 aa, Borrelia burgdorferi B31
ALQNPDMKYAI

SEQ ID NO: 54106 - protein, 11 aa, Borrelia burgdorferi B31
MTFRAQEGAFL

SEQ ID NO: 54107 - protein, 11 aa, Borrelia burgdorferi B31
KSFNESALNGV

SEQ ID NO: 54108 - protein, 11 aa, Borrelia burgdorferi B31
ELGSGHYIIGV

SEQ ID NO: 54109 - protein, 11 aa, Borrelia burgdorferi B31
KLSKTGKIGFL

SEQ ID NO: 54110 - protein, 11 aa, Borrelia burgdorferi B31
KISTQYIGSFA

SEQ ID NO: 54111 - protein, 11 aa, Borrelia burgdorferi B31
SVATRMYSDEI

SEQ ID NO: 54112 - protein, 11 aa, Borrelia burgdorferi B31
FLTGYIAAKLS

SEQ ID NO: 54113 - protein, 11 aa, Borrelia burgdorferi B31
GLGGIGAIEVA

SEQ ID NO: 54114 - protein, 11 aa, Borrelia burgdorferi B31
YSDEIDIIHHA

SEQ ID NO: 54115 - protein, 11 aa, Borrelia burgdorferi B31
YSNDPIPANLV

SEQ ID NO: 54116 - protein, 11 aa, Borrelia burgdorferi B31
IVDAFRYGYEA

SEQ ID NO: 54117 - protein, 9 aa, Borrelia burgdorferi B31
IVFLSCSGK

SEQ ID NO: 54118 - protein, 9 aa, Borrelia burgdorferi B31
KMISFELEK

SEQ ID NO: 54119 - protein, 9 aa, Borrelia burgdorferi B31
NLSSKIINK

SEQ ID NO: 54120 - protein, 9 aa, Borrelia burgdorferi B31
NIFTSNHLK

SEQ ID NO: 54121 - protein, 9 aa, Borrelia burgdorferi B31
FLTGYIAAK

SEQ ID NO: 54122 - protein, 9 aa, Borrelia burgdorferi B31
ALNGVKKVK

SEQ ID NO: 54123 - protein, 9 aa, Borrelia burgdorferi B31
KTNTFEGGK

SEQ ID NO: 54124 - protein, 9 aa, Borrelia burgdorferi B31
VVGFVRNPK

SEQ ID NO: 54125 - protein, 9 aa, Borrelia burgdorferi B31
GSLGSEIPK

SEQ ID NO: 54126 - protein, 9 aa, Borrelia burgdorferi B31
GIGAIEVAK

SEQ ID NO: 54127 - protein, 9 aa, Borrelia burgdorferi B31
YLSDLEGLK

SEQ ID NO: 54128 - protein, 9 aa, Borrelia burgdorferi B31
ALQNPDMKY

SEQ ID NO: 54129 - protein, 10 aa, Borrelia burgdorferi B31
SIVFLSCSGK

SEQ ID NO: 54130 - protein, 10 aa, Borrelia burgdorferi B31
TGYIAAKLSK

SEQ ID NO: 54131 - protein, 10 aa, Borrelia burgdorferi B31
GVVGFVRNPK

SEQ ID NO: 54132 - protein, 10 aa, Borrelia burgdorferi B31
AFLTGYIAAK

SEQ ID NO: 54133 - protein, 10 aa, Borrelia burgdorferi B31
LIIDGTFDDK

SEQ ID NO: 54134 - protein, 10 aa, Borrelia burgdorferi B31
SALNGVKKVK

SEQ ID NO: 54135 - protein, 10 aa, Borrelia burgdorferi B31
LNIFTSNHLK

SEQ ID NO: 54136 - protein, 10 aa, Borrelia burgdorferi B31
IAAKLSKTGK

SEQ ID NO: 54137 - protein, 10 aa, Borrelia burgdorferi B31
GVKKVKEEFK

SEQ ID NO: 54138 - protein, 10 aa, Borrelia burgdorferi B31
KGSLGSEIPK

SEQ ID NO: 54139 - protein, 10 aa, Borrelia burgdorferi B31
SYLSDLEGLK

SEQ ID NO: 54140 - protein, 10 aa, Borrelia burgdorferi B31
IGYRFSDVAK

SEQ ID NO: 54141 - protein, 10 aa, Borrelia burgdorferi B31
FRYGYEAGAK

SEQ ID NO: 54142 - protein, 10 aa, Borrelia burgdorferi B31
RYGYEAGAKY

SEQ ID NO: 54143 - protein, 11 aa, Borrelia burgdorferi B31
ALNIFTSNHLK

SEQ ID NO: 54144 - protein, 11 aa, Borrelia burgdorferi B31
LTGYIAAKLSK

SEQ ID NO: 54145 - protein, 11 aa, Borrelia burgdorferi B31
HLKTNTFEGGK

SEQ ID NO: 54146 - protein, 11 aa, Borrelia burgdorferi B31
RMYSDEIDIIH

SEQ ID NO: 54147 - protein, 11 aa, Borrelia burgdorferi B31
YIAAKLSKTGK

SEQ ID NO: 54148 - protein, 11 aa, Borrelia burgdorferi B31
KVAALQNPDMK

SEQ ID NO: 54149 - protein, 11 aa, Borrelia burgdorferi B31
GAFLTGYIAAK

SEQ ID NO: 54150 - protein, 11 aa, Borrelia burgdorferi B31
NSYLSDLEGLK

SEQ ID NO: 54151 - protein, 11 aa, Borrelia burgdorferi B31
LIGYRFSDVAK

SEQ ID NO: 54152 - protein, 11 aa, Borrelia burgdorferi B31
SFNESALNGVK

SEQ ID NO: 54153 - protein, 11 aa, Borrelia burgdorferi B31
SLIIDGTFDDK

SEQ ID NO: 54154 - protein, 9 aa, Borrelia burgdorferi B31
KMISFELEK

SEQ ID NO: 54155 - protein, 9 aa, Borrelia burgdorferi B31
IVFLSCSGK

SEQ ID NO: 54156 - protein, 9 aa, Borrelia burgdorferi B31
NIFTSNHLK

SEQ ID NO: 54157 - protein, 9 aa, Borrelia burgdorferi B31
KTNTFEGGK

SEQ ID NO: 54158 - protein, 9 aa, Borrelia burgdorferi B31
VVGFVRNPK

SEQ ID NO: 54159 - protein, 9 aa, Borrelia burgdorferi B31
GSLGSEIPK

SEQ ID NO: 54160 - protein, 9 aa, Borrelia burgdorferi B31
GIGAIEVAK

SEQ ID NO: 54161 - protein, 9 aa, Borrelia burgdorferi B31
AALQNPDMK

SEQ ID NO: 54162 - protein, 9 aa, Borrelia burgdorferi B31
NLSSKIINK

SEQ ID NO: 54163 - protein, 9 aa, Borrelia burgdorferi B31
IVDAFRYGY

SEQ ID NO: 54164 - protein, 9 aa, Borrelia burgdorferi B31
YLSDLEGLK

SEQ ID NO: 54165 - protein, 9 aa, Borrelia burgdorferi B31
GYIAAKLSK

SEQ ID NO: 54166 - protein, 9 aa, Borrelia burgdorferi B31
PSNKESYEK

SEQ ID NO: 54167 - protein, 9 aa, Borrelia burgdorferi B31
ALNGVKKVK

SEQ ID NO: 54168 - protein, 9 aa, Borrelia burgdorferi B31
IIDGTFDDK

SEQ ID NO: 54169 - protein, 9 aa, Borrelia burgdorferi B31
AAKLSKTGK

SEQ ID NO: 54170 - protein, 9 aa, Borrelia burgdorferi B31
FLTGYIAAK

SEQ ID NO: 54171 - protein, 9 aa, Borrelia burgdorferi B31
ESALNGVKK

SEQ ID NO: 54172 - protein, 9 aa, Borrelia burgdorferi B31
KESYEKFLK

SEQ ID NO: 54173 - protein, 9 aa, Borrelia burgdorferi B31
ALQNPDMKY

SEQ ID NO: 54174 - protein, 9 aa, Borrelia burgdorferi B31
KEIIVPSNK

SEQ ID NO: 54175 - protein, 9 aa, Borrelia burgdorferi B31
KEIDNLSSK

SEQ ID NO: 54176 - protein, 9 aa, Borrelia burgdorferi B31
EAGAKYANK

SEQ ID NO: 54177 - protein, 10 aa, Borrelia burgdorferi B31
SIVFLSCSGK

SEQ ID NO: 54178 - protein, 10 aa, Borrelia burgdorferi B31
GVVGFVRNPK

SEQ ID NO: 54179 - protein, 10 aa, Borrelia burgdorferi B31
LIIDGTFDDK

SEQ ID NO: 54180 - protein, 10 aa, Borrelia burgdorferi B31
SALNGVKKVK

SEQ ID NO: 54181 - protein, 10 aa, Borrelia burgdorferi B31
GVKKVKEEFK

SEQ ID NO: 54182 - protein, 10 aa, Borrelia burgdorferi B31
VAALQNPDMK

SEQ ID NO: 54183 - protein, 10 aa, Borrelia burgdorferi B31
SYLSDLEGLK

SEQ ID NO: 54184 - protein, 10 aa, Borrelia burgdorferi B31
GSFADLEAGR

SEQ ID NO: 54185 - protein, 10 aa, Borrelia burgdorferi B31
IAAKLSKTGK

SEQ ID NO: 54186 - protein, 10 aa, Borrelia burgdorferi B31
TGYIAAKLSK

SEQ ID NO: 54187 - protein, 10 aa, Borrelia burgdorferi B31
AFLTGYIAAK

SEQ ID NO: 54188 - protein, 10 aa, Borrelia burgdorferi B31
IGYRFSDVAK

SEQ ID NO: 54189 - protein, 10 aa, Borrelia burgdorferi B31
ITSTTKDVGR

SEQ ID NO: 54190 - protein, 10 aa, Borrelia burgdorferi B31
KGSLGSEIPK

SEQ ID NO: 54191 - protein, 10 aa, Borrelia burgdorferi B31
LNIFTSNHLK

SEQ ID NO: 54192 - protein, 10 aa, Borrelia burgdorferi B31
PANLVGMTFR

SEQ ID NO: 54193 - protein, 10 aa, Borrelia burgdorferi B31
GSDLIWLIGY

SEQ ID NO: 54194 - protein, 10 aa, Borrelia burgdorferi B31
AALQNPDMKY

SEQ ID NO: 54195 - protein, 11 aa, Borrelia burgdorferi B31
ALNIFTSNHLK

SEQ ID NO: 54196 - protein, 11 aa, Borrelia burgdorferi B31
KVAALQNPDMK

SEQ ID NO: 54197 - protein, 11 aa, Borrelia burgdorferi B31
GAFLTGYIAAK

SEQ ID NO: 54198 - protein, 11 aa, Borrelia burgdorferi B31
NSYLSDLEGLK

SEQ ID NO: 54199 - protein, 11 aa, Borrelia burgdorferi B31
LTGYIAAKLSK

SEQ ID NO: 54200 - protein, 11 aa, Borrelia burgdorferi B31
SLIIDGTFDDK

SEQ ID NO: 54201 - protein, 11 aa, Borrelia burgdorferi B31
YIAAKLSKTGK

SEQ ID NO: 54202 - protein, 11 aa, Borrelia burgdorferi B31
IVPSNKESYEK

SEQ ID NO: 54203 - protein, 11 aa, Borrelia burgdorferi B31
SFNESALNGVK

SEQ ID NO: 54204 - protein, 11 aa, Borrelia burgdorferi B31
ESIVFLSCSGK

SEQ ID NO: 54205 - protein, 11 aa, Borrelia burgdorferi B31
LIGYRFSDVAK

SEQ ID NO: 54206 - protein, 11 aa, Borrelia burgdorferi B31
GSDLIWLIGYR

SEQ ID NO: 54207 - protein, 11 aa, Borrelia burgdorferi B31
RAQEGAFLTGY

SEQ ID NO: 54208 - protein, 11 aa, Borrelia burgdorferi B31
NTFEGGKLINY

SEQ ID NO: 54209 - protein, 11 aa, Borrelia burgdorferi B31
HLKTNTFEGGK

SEQ ID NO: 54210 - protein, 11 aa, Borrelia burgdorferi B31
SNKESYEKFLK

SEQ ID NO: 54211 - protein, 9 aa, Borrelia burgdorferi B31
KYANKDIKI

SEQ ID NO: 54212 - protein, 9 aa, Borrelia burgdorferi B31
SYEKFLKEF

SEQ ID NO: 54213 - protein, 9 aa, Borrelia burgdorferi B31
QYIGSFADL

SEQ ID NO: 54214 - protein, 9 aa, Borrelia burgdorferi B31
MYSDEIDII

SEQ ID NO: 54215 - protein, 9 aa, Borrelia burgdorferi B31
AYLAPDNVI

SEQ ID NO: 54216 - protein, 9 aa, Borrelia burgdorferi B31
SYLSDLEGL

SEQ ID NO: 54217 - protein, 9 aa, Borrelia burgdorferi B31
GFVRNPKMI

SEQ ID NO: 54218 - protein, 9 aa, Borrelia burgdorferi B31
KYAIIDPIY

SEQ ID NO: 54219 - protein, 10 aa, Borrelia burgdorferi B31
SYEKFLKEFI

SEQ ID NO: 54220 - protein, 10 aa, Borrelia burgdorferi B31
SYLSDLEGLK

SEQ ID NO: 54221 - protein, 11 aa, Borrelia burgdorferi B31
IYSNDPIPANL

SEQ ID NO: 54222 - protein, 11 aa, Borrelia burgdorferi B31
NYGLKEGVVGF

SEQ ID NO: 54223 - protein, 11 aa, Borrelia burgdorferi B31
GFVRNPKMISF

SEQ ID NO: 54224 - protein, 11 aa, Borrelia burgdorferi B31
AFLTGYIAAKL

SEQ ID NO: 54225 - protein, 11 aa, Borrelia burgdorferi B31
VFLSCSGKGSL

SEQ ID NO: 54226 - protein, 9 aa, Borrelia burgdorferi B31
KYAIIDPIY

SEQ ID NO: 54227 - protein, 9 aa, Borrelia burgdorferi B31
ALQNPDMKY

SEQ ID NO: 54228 - protein, 9 aa, Borrelia burgdorferi B31
YGYEAGAKY

SEQ ID NO: 54229 - protein, 9 aa, Borrelia burgdorferi B31
KDIKISTQY

SEQ ID NO: 54230 - protein, 9 aa, Borrelia burgdorferi B31
IVPSNKESY

SEQ ID NO: 54231 - protein, 9 aa, Borrelia burgdorferi B31
IVDAFRYGY

SEQ ID NO: 54232 - protein, 9 aa, Borrelia burgdorferi B31
GEIVDAFRY

SEQ ID NO: 54233 - protein, 9 aa, Borrelia burgdorferi B31
LIWLIGYRF

SEQ ID NO: 54234 - protein, 9 aa, Borrelia burgdorferi B31
IGVDEDQAY

SEQ ID NO: 54235 - protein, 10 aa, Borrelia burgdorferi B31
RYGYEAGAKY

SEQ ID NO: 54236 - protein, 10 aa, Borrelia burgdorferi B31
IIGVDEDQAY

SEQ ID NO: 54237 - protein, 10 aa, Borrelia burgdorferi B31
VAKELGSGHY

SEQ ID NO: 54238 - protein, 10 aa, Borrelia burgdorferi B31
TFEGGKLINY

SEQ ID NO: 54239 - protein, 10 aa, Borrelia burgdorferi B31
EIVDAFRYGY

SEQ ID NO: 54240 - protein, 10 aa, Borrelia burgdorferi B31
LLILLESIVF

SEQ ID NO: 54241 - protein, 10 aa, Borrelia burgdorferi B31
FVRNPKMISF

SEQ ID NO: 54242 - protein, 11 aa, Borrelia burgdorferi B31
YIIGVDEDQAY

SEQ ID NO: 54243 - protein, 11 aa, Borrelia burgdorferi B31
EIIVPSNKESY

SEQ ID NO: 54244 - protein, 11 aa, Borrelia burgdorferi B31
EVAKELGSGHY

SEQ ID NO: 54245 - protein, 11 aa, Borrelia burgdorferi B31
VAALQNPDMKY

SEQ ID NO: 54246 - protein, 11 aa, Borrelia burgdorferi B31
RAQEGAFLTGY

SEQ ID NO: 54247 - protein, 11 aa, Borrelia burgdorferi B31
LVLKESSSNSY

SEQ ID NO: 54248 - protein, 11 aa, Borrelia burgdorferi B31
NTFEGGKLINY

SEQ ID NO: 54249 - protein, 9 aa, Borrelia burgdorferi B31
NIFTSNHLK

SEQ ID NO: 54250 - protein, 9 aa, Borrelia burgdorferi B31
DLIWLIGYR

SEQ ID NO: 54251 - protein, 9 aa, Borrelia burgdorferi B31
IVFLSCSGK

SEQ ID NO: 54252 - protein, 9 aa, Borrelia burgdorferi B31
EAGRSVATR

SEQ ID NO: 54253 - protein, 9 aa, Borrelia burgdorferi B31
ESALNGVKK

SEQ ID NO: 54254 - protein, 9 aa, Borrelia burgdorferi B31
FLTGYIAAK

SEQ ID NO: 54255 - protein, 9 aa, Borrelia burgdorferi B31
EGEIVDAFR

SEQ ID NO: 54256 - protein, 9 aa, Borrelia burgdorferi B31
TSTTKDVGR

SEQ ID NO: 54257 - protein, 9 aa, Borrelia burgdorferi B31
KTNTFEGGK

SEQ ID NO: 54258 - protein, 9 aa, Borrelia burgdorferi B31
YLSDLEGLK

SEQ ID NO: 54259 - protein, 9 aa, Borrelia burgdorferi B31
SFADLEAGR

SEQ ID NO: 54260 - protein, 9 aa, Borrelia burgdorferi B31
DVAKVAALQ

SEQ ID NO: 54261 - protein, 9 aa, Borrelia burgdorferi B31
VVGFVRNPK

SEQ ID NO: 54262 - protein, 9 aa, Borrelia burgdorferi B31
EAGAKYANK

SEQ ID NO: 54263 - protein, 9 aa, Borrelia burgdorferi B31
KMISFELEK

SEQ ID NO: 54264 - protein, 9 aa, Borrelia burgdorferi B31
NLSSKIINK

SEQ ID NO: 54265 - protein, 9 aa, Borrelia burgdorferi B31
EFKIELVLK

SEQ ID NO: 54266 - protein, 9 aa, Borrelia burgdorferi B31
DNVITSTTK

SEQ ID NO: 54267 - protein, 9 aa, Borrelia burgdorferi B31
ESSSNSYLS

SEQ ID NO: 54268 - protein, 10 aa, Borrelia burgdorferi B31
SIVFLSCSGK

SEQ ID NO: 54269 - protein, 10 aa, Borrelia burgdorferi B31
ITSTTKDVGR

SEQ ID NO: 54270 - protein, 10 aa, Borrelia burgdorferi B31
EEFKIELVLK

SEQ ID NO: 54271 - protein, 10 aa, Borrelia burgdorferi B31
GSFADLEAGR

SEQ ID NO: 54272 - protein, 10 aa, Borrelia burgdorferi B31
LNIFTSNHLK

SEQ ID NO: 54273 - protein, 10 aa, Borrelia burgdorferi B31
GVVGFVRNPK

SEQ ID NO: 54274 - protein, 10 aa, Borrelia burgdorferi B31
EIVDAFRYGY

SEQ ID NO: 54275 - protein, 10 aa, Borrelia burgdorferi B31
LIIDGTFDDK

SEQ ID NO: 54276 - protein, 10 aa, Borrelia burgdorferi B31
IAAKLSKTGK

SEQ ID NO: 54277 - protein, 10 aa, Borrelia burgdorferi B31
GVKKVKEEFK

SEQ ID NO: 54278 - protein, 10 aa, Borrelia burgdorferi B31
VAALQNPDMK

SEQ ID NO: 54279 - protein, 10 aa, Borrelia burgdorferi B31
PANLVGMTFR

SEQ ID NO: 54280 - protein, 10 aa, Borrelia burgdorferi B31
MTFRAQEGAF

SEQ ID NO: 54281 - protein, 10 aa, Borrelia burgdorferi B31
TGYIAAKLSK

SEQ ID NO: 54282 - protein, 10 aa, Borrelia burgdorferi B31
IGYRFSDVAK

SEQ ID NO: 54283 - protein, 10 aa, Borrelia burgdorferi B31
MKYAIIDPIY

SEQ ID NO: 54284 - protein, 10 aa, Borrelia burgdorferi B31
LEAGRSVATR

SEQ ID NO: 54285 - protein, 10 aa, Borrelia burgdorferi B31
YEAGAKYANK

SEQ ID NO: 54286 - protein, 10 aa, Borrelia burgdorferi B31
IEGEIVDAFR

SEQ ID NO: 54287 - protein, 11 aa, Borrelia burgdorferi B31
ESIVFLSCSGK

SEQ ID NO: 54288 - protein, 11 aa, Borrelia burgdorferi B31
NSYLSDLEGLK

SEQ ID NO: 54289 - protein, 11 aa, Borrelia burgdorferi B31
IPANLVGMTFR

SEQ ID NO: 54290 - protein, 11 aa, Borrelia burgdorferi B31
YIAAKLSKTGK

SEQ ID NO: 54291 - protein, 11 aa, Borrelia burgdorferi B31
ESALNGVKKVK

SEQ ID NO: 54292 - protein, 11 aa, Borrelia burgdorferi B31
LTGYIAAKLSK

SEQ ID NO: 54293 - protein, 11 aa, Borrelia burgdorferi B31
IVPSNKESYEK

SEQ ID NO: 54294 - protein, 11 aa, Borrelia burgdorferi B31
NPKMISFELEK

SEQ ID NO: 54295 - protein, 11 aa, Borrelia burgdorferi B31
DLEAGRSVATR

SEQ ID NO: 54296 - protein, 11 aa, Borrelia burgdorferi B31
GIEGEIVDAFR

SEQ ID NO: 54297 - protein, 11 aa, Borrelia burgdorferi B31
GAFLTGYIAAK

SEQ ID NO: 54298 - protein, 11 aa, Borrelia burgdorferi B31
VITSTTKDVGR

SEQ ID NO: 54299 - protein, 11 aa, Borrelia burgdorferi B31
HLKTNTFEGGK

SEQ ID NO: 54300 - protein, 11 aa, Borrelia burgdorferi B31
ALNIFTSNHLK

SEQ ID NO: 54301 - protein, 11 aa, Borrelia burgdorferi B31
KVAALQNPDMK

SEQ ID NO: 54302 - protein, 11 aa, Borrelia burgdorferi B31
MTFRAQEGAFL

SEQ ID NO: 54303 - protein, 11 aa, Borrelia burgdorferi B31
NTFEGGKLINY

SEQ ID NO: 54304 - protein, 11 aa, Borrelia burgdorferi B31
EVAKELGSGHY

SEQ ID NO: 54305 - protein, 11 aa, Borrelia burgdorferi B31
IGSFADLEAGR

SEQ ID NO: 54306 - protein, 11 aa, Borrelia burgdorferi B31
EIIVPSNKESY

SEQ ID NO: 54307 - protein, 11 aa, Borrelia burgdorferi B31
LIGYRFSDVAK

SEQ ID NO: 54308 - protein, 11 aa, Borrelia burgdorferi B31
SLIIDGTFDDK

SEQ ID NO: 54309 - protein, 11 aa, Borrelia burgdorferi B31
EGVVGFVRNPK

SEQ ID NO: 54310 - protein, 11 aa, Borrelia burgdorferi B31
YIIGVDEDQAY

SEQ ID NO: 54311 - protein, 11 aa, Borrelia burgdorferi B31
SFNESALNGVK

SEQ ID NO: 54312 - protein, 11 aa, Borrelia burgdorferi B31
GSDLIWLIGYR

SEQ ID NO: 54313 - protein, 9 aa, Borrelia burgdorferi B31
APDNVITST

SEQ ID NO: 54314 - protein, 9 aa, Borrelia burgdorferi B31
IPANLVGMT

SEQ ID NO: 54315 - protein, 9 aa, Borrelia burgdorferi B31
NPKMISFEL

SEQ ID NO: 54316 - protein, 9 aa, Borrelia burgdorferi B31
DPIYSNDPI

SEQ ID NO: 54317 - protein, 9 aa, Borrelia burgdorferi B31
TTKDVGRAL

SEQ ID NO: 54318 - protein, 9 aa, Borrelia burgdorferi B31
NPDMKYAII

SEQ ID NO: 54319 - protein, 10 aa, Borrelia burgdorferi B31
IPANLVGMTF

SEQ ID NO: 54320 - protein, 10 aa, Borrelia burgdorferi B31
FVRNPKMISF

SEQ ID NO: 54321 - protein, 10 aa, Borrelia burgdorferi B31
APDNVITSTT

SEQ ID NO: 54322 - protein, 11 aa, Borrelia burgdorferi B31
VPSNKESYEKF

SEQ ID NO: 54323 - protein, 11 aa, Borrelia burgdorferi B31
RALNIFTSNHL

SEQ ID NO: 54324 - protein, 11 aa, Borrelia burgdorferi B31
HAAGLGGIGAI

SEQ ID NO: 54325 - protein, 9 aa, Borrelia burgdorferi B31
NPKMISFEL

SEQ ID NO: 54326 - protein, 10 aa, Borrelia burgdorferi B31
FVRNPKMISF

SEQ ID NO: 54327 - protein, 9 aa, Borrelia burgdorferi B31
GLKEGVVGF

SEQ ID NO: 54328 - protein, 9 aa, Borrelia burgdorferi B31
YGYEAGAKY

SEQ ID NO: 54329 - protein, 9 aa, Borrelia burgdorferi B31
ALQNPDMKY

SEQ ID NO: 54330 - protein, 9 aa, Borrelia burgdorferi B31
ISTQYIGSF

SEQ ID NO: 54331 - protein, 9 aa, Borrelia burgdorferi B31
IGVDEDQAY

SEQ ID NO: 54332 - protein, 9 aa, Borrelia burgdorferi B31
LILLESIVF

SEQ ID NO: 54333 - protein, 9 aa, Borrelia burgdorferi B31
TFRAQEGAF

SEQ ID NO: 54334 - protein, 9 aa, Borrelia burgdorferi B31
LSKTGKIGF

SEQ ID NO: 54335 - protein, 9 aa, Borrelia burgdorferi B31
TTKDVGRAL

SEQ ID NO: 54336 - protein, 9 aa, Borrelia burgdorferi B31
VSLIIDGTF

SEQ ID NO: 54337 - protein, 9 aa, Borrelia burgdorferi B31
SNHLKTNTF

SEQ ID NO: 54338 - protein, 10 aa, Borrelia burgdorferi B31
VLKESSSNSY

SEQ ID NO: 54339 - protein, 10 aa, Borrelia burgdorferi B31
FVRNPKMISF

SEQ ID NO: 54340 - protein, 10 aa, Borrelia burgdorferi B31
LLILLESIVF

SEQ ID NO: 54341 - protein, 10 aa, Borrelia burgdorferi B31
AQEGAFLTGY

SEQ ID NO: 54342 - protein, 10 aa, Borrelia burgdorferi B31
VAKELGSGHY

SEQ ID NO: 54343 - protein, 10 aa, Borrelia burgdorferi B31
MTFRAQEGAF

SEQ ID NO: 54344 - protein, 10 aa, Borrelia burgdorferi B31
KLSKTGKIGF

SEQ ID NO: 54345 - protein, 10 aa, Borrelia burgdorferi B31
TQYIGSFADL

SEQ ID NO: 54346 - protein, 10 aa, Borrelia burgdorferi B31
KVSLIIDGTF

SEQ ID NO: 54347 - protein, 10 aa, Borrelia burgdorferi B31
IIVPSNKESY

SEQ ID NO: 54348 - protein, 10 aa, Borrelia burgdorferi B31
KISTQYIGSF

SEQ ID NO: 54349 - protein, 10 aa, Borrelia burgdorferi B31
TSNHLKTNTF

SEQ ID NO: 54350 - protein, 10 aa, Borrelia burgdorferi B31
YGLKEGVVGF

SEQ ID NO: 54351 - protein, 10 aa, Borrelia burgdorferi B31
IIGVDEDQAY

SEQ ID NO: 54352 - protein, 10 aa, Borrelia burgdorferi B31
KVAALQNPDM

SEQ ID NO: 54353 - protein, 10 aa, Borrelia burgdorferi B31
LQNPDMKYAI

SEQ ID NO: 54354 - protein, 10 aa, Borrelia burgdorferi B31
MKYAIIDPIY

SEQ ID NO: 54355 - protein, 10 aa, Borrelia burgdorferi B31
FLSCSGKGSL

SEQ ID NO: 54356 - protein, 11 aa, Borrelia burgdorferi B31
YIIGVDEDQAY

SEQ ID NO: 54357 - protein, 11 aa, Borrelia burgdorferi B31
LVLKESSSNSY

SEQ ID NO: 54358 - protein, 11 aa, Borrelia burgdorferi B31
GMTFRAQEGAF

SEQ ID NO: 54359 - protein, 11 aa, Borrelia burgdorferi B31
RAQEGAFLTGY

SEQ ID NO: 54360 - protein, 11 aa, Borrelia burgdorferi B31
FTSNHLKTNTF

SEQ ID NO: 54361 - protein, 11 aa, Borrelia burgdorferi B31
LLLILLESIVF

SEQ ID NO: 54362 - protein, 11 aa, Borrelia burgdorferi B31
NTFEGGKLINY

SEQ ID NO: 54363 - protein, 11 aa, Borrelia burgdorferi B31
VLKESSSNSYL

SEQ ID NO: 54364 - protein, 11 aa, Borrelia burgdorferi B31
DMKYAIIDPIY

SEQ ID NO: 54365 - protein, 11 aa, Borrelia burgdorferi B31
GGIEGEIVDAF

SEQ ID NO: 54366 - protein, 11 aa, Borrelia burgdorferi B31
RMYSDEIDIIH

SEQ ID NO: 54367 - protein, 11 aa, Borrelia burgdorferi B31
EIIVPSNKESY

SEQ ID NO: 54368 - protein, 11 aa, Borrelia burgdorferi B31
VAALQNPDMKY

SEQ ID NO: 54369 - protein, 11 aa, Borrelia burgdorferi B31
EVAKELGSGHY

SEQ ID NO: 54370 - protein, 9 aa, Borrelia burgdorferi B31
FRYGYEAGA

SEQ ID NO: 54371 - protein, 9 aa, Borrelia burgdorferi B31
YRFSDVAKV

SEQ ID NO: 54372 - protein, 9 aa, Borrelia burgdorferi B31
VRNPKMISF

SEQ ID NO: 54373 - protein, 9 aa, Borrelia burgdorferi B31
GRSVATRMY

SEQ ID NO: 54374 - protein, 9 aa, Borrelia burgdorferi B31
FRAQEGAFL

SEQ ID NO: 54375 - protein, 10 aa, Borrelia burgdorferi B31
FRYGYEAGAK

SEQ ID NO: 54376 - protein, 10 aa, Borrelia burgdorferi B31
YRFSDVAKVA

SEQ ID NO: 54377 - protein, 11 aa, Borrelia burgdorferi B31
YRFSDVAKVAA

SEQ ID NO: 54378 - protein, 11 aa, Borrelia burgdorferi B31
GRALNIFTSNH

SEQ ID NO: 54379 - protein, 9 aa, Borrelia burgdorferi B31
IGVDEDQAY

SEQ ID NO: 54380 - protein, 9 aa, Borrelia burgdorferi B31
YGYEAGAKY

SEQ ID NO: 54381 - protein, 9 aa, Borrelia burgdorferi B31
LIWLIGYRF

SEQ ID NO: 54382 - protein, 9 aa, Borrelia burgdorferi B31
NPKMISFEL

SEQ ID NO: 54383 - protein, 9 aa, Borrelia burgdorferi B31
LILLESIVF

SEQ ID NO: 54384 - protein, 9 aa, Borrelia burgdorferi B31
DPIYSNDPI

SEQ ID NO: 54385 - protein, 9 aa, Borrelia burgdorferi B31
PANLVGMTF

SEQ ID NO: 54386 - protein, 9 aa, Borrelia burgdorferi B31
VAALQNPDM

SEQ ID NO: 54387 - protein, 9 aa, Borrelia burgdorferi B31
DVGRALNIF

SEQ ID NO: 54388 - protein, 9 aa, Borrelia burgdorferi B31
IPANLVGMT

SEQ ID NO: 54389 - protein, 9 aa, Borrelia burgdorferi B31
TFRAQEGAF

SEQ ID NO: 54390 - protein, 9 aa, Borrelia burgdorferi B31
LKESSSNSY

SEQ ID NO: 54391 - protein, 9 aa, Borrelia burgdorferi B31
DPIPANLVG

SEQ ID NO: 54392 - protein, 9 aa, Borrelia burgdorferi B31
YSDEIDIIH

SEQ ID NO: 54393 - protein, 9 aa, Borrelia burgdorferi B31
VSLIIDGTF

SEQ ID NO: 54394 - protein, 9 aa, Borrelia burgdorferi B31
IEGEIVDAF

SEQ ID NO: 54395 - protein, 10 aa, Borrelia burgdorferi B31
IPANLVGMTF

SEQ ID NO: 54396 - protein, 10 aa, Borrelia burgdorferi B31
DPIPANLVGM

SEQ ID NO: 54397 - protein, 10 aa, Borrelia burgdorferi B31
MTFRAQEGAF

SEQ ID NO: 54398 - protein, 10 aa, Borrelia burgdorferi B31
MKYAIIDPIY

SEQ ID NO: 54399 - protein, 10 aa, Borrelia burgdorferi B31
EIVDAFRYGY

SEQ ID NO: 54400 - protein, 10 aa, Borrelia burgdorferi B31
IIGVDEDQAY

SEQ ID NO: 54401 - protein, 10 aa, Borrelia burgdorferi B31
AALQNPDMKY

SEQ ID NO: 54402 - protein, 10 aa, Borrelia burgdorferi B31
EAGRSVATRM

SEQ ID NO: 54403 - protein, 10 aa, Borrelia burgdorferi B31
LLILLESIVF

SEQ ID NO: 54404 - protein, 10 aa, Borrelia burgdorferi B31
FSDVAKVAAL

SEQ ID NO: 54405 - protein, 10 aa, Borrelia burgdorferi B31
TSNHLKTNTF

SEQ ID NO: 54406 - protein, 10 aa, Borrelia burgdorferi B31
IIVPSNKESY

SEQ ID NO: 54407 - protein, 10 aa, Borrelia burgdorferi B31
KVSLIIDGTF

SEQ ID NO: 54408 - protein, 10 aa, Borrelia burgdorferi B31
DLIWLIGYRF

SEQ ID NO: 54409 - protein, 10 aa, Borrelia burgdorferi B31
VAKELGSGHY

SEQ ID NO: 54410 - protein, 10 aa, Borrelia burgdorferi B31
FVRNPKMISF

SEQ ID NO: 54411 - protein, 11 aa, Borrelia burgdorferi B31
YIIGVDEDQAY

SEQ ID NO: 54412 - protein, 11 aa, Borrelia burgdorferi B31
EAGRSVATRMY

SEQ ID NO: 54413 - protein, 11 aa, Borrelia burgdorferi B31
FTSNHLKTNTF

SEQ ID NO: 54414 - protein, 11 aa, Borrelia burgdorferi B31
VAALQNPDMKY

SEQ ID NO: 54415 - protein, 11 aa, Borrelia burgdorferi B31
LVLKESSSNSY

SEQ ID NO: 54416 - protein, 11 aa, Borrelia burgdorferi B31
VPSNKESYEKF

SEQ ID NO: 54417 - protein, 11 aa, Borrelia burgdorferi B31
DPIYSNDPIPA

SEQ ID NO: 54418 - protein, 11 aa, Borrelia burgdorferi B31
RAQEGAFLTGY

SEQ ID NO: 54419 - protein, 11 aa, Borrelia burgdorferi B31
FRYGYEAGAKY

SEQ ID NO: 54420 - protein, 11 aa, Borrelia burgdorferi B31
DMKYAIIDPIY

SEQ ID NO: 54421 - protein, 11 aa, Borrelia burgdorferi B31
DPIPANLVGMT

SEQ ID NO: 54422 - protein, 11 aa, Borrelia burgdorferi B31
LLLILLESIVF

SEQ ID NO: 54423 - protein, 11 aa, Borrelia burgdorferi B31
EVAKELGSGHY

SEQ ID NO: 54424 - protein, 11 aa, Borrelia burgdorferi B31
HAAGLGGIGAI

SEQ ID NO: 54425 - protein, 11 aa, Borrelia burgdorferi B31
EIIVPSNKESY

SEQ ID NO: 54426 - protein, 9 aa, Borrelia burgdorferi B31
EEFKIELVL

SEQ ID NO: 54427 - protein, 9 aa, Borrelia burgdorferi B31
GEIVDAFRY

SEQ ID NO: 54428 - protein, 9 aa, Borrelia burgdorferi B31
SEIPKVSLI

SEQ ID NO: 54429 - protein, 9 aa, Borrelia burgdorferi B31
DEIDIIHHA

SEQ ID NO: 54430 - protein, 10 aa, Borrelia burgdorferi B31
SEIPKVSLII

SEQ ID NO: 54431 - protein, 10 aa, Borrelia burgdorferi B31
EEFKIELVLK

SEQ ID NO: 54432 - protein, 10 aa, Borrelia burgdorferi B31
DEIDIIHHAA

SEQ ID NO: 54433 - protein, 10 aa, Borrelia burgdorferi B31
KEIDNLSSKI

SEQ ID NO: 54434 - protein, 11 aa, Borrelia burgdorferi B31
GEIVDAFRYGY

SEQ ID NO: 54435 - protein, 11 aa, Borrelia burgdorferi B31
EEFKIELVLKE

SEQ ID NO: 54436 - protein, 11 aa, Borrelia burgdorferi B31
KEIIVPSNKES

SEQ ID NO: 54437 - protein, 11 aa, Borrelia burgdorferi B31
KEIDNLSSKII

SEQ ID NO: 54438 - protein, 11 aa, Borrelia burgdorferi B31
KESYEKFLKEF

SEQ ID NO: 54439 - protein, 11 aa, Borrelia burgdorferi B31
SEIPKVSLIID

SEQ ID NO: 54440 - protein, 9 aa, Borrelia burgdorferi B31
IPKVSLIID

SEQ ID NO: 54441 - protein, 9 aa, Borrelia burgdorferi B31
IPANLVGMT

SEQ ID NO: 54442 - protein, 9 aa, Borrelia burgdorferi B31
DPIYSNDPI

SEQ ID NO: 54443 - protein, 10 aa, Borrelia burgdorferi B31
IPANLVGMTF

SEQ ID NO: 54444 - protein, 10 aa, Borrelia burgdorferi B31
IPKVSLIIDG

SEQ ID NO: 54445 - protein, 10 aa, Borrelia burgdorferi B31
DPIPANLVGM

SEQ ID NO: 54446 - protein, 11 aa, Borrelia burgdorferi B31
IPKVSLIIDGT

SEQ ID NO: 54447 - protein, 9 aa, Borrelia burgdorferi B31
FSCAISGVY

SEQ ID NO: 54448 - protein, 9 aa, Borrelia burgdorferi B31
SSENPKISY

SEQ ID NO: 54449 - protein, 9 aa, Borrelia burgdorferi B31
IVDAFRYGY

SEQ ID NO: 54450 - protein, 10 aa, Borrelia burgdorferi B31
GSDLIWLVGY

SEQ ID NO: 54451 - protein, 10 aa, Borrelia burgdorferi B31
ETAKNLGDGY

SEQ ID NO: 54452 - protein, 10 aa, Borrelia burgdorferi B31
VSSENPKISY

SEQ ID NO: 54453 - protein, 10 aa, Borrelia burgdorferi B31
NKDIEIISEY

SEQ ID NO: 54454 - protein, 11 aa, Borrelia burgdorferi B31
ETAKNLGDGYY

SEQ ID NO: 54455 - protein, 9 aa, Borrelia burgdorferi B31
MLTDASLLV

SEQ ID NO: 54456 - protein, 9 aa, Borrelia burgdorferi B31
NLIAVVFRV

SEQ ID NO: 54457 - protein, 9 aa, Borrelia burgdorferi B31
YMLTDASLL

SEQ ID NO: 54458 - protein, 9 aa, Borrelia burgdorferi B31
KMYSKGIDV

SEQ ID NO: 54459 - protein, 9 aa, Borrelia burgdorferi B31
RIVIFIFGI

SEQ ID NO: 54460 - protein, 9 aa, Borrelia burgdorferi B31
YLAPKNFIT

SEQ ID NO: 54461 - protein, 9 aa, Borrelia burgdorferi B31
NIGDALYLI

SEQ ID NO: 54462 - protein, 9 aa, Borrelia burgdorferi B31
GLRDGVIGL

SEQ ID NO: 54463 - protein, 9 aa, Borrelia burgdorferi B31
NLGDGYYVI

SEQ ID NO: 54464 - protein, 9 aa, Borrelia burgdorferi B31
KISMLVDGV

SEQ ID NO: 54465 - protein, 9 aa, Borrelia burgdorferi B31
FIFGILLTS

SEQ ID NO: 54466 - protein, 9 aa, Borrelia burgdorferi B31
QIPENLIAV

SEQ ID NO: 54467 - protein, 9 aa, Borrelia burgdorferi B31
KIINKEIIV

SEQ ID NO: 54468 - protein, 9 aa, Borrelia burgdorferi B31
VIFIFGILL

SEQ ID NO: 54469 - protein, 9 aa, Borrelia burgdorferi B31
FITSVIKNI

SEQ ID NO: 54470 - protein, 9 aa, Borrelia burgdorferi B31
FLAGYIAAK

SEQ ID NO: 54471 - protein, 9 aa, Borrelia burgdorferi B31
LIWLVGYML

SEQ ID NO: 54472 - protein, 9 aa, Borrelia burgdorferi B31
VLDDKSFNS

SEQ ID NO: 54473 - protein, 9 aa, Borrelia burgdorferi B31
KGIDVIHFA

SEQ ID NO: 54474 - protein, 9 aa, Borrelia burgdorferi B31
GIDVIHFAA

SEQ ID NO: 54475 - protein, 9 aa, Borrelia burgdorferi B31
SANEALLRL

SEQ ID NO: 54476 - protein, 9 aa, Borrelia burgdorferi B31
ISGVYSSYV

SEQ ID NO: 54477 - protein, 9 aa, Borrelia burgdorferi B31
NGSDLIWLV

SEQ ID NO: 54478 - protein, 9 aa, Borrelia burgdorferi B31
YANKDIEII

SEQ ID NO: 54479 - protein, 10 aa, Borrelia burgdorferi B31
YMLTDASLLV

SEQ ID NO: 54480 - protein, 10 aa, Borrelia burgdorferi B31
KMYSKGIDVI

SEQ ID NO: 54481 - protein, 10 aa, Borrelia burgdorferi B31
AISGVYSSYV

SEQ ID NO: 54482 - protein, 10 aa, Borrelia burgdorferi B31
ALYLITGEYI

SEQ ID NO: 54483 - protein, 10 aa, Borrelia burgdorferi B31
KISYGIIDPI

SEQ ID NO: 54484 - protein, 10 aa, Borrelia burgdorferi B31
WLVGYMLTDA

SEQ ID NO: 54485 - protein, 10 aa, Borrelia burgdorferi B31
LLVSSENPKI

SEQ ID NO: 54486 - protein, 10 aa, Borrelia burgdorferi B31
YLAPKNFITS

SEQ ID NO: 54487 - protein, 10 aa, Borrelia burgdorferi B31
VQIPENLIAV

SEQ ID NO: 54488 - protein, 10 aa, Borrelia burgdorferi B31
GLAGIGVIET

SEQ ID NO: 54489 - protein, 10 aa, Borrelia burgdorferi B31
FAAGLAGIGV

SEQ ID NO: 54490 - protein, 10 aa, Borrelia burgdorferi B31
QIPENLIAVV

SEQ ID NO: 54491 - protein, 10 aa, Borrelia burgdorferi B31
MLTDASLLVS

SEQ ID NO: 54492 - protein, 10 aa, Borrelia burgdorferi B31
FIFGILLTSC

SEQ ID NO: 54493 - protein, 10 aa, Borrelia burgdorferi B31
GVYSSYVSDL

SEQ ID NO: 54494 - protein, 10 aa, Borrelia burgdorferi B31
EVFSCAISGV

SEQ ID NO: 54495 - protein, 10 aa, Borrelia burgdorferi B31
IVIFIFGILL

SEQ ID NO: 54496 - protein, 10 aa, Borrelia burgdorferi B31
LAPKNFITSV

SEQ ID NO: 54497 - protein, 10 aa, Borrelia burgdorferi B31
RIVIFIFGIL

SEQ ID NO: 54498 - protein, 10 aa, Borrelia burgdorferi B31
VLDDKSFNSS

SEQ ID NO: 54499 - protein, 10 aa, Borrelia burgdorferi B31
FIGGMKGNIV

SEQ ID NO: 54500 - protein, 10 aa, Borrelia burgdorferi B31
FLAGYIAAKK

SEQ ID NO: 54501 - protein, 11 aa, Borrelia burgdorferi B31
YLAPKNFITSV

SEQ ID NO: 54502 - protein, 11 aa, Borrelia burgdorferi B31
VLDDKSFNSSA

SEQ ID NO: 54503 - protein, 11 aa, Borrelia burgdorferi B31
GLPNANEFEYI

SEQ ID NO: 54504 - protein, 11 aa, Borrelia burgdorferi B31
NLGDGYYVIGA

SEQ ID NO: 54505 - protein, 11 aa, Borrelia burgdorferi B31
SLLVSSENPKI

SEQ ID NO: 54506 - protein, 11 aa, Borrelia burgdorferi B31
GLAGIGVIETA

SEQ ID NO: 54507 - protein, 11 aa, Borrelia burgdorferi B31
MLTDASLLVSS

SEQ ID NO: 54508 - protein, 11 aa, Borrelia burgdorferi B31
RIVIFIFGILL

SEQ ID NO: 54509 - protein, 11 aa, Borrelia burgdorferi B31
LLTSCFSRNGI

SEQ ID NO: 54510 - protein, 11 aa, Borrelia burgdorferi B31
YMLTDASLLVS

SEQ ID NO: 54511 - protein, 11 aa, Borrelia burgdorferi B31
GIIDPIYGDDV

SEQ ID NO: 54512 - protein, 11 aa, Borrelia burgdorferi B31
CAISGVYSSYV

SEQ ID NO: 54513 - protein, 11 aa, Borrelia burgdorferi B31
VQIPENLIAVV

SEQ ID NO: 54514 - protein, 11 aa, Borrelia burgdorferi B31
GIDVIHFAAGL

SEQ ID NO: 54515 - protein, 11 aa, Borrelia burgdorferi B31
FLAGYIAAKKS

SEQ ID NO: 54516 - protein, 11 aa, Borrelia burgdorferi B31
QMGLRDGVIGL

SEQ ID NO: 54517 - protein, 11 aa, Borrelia burgdorferi B31
VVFRVEQGAFL

SEQ ID NO: 54518 - protein, 11 aa, Borrelia burgdorferi B31
MLVDGVLDDKS

SEQ ID NO: 54519 - protein, 11 aa, Borrelia burgdorferi B31
VIGADQDQSYL

SEQ ID NO: 54520 - protein, 11 aa, Borrelia burgdorferi B31
TIASKMYSKGI

SEQ ID NO: 54521 - protein, 9 aa, Borrelia burgdorferi B31
FLAGYIAAK

SEQ ID NO: 54522 - protein, 9 aa, Borrelia burgdorferi B31
TIASKMYSK

SEQ ID NO: 54523 - protein, 9 aa, Borrelia burgdorferi B31
KIGFIGGMK

SEQ ID NO: 54524 - protein, 9 aa, Borrelia burgdorferi B31
VLERKIINK

SEQ ID NO: 54525 - protein, 9 aa, Borrelia burgdorferi B31
ILLTSCFSR

SEQ ID NO: 54526 - protein, 9 aa, Borrelia burgdorferi B31
EIFIKQILK

SEQ ID NO: 54527 - protein, 9 aa, Borrelia burgdorferi B31
ALYLITGEY

SEQ ID NO: 54528 - protein, 9 aa, Borrelia burgdorferi B31
LAGYIAAKK

SEQ ID NO: 54529 - protein, 9 aa, Borrelia burgdorferi B31
AAKKSFSGK

SEQ ID NO: 54530 - protein, 9 aa, Borrelia burgdorferi B31
LLVSSENPK

SEQ ID NO: 54531 - protein, 9 aa, Borrelia burgdorferi B31
AISGVYSSY

SEQ ID NO: 54532 - protein, 9 aa, Borrelia burgdorferi B31
SSANEALLR

SEQ ID NO: 54533 - protein, 9 aa, Borrelia burgdorferi B31
KMYSKGIDV

SEQ ID NO: 54534 - protein, 9 aa, Borrelia burgdorferi B31
KNFITSVIK

SEQ ID NO: 54535 - protein, 9 aa, Borrelia burgdorferi B31
GIGVIETAK

SEQ ID NO: 54536 - protein, 10 aa, Borrelia burgdorferi B31
RTIASKMYSK

SEQ ID NO: 54537 - protein, 10 aa, Borrelia burgdorferi B31
FLAGYIAAKK

SEQ ID NO: 54538 - protein, 10 aa, Borrelia burgdorferi B31
KVLERKIINK

SEQ ID NO: 54539 - protein, 10 aa, Borrelia burgdorferi B31
SLLVSSENPK

SEQ ID NO: 54540 - protein, 10 aa, Borrelia burgdorferi B31
AFLAGYIAAK

SEQ ID NO: 54541 - protein, 10 aa, Borrelia burgdorferi B31
MLVDGVLDDK

SEQ ID NO: 54542 - protein, 10 aa, Borrelia burgdorferi B31
IAAKKSFSGK

SEQ ID NO: 54543 - protein, 10 aa, Borrelia burgdorferi B31
YEIFIKQILK

SEQ ID NO: 54544 - protein, 10 aa, Borrelia burgdorferi B31
GKIGFIGGMK

SEQ ID NO: 54545 - protein, 10 aa, Borrelia burgdorferi B31
GILLTSCFSR

SEQ ID NO: 54546 - protein, 10 aa, Borrelia burgdorferi B31
SANEALLRLK

SEQ ID NO: 54547 - protein, 10 aa, Borrelia burgdorferi B31
LYLITGEYIK

SEQ ID NO: 54548 - protein, 10 aa, Borrelia burgdorferi B31
FRYGYESGAK

SEQ ID NO: 54549 - protein, 10 aa, Borrelia burgdorferi B31
CAISGVYSSY

SEQ ID NO: 54550 - protein, 10 aa, Borrelia burgdorferi B31
SRNGIESSSK

SEQ ID NO: 54551 - protein, 10 aa, Borrelia burgdorferi B31
VDIGRTIASK

SEQ ID NO: 54552 - protein, 10 aa, Borrelia burgdorferi B31
RYGYESGAKY

SEQ ID NO: 54553 - protein, 10 aa, Borrelia burgdorferi B31
RNGIESSSKK

SEQ ID NO: 54554 - protein, 10 aa, Borrelia burgdorferi B31
YESGAKYANK

SEQ ID NO: 54555 - protein, 10 aa, Borrelia burgdorferi B31
AGIGVIETAK

SEQ ID NO: 54556 - protein, 10 aa, Borrelia burgdorferi B31
PKNFITSVIK

SEQ ID NO: 54557 - protein, 10 aa, Borrelia burgdorferi B31
FEYIKVLERK

SEQ ID NO: 54558 - protein, 10 aa, Borrelia burgdorferi B31
VFSCAISGVY

SEQ ID NO: 54559 - protein, 11 aa, Borrelia burgdorferi B31
ALYLITGEYIK

SEQ ID NO: 54560 - protein, 11 aa, Borrelia burgdorferi B31
YIAAKKSFSGK

SEQ ID NO: 54561 - protein, 11 aa, Borrelia burgdorferi B31
KMYSKGIDVIH

SEQ ID NO: 54562 - protein, 11 aa, Borrelia burgdorferi B31
SSANEALLRLK

SEQ ID NO: 54563 - protein, 11 aa, Borrelia burgdorferi B31
FSRNGIESSSK

SEQ ID NO: 54564 - protein, 11 aa, Borrelia burgdorferi B31
SSYVSDLDNLK

SEQ ID NO: 54565 - protein, 11 aa, Borrelia burgdorferi B31
GAFLAGYIAAK

SEQ ID NO: 54566 - protein, 11 aa, Borrelia burgdorferi B31
SANEALLRLKK

SEQ ID NO: 54567 - protein, 11 aa, Borrelia burgdorferi B31
AFLAGYIAAKK

SEQ ID NO: 54568 - protein, 11 aa, Borrelia burgdorferi B31
ASLLVSSENPK

SEQ ID NO: 54569 - protein, 11 aa, Borrelia burgdorferi B31
EVFSCAISGVY

SEQ ID NO: 54570 - protein, 11 aa, Borrelia burgdorferi B31
KISYGIIDPIY

SEQ ID NO: 54571 - protein, 11 aa, Borrelia burgdorferi B31
RVEQGAFLAGY

SEQ ID NO: 54572 - protein, 11 aa, Borrelia burgdorferi B31
SMLVDGVLDDK

SEQ ID NO: 54573 - protein, 11 aa, Borrelia burgdorferi B31
LVSSENPKISY

SEQ ID NO: 54574 - protein, 9 aa, Borrelia burgdorferi B31
TIASKMYSK

SEQ ID NO: 54575 - protein, 9 aa, Borrelia burgdorferi B31
SSANEALLR

SEQ ID NO: 54576 - protein, 9 aa, Borrelia burgdorferi B31
YVSDLDNLK

SEQ ID NO: 54577 - protein, 9 aa, Borrelia burgdorferi B31
KIGFIGGMK

SEQ ID NO: 54578 - protein, 9 aa, Borrelia burgdorferi B31
AAKKSFSGK

SEQ ID NO: 54579 - protein, 9 aa, Borrelia burgdorferi B31
EIFIKQILK

SEQ ID NO: 54580 - protein, 9 aa, Borrelia burgdorferi B31
NANEFEYIK

SEQ ID NO: 54581 - protein, 9 aa, Borrelia burgdorferi B31
IVDAFRYGY

SEQ ID NO: 54582 - protein, 9 aa, Borrelia burgdorferi B31
VLERKIINK

SEQ ID NO: 54583 - protein, 9 aa, Borrelia burgdorferi B31
AISGVYSSY

SEQ ID NO: 54584 - protein, 9 aa, Borrelia burgdorferi B31
ALYLITGEY

SEQ ID NO: 54585 - protein, 9 aa, Borrelia burgdorferi B31
ILLTSCFSR

SEQ ID NO: 54586 - protein, 9 aa, Borrelia burgdorferi B31
LLVSSENPK

SEQ ID NO: 54587 - protein, 9 aa, Borrelia burgdorferi B31
FLAGYIAAK

SEQ ID NO: 54588 - protein, 9 aa, Borrelia burgdorferi B31
LVDGVLDDK

SEQ ID NO: 54589 - protein, 9 aa, Borrelia burgdorferi B31
GIGVIETAK

SEQ ID NO: 54590 - protein, 9 aa, Borrelia burgdorferi B31
YLITGEYIK

SEQ ID NO: 54591 - protein, 9 aa, Borrelia burgdorferi B31
LAGYIAAKK

SEQ ID NO: 54592 - protein, 9 aa, Borrelia burgdorferi B31
KNFITSVIK

SEQ ID NO: 54593 - protein, 9 aa, Borrelia burgdorferi B31
ESGAKYANK

SEQ ID NO: 54594 - protein, 9 aa, Borrelia burgdorferi B31
SSENPKISY

SEQ ID NO: 54595 - protein, 9 aa, Borrelia burgdorferi B31
RTIASKMYS

SEQ ID NO: 54596 - protein, 10 aa, Borrelia burgdorferi B31
RTIASKMYSK

SEQ ID NO: 54597 - protein, 10 aa, Borrelia burgdorferi B31
KVLERKIINK

SEQ ID NO: 54598 - protein, 10 aa, Borrelia burgdorferi B31
SANEALLRLK

SEQ ID NO: 54599 - protein, 10 aa, Borrelia burgdorferi B31
SLLVSSENPK

SEQ ID NO: 54600 - protein, 10 aa, Borrelia burgdorferi B31
IAAKKSFSGK

SEQ ID NO: 54601 - protein, 10 aa, Borrelia burgdorferi B31
GILLTSCFSR

SEQ ID NO: 54602 - protein, 10 aa, Borrelia burgdorferi B31
AFLAGYIAAK

SEQ ID NO: 54603 - protein, 10 aa, Borrelia burgdorferi B31
MLVDGVLDDK

SEQ ID NO: 54604 - protein, 10 aa, Borrelia burgdorferi B31
NSSANEALLR

SEQ ID NO: 54605 - protein, 10 aa, Borrelia burgdorferi B31
FLAGYIAAKK

SEQ ID NO: 54606 - protein, 10 aa, Borrelia burgdorferi B31
SYVSDLDNLK

SEQ ID NO: 54607 - protein, 10 aa, Borrelia burgdorferi B31
YVSDLDNLKR

SEQ ID NO: 54608 - protein, 10 aa, Borrelia burgdorferi B31
ISYGIIDPIY

SEQ ID NO: 54609 - protein, 10 aa, Borrelia burgdorferi B31
NQEEYEIFIK

SEQ ID NO: 54610 - protein, 10 aa, Borrelia burgdorferi B31
NSFSDVDIGR

SEQ ID NO: 54611 - protein, 10 aa, Borrelia burgdorferi B31
GIESSSKKIK

SEQ ID NO: 54612 - protein, 10 aa, Borrelia burgdorferi B31
AGIGVIETAK

SEQ ID NO: 54613 - protein, 11 aa, Borrelia burgdorferi B31
SSYVSDLDNLK

SEQ ID NO: 54614 - protein, 11 aa, Borrelia burgdorferi B31
SSANEALLRLK

SEQ ID NO: 54615 - protein, 11 aa, Borrelia burgdorferi B31
SANEALLRLKK

SEQ ID NO: 54616 - protein, 11 aa, Borrelia burgdorferi B31
ASLLVSSENPK

SEQ ID NO: 54617 - protein, 11 aa, Borrelia burgdorferi B31
ALYLITGEYIK

SEQ ID NO: 54618 - protein, 11 aa, Borrelia burgdorferi B31
GAFLAGYIAAK

SEQ ID NO: 54619 - protein, 11 aa, Borrelia burgdorferi B31
YIAAKKSFSGK

SEQ ID NO: 54620 - protein, 11 aa, Borrelia burgdorferi B31
SMLVDGVLDDK

SEQ ID NO: 54621 - protein, 11 aa, Borrelia burgdorferi B31
SVIKNIGDALY

SEQ ID NO: 54622 - protein, 11 aa, Borrelia burgdorferi B31
AFLAGYIAAKK

SEQ ID NO: 54623 - protein, 11 aa, Borrelia burgdorferi B31
LAGIGVIETAK

SEQ ID NO: 54624 - protein, 11 aa, Borrelia burgdorferi B31
RVEQGAFLAGY

SEQ ID NO: 54625 - protein, 11 aa, Borrelia burgdorferi B31
ADQDQSYLAPK

SEQ ID NO: 54626 - protein, 11 aa, Borrelia burgdorferi B31
EVFSCAISGVY

SEQ ID NO: 54627 - protein, 11 aa, Borrelia burgdorferi B31
LVSSENPKISY

SEQ ID NO: 54628 - protein, 11 aa, Borrelia burgdorferi B31
KISYGIIDPIY

SEQ ID NO: 54629 - protein, 11 aa, Borrelia burgdorferi B31
LPNANEFEYIK

SEQ ID NO: 54630 - protein, 9 aa, Borrelia burgdorferi B31
VYSSYVSDL

SEQ ID NO: 54631 - protein, 9 aa, Borrelia burgdorferi B31
LYLITGEYI

SEQ ID NO: 54632 - protein, 9 aa, Borrelia burgdorferi B31
KYANKDIEI

SEQ ID NO: 54633 - protein, 9 aa, Borrelia burgdorferi B31
EYIKNNNVW

SEQ ID NO: 54634 - protein, 9 aa, Borrelia burgdorferi B31
SYLAPKNFI

SEQ ID NO: 54635 - protein, 9 aa, Borrelia burgdorferi B31
GYMLTDASL

SEQ ID NO: 54636 - protein, 9 aa, Borrelia burgdorferi B31
MYSKGIDVI

SEQ ID NO: 54637 - protein, 9 aa, Borrelia burgdorferi B31
IFIKQILKL

SEQ ID NO: 54638 - protein, 9 aa, Borrelia burgdorferi B31
SYVSDLDNL

SEQ ID NO: 54639 - protein, 9 aa, Borrelia burgdorferi B31
GYIAAKKSF

SEQ ID NO: 54640 - protein, 9 aa, Borrelia burgdorferi B31
EYEIFIKQI

SEQ ID NO: 54641 - protein, 9 aa, Borrelia burgdorferi B31
EYIKVLERK

SEQ ID NO: 54642 - protein, 9 aa, Borrelia burgdorferi B31
EYSNSFSDV

SEQ ID NO: 54643 - protein, 10 aa, Borrelia burgdorferi B31
EYIKVLERKI

SEQ ID NO: 54644 - protein, 10 aa, Borrelia burgdorferi B31
KYANKDIEII

SEQ ID NO: 54645 - protein, 10 aa, Borrelia burgdorferi B31
GYMLTDASLL

SEQ ID NO: 54646 - protein, 10 aa, Borrelia burgdorferi B31
IFGILLTSCF

SEQ ID NO: 54647 - protein, 10 aa, Borrelia burgdorferi B31
NFITSVIKNI

SEQ ID NO: 54648 - protein, 10 aa, Borrelia burgdorferi B31
DFPENIEEVF

SEQ ID NO: 54649 - protein, 10 aa, Borrelia burgdorferi B31
EYEIFIKQIL

SEQ ID NO: 54650 - protein, 10 aa, Borrelia burgdorferi B31
SYVSDLDNLK

SEQ ID NO: 54651 - protein, 10 aa, Borrelia burgdorferi B31
LYLITGEYIK

SEQ ID NO: 54652 - protein, 10 aa, Borrelia burgdorferi B31
EYIKNNNVWE

SEQ ID NO: 54653 - protein, 11 aa, Borrelia burgdorferi B31
MYSKGIDVIHF

SEQ ID NO: 54654 - protein, 11 aa, Borrelia burgdorferi B31
EYIKVLERKII

SEQ ID NO: 54655 - protein, 11 aa, Borrelia burgdorferi B31
EYSNSFSDVDI

SEQ ID NO: 54656 - protein, 11 aa, Borrelia burgdorferi B31
GYMLTDASLLV

SEQ ID NO: 54657 - protein, 11 aa, Borrelia burgdorferi B31
SFSDVDIGRTI

SEQ ID NO: 54658 - protein, 11 aa, Borrelia burgdorferi B31
EYIKNNNVWEG

SEQ ID NO: 54659 - protein, 9 aa, Borrelia burgdorferi B31
SYGIIDPIY

SEQ ID NO: 54660 - protein, 9 aa, Borrelia burgdorferi B31
IVPCNQEEY

SEQ ID NO: 54661 - protein, 9 aa, Borrelia burgdorferi B31
FSCAISGVY

SEQ ID NO: 54662 - protein, 9 aa, Borrelia burgdorferi B31
GNIVDAFRY

SEQ ID NO: 54663 - protein, 9 aa, Borrelia burgdorferi B31
ALYLITGEY

SEQ ID NO: 54664 - protein, 9 aa, Borrelia burgdorferi B31
YGYESGAKY

SEQ ID NO: 54665 - protein, 9 aa, Borrelia burgdorferi B31
LPNANEFEY

SEQ ID NO: 54666 - protein, 9 aa, Borrelia burgdorferi B31
IVDAFRYGY

SEQ ID NO: 54667 - protein, 9 aa, Borrelia burgdorferi B31
SSENPKISY

SEQ ID NO: 54668 - protein, 9 aa, Borrelia burgdorferi B31
VFRVEQGAF

SEQ ID NO: 54669 - protein, 10 aa, Borrelia burgdorferi B31
RYGYESGAKY

SEQ ID NO: 54670 - protein, 10 aa, Borrelia burgdorferi B31
GLPNANEFEY

SEQ ID NO: 54671 - protein, 10 aa, Borrelia burgdorferi B31
VFSCAISGVY

SEQ ID NO: 54672 - protein, 10 aa, Borrelia burgdorferi B31
CAISGVYSSY

SEQ ID NO: 54673 - protein, 10 aa, Borrelia burgdorferi B31
IIVPCNQEEY

SEQ ID NO: 54674 - protein, 10 aa, Borrelia burgdorferi B31
VVFRVEQGAF

SEQ ID NO: 54675 - protein, 10 aa, Borrelia burgdorferi B31
VIGADQDQSY

SEQ ID NO: 54676 - protein, 10 aa, Borrelia burgdorferi B31
DALYLITGEY

SEQ ID NO: 54677 - protein, 10 aa, Borrelia burgdorferi B31
VIKNIGDALY

SEQ ID NO: 54678 - protein, 10 aa, Borrelia burgdorferi B31
KGNIVDAFRY

SEQ ID NO: 54679 - protein, 10 aa, Borrelia burgdorferi B31
TAKNLGDGYY

SEQ ID NO: 54680 - protein, 10 aa, Borrelia burgdorferi B31
ISYGIIDPIY

SEQ ID NO: 54681 - protein, 10 aa, Borrelia burgdorferi B31
VSSENPKISY

SEQ ID NO: 54682 - protein, 11 aa, Borrelia burgdorferi B31
EVFSCAISGVY

SEQ ID NO: 54683 - protein, 11 aa, Borrelia burgdorferi B31
YVIGADQDQSY

SEQ ID NO: 54684 - protein, 11 aa, Borrelia burgdorferi B31
EIIVPCNQEEY

SEQ ID NO: 54685 - protein, 11 aa, Borrelia burgdorferi B31
SVIKNIGDALY

SEQ ID NO: 54686 - protein, 11 aa, Borrelia burgdorferi B31
LVSSENPKISY

SEQ ID NO: 54687 - protein, 11 aa, Borrelia burgdorferi B31
IGLPNANEFEY

SEQ ID NO: 54688 - protein, 11 aa, Borrelia burgdorferi B31
ETAKNLGDGYY

SEQ ID NO: 54689 - protein, 11 aa, Borrelia burgdorferi B31
FIFGILLTSCF

SEQ ID NO: 54690 - protein, 11 aa, Borrelia burgdorferi B31
SCAISGVYSSY

SEQ ID NO: 54691 - protein, 11 aa, Borrelia burgdorferi B31
RVEQGAFLAGY

SEQ ID NO: 54692 - protein, 11 aa, Borrelia burgdorferi B31
KISYGIIDPIY

SEQ ID NO: 54693 - protein, 11 aa, Borrelia burgdorferi B31
GNIVDAFRYGY

SEQ ID NO: 54694 - protein, 9 aa, Borrelia burgdorferi B31
TIASKMYSK

SEQ ID NO: 54695 - protein, 9 aa, Borrelia burgdorferi B31
EIFIKQILK

SEQ ID NO: 54696 - protein, 9 aa, Borrelia burgdorferi B31
YVSDLDNLK

SEQ ID NO: 54697 - protein, 9 aa, Borrelia burgdorferi B31
NANEFEYIK

SEQ ID NO: 54698 - protein, 9 aa, Borrelia burgdorferi B31
SSANEALLR

SEQ ID NO: 54699 - protein, 9 aa, Borrelia burgdorferi B31
FLAGYIAAK

SEQ ID NO: 54700 - protein, 9 aa, Borrelia burgdorferi B31
EYIKVLERK

SEQ ID NO: 54701 - protein, 9 aa, Borrelia burgdorferi B31
ENLIAVVFR

SEQ ID NO: 54702 - protein, 9 aa, Borrelia burgdorferi B31
LAGYIAAKK

SEQ ID NO: 54703 - protein, 9 aa, Borrelia burgdorferi B31
ILLTSCFSR

SEQ ID NO: 54704 - protein, 9 aa, Borrelia burgdorferi B31
YLITGEYIK

SEQ ID NO: 54705 - protein, 9 aa, Borrelia burgdorferi B31
SFSDVDIGR

SEQ ID NO: 54706 - protein, 9 aa, Borrelia burgdorferi B31
FSCAISGVY

SEQ ID NO: 54707 - protein, 9 aa, Borrelia burgdorferi B31
ESGAKYANK

SEQ ID NO: 54708 - protein, 9 aa, Borrelia burgdorferi B31
LLVSSENPK

SEQ ID NO: 54709 - protein, 9 aa, Borrelia burgdorferi B31
KGNIVDAFR

SEQ ID NO: 54710 - protein, 9 aa, Borrelia burgdorferi B31
DIGRTIASK

SEQ ID NO: 54711 - protein, 9 aa, Borrelia burgdorferi B31
FEYIKVLER

SEQ ID NO: 54712 - protein, 9 aa, Borrelia burgdorferi B31
NGIESSSKK

SEQ ID NO: 54713 - protein, 9 aa, Borrelia burgdorferi B31
IVPCNQEEY

SEQ ID NO: 54714 - protein, 9 aa, Borrelia burgdorferi B31
LVDGVLDDK

SEQ ID NO: 54715 - protein, 10 aa, Borrelia burgdorferi B31
NSFSDVDIGR

SEQ ID NO: 54716 - protein, 10 aa, Borrelia burgdorferi B31
NSSANEALLR

SEQ ID NO: 54717 - protein, 10 aa, Borrelia burgdorferi B31
YVSDLDNLKR

SEQ ID NO: 54718 - protein, 10 aa, Borrelia burgdorferi B31
FLAGYIAAKK

SEQ ID NO: 54719 - protein, 10 aa, Borrelia burgdorferi B31
RTIASKMYSK

SEQ ID NO: 54720 - protein, 10 aa, Borrelia burgdorferi B31
EFEYIKVLER

SEQ ID NO: 54721 - protein, 10 aa, Borrelia burgdorferi B31
IAAKKSFSGK

SEQ ID NO: 54722 - protein, 10 aa, Borrelia burgdorferi B31
ETAKNLGDGY

SEQ ID NO: 54723 - protein, 10 aa, Borrelia burgdorferi B31
MKGNIVDAFR

SEQ ID NO: 54724 - protein, 10 aa, Borrelia burgdorferi B31
MLVDGVLDDK

SEQ ID NO: 54725 - protein, 10 aa, Borrelia burgdorferi B31
SANEALLRLK

SEQ ID NO: 54726 - protein, 10 aa, Borrelia burgdorferi B31
ISYGIIDPIY

SEQ ID NO: 54727 - protein, 10 aa, Borrelia burgdorferi B31
CAISGVYSSY

SEQ ID NO: 54728 - protein, 10 aa, Borrelia burgdorferi B31
GILLTSCFSR

SEQ ID NO: 54729 - protein, 10 aa, Borrelia burgdorferi B31
YEIFIKQILK

SEQ ID NO: 54730 - protein, 10 aa, Borrelia burgdorferi B31
SYVSDLDNLK

SEQ ID NO: 54731 - protein, 10 aa, Borrelia burgdorferi B31
NIVDAFRYGY

SEQ ID NO: 54732 - protein, 10 aa, Borrelia burgdorferi B31
DALYLITGEY

SEQ ID NO: 54733 - protein, 10 aa, Borrelia burgdorferi B31
NQEEYEIFIK

SEQ ID NO: 54734 - protein, 11 aa, Borrelia burgdorferi B31
EVFSCAISGVY

SEQ ID NO: 54735 - protein, 11 aa, Borrelia burgdorferi B31
YIAAKKSFSGK

SEQ ID NO: 54736 - protein, 11 aa, Borrelia burgdorferi B31
SSYVSDLDNLK

SEQ ID NO: 54737 - protein, 11 aa, Borrelia burgdorferi B31
ETAKNLGDGYY

SEQ ID NO: 54738 - protein, 11 aa, Borrelia burgdorferi B31
FGILLTSCFSR

SEQ ID NO: 54739 - protein, 11 aa, Borrelia burgdorferi B31
FNSSANEALLR

SEQ ID NO: 54740 - protein, 11 aa, Borrelia burgdorferi B31
SSANEALLRLK

SEQ ID NO: 54741 - protein, 11 aa, Borrelia burgdorferi B31
EFEYIKVLERK

SEQ ID NO: 54742 - protein, 11 aa, Borrelia burgdorferi B31
GAFLAGYIAAK

SEQ ID NO: 54743 - protein, 11 aa, Borrelia burgdorferi B31
SANEALLRLKK

SEQ ID NO: 54744 - protein, 11 aa, Borrelia burgdorferi B31
SNSFSDVDIGR

SEQ ID NO: 54745 - protein, 11 aa, Borrelia burgdorferi B31
GMKGNIVDAFR

SEQ ID NO: 54746 - protein, 11 aa, Borrelia burgdorferi B31
NEFEYIKVLER

SEQ ID NO: 54747 - protein, 11 aa, Borrelia burgdorferi B31
IPENLIAVVFR

SEQ ID NO: 54748 - protein, 11 aa, Borrelia burgdorferi B31
SYVSDLDNLKR

SEQ ID NO: 54749 - protein, 11 aa, Borrelia burgdorferi B31
SVIKNIGDALY

SEQ ID NO: 54750 - protein, 11 aa, Borrelia burgdorferi B31
EYEIFIKQILK

SEQ ID NO: 54751 - protein, 11 aa, Borrelia burgdorferi B31
EIIVPCNQEEY

SEQ ID NO: 54752 - protein, 11 aa, Borrelia burgdorferi B31
LPNANEFEYIK

SEQ ID NO: 54753 - protein, 11 aa, Borrelia burgdorferi B31
ALYLITGEYIK

SEQ ID NO: 54754 - protein, 11 aa, Borrelia burgdorferi B31
FSRNGIESSSK

SEQ ID NO: 54755 - protein, 11 aa, Borrelia burgdorferi B31
YVIGADQDQSY

SEQ ID NO: 54756 - protein, 11 aa, Borrelia burgdorferi B31
DVDIGRTIASK

SEQ ID NO: 54757 - protein, 11 aa, Borrelia burgdorferi B31
EGGKVVQMGLR

SEQ ID NO: 54758 - protein, 11 aa, Borrelia burgdorferi B31
NLIAVVFRVEQ

SEQ ID NO: 54759 - protein, 11 aa, Borrelia burgdorferi B31
LAGIGVIETAK

SEQ ID NO: 54760 - protein, 11 aa, Borrelia burgdorferi B31
FIFGILLTSCF

SEQ ID NO: 54761 - protein, 9 aa, Borrelia burgdorferi B31
APKNFITSV

SEQ ID NO: 54762 - protein, 9 aa, Borrelia burgdorferi B31
IPENLIAVV

SEQ ID NO: 54763 - protein, 9 aa, Borrelia burgdorferi B31
NPKISYGII

SEQ ID NO: 54764 - protein, 9 aa, Borrelia burgdorferi B31
FPENIEEVF

SEQ ID NO: 54765 - protein, 9 aa, Borrelia burgdorferi B31
VIKNIGDAL

SEQ ID NO: 54766 - protein, 10 aa, Borrelia burgdorferi B31
APKNFITSVI

SEQ ID NO: 54767 - protein, 10 aa, Borrelia burgdorferi B31
IPENLIAVVF

SEQ ID NO: 54768 - protein, 10 aa, Borrelia burgdorferi B31
SVIKNIGDAL

SEQ ID NO: 54769 - protein, 10 aa, Borrelia burgdorferi B31
LPNANEFEYI

SEQ ID NO: 54770 - protein, 11 aa, Borrelia burgdorferi B31
AVVFRVEQGAF

SEQ ID NO: 54771 - protein, 9 aa, Borrelia burgdorferi B31
YIKVLERKI

SEQ ID NO: 54772 - protein, 9 aa, Borrelia burgdorferi B31
NLKRNGSDL

SEQ ID NO: 54773 - protein, 10 aa, Borrelia burgdorferi B31
YIKVLERKII

SEQ ID NO: 54774 - protein, 9 aa, Borrelia burgdorferi B31
FSCAISGVY

SEQ ID NO: 54775 - protein, 9 aa, Borrelia burgdorferi B31
IISEYSNSF

SEQ ID NO: 54776 - protein, 9 aa, Borrelia burgdorferi B31
ALYLITGEY

SEQ ID NO: 54777 - protein, 9 aa, Borrelia burgdorferi B31
AISGVYSSY

SEQ ID NO: 54778 - protein, 9 aa, Borrelia burgdorferi B31
YGYESGAKY

SEQ ID NO: 54779 - protein, 9 aa, Borrelia burgdorferi B31
EQGAFLAGY

SEQ ID NO: 54780 - protein, 9 aa, Borrelia burgdorferi B31
FGILLTSCF

SEQ ID NO: 54781 - protein, 9 aa, Borrelia burgdorferi B31
IGADQDQSY

SEQ ID NO: 54782 - protein, 9 aa, Borrelia burgdorferi B31
VFRVEQGAF

SEQ ID NO: 54783 - protein, 9 aa, Borrelia burgdorferi B31
KSFSGKIGF

SEQ ID NO: 54784 - protein, 9 aa, Borrelia burgdorferi B31
YMLTDASLL

SEQ ID NO: 54785 - protein, 9 aa, Borrelia burgdorferi B31
GLRDGVIGL

SEQ ID NO: 54786 - protein, 9 aa, Borrelia burgdorferi B31
TAKNLGDGY

SEQ ID NO: 54787 - protein, 9 aa, Borrelia burgdorferi B31
VQIPENLIA

SEQ ID NO: 54788 - protein, 9 aa, Borrelia burgdorferi B31
KDIEIISEY

SEQ ID NO: 54789 - protein, 9 aa, Borrelia burgdorferi B31
SSENPKISY

SEQ ID NO: 54790 - protein, 9 aa, Borrelia burgdorferi B31
IGLPNANEF

SEQ ID NO: 54791 - protein, 9 aa, Borrelia burgdorferi B31
ISMLVDGVL

SEQ ID NO: 54792 - protein, 10 aa, Borrelia burgdorferi B31
GMKGNIVDAF

SEQ ID NO: 54793 - protein, 10 aa, Borrelia burgdorferi B31
VVFRVEQGAF

SEQ ID NO: 54794 - protein, 10 aa, Borrelia burgdorferi B31
YSKGIDVIHF

SEQ ID NO: 54795 - protein, 10 aa, Borrelia burgdorferi B31
ISYGIIDPIY

SEQ ID NO: 54796 - protein, 10 aa, Borrelia burgdorferi B31
VSSENPKISY

SEQ ID NO: 54797 - protein, 10 aa, Borrelia burgdorferi B31
VQIPENLIAV

SEQ ID NO: 54798 - protein, 10 aa, Borrelia burgdorferi B31
VIKNIGDALY

SEQ ID NO: 54799 - protein, 10 aa, Borrelia burgdorferi B31
VQMGLRDGVI

SEQ ID NO: 54800 - protein, 10 aa, Borrelia burgdorferi B31
TAKNLGDGYY

SEQ ID NO: 54801 - protein, 10 aa, Borrelia burgdorferi B31
IIVPCNQEEY

SEQ ID NO: 54802 - protein, 10 aa, Borrelia burgdorferi B31
VFSCAISGVY

SEQ ID NO: 54803 - protein, 10 aa, Borrelia burgdorferi B31
VIGADQDQSY

SEQ ID NO: 54804 - protein, 10 aa, Borrelia burgdorferi B31
IGRTIASKMY

SEQ ID NO: 54805 - protein, 10 aa, Borrelia burgdorferi B31
CAISGVYSSY

SEQ ID NO: 54806 - protein, 10 aa, Borrelia burgdorferi B31
EIISEYSNSF

SEQ ID NO: 54807 - protein, 10 aa, Borrelia burgdorferi B31
VIGLPNANEF

SEQ ID NO: 54808 - protein, 11 aa, Borrelia burgdorferi B31
YVIGADQDQSY

SEQ ID NO: 54809 - protein, 11 aa, Borrelia burgdorferi B31
FIFGILLTSCF

SEQ ID NO: 54810 - protein, 11 aa, Borrelia burgdorferi B31
GVIGLPNANEF

SEQ ID NO: 54811 - protein, 11 aa, Borrelia burgdorferi B31
SVIKNIGDALY

SEQ ID NO: 54812 - protein, 11 aa, Borrelia burgdorferi B31
LVSSENPKISY

SEQ ID NO: 54813 - protein, 11 aa, Borrelia burgdorferi B31
VQIPENLIAVV

SEQ ID NO: 54814 - protein, 11 aa, Borrelia burgdorferi B31
AVVFRVEQGAF

SEQ ID NO: 54815 - protein, 11 aa, Borrelia burgdorferi B31
EVFSCAISGVY

SEQ ID NO: 54816 - protein, 11 aa, Borrelia burgdorferi B31
RVEQGAFLAGY

SEQ ID NO: 54817 - protein, 11 aa, Borrelia burgdorferi B31
KISYGIIDPIY

SEQ ID NO: 54818 - protein, 11 aa, Borrelia burgdorferi B31
KSFNSSANEAL

SEQ ID NO: 54819 - protein, 11 aa, Borrelia burgdorferi B31
ANKDIEIISEY

SEQ ID NO: 54820 - protein, 11 aa, Borrelia burgdorferi B31
KMYSKGIDVIH

SEQ ID NO: 54821 - protein, 11 aa, Borrelia burgdorferi B31
SCAISGVYSSY

SEQ ID NO: 54822 - protein, 11 aa, Borrelia burgdorferi B31
YLAPKNFITSV

SEQ ID NO: 54823 - protein, 11 aa, Borrelia burgdorferi B31
IEIISEYSNSF

SEQ ID NO: 54824 - protein, 11 aa, Borrelia burgdorferi B31
QIPENLIAVVF

SEQ ID NO: 54825 - protein, 11 aa, Borrelia burgdorferi B31
GGMKGNIVDAF

SEQ ID NO: 54826 - protein, 11 aa, Borrelia burgdorferi B31
EIIVPCNQEEY

SEQ ID NO: 54827 - protein, 9 aa, Borrelia burgdorferi B31
FRYGYESGA

SEQ ID NO: 54828 - protein, 9 aa, Borrelia burgdorferi B31
FRVEQGAFL

SEQ ID NO: 54829 - protein, 9 aa, Borrelia burgdorferi B31
GRTIASKMY

SEQ ID NO: 54830 - protein, 9 aa, Borrelia burgdorferi B31
SRNGIESSS

SEQ ID NO: 54831 - protein, 9 aa, Borrelia burgdorferi B31
KRNGSDLIW

SEQ ID NO: 54832 - protein, 10 aa, Borrelia burgdorferi B31
FRYGYESGAK

SEQ ID NO: 54833 - protein, 10 aa, Borrelia burgdorferi B31
SRNGIESSSK

SEQ ID NO: 54834 - protein, 10 aa, Borrelia burgdorferi B31
KRNGSDLIWL

SEQ ID NO: 54835 - protein, 10 aa, Borrelia burgdorferi B31
MRIVIFIFGI

SEQ ID NO: 54836 - protein, 11 aa, Borrelia burgdorferi B31
SRNGIESSSKK

SEQ ID NO: 54837 - protein, 11 aa, Borrelia burgdorferi B31
GRTIASKMYSK

SEQ ID NO: 54838 - protein, 11 aa, Borrelia burgdorferi B31
KRNGSDLIWLV

SEQ ID NO: 54839 - protein, 11 aa, Borrelia burgdorferi B31
MRIVIFIFGIL

SEQ ID NO: 54840 - protein, 9 aa, Borrelia burgdorferi B31
FPENIEEVF

SEQ ID NO: 54841 - protein, 9 aa, Borrelia burgdorferi B31
LPNANEFEY

SEQ ID NO: 54842 - protein, 9 aa, Borrelia burgdorferi B31
TAKNLGDGY

SEQ ID NO: 54843 - protein, 9 aa, Borrelia burgdorferi B31
FSCAISGVY

SEQ ID NO: 54844 - protein, 9 aa, Borrelia burgdorferi B31
IISEYSNSF

SEQ ID NO: 54845 - protein, 9 aa, Borrelia burgdorferi B31
IGADQDQSY

SEQ ID NO: 54846 - protein, 9 aa, Borrelia burgdorferi B31
DPIYGDDVQ

SEQ ID NO: 54847 - protein, 9 aa, Borrelia burgdorferi B31
MKGNIVDAF

SEQ ID NO: 54848 - protein, 9 aa, Borrelia burgdorferi B31
YGYESGAKY

SEQ ID NO: 54849 - protein, 9 aa, Borrelia burgdorferi B31
IPENLIAVV

SEQ ID NO: 54850 - protein, 9 aa, Borrelia burgdorferi B31
IKNIGDALY

SEQ ID NO: 54851 - protein, 9 aa, Borrelia burgdorferi B31
LIWLVGYML

SEQ ID NO: 54852 - protein, 9 aa, Borrelia burgdorferi B31
FNSSANEAL

SEQ ID NO: 54853 - protein, 9 aa, Borrelia burgdorferi B31
IGLPNANEF

SEQ ID NO: 54854 - protein, 9 aa, Borrelia burgdorferi B31
IVPCNQEEY

SEQ ID NO: 54855 - protein, 9 aa, Borrelia burgdorferi B31
FGILLTSCF

SEQ ID NO: 54856 - protein, 9 aa, Borrelia burgdorferi B31
FRVEQGAFL

SEQ ID NO: 54857 - protein, 9 aa, Borrelia burgdorferi B31
SANEALLRL

SEQ ID NO: 54858 - protein, 9 aa, Borrelia burgdorferi B31
YMLTDASLL

SEQ ID NO: 54859 - protein, 10 aa, Borrelia burgdorferi B31
IPENLIAVVF

SEQ ID NO: 54860 - protein, 10 aa, Borrelia burgdorferi B31
DALYLITGEY

SEQ ID NO: 54861 - protein, 10 aa, Borrelia burgdorferi B31
TAKNLGDGYY

SEQ ID NO: 54862 - protein, 10 aa, Borrelia burgdorferi B31
CAISGVYSSY

SEQ ID NO: 54863 - protein, 10 aa, Borrelia burgdorferi B31
FPENIEEVFS

SEQ ID NO: 54864 - protein, 10 aa, Borrelia burgdorferi B31
ISYGIIDPIY

SEQ ID NO: 54865 - protein, 10 aa, Borrelia burgdorferi B31
IIVPCNQEEY

SEQ ID NO: 54866 - protein, 10 aa, Borrelia burgdorferi B31
VFSCAISGVY

SEQ ID NO: 54867 - protein, 10 aa, Borrelia burgdorferi B31
NIVDAFRYGY

SEQ ID NO: 54868 - protein, 10 aa, Borrelia burgdorferi B31
EIISEYSNSF

SEQ ID NO: 54869 - protein, 10 aa, Borrelia burgdorferi B31
DPIYGDDVQI

SEQ ID NO: 54870 - protein, 10 aa, Borrelia burgdorferi B31
VVFRVEQGAF

SEQ ID NO: 54871 - protein, 10 aa, Borrelia burgdorferi B31
LPNANEFEYI

SEQ ID NO: 54872 - protein, 10 aa, Borrelia burgdorferi B31
DFPENIEEVF

SEQ ID NO: 54873 - protein, 10 aa, Borrelia burgdorferi B31
VIKNIGDALY

SEQ ID NO: 54874 - protein, 10 aa, Borrelia burgdorferi B31
SFNSSANEAL

SEQ ID NO: 54875 - protein, 10 aa, Borrelia burgdorferi B31
VPCNQEEYEI

SEQ ID NO: 54876 - protein, 10 aa, Borrelia burgdorferi B31
YSKGIDVIHF

SEQ ID NO: 54877 - protein, 10 aa, Borrelia burgdorferi B31
ETAKNLGDGY

SEQ ID NO: 54878 - protein, 10 aa, Borrelia burgdorferi B31
FAAGLAGIGV

SEQ ID NO: 54879 - protein, 11 aa, Borrelia burgdorferi B31
YVIGADQDQSY

SEQ ID NO: 54880 - protein, 11 aa, Borrelia burgdorferi B31
VPCNQEEYEIF

SEQ ID NO: 54881 - protein, 11 aa, Borrelia burgdorferi B31
EVFSCAISGVY

SEQ ID NO: 54882 - protein, 11 aa, Borrelia burgdorferi B31
NVWEGGKVVQM

SEQ ID NO: 54883 - protein, 11 aa, Borrelia burgdorferi B31
NANEFEYIKVL

SEQ ID NO: 54884 - protein, 11 aa, Borrelia burgdorferi B31
LVSSENPKISY

SEQ ID NO: 54885 - protein, 11 aa, Borrelia burgdorferi B31
FIFGILLTSCF

SEQ ID NO: 54886 - protein, 11 aa, Borrelia burgdorferi B31
FPENIEEVFSC

SEQ ID NO: 54887 - protein, 11 aa, Borrelia burgdorferi B31
LAGYIAAKKSF

SEQ ID NO: 54888 - protein, 11 aa, Borrelia burgdorferi B31
FAAGLAGIGVI

SEQ ID NO: 54889 - protein, 11 aa, Borrelia burgdorferi B31
RVEQGAFLAGY

SEQ ID NO: 54890 - protein, 11 aa, Borrelia burgdorferi B31
SVIKNIGDALY

SEQ ID NO: 54891 - protein, 11 aa, Borrelia burgdorferi B31
KISYGIIDPIY

SEQ ID NO: 54892 - protein, 11 aa, Borrelia burgdorferi B31
LVDGVLDDKSF

SEQ ID NO: 54893 - protein, 11 aa, Borrelia burgdorferi B31
IGLPNANEFEY

SEQ ID NO: 54894 - protein, 11 aa, Borrelia burgdorferi B31
QIPENLIAVVF

SEQ ID NO: 54895 - protein, 11 aa, Borrelia burgdorferi B31
FRYGYESGAKY

SEQ ID NO: 54896 - protein, 11 aa, Borrelia burgdorferi B31
MKGNIVDAFRY

SEQ ID NO: 54897 - protein, 11 aa, Borrelia burgdorferi B31
GVIGLPNANEF

SEQ ID NO: 54898 - protein, 11 aa, Borrelia burgdorferi B31
AVVFRVEQGAF

SEQ ID NO: 54899 - protein, 11 aa, Borrelia burgdorferi B31
NGSDLIWLVGY

SEQ ID NO: 54900 - protein, 11 aa, Borrelia burgdorferi B31
EIIVPCNQEEY

SEQ ID NO: 54901 - protein, 11 aa, Borrelia burgdorferi B31
TSVIKNIGDAL

SEQ ID NO: 54902 - protein, 11 aa, Borrelia burgdorferi B31
LVGYMLTDASL

SEQ ID NO: 54903 - protein, 11 aa, Borrelia burgdorferi B31
ETAKNLGDGYY

SEQ ID NO: 54904 - protein, 9 aa, Borrelia burgdorferi B31
NEFEYIKVL

SEQ ID NO: 54905 - protein, 9 aa, Borrelia burgdorferi B31
KEIIVPCNQ

SEQ ID NO: 54906 - protein, 9 aa, Borrelia burgdorferi B31
EEYEIFIKQ

SEQ ID NO: 54907 - protein, 9 aa, Borrelia burgdorferi B31
PENLIAVVF

SEQ ID NO: 54908 - protein, 9 aa, Borrelia burgdorferi B31
EEVFSCAIS

SEQ ID NO: 54909 - protein, 10 aa, Borrelia burgdorferi B31
EEYEIFIKQI

SEQ ID NO: 54910 - protein, 10 aa, Borrelia burgdorferi B31
SENPKISYGI

SEQ ID NO: 54911 - protein, 10 aa, Borrelia burgdorferi B31
NEFEYIKVLE

SEQ ID NO: 54912 - protein, 10 aa, Borrelia burgdorferi B31
GEYIKNNNVW

SEQ ID NO: 54913 - protein, 10 aa, Borrelia burgdorferi B31
KEIIVPCNQE

SEQ ID NO: 54914 - protein, 10 aa, Borrelia burgdorferi B31
EEVFSCAISG

SEQ ID NO: 54915 - protein, 11 aa, Borrelia burgdorferi B31
EEYEIFIKQIL

SEQ ID NO: 54916 - protein, 11 aa, Borrelia burgdorferi B31
SENPKISYGII

SEQ ID NO: 54917 - protein, 11 aa, Borrelia burgdorferi B31
IEIISEYSNSF

SEQ ID NO: 54918 - protein, 11 aa, Borrelia burgdorferi B31
NEFEYIKVLER

SEQ ID NO: 54919 - protein, 11 aa, Borrelia burgdorferi B31
YEIFIKQILKL

SEQ ID NO: 54920 - protein, 11 aa, Borrelia burgdorferi B31
EEVFSCAISGV

SEQ ID NO: 54921 - protein, 11 aa, Borrelia burgdorferi B31
KEIIVPCNQEE

SEQ ID NO: 54922 - protein, 11 aa, Borrelia burgdorferi B31
NEALLRLKKDF

SEQ ID NO: 54923 - protein, 9 aa, Borrelia burgdorferi B31
IPENLIAVV

SEQ ID NO: 54924 - protein, 9 aa, Borrelia burgdorferi B31
NPKISYGII

SEQ ID NO: 54925 - protein, 10 aa, Borrelia burgdorferi B31
LPNANEFEYI

SEQ ID NO: 54926 - protein, 10 aa, Borrelia burgdorferi B31
DPIYGDDVQI

SEQ ID NO: 54927 - protein, 10 aa, Borrelia burgdorferi B31
LAPKNFITSV

SEQ ID NO: 54928 - protein, 10 aa, Borrelia burgdorferi B31
APKNFITSVI

SEQ ID NO: 54929 - protein, 10 aa, Borrelia burgdorferi B31
IPENLIAVVF

SEQ ID NO: 54930 - protein, 10 aa, Borrelia burgdorferi B31
VPCNQEEYEI

SEQ ID NO: 54931 - protein, 11 aa, Borrelia burgdorferi B31
LAPKNFITSVI

SEQ ID NO: 54932 - protein, 11 aa, Borrelia burgdorferi B31
FPENIEEVFSC

SEQ ID NO: 54933 - protein, 10 aa, Borrelia burgdorferi B31
ISYGIIDPIY

SEQ ID NO: 54934 - protein, 11 aa, Borrelia burgdorferi B31
TGEYIKNNNVW

SEQ ID NO: 54935 - protein, 10 aa, Borrelia burgdorferi B31
FSDLSVKLSY

SEQ ID NO: 54936 - protein, 11 aa, Borrelia burgdorferi B31
TVDEAMTEDAY

SEQ ID NO: 54937 - protein, 9 aa, Borrelia burgdorferi B31
AMTEDAYEV

SEQ ID NO: 54938 - protein, 9 aa, Borrelia burgdorferi B31
RLVDEVIDL

SEQ ID NO: 54939 - protein, 9 aa, Borrelia burgdorferi B31
FIFITLSLL

SEQ ID NO: 54940 - protein, 9 aa, Borrelia burgdorferi B31
KIISGEIIV

SEQ ID NO: 54941 - protein, 9 aa, Borrelia burgdorferi B31
GLKEGVIEI

SEQ ID NO: 54942 - protein, 9 aa, Borrelia burgdorferi B31
GIFYANPKL

SEQ ID NO: 54943 - protein, 9 aa, Borrelia burgdorferi B31
GLNQDQSYI

SEQ ID NO: 54944 - protein, 9 aa, Borrelia burgdorferi B31
ITLSLLVFA

SEQ ID NO: 54945 - protein, 9 aa, Borrelia burgdorferi B31
RLLTVDEAM

SEQ ID NO: 54946 - protein, 9 aa, Borrelia burgdorferi B31
FLAGYIAAK

SEQ ID NO: 54947 - protein, 9 aa, Borrelia burgdorferi B31
SIIKDIGKV

SEQ ID NO: 54948 - protein, 9 aa, Borrelia burgdorferi B31
SVHDGVVKL

SEQ ID NO: 54949 - protein, 9 aa, Borrelia burgdorferi B31
IIVPDSEYA

SEQ ID NO: 54950 - protein, 9 aa, Borrelia burgdorferi B31
KSDKVVVGV

SEQ ID NO: 54951 - protein, 9 aa, Borrelia burgdorferi B31
KLSYERPDI

SEQ ID NO: 54952 - protein, 9 aa, Borrelia burgdorferi B31
YIAPQNVIT

SEQ ID NO: 54953 - protein, 9 aa, Borrelia burgdorferi B31
KVGVIFPIA

SEQ ID NO: 54954 - protein, 9 aa, Borrelia burgdorferi B31
YANPKLRLV

SEQ ID NO: 54955 - protein, 10 aa, Borrelia burgdorferi B31
FMYKEDKVGV

SEQ ID NO: 54956 - protein, 10 aa, Borrelia burgdorferi B31
FLAGYIAAKM

SEQ ID NO: 54957 - protein, 10 aa, Borrelia burgdorferi B31
FIFITLSLLV

SEQ ID NO: 54958 - protein, 10 aa, Borrelia burgdorferi B31
FLTGPMSEHV

SEQ ID NO: 54959 - protein, 10 aa, Borrelia burgdorferi B31
VLNNRLVDEV

SEQ ID NO: 54960 - protein, 10 aa, Borrelia burgdorferi B31
ALFMYKEDKV

SEQ ID NO: 54961 - protein, 10 aa, Borrelia burgdorferi B31
VIYSISSEYI

SEQ ID NO: 54962 - protein, 10 aa, Borrelia burgdorferi B31
FITLSLLVFA

SEQ ID NO: 54963 - protein, 10 aa, Borrelia burgdorferi B31
WLIGYRFSDL

SEQ ID NO: 54964 - protein, 10 aa, Borrelia burgdorferi B31
GLKEGVIEIV

SEQ ID NO: 54965 - protein, 10 aa, Borrelia burgdorferi B31
RLVSKKAPSL

SEQ ID NO: 54966 - protein, 10 aa, Borrelia burgdorferi B31
KLRDNFGIKL

SEQ ID NO: 54967 - protein, 10 aa, Borrelia burgdorferi B31
FGFKAGIFYA

SEQ ID NO: 54968 - protein, 10 aa, Borrelia burgdorferi B31
GLNQDQSYIA

SEQ ID NO: 54969 - protein, 10 aa, Borrelia burgdorferi B31
YAFDLFKSKL

SEQ ID NO: 54970 - protein, 10 aa, Borrelia burgdorferi B31
RLLTVDEAMT

SEQ ID NO: 54971 - protein, 10 aa, Borrelia burgdorferi B31
IIDRGLKEGV

SEQ ID NO: 54972 - protein, 10 aa, Borrelia burgdorferi B31
ISSEYINNRV

SEQ ID NO: 54973 - protein, 11 aa, Borrelia burgdorferi B31
YIAPQNVITSI

SEQ ID NO: 54974 - protein, 11 aa, Borrelia burgdorferi B31
FMYKEDKVGVI

SEQ ID NO: 54975 - protein, 11 aa, Borrelia burgdorferi B31
KVIYSISSEYI

SEQ ID NO: 54976 - protein, 11 aa, Borrelia burgdorferi B31
VIFPIAGITGL

SEQ ID NO: 54977 - protein, 11 aa, Borrelia burgdorferi B31
SISSEYINNRV

SEQ ID NO: 54978 - protein, 11 aa, Borrelia burgdorferi B31
IIIDRGLKEGV

SEQ ID NO: 54979 - protein, 11 aa, Borrelia burgdorferi B31
LIGYRFSDLSV

SEQ ID NO: 54980 - protein, 11 aa, Borrelia burgdorferi B31
VLNNRLVDEVI

SEQ ID NO: 54981 - protein, 11 aa, Borrelia burgdorferi B31
YINNRVFKGGI

SEQ ID NO: 54982 - protein, 11 aa, Borrelia burgdorferi B31
FLAGYIAAKMS

SEQ ID NO: 54983 - protein, 11 aa, Borrelia burgdorferi B31
GIFYANPKLRL

SEQ ID NO: 54984 - protein, 11 aa, Borrelia burgdorferi B31
KMSRKEKIGFL

SEQ ID NO: 54985 - protein, 11 aa, Borrelia burgdorferi B31
SLAIKFRNEEA

SEQ ID NO: 54986 - protein, 11 aa, Borrelia burgdorferi B31
SFYDKGYNQSV

SEQ ID NO: 54987 - protein, 11 aa, Borrelia burgdorferi B31
KLRDNFGIKLI

SEQ ID NO: 54988 - protein, 11 aa, Borrelia burgdorferi B31
LITKSLRPYPI

SEQ ID NO: 54989 - protein, 11 aa, Borrelia burgdorferi B31
RFIFITLSLLV

SEQ ID NO: 54990 - protein, 11 aa, Borrelia burgdorferi B31
KVGVIFPIAGI

SEQ ID NO: 54991 - protein, 11 aa, Borrelia burgdorferi B31
GVIEIVKDPDV

SEQ ID NO: 54992 - protein, 11 aa, Borrelia burgdorferi B31
GLGVYDAAKEL

SEQ ID NO: 54993 - protein, 11 aa, Borrelia burgdorferi B31
IVPDSEYAFDL

SEQ ID NO: 54994 - protein, 11 aa, Borrelia burgdorferi B31
SLFDKEKGKAM

SEQ ID NO: 54995 - protein, 9 aa, Borrelia burgdorferi B31
KAMALFMYK

SEQ ID NO: 54996 - protein, 9 aa, Borrelia burgdorferi B31
FLAGYIAAK

SEQ ID NO: 54997 - protein, 9 aa, Borrelia burgdorferi B31
YIAAKMSRK

SEQ ID NO: 54998 - protein, 9 aa, Borrelia burgdorferi B31
SLLVFACFK

SEQ ID NO: 54999 - protein, 9 aa, Borrelia burgdorferi B31
KLRDNFGIK

SEQ ID NO: 55000 - protein, 9 aa, Borrelia burgdorferi B31
GVLAHGSFY

SEQ ID NO: 55001 - protein, 9 aa, Borrelia burgdorferi B31
NLFWLIGYR

SEQ ID NO: 55002 - protein, 9 aa, Borrelia burgdorferi B31
VIYSISSEY

SEQ ID NO: 55003 - protein, 9 aa, Borrelia burgdorferi B31
ALFMYKEDK

SEQ ID NO: 55004 - protein, 9 aa, Borrelia burgdorferi B31
LAHGSFYDK

SEQ ID NO: 55005 - protein, 9 aa, Borrelia burgdorferi B31
GIIIDRGLK

SEQ ID NO: 55006 - protein, 9 aa, Borrelia burgdorferi B31
SLFDKEKGK

SEQ ID NO: 55007 - protein, 9 aa, Borrelia burgdorferi B31
VFACFKSNK

SEQ ID NO: 55008 - protein, 9 aa, Borrelia burgdorferi B31
IFYANPKLR

SEQ ID NO: 55009 - protein, 9 aa, Borrelia burgdorferi B31
MSEHVKDFK

SEQ ID NO: 55010 - protein, 9 aa, Borrelia burgdorferi B31
SEYAFDLFK

SEQ ID NO: 55011 - protein, 9 aa, Borrelia burgdorferi B31
YAFDLFKSK

SEQ ID NO: 55012 - protein, 9 aa, Borrelia burgdorferi B31
FACFKSNKK

SEQ ID NO: 55013 - protein, 9 aa, Borrelia burgdorferi B31
KAMALFMYK

SEQ ID NO: 55014 - protein, 9 aa, Borrelia burgdorferi B31
FLAGYIAAK

SEQ ID NO: 55015 - protein, 9 aa, Borrelia burgdorferi B31
YIAAKMSRK

SEQ ID NO: 55016 - protein, 9 aa, Borrelia burgdorferi B31
SLLVFACFK

SEQ ID NO: 55017 - protein, 9 aa, Borrelia burgdorferi B31
KLRDNFGIK

SEQ ID NO: 55018 - protein, 9 aa, Borrelia burgdorferi B31
GVLAHGSFY

SEQ ID NO: 55019 - protein, 9 aa, Borrelia burgdorferi B31
NLFWLIGYR

SEQ ID NO: 55020 - protein, 9 aa, Borrelia burgdorferi B31
VIYSISSEY

SEQ ID NO: 55021 - protein, 9 aa, Borrelia burgdorferi B31
ALFMYKEDK

SEQ ID NO: 55022 - protein, 9 aa, Borrelia burgdorferi B31
LAHGSFYDK

SEQ ID NO: 55023 - protein, 9 aa, Borrelia burgdorferi B31
GIIIDRGLK

SEQ ID NO: 55024 - protein, 9 aa, Borrelia burgdorferi B31
SLFDKEKGK

SEQ ID NO: 55025 - protein, 9 aa, Borrelia burgdorferi B31
VFACFKSNK

SEQ ID NO: 55026 - protein, 9 aa, Borrelia burgdorferi B31
IFYANPKLR

SEQ ID NO: 55027 - protein, 9 aa, Borrelia burgdorferi B31
MSEHVKDFK

SEQ ID NO: 55028 - protein, 9 aa, Borrelia burgdorferi B31
SEYAFDLFK

SEQ ID NO: 55029 - protein, 9 aa, Borrelia burgdorferi B31
YAFDLFKSK

SEQ ID NO: 55030 - protein, 9 aa, Borrelia burgdorferi B31
FACFKSNKK

SEQ ID NO: 55031 - protein, 11 aa, Borrelia burgdorferi B31
LVFACFKSNKK

SEQ ID NO: 55032 - protein, 11 aa, Borrelia burgdorferi B31
KSNKKSIKSDK

SEQ ID NO: 55033 - protein, 11 aa, Borrelia burgdorferi B31
TLSLLVFACFK

SEQ ID NO: 55034 - protein, 11 aa, Borrelia burgdorferi B31
GVLAHGSFYDK

SEQ ID NO: 55035 - protein, 11 aa, Borrelia burgdorferi B31
KSLRPYPIEGK

SEQ ID NO: 55036 - protein, 11 aa, Borrelia burgdorferi B31
LLVFACFKSNK

SEQ ID NO: 55037 - protein, 11 aa, Borrelia burgdorferi B31
RVFKGGIIIDR

SEQ ID NO: 55038 - protein, 11 aa, Borrelia burgdorferi B31
FLTGPMSEHVK

SEQ ID NO: 55039 - protein, 11 aa, Borrelia burgdorferi B31
KGKAMALFMYK

SEQ ID NO: 55040 - protein, 11 aa, Borrelia burgdorferi B31
KLSYERPDIYY

SEQ ID NO: 55041 - protein, 11 aa, Borrelia burgdorferi B31
YIAAKMSRKEK

SEQ ID NO: 55042 - protein, 11 aa, Borrelia burgdorferi B31
GLKEGVIEIVK

SEQ ID NO: 55043 - protein, 11 aa, Borrelia burgdorferi B31
VSKKAPSLFDK

SEQ ID NO: 55044 - protein, 11 aa, Borrelia burgdorferi B31
AMALFMYKEDK

SEQ ID NO: 55045 - protein, 11 aa, Borrelia burgdorferi B31
AAFLAGYIAAK

SEQ ID NO: 55046 - protein, 11 aa, Borrelia burgdorferi B31
IGYRFSDLSVK

SEQ ID NO: 55047 - protein, 11 aa, Borrelia burgdorferi B31
YANPKLRLVSK

SEQ ID NO: 55048 - protein, 11 aa, Borrelia burgdorferi B31
VITSIIKDIGK

SEQ ID NO: 55049 - protein, 11 aa, Borrelia burgdorferi B31
IQVPKNSLAIK

SEQ ID NO: 55050 - protein, 11 aa, Borrelia burgdorferi B31
AMTEDAYEVQK

SEQ ID NO: 55051 - protein, 11 aa, Borrelia burgdorferi B31
VVGVLAHGSFY

SEQ ID NO: 55052 - protein, 11 aa, Borrelia burgdorferi B31
VVKLRDNFGIK

SEQ ID NO: 55053 - protein, 11 aa, Borrelia burgdorferi B31
RFSDLSVKLSY

SEQ ID NO: 55054 - protein, 11 aa, Borrelia burgdorferi B31
ITGLGVYDAAK

SEQ ID NO: 55055 - protein, 11 aa, Borrelia burgdorferi B31
SSEYINNRVFK

SEQ ID NO: 55056 - protein, 11 aa, Borrelia burgdorferi B31
AGYIAAKMSRK

SEQ ID NO: 55057 - protein, 11 aa, Borrelia burgdorferi B31
SLRPYPIEGKR

SEQ ID NO: 55058 - protein, 11 aa, Borrelia burgdorferi B31
PLNLFWLIGYR

SEQ ID NO: 55059 - protein, 11 aa, Borrelia burgdorferi B31
RDNFGIKLITK

SEQ ID NO: 55060 - protein, 9 aa, Borrelia burgdorferi B31
KAMALFMYK

SEQ ID NO: 55061 - protein, 9 aa, Borrelia burgdorferi B31
SLLVFACFK

SEQ ID NO: 55062 - protein, 9 aa, Borrelia burgdorferi B31
SEYAFDLFK

SEQ ID NO: 55063 - protein, 9 aa, Borrelia burgdorferi B31
YIAAKMSRK

SEQ ID NO: 55064 - protein, 9 aa, Borrelia burgdorferi B31
GIIIDRGLK

SEQ ID NO: 55065 - protein, 9 aa, Borrelia burgdorferi B31
MSEHVKDFK

SEQ ID NO: 55066 - protein, 9 aa, Borrelia burgdorferi B31
TSIIKDIGK

SEQ ID NO: 55067 - protein, 9 aa, Borrelia burgdorferi B31
YAFDLFKSK

SEQ ID NO: 55068 - protein, 9 aa, Borrelia burgdorferi B31
GVLAHGSFY

SEQ ID NO: 55069 - protein, 9 aa, Borrelia burgdorferi B31
ALFMYKEDK

SEQ ID NO: 55070 - protein, 9 aa, Borrelia burgdorferi B31
LAHGSFYDK

SEQ ID NO: 55071 - protein, 9 aa, Borrelia burgdorferi B31
VIYSISSEY

SEQ ID NO: 55072 - protein, 9 aa, Borrelia burgdorferi B31
SLFDKEKGK

SEQ ID NO: 55073 - protein, 9 aa, Borrelia burgdorferi B31
AGIFYANPK

SEQ ID NO: 55074 - protein, 9 aa, Borrelia burgdorferi B31
NLFWLIGYR

SEQ ID NO: 55075 - protein, 9 aa, Borrelia burgdorferi B31
AAKMSRKEK

SEQ ID NO: 55076 - protein, 9 aa, Borrelia burgdorferi B31
FLAGYIAAK

SEQ ID NO: 55077 - protein, 9 aa, Borrelia burgdorferi B31
ISSEYINNR

SEQ ID NO: 55078 - protein, 9 aa, Borrelia burgdorferi B31
FACFKSNKK

SEQ ID NO: 55079 - protein, 9 aa, Borrelia burgdorferi B31
VFACFKSNK

SEQ ID NO: 55080 - protein, 9 aa, Borrelia burgdorferi B31
QSVHDGVVK

SEQ ID NO: 55081 - protein, 9 aa, Borrelia burgdorferi B31
KLRDNFGIK

SEQ ID NO: 55082 - protein, 9 aa, Borrelia burgdorferi B31
LSVKLSYER

SEQ ID NO: 55083 - protein, 9 aa, Borrelia burgdorferi B31
GLGVYDAAK

SEQ ID NO: 55084 - protein, 9 aa, Borrelia burgdorferi B31
EYINNRVFK

SEQ ID NO: 55085 - protein, 10 aa, Borrelia burgdorferi B31
LVFACFKSNK

SEQ ID NO: 55086 - protein, 10 aa, Borrelia burgdorferi B31
LSLLVFACFK

SEQ ID NO: 55087 - protein, 10 aa, Borrelia burgdorferi B31
HVKDFKFGFK

SEQ ID NO: 55088 - protein, 10 aa, Borrelia burgdorferi B31
VLAHGSFYDK

SEQ ID NO: 55089 - protein, 10 aa, Borrelia burgdorferi B31
KAGIFYANPK

SEQ ID NO: 55090 - protein, 10 aa, Borrelia burgdorferi B31
MTEDAYEVQK

SEQ ID NO: 55091 - protein, 10 aa, Borrelia burgdorferi B31
ITSIIKDIGK

SEQ ID NO: 55092 - protein, 10 aa, Borrelia burgdorferi B31
KVIYSISSEY

SEQ ID NO: 55093 - protein, 10 aa, Borrelia burgdorferi B31
SISSEYINNR

SEQ ID NO: 55094 - protein, 10 aa, Borrelia burgdorferi B31
MALFMYKEDK

SEQ ID NO: 55095 - protein, 10 aa, Borrelia burgdorferi B31
LTGPMSEHVK

SEQ ID NO: 55096 - protein, 10 aa, Borrelia burgdorferi B31
AFLAGYIAAK

SEQ ID NO: 55097 - protein, 10 aa, Borrelia burgdorferi B31
SVHDGVVKLR

SEQ ID NO: 55098 - protein, 10 aa, Borrelia burgdorferi B31
GYIAAKMSRK

SEQ ID NO: 55099 - protein, 10 aa, Borrelia burgdorferi B31
GIFYANPKLR

SEQ ID NO: 55100 - protein, 10 aa, Borrelia burgdorferi B31
GKAMALFMYK

SEQ ID NO: 55101 - protein, 10 aa, Borrelia burgdorferi B31
IAAKMSRKEK

SEQ ID NO: 55102 - protein, 10 aa, Borrelia burgdorferi B31
SEYINNRVFK

SEQ ID NO: 55103 - protein, 10 aa, Borrelia burgdorferi B31
KAPSLFDKEK

SEQ ID NO: 55104 - protein, 10 aa, Borrelia burgdorferi B31
QVPKNSLAIK

SEQ ID NO: 55105 - protein, 10 aa, Borrelia burgdorferi B31
SLRPYPIEGK

SEQ ID NO: 55106 - protein, 10 aa, Borrelia burgdorferi B31
DSEYAFDLFK

SEQ ID NO: 55107 - protein, 10 aa, Borrelia burgdorferi B31
LSYERPDIYY

SEQ ID NO: 55108 - protein, 10 aa, Borrelia burgdorferi B31
KAMALFMYKE

SEQ ID NO: 55109 - protein, 10 aa, Borrelia burgdorferi B31
PMSEHVKDFK

SEQ ID NO: 55110 - protein, 10 aa, Borrelia burgdorferi B31
VFACFKSNKK

SEQ ID NO: 55111 - protein, 10 aa, Borrelia burgdorferi B31
PQNVITSIIK

SEQ ID NO: 55112 - protein, 10 aa, Borrelia burgdorferi B31
KLITKSLRPY

SEQ ID NO: 55113 - protein, 10 aa, Borrelia burgdorferi B31
NQSVHDGVVK

SEQ ID NO: 55114 - protein, 10 aa, Borrelia burgdorferi B31
SKKAPSLFDK

SEQ ID NO: 55115 - protein, 11 aa, Borrelia burgdorferi B31
TLSLLVFACFK

SEQ ID NO: 55116 - protein, 11 aa, Borrelia burgdorferi B31
GVLAHGSFYDK

SEQ ID NO: 55117 - protein, 11 aa, Borrelia burgdorferi B31
LVFACFKSNKK

SEQ ID NO: 55118 - protein, 11 aa, Borrelia burgdorferi B31
AAFLAGYIAAK

SEQ ID NO: 55119 - protein, 11 aa, Borrelia burgdorferi B31
SSEYINNRVFK

SEQ ID NO: 55120 - protein, 11 aa, Borrelia burgdorferi B31
KSLRPYPIEGK

SEQ ID NO: 55121 - protein, 11 aa, Borrelia burgdorferi B31
AMALFMYKEDK

SEQ ID NO: 55122 - protein, 11 aa, Borrelia burgdorferi B31
AMTEDAYEVQK

SEQ ID NO: 55123 - protein, 11 aa, Borrelia burgdorferi B31
KSNKKSIKSDK

SEQ ID NO: 55124 - protein, 11 aa, Borrelia burgdorferi B31
ITGLGVYDAAK

SEQ ID NO: 55125 - protein, 11 aa, Borrelia burgdorferi B31
KGKAMALFMYK

SEQ ID NO: 55126 - protein, 11 aa, Borrelia burgdorferi B31
YIAAKMSRKEK

SEQ ID NO: 55127 - protein, 11 aa, Borrelia burgdorferi B31
VSKKAPSLFDK

SEQ ID NO: 55128 - protein, 11 aa, Borrelia burgdorferi B31
SEYAFDLFKSK

SEQ ID NO: 55129 - protein, 11 aa, Borrelia burgdorferi B31
VVKLRDNFGIK

SEQ ID NO: 55130 - protein, 11 aa, Borrelia burgdorferi B31
LVDEVIDLENK

SEQ ID NO: 55131 - protein, 11 aa, Borrelia burgdorferi B31
VITSIIKDIGK

SEQ ID NO: 55132 - protein, 11 aa, Borrelia burgdorferi B31
YANPKLRLVSK

SEQ ID NO: 55133 - protein, 11 aa, Borrelia burgdorferi B31
LLVFACFKSNK

SEQ ID NO: 55134 - protein, 11 aa, Borrelia burgdorferi B31
RVFKGGIIIDR

SEQ ID NO: 55135 - protein, 11 aa, Borrelia burgdorferi B31
VVGVLAHGSFY

SEQ ID NO: 55136 - protein, 11 aa, Borrelia burgdorferi B31
AGYIAAKMSRK

SEQ ID NO: 55137 - protein, 11 aa, Borrelia burgdorferi B31
YSISSEYINNR

SEQ ID NO: 55138 - protein, 11 aa, Borrelia burgdorferi B31
FLTGPMSEHVK

SEQ ID NO: 55139 - protein, 11 aa, Borrelia burgdorferi B31
GPMSEHVKDFK

SEQ ID NO: 55140 - protein, 11 aa, Borrelia burgdorferi B31
APQNVITSIIK

SEQ ID NO: 55141 - protein, 11 aa, Borrelia burgdorferi B31
IGYRFSDLSVK

SEQ ID NO: 55142 - protein, 11 aa, Borrelia burgdorferi B31
IVKDPDVLNNR

SEQ ID NO: 55143 - protein, 11 aa, Borrelia burgdorferi B31
IQVPKNSLAIK

SEQ ID NO: 55144 - protein, 11 aa, Borrelia burgdorferi B31
GLKEGVIEIVK

SEQ ID NO: 55145 - protein, 11 aa, Borrelia burgdorferi B31
AFDYGDIQVPK

SEQ ID NO: 55146 - protein, 11 aa, Borrelia burgdorferi B31
KLSYERPDIYY

SEQ ID NO: 55147 - protein, 11 aa, Borrelia burgdorferi B31
SIIKDIGKVIY

SEQ ID NO: 55148 - protein, 9 aa, Borrelia burgdorferi B31
IYSISSEYI

SEQ ID NO: 55149 - protein, 9 aa, Borrelia burgdorferi B31
IYYGIIDAF

SEQ ID NO: 55150 - protein, 9 aa, Borrelia burgdorferi B31
IFITLSLLV

SEQ ID NO: 55151 - protein, 9 aa, Borrelia burgdorferi B31
SYIAPQNVI

SEQ ID NO: 55152 - protein, 9 aa, Borrelia burgdorferi B31
RFIFITLSL

SEQ ID NO: 55153 - protein, 9 aa, Borrelia burgdorferi B31
LFWLIGYRF

SEQ ID NO: 55154 - protein, 9 aa, Borrelia burgdorferi B31
FYANPKLRL

SEQ ID NO: 55155 - protein, 9 aa, Borrelia burgdorferi B31
EYINNRVFK

SEQ ID NO: 55156 - protein, 9 aa, Borrelia burgdorferi B31
KFGFKAGIF

SEQ ID NO: 55157 - protein, 9 aa, Borrelia burgdorferi B31
IVPDSEYAF

SEQ ID NO: 55158 - protein, 9 aa, Borrelia burgdorferi B31
VSKKAPSLF

SEQ ID NO: 55159 - protein, 9 aa, Borrelia burgdorferi B31
LSLLVFACF

SEQ ID NO: 55160 - protein, 9 aa, Borrelia burgdorferi B31
NPLNLFWLI

SEQ ID NO: 55161 - protein, 10 aa, Borrelia burgdorferi B31
IFITLSLLVF

SEQ ID NO: 55162 - protein, 10 aa, Borrelia burgdorferi B31
RFIFITLSLL

SEQ ID NO: 55163 - protein, 10 aa, Borrelia burgdorferi B31
MYKEDKVGVI

SEQ ID NO: 55164 - protein, 10 aa, Borrelia burgdorferi B31
MFKRFIFITL

SEQ ID NO: 55165 - protein, 10 aa, Borrelia burgdorferi B31
FYANPKLRLV

SEQ ID NO: 55166 - protein, 10 aa, Borrelia burgdorferi B31
EVQKNPLNLF

SEQ ID NO: 55167 - protein, 10 aa, Borrelia burgdorferi B31
EYAFDLFKSK

SEQ ID NO: 55168 - protein, 10 aa, Borrelia burgdorferi B31
PYPIEGKRLL

SEQ ID NO: 55169 - protein, 10 aa, Borrelia burgdorferi B31
YYGIIDAFDY

SEQ ID NO: 55170 - protein, 10 aa, Borrelia burgdorferi B31
KNPLNLFWLI

SEQ ID NO: 55171 - protein, 11 aa, Borrelia burgdorferi B31
EYAFDLFKSKL

SEQ ID NO: 55172 - protein, 11 aa, Borrelia burgdorferi B31
RFIFITLSLLV

SEQ ID NO: 55173 - protein, 11 aa, Borrelia burgdorferi B31
SYERPDIYYGI

SEQ ID NO: 55174 - protein, 11 aa, Borrelia burgdorferi B31
MYKEDKVGVIF

SEQ ID NO: 55175 - protein, 11 aa, Borrelia burgdorferi B31
ITLSLLVFACF

SEQ ID NO: 55176 - protein, 11 aa, Borrelia burgdorferi B31
AYEVQKNPLNL

SEQ ID NO: 55177 - protein, 11 aa, Borrelia burgdorferi B31
IYYGIIDAFDY

SEQ ID NO: 55178 - protein, 11 aa, Borrelia burgdorferi B31
GYRFSDLSVKL

SEQ ID NO: 55179 - protein, 11 aa, Borrelia burgdorferi B31
QVPKNSLAIKF

SEQ ID NO: 55180 - protein, 9 aa, Borrelia burgdorferi B31
SYERPDIYY

SEQ ID NO: 55181 - protein, 9 aa, Borrelia burgdorferi B31
YGIIDAFDY

SEQ ID NO: 55182 - protein, 9 aa, Borrelia burgdorferi B31
VIYSISSEY

SEQ ID NO: 55183 - protein, 9 aa, Borrelia burgdorferi B31
EIIVPDSEY

SEQ ID NO: 55184 - protein, 9 aa, Borrelia burgdorferi B31
FGFKAGIFY

SEQ ID NO: 55185 - protein, 9 aa, Borrelia burgdorferi B31
LFWLIGYRF

SEQ ID NO: 55186 - protein, 9 aa, Borrelia burgdorferi B31
IVPDSEYAF

SEQ ID NO: 55187 - protein, 9 aa, Borrelia burgdorferi B31
HVKDFKFGF

SEQ ID NO: 55188 - protein, 9 aa, Borrelia burgdorferi B31
IFITLSLLV

SEQ ID NO: 55189 - protein, 10 aa, Borrelia burgdorferi B31
YYGIIDAFDY

SEQ ID NO: 55190 - protein, 10 aa, Borrelia burgdorferi B31
IFITLSLLVF

SEQ ID NO: 55191 - protein, 10 aa, Borrelia burgdorferi B31
KVIYSISSEY

SEQ ID NO: 55192 - protein, 10 aa, Borrelia burgdorferi B31
KLITKSLRPY

SEQ ID NO: 55193 - protein, 10 aa, Borrelia burgdorferi B31
KFGFKAGIFY

SEQ ID NO: 55194 - protein, 10 aa, Borrelia burgdorferi B31
VIGLNQDQSY

SEQ ID NO: 55195 - protein, 10 aa, Borrelia burgdorferi B31
IIKDIGKVIY

SEQ ID NO: 55196 - protein, 10 aa, Borrelia burgdorferi B31
PLNLFWLIGY

SEQ ID NO: 55197 - protein, 10 aa, Borrelia burgdorferi B31
LSYERPDIYY

SEQ ID NO: 55198 - protein, 10 aa, Borrelia burgdorferi B31
DAAKELGPKY

SEQ ID NO: 55199 - protein, 10 aa, Borrelia burgdorferi B31
IIVPDSEYAF

SEQ ID NO: 55200 - protein, 10 aa, Borrelia burgdorferi B31
IAGITGLGVY

SEQ ID NO: 55201 - protein, 11 aa, Borrelia burgdorferi B31
YVIGLNQDQSY

SEQ ID NO: 55202 - protein, 11 aa, Borrelia burgdorferi B31
RFSDLSVKLSY

SEQ ID NO: 55203 - protein, 11 aa, Borrelia burgdorferi B31
IYYGIIDAFDY

SEQ ID NO: 55204 - protein, 11 aa, Borrelia burgdorferi B31
VVGVLAHGSFY

SEQ ID NO: 55205 - protein, 11 aa, Borrelia burgdorferi B31
KLSYERPDIYY

SEQ ID NO: 55206 - protein, 11 aa, Borrelia burgdorferi B31
SIIKDIGKVIY

SEQ ID NO: 55207 - protein, 11 aa, Borrelia burgdorferi B31
EIIVPDSEYAF

SEQ ID NO: 55208 - protein, 11 aa, Borrelia burgdorferi B31
YDAAKELGPKY

SEQ ID NO: 55209 - protein, 11 aa, Borrelia burgdorferi B31
PIAGITGLGVY

SEQ ID NO: 55210 - protein, 11 aa, Borrelia burgdorferi B31
FIFITLSLLVF

SEQ ID NO: 55211 - protein, 11 aa, Borrelia burgdorferi B31
FKFGFKAGIFY

SEQ ID NO: 55212 - protein, 11 aa, Borrelia burgdorferi B31
TVDEAMTEDAY

SEQ ID NO: 55213 - protein, 11 aa, Borrelia burgdorferi B31
QVPKNSLAIKF

SEQ ID NO: 55214 - protein, 11 aa, Borrelia burgdorferi B31
PMSEHVKDFKF

SEQ ID NO: 55215 - protein, 9 aa, Borrelia burgdorferi B31
NLFWLIGYR

SEQ ID NO: 55216 - protein, 9 aa, Borrelia burgdorferi B31
EYINNRVFK

SEQ ID NO: 55217 - protein, 9 aa, Borrelia burgdorferi B31
MSEHVKDFK

SEQ ID NO: 55218 - protein, 9 aa, Borrelia burgdorferi B31
LSVKLSYER

SEQ ID NO: 55219 - protein, 9 aa, Borrelia burgdorferi B31
ISSEYINNR

SEQ ID NO: 55220 - protein, 9 aa, Borrelia burgdorferi B31
YIAAKMSRK

SEQ ID NO: 55221 - protein, 9 aa, Borrelia burgdorferi B31
FLAGYIAAK

SEQ ID NO: 55222 - protein, 9 aa, Borrelia burgdorferi B31
SLLVFACFK

SEQ ID NO: 55223 - protein, 9 aa, Borrelia burgdorferi B31
YAFDLFKSK

SEQ ID NO: 55224 - protein, 9 aa, Borrelia burgdorferi B31
FACFKSNKK

SEQ ID NO: 55225 - protein, 9 aa, Borrelia burgdorferi B31
KAMALFMYK

SEQ ID NO: 55226 - protein, 9 aa, Borrelia burgdorferi B31
TSIIKDIGK

SEQ ID NO: 55227 - protein, 9 aa, Borrelia burgdorferi B31
IFYANPKLR

SEQ ID NO: 55228 - protein, 9 aa, Borrelia burgdorferi B31
SEYAFDLFK

SEQ ID NO: 55229 - protein, 9 aa, Borrelia burgdorferi B31
LAHGSFYDK

SEQ ID NO: 55230 - protein, 9 aa, Borrelia burgdorferi B31
VIYSISSEY

SEQ ID NO: 55231 - protein, 9 aa, Borrelia burgdorferi B31
VFACFKSNK

SEQ ID NO: 55232 - protein, 9 aa, Borrelia burgdorferi B31
GYIAAKMSR

SEQ ID NO: 55233 - protein, 9 aa, Borrelia burgdorferi B31
DAAKELGPK

SEQ ID NO: 55234 - protein, 9 aa, Borrelia burgdorferi B31
GIIIDRGLK

SEQ ID NO: 55235 - protein, 9 aa, Borrelia burgdorferi B31
EIIVPDSEY

SEQ ID NO: 55236 - protein, 9 aa, Borrelia burgdorferi B31
RPYPIEGKR

SEQ ID NO: 55237 - protein, 9 aa, Borrelia burgdorferi B31
DYGDIQVPK

SEQ ID NO: 55238 - protein, 9 aa, Borrelia burgdorferi B31
ALFMYKEDK

SEQ ID NO: 55239 - protein, 9 aa, Borrelia burgdorferi B31
MTEDAYEVQ

SEQ ID NO: 55240 - protein, 9 aa, Borrelia burgdorferi B31
QSVHDGVVK

SEQ ID NO: 55241 - protein, 9 aa, Borrelia burgdorferi B31
YRFSDLSVK

SEQ ID NO: 55242 - protein, 9 aa, Borrelia burgdorferi B31
EAAFLAGYI

SEQ ID NO: 55243 - protein, 10 aa, Borrelia burgdorferi B31
MTEDAYEVQK

SEQ ID NO: 55244 - protein, 10 aa, Borrelia burgdorferi B31
HVKDFKFGFK

SEQ ID NO: 55245 - protein, 10 aa, Borrelia burgdorferi B31
DSEYAFDLFK

SEQ ID NO: 55246 - protein, 10 aa, Borrelia burgdorferi B31
LVFACFKSNK

SEQ ID NO: 55247 - protein, 10 aa, Borrelia burgdorferi B31
SVHDGVVKLR

SEQ ID NO: 55248 - protein, 10 aa, Borrelia burgdorferi B31
SISSEYINNR

SEQ ID NO: 55249 - protein, 10 aa, Borrelia burgdorferi B31
GIFYANPKLR

SEQ ID NO: 55250 - protein, 10 aa, Borrelia burgdorferi B31
LSLLVFACFK

SEQ ID NO: 55251 - protein, 10 aa, Borrelia burgdorferi B31
ITSIIKDIGK

SEQ ID NO: 55252 - protein, 10 aa, Borrelia burgdorferi B31
DLSVKLSYER

SEQ ID NO: 55253 - protein, 10 aa, Borrelia burgdorferi B31
EYAFDLFKSK

SEQ ID NO: 55254 - protein, 10 aa, Borrelia burgdorferi B31
MALFMYKEDK

SEQ ID NO: 55255 - protein, 10 aa, Borrelia burgdorferi B31
IAAKMSRKEK

SEQ ID NO: 55256 - protein, 10 aa, Borrelia burgdorferi B31
LTGPMSEHVK

SEQ ID NO: 55257 - protein, 10 aa, Borrelia burgdorferi B31
GIKLITKSLR

SEQ ID NO: 55258 - protein, 10 aa, Borrelia burgdorferi B31
DNFGIKLITK

SEQ ID NO: 55259 - protein, 10 aa, Borrelia burgdorferi B31
KVIYSISSEY

SEQ ID NO: 55260 - protein, 10 aa, Borrelia burgdorferi B31
SEYINNRVFK

SEQ ID NO: 55261 - protein, 10 aa, Borrelia burgdorferi B31
QVPKNSLAIK

SEQ ID NO: 55262 - protein, 10 aa, Borrelia burgdorferi B31
LNLFWLIGYR

SEQ ID NO: 55263 - protein, 10 aa, Borrelia burgdorferi B31
VFACFKSNKK

SEQ ID NO: 55264 - protein, 10 aa, Borrelia burgdorferi B31
LSYERPDIYY

SEQ ID NO: 55265 - protein, 10 aa, Borrelia burgdorferi B31
VLAHGSFYDK

SEQ ID NO: 55266 - protein, 10 aa, Borrelia burgdorferi B31
FDYGDIQVPK

SEQ ID NO: 55267 - protein, 10 aa, Borrelia burgdorferi B31
GYIAAKMSRK

SEQ ID NO: 55268 - protein, 11 aa, Borrelia burgdorferi B31
YSISSEYINNR

SEQ ID NO: 55269 - protein, 11 aa, Borrelia burgdorferi B31
TLSLLVFACFK

SEQ ID NO: 55270 - protein, 11 aa, Borrelia burgdorferi B31
SSEYINNRVFK

SEQ ID NO: 55271 - protein, 11 aa, Borrelia burgdorferi B31
LAGYIAAKMSR

SEQ ID NO: 55272 - protein, 11 aa, Borrelia burgdorferi B31
YIAAKMSRKEK

SEQ ID NO: 55273 - protein, 11 aa, Borrelia burgdorferi B31
LLVFACFKSNK

SEQ ID NO: 55274 - protein, 11 aa, Borrelia burgdorferi B31
LVFACFKSNKK

SEQ ID NO: 55275 - protein, 11 aa, Borrelia burgdorferi B31
IVKDPDVLNNR

SEQ ID NO: 55276 - protein, 11 aa, Borrelia burgdorferi B31
QSVHDGVVKLR

SEQ ID NO: 55277 - protein, 11 aa, Borrelia burgdorferi B31
FLTGPMSEHVK

SEQ ID NO: 55278 - protein, 11 aa, Borrelia burgdorferi B31
FGIKLITKSLR

SEQ ID NO: 55279 - protein, 11 aa, Borrelia burgdorferi B31
RVFKGGIIIDR

SEQ ID NO: 55280 - protein, 11 aa, Borrelia burgdorferi B31
AAFLAGYIAAK

SEQ ID NO: 55281 - protein, 11 aa, Borrelia burgdorferi B31
YANPKLRLVSK

SEQ ID NO: 55282 - protein, 11 aa, Borrelia burgdorferi B31
ITGLGVYDAAK

SEQ ID NO: 55283 - protein, 11 aa, Borrelia burgdorferi B31
YVIGLNQDQSY

SEQ ID NO: 55284 - protein, 11 aa, Borrelia burgdorferi B31
VITSIIKDIGK

SEQ ID NO: 55285 - protein, 11 aa, Borrelia burgdorferi B31
FKAGIFYANPK

SEQ ID NO: 55286 - protein, 11 aa, Borrelia burgdorferi B31
LVDEVIDLENK

SEQ ID NO: 55287 - protein, 11 aa, Borrelia burgdorferi B31
IGYRFSDLSVK

SEQ ID NO: 55288 - protein, 11 aa, Borrelia burgdorferi B31
EHVKDFKFGFK

SEQ ID NO: 55289 - protein, 11 aa, Borrelia burgdorferi B31
AMALFMYKEDK

SEQ ID NO: 55290 - protein, 11 aa, Borrelia burgdorferi B31
AMTEDAYEVQK

SEQ ID NO: 55291 - protein, 11 aa, Borrelia burgdorferi B31
IYYGIIDAFDY

SEQ ID NO: 55292 - protein, 11 aa, Borrelia burgdorferi B31
SLRPYPIEGKR

SEQ ID NO: 55293 - protein, 11 aa, Borrelia burgdorferi B31
PLNLFWLIGYR

SEQ ID NO: 55294 - protein, 11 aa, Borrelia burgdorferi B31
GVLAHGSFYDK

SEQ ID NO: 55295 - protein, 11 aa, Borrelia burgdorferi B31
VVKLRDNFGIK

SEQ ID NO: 55296 - protein, 11 aa, Borrelia burgdorferi B31
AGIFYANPKLR

SEQ ID NO: 55297 - protein, 11 aa, Borrelia burgdorferi B31
VPKNSLAIKFR

SEQ ID NO: 55298 - protein, 9 aa, Borrelia burgdorferi B31
APQNVITSI

SEQ ID NO: 55299 - protein, 9 aa, Borrelia burgdorferi B31
YPIEGKRLL

SEQ ID NO: 55300 - protein, 9 aa, Borrelia burgdorferi B31
FPIAGITGL

SEQ ID NO: 55301 - protein, 9 aa, Borrelia burgdorferi B31
RPDIYYGII

SEQ ID NO: 55302 - protein, 9 aa, Borrelia burgdorferi B31
GPKYYVIGL

SEQ ID NO: 55303 - protein, 9 aa, Borrelia burgdorferi B31
LVSKKAPSL

SEQ ID NO: 55304 - protein, 9 aa, Borrelia burgdorferi B31
QVPKNSLAI

SEQ ID NO: 55305 - protein, 10 aa, Borrelia burgdorferi B31
RPYPIEGKRL

SEQ ID NO: 55306 - protein, 10 aa, Borrelia burgdorferi B31
APQNVITSII

SEQ ID NO: 55307 - protein, 10 aa, Borrelia burgdorferi B31
VPKNSLAIKF

SEQ ID NO: 55308 - protein, 10 aa, Borrelia burgdorferi B31
YPIEGKRLLT

SEQ ID NO: 55309 - protein, 10 aa, Borrelia burgdorferi B31
GPMSEHVKDF

SEQ ID NO: 55310 - protein, 10 aa, Borrelia burgdorferi B31
KLRDNFGIKL

SEQ ID NO: 55311 - protein, 10 aa, Borrelia burgdorferi B31
RLVSKKAPSL

SEQ ID NO: 55312 - protein, 11 aa, Borrelia burgdorferi B31
RPYPIEGKRLL

SEQ ID NO: 55313 - protein, 11 aa, Borrelia burgdorferi B31
YPIEGKRLLTV

SEQ ID NO: 55314 - protein, 11 aa, Borrelia burgdorferi B31
FPIAGITGLGV

SEQ ID NO: 55315 - protein, 11 aa, Borrelia burgdorferi B31
FKRFIFITLSL

SEQ ID NO: 55316 - protein, 11 aa, Borrelia burgdorferi B31
NPKLRLVSKKA

SEQ ID NO: 55317 - protein, 9 aa, Borrelia burgdorferi B31
FDKEKGKAM

SEQ ID NO: 55318 - protein, 9 aa, Borrelia burgdorferi B31
KEKGKAMAL

SEQ ID NO: 55319 - protein, 9 aa, Borrelia burgdorferi B31
FKRFIFITL

SEQ ID NO: 55320 - protein, 10 aa, Borrelia burgdorferi B31
MFKRFIFITL

SEQ ID NO: 55321 - protein, 10 aa, Borrelia burgdorferi B31
FGIKLITKSL

SEQ ID NO: 55322 - protein, 11 aa, Borrelia burgdorferi B31
FDKEKGKAMAL

SEQ ID NO: 55323 - protein, 11 aa, Borrelia burgdorferi B31
AIKFRNEEAAF

SEQ ID NO: 55324 - protein, 11 aa, Borrelia burgdorferi B31
FMYKEDKVGVI

SEQ ID NO: 55325 - protein, 11 aa, Borrelia burgdorferi B31
NPKLRLVSKKA

SEQ ID NO: 55326 - protein, 11 aa, Borrelia burgdorferi B31
FKRFIFITLSL

SEQ ID NO: 55327 - protein, 9 aa, Borrelia burgdorferi B31
VQKNPLNLF

SEQ ID NO: 55328 - protein, 9 aa, Borrelia burgdorferi B31
GVLAHGSFY

SEQ ID NO: 55329 - protein, 9 aa, Borrelia burgdorferi B31
VIYSISSEY

SEQ ID NO: 55330 - protein, 9 aa, Borrelia burgdorferi B31
AAKELGPKY

SEQ ID NO: 55331 - protein, 9 aa, Borrelia burgdorferi B31
KFRNEEAAF

SEQ ID NO: 55332 - protein, 9 aa, Borrelia burgdorferi B31
KVVVGVLAH

SEQ ID NO: 55333 - protein, 9 aa, Borrelia burgdorferi B31
IVPDSEYAF

SEQ ID NO: 55334 - protein, 9 aa, Borrelia burgdorferi B31
EIIVPDSEY

SEQ ID NO: 55335 - protein, 9 aa, Borrelia burgdorferi B31
HVKDFKFGF

SEQ ID NO: 55336 - protein, 9 aa, Borrelia burgdorferi B31
LITKSLRPY

SEQ ID NO: 55337 - protein, 9 aa, Borrelia burgdorferi B31
FITLSLLVF

SEQ ID NO: 55338 - protein, 9 aa, Borrelia burgdorferi B31
FGFKAGIFY

SEQ ID NO: 55339 - protein, 9 aa, Borrelia burgdorferi B31
LSYERPDIY

SEQ ID NO: 55340 - protein, 9 aa, Borrelia burgdorferi B31
PMSEHVKDF

SEQ ID NO: 55341 - protein, 9 aa, Borrelia burgdorferi B31
YGIIDAFDY

SEQ ID NO: 55342 - protein, 9 aa, Borrelia burgdorferi B31
AGITGLGVY

SEQ ID NO: 55343 - protein, 9 aa, Borrelia burgdorferi B31
RLLTVDEAM

SEQ ID NO: 55344 - protein, 9 aa, Borrelia burgdorferi B31
LSLLVFACF

SEQ ID NO: 55345 - protein, 9 aa, Borrelia burgdorferi B31
IGLNQDQSY

SEQ ID NO: 55346 - protein, 10 aa, Borrelia burgdorferi B31
KVIYSISSEY

SEQ ID NO: 55347 - protein, 10 aa, Borrelia burgdorferi B31
KLITKSLRPY

SEQ ID NO: 55348 - protein, 10 aa, Borrelia burgdorferi B31
LSYERPDIYY

SEQ ID NO: 55349 - protein, 10 aa, Borrelia burgdorferi B31
KMSRKEKIGF

SEQ ID NO: 55350 - protein, 10 aa, Borrelia burgdorferi B31
IIKDIGKVIY

SEQ ID NO: 55351 - protein, 10 aa, Borrelia burgdorferi B31
IQVPKNSLAI

SEQ ID NO: 55352 - protein, 10 aa, Borrelia burgdorferi B31
AAKELGPKYY

SEQ ID NO: 55353 - protein, 10 aa, Borrelia burgdorferi B31
IIVPDSEYAF

SEQ ID NO: 55354 - protein, 10 aa, Borrelia burgdorferi B31
IFITLSLLVF

SEQ ID NO: 55355 - protein, 10 aa, Borrelia burgdorferi B31
VQKNPLNLFW

SEQ ID NO: 55356 - protein, 10 aa, Borrelia burgdorferi B31
VVGVLAHGSF

SEQ ID NO: 55357 - protein, 10 aa, Borrelia burgdorferi B31
TLSLLVFACF

SEQ ID NO: 55358 - protein, 10 aa, Borrelia burgdorferi B31
IAGITGLGVY

SEQ ID NO: 55359 - protein, 10 aa, Borrelia burgdorferi B31
FLAGYIAAKM

SEQ ID NO: 55360 - protein, 10 aa, Borrelia burgdorferi B31
KLSYERPDIY

SEQ ID NO: 55361 - protein, 10 aa, Borrelia burgdorferi B31
KGKAMALFMY

SEQ ID NO: 55362 - protein, 10 aa, Borrelia burgdorferi B31
NLFWLIGYRF

SEQ ID NO: 55363 - protein, 10 aa, Borrelia burgdorferi B31
LVSKKAPSLF

SEQ ID NO: 55364 - protein, 10 aa, Borrelia burgdorferi B31
WLIGYRFSDL

SEQ ID NO: 55365 - protein, 10 aa, Borrelia burgdorferi B31
SSEYINNRVF

SEQ ID NO: 55366 - protein, 11 aa, Borrelia burgdorferi B31
YVIGLNQDQSY

SEQ ID NO: 55367 - protein, 11 aa, Borrelia burgdorferi B31
ISSEYINNRVF

SEQ ID NO: 55368 - protein, 11 aa, Borrelia burgdorferi B31
VVVGVLAHGSF

SEQ ID NO: 55369 - protein, 11 aa, Borrelia burgdorferi B31
FIFITLSLLVF

SEQ ID NO: 55370 - protein, 11 aa, Borrelia burgdorferi B31
KLSYERPDIYY

SEQ ID NO: 55371 - protein, 11 aa, Borrelia burgdorferi B31
AIKFRNEEAAF

SEQ ID NO: 55372 - protein, 11 aa, Borrelia burgdorferi B31
RFSDLSVKLSY

SEQ ID NO: 55373 - protein, 11 aa, Borrelia burgdorferi B31
SLFDKEKGKAM

SEQ ID NO: 55374 - protein, 11 aa, Borrelia burgdorferi B31
VVGVLAHGSFY

SEQ ID NO: 55375 - protein, 11 aa, Borrelia burgdorferi B31
LAHGSFYDKGY

SEQ ID NO: 55376 - protein, 11 aa, Borrelia burgdorferi B31
EIIVPDSEYAF

SEQ ID NO: 55377 - protein, 11 aa, Borrelia burgdorferi B31
FMYKEDKVGVI

SEQ ID NO: 55378 - protein, 11 aa, Borrelia burgdorferi B31
RLVSKKAPSLF

SEQ ID NO: 55379 - protein, 11 aa, Borrelia burgdorferi B31
VQKNPLNLFWL

SEQ ID NO: 55380 - protein, 11 aa, Borrelia burgdorferi B31
SIIKDIGKVIY

SEQ ID NO: 55381 - protein, 11 aa, Borrelia burgdorferi B31
PMSEHVKDFKF

SEQ ID NO: 55382 - protein, 9 aa, Borrelia burgdorferi B31
YRFSDLSVK

SEQ ID NO: 55383 - protein, 9 aa, Borrelia burgdorferi B31
KRFIFITLS

SEQ ID NO: 55384 - protein, 9 aa, Borrelia burgdorferi B31
FRNEEAAFL

SEQ ID NO: 55385 - protein, 9 aa, Borrelia burgdorferi B31
FKFGFKAGI

SEQ ID NO: 55386 - protein, 10 aa, Borrelia burgdorferi B31
KRFIFITLSL

SEQ ID NO: 55387 - protein, 10 aa, Borrelia burgdorferi B31
YRFSDLSVKL

SEQ ID NO: 55388 - protein, 10 aa, Borrelia burgdorferi B31
KRLLTVDEAM

SEQ ID NO: 55389 - protein, 11 aa, Borrelia burgdorferi B31
KRFIFITLSLL

SEQ ID NO: 55390 - protein, 11 aa, Borrelia burgdorferi B31
LRLVSKKAPSL

SEQ ID NO: 55391 - protein, 11 aa, Borrelia burgdorferi B31
FKFGFKAGIFY

SEQ ID NO: 55392 - protein, 11 aa, Borrelia burgdorferi B31
KRLLTVDEAMT

SEQ ID NO: 55393 - protein, 9 aa, Borrelia burgdorferi B31
FPIAGITGL

SEQ ID NO: 55394 - protein, 9 aa, Borrelia burgdorferi B31
IVPDSEYAF

SEQ ID NO: 55395 - protein, 9 aa, Borrelia burgdorferi B31
YPIEGKRLL

SEQ ID NO: 55396 - protein, 9 aa, Borrelia burgdorferi B31
LFWLIGYRF

SEQ ID NO: 55397 - protein, 9 aa, Borrelia burgdorferi B31
LAGYIAAKM

SEQ ID NO: 55398 - protein, 9 aa, Borrelia burgdorferi B31
DPDVLNNRL

SEQ ID NO: 55399 - protein, 9 aa, Borrelia burgdorferi B31
IGLNQDQSY

SEQ ID NO: 55400 - protein, 9 aa, Borrelia burgdorferi B31
FITLSLLVF

SEQ ID NO: 55401 - protein, 9 aa, Borrelia burgdorferi B31
DEAMTEDAY

SEQ ID NO: 55402 - protein, 9 aa, Borrelia burgdorferi B31
DSEYAFDLF

SEQ ID NO: 55403 - protein, 9 aa, Borrelia burgdorferi B31
EIIVPDSEY

SEQ ID NO: 55404 - protein, 9 aa, Borrelia burgdorferi B31
IYYGIIDAF

SEQ ID NO: 55405 - protein, 9 aa, Borrelia burgdorferi B31
FGFKAGIFY

SEQ ID NO: 55406 - protein, 9 aa, Borrelia burgdorferi B31
NPLNLFWLI

SEQ ID NO: 55407 - protein, 9 aa, Borrelia burgdorferi B31
RLLTVDEAM

SEQ ID NO: 55408 - protein, 9 aa, Borrelia burgdorferi B31
VIYSISSEY

SEQ ID NO: 55409 - protein, 9 aa, Borrelia burgdorferi B31
LSLLVFACF

SEQ ID NO: 55410 - protein, 9 aa, Borrelia burgdorferi B31
LSYERPDIY

SEQ ID NO: 55411 - protein, 9 aa, Borrelia burgdorferi B31
YGIIDAFDY

SEQ ID NO: 55412 - protein, 9 aa, Borrelia burgdorferi B31
KFRNEEAAF

SEQ ID NO: 55413 - protein, 9 aa, Borrelia burgdorferi B31
AAKELGPKY

SEQ ID NO: 55414 - protein, 9 aa, Borrelia burgdorferi B31
YIAPQNVIT

SEQ ID NO: 55415 - protein, 10 aa, Borrelia burgdorferi B31
IIVPDSEYAF

SEQ ID NO: 55416 - protein, 10 aa, Borrelia burgdorferi B31
IAGITGLGVY

SEQ ID NO: 55417 - protein, 10 aa, Borrelia burgdorferi B31
VPKNSLAIKF

SEQ ID NO: 55418 - protein, 10 aa, Borrelia burgdorferi B31
DIYYGIIDAF

SEQ ID NO: 55419 - protein, 10 aa, Borrelia burgdorferi B31
FLAGYIAAKM

SEQ ID NO: 55420 - protein, 10 aa, Borrelia burgdorferi B31
DAAKELGPKY

SEQ ID NO: 55421 - protein, 10 aa, Borrelia burgdorferi B31
IFITLSLLVF

SEQ ID NO: 55422 - protein, 10 aa, Borrelia burgdorferi B31
DAYEVQKNPL

SEQ ID NO: 55423 - protein, 10 aa, Borrelia burgdorferi B31
YPIEGKRLLT

SEQ ID NO: 55424 - protein, 10 aa, Borrelia burgdorferi B31
YAFDLFKSKL

SEQ ID NO: 55425 - protein, 10 aa, Borrelia burgdorferi B31
KVIYSISSEY

SEQ ID NO: 55426 - protein, 10 aa, Borrelia burgdorferi B31
NLFWLIGYRF

SEQ ID NO: 55427 - protein, 10 aa, Borrelia burgdorferi B31
FSDLSVKLSY

SEQ ID NO: 55428 - protein, 10 aa, Borrelia burgdorferi B31
TLSLLVFACF

SEQ ID NO: 55429 - protein, 10 aa, Borrelia burgdorferi B31
FPIAGITGLG

SEQ ID NO: 55430 - protein, 10 aa, Borrelia burgdorferi B31
VDEAMTEDAY

SEQ ID NO: 55431 - protein, 10 aa, Borrelia burgdorferi B31
VPDSEYAFDL

SEQ ID NO: 55432 - protein, 10 aa, Borrelia burgdorferi B31
IKFRNEEAAF

SEQ ID NO: 55433 - protein, 10 aa, Borrelia burgdorferi B31
EKIGFLTGPM

SEQ ID NO: 55434 - protein, 10 aa, Borrelia burgdorferi B31
EAAFLAGYIA

SEQ ID NO: 55435 - protein, 10 aa, Borrelia burgdorferi B31
LSYERPDIYY

SEQ ID NO: 55436 - protein, 10 aa, Borrelia burgdorferi B31
EAMTEDAYEV

SEQ ID NO: 55437 - protein, 10 aa, Borrelia burgdorferi B31
NEEAAFLAGY

SEQ ID NO: 55438 - protein, 11 aa, Borrelia burgdorferi B31
NPLNLFWLIGY

SEQ ID NO: 55439 - protein, 11 aa, Borrelia burgdorferi B31
TVDEAMTEDAY

SEQ ID NO: 55440 - protein, 11 aa, Borrelia burgdorferi B31
YVIGLNQDQSY

SEQ ID NO: 55441 - protein, 11 aa, Borrelia burgdorferi B31
VPDSEYAFDLF

SEQ ID NO: 55442 - protein, 11 aa, Borrelia burgdorferi B31
LAHGSFYDKGY

SEQ ID NO: 55443 - protein, 11 aa, Borrelia burgdorferi B31
EIIVPDSEYAF

SEQ ID NO: 55444 - protein, 11 aa, Borrelia burgdorferi B31
FIFITLSLLVF

SEQ ID NO: 55445 - protein, 11 aa, Borrelia burgdorferi B31
YPIEGKRLLTV

SEQ ID NO: 55446 - protein, 11 aa, Borrelia burgdorferi B31
FPIAGITGLGV

SEQ ID NO: 55447 - protein, 11 aa, Borrelia burgdorferi B31
EAAFLAGYIAA

SEQ ID NO: 55448 - protein, 11 aa, Borrelia burgdorferi B31
DAAKELGPKYY

SEQ ID NO: 55449 - protein, 11 aa, Borrelia burgdorferi B31
ISSEYINNRVF

SEQ ID NO: 55450 - protein, 11 aa, Borrelia burgdorferi B31
FKFGFKAGIFY

SEQ ID NO: 55451 - protein, 11 aa, Borrelia burgdorferi B31
VVVGVLAHGSF

SEQ ID NO: 55452 - protein, 11 aa, Borrelia burgdorferi B31
YEVQKNPLNLF

SEQ ID NO: 55453 - protein, 11 aa, Borrelia burgdorferi B31
VVGVLAHGSFY

SEQ ID NO: 55454 - protein, 11 aa, Borrelia burgdorferi B31
RFSDLSVKLSY

SEQ ID NO: 55455 - protein, 11 aa, Borrelia burgdorferi B31
ITLSLLVFACF

SEQ ID NO: 55456 - protein, 9 aa, Borrelia burgdorferi B31
SEHVKDFKF

SEQ ID NO: 55457 - protein, 9 aa, Borrelia burgdorferi B31
KEDKVGVIF

SEQ ID NO: 55458 - protein, 9 aa, Borrelia burgdorferi B31
SEYINNRVF

SEQ ID NO: 55459 - protein, 9 aa, Borrelia burgdorferi B31
EEAAFLAGY

SEQ ID NO: 55460 - protein, 9 aa, Borrelia burgdorferi B31
SEYAFDLFK

SEQ ID NO: 55461 - protein, 10 aa, Borrelia burgdorferi B31
GEIIVPDSEY

SEQ ID NO: 55462 - protein, 10 aa, Borrelia burgdorferi B31
YEVQKNPLNL

SEQ ID NO: 55463 - protein, 10 aa, Borrelia burgdorferi B31
EEAAFLAGYI

SEQ ID NO: 55464 - protein, 10 aa, Borrelia burgdorferi B31
NEEAAFLAGY

SEQ ID NO: 55465 - protein, 10 aa, Borrelia burgdorferi B31
SEYAFDLFKS

SEQ ID NO: 55466 - protein, 10 aa, Borrelia burgdorferi B31
KEKGKAMALF

SEQ ID NO: 55467 - protein, 11 aa, Borrelia burgdorferi B31
SEHVKDFKFGF

SEQ ID NO: 55468 - protein, 11 aa, Borrelia burgdorferi B31
GEIIVPDSEYA

SEQ ID NO: 55469 - protein, 11 aa, Borrelia burgdorferi B31
KEKGKAMALFM

SEQ ID NO: 55470 - protein, 11 aa, Borrelia burgdorferi B31
KEDKVGVIFPI

SEQ ID NO: 55471 - protein, 11 aa, Borrelia burgdorferi B31
YEVQKNPLNLF

SEQ ID NO: 55472 - protein, 11 aa, Borrelia burgdorferi B31
KEKIGFLTGPM

SEQ ID NO: 55473 - protein, 11 aa, Borrelia burgdorferi B31
EEAAFLAGYIA

SEQ ID NO: 55474 - protein, 9 aa, Borrelia burgdorferi B31
NPLNLFWLI

SEQ ID NO: 55475 - protein, 9 aa, Borrelia burgdorferi B31
FPIAGITGL

SEQ ID NO: 55476 - protein, 9 aa, Borrelia burgdorferi B31
YPIEGKRLL

SEQ ID NO: 55477 - protein, 9 aa, Borrelia burgdorferi B31
APQNVITSI

SEQ ID NO: 55478 - protein, 10 aa, Borrelia burgdorferi B31
APQNVITSII

SEQ ID NO: 55479 - protein, 10 aa, Borrelia burgdorferi B31
VPKNSLAIKF

SEQ ID NO: 55480 - protein, 10 aa, Borrelia burgdorferi B31
IAPQNVITSI

SEQ ID NO: 55481 - protein, 10 aa, Borrelia burgdorferi B31
FPIAGITGLG

SEQ ID NO: 55482 - protein, 10 aa, Borrelia burgdorferi B31
YPIEGKRLLT

SEQ ID NO: 55483 - protein, 11 aa, Borrelia burgdorferi B31
YPIEGKRLLTV

SEQ ID NO: 55484 - protein, 11 aa, Borrelia burgdorferi B31
FPIAGITGLGV

SEQ ID NO: 55485 - protein, 11 aa, Borrelia burgdorferi B31
IAPQNVITSII

SEQ ID NO: 55486 - protein, 11 aa, Borrelia burgdorferi B31
EVQKNPLNLFW

SEQ ID NO: 55487 - protein, 9 aa, Borrelia burgdorfer iB31
ASENVSVNY

SEQ ID NO: 55488 - protein, 9 aa, Borrelia burgdorfer iB31
VLESFMYGY

SEQ ID NO: 55489 - protein, 10 aa, Borrelia burgdorfer iB31
NSNIKVVSQY

SEQ ID NO: 55490 - protein, 11 aa, Borrelia burgdorfer iB31
RSEEVAFLAGY

SEQ ID NO: 55491 - protein, 9 aa, Borrelia burgdorfer iB31
FMYGYEAGA

SEQ ID NO: 55492 - protein, 9 aa, Borrelia burgdorfer iB31
YLAPNNVIV

SEQ ID NO: 55493 - protein, 9 aa, Borrelia burgdorfer iB31
SIMNGIIKV

SEQ ID NO: 55494 - protein, 9 aa, Borrelia burgdorfer iB31
LIWGIGFRL

SEQ ID NO: 55495 - protein, 9 aa, Borrelia burgdorfer iB31
KVYYFLIFL

SEQ ID NO: 55496 - protein, 9 aa, Borrelia burgdorfer iB31
FLIFLFIVA

SEQ ID NO: 55497 - protein, 9 aa, Borrelia burgdorfer iB31
KVDSLMYSL

SEQ ID NO: 55498 - protein, 9 aa, Borrelia burgdorfer iB31
YFLIFLFIV

SEQ ID NO: 55499 - protein, 9 aa, Borrelia burgdorfer iB31
MLKKVYYFL

SEQ ID NO: 55500 - protein, 9 aa, Borrelia burgdorfer iB31
FAAAGLSGI

SEQ ID NO: 55501 - protein, 9 aa, Borrelia burgdorfer iB31
FMLKKVYYF

SEQ ID NO: 55502 - protein, 9 aa, Borrelia burgdorfer iB31
FLAGYFASK

SEQ ID NO: 55503 - protein, 9 aa, Borrelia burgdorfer iB31
FLGLKEDGL

SEQ ID NO: 55504 - protein, 9 aa, Borrelia burgdorfer iB31
YYFLIFLFI

SEQ ID NO: 55505 - protein, 9 aa, Borrelia burgdorfer iB31
EIYFLYFFI

SEQ ID NO: 55506 - protein, 9 aa, Borrelia burgdorfer iB31
NLLNISFRS

SEQ ID NO: 55507 - protein, 9 aa, Borrelia burgdorfer iB31
GLKEDGLGL

SEQ ID NO: 55508 - protein, 9 aa, Borrelia burgdorfer iB31
NISFRSEEV

SEQ ID NO: 55509 - protein, 9 aa, Borrelia burgdorfer iB31
FLFIVACSS

SEQ ID NO: 55510 - protein, 9 aa, Borrelia burgdorfer iB31
KVSYFVLQM

SEQ ID NO: 55511 - protein, 9 aa, Borrelia burgdorfer iB31
SLTKKYLET

SEQ ID NO: 55512 - protein, 10 aa, Borrelia burgdorfer iB31
FMLKKVYYFL

SEQ ID NO: 55513 - protein, 10 aa, Borrelia burgdorfer iB31
FLAGYFASKA

SEQ ID NO: 55514 - protein, 10 aa, Borrelia burgdorfer iB31
RLSDILFQRA

SEQ ID NO: 55515 - protein, 10 aa, Borrelia burgdorfer iB31
SVNYAIIEGV

SEQ ID NO: 55516 - protein, 10 aa, Borrelia burgdorfer iB31
VLDGGKTMFL

SEQ ID NO: 55517 - protein, 10 aa, Borrelia burgdorfer iB31
MLKKVYYFLI

SEQ ID NO: 55518 - protein, 10 aa, Borrelia burgdorfer iB31
NLIWGIGFRL

SEQ ID NO: 55519 - protein, 10 aa, Borrelia burgdorfer iB31
ILFQRASENV

SEQ ID NO: 55520 - protein, 10 aa, Borrelia burgdorfer iB31
AIIEGVYDEI

SEQ ID NO: 55521 - protein, 10 aa, Borrelia burgdorfer iB31
GLSGIGVIEA

SEQ ID NO: 55522 - protein, 10 aa, Borrelia burgdorfer iB31
LMYSLTKKYL

SEQ ID NO: 55523 - protein, 10 aa, Borrelia burgdorfer iB31
YYFLIFLFIV

SEQ ID NO: 55524 - protein, 10 aa, Borrelia burgdorfer iB31
YVGTFGDFGL

SEQ ID NO: 55525 - protein, 10 aa, Borrelia burgdorfer iB31
KLKADLNINI

SEQ ID NO: 55526 - protein, 10 aa, Borrelia burgdorfer iB31
YEIYFLYFFI

SEQ ID NO: 55527 - protein, 10 aa, Borrelia burgdorfer iB31
YLAPNNVIVS

SEQ ID NO: 55528 - protein, 10 aa, Borrelia burgdorfer iB31
FLIFLFIVAC

SEQ ID NO: 55529 - protein, 10 aa, Borrelia burgdorfer iB31
NMYRDGVDII

SEQ ID NO: 55530 - protein, 10 aa, Borrelia burgdorfer iB31
KIGQSIMNGI

SEQ ID NO: 55531 - protein, 10 aa, Borrelia burgdorfer iB31
FLFIVACSSS

SEQ ID NO: 55532 - protein, 10 aa, Borrelia burgdorfer iB31
FQRASENVSV

SEQ ID NO: 55533 - protein, 10 aa, Borrelia burgdorfer iB31
GIIKVPYDKV

SEQ ID NO: 55534 - protein, 10 aa, Borrelia burgdorfer iB31
GLKEDGLGLV

SEQ ID NO: 55535 - protein, 10 aa, Borrelia burgdorfer iB31
GLGLVLNENL

SEQ ID NO: 55536 - protein, 10 aa, Borrelia burgdorfer iB31
KKVYYFLIFL

SEQ ID NO: 55537 - protein, 11 aa, Borrelia burgdorfer iB31
FMLKKVYYFLI

SEQ ID NO: 55538 - protein, 11 aa, Borrelia burgdorfer iB31
YLAPNNVIVSA

SEQ ID NO: 55539 - protein, 11 aa, Borrelia burgdorfer iB31
KVYYFLIFLFI

SEQ ID NO: 55540 - protein, 11 aa, Borrelia burgdorfer iB31
FAAAGLSGIGV

SEQ ID NO: 55541 - protein, 11 aa, Borrelia burgdorfer iB31
SLTKKYLETGV

SEQ ID NO: 55542 - protein, 11 aa, Borrelia burgdorfer iB31
SLMYSLTKKYL

SEQ ID NO: 55543 - protein, 11 aa, Borrelia burgdorfer iB31
LLNISFRSEEV

SEQ ID NO: 55544 - protein, 11 aa, Borrelia burgdorfer iB31
FLGLKEDGLGL

SEQ ID NO: 55545 - protein, 11 aa, Borrelia burgdorfer iB31
VLESFMYGYEA

SEQ ID NO: 55546 - protein, 11 aa, Borrelia burgdorfer iB31
KVPYDKVSYFV

SEQ ID NO: 55547 - protein, 11 aa, Borrelia burgdorfer iB31
GLSGIGVIEAA

SEQ ID NO: 55548 - protein, 11 aa, Borrelia burgdorfer iB31
FLIFLFIVACS

SEQ ID NO: 55549 - protein, 11 aa, Borrelia burgdorfer iB31
GVLDGGKTMFL

SEQ ID NO: 55550 - protein, 11 aa, Borrelia burgdorfer iB31
FIKSKEDIFML

SEQ ID NO: 55551 - protein, 11 aa, Borrelia burgdorfer iB31
IIFAAAGLSGI

SEQ ID NO: 55552 - protein, 11 aa, Borrelia burgdorfer iB31
FLAGYFASKAS

SEQ ID NO: 55553 - protein, 11 aa, Borrelia burgdorfer iB31
TMFLGLKEDGL

SEQ ID NO: 55554 - protein, 11 aa, Borrelia burgdorfer iB31
STASNMYRDGV

SEQ ID NO: 55555 - protein, 11 aa, Borrelia burgdorfer iB31
ELGPDHYIIGV

SEQ ID NO: 55556 - protein, 11 aa, Borrelia burgdorfer iB31
VYYFLIFLFIV

SEQ ID NO: 55557 - protein, 11 aa, Borrelia burgdorfer iB31
RLSDILFQRAS

SEQ ID NO: 55558 - protein, 11 aa, Borrelia burgdorfer iB31
KLKADLNINII

SEQ ID NO: 55559 - protein, 11 aa, Borrelia burgdorfer iB31
KTGKIGFVGGV

SEQ ID NO: 55560 - protein, 11 aa, Borrelia burgdorfer iB31
VSVNYAIIEGV

SEQ ID NO: 55561 - protein, 11 aa, Borrelia burgdorfer iB31
YAIIEGVYDEI

SEQ ID NO: 55562 - protein, 9 aa, Borrelia burgdorfer iB31
FLAGYFASK

SEQ ID NO: 55563 - protein, 9 aa, Borrelia burgdorfer iB31
FLYFFIKSK

SEQ ID NO: 55564 - protein, 9 aa, Borrelia burgdorfer iB31
SLMYSLTKK

SEQ ID NO: 55565 - protein, 9 aa, Borrelia burgdorfer iB31
RSTASNMYR

SEQ ID NO: 55566 - protein, 9 aa, Borrelia burgdorfer iB31
RLSDILFQR

SEQ ID NO: 55567 - protein, 9 aa, Borrelia burgdorfer iB31
IYFLYFFIK

SEQ ID NO: 55568 - protein, 9 aa, Borrelia burgdorfer iB31
LMYSLTKKY

SEQ ID NO: 55569 - protein, 9 aa, Borrelia burgdorfer iB31
KGFNESSSK

SEQ ID NO: 55570 - protein, 9 aa, Borrelia burgdorfer iB31
SSKAIRKLK

SEQ ID NO: 55571 - protein, 9 aa, Borrelia burgdorfer iB31
KIGFVGGVR

SEQ ID NO: 55572 - protein, 9 aa, Borrelia burgdorfer iB31
GIIKVPYDK

SEQ ID NO: 55573 - protein, 9 aa, Borrelia burgdorfer iB31
GYFASKASK

SEQ ID NO: 55574 - protein, 9 aa, Borrelia burgdorfer iB31
ESSSKAIRK

SEQ ID NO: 55575 - protein, 9 aa, Borrelia burgdorfer iB31
NVIVSAVKK

SEQ ID NO: 55576 - protein, 9 aa, Borrelia burgdorfer iB31
KVYYFLIFL

SEQ ID NO: 55577 - protein, 9 aa, Borrelia burgdorfer iB31
ASKASKTGK

SEQ ID NO: 55578 - protein, 9 aa, Borrelia burgdorfer iB31
NLIWGIGFR

SEQ ID NO: 55579 - protein, 9 aa, Borrelia burgdorfer iB31
GLVLNENLK

SEQ ID NO: 55580 - protein, 9 aa, Borrelia burgdorfer iB31
QSIMNGIIK

SEQ ID NO: 55581 - protein, 10 aa, Borrelia burgdorfer iB31
FMYGYEAGAK

SEQ ID NO: 55582 - protein, 10 aa, Borrelia burgdorfer iB31
GVYDEIQIPK

SEQ ID NO: 55583 - protein, 10 aa, Borrelia burgdorfer iB31
AFLAGYFASK

SEQ ID NO: 55584 - protein, 10 aa, Borrelia burgdorfer iB31
EIYFLYFFIK

SEQ ID NO: 55585 - protein, 10 aa, Borrelia burgdorfer iB31
AGYFASKASK

SEQ ID NO: 55586 - protein, 10 aa, Borrelia burgdorfer iB31
IMNGIIKVPY

SEQ ID NO: 55587 - protein, 10 aa, Borrelia burgdorfer iB31
SLMYSLTKKY

SEQ ID NO: 55588 - protein, 10 aa, Borrelia burgdorfer iB31
KSKEDIFMLK

SEQ ID NO: 55589 - protein, 10 aa, Borrelia burgdorfer iB31
YFLYFFIKSK

SEQ ID NO: 55590 - protein, 10 aa, Borrelia burgdorfer iB31
KSNYSEIYNK

SEQ ID NO: 55591 - protein, 10 aa, Borrelia burgdorfer iB31
KVLESFMYGY

SEQ ID NO: 55592 - protein, 10 aa, Borrelia burgdorfer iB31
SSSKAIRKLK

SEQ ID NO: 55593 - protein, 10 aa, Borrelia burgdorfer iB31
GQSIMNGIIK

SEQ ID NO: 55594 - protein, 10 aa, Borrelia burgdorfer iB31
LIVDGAFDDK

SEQ ID NO: 55595 - protein, 10 aa, Borrelia burgdorfer iB31
DSLMYSLTKK

SEQ ID NO: 55596 - protein, 10 aa, Borrelia burgdorfer iB31
KVYYFLIFLF

SEQ ID NO: 55597 - protein, 10 aa, Borrelia burgdorfer iB31
VDSLMYSLTK

SEQ ID NO: 55598 - protein, 10 aa, Borrelia burgdorfer iB31
ADLNINIIEK

SEQ ID NO: 55599 - protein, 10 aa, Borrelia burgdorfer iB31
YSEIYNKSLK

SEQ ID NO: 55600 - protein, 10 aa, Borrelia burgdorfer iB31
GTFGDFGLGR

SEQ ID NO: 55601 - protein, 10 aa, Borrelia burgdorfer iB31
FASKASKTGK

SEQ ID NO: 55602 - protein, 10 aa, Borrelia burgdorfer iB31
GAKYANSNIK

SEQ ID NO: 55603 - protein, 10 aa, Borrelia burgdorfer iB31
DIFMLKKVYY

SEQ ID NO: 55604 - protein, 10 aa, Borrelia burgdorfer iB31
SSDDGKSEAK

SEQ ID NO: 55605 - protein, 10 aa, Borrelia burgdorfer iB31
GGKTMFLGLK

SEQ ID NO: 55606 - protein, 10 aa, Borrelia burgdorfer iB31
RASENVSVNY

SEQ ID NO: 55607 - protein, 10 aa, Borrelia burgdorfer iB31
AVKKVDSLMY

SEQ ID NO: 55608 - protein, 10 aa, Borrelia burgdorfer iB31
VYYFLIFLFI

SEQ ID NO: 55609 - protein, 11 aa, Borrelia burgdorfer iB31
KVDSLMYSLTK

SEQ ID NO: 55610 - protein, 11 aa, Borrelia burgdorfer iB31
KIGFVGGVRGK

SEQ ID NO: 55611 - protein, 11 aa, Borrelia burgdorfer iB31
VAFLAGYFASK

SEQ ID NO: 55612 - protein, 11 aa, Borrelia burgdorfer iB31
KSKEDIFMLKK

SEQ ID NO: 55613 - protein, 11 aa, Borrelia burgdorfer iB31
GLGLVLNENLK

SEQ ID NO: 55614 - protein, 11 aa, Borrelia burgdorfer iB31
IYFLYFFIKSK

SEQ ID NO: 55615 - protein, 11 aa, Borrelia burgdorfer iB31
FMYGYEAGAKY

SEQ ID NO: 55616 - protein, 11 aa, Borrelia burgdorfer iB31
IVACSSSDDGK

SEQ ID NO: 55617 - protein, 11 aa, Borrelia burgdorfer iB31
KVYYFLIFLFI

SEQ ID NO: 55618 - protein, 11 aa, Borrelia burgdorfer iB31
SIMNGIIKVPY

SEQ ID NO: 55619 - protein, 11 aa, Borrelia burgdorfer iB31
LAGYFASKASK

SEQ ID NO: 55620 - protein, 11 aa, Borrelia burgdorfer iB31
ESSSKAIRKLK

SEQ ID NO: 55621 - protein, 11 aa, Borrelia burgdorfer iB31
NSNLIWGIGFR

SEQ ID NO: 55622 - protein, 11 aa, Borrelia burgdorfer iB31
SVNYAIIEGVY

SEQ ID NO: 55623 - protein, 11 aa, Borrelia burgdorfer iB31
GLGRSTASNMY

SEQ ID NO: 55624 - protein, 11 aa, Borrelia burgdorfer iB31
YFASKASKTGK

SEQ ID NO: 55625 - protein, 9 aa, Borrelia burgdorfer iB31
SLMYSLTKK

SEQ ID NO: 55626 - protein, 9 aa, Borrelia burgdorfer iB31
RSTASNMYR

SEQ ID NO: 55627 - protein, 9 aa, Borrelia burgdorfer iB31
GIIKVPYDK

SEQ ID NO: 55628 - protein, 9 aa, Borrelia burgdorfer iB31
SSKAIRKLK

SEQ ID NO: 55629 - protein, 9 aa, Borrelia burgdorfer iB31
QSIMNGIIK

SEQ ID NO: 55630 - protein, 9 aa, Borrelia burgdorfer iB31
IYFLYFFIK

SEQ ID NO: 55631 - protein, 9 aa, Borrelia burgdorfer iB31
NVIVSAVKK

SEQ ID NO: 55632 - protein, 9 aa, Borrelia burgdorfer iB31
RLSDILFQR

SEQ ID NO: 55633 - protein, 9 aa, Borrelia burgdorfer iB31
SNYSEIYNK

SEQ ID NO: 55634 - protein, 9 aa, Borrelia burgdorfer iB31
ASKASKTGK

SEQ ID NO: 55635 - protein, 9 aa, Borrelia burgdorfer iB31
DSLMYSLTK

SEQ ID NO: 55636 - protein, 9 aa, Borrelia burgdorfer iB31
FLAGYFASK

SEQ ID NO: 55637 - protein, 9 aa, Borrelia burgdorfer iB31
FLYFFIKSK

SEQ ID NO: 55638 - protein, 9 aa, Borrelia burgdorfer iB31
ESSSKAIRK

SEQ ID NO: 55639 - protein, 9 aa, Borrelia burgdorfer iB31
GYFASKASK

SEQ ID NO: 55640 - protein, 9 aa, Borrelia burgdorfer iB31
IVDGAFDDK

SEQ ID NO: 55641 - protein, 9 aa, Borrelia burgdorfer iB31
SKEDIFMLK

SEQ ID NO: 55642 - protein, 9 aa, Borrelia burgdorfer iB31
KVYYFLIFL

SEQ ID NO: 55643 - protein, 9 aa, Borrelia burgdorfer iB31
GIGVIEAAK

SEQ ID NO: 55644 - protein, 9 aa, Borrelia burgdorfer iB31
GLVLNENLK

SEQ ID NO: 55645 - protein, 9 aa, Borrelia burgdorfer iB31
KGFNESSSK

SEQ ID NO: 55646 - protein, 9 aa, Borrelia burgdorfer iB31
ASENVSVNY

SEQ ID NO: 55647 - protein, 9 aa, Borrelia burgdorfer iB31
NLIWGIGFR

SEQ ID NO: 55648 - protein, 9 aa, Borrelia burgdorfer iB31
VLESFMYGY

SEQ ID NO: 55649 - protein, 9 aa, Borrelia burgdorfer iB31
VYDEIQIPK

SEQ ID NO: 55650 - protein, 9 aa, Borrelia burgdorfer iB31
KIGFVGGVR

SEQ ID NO: 55651 - protein, 9 aa, Borrelia burgdorfer iB31
KTMFLGLKE

SEQ ID NO: 55652 - protein, 9 aa, Borrelia burgdorfer iB31
DLNINIIEK

SEQ ID NO: 55653 - protein, 9 aa, Borrelia burgdorfer iB31
KEDIFMLKK

SEQ ID NO: 55654 - protein, 9 aa, Borrelia burgdorfer iB31
AKYANSNIK

SEQ ID NO: 55655 - protein, 9 aa, Borrelia burgdorfer iB31
SEIYNKSLK

SEQ ID NO: 55656 - protein, 9 aa, Borrelia burgdorfer iB31
GKTMFLGLK

SEQ ID NO: 55657 - protein, 10 aa, Borrelia burgdorfer iB31
GVYDEIQIPK

SEQ ID NO: 55658 - protein, 10 aa, Borrelia burgdorfer iB31
KSNYSEIYNK

SEQ ID NO: 55659 - protein, 10 aa, Borrelia burgdorfer iB31
EIYFLYFFIK

SEQ ID NO: 55660 - protein, 10 aa, Borrelia burgdorfer iB31
KSKEDIFMLK

SEQ ID NO: 55661 - protein, 10 aa, Borrelia burgdorfer iB31
KVLESFMYGY

SEQ ID NO: 55662 - protein, 10 aa, Borrelia burgdorfer iB31
SSSKAIRKLK

SEQ ID NO: 55663 - protein, 10 aa, Borrelia burgdorfer iB31
GTFGDFGLGR

SEQ ID NO: 55664 - protein, 10 aa, Borrelia burgdorfer iB31
AFLAGYFASK

SEQ ID NO: 55665 - protein, 10 aa, Borrelia burgdorfer iB31
FMYGYEAGAK

SEQ ID NO: 55666 - protein, 10 aa, Borrelia burgdorfer iB31
SSDDGKSEAK

SEQ ID NO: 55667 - protein, 10 aa, Borrelia burgdorfer iB31
VACSSSDDGK

SEQ ID NO: 55668 - protein, 10 aa, Borrelia burgdorfer iB31
GQSIMNGIIK

SEQ ID NO: 55669 - protein, 10 aa, Borrelia burgdorfer iB31
DSLMYSLTKK

SEQ ID NO: 55670 - protein, 10 aa, Borrelia burgdorfer iB31
KVYYFLIFLF

SEQ ID NO: 55671 - protein, 10 aa, Borrelia burgdorfer iB31
LIVDGAFDDK

SEQ ID NO: 55672 - protein, 10 aa, Borrelia burgdorfer iB31
SLMYSLTKKY

SEQ ID NO: 55673 - protein, 10 aa, Borrelia burgdorfer iB31
AGYFASKASK

SEQ ID NO: 55674 - protein, 10 aa, Borrelia burgdorfer iB31
YSEIYNKSLK

SEQ ID NO: 55675 - protein, 10 aa, Borrelia burgdorfer iB31
YFLYFFIKSK

SEQ ID NO: 55676 - protein, 10 aa, Borrelia burgdorfer iB31
AVKKVDSLMY

SEQ ID NO: 55677 - protein, 10 aa, Borrelia burgdorfer iB31
GAKYANSNIK

SEQ ID NO: 55678 - protein, 10 aa, Borrelia burgdorfer iB31
RASENVSVNY

SEQ ID NO: 55679 - protein, 10 aa, Borrelia burgdorfer iB31
SGIGVIEAAK

SEQ ID NO: 55680 - protein, 10 aa, Borrelia burgdorfer iB31
SKEDIFMLKK

SEQ ID NO: 55681 - protein, 10 aa, Borrelia burgdorfer iB31
GGKTMFLGLK

SEQ ID NO: 55682 - protein, 10 aa, Borrelia burgdorfer iB31
IMNGIIKVPY

SEQ ID NO: 55683 - protein, 10 aa, Borrelia burgdorfer iB31
FASKASKTGK

SEQ ID NO: 55684 - protein, 11 aa, Borrelia burgdorfer iB31
KVDSLMYSLTK

SEQ ID NO: 55685 - protein, 11 aa, Borrelia burgdorfer iB31
VAFLAGYFASK

SEQ ID NO: 55686 - protein, 11 aa, Borrelia burgdorfer iB31
KSKEDIFMLKK

SEQ ID NO: 55687 - protein, 11 aa, Borrelia burgdorfer iB31
SIMNGIIKVPY

SEQ ID NO: 55688 - protein, 11 aa, Borrelia burgdorfer iB31
SSSDDGKSEAK

SEQ ID NO: 55689 - protein, 11 aa, Borrelia burgdorfer iB31
IVACSSSDDGK

SEQ ID NO: 55690 - protein, 11 aa, Borrelia burgdorfer iB31
SLIVDGAFDDK

SEQ ID NO: 55691 - protein, 11 aa, Borrelia burgdorfer iB31
KADLNINIIEK

SEQ ID NO: 55692 - protein, 11 aa, Borrelia burgdorfer iB31
KIGFVGGVRGK

SEQ ID NO: 55693 - protein, 11 aa, Borrelia burgdorfer iB31
SFMYGYEAGAK

SEQ ID NO: 55694 - protein, 11 aa, Borrelia burgdorfer iB31
IYFLYFFIKSK

SEQ ID NO: 55695 - protein, 11 aa, Borrelia burgdorfer iB31
GLGLVLNENLK

SEQ ID NO: 55696 - protein, 11 aa, Borrelia burgdorfer iB31
SVNYAIIEGVY

SEQ ID NO: 55697 - protein, 11 aa, Borrelia burgdorfer iB31
KVYYFLIFLFI

SEQ ID NO: 55698 - protein, 11 aa, Borrelia burgdorfer iB31
LAGYFASKASK

SEQ ID NO: 55699 - protein, 11 aa, Borrelia burgdorfer iB31
NSNLIWGIGFR

SEQ ID NO: 55700 - protein, 11 aa, Borrelia burgdorfer iB31
ESSSKAIRKLK

SEQ ID NO: 55701 - protein, 11 aa, Borrelia burgdorfer iB31
LSGIGVIEAAK

SEQ ID NO: 55702 - protein, 11 aa, Borrelia burgdorfer iB31
APNNVIVSAVK

SEQ ID NO: 55703 - protein, 11 aa, Borrelia burgdorfer iB31
YEIYFLYFFIK

SEQ ID NO: 55704 - protein, 11 aa, Borrelia burgdorfer iB31
RSEEVAFLAGY

SEQ ID NO: 55705 - protein, 11 aa, Borrelia burgdorfer iB31
LVLNENLKSNY

SEQ ID NO: 55706 - protein, 9 aa, Borrelia burgdorfer iB31
MDNYYEIYF

SEQ ID NO: 55707 - protein, 9 aa, Borrelia burgdorfer iB31
DNYYEIYFL

SEQ ID NO: 55708 - protein, 9 aa, Borrelia burgdorfer iB31
VYYFLIFLF

SEQ ID NO: 55709 - protein, 9 aa, Borrelia burgdorfer iB31
YYFLIFLFI

SEQ ID NO: 55710 - protein, 9 aa, Borrelia burgdorfer iB31
YYEIYFLYF

SEQ ID NO: 55711 - protein, 9 aa, Borrelia burgdorfer iB31
NYYEIYFLY

SEQ ID NO: 55712 - protein, 9 aa, Borrelia burgdorfer iB31
QYVGTFGDF

SEQ ID NO: 55713 - protein, 9 aa, Borrelia burgdorfer iB31
IYFLYFFIK

SEQ ID NO: 55714 - protein, 9 aa, Borrelia burgdorfer iB31
PYDKVSYFV

SEQ ID NO: 55715 - protein, 9 aa, Borrelia burgdorfer iB31
SYLAPNNVI

SEQ ID NO: 55716 - protein, 9 aa, Borrelia burgdorfer iB31
SYLGDIANL

SEQ ID NO: 55717 - protein, 9 aa, Borrelia burgdorfer iB31
KYANSNIKV

SEQ ID NO: 55718 - protein, 9 aa, Borrelia burgdorfer iB31
FMLKKVYYF

SEQ ID NO: 55719 - protein, 9 aa, Borrelia burgdorfer iB31
MYRDGVDII

SEQ ID NO: 55720 - protein, 9 aa, Borrelia burgdorfer iB31
YFLIFLFIV

SEQ ID NO: 55721 - protein, 9 aa, Borrelia burgdorfer iB31
EIYFLYFFI

SEQ ID NO: 55722 - protein, 9 aa, Borrelia burgdorfer iB31
YEIYFLYFF

SEQ ID NO: 55723 - protein, 10 aa, Borrelia burgdorfer iB31
VYYFLIFLFI

SEQ ID NO: 55724 - protein, 10 aa, Borrelia burgdorfer iB31
YYEIYFLYFF

SEQ ID NO: 55725 - protein, 10 aa, Borrelia burgdorfer iB31
NYYEIYFLYF

SEQ ID NO: 55726 - protein, 10 aa, Borrelia burgdorfer iB31
PYDKVSYFVL

SEQ ID NO: 55727 - protein, 10 aa, Borrelia burgdorfer iB31
IFMLKKVYYF

SEQ ID NO: 55728 - protein, 10 aa, Borrelia burgdorfer iB31
YYFLIFLFIV

SEQ ID NO: 55729 - protein, 10 aa, Borrelia burgdorfer iB31
MYRDGVDIIF

SEQ ID NO: 55730 - protein, 10 aa, Borrelia burgdorfer iB31
KVYYFLIFLF

SEQ ID NO: 55731 - protein, 10 aa, Borrelia burgdorfer iB31
NYSEIYNKSL

SEQ ID NO: 55732 - protein, 10 aa, Borrelia burgdorfer iB31
KYANSNIKVV

SEQ ID NO: 55733 - protein, 10 aa, Borrelia burgdorfer iB31
FFIKSKEDIF

SEQ ID NO: 55734 - protein, 10 aa, Borrelia burgdorfer iB31
IFAAAGLSGI

SEQ ID NO: 55735 - protein, 10 aa, Borrelia burgdorfer iB31
SYLAPNNVIV

SEQ ID NO: 55736 - protein, 10 aa, Borrelia burgdorfer iB31
MLKKVYYFLI

SEQ ID NO: 55737 - protein, 10 aa, Borrelia burgdorfer iB31
YEIYFLYFFI

SEQ ID NO: 55738 - protein, 10 aa, Borrelia burgdorfer iB31
KVVSQYVGTF

SEQ ID NO: 55739 - protein, 11 aa, Borrelia burgdorfer iB31
NYYEIYFLYFF

SEQ ID NO: 55740 - protein, 11 aa, Borrelia burgdorfer iB31
YYEIYFLYFFI

SEQ ID NO: 55741 - protein, 11 aa, Borrelia burgdorfer iB31
VYYFLIFLFIV

SEQ ID NO: 55742 - protein, 11 aa, Borrelia burgdorfer iB31
IFMLKKVYYFL

SEQ ID NO: 55743 - protein, 11 aa, Borrelia burgdorfer iB31
FMLKKVYYFLI

SEQ ID NO: 55744 - protein, 11 aa, Borrelia burgdorfer iB31
QYVGTFGDFGL

SEQ ID NO: 55745 - protein, 11 aa, Borrelia burgdorfer iB31
LYFFIKSKEDI

SEQ ID NO: 55746 - protein, 11 aa, Borrelia burgdorfer iB31
VYDEIQIPKNL

SEQ ID NO: 55747 - protein, 11 aa, Borrelia burgdorfer iB31
YYFLIFLFIVA

SEQ ID NO: 55748 - protein, 11 aa, Borrelia burgdorfer iB31
NYSEIYNKSLK

SEQ ID NO: 55749 - protein, 11 aa, Borrelia burgdorfer iB31
IWGIGFRLSDI

SEQ ID NO: 55750 - protein, 11 aa, Borrelia burgdorfer iB31
YFFIKSKEDIF

SEQ ID NO: 55751 - protein, 11 aa, Borrelia burgdorfer iB31
KKVYYFLIFLF

SEQ ID NO: 55752 - protein, 11 aa, Borrelia burgdorfer iB31
IYFLYFFIKSK

SEQ ID NO: 55753 - protein, 9 aa, Borrelia burgdorfer iB31
NYYEIYFLY

SEQ ID NO: 55754 - protein, 9 aa, Borrelia burgdorfer iB31
VYYFLIFLF

SEQ ID NO: 55755 - protein, 9 aa, Borrelia burgdorfer iB31
LMYSLTKKY

SEQ ID NO: 55756 - protein, 9 aa, Borrelia burgdorfer iB31
NYAIIEGVY

SEQ ID NO: 55757 - protein, 9 aa, Borrelia burgdorfer iB31
IFMLKKVYY

SEQ ID NO: 55758 - protein, 9 aa, Borrelia burgdorfer iB31
KVPYDKVSY

SEQ ID NO: 55759 - protein, 9 aa, Borrelia burgdorfer iB31
VLESFMYGY

SEQ ID NO: 55760 - protein, 9 aa, Borrelia burgdorfer iB31
YYEIYFLYF

SEQ ID NO: 55761 - protein, 9 aa, Borrelia burgdorfer iB31
YGYEAGAKY

SEQ ID NO: 55762 - protein, 9 aa, Borrelia burgdorfer iB31
DIFMLKKVY

SEQ ID NO: 55763 - protein, 9 aa, Borrelia burgdorfer iB31
EVAFLAGYF

SEQ ID NO: 55764 - protein, 9 aa, Borrelia burgdorfer iB31
YYFLIFLFI

SEQ ID NO: 55765 - protein, 9 aa, Borrelia burgdorfer iB31
FMLKKVYYF

SEQ ID NO: 55766 - protein, 9 aa, Borrelia burgdorfer iB31
EIYFLYFFI

SEQ ID NO: 55767 - protein, 9 aa, Borrelia burgdorfer iB31
MNGIIKVPY

SEQ ID NO: 55768 - protein, 9 aa, Borrelia burgdorfer iB31
SFRSEEVAF

SEQ ID NO: 55769 - protein, 9 aa, Borrelia burgdorfer iB31
YEIYFLYFF

SEQ ID NO: 55770 - protein, 9 aa, Borrelia burgdorfer iB31
ASENVSVNY

SEQ ID NO: 55771 - protein, 9 aa, Borrelia burgdorfer iB31
YFLIFLFIV

SEQ ID NO: 55772 - protein, 10 aa, Borrelia burgdorfer iB31
MYGYEAGAKY

SEQ ID NO: 55773 - protein, 10 aa, Borrelia burgdorfer iB31
IMNGIIKVPY

SEQ ID NO: 55774 - protein, 10 aa, Borrelia burgdorfer iB31
DIFMLKKVYY

SEQ ID NO: 55775 - protein, 10 aa, Borrelia burgdorfer iB31
NYYEIYFLYF

SEQ ID NO: 55776 - protein, 10 aa, Borrelia burgdorfer iB31
DNYYEIYFLY

SEQ ID NO: 55777 - protein, 10 aa, Borrelia burgdorfer iB31
KVYYFLIFLF

SEQ ID NO: 55778 - protein, 10 aa, Borrelia burgdorfer iB31
SLMYSLTKKY

SEQ ID NO: 55779 - protein, 10 aa, Borrelia burgdorfer iB31
YYEIYFLYFF

SEQ ID NO: 55780 - protein, 10 aa, Borrelia burgdorfer iB31
KVLESFMYGY

SEQ ID NO: 55781 - protein, 10 aa, Borrelia burgdorfer iB31
YYFLIFLFIV

SEQ ID NO: 55782 - protein, 10 aa, Borrelia burgdorfer iB31
IIGVDQDQSY

SEQ ID NO: 55783 - protein, 10 aa, Borrelia burgdorfer iB31
AVKKVDSLMY

SEQ ID NO: 55784 - protein, 10 aa, Borrelia burgdorfer iB31
VLNENLKSNY

SEQ ID NO: 55785 - protein, 10 aa, Borrelia burgdorfer iB31
VNYAIIEGVY

SEQ ID NO: 55786 - protein, 10 aa, Borrelia burgdorfer iB31
VYYFLIFLFI

SEQ ID NO: 55787 - protein, 10 aa, Borrelia burgdorfer iB31
IFMLKKVYYF

SEQ ID NO: 55788 - protein, 10 aa, Borrelia burgdorfer iB31
RGKVLESFMY

SEQ ID NO: 55789 - protein, 10 aa, Borrelia burgdorfer iB31
RASENVSVNY

SEQ ID NO: 55790 - protein, 11 aa, Borrelia burgdorfer iB31
YIIGVDQDQSY

SEQ ID NO: 55791 - protein, 11 aa, Borrelia burgdorfer iB31
FMYGYEAGAKY

SEQ ID NO: 55792 - protein, 11 aa, Borrelia burgdorfer iB31
SIMNGIIKVPY

SEQ ID NO: 55793 - protein, 11 aa, Borrelia burgdorfer iB31
NYYEIYFLYFF

SEQ ID NO: 55794 - protein, 11 aa, Borrelia burgdorfer iB31
SVNYAIIEGVY

SEQ ID NO: 55795 - protein, 11 aa, Borrelia burgdorfer iB31
LVLNENLKSNY

SEQ ID NO: 55796 - protein, 11 aa, Borrelia burgdorfer iB31
MDNYYEIYFLY

SEQ ID NO: 55797 - protein, 11 aa, Borrelia burgdorfer iB31
IIKVPYDKVSY

SEQ ID NO: 55798 - protein, 11 aa, Borrelia burgdorfer iB31
VYYFLIFLFIV

SEQ ID NO: 55799 - protein, 11 aa, Borrelia burgdorfer iB31
YFFIKSKEDIF

SEQ ID NO: 55800 - protein, 11 aa, Borrelia burgdorfer iB31
QRASENVSVNY

SEQ ID NO: 55801 - protein, 11 aa, Borrelia burgdorfer iB31
NMYRDGVDIIF

SEQ ID NO: 55802 - protein, 11 aa, Borrelia burgdorfer iB31
YYEIYFLYFFI

SEQ ID NO: 55803 - protein, 11 aa, Borrelia burgdorfer iB31
DIFMLKKVYYF

SEQ ID NO: 55804 - protein, 11 aa, Borrelia burgdorfer iB31
SAVKKVDSLMY

SEQ ID NO: 55805 - protein, 11 aa, Borrelia burgdorfer iB31
VRGKVLESFMY

SEQ ID NO: 55806 - protein, 11 aa, Borrelia burgdorfer iB31
EDIFMLKKVYY

SEQ ID NO: 55807 - protein, 9 aa, Borrelia burgdorfer iB31
NLIWGIGFR

SEQ ID NO: 55808 - protein, 9 aa, Borrelia burgdorfer iB31
NVIVSAVKK

SEQ ID NO: 55809 - protein, 9 aa, Borrelia burgdorfer iB31
RSTASNMYR

SEQ ID NO: 55810 - protein, 9 aa, Borrelia burgdorfer iB31
RLSDILFQR

SEQ ID NO: 55811 - protein, 9 aa, Borrelia burgdorfer iB31
FLAGYFASK

SEQ ID NO: 55812 - protein, 9 aa, Borrelia burgdorfer iB31
ESSSKAIRK

SEQ ID NO: 55813 - protein, 9 aa, Borrelia burgdorfer iB31
NYYEIYFLY

SEQ ID NO: 55814 - protein, 9 aa, Borrelia burgdorfer iB31
FLYFFIKSK

SEQ ID NO: 55815 - protein, 9 aa, Borrelia burgdorfer iB31
IYFLYFFIK

SEQ ID NO: 55816 - protein, 9 aa, Borrelia burgdorfer iB31
SSKAIRKLK

SEQ ID NO: 55817 - protein, 9 aa, Borrelia burgdorfer iB31
DSLMYSLTK

SEQ ID NO: 55818 - protein, 9 aa, Borrelia burgdorfer iB31
ETGVLDGGK

SEQ ID NO: 55819 - protein, 9 aa, Borrelia burgdorfer iB31
SLMYSLTKK

SEQ ID NO: 55820 - protein, 9 aa, Borrelia burgdorfer iB31
DLNINIIEK

SEQ ID NO: 55821 - protein, 9 aa, Borrelia burgdorfer iB31
EVAFLAGYF

SEQ ID NO: 55822 - protein, 9 aa, Borrelia burgdorfer iB31
NNVIVSAVK

SEQ ID NO: 55823 - protein, 9 aa, Borrelia burgdorfer iB31
EIYFLYFFI

SEQ ID NO: 55824 - protein, 9 aa, Borrelia burgdorfer iB31
SNYSEIYNK

SEQ ID NO: 55825 - protein, 9 aa, Borrelia burgdorfer iB31
QSIMNGIIK

SEQ ID NO: 55826 - protein, 9 aa, Borrelia burgdorfer iB31
SEIYNKSLK

SEQ ID NO: 55827 - protein, 9 aa, Borrelia burgdorfer iB31
GIIKVPYDK

SEQ ID NO: 55828 - protein, 9 aa, Borrelia burgdorfer iB31
MYGYEAGAK

SEQ ID NO: 55829 - protein, 9 aa, Borrelia burgdorfer iB31
GYFASKASK

SEQ ID NO: 55830 - protein, 9 aa, Borrelia burgdorfer iB31
NESSSKAIR

SEQ ID NO: 55831 - protein, 9 aa, Borrelia burgdorfer iB31
GLVLNENLK

SEQ ID NO: 55832 - protein, 9 aa, Borrelia burgdorfer iB31
TFGDFGLGR

SEQ ID NO: 55833 - protein, 9 aa, Borrelia burgdorfer iB31
IVDGAFDDK

SEQ ID NO: 55834 - protein, 9 aa, Borrelia burgdorfer iB31
SKEDIFMLK

SEQ ID NO: 55835 - protein, 10 aa, Borrelia burgdorfer iB31
EIYFLYFFIK

SEQ ID NO: 55836 - protein, 10 aa, Borrelia burgdorfer iB31
GTFGDFGLGR

SEQ ID NO: 55837 - protein, 10 aa, Borrelia burgdorfer iB31
FMYGYEAGAK

SEQ ID NO: 55838 - protein, 10 aa, Borrelia burgdorfer iB31
YSEIYNKSLK

SEQ ID NO: 55839 - protein, 10 aa, Borrelia burgdorfer iB31
FASKASKTGK

SEQ ID NO: 55840 - protein, 10 aa, Borrelia burgdorfer iB31
SSSKAIRKLK

SEQ ID NO: 55841 - protein, 10 aa, Borrelia burgdorfer iB31
DSLMYSLTKK

SEQ ID NO: 55842 - protein, 10 aa, Borrelia burgdorfer iB31
DNYYEIYFLY

SEQ ID NO: 55843 - protein, 10 aa, Borrelia burgdorfer iB31
GVYDEIQIPK

SEQ ID NO: 55844 - protein, 10 aa, Borrelia burgdorfer iB31
LIVDGAFDDK

SEQ ID NO: 55845 - protein, 10 aa, Borrelia burgdorfer iB31
NNVIVSAVKK

SEQ ID NO: 55846 - protein, 10 aa, Borrelia burgdorfer iB31
DIFMLKKVYY

SEQ ID NO: 55847 - protein, 10 aa, Borrelia burgdorfer iB31
KSNYSEIYNK

SEQ ID NO: 55848 - protein, 10 aa, Borrelia burgdorfer iB31
VACSSSDDGK

SEQ ID NO: 55849 - protein, 10 aa, Borrelia burgdorfer iB31
EVAFLAGYFA

SEQ ID NO: 55850 - protein, 10 aa, Borrelia burgdorfer iB31
YFLYFFIKSK

SEQ ID NO: 55851 - protein, 10 aa, Borrelia burgdorfer iB31
NSNIKVVSQY

SEQ ID NO: 55852 - protein, 10 aa, Borrelia burgdorfer iB31
SGIGVIEAAK

SEQ ID NO: 55853 - protein, 10 aa, Borrelia burgdorfer iB31
KSKEDIFMLK

SEQ ID NO: 55854 - protein, 10 aa, Borrelia burgdorfer iB31
GAKYANSNIK

SEQ ID NO: 55855 - protein, 10 aa, Borrelia burgdorfer iB31
FNESSSKAIR

SEQ ID NO: 55856 - protein, 10 aa, Borrelia burgdorfer iB31
FRLSDILFQR

SEQ ID NO: 55857 - protein, 10 aa, Borrelia burgdorfer iB31
SNLIWGIGFR

SEQ ID NO: 55858 - protein, 10 aa, Borrelia burgdorfer iB31
KVYYFLIFLF

SEQ ID NO: 55859 - protein, 11 aa, Borrelia burgdorfer iB31
NSNLIWGIGFR

SEQ ID NO: 55860 - protein, 11 aa, Borrelia burgdorfer iB31
ESSSKAIRKLK

SEQ ID NO: 55861 - protein, 11 aa, Borrelia burgdorfer iB31
IVACSSSDDGK

SEQ ID NO: 55862 - protein, 11 aa, Borrelia burgdorfer iB31
NYSEIYNKSLK

SEQ ID NO: 55863 - protein, 11 aa, Borrelia burgdorfer iB31
VAFLAGYFASK

SEQ ID NO: 55864 - protein, 11 aa, Borrelia burgdorfer iB31
YEIYFLYFFIK

SEQ ID NO: 55865 - protein, 11 aa, Borrelia burgdorfer iB31
LAGYFASKASK

SEQ ID NO: 55866 - protein, 11 aa, Borrelia burgdorfer iB31
IPKNLLNISFR

SEQ ID NO: 55867 - protein, 11 aa, Borrelia burgdorfer iB31
IYFLYFFIKSK

SEQ ID NO: 55868 - protein, 11 aa, Borrelia burgdorfer iB31
YFASKASKTGK

SEQ ID NO: 55869 - protein, 11 aa, Borrelia burgdorfer iB31
MDNYYEIYFLY

SEQ ID NO: 55870 - protein, 11 aa, Borrelia burgdorfer iB31
EGVYDEIQIPK

SEQ ID NO: 55871 - protein, 11 aa, Borrelia burgdorfer iB31
SVNYAIIEGVY

SEQ ID NO: 55872 - protein, 11 aa, Borrelia burgdorfer iB31
NYYEIYFLYFF

SEQ ID NO: 55873 - protein, 11 aa, Borrelia burgdorfer iB31
SFMYGYEAGAK

SEQ ID NO: 55874 - protein, 11 aa, Borrelia burgdorfer iB31
FMYGYEAGAKY

SEQ ID NO: 55875 - protein, 11 aa, Borrelia burgdorfer iB31
EAAKELGPDHY

SEQ ID NO: 55876 - protein, 11 aa, Borrelia burgdorfer iB31
SLIVDGAFDDK

SEQ ID NO: 55877 - protein, 11 aa, Borrelia burgdorfer iB31
EVAFLAGYFAS

SEQ ID NO: 55878 - protein, 11 aa, Borrelia burgdorfer iB31
LGRSTASNMYR

SEQ ID NO: 55879 - protein, 11 aa, Borrelia burgdorfer iB31
YIIGVDQDQSY

SEQ ID NO: 55880 - protein, 11 aa, Borrelia burgdorfer iB31
SSSDDGKSEAK

SEQ ID NO: 55881 - protein, 11 aa, Borrelia burgdorfer iB31
EIYFLYFFIKS

SEQ ID NO: 55882 - protein, 11 aa, Borrelia burgdorfer iB31
NSYLGDIANLE

SEQ ID NO: 55883 - protein, 11 aa, Borrelia burgdorfer iB31
MNGIIKVPYDK

SEQ ID NO: 55884 - protein, 11 aa, Borrelia burgdorfer iB31
SIMNGIIKVPY

SEQ ID NO: 55885 - protein, 11 aa, Borrelia burgdorfer iB31
LSGIGVIEAAK

SEQ ID NO: 55886 - protein, 9 aa, Borrelia burgdorfer iB31
APNNVIVSA

SEQ ID NO: 55887 - protein, 9 aa, Borrelia burgdorfer iB31
VPYDKVSYF

SEQ ID NO: 55888 - protein, 9 aa, Borrelia burgdorfer iB31
SAVKKVDSL

SEQ ID NO: 55889 - protein, 9 aa, Borrelia burgdorfer iB31
AIRKLKADL

SEQ ID NO: 55890 - protein, 9 aa, Borrelia burgdorfer iB31
KASTGNSYL

SEQ ID NO: 55891 - protein, 9 aa, Borrelia burgdorfer iB31
KVSYFVLQM

SEQ ID NO: 55892 - protein, 10 aa, Borrelia burgdorfer iB31
APNNVIVSAV

SEQ ID NO: 55893 - protein, 10 aa, Borrelia burgdorfer iB31
IPKNLLNISF

SEQ ID NO: 55894 - protein, 10 aa, Borrelia burgdorfer iB31
VPYDKVSYFV

SEQ ID NO: 55895 - protein, 10 aa, Borrelia burgdorfer iB31
FVGGVRGKVL

SEQ ID NO: 55896 - protein, 10 aa, Borrelia burgdorfer iB31
GVRGKVLESF

SEQ ID NO: 55897 - protein, 11 aa, Borrelia burgdorfer iB31
VPYDKVSYFVL

SEQ ID NO: 55898 - protein, 11 aa, Borrelia burgdorfer iB31
IVSAVKKVDSL

SEQ ID NO: 55899 - protein, 9 aa, Borrelia burgdorfer iB31
YDKVSYFVL

SEQ ID NO: 55900 - protein, 9 aa, Borrelia burgdorfer iB31
MLKKVYYFL

SEQ ID NO: 55901 - protein, 9 aa, Borrelia burgdorfer iB31
FMLKKVYYF

SEQ ID NO: 55902 - protein, 10 aa, Borrelia burgdorfer iB31
FMLKKVYYFL

SEQ ID NO: 55903 - protein, 10 aa, Borrelia burgdorfer iB31
MLKKVYYFLI

SEQ ID NO: 55904 - protein, 10 aa, Borrelia burgdorfer iB31
IPKNLLNISF

SEQ ID NO: 55905 - protein, 10 aa, Borrelia burgdorfer iB31
FIKSKEDIFM

SEQ ID NO: 55906 - protein, 11 aa, Borrelia burgdorfer iB31
MLKKVYYFLIF

SEQ ID NO: 55907 - protein, 11 aa, Borrelia burgdorfer iB31
YDKVSYFVLQM

SEQ ID NO: 55908 - protein, 11 aa, Borrelia burgdorfer iB31
FIKSKEDIFML

SEQ ID NO: 55909 - protein, 11 aa, Borrelia burgdorfer iB31
FMLKKVYYFLI

SEQ ID NO: 55910 - protein, 9 aa, Borrelia burgdorfer iB31
LMYSLTKKY

SEQ ID NO: 55911 - protein, 9 aa, Borrelia burgdorfer iB31
YGYEAGAKY

SEQ ID NO: 55912 - protein, 9 aa, Borrelia burgdorfer iB31
FMLKKVYYF

SEQ ID NO: 55913 - protein, 9 aa, Borrelia burgdorfer iB31
VVSQYVGTF

SEQ ID NO: 55914 - protein, 9 aa, Borrelia burgdorfer iB31
FQRASENVS

SEQ ID NO: 55915 - protein, 9 aa, Borrelia burgdorfer iB31
VSLIVDGAF

SEQ ID NO: 55916 - protein, 9 aa, Borrelia burgdorfer iB31
IGVDQDQSY

SEQ ID NO: 55917 - protein, 9 aa, Borrelia burgdorfer iB31
GLKEDGLGL

SEQ ID NO: 55918 - protein, 9 aa, Borrelia burgdorfer iB31
GVLDGGKTM

SEQ ID NO: 55919 - protein, 9 aa, Borrelia burgdorfer iB31
ASKTGKIGF

SEQ ID NO: 55920 - protein, 9 aa, Borrelia burgdorfer iB31
SLKIGQSIM

SEQ ID NO: 55921 - protein, 9 aa, Borrelia burgdorfer iB31
KVPYDKVSY

SEQ ID NO: 55922 - protein, 9 aa, Borrelia burgdorfer iB31
SFRSEEVAF

SEQ ID NO: 55923 - protein, 9 aa, Borrelia burgdorfer iB31
GVIEAAKEL

SEQ ID NO: 55924 - protein, 10 aa, Borrelia burgdorfer iB31
IMNGIIKVPY

SEQ ID NO: 55925 - protein, 10 aa, Borrelia burgdorfer iB31
SQYVGTFGDF

SEQ ID NO: 55926 - protein, 10 aa, Borrelia burgdorfer iB31
FQRASENVSV

SEQ ID NO: 55927 - protein, 10 aa, Borrelia burgdorfer iB31
ISFRSEEVAF

SEQ ID NO: 55928 - protein, 10 aa, Borrelia burgdorfer iB31
IEKASTGNSY

SEQ ID NO: 55929 - protein, 10 aa, Borrelia burgdorfer iB31
RASENVSVNY

SEQ ID NO: 55930 - protein, 10 aa, Borrelia burgdorfer iB31
GVRGKVLESF

SEQ ID NO: 55931 - protein, 10 aa, Borrelia burgdorfer iB31
AVKKVDSLMY

SEQ ID NO: 55932 - protein, 10 aa, Borrelia burgdorfer iB31
SLMYSLTKKY

SEQ ID NO: 55933 - protein, 10 aa, Borrelia burgdorfer iB31
VLNENLKSNY

SEQ ID NO: 55934 - protein, 10 aa, Borrelia burgdorfer iB31
TVSLIVDGAF

SEQ ID NO: 55935 - protein, 10 aa, Borrelia burgdorfer iB31
KVLESFMYGY

SEQ ID NO: 55936 - protein, 10 aa, Borrelia burgdorfer iB31
KVYYFLIFLF

SEQ ID NO: 55937 - protein, 10 aa, Borrelia burgdorfer iB31
GVLDGGKTMF

SEQ ID NO: 55938 - protein, 10 aa, Borrelia burgdorfer iB31
VNYAIIEGVY

SEQ ID NO: 55939 - protein, 10 aa, Borrelia burgdorfer iB31
KVVSQYVGTF

SEQ ID NO: 55940 - protein, 10 aa, Borrelia burgdorfer iB31
LGRSTASNMY

SEQ ID NO: 55941 - protein, 10 aa, Borrelia burgdorfer iB31
RGKVLESFMY

SEQ ID NO: 55942 - protein, 10 aa, Borrelia burgdorfer iB31
AAKELGPDHY

SEQ ID NO: 55943 - protein, 10 aa, Borrelia burgdorfer iB31
IQIPKNLLNI

SEQ ID NO: 55944 - protein, 10 aa, Borrelia burgdorfer iB31
NLKSNYSEIY

SEQ ID NO: 55945 - protein, 10 aa, Borrelia burgdorfer iB31
KASKTGKIGF

SEQ ID NO: 55946 - protein, 10 aa, Borrelia burgdorfer iB31
IIGVDQDQSY

SEQ ID NO: 55947 - protein, 10 aa, Borrelia burgdorfer iB31
LMYSLTKKYL

SEQ ID NO: 55948 - protein, 10 aa, Borrelia burgdorfer iB31
IGFRLSDILF

SEQ ID NO: 55949 - protein, 11 aa, Borrelia burgdorfer iB31
FMYGYEAGAKY

SEQ ID NO: 55950 - protein, 11 aa, Borrelia burgdorfer iB31
YIIGVDQDQSY

SEQ ID NO: 55951 - protein, 11 aa, Borrelia burgdorfer iB31
SIMNGIIKVPY

SEQ ID NO: 55952 - protein, 11 aa, Borrelia burgdorfer iB31
NMYRDGVDIIF

SEQ ID NO: 55953 - protein, 11 aa, Borrelia burgdorfer iB31
SVNYAIIEGVY

SEQ ID NO: 55954 - protein, 11 aa, Borrelia burgdorfer iB31
IIKVPYDKVSY

SEQ ID NO: 55955 - protein, 11 aa, Borrelia burgdorfer iB31
MLKKVYYFLIF

SEQ ID NO: 55956 - protein, 11 aa, Borrelia burgdorfer iB31
GLGRSTASNMY

SEQ ID NO: 55957 - protein, 11 aa, Borrelia burgdorfer iB31
GLKEDGLGLVL

SEQ ID NO: 55958 - protein, 11 aa, Borrelia burgdorfer iB31
KTVSLIVDGAF

SEQ ID NO: 55959 - protein, 11 aa, Borrelia burgdorfer iB31
RSEEVAFLAGY

SEQ ID NO: 55960 - protein, 11 aa, Borrelia burgdorfer iB31
IIEKASTGNSY

SEQ ID NO: 55961 - protein, 11 aa, Borrelia burgdorfer iB31
LVLNENLKSNY

SEQ ID NO: 55962 - protein, 11 aa, Borrelia burgdorfer iB31
FQRASENVSVN

SEQ ID NO: 55963 - protein, 11 aa, Borrelia burgdorfer iB31
VSQYVGTFGDF

SEQ ID NO: 55964 - protein, 11 aa, Borrelia burgdorfer iB31
YFFIKSKEDIF

SEQ ID NO: 55965 - protein, 9 aa, Borrelia burgdorfer iB31
YRDGVDIIF

SEQ ID NO: 55966 - protein, 9 aa, Borrelia burgdorfer iB31
FRSEEVAFL

SEQ ID NO: 55967 - protein, 9 aa, Borrelia burgdorfer iB31
GRSTASNMY

SEQ ID NO: 55968 - protein, 9 aa, Borrelia burgdorfer iB31
QRASENVSV

SEQ ID NO: 55969 - protein, 10 aa, Borrelia burgdorfer iB31
FRLSDILFQR

SEQ ID NO: 55970 - protein, 10 aa, Borrelia burgdorfer iB31
GRSTASNMYR

SEQ ID NO: 55971 - protein, 10 aa, Borrelia burgdorfer iB31
KKVDSLMYSL

SEQ ID NO: 55972 - protein, 11 aa, Borrelia burgdorfer iB31
QRASENVSVNY

SEQ ID NO: 55973 - protein, 9 aa, Borrelia burgdorfer iB31
YGYEAGAKY

SEQ ID NO: 55974 - protein, 9 aa, Borrelia burgdorfer iB31
IGVDQDQSY

SEQ ID NO: 55975 - protein, 9 aa, Borrelia burgdorfer iB31
VPYDKVSYF

SEQ ID NO: 55976 - protein, 9 aa, Borrelia burgdorfer iB31
VVSQYVGTF

SEQ ID NO: 55977 - protein, 9 aa, Borrelia burgdorfer iB31
EVAFLAGYF

SEQ ID NO: 55978 - protein, 9 aa, Borrelia burgdorfer iB31
LKSNYSEIY

SEQ ID NO: 55979 - protein, 9 aa, Borrelia burgdorfer iB31
VSLIVDGAF

SEQ ID NO: 55980 - protein, 9 aa, Borrelia burgdorfer iB31
EKASTGNSY

SEQ ID NO: 55981 - protein, 9 aa, Borrelia burgdorfer iB31
YRDGVDIIF

SEQ ID NO: 55982 - protein, 9 aa, Borrelia burgdorfer iB31
MDNYYEIYF

SEQ ID NO: 55983 - protein, 9 aa, Borrelia burgdorfer iB31
YYEIYFLYF

SEQ ID NO: 55984 - protein, 9 aa, Borrelia burgdorfer iB31
SFRSEEVAF

SEQ ID NO: 55985 - protein, 9 aa, Borrelia burgdorfer iB31
NYAIIEGVY

SEQ ID NO: 55986 - protein, 9 aa, Borrelia burgdorfer iB31
YEIYFLYFF

SEQ ID NO: 55987 - protein, 9 aa, Borrelia burgdorfer iB31
MNGIIKVPY

SEQ ID NO: 55988 - protein, 9 aa, Borrelia burgdorfer iB31
EEVAFLAGY

SEQ ID NO: 55989 - protein, 9 aa, Borrelia burgdorfer iB31
LIWGIGFRL

SEQ ID NO: 55990 - protein, 10 aa, Borrelia burgdorfer iB31
IPKNLLNISF

SEQ ID NO: 55991 - protein, 10 aa, Borrelia burgdorfer iB31
TVSLIVDGAF

SEQ ID NO: 55992 - protein, 10 aa, Borrelia burgdorfer iB31
RASENVSVNY

SEQ ID NO: 55993 - protein, 10 aa, Borrelia burgdorfer iB31
IMNGIIKVPY

SEQ ID NO: 55994 - protein, 10 aa, Borrelia burgdorfer iB31
KVVSQYVGTF

SEQ ID NO: 55995 - protein, 10 aa, Borrelia burgdorfer iB31
ISFRSEEVAF

SEQ ID NO: 55996 - protein, 10 aa, Borrelia burgdorfer iB31
MYRDGVDIIF

SEQ ID NO: 55997 - protein, 10 aa, Borrelia burgdorfer iB31
MYGYEAGAKY

SEQ ID NO: 55998 - protein, 10 aa, Borrelia burgdorfer iB31
YVGTFGDFGL

SEQ ID NO: 55999 - protein, 10 aa, Borrelia burgdorfer iB31
FFIKSKEDIF

SEQ ID NO: 56000 - protein, 10 aa, Borrelia burgdorfer iB31
KVLESFMYGY

SEQ ID NO: 56001 - protein, 10 aa, Borrelia burgdorfer iB31
IKVPYDKVSY

SEQ ID NO: 56002 - protein, 10 aa, Borrelia burgdorfer iB31
YANSNIKVVS

SEQ ID NO: 56003 - protein, 10 aa, Borrelia burgdorfer iB31
TGVLDGGKTM

SEQ ID NO: 56004 - protein, 10 aa, Borrelia burgdorfer iB31
IIGVDQDQSY

SEQ ID NO: 56005 - protein, 10 aa, Borrelia burgdorfer iB31
YYEIYFLYFF

SEQ ID NO: 56006 - protein, 10 aa, Borrelia burgdorfer iB31
SAVKKVDSLM

SEQ ID NO: 56007 - protein, 10 aa, Borrelia burgdorfer iB31
APNNVIVSAV

SEQ ID NO: 56008 - protein, 11 aa, Borrelia burgdorfer iB31
YIIGVDQDQSY

SEQ ID NO: 56009 - protein, 11 aa, Borrelia burgdorfer iB31
SVNYAIIEGVY

SEQ ID NO: 56010 - protein, 11 aa, Borrelia burgdorfer iB31
FMYGYEAGAKY

SEQ ID NO: 56011 - protein, 11 aa, Borrelia burgdorfer iB31
EAAKELGPDHY

SEQ ID NO: 56012 - protein, 11 aa, Borrelia burgdorfer iB31
SAVKKVDSLMY

SEQ ID NO: 56013 - protein, 11 aa, Borrelia burgdorfer iB31
SIMNGIIKVPY

SEQ ID NO: 56014 - protein, 11 aa, Borrelia burgdorfer iB31
VPYDKVSYFVL

SEQ ID NO: 56015 - protein, 11 aa, Borrelia burgdorfer iB31
NISFRSEEVAF

SEQ ID NO: 56016 - protein, 11 aa, Borrelia burgdorfer iB31
MDNYYEIYFLY

SEQ ID NO: 56017 - protein, 11 aa, Borrelia burgdorfer iB31
NMYRDGVDIIF

SEQ ID NO: 56018 - protein, 11 aa, Borrelia burgdorfer iB31
YFFIKSKEDIF

SEQ ID NO: 56019 - protein, 11 aa, Borrelia burgdorfer iB31
LVLNENLKSNY

SEQ ID NO: 56020 - protein, 11 aa, Borrelia burgdorfer iB31
IIEKASTGNSY

SEQ ID NO: 56021 - protein, 11 aa, Borrelia burgdorfer iB31
KTVSLIVDGAF

SEQ ID NO: 56022 - protein, 11 aa, Borrelia burgdorfer iB31
IVDGAFDDKGF

SEQ ID NO: 56023 - protein, 11 aa, Borrelia burgdorfer iB31
YAIIEGVYDEI

SEQ ID NO: 56024 - protein, 11 aa, Borrelia burgdorfer iB31
FFIKSKEDIFM

SEQ ID NO: 56025 - protein, 11 aa, Borrelia burgdorfer iB31
TGVLDGGKTMF

SEQ ID NO: 56026 - protein, 11 aa, Borrelia burgdorfer iB31
DSLMYSLTKKY

SEQ ID NO: 56027 - protein, 9 aa, Borrelia burgdorfer iB31
EEVAFLAGY

SEQ ID NO: 56028 - protein, 9 aa, Borrelia burgdorfer iB31
YEIYFLYFF

SEQ ID NO: 56029 - protein, 9 aa, Borrelia burgdorfer iB31
DEIQIPKNL

SEQ ID NO: 56030 - protein, 9 aa, Borrelia burgdorfer iB31
KEDGLGLVL

SEQ ID NO: 56031 - protein, 9 aa, Borrelia burgdorfer iB31
KELGPDHYI

SEQ ID NO: 56032 - protein, 10 aa, Borrelia burgdorfer iB31
EEVAFLAGYF

SEQ ID NO: 56033 - protein, 10 aa, Borrelia burgdorfer iB31
SEIYNKSLKI

SEQ ID NO: 56034 - protein, 10 aa, Borrelia burgdorfer iB31
YEIYFLYFFI

SEQ ID NO: 56035 - protein, 10 aa, Borrelia burgdorfer iB31
SEEVAFLAGY

SEQ ID NO: 56036 - protein, 10 aa, Borrelia burgdorfer iB31
SENVSVNYAI

SEQ ID NO: 56037 - protein, 10 aa, Borrelia burgdorfer iB31
DEIQIPKNLL

SEQ ID NO: 56038 - protein, 10 aa, Borrelia burgdorfer iB31
SEAKTVSLIV

SEQ ID NO: 56039 - protein, 11 aa, Borrelia burgdorfer iB31
SEEVAFLAGYF

SEQ ID NO: 56040 - protein, 11 aa, Borrelia burgdorfer iB31
EEVAFLAGYFA

SEQ ID NO: 56041 - protein, 11 aa, Borrelia burgdorfer iB31
DEIQIPKNLLN

SEQ ID NO: 56042 - protein, 11 aa, Borrelia burgdorfer iB31
SENVSVNYAII

SEQ ID NO: 56043 - protein, 11 aa, Borrelia burgdorfer iB31
KEDIFMLKKVY

SEQ ID NO: 56044 - protein, 9 aa, Borrelia burgdorfer iB31
VPYDKVSYF

SEQ ID NO: 56045 - protein, 9 aa, Borrelia burgdorfer iB31
FAAAGLSGI

SEQ ID NO: 56046 - protein, 9 aa, Borrelia burgdorfer iB31
IPKNLLNIS

SEQ ID NO: 56047 - protein, 10 aa, Borrelia burgdorfer iB31
VPYDKVSYFV

SEQ ID NO: 56048 - protein, 10 aa, Borrelia burgdorfer iB31
IPKNLLNISF

SEQ ID NO: 56049 - protein, 11 aa, Borrelia burgdorfer iB31
VPYDKVSYFVL

SEQ ID NO: 56050 - protein, 11 aa, Borrelia burgdorfer iB31
LAPNNVIVSAV

SEQ ID NO: 56051 - protein, 11 aa, Borrelia burgdorfer iB31
FAAAGLSGIGV

SEQ ID NO: 56052 - protein, 10 aa, Borrelia burgdorfer iB31
ISFRSEEVAF

SEQ ID NO: 56053 - protein, 9 aa, Borrelia afzelii
ATEEETITF

SEQ ID NO: 56054 - protein, 10 aa, Borrelia afzelii
FTETQTGGKV

SEQ ID NO: 56055 - protein, 9 aa, Borrelia afzelii
GIYDLILNA

SEQ ID NO: 56056 - protein, 9 aa, Borrelia afzelii
TLLASLLAA

SEQ ID NO: 56057 - protein, 9 aa, Borrelia afzelii
IILTLTLLA

SEQ ID NO: 56058 - protein, 9 aa, Borrelia afzelii
LTLTLLASL

SEQ ID NO: 56059 - protein, 9 aa, Borrelia afzelii
TTADGIIAI

SEQ ID NO: 56060 - protein, 9 aa, Borrelia afzelii
SLLAACSLT

SEQ ID NO: 56061 - protein, 9 aa, Borrelia afzelii
KIILTLTLL

SEQ ID NO: 56062 - protein, 9 aa, Borrelia afzelii
TADGIIAIV

SEQ ID NO: 56063 - protein, 9 aa, Borrelia afzelii
GMQGMKQAV

SEQ ID NO: 56064 - protein, 9 aa, Borrelia afzelii
VMKAKVENI

SEQ ID NO: 56065 - protein, 9 aa, Borrelia afzelii
LLASLLAAC

SEQ ID NO: 56066 - protein, 9 aa, Borrelia afzelii
GMKQAVEEA

SEQ ID NO: 56067 - protein, 9 aa, Borrelia afzelii
FLEATEEET

SEQ ID NO: 56068 - protein, 10 aa, Borrelia afzelii
GIYDLILNAA

SEQ ID NO: 56069 - protein, 10 aa, Borrelia afzelii
TTADGIIAIV

SEQ ID NO: 56070 - protein, 10 aa, Borrelia afzelii
ILTLTLLASL

SEQ ID NO: 56071 - protein, 10 aa, Borrelia afzelii
FLEATEEETI

SEQ ID NO: 56072 - protein, 10 aa, Borrelia afzelii
RVADLTIKFL

SEQ ID NO: 56073 - protein, 10 aa, Borrelia afzelii
KIILTLTLLA

SEQ ID NO: 56074 - protein, 10 aa, Borrelia afzelii
KVMKAKVENI

SEQ ID NO: 56075 - protein, 10 aa, Borrelia afzelii
LTLTLLASLL

SEQ ID NO: 56076 - protein, 10 aa, Borrelia afzelii
KTTADGIIAI

SEQ ID NO: 56077 - protein, 10 aa, Borrelia afzelii
AIVKVMKAKV

SEQ ID NO: 56078 - protein, 10 aa, Borrelia afzelii
LTLLASLLAA

SEQ ID NO: 56079 - protein, 10 aa, Borrelia afzelii
LLASLLAACS

SEQ ID NO: 56080 - protein, 11 aa, Borrelia afzelii
IILTLTLLASL

SEQ ID NO: 56081 - protein, 11 aa, Borrelia afzelii
LLASLLAACSL

SEQ ID NO: 56082 - protein, 11 aa, Borrelia afzelii
LLAACSLTGKA

SEQ ID NO: 56083 - protein, 11 aa, Borrelia afzelii
ILNAAKAVEKI

SEQ ID NO: 56084 - protein, 11 aa, Borrelia afzelii
KTTADGIIAIV

SEQ ID NO: 56085 - protein, 11 aa, Borrelia afzelii
LTLTLLASLLA

SEQ ID NO: 56086 - protein, 11 aa, Borrelia afzelii
TADGIIAIVKV

SEQ ID NO: 56087 - protein, 11 aa, Borrelia afzelii
ILTLTLLASLL

SEQ ID NO: 56088 - protein, 11 aa, Borrelia afzelii
TLTLLASLLAA

SEQ ID NO: 56089 - protein, 11 aa, Borrelia afzelii
GIIAIVKVMKA

SEQ ID NO: 56090 - protein, 9 aa, Borrelia afzelii
IIAIVKVMK

SEQ ID NO: 56091 - protein, 9 aa, Borrelia afzelii
LAACSLTGK

SEQ ID NO: 56092 - protein, 9 aa, Borrelia afzelii
KARLESSVK

SEQ ID NO: 56093 - protein, 9 aa, Borrelia afzelii
AIVKVMKAK

SEQ ID NO: 56094 - protein, 9 aa, Borrelia afzelii
FTETQTGGK

SEQ ID NO: 56095 - protein, 10 aa, Borrelia afzelii
LLAACSLTGK

SEQ ID NO: 56096 - protein, 10 aa, Borrelia afzelii
ILNAAKAVEK

SEQ ID NO: 56097 - protein, 10 aa, Borrelia afzelii
GIIAIVKVMK

SEQ ID NO: 56098 - protein, 10 aa, Borrelia afzelii
KIRVADLTIK

SEQ ID NO: 56099 - protein, 10 aa, Borrelia afzelii
ATEEETITFK

SEQ ID NO: 56100 - protein, 10 aa, Borrelia afzelii
IAIVKVMKAK

SEQ ID NO: 56101 - protein, 10 aa, Borrelia afzelii
TADGIIAIVK

SEQ ID NO: 56102 - protein, 10 aa, Borrelia afzelii
IYDLILNAAK

SEQ ID NO: 56103 - protein, 10 aa, Borrelia afzelii
VMKAKVENIK

SEQ ID NO: 56104 - protein, 10 aa, Borrelia afzelii
ITNEIEKAIK

SEQ ID NO: 56105 - protein, 10 aa, Borrelia afzelii
AFTETQTGGK

SEQ ID NO: 56106 - protein, 11 aa, Borrelia afzelii
GIYDLILNAAK

SEQ ID NO: 56107 - protein, 11 aa, Borrelia afzelii
SLLAACSLTGK

SEQ ID NO: 56108 - protein, 11 aa, Borrelia afzelii
KVGGSQIRAAK

SEQ ID NO: 56109 - protein, 11 aa, Borrelia afzelii
IIAIVKVMKAK

SEQ ID NO: 56110 - protein, 11 aa, Borrelia afzelii
KVMKAKVENIK

SEQ ID NO: 56111 - protein, 11 aa, Borrelia afzelii
TTADGIIAIVK

SEQ ID NO: 56112 - protein, 11 aa, Borrelia afzelii
LILNAAKAVEK

SEQ ID NO: 56113 - protein, 11 aa, Borrelia afzelii
AVEKIGMQGMK

SEQ ID NO: 56114 - protein, 11 aa, Borrelia afzelii
KVENIKEKQTK

SEQ ID NO: 56115 - protein, 11 aa, Borrelia afzelii
SVKDITNEIEK

SEQ ID NO: 56116 - protein, 9 aa, Borrelia afzelii
IIAIVKVMK

SEQ ID NO: 56117 - protein, 9 aa, Borrelia afzelii
AIVKVMKAK

SEQ ID NO: 56118 - protein, 9 aa, Borrelia afzelii
LAACSLTGK

SEQ ID NO: 56119 - protein, 9 aa, Borrelia afzelii
AVEEAAKEK

SEQ ID NO: 56120 - protein, 9 aa, Borrelia afzelii
KQAVEEAAK

SEQ ID NO: 56121 - protein, 9 aa, Borrelia afzelii
FTETQTGGK

SEQ ID NO: 56122 - protein, 9 aa, Borrelia afzelii
KARLESSVK

SEQ ID NO: 56123 - protein, 10 aa, Borrelia afzelii
ATEEETITFK

SEQ ID NO: 56124 - protein, 10 aa, Borrelia afzelii
GIIAIVKVMK

SEQ ID NO: 56125 - protein, 10 aa, Borrelia afzelii
ILNAAKAVEK

SEQ ID NO: 56126 - protein, 10 aa, Borrelia afzelii
TADGIIAIVK

SEQ ID NO: 56127 - protein, 10 aa, Borrelia afzelii
LLAACSLTGK

SEQ ID NO: 56128 - protein, 10 aa, Borrelia afzelii
ITNEIEKAIK

SEQ ID NO: 56129 - protein, 10 aa, Borrelia afzelii
IAIVKVMKAK

SEQ ID NO: 56130 - protein, 10 aa, Borrelia afzelii
VMKAKVENIK

SEQ ID NO: 56131 - protein, 10 aa, Borrelia afzelii
AACSLTGKAR

SEQ ID NO: 56132 - protein, 10 aa, Borrelia afzelii
KIRVADLTIK

SEQ ID NO: 56133 - protein, 10 aa, Borrelia afzelii
KAKVENIKEK

SEQ ID NO: 56134 - protein, 10 aa, Borrelia afzelii
AFTETQTGGK

SEQ ID NO: 56135 - protein, 11 aa, Borrelia afzelii
TTADGIIAIVK

SEQ ID NO: 56136 - protein, 11 aa, Borrelia afzelii
GIYDLILNAAK

SEQ ID NO: 56137 - protein, 11 aa, Borrelia afzelii
SLLAACSLTGK

SEQ ID NO: 56138 - protein, 11 aa, Borrelia afzelii
SVKDITNEIEK

SEQ ID NO: 56139 - protein, 11 aa, Borrelia afzelii
KVMKAKVENIK

SEQ ID NO: 56140 - protein, 11 aa, Borrelia afzelii
KVGGSQIRAAK

SEQ ID NO: 56141 - protein, 11 aa, Borrelia afzelii
AVEKIGMQGMK

SEQ ID NO: 56142 - protein, 11 aa, Borrelia afzelii
IIAIVKVMKAK

SEQ ID NO: 56143 - protein, 11 aa, Borrelia afzelii
LILNAAKAVEK

SEQ ID NO: 56144 - protein, 11 aa, Borrelia afzelii
AVEEAAKEKPK

SEQ ID NO: 56145 - protein, 11 aa, Borrelia afzelii
KVENIKEKQTK

SEQ ID NO: 56146 - protein, 11 aa, Borrelia afzelii
AIKEAEDAGVK

SEQ ID NO: 56147 - protein, 11 aa, Borrelia afzelii
KQAVEEAAKEK

SEQ ID NO: 56148 - protein, 11 aa, Borrelia afzelii
GMKQAVEEAAK

SEQ ID NO: 56149 - protein, 11 aa, Borrelia afzelii
EATEEETITFK

SEQ ID NO: 56150 - protein, 11 aa, Borrelia afzelii
RVADLTIKFLE

SEQ ID NO: 56151 - protein, 11 aa, Borrelia afzelii
DAFTETQTGGK

SEQ ID NO: 56152 - protein, 9 aa, Borrelia afzelii
KYNKIILTL

SEQ ID NO: 56153 - protein, 9 aa, Borrelia afzelii
DFSGIYDLI

SEQ ID NO: 56154 - protein, 10 aa, Borrelia afzelii
KYNKIILTLT

SEQ ID NO: 56155 - protein, 10 aa, Borrelia afzelii
IYDLILNAAK

SEQ ID NO: 56156 - protein, 11 aa, Borrelia afzelii
KYNKIILTLTL

SEQ ID NO: 56157 - protein, 11 aa, Borrelia afzelii
KFLEATEEETI

SEQ ID NO: 56158 - protein, 9 aa, Borrelia afzelii
RVADLTIKF

SEQ ID NO: 56159 - protein, 11 aa, Borrelia afzelii
GAGEEDFSGIY

SEQ ID NO: 56160 - protein, 9 aa, Borrelia afzelii
IIAIVKVMK

SEQ ID NO: 56161 - protein, 9 aa, Borrelia afzelii
FTETQTGGK

SEQ ID NO: 56162 - protein, 9 aa, Borrelia afzelii
LAACSLTGK

SEQ ID NO: 56163 - protein, 9 aa, Borrelia afzelii
EKIGMQGMK

SEQ ID NO: 56164 - protein, 9 aa, Borrelia afzelii
MKAKVENIK

SEQ ID NO: 56165 - protein, 9 aa, Borrelia afzelii
LNAAKAVEK

SEQ ID NO: 56166 - protein, 9 aa, Borrelia afzelii
AIVKVMKAK

SEQ ID NO: 56167 - protein, 9 aa, Borrelia afzelii
ENIKEKQTK

SEQ ID NO: 56168 - protein, 10 aa, Borrelia afzelii
ITNEIEKAIK

SEQ ID NO: 56169 - protein, 10 aa, Borrelia afzelii
TADGIIAIVK

SEQ ID NO: 56170 - protein, 10 aa, Borrelia afzelii
GIIAIVKVMK

SEQ ID NO: 56171 - protein, 10 aa, Borrelia afzelii
QAVEEAAKEK

SEQ ID NO: 56172 - protein, 10 aa, Borrelia afzelii
ILNAAKAVEK

SEQ ID NO: 56173 - protein, 10 aa, Borrelia afzelii
IAIVKVMKAK

SEQ ID NO: 56174 - protein, 10 aa, Borrelia afzelii
LLAACSLTGK

SEQ ID NO: 56175 - protein, 10 aa, Borrelia afzelii
ATEEETITFK

SEQ ID NO: 56176 - protein, 10 aa, Borrelia afzelii
AACSLTGKAR

SEQ ID NO: 56177 - protein, 11 aa, Borrelia afzelii
TTADGIIAIVK

SEQ ID NO: 56178 - protein, 11 aa, Borrelia afzelii
EATEEETITFK

SEQ ID NO: 56179 - protein, 11 aa, Borrelia afzelii
DAFTETQTGGK

SEQ ID NO: 56180 - protein, 11 aa, Borrelia afzelii
SVKDITNEIEK

SEQ ID NO: 56181 - protein, 11 aa, Borrelia afzelii
IIAIVKVMKAK

SEQ ID NO: 56182 - protein, 11 aa, Borrelia afzelii
LAACSLTGKAR

SEQ ID NO: 56183 - protein, 11 aa, Borrelia afzelii
DITNEIEKAIK

SEQ ID NO: 56184 - protein, 11 aa, Borrelia afzelii
GIYDLILNAAK

SEQ ID NO: 56185 - protein, 11 aa, Borrelia afzelii
NIKEKQTKNQK

SEQ ID NO: 56186 - protein, 11 aa, Borrelia afzelii
DGIIAIVKVMK

SEQ ID NO: 56187 - protein, 11 aa, Borrelia afzelii
LILNAAKAVEK

SEQ ID NO: 56188 - protein, 11 aa, Borrelia afzelii
KVMKAKVENIK

SEQ ID NO: 56189 - protein, 11 aa, Borrelia afzelii
MKAKVENIKEK

SEQ ID NO: 56190 - protein, 11 aa, Borrelia afzelii
SLLAACSLTGK

SEQ ID NO: 56191 - protein, 11 aa, Borrelia afzelii
AVEKIGMQGMK

SEQ ID NO: 56192 - protein, 11 aa, Borrelia afzelii
KVENIKEKQTK

SEQ ID NO: 56193 - protein, 11 aa, Borrelia afzelii
KVGGSQIRAAK

SEQ ID NO: 56194 - protein, 9 aa, Borrelia afzelii
RVADLTIKF

SEQ ID NO: 56195 - protein, 9 aa, Borrelia afzelii
KPKTTADGI

SEQ ID NO: 56196 - protein, 9 aa, Borrelia afzelii
MIKYNKIIL

SEQ ID NO: 56197 - protein, 10 aa, Borrelia afzelii
RAAKIRVADL

SEQ ID NO: 56198 - protein, 10 aa, Borrelia afzelii
KPKTTADGII

SEQ ID NO: 56199 - protein, 10 aa, Borrelia afzelii
RVADLTIKFL

SEQ ID NO: 56200 - protein, 10 aa, Borrelia afzelii
LASLLAACSL

SEQ ID NO: 56201 - protein, 11 aa, Borrelia afzelii
KPKTTADGIIA

SEQ ID NO: 56202 - protein, 11 aa, Borrelia afzelii
MIKYNKIILTL

SEQ ID NO: 56203 - protein, 9 aa, Borrelia afzelii
MIKYNKIIL

SEQ ID NO: 56204 - protein, 10 aa, Borrelia afzelii
YNKIILTLTL

SEQ ID NO: 56205 - protein, 10 aa, Borrelia afzelii
RAAKIRVADL

SEQ ID NO: 56206 - protein, 11 aa, Borrelia afzelii
MIKYNKIILTL

SEQ ID NO: 56207 - protein, 9 aa, Borrelia afzelii
RVADLTIKF

SEQ ID NO: 56208 - protein, 9 aa, Borrelia afzelii
GIIAIVKVM

SEQ ID NO: 56209 - protein, 9 aa, Borrelia afzelii
ATEEETITF

SEQ ID NO: 56210 - protein, 10 aa, Borrelia afzelii
RVADLTIKFL

SEQ ID NO: 56211 - protein, 11 aa, Borrelia afzelii
KIRVADLTIKF

SEQ ID NO: 56212 - protein, 11 aa, Borrelia afzelii
SQIRAAKIRVA

SEQ ID NO: 56213 - protein, 9 aa, Borrelia afzelii
KQAVEEAAK

SEQ ID NO: 56214 - protein, 10 aa, Borrelia afzelii
IRVADLTIKF

SEQ ID NO: 56215 - protein, 11 aa, Borrelia afzelii
IRAAKIRVADL

SEQ ID NO: 56216 - protein, 9 aa, Borrelia afzelii
DAGVKTDAF

SEQ ID NO: 56217 - protein, 9 aa, Borrelia afzelii
RVADLTIKF

SEQ ID NO: 56218 - protein, 9 aa, Borrelia afzelii
ATEEETITF

SEQ ID NO: 56219 - protein, 9 aa, Borrelia afzelii
FSGIYDLIL

SEQ ID NO: 56220 - protein, 10 aa, Borrelia afzelii
EATEEETITF

SEQ ID NO: 56221 - protein, 10 aa, Borrelia afzelii
LASLLAACSL

SEQ ID NO: 56222 - protein, 10 aa, Borrelia afzelii
EDAGVKTDAF

SEQ ID NO: 56223 - protein, 11 aa, Borrelia afzelii
NAAKAVEKIGM

SEQ ID NO: 56224 - protein, 11 aa, Borrelia afzelii
LEATEEETITF

SEQ ID NO: 56225 - protein, 11 aa, Borrelia afzelii
GAGEEDFSGIY

SEQ ID NO: 56226 - protein, 11 aa, Borrelia afzelii
KAVEKIGMQGM

SEQ ID NO: 56227 - protein, 9 aa, Borrelia afzelii
GEEDFSGIY

SEQ ID NO: 56228 - protein, 9 aa, Borrelia afzelii
EEDFSGIYD

SEQ ID NO: 56229 - protein, 10 aa, Borrelia afzelii
NEIEKAIKEA

SEQ ID NO: 56230 - protein, 10 aa, Borrelia afzelii
EEDFSGIYDL

SEQ ID NO: 56231 - protein, 10 aa, Borrelia afzelii
KENGAGEEDF

SEQ ID NO: 56232 - protein, 11 aa, Borrelia afzelii
EEDFSGIYDLI

SEQ ID NO: 56233 - protein, 11 aa, Borrelia afzelii
AEDAGVKTDAF

SEQ ID NO: 56234 - protein, 9 aa, Borrelia afzelii
KPKTTADGI

SEQ ID NO: 56235 - protein, 10 aa, Borrelia afzelii
KPKTTADGII

SEQ ID NO: 56236 - protein, 10 aa, Borrelia afzelii
LASLLAACSL

SEQ ID NO: 56237 - protein, 9 aa, Borrelia afzelii
ATEEETITF

SEQ ID NO: 56238 - protein, 9 aa, Borrelia garinii
SSGAFSAMY

SEQ ID NO: 56239 - protein, 9 aa, Borrelia garinii
FSAMYDLMI

SEQ ID NO: 56240 - protein, 10 aa, Borrelia garinii
GSSGAFSAMY

SEQ ID NO: 56241 - protein, 9 aa, Borrelia garinii
AMYDLMIDV

SEQ ID NO: 56242 - protein, 9 aa, Borrelia garinii
ILLKLSLIV

SEQ ID NO: 56243 - protein, 9 aa, Borrelia garinii
LMIDVSKPL

SEQ ID NO: 56244 - protein, 9 aa, Borrelia garinii
KLSLIVSLL

SEQ ID NO: 56245 - protein, 9 aa, Borrelia garinii
KISEKPEFI

SEQ ID NO: 56246 - protein, 9 aa, Borrelia garinii
SLIVSLLVA

SEQ ID NO: 56247 - protein, 9 aa, Borrelia garinii
AMEEKLNNV

SEQ ID NO: 56248 - protein, 9 aa, Borrelia garinii
TTADGIIAI

SEQ ID NO: 56249 - protein, 9 aa, Borrelia garinii
FILKAKIKA

SEQ ID NO: 56250 - protein, 9 aa, Borrelia garinii
KILLKLSLI

SEQ ID NO: 56251 - protein, 9 aa, Borrelia garinii
LSLIVSLLV

SEQ ID NO: 56252 - protein, 9 aa, Borrelia garinii
FSAMYDLMI

SEQ ID NO: 56253 - protein, 9 aa, Borrelia garinii
GAFSAMYDL

SEQ ID NO: 56254 - protein, 10 aa, Borrelia garinii
KLSLIVSLLV

SEQ ID NO: 56255 - protein, 10 aa, Borrelia garinii
SAMYDLMIDV

SEQ ID NO: 56256 - protein, 10 aa, Borrelia garinii
KILLKLSLIV

SEQ ID NO: 56257 - protein, 10 aa, Borrelia garinii
FILKAKIKAI

SEQ ID NO: 56258 - protein, 10 aa, Borrelia garinii
KMTGTVTKEA

SEQ ID NO: 56259 - protein, 10 aa, Borrelia garinii
KISEKPEFIL

SEQ ID NO: 56260 - protein, 10 aa, Borrelia garinii
LLKLSLIVSL

SEQ ID NO: 56261 - protein, 10 aa, Borrelia garinii
GLTGETKIRL

SEQ ID NO: 56262 - protein, 10 aa, Borrelia garinii
TTADGIIAIA

SEQ ID NO: 56263 - protein, 10 aa, Borrelia garinii
AMYDLMIDVS

SEQ ID NO: 56264 - protein, 10 aa, Borrelia garinii
AIAQAMEEKL

SEQ ID NO: 56265 - protein, 11 aa, Borrelia garinii
ILLKLSLIVSL

SEQ ID NO: 56266 - protein, 11 aa, Borrelia garinii
KLSLIVSLLVA

SEQ ID NO: 56267 - protein, 11 aa, Borrelia garinii
FSAMYDLMIDV

SEQ ID NO: 56268 - protein, 11 aa, Borrelia garinii
MIDVSKPLEEI

SEQ ID NO: 56269 - protein, 11 aa, Borrelia garinii
LIVSLLVACGL

SEQ ID NO: 56270 - protein, 11 aa, Borrelia garinii
LKLSLIVSLLV

SEQ ID NO: 56271 - protein, 11 aa, Borrelia garinii
GAFSAMYDLMI

SEQ ID NO: 56272 - protein, 11 aa, Borrelia garinii
LLVACGLTGET

SEQ ID NO: 56273 - protein, 11 aa, Borrelia garinii
ILKAKIKAIQV

SEQ ID NO: 56274 - protein, 11 aa, Borrelia garinii
LLKLSLIVSLL

SEQ ID NO: 56275 - protein, 9 aa, Borrelia garinii
FTNTQTGSK

SEQ ID NO: 56276 - protein, 9 aa, Borrelia garinii
QTGSKISEK

SEQ ID NO: 56277 - protein, 9 aa, Borrelia garinii
IKYNKILLK

SEQ ID NO: 56278 - protein, 9 aa, Borrelia garinii
IQVAERFVK

SEQ ID NO: 56279 - protein, 10 aa, Borrelia garinii
MIKYNKILLK

SEQ ID NO: 56280 - protein, 10 aa, Borrelia garinii
IQKMTGTVTK

SEQ ID NO: 56281 - protein, 10 aa, Borrelia garinii
AIQVAERFVK

SEQ ID NO: 56282 - protein, 10 aa, Borrelia garinii
AFTNTQTGSK

SEQ ID NO: 56283 - protein, 10 aa, Borrelia garinii
VACGLTGETK

SEQ ID NO: 56284 - protein, 10 aa, Borrelia garinii
TQTGSKISEK

SEQ ID NO: 56285 - protein, 10 aa, Borrelia garinii
GSSGAFSAMY

SEQ ID NO: 56286 - protein, 10 aa, Borrelia garinii
IAIAQAMEEK

SEQ ID NO: 56287 - protein, 10 aa, Borrelia garinii
ISEKPEFILK

SEQ ID NO: 56288 - protein, 10 aa, Borrelia garinii
KPLEEIGIQK

SEQ ID NO: 56289 - protein, 10 aa, Borrelia garinii
KANAKKEGVK

SEQ ID NO: 56290 - protein, 10 aa, Borrelia garinii
RLESSAQEIK

SEQ ID NO: 56291 - protein, 10 aa, Borrelia garinii
MYDLMIDVSK

SEQ ID NO: 56292 - protein, 10 aa, Borrelia garinii
KIKAIQVAER

SEQ ID NO: 56293 - protein, 11 aa, Borrelia garinii
AMYDLMIDVSK

SEQ ID NO: 56294 - protein, 11 aa, Borrelia garinii
KISEKPEFILK

SEQ ID NO: 56295 - protein, 11 aa, Borrelia garinii
GIQKMTGTVTK

SEQ ID NO: 56296 - protein, 11 aa, Borrelia garinii
QVAERFVKAIK

SEQ ID NO: 56297 - protein, 11 aa, Borrelia garinii
MTGTVTKEAEK

SEQ ID NO: 56298 - protein, 11 aa, Borrelia garinii
NVNKKQHDALK

SEQ ID NO: 56299 - protein, 11 aa, Borrelia garinii
LVACGLTGETK

SEQ ID NO: 56300 - protein, 11 aa, Borrelia garinii
KAIQVAERFVK

SEQ ID NO: 56301 - protein, 11 aa, Borrelia garinii
IIAIAQAMEEK

SEQ ID NO: 56302 - protein, 11 aa, Borrelia garinii
EINKIKANAKK

SEQ ID NO: 56303 - protein, 11 aa, Borrelia garinii
EAFTNTQTGSK

SEQ ID NO: 56304 - protein, 11 aa, Borrelia garinii
AMEEKLNNVNK

SEQ ID NO: 56305 - protein, 11 aa, Borrelia garinii
AIKEEAEKLKK

SEQ ID NO: 56306 - protein, 9 aa, Borrelia garinii
AIAQAMEEK

SEQ ID NO: 56307 - protein, 9 aa, Borrelia garinii
FTNTQTGSK

SEQ ID NO: 56308 - protein, 9 aa, Borrelia garinii
IQVAERFVK

SEQ ID NO: 56309 - protein, 9 aa, Borrelia garinii
QTGSKISEK

SEQ ID NO: 56310 - protein, 9 aa, Borrelia garinii
SSGAFSAMY

SEQ ID NO: 56311 - protein, 9 aa, Borrelia garinii
GTVTKEAEK

SEQ ID NO: 56312 - protein, 9 aa, Borrelia garinii
KAIKEEAEK

SEQ ID NO: 56313 - protein, 9 aa, Borrelia garinii
IKYNKILLK

SEQ ID NO: 56314 - protein, 9 aa, Borrelia garinii
SEKPEFILK

SEQ ID NO: 56315 - protein, 10 aa, Borrelia garinii
MIKYNKILLK

SEQ ID NO: 56316 - protein, 10 aa, Borrelia garinii
IAIAQAMEEK

SEQ ID NO: 56317 - protein, 10 aa, Borrelia garinii
AIQVAERFVK

SEQ ID NO: 56318 - protein, 10 aa, Borrelia garinii
ISEKPEFILK

SEQ ID NO: 56319 - protein, 10 aa, Borrelia garinii
TQTGSKISEK

SEQ ID NO: 56320 - protein, 10 aa, Borrelia garinii
VACGLTGETK

SEQ ID NO: 56321 - protein, 10 aa, Borrelia garinii
KANAKKEGVK

SEQ ID NO: 56322 - protein, 10 aa, Borrelia garinii
IQKMTGTVTK

SEQ ID NO: 56323 - protein, 10 aa, Borrelia garinii
VAERFVKAIK

SEQ ID NO: 56324 - protein, 10 aa, Borrelia garinii
AIKEEAEKLK

SEQ ID NO: 56325 - protein, 10 aa, Borrelia garinii
GSSGAFSAMY

SEQ ID NO: 56326 - protein, 10 aa, Borrelia garinii
RLESSAQEIK

SEQ ID NO: 56327 - protein, 10 aa, Borrelia garinii
AFTNTQTGSK

SEQ ID NO: 56328 - protein, 10 aa, Borrelia garinii
AQEIKDEINK

SEQ ID NO: 56329 - protein, 10 aa, Borrelia garinii
KIKAIQVAER

SEQ ID NO: 56330 - protein, 10 aa, Borrelia garinii
EINKIKANAK

SEQ ID NO: 56331 - protein, 10 aa, Borrelia garinii
MYDLMIDVSK

SEQ ID NO: 56332 - protein, 11 aa, Borrelia garinii
AMYDLMIDVSK

SEQ ID NO: 56333 - protein, 11 aa, Borrelia garinii
KISEKPEFILK

SEQ ID NO: 56334 - protein, 11 aa, Borrelia garinii
KAIQVAERFVK

SEQ ID NO: 56335 - protein, 11 aa, Borrelia garinii
SAQEIKDEINK

SEQ ID NO: 56336 - protein, 11 aa, Borrelia garinii
GIQKMTGTVTK

SEQ ID NO: 56337 - protein, 11 aa, Borrelia garinii
MTGTVTKEAEK

SEQ ID NO: 56338 - protein, 11 aa, Borrelia garinii
QVAERFVKAIK

SEQ ID NO: 56339 - protein, 11 aa, Borrelia garinii
NVNKKQHDALK

SEQ ID NO: 56340 - protein, 11 aa, Borrelia garinii
AMEEKLNNVNK

SEQ ID NO: 56341 - protein, 11 aa, Borrelia garinii
NTQTGSKISEK

SEQ ID NO: 56342 - protein, 11 aa, Borrelia garinii
IIAIAQAMEEK

SEQ ID NO: 56343 - protein, 11 aa, Borrelia garinii
LVACGLTGETK

SEQ ID NO: 56344 - protein, 11 aa, Borrelia garinii
KAIKEEAEKLK

SEQ ID NO: 56345 - protein, 11 aa, Borrelia garinii
AIKEEAEKLKK

SEQ ID NO: 56346 - protein, 11 aa, Borrelia garinii
EAFTNTQTGSK

SEQ ID NO: 56347 - protein, 11 aa, Borrelia garinii
FVKAIKEEAEK

SEQ ID NO: 56348 - protein, 11 aa, Borrelia garinii
EINKIKANAKK

SEQ ID NO: 56349 - protein, 9 aa, Borrelia garinii
KYNKILLKL

SEQ ID NO: 56350 - protein, 10 aa, Borrelia garinii
AFSAMYDLMI

SEQ ID NO: 56351 - protein, 11 aa, Borrelia garinii
KYNKILLKLSL

SEQ ID NO: 56352 - protein, 9 aa, Borrelia garinii
SSGAFSAMY

SEQ ID NO: 56353 - protein, 11 aa, Borrelia garinii
SGSSGAFSAMY

SEQ ID NO: 56354 - protein, 9 aa, Borrelia garinii
FTNTQTGSK

SEQ ID NO: 56355 - protein, 9 aa, Borrelia garinii
QTGSKISEK

SEQ ID NO: 56356 - protein, 9 aa, Borrelia garinii
AIAQAMEEK

SEQ ID NO: 56357 - protein, 9 aa, Borrelia garinii
DALKNLEEK

SEQ ID NO: 56358 - protein, 9 aa, Borrelia garinii
GTVTKEAEK

SEQ ID NO: 56359 - protein, 9 aa, Borrelia garinii
IKAIQVAER

SEQ ID NO: 56360 - protein, 9 aa, Borrelia garinii
IQVAERFVK

SEQ ID NO: 56361 - protein, 9 aa, Borrelia garinii
EFILKAKIK

SEQ ID NO: 56362 - protein, 9 aa, Borrelia garinii
KAIKEEAEK

SEQ ID NO: 56363 - protein, 9 aa, Borrelia garinii
SSGAFSAMY

SEQ ID NO: 56364 - protein, 10 aa, Borrelia garinii
IAIAQAMEEK

SEQ ID NO: 56365 - protein, 10 aa, Borrelia garinii
EINKIKANAK

SEQ ID NO: 56366 - protein, 10 aa, Borrelia garinii
MIKYNKILLK

SEQ ID NO: 56367 - protein, 10 aa, Borrelia garinii
KIKAIQVAER

SEQ ID NO: 56368 - protein, 10 aa, Borrelia garinii
EIKDEINKIK

SEQ ID NO: 56369 - protein, 10 aa, Borrelia garinii
TQTGSKISEK

SEQ ID NO: 56370 - protein, 10 aa, Borrelia garinii
MYDLMIDVSK

SEQ ID NO: 56371 - protein, 10 aa, Borrelia garinii
VACGLTGETK

SEQ ID NO: 56372 - protein, 10 aa, Borrelia garinii
ISEKPEFILK

SEQ ID NO: 56373 - protein, 10 aa, Borrelia garinii
TGTVTKEAEK

SEQ ID NO: 56374 - protein, 10 aa, Borrelia garinii
VAERFVKAIK

SEQ ID NO: 56375 - protein, 11 aa, Borrelia garinii
EAFTNTQTGSK

SEQ ID NO: 56376 - protein, 11 aa, Borrelia garinii
MTGTVTKEAEK

SEQ ID NO: 56377 - protein, 11 aa, Borrelia garinii
EINKIKANAKK

SEQ ID NO: 56378 - protein, 11 aa, Borrelia garinii
FVKAIKEEAEK

SEQ ID NO: 56379 - protein, 11 aa, Borrelia garinii
IIAIAQAMEEK

SEQ ID NO: 56380 - protein, 11 aa, Borrelia garinii
NVNKKQHDALK

SEQ ID NO: 56381 - protein, 11 aa, Borrelia garinii
QVAERFVKAIK

SEQ ID NO: 56382 - protein, 11 aa, Borrelia garinii
NTQTGSKISEK

SEQ ID NO: 56383 - protein, 11 aa, Borrelia garinii
KAIQVAERFVK

SEQ ID NO: 56384 - protein, 11 aa, Borrelia garinii
LVACGLTGETK

SEQ ID NO: 56385 - protein, 11 aa, Borrelia garinii
SAQEIKDEINK

SEQ ID NO: 56386 - protein, 11 aa, Borrelia garinii
AMYDLMIDVSK

SEQ ID NO: 56387 - protein, 11 aa, Borrelia garinii
TTADGIIAIAQ

SEQ ID NO: 56388 - protein, 10 aa, Borrelia garinii
KPEFILKAKI

SEQ ID NO: 56389 - protein, 11 aa, Borrelia garinii
KPLEEIGIQKM

SEQ ID NO: 56390 - protein, 11 aa, Borrelia garinii
PPTTADGIIAI

SEQ ID NO: 56391 - protein, 9 aa, Borrelia garinii
ILKAKIKAI

SEQ ID NO: 56392 - protein, 10 aa, Borrelia garinii
LLKLSLIVSL

SEQ ID NO: 56393 - protein, 10 aa, Borrelia garinii
FILKAKIKAI

SEQ ID NO: 56394 - protein, 10 aa, Borrelia garinii
YNKILLKLSL

SEQ ID NO: 56395 - protein, 11 aa, Borrelia garinii
KLKKSGSSGAF

SEQ ID NO: 56396 - protein, 11 aa, Borrelia garinii
LLKLSLIVSLL

SEQ ID NO: 56397 - protein, 9 aa, Borrelia garinii
LMIDVSKPL

SEQ ID NO: 56398 - protein, 9 aa, Borrelia garinii
SSGAFSAMY

SEQ ID NO: 56399 - protein, 9 aa, Borrelia garinii
GIIAIAQAM

SEQ ID NO: 56400 - protein, 9 aa, Borrelia garinii
KQHDALKNL

SEQ ID NO: 56401 - protein, 9 aa, Borrelia garinii
IQKMTGTVT

SEQ ID NO: 56402 - protein, 9 aa, Borrelia garinii
KKSGSSGAF

SEQ ID NO: 56403 - protein, 9 aa, Borrelia garinii
ILKAKIKAI

SEQ ID NO: 56404 - protein, 9 aa, Borrelia garinii
KAIQVAERF

SEQ ID NO: 56405 - protein, 10 aa, Borrelia garinii
GSSGAFSAMY

SEQ ID NO: 56406 - protein, 10 aa, Borrelia garinii
LLKLSLIVSL

SEQ ID NO: 56407 - protein, 10 aa, Borrelia garinii
LKKSGSSGAF

SEQ ID NO: 56408 - protein, 10 aa, Borrelia garinii
GSKISEKPEF

SEQ ID NO: 56409 - protein, 11 aa, Borrelia garinii
KLKKSGSSGAF

SEQ ID NO: 56410 - protein, 11 aa, Borrelia garinii
IQVAERFVKAI

SEQ ID NO: 56411 - protein, 11 aa, Borrelia garinii
KIKAIQVAERF

SEQ ID NO: 56412 - protein, 11 aa, Borrelia garinii
SGSSGAFSAMY

SEQ ID NO: 56413 - protein, 11 aa, Borrelia garinii
IRLESSAQEIK

SEQ ID NO: 56414 - protein, 9 aa, Borrelia garinii
KAIQVAERF

SEQ ID NO: 56415 - protein, 9 aa, Borrelia garinii
GSSGAFSAM

SEQ ID NO: 56416 - protein, 9 aa, Borrelia garinii
SSGAFSAMY

SEQ ID NO: 56417 - protein, 9 aa, Borrelia garinii
KANTAATTT

SEQ ID NO: 56418 - protein, 10 aa, Borrelia garinii
DGIIAIAQAM

SEQ ID NO: 56419 - protein, 10 aa, Borrelia garinii
SGSSGAFSAM

SEQ ID NO: 56420 - protein, 10 aa, Borrelia garinii
GSSGAFSAMY

SEQ ID NO: 56421 - protein, 10 aa, Borrelia garinii
GAFSAMYDLM

SEQ ID NO: 56422 - protein, 11 aa, Borrelia garinii
KPLEEIGIQKM

SEQ ID NO: 56423 - protein, 11 aa, Borrelia garinii
SGSSGAFSAMY

SEQ ID NO: 56424 - protein, 11 aa, Borrelia garinii
TPPTTADGIIA

SEQ ID NO: 56425 - protein, 9 aa, Borrelia garinii
EEIGIQKMT

SEQ ID NO: 56426 - protein, 10 aa, Borrelia garinii
EEIGIQKMTG

SEQ ID NO: 56427 - protein, 10 aa, Borrelia garinii
SEKPEFILKA

SEQ ID NO: 56428 - protein, 10 aa, Borrelia garinii
QEIKDEINKI

SEQ ID NO: 56429 - protein, 11 aa, Borrelia garinii
EEIGIQKMTGT

SEQ ID NO: 56430 - protein, 9 aa, Borrelia garinii
TPPTTADGI

SEQ ID NO: 56431 - protein, 9 aa, Borrelia garinii
PPTTADGII

SEQ ID NO: 56432 - protein, 10 aa, Borrelia garinii
TPPTTADGII

SEQ ID NO: 56433 - protein, 10 aa, Borrelia garinii
KPEFILKAKI

SEQ ID NO: 56434 - protein, 10 aa, Borrelia garinii
PPTTADGIIA

SEQ ID NO: 56435 - protein, 11 aa, Borrelia garinii
PPTTADGIIAI

SEQ ID NO: 56436 - protein, 11 aa, Borrelia garinii
TPPTTADGIIA

SEQ ID NO: 56437 - protein, 9 aa, Borrelia burgdorferi
AMFDLMLEV

SEQ ID NO: 56438 - protein, 9 aa, Borrelia burgdorferi
VLFEAFTGL

SEQ ID NO: 56439 - protein, 9 aa, Borrelia burgdorferi
LMLEVVESL

SEQ ID NO: 56440 - protein, 9 aa, Borrelia burgdorferi
FLAMFDLML

SEQ ID NO: 56441 - protein, 9 aa, Borrelia burgdorferi
LLVACSIGL

SEQ ID NO: 56442 - protein, 9 aa, Borrelia burgdorferi
IVIALFFKL

SEQ ID NO: 56443 - protein, 9 aa, Borrelia burgdorferi
ALFFKLLVA

SEQ ID NO: 56444 - protein, 9 aa, Borrelia burgdorferi
LVACSIGLV

SEQ ID NO: 56445 - protein, 9 aa, Borrelia burgdorferi
GLVERTNAA

SEQ ID NO: 56446 - protein, 9 aa, Borrelia burgdorferi
RLLAAKAQI

SEQ ID NO: 56447 - protein, 9 aa, Borrelia burgdorferi
FLKIIEEEA

SEQ ID NO: 56448 - protein, 9 aa, Borrelia burgdorferi
GLALREAKV

SEQ ID NO: 56449 - protein, 9 aa, Borrelia burgdorferi
AQIENQLKV

SEQ ID NO: 56450 - protein, 9 aa, Borrelia burgdorferi
GIIGLKARV

SEQ ID NO: 56451 - protein, 9 aa, Borrelia burgdorferi
IALFFKLLV

SEQ ID NO: 56452 - protein, 9 aa, Borrelia burgdorferi
GQFLAMFDL

SEQ ID NO: 56453 - protein, 10 aa, Borrelia burgdorferi
AMFDLMLEVV

SEQ ID NO: 56454 - protein, 10 aa, Borrelia burgdorferi
LAMFDLMLEV

SEQ ID NO: 56455 - protein, 10 aa, Borrelia burgdorferi
KLLVACSIGL

SEQ ID NO: 56456 - protein, 10 aa, Borrelia burgdorferi
SLEDVGIIGL

SEQ ID NO: 56457 - protein, 10 aa, Borrelia burgdorferi
LLVACSIGLV

SEQ ID NO: 56458 - protein, 10 aa, Borrelia burgdorferi
GLVERTNAAL

SEQ ID NO: 56459 - protein, 10 aa, Borrelia burgdorferi
SIVIALFFKL

SEQ ID NO: 56460 - protein, 10 aa, Borrelia burgdorferi
KIIEEEALKL

SEQ ID NO: 56461 - protein, 10 aa, Borrelia burgdorferi
VIALFFKLLV

SEQ ID NO: 56462 - protein, 10 aa, Borrelia burgdorferi
FLKIIEEEAL

SEQ ID NO: 56463 - protein, 10 aa, Borrelia burgdorferi
GVLFEAFTGL

SEQ ID NO: 56464 - protein, 10 aa, Borrelia burgdorferi
IVIALFFKLL

SEQ ID NO: 56465 - protein, 10 aa, Borrelia burgdorferi
DLMLEVVESL

SEQ ID NO: 56466 - protein, 10 aa, Borrelia burgdorferi
ALREAKVQAI

SEQ ID NO: 56467 - protein, 10 aa, Borrelia burgdorferi
ATGKGVLFEA

SEQ ID NO: 56468 - protein, 11 aa, Borrelia burgdorferi
FLAMFDLMLEV

SEQ ID NO: 56469 - protein, 11 aa, Borrelia burgdorferi
KLLVACSIGLV

SEQ ID NO: 56470 - protein, 11 aa, Borrelia burgdorferi
IVIALFFKLLV

SEQ ID NO: 56471 - protein, 11 aa, Borrelia burgdorferi
VLFEAFTGLKT

SEQ ID NO: 56472 - protein, 11 aa, Borrelia burgdorferi
LAMFDLMLEVV

SEQ ID NO: 56473 - protein, 11 aa, Borrelia burgdorferi
MLEVVESLEDV

SEQ ID NO: 56474 - protein, 11 aa, Borrelia burgdorferi
ALREAKVQAIV

SEQ ID NO: 56475 - protein, 11 aa, Borrelia burgdorferi
GQFLAMFDLML

SEQ ID NO: 56476 - protein, 11 aa, Borrelia burgdorferi
SIVIALFFKLL

SEQ ID NO: 56477 - protein, 11 aa, Borrelia burgdorferi
AIVETGKFLKI

SEQ ID NO: 56478 - protein, 9 aa, Borrelia burgdorferi
FTGLKTGSK

SEQ ID NO: 56479 - protein, 9 aa, Borrelia burgdorferi
KIKKEATGK

SEQ ID NO: 56480 - protein, 9 aa, Borrelia burgdorferi
SIVIALFFK

SEQ ID NO: 56481 - protein, 9 aa, Borrelia burgdorferi
IVETGKFLK

SEQ ID NO: 56482 - protein, 9 aa, Borrelia burgdorferi
KIIEEEALK

SEQ ID NO: 56483 - protein, 9 aa, Borrelia burgdorferi
VTSGGLALR

SEQ ID NO: 56484 - protein, 9 aa, Borrelia burgdorferi
LFEAFTGLK

SEQ ID NO: 56485 - protein, 10 aa, Borrelia burgdorferi
VLFEAFTGLK

SEQ ID NO: 56486 - protein, 10 aa, Borrelia burgdorferi
KVQAIVETGK

SEQ ID NO: 56487 - protein, 10 aa, Borrelia burgdorferi
AFTGLKTGSK

SEQ ID NO: 56488 - protein, 10 aa, Borrelia burgdorferi
AIVETGKFLK

SEQ ID NO: 56489 - protein, 10 aa, Borrelia burgdorferi
KVTSGGLALR

SEQ ID NO: 56490 - protein, 10 aa, Borrelia burgdorferi
NTAERLLAAK

SEQ ID NO: 56491 - protein, 10 aa, Borrelia burgdorferi
ALESSSKDLK

SEQ ID NO: 56492 - protein, 10 aa, Borrelia burgdorferi
KQNIENGGEK

SEQ ID NO: 56493 - protein, 10 aa, Borrelia burgdorferi
TNAALESSSK

SEQ ID NO: 56494 - protein, 10 aa, Borrelia burgdorferi
QIENQLKVVK

SEQ ID NO: 56495 - protein, 10 aa, Borrelia burgdorferi
DLKNKILKIK

SEQ ID NO: 56496 - protein, 10 aa, Borrelia burgdorferi
IIEEEALKLK

SEQ ID NO: 56497 - protein, 11 aa, Borrelia burgdorferi
RTNAALESSSK

SEQ ID NO: 56498 - protein, 11 aa, Borrelia burgdorferi
GVLFEAFTGLK

SEQ ID NO: 56499 - protein, 11 aa, Borrelia burgdorferi
GLKARVLEESK

SEQ ID NO: 56500 - protein, 11 aa, Borrelia burgdorferi
ILKIKKEATGK

SEQ ID NO: 56501 - protein, 11 aa, Borrelia burgdorferi
SLEDVGIIGLK

SEQ ID NO: 56502 - protein, 11 aa, Borrelia burgdorferi
KIIEEEALKLK

SEQ ID NO: 56503 - protein, 11 aa, Borrelia burgdorferi
FLKIIEEEALK

SEQ ID NO: 56504 - protein, 11 aa, Borrelia burgdorferi
TSGGLALREAK

SEQ ID NO: 56505 - protein, 11 aa, Borrelia burgdorferi
KQNIENGGEKK

SEQ ID NO: 56506 - protein, 11 aa, Borrelia burgdorferi
SSKDLKNKILK

SEQ ID NO: 56507 - protein, 11 aa, Borrelia burgdorferi
LVACSIGLVER

SEQ ID NO: 56508 - protein, 11 aa, Borrelia burgdorferi
EAFTGLKTGSK

SEQ ID NO: 56509 - protein, 11 aa, Borrelia burgdorferi
AALESSSKDLK

SEQ ID NO: 56510 - protein, 9 aa, Borrelia burgdorferi
SIVIALFFK

SEQ ID NO: 56511 - protein, 9 aa, Borrelia burgdorferi
IVETGKFLK

SEQ ID NO: 56512 - protein, 9 aa, Borrelia burgdorferi
KIIEEEALK

SEQ ID NO: 56513 - protein, 9 aa, Borrelia burgdorferi
SSSKDLKNK

SEQ ID NO: 56514 - protein, 9 aa, Borrelia burgdorferi
TAERLLAAK

SEQ ID NO: 56515 - protein, 9 aa, Borrelia burgdorferi
VTSGGLALR

SEQ ID NO: 56516 - protein, 9 aa, Borrelia burgdorferi
KAQIENQLK

SEQ ID NO: 56517 - protein, 9 aa, Borrelia burgdorferi
FTGLKTGSK

SEQ ID NO: 56518 - protein, 9 aa, Borrelia burgdorferi
NAALESSSK

SEQ ID NO: 56519 - protein, 9 aa, Borrelia burgdorferi
VQAIVETGK

SEQ ID NO: 56520 - protein, 9 aa, Borrelia burgdorferi
LFEAFTGLK

SEQ ID NO: 56521 - protein, 9 aa, Borrelia burgdorferi
KIKKEATGK

SEQ ID NO: 56522 - protein, 9 aa, Borrelia burgdorferi
IVIALFFKL

SEQ ID NO: 56523 - protein, 9 aa, Borrelia burgdorferi
NQLKVVKEK

SEQ ID NO: 56524 - protein, 9 aa, Borrelia burgdorferi
KARVLEESK

SEQ ID NO: 56525 - protein, 10 aa, Borrelia burgdorferi
VLFEAFTGLK

SEQ ID NO: 56526 - protein, 10 aa, Borrelia burgdorferi
KVQAIVETGK

SEQ ID NO: 56527 - protein, 10 aa, Borrelia burgdorferi
AIVETGKFLK

SEQ ID NO: 56528 - protein, 10 aa, Borrelia burgdorferi
NTAERLLAAK

SEQ ID NO: 56529 - protein, 10 aa, Borrelia burgdorferi
KVTSGGLALR

SEQ ID NO: 56530 - protein, 10 aa, Borrelia burgdorferi
KQNIENGGEK

SEQ ID NO: 56531 - protein, 10 aa, Borrelia burgdorferi
ALESSSKDLK

SEQ ID NO: 56532 - protein, 10 aa, Borrelia burgdorferi
VACSIGLVER

SEQ ID NO: 56533 - protein, 10 aa, Borrelia burgdorferi
IIEEEALKLK

SEQ ID NO: 56534 - protein, 10 aa, Borrelia burgdorferi
TNAALESSSK

SEQ ID NO: 56535 - protein, 10 aa, Borrelia burgdorferi
AFTGLKTGSK

SEQ ID NO: 56536 - protein, 10 aa, Borrelia burgdorferi
ESSSKDLKNK

SEQ ID NO: 56537 - protein, 10 aa, Borrelia burgdorferi
QIENQLKVVK

SEQ ID NO: 56538 - protein, 11 aa, Borrelia burgdorferi
RTNAALESSSK

SEQ ID NO: 56539 - protein, 11 aa, Borrelia burgdorferi
GVLFEAFTGLK

SEQ ID NO: 56540 - protein, 11 aa, Borrelia burgdorferi
AALESSSKDLK

SEQ ID NO: 56541 - protein, 11 aa, Borrelia burgdorferi
SSKDLKNKILK

SEQ ID NO: 56542 - protein, 11 aa, Borrelia burgdorferi
TSGGLALREAK

SEQ ID NO: 56543 - protein, 11 aa, Borrelia burgdorferi
SLEDVGIIGLK

SEQ ID NO: 56544 - protein, 11 aa, Borrelia burgdorferi
QAIVETGKFLK

SEQ ID NO: 56545 - protein, 11 aa, Borrelia burgdorferi
KIIEEEALKLK

SEQ ID NO: 56546 - protein, 11 aa, Borrelia burgdorferi
AQIENQLKVVK

SEQ ID NO: 56547 - protein, 11 aa, Borrelia burgdorferi
AAKAQIENQLK

SEQ ID NO: 56548 - protein, 11 aa, Borrelia burgdorferi
GLKARVLEESK

SEQ ID NO: 56549 - protein, 11 aa, Borrelia burgdorferi
LVACSIGLVER

SEQ ID NO: 56550 - protein, 11 aa, Borrelia burgdorferi
KQNIENGGEKK

SEQ ID NO: 56551 - protein, 11 aa, Borrelia burgdorferi
EAFTGLKTGSK

SEQ ID NO: 56552 - protein, 11 aa, Borrelia burgdorferi
IVIALFFKLLV

SEQ ID NO: 56553 - protein, 10 aa, Borrelia burgdorferi
QFLAMFDLML

SEQ ID NO: 56554 - protein, 10 aa, Borrelia burgdorferi
FFKLLVACSI

SEQ ID NO: 56555 - protein, 11 aa, Borrelia burgdorferi
LFFKLLVACSI

SEQ ID NO: 56556 - protein, 11 aa, Borrelia burgdorferi
KFLKIIEEEAL

SEQ ID NO: 56557 - protein, 9 aa, Borrelia burgdorferi
IVIALFFKL

SEQ ID NO: 56558 - protein, 9 aa, Borrelia burgdorferi
SIVIALFFK

SEQ ID NO: 56559 - protein, 9 aa, Borrelia burgdorferi
NAALESSSK

SEQ ID NO: 56560 - protein, 9 aa, Borrelia burgdorferi
VTSGGLALR

SEQ ID NO: 56561 - protein, 9 aa, Borrelia burgdorferi
IVETGKFLK

SEQ ID NO: 56562 - protein, 9 aa, Borrelia burgdorferi
EDVGIIGLK

SEQ ID NO: 56563 - protein, 9 aa, Borrelia burgdorferi
NNPINTAER

SEQ ID NO: 56564 - protein, 9 aa, Borrelia burgdorferi
FTGLKTGSK

SEQ ID NO: 56565 - protein, 9 aa, Borrelia burgdorferi
LFEAFTGLK

SEQ ID NO: 56566 - protein, 9 aa, Borrelia burgdorferi
TAERLLAAK

SEQ ID NO: 56567 - protein, 9 aa, Borrelia burgdorferi
KIIEEEALK

SEQ ID NO: 56568 - protein, 9 aa, Borrelia burgdorferi
NIENGGEKK

SEQ ID NO: 56569 - protein, 10 aa, Borrelia burgdorferi
NTAERLLAAK

SEQ ID NO: 56570 - protein, 10 aa, Borrelia burgdorferi
VACSIGLVER

SEQ ID NO: 56571 - protein, 10 aa, Borrelia burgdorferi
VLFEAFTGLK

SEQ ID NO: 56572 - protein, 10 aa, Borrelia burgdorferi
KVTSGGLALR

SEQ ID NO: 56573 - protein, 10 aa, Borrelia burgdorferi
ESSSKDLKNK

SEQ ID NO: 56574 - protein, 10 aa, Borrelia burgdorferi
TNAALESSSK

SEQ ID NO: 56575 - protein, 10 aa, Borrelia burgdorferi
DVGIIGLKAR

SEQ ID NO: 56576 - protein, 10 aa, Borrelia burgdorferi
KVQAIVETGK

SEQ ID NO: 56577 - protein, 10 aa, Borrelia burgdorferi
AIVETGKFLK

SEQ ID NO: 56578 - protein, 10 aa, Borrelia burgdorferi
KNNPINTAER

SEQ ID NO: 56579 - protein, 11 aa, Borrelia burgdorferi
LVACSIGLVER

SEQ ID NO: 56580 - protein, 11 aa, Borrelia burgdorferi
EAFTGLKTGSK

SEQ ID NO: 56581 - protein, 11 aa, Borrelia burgdorferi
QAIVETGKFLK

SEQ ID NO: 56582 - protein, 11 aa, Borrelia burgdorferi
RTNAALESSSK

SEQ ID NO: 56583 - protein, 11 aa, Borrelia burgdorferi
GVLFEAFTGLK

SEQ ID NO: 56584 - protein, 11 aa, Borrelia burgdorferi
FLKIIEEEALK

SEQ ID NO: 56585 - protein, 11 aa, Borrelia burgdorferi
TSGGLALREAK

SEQ ID NO: 56586 - protein, 11 aa, Borrelia burgdorferi
SSKDLKNKILK

SEQ ID NO: 56587 - protein, 11 aa, Borrelia burgdorferi
EDVGIIGLKAR

SEQ ID NO: 56588 - protein, 11 aa, Borrelia burgdorferi
SLEDVGIIGLK

SEQ ID NO: 56589 - protein, 11 aa, Borrelia burgdorferi
SKNNPINTAER

SEQ ID NO: 56590 - protein, 11 aa, Borrelia burgdorferi
AALESSSKDLK

SEQ ID NO: 56591 - protein, 11 aa, Borrelia burgdorferi
SKVTSGGLALR

SEQ ID NO: 56592 - protein, 9 aa, Borrelia burgdorferi
KVTSGGLAL

SEQ ID NO: 56593 - protein, 9 aa, Borrelia burgdorferi
NPINTAERL

SEQ ID NO: 56594 - protein, 9 aa, Borrelia burgdorferi
LVERTNAAL

SEQ ID NO: 56595 - protein, 10 aa, Borrelia burgdorferi
NPINTAERLL

SEQ ID NO: 56596 - protein, 10 aa, Borrelia burgdorferi
ALREAKVQAI

SEQ ID NO: 56597 - protein, 10 aa, Borrelia burgdorferi
SKVTSGGLAL

SEQ ID NO: 56598 - protein, 9 aa, Borrelia burgdorferi
ILKIKKEAT

SEQ ID NO: 56599 - protein, 9 aa, Borrelia burgdorferi
LVERTNAAL

SEQ ID NO: 56600 - protein, 10 aa, Borrelia burgdorferi
FLKIIEEEAL

SEQ ID NO: 56601 - protein, 10 aa, Borrelia burgdorferi
FFKLLVACSI

SEQ ID NO: 56602 - protein, 9 aa, Borrelia burgdorferi
LMLEVVESL

SEQ ID NO: 56603 - protein, 9 aa, Borrelia burgdorferi
KVTSGGLAL

SEQ ID NO: 56604 - protein, 9 aa, Borrelia burgdorferi
QAIVETGKF

SEQ ID NO: 56605 - protein, 9 aa, Borrelia burgdorferi
AMFDLMLEV

SEQ ID NO: 56606 - protein, 9 aa, Borrelia burgdorferi
FLAMFDLML

SEQ ID NO: 56607 - protein, 9 aa, Borrelia burgdorferi
GQFLAMFDL

SEQ ID NO: 56608 - protein, 9 aa, Borrelia burgdorferi
LLVACSIGL

SEQ ID NO: 56609 - protein, 9 aa, Borrelia burgdorferi
VLFEAFTGL

SEQ ID NO: 56610 - protein, 9 aa, Borrelia burgdorferi
AQIENQLKV

SEQ ID NO: 56611 - protein, 10 aa, Borrelia burgdorferi
VQAIVETGKF

SEQ ID NO: 56612 - protein, 10 aa, Borrelia burgdorferi
GLVERTNAAL

SEQ ID NO: 56613 - protein, 10 aa, Borrelia burgdorferi
AQIENQLKVV

SEQ ID NO: 56614 - protein, 10 aa, Borrelia burgdorferi
GQFLAMFDLM

SEQ ID NO: 56615 - protein, 11 aa, Borrelia burgdorferi
KLKETGNSGQF

SEQ ID NO: 56616 - protein, 11 aa, Borrelia burgdorferi
KVQAIVETGKF

SEQ ID NO: 56617 - protein, 11 aa, Borrelia burgdorferi
GQFLAMFDLML

SEQ ID NO: 56618 - protein, 11 aa, Borrelia burgdorferi
VQAIVETGKFL

SEQ ID NO: 56619 - protein, 11 aa, Borrelia burgdorferi
GSKVTSGGLAL

SEQ ID NO: 56620 - protein, 9 aa, Borrelia burgdorferi
GQFLAMFDL

SEQ ID NO: 56621 - protein, 11 aa, Borrelia burgdorferi
GQFLAMFDLML

SEQ ID NO: 56622 - protein, 9 aa, Borrelia burgdorferi
NPINTAERL

SEQ ID NO: 56623 - protein, 9 aa, Borrelia burgdorferi
QFLAMFDLM

SEQ ID NO: 56624 - protein, 9 aa, Borrelia burgdorferi
LVERTNAAL

SEQ ID NO: 56625 - protein, 9 aa, Borrelia burgdorferi
EATGKGVLF

SEQ ID NO: 56626 - protein, 9 aa, Borrelia burgdorferi
QAIVETGKF

SEQ ID NO: 56627 - protein, 9 aa, Borrelia burgdorferi
FLAMFDLML

SEQ ID NO: 56628 - protein, 9 aa, Borrelia burgdorferi
NSGQFLAMF

SEQ ID NO: 56629 - protein, 10 aa, Borrelia burgdorferi
NPINTAERLL

SEQ ID NO: 56630 - protein, 10 aa, Borrelia burgdorferi
TGNSGQFLAM

SEQ ID NO: 56631 - protein, 11 aa, Borrelia burgdorferi
ETGNSGQFLAM

SEQ ID NO: 56632 - protein, 11 aa, Borrelia burgdorferi
LAAKAQIENQL

SEQ ID NO: 56633 - protein, 11 aa, Borrelia burgdorferi
TGNSGQFLAMF

SEQ ID NO: 56634 - protein, 9 aa, Borrelia burgdorferi
KETGNSGQF

SEQ ID NO: 56635 - protein, 10 aa, Borrelia burgdorferi
KEATGKGVLF

SEQ ID NO: 56636 - protein, 10 aa, Borrelia burgdorferi
EESKNNPINT

SEQ ID NO: 56637 - protein, 11 aa, Borrelia burgdorferi
AERLLAAKAQI

SEQ ID NO: 56638 - protein, 10 aa, Borrelia burgdorferi
LAMFDLMLEV

SEQ ID NO: 56639 - protein, 11 aa, Borrelia burgdorferi
LAMFDLMLEVV

SEQ ID NO: 56640 - protein, 9 aa, Borrelia burgdorferi B31
DTEVNDLLY

SEQ ID NO: 56641 - protein, 9 aa, Borrelia burgdorferi B31
NLEYTNLFY

SEQ ID NO: 56642 - protein, 9 aa, Borrelia burgdorferi B31
KSEIKAEEY

SEQ ID NO: 56643 - protein, 9 aa, Borrelia burgdorferi B31
YLNKEGLEY

SEQ ID NO: 56644 - protein, 9 aa, Borrelia burgdorferi B31
KAEEYNEFY

SEQ ID NO: 56645 - protein, 9 aa, Borrelia burgdorferi B31
WSSDGKTGY

SEQ ID NO: 56646 - protein, 9 aa, Borrelia burgdorferi B31
ITDSEGSLL

SEQ ID NO: 56647 - protein, 9 aa, Borrelia burgdorferi B31
IIDSNDPTY

SEQ ID NO: 56648 - protein, 10 aa, Borrelia burgdorferi B31
HTKAEGNLEY

SEQ ID NO: 56649 - protein, 10 aa, Borrelia burgdorferi B31
YSNHINYPIY

SEQ ID NO: 56650 - protein, 10 aa, Borrelia burgdorferi B31
DSEGSLLPNY

SEQ ID NO: 56651 - protein, 10 aa, Borrelia burgdorferi B31
ASDAIDKLKF

SEQ ID NO: 56652 - protein, 11 aa, Borrelia burgdorferi B31
SVDGFVSFKEY

SEQ ID NO: 56653 - protein, 11 aa, Borrelia burgdorferi B31
QFDTEVNDLLY

SEQ ID NO: 56654 - protein, 9 aa, Borrelia burgdorferi B31
LLYLIIHSL

SEQ ID NO: 56655 - protein, 9 aa, Borrelia burgdorferi B31
FINIINEFI

SEQ ID NO: 56656 - protein, 9 aa, Borrelia burgdorferi B31
IMLSMGQEV

SEQ ID NO: 56657 - protein, 9 aa, Borrelia burgdorferi B31
FLRELISNA

SEQ ID NO: 56658 - protein, 9 aa, Borrelia burgdorferi B31
FIIFRLCYI

SEQ ID NO: 56659 - protein, 9 aa, Borrelia burgdorferi B31
IMDDELDEA

SEQ ID NO: 56660 - protein, 9 aa, Borrelia burgdorferi B31
FIVSEKVEV

SEQ ID NO: 56661 - protein, 9 aa, Borrelia burgdorferi B31
LLPNYLRFI

SEQ ID NO: 56662 - protein, 9 aa, Borrelia burgdorferi B31
KILSELEKL

SEQ ID NO: 56663 - protein, 9 aa, Borrelia burgdorferi B31
KLFINRIFI

SEQ ID NO: 56664 - protein, 9 aa, Borrelia burgdorferi B31
KLEKISILL

SEQ ID NO: 56665 - protein, 9 aa, Borrelia burgdorferi B31
QMQKIMLSM

SEQ ID NO: 56666 - protein, 9 aa, Borrelia burgdorferi B31
ELDEAILNL

SEQ ID NO: 56667 - protein, 9 aa, Borrelia burgdorferi B31
YLIIHSLYS

SEQ ID NO: 56668 - protein, 9 aa, Borrelia burgdorferi B31
LLFEEAMLT

SEQ ID NO: 56669 - protein, 9 aa, Borrelia burgdorferi B31
IALFIIFRL

SEQ ID NO: 56670 - protein, 9 aa, Borrelia burgdorferi B31
KALESDAYI

SEQ ID NO: 56671 - protein, 9 aa, Borrelia burgdorferi B31
NLIPEYEGL

SEQ ID NO: 56672 - protein, 9 aa, Borrelia burgdorferi B31
TTFDYENPL

SEQ ID NO: 56673 - protein, 9 aa, Borrelia burgdorferi B31
ILLFEEAML

SEQ ID NO: 56674 - protein, 9 aa, Borrelia burgdorferi B31
RLCYIIKKV

SEQ ID NO: 56675 - protein, 9 aa, Borrelia burgdorferi B31
NILKENPIV

SEQ ID NO: 56676 - protein, 9 aa, Borrelia burgdorferi B31
LEYTNLFYV

SEQ ID NO: 56677 - protein, 9 aa, Borrelia burgdorferi B31
ILKDHIKEV

SEQ ID NO: 56678 - protein, 9 aa, Borrelia burgdorferi B31
IIFRLCYII

SEQ ID NO: 56679 - protein, 9 aa, Borrelia burgdorferi B31
ILIFYFKQI

SEQ ID NO: 56680 - protein, 9 aa, Borrelia burgdorferi B31
IIDCQDLPL

SEQ ID NO: 56681 - protein, 9 aa, Borrelia burgdorferi B31
YSNHINYPI

SEQ ID NO: 56682 - protein, 9 aa, Borrelia burgdorferi B31
YQMQKIMLS

SEQ ID NO: 56683 - protein, 9 aa, Borrelia burgdorferi B31
TLIKEPSAI

SEQ ID NO: 56684 - protein, 9 aa, Borrelia burgdorferi B31
FITDSEGSL

SEQ ID NO: 56685 - protein, 9 aa, Borrelia burgdorferi B31
KLYLNKEGL

SEQ ID NO: 56686 - protein, 9 aa, Borrelia burgdorferi B31
RMNESQKSI

SEQ ID NO: 56687 - protein, 9 aa, Borrelia burgdorferi B31
SAFIVSEKV

SEQ ID NO: 56688 - protein, 9 aa, Borrelia burgdorferi B31
ASLIGQFGV

SEQ ID NO: 56689 - protein, 9 aa, Borrelia burgdorferi B31
NLFYVPSKA

SEQ ID NO: 56690 - protein, 9 aa, Borrelia burgdorferi B31
SMGQEVKEI

SEQ ID NO: 56691 - protein, 9 aa, Borrelia burgdorferi B31
GVGFYSAFI

SEQ ID NO: 56692 - protein, 9 aa, Borrelia burgdorferi B31
EVNDLLYLI

SEQ ID NO: 56693 - protein, 10 aa, Borrelia burgdorferi B31
YLNKEGLEYA

SEQ ID NO: 56694 - protein, 10 aa, Borrelia burgdorferi B31
SLLPNYLRFI

SEQ ID NO: 56695 - protein, 10 aa, Borrelia burgdorferi B31
IMDDELDEAI

SEQ ID NO: 56696 - protein, 10 aa, Borrelia burgdorferi B31
SLYSHKEIFL

SEQ ID NO: 56697 - protein, 10 aa, Borrelia burgdorferi B31
YQMQKIMLSM

SEQ ID NO: 56698 - protein, 10 aa, Borrelia burgdorferi B31
NLEYTNLFYV

SEQ ID NO: 56699 - protein, 10 aa, Borrelia burgdorferi B31
FIIFRLCYII

SEQ ID NO: 56700 - protein, 10 aa, Borrelia burgdorferi B31
SLIRFKSSSV

SEQ ID NO: 56701 - protein, 10 aa, Borrelia burgdorferi B31
LIMDDELDEA

SEQ ID NO: 56702 - protein, 10 aa, Borrelia burgdorferi B31
KIMLSMGQEV

SEQ ID NO: 56703 - protein, 10 aa, Borrelia burgdorferi B31
GIIDCQDLPL

SEQ ID NO: 56704 - protein, 10 aa, Borrelia burgdorferi B31
ILSKIKSSSV

SEQ ID NO: 56705 - protein, 10 aa, Borrelia burgdorferi B31
QIALFIIFRL

SEQ ID NO: 56706 - protein, 10 aa, Borrelia burgdorferi B31
FITDSEGSLL

SEQ ID NO: 56707 - protein, 10 aa, Borrelia burgdorferi B31
KLNETTALWT

SEQ ID NO: 56708 - protein, 10 aa, Borrelia burgdorferi B31
ALWTKNKSEI

SEQ ID NO: 56709 - protein, 10 aa, Borrelia burgdorferi B31
ELDEAILNLI

SEQ ID NO: 56710 - protein, 10 aa, Borrelia burgdorferi B31
KLFINRIFIT

SEQ ID NO: 56711 - protein, 10 aa, Borrelia burgdorferi B31
LLFEEAMLTS

SEQ ID NO: 56712 - protein, 10 aa, Borrelia burgdorferi B31
LIFYFKQIAL

SEQ ID NO: 56713 - protein, 10 aa, Borrelia burgdorferi B31
KISILLFEEA

SEQ ID NO: 56714 - protein, 10 aa, Borrelia burgdorferi B31
YSAFIVSEKV

SEQ ID NO: 56715 - protein, 10 aa, Borrelia burgdorferi B31
GQFGVGFYSA

SEQ ID NO: 56716 - protein, 10 aa, Borrelia burgdorferi B31
YIIKKVKIKL

SEQ ID NO: 56717 - protein, 10 aa, Borrelia burgdorferi B31
MILIFYFKQI

SEQ ID NO: 56718 - protein, 10 aa, Borrelia burgdorferi B31
AIDKLKFLSL

SEQ ID NO: 56719 - protein, 10 aa, Borrelia burgdorferi B31
GVGFYSAFIV

SEQ ID NO: 56720 - protein, 10 aa, Borrelia burgdorferi B31
TLIKEPSAII

SEQ ID NO: 56721 - protein, 10 aa, Borrelia burgdorferi B31
DLLYLIIHSL

SEQ ID NO: 56722 - protein, 10 aa, Borrelia burgdorferi B31
ILIKDNGIGM

SEQ ID NO: 56723 - protein, 10 aa, Borrelia burgdorferi B31
FYFKQIALFI

SEQ ID NO: 56724 - protein, 10 aa, Borrelia burgdorferi B31
TTFDYENPLM

SEQ ID NO: 56725 - protein, 10 aa, Borrelia burgdorferi B31
YANKWKIQEI

SEQ ID NO: 56726 - protein, 10 aa, Borrelia burgdorferi B31
SILLFEEAML

SEQ ID NO: 56727 - protein, 10 aa, Borrelia burgdorferi B31
YVPSKAPYDL

SEQ ID NO: 56728 - protein, 10 aa, Borrelia burgdorferi B31
KLISLIRFKS

SEQ ID NO: 56729 - protein, 10 aa, Borrelia burgdorferi B31
FRLCYIIKKV

SEQ ID NO: 56730 - protein, 10 aa, Borrelia burgdorferi B31
ILIFYFKQIA

SEQ ID NO: 56731 - protein, 10 aa, Borrelia burgdorferi B31
LIPEYEGLKL

SEQ ID NO: 56732 - protein, 10 aa, Borrelia burgdorferi B31
SASLIGQFGV

SEQ ID NO: 56733 - protein, 10 aa, Borrelia burgdorferi B31
SLTNEKFKNI

SEQ ID NO: 56734 - protein, 10 aa, Borrelia burgdorferi B31
ILLFEEAMLT

SEQ ID NO: 56735 - protein, 10 aa, Borrelia burgdorferi B31
KQFDTEVNDL

SEQ ID NO: 56736 - protein, 11 aa, Borrelia burgdorferi B31
KQIALFIIFRL

SEQ ID NO: 56737 - protein, 11 aa, Borrelia burgdorferi B31
IMDDELDEAIL

SEQ ID NO: 56738 - protein, 11 aa, Borrelia burgdorferi B31
ALFIIFRLCYI

SEQ ID NO: 56739 - protein, 11 aa, Borrelia burgdorferi B31
KILSKIKSSSV

SEQ ID NO: 56740 - protein, 11 aa, Borrelia burgdorferi B31
LIMDDELDEAI

SEQ ID NO: 56741 - protein, 11 aa, Borrelia burgdorferi B31
ILIFYFKQIAL

SEQ ID NO: 56742 - protein, 11 aa, Borrelia burgdorferi B31
GMDEQDLTNHL

SEQ ID NO: 56743 - protein, 11 aa, Borrelia burgdorferi B31
KQFDTEVNDLL

SEQ ID NO: 56744 - protein, 11 aa, Borrelia burgdorferi B31
IIDCQDLPLNV

SEQ ID NO: 56745 - protein, 11 aa, Borrelia burgdorferi B31
ILNLIPEYEGL

SEQ ID NO: 56746 - protein, 11 aa, Borrelia burgdorferi B31
ILIMDDELDEA

SEQ ID NO: 56747 - protein, 11 aa, Borrelia burgdorferi B31
MLSMGQEVKEI

SEQ ID NO: 56748 - protein, 11 aa, Borrelia burgdorferi B31
IINEFIEKDFL

SEQ ID NO: 56749 - protein, 11 aa, Borrelia burgdorferi B31
NLIPEYEGLKL

SEQ ID NO: 56750 - protein, 11 aa, Borrelia burgdorferi B31
LLYLIIHSLYS

SEQ ID NO: 56751 - protein, 11 aa, Borrelia burgdorferi B31
YSNHINYPIYI

SEQ ID NO: 56752 - protein, 11 aa, Borrelia burgdorferi B31
TLIKEPSAIII

SEQ ID NO: 56753 - protein, 11 aa, Borrelia burgdorferi B31
GNLEYTNLFYV

SEQ ID NO: 56754 - protein, 11 aa, Borrelia burgdorferi B31
ILQQNKILSKI

SEQ ID NO: 56755 - protein, 11 aa, Borrelia burgdorferi B31
KSASLIGQFGV

SEQ ID NO: 56756 - protein, 11 aa, Borrelia burgdorferi B31
FYSAFIVSEKV

SEQ ID NO: 56757 - protein, 11 aa, Borrelia burgdorferi B31
SAFIVSEKVEV

SEQ ID NO: 56758 - protein, 11 aa, Borrelia burgdorferi B31
MILIFYFKQIA

SEQ ID NO: 56759 - protein, 11 aa, Borrelia burgdorferi B31
FYFKQIALFII

SEQ ID NO: 56760 - protein, 11 aa, Borrelia burgdorferi B31
ILKDHIKEVNL

SEQ ID NO: 56761 - protein, 11 aa, Borrelia burgdorferi B31
RLCYIIKKVKI

SEQ ID NO: 56762 - protein, 11 aa, Borrelia burgdorferi B31
GMPSKNPGKFI

SEQ ID NO: 56763 - protein, 9 aa, Borrelia burgdorferi B31
KLISLIRFK

SEQ ID NO: 56764 - protein, 9 aa, Borrelia burgdorferi B31
IIHSLYSHK

SEQ ID NO: 56765 - protein, 9 aa, Borrelia burgdorferi B31
MLTSGMPSK

SEQ ID NO: 56766 - protein, 9 aa, Borrelia burgdorferi B31
KIKSSSVKK

SEQ ID NO: 56767 - protein, 9 aa, Borrelia burgdorferi B31
SIYYITGGK

SEQ ID NO: 56768 - protein, 9 aa, Borrelia burgdorferi B31
HINYPIYIK

SEQ ID NO: 56769 - protein, 9 aa, Borrelia burgdorferi B31
KLSKKNPEK

SEQ ID NO: 56770 - protein, 9 aa, Borrelia burgdorferi B31
GLKLKAINK

SEQ ID NO: 56771 - protein, 9 aa, Borrelia burgdorferi B31
KLKRKSCMK

SEQ ID NO: 56772 - protein, 9 aa, Borrelia burgdorferi B31
GVIAKSGTK

SEQ ID NO: 56773 - protein, 9 aa, Borrelia burgdorferi B31
SVDGFVSFK

SEQ ID NO: 56774 - protein, 9 aa, Borrelia burgdorferi B31
TTALWTKNK

SEQ ID NO: 56775 - protein, 9 aa, Borrelia burgdorferi B31
YSAFIVSEK

SEQ ID NO: 56776 - protein, 9 aa, Borrelia burgdorferi B31
LQQNKILSK

SEQ ID NO: 56777 - protein, 9 aa, Borrelia burgdorferi B31
KVKIKLKRK

SEQ ID NO: 56778 - protein, 9 aa, Borrelia burgdorferi B31
MLSMGQEVK

SEQ ID NO: 56779 - protein, 9 aa, Borrelia burgdorferi B31
KFLSLTNEK

SEQ ID NO: 56780 - protein, 9 aa, Borrelia burgdorferi B31
GMPSKNPGK

SEQ ID NO: 56781 - protein, 9 aa, Borrelia burgdorferi B31
QIALFIIFR

SEQ ID NO: 56782 - protein, 9 aa, Borrelia burgdorferi B31
ILELNPNNK

SEQ ID NO: 56783 - protein, 9 aa, Borrelia burgdorferi B31
LTKVKEILK

SEQ ID NO: 56784 - protein, 9 aa, Borrelia burgdorferi B31
IFRLCYIIK

SEQ ID NO: 56785 - protein, 9 aa, Borrelia burgdorferi B31
YLNKEGLEY

SEQ ID NO: 56786 - protein, 9 aa, Borrelia burgdorferi B31
GVYSDFENR

SEQ ID NO: 56787 - protein, 9 aa, Borrelia burgdorferi B31
KIQEIIKKY

SEQ ID NO: 56788 - protein, 9 aa, Borrelia burgdorferi B31
NIINEFIEK

SEQ ID NO: 56789 - protein, 9 aa, Borrelia burgdorferi B31
LSLTNEKFK

SEQ ID NO: 56790 - protein, 9 aa, Borrelia burgdorferi B31
YSHKEIFLR

SEQ ID NO: 56791 - protein, 9 aa, Borrelia burgdorferi B31
GLEYANKWK

SEQ ID NO: 56792 - protein, 9 aa, Borrelia burgdorferi B31
GSLLPNYLR

SEQ ID NO: 56793 - protein, 10 aa, Borrelia burgdorferi B31
KSIYYITGGK

SEQ ID NO: 56794 - protein, 10 aa, Borrelia burgdorferi B31
RLCYIIKKVK

SEQ ID NO: 56795 - protein, 10 aa, Borrelia burgdorferi B31
KLKRKSCMKK

SEQ ID NO: 56796 - protein, 10 aa, Borrelia burgdorferi B31
AMLTSGMPSK

SEQ ID NO: 56797 - protein, 10 aa, Borrelia burgdorferi B31
LIIHSLYSHK

SEQ ID NO: 56798 - protein, 10 aa, Borrelia burgdorferi B31
ILQQNKILSK

SEQ ID NO: 56799 - protein, 10 aa, Borrelia burgdorferi B31
SSVDGFVSFK

SEQ ID NO: 56800 - protein, 10 aa, Borrelia burgdorferi B31
ILSELEKLSK

SEQ ID NO: 56801 - protein, 10 aa, Borrelia burgdorferi B31
LLYLIIHSLY

SEQ ID NO: 56802 - protein, 10 aa, Borrelia burgdorferi B31
IIFRLCYIIK

SEQ ID NO: 56803 - protein, 10 aa, Borrelia burgdorferi B31
ITGGKENILK

SEQ ID NO: 56804 - protein, 10 aa, Borrelia burgdorferi B31
LTNHLGVIAK

SEQ ID NO: 56805 - protein, 10 aa, Borrelia burgdorferi B31
IMLSMGQEVK

SEQ ID NO: 56806 - protein, 10 aa, Borrelia burgdorferi B31
TLTKVKEILK

SEQ ID NO: 56807 - protein, 10 aa, Borrelia burgdorferi B31
FYSAFIVSEK

SEQ ID NO: 56808 - protein, 10 aa, Borrelia burgdorferi B31
YTNLFYVPSK

SEQ ID NO: 56809 - protein, 10 aa, Borrelia burgdorferi B31
ALFIIFRLCY

SEQ ID NO: 56810 - protein, 10 aa, Borrelia burgdorferi B31
HINYPIYIKY

SEQ ID NO: 56811 - protein, 10 aa, Borrelia burgdorferi B31
LLPNYLRFIK

SEQ ID NO: 56812 - protein, 10 aa, Borrelia burgdorferi B31
LSKIKSSSVK

SEQ ID NO: 56813 - protein, 10 aa, Borrelia burgdorferi B31
YIKYSEPIMK

SEQ ID NO: 56814 - protein, 10 aa, Borrelia burgdorferi B31
IIKKVKIKLK

SEQ ID NO: 56815 - protein, 10 aa, Borrelia burgdorferi B31
KENPIVAAYK

SEQ ID NO: 56816 - protein, 10 aa, Borrelia burgdorferi B31
KFKNIALEPK

SEQ ID NO: 56817 - protein, 10 aa, Borrelia burgdorferi B31
FLSLTNEKFK

SEQ ID NO: 56818 - protein, 10 aa, Borrelia burgdorferi B31
GTKEFINNLK

SEQ ID NO: 56819 - protein, 10 aa, Borrelia burgdorferi B31
IFRLCYIIKK

SEQ ID NO: 56820 - protein, 10 aa, Borrelia burgdorferi B31
GTEIKLYLNK

SEQ ID NO: 56821 - protein, 10 aa, Borrelia burgdorferi B31
KQIALFIIFR

SEQ ID NO: 56822 - protein, 10 aa, Borrelia burgdorferi B31
LYLNKEGLEY

SEQ ID NO: 56823 - protein, 10 aa, Borrelia burgdorferi B31
LIGQFGVGFY

SEQ ID NO: 56824 - protein, 10 aa, Borrelia burgdorferi B31
EVNLSATLIK

SEQ ID NO: 56825 - protein, 10 aa, Borrelia burgdorferi B31
NLIPEYEGLK

SEQ ID NO: 56826 - protein, 10 aa, Borrelia burgdorferi B31
IKLKRKSCMK

SEQ ID NO: 56827 - protein, 10 aa, Borrelia burgdorferi B31
LFYVPSKAPY

SEQ ID NO: 56828 - protein, 10 aa, Borrelia burgdorferi B31
FINNLKQDEK

SEQ ID NO: 56829 - protein, 10 aa, Borrelia burgdorferi B31
KTGYEIEKAK

SEQ ID NO: 56830 - protein, 10 aa, Borrelia burgdorferi B31
VYSDFENREK

SEQ ID NO: 56831 - protein, 10 aa, Borrelia burgdorferi B31
LGVIAKSGTK

SEQ ID NO: 56832 - protein, 10 aa, Borrelia burgdorferi B31
CYIIKKVKIK

SEQ ID NO: 56833 - protein, 10 aa, Borrelia burgdorferi B31
GNLEYTNLFY

SEQ ID NO: 56834 - protein, 10 aa, Borrelia burgdorferi B31
SFDDKSILIK

SEQ ID NO: 56835 - protein, 10 aa, Borrelia burgdorferi B31
RMNESQKSIY

SEQ ID NO: 56836 - protein, 10 aa, Borrelia burgdorferi B31
KNLEPEKLEK

SEQ ID NO: 56837 - protein, 10 aa, Borrelia burgdorferi B31
DAYIWSSDGK

SEQ ID NO: 56838 - protein, 10 aa, Borrelia burgdorferi B31
SKIKSSSVKK

SEQ ID NO: 56839 - protein, 10 aa, Borrelia burgdorferi B31
SGMPSKNPGK

SEQ ID NO: 56840 - protein, 10 aa, Borrelia burgdorferi B31
INIINEFIEK

SEQ ID NO: 56841 - protein, 10 aa, Borrelia burgdorferi B31
ISNASDAIDK

SEQ ID NO: 56842 - protein, 10 aa, Borrelia burgdorferi B31
YYPNTKPGVK

SEQ ID NO: 56843 - protein, 10 aa, Borrelia burgdorferi B31
SMGQEVKEIK

SEQ ID NO: 56844 - protein, 10 aa, Borrelia burgdorferi B31
NHINYPIYIK

SEQ ID NO: 56845 - protein, 11 aa, Borrelia burgdorferi B31
IIFRLCYIIKK

SEQ ID NO: 56846 - protein, 11 aa, Borrelia burgdorferi B31
ILSKIKSSSVK

SEQ ID NO: 56847 - protein, 11 aa, Borrelia burgdorferi B31
KLKFLSLTNEK

SEQ ID NO: 56848 - protein, 11 aa, Borrelia burgdorferi B31
RMNESQKSIYY

SEQ ID NO: 56849 - protein, 11 aa, Borrelia burgdorferi B31
KLNETTALWTK

SEQ ID NO: 56850 - protein, 11 aa, Borrelia burgdorferi B31
SLLPNYLRFIK

SEQ ID NO: 56851 - protein, 11 aa, Borrelia burgdorferi B31
SLYSHKEIFLR

SEQ ID NO: 56852 - protein, 11 aa, Borrelia burgdorferi B31
KILSELEKLSK

SEQ ID NO: 56853 - protein, 11 aa, Borrelia burgdorferi B31
HLGVIAKSGTK

SEQ ID NO: 56854 - protein, 11 aa, Borrelia burgdorferi B31
YLIIHSLYSHK

SEQ ID NO: 56855 - protein, 11 aa, Borrelia burgdorferi B31
ILSELEKLSKK

SEQ ID NO: 56856 - protein, 11 aa, Borrelia burgdorferi B31
KIMLSMGQEVK

SEQ ID NO: 56857 - protein, 11 aa, Borrelia burgdorferi B31
GFYSAFIVSEK

SEQ ID NO: 56858 - protein, 11 aa, Borrelia burgdorferi B31
FIIFRLCYIIK

SEQ ID NO: 56859 - protein, 11 aa, Borrelia burgdorferi B31
KLYLNKEGLEY

SEQ ID NO: 56860 - protein, 11 aa, Borrelia burgdorferi B31
ISFDDKSILIK

SEQ ID NO: 56861 - protein, 11 aa, Borrelia burgdorferi B31
GVYSDFENREK

SEQ ID NO: 56862 - protein, 11 aa, Borrelia burgdorferi B31
FINIINEFIEK

SEQ ID NO: 56863 - protein, 11 aa, Borrelia burgdorferi B31
KIKLKRKSCMK

SEQ ID NO: 56864 - protein, 11 aa, Borrelia burgdorferi B31
LSKIKSSSVKK

SEQ ID NO: 56865 - protein, 11 aa, Borrelia burgdorferi B31
IVSEKVEVTSK

SEQ ID NO: 56866 - protein, 11 aa, Borrelia burgdorferi B31
SSSVDGFVSFK

SEQ ID NO: 56867 - protein, 11 aa, Borrelia burgdorferi B31
KFLSLTNEKFK

SEQ ID NO: 56868 - protein, 11 aa, Borrelia burgdorferi B31
SLIGQFGVGFY

SEQ ID NO: 56869 - protein, 11 aa, Borrelia burgdorferi B31
ALWTKNKSEIK

SEQ ID NO: 56870 - protein, 11 aa, Borrelia burgdorferi B31
SVKKILSELEK

SEQ ID NO: 56871 - protein, 11 aa, Borrelia burgdorferi B31
KTGYEIEKAKK

SEQ ID NO: 56872 - protein, 11 aa, Borrelia burgdorferi B31
TSGMPSKNPGK

SEQ ID NO: 56873 - protein, 11 aa, Borrelia burgdorferi B31
VSEKVEVTSKK

SEQ ID NO: 56874 - protein, 11 aa, Borrelia burgdorferi B31
IIKKVKIKLKR

SEQ ID NO: 56875 - protein, 11 aa, Borrelia burgdorferi B31
YIIKKVKIKLK

SEQ ID NO: 56876 - protein, 11 aa, Borrelia burgdorferi B31
EILQQNKILSK

SEQ ID NO: 56877 - protein, 11 aa, Borrelia burgdorferi B31
NVSREILQQNK

SEQ ID NO: 56878 - protein, 11 aa, Borrelia burgdorferi B31
KVKEILKDHIK

SEQ ID NO: 56879 - protein, 11 aa, Borrelia burgdorferi B31
LISNASDAIDK

SEQ ID NO: 56880 - protein, 11 aa, Borrelia burgdorferi B31
FINNLKQDEKK

SEQ ID NO: 56881 - protein, 11 aa, Borrelia burgdorferi B31
IIKKYSNHINY

SEQ ID NO: 56882 - protein, 11 aa, Borrelia burgdorferi B31
NLFYVPSKAPY

SEQ ID NO: 56883 - protein, 11 aa, Borrelia burgdorferi B31
YITGGKENILK

SEQ ID NO: 56884 - protein, 11 aa, Borrelia burgdorferi B31
VQNLKNLEPEK

SEQ ID NO: 56885 - protein, 11 aa, Borrelia burgdorferi B31
ILKENPIVAAY

SEQ ID NO: 56886 - protein, 11 aa, Borrelia burgdorferi B31
IALFIIFRLCY

SEQ ID NO: 56887 - protein, 11 aa, Borrelia burgdorferi B31
LYYPNTKPGVK

SEQ ID NO: 56888 - protein, 11 aa, Borrelia burgdorferi B31
TSNELKDENFK

SEQ ID NO: 56889 - protein, 11 aa, Borrelia burgdorferi B31
DSNDPTYQMQK

SEQ ID NO: 56890 - protein, 11 aa, Borrelia burgdorferi B31
LSMGQEVKEIK

SEQ ID NO: 56891 - protein, 9 aa, Borrelia burgdorferi B31
SVDGFVSFK

SEQ ID NO: 56892 - protein, 9 aa, Borrelia burgdorferi B31
SIYYITGGK

SEQ ID NO: 56893 - protein, 9 aa, Borrelia burgdorferi B31
TTALWTKNK

SEQ ID NO: 56894 - protein, 9 aa, Borrelia burgdorferi B31
GVIAKSGTK

SEQ ID NO: 56895 - protein, 9 aa, Borrelia burgdorferi B31
KLISLIRFK

SEQ ID NO: 56896 - protein, 9 aa, Borrelia burgdorferi B31
HINYPIYIK

SEQ ID NO: 56897 - protein, 9 aa, Borrelia burgdorferi B31
MLTSGMPSK

SEQ ID NO: 56898 - protein, 9 aa, Borrelia burgdorferi B31
YSAFIVSEK

SEQ ID NO: 56899 - protein, 9 aa, Borrelia burgdorferi B31
NIINEFIEK

SEQ ID NO: 56900 - protein, 9 aa, Borrelia burgdorferi B31
IIHSLYSHK

SEQ ID NO: 56901 - protein, 9 aa, Borrelia burgdorferi B31
GVYSDFENR

SEQ ID NO: 56902 - protein, 9 aa, Borrelia burgdorferi B31
GSLLPNYLR

SEQ ID NO: 56903 - protein, 9 aa, Borrelia burgdorferi B31
KIKSSSVKK

SEQ ID NO: 56904 - protein, 9 aa, Borrelia burgdorferi B31
QIALFIIFR

SEQ ID NO: 56905 - protein, 9 aa, Borrelia burgdorferi B31
LQQNKILSK

SEQ ID NO: 56906 - protein, 9 aa, Borrelia burgdorferi B31
KLSKKNPEK

SEQ ID NO: 56907 - protein, 9 aa, Borrelia burgdorferi B31
ASDAIDKLK

SEQ ID NO: 56908 - protein, 9 aa, Borrelia burgdorferi B31
AILNLIPEY

SEQ ID NO: 56909 - protein, 9 aa, Borrelia burgdorferi B31
LTKVKEILK

SEQ ID NO: 56910 - protein, 9 aa, Borrelia burgdorferi B31
KFLSLTNEK

SEQ ID NO: 56911 - protein, 9 aa, Borrelia burgdorferi B31
TNLFYVPSK

SEQ ID NO: 56912 - protein, 9 aa, Borrelia burgdorferi B31
MLSMGQEVK

SEQ ID NO: 56913 - protein, 9 aa, Borrelia burgdorferi B31
LSLTNEKFK

SEQ ID NO: 56914 - protein, 9 aa, Borrelia burgdorferi B31
GLKLKAINK

SEQ ID NO: 56915 - protein, 9 aa, Borrelia burgdorferi B31
KIEISFDDK

SEQ ID NO: 56916 - protein, 9 aa, Borrelia burgdorferi B31
AYIWSSDGK

SEQ ID NO: 56917 - protein, 9 aa, Borrelia burgdorferi B31
KVKIKLKRK

SEQ ID NO: 56918 - protein, 9 aa, Borrelia burgdorferi B31
LSELEKLSK

SEQ ID NO: 56919 - protein, 9 aa, Borrelia burgdorferi B31
TEIKLYLNK

SEQ ID NO: 56920 - protein, 9 aa, Borrelia burgdorferi B31
GMPSKNPGK

SEQ ID NO: 56921 - protein, 9 aa, Borrelia burgdorferi B31
LIPEYEGLK

SEQ ID NO: 56922 - protein, 9 aa, Borrelia burgdorferi B31
YSHKEIFLR

SEQ ID NO: 56923 - protein, 9 aa, Borrelia burgdorferi B31
ILELNPNNK

SEQ ID NO: 56924 - protein, 9 aa, Borrelia burgdorferi B31
KLKRKSCMK

SEQ ID NO: 56925 - protein, 9 aa, Borrelia burgdorferi B31
LPNYLRFIK

SEQ ID NO: 56926 - protein, 9 aa, Borrelia burgdorferi B31
GFVSFKEYK

SEQ ID NO: 56927 - protein, 9 aa, Borrelia burgdorferi B31
VNLSATLIK

SEQ ID NO: 56928 - protein, 9 aa, Borrelia burgdorferi B31
YIIKKVKIK

SEQ ID NO: 56929 - protein, 9 aa, Borrelia burgdorferi B31
TNHLGVIAK

SEQ ID NO: 56930 - protein, 9 aa, Borrelia burgdorferi B31
NLKNLEPEK

SEQ ID NO: 56931 - protein, 10 aa, Borrelia burgdorferi B31
SSVDGFVSFK

SEQ ID NO: 56932 - protein, 10 aa, Borrelia burgdorferi B31
AMLTSGMPSK

SEQ ID NO: 56933 - protein, 10 aa, Borrelia burgdorferi B31
YTNLFYVPSK

SEQ ID NO: 56934 - protein, 10 aa, Borrelia burgdorferi B31
KSIYYITGGK

SEQ ID NO: 56935 - protein, 10 aa, Borrelia burgdorferi B31
KQIALFIIFR

SEQ ID NO: 56936 - protein, 10 aa, Borrelia burgdorferi B31
IIFRLCYIIK

SEQ ID NO: 56937 - protein, 10 aa, Borrelia burgdorferi B31
LTNHLGVIAK

SEQ ID NO: 56938 - protein, 10 aa, Borrelia burgdorferi B31
LIIHSLYSHK

SEQ ID NO: 56939 - protein, 10 aa, Borrelia burgdorferi B31
GTEIKLYLNK

SEQ ID NO: 56940 - protein, 10 aa, Borrelia burgdorferi B31
GTKEFINNLK

SEQ ID NO: 56941 - protein, 10 aa, Borrelia burgdorferi B31
ISNASDAIDK

SEQ ID NO: 56942 - protein, 10 aa, Borrelia burgdorferi B31
KAEEYNEFYK

SEQ ID NO: 56943 - protein, 10 aa, Borrelia burgdorferi B31
ITGGKENILK

SEQ ID NO: 56944 - protein, 10 aa, Borrelia burgdorferi B31
ILQQNKILSK

SEQ ID NO: 56945 - protein, 10 aa, Borrelia burgdorferi B31
TLTKVKEILK

SEQ ID NO: 56946 - protein, 10 aa, Borrelia burgdorferi B31
EVNLSATLIK

SEQ ID NO: 56947 - protein, 10 aa, Borrelia burgdorferi B31
IMLSMGQEVK

SEQ ID NO: 56948 - protein, 10 aa, Borrelia burgdorferi B31
ETTALWTKNK

SEQ ID NO: 56949 - protein, 10 aa, Borrelia burgdorferi B31
ALFIIFRLCY

SEQ ID NO: 56950 - protein, 10 aa, Borrelia burgdorferi B31
ILSELEKLSK

SEQ ID NO: 56951 - protein, 10 aa, Borrelia burgdorferi B31
KTGYEIEKAK

SEQ ID NO: 56952 - protein, 10 aa, Borrelia burgdorferi B31
VSEKVEVTSK

SEQ ID NO: 56953 - protein, 10 aa, Borrelia burgdorferi B31
KLKRKSCMKK

SEQ ID NO: 56954 - protein, 10 aa, Borrelia burgdorferi B31
RLCYIIKKVK

SEQ ID NO: 56955 - protein, 10 aa, Borrelia burgdorferi B31
SFDDKSILIK

SEQ ID NO: 56956 - protein, 10 aa, Borrelia burgdorferi B31
YIKYSEPIMK

SEQ ID NO: 56957 - protein, 10 aa, Borrelia burgdorferi B31
IIKKVKIKLK

SEQ ID NO: 56958 - protein, 10 aa, Borrelia burgdorferi B31
LLPNYLRFIK

SEQ ID NO: 56959 - protein, 10 aa, Borrelia burgdorferi B31
VSREILQQNK

SEQ ID NO: 56960 - protein, 10 aa, Borrelia burgdorferi B31
SMGQEVKEIK

SEQ ID NO: 56961 - protein, 10 aa, Borrelia burgdorferi B31
PILELNPNNK

SEQ ID NO: 56962 - protein, 10 aa, Borrelia burgdorferi B31
FINNLKQDEK

SEQ ID NO: 56963 - protein, 10 aa, Borrelia burgdorferi B31
LSKIKSSSVK

SEQ ID NO: 56964 - protein, 10 aa, Borrelia burgdorferi B31
SGMPSKNPGK

SEQ ID NO: 56965 - protein, 10 aa, Borrelia burgdorferi B31
LSELEKLSKK

SEQ ID NO: 56966 - protein, 10 aa, Borrelia burgdorferi B31
NLIPEYEGLK

SEQ ID NO: 56967 - protein, 10 aa, Borrelia burgdorferi B31
NASDAIDKLK

SEQ ID NO: 56968 - protein, 10 aa, Borrelia burgdorferi B31
DAYIWSSDGK

SEQ ID NO: 56969 - protein, 10 aa, Borrelia burgdorferi B31
LLYLIIHSLY

SEQ ID NO: 56970 - protein, 10 aa, Borrelia burgdorferi B31
QQNKILSKIK

SEQ ID NO: 56971 - protein, 10 aa, Borrelia burgdorferi B31
FLSLTNEKFK

SEQ ID NO: 56972 - protein, 10 aa, Borrelia burgdorferi B31
FYSAFIVSEK

SEQ ID NO: 56973 - protein, 10 aa, Borrelia burgdorferi B31
HINYPIYIKY

SEQ ID NO: 56974 - protein, 10 aa, Borrelia burgdorferi B31
KFKNIALEPK

SEQ ID NO: 56975 - protein, 10 aa, Borrelia burgdorferi B31
KENPIVAAYK

SEQ ID NO: 56976 - protein, 10 aa, Borrelia burgdorferi B31
IIIDSNDPTY

SEQ ID NO: 56977 - protein, 10 aa, Borrelia burgdorferi B31
INIINEFIEK

SEQ ID NO: 56978 - protein, 11 aa, Borrelia burgdorferi B31
SSSVDGFVSFK

SEQ ID NO: 56979 - protein, 11 aa, Borrelia burgdorferi B31
IIFRLCYIIKK

SEQ ID NO: 56980 - protein, 11 aa, Borrelia burgdorferi B31
SLLPNYLRFIK

SEQ ID NO: 56981 - protein, 11 aa, Borrelia burgdorferi B31
TSNELKDENFK

SEQ ID NO: 56982 - protein, 11 aa, Borrelia burgdorferi B31
KIMLSMGQEVK

SEQ ID NO: 56983 - protein, 11 aa, Borrelia burgdorferi B31
GVYSDFENREK

SEQ ID NO: 56984 - protein, 11 aa, Borrelia burgdorferi B31
SVKKILSELEK

SEQ ID NO: 56985 - protein, 11 aa, Borrelia burgdorferi B31
KILSELEKLSK

SEQ ID NO: 56986 - protein, 11 aa, Borrelia burgdorferi B31
ISFDDKSILIK

SEQ ID NO: 56987 - protein, 11 aa, Borrelia burgdorferi B31
KLNETTALWTK

SEQ ID NO: 56988 - protein, 11 aa, Borrelia burgdorferi B31
TSGMPSKNPGK

SEQ ID NO: 56989 - protein, 11 aa, Borrelia burgdorferi B31
SLYSHKEIFLR

SEQ ID NO: 56990 - protein, 11 aa, Borrelia burgdorferi B31
IVSEKVEVTSK

SEQ ID NO: 56991 - protein, 11 aa, Borrelia burgdorferi B31
YLIIHSLYSHK

SEQ ID NO: 56992 - protein, 11 aa, Borrelia burgdorferi B31
FIIFRLCYIIK

SEQ ID NO: 56993 - protein, 11 aa, Borrelia burgdorferi B31
GFYSAFIVSEK

SEQ ID NO: 56994 - protein, 11 aa, Borrelia burgdorferi B31
KLKFLSLTNEK

SEQ ID NO: 56995 - protein, 11 aa, Borrelia burgdorferi B31
FINIINEFIEK

SEQ ID NO: 56996 - protein, 11 aa, Borrelia burgdorferi B31
VQNLKNLEPEK

SEQ ID NO: 56997 - protein, 11 aa, Borrelia burgdorferi B31
DSNDPTYQMQK

SEQ ID NO: 56998 - protein, 11 aa, Borrelia burgdorferi B31
NVSREILQQNK

SEQ ID NO: 56999 - protein, 11 aa, Borrelia burgdorferi B31
EAMLTSGMPSK

SEQ ID NO: 57000 - protein, 11 aa, Borrelia burgdorferi B31
KTGYEIEKAKK

SEQ ID NO: 57001 - protein, 11 aa, Borrelia burgdorferi B31
LSMGQEVKEIK

SEQ ID NO: 57002 - protein, 11 aa, Borrelia burgdorferi B31
APYDLYYPNTK

SEQ ID NO: 57003 - protein, 11 aa, Borrelia burgdorferi B31
SLIGQFGVGFY

SEQ ID NO: 57004 - protein, 11 aa, Borrelia burgdorferi B31
LISNASDAIDK

SEQ ID NO: 57005 - protein, 11 aa, Borrelia burgdorferi B31
IALFIIFRLCY

SEQ ID NO: 57006 - protein, 11 aa, Borrelia burgdorferi B31
TTFDYENPLMH

SEQ ID NO: 57007 - protein, 11 aa, Borrelia burgdorferi B31
ILSKIKSSSVK

SEQ ID NO: 57008 - protein, 11 aa, Borrelia burgdorferi B31
VSEKVEVTSKK

SEQ ID NO: 57009 - protein, 11 aa, Borrelia burgdorferi B31
YITGGKENILK

SEQ ID NO: 57010 - protein, 11 aa, Borrelia burgdorferi B31
KVKEILKDHIK

SEQ ID NO: 57011 - protein, 11 aa, Borrelia burgdorferi B31
ILSELEKLSKK

SEQ ID NO: 57012 - protein, 11 aa, Borrelia burgdorferi B31
KFLSLTNEKFK

SEQ ID NO: 57013 - protein, 11 aa, Borrelia burgdorferi B31
YIIKKVKIKLK

SEQ ID NO: 57014 - protein, 11 aa, Borrelia burgdorferi B31
KIKLKRKSCMK

SEQ ID NO: 57015 - protein, 11 aa, Borrelia burgdorferi B31
DTLTKVKEILK

SEQ ID NO: 57016 - protein, 11 aa, Borrelia burgdorferi B31
SVDGFVSFKEY

SEQ ID NO: 57017 - protein, 11 aa, Borrelia burgdorferi B31
LSKIKSSSVKK

SEQ ID NO: 57018 - protein, 11 aa, Borrelia burgdorferi B31
RMNESQKSIYY

SEQ ID NO: 57019 - protein, 11 aa, Borrelia burgdorferi B31
SGTEIKLYLNK

SEQ ID NO: 57020 - protein, 11 aa, Borrelia burgdorferi B31
IYIKYSEPIMK

SEQ ID NO: 57021 - protein, 11 aa, Borrelia burgdorferi B31
EILQQNKILSK

SEQ ID NO: 57022 - protein, 11 aa, Borrelia burgdorferi B31
LQQNKILSKIK

SEQ ID NO: 57023 - protein, 11 aa, Borrelia burgdorferi B31
ALWTKNKSEIK

SEQ ID NO: 57024 - protein, 11 aa, Borrelia burgdorferi B31
LIPEYEGLKLK

SEQ ID NO: 57025 - protein, 11 aa, Borrelia burgdorferi B31
KLYLNKEGLEY

SEQ ID NO: 57026 - protein, 11 aa, Borrelia burgdorferi B31
KYSEPIMKDGK

SEQ ID NO: 57027 - protein, 11 aa, Borrelia burgdorferi B31
SGTKEFINNLK

SEQ ID NO: 57028 - protein, 11 aa, Borrelia burgdorferi B31
FINNLKQDEKK

SEQ ID NO: 57029 - protein, 11 aa, Borrelia burgdorferi B31
KPILELNPNNK

SEQ ID NO: 57030 - protein, 11 aa, Borrelia burgdorferi B31
HLGVIAKSGTK

SEQ ID NO: 57031 - protein, 11 aa, Borrelia burgdorferi B31
AIIIDSNDPTY

SEQ ID NO: 57032 - protein, 11 aa, Borrelia burgdorferi B31
SNHINYPIYIK

SEQ ID NO: 57033 - protein, 9 aa, Borrelia burgdorferi B31
IYIKYSEPI

SEQ ID NO: 57034 - protein, 9 aa, Borrelia burgdorferi B31
FYFKQIALF

SEQ ID NO: 57035 - protein, 9 aa, Borrelia burgdorferi B31
KFINIINEF

SEQ ID NO: 57036 - protein, 9 aa, Borrelia burgdorferi B31
LYLIIHSLY

SEQ ID NO: 57037 - protein, 9 aa, Borrelia burgdorferi B31
AYKEKGFEI

SEQ ID NO: 57038 - protein, 9 aa, Borrelia burgdorferi B31
YFKQIALFI

SEQ ID NO: 57039 - protein, 9 aa, Borrelia burgdorferi B31
TYQMQKIML

SEQ ID NO: 57040 - protein, 9 aa, Borrelia burgdorferi B31
LYSHKEIFL

SEQ ID NO: 57041 - protein, 9 aa, Borrelia burgdorferi B31
NYLRFIKGI

SEQ ID NO: 57042 - protein, 9 aa, Borrelia burgdorferi B31
CYIIKKVKI

SEQ ID NO: 57043 - protein, 9 aa, Borrelia burgdorferi B31
DYENPLMHI

SEQ ID NO: 57044 - protein, 9 aa, Borrelia burgdorferi B31
KQIALFIIF

SEQ ID NO: 57045 - protein, 9 aa, Borrelia burgdorferi B31
SLLPNYLRF

SEQ ID NO: 57046 - protein, 9 aa, Borrelia burgdorferi B31
FYKNTTFDY

SEQ ID NO: 57047 - protein, 9 aa, Borrelia burgdorferi B31
YYPNTKPGV

SEQ ID NO: 57048 - protein, 9 aa, Borrelia burgdorferi B31
SFDDKSILI

SEQ ID NO: 57049 - protein, 9 aa, Borrelia burgdorferi B31
LWTKNKSEI

SEQ ID NO: 57050 - protein, 9 aa, Borrelia burgdorferi B31
AYIWSSDGK

SEQ ID NO: 57051 - protein, 9 aa, Borrelia burgdorferi B31
KFSEFSKEF

SEQ ID NO: 57052 - protein, 9 aa, Borrelia burgdorferi B31
NFKKIEEEF

SEQ ID NO: 57053 - protein, 10 aa, Borrelia burgdorferi B31
KYSNHINYPI

SEQ ID NO: 57054 - protein, 10 aa, Borrelia burgdorferi B31
FYFKQIALFI

SEQ ID NO: 57055 - protein, 10 aa, Borrelia burgdorferi B31
IFYFKQIALF

SEQ ID NO: 57056 - protein, 10 aa, Borrelia burgdorferi B31
KFLSLTNEKF

SEQ ID NO: 57057 - protein, 10 aa, Borrelia burgdorferi B31
KFINIINEFI

SEQ ID NO: 57058 - protein, 10 aa, Borrelia burgdorferi B31
IYIKYSEPIM

SEQ ID NO: 57059 - protein, 10 aa, Borrelia burgdorferi B31
YFKQIALFII

SEQ ID NO: 57060 - protein, 10 aa, Borrelia burgdorferi B31
NYLRFIKGII

SEQ ID NO: 57061 - protein, 10 aa, Borrelia burgdorferi B31
YYITGGKENI

SEQ ID NO: 57062 - protein, 10 aa, Borrelia burgdorferi B31
QFGVGFYSAF

SEQ ID NO: 57063 - protein, 10 aa, Borrelia burgdorferi B31
RFKSSSVDGF

SEQ ID NO: 57064 - protein, 10 aa, Borrelia burgdorferi B31
YYPNTKPGVK

SEQ ID NO: 57065 - protein, 10 aa, Borrelia burgdorferi B31
EYEGLKLKAI

SEQ ID NO: 57066 - protein, 10 aa, Borrelia burgdorferi B31
AYKEKGFEIL

SEQ ID NO: 57067 - protein, 10 aa, Borrelia burgdorferi B31
IFITDSEGSL

SEQ ID NO: 57068 - protein, 10 aa, Borrelia burgdorferi B31
LFIIFRLCYI

SEQ ID NO: 57069 - protein, 10 aa, Borrelia burgdorferi B31
FYSAFIVSEK

SEQ ID NO: 57070 - protein, 10 aa, Borrelia burgdorferi B31
LYSHKEIFLR

SEQ ID NO: 57071 - protein, 11 aa, Borrelia burgdorferi B31
FYFKQIALFII

SEQ ID NO: 57072 - protein, 11 aa, Borrelia burgdorferi B31
EYANKWKIQEI

SEQ ID NO: 57073 - protein, 11 aa, Borrelia burgdorferi B31
EYNEFYKNTTF

SEQ ID NO: 57074 - protein, 11 aa, Borrelia burgdorferi B31
YFKQIALFIIF

SEQ ID NO: 57075 - protein, 11 aa, Borrelia burgdorferi B31
YYPNTKPGVKL

SEQ ID NO: 57076 - protein, 11 aa, Borrelia burgdorferi B31
YYITGGKENIL

SEQ ID NO: 57077 - protein, 11 aa, Borrelia burgdorferi B31
AYKEKGFEILI

SEQ ID NO: 57078 - protein, 11 aa, Borrelia burgdorferi B31
IYIKYSEPIMK

SEQ ID NO: 57079 - protein, 11 aa, Borrelia burgdorferi B31
IFITDSEGSLL

SEQ ID NO: 57080 - protein, 11 aa, Borrelia burgdorferi B31
IFYFKQIALFI

SEQ ID NO: 57081 - protein, 11 aa, Borrelia burgdorferi B31
IYYITGGKENI

SEQ ID NO: 57082 - protein, 11 aa, Borrelia burgdorferi B31
FYVPSKAPYDL

SEQ ID NO: 57083 - protein, 11 aa, Borrelia burgdorferi B31
TYQMQKIMLSM

SEQ ID NO: 57084 - protein, 11 aa, Borrelia burgdorferi B31
VYSDFENREKL

SEQ ID NO: 57085 - protein, 11 aa, Borrelia burgdorferi B31
KYSNHINYPIY

SEQ ID NO: 57086 - protein, 11 aa, Borrelia burgdorferi B31
LFIIFRLCYII

SEQ ID NO: 57087 - protein, 11 aa, Borrelia burgdorferi B31
CYIIKKVKIKL

SEQ ID NO: 57088 - protein, 11 aa, Borrelia burgdorferi B31
EYTNLFYVPSK

SEQ ID NO: 57089 - protein, 11 aa, Borrelia burgdorferi B31
KFKNIALEPKI

SEQ ID NO: 57090 - protein, 11 aa, Borrelia burgdorferi B31
QFGVGFYSAFI

SEQ ID NO: 57091 - protein, 11 aa, Borrelia burgdorferi B31
FYSAFIVSEKV

SEQ ID NO: 57092 - protein, 11 aa, Borrelia burgdorferi B31
TFDYENPLMHI

SEQ ID NO: 57093 - protein, 9 aa, Borrelia burgdorferi B31
FYKNTTFDY

SEQ ID NO: 57094 - protein, 9 aa, Borrelia burgdorferi B31
YLNKEGLEY

SEQ ID NO: 57095 - protein, 9 aa, Borrelia burgdorferi B31
LFIIFRLCY

SEQ ID NO: 57096 - protein, 9 aa, Borrelia burgdorferi B31
FYVPSKAPY

SEQ ID NO: 57097 - protein, 9 aa, Borrelia burgdorferi B31
INYPIYIKY

SEQ ID NO: 57098 - protein, 9 aa, Borrelia burgdorferi B31
NLEYTNLFY

SEQ ID NO: 57099 - protein, 9 aa, Borrelia burgdorferi B31
LYLIIHSLY

SEQ ID NO: 57100 - protein, 9 aa, Borrelia burgdorferi B31
SKAPYDLYY

SEQ ID NO: 57101 - protein, 9 aa, Borrelia burgdorferi B31
TKAEGNLEY

SEQ ID NO: 57102 - protein, 9 aa, Borrelia burgdorferi B31
DTEVNDLLY

SEQ ID NO: 57103 - protein, 9 aa, Borrelia burgdorferi B31
FYFKQIALF

SEQ ID NO: 57104 - protein, 9 aa, Borrelia burgdorferi B31
KFINIINEF

SEQ ID NO: 57105 - protein, 9 aa, Borrelia burgdorferi B31
AILNLIPEY

SEQ ID NO: 57106 - protein, 9 aa, Borrelia burgdorferi B31
YSNHINYPI

SEQ ID NO: 57107 - protein, 9 aa, Borrelia burgdorferi B31
IIDSNDPTY

SEQ ID NO: 57108 - protein, 9 aa, Borrelia burgdorferi B31
KIQEIIKKY

SEQ ID NO: 57109 - protein, 10 aa, Borrelia burgdorferi B31
EFYKNTTFDY

SEQ ID NO: 57110 - protein, 10 aa, Borrelia burgdorferi B31
HINYPIYIKY

SEQ ID NO: 57111 - protein, 10 aa, Borrelia burgdorferi B31
YSNHINYPIY

SEQ ID NO: 57112 - protein, 10 aa, Borrelia burgdorferi B31
LYLNKEGLEY

SEQ ID NO: 57113 - protein, 10 aa, Borrelia burgdorferi B31
LFYVPSKAPY

SEQ ID NO: 57114 - protein, 10 aa, Borrelia burgdorferi B31
IIIDSNDPTY

SEQ ID NO: 57115 - protein, 10 aa, Borrelia burgdorferi B31
IWSSDGKTGY

SEQ ID NO: 57116 - protein, 10 aa, Borrelia burgdorferi B31
LLYLIIHSLY

SEQ ID NO: 57117 - protein, 10 aa, Borrelia burgdorferi B31
ALFIIFRLCY

SEQ ID NO: 57118 - protein, 10 aa, Borrelia burgdorferi B31
EAILNLIPEY

SEQ ID NO: 57119 - protein, 10 aa, Borrelia burgdorferi B31
HTKAEGNLEY

SEQ ID NO: 57120 - protein, 10 aa, Borrelia burgdorferi B31
FDTEVNDLLY

SEQ ID NO: 57121 - protein, 10 aa, Borrelia burgdorferi B31
LIGQFGVGFY

SEQ ID NO: 57122 - protein, 10 aa, Borrelia burgdorferi B31
KFLSLTNEKF

SEQ ID NO: 57123 - protein, 10 aa, Borrelia burgdorferi B31
IFYFKQIALF

SEQ ID NO: 57124 - protein, 10 aa, Borrelia burgdorferi B31
RMNESQKSIY

SEQ ID NO: 57125 - protein, 10 aa, Borrelia burgdorferi B31
PSKAPYDLYY

SEQ ID NO: 57126 - protein, 11 aa, Borrelia burgdorferi B31
YVPSKAPYDLY

SEQ ID NO: 57127 - protein, 11 aa, Borrelia burgdorferi B31
YIWSSDGKTGY

SEQ ID NO: 57128 - protein, 11 aa, Borrelia burgdorferi B31
IALFIIFRLCY

SEQ ID NO: 57129 - protein, 11 aa, Borrelia burgdorferi B31
KLYLNKEGLEY

SEQ ID NO: 57130 - protein, 11 aa, Borrelia burgdorferi B31
NLFYVPSKAPY

SEQ ID NO: 57131 - protein, 11 aa, Borrelia burgdorferi B31
RMNESQKSIYY

SEQ ID NO: 57132 - protein, 11 aa, Borrelia burgdorferi B31
QFDTEVNDLLY

SEQ ID NO: 57133 - protein, 11 aa, Borrelia burgdorferi B31
YFKQIALFIIF

SEQ ID NO: 57134 - protein, 11 aa, Borrelia burgdorferi B31
DLLYLIIHSLY

SEQ ID NO: 57135 - protein, 11 aa, Borrelia burgdorferi B31
EYNEFYKNTTF

SEQ ID NO: 57136 - protein, 11 aa, Borrelia burgdorferi B31
KYSNHINYPIY

SEQ ID NO: 57137 - protein, 11 aa, Borrelia burgdorferi B31
SLIGQFGVGFY

SEQ ID NO: 57138 - protein, 11 aa, Borrelia burgdorferi B31
EGNLEYTNLFY

SEQ ID NO: 57139 - protein, 11 aa, Borrelia burgdorferi B31
EFGRCIKEGVY

SEQ ID NO: 57140 - protein, 11 aa, Borrelia burgdorferi B31
AIIIDSNDPTY

SEQ ID NO: 57141 - protein, 11 aa, Borrelia burgdorferi B31
ILKENPIVAAY

SEQ ID NO: 57142 - protein, 11 aa, Borrelia burgdorferi B31
NEFYKNTTFDY

SEQ ID NO: 57143 - protein, 11 aa, Borrelia burgdorferi B31
NHINYPIYIKY

SEQ ID NO: 57144 - protein, 11 aa, Borrelia burgdorferi B31
EIKAEEYNEFY

SEQ ID NO: 57145 - protein, 11 aa, Borrelia burgdorferi B31
IIKKYSNHINY

SEQ ID NO: 57146 - protein, 11 aa, Borrelia burgdorferi B31
KWKIQEIIKKY

SEQ ID NO: 57147 - protein, 9 aa, Borrelia burgdorferi B31
YSAFIVSEK

SEQ ID NO: 57148 - protein, 9 aa, Borrelia burgdorferi B31
QIALFIIFR

SEQ ID NO: 57149 - protein, 9 aa, Borrelia burgdorferi B31
YSHKEIFLR

SEQ ID NO: 57150 - protein, 9 aa, Borrelia burgdorferi B31
TTALWTKNK

SEQ ID NO: 57151 - protein, 9 aa, Borrelia burgdorferi B31
SIYYITGGK

SEQ ID NO: 57152 - protein, 9 aa, Borrelia burgdorferi B31
SVDGFVSFK

SEQ ID NO: 57153 - protein, 9 aa, Borrelia burgdorferi B31
HINYPIYIK

SEQ ID NO: 57154 - protein, 9 aa, Borrelia burgdorferi B31
MLTSGMPSK

SEQ ID NO: 57155 - protein, 9 aa, Borrelia burgdorferi B31
GVYSDFENR

SEQ ID NO: 57156 - protein, 9 aa, Borrelia burgdorferi B31
NIINEFIEK

SEQ ID NO: 57157 - protein, 9 aa, Borrelia burgdorferi B31
ENPIVAAYK

SEQ ID NO: 57158 - protein, 9 aa, Borrelia burgdorferi B31
MLSMGQEVK

SEQ ID NO: 57159 - protein, 9 aa, Borrelia burgdorferi B31
IIHSLYSHK

SEQ ID NO: 57160 - protein, 9 aa, Borrelia burgdorferi B31
ELKDENFKK

SEQ ID NO: 57161 - protein, 9 aa, Borrelia burgdorferi B31
LPNYLRFIK

SEQ ID NO: 57162 - protein, 9 aa, Borrelia burgdorferi B31
EKVEVTSKK

SEQ ID NO: 57163 - protein, 9 aa, Borrelia burgdorferi B31
NLKNLEPEK

SEQ ID NO: 57164 - protein, 9 aa, Borrelia burgdorferi B31
VSFKEYKER

SEQ ID NO: 57165 - protein, 9 aa, Borrelia burgdorferi B31
TKEFINNLK

SEQ ID NO: 57166 - protein, 9 aa, Borrelia burgdorferi B31
GFVSFKEYK

SEQ ID NO: 57167 - protein, 9 aa, Borrelia burgdorferi B31
GSLLPNYLR

SEQ ID NO: 57168 - protein, 9 aa, Borrelia burgdorferi B31
LTKVKEILK

SEQ ID NO: 57169 - protein, 9 aa, Borrelia burgdorferi B31
WTKNKSEIK

SEQ ID NO: 57170 - protein, 9 aa, Borrelia burgdorferi B31
SEFSKEFGR

SEQ ID NO: 57171 - protein, 9 aa, Borrelia burgdorferi B31
LIPEYEGLK

SEQ ID NO: 57172 - protein, 9 aa, Borrelia burgdorferi B31
TNLFYVPSK

SEQ ID NO: 57173 - protein, 9 aa, Borrelia burgdorferi B31
EEFKDTLTK

SEQ ID NO: 57174 - protein, 9 aa, Borrelia burgdorferi B31
NNKIVQNLK

SEQ ID NO: 57175 - protein, 9 aa, Borrelia burgdorferi B31
YIIKKVKIK

SEQ ID NO: 57176 - protein, 9 aa, Borrelia burgdorferi B31
EGIEEKEEK

SEQ ID NO: 57177 - protein, 9 aa, Borrelia burgdorferi B31
GVIAKSGTK

SEQ ID NO: 57178 - protein, 9 aa, Borrelia burgdorferi B31
LSLTNEKFK

SEQ ID NO: 57179 - protein, 9 aa, Borrelia burgdorferi B31
AYIWSSDGK

SEQ ID NO: 57180 - protein, 9 aa, Borrelia burgdorferi B31
KLISLIRFK

SEQ ID NO: 57181 - protein, 9 aa, Borrelia burgdorferi B31
YSDFENREK

SEQ ID NO: 57182 - protein, 9 aa, Borrelia burgdorferi B31
NPLMHIHTK

SEQ ID NO: 57183 - protein, 9 aa, Borrelia burgdorferi B31
DTEVNDLLY

SEQ ID NO: 57184 - protein, 9 aa, Borrelia burgdorferi B31
TGYEIEKAK

SEQ ID NO: 57185 - protein, 9 aa, Borrelia burgdorferi B31
MGQEVKEIK

SEQ ID NO: 57186 - protein, 9 aa, Borrelia burgdorferi B31
SNASDAIDK

SEQ ID NO: 57187 - protein, 10 aa, Borrelia burgdorferi B31
ETTALWTKNK

SEQ ID NO: 57188 - protein, 10 aa, Borrelia burgdorferi B31
YTNLFYVPSK

SEQ ID NO: 57189 - protein, 10 aa, Borrelia burgdorferi B31
FSEFSKEFGR

SEQ ID NO: 57190 - protein, 10 aa, Borrelia burgdorferi B31
EVNLSATLIK

SEQ ID NO: 57191 - protein, 10 aa, Borrelia burgdorferi B31
SSVDGFVSFK

SEQ ID NO: 57192 - protein, 10 aa, Borrelia burgdorferi B31
FVSFKEYKER

SEQ ID NO: 57193 - protein, 10 aa, Borrelia burgdorferi B31
DAYIWSSDGK

SEQ ID NO: 57194 - protein, 10 aa, Borrelia burgdorferi B31
FYSAFIVSEK

SEQ ID NO: 57195 - protein, 10 aa, Borrelia burgdorferi B31
NASDAIDKLK

SEQ ID NO: 57196 - protein, 10 aa, Borrelia burgdorferi B31
GTKEFINNLK

SEQ ID NO: 57197 - protein, 10 aa, Borrelia burgdorferi B31
LIIHSLYSHK

SEQ ID NO: 57198 - protein, 10 aa, Borrelia burgdorferi B31
EGVYSDFENR

SEQ ID NO: 57199 - protein, 10 aa, Borrelia burgdorferi B31
TLTKVKEILK

SEQ ID NO: 57200 - protein, 10 aa, Borrelia burgdorferi B31
EAILNLIPEY

SEQ ID NO: 57201 - protein, 10 aa, Borrelia burgdorferi B31
EGSLLPNYLR

SEQ ID NO: 57202 - protein, 10 aa, Borrelia burgdorferi B31
KSIYYITGGK

SEQ ID NO: 57203 - protein, 10 aa, Borrelia burgdorferi B31
FLSLTNEKFK

SEQ ID NO: 57204 - protein, 10 aa, Borrelia burgdorferi B31
FINNLKQDEK

SEQ ID NO: 57205 - protein, 10 aa, Borrelia burgdorferi B31
NLIPEYEGLK

SEQ ID NO: 57206 - protein, 10 aa, Borrelia burgdorferi B31
YIKYSEPIMK

SEQ ID NO: 57207 - protein, 10 aa, Borrelia burgdorferi B31
LYSHKEIFLR

SEQ ID NO: 57208 - protein, 10 aa, Borrelia burgdorferi B31
EFYKNTTFDY

SEQ ID NO: 57209 - protein, 10 aa, Borrelia burgdorferi B31
IIFRLCYIIK

SEQ ID NO: 57210 - protein, 10 aa, Borrelia burgdorferi B31
NFKKIEEEFK

SEQ ID NO: 57211 - protein, 10 aa, Borrelia burgdorferi B31
FSKEFGRCIK

SEQ ID NO: 57212 - protein, 10 aa, Borrelia burgdorferi B31
LTNHLGVIAK

SEQ ID NO: 57213 - protein, 10 aa, Borrelia burgdorferi B31
NPEKFSEFSK

SEQ ID NO: 57214 - protein, 10 aa, Borrelia burgdorferi B31
TTFDYENPLM

SEQ ID NO: 57215 - protein, 10 aa, Borrelia burgdorferi B31
DGFVSFKEYK

SEQ ID NO: 57216 - protein, 10 aa, Borrelia burgdorferi B31
KAEEYNEFYK

SEQ ID NO: 57217 - protein, 10 aa, Borrelia burgdorferi B31
LLYLIIHSLY

SEQ ID NO: 57218 - protein, 10 aa, Borrelia burgdorferi B31
NPIVAAYKEK

SEQ ID NO: 57219 - protein, 10 aa, Borrelia burgdorferi B31
YSEPIMKDGK

SEQ ID NO: 57220 - protein, 10 aa, Borrelia burgdorferi B31
ISNASDAIDK

SEQ ID NO: 57221 - protein, 10 aa, Borrelia burgdorferi B31
YSNHINYPIY

SEQ ID NO: 57222 - protein, 10 aa, Borrelia burgdorferi B31
ITGGKENILK

SEQ ID NO: 57223 - protein, 10 aa, Borrelia burgdorferi B31
HINYPIYIKY

SEQ ID NO: 57224 - protein, 10 aa, Borrelia burgdorferi B31
ENPLMHIHTK

SEQ ID NO: 57225 - protein, 10 aa, Borrelia burgdorferi B31
TGYEIEKAKK

SEQ ID NO: 57226 - protein, 10 aa, Borrelia burgdorferi B31
KQIALFIIFR

SEQ ID NO: 57227 - protein, 10 aa, Borrelia burgdorferi B31
INIINEFIEK

SEQ ID NO: 57228 - protein, 10 aa, Borrelia burgdorferi B31
LLPNYLRFIK

SEQ ID NO: 57229 - protein, 10 aa, Borrelia burgdorferi B31
IIKKVKIKLK

SEQ ID NO: 57230 - protein, 10 aa, Borrelia burgdorferi B31
LSKIKSSSVK

SEQ ID NO: 57231 - protein, 10 aa, Borrelia burgdorferi B31
NHINYPIYIK

SEQ ID NO: 57232 - protein, 10 aa, Borrelia burgdorferi B31
HTKAEGNLEY

SEQ ID NO: 57233 - protein, 10 aa, Borrelia burgdorferi B31
EFKDTLTKVK

SEQ ID NO: 57234 - protein, 10 aa, Borrelia burgdorferi B31
IIIDSNDPTY

SEQ ID NO: 57235 - protein, 10 aa, Borrelia burgdorferi B31
LKFLSLTNEK

SEQ ID NO: 57236 - protein, 11 aa, Borrelia burgdorferi B31
SLYSHKEIFLR

SEQ ID NO: 57237 - protein, 11 aa, Borrelia burgdorferi B31
EAMLTSGMPSK

SEQ ID NO: 57238 - protein, 11 aa, Borrelia burgdorferi B31
TSNELKDENFK

SEQ ID NO: 57239 - protein, 11 aa, Borrelia burgdorferi B31
DSNDPTYQMQK

SEQ ID NO: 57240 - protein, 11 aa, Borrelia burgdorferi B31
FINIINEFIEK

SEQ ID NO: 57241 - protein, 11 aa, Borrelia burgdorferi B31
EYTNLFYVPSK

SEQ ID NO: 57242 - protein, 11 aa, Borrelia burgdorferi B31
FIIFRLCYIIK

SEQ ID NO: 57243 - protein, 11 aa, Borrelia burgdorferi B31
SSSVDGFVSFK

SEQ ID NO: 57244 - protein, 11 aa, Borrelia burgdorferi B31
YITGGKENILK

SEQ ID NO: 57245 - protein, 11 aa, Borrelia burgdorferi B31
IIFRLCYIIKK

SEQ ID NO: 57246 - protein, 11 aa, Borrelia burgdorferi B31
YLIIHSLYSHK

SEQ ID NO: 57247 - protein, 11 aa, Borrelia burgdorferi B31
SVKKILSELEK

SEQ ID NO: 57248 - protein, 11 aa, Borrelia burgdorferi B31
ENFKKIEEEFK

SEQ ID NO: 57249 - protein, 11 aa, Borrelia burgdorferi B31
NVSREILQQNK

SEQ ID NO: 57250 - protein, 11 aa, Borrelia burgdorferi B31
ISFDDKSILIK

SEQ ID NO: 57251 - protein, 11 aa, Borrelia burgdorferi B31
GVYSDFENREK

SEQ ID NO: 57252 - protein, 11 aa, Borrelia burgdorferi B31
EFINNLKQDEK

SEQ ID NO: 57253 - protein, 11 aa, Borrelia burgdorferi B31
LSMGQEVKEIK

SEQ ID NO: 57254 - protein, 11 aa, Borrelia burgdorferi B31
FINNLKQDEKK

SEQ ID NO: 57255 - protein, 11 aa, Borrelia burgdorferi B31
IIKKVKIKLKR

SEQ ID NO: 57256 - protein, 11 aa, Borrelia burgdorferi B31
DTLTKVKEILK

SEQ ID NO: 57257 - protein, 11 aa, Borrelia burgdorferi B31
YIIKKVKIKLK

SEQ ID NO: 57258 - protein, 11 aa, Borrelia burgdorferi B31
EYKERMNESQK

SEQ ID NO: 57259 - protein, 11 aa, Borrelia burgdorferi B31
TTFDYENPLMH

SEQ ID NO: 57260 - protein, 11 aa, Borrelia burgdorferi B31
ILSKIKSSSVK

SEQ ID NO: 57261 - protein, 11 aa, Borrelia burgdorferi B31
IVSEKVEVTSK

SEQ ID NO: 57262 - protein, 11 aa, Borrelia burgdorferi B31
NPNNKIVQNLK

SEQ ID NO: 57263 - protein, 11 aa, Borrelia burgdorferi B31
EIKAEEYNEFY

SEQ ID NO: 57264 - protein, 11 aa, Borrelia burgdorferi B31
EILQQNKILSK

SEQ ID NO: 57265 - protein, 11 aa, Borrelia burgdorferi B31
EFSKEFGRCIK

SEQ ID NO: 57266 - protein, 11 aa, Borrelia burgdorferi B31
LISNASDAIDK

SEQ ID NO: 57267 - protein, 11 aa, Borrelia burgdorferi B31
GFYSAFIVSEK

SEQ ID NO: 57268 - protein, 11 aa, Borrelia burgdorferi B31
IYIKYSEPIMK

SEQ ID NO: 57269 - protein, 11 aa, Borrelia burgdorferi B31
EKFKNIALEPK

SEQ ID NO: 57270 - protein, 11 aa, Borrelia burgdorferi B31
NLFYVPSKAPY

SEQ ID NO: 57271 - protein, 11 aa, Borrelia burgdorferi B31
DLTNHLGVIAK

SEQ ID NO: 57272 - protein, 11 aa, Borrelia burgdorferi B31
FKQIALFIIFR

SEQ ID NO: 57273 - protein, 11 aa, Borrelia burgdorferi B31
ENPIVAAYKEK

SEQ ID NO: 57274 - protein, 11 aa, Borrelia burgdorferi B31
TSGMPSKNPGK

SEQ ID NO: 57275 - protein, 11 aa, Borrelia burgdorferi B31
VSEKVEVTSKK

SEQ ID NO: 57276 - protein, 11 aa, Borrelia burgdorferi B31
SLIGQFGVGFY

SEQ ID NO: 57277 - protein, 11 aa, Borrelia burgdorferi B31
LSKIKSSSVKK

SEQ ID NO: 57278 - protein, 11 aa, Borrelia burgdorferi B31
YVPSKAPYDLY

SEQ ID NO: 57279 - protein, 11 aa, Borrelia burgdorferi B31
SNASDAIDKLK

SEQ ID NO: 57280 - protein, 11 aa, Borrelia burgdorferi B31
LYYPNTKPGVK

SEQ ID NO: 57281 - protein, 11 aa, Borrelia burgdorferi B31
SLLPNYLRFIK

SEQ ID NO: 57282 - protein, 11 aa, Borrelia burgdorferi B31
SDAYIWSSDGK

SEQ ID NO: 57283 - protein, 11 aa, Borrelia burgdorferi B31
GFVSFKEYKER

SEQ ID NO: 57284 - protein, 11 aa, Borrelia burgdorferi B31
KFSEFSKEFGR

SEQ ID NO: 57285 - protein, 11 aa, Borrelia burgdorferi B31
TKPGVKLFINR

SEQ ID NO: 57286 - protein, 11 aa, Borrelia burgdorferi B31
NTTFDYENPLM

SEQ ID NO: 57287 - protein, 11 aa, Borrelia burgdorferi B31
IALFIIFRLCY

SEQ ID NO: 57288 - protein, 11 aa, Borrelia burgdorferi B31
EEFKDTLTKVK

SEQ ID NO: 57289 - protein, 11 aa, Borrelia burgdorferi B31
KIMLSMGQEVK

SEQ ID NO: 57290 - protein, 11 aa, Borrelia burgdorferi B31
SGTKEFINNLK

SEQ ID NO: 57291 - protein, 11 aa, Borrelia burgdorferi B31
EVNDLLYLIIH

SEQ ID NO: 57292 - protein, 11 aa, Borrelia burgdorferi B31
LIPEYEGLKLK

SEQ ID NO: 57293 - protein, 11 aa, Borrelia burgdorferi B31
EAILNLIPEYE

SEQ ID NO: 57294 - protein, 11 aa, Borrelia burgdorferi B31
EPKIEISFDDK

SEQ ID NO: 57295 - protein, 11 aa, Borrelia burgdorferi B31
ILSELEKLSKK

SEQ ID NO: 57296 - protein, 11 aa, Borrelia burgdorferi B31
DLLYLIIHSLY

SEQ ID NO: 57297 - protein, 11 aa, Borrelia burgdorferi B31
IKAEEYNEFYK

SEQ ID NO: 57298 - protein, 11 aa, Borrelia burgdorferi B31
HLGVIAKSGTK

SEQ ID NO: 57299 - protein, 11 aa, Borrelia burgdorferi B31
KTGYEIEKAKK

SEQ ID NO: 57300 - protein, 9 aa, Borrelia burgdorferi B31
MPSKNPGKF

SEQ ID NO: 57301 - protein, 9 aa, Borrelia burgdorferi B31
IPEYEGLKL

SEQ ID NO: 57302 - protein, 9 aa, Borrelia burgdorferi B31
VPSKAPYDL

SEQ ID NO: 57303 - protein, 9 aa, Borrelia burgdorferi B31
LPLNVSREI

SEQ ID NO: 57304 - protein, 9 aa, Borrelia burgdorferi B31
YPIYIKYSE

SEQ ID NO: 57305 - protein, 9 aa, Borrelia burgdorferi B31
LIRFKSSSV

SEQ ID NO: 57306 - protein, 9 aa, Borrelia burgdorferi B31
SVKKILSEL

SEQ ID NO: 57307 - protein, 10 aa, Borrelia burgdorferi B31
YPNTKPGVKL

SEQ ID NO: 57308 - protein, 10 aa, Borrelia burgdorferi B31
MPSKNPGKFI

SEQ ID NO: 57309 - protein, 10 aa, Borrelia burgdorferi B31
LPLNVSREIL

SEQ ID NO: 57310 - protein, 10 aa, Borrelia burgdorferi B31
KVEVTSKKAL

SEQ ID NO: 57311 - protein, 10 aa, Borrelia burgdorferi B31
NPNNKIVQNL

SEQ ID NO: 57312 - protein, 11 aa, Borrelia burgdorferi B31
YPIYIKYSEPI

SEQ ID NO: 57313 - protein, 11 aa, Borrelia burgdorferi B31
YPNTKPGVKLF

SEQ ID NO: 57314 - protein, 11 aa, Borrelia burgdorferi B31
LPNYLRFIKGI

SEQ ID NO: 57315 - protein, 11 aa, Borrelia burgdorferi B31
KPGVKLFINRI

SEQ ID NO: 57316 - protein, 11 aa, Borrelia burgdorferi B31
IPEYEGLKLKA

SEQ ID NO: 57317 - protein, 11 aa, Borrelia burgdorferi B31
DPTYQMQKIML

SEQ ID NO: 57318 - protein, 11 aa, Borrelia burgdorferi B31
SATLIKEPSAI

SEQ ID NO: 57319 - protein, 11 aa, Borrelia burgdorferi B31
AAYKEKGFEIL

SEQ ID NO: 57320 - protein, 11 aa, Borrelia burgdorferi B31
EPEKLEKISIL

SEQ ID NO: 57321 - protein, 9 aa, Borrelia burgdorferi B31
IDKLKFLSL

SEQ ID NO: 57322 - protein, 9 aa, Borrelia burgdorferi B31
NEKFKNIAL

SEQ ID NO: 57323 - protein, 9 aa, Borrelia burgdorferi B31
IIKKVKIKL

SEQ ID NO: 57324 - protein, 9 aa, Borrelia burgdorferi B31
QMQKIMLSM

SEQ ID NO: 57325 - protein, 9 aa, Borrelia burgdorferi B31
IFYFKQIAL

SEQ ID NO: 57326 - protein, 9 aa, Borrelia burgdorferi B31
FIIFRLCYI

SEQ ID NO: 57327 - protein, 9 aa, Borrelia burgdorferi B31
YLRFIKGII

SEQ ID NO: 57328 - protein, 10 aa, Borrelia burgdorferi B31
KIKLKRKSCM

SEQ ID NO: 57329 - protein, 10 aa, Borrelia burgdorferi B31
YIIKKVKIKL

SEQ ID NO: 57330 - protein, 11 aa, Borrelia burgdorferi B31
HIKEVNLSATL

SEQ ID NO: 57331 - protein, 11 aa, Borrelia burgdorferi B31
YFKQIALFIIF

SEQ ID NO: 57332 - protein, 11 aa, Borrelia burgdorferi B31
ILIFYFKQIAL

SEQ ID NO: 57333 - protein, 9 aa, Borrelia burgdorferi B31
KQIALFIIF

SEQ ID NO: 57334 - protein, 9 aa, Borrelia burgdorferi B31
YLNKEGLEY

SEQ ID NO: 57335 - protein, 9 aa, Borrelia burgdorferi B31
SSVDGFVSF

SEQ ID NO: 57336 - protein, 9 aa, Borrelia burgdorferi B31
WSSDGKTGY

SEQ ID NO: 57337 - protein, 9 aa, Borrelia burgdorferi B31
RMNESQKSI

SEQ ID NO: 57338 - protein, 9 aa, Borrelia burgdorferi B31
FGVGFYSAF

SEQ ID NO: 57339 - protein, 9 aa, Borrelia burgdorferi B31
IAKSGTKEF

SEQ ID NO: 57340 - protein, 9 aa, Borrelia burgdorferi B31
QMQKIMLSM

SEQ ID NO: 57341 - protein, 9 aa, Borrelia burgdorferi B31
KFINIINEF

SEQ ID NO: 57342 - protein, 9 aa, Borrelia burgdorferi B31
FLSLTNEKF

SEQ ID NO: 57343 - protein, 9 aa, Borrelia burgdorferi B31
KFSEFSKEF

SEQ ID NO: 57344 - protein, 9 aa, Borrelia burgdorferi B31
LLYLIIHSL

SEQ ID NO: 57345 - protein, 9 aa, Borrelia burgdorferi B31
KENPIVAAY

SEQ ID NO: 57346 - protein, 9 aa, Borrelia burgdorferi B31
KIQEIIKKY

SEQ ID NO: 57347 - protein, 9 aa, Borrelia burgdorferi B31
LFIIFRLCY

SEQ ID NO: 57348 - protein, 9 aa, Borrelia burgdorferi B31
AILNLIPEY

SEQ ID NO: 57349 - protein, 9 aa, Borrelia burgdorferi B31
KSASLIGQF

SEQ ID NO: 57350 - protein, 9 aa, Borrelia burgdorferi B31
SLLPNYLRF

SEQ ID NO: 57351 - protein, 9 aa, Borrelia burgdorferi B31
TKAEGNLEY

SEQ ID NO: 57352 - protein, 9 aa, Borrelia burgdorferi B31
YQMQKIMLS

SEQ ID NO: 57353 - protein, 9 aa, Borrelia burgdorferi B31
KLNETTALW

SEQ ID NO: 57354 - protein, 9 aa, Borrelia burgdorferi B31
LIGQFGVGF

SEQ ID NO: 57355 - protein, 9 aa, Borrelia burgdorferi B31
NTKPGVKLF

SEQ ID NO: 57356 - protein, 9 aa, Borrelia burgdorferi B31
IKAEEYNEF

SEQ ID NO: 57357 - protein, 9 aa, Borrelia burgdorferi B31
INYPIYIKY

SEQ ID NO: 57358 - protein, 9 aa, Borrelia burgdorferi B31
IGQFGVGFY

SEQ ID NO: 57359 - protein, 9 aa, Borrelia burgdorferi B31
FYVPSKAPY

SEQ ID NO: 57360 - protein, 10 aa, Borrelia burgdorferi B31
YQMQKIMLSM

SEQ ID NO: 57361 - protein, 10 aa, Borrelia burgdorferi B31
RMNESQKSIY

SEQ ID NO: 57362 - protein, 10 aa, Borrelia burgdorferi B31
HTKAEGNLEY

SEQ ID NO: 57363 - protein, 10 aa, Borrelia burgdorferi B31
YSNHINYPIY

SEQ ID NO: 57364 - protein, 10 aa, Borrelia burgdorferi B31
LLYLIIHSLY

SEQ ID NO: 57365 - protein, 10 aa, Borrelia burgdorferi B31
SLIGQFGVGF

SEQ ID NO: 57366 - protein, 10 aa, Borrelia burgdorferi B31
LFYVPSKAPY

SEQ ID NO: 57367 - protein, 10 aa, Borrelia burgdorferi B31
IIIDSNDPTY

SEQ ID NO: 57368 - protein, 10 aa, Borrelia burgdorferi B31
KQFDTEVNDL

SEQ ID NO: 57369 - protein, 10 aa, Borrelia burgdorferi B31
ALFIIFRLCY

SEQ ID NO: 57370 - protein, 10 aa, Borrelia burgdorferi B31
SSSVDGFVSF

SEQ ID NO: 57371 - protein, 10 aa, Borrelia burgdorferi B31
VIAKSGTKEF

SEQ ID NO: 57372 - protein, 10 aa, Borrelia burgdorferi B31
GVKLFINRIF

SEQ ID NO: 57373 - protein, 10 aa, Borrelia burgdorferi B31
YLIIHSLYSH

SEQ ID NO: 57374 - protein, 10 aa, Borrelia burgdorferi B31
IVAAYKEKGF

SEQ ID NO: 57375 - protein, 10 aa, Borrelia burgdorferi B31
HINYPIYIKY

SEQ ID NO: 57376 - protein, 10 aa, Borrelia burgdorferi B31
ILIKDNGIGM

SEQ ID NO: 57377 - protein, 10 aa, Borrelia burgdorferi B31
IINEFIEKDF

SEQ ID NO: 57378 - protein, 10 aa, Borrelia burgdorferi B31
GQFGVGFYSA

SEQ ID NO: 57379 - protein, 10 aa, Borrelia burgdorferi B31
PSKAPYDLYY

SEQ ID NO: 57380 - protein, 10 aa, Borrelia burgdorferi B31
RFKSSSVDGF

SEQ ID NO: 57381 - protein, 10 aa, Borrelia burgdorferi B31
ALEPKIEISF

SEQ ID NO: 57382 - protein, 10 aa, Borrelia burgdorferi B31
QFGVGFYSAF

SEQ ID NO: 57383 - protein, 10 aa, Borrelia burgdorferi B31
LIGQFGVGFY

SEQ ID NO: 57384 - protein, 10 aa, Borrelia burgdorferi B31
KLEKISILLF

SEQ ID NO: 57385 - protein, 10 aa, Borrelia burgdorferi B31
EIKAEEYNEF

SEQ ID NO: 57386 - protein, 11 aa, Borrelia burgdorferi B31
GQFGVGFYSAF

SEQ ID NO: 57387 - protein, 11 aa, Borrelia burgdorferi B31
RMNESQKSIYY

SEQ ID NO: 57388 - protein, 11 aa, Borrelia burgdorferi B31
ILKENPIVAAY

SEQ ID NO: 57389 - protein, 11 aa, Borrelia burgdorferi B31
GVIAKSGTKEF

SEQ ID NO: 57390 - protein, 11 aa, Borrelia burgdorferi B31
SLIGQFGVGFY

SEQ ID NO: 57391 - protein, 11 aa, Borrelia burgdorferi B31
KLYLNKEGLEY

SEQ ID NO: 57392 - protein, 11 aa, Borrelia burgdorferi B31
KQIALFIIFRL

SEQ ID NO: 57393 - protein, 11 aa, Borrelia burgdorferi B31
NLFYVPSKAPY

SEQ ID NO: 57394 - protein, 11 aa, Borrelia burgdorferi B31
KQFDTEVNDLL

SEQ ID NO: 57395 - protein, 11 aa, Borrelia burgdorferi B31
YFKQIALFIIF

SEQ ID NO: 57396 - protein, 11 aa, Borrelia burgdorferi B31
KSSSVDGFVSF

SEQ ID NO: 57397 - protein, 11 aa, Borrelia burgdorferi B31
AIIIDSNDPTY

SEQ ID NO: 57398 - protein, 11 aa, Borrelia burgdorferi B31
YIWSSDGKTGY

SEQ ID NO: 57399 - protein, 11 aa, Borrelia burgdorferi B31
IIKKYSNHINY

SEQ ID NO: 57400 - protein, 11 aa, Borrelia burgdorferi B31
TSKKALESDAY

SEQ ID NO: 57401 - protein, 11 aa, Borrelia burgdorferi B31
IALEPKIEISF

SEQ ID NO: 57402 - protein, 11 aa, Borrelia burgdorferi B31
LIFYFKQIALF

SEQ ID NO: 57403 - protein, 11 aa, Borrelia burgdorferi B31
YVPSKAPYDLY

SEQ ID NO: 57404 - protein, 11 aa, Borrelia burgdorferi B31
ASLIGQFGVGF

SEQ ID NO: 57405 - protein, 11 aa, Borrelia burgdorferi B31
HIKEVNLSATL

SEQ ID NO: 57406 - protein, 11 aa, Borrelia burgdorferi B31
ILIFYFKQIAL

SEQ ID NO: 57407 - protein, 11 aa, Borrelia burgdorferi B31
IALFIIFRLCY

SEQ ID NO: 57408 - protein, 11 aa, Borrelia burgdorferi B31
RIFITDSEGSL

SEQ ID NO: 57409 - protein, 11 aa, Borrelia burgdorferi B31
KNKSEIKAEEY

SEQ ID NO: 57410 - protein, 9 aa, Borrelia burgdorferi B31
FRLCYIIKK

SEQ ID NO: 57411 - protein, 9 aa, Borrelia burgdorferi B31
KQIALFIIF

SEQ ID NO: 57412 - protein, 9 aa, Borrelia burgdorferi B31
LQQNKILSK

SEQ ID NO: 57413 - protein, 9 aa, Borrelia burgdorferi B31
GRCIKEGVY

SEQ ID NO: 57414 - protein, 9 aa, Borrelia burgdorferi B31
KKVKIKLKR

SEQ ID NO: 57415 - protein, 9 aa, Borrelia burgdorferi B31
SREILQQNK

SEQ ID NO: 57416 - protein, 10 aa, Borrelia burgdorferi B31
YQMQKIMLSM

SEQ ID NO: 57417 - protein, 10 aa, Borrelia burgdorferi B31
KRKSCMKKQF

SEQ ID NO: 57418 - protein, 10 aa, Borrelia burgdorferi B31
FRLCYIIKKV

SEQ ID NO: 57419 - protein, 10 aa, Borrelia burgdorferi B31
KQIALFIIFR

SEQ ID NO: 57420 - protein, 11 aa, Borrelia burgdorferi B31
FRLCYIIKKVK

SEQ ID NO: 57421 - protein, 11 aa, Borrelia burgdorferi B31
GQFGVGFYSAF

SEQ ID NO: 57422 - protein, 11 aa, Borrelia burgdorferi B31
IRFKSSSVDGF

SEQ ID NO: 57423 - protein, 11 aa, Borrelia burgdorferi B31
KQIALFIIFRL

SEQ ID NO: 57424 - protein, 11 aa, Borrelia burgdorferi B31
ERMNESQKSIY

SEQ ID NO: 57425 - protein, 11 aa, Borrelia burgdorferi B31
NREKLISLIRF

SEQ ID NO: 57426 - protein, 9 aa, Borrelia burgdorferi B31
MPSKNPGKF

SEQ ID NO: 57427 - protein, 9 aa, Borrelia burgdorferi B31
FYVPSKAPY

SEQ ID NO: 57428 - protein, 9 aa, Borrelia burgdorferi B31
FGVGFYSAF

SEQ ID NO: 57429 - protein, 9 aa, Borrelia burgdorferi B31
WSSDGKTGY

SEQ ID NO: 57430 - protein, 9 aa, Borrelia burgdorferi B31
IIDSNDPTY

SEQ ID NO: 57431 - protein, 9 aa, Borrelia burgdorferi B31
SSVDGFVSF

SEQ ID NO: 57432 - protein, 9 aa, Borrelia burgdorferi B31
KAEEYNEFY

SEQ ID NO: 57433 - protein, 9 aa, Borrelia burgdorferi B31
TKAEGNLEY

SEQ ID NO: 57434 - protein, 9 aa, Borrelia burgdorferi B31
IPEYEGLKL

SEQ ID NO: 57435 - protein, 9 aa, Borrelia burgdorferi B31
TTFDYENPL

SEQ ID NO: 57436 - protein, 9 aa, Borrelia burgdorferi B31
YLNKEGLEY

SEQ ID NO: 57437 - protein, 9 aa, Borrelia burgdorferi B31
IAKSGTKEF

SEQ ID NO: 57438 - protein, 9 aa, Borrelia burgdorferi B31
DTEVNDLLY

SEQ ID NO: 57439 - protein, 9 aa, Borrelia burgdorferi B31
NASDAIDKL

SEQ ID NO: 57440 - protein, 9 aa, Borrelia burgdorferi B31
YIKYSEPIM

SEQ ID NO: 57441 - protein, 9 aa, Borrelia burgdorferi B31
EILIMDDEL

SEQ ID NO: 57442 - protein, 9 aa, Borrelia burgdorferi B31
KENPIVAAY

SEQ ID NO: 57443 - protein, 9 aa, Borrelia burgdorferi B31
SILLFEEAM

SEQ ID NO: 57444 - protein, 9 aa, Borrelia burgdorferi B31
KFINIINEF

SEQ ID NO: 57445 - protein, 9 aa, Borrelia burgdorferi B31
LPLNVSREI

SEQ ID NO: 57446 - protein, 9 aa, Borrelia burgdorferi B31
KKALESDAY

SEQ ID NO: 57447 - protein, 9 aa, Borrelia burgdorferi B31
TFDYENPLM

SEQ ID NO: 57448 - protein, 9 aa, Borrelia burgdorferi B31
LISNASDAI

SEQ ID NO: 57449 - protein, 9 aa, Borrelia burgdorferi B31
YPIYIKYSE

SEQ ID NO: 57450 - protein, 9 aa, Borrelia burgdorferi B31
EKLNETTAL

SEQ ID NO: 57451 - protein, 9 aa, Borrelia burgdorferi B31
FYFKQIALF

SEQ ID NO: 57452 - protein, 9 aa, Borrelia burgdorferi B31
IIDCQDLPL

SEQ ID NO: 57453 - protein, 9 aa, Borrelia burgdorferi B31
AILNLIPEY

SEQ ID NO: 57454 - protein, 9 aa, Borrelia burgdorferi B31
SKAPYDLYY

SEQ ID NO: 57455 - protein, 9 aa, Borrelia burgdorferi B31
IKAEEYNEF

SEQ ID NO: 57456 - protein, 9 aa, Borrelia burgdorferi B31
MNESQKSIY

SEQ ID NO: 57457 - protein, 9 aa, Borrelia burgdorferi B31
NLEYTNLFY

SEQ ID NO: 57458 - protein, 9 aa, Borrelia burgdorferi B31
NPLMHIHTK

SEQ ID NO: 57459 - protein, 10 aa, Borrelia burgdorferi B31
EAILNLIPEY

SEQ ID NO: 57460 - protein, 10 aa, Borrelia burgdorferi B31
DPTYQMQKIM

SEQ ID NO: 57461 - protein, 10 aa, Borrelia burgdorferi B31
YSNHINYPIY

SEQ ID NO: 57462 - protein, 10 aa, Borrelia burgdorferi B31
IIIDSNDPTY

SEQ ID NO: 57463 - protein, 10 aa, Borrelia burgdorferi B31
VPSKAPYDLY

SEQ ID NO: 57464 - protein, 10 aa, Borrelia burgdorferi B31
LPLNVSREIL

SEQ ID NO: 57465 - protein, 10 aa, Borrelia burgdorferi B31
YPNTKPGVKL

SEQ ID NO: 57466 - protein, 10 aa, Borrelia burgdorferi B31
LFYVPSKAPY

SEQ ID NO: 57467 - protein, 10 aa, Borrelia burgdorferi B31
TTFDYENPLM

SEQ ID NO: 57468 - protein, 10 aa, Borrelia burgdorferi B31
ISILLFEEAM

SEQ ID NO: 57469 - protein, 10 aa, Borrelia burgdorferi B31
LKENPIVAAY

SEQ ID NO: 57470 - protein, 10 aa, Borrelia burgdorferi B31
QFGVGFYSAF

SEQ ID NO: 57471 - protein, 10 aa, Borrelia burgdorferi B31
SSSVDGFVSF

SEQ ID NO: 57472 - protein, 10 aa, Borrelia burgdorferi B31
FDTEVNDLLY

SEQ ID NO: 57473 - protein, 10 aa, Borrelia burgdorferi B31
NPNNKIVQNL

SEQ ID NO: 57474 - protein, 10 aa, Borrelia burgdorferi B31
YNEFYKNTTF

SEQ ID NO: 57475 - protein, 10 aa, Borrelia burgdorferi B31
FKQIALFIIF

SEQ ID NO: 57476 - protein, 10 aa, Borrelia burgdorferi B31
EGNLEYTNLF

SEQ ID NO: 57477 - protein, 10 aa, Borrelia burgdorferi B31
EFYKNTTFDY

SEQ ID NO: 57478 - protein, 10 aa, Borrelia burgdorferi B31
NKSEIKAEEY

SEQ ID NO: 57479 - protein, 10 aa, Borrelia burgdorferi B31
HTKAEGNLEY

SEQ ID NO: 57480 - protein, 10 aa, Borrelia burgdorferi B31
MDDELDEAIL

SEQ ID NO: 57481 - protein, 10 aa, Borrelia burgdorferi B31
IKAEEYNEFY

SEQ ID NO: 57482 - protein, 10 aa, Borrelia burgdorferi B31
YQMQKIMLSM

SEQ ID NO: 57483 - protein, 11 aa, Borrelia burgdorferi B31
YPNTKPGVKLF

SEQ ID NO: 57484 - protein, 11 aa, Borrelia burgdorferi B31
VPSKAPYDLYY

SEQ ID NO: 57485 - protein, 11 aa, Borrelia burgdorferi B31
YIWSSDGKTGY

SEQ ID NO: 57486 - protein, 11 aa, Borrelia burgdorferi B31
YPIYIKYSEPI

SEQ ID NO: 57487 - protein, 11 aa, Borrelia burgdorferi B31
NASDAIDKLKF

SEQ ID NO: 57488 - protein, 11 aa, Borrelia burgdorferi B31
IALFIIFRLCY

SEQ ID NO: 57489 - protein, 11 aa, Borrelia burgdorferi B31
YFKQIALFIIF

SEQ ID NO: 57490 - protein, 11 aa, Borrelia burgdorferi B31
DPTYQMQKIML

SEQ ID NO: 57491 - protein, 11 aa, Borrelia burgdorferi B31
IALEPKIEISF

SEQ ID NO: 57492 - protein, 11 aa, Borrelia burgdorferi B31
NLFYVPSKAPY

SEQ ID NO: 57493 - protein, 11 aa, Borrelia burgdorferi B31
ILKENPIVAAY

SEQ ID NO: 57494 - protein, 11 aa, Borrelia burgdorferi B31
LFEEAMLTSGM

SEQ ID NO: 57495 - protein, 11 aa, Borrelia burgdorferi B31
AIIIDSNDPTY

SEQ ID NO: 57496 - protein, 11 aa, Borrelia burgdorferi B31
TSKKALESDAY

SEQ ID NO: 57497 - protein, 11 aa, Borrelia burgdorferi B31
FVSFKEYKERM

SEQ ID NO: 57498 - protein, 11 aa, Borrelia burgdorferi B31
YVPSKAPYDLY

SEQ ID NO: 57499 - protein, 11 aa, Borrelia burgdorferi B31
QFDTEVNDLLY

SEQ ID NO: 57500 - protein, 11 aa, Borrelia burgdorferi B31
EPEKLEKISIL

SEQ ID NO: 57501 - protein, 11 aa, Borrelia burgdorferi B31
NPLMHIHTKAE

SEQ ID NO: 57502 - protein, 11 aa, Borrelia burgdorferi B31
LIFYFKQIALF

SEQ ID NO: 57503 - protein, 11 aa, Borrelia burgdorferi B31
SVDGFVSFKEY

SEQ ID NO: 57504 - protein, 11 aa, Borrelia burgdorferi B31
ERMNESQKSIY

SEQ ID NO: 57505 - protein, 11 aa, Borrelia burgdorferi B31
EVNDLLYLIIH

SEQ ID NO: 57506 - protein, 11 aa, Borrelia burgdorferi B31
DEAILNLIPEY

SEQ ID NO: 57507 - protein, 11 aa, Borrelia burgdorferi B31
EYNEFYKNTTF

SEQ ID NO: 57508 - protein, 11 aa, Borrelia burgdorferi B31
YKEKGFEILIM

SEQ ID NO: 57509 - protein, 9 aa, Borrelia burgdorferi B31
KEIKPILEL

SEQ ID NO: 57510 - protein, 9 aa, Borrelia burgdorferi B31
KENPIVAAY

SEQ ID NO: 57511 - protein, 9 aa, Borrelia burgdorferi B31
NEFYKNTTF

SEQ ID NO: 57512 - protein, 9 aa, Borrelia burgdorferi B31
EEAMLTSGM

SEQ ID NO: 57513 - protein, 9 aa, Borrelia burgdorferi B31
KEFINNLKQ

SEQ ID NO: 57514 - protein, 9 aa, Borrelia burgdorferi B31
NESQKSIYY

SEQ ID NO: 57515 - protein, 9 aa, Borrelia burgdorferi B31
EEFKDTLTK

SEQ ID NO: 57516 - protein, 9 aa, Borrelia burgdorferi B31
SEGSLLPNY

SEQ ID NO: 57517 - protein, 9 aa, Borrelia burgdorferi B31
REILQQNKI

SEQ ID NO: 57518 - protein, 9 aa, Borrelia burgdorferi B31
SEIKAEEYN

SEQ ID NO: 57519 - protein, 9 aa, Borrelia burgdorferi B31
TEIKLYLNK

SEQ ID NO: 57520 - protein, 9 aa, Borrelia burgdorferi B31
NEFIEKDFL

SEQ ID NO: 57521 - protein, 9 aa, Borrelia burgdorferi B31
KEVNLSATL

SEQ ID NO: 57522 - protein, 9 aa, Borrelia burgdorferi B31
SEFSKEFGR

SEQ ID NO: 57523 - protein, 9 aa, Borrelia burgdorferi B31
TEVNDLLYL

SEQ ID NO: 57524 - protein, 9 aa, Borrelia burgdorferi B31
LEKISILLF

SEQ ID NO: 57525 - protein, 9 aa, Borrelia burgdorferi B31
KEKGFEILI

SEQ ID NO: 57526 - protein, 9 aa, Borrelia burgdorferi B31
QEVKEIKPI

SEQ ID NO: 57527 - protein, 9 aa, Borrelia burgdorferi B31
KEILKDHIK

SEQ ID NO: 57528 - protein, 9 aa, Borrelia burgdorferi B31
KEIFLRELI

SEQ ID NO: 57529 - protein, 10 aa, Borrelia burgdorferi B31
REILQQNKIL

SEQ ID NO: 57530 - protein, 10 aa, Borrelia burgdorferi B31
REKLISLIRF

SEQ ID NO: 57531 - protein, 10 aa, Borrelia burgdorferi B31
DELDEAILNL

SEQ ID NO: 57532 - protein, 10 aa, Borrelia burgdorferi B31
KEIFLRELIS

SEQ ID NO: 57533 - protein, 10 aa, Borrelia burgdorferi B31
KEVNLSATLI

SEQ ID NO: 57534 - protein, 10 aa, Borrelia burgdorferi B31
SEGSLLPNYL

SEQ ID NO: 57535 - protein, 10 aa, Borrelia burgdorferi B31
AEGNLEYTNL

SEQ ID NO: 57536 - protein, 10 aa, Borrelia burgdorferi B31
EEFKDTLTKV

SEQ ID NO: 57537 - protein, 10 aa, Borrelia burgdorferi B31
EEKLNETTAL

SEQ ID NO: 57538 - protein, 10 aa, Borrelia burgdorferi B31
FEILIMDDEL

SEQ ID NO: 57539 - protein, 10 aa, Borrelia burgdorferi B31
KEKGFEILIM

SEQ ID NO: 57540 - protein, 10 aa, Borrelia burgdorferi B31
KEGLEYANKW

SEQ ID NO: 57541 - protein, 10 aa, Borrelia burgdorferi B31
EESGTEIKLY

SEQ ID NO: 57542 - protein, 10 aa, Borrelia burgdorferi B31
QEVKEIKPIL

SEQ ID NO: 57543 - protein, 10 aa, Borrelia burgdorferi B31
SEIKAEEYNE

SEQ ID NO: 57544 - protein, 10 aa, Borrelia burgdorferi B31
KEPSAIIIDS

SEQ ID NO: 57545 - protein, 10 aa, Borrelia burgdorferi B31
KEFINNLKQD

SEQ ID NO: 57546 - protein, 10 aa, Borrelia burgdorferi B31
TEVNDLLYLI

SEQ ID NO: 57547 - protein, 11 aa, Borrelia burgdorferi B31
SEIKAEEYNEF

SEQ ID NO: 57548 - protein, 11 aa, Borrelia burgdorferi B31
AEGNLEYTNLF

SEQ ID NO: 57549 - protein, 11 aa, Borrelia burgdorferi B31
SEFSKEFGRCI

SEQ ID NO: 57550 - protein, 11 aa, Borrelia burgdorferi B31
REILQQNKILS

SEQ ID NO: 57551 - protein, 11 aa, Borrelia burgdorferi B31
NEFYKNTTFDY

SEQ ID NO: 57552 - protein, 11 aa, Borrelia burgdorferi B31
KEILKDHIKEV

SEQ ID NO: 57553 - protein, 11 aa, Borrelia burgdorferi B31
EEKLNETTALW

SEQ ID NO: 57554 - protein, 11 aa, Borrelia burgdorferi B31
EEAMLTSGMPS

SEQ ID NO: 57555 - protein, 11 aa, Borrelia burgdorferi B31
EESGTEIKLYL

SEQ ID NO: 57556 - protein, 11 aa, Borrelia burgdorferi B31
EEFKDTLTKVK

SEQ ID NO: 57557 - protein, 11 aa, Borrelia burgdorferi B31
TEVNDLLYLII

SEQ ID NO: 57558 - protein, 11 aa, Borrelia burgdorferi B31
DEAILNLIPEY

SEQ ID NO: 57559 - protein, 11 aa, Borrelia burgdorferi B31
RELISNASDAI

SEQ ID NO: 57560 - protein, 11 aa, Borrelia burgdorferi B31
KEVNLSATLIK

SEQ ID NO: 57561 - protein, 11 aa, Borrelia burgdorferi B31
DELDEAILNLI

SEQ ID NO: 57562 - protein, 11 aa, Borrelia burgdorferi B31
TEIKLYLNKEG

SEQ ID NO: 57563 - protein, 11 aa, Borrelia burgdorferi B31
KEESGTEIKLY

SEQ ID NO: 57564 - protein, 11 aa, Borrelia burgdorferi B31
KENILKENPIV

SEQ ID NO: 57565 - protein, 11 aa, Borrelia burgdorferi B31
KEFGRCIKEGV

SEQ ID NO: 57566 - protein, 9 aa, Borrelia burgdorferi B31
LPLNVSREI

SEQ ID NO: 57567 - protein, 9 aa, Borrelia burgdorferi B31
IALEPKIEI

SEQ ID NO: 57568 - protein, 9 aa, Borrelia burgdorferi B31
NPGKFINII

SEQ ID NO: 57569 - protein, 10 aa, Borrelia burgdorferi B31
MPSKNPGKFI

SEQ ID NO: 57570 - protein, 10 aa, Borrelia burgdorferi B31
LPLNVSREIL

SEQ ID NO: 57571 - protein, 10 aa, Borrelia burgdorferi B31
EPEKLEKISI

SEQ ID NO: 57572 - protein, 10 aa, Borrelia burgdorferi B31
YPNTKPGVKL

SEQ ID NO: 57573 - protein, 11 aa, Borrelia burgdorferi B31
YPIYIKYSEPI

SEQ ID NO: 57574 - protein, 11 aa, Borrelia burgdorferi B31
LPNYLRFIKGI

SEQ ID NO: 57575 - protein, 11 aa, Borrelia burgdorferi B31
KPGVKLFINRI

SEQ ID NO: 57576 - protein, 9 aa, Borrelia burgdorferi B31
EGLEYANKW

SEQ ID NO: 57577 - protein, 9 aa, Borrelia burgdorferi B31
KLNETTALW

SEQ ID NO: 57578 - protein, 10 aa, Borrelia burgdorferi B31
KALESDAYIW

SEQ ID NO: 57579 - protein, 10 aa, Borrelia burgdorferi B31
HTKAEGNLEY

SEQ ID NO: 57580 - protein, 9 aa, Borrelia burgdorferi
YLLGIGLIL

SEQ ID NO: 57581 - protein, 9 aa, Borrelia burgdorferi
FTLEGTLAA

SEQ ID NO: 57582 - protein, 9 aa, Borrelia burgdorferi
KTSTLTISV

SEQ ID NO: 57583 - protein, 9 aa, Borrelia burgdorferi
FTKEDTITV

SEQ ID NO: 57584 - protein, 9 aa, Borrelia burgdorferi
ALIACKQNV

SEQ ID NO: 57585 - protein, 9 aa, Borrelia burgdorferi
LLGIGLILA

SEQ ID NO: 57586 - protein, 9 aa, Borrelia burgdorferi
SLEATVDKL

SEQ ID NO: 57587 - protein, 9 aa, Borrelia burgdorferi
ILKSGEITV

SEQ ID NO: 57588 - protein, 9 aa, Borrelia burgdorferi
KVTEGTVVL

SEQ ID NO: 57589 - protein, 9 aa, Borrelia burgdorferi
STLDEKNSV

SEQ ID NO: 57590 - protein, 9 aa, Borrelia burgdorferi
TLVSKKVTL

SEQ ID NO: 57591 - protein, 9 aa, Borrelia burgdorferi
GIGLILALI

SEQ ID NO: 57592 - protein, 10 aa, Borrelia burgdorferi
YLLGIGLILA

SEQ ID NO: 57593 - protein, 10 aa, Borrelia burgdorferi
TLDEKNSVSV

SEQ ID NO: 57594 - protein, 10 aa, Borrelia burgdorferi
ALDDSDTTQA

SEQ ID NO: 57595 - protein, 10 aa, Borrelia burgdorferi
LLGIGLILAL

SEQ ID NO: 57596 - protein, 10 aa, Borrelia burgdorferi
NILKSGEITV

SEQ ID NO: 57597 - protein, 10 aa, Borrelia burgdorferi
TLAADGKTTL

SEQ ID NO: 57598 - protein, 10 aa, Borrelia burgdorferi
VLKDFTLEGT

SEQ ID NO: 57599 - protein, 10 aa, Borrelia burgdorferi
YSLEATVDKL

SEQ ID NO: 57600 - protein, 11 aa, Borrelia burgdorferi
YLLGIGLILAL

SEQ ID NO: 57601 - protein, 11 aa, Borrelia burgdorferi
LVFTKEDTITV

SEQ ID NO: 57602 - protein, 11 aa, Borrelia burgdorferi
LLGIGLILALI

SEQ ID NO: 57603 - protein, 11 aa, Borrelia burgdorferi
ILALIACKQNV

SEQ ID NO: 57604 - protein, 11 aa, Borrelia burgdorferi
STLDEKNSVSV

SEQ ID NO: 57605 - protein, 11 aa, Borrelia burgdorferi
ALDDSDTTQAT

SEQ ID NO: 57606 - protein, 11 aa, Borrelia burgdorferi
VLKDFTLEGTL

SEQ ID NO: 57607 - protein, 11 aa, Borrelia burgdorferi
SLEATVDKLEL

SEQ ID NO: 57608 - protein, 11 aa, Borrelia burgdorferi
ILKSGEITVAL

SEQ ID NO: 57609 - protein, 11 aa, Borrelia burgdorferi
ALIACKQNVST

SEQ ID NO: 57610 - protein, 11 aa, Borrelia burgdorferi
TTLKVTEGTVV

SEQ ID NO: 57611 - protein, 11 aa, Borrelia burgdorferi
LAADGKTTLKV

SEQ ID NO: 57612 - protein, 11 aa, Borrelia burgdorferi
LIACKQNVSTL

SEQ ID NO: 57613 - protein, 9 aa, Borrelia burgdorferi
VVLSKNILK

SEQ ID NO: 57614 - protein, 9 aa, Borrelia burgdorferi
KTKNLVFTK

SEQ ID NO: 57615 - protein, 9 aa, Borrelia burgdorferi
LVSKKVTLK

SEQ ID NO: 57616 - protein, 9 aa, Borrelia burgdorferi
LILALIACK

SEQ ID NO: 57617 - protein, 9 aa, Borrelia burgdorferi
LTISVNSQK

SEQ ID NO: 57618 - protein, 9 aa, Borrelia burgdorferi
KAVEITTLK

SEQ ID NO: 57619 - protein, 9 aa, Borrelia burgdorferi
AADGKTTLK

SEQ ID NO: 57620 - protein, 9 aa, Borrelia burgdorferi
ISVNSQKTK

SEQ ID NO: 57621 - protein, 9 aa, Borrelia burgdorferi
RANGTRLEY

SEQ ID NO: 57622 - protein, 9 aa, Borrelia burgdorferi
SQTKFEIFK

SEQ ID NO: 57623 - protein, 9 aa, Borrelia burgdorferi
KSDGSGKAK

SEQ ID NO: 57624 - protein, 9 aa, Borrelia burgdorferi
TQATKKTGK

SEQ ID NO: 57625 - protein, 9 aa, Borrelia burgdorferi
MTELVSKEK

SEQ ID NO: 57626 - protein, 10 aa, Borrelia burgdorferi
TLVSKKVTLK

SEQ ID NO: 57627 - protein, 10 aa, Borrelia burgdorferi
TLTISVNSQK

SEQ ID NO: 57628 - protein, 10 aa, Borrelia burgdorferi
TVVLSKNILK

SEQ ID NO: 57629 - protein, 10 aa, Borrelia burgdorferi
GLILALIACK

SEQ ID NO: 57630 - protein, 10 aa, Borrelia burgdorferi
TLKELKNALK

SEQ ID NO: 57631 - protein, 10 aa, Borrelia burgdorferi
LSQTKFEIFK

SEQ ID NO: 57632 - protein, 10 aa, Borrelia burgdorferi
LAADGKTTLK

SEQ ID NO: 57633 - protein, 10 aa, Borrelia burgdorferi
VTEGTVVLSK

SEQ ID NO: 57634 - protein, 10 aa, Borrelia burgdorferi
KLELKGTSDK

SEQ ID NO: 57635 - protein, 10 aa, Borrelia burgdorferi
TTQATKKTGK

SEQ ID NO: 57636 - protein, 10 aa, Borrelia burgdorferi
GMTELVSKEK

SEQ ID NO: 57637 - protein, 10 aa, Borrelia burgdorferi
KYSLEATVDK

SEQ ID NO: 57638 - protein, 10 aa, Borrelia burgdorferi
KQNVSTLDEK

SEQ ID NO: 57639 - protein, 10 aa, Borrelia burgdorferi
TIADDLSQTK

SEQ ID NO: 57640 - protein, 10 aa, Borrelia burgdorferi
TISVNSQKTK

SEQ ID NO: 57641 - protein, 10 aa, Borrelia burgdorferi
KEDAKTLVSK

SEQ ID NO: 57642 - protein, 10 aa, Borrelia burgdorferi
GSGKAKEVLK

SEQ ID NO: 57643 - protein, 10 aa, Borrelia burgdorferi
KTIVRANGTR

SEQ ID NO: 57644 - protein, 10 aa, Borrelia burgdorferi
GTLEGEKTDK

SEQ ID NO: 57645 - protein, 10 aa, Borrelia burgdorferi
GKAVEITTLK

SEQ ID NO: 57646 - protein, 10 aa, Borrelia burgdorferi
GTRLEYTDIK

SEQ ID NO: 57647 - protein, 10 aa, Borrelia burgdorferi
VSKKVTLKDK

SEQ ID NO: 57648 - protein, 10 aa, Borrelia burgdorferi
IKSDGSGKAK

SEQ ID NO: 57649 - protein, 11 aa, Borrelia burgdorferi
TLAADGKTTLK

SEQ ID NO: 57650 - protein, 11 aa, Borrelia burgdorferi
STLTISVNSQK

SEQ ID NO: 57651 - protein, 11 aa, Borrelia burgdorferi
KTLVSKKVTLK

SEQ ID NO: 57652 - protein, 11 aa, Borrelia burgdorferi
KVTEGTVVLSK

SEQ ID NO: 57653 - protein, 11 aa, Borrelia burgdorferi
TTLKELKNALK

SEQ ID NO: 57654 - protein, 11 aa, Borrelia burgdorferi
LTISVNSQKTK

SEQ ID NO: 57655 - protein, 11 aa, Borrelia burgdorferi
GTVVLSKNILK

SEQ ID NO: 57656 - protein, 11 aa, Borrelia burgdorferi
FTKEDTITVQK

SEQ ID NO: 57657 - protein, 11 aa, Borrelia burgdorferi
IVRANGTRLEY

SEQ ID NO: 57658 - protein, 11 aa, Borrelia burgdorferi
TLKDKSSTEEK

SEQ ID NO: 57659 - protein, 11 aa, Borrelia burgdorferi
LVSKKVTLKDK

SEQ ID NO: 57660 - protein, 11 aa, Borrelia burgdorferi
KFNEKGETSEK

SEQ ID NO: 57661 - protein, 11 aa, Borrelia burgdorferi
LTIADDLSQTK

SEQ ID NO: 57662 - protein, 11 aa, Borrelia burgdorferi
SQKTKNLVFTK

SEQ ID NO: 57663 - protein, 11 aa, Borrelia burgdorferi
KSSTEEKFNEK

SEQ ID NO: 57664 - protein, 11 aa, Borrelia burgdorferi
ATKKTGKWDSK

SEQ ID NO: 57665 - protein, 9 aa, Borrelia burgdorferi
VVLSKNILK

SEQ ID NO: 57666 - protein, 9 aa, Borrelia burgdorferi
KTKNLVFTK

SEQ ID NO: 57667 - protein, 9 aa, Borrelia burgdorferi
SQTKFEIFK

SEQ ID NO: 57668 - protein, 9 aa, Borrelia burgdorferi
LTISVNSQK

SEQ ID NO: 57669 - protein, 9 aa, Borrelia burgdorferi
ATVDKLELK

SEQ ID NO: 57670 - protein, 9 aa, Borrelia burgdorferi
LILALIACK

SEQ ID NO: 57671 - protein, 9 aa, Borrelia burgdorferi
STEEKFNEK

SEQ ID NO: 57672 - protein, 9 aa, Borrelia burgdorferi
KAVEITTLK

SEQ ID NO: 57673 - protein, 9 aa, Borrelia burgdorferi
LVSKKVTLK

SEQ ID NO: 57674 - protein, 9 aa, Borrelia burgdorferi
MTELVSKEK

SEQ ID NO: 57675 - protein, 9 aa, Borrelia burgdorferi
AADGKTTLK

SEQ ID NO: 57676 - protein, 9 aa, Borrelia burgdorferi
SAGTNLEGK

SEQ ID NO: 57677 - protein, 9 aa, Borrelia burgdorferi
YSLEATVDK

SEQ ID NO: 57678 - protein, 9 aa, Borrelia burgdorferi
GSGTLEGEK

SEQ ID NO: 57679 - protein, 9 aa, Borrelia burgdorferi
TQATKKTGK

SEQ ID NO: 57680 - protein, 9 aa, Borrelia burgdorferi
RANGTRLEY

SEQ ID NO: 57681 - protein, 9 aa, Borrelia burgdorferi
IADDLSQTK

SEQ ID NO: 57682 - protein, 9 aa, Borrelia burgdorferi
ISVNSQKTK

SEQ ID NO: 57683 - protein, 9 aa, Borrelia burgdorferi
KSDGSGKAK

SEQ ID NO: 57684 - protein, 9 aa, Borrelia burgdorferi
GGMTELVSK

SEQ ID NO: 57685 - protein, 9 aa, Borrelia burgdorferi
TEGTVVLSK

SEQ ID NO: 57686 - protein, 9 aa, Borrelia burgdorferi
EITTLKELK

SEQ ID NO: 57687 - protein, 9 aa, Borrelia burgdorferi
TIVRANGTR

SEQ ID NO: 57688 - protein, 10 aa, Borrelia burgdorferi
TVVLSKNILK

SEQ ID NO: 57689 - protein, 10 aa, Borrelia burgdorferi
TTQATKKTGK

SEQ ID NO: 57690 - protein, 10 aa, Borrelia burgdorferi
TIADDLSQTK

SEQ ID NO: 57691 - protein, 10 aa, Borrelia burgdorferi
VTEGTVVLSK

SEQ ID NO: 57692 - protein, 10 aa, Borrelia burgdorferi
LSQTKFEIFK

SEQ ID NO: 57693 - protein, 10 aa, Borrelia burgdorferi
SSTEEKFNEK

SEQ ID NO: 57694 - protein, 10 aa, Borrelia burgdorferi
GLILALIACK

SEQ ID NO: 57695 - protein, 10 aa, Borrelia burgdorferi
KQNVSTLDEK

SEQ ID NO: 57696 - protein, 10 aa, Borrelia burgdorferi
TLTISVNSQK

SEQ ID NO: 57697 - protein, 10 aa, Borrelia burgdorferi
TLVSKKVTLK

SEQ ID NO: 57698 - protein, 10 aa, Borrelia burgdorferi
TISVNSQKTK

SEQ ID NO: 57699 - protein, 10 aa, Borrelia burgdorferi
LAADGKTTLK

SEQ ID NO: 57700 - protein, 10 aa, Borrelia burgdorferi
GMTELVSKEK

SEQ ID NO: 57701 - protein, 10 aa, Borrelia burgdorferi
TLKELKNALK

SEQ ID NO: 57702 - protein, 10 aa, Borrelia burgdorferi
KTIVRANGTR

SEQ ID NO: 57703 - protein, 10 aa, Borrelia burgdorferi
GSGKAKEVLK

SEQ ID NO: 57704 - protein, 10 aa, Borrelia burgdorferi
GTLEGEKTDK

SEQ ID NO: 57705 - protein, 10 aa, Borrelia burgdorferi
VSKKVTLKDK

SEQ ID NO: 57706 - protein, 10 aa, Borrelia burgdorferi
GTRLEYTDIK

SEQ ID NO: 57707 - protein, 10 aa, Borrelia burgdorferi
KLELKGTSDK

SEQ ID NO: 57708 - protein, 10 aa, Borrelia burgdorferi
DSAGTNLEGK

SEQ ID NO: 57709 - protein, 11 aa, Borrelia burgdorferi
STLTISVNSQK

SEQ ID NO: 57710 - protein, 11 aa, Borrelia burgdorferi
TTLKELKNALK

SEQ ID NO: 57711 - protein, 11 aa, Borrelia burgdorferi
KVTEGTVVLSK

SEQ ID NO: 57712 - protein, 11 aa, Borrelia burgdorferi
KTLVSKKVTLK

SEQ ID NO: 57713 - protein, 11 aa, Borrelia burgdorferi
GTVVLSKNILK

SEQ ID NO: 57714 - protein, 11 aa, Borrelia burgdorferi
LTIADDLSQTK

SEQ ID NO: 57715 - protein, 11 aa, Borrelia burgdorferi
TLAADGKTTLK

SEQ ID NO: 57716 - protein, 11 aa, Borrelia burgdorferi
AVEITTLKELK

SEQ ID NO: 57717 - protein, 11 aa, Borrelia burgdorferi
LTISVNSQKTK

SEQ ID NO: 57718 - protein, 11 aa, Borrelia burgdorferi
SQKTKNLVFTK

SEQ ID NO: 57719 - protein, 11 aa, Borrelia burgdorferi
KSSTEEKFNEK

SEQ ID NO: 57720 - protein, 11 aa, Borrelia burgdorferi
ATKKTGKWDSK

SEQ ID NO: 57721 - protein, 11 aa, Borrelia burgdorferi
TLKDKSSTEEK

SEQ ID NO: 57722 - protein, 11 aa, Borrelia burgdorferi
FTKEDTITVQK

SEQ ID NO: 57723 - protein, 11 aa, Borrelia burgdorferi
TLEGTLAADGK

SEQ ID NO: 57724 - protein, 11 aa, Borrelia burgdorferi
LVSKKVTLKDK

SEQ ID NO: 57725 - protein, 11 aa, Borrelia burgdorferi
MTELVSKEKDK

SEQ ID NO: 57726 - protein, 11 aa, Borrelia burgdorferi
DLSQTKFEIFK

SEQ ID NO: 57727 - protein, 11 aa, Borrelia burgdorferi
YTDIKSDGSGK

SEQ ID NO: 57728 - protein, 11 aa, Borrelia burgdorferi
LVSKEKDKDGK

SEQ ID NO: 57729 - protein, 11 aa, Borrelia burgdorferi
KFNEKGETSEK

SEQ ID NO: 57730 - protein, 11 aa, Borrelia burgdorferi
IGLILALIACK

SEQ ID NO: 57731 - protein, 9 aa, Borrelia burgdorferi
KYLLGIGLI

SEQ ID NO: 57732 - protein, 9 aa, Borrelia burgdorferi
KWDSKTSTL

SEQ ID NO: 57733 - protein, 9 aa, Borrelia burgdorferi
KYDSAGTNL

SEQ ID NO: 57734 - protein, 10 aa, Borrelia burgdorferi
KYLLGIGLIL

SEQ ID NO: 57735 - protein, 11 aa, Borrelia burgdorferi
KWDSKTSTLTI

SEQ ID NO: 57736 - protein, 11 aa, Borrelia burgdorferi
KYSLEATVDKL

SEQ ID NO: 57737 - protein, 11 aa, Borrelia burgdorferi
IVRANGTRLEY

SEQ ID NO: 57738 - protein, 11 aa, Borrelia burgdorferi
TIADDLSQTKF

SEQ ID NO: 57739 - protein, 9 aa, Borrelia burgdorferi
LTISVNSQK

SEQ ID NO: 57740 - protein, 9 aa, Borrelia burgdorferi
ETSEKTIVR

SEQ ID NO: 57741 - protein, 9 aa, Borrelia burgdorferi
MTELVSKEK

SEQ ID NO: 57742 - protein, 9 aa, Borrelia burgdorferi
EITTLKELK

SEQ ID NO: 57743 - protein, 9 aa, Borrelia burgdorferi
TIVRANGTR

SEQ ID NO: 57744 - protein, 9 aa, Borrelia burgdorferi
KAVEITTLK

SEQ ID NO: 57745 - protein, 9 aa, Borrelia burgdorferi
DAKTLVSKK

SEQ ID NO: 57746 - protein, 9 aa, Borrelia burgdorferi
KTKNLVFTK

SEQ ID NO: 57747 - protein, 9 aa, Borrelia burgdorferi
STEEKFNEK

SEQ ID NO: 57748 - protein, 9 aa, Borrelia burgdorferi
ATVDKLELK

SEQ ID NO: 57749 - protein, 9 aa, Borrelia burgdorferi
LVSKKVTLK

SEQ ID NO: 57750 - protein, 9 aa, Borrelia burgdorferi
SQTKFEIFK

SEQ ID NO: 57751 - protein, 9 aa, Borrelia burgdorferi
YSLEATVDK

SEQ ID NO: 57752 - protein, 9 aa, Borrelia burgdorferi
EGTLAADGK

SEQ ID NO: 57753 - protein, 9 aa, Borrelia burgdorferi
ISVNSQKTK

SEQ ID NO: 57754 - protein, 9 aa, Borrelia burgdorferi
LILALIACK

SEQ ID NO: 57755 - protein, 9 aa, Borrelia burgdorferi
DIKSDGSGK

SEQ ID NO: 57756 - protein, 9 aa, Borrelia burgdorferi
VVLSKNILK

SEQ ID NO: 57757 - protein, 9 aa, Borrelia burgdorferi
EDAKTLVSK

SEQ ID NO: 57758 - protein, 9 aa, Borrelia burgdorferi
DSDTTQATK

SEQ ID NO: 57759 - protein, 9 aa, Borrelia burgdorferi
SAGTNLEGK

SEQ ID NO: 57760 - protein, 10 aa, Borrelia burgdorferi
TVVLSKNILK

SEQ ID NO: 57761 - protein, 10 aa, Borrelia burgdorferi
TLTISVNSQK

SEQ ID NO: 57762 - protein, 10 aa, Borrelia burgdorferi
EATVDKLELK

SEQ ID NO: 57763 - protein, 10 aa, Borrelia burgdorferi
TIADDLSQTK

SEQ ID NO: 57764 - protein, 10 aa, Borrelia burgdorferi
DSAGTNLEGK

SEQ ID NO: 57765 - protein, 10 aa, Borrelia burgdorferi
TTQATKKTGK

SEQ ID NO: 57766 - protein, 10 aa, Borrelia burgdorferi
LAADGKTTLK

SEQ ID NO: 57767 - protein, 10 aa, Borrelia burgdorferi
KTIVRANGTR

SEQ ID NO: 57768 - protein, 10 aa, Borrelia burgdorferi
TISVNSQKTK

SEQ ID NO: 57769 - protein, 10 aa, Borrelia burgdorferi
TLVSKKVTLK

SEQ ID NO: 57770 - protein, 10 aa, Borrelia burgdorferi
SSTEEKFNEK

SEQ ID NO: 57771 - protein, 10 aa, Borrelia burgdorferi
TLKELKNALK

SEQ ID NO: 57772 - protein, 10 aa, Borrelia burgdorferi
LSQTKFEIFK

SEQ ID NO: 57773 - protein, 10 aa, Borrelia burgdorferi
VTEGTVVLSK

SEQ ID NO: 57774 - protein, 10 aa, Borrelia burgdorferi
EDAKTLVSKK

SEQ ID NO: 57775 - protein, 10 aa, Borrelia burgdorferi
DSDTTQATKK

SEQ ID NO: 57776 - protein, 10 aa, Borrelia burgdorferi
GLILALIACK

SEQ ID NO: 57777 - protein, 9 aa, Borrelia burgdorferi
IVRANGTRL

SEQ ID NO: 57778 - protein, 9 aa, Borrelia burgdorferi
KVTEGTVVL

SEQ ID NO: 57779 - protein, 9 aa, Borrelia burgdorferi
LAADGKTTL

SEQ ID NO: 57780 - protein, 9 aa, Borrelia burgdorferi
LPGGMTELV

SEQ ID NO: 57781 - protein, 9 aa, Borrelia burgdorferi
TVVLSKNIL

SEQ ID NO: 57782 - protein, 11 aa, Borrelia burgdorferi
KAVEITTLKEL

SEQ ID NO: 57783 - protein, 9 aa, Borrelia burgdorferi
TLKELKNAL

SEQ ID NO: 57784 - protein, 11 aa, Borrelia burgdorferi
ILKSGEITVAL

SEQ ID NO: 57785 - protein, 11 aa, Borrelia burgdorferi
YLLGIGLILAL

SEQ ID NO: 57786 - protein, 11 aa, Borrelia burgdorferi
TLKVTEGTVVL

SEQ ID NO: 57787 - protein, 9 aa, Borrelia burgdorferi
SQKTKNLVF

SEQ ID NO: 57788 - protein, 9 aa, Borrelia burgdorferi
RANGTRLEY

SEQ ID NO: 57789 - protein, 9 aa, Borrelia burgdorferi
YLLGIGLIL

SEQ ID NO: 57790 - protein, 9 aa, Borrelia burgdorferi
KVTEGTVVL

SEQ ID NO: 57791 - protein, 9 aa, Borrelia burgdorferi
TLKELKNAL

SEQ ID NO: 57792 - protein, 9 aa, Borrelia burgdorferi
KAKEVLKDF

SEQ ID NO: 57793 - protein, 9 aa, Borrelia burgdorferi
IVRANGTRL

SEQ ID NO: 57794 - protein, 9 aa, Borrelia burgdorferi
LGIGLILAL

SEQ ID NO: 57795 - protein, 10 aa, Borrelia burgdorferi
TLAADGKTTL

SEQ ID NO: 57796 - protein, 11 aa, Borrelia burgdorferi
IVRANGTRLEY

SEQ ID NO: 57797 - protein, 11 aa, Borrelia burgdorferi
YLLGIGLILAL

SEQ ID NO: 57798 - protein, 11 aa, Borrelia burgdorferi
VQKYDSAGTNL

SEQ ID NO: 57799 - protein, 11 aa, Borrelia burgdorferi
ILKSGEITVAL

SEQ ID NO: 57800 - protein, 11 aa, Borrelia burgdorferi
VSKEKDKDGKY

SEQ ID NO: 57801 - protein, 11 aa, Borrelia burgdorferi
VLKDFTLEGTL

SEQ ID NO: 57802 - protein, 11 aa, Borrelia burgdorferi
TLKVTEGTVVL

SEQ ID NO: 57803 - protein, 11 aa, Borrelia burgdorferi
VNSQKTKNLVF

SEQ ID NO: 57804 - protein, 9 aa, Borrelia burgdorferi
KKYLLGIGL

SEQ ID NO: 57805 - protein, 10 aa, Borrelia burgdorferi
VRANGTRLEY

SEQ ID NO: 57806 - protein, 10 aa, Borrelia burgdorferi
GKWDSKTSTL

SEQ ID NO: 57807 - protein, 11 aa, Borrelia burgdorferi
KKYLLGIGLIL

SEQ ID NO: 57808 - protein, 9 aa, Borrelia burgdorferi
LAADGKTTL

SEQ ID NO: 57809 - protein, 9 aa, Borrelia burgdorferi
RANGTRLEY

SEQ ID NO: 57810 - protein, 9 aa, Borrelia burgdorferi
FTLEGTLAA

SEQ ID NO: 57811 - protein, 9 aa, Borrelia burgdorferi
TVVLSKNIL

SEQ ID NO: 57812 - protein, 9 aa, Borrelia burgdorferi
VALDDSDTT

SEQ ID NO: 57813 - protein, 9 aa, Borrelia burgdorferi
YLLGIGLIL

SEQ ID NO: 57814 - protein, 9 aa, Borrelia burgdorferi
LPGGMTELV

SEQ ID NO: 57815 - protein, 10 aa, Borrelia burgdorferi
IADDLSQTKF

SEQ ID NO: 57816 - protein, 10 aa, Borrelia burgdorferi
LPGGMTELVS

SEQ ID NO: 57817 - protein, 10 aa, Borrelia burgdorferi
LKVTEGTVVL

SEQ ID NO: 57818 - protein, 10 aa, Borrelia burgdorferi
YSLEATVDKL

SEQ ID NO: 57819 - protein, 11 aa, Borrelia burgdorferi
YLLGIGLILAL

SEQ ID NO: 57820 - protein, 11 aa, Borrelia burgdorferi
NSVSVDLPGGM

SEQ ID NO: 57821 - protein, 11 aa, Borrelia burgdorferi
IVRANGTRLEY

SEQ ID NO: 57822 - protein, 11 aa, Borrelia burgdorferi
TIADDLSQTKF

SEQ ID NO: 57823 - protein, 11 aa, Borrelia burgdorferi
KAVEITTLKEL

SEQ ID NO: 57824 - protein, 9 aa, Borrelia burgdorferi
KEVLKDFTL

SEQ ID NO: 57825 - protein, 9 aa, Borrelia burgdorferi
GEITVALDD

SEQ ID NO: 57826 - protein, 9 aa, Borrelia burgdorferi
KEKDKDGKY

SEQ ID NO: 57827 - protein, 9 aa, Borrelia burgdorferi
KEDAKTLVS

SEQ ID NO: 57828 - protein, 10 aa, Borrelia burgdorferi
GEITVALDDS

SEQ ID NO: 57829 - protein, 10 aa, Borrelia burgdorferi
KEDTITVQKY

SEQ ID NO: 57830 - protein, 11 aa, Borrelia burgdorferi
GEITVALDDSD

SEQ ID NO: 57831 - protein, 11 aa, Borrelia burgdorferi
KEVLKDFTLEG

SEQ ID NO: 57832 - protein, 9 aa, Borrelia burgdorferi
LPGGMTELV

SEQ ID NO: 57833 - protein, 11 aa, Borrelia burgdorferi
TTQATKKTGKW

SEQ ID NO: 57834 - protein, 9 aa, Borrelia garinii
LTEETEETY

SEQ ID NO: 57835 - protein, 9 aa, Borrelia garinii
RTNGTTLEY

SEQ ID NO: 57836 - protein, 9 aa, Borrelia garinii
WSDTSNTLT

SEQ ID NO: 57837 - protein, 9 aa, Borrelia garinii
ITDDLNTIT

SEQ ID NO: 57838 - protein, 10 aa, Borrelia garinii
WSDTSNTLTV

SEQ ID NO: 57839 - protein, 10 aa, Borrelia garinii
ITDDLNTITV

SEQ ID NO: 57840 - protein, 11 aa, Borrelia garinii
LTDGTITVQNY

SEQ ID NO: 57841 - protein, 11 aa, Borrelia garinii
ITRTNGTTLEY

SEQ ID NO: 57842 - protein, 11 aa, Borrelia garinii
WSDTSNTLTVS

SEQ ID NO: 57843 - protein, 11 aa, Borrelia garinii
YSDMTNDENAT

SEQ ID NO: 57844 - protein, 9 aa, Borrelia garinii
FLTDGTITV

SEQ ID NO: 57845 - protein, 9 aa, Borrelia garinii
YLLGFALVL

SEQ ID NO: 57846 - protein, 9 aa, Borrelia garinii
KLAGTATEI

SEQ ID NO: 57847 - protein, 9 aa, Borrelia garinii
LLGFALVLA

SEQ ID NO: 57848 - protein, 9 aa, Borrelia garinii
SLTEETEET

SEQ ID NO: 57849 - protein, 9 aa, Borrelia garinii
KIKDFVFLT

SEQ ID NO: 57850 - protein, 9 aa, Borrelia garinii
FLDDTSSGS

SEQ ID NO: 57851 - protein, 9 aa, Borrelia garinii
SITDDLNTI

SEQ ID NO: 57852 - protein, 9 aa, Borrelia garinii
GIMLEGNLV

SEQ ID NO: 57853 - protein, 9 aa, Borrelia garinii
NLVGGKTSV

SEQ ID NO: 57854 - protein, 9 aa, Borrelia garinii
LVTEDTVKL

SEQ ID NO: 57855 - protein, 9 aa, Borrelia garinii
VTMSITDDL

SEQ ID NO: 57856 - protein, 10 aa, Borrelia garinii
YLLGFALVLA

SEQ ID NO: 57857 - protein, 10 aa, Borrelia garinii
KLFNDTKIFI

SEQ ID NO: 57858 - protein, 10 aa, Borrelia garinii
LLGFALVLAL

SEQ ID NO: 57859 - protein, 10 aa, Borrelia garinii
FLDDTSSGST

SEQ ID NO: 57860 - protein, 10 aa, Borrelia garinii
ITDDLNTITV

SEQ ID NO: 57861 - protein, 10 aa, Borrelia garinii
FLTDGTITVQ

SEQ ID NO: 57862 - protein, 10 aa, Borrelia garinii
AVWSDTSNTL

SEQ ID NO: 57863 - protein, 10 aa, Borrelia garinii
ALIACGQKGA

SEQ ID NO: 57864 - protein, 10 aa, Borrelia garinii
KLSTKKITRT

SEQ ID NO: 57865 - protein, 10 aa, Borrelia garinii
KKYLLGFALV

SEQ ID NO: 57866 - protein, 11 aa, Borrelia garinii
YLLGFALVLAL

SEQ ID NO: 57867 - protein, 11 aa, Borrelia garinii
FVFLTDGTITV

SEQ ID NO: 57868 - protein, 11 aa, Borrelia garinii
SITDDLNTITV

SEQ ID NO: 57869 - protein, 11 aa, Borrelia garinii
LLGFALVLALI

SEQ ID NO: 57870 - protein, 11 aa, Borrelia garinii
KLFNDTKIFIS

SEQ ID NO: 57871 - protein, 11 aa, Borrelia garinii
NLVGGKTSVEI

SEQ ID NO: 57872 - protein, 11 aa, Borrelia garinii
TMSITDDLNTI

SEQ ID NO: 57873 - protein, 11 aa, Borrelia garinii
MTNDENATKAV

SEQ ID NO: 57874 - protein, 11 aa, Borrelia garinii
ATVDTVELKGV

SEQ ID NO: 57875 - protein, 9 aa, Borrelia garinii
KVASKVFKK

SEQ ID NO: 57876 - protein, 9 aa, Borrelia garinii
KTGKLSTKK

SEQ ID NO: 57877 - protein, 9 aa, Borrelia garinii
RTNGTTLEY

SEQ ID NO: 57878 - protein, 9 aa, Borrelia garinii
SSNTKVASK

SEQ ID NO: 57879 - protein, 9 aa, Borrelia garinii
ATKAVETLK

SEQ ID NO: 57880 - protein, 9 aa, Borrelia garinii
KLSTKKITR

SEQ ID NO: 57881 - protein, 9 aa, Borrelia garinii
MTNDENATK

SEQ ID NO: 57882 - protein, 9 aa, Borrelia garinii
VTLKKEIEK

SEQ ID NO: 57883 - protein, 9 aa, Borrelia garinii
ETYDSSNTK

SEQ ID NO: 57884 - protein, 9 aa, Borrelia garinii
TLTVSADSK

SEQ ID NO: 57885 - protein, 9 aa, Borrelia garinii
KEGTVTLKK

SEQ ID NO: 57886 - protein, 10 aa, Borrelia garinii
VLALIACGQK

SEQ ID NO: 57887 - protein, 10 aa, Borrelia garinii
KLAGTATEIK

SEQ ID NO: 57888 - protein, 10 aa, Borrelia garinii
NTKVASKVFK

SEQ ID NO: 57889 - protein, 10 aa, Borrelia garinii
NTLTVSADSK

SEQ ID NO: 57890 - protein, 10 aa, Borrelia garinii
TYKTGKLSTK

SEQ ID NO: 57891 - protein, 10 aa, Borrelia garinii
MLEGNLVGGK

SEQ ID NO: 57892 - protein, 10 aa, Borrelia garinii
KIFISKEKNK

SEQ ID NO: 57893 - protein, 10 aa, Borrelia garinii
VQNYDTAGTK

SEQ ID NO: 57894 - protein, 10 aa, Borrelia garinii
TVTLKKEIEK

SEQ ID NO: 57895 - protein, 10 aa, Borrelia garinii
TLTVSADSKK

SEQ ID NO: 57896 - protein, 10 aa, Borrelia garinii
EIKEGTVTLK

SEQ ID NO: 57897 - protein, 10 aa, Borrelia garinii
DLEALKAALK

SEQ ID NO: 57898 - protein, 10 aa, Borrelia garinii
DSSNTKVASK

SEQ ID NO: 57899 - protein, 10 aa, Borrelia garinii
RATVDTVELK

SEQ ID NO: 57900 - protein, 10 aa, Borrelia garinii
KEIEKAGTVK

SEQ ID NO: 57901 - protein, 10 aa, Borrelia garinii
YKTGKLSTKK

SEQ ID NO: 57902 - protein, 10 aa, Borrelia garinii
GSGGKLEGVK

SEQ ID NO: 57903 - protein, 10 aa, Borrelia garinii
TVELKGVADK

SEQ ID NO: 57904 - protein, 10 aa, Borrelia garinii
DTKIFISKEK

SEQ ID NO: 57905 - protein, 10 aa, Borrelia garinii
IKEGTVTLKK

SEQ ID NO: 57906 - protein, 10 aa, Borrelia garinii
FNDTKIFISK

SEQ ID NO: 57907 - protein, 11 aa, Borrelia garinii
IMLEGNLVGGK

SEQ ID NO: 57908 - protein, 11 aa, Borrelia garinii
LVLALIACGQK

SEQ ID NO: 57909 - protein, 11 aa, Borrelia garinii
ETYKTGKLSTK

SEQ ID NO: 57910 - protein, 11 aa, Borrelia garinii
KLEGVKSDQSK

SEQ ID NO: 57911 - protein, 11 aa, Borrelia garinii
FLDDTSSGSTK

SEQ ID NO: 57912 - protein, 11 aa, Borrelia garinii
LFNDTKIFISK

SEQ ID NO: 57913 - protein, 11 aa, Borrelia garinii
LVGGKTSVEIK

SEQ ID NO: 57914 - protein, 11 aa, Borrelia garinii
ITRTNGTTLEY

SEQ ID NO: 57915 - protein, 11 aa, Borrelia garinii
NTLTVSADSKK

SEQ ID NO: 57916 - protein, 11 aa, Borrelia garinii
SLTEETEETYK

SEQ ID NO: 57917 - protein, 11 aa, Borrelia garinii
TVQNYDTAGTK

SEQ ID NO: 57918 - protein, 11 aa, Borrelia garinii
EIKEGTVTLKK

SEQ ID NO: 57919 - protein, 9 aa, Borrelia garinii
KVASKVFKK

SEQ ID NO: 57920 - protein, 9 aa, Borrelia garinii
ATVDTVELK

SEQ ID NO: 57921 - protein, 9 aa, Borrelia garinii
SSNTKVASK

SEQ ID NO: 57922 - protein, 9 aa, Borrelia garinii
ATKAVETLK

SEQ ID NO: 57923 - protein, 9 aa, Borrelia garinii
MTNDENATK

SEQ ID NO: 57924 - protein, 9 aa, Borrelia garinii
ETYDSSNTK

SEQ ID NO: 57925 - protein, 9 aa, Borrelia garinii
KTGKLSTKK

SEQ ID NO: 57926 - protein, 9 aa, Borrelia garinii
VTLKKEIEK

SEQ ID NO: 57927 - protein, 9 aa, Borrelia garinii
TVKLFNDTK

SEQ ID NO: 57928 - protein, 9 aa, Borrelia garinii
RTNGTTLEY

SEQ ID NO: 57929 - protein, 9 aa, Borrelia garinii
TLTVSADSK

SEQ ID NO: 57930 - protein, 9 aa, Borrelia garinii
LTVSADSKK

SEQ ID NO: 57931 - protein, 9 aa, Borrelia garinii
VSADSKKIK

SEQ ID NO: 57932 - protein, 9 aa, Borrelia garinii
LALIACGQK

SEQ ID NO: 57933 - protein, 9 aa, Borrelia garinii
DTSSGSTKK

SEQ ID NO: 57934 - protein, 9 aa, Borrelia garinii
TKVASKVFK

SEQ ID NO: 57935 - protein, 9 aa, Borrelia garinii
EIKDLEALK

SEQ ID NO: 57936 - protein, 9 aa, Borrelia garinii
KLSTKKITR

SEQ ID NO: 57937 - protein, 10 aa, Borrelia garinii
TVTLKKEIEK

SEQ ID NO: 57938 - protein, 10 aa, Borrelia garinii
NTLTVSADSK

SEQ ID NO: 57939 - protein, 10 aa, Borrelia garinii
TVSADSKKIK

SEQ ID NO: 57940 - protein, 10 aa, Borrelia garinii
KIFISKEKNK

SEQ ID NO: 57941 - protein, 10 aa, Borrelia garinii
RATVDTVELK

SEQ ID NO: 57942 - protein, 10 aa, Borrelia garinii
VQNYDTAGTK

SEQ ID NO: 57943 - protein, 10 aa, Borrelia garinii
VLALIACGQK

SEQ ID NO: 57944 - protein, 10 aa, Borrelia garinii
KLAGTATEIK

SEQ ID NO: 57945 - protein, 10 aa, Borrelia garinii
TVELKGVADK

SEQ ID NO: 57946 - protein, 10 aa, Borrelia garinii
TLTVSADSKK

SEQ ID NO: 57947 - protein, 10 aa, Borrelia garinii
NTKVASKVFK

SEQ ID NO: 57948 - protein, 10 aa, Borrelia garinii
LTEETEETYK

SEQ ID NO: 57949 - protein, 10 aa, Borrelia garinii
MLEGNLVGGK

SEQ ID NO: 57950 - protein, 10 aa, Borrelia garinii
GSGGKLEGVK

SEQ ID NO: 57951 - protein, 10 aa, Borrelia garinii
NATKAVETLK

SEQ ID NO: 57952 - protein, 10 aa, Borrelia garinii
DSSNTKVASK

SEQ ID NO: 57953 - protein, 10 aa, Borrelia garinii
DTVKLFNDTK

SEQ ID NO: 57954 - protein, 10 aa, Borrelia garinii
TKVASKVFKK

SEQ ID NO: 57955 - protein, 10 aa, Borrelia garinii
EIKEGTVTLK

SEQ ID NO: 57956 - protein, 11 aa, Borrelia garinii
TVQNYDTAGTK

SEQ ID NO: 57957 - protein, 11 aa, Borrelia garinii
LVLALIACGQK

SEQ ID NO: 57958 - protein, 11 aa, Borrelia garinii
ATEIKDLEALK

SEQ ID NO: 57959 - protein, 11 aa, Borrelia garinii
TVETYDSSNTK

SEQ ID NO: 57960 - protein, 11 aa, Borrelia garinii
GTVTLKKEIEK

SEQ ID NO: 57961 - protein, 11 aa, Borrelia garinii
NTLTVSADSKK

SEQ ID NO: 57962 - protein, 11 aa, Borrelia garinii
IMLEGNLVGGK

SEQ ID NO: 57963 - protein, 11 aa, Borrelia garinii
SLTEETEETYK

SEQ ID NO: 57964 - protein, 11 aa, Borrelia garinii
ETYKTGKLSTK

SEQ ID NO: 57965 - protein, 11 aa, Borrelia garinii
IACGQKGAEPK

SEQ ID NO: 57966 - protein, 11 aa, Borrelia garinii
NTKVASKVFKK

SEQ ID NO: 57967 - protein, 11 aa, Borrelia garinii
LFNDTKIFISK

SEQ ID NO: 57968 - protein, 11 aa, Borrelia garinii
LVGGKTSVEIK

SEQ ID NO: 57969 - protein, 11 aa, Borrelia garinii
LTVSADSKKIK

SEQ ID NO: 57970 - protein, 11 aa, Borrelia garinii
SNTKVASKVFK

SEQ ID NO: 57971 - protein, 11 aa, Borrelia garinii
KLEGVKSDQSK

SEQ ID NO: 57972 - protein, 11 aa, Borrelia garinii
VADKNDGSGGK

SEQ ID NO: 57973 - protein, 11 aa, Borrelia garinii
EIKEGTVTLKK

SEQ ID NO: 57974 - protein, 9 aa, Borrelia garinii
VWSDTSNTL

SEQ ID NO: 57975 - protein, 9 aa, Borrelia garinii
KYLLGFALV

SEQ ID NO: 57976 - protein, 9 aa, Borrelia garinii
GFALVLALI

SEQ ID NO: 57977 - protein, 9 aa, Borrelia garinii
NYDTAGTKL

SEQ ID NO: 57978 - protein, 10 aa, Borrelia garinii
KYLLGFALVL

SEQ ID NO: 57979 - protein, 10 aa, Borrelia garinii
DFVFLTDGTI

SEQ ID NO: 57980 - protein, 11 aa, Borrelia garinii
VWSDTSNTLTV

SEQ ID NO: 57981 - protein, 11 aa, Borrelia garinii
KYELRATVDTV

SEQ ID NO: 57982 - protein, 11 aa, Borrelia garinii
KYLLGFALVLA

SEQ ID NO: 57983 - protein, 9 aa, Borrelia garinii
RTNGTTLEY

SEQ ID NO: 57984 - protein, 10 aa, Borrelia garinii
DLNTITVETY

SEQ ID NO: 57985 - protein, 10 aa, Borrelia garinii
SLTEETEETY

SEQ ID NO: 57986 - protein, 11 aa, Borrelia garinii
ITRTNGTTLEY

SEQ ID NO: 57987 - protein, 9 aa, Borrelia garinii
ETYDSSNTK

SEQ ID NO: 57988 - protein, 9 aa, Borrelia garinii
MTNDENATK

SEQ ID NO: 57989 - protein, 9 aa, Borrelia garinii
DTSSGSTKK

SEQ ID NO: 57990 - protein, 9 aa, Borrelia garinii
LTVSADSKK

SEQ ID NO: 57991 - protein, 9 aa, Borrelia garinii
TVKLFNDTK

SEQ ID NO: 57992 - protein, 9 aa, Borrelia garinii
EIKDLEALK

SEQ ID NO: 57993 - protein, 9 aa, Borrelia garinii
ATVDTVELK

SEQ ID NO: 57994 - protein, 9 aa, Borrelia garinii
ATKAVETLK

SEQ ID NO: 57995 - protein, 9 aa, Borrelia garinii
TLTVSADSK

SEQ ID NO: 57996 - protein, 9 aa, Borrelia garinii
KVASKVFKK

SEQ ID NO: 57997 - protein, 9 aa, Borrelia garinii
TKVASKVFK

SEQ ID NO: 57998 - protein, 9 aa, Borrelia garinii
TKIFISKEK

SEQ ID NO: 57999 - protein, 9 aa, Borrelia garinii
SSNTKVASK

SEQ ID NO: 58000 - protein, 9 aa, Borrelia garinii
RTNGTTLEY

SEQ ID NO: 58001 - protein, 9 aa, Borrelia garinii
EIEKAGTVK

SEQ ID NO: 58002 - protein, 9 aa, Borrelia garinii
LALIACGQK

SEQ ID NO: 58003 - protein, 9 aa, Borrelia garinii
QNYDTAGTK

SEQ ID NO: 58004 - protein, 9 aa, Borrelia garinii
LAGTATEIK

SEQ ID NO: 58005 - protein, 9 aa, Borrelia garinii
NDTKIFISK

SEQ ID NO: 58006 - protein, 9 aa, Borrelia garinii
TATEIKDLE

SEQ ID NO: 58007 - protein, 9 aa, Borrelia garinii
VTLKKEIEK

SEQ ID NO: 58008 - protein, 10 aa, Borrelia garinii
DTVKLFNDTK

SEQ ID NO: 58009 - protein, 10 aa, Borrelia garinii
DTKIFISKEK

SEQ ID NO: 58010 - protein, 10 aa, Borrelia garinii
NATKAVETLK

SEQ ID NO: 58011 - protein, 10 aa, Borrelia garinii
NTLTVSADSK

SEQ ID NO: 58012 - protein, 10 aa, Borrelia garinii
NTKVASKVFK

SEQ ID NO: 58013 - protein, 10 aa, Borrelia garinii
ETEETYKTGK

SEQ ID NO: 58014 - protein, 10 aa, Borrelia garinii
EIKEGTVTLK

SEQ ID NO: 58015 - protein, 10 aa, Borrelia garinii
TVTLKKEIEK

SEQ ID NO: 58016 - protein, 10 aa, Borrelia garinii
TLTVSADSKK

SEQ ID NO: 58017 - protein, 10 aa, Borrelia garinii
DSSNTKVASK

SEQ ID NO: 58018 - protein, 10 aa, Borrelia garinii
EVEDSKKDQK

SEQ ID NO: 58019 - protein, 10 aa, Borrelia garinii
TVSADSKKIK

SEQ ID NO: 58020 - protein, 10 aa, Borrelia garinii
LTEETEETYK

SEQ ID NO: 58021 - protein, 10 aa, Borrelia garinii
VLALIACGQK

SEQ ID NO: 58022 - protein, 10 aa, Borrelia garinii
RATVDTVELK

SEQ ID NO: 58023 - protein, 10 aa, Borrelia garinii
MLEGNLVGGK

SEQ ID NO: 58024 - protein, 10 aa, Borrelia garinii
DLEALKAALK

SEQ ID NO: 58025 - protein, 10 aa, Borrelia garinii
DMTNDENATK

SEQ ID NO: 58026 - protein, 10 aa, Borrelia garinii
TKVASKVFKK

SEQ ID NO: 58027 - protein, 10 aa, Borrelia garinii
TVELKGVADK

SEQ ID NO: 58028 - protein, 10 aa, Borrelia garinii
ETYDSSNTKV

SEQ ID NO: 58029 - protein, 10 aa, Borrelia garinii
DLNTITVETY

SEQ ID NO: 58030 - protein, 10 aa, Borrelia garinii
TEIKDLEALK

SEQ ID NO: 58031 - protein, 10 aa, Borrelia garinii
KIFISKEKNK

SEQ ID NO: 58032 - protein, 10 aa, Borrelia garinii
KLAGTATEIK

SEQ ID NO: 58033 - protein, 10 aa, Borrelia garinii
TYKTGKLSTK

SEQ ID NO: 58034 - protein, 11 aa, Borrelia garinii
ETYKTGKLSTK

SEQ ID NO: 58035 - protein, 11 aa, Borrelia garinii
NTLTVSADSKK

SEQ ID NO: 58036 - protein, 11 aa, Borrelia garinii
DTVELKGVADK

SEQ ID NO: 58037 - protein, 11 aa, Borrelia garinii
TVETYDSSNTK

SEQ ID NO: 58038 - protein, 11 aa, Borrelia garinii
NTKVASKVFKK

SEQ ID NO: 58039 - protein, 11 aa, Borrelia garinii
TVQNYDTAGTK

SEQ ID NO: 58040 - protein, 11 aa, Borrelia garinii
EIKEGTVTLKK

SEQ ID NO: 58041 - protein, 11 aa, Borrelia garinii
LTVSADSKKIK

SEQ ID NO: 58042 - protein, 11 aa, Borrelia garinii
ENATKAVETLK

SEQ ID NO: 58043 - protein, 11 aa, Borrelia garinii
FISKEKNKDGK

SEQ ID NO: 58044 - protein, 11 aa, Borrelia garinii
LVLALIACGQK

SEQ ID NO: 58045 - protein, 11 aa, Borrelia garinii
SNTKVASKVFK

SEQ ID NO: 58046 - protein, 11 aa, Borrelia garinii
SLTEETEETYK

SEQ ID NO: 58047 - protein, 11 aa, Borrelia garinii
GTVTLKKEIEK

SEQ ID NO: 58048 - protein, 11 aa, Borrelia garinii
IACGQKGAEPK

SEQ ID NO: 58049 - protein, 11 aa, Borrelia garinii
DLPLVTEDTVK

SEQ ID NO: 58050 - protein, 11 aa, Borrelia garinii
LVGGKTSVEIK

SEQ ID NO: 58051 - protein, 11 aa, Borrelia garinii
ATEIKDLEALK

SEQ ID NO: 58052 - protein, 11 aa, Borrelia garinii
LFNDTKIFISK

SEQ ID NO: 58053 - protein, 11 aa, Borrelia garinii
EETEETYKTGK

SEQ ID NO: 58054 - protein, 11 aa, Borrelia garinii
EKNKDGKYELR

SEQ ID NO: 58055 - protein, 11 aa, Borrelia garinii
TKIFISKEKNK

SEQ ID NO: 58056 - protein, 11 aa, Borrelia garinii
TYKTGKLSTKK

SEQ ID NO: 58057 - protein, 11 aa, Borrelia garinii
NDTKIFISKEK

SEQ ID NO: 58058 - protein, 11 aa, Borrelia garinii
DSKKDQKDASK

SEQ ID NO: 58059 - protein, 11 aa, Borrelia garinii
SNTLTVSADSK

SEQ ID NO: 58060 - protein, 11 aa, Borrelia garinii
EDTVKLFNDTK

SEQ ID NO: 58061 - protein, 9 aa, Borrelia garinii
ITRTNGTTL

SEQ ID NO: 58062 - protein, 9 aa, Borrelia garinii
RATVDTVEL

SEQ ID NO: 58063 - protein, 9 aa, Borrelia garinii
KVFKKQGSL

SEQ ID NO: 58064 - protein, 10 aa, Borrelia garinii
AVWSDTSNTL

SEQ ID NO: 58065 - protein, 10 aa, Borrelia garinii
KITRTNGTTL

SEQ ID NO: 58066 - protein, 11 aa, Borrelia garinii
LPLVTEDTVKL

SEQ ID NO: 58067 - protein, 11 aa, Borrelia garinii
TAVWSDTSNTL

SEQ ID NO: 58068 - protein, 11 aa, Borrelia garinii
AVETLKNGIML

SEQ ID NO: 58069 - protein, 10 aa, Borrelia garinii
MKKYLLGFAL

SEQ ID NO: 58070 - protein, 11 aa, Borrelia garinii
YLLGFALVLAL

SEQ ID NO: 58071 - protein, 9 aa, Borrelia garinii
RTNGTTLEY

SEQ ID NO: 58072 - protein, 9 aa, Borrelia garinii
KLFNDTKIF

SEQ ID NO: 58073 - protein, 9 aa, Borrelia garinii
YLLGFALVL

SEQ ID NO: 58074 - protein, 9 aa, Borrelia garinii
NTKVASKVF

SEQ ID NO: 58075 - protein, 9 aa, Borrelia garinii
LGFALVLAL

SEQ ID NO: 58076 - protein, 9 aa, Borrelia garinii
LTEETEETY

SEQ ID NO: 58077 - protein, 10 aa, Borrelia garinii
SLTEETEETY

SEQ ID NO: 58078 - protein, 10 aa, Borrelia garinii
LVTEDTVKLF

SEQ ID NO: 58079 - protein, 10 aa, Borrelia garinii
IEKAGTVKLF

SEQ ID NO: 58080 - protein, 11 aa, Borrelia garinii
ITRTNGTTLEY

SEQ ID NO: 58081 - protein, 11 aa, Borrelia garinii
YLLGFALVLAL

SEQ ID NO: 58082 - protein, 11 aa, Borrelia garinii
ISKEKNKDGKY

SEQ ID NO: 58083 - protein, 11 aa, Borrelia garinii
SSNTKVASKVF

SEQ ID NO: 58084 - protein, 11 aa, Borrelia garinii
TVKLFNDTKIF

SEQ ID NO: 58085 - protein, 11 aa, Borrelia garinii
VQNYDTAGTKL

SEQ ID NO: 58086 - protein, 11 aa, Borrelia garinii
VSADSKKIKDF

SEQ ID NO: 58087 - protein, 9 aa, Borrelia garinii
KKYLLGFAL

SEQ ID NO: 58088 - protein, 10 aa, Borrelia garinii
TRTNGTTLEY

SEQ ID NO: 58089 - protein, 10 aa, Borrelia garinii
LRATVDTVEL

SEQ ID NO: 58090 - protein, 11 aa, Borrelia garinii
KKYLLGFALVL

SEQ ID NO: 58091 - protein, 11 aa, Borrelia garinii
LRATVDTVELK

SEQ ID NO: 58092 - protein, 9 aa, Borrelia garinii
LTEETEETY

SEQ ID NO: 58093 - protein, 9 aa, Borrelia garinii
FALVLALIA

SEQ ID NO: 58094 - protein, 9 aa, Borrelia garinii
LPLVTEDTV

SEQ ID NO: 58095 - protein, 9 aa, Borrelia garinii
RTNGTTLEY

SEQ ID NO: 58096 - protein, 9 aa, Borrelia garinii
TAVWSDTSN

SEQ ID NO: 58097 - protein, 9 aa, Borrelia garinii
YLLGFALVL

SEQ ID NO: 58098 - protein, 9 aa, Borrelia garinii
DASKKDLPL

SEQ ID NO: 58099 - protein, 9 aa, Borrelia garinii
RATVDTVEL

SEQ ID NO: 58100 - protein, 10 aa, Borrelia garinii
DLNTITVETY

SEQ ID NO: 58101 - protein, 10 aa, Borrelia garinii
AVWSDTSNTL

SEQ ID NO: 58102 - protein, 10 aa, Borrelia garinii
FALVLALIAC

SEQ ID NO: 58103 - protein, 10 aa, Borrelia garinii
LVTEDTVKLF

SEQ ID NO: 58104 - protein, 10 aa, Borrelia garinii
TAVWSDTSNT

SEQ ID NO: 58105 - protein, 10 aa, Borrelia garinii
TRTNGTTLEY

SEQ ID NO: 58106 - protein, 10 aa, Borrelia garinii
FVFLTDGTIT

SEQ ID NO: 58107 - protein, 10 aa, Borrelia garinii
SLTEETEETY

SEQ ID NO: 58108 - protein, 10 aa, Borrelia garinii
LPLVTEDTVK

SEQ ID NO: 58109 - protein, 11 aa, Borrelia garinii
TAVWSDTSNTL

SEQ ID NO: 58110 - protein, 11 aa, Borrelia garinii
LPLVTEDTVKL

SEQ ID NO: 58111 - protein, 11 aa, Borrelia garinii
TATEIKDLEAL

SEQ ID NO: 58112 - protein, 11 aa, Borrelia garinii
YLLGFALVLAL

SEQ ID NO: 58113 - protein, 11 aa, Borrelia garinii
KAVETLKNGIM

SEQ ID NO: 58114 - protein, 11 aa, Borrelia garinii
ITRTNGTTLEY

SEQ ID NO: 58115 - protein, 11 aa, Borrelia garinii
TVKLFNDTKIF

SEQ ID NO: 58116 - protein, 11 aa, Borrelia garinii
DDLNTITVETY

SEQ ID NO: 58117 - protein, 11 aa, Borrelia garinii
FVFLTDGTITV

SEQ ID NO: 58118 - protein, 9 aa, Borrelia garinii
KEIEKAGTV

SEQ ID NO: 58119 - protein, 9 aa, Borrelia garinii
KEKNKDGKY

SEQ ID NO: 58120 - protein, 9 aa, Borrelia garinii
EETYKTGKL

SEQ ID NO: 58121 - protein, 9 aa, Borrelia garinii
AEPKHNDQE

SEQ ID NO: 58122 - protein, 9 aa, Borrelia garinii
EETEETYKT

SEQ ID NO: 58123 - protein, 10 aa, Borrelia garinii
AEPKHNDQEV

SEQ ID NO: 58124 - protein, 10 aa, Borrelia garinii
EETYKTGKLS

SEQ ID NO: 58125 - protein, 10 aa, Borrelia garinii
VEIKEGTVTL

SEQ ID NO: 58126 - protein, 11 aa, Borrelia garinii
KEIEKAGTVKL

SEQ ID NO: 58127 - protein, 11 aa, Borrelia garinii
KEGTVTLKKEI

SEQ ID NO: 58128 - protein, 9 aa, Borrelia garinii
LPLVTEDTV

SEQ ID NO: 58129 - protein, 9 aa, Borrelia garinii
FALVLALIA

SEQ ID NO: 58130 - protein, 10 aa, Borrelia garinii
LPLVTEDTVK

SEQ ID NO: 58131 - protein, 11 aa, Borrelia garinii
LPLVTEDTVKL

SEQ ID NO: 58132 - protein, 9 aa, Borrelia garinii
LTEETEETY

SEQ ID NO: 58133 - protein, 9 aa, Borrelia garinii
GSTKKTAVW

SEQ ID NO: 58134 - protein, 9 aa, Borrelia garinii
RTNGTTLEY

SEQ ID NO: 58135 - protein, 11 aa, Borrelia garinii
SSGSTKKTAVW

SEQ ID NO: 58136 - protein, 11 aa, Borrelia garinii
GSLTEETEETY

SEQ ID NO: 58137 - protein, 11 aa, Borrelia garinii
ITRTNGTTLEY

SEQ ID NO: 58138 - protein, 9 aa, Borrelia afzelii
LSAILMTLF

SEQ ID NO: 58139 - protein, 9 aa, Borrelia afzelii
ITDSNAFVL

SEQ ID NO: 58140 - protein, 11 aa, Borrelia afzelii
ITDSNAFVLAV

SEQ ID NO: 58141 - protein, 9 aa, Borrelia afzelii
ILMTLFLFI

SEQ ID NO: 58142 - protein, 9 aa, Borrelia afzelii
SLLAGVHEI

SEQ ID NO: 58143 - protein, 9 aa, Borrelia afzelii
KITDSNAFV

SEQ ID NO: 58144 - protein, 9 aa, Borrelia afzelii
KLFKSVEGL

SEQ ID NO: 58145 - protein, 9 aa, Borrelia afzelii
TLSAILMTL

SEQ ID NO: 58146 - protein, 9 aa, Borrelia afzelii
TLVSSIDEL

SEQ ID NO: 58147 - protein, 9 aa, Borrelia afzelii
ALTNSVKEL

SEQ ID NO: 58148 - protein, 9 aa, Borrelia afzelii
GVHEISTLI

SEQ ID NO: 58149 - protein, 9 aa, Borrelia afzelii
SAILMTLFL

SEQ ID NO: 58150 - protein, 9 aa, Borrelia afzelii
FLFISCNNS

SEQ ID NO: 58151 - protein, 9 aa, Borrelia afzelii
SVKELTSPV

SEQ ID NO: 58152 - protein, 9 aa, Borrelia afzelii
LITEKLSKL

SEQ ID NO: 58153 - protein, 9 aa, Borrelia afzelii
LMTLFLFIS

SEQ ID NO: 58154 - protein, 9 aa, Borrelia afzelii
LVSSIDELA

SEQ ID NO: 58155 - protein, 9 aa, Borrelia afzelii
AQEALTNSV

SEQ ID NO: 58156 - protein, 10 aa, Borrelia afzelii
KLFKSVEGLV

SEQ ID NO: 58157 - protein, 10 aa, Borrelia afzelii
AILMTLFLFI

SEQ ID NO: 58158 - protein, 10 aa, Borrelia afzelii
KITDSNAFVL

SEQ ID NO: 58159 - protein, 10 aa, Borrelia afzelii
NTLSAILMTL

SEQ ID NO: 58160 - protein, 10 aa, Borrelia afzelii
TLVSSIDELA

SEQ ID NO: 58161 - protein, 10 aa, Borrelia afzelii
ILMTLFLFIS

SEQ ID NO: 58162 - protein, 10 aa, Borrelia afzelii
VLAVKEVETL

SEQ ID NO: 58163 - protein, 10 aa, Borrelia afzelii
TLITEKLSKL

SEQ ID NO: 58164 - protein, 10 aa, Borrelia afzelii
LLAGVHEIST

SEQ ID NO: 58165 - protein, 10 aa, Borrelia afzelii
GLVKAAQEAL

SEQ ID NO: 58166 - protein, 10 aa, Borrelia afzelii
AAQEALTNSV

SEQ ID NO: 58167 - protein, 10 aa, Borrelia afzelii
FVLAVKEVET

SEQ ID NO: 58168 - protein, 11 aa, Borrelia afzelii
TLSAILMTLFL

SEQ ID NO: 58169 - protein, 11 aa, Borrelia afzelii
VLAVKEVETLV

SEQ ID NO: 58170 - protein, 11 aa, Borrelia afzelii
LLAGVHEISTL

SEQ ID NO: 58171 - protein, 11 aa, Borrelia afzelii
FVLAVKEVETL

SEQ ID NO: 58172 - protein, 11 aa, Borrelia afzelii
KITDSNAFVLA

SEQ ID NO: 58173 - protein, 11 aa, Borrelia afzelii
SLLAGVHEIST

SEQ ID NO: 58174 - protein, 11 aa, Borrelia afzelii
ITDSNAFVLAV

SEQ ID NO: 58175 - protein, 11 aa, Borrelia afzelii
ILMTLFLFISC

SEQ ID NO: 58176 - protein, 11 aa, Borrelia afzelii
KAAQEALTNSV

SEQ ID NO: 58177 - protein, 11 aa, Borrelia afzelii
SAILMTLFLFI

SEQ ID NO: 58178 - protein, 9 aa, Borrelia afzelii
KLKNSGELK

SEQ ID NO: 58179 - protein, 9 aa, Borrelia afzelii
TLITEKLSK

SEQ ID NO: 58180 - protein, 9 aa, Borrelia afzelii
ELANKAIGK

SEQ ID NO: 58181 - protein, 9 aa, Borrelia afzelii
LANKAIGKK

SEQ ID NO: 58182 - protein, 9 aa, Borrelia afzelii
RVSHADLGK

SEQ ID NO: 58183 - protein, 9 aa, Borrelia afzelii
FISCNNSGK

SEQ ID NO: 58184 - protein, 9 aa, Borrelia afzelii
ITEKLSKLK

SEQ ID NO: 58185 - protein, 9 aa, Borrelia afzelii
AILKTNADK

SEQ ID NO: 58186 - protein, 9 aa, Borrelia afzelii
EISTLITEK

SEQ ID NO: 58187 - protein, 9 aa, Borrelia afzelii
ILMTLFLFI

SEQ ID NO: 58188 - protein, 10 aa, Borrelia afzelii
STLITEKLSK

SEQ ID NO: 58189 - protein, 10 aa, Borrelia afzelii
LITEKLSKLK

SEQ ID NO: 58190 - protein, 10 aa, Borrelia afzelii
KTKGAEELGK

SEQ ID NO: 58191 - protein, 10 aa, Borrelia afzelii
KAILKTNADK

SEQ ID NO: 58192 - protein, 10 aa, Borrelia afzelii
ELANKAIGKK

SEQ ID NO: 58193 - protein, 10 aa, Borrelia afzelii
LFKSVEGLVK

SEQ ID NO: 58194 - protein, 10 aa, Borrelia afzelii
AQEALTNSVK

SEQ ID NO: 58195 - protein, 10 aa, Borrelia afzelii
LFISCNNSGK

SEQ ID NO: 58196 - protein, 10 aa, Borrelia afzelii
DSNAFVLAVK

SEQ ID NO: 58197 - protein, 10 aa, Borrelia afzelii
TSPVVAESPK

SEQ ID NO: 58198 - protein, 10 aa, Borrelia afzelii
GAEELGKLFK

SEQ ID NO: 58199 - protein, 10 aa, Borrelia afzelii
ILKTNADKTK

SEQ ID NO: 58200 - protein, 10 aa, Borrelia afzelii
SKLKNSGELK

SEQ ID NO: 58201 - protein, 10 aa, Borrelia afzelii
VSSIDELANK

SEQ ID NO: 58202 - protein, 10 aa, Borrelia afzelii
HEISTLITEK

SEQ ID NO: 58203 - protein, 11 aa, Borrelia afzelii
KLFKSVEGLVK

SEQ ID NO: 58204 - protein, 11 aa, Borrelia afzelii
FLFISCNNSGK

SEQ ID NO: 58205 - protein, 11 aa, Borrelia afzelii
KLRVSHADLGK

SEQ ID NO: 58206 - protein, 11 aa, Borrelia afzelii
TLITEKLSKLK

SEQ ID NO: 58207 - protein, 11 aa, Borrelia afzelii
KLKNSGELKAK

SEQ ID NO: 58208 - protein, 11 aa, Borrelia afzelii
ISTLITEKLSK

SEQ ID NO: 58209 - protein, 11 aa, Borrelia afzelii
LTSPVVAESPK

SEQ ID NO: 58210 - protein, 11 aa, Borrelia afzelii
LVSSIDELANK

SEQ ID NO: 58211 - protein, 11 aa, Borrelia afzelii
LSKLKNSGELK

SEQ ID NO: 58212 - protein, 11 aa, Borrelia afzelii
TLSAILMTLFL

SEQ ID NO: 58213 - protein, 11 aa, Borrelia afzelii
KGAEELGKLFK

SEQ ID NO: 58214 - protein, 11 aa, Borrelia afzelii
AILKTNADKTK

SEQ ID NO: 58215 - protein, 9 aa, Borrelia afzelii
SSIDELANK

SEQ ID NO: 58216 - protein, 9 aa, Borrelia afzelii
TLITEKLSK

SEQ ID NO: 58217 - protein, 9 aa, Borrelia afzelii
RVSHADLGK

SEQ ID NO: 58218 - protein, 9 aa, Borrelia afzelii
AILKTNADK

SEQ ID NO: 58219 - protein, 9 aa, Borrelia afzelii
GVNDDDAKK

SEQ ID NO: 58220 - protein, 9 aa, Borrelia afzelii
ITEKLSKLK

SEQ ID NO: 58221 - protein, 9 aa, Borrelia afzelii
LANKAIGKK

SEQ ID NO: 58222 - protein, 9 aa, Borrelia afzelii
KLKNSGELK

SEQ ID NO: 58223 - protein, 9 aa, Borrelia afzelii
FISCNNSGK

SEQ ID NO: 58224 - protein, 9 aa, Borrelia afzelii
EISTLITEK

SEQ ID NO: 58225 - protein, 9 aa, Borrelia afzelii
PVVAESPKK

SEQ ID NO: 58226 - protein, 9 aa, Borrelia afzelii
SNAFVLAVK

SEQ ID NO: 58227 - protein, 9 aa, Borrelia afzelii
AILMTLFLF

SEQ ID NO: 58228 - protein, 9 aa, Borrelia afzelii
ELANKAIGK

SEQ ID NO: 58229 - protein, 9 aa, Borrelia afzelii
GPNLTEISK

SEQ ID NO: 58230 - protein, 10 aa, Borrelia afzelii
STLITEKLSK

SEQ ID NO: 58231 - protein, 10 aa, Borrelia afzelii
STNPADESAK

SEQ ID NO: 58232 - protein, 10 aa, Borrelia afzelii
VSSIDELANK

SEQ ID NO: 58233 - protein, 10 aa, Borrelia afzelii
TSPVVAESPK

SEQ ID NO: 58234 - protein, 10 aa, Borrelia afzelii
KAILKTNADK

SEQ ID NO: 58235 - protein, 10 aa, Borrelia afzelii
DSNAFVLAVK

SEQ ID NO: 58236 - protein, 10 aa, Borrelia afzelii
AQEALTNSVK

SEQ ID NO: 58237 - protein, 10 aa, Borrelia afzelii
KTKGAEELGK

SEQ ID NO: 58238 - protein, 10 aa, Borrelia afzelii
GAEELGKLFK

SEQ ID NO: 58239 - protein, 10 aa, Borrelia afzelii
LITEKLSKLK

SEQ ID NO: 58240 - protein, 10 aa, Borrelia afzelii
AILMTLFLFI

SEQ ID NO: 58241 - protein, 10 aa, Borrelia afzelii
LFISCNNSGK

SEQ ID NO: 58242 - protein, 11 aa, Borrelia afzelii
LTSPVVAESPK

SEQ ID NO: 58243 - protein, 11 aa, Borrelia afzelii
KLFKSVEGLVK

SEQ ID NO: 58244 - protein, 11 aa, Borrelia afzelii
ASTNPADESAK

SEQ ID NO: 58245 - protein, 11 aa, Borrelia afzelii
LVSSIDELANK

SEQ ID NO: 58246 - protein, 11 aa, Borrelia afzelii
AAQEALTNSVK

SEQ ID NO: 58247 - protein, 11 aa, Borrelia afzelii
TLITEKLSKLK

SEQ ID NO: 58248 - protein, 11 aa, Borrelia afzelii
ISTLITEKLSK

SEQ ID NO: 58249 - protein, 11 aa, Borrelia afzelii
TSPVVAESPKK

SEQ ID NO: 58250 - protein, 11 aa, Borrelia afzelii
AILKTNADKTK

SEQ ID NO: 58251 - protein, 11 aa, Borrelia afzelii
FLFISCNNSGK

SEQ ID NO: 58252 - protein, 11 aa, Borrelia afzelii
LSKLKNSGELK

SEQ ID NO: 58253 - protein, 11 aa, Borrelia afzelii
KGAEELGKLFK

SEQ ID NO: 58254 - protein, 11 aa, Borrelia afzelii
KLKNSGELKAK

SEQ ID NO: 58255 - protein, 11 aa, Borrelia afzelii
KLRVSHADLGK

SEQ ID NO: 58256 - protein, 9 aa, Borrelia afzelii
AILMTLFLF

SEQ ID NO: 58257 - protein, 9 aa, Borrelia afzelii
ILMTLFLFI

SEQ ID NO: 58258 - protein, 10 aa, Borrelia afzelii
SAILMTLFLF

SEQ ID NO: 58259 - protein, 11 aa, Borrelia afzelii
LSAILMTLFLF

SEQ ID NO: 58260 - protein, 11 aa, Borrelia afzelii
NTLSAILMTLF

SEQ ID NO: 58261 - protein, 10 aa, Borrelia afzelii
SAILMTLFLF

SEQ ID NO: 58262 - protein, 9 aa, Borrelia afzelii
EISTLITEK

SEQ ID NO: 58263 - protein, 9 aa, Borrelia afzelii
FISCNNSGK

SEQ ID NO: 58264 - protein, 9 aa, Borrelia afzelii
ELANKAIGK

SEQ ID NO: 58265 - protein, 9 aa, Borrelia afzelii
SSIDELANK

SEQ ID NO: 58266 - protein, 9 aa, Borrelia afzelii
SNAFVLAVK

SEQ ID NO: 58267 - protein, 9 aa, Borrelia afzelii
LANKAIGKK

SEQ ID NO: 58268 - protein, 9 aa, Borrelia afzelii
ITEKLSKLK

SEQ ID NO: 58269 - protein, 9 aa, Borrelia afzelii
TLITEKLSK

SEQ ID NO: 58270 - protein, 9 aa, Borrelia afzelii
RVSHADLGK

SEQ ID NO: 58271 - protein, 9 aa, Borrelia afzelii
GVNDDDAKK

SEQ ID NO: 58272 - protein, 9 aa, Borrelia afzelii
SPVVAESPK

SEQ ID NO: 58273 - protein, 10 aa, Borrelia afzelii
DSNAFVLAVK

SEQ ID NO: 58274 - protein, 10 aa, Borrelia afzelii
STNPADESAK

SEQ ID NO: 58275 - protein, 10 aa, Borrelia afzelii
CSEEFTNKLR

SEQ ID NO: 58276 - protein, 10 aa, Borrelia afzelii
TSPVVAESPK

SEQ ID NO: 58277 - protein, 10 aa, Borrelia afzelii
ELANKAIGKK

SEQ ID NO: 58278 - protein, 10 aa, Borrelia afzelii
LFISCNNSGK

SEQ ID NO: 58279 - protein, 10 aa, Borrelia afzelii
STLITEKLSK

SEQ ID NO: 58280 - protein, 10 aa, Borrelia afzelii
ELKAKIEDAK

SEQ ID NO: 58281 - protein, 10 aa, Borrelia afzelii
LITEKLSKLK

SEQ ID NO: 58282 - protein, 10 aa, Borrelia afzelii
HEISTLITEK

SEQ ID NO: 58283 - protein, 10 aa, Borrelia afzelii
KTKGAEELGK

SEQ ID NO: 58284 - protein, 10 aa, Borrelia afzelii
SPVVAESPKK

SEQ ID NO: 58285 - protein, 10 aa, Borrelia afzelii
SAILMTLFLF

SEQ ID NO: 58286 - protein, 10 aa, Borrelia afzelii
VSSIDELANK

SEQ ID NO: 58287 - protein, 11 aa, Borrelia afzelii
LTSPVVAESPK

SEQ ID NO: 58288 - protein, 11 aa, Borrelia afzelii
FLFISCNNSGK

SEQ ID NO: 58289 - protein, 11 aa, Borrelia afzelii
LVSSIDELANK

SEQ ID NO: 58290 - protein, 11 aa, Borrelia afzelii
TSPVVAESPKK

SEQ ID NO: 58291 - protein, 11 aa, Borrelia afzelii
ISTLITEKLSK

SEQ ID NO: 58292 - protein, 11 aa, Borrelia afzelii
TLITEKLSKLK

SEQ ID NO: 58293 - protein, 11 aa, Borrelia afzelii
ELKAKIEDAKK

SEQ ID NO: 58294 - protein, 11 aa, Borrelia afzelii
LSKLKNSGELK

SEQ ID NO: 58295 - protein, 11 aa, Borrelia afzelii
QQNGLGAEANR

SEQ ID NO: 58296 - protein, 11 aa, Borrelia afzelii
ASTNPADESAK

SEQ ID NO: 58297 - protein, 11 aa, Borrelia afzelii
TDSNAFVLAVK

SEQ ID NO: 58298 - protein, 11 aa, Borrelia afzelii
MTLFLFISCNN

SEQ ID NO: 58299 - protein, 9 aa, Borrelia afzelii
SVKELTSPV

SEQ ID NO: 58300 - protein, 9 aa, Borrelia afzelii
LVKAAQEAL

SEQ ID NO: 58301 - protein, 9 aa, Borrelia afzelii
SAILMTLFL

SEQ ID NO: 58302 - protein, 10 aa, Borrelia afzelii
AAQEALTNSV

SEQ ID NO: 58303 - protein, 11 aa, Borrelia afzelii
KAAQEALTNSV

SEQ ID NO: 58304 - protein, 11 aa, Borrelia afzelii
GPNLTEISKKI

SEQ ID NO: 58305 - protein, 9 aa, Borrelia afzelii
KLRVSHADL

SEQ ID NO: 58306 - protein, 9 aa, Borrelia afzelii
LVKAAQEAL

SEQ ID NO: 58307 - protein, 9 aa, Borrelia afzelii
LVKAAQEAL

SEQ ID NO: 58308 - protein, 9 aa, Borrelia afzelii
QQNGLGAEA

SEQ ID NO: 58309 - protein, 9 aa, Borrelia afzelii
AQEALTNSV

SEQ ID NO: 58310 - protein, 9 aa, Borrelia afzelii
KKITDSNAF

SEQ ID NO: 58311 - protein, 9 aa, Borrelia afzelii
IQQNGLGAE

SEQ ID NO: 58312 - protein, 9 aa, Borrelia afzelii
SVKELTSPV

SEQ ID NO: 58313 - protein, 9 aa, Borrelia afzelii
KLRVSHADL

SEQ ID NO: 58314 - protein, 9 aa, Borrelia afzelii
LSAILMTLF

SEQ ID NO: 58315 - protein, 10 aa, Borrelia afzelii
TLSAILMTLF

SEQ ID NO: 58316 - protein, 10 aa, Borrelia afzelii
IQQNGLGAEA

SEQ ID NO: 58317 - protein, 10 aa, Borrelia afzelii
SAILMTLFLF

SEQ ID NO: 58318 - protein, 11 aa, Borrelia afzelii
ISKKITDSNAF

SEQ ID NO: 58319 - protein, 11 aa, Borrelia afzelii
LLAGVHEISTL

SEQ ID NO: 58320 - protein, 11 aa, Borrelia afzelii
LSAILMTLFLF

SEQ ID NO: 58321 - protein, 10 aa, Borrelia afzelii
LRVSHADLGK

SEQ ID NO: 58322 - protein, 9 aa, Borrelia afzelii
KKITDSNAF

SEQ ID NO: 58323 - protein, 9 aa, Borrelia afzelii
SAILMTLFL

SEQ ID NO: 58324 - protein, 9 aa, Borrelia afzelii
LAVKEVETL

SEQ ID NO: 58325 - protein, 9 aa, Borrelia afzelii
LSAILMTLF

SEQ ID NO: 58326 - protein, 9 aa, Borrelia afzelii
DAKKCSEEF

SEQ ID NO: 58327 - protein, 9 aa, Borrelia afzelii
NPADESAKG

SEQ ID NO: 58328 - protein, 10 aa, Borrelia afzelii
SAILMTLFLF

SEQ ID NO: 58329 - protein, 10 aa, Borrelia afzelii
EALTNSVKEL

SEQ ID NO: 58330 - protein, 10 aa, Borrelia afzelii
LAGVHEISTL

SEQ ID NO: 58331 - protein, 11 aa, Borrelia afzelii
NPADESAKGPN

SEQ ID NO: 58332 - protein, 11 aa, Borrelia afzelii
NTLSAILMTLF

SEQ ID NO: 58333 - protein, 11 aa, Borrelia afzelii
FVLAVKEVETL

SEQ ID NO: 58334 - protein, 11 aa, Borrelia afzelii
ISKKITDSNAF

SEQ ID NO: 58335 - protein, 9 aa, Borrelia afzelii
EEFTNKLRV

SEQ ID NO: 58336 - protein, 9 aa, Borrelia afzelii
KELTSPVVA

SEQ ID NO: 58337 - protein, 9 aa, Borrelia afzelii
AEANRNESL

SEQ ID NO: 58338 - protein, 10 aa, Borrelia afzelii
EEFTNKLRVS

SEQ ID NO: 58339 - protein, 10 aa, Borrelia afzelii
AEANRNESLL

SEQ ID NO: 58340 - protein, 11 aa, Borrelia afzelii
AEANRNESLLA

SEQ ID NO: 58341 - protein, 11 aa, Borrelia afzelii
EEFTNKLRVSH

SEQ ID NO: 58342 - protein, 11 aa, Borrelia afzelii
KELTSPVVAES

SEQ ID NO: 58343 - protein, 11 aa, Borrelia afzelii
GPNLTEISKKI

SEQ ID NO: 58344 - protein, 11 aa, Borrelia afzelii
LAGVHEISTLI

SEQ ID NO: 58345 - protein, 11 aa, Borrelia afzelii
ISKKITDSNAF

SEQ ID NO: 58346 - protein, 9 aa, Borrelia garinii
GSFKTSLYY

SEQ ID NO: 58347 - protein, 10 aa, Borrelia garinii
SSDTIKFSEF

SEQ ID NO: 58348 - protein, 9 aa, Borrelia garinii
FIICAVFVL

SEQ ID NO: 58349 - protein, 9 aa, Borrelia garinii
KMKMFIICA

SEQ ID NO: 58350 - protein, 9 aa, Borrelia garinii
MKMFIICAV

SEQ ID NO: 58351 - protein, 9 aa, Borrelia garinii
ATFFCIEEA

SEQ ID NO: 58352 - protein, 9 aa, Borrelia garinii
IICAVFVLI

SEQ ID NO: 58353 - protein, 9 aa, Borrelia garinii
MFIICAVFV

SEQ ID NO: 58354 - protein, 10 aa, Borrelia garinii
KMFIICAVFV

SEQ ID NO: 58355 - protein, 10 aa, Borrelia garinii
FIICAVFVLI

SEQ ID NO: 58356 - protein, 10 aa, Borrelia garinii
KMKMFIICAV

SEQ ID NO: 58357 - protein, 11 aa, Borrelia garinii
KMFIICAVFVL

SEQ ID NO: 58358 - protein, 11 aa, Borrelia garinii
ATFFCIEEAEV

SEQ ID NO: 58359 - protein, 11 aa, Borrelia garinii
MKMFIICAVFV

SEQ ID NO: 58360 - protein, 11 aa, Borrelia garinii
KKMKMFIICAV

SEQ ID NO: 58361 - protein, 11 aa, Borrelia garinii
GLSGQASSDTI

SEQ ID NO: 58362 - protein, 11 aa, Borrelia garinii
FIICAVFVLIS

SEQ ID NO: 58363 - protein, 11 aa, Borrelia garinii
TLVIRKEQDGV

SEQ ID NO: 58364 - protein, 9 aa, Borrelia garinii
AMTNVGSFK

SEQ ID NO: 58365 - protein, 9 aa, Borrelia garinii
KTSLYYGYK

SEQ ID NO: 58366 - protein, 9 aa, Borrelia garinii
GSFKTSLYY

SEQ ID NO: 58367 - protein, 9 aa, Borrelia garinii
NLGTLVIRK

SEQ ID NO: 58368 - protein, 9 aa, Borrelia garinii
LISSCGNFR

SEQ ID NO: 58369 - protein, 9 aa, Borrelia garinii
FTVNIKNKK

SEQ ID NO: 58370 - protein, 9 aa, Borrelia garinii
GQASSDTIK

SEQ ID NO: 58371 - protein, 10 aa, Borrelia garinii
KAMTNVGSFK

SEQ ID NO: 58372 - protein, 10 aa, Borrelia garinii
GIKGKEITTK

SEQ ID NO: 58373 - protein, 10 aa, Borrelia garinii
VGSFKTSLYY

SEQ ID NO: 58374 - protein, 10 aa, Borrelia garinii
SNLGTLVIRK

SEQ ID NO: 58375 - protein, 10 aa, Borrelia garinii
VLISSCGNFR

SEQ ID NO: 58376 - protein, 10 aa, Borrelia garinii
NVGSFKTSLY

SEQ ID NO: 58377 - protein, 10 aa, Borrelia garinii
KFSEFTVNIK

SEQ ID NO: 58378 - protein, 10 aa, Borrelia garinii
QLRGHSATFF

SEQ ID NO: 58379 - protein, 10 aa, Borrelia garinii
FKTSLYYGYK

SEQ ID NO: 58380 - protein, 10 aa, Borrelia garinii
QSSTNGIKGK

SEQ ID NO: 58381 - protein, 11 aa, Borrelia garinii
WSNLGTLVIRK

SEQ ID NO: 58382 - protein, 11 aa, Borrelia garinii
GSFKTSLYYGY

SEQ ID NO: 58383 - protein, 11 aa, Borrelia garinii
SFKTSLYYGYK

SEQ ID NO: 58384 - protein, 11 aa, Borrelia garinii
FVLISSCGNFR

SEQ ID NO: 58385 - protein, 9 aa, Borrelia garinii
KTSLYYGYK

SEQ ID NO: 58386 - protein, 9 aa, Borrelia garinii
AMTNVGSFK

SEQ ID NO: 58387 - protein, 9 aa, Borrelia garinii
GSFKTSLYY

SEQ ID NO: 58388 - protein, 9 aa, Borrelia garinii
SSTNGIKGK

SEQ ID NO: 58389 - protein, 9 aa, Borrelia garinii
NLGTLVIRK

SEQ ID NO: 58390 - protein, 9 aa, Borrelia garinii
GQASSDTIK

SEQ ID NO: 58391 - protein, 9 aa, Borrelia garinii
FTVNIKNKK

SEQ ID NO: 58392 - protein, 9 aa, Borrelia garinii
LISSCGNFR

SEQ ID NO: 58393 - protein, 9 aa, Borrelia garinii
FSEFTVNIK

SEQ ID NO: 58394 - protein, 10 aa, Borrelia garinii
KAMTNVGSFK

SEQ ID NO: 58395 - protein, 10 aa, Borrelia garinii
VLISSCGNFR

SEQ ID NO: 58396 - protein, 10 aa, Borrelia garinii
SNLGTLVIRK

SEQ ID NO: 58397 - protein, 10 aa, Borrelia garinii
QSSTNGIKGK

SEQ ID NO: 58398 - protein, 10 aa, Borrelia garinii
KFSEFTVNIK

SEQ ID NO: 58399 - protein, 10 aa, Borrelia garinii
GIKGKEITTK

SEQ ID NO: 58400 - protein, 10 aa, Borrelia garinii
SEFTVNIKNK

SEQ ID NO: 58401 - protein, 10 aa, Borrelia garinii
SGQASSDTIK

SEQ ID NO: 58402 - protein, 10 aa, Borrelia garinii
NVGSFKTSLY

SEQ ID NO: 58403 - protein, 11 aa, Borrelia garinii
WSNLGTLVIRK

SEQ ID NO: 58404 - protein, 11 aa, Borrelia garinii
GSFKTSLYYGY

SEQ ID NO: 58405 - protein, 11 aa, Borrelia garinii
SFKTSLYYGYK

SEQ ID NO: 58406 - protein, 11 aa, Borrelia garinii
NSEHITFSGDK

SEQ ID NO: 58407 - protein, 11 aa, Borrelia garinii
FVLISSCGNFR

SEQ ID NO: 58408 - protein, 11 aa, Borrelia garinii
NVGSFKTSLYY

SEQ ID NO: 58409 - protein, 11 aa, Borrelia garinii
NVIGTINGQLR

SEQ ID NO: 58410 - protein, 11 aa, Borrelia garinii
LSGQASSDTIK

SEQ ID NO: 58411 - protein, 11 aa, Borrelia garinii
SEFTVNIKNKK

SEQ ID NO: 58412 - protein, 11 aa, Borrelia garinii
FSEFTVNIKNK

SEQ ID NO: 58413 - protein, 9 aa, Borrelia garinii
KAMTNVGSF

SEQ ID NO: 58414 - protein, 9 aa, Borrelia garinii
DWSNLGTLV

SEQ ID NO: 58415 - protein, 9 aa, Borrelia garinii
KFSEFTVNI

SEQ ID NO: 58416 - protein, 10 aa, Borrelia garinii
MFIICAVFVL

SEQ ID NO: 58417 - protein, 10 aa, Borrelia garinii
DWSNLGTLVI

SEQ ID NO: 58418 - protein, 11 aa, Borrelia garinii
MFIICAVFVLI

SEQ ID NO: 58419 - protein, 11 aa, Borrelia garinii
VFVLISSCGNF

SEQ ID NO: 58420 - protein, 11 aa, Borrelia garinii
ETINNSEHITF

SEQ ID NO: 58421 - protein, 9 aa, Borrelia garinii
GSFKTSLYY

SEQ ID NO: 58422 - protein, 9 aa, Borrelia garinii
FKTSLYYGY

SEQ ID NO: 58423 - protein, 9 aa, Borrelia garinii
KMFIICAVF

SEQ ID NO: 58424 - protein, 10 aa, Borrelia garinii
SFKTSLYYGY

SEQ ID NO: 58425 - protein, 10 aa, Borrelia garinii
NVGSFKTSLY

SEQ ID NO: 58426 - protein, 10 aa, Borrelia garinii
VGSFKTSLYY

SEQ ID NO: 58427 - protein, 11 aa, Borrelia garinii
NVGSFKTSLYY

SEQ ID NO: 58428 - protein, 11 aa, Borrelia garinii
GSFKTSLYYGY

SEQ ID NO: 58429 - protein, 9 aa, Borrelia garinii
FTVNIKNKK

SEQ ID NO: 58430 - protein, 9 aa, Borrelia garinii
LISSCGNFR

SEQ ID NO: 58431 - protein, 9 aa, Borrelia garinii
EAEVNNFVK

SEQ ID NO: 58432 - protein, 9 aa, Borrelia garinii
KTSLYYGYK

SEQ ID NO: 58433 - protein, 9 aa, Borrelia garinii
FSEFTVNIK

SEQ ID NO: 58434 - protein, 9 aa, Borrelia garinii
AMTNVGSFK

SEQ ID NO: 58435 - protein, 9 aa, Borrelia garinii
EFTVNIKNK

SEQ ID NO: 58436 - protein, 9 aa, Borrelia garinii
DTIKFSEFT

SEQ ID NO: 58437 - protein, 9 aa, Borrelia garinii
SSTNGIKGK

SEQ ID NO: 58438 - protein, 9 aa, Borrelia garinii
EQSSTNGIK

SEQ ID NO: 58439 - protein, 9 aa, Borrelia garinii
EHITFSGDK

SEQ ID NO: 58440 - protein, 9 aa, Borrelia garinii
HSATFFCIE

SEQ ID NO: 58441 - protein, 9 aa, Borrelia garinii
NLGTLVIRK

SEQ ID NO: 58442 - protein, 9 aa, Borrelia garinii
MTNVGSFKT

SEQ ID NO: 58443 - protein, 9 aa, Borrelia garinii
NVIGTINGQ

SEQ ID NO: 58444 - protein, 9 aa, Borrelia garinii
ETINNSEHI

SEQ ID NO: 58445 - protein, 10 aa, Borrelia garinii
VLISSCGNFR

SEQ ID NO: 58446 - protein, 10 aa, Borrelia garinii
EEAEVNNFVK

SEQ ID NO: 58447 - protein, 10 aa, Borrelia garinii
KAMTNVGSFK

SEQ ID NO: 58448 - protein, 10 aa, Borrelia garinii
EFTVNIKNKK

SEQ ID NO: 58449 - protein, 10 aa, Borrelia garinii
WSNLGTLVIR

SEQ ID NO: 58450 - protein, 10 aa, Borrelia garinii
NVGSFKTSLY

SEQ ID NO: 58451 - protein, 10 aa, Borrelia garinii
VIGTINGQLR

SEQ ID NO: 58452 - protein, 10 aa, Borrelia garinii
FKTSLYYGYK

SEQ ID NO: 58453 - protein, 10 aa, Borrelia garinii
HSATFFCIEE

SEQ ID NO: 58454 - protein, 10 aa, Borrelia garinii
QSSTNGIKGK

SEQ ID NO: 58455 - protein, 10 aa, Borrelia garinii
ETINNSEHIT

SEQ ID NO: 58456 - protein, 10 aa, Borrelia garinii
DTIKFSEFTV

SEQ ID NO: 58457 - protein, 11 aa, Borrelia garinii
NVIGTINGQLR

SEQ ID NO: 58458 - protein, 11 aa, Borrelia garinii
FVLISSCGNFR

SEQ ID NO: 58459 - protein, 11 aa, Borrelia garinii
NSEHITFSGDK

SEQ ID NO: 58460 - protein, 11 aa, Borrelia garinii
FSEFTVNIKNK

SEQ ID NO: 58461 - protein, 11 aa, Borrelia garinii
WSNLGTLVIRK

SEQ ID NO: 58462 - protein, 11 aa, Borrelia garinii
ETINNSEHITF

SEQ ID NO: 58463 - protein, 11 aa, Borrelia garinii
SFKTSLYYGYK

SEQ ID NO: 58464 - protein, 11 aa, Borrelia garinii
DWSNLGTLVIR

SEQ ID NO: 58465 - protein, 11 aa, Borrelia garinii
NVGSFKTSLYY

SEQ ID NO: 58466 - protein, 11 aa, Borrelia garinii
EQSSTNGIKGK

SEQ ID NO: 58467 - protein, 11 aa, Borrelia garinii
SEFTVNIKNKK

SEQ ID NO: 58468 - protein, 11 aa, Borrelia garinii
TNVGSFKTSLY

SEQ ID NO: 58469 - protein, 9 aa, Borrelia garinii
KAMTNVGSF

SEQ ID NO: 58470 - protein, 11 aa, Borrelia garinii
FVKAMTNVGSF

SEQ ID NO: 58471 - protein, 9 aa, Borrelia garinii
QLRGHSATF

SEQ ID NO: 58472 - protein, 11 aa, Borrelia garinii
FVKAMTNVGSF

SEQ ID NO: 58473 - protein, 11 aa, Borrelia garinii
NGQLRGHSATF

SEQ ID NO: 58474 - protein, 9 aa, Borrelia garinii
KMFIICAVF

SEQ ID NO: 58475 - protein, 9 aa, Borrelia garinii
QLRGHSATF

SEQ ID NO: 58476 - protein, 9 aa, Borrelia garinii
GSFKTSLYY

SEQ ID NO: 58477 - protein, 9 aa, Borrelia garinii
KAMTNVGSF

SEQ ID NO: 58478 - protein, 9 aa, Borrelia garinii
VLISSCGNF

SEQ ID NO: 58479 - protein, 9 aa, Borrelia garinii
GQLRGHSAT

SEQ ID NO: 58480 - protein, 10 aa, Borrelia garinii
GQLRGHSATF

SEQ ID NO: 58481 - protein, 10 aa, Borrelia garinii
QLRGHSATFF

SEQ ID NO: 58482 - protein, 10 aa, Borrelia garinii
GQASSDTIKF

SEQ ID NO: 58483 - protein, 10 aa, Borrelia garinii
FVLISSCGNF

SEQ ID NO: 58484 - protein, 10 aa, Borrelia garinii
TINNSEHITF

SEQ ID NO: 58485 - protein, 10 aa, Borrelia garinii
KMKMFIICAV

SEQ ID NO: 58486 - protein, 10 aa, Borrelia garinii
VGSFKTSLYY

SEQ ID NO: 58487 - protein, 11 aa, Borrelia garinii
FVKAMTNVGSF

SEQ ID NO: 58488 - protein, 11 aa, Borrelia garinii
KMKMFIICAVF

SEQ ID NO: 58489 - protein, 11 aa, Borrelia garinii
GQLRGHSATFF

SEQ ID NO: 58490 - protein, 11 aa, Borrelia garinii
KMFIICAVFVL

SEQ ID NO: 58491 - protein, 11 aa, Borrelia garinii
GSFKTSLYYGY

SEQ ID NO: 58492 - protein, 11 aa, Borrelia garinii
ASSDTIKFSEF

SEQ ID NO: 58493 - protein, 11 aa, Borrelia garinii
ETINNSEHITF

SEQ ID NO: 58494 - protein, 11 aa, Borrelia garinii
FCIEEAEVNNF

SEQ ID NO: 58495 - protein, 10 aa, Borrelia garinii
GQLRGHSATF

SEQ ID NO: 58496 - protein, 11 aa, Borrelia garinii
FRSSLSDQGSL

SEQ ID NO: 58497 - protein, 9 aa, Borrelia garinii
EVNNFVKAM

SEQ ID NO: 58498 - protein, 9 aa, Borrelia garinii
QASSDTIKF

SEQ ID NO: 58499 - protein, 9 aa, Borrelia garinii
FIICAVFVL

SEQ ID NO: 58500 - protein, 9 aa, Borrelia garinii
KAMTNVGSF

SEQ ID NO: 58501 - protein, 9 aa, Borrelia garinii
QLRGHSATF

SEQ ID NO: 58502 - protein, 10 aa, Borrelia garinii
MKMFIICAVF

SEQ ID NO: 58503 - protein, 10 aa, Borrelia garinii
TINNSEHITF

SEQ ID NO: 58504 - protein, 10 aa, Borrelia garinii
MFIICAVFVL

SEQ ID NO: 58505 - protein, 10 aa, Borrelia garinii
FVLISSCGNF

SEQ ID NO: 58506 - protein, 10 aa, Borrelia garinii
NVGSFKTSLY

SEQ ID NO: 58507 - protein, 11 aa, Borrelia garinii
EAEVNNFVKAM

SEQ ID NO: 58508 - protein, 11 aa, Borrelia garinii
FVKAMTNVGSF

SEQ ID NO: 58509 - protein, 11 aa, Borrelia garinii
ETINNSEHITF

SEQ ID NO: 58510 - protein, 11 aa, Borrelia garinii
FCIEEAEVNNF

SEQ ID NO: 58511 - protein, 11 aa, Borrelia garinii
NVGSFKTSLYY

SEQ ID NO: 58512 - protein, 11 aa, Borrelia garinii
MTNVGSFKTSL

SEQ ID NO: 58513 - protein, 9 aa, Borrelia garinii
SEFTVNIKN

SEQ ID NO: 58514 - protein, 9 aa, Borrelia garinii
EEAEVNNFV

SEQ ID NO: 58515 - protein, 9 aa, Borrelia garinii
KEITTKIET

SEQ ID NO: 58516 - protein, 9 aa, Borrelia garinii
EEQSSTNGI

SEQ ID NO: 58517 - protein, 9 aa, Borrelia garinii
AEVNNFVKA

SEQ ID NO: 58518 - protein, 10 aa, Borrelia garinii
AEVNNFVKAM

SEQ ID NO: 58519 - protein, 10 aa, Borrelia garinii
SEFTVNIKNK

SEQ ID NO: 58520 - protein, 10 aa, Borrelia garinii
KEITTKIETI

SEQ ID NO: 58521 - protein, 11 aa, Borrelia garinii
AEVNNFVKAMT

SEQ ID NO: 58522 - protein, 11 aa, Borrelia garinii
SEFTVNIKNKK

SEQ ID NO: 58523 - protein, 11 aa, Borrelia garinii
EEAEVNNFVKA

SEQ ID NO: 58524 - protein, 9 aa, Borrelia burgdorferi
LIICAVFVL

SEQ ID NO: 58525 - protein, 9 aa, Borrelia burgdorferi
NLIICAVFV

SEQ ID NO: 58526 - protein, 9 aa, Borrelia burgdorferi
SLFNPPPVL

SEQ ID NO: 58527 - protein, 9 aa, Borrelia burgdorferi
KMKNLIICA

SEQ ID NO: 58528 - protein, 9 aa, Borrelia burgdorferi
FVLIISCKI

SEQ ID NO: 58529 - protein, 9 aa, Borrelia burgdorferi
ALKNIEEEL

SEQ ID NO: 58530 - protein, 9 aa, Borrelia burgdorferi
IICAVFVLI

SEQ ID NO: 58531 - protein, 9 aa, Borrelia burgdorferi
VIDDALKNI

SEQ ID NO: 58532 - protein, 9 aa, Borrelia burgdorferi
ATGESTEKV

SEQ ID NO: 58533 - protein, 10 aa, Borrelia burgdorferi
KMKNLIICAV

SEQ ID NO: 58534 - protein, 10 aa, Borrelia burgdorferi
LIICAVFVLI

SEQ ID NO: 58535 - protein, 10 aa, Borrelia burgdorferi
NLIICAVFVL

SEQ ID NO: 58536 - protein, 10 aa, Borrelia burgdorferi
ALKYAKELGV

SEQ ID NO: 58537 - protein, 10 aa, Borrelia burgdorferi
KVIDDALKNI

SEQ ID NO: 58538 - protein, 10 aa, Borrelia burgdorferi
IICAVFVLII

SEQ ID NO: 58539 - protein, 11 aa, Borrelia burgdorferi
SLFNPPPVLPA

SEQ ID NO: 58540 - protein, 11 aa, Borrelia burgdorferi
LIICAVFVLII

SEQ ID NO: 58541 - protein, 11 aa, Borrelia burgdorferi
LMQGDDPNNSL

SEQ ID NO: 58542 - protein, 11 aa, Borrelia burgdorferi
NLIICAVFVLI

SEQ ID NO: 58543 - protein, 11 aa, Borrelia burgdorferi
KALKYAKELGV

SEQ ID NO: 58544 - protein, 11 aa, Borrelia burgdorferi
FVLIISCKIDA

SEQ ID NO: 58545 - protein, 11 aa, Borrelia burgdorferi
KKMKNLIICAV

SEQ ID NO: 58546 - protein, 11 aa, Borrelia burgdorferi
AVFVLIISCKI

SEQ ID NO: 58547 - protein, 9 aa, Borrelia burgdorferi
GTNTNDFVK

SEQ ID NO: 58548 - protein, 9 aa, Borrelia burgdorferi
VFVLIISCK

SEQ ID NO: 58549 - protein, 10 aa, Borrelia burgdorferi
AVFVLIISCK

SEQ ID NO: 58550 - protein, 10 aa, Borrelia burgdorferi
SSHDNTPVLK

SEQ ID NO: 58551 - protein, 10 aa, Borrelia burgdorferi
GTNTNDFVKK

SEQ ID NO: 58552 - protein, 10 aa, Borrelia burgdorferi
KIDASSEDLK

SEQ ID NO: 58553 - protein, 10 aa, Borrelia burgdorferi
ESATGESTEK

SEQ ID NO: 58554 - protein, 11 aa, Borrelia burgdorferi
KVKKQGNIGQK

SEQ ID NO: 58555 - protein, 11 aa, Borrelia burgdorferi
KLAEPQNIEDK

SEQ ID NO: 58556 - protein, 11 aa, Borrelia burgdorferi
KQGNIGQKALK

SEQ ID NO: 58557 - protein, 11 aa, Borrelia burgdorferi
ASSHDNTPVLK

SEQ ID NO: 58558 - protein, 11 aa, Borrelia burgdorferi
CAVFVLIISCK

SEQ ID NO: 58559 - protein, 11 aa, Borrelia burgdorferi
FVKKVIDDALK

SEQ ID NO: 58560 - protein, 11 aa, Borrelia burgdorferi
ATGESTEKVKK

SEQ ID NO: 58561 - protein, 11 aa, Borrelia burgdorferi
ALKNIEEELEK

SEQ ID NO: 58562 - protein, 9 aa, Borrelia burgdorferi
GTNTNDFVK

SEQ ID NO: 58563 - protein, 9 aa, Borrelia burgdorferi
SATGESTEK

SEQ ID NO: 58564 - protein, 9 aa, Borrelia burgdorferi
GQKALKYAK

SEQ ID NO: 58565 - protein, 9 aa, Borrelia burgdorferi
VFVLIISCK

SEQ ID NO: 58566 - protein, 9 aa, Borrelia burgdorferi
PVLKAVQAK

SEQ ID NO: 58567 - protein, 9 aa, Borrelia burgdorferi
GQQEGKEEK

SEQ ID NO: 58568 - protein, 10 aa, Borrelia burgdorferi
AVFVLIISCK

SEQ ID NO: 58569 - protein, 10 aa, Borrelia burgdorferi
SSHDNTPVLK

SEQ ID NO: 58570 - protein, 10 aa, Borrelia burgdorferi
GTNTNDFVKK

SEQ ID NO: 58571 - protein, 10 aa, Borrelia burgdorferi
KIDASSEDLK

SEQ ID NO: 58572 - protein, 10 aa, Borrelia burgdorferi
SSEDLKQNVK

SEQ ID NO: 58573 - protein, 10 aa, Borrelia burgdorferi
ATGESTEKVK

SEQ ID NO: 58574 - protein, 10 aa, Borrelia burgdorferi
ESATGESTEK

SEQ ID NO: 58575 - protein, 11 aa, Borrelia burgdorferi
ASSHDNTPVLK

SEQ ID NO: 58576 - protein, 11 aa, Borrelia burgdorferi
ATGESTEKVKK

SEQ ID NO: 58577 - protein, 11 aa, Borrelia burgdorferi
CAVFVLIISCK

SEQ ID NO: 58578 - protein, 11 aa, Borrelia burgdorferi
ASSEDLKQNVK

SEQ ID NO: 58579 - protein, 11 aa, Borrelia burgdorferi
KVKKQGNIGQK

SEQ ID NO: 58580 - protein, 11 aa, Borrelia burgdorferi
KQGNIGQKALK

SEQ ID NO: 58581 - protein, 11 aa, Borrelia burgdorferi
NIGQKALKYAK

SEQ ID NO: 58582 - protein, 11 aa, Borrelia burgdorferi
SATGESTEKVK

SEQ ID NO: 58583 - protein, 11 aa, Borrelia burgdorferi
ALKNIEEELEK

SEQ ID NO: 58584 - protein, 11 aa, Borrelia burgdorferi
KLAEPQNIEDK

SEQ ID NO: 58585 - protein, 11 aa, Borrelia burgdorferi
FVKKVIDDALK

SEQ ID NO: 58586 - protein, 11 aa, Borrelia burgdorferi
NTPVLKAVQAK

SEQ ID NO: 58587 - protein, 9 aa, Borrelia burgdorferi
NIGQKALKY

SEQ ID NO: 58588 - protein, 11 aa, Borrelia burgdorferi
YAKELGVNGSY

SEQ ID NO: 58589 - protein, 9 aa, Borrelia burgdorferi
GTNTNDFVK

SEQ ID NO: 58590 - protein, 9 aa, Borrelia burgdorferi
SATGESTEK

SEQ ID NO: 58591 - protein, 9 aa, Borrelia burgdorferi
ELKDKIDKR

SEQ ID NO: 58592 - protein, 9 aa, Borrelia burgdorferi
VFVLIISCK

SEQ ID NO: 58593 - protein, 9 aa, Borrelia burgdorferi
EPQNIEDKK

SEQ ID NO: 58594 - protein, 9 aa, Borrelia burgdorferi
TNTNDFVKK

SEQ ID NO: 58595 - protein, 9 aa, Borrelia burgdorferi
DLKQNVKEK

SEQ ID NO: 58596 - protein, 9 aa, Borrelia burgdorferi
IDASSEDLK

SEQ ID NO: 58597 - protein, 10 aa, Borrelia burgdorferi
ESATGESTEK

SEQ ID NO: 58598 - protein, 10 aa, Borrelia burgdorferi
EARKKFQEFK

SEQ ID NO: 58599 - protein, 10 aa, Borrelia burgdorferi
AVFVLIISCK

SEQ ID NO: 58600 - protein, 10 aa, Borrelia burgdorferi
SSHDNTPVLK

SEQ ID NO: 58601 - protein, 10 aa, Borrelia burgdorferi
GTNTNDFVKK

SEQ ID NO: 58602 - protein, 10 aa, Borrelia burgdorferi
TPVLKAVQAK

SEQ ID NO: 58603 - protein, 10 aa, Borrelia burgdorferi
DGTNTNDFVK

SEQ ID NO: 58604 - protein, 10 aa, Borrelia burgdorferi
ELKDKIDKRK

SEQ ID NO: 58605 - protein, 10 aa, Borrelia burgdorferi
LAEPQNIEDK

SEQ ID NO: 58606 - protein, 10 aa, Borrelia burgdorferi
SSEDLKQNVK

SEQ ID NO: 58607 - protein, 11 aa, Borrelia burgdorferi
CAVFVLIISCK

SEQ ID NO: 58608 - protein, 11 aa, Borrelia burgdorferi
FVKKVIDDALK

SEQ ID NO: 58609 - protein, 11 aa, Borrelia burgdorferi
NTPVLKAVQAK

SEQ ID NO: 58610 - protein, 11 aa, Borrelia burgdorferi
EEARKKFQEFK

SEQ ID NO: 58611 - protein, 11 aa, Borrelia burgdorferi
EIQELKDKIDK

SEQ ID NO: 58612 - protein, 11 aa, Borrelia burgdorferi
SATGESTEKVK

SEQ ID NO: 58613 - protein, 11 aa, Borrelia burgdorferi
NIGQKALKYAK

SEQ ID NO: 58614 - protein, 11 aa, Borrelia burgdorferi
LAEPQNIEDKK

SEQ ID NO: 58615 - protein, 11 aa, Borrelia burgdorferi
CKIDASSEDLK

SEQ ID NO: 58616 - protein, 11 aa, Borrelia burgdorferi
QAKDGGQQEGK

SEQ ID NO: 58617 - protein, 11 aa, Borrelia burgdorferi
DGTNTNDFVKK

SEQ ID NO: 58618 - protein, 11 aa, Borrelia burgdorferi
ELKDKIDKRKK

SEQ ID NO: 58619 - protein, 11 aa, Borrelia burgdorferi
ASSHDNTPVLK

SEQ ID NO: 58620 - protein, 9 aa, Borrelia burgdorferi
TPVLKAVQA

SEQ ID NO: 58621 - protein, 9 aa, Borrelia burgdorferi
LPASSHDNT

SEQ ID NO: 58622 - protein, 11 aa, Borrelia burgdorferi
LPASSHDNTPV

SEQ ID NO: 58623 - protein, 9 aa, Borrelia burgdorferi
EARKKFQEF

SEQ ID NO: 58624 - protein, 10 aa, Borrelia burgdorferi
FVKKVIDDAL

SEQ ID NO: 58625 - protein, 9 aa, Borrelia burgdorferi
SLFNPPPVL

SEQ ID NO: 58626 - protein, 9 aa, Borrelia burgdorferi
KELGVNGSY

SEQ ID NO: 58627 - protein, 9 aa, Borrelia burgdorferi
NVKEKVEGF

SEQ ID NO: 58628 - protein, 10 aa, Borrelia burgdorferi
KQGNIGQKAL

SEQ ID NO: 58629 - protein, 10 aa, Borrelia burgdorferi
MQGDDPNNSL

SEQ ID NO: 58630 - protein, 10 aa, Borrelia burgdorferi
KMKNLIICAV

SEQ ID NO: 58631 - protein, 11 aa, Borrelia burgdorferi
YAKELGVNGSY

SEQ ID NO: 58632 - protein, 11 aa, Borrelia burgdorferi
KMKNLIICAVF

SEQ ID NO: 58633 - protein, 11 aa, Borrelia burgdorferi
KQNVKEKVEGF

SEQ ID NO: 58634 - protein, 11 aa, Borrelia burgdorferi
MQGDDPNNSLF

SEQ ID NO: 58635 - protein, 11 aa, Borrelia burgdorferi
SVNDGTNTNDF

SEQ ID NO: 58636 - protein, 11 aa, Borrelia burgdorferi
LMQGDDPNNSL

SEQ ID NO: 58637 - protein, 11 aa, Borrelia burgdorferi
GQKALKYAKEL

SEQ ID NO: 58638 - protein, 9 aa, Borrelia burgdorferi
GQKALKYAK

SEQ ID NO: 58639 - protein, 11 aa, Borrelia burgdorferi
KRKKELEEARK

SEQ ID NO: 58640 - protein, 11 aa, Borrelia burgdorferi
KQGNIGQKALK

SEQ ID NO: 58641 - protein, 9 aa, Borrelia burgdorferi
NPPPVLPAS

SEQ ID NO: 58642 - protein, 9 aa, Borrelia burgdorferi
EARKKFQEF

SEQ ID NO: 58643 - protein, 9 aa, Borrelia burgdorferi
LIICAVFVL

SEQ ID NO: 58644 - protein, 10 aa, Borrelia burgdorferi
MKNLIICAVF

SEQ ID NO: 58645 - protein, 10 aa, Borrelia burgdorferi
FVKKVIDDAL

SEQ ID NO: 58646 - protein, 10 aa, Borrelia burgdorferi
TPVLKAVQAK

SEQ ID NO: 58647 - protein, 10 aa, Borrelia burgdorferi
LPASSHDNTP

SEQ ID NO: 58648 - protein, 11 aa, Borrelia burgdorferi
YAKELGVNGSY

SEQ ID NO: 58649 - protein, 11 aa, Borrelia burgdorferi
SVNDGTNTNDF

SEQ ID NO: 58650 - protein, 11 aa, Borrelia burgdorferi
LPASSHDNTPV

SEQ ID NO: 58651 - protein, 11 aa, Borrelia burgdorferi
PASSHDNTPVL

SEQ ID NO: 58652 - protein, 11 aa, Borrelia burgdorferi
NPPPVLPASSH

SEQ ID NO: 58653 - protein, 11 aa, Borrelia burgdorferi
MQGDDPNNSLF

SEQ ID NO: 58654 - protein, 9 aa, Borrelia burgdorferi
QEFKEQVES

SEQ ID NO: 58655 - protein, 9 aa, Borrelia burgdorferi
KELGVNGSY

SEQ ID NO: 58656 - protein, 10 aa, Borrelia burgdorferi
EEARKKFQEF

SEQ ID NO: 58657 - protein, 10 aa, Borrelia burgdorferi
EEKEKEIQEL

SEQ ID NO: 58658 - protein, 10 aa, Borrelia burgdorferi
KELEEARKKF

SEQ ID NO: 58659 - protein, 10 aa, Borrelia burgdorferi
KEIQELKDKI

SEQ ID NO: 58660 - protein, 11 aa, Borrelia burgdorferi
EEELEKLAEPQ

SEQ ID NO: 58661 - protein, 11 aa, Borrelia burgdorferi
QEFKEQVESAT

SEQ ID NO: 58662 - protein, 11 aa, Borrelia burgdorferi
EELEKLAEPQN

SEQ ID NO: 58663 - protein, 9 aa, Borrelia burgdorferi
PPPVLPASS

SEQ ID NO: 58664 - protein, 9 aa, Borrelia burgdorferi
TPVLKAVQA

SEQ ID NO: 58665 - protein, 9 aa, Borrelia burgdorferi
LPASSHDNT

SEQ ID NO: 58666 - protein, 10 aa, Borrelia burgdorferi
LPASSHDNTP

SEQ ID NO: 58667 - protein, 10 aa, Borrelia burgdorferi
NPPPVLPASS

SEQ ID NO: 58668 - protein, 10 aa, Borrelia burgdorferi
CAVFVLIISC

SEQ ID NO: 58669 - protein, 11 aa, Borrelia burgdorferi
LPASSHDNTPV

SEQ ID NO: 58670 - protein, 9 aa, Borrelia burgdorferi
LTNYVDYVY

SEQ ID NO: 58671 - protein, 9 aa, Borrelia burgdorferi
KVSVYSLGY

SEQ ID NO: 58672 - protein, 9 aa, Borrelia burgdorferi
FEDMNGMEY

SEQ ID NO: 58673 - protein, 9 aa, Borrelia burgdorferi
DSESVFKVY

SEQ ID NO: 58674 - protein, 10 aa, Borrelia burgdorferi
RLDLTNYVDY

SEQ ID NO: 58675 - protein, 10 aa, Borrelia burgdorferi
SSKVKNFIFY

SEQ ID NO: 58676 - protein, 10 aa, Borrelia burgdorferi
LTPSARLQAY

SEQ ID NO: 58677 - protein, 10 aa, Borrelia burgdorferi
SSTRLDLTNY

SEQ ID NO: 58678 - protein, 11 aa, Borrelia burgdorferi
HSSKVKNFIFY

SEQ ID NO: 58679 - protein, 11 aa, Borrelia burgdorferi
WADLIWSNPNY

SEQ ID NO: 58680 - protein, 11 aa, Borrelia burgdorferi
PSSTRLDLTNY

SEQ ID NO: 58681 - protein, 11 aa, Borrelia burgdorferi
DIDSESVFKVY

SEQ ID NO: 58682 - protein, 11 aa, Borrelia burgdorferi
KTMKEIKVSVY

SEQ ID NO: 58683 - protein, 9 aa, Borrelia burgdorferi
FLLSTVLFA

SEQ ID NO: 58684 - protein, 9 aa, Borrelia burgdorferi
ILFFLLSTV

SEQ ID NO: 58685 - protein, 9 aa, Borrelia burgdorferi
KVKNFIFYV

SEQ ID NO: 58686 - protein, 9 aa, Borrelia burgdorferi
YAGDTILGV

SEQ ID NO: 58687 - protein, 9 aa, Borrelia burgdorferi
VLFEDMNGM

SEQ ID NO: 58688 - protein, 9 aa, Borrelia burgdorferi
LIWSNPNYI

SEQ ID NO: 58689 - protein, 9 aa, Borrelia burgdorferi
AMIMPPFKI

SEQ ID NO: 58690 - protein, 9 aa, Borrelia burgdorferi
YVYSGASGI

SEQ ID NO: 58691 - protein, 9 aa, Borrelia burgdorferi
GINNWSVLL

SEQ ID NO: 58692 - protein, 9 aa, Borrelia burgdorferi
VLLTPSARL

SEQ ID NO: 58693 - protein, 9 aa, Borrelia burgdorferi
KMRFKAFRV

SEQ ID NO: 58694 - protein, 9 aa, Borrelia burgdorferi
YVDYVYSGA

SEQ ID NO: 58695 - protein, 9 aa, Borrelia burgdorferi
LVLDFAELA

SEQ ID NO: 58696 - protein, 9 aa, Borrelia burgdorferi
YIPNISSRI

SEQ ID NO: 58697 - protein, 9 aa, Borrelia burgdorferi
TMKEIKVSV

SEQ ID NO: 58698 - protein, 9 aa, Borrelia burgdorferi
GLIDNIKTM

SEQ ID NO: 58699 - protein, 9 aa, Borrelia burgdorferi
DLTNYVDYV

SEQ ID NO: 58700 - protein, 9 aa, Borrelia burgdorferi
RVLYDKLSV

SEQ ID NO: 58701 - protein, 9 aa, Borrelia burgdorferi
SVYSLGYEI

SEQ ID NO: 58702 - protein, 9 aa, Borrelia burgdorferi
KAKSILFFL

SEQ ID NO: 58703 - protein, 9 aa, Borrelia burgdorferi
LLSTVLFAQ

SEQ ID NO: 58704 - protein, 9 aa, Borrelia burgdorferi
KLREKISIA

SEQ ID NO: 58705 - protein, 9 aa, Borrelia burgdorferi
LQAYVKNSV

SEQ ID NO: 58706 - protein, 9 aa, Borrelia burgdorferi
SILFFLLST

SEQ ID NO: 58707 - protein, 9 aa, Borrelia burgdorferi
LGYEIDLEV

SEQ ID NO: 58708 - protein, 9 aa, Borrelia burgdorferi
VLYDKLSVS

SEQ ID NO: 58709 - protein, 9 aa, Borrelia burgdorferi
GLAEGSKRA

SEQ ID NO: 58710 - protein, 10 aa, Borrelia burgdorferi
VLYDKLSVSI

SEQ ID NO: 58711 - protein, 10 aa, Borrelia burgdorferi
FIFYVKDLRV

SEQ ID NO: 58712 - protein, 10 aa, Borrelia burgdorferi
FLGKGLIDNI

SEQ ID NO: 58713 - protein, 10 aa, Borrelia burgdorferi
SLGYEIDLEV

SEQ ID NO: 58714 - protein, 10 aa, Borrelia burgdorferi
SILFFLLSTV

SEQ ID NO: 58715 - protein, 10 aa, Borrelia burgdorferi
FLLSTVLFAQ

SEQ ID NO: 58716 - protein, 10 aa, Borrelia burgdorferi
RLQAYVKNSV

SEQ ID NO: 58717 - protein, 10 aa, Borrelia burgdorferi
KTMKEIKVSV

SEQ ID NO: 58718 - protein, 10 aa, Borrelia burgdorferi
VLFAQETDGL

SEQ ID NO: 58719 - protein, 10 aa, Borrelia burgdorferi
ILFFLLSTVL

SEQ ID NO: 58720 - protein, 10 aa, Borrelia burgdorferi
YVYSGASGIV

SEQ ID NO: 58721 - protein, 10 aa, Borrelia burgdorferi
KLSVSIDSDI

SEQ ID NO: 58722 - protein, 10 aa, Borrelia burgdorferi
FFLLSTVLFA

SEQ ID NO: 58723 - protein, 10 aa, Borrelia burgdorferi
SKVKNFIFYV

SEQ ID NO: 58724 - protein, 10 aa, Borrelia burgdorferi
VLFPSYSQSS

SEQ ID NO: 58725 - protein, 10 aa, Borrelia burgdorferi
LQAYVKNSVV

SEQ ID NO: 58726 - protein, 10 aa, Borrelia burgdorferi
KAKSILFFLL

SEQ ID NO: 58727 - protein, 10 aa, Borrelia burgdorferi
YIPNISSRII

SEQ ID NO: 58728 - protein, 10 aa, Borrelia burgdorferi
YVKNSVVAPA

SEQ ID NO: 58729 - protein, 10 aa, Borrelia burgdorferi
LLTPSARLQA

SEQ ID NO: 58730 - protein, 11 aa, Borrelia burgdorferi
RLDLTNYVDYV

SEQ ID NO: 58731 - protein, 11 aa, Borrelia burgdorferi
SIAEGSFQNFV

SEQ ID NO: 58732 - protein, 11 aa, Borrelia burgdorferi
SIDSDIDSESV

SEQ ID NO: 58733 - protein, 11 aa, Borrelia burgdorferi
VLFPSYSQSSA

SEQ ID NO: 58734 - protein, 11 aa, Borrelia burgdorferi
YSLGYEIDLEV

SEQ ID NO: 58735 - protein, 11 aa, Borrelia burgdorferi
RLQAYVKNSVV

SEQ ID NO: 58736 - protein, 11 aa, Borrelia burgdorferi
KVYETSGTESL

SEQ ID NO: 58737 - protein, 11 aa, Borrelia burgdorferi
YAGDTILGVRV

SEQ ID NO: 58738 - protein, 11 aa, Borrelia burgdorferi
SLGYEIDLEVL

SEQ ID NO: 58739 - protein, 11 aa, Borrelia burgdorferi
VVDLGINNWSV

SEQ ID NO: 58740 - protein, 11 aa, Borrelia burgdorferi
SILFFLLSTVL

SEQ ID NO: 58741 - protein, 11 aa, Borrelia burgdorferi
KVSVYSLGYEI

SEQ ID NO: 58742 - protein, 11 aa, Borrelia burgdorferi
FIFYVKDLRVL

SEQ ID NO: 58743 - protein, 11 aa, Borrelia burgdorferi
LLSTVLFAQET

SEQ ID NO: 58744 - protein, 11 aa, Borrelia burgdorferi
KSILFFLLSTV

SEQ ID NO: 58745 - protein, 11 aa, Borrelia burgdorferi
VLLTPSARLQA

SEQ ID NO: 58746 - protein, 11 aa, Borrelia burgdorferi
SVYSLGYEIDL

SEQ ID NO: 58747 - protein, 11 aa, Borrelia burgdorferi
YVKNSVVAPAV

SEQ ID NO: 58748 - protein, 11 aa, Borrelia burgdorferi
LTPSARLQAYV

SEQ ID NO: 58749 - protein, 11 aa, Borrelia burgdorferi
VLFAQETDGLA

SEQ ID NO: 58750 - protein, 11 aa, Borrelia burgdorferi
IMPPFKIPFYS

SEQ ID NO: 58751 - protein, 11 aa, Borrelia burgdorferi
IIKDDVPNYPL

SEQ ID NO: 58752 - protein, 11 aa, Borrelia burgdorferi
RVLYDKLSVSI

SEQ ID NO: 58753 - protein, 11 aa, Borrelia burgdorferi
KLKAHETFKRV

SEQ ID NO: 58754 - protein, 9 aa, Borrelia burgdorferi
KLKAHETFK

SEQ ID NO: 58755 - protein, 9 aa, Borrelia burgdorferi
RVSKSHSSK

SEQ ID NO: 58756 - protein, 9 aa, Borrelia burgdorferi
YAYSMGTLK

SEQ ID NO: 58757 - protein, 9 aa, Borrelia burgdorferi
GSFQNFVEK

SEQ ID NO: 58758 - protein, 9 aa, Borrelia burgdorferi
LASSKMRFK

SEQ ID NO: 58759 - protein, 9 aa, Borrelia burgdorferi
KVSVYSLGY

SEQ ID NO: 58760 - protein, 9 aa, Borrelia burgdorferi
SVVAPAVVK

SEQ ID NO: 58761 - protein, 9 aa, Borrelia burgdorferi
SAMIMPPFK

SEQ ID NO: 58762 - protein, 9 aa, Borrelia burgdorferi
RFKAFRVSK

SEQ ID NO: 58763 - protein, 9 aa, Borrelia burgdorferi
TSGTESLRK

SEQ ID NO: 58764 - protein, 9 aa, Borrelia burgdorferi
YSMGTLKFK

SEQ ID NO: 58765 - protein, 9 aa, Borrelia burgdorferi
YSGASGIVK

SEQ ID NO: 58766 - protein, 9 aa, Borrelia burgdorferi
LIDNIKTMK

SEQ ID NO: 58767 - protein, 9 aa, Borrelia burgdorferi
GTESLRKLK

SEQ ID NO: 58768 - protein, 9 aa, Borrelia burgdorferi
GVRVLFPSY

SEQ ID NO: 58769 - protein, 9 aa, Borrelia burgdorferi
KAFRVSKSH

SEQ ID NO: 58770 - protein, 10 aa, Borrelia burgdorferi
KVKNFIFYVK

SEQ ID NO: 58771 - protein, 10 aa, Borrelia burgdorferi
AYSMGTLKFK

SEQ ID NO: 58772 - protein, 10 aa, Borrelia burgdorferi
SSAMIMPPFK

SEQ ID NO: 58773 - protein, 10 aa, Borrelia burgdorferi
VYSGASGIVK

SEQ ID NO: 58774 - protein, 10 aa, Borrelia burgdorferi
GLIDNIKTMK

SEQ ID NO: 58775 - protein, 10 aa, Borrelia burgdorferi
PLASSKMRFK

SEQ ID NO: 58776 - protein, 10 aa, Borrelia burgdorferi
EYAYSMGTLK

SEQ ID NO: 58777 - protein, 10 aa, Borrelia burgdorferi
RKLKAHETFK

SEQ ID NO: 58778 - protein, 10 aa, Borrelia burgdorferi
VPNYPLASSK

SEQ ID NO: 58779 - protein, 10 aa, Borrelia burgdorferi
ETSGTESLRK

SEQ ID NO: 58780 - protein, 10 aa, Borrelia burgdorferi
VSKSHSSKVK

SEQ ID NO: 58781 - protein, 10 aa, Borrelia burgdorferi
IMPPFKIPFY

SEQ ID NO: 58782 - protein, 10 aa, Borrelia burgdorferi
SDIDSESVFK

SEQ ID NO: 58783 - protein, 10 aa, Borrelia burgdorferi
SSKVKNFIFY

SEQ ID NO: 58784 - protein, 10 aa, Borrelia burgdorferi
NSVVAPAVVK

SEQ ID NO: 58785 - protein, 10 aa, Borrelia burgdorferi
RLDLTNYVDY

SEQ ID NO: 58786 - protein, 10 aa, Borrelia burgdorferi
KLKAHETFKR

SEQ ID NO: 58787 - protein, 10 aa, Borrelia burgdorferi
MRFKAFRVSK

SEQ ID NO: 58788 - protein, 10 aa, Borrelia burgdorferi
APAVVKSESK

SEQ ID NO: 58789 - protein, 10 aa, Borrelia burgdorferi
AHETFKRVLK

SEQ ID NO: 58790 - protein, 10 aa, Borrelia burgdorferi
GESGNQFLGK

SEQ ID NO: 58791 - protein, 10 aa, Borrelia burgdorferi
SSKMRFKAFR

SEQ ID NO: 58792 - protein, 10 aa, Borrelia burgdorferi
LVLDFAELAR

SEQ ID NO: 58793 - protein, 10 aa, Borrelia burgdorferi
FRVSKSHSSK

SEQ ID NO: 58794 - protein, 10 aa, Borrelia burgdorferi
MIMPPFKIPF

SEQ ID NO: 58795 - protein, 10 aa, Borrelia burgdorferi
IPNISSRIIK

SEQ ID NO: 58796 - protein, 10 aa, Borrelia burgdorferi
KISIAEGSFQ

SEQ ID NO: 58797 - protein, 11 aa, Borrelia burgdorferi
KMRFKAFRVSK

SEQ ID NO: 58798 - protein, 11 aa, Borrelia burgdorferi
YVYSGASGIVK

SEQ ID NO: 58799 - protein, 11 aa, Borrelia burgdorferi
RVSKSHSSKVK

SEQ ID NO: 58800 - protein, 11 aa, Borrelia burgdorferi
MEYAYSMGTLK

SEQ ID NO: 58801 - protein, 11 aa, Borrelia burgdorferi
MIMPPFKIPFY

SEQ ID NO: 58802 - protein, 11 aa, Borrelia burgdorferi
KAHETFKRVLK

SEQ ID NO: 58803 - protein, 11 aa, Borrelia burgdorferi
QSSAMIMPPFK

SEQ ID NO: 58804 - protein, 11 aa, Borrelia burgdorferi
YAYSMGTLKFK

SEQ ID NO: 58805 - protein, 11 aa, Borrelia burgdorferi
HSSKVKNFIFY

SEQ ID NO: 58806 - protein, 11 aa, Borrelia burgdorferi
ILGVRVLFPSY

SEQ ID NO: 58807 - protein, 11 aa, Borrelia burgdorferi
KTMKEIKVSVY

SEQ ID NO: 58808 - protein, 11 aa, Borrelia burgdorferi
VLFEDMNGMEY

SEQ ID NO: 58809 - protein, 11 aa, Borrelia burgdorferi
FLGKGLIDNIK

SEQ ID NO: 58810 - protein, 11 aa, Borrelia burgdorferi
TSGTESLRKLK

SEQ ID NO: 58811 - protein, 11 aa, Borrelia burgdorferi
YIPNISSRIIK

SEQ ID NO: 58812 - protein, 11 aa, Borrelia burgdorferi
ASSKMRFKAFR

SEQ ID NO: 58813 - protein, 11 aa, Borrelia burgdorferi
LLTPSARLQAY

SEQ ID NO: 58814 - protein, 9 aa, Borrelia burgdorferi
SAMIMPPFK

SEQ ID NO: 58815 - protein, 9 aa, Borrelia burgdorferi
SVVAPAVVK

SEQ ID NO: 58816 - protein, 9 aa, Borrelia burgdorferi
GSFQNFVEK

SEQ ID NO: 58817 - protein, 9 aa, Borrelia burgdorferi
RVSKSHSSK

SEQ ID NO: 58818 - protein, 9 aa, Borrelia burgdorferi
YAYSMGTLK

SEQ ID NO: 58819 - protein, 9 aa, Borrelia burgdorferi
YSMGTLKFK

SEQ ID NO: 58820 - protein, 9 aa, Borrelia burgdorferi
TSGTESLRK

SEQ ID NO: 58821 - protein, 9 aa, Borrelia burgdorferi
SVLLTPSAR

SEQ ID NO: 58822 - protein, 9 aa, Borrelia burgdorferi
KLKAHETFK

SEQ ID NO: 58823 - protein, 9 aa, Borrelia burgdorferi
GTESLRKLK

SEQ ID NO: 58824 - protein, 9 aa, Borrelia burgdorferi
LASSKMRFK

SEQ ID NO: 58825 - protein, 9 aa, Borrelia burgdorferi
KVSVYSLGY

SEQ ID NO: 58826 - protein, 9 aa, Borrelia burgdorferi
YSGASGIVK

SEQ ID NO: 58827 - protein, 9 aa, Borrelia burgdorferi
SARLQAYVK

SEQ ID NO: 58828 - protein, 9 aa, Borrelia burgdorferi
RFKAFRVSK

SEQ ID NO: 58829 - protein, 9 aa, Borrelia burgdorferi
ESGNQFLGK

SEQ ID NO: 58830 - protein, 9 aa, Borrelia burgdorferi
VKNFIFYVK

SEQ ID NO: 58831 - protein, 9 aa, Borrelia burgdorferi
LIDNIKTMK

SEQ ID NO: 58832 - protein, 9 aa, Borrelia burgdorferi
LTNYVDYVY

SEQ ID NO: 58833 - protein, 9 aa, Borrelia burgdorferi
DIDSESVFK

SEQ ID NO: 58834 - protein, 9 aa, Borrelia burgdorferi
AVVKSESKR

SEQ ID NO: 58835 - protein, 9 aa, Borrelia burgdorferi
RVLFPSYSQ

SEQ ID NO: 58836 - protein, 9 aa, Borrelia burgdorferi
FVEKIESEK

SEQ ID NO: 58837 - protein, 9 aa, Borrelia burgdorferi
KSILFFLLS

SEQ ID NO: 58838 - protein, 9 aa, Borrelia burgdorferi
FIFYVKDLR

SEQ ID NO: 58839 - protein, 9 aa, Borrelia burgdorferi
GVRVLFPSY

SEQ ID NO: 58840 - protein, 9 aa, Borrelia burgdorferi
YVKDLRVLY

SEQ ID NO: 58841 - protein, 9 aa, Borrelia burgdorferi
SVYSLGYEI

SEQ ID NO: 58842 - protein, 9 aa, Borrelia burgdorferi
STRLDLTNY

SEQ ID NO: 58843 - protein, 10 aa, Borrelia burgdorferi
SSAMIMPPFK

SEQ ID NO: 58844 - protein, 10 aa, Borrelia burgdorferi
KVKNFIFYVK

SEQ ID NO: 58845 - protein, 10 aa, Borrelia burgdorferi
SSKMRFKAFR

SEQ ID NO: 58846 - protein, 10 aa, Borrelia burgdorferi
ETSGTESLRK

SEQ ID NO: 58847 - protein, 10 aa, Borrelia burgdorferi
GLIDNIKTMK

SEQ ID NO: 58848 - protein, 10 aa, Borrelia burgdorferi
AYSMGTLKFK

SEQ ID NO: 58849 - protein, 10 aa, Borrelia burgdorferi
SSKVKNFIFY

SEQ ID NO: 58850 - protein, 10 aa, Borrelia burgdorferi
LVLDFAELAR

SEQ ID NO: 58851 - protein, 10 aa, Borrelia burgdorferi
VSKSHSSKVK

SEQ ID NO: 58852 - protein, 10 aa, Borrelia burgdorferi
NSVVAPAVVK

SEQ ID NO: 58853 - protein, 10 aa, Borrelia burgdorferi
PSARLQAYVK

SEQ ID NO: 58854 - protein, 10 aa, Borrelia burgdorferi
PLASSKMRFK

SEQ ID NO: 58855 - protein, 10 aa, Borrelia burgdorferi
SSTRLDLTNY

SEQ ID NO: 58856 - protein, 10 aa, Borrelia burgdorferi
ETFKRVLKLR

SEQ ID NO: 58857 - protein, 10 aa, Borrelia burgdorferi
SDIDSESVFK

SEQ ID NO: 58858 - protein, 10 aa, Borrelia burgdorferi
RIIKDDVPNY

SEQ ID NO: 58859 - protein, 10 aa, Borrelia burgdorferi
KLKAHETFKR

SEQ ID NO: 58860 - protein, 10 aa, Borrelia burgdorferi
VPNYPLASSK

SEQ ID NO: 58861 - protein, 10 aa, Borrelia burgdorferi
VYSGASGIVK

SEQ ID NO: 58862 - protein, 10 aa, Borrelia burgdorferi
ETDGLAEGSK

SEQ ID NO: 58863 - protein, 11 aa, Borrelia burgdorferi
QSSAMIMPPFK

SEQ ID NO: 58864 - protein, 11 aa, Borrelia burgdorferi
YVYSGASGIVK

SEQ ID NO: 58865 - protein, 11 aa, Borrelia burgdorferi
YAYSMGTLKFK

SEQ ID NO: 58866 - protein, 11 aa, Borrelia burgdorferi
MIMPPFKIPFY

SEQ ID NO: 58867 - protein, 11 aa, Borrelia burgdorferi
KAHETFKRVLK

SEQ ID NO: 58868 - protein, 11 aa, Borrelia burgdorferi
ASSKMRFKAFR

SEQ ID NO: 58869 - protein, 11 aa, Borrelia burgdorferi
RVSKSHSSKVK

SEQ ID NO: 58870 - protein, 11 aa, Borrelia burgdorferi
TSGTESLRKLK

SEQ ID NO: 58871 - protein, 11 aa, Borrelia burgdorferi
KMRFKAFRVSK

SEQ ID NO: 58872 - protein, 11 aa, Borrelia burgdorferi
MEYAYSMGTLK

SEQ ID NO: 58873 - protein, 11 aa, Borrelia burgdorferi
YVKDLRVLYDK

SEQ ID NO: 58874 - protein, 11 aa, Borrelia burgdorferi
TPSARLQAYVK

SEQ ID NO: 58875 - protein, 11 aa, Borrelia burgdorferi
KTMKEIKVSVY

SEQ ID NO: 58876 - protein, 11 aa, Borrelia burgdorferi
VAPAVVKSESK

SEQ ID NO: 58877 - protein, 11 aa, Borrelia burgdorferi
YIPNISSRIIK

SEQ ID NO: 58878 - protein, 11 aa, Borrelia burgdorferi
HSSKVKNFIFY

SEQ ID NO: 58879 - protein, 11 aa, Borrelia burgdorferi
VLFEDMNGMEY

SEQ ID NO: 58880 - protein, 11 aa, Borrelia burgdorferi
DVPNYPLASSK

SEQ ID NO: 58881 - protein, 11 aa, Borrelia burgdorferi
KNSVVAPAVVK

SEQ ID NO: 58882 - protein, 11 aa, Borrelia burgdorferi
SKVKNFIFYVK

SEQ ID NO: 58883 - protein, 11 aa, Borrelia burgdorferi
SGESGNQFLGK

SEQ ID NO: 58884 - protein, 11 aa, Borrelia burgdorferi
AEGSFQNFVEK

SEQ ID NO: 58885 - protein, 9 aa, Borrelia burgdorferi
SYSQSSAMI

SEQ ID NO: 58886 - protein, 9 aa, Borrelia burgdorferi
EYAYSMGTL

SEQ ID NO: 58887 - protein, 9 aa, Borrelia burgdorferi
FFLLSTVLF

SEQ ID NO: 58888 - protein, 9 aa, Borrelia burgdorferi
LYDKLSVSI

SEQ ID NO: 58889 - protein, 9 aa, Borrelia burgdorferi
AYSMGTLKF

SEQ ID NO: 58890 - protein, 9 aa, Borrelia burgdorferi
FYVKDLRVL

SEQ ID NO: 58891 - protein, 9 aa, Borrelia burgdorferi
SFQNFVEKI

SEQ ID NO: 58892 - protein, 9 aa, Borrelia burgdorferi
NYPLASSKM

SEQ ID NO: 58893 - protein, 9 aa, Borrelia burgdorferi
VYSGASGIV

SEQ ID NO: 58894 - protein, 9 aa, Borrelia burgdorferi
KFKGWADLI

SEQ ID NO: 58895 - protein, 10 aa, Borrelia burgdorferi
NYIPNISSRI

SEQ ID NO: 58896 - protein, 10 aa, Borrelia burgdorferi
FYSGESGNQF

SEQ ID NO: 58897 - protein, 10 aa, Borrelia burgdorferi
LFFLLSTVLF

SEQ ID NO: 58898 - protein, 10 aa, Borrelia burgdorferi
GYEIDLEVLF

SEQ ID NO: 58899 - protein, 10 aa, Borrelia burgdorferi
EYAYSMGTLK

SEQ ID NO: 58900 - protein, 10 aa, Borrelia burgdorferi
DYVYSGASGI

SEQ ID NO: 58901 - protein, 10 aa, Borrelia burgdorferi
VYETSGTESL

SEQ ID NO: 58902 - protein, 10 aa, Borrelia burgdorferi
VYSLGYEIDL

SEQ ID NO: 58903 - protein, 10 aa, Borrelia burgdorferi
RYAGDTILGV

SEQ ID NO: 58904 - protein, 10 aa, Borrelia burgdorferi
SYSQSSAMIM

SEQ ID NO: 58905 - protein, 10 aa, Borrelia burgdorferi
FYVKDLRVLY

SEQ ID NO: 58906 - protein, 11 aa, Borrelia burgdorferi
EYAYSMGTLKF

SEQ ID NO: 58907 - protein, 11 aa, Borrelia burgdorferi
NYPLASSKMRF

SEQ ID NO: 58908 - protein, 11 aa, Borrelia burgdorferi
NYIPNISSRII

SEQ ID NO: 58909 - protein, 11 aa, Borrelia burgdorferi
IWSNPNYIPNI

SEQ ID NO: 58910 - protein, 11 aa, Borrelia burgdorferi
FYSGESGNQFL

SEQ ID NO: 58911 - protein, 11 aa, Borrelia burgdorferi
DYVYSGASGIV

SEQ ID NO: 58912 - protein, 9 aa, Borrelia burgdorferi
YVKDLRVLY

SEQ ID NO: 58913 - protein, 9 aa, Borrelia burgdorferi
DMNGMEYAY

SEQ ID NO: 58914 - protein, 9 aa, Borrelia burgdorferi
LTNYVDYVY

SEQ ID NO: 58915 - protein, 9 aa, Borrelia burgdorferi
KVSVYSLGY

SEQ ID NO: 58916 - protein, 9 aa, Borrelia burgdorferi
IMPPFKIPF

SEQ ID NO: 58917 - protein, 9 aa, Borrelia burgdorferi
YEIDLEVLF

SEQ ID NO: 58918 - protein, 9 aa, Borrelia burgdorferi
GVRVLFPSY

SEQ ID NO: 58919 - protein, 9 aa, Borrelia burgdorferi
AYSMGTLKF

SEQ ID NO: 58920 - protein, 9 aa, Borrelia burgdorferi
DLIWSNPNY

SEQ ID NO: 58921 - protein, 9 aa, Borrelia burgdorferi
FFLLSTVLF

SEQ ID NO: 58922 - protein, 10 aa, Borrelia burgdorferi
FYVKDLRVLY

SEQ ID NO: 58923 - protein, 10 aa, Borrelia burgdorferi
IMPPFKIPFY

SEQ ID NO: 58924 - protein, 10 aa, Borrelia burgdorferi
YAYSMGTLKF

SEQ ID NO: 58925 - protein, 10 aa, Borrelia burgdorferi
LFEDMNGMEY

SEQ ID NO: 58926 - protein, 10 aa, Borrelia burgdorferi
DLTNYVDYVY

SEQ ID NO: 58927 - protein, 10 aa, Borrelia burgdorferi
LFFLLSTVLF

SEQ ID NO: 58928 - protein, 10 aa, Borrelia burgdorferi
TMKEIKVSVY

SEQ ID NO: 58929 - protein, 10 aa, Borrelia burgdorferi
SSTRLDLTNY

SEQ ID NO: 58930 - protein, 10 aa, Borrelia burgdorferi
RIIKDDVPNY

SEQ ID NO: 58931 - protein, 10 aa, Borrelia burgdorferi
MIMPPFKIPF

SEQ ID NO: 58932 - protein, 10 aa, Borrelia burgdorferi
SSKVKNFIFY

SEQ ID NO: 58933 - protein, 10 aa, Borrelia burgdorferi
RLDLTNYVDY

SEQ ID NO: 58934 - protein, 10 aa, Borrelia burgdorferi
EDMNGMEYAY

SEQ ID NO: 58935 - protein, 11 aa, Borrelia burgdorferi
IFYVKDLRVLY

SEQ ID NO: 58936 - protein, 11 aa, Borrelia burgdorferi
VLFEDMNGMEY

SEQ ID NO: 58937 - protein, 11 aa, Borrelia burgdorferi
MIMPPFKIPFY

SEQ ID NO: 58938 - protein, 11 aa, Borrelia burgdorferi
AMIMPPFKIPF

SEQ ID NO: 58939 - protein, 11 aa, Borrelia burgdorferi
EYAYSMGTLKF

SEQ ID NO: 58940 - protein, 11 aa, Borrelia burgdorferi
HSSKVKNFIFY

SEQ ID NO: 58941 - protein, 11 aa, Borrelia burgdorferi
ILGVRVLFPSY

SEQ ID NO: 58942 - protein, 11 aa, Borrelia burgdorferi
ILFFLLSTVLF

SEQ ID NO: 58943 - protein, 11 aa, Borrelia burgdorferi
FEDMNGMEYAY

SEQ ID NO: 58944 - protein, 11 aa, Borrelia burgdorferi
DIDSESVFKVY

SEQ ID NO: 58945 - protein, 9 aa, Borrelia burgdorferi
ETSGTESLR

SEQ ID NO: 58946 - protein, 9 aa, Borrelia burgdorferi
FIFYVKDLR

SEQ ID NO: 58947 - protein, 9 aa, Borrelia burgdorferi
YAYSMGTLK

SEQ ID NO: 58948 - protein, 9 aa, Borrelia burgdorferi
FVEKIESEK

SEQ ID NO: 58949 - protein, 9 aa, Borrelia burgdorferi
NYIPNISSR

SEQ ID NO: 58950 - protein, 9 aa, Borrelia burgdorferi
YSMGTLKFK

SEQ ID NO: 58951 - protein, 9 aa, Borrelia burgdorferi
SAMIMPPFK

SEQ ID NO: 58952 - protein, 9 aa, Borrelia burgdorferi
LTNYVDYVY

SEQ ID NO: 58953 - protein, 9 aa, Borrelia burgdorferi
GSFQNFVEK

SEQ ID NO: 58954 - protein, 9 aa, Borrelia burgdorferi
SVVAPAVVK

SEQ ID NO: 58955 - protein, 9 aa, Borrelia burgdorferi
SVLLTPSAR

SEQ ID NO: 58956 - protein, 9 aa, Borrelia burgdorferi
AVVKSESKR

SEQ ID NO: 58957 - protein, 9 aa, Borrelia burgdorferi
LASSKMRFK

SEQ ID NO: 58958 - protein, 9 aa, Borrelia burgdorferi
SKMRFKAFR

SEQ ID NO: 58959 - protein, 9 aa, Borrelia burgdorferi
RVSKSHSSK

SEQ ID NO: 58960 - protein, 9 aa, Borrelia burgdorferi
NIKTMKEIK

SEQ ID NO: 58961 - protein, 9 aa, Borrelia burgdorferi
DIDSESVFK

SEQ ID NO: 58962 - protein, 9 aa, Borrelia burgdorferi
LARDPSSTR

SEQ ID NO: 58963 - protein, 9 aa, Borrelia burgdorferi
YVKDLRVLY

SEQ ID NO: 58964 - protein, 9 aa, Borrelia burgdorferi
TFKRVLKLR

SEQ ID NO: 58965 - protein, 9 aa, Borrelia burgdorferi
ESGNQFLGK

SEQ ID NO: 58966 - protein, 9 aa, Borrelia burgdorferi
DLIWSNPNY

SEQ ID NO: 58967 - protein, 9 aa, Borrelia burgdorferi
LIDNIKTMK

SEQ ID NO: 58968 - protein, 9 aa, Borrelia burgdorferi
SARLQAYVK

SEQ ID NO: 58969 - protein, 9 aa, Borrelia burgdorferi
MPPFKIPFY

SEQ ID NO: 58970 - protein, 9 aa, Borrelia burgdorferi
GTESLRKLK

SEQ ID NO: 58971 - protein, 9 aa, Borrelia burgdorferi
HETFKRVLK

SEQ ID NO: 58972 - protein, 9 aa, Borrelia burgdorferi
YPLASSKMR

SEQ ID NO: 58973 - protein, 9 aa, Borrelia burgdorferi
LKAHETFKR

SEQ ID NO: 58974 - protein, 9 aa, Borrelia burgdorferi
DMNGMEYAY

SEQ ID NO: 58975 - protein, 9 aa, Borrelia burgdorferi
VKNFIFYVK

SEQ ID NO: 58976 - protein, 9 aa, Borrelia burgdorferi
RFKAFRVSK

SEQ ID NO: 58977 - protein, 10 aa, Borrelia burgdorferi
ETFKRVLKLR

SEQ ID NO: 58978 - protein, 10 aa, Borrelia burgdorferi
ETSGTESLRK

SEQ ID NO: 58979 - protein, 10 aa, Borrelia burgdorferi
SSAMIMPPFK

SEQ ID NO: 58980 - protein, 10 aa, Borrelia burgdorferi
NFIFYVKDLR

SEQ ID NO: 58981 - protein, 10 aa, Borrelia burgdorferi
EYAYSMGTLK

SEQ ID NO: 58982 - protein, 10 aa, Borrelia burgdorferi
WSVLLTPSAR

SEQ ID NO: 58983 - protein, 10 aa, Borrelia burgdorferi
LVLDFAELAR

SEQ ID NO: 58984 - protein, 10 aa, Borrelia burgdorferi
SSKMRFKAFR

SEQ ID NO: 58985 - protein, 10 aa, Borrelia burgdorferi
ETDGLAEGSK

SEQ ID NO: 58986 - protein, 10 aa, Borrelia burgdorferi
ELARDPSSTR

SEQ ID NO: 58987 - protein, 10 aa, Borrelia burgdorferi
EGSFQNFVEK

SEQ ID NO: 58988 - protein, 10 aa, Borrelia burgdorferi
NSVVAPAVVK

SEQ ID NO: 58989 - protein, 10 aa, Borrelia burgdorferi
KVKNFIFYVK

SEQ ID NO: 58990 - protein, 10 aa, Borrelia burgdorferi
YAGDTILGVR

SEQ ID NO: 58991 - protein, 10 aa, Borrelia burgdorferi
YETSGTESLR

SEQ ID NO: 58992 - protein, 10 aa, Borrelia burgdorferi
NFVEKIESEK

SEQ ID NO: 58993 - protein, 10 aa, Borrelia burgdorferi
MRFKAFRVSK

SEQ ID NO: 58994 - protein, 10 aa, Borrelia burgdorferi
NYPLASSKMR

SEQ ID NO: 58995 - protein, 10 aa, Borrelia burgdorferi
DLTNYVDYVY

SEQ ID NO: 58996 - protein, 10 aa, Borrelia burgdorferi
DTILGVRVLF

SEQ ID NO: 58997 - protein, 10 aa, Borrelia burgdorferi
SDIDSESVFK

SEQ ID NO: 58998 - protein, 10 aa, Borrelia burgdorferi
GLIDNIKTMK

SEQ ID NO: 58999 - protein, 10 aa, Borrelia burgdorferi
KLKAHETFKR

SEQ ID NO: 59000 - protein, 10 aa, Borrelia burgdorferi
DNIKTMKEIK

SEQ ID NO: 59001 - protein, 11 aa, Borrelia burgdorferi
YAYSMGTLKFK

SEQ ID NO: 59002 - protein, 11 aa, Borrelia burgdorferi
YVYSGASGIVK

SEQ ID NO: 59003 - protein, 11 aa, Borrelia burgdorferi
QSSAMIMPPFK

SEQ ID NO: 59004 - protein, 11 aa, Borrelia burgdorferi
ELVLDFAELAR

SEQ ID NO: 59005 - protein, 11 aa, Borrelia burgdorferi
ASSKMRFKAFR

SEQ ID NO: 59006 - protein, 11 aa, Borrelia burgdorferi
ETDGLAEGSKR

SEQ ID NO: 59007 - protein, 11 aa, Borrelia burgdorferi
NPNYIPNISSR

SEQ ID NO: 59008 - protein, 11 aa, Borrelia burgdorferi
DVPNYPLASSK

SEQ ID NO: 59009 - protein, 11 aa, Borrelia burgdorferi
YVKDLRVLYDK

SEQ ID NO: 59010 - protein, 11 aa, Borrelia burgdorferi
MEYAYSMGTLK

SEQ ID NO: 59011 - protein, 11 aa, Borrelia burgdorferi
YIPNISSRIIK

SEQ ID NO: 59012 - protein, 11 aa, Borrelia burgdorferi
MIMPPFKIPFY

SEQ ID NO: 59013 - protein, 11 aa, Borrelia burgdorferi
HSSKVKNFIFY

SEQ ID NO: 59014 - protein, 11 aa, Borrelia burgdorferi
TPSARLQAYVK

SEQ ID NO: 59015 - protein, 11 aa, Borrelia burgdorferi
KNFIFYVKDLR

SEQ ID NO: 59016 - protein, 11 aa, Borrelia burgdorferi
ESEKPEESSPK

SEQ ID NO: 59017 - protein, 11 aa, Borrelia burgdorferi
DSDIDSESVFK

SEQ ID NO: 59018 - protein, 11 aa, Borrelia burgdorferi
HETFKRVLKLR

SEQ ID NO: 59019 - protein, 11 aa, Borrelia burgdorferi
QNFVEKIESEK

SEQ ID NO: 59020 - protein, 11 aa, Borrelia burgdorferi
ETFKRVLKLRE

SEQ ID NO: 59021 - protein, 11 aa, Borrelia burgdorferi
RYAGDTILGVR

SEQ ID NO: 59022 - protein, 11 aa, Borrelia burgdorferi
TSGTESLRKLK

SEQ ID NO: 59023 - protein, 11 aa, Borrelia burgdorferi
APAVVKSESKR

SEQ ID NO: 59024 - protein, 11 aa, Borrelia burgdorferi
RVSKSHSSKVK

SEQ ID NO: 59025 - protein, 11 aa, Borrelia burgdorferi
YPLASSKMRFK

SEQ ID NO: 59026 - protein, 11 aa, Borrelia burgdorferi
NWSVLLTPSAR

SEQ ID NO: 59027 - protein, 11 aa, Borrelia burgdorferi
VAPAVVKSESK

SEQ ID NO: 59028 - protein, 11 aa, Borrelia burgdorferi
KAHETFKRVLK

SEQ ID NO: 59029 - protein, 11 aa, Borrelia burgdorferi
VYETSGTESLR

SEQ ID NO: 59030 - protein, 11 aa, Borrelia burgdorferi
SKVKNFIFYVK

SEQ ID NO: 59031 - protein, 9 aa, Borrelia burgdorferi
FPSYSQSSA

SEQ ID NO: 59032 - protein, 9 aa, Borrelia burgdorferi
IPNISSRII

SEQ ID NO: 59033 - protein, 9 aa, Borrelia burgdorferi
TPSARLQAY

SEQ ID NO: 59034 - protein, 9 aa, Borrelia burgdorferi
MKRKAKSIL

SEQ ID NO: 59035 - protein, 9 aa, Borrelia burgdorferi
VPNYPLASS

SEQ ID NO: 59036 - protein, 9 aa, Borrelia burgdorferi
DPSSTRLDL

SEQ ID NO: 59037 - protein, 9 aa, Borrelia burgdorferi
APAVVKSES

SEQ ID NO: 59038 - protein, 9 aa, Borrelia burgdorferi
RVLYDKLSV

SEQ ID NO: 59039 - protein, 9 aa, Borrelia burgdorferi
IPFYSGESG

SEQ ID NO: 59040 - protein, 9 aa, Borrelia burgdorferi
KPEDMVVDL

SEQ ID NO: 59041 - protein, 9 aa, Borrelia burgdorferi
RAEPGELVL

SEQ ID NO: 59042 - protein, 10 aa, Borrelia burgdorferi
LARDPSSTRL

SEQ ID NO: 59043 - protein, 10 aa, Borrelia burgdorferi
YPLASSKMRF

SEQ ID NO: 59044 - protein, 10 aa, Borrelia burgdorferi
RVSKSHSSKV

SEQ ID NO: 59045 - protein, 10 aa, Borrelia burgdorferi
TPSARLQAYV

SEQ ID NO: 59046 - protein, 10 aa, Borrelia burgdorferi
KAHETFKRVL

SEQ ID NO: 59047 - protein, 10 aa, Borrelia burgdorferi
SKRYAGDTIL

SEQ ID NO: 59048 - protein, 10 aa, Borrelia burgdorferi
APAVVKSESK

SEQ ID NO: 59049 - protein, 10 aa, Borrelia burgdorferi
YAYSMGTLKF

SEQ ID NO: 59050 - protein, 11 aa, Borrelia burgdorferi
FPSYSQSSAMI

SEQ ID NO: 59051 - protein, 11 aa, Borrelia burgdorferi
VPNYPLASSKM

SEQ ID NO: 59052 - protein, 11 aa, Borrelia burgdorferi
KVYETSGTESL

SEQ ID NO: 59053 - protein, 11 aa, Borrelia burgdorferi
RVLYDKLSVSI

SEQ ID NO: 59054 - protein, 11 aa, Borrelia burgdorferi
RVLKLREKISI

SEQ ID NO: 59055 - protein, 11 aa, Borrelia burgdorferi
LASSKMRFKAF

SEQ ID NO: 59056 - protein, 11 aa, Borrelia burgdorferi
YVKNSVVAPAV

SEQ ID NO: 59057 - protein, 9 aa, Borrelia burgdorferi
SSKMRFKAF

SEQ ID NO: 59058 - protein, 9 aa, Borrelia burgdorferi
EIKVSVYSL

SEQ ID NO: 59059 - protein, 9 aa, Borrelia burgdorferi
QAYVKNSVV

SEQ ID NO: 59060 - protein, 10 aa, Borrelia burgdorferi
FPSYSQSSAM

SEQ ID NO: 59061 - protein, 10 aa, Borrelia burgdorferi
VLKLREKISI

SEQ ID NO: 59062 - protein, 10 aa, Borrelia burgdorferi
LRKLKAHETF

SEQ ID NO: 59063 - protein, 11 aa, Borrelia burgdorferi
SLRKLKAHETF

SEQ ID NO: 59064 - protein, 11 aa, Borrelia burgdorferi
LASSKMRFKAF

SEQ ID NO: 59065 - protein, 11 aa, Borrelia burgdorferi
FKRVLKLREKI

SEQ ID NO: 59066 - protein, 11 aa, Borrelia burgdorferi
VLKLREKISIA

SEQ ID NO: 59067 - protein, 9 aa, Borrelia burgdorferi
YVKDLRVLY

SEQ ID NO: 59068 - protein, 9 aa, Borrelia burgdorferi
YSGESGNQF

SEQ ID NO: 59069 - protein, 9 aa, Borrelia burgdorferi
IMPPFKIPF

SEQ ID NO: 59070 - protein, 9 aa, Borrelia burgdorferi
KVSVYSLGY

SEQ ID NO: 59071 - protein, 9 aa, Borrelia burgdorferi
GVRVLFPSY

SEQ ID NO: 59072 - protein, 9 aa, Borrelia burgdorferi
SSAMIMPPF

SEQ ID NO: 59073 - protein, 9 aa, Borrelia burgdorferi
SSKMRFKAF

SEQ ID NO: 59074 - protein, 9 aa, Borrelia burgdorferi
LTNYVDYVY

SEQ ID NO: 59075 - protein, 9 aa, Borrelia burgdorferi
IIKDDVPNY

SEQ ID NO: 59076 - protein, 9 aa, Borrelia burgdorferi
DMNGMEYAY

SEQ ID NO: 59077 - protein, 9 aa, Borrelia burgdorferi
VVKSESKRY

SEQ ID NO: 59078 - protein, 9 aa, Borrelia burgdorferi
GLIDNIKTM

SEQ ID NO: 59079 - protein, 9 aa, Borrelia burgdorferi
SSKVKNFIF

SEQ ID NO: 59080 - protein, 9 aa, Borrelia burgdorferi
VLFEDMNGM

SEQ ID NO: 59081 - protein, 9 aa, Borrelia burgdorferi
LQAYVKNSV

SEQ ID NO: 59082 - protein, 9 aa, Borrelia burgdorferi
KISIAEGSF

SEQ ID NO: 59083 - protein, 9 aa, Borrelia burgdorferi
YSQSSAMIM

SEQ ID NO: 59084 - protein, 9 aa, Borrelia burgdorferi
STRLDLTNY

SEQ ID NO: 59085 - protein, 9 aa, Borrelia burgdorferi
DLIWSNPNY

SEQ ID NO: 59086 - protein, 9 aa, Borrelia burgdorferi
YEIDLEVLF

SEQ ID NO: 59087 - protein, 9 aa, Borrelia burgdorferi
FFLLSTVLF

SEQ ID NO: 59088 - protein, 10 aa, Borrelia burgdorferi
TMKEIKVSVY

SEQ ID NO: 59089 - protein, 10 aa, Borrelia burgdorferi
QSSAMIMPPF

SEQ ID NO: 59090 - protein, 10 aa, Borrelia burgdorferi
MIMPPFKIPF

SEQ ID NO: 59091 - protein, 10 aa, Borrelia burgdorferi
SIAEGSFQNF

SEQ ID NO: 59092 - protein, 10 aa, Borrelia burgdorferi
IMPPFKIPFY

SEQ ID NO: 59093 - protein, 10 aa, Borrelia burgdorferi
YAYSMGTLKF

SEQ ID NO: 59094 - protein, 10 aa, Borrelia burgdorferi
RIIKDDVPNY

SEQ ID NO: 59095 - protein, 10 aa, Borrelia burgdorferi
LQAYVKNSVV

SEQ ID NO: 59096 - protein, 10 aa, Borrelia burgdorferi
SSKVKNFIFY

SEQ ID NO: 59097 - protein, 10 aa, Borrelia burgdorferi
LFFLLSTVLF

SEQ ID NO: 59098 - protein, 10 aa, Borrelia burgdorferi
ILFFLLSTVL

SEQ ID NO: 59099 - protein, 10 aa, Borrelia burgdorferi
ASSKMRFKAF

SEQ ID NO: 59100 - protein, 10 aa, Borrelia burgdorferi
LTPSARLQAY

SEQ ID NO: 59101 - protein, 10 aa, Borrelia burgdorferi
LGVRVLFPSY

SEQ ID NO: 59102 - protein, 10 aa, Borrelia burgdorferi
YVKNSVVAPA

SEQ ID NO: 59103 - protein, 10 aa, Borrelia burgdorferi
AVVKSESKRY

SEQ ID NO: 59104 - protein, 10 aa, Borrelia burgdorferi
TMKEIKVSVY

SEQ ID NO: 59105 - protein, 10 aa, Borrelia burgdorferi
QSSAMIMPPF

SEQ ID NO: 59106 - protein, 10 aa, Borrelia burgdorferi
MIMPPFKIPF

SEQ ID NO: 59107 - protein, 10 aa, Borrelia burgdorferi
SIAEGSFQNF

SEQ ID NO: 59108 - protein, 10 aa, Borrelia burgdorferi
IMPPFKIPFY

SEQ ID NO: 59109 - protein, 10 aa, Borrelia burgdorferi
YAYSMGTLKF

SEQ ID NO: 59110 - protein, 10 aa, Borrelia burgdorferi
RIIKDDVPNY

SEQ ID NO: 59111 - protein, 10 aa, Borrelia burgdorferi
LQAYVKNSVV

SEQ ID NO: 59112 - protein, 10 aa, Borrelia burgdorferi
SSKVKNFIFY

SEQ ID NO: 59113 - protein, 10 aa, Borrelia burgdorferi
LFFLLSTVLF

SEQ ID NO: 59114 - protein, 10 aa, Borrelia burgdorferi
ILFFLLSTVL

SEQ ID NO: 59115 - protein, 10 aa, Borrelia burgdorferi
ASSKMRFKAF

SEQ ID NO: 59116 - protein, 10 aa, Borrelia burgdorferi
LTPSARLQAY

SEQ ID NO: 59117 - protein, 10 aa, Borrelia burgdorferi
LGVRVLFPSY

SEQ ID NO: 59118 - protein, 10 aa, Borrelia burgdorferi
YVKNSVVAPA

SEQ ID NO: 59119 - protein, 10 aa, Borrelia burgdorferi
AVVKSESKRY

SEQ ID NO: 59120 - protein, 9 aa, Borrelia burgdorferi
KRKAKSILF

SEQ ID NO: 59121 - protein, 9 aa, Borrelia burgdorferi
KRVLKLREK

SEQ ID NO: 59122 - protein, 9 aa, Borrelia burgdorferi
KRYAGDTIL

SEQ ID NO: 59123 - protein, 9 aa, Borrelia burgdorferi
RKAKSILFF

SEQ ID NO: 59124 - protein, 9 aa, Borrelia burgdorferi
RKLKAHETF

SEQ ID NO: 59125 - protein, 9 aa, Borrelia burgdorferi
ARLQAYVKN

SEQ ID NO: 59126 - protein, 10 aa, Borrelia burgdorferi
MRFKAFRVSK

SEQ ID NO: 59127 - protein, 10 aa, Borrelia burgdorferi
FRVSKSHSSK

SEQ ID NO: 59128 - protein, 10 aa, Borrelia burgdorferi
KRKAKSILFF

SEQ ID NO: 59129 - protein, 10 aa, Borrelia burgdorferi
KRVLKLREKI

SEQ ID NO: 59130 - protein, 10 aa, Borrelia burgdorferi
KRAEPGELVL

SEQ ID NO: 59131 - protein, 10 aa, Borrelia burgdorferi
RKLKAHETFK

SEQ ID NO: 59132 - protein, 11 aa, Borrelia burgdorferi
KRYAGDTILGV

SEQ ID NO: 59133 - protein, 11 aa, Borrelia burgdorferi
KRKAKSILFFL

SEQ ID NO: 59134 - protein, 11 aa, Borrelia burgdorferi
TRLDLTNYVDY

SEQ ID NO: 59135 - protein, 11 aa, Borrelia burgdorferi
FRVSKSHSSKV

SEQ ID NO: 59136 - protein, 11 aa, Borrelia burgdorferi
SRIIKDDVPNY

SEQ ID NO: 59137 - protein, 11 aa, Borrelia burgdorferi
ARLQAYVKNSV

SEQ ID NO: 59138 - protein, 11 aa, Borrelia burgdorferi
RKLKAHETFKR

SEQ ID NO: 59139 - protein, 9 aa, Borrelia burgdorferi
TPSARLQAY

SEQ ID NO: 59140 - protein, 9 aa, Borrelia burgdorferi
MPPFKIPFY

SEQ ID NO: 59141 - protein, 9 aa, Borrelia burgdorferi
DMNGMEYAY

SEQ ID NO: 59142 - protein, 9 aa, Borrelia burgdorferi
LTNYVDYVY

SEQ ID NO: 59143 - protein, 9 aa, Borrelia burgdorferi
EPGELVLDF

SEQ ID NO: 59144 - protein, 9 aa, Borrelia burgdorferi
FFLLSTVLF

SEQ ID NO: 59145 - protein, 9 aa, Borrelia burgdorferi
IAEGSFQNF

SEQ ID NO: 59146 - protein, 9 aa, Borrelia burgdorferi
FPSYSQSSA

SEQ ID NO: 59147 - protein, 9 aa, Borrelia burgdorferi
NPNYIPNIS

SEQ ID NO: 59148 - protein, 9 aa, Borrelia burgdorferi
YVKDLRVLY

SEQ ID NO: 59149 - protein, 9 aa, Borrelia burgdorferi
YSGESGNQF

SEQ ID NO: 59150 - protein, 9 aa, Borrelia burgdorferi
YSQSSAMIM

SEQ ID NO: 59151 - protein, 9 aa, Borrelia burgdorferi
SSAMIMPPF

SEQ ID NO: 59152 - protein, 9 aa, Borrelia burgdorferi
FEDMNGMEY

SEQ ID NO: 59153 - protein, 9 aa, Borrelia burgdorferi
KVSVYSLGY

SEQ ID NO: 59154 - protein, 9 aa, Borrelia burgdorferi
DLIWSNPNY

SEQ ID NO: 59155 - protein, 9 aa, Borrelia burgdorferi
ELVLDFAEL

SEQ ID NO: 59156 - protein, 9 aa, Borrelia burgdorferi
YEIDLEVLF

SEQ ID NO: 59157 - protein, 9 aa, Borrelia burgdorferi
LFFLLSTVL

SEQ ID NO: 59158 - protein, 9 aa, Borrelia burgdorferi
NGMEYAYSM

SEQ ID NO: 59159 - protein, 9 aa, Borrelia burgdorferi
KPEDMVVDL

SEQ ID NO: 59160 - protein, 9 aa, Borrelia burgdorferi
FAELARDPS

SEQ ID NO: 59161 - protein, 9 aa, Borrelia burgdorferi
DSESVFKVY

SEQ ID NO: 59162 - protein, 9 aa, Borrelia burgdorferi
RAEPGELVL

SEQ ID NO: 59163 - protein, 9 aa, Borrelia burgdorferi
FKGWADLIW

SEQ ID NO: 59164 - protein, 9 aa, Borrelia burgdorferi
PSYSQSSAM

SEQ ID NO: 59165 - protein, 9 aa, Borrelia burgdorferi
IPNISSRII

SEQ ID NO: 59166 - protein, 10 aa, Borrelia burgdorferi
FPSYSQSSAM

SEQ ID NO: 59167 - protein, 10 aa, Borrelia burgdorferi
YPLASSKMRF

SEQ ID NO: 59168 - protein, 10 aa, Borrelia burgdorferi
YAYSMGTLKF

SEQ ID NO: 59169 - protein, 10 aa, Borrelia burgdorferi
LFEDMNGMEY

SEQ ID NO: 59170 - protein, 10 aa, Borrelia burgdorferi
EDMNGMEYAY

SEQ ID NO: 59171 - protein, 10 aa, Borrelia burgdorferi
MIMPPFKIPF

SEQ ID NO: 59172 - protein, 10 aa, Borrelia burgdorferi
EVLFEDMNGM

SEQ ID NO: 59173 - protein, 10 aa, Borrelia burgdorferi
QSSAMIMPPF

SEQ ID NO: 59174 - protein, 10 aa, Borrelia burgdorferi
LFFLLSTVLF

SEQ ID NO: 59175 - protein, 10 aa, Borrelia burgdorferi
DLTNYVDYVY

SEQ ID NO: 59176 - protein, 10 aa, Borrelia burgdorferi
MVVDLGINNW

SEQ ID NO: 59177 - protein, 10 aa, Borrelia burgdorferi
LTPSARLQAY

SEQ ID NO: 59178 - protein, 10 aa, Borrelia burgdorferi
NPNYIPNISS

SEQ ID NO: 59179 - protein, 10 aa, Borrelia burgdorferi
FYSGESGNQF

SEQ ID NO: 59180 - protein, 10 aa, Borrelia burgdorferi
LGVRVLFPSY

SEQ ID NO: 59181 - protein, 10 aa, Borrelia burgdorferi
FYVKDLRVLY

SEQ ID NO: 59182 - protein, 10 aa, Borrelia burgdorferi
FAQETDGLAE

SEQ ID NO: 59183 - protein, 10 aa, Borrelia burgdorferi
DSDIDSESVF

SEQ ID NO: 59184 - protein, 10 aa, Borrelia burgdorferi
SIAEGSFQNF

SEQ ID NO: 59185 - protein, 11 aa, Borrelia burgdorferi
FPSYSQSSAMI

SEQ ID NO: 59186 - protein, 11 aa, Borrelia burgdorferi
WADLIWSNPNY

SEQ ID NO: 59187 - protein, 11 aa, Borrelia burgdorferi
VPNYPLASSKM

SEQ ID NO: 59188 - protein, 11 aa, Borrelia burgdorferi
FEDMNGMEYAY

SEQ ID NO: 59189 - protein, 11 aa, Borrelia burgdorferi
LASSKMRFKAF

SEQ ID NO: 59190 - protein, 11 aa, Borrelia burgdorferi
LFPSYSQSSAM

SEQ ID NO: 59191 - protein, 11 aa, Borrelia burgdorferi
DMNGMEYAYSM

SEQ ID NO: 59192 - protein, 11 aa, Borrelia burgdorferi
MIMPPFKIPFY

SEQ ID NO: 59193 - protein, 11 aa, Borrelia burgdorferi
VLFEDMNGMEY

SEQ ID NO: 59194 - protein, 11 aa, Borrelia burgdorferi
LLTPSARLQAY

SEQ ID NO: 59195 - protein, 11 aa, Borrelia burgdorferi
LDLTNYVDYVY

SEQ ID NO: 59196 - protein, 11 aa, Borrelia burgdorferi
EPGELVLDFAE

SEQ ID NO: 59197 - protein, 11 aa, Borrelia burgdorferi
DIDSESVFKVY

SEQ ID NO: 59198 - protein, 11 aa, Borrelia burgdorferi
RAEPGELVLDF

SEQ ID NO: 59199 - protein, 11 aa, Borrelia burgdorferi
SQSSAMIMPPF

SEQ ID NO: 59200 - protein, 11 aa, Borrelia burgdorferi
WSVLLTPSARL

SEQ ID NO: 59201 - protein, 11 aa, Borrelia burgdorferi
IDSDIDSESVF

SEQ ID NO: 59202 - protein, 11 aa, Borrelia burgdorferi
LGYEIDLEVLF

SEQ ID NO: 59203 - protein, 11 aa, Borrelia burgdorferi
TVLFAQETDGL

SEQ ID NO: 59204 - protein, 9 aa, Borrelia burgdorferi
YEIDLEVLF

SEQ ID NO: 59205 - protein, 9 aa, Borrelia burgdorferi
KEIKVSVYS

SEQ ID NO: 59206 - protein, 9 aa, Borrelia burgdorferi
AELARDPSS

SEQ ID NO: 59207 - protein, 9 aa, Borrelia burgdorferi
AEGSFQNFV

SEQ ID NO: 59208 - protein, 9 aa, Borrelia burgdorferi
GELVLDFAE

SEQ ID NO: 59209 - protein, 10 aa, Borrelia burgdorferi
KEIKVSVYSL

SEQ ID NO: 59210 - protein, 10 aa, Borrelia burgdorferi
AEPGELVLDF

SEQ ID NO: 59211 - protein, 10 aa, Borrelia burgdorferi
GELVLDFAEL

SEQ ID NO: 59212 - protein, 10 aa, Borrelia burgdorferi
YEIDLEVLFE

SEQ ID NO: 59213 - protein, 11 aa, Borrelia burgdorferi
REKISIAEGSF

SEQ ID NO: 59214 - protein, 11 aa, Borrelia burgdorferi
KEIKVSVYSLG

SEQ ID NO: 59215 - protein, 11 aa, Borrelia burgdorferi
GELVLDFAELA

SEQ ID NO: 59216 - protein, 11 aa, Borrelia burgdorferi
YEIDLEVLFED

SEQ ID NO: 59217 - protein, 9 aa, Borrelia burgdorferi
IPNISSRII

SEQ ID NO: 59218 - protein, 9 aa, Borrelia burgdorferi
FPSYSQSSA

SEQ ID NO: 59219 - protein, 9 aa, Borrelia burgdorferi
IPFYSGESG

SEQ ID NO: 59220 - protein, 9 aa, Borrelia burgdorferi
MPPFKIPFY

SEQ ID NO: 59221 - protein, 9 aa, Borrelia burgdorferi
EPGELVLDF

SEQ ID NO: 59222 - protein, 10 aa, Borrelia burgdorferi
MPPFKIPFYS

SEQ ID NO: 59223 - protein, 10 aa, Borrelia burgdorferi
FPSYSQSSAM

SEQ ID NO: 59224 - protein, 10 aa, Borrelia burgdorferi
YPLASSKMRF

SEQ ID NO: 59225 - protein, 10 aa, Borrelia burgdorferi
EPGELVLDFA

SEQ ID NO: 59226 - protein, 10 aa, Borrelia burgdorferi
TPSARLQAYV

SEQ ID NO: 59227 - protein, 11 aa, Borrelia burgdorferi
FPSYSQSSAMI

SEQ ID NO: 59228 - protein, 11 aa, Borrelia burgdorferi
MPPFKIPFYSG

SEQ ID NO: 59229 - protein, 11 aa, Borrelia burgdorferi
KPEDMVVDLGI

SEQ ID NO: 59230 - protein, 11 aa, Borrelia burgdorferi
VPNYPLASSKM

SEQ ID NO: 59231 - protein, 11 aa, Borrelia burgdorferi
YSMGTLKFKGW

SEQ ID NO: 59232 - protein, 11 aa, Borrelia burgdorferi
KTMKEIKVSVY

SEQ ID NO: 59233 - protein, 11 aa, Borrelia garinii
NQDEAIAVNIY

SEQ ID NO: 59234 - protein, 11 aa, Borrelia garinii
ELAVQSGNGTY

SEQ ID NO: 59235 - protein, 9 aa, Borrelia garinii
SQASWTLRV

SEQ ID NO: 59236 - protein, 9 aa, Borrelia garinii
QLTDEINRI

SEQ ID NO: 59237 - protein, 9 aa, Borrelia garinii
AQAAQTAPV

SEQ ID NO: 59238 - protein, 9 aa, Borrelia garinii
AIAVNIYAA

SEQ ID NO: 59239 - protein, 9 aa, Borrelia garinii
SLAKIENAI

SEQ ID NO: 59240 - protein, 9 aa, Borrelia garinii
AVNIYAANV

SEQ ID NO: 59241 - protein, 9 aa, Borrelia garinii
AQYNQMHML

SEQ ID NO: 59242 - protein, 9 aa, Borrelia garinii
TTVDANTSL

SEQ ID NO: 59243 - protein, 9 aa, Borrelia garinii
SQGGVNSPV

SEQ ID NO: 59244 - protein, 9 aa, Borrelia garinii
QTAPVQEGV

SEQ ID NO: 59245 - protein, 10 aa, Borrelia garinii
NIYAANVANL

SEQ ID NO: 59246 - protein, 10 aa, Borrelia garinii
NLNEVEKVLV

SEQ ID NO: 59247 - protein, 10 aa, Borrelia garinii
VLVRMKELAV

SEQ ID NO: 59248 - protein, 10 aa, Borrelia garinii
QLTDEINRIA

SEQ ID NO: 59249 - protein, 10 aa, Borrelia garinii
NLFSGEGAQA

SEQ ID NO: 59250 - protein, 10 aa, Borrelia garinii
IAVNIYAANV

SEQ ID NO: 59251 - protein, 11 aa, Borrelia garinii
SLSGSQASWTL

SEQ ID NO: 59252 - protein, 11 aa, Borrelia garinii
MLSNKSASQNV

SEQ ID NO: 59253 - protein, 11 aa, Borrelia garinii
AIAVNIYAANV

SEQ ID NO: 59254 - protein, 11 aa, Borrelia garinii
SQASWTLRVHV

SEQ ID NO: 59255 - protein, 11 aa, Borrelia garinii
GMQPAKINTPA

SEQ ID NO: 59256 - protein, 11 aa, Borrelia garinii
KVLVRMKELAV

SEQ ID NO: 59257 - protein, 11 aa, Borrelia garinii
SLAKIENAIRM

SEQ ID NO: 59258 - protein, 11 aa, Borrelia garinii
NLFSGEGAQAA

SEQ ID NO: 59259 - protein, 9 aa, Borrelia garinii
NQMHMLSNK

SEQ ID NO: 59260 - protein, 9 aa, Borrelia garinii
GSQASWTLR

SEQ ID NO: 59261 - protein, 10 aa, Borrelia garinii
TVDANTSLAK

SEQ ID NO: 59262 - protein, 10 aa, Borrelia garinii
YNQMHMLSNK

SEQ ID NO: 59263 - protein, 11 aa, Borrelia garinii
LSGSQASWTLR

SEQ ID NO: 59264 - protein, 11 aa, Borrelia garinii
TTVDANTSLAK

SEQ ID NO: 59265 - protein, 11 aa, Borrelia garinii
LSNKSASQNVR

SEQ ID NO: 59266 - protein, 9 aa, Borrelia garinii
NQMHMLSNK

SEQ ID NO: 59267 - protein, 9 aa, Borrelia garinii
GSQASWTLR

SEQ ID NO: 59268 - protein, 9 aa, Borrelia garinii
AVQSGNGTY

SEQ ID NO: 59269 - protein, 10 aa, Borrelia garinii
TVDANTSLAK

SEQ ID NO: 59270 - protein, 10 aa, Borrelia garinii
YNQMHMLSNK

SEQ ID NO: 59271 - protein, 10 aa, Borrelia garinii
EVEKVLVRMK

SEQ ID NO: 59272 - protein, 11 aa, Borrelia garinii
TTVDANTSLAK

SEQ ID NO: 59273 - protein, 11 aa, Borrelia garinii
TTEGNLNEVEK

SEQ ID NO: 59274 - protein, 11 aa, Borrelia garinii
TAEELGMQPAK

SEQ ID NO: 59275 - protein, 11 aa, Borrelia garinii
TSLAKIENAIR

SEQ ID NO: 59276 - protein, 11 aa, Borrelia garinii
QYNQMHMLSNK

SEQ ID NO: 59277 - protein, 11 aa, Borrelia garinii
LSGSQASWTLR

SEQ ID NO: 59278 - protein, 11 aa, Borrelia garinii
LSNKSASQNVR

SEQ ID NO: 59279 - protein, 9 aa, Borrelia garinii
IYAANVANL

SEQ ID NO: 59280 - protein, 9 aa, Borrelia garinii
YAANVANLF

SEQ ID NO: 59281 - protein, 10 aa, Borrelia garinii
IYAANVANLF

SEQ ID NO: 59282 - protein, 10 aa, Borrelia garinii
TYSDADRGSI

SEQ ID NO: 59283 - protein, 11 aa, Borrelia garinii
IYAANVANLFS

SEQ ID NO: 59284 - protein, 9 aa, Borrelia garinii
AVQSGNGTY

SEQ ID NO: 59285 - protein, 9 aa, Borrelia garinii
YAANVANLF

SEQ ID NO: 59286 - protein, 11 aa, Borrelia garinii
ELAVQSGNGTY

SEQ ID NO: 59287 - protein, 11 aa, Borrelia garinii
EINRIADQAQY

SEQ ID NO: 59288 - protein, 9 aa, Borrelia garinii
LAKIENAIR

SEQ ID NO: 59289 - protein, 9 aa, Borrelia garinii
EGNLNEVEK

SEQ ID NO: 59290 - protein, 9 aa, Borrelia garinii
YAANVANLF

SEQ ID NO: 59291 - protein, 9 aa, Borrelia garinii
NGTYSDADR

SEQ ID NO: 59292 - protein, 9 aa, Borrelia garinii
GSQASWTLR

SEQ ID NO: 59293 - protein, 9 aa, Borrelia garinii
NQMHMLSNK

SEQ ID NO: 59294 - protein, 9 aa, Borrelia garinii
TSKAINFIQ

SEQ ID NO: 59295 - protein, 9 aa, Borrelia garinii
NKSASQNVR

SEQ ID NO: 59296 - protein, 10 aa, Borrelia garinii
EVEKVLVRMK

SEQ ID NO: 59297 - protein, 10 aa, Borrelia garinii
SLAKIENAIR

SEQ ID NO: 59298 - protein, 10 aa, Borrelia garinii
TVDANTSLAK

SEQ ID NO: 59299 - protein, 10 aa, Borrelia garinii
NTSKAINFIQ

SEQ ID NO: 59300 - protein, 10 aa, Borrelia garinii
SGSQASWTLR

SEQ ID NO: 59301 - protein, 10 aa, Borrelia garinii
TTVDANTSLA

SEQ ID NO: 59302 - protein, 11 aa, Borrelia garinii
TTVDANTSLAK

SEQ ID NO: 59303 - protein, 11 aa, Borrelia garinii
TTEGNLNEVEK

SEQ ID NO: 59304 - protein, 11 aa, Borrelia garinii
EIEQLTDEINR

SEQ ID NO: 59305 - protein, 11 aa, Borrelia garinii
LSNKSASQNVR

SEQ ID NO: 59306 - protein, 11 aa, Borrelia garinii
TSLAKIENAIR

SEQ ID NO: 59307 - protein, 11 aa, Borrelia garinii
EINRIADQAQY

SEQ ID NO: 59308 - protein, 11 aa, Borrelia garinii
NLNEVEKVLVR

SEQ ID NO: 59309 - protein, 11 aa, Borrelia garinii
LSGSQASWTLR

SEQ ID NO: 59310 - protein, 11 aa, Borrelia garinii
TAEELGMQPAK

SEQ ID NO: 59311 - protein, 11 aa, Borrelia garinii
QYNQMHMLSNK

SEQ ID NO: 59312 - protein, 11 aa, Borrelia garinii
NIYAANVANLF

SEQ ID NO: 59313 - protein, 11 aa, Borrelia garinii
QTAPVQEGVQQ

SEQ ID NO: 59314 - protein, 9 aa, Borrelia garinii
SPVNVTTTV

SEQ ID NO: 59315 - protein, 9 aa, Borrelia garinii
QPAKINTPA

SEQ ID NO: 59316 - protein, 9 aa, Borrelia garinii
QPAPATAPS

SEQ ID NO: 59317 - protein, 9 aa, Borrelia garinii
LVRMKELAV

SEQ ID NO: 59318 - protein, 9 aa, Borrelia garinii
TPASLSGSQ

SEQ ID NO: 59319 - protein, 9 aa, Borrelia garinii
APSQGGVNS

SEQ ID NO: 59320 - protein, 9 aa, Borrelia garinii
APATAPSQG

SEQ ID NO: 59321 - protein, 9 aa, Borrelia garinii
APVQEGVQQ

SEQ ID NO: 59322 - protein, 10 aa, Borrelia garinii
TPASLSGSQA

SEQ ID NO: 59323 - protein, 10 aa, Borrelia garinii
SPVNVTTTVD

SEQ ID NO: 59324 - protein, 10 aa, Borrelia garinii
APSQGGVNSP

SEQ ID NO: 59325 - protein, 10 aa, Borrelia garinii
QPAKINTPAS

SEQ ID NO: 59326 - protein, 11 aa, Borrelia garinii
APSQGGVNSPV

SEQ ID NO: 59327 - protein, 11 aa, Borrelia garinii
QPAKINTPASL

SEQ ID NO: 59328 - protein, 11 aa, Borrelia garinii
APATAPSQGGV

SEQ ID NO: 59329 - protein, 11 aa, Borrelia garinii
SPVNVTTTVDA

SEQ ID NO: 59330 - protein, 11 aa, Borrelia garinii
TPASLSGSQAS

SEQ ID NO: 59331 - protein, 9 aa, Borrelia garinii
KVLVRMKEL

SEQ ID NO: 59332 - protein, 11 aa, Borrelia garinii
VEKVLVRMKEL

SEQ ID NO: 59333 - protein, 9 aa, Borrelia garinii
YAANVANLF

SEQ ID NO: 59334 - protein, 9 aa, Borrelia garinii
AVQSGNGTY

SEQ ID NO: 59335 - protein, 9 aa, Borrelia garinii
AQAAQTAPV

SEQ ID NO: 59336 - protein, 9 aa, Borrelia garinii
AQYNQMHML

SEQ ID NO: 59337 - protein, 9 aa, Borrelia garinii
SQGGVNSPV

SEQ ID NO: 59338 - protein, 9 aa, Borrelia garinii
SLSGSQASW

SEQ ID NO: 59339 - protein, 9 aa, Borrelia garinii
SQASWTLRV

SEQ ID NO: 59340 - protein, 9 aa, Borrelia garinii
IQIEIEQLT

SEQ ID NO: 59341 - protein, 10 aa, Borrelia garinii
LAVQSGNGTY

SEQ ID NO: 59342 - protein, 10 aa, Borrelia garinii
SQASWTLRVH

SEQ ID NO: 59343 - protein, 10 aa, Borrelia garinii
SQNVRTAEEL

SEQ ID NO: 59344 - protein, 10 aa, Borrelia garinii
VQQEGAQQPA

SEQ ID NO: 59345 - protein, 10 aa, Borrelia garinii
INRIADQAQY

SEQ ID NO: 59346 - protein, 10 aa, Borrelia garinii
AQAAQTAPVQ

SEQ ID NO: 59347 - protein, 10 aa, Borrelia garinii
MQPAKINTPA

SEQ ID NO: 59348 - protein, 11 aa, Borrelia garinii
ELAVQSGNGTY

SEQ ID NO: 59349 - protein, 11 aa, Borrelia garinii
NIYAANVANLF

SEQ ID NO: 59350 - protein, 11 aa, Borrelia garinii
NQDEAIAVNIY

SEQ ID NO: 59351 - protein, 11 aa, Borrelia garinii
SLSGSQASWTL

SEQ ID NO: 59352 - protein, 9 aa, Borrelia garinii
NRIADQAQY

SEQ ID NO: 59353 - protein, 9 aa, Borrelia garinii
YAANVANLF

SEQ ID NO: 59354 - protein, 9 aa, Borrelia garinii
QPAPATAPS

SEQ ID NO: 59355 - protein, 9 aa, Borrelia garinii
SPVNVTTTV

SEQ ID NO: 59356 - protein, 9 aa, Borrelia garinii
DEAIAVNIY

SEQ ID NO: 59357 - protein, 9 aa, Borrelia garinii
TTVDANTSL

SEQ ID NO: 59358 - protein, 9 aa, Borrelia garinii
LAVQSGNGT

SEQ ID NO: 59359 - protein, 9 aa, Borrelia garinii
QPAKINTPA

SEQ ID NO: 59360 - protein, 9 aa, Borrelia garinii
AVQSGNGTY

SEQ ID NO: 59361 - protein, 9 aa, Borrelia garinii
QASWTLRVH

SEQ ID NO: 59362 - protein, 9 aa, Borrelia garinii
IAVNIYAAN

SEQ ID NO: 59363 - protein, 10 aa, Borrelia garinii
LAVQSGNGTY

SEQ ID NO: 59364 - protein, 10 aa, Borrelia garinii
IADQAQYNQM

SEQ ID NO: 59365 - protein, 10 aa, Borrelia garinii
QPAKINTPAS

SEQ ID NO: 59366 - protein, 10 aa, Borrelia garinii
LAKIENAIRM

SEQ ID NO: 59367 - protein, 10 aa, Borrelia garinii
QPAPATAPSQ

SEQ ID NO: 59368 - protein, 10 aa, Borrelia garinii
YAANVANLFS

SEQ ID NO: 59369 - protein, 10 aa, Borrelia garinii
TAEELGMQPA

SEQ ID NO: 59370 - protein, 10 aa, Borrelia garinii
EAIAVNIYAA

SEQ ID NO: 59371 - protein, 10 aa, Borrelia garinii
QAQYNQMHML

SEQ ID NO: 59372 - protein, 10 aa, Borrelia garinii
TPASLSGSQA

SEQ ID NO: 59373 - protein, 10 aa, Borrelia garinii
SPVNVTTTVD

SEQ ID NO: 59374 - protein, 11 aa, Borrelia garinii
TPASLSGSQAS

SEQ ID NO: 59375 - protein, 11 aa, Borrelia garinii
ELAVQSGNGTY

SEQ ID NO: 59376 - protein, 11 aa, Borrelia garinii
NQDEAIAVNIY

SEQ ID NO: 59377 - protein, 11 aa, Borrelia garinii
QPAKINTPASL

SEQ ID NO: 59378 - protein, 11 aa, Borrelia garinii
IAVNIYAANVA

SEQ ID NO: 59379 - protein, 11 aa, Borrelia garinii
NIYAANVANLF

SEQ ID NO: 59380 - protein, 11 aa, Borrelia garinii
SPVNVTTTVDA

SEQ ID NO: 59381 - protein, 11 aa, Borrelia garinii
EINRIADQAQY

SEQ ID NO: 59382 - protein, 11 aa, Borrelia garinii
IADQAQYNQMH

SEQ ID NO: 59383 - protein, 11 aa, Borrelia garinii
APSQGGVNSPV

SEQ ID NO: 59384 - protein, 11 aa, Borrelia garinii
LAVQSGNGTYS

SEQ ID NO: 59385 - protein, 10 aa, Borrelia garinii
EELGMQPAKI

SEQ ID NO: 59386 - protein, 10 aa, Borrelia garinii
NEVEKVLVRM

SEQ ID NO: 59387 - protein, 10 aa, Borrelia garinii
DEINRIADQA

SEQ ID NO: 59388 - protein, 11 aa, Borrelia garinii
DEINRIADQAQ

SEQ ID NO: 59389 - protein, 9 aa, Borrelia garinii
SPVNVTTTV

SEQ ID NO: 59390 - protein, 11 aa, Borrelia garinii
APATAPSQGGV

SEQ ID NO: 59391 - protein, 11 aa, Borrelia garinii
APSQGGVNSPV

SEQ ID NO: 59392 - protein, 10 aa, Borrelia garinii
ASLSGSQASW

SEQ ID NO: 59393 - protein, 10 aa, Borrelia garinii PBi
KTQEKLSSGY

SEQ ID NO: 59394 - protein, 10 aa, Borrelia garinii PBi
MTDEVVASTT

SEQ ID NO: 59395 - protein, 10 aa, Borrelia garinii PBi
ASDDAAGMGV

SEQ ID NO: 59396 - protein, 11 aa, Borrelia garinii PBi
NQDEAIAVNIY

SEQ ID NO: 59397 - protein, 11 aa, Borrelia garinii PBi
ISDQRANLGAF

SEQ ID NO: 59398 - protein, 11 aa, Borrelia garinii PBi
RLESIKDSTEY

SEQ ID NO: 59399 - protein, 11 aa, Borrelia garinii PBi
ELAVQSGNGTY

SEQ ID NO: 59400 - protein, 11 aa, Borrelia garinii PBi
MIAQANQVPQY

SEQ ID NO: 59401 - protein, 9 aa, Borrelia garinii PBi
SQASWTLRV

SEQ ID NO: 59402 - protein, 9 aa, Borrelia garinii PBi
QLTDEINRI

SEQ ID NO: 59403 - protein, 9 aa, Borrelia garinii PBi
SQAAQTAPV

SEQ ID NO: 59404 - protein, 9 aa, Borrelia garinii PBi
AMIAQANQV

SEQ ID NO: 59405 - protein, 9 aa, Borrelia garinii PBi
MIINHNTSA

SEQ ID NO: 59406 - protein, 9 aa, Borrelia garinii PBi
QVPQYVLSL

SEQ ID NO: 59407 - protein, 9 aa, Borrelia garinii PBi
AIAVNIYAA

SEQ ID NO: 59408 - protein, 9 aa, Borrelia garinii PBi
SLAKIENAI

SEQ ID NO: 59409 - protein, 9 aa, Borrelia garinii PBi
AVNIYAANV

SEQ ID NO: 59410 - protein, 9 aa, Borrelia garinii PBi
AQYNQMHML

SEQ ID NO: 59411 - protein, 9 aa, Borrelia garinii PBi
MTDEVVAST

SEQ ID NO: 59412 - protein, 9 aa, Borrelia garinii PBi
SIKDSTEYA

SEQ ID NO: 59413 - protein, 9 aa, Borrelia garinii PBi
TTVDANTSL

SEQ ID NO: 59414 - protein, 9 aa, Borrelia garinii PBi
NLGAFQNRL

SEQ ID NO: 59415 - protein, 9 aa, Borrelia garinii PBi
SQGGVNSPV

SEQ ID NO: 59416 - protein, 9 aa, Borrelia garinii PBi
SAMAMIAQA

SEQ ID NO: 59417 - protein, 9 aa, Borrelia garinii PBi
VVASTTNSI

SEQ ID NO: 59418 - protein, 9 aa, Borrelia garinii PBi
MISDQRANL

SEQ ID NO: 59419 - protein, 9 aa, Borrelia garinii PBi
ILTQSAMAM

SEQ ID NO: 59420 - protein, 9 aa, Borrelia garinii PBi
SILTQSAMA

SEQ ID NO: 59421 - protein, 9 aa, Borrelia garinii PBi
LTQSAMAMI

SEQ ID NO: 59422 - protein, 10 aa, Borrelia garinii PBi
TMTDEVVAST

SEQ ID NO: 59423 - protein, 10 aa, Borrelia garinii PBi
AQANQVPQYV

SEQ ID NO: 59424 - protein, 10 aa, Borrelia garinii PBi
MIINHNTSAI

SEQ ID NO: 59425 - protein, 10 aa, Borrelia garinii PBi
ILTQSAMAMI

SEQ ID NO: 59426 - protein, 10 aa, Borrelia garinii PBi
NIYAANVANL

SEQ ID NO: 59427 - protein, 10 aa, Borrelia garinii PBi
RMISDQRANL

SEQ ID NO: 59428 - protein, 10 aa, Borrelia garinii PBi
NLNEVEKVLV

SEQ ID NO: 59429 - protein, 10 aa, Borrelia garinii PBi
VLVRMKELAV

SEQ ID NO: 59430 - protein, 10 aa, Borrelia garinii PBi
MAMIAQANQV

SEQ ID NO: 59431 - protein, 10 aa, Borrelia garinii PBi
QLTDEINRIA

SEQ ID NO: 59432 - protein, 10 aa, Borrelia garinii PBi
QVPQYVLSLL

SEQ ID NO: 59433 - protein, 10 aa, Borrelia garinii PBi
NQVPQYVLSL

SEQ ID NO: 59434 - protein, 10 aa, Borrelia garinii PBi
IAVNIYAANV

SEQ ID NO: 59435 - protein, 11 aa, Borrelia garinii PBi
SLSGSQASWTL

SEQ ID NO: 59436 - protein, 11 aa, Borrelia garinii PBi
MLSNKSASQNV

SEQ ID NO: 59437 - protein, 11 aa, Borrelia garinii PBi
AMAMIAQANQV

SEQ ID NO: 59438 - protein, 11 aa, Borrelia garinii PBi
AIAVNIYAANV

SEQ ID NO: 59439 - protein, 11 aa, Borrelia garinii PBi
SQASWTLRVHV

SEQ ID NO: 59440 - protein, 11 aa, Borrelia garinii PBi
KLSSGYRINRA

SEQ ID NO: 59441 - protein, 11 aa, Borrelia garinii PBi
SILTQSAMAMI

SEQ ID NO: 59442 - protein, 11 aa, Borrelia garinii PBi
GMQPAKINTPA

SEQ ID NO: 59443 - protein, 11 aa, Borrelia garinii PBi
KVLVRMKELAV

SEQ ID NO: 59444 - protein, 11 aa, Borrelia garinii PBi
MISDQRANLGA

SEQ ID NO: 59445 - protein, 11 aa, Borrelia garinii PBi
NLFSGEGSQAA

SEQ ID NO: 59446 - protein, 11 aa, Borrelia garinii PBi
YAIENLKASYA

SEQ ID NO: 59447 - protein, 11 aa, Borrelia garinii PBi
SLAKIENAIRM

SEQ ID NO: 59448 - protein, 11 aa, Borrelia garinii PBi
TMTDEVVASTT

SEQ ID NO: 59449 - protein, 11 aa, Borrelia garinii PBi
ILTQSAMAMIA

SEQ ID NO: 59450 - protein, 9 aa, Borrelia garinii PBi
SINAANLSK

SEQ ID NO: 59451 - protein, 9 aa, Borrelia garinii PBi
SQASRNTSK

SEQ ID NO: 59452 - protein, 9 aa, Borrelia garinii PBi
NQMHMLSNK

SEQ ID NO: 59453 - protein, 9 aa, Borrelia garinii PBi
GSQASWTLR

SEQ ID NO: 59454 - protein, 9 aa, Borrelia garinii PBi
FQNRLESIK

SEQ ID NO: 59455 - protein, 9 aa, Borrelia garinii PBi
LSSGYRINR

SEQ ID NO: 59456 - protein, 10 aa, Borrelia garinii PBi
NSINAANLSK

SEQ ID NO: 59457 - protein, 10 aa, Borrelia garinii PBi
TVDANTSLAK

SEQ ID NO: 59458 - protein, 10 aa, Borrelia garinii PBi
LSQASRNTSK

SEQ ID NO: 59459 - protein, 10 aa, Borrelia garinii PBi
KLSSGYRINR

SEQ ID NO: 59460 - protein, 10 aa, Borrelia garinii PBi
NLKASYAQIK

SEQ ID NO: 59461 - protein, 10 aa, Borrelia garinii PBi
AANLSKTQEK

SEQ ID NO: 59462 - protein, 10 aa, Borrelia garinii PBi
STEYAIENLK

SEQ ID NO: 59463 - protein, 10 aa, Borrelia garinii PBi
KTQEKLSSGY

SEQ ID NO: 59464 - protein, 10 aa, Borrelia garinii PBi
YNQMHMLSNK

SEQ ID NO: 59465 - protein, 10 aa, Borrelia garinii PBi
AFQNRLESIK

SEQ ID NO: 59466 - protein, 10 aa, Borrelia garinii PBi
QIRGLSQASR

SEQ ID NO: 59467 - protein, 10 aa, Borrelia garinii PBi
VPQYVLSLLR

SEQ ID NO: 59468 - protein, 11 aa, Borrelia garinii PBi
GLSQASRNTSK

SEQ ID NO: 59469 - protein, 11 aa, Borrelia garinii PBi
MIAQANQVPQY

SEQ ID NO: 59470 - protein, 11 aa, Borrelia garinii PBi
LSGSQASWTLR

SEQ ID NO: 59471 - protein, 11 aa, Borrelia garinii PBi
GAFQNRLESIK

SEQ ID NO: 59472 - protein, 11 aa, Borrelia garinii PBi
KTQEKLSSGYR

SEQ ID NO: 59473 - protein, 11 aa, Borrelia garinii PBi
TTVDANTSLAK

SEQ ID NO: 59474 - protein, 11 aa, Borrelia garinii PBi
KINAQIRGLSQ

SEQ ID NO: 59475 - protein, 11 aa, Borrelia garinii PBi
RLESIKDSTEY

SEQ ID NO: 59476 - protein, 11 aa, Borrelia garinii PBi
LSNKSASQNVR

SEQ ID NO: 59477 - protein, 9 aa, Borrelia garinii PBi
SINAANLSK

SEQ ID NO: 59478 - protein, 9 aa, Borrelia garinii PBi
SQASRNTSK

SEQ ID NO: 59479 - protein, 9 aa, Borrelia garinii PBi
NQMHMLSNK

SEQ ID NO: 59480 - protein, 9 aa, Borrelia garinii PBi
GSQASWTLR

SEQ ID NO: 59481 - protein, 9 aa, Borrelia garinii PBi
AAGMGVSGK

SEQ ID NO: 59482 - protein, 9 aa, Borrelia garinii PBi
LSSGYRINR

SEQ ID NO: 59483 - protein, 9 aa, Borrelia garinii PBi
NTSAINASR

SEQ ID NO: 59484 - protein, 9 aa, Borrelia garinii PBi
TEYAIENLK

SEQ ID NO: 59485 - protein, 9 aa, Borrelia garinii PBi
AVQSGNGTY

SEQ ID NO: 59486 - protein, 9 aa, Borrelia garinii PBi
PQYVLSLLR

SEQ ID NO: 59487 - protein, 9 aa, Borrelia garinii PBi
FQNRLESIK

SEQ ID NO: 59488 - protein, 9 aa, Borrelia garinii PBi
AQANQVPQY

SEQ ID NO: 59489 - protein, 10 aa, Borrelia garinii PBi
TVDANTSLAK

SEQ ID NO: 59490 - protein, 10 aa, Borrelia garinii PBi
STEYAIENLK

SEQ ID NO: 59491 - protein, 10 aa, Borrelia garinii PBi
LSQASRNTSK

SEQ ID NO: 59492 - protein, 10 aa, Borrelia garinii PBi
NSINAANLSK

SEQ ID NO: 59493 - protein, 10 aa, Borrelia garinii PBi
AANLSKTQEK

SEQ ID NO: 59494 - protein, 10 aa, Borrelia garinii PBi
RANLGAFQNR

SEQ ID NO: 59495 - protein, 10 aa, Borrelia garinii PBi
KTQEKLSSGY

SEQ ID NO: 59496 - protein, 10 aa, Borrelia garinii PBi
KLSSGYRINR

SEQ ID NO: 59497 - protein, 10 aa, Borrelia garinii PBi
AFQNRLESIK

SEQ ID NO: 59498 - protein, 10 aa, Borrelia garinii PBi
YNQMHMLSNK

SEQ ID NO: 59499 - protein, 10 aa, Borrelia garinii PBi
IAQANQVPQY

SEQ ID NO: 59500 - protein, 10 aa, Borrelia garinii PBi
TQEKLSSGYR

SEQ ID NO: 59501 - protein, 10 aa, Borrelia garinii PBi
NLKASYAQIK

SEQ ID NO: 59502 - protein, 10 aa, Borrelia garinii PBi
EVEKVLVRMK

SEQ ID NO: 59503 - protein, 11 aa, Borrelia garinii PBi
TTVDANTSLAK

SEQ ID NO: 59504 - protein, 11 aa, Borrelia garinii PBi
TTEGNLNEVEK

SEQ ID NO: 59505 - protein, 11 aa, Borrelia garinii PBi
KTQEKLSSGYR

SEQ ID NO: 59506 - protein, 11 aa, Borrelia garinii PBi
GAFQNRLESIK

SEQ ID NO: 59507 - protein, 11 aa, Borrelia garinii PBi
TAEELGMQPAK

SEQ ID NO: 59508 - protein, 11 aa, Borrelia garinii PBi
GLSQASRNTSK

SEQ ID NO: 59509 - protein, 11 aa, Borrelia garinii PBi
TSLAKIENAIR

SEQ ID NO: 59510 - protein, 11 aa, Borrelia garinii PBi
QYNQMHMLSNK

SEQ ID NO: 59511 - protein, 11 aa, Borrelia garinii PBi
NAANLSKTQEK

SEQ ID NO: 59512 - protein, 11 aa, Borrelia garinii PBi
QVPQYVLSLLR

SEQ ID NO: 59513 - protein, 11 aa, Borrelia garinii PBi
AQIRGLSQASR

SEQ ID NO: 59514 - protein, 11 aa, Borrelia garinii PBi
DSTEYAIENLK

SEQ ID NO: 59515 - protein, 11 aa, Borrelia garinii PBi
LSGSQASWTLR

SEQ ID NO: 59516 - protein, 11 aa, Borrelia garinii PBi
GVSGKINAQIR

SEQ ID NO: 59517 - protein, 11 aa, Borrelia garinii PBi
MIAQANQVPQY

SEQ ID NO: 59518 - protein, 11 aa, Borrelia garinii PBi
LSNKSASQNVR

SEQ ID NO: 59519 - protein, 11 aa, Borrelia garinii PBi
SAMAMIAQANQ

SEQ ID NO: 59520 - protein, 9 aa, Borrelia garinii PBi
IYAANVANL

SEQ ID NO: 59521 - protein, 9 aa, Borrelia garinii PBi
YAANVANLF

SEQ ID NO: 59522 - protein, 9 aa, Borrelia garinii PBi
AFQNRLESI

SEQ ID NO: 59523 - protein, 10 aa, Borrelia garinii PBi
IYAANVANLF

SEQ ID NO: 59524 - protein, 10 aa, Borrelia garinii PBi
TYSDADRGSI

SEQ ID NO: 59525 - protein, 10 aa, Borrelia garinii PBi
SYAQIKDATM

SEQ ID NO: 59526 - protein, 11 aa, Borrelia garinii PBi
IYAANVANLFS

SEQ ID NO: 59527 - protein, 9 aa, Borrelia garinii PBi
ESIKDSTEY

SEQ ID NO: 59528 - protein, 9 aa, Borrelia garinii PBi
AVQSGNGTY

SEQ ID NO: 59529 - protein, 9 aa, Borrelia garinii PBi
YAANVANLF

SEQ ID NO: 59530 - protein, 9 aa, Borrelia garinii PBi
AIENLKASY

SEQ ID NO: 59531 - protein, 10 aa, Borrelia garinii PBi
YAIENLKASY

SEQ ID NO: 59532 - protein, 10 aa, Borrelia garinii PBi
IAQANQVPQY

SEQ ID NO: 59533 - protein, 11 aa, Borrelia garinii PBi
EYAIENLKASY

SEQ ID NO: 59534 - protein, 11 aa, Borrelia garinii PBi
ELAVQSGNGTY

SEQ ID NO: 59535 - protein, 11 aa, Borrelia garinii PBi
EINRIADQAQY

SEQ ID NO: 59536 - protein, 11 aa, Borrelia garinii PBi
MIAQANQVPQY

SEQ ID NO: 59537 - protein, 11 aa, Borrelia garinii PBi
RLESIKDSTEY

SEQ ID NO: 59538 - protein, 9 aa, Borrelia garinii PBi
NTSAINASR

SEQ ID NO: 59539 - protein, 9 aa, Borrelia garinii PBi
LSSGYRINR

SEQ ID NO: 59540 - protein, 9 aa, Borrelia garinii PBi
TEYAIENLK

SEQ ID NO: 59541 - protein, 9 aa, Borrelia garinii PBi
SINAANLSK

SEQ ID NO: 59542 - protein, 9 aa, Borrelia garinii PBi
ESIKDSTEY

SEQ ID NO: 59543 - protein, 9 aa, Borrelia garinii PBi
AIRMISDQR

SEQ ID NO: 59544 - protein, 9 aa, Borrelia garinii PBi
LAKIENAIR

SEQ ID NO: 59545 - protein, 9 aa, Borrelia garinii PBi
EGNLNEVEK

SEQ ID NO: 59546 - protein, 9 aa, Borrelia garinii PBi
YAANVANLF

SEQ ID NO: 59547 - protein, 9 aa, Borrelia garinii PBi
NGTYSDADR

SEQ ID NO: 59548 - protein, 9 aa, Borrelia garinii PBi
GSQASWTLR

SEQ ID NO: 59549 - protein, 9 aa, Borrelia garinii PBi
NQMHMLSNK

SEQ ID NO: 59550 - protein, 9 aa, Borrelia garinii PBi
TSKAINFIQ

SEQ ID NO: 59551 - protein, 9 aa, Borrelia garinii PBi
MAMIAQANQ

SEQ ID NO: 59552 - protein, 9 aa, Borrelia garinii PBi
NKSASQNVR

SEQ ID NO: 59553 - protein, 9 aa, Borrelia garinii PBi
TTNSILTQS

SEQ ID NO: 59554 - protein, 9 aa, Borrelia garinii PBi
SQASRNTSK

SEQ ID NO: 59555 - protein, 10 aa, Borrelia garinii PBi
NAIRMISDQR

SEQ ID NO: 59556 - protein, 10 aa, Borrelia garinii PBi
STEYAIENLK

SEQ ID NO: 59557 - protein, 10 aa, Borrelia garinii PBi
NSINAANLSK

SEQ ID NO: 59558 - protein, 10 aa, Borrelia garinii PBi
DAAGMGVSGK

SEQ ID NO: 59559 - protein, 10 aa, Borrelia garinii PBi
HNTSAINASR

SEQ ID NO: 59560 - protein, 10 aa, Borrelia garinii PBi
EVEKVLVRMK

SEQ ID NO: 59561 - protein, 10 aa, Borrelia garinii PBi
SLAKIENAIR

SEQ ID NO: 59562 - protein, 10 aa, Borrelia garinii PBi
TVDANTSLAK

SEQ ID NO: 59563 - protein, 10 aa, Borrelia garinii PBi
RANLGAFQNR

SEQ ID NO: 59564 - protein, 10 aa, Borrelia garinii PBi
QIRGLSQASR

SEQ ID NO: 59565 - protein, 10 aa, Borrelia garinii PBi
NTSKAINFIQ

SEQ ID NO: 59566 - protein, 10 aa, Borrelia garinii PBi
LSQASRNTSK

SEQ ID NO: 59567 - protein, 10 aa, Borrelia garinii PBi
NLKASYAQIK

SEQ ID NO: 59568 - protein, 10 aa, Borrelia garinii PBi
SGSQASWTLR

SEQ ID NO: 59569 - protein, 10 aa, Borrelia garinii PBi
TQEKLSSGYR

SEQ ID NO: 59570 - protein, 10 aa, Borrelia garinii PBi
VPQYVLSLLR

SEQ ID NO: 59571 - protein, 10 aa, Borrelia garinii PBi
AANLSKTQEK

SEQ ID NO: 59572 - protein, 10 aa, Borrelia garinii PBi
YAIENLKASY

SEQ ID NO: 59573 - protein, 10 aa, Borrelia garinii PBi
VSGKINAQIR

SEQ ID NO: 59574 - protein, 10 aa, Borrelia garinii PBi
TTVDANTSLA

SEQ ID NO: 59575 - protein, 10 aa, Borrelia garinii PBi
KLSSGYRINR

SEQ ID NO: 59576 - protein, 10 aa, Borrelia garinii PBi
MIAQANQVPQ

SEQ ID NO: 59577 - protein, 10 aa, Borrelia garinii PBi
NTSAINASRN

SEQ ID NO: 59578 - protein, 11 aa, Borrelia garinii PBi
DSTEYAIENLK

SEQ ID NO: 59579 - protein, 11 aa, Borrelia garinii PBi
TTVDANTSLAK

SEQ ID NO: 59580 - protein, 11 aa, Borrelia garinii PBi
TTEGNLNEVEK

SEQ ID NO: 59581 - protein, 11 aa, Borrelia garinii PBi
EIEQLTDEINR

SEQ ID NO: 59582 - protein, 11 aa, Borrelia garinii PBi
QVPQYVLSLLR

SEQ ID NO: 59583 - protein, 11 aa, Borrelia garinii PBi
NAANLSKTQEK

SEQ ID NO: 59584 - protein, 11 aa, Borrelia garinii PBi
ENAIRMISDQR

SEQ ID NO: 59585 - protein, 11 aa, Borrelia garinii PBi
LSNKSASQNVR

SEQ ID NO: 59586 - protein, 11 aa, Borrelia garinii PBi
MIAQANQVPQY

SEQ ID NO: 59587 - protein, 11 aa, Borrelia garinii PBi
TSLAKIENAIR

SEQ ID NO: 59588 - protein, 11 aa, Borrelia garinii PBi
EINRIADQAQY

SEQ ID NO: 59589 - protein, 11 aa, Borrelia garinii PBi
NLNEVEKVLVR

SEQ ID NO: 59590 - protein, 11 aa, Borrelia garinii PBi
LSGSQASWTLR

SEQ ID NO: 59591 - protein, 11 aa, Borrelia garinii PBi
GAFQNRLESIK

SEQ ID NO: 59592 - protein, 11 aa, Borrelia garinii PBi
TAEELGMQPAK

SEQ ID NO: 59593 - protein, 11 aa, Borrelia garinii PBi
QYNQMHMLSNK

SEQ ID NO: 59594 - protein, 11 aa, Borrelia garinii PBi
GVSGKINAQIR

SEQ ID NO: 59595 - protein, 11 aa, Borrelia garinii PBi
KTQEKLSSGYR

SEQ ID NO: 59596 - protein, 11 aa, Borrelia garinii PBi
NHNTSAINASR

SEQ ID NO: 59597 - protein, 11 aa, Borrelia garinii PBi
NIYAANVANLF

SEQ ID NO: 59598 - protein, 11 aa, Borrelia garinii PBi
EKLSSGYRINR

SEQ ID NO: 59599 - protein, 11 aa, Borrelia garinii PBi
NNSINAANLSK

SEQ ID NO: 59600 - protein, 11 aa, Borrelia garinii PBi
QTAPVQEGAQQ

SEQ ID NO: 59601 - protein, 11 aa, Borrelia garinii PBi
ENLKASYAQIK

SEQ ID NO: 59602 - protein, 9 aa, Borrelia garinii PBi
SPVNVTTTV

SEQ ID NO: 59603 - protein, 9 aa, Borrelia garinii PBi
VPQYVLSLL

SEQ ID NO: 59604 - protein, 9 aa, Borrelia garinii PBi
QPAKINTPA

SEQ ID NO: 59605 - protein, 9 aa, Borrelia garinii PBi
VVASTTNSI

SEQ ID NO: 59606 - protein, 9 aa, Borrelia garinii PBi
QPAPATAPS

SEQ ID NO: 59607 - protein, 9 aa, Borrelia garinii PBi
LVRMKELAV

SEQ ID NO: 59608 - protein, 9 aa, Borrelia garinii PBi
ASRNTSKAI

SEQ ID NO: 59609 - protein, 9 aa, Borrelia garinii PBi
IINHNTSAI

SEQ ID NO: 59610 - protein, 9 aa, Borrelia garinii PBi
TPASLSGSQ

SEQ ID NO: 59611 - protein, 9 aa, Borrelia garinii PBi
APSQGGVNS

SEQ ID NO: 59612 - protein, 9 aa, Borrelia garinii PBi
APVQEGAQQ

SEQ ID NO: 59613 - protein, 9 aa, Borrelia garinii PBi
APATAPSQG

SEQ ID NO: 59614 - protein, 9 aa, Borrelia garinii PBi
VASTTNSIL

SEQ ID NO: 59615 - protein, 9 aa, Borrelia garinii PBi
ILTQSAMAM

SEQ ID NO: 59616 - protein, 10 aa, Borrelia garinii PBi
TPASLSGSQA

SEQ ID NO: 59617 - protein, 10 aa, Borrelia garinii PBi
VVASTTNSIL

SEQ ID NO: 59618 - protein, 10 aa, Borrelia garinii PBi
SPVNVTTTVD

SEQ ID NO: 59619 - protein, 10 aa, Borrelia garinii PBi
APSQGGVNSP

SEQ ID NO: 59620 - protein, 10 aa, Borrelia garinii PBi
QPAKINTPAS

SEQ ID NO: 59621 - protein, 10 aa, Borrelia garinii PBi
QASRNTSKAI

SEQ ID NO: 59622 - protein, 10 aa, Borrelia garinii PBi
MIINHNTSAI

SEQ ID NO: 59623 - protein, 11 aa, Borrelia garinii PBi
APSQGGVNSPV

SEQ ID NO: 59624 - protein, 11 aa, Borrelia garinii PBi
QPAKINTPASL

SEQ ID NO: 59625 - protein, 11 aa, Borrelia garinii PBi
APATAPSQGGV

SEQ ID NO: 59626 - protein, 11 aa, Borrelia garinii PBi
SPVNVTTTVDA

SEQ ID NO: 59627 - protein, 11 aa, Borrelia garinii PBi
TPASLSGSQAS

SEQ ID NO: 59628 - protein, 11 aa, Borrelia garinii PBi
SAINASRNNSI

SEQ ID NO: 59629 - protein, 11 aa, Borrelia garinii PBi
AANLSKTQEKL

SEQ ID NO: 59630 - protein, 11 aa, Borrelia garinii PBi
RANLGAFQNRL

SEQ ID NO: 59631 - protein, 9 aa, Borrelia garinii PBi
YAQIKDATM

SEQ ID NO: 59632 - protein, 9 aa, Borrelia garinii PBi
KVLVRMKEL

SEQ ID NO: 59633 - protein, 11 aa, Borrelia garinii PBi
VEKVLVRMKEL

SEQ ID NO: 59634 - protein, 9 aa, Borrelia garinii PBi
AQANQVPQY

SEQ ID NO: 59635 - protein, 9 aa, Borrelia garinii PBi
DQRANLGAF

SEQ ID NO: 59636 - protein, 9 aa, Borrelia garinii PBi
YAANVANLF

SEQ ID NO: 59637 - protein, 9 aa, Borrelia garinii PBi
SQAAQTAPV

SEQ ID NO: 59638 - protein, 9 aa, Borrelia garinii PBi
AVQSGNGTY

SEQ ID NO: 59639 - protein, 9 aa, Borrelia garinii PBi
TQEKLSSGY

SEQ ID NO: 59640 - protein, 9 aa, Borrelia garinii PBi
ILTQSAMAM

SEQ ID NO: 59641 - protein, 9 aa, Borrelia garinii PBi
AQYNQMHML

SEQ ID NO: 59642 - protein, 9 aa, Borrelia garinii PBi
SQGGVNSPV

SEQ ID NO: 59643 - protein, 9 aa, Borrelia garinii PBi
ESIKDSTEY

SEQ ID NO: 59644 - protein, 9 aa, Borrelia garinii PBi
SLSGSQASW

SEQ ID NO: 59645 - protein, 9 aa, Borrelia garinii PBi
SQASWTLRV

SEQ ID NO: 59646 - protein, 9 aa, Borrelia garinii PBi
IQIEIEQLT

SEQ ID NO: 59647 - protein, 9 aa, Borrelia garinii PBi
AMIAQANQV

SEQ ID NO: 59648 - protein, 10 aa, Borrelia garinii PBi
YAIENLKASY

SEQ ID NO: 59649 - protein, 10 aa, Borrelia garinii PBi
LAVQSGNGTY

SEQ ID NO: 59650 - protein, 10 aa, Borrelia garinii PBi
SQASWTLRVH

SEQ ID NO: 59651 - protein, 10 aa, Borrelia garinii PBi
KTQEKLSSGY

SEQ ID NO: 59652 - protein, 10 aa, Borrelia garinii PBi
SQNVRTAEEL

SEQ ID NO: 59653 - protein, 10 aa, Borrelia garinii PBi
RMISDQRANL

SEQ ID NO: 59654 - protein, 10 aa, Borrelia garinii PBi
IAQANQVPQY

SEQ ID NO: 59655 - protein, 10 aa, Borrelia garinii PBi
AQQEGAQQPA

SEQ ID NO: 59656 - protein, 10 aa, Borrelia garinii PBi
AQIRGLSQAS

SEQ ID NO: 59657 - protein, 10 aa, Borrelia garinii PBi
NQVPQYVLSL

SEQ ID NO: 59658 - protein, 10 aa, Borrelia garinii PBi
SQAAQTAPVQ

SEQ ID NO: 59659 - protein, 10 aa, Borrelia garinii PBi
INRIADQAQY

SEQ ID NO: 59660 - protein, 10 aa, Borrelia garinii PBi
MQPAKINTPA

SEQ ID NO: 59661 - protein, 11 aa, Borrelia garinii PBi
SQASRNTSKAI

SEQ ID NO: 59662 - protein, 11 aa, Borrelia garinii PBi
AQANQVPQYVL

SEQ ID NO: 59663 - protein, 11 aa, Borrelia garinii PBi
MIAQANQVPQY

SEQ ID NO: 59664 - protein, 11 aa, Borrelia garinii PBi
ASRNTSKAINF

SEQ ID NO: 59665 - protein, 11 aa, Borrelia garinii PBi
ELAVQSGNGTY

SEQ ID NO: 59666 - protein, 11 aa, Borrelia garinii PBi
NIYAANVANLF

SEQ ID NO: 59667 - protein, 11 aa, Borrelia garinii PBi
NQDEAIAVNIY

SEQ ID NO: 59668 - protein, 11 aa, Borrelia garinii PBi
RLESIKDSTEY

SEQ ID NO: 59669 - protein, 11 aa, Borrelia garinii PBi
SLSGSQASWTL

SEQ ID NO: 59670 - protein, 9 aa, Borrelia garinii PBi
NRIADQAQY

SEQ ID NO: 59671 - protein, 9 aa, Borrelia garinii PBi
IRGLSQASR

SEQ ID NO: 59672 - protein, 9 aa, Borrelia garinii PBi
QRANLGAFQ

SEQ ID NO: 59673 - protein, 10 aa, Borrelia garinii PBi
SRNTSKAINF

SEQ ID NO: 59674 - protein, 11 aa, Borrelia garinii PBi
QRANLGAFQNR

SEQ ID NO: 59675 - protein, 11 aa, Borrelia garinii PBi
SRNNSINAANL

SEQ ID NO: 59676 - protein, 11 aa, Borrelia garinii PBi
IRMISDQRANL

SEQ ID NO: 59677 - protein, 9 aa, Borrelia garinii PBi
YAANVANLF

SEQ ID NO: 59678 - protein, 9 aa, Borrelia garinii PBi
YAQIKDATM

SEQ ID NO: 59679 - protein, 9 aa, Borrelia garinii PBi
QPAPATAPS

SEQ ID NO: 59680 - protein, 9 aa, Borrelia garinii PBi
RASDDAAGM

SEQ ID NO: 59681 - protein, 9 aa, Borrelia garinii PBi
ESIKDSTEY

SEQ ID NO: 59682 - protein, 9 aa, Borrelia garinii PBi
SPVNVTTTV

SEQ ID NO: 59683 - protein, 9 aa, Borrelia garinii PBi
ILTQSAMAM

SEQ ID NO: 59684 - protein, 9 aa, Borrelia garinii PBi
DEAIAVNIY

SEQ ID NO: 59685 - protein, 9 aa, Borrelia garinii PBi
TTVDANTSL

SEQ ID NO: 59686 - protein, 9 aa, Borrelia garinii PBi
LAVQSGNGT

SEQ ID NO: 59687 - protein, 9 aa, Borrelia garinii PBi
QPAKINTPA

SEQ ID NO: 59688 - protein, 9 aa, Borrelia garinii PBi
NSILTQSAM

SEQ ID NO: 59689 - protein, 9 aa, Borrelia garinii PBi
YAIENLKAS

SEQ ID NO: 59690 - protein, 9 aa, Borrelia garinii PBi
AVQSGNGTY

SEQ ID NO: 59691 - protein, 9 aa, Borrelia garinii PBi
QASWTLRVH

SEQ ID NO: 59692 - protein, 9 aa, Borrelia garinii PBi
VASTTNSIL

SEQ ID NO: 59693 - protein, 9 aa, Borrelia garinii PBi
IAVNIYAAN

SEQ ID NO: 59694 - protein, 9 aa, Borrelia garinii PBi
FSGEGSQAA

SEQ ID NO: 59695 - protein, 9 aa, Borrelia garinii PBi
VPQYVLSLL

SEQ ID NO: 59696 - protein, 10 aa, Borrelia garinii PBi
LAVQSGNGTY

SEQ ID NO: 59697 - protein, 10 aa, Borrelia garinii PBi
YAIENLKASY

SEQ ID NO: 59698 - protein, 10 aa, Borrelia garinii PBi
IADQAQYNQM

SEQ ID NO: 59699 - protein, 10 aa, Borrelia garinii PBi
SILTQSAMAM

SEQ ID NO: 59700 - protein, 10 aa, Borrelia garinii PBi
IAQANQVPQY

SEQ ID NO: 59701 - protein, 10 aa, Borrelia garinii PBi
QPAKINTPAS

SEQ ID NO: 59702 - protein, 10 aa, Borrelia garinii PBi
LAKIENAIRM

SEQ ID NO: 59703 - protein, 10 aa, Borrelia garinii PBi
QANQVPQYVL

SEQ ID NO: 59704 - protein, 10 aa, Borrelia garinii PBi
QPAPATAPSQ

SEQ ID NO: 59705 - protein, 10 aa, Borrelia garinii PBi
YAANVANLFS

SEQ ID NO: 59706 - protein, 10 aa, Borrelia garinii PBi
TAEELGMQPA

SEQ ID NO: 59707 - protein, 10 aa, Borrelia garinii PBi
MIINHNTSAI

SEQ ID NO: 59708 - protein, 10 aa, Borrelia garinii PBi
EAIAVNIYAA

SEQ ID NO: 59709 - protein, 10 aa, Borrelia garinii PBi
NRASDDAAGM

SEQ ID NO: 59710 - protein, 10 aa, Borrelia garinii PBi
QAQYNQMHML

SEQ ID NO: 59711 - protein, 10 aa, Borrelia garinii PBi
TPASLSGSQA

SEQ ID NO: 59712 - protein, 10 aa, Borrelia garinii PBi
SPVNVTTTVD

SEQ ID NO: 59713 - protein, 10 aa, Borrelia garinii PBi
SYAQIKDATM

SEQ ID NO: 59714 - protein, 10 aa, Borrelia garinii PBi
MAMIAQANQV

SEQ ID NO: 59715 - protein, 11 aa, Borrelia garinii PBi
MIAQANQVPQY

SEQ ID NO: 59716 - protein, 11 aa, Borrelia garinii PBi
TPASLSGSQAS

SEQ ID NO: 59717 - protein, 11 aa, Borrelia garinii PBi
ELAVQSGNGTY

SEQ ID NO: 59718 - protein, 11 aa, Borrelia garinii PBi
NQDEAIAVNIY

SEQ ID NO: 59719 - protein, 11 aa, Borrelia garinii PBi
QPAKINTPASL

SEQ ID NO: 59720 - protein, 11 aa, Borrelia garinii PBi
IAVNIYAANVA

SEQ ID NO: 59721 - protein, 11 aa, Borrelia garinii PBi
NSILTQSAMAM

SEQ ID NO: 59722 - protein, 11 aa, Borrelia garinii PBi
NIYAANVANLF

SEQ ID NO: 59723 - protein, 11 aa, Borrelia garinii PBi
TTNSILTQSAM

SEQ ID NO: 59724 - protein, 11 aa, Borrelia garinii PBi
EVVASTTNSIL

SEQ ID NO: 59725 - protein, 11 aa, Borrelia garinii PBi
SPVNVTTTVDA

SEQ ID NO: 59726 - protein, 11 aa, Borrelia garinii PBi
EINRIADQAQY

SEQ ID NO: 59727 - protein, 11 aa, Borrelia garinii PBi
IADQAQYNQMH

SEQ ID NO: 59728 - protein, 11 aa, Borrelia garinii PBi
NASRNNSINAA

SEQ ID NO: 59729 - protein, 11 aa, Borrelia garinii PBi
ISDQRANLGAF

SEQ ID NO: 59730 - protein, 11 aa, Borrelia garinii PBi
APSQGGVNSPV

SEQ ID NO: 59731 - protein, 11 aa, Borrelia garinii PBi
LAVQSGNGTYS

SEQ ID NO: 59732 - protein, 11 aa, Borrelia garinii PBi
EYAIENLKASY

SEQ ID NO: 59733 - protein, 10 aa, Borrelia garinii PBi
EELGMQPAKI

SEQ ID NO: 59734 - protein, 10 aa, Borrelia garinii PBi
NEVEKVLVRM

SEQ ID NO: 59735 - protein, 10 aa, Borrelia garinii PBi
DEINRIADQA

SEQ ID NO: 59736 - protein, 11 aa, Borrelia garinii PBi
DEINRIADQAQ

SEQ ID NO: 59737 - protein, 9 aa, Borrelia garinii PBi
SPVNVTTTV

SEQ ID NO: 59738 - protein, 9 aa, Borrelia garinii PBi
VPQYVLSLL

SEQ ID NO: 59739 - protein, 11 aa, Borrelia garinii PBi
APATAPSQGGV

SEQ ID NO: 59740 - protein, 11 aa, Borrelia garinii PBi
APSQGGVNSPV

SEQ ID NO: 59741 - protein, 10 aa, Borrelia garinii PBi
ASLSGSQASW

SEQ ID NO: 59742 - protein, 11 aa, Borrelia Burgdorferi
KSDVKTYFTTV

SEQ ID NO: 59743 - protein, 9 aa, Borrelia Burgdorferi
ILSAIVTAA

SEQ ID NO: 59744 - protein, 9 aa, Borrelia Burgdorferi
KVLGAITGL

SEQ ID NO: 59745 - protein, 9 aa, Borrelia Burgdorferi
LLDKLVKAV

SEQ ID NO: 59746 - protein, 9 aa, Borrelia Burgdorferi
QILSAIVTA

SEQ ID NO: 59747 - protein, 9 aa, Borrelia Burgdorferi
VLGAITGLI

SEQ ID NO: 59748 - protein, 9 aa, Borrelia Burgdorferi
ELLDKLVKA

SEQ ID NO: 59749 - protein, 9 aa, Borrelia Burgdorferi
QLGNGFLDV

SEQ ID NO: 59750 - protein, 9 aa, Borrelia Burgdorferi
KAAGAVSAV

SEQ ID NO: 59751 - protein, 9 aa, Borrelia Burgdorferi
KLVKAVKTA

SEQ ID NO: 59752 - protein, 9 aa, Borrelia Burgdorferi
KTYFTTVAA

SEQ ID NO: 59753 - protein, 9 aa, Borrelia Burgdorferi
FLDVFTSFG

SEQ ID NO: 59754 - protein, 9 aa, Borrelia Burgdorferi
AIGEVVADA

SEQ ID NO: 59755 - protein, 9 aa, Borrelia Burgdorferi
GTAAIGEVV

SEQ ID NO: 59756 - protein, 10 aa, Borrelia Burgdorferi
QILSAIVTAA

SEQ ID NO: 59757 - protein, 10 aa, Borrelia Burgdorferi
KVLGAITGLI

SEQ ID NO: 59758 - protein, 10 aa, Borrelia Burgdorferi
VVADADAAKV

SEQ ID NO: 59759 - protein, 10 aa, Borrelia Burgdorferi
LIGDAVSSGL

SEQ ID NO: 59760 - protein, 10 aa, Borrelia Burgdorferi
KLFGKAGAAA

SEQ ID NO: 59761 - protein, 10 aa, Borrelia Burgdorferi
ELLDKLVKAV

SEQ ID NO: 59762 - protein, 10 aa, Borrelia Burgdorferi
GIAKGIKEIV

SEQ ID NO: 59763 - protein, 10 aa, Borrelia Burgdorferi
AITGLIGDAV

SEQ ID NO: 59764 - protein, 10 aa, Borrelia Burgdorferi
IQLGNGFLDV

SEQ ID NO: 59765 - protein, 10 aa, Borrelia Burgdorferi
AVSGEQILSA

SEQ ID NO: 59766 - protein, 10 aa, Borrelia Burgdorferi
FLDVFTSFGG

SEQ ID NO: 59767 - protein, 11 aa, Borrelia Burgdorferi
FLDVFTSFGGL

SEQ ID NO: 59768 - protein, 11 aa, Borrelia Burgdorferi
GLIGDAVSSGL

SEQ ID NO: 59769 - protein, 11 aa, Borrelia Burgdorferi
ILSAIVTAADA

SEQ ID NO: 59770 - protein, 11 aa, Borrelia Burgdorferi
KSDVKTYFTTV

SEQ ID NO: 59771 - protein, 11 aa, Borrelia Burgdorferi
FTSFGGLVAEA

SEQ ID NO: 59772 - protein, 11 aa, Borrelia Burgdorferi
KTYFTTVAAKL

SEQ ID NO: 59773 - protein, 9 aa, Borrelia Burgdorferi
KLKAVAAAK

SEQ ID NO: 59774 - protein, 9 aa, Borrelia Burgdorferi
KVADKASVK

SEQ ID NO: 59775 - protein, 9 aa, Borrelia Burgdorferi
LVAEAFGFK

SEQ ID NO: 59776 - protein, 9 aa, Borrelia Burgdorferi
  Xaa can be any naturally occurring amino acid
  VARIANT 7: Xaa = Any Amino Acid
AIALRGXAK

SEQ ID NO: 59777 - protein, 9 aa, Borrelia Burgdorferi
KTDLNSLPK

SEQ ID NO: 59778 - protein, 9 aa, Borrelia Burgdorferi
GAAESAVRK

SEQ ID NO: 59779 - protein, 9 aa, Borrelia Burgdorferi
QIAAAIALR

SEQ ID NO: 59780 - protein, 9 aa, Borrelia Burgdorferi
KASVKGIAK

SEQ ID NO: 59781 - protein, 9 aa, Borrelia Burgdorferi
TTVAAKLEK

SEQ ID NO: 59782 - protein, 9 aa, Borrelia Burgdorferi
KGAGKLFGK

SEQ ID NO: 59783 - protein, 9 aa, Borrelia Burgdorferi
KETPPALNK

SEQ ID NO: 59784 - protein, 9 aa, Borrelia Burgdorferi
GTAVEGAIK

SEQ ID NO: 59785 - protein, 9 aa, Borrelia Burgdorferi
TYFTTVAAK

SEQ ID NO: 59786 - protein, 10 aa, Borrelia Burgdorferi
KTYFTTVAAK

SEQ ID NO: 59787 - protein, 10 aa, Borrelia Burgdorferi
GLVAEAFGFK

SEQ ID NO: 59788 - protein, 10 aa, Borrelia Burgdorferi
  Xaa can be any naturally occurring amino acid
  VARIANT 8: Xaa = Any Amino Acid
AAIALRGXAK

SEQ ID NO: 59789 - protein, 10 aa, Borrelia Burgdorferi
FTTVAAKLEK

SEQ ID NO: 59790 - protein, 10 aa, Borrelia Burgdorferi
  Xaa can be any naturally occurring amino acid
  VARIANT 5: Xaa = Any Amino Acid
ALRGXAKDGK

SEQ ID NO: 59791 - protein, 10 aa, Borrelia Burgdorferi
IVEAAGGSEK

SEQ ID NO: 59792 - protein, 10 aa, Borrelia Burgdorferi
KSDISSTTGK

SEQ ID NO: 59793 - protein, 10 aa, Borrelia Burgdorferi
LLDKLVKAVK

SEQ ID NO: 59794 - protein, 10 aa, Borrelia Burgdorferi
SVKGIAKGIK

SEQ ID NO: 59795 - protein, 10 aa, Borrelia Burgdorferi
GLRKVGDSVK

SEQ ID NO: 59796 - protein, 10 aa, Borrelia Burgdorferi
  Xaa can be any naturally occurring amino acid
  VARIANT 1: Xaa = Any Amino Acid
XAKDGKFAVK

SEQ ID NO: 59797 - protein, 10 aa, Borrelia Burgdorferi
TKTDLNSLPK

SEQ ID NO: 59798 - protein, 10 aa, Borrelia Burgdorferi
EAFGFKSDPK

SEQ ID NO: 59799 - protein, 10 aa, Borrelia Burgdorferi
GDAVSSGLRK

SEQ ID NO: 59800 - protein, 10 aa, Borrelia Burgdorferi
KSDPKKSDVK

SEQ ID NO: 59801 - protein, 10 aa, Borrelia Burgdorferi
TVAAKLEKTK

SEQ ID NO: 59802 - protein, 10 aa, Borrelia Burgdorferi
KGAAESAVRK

SEQ ID NO: 59803 - protein, 11 aa, Borrelia Burgdorferi
KVGDSVKAASK

SEQ ID NO: 59804 - protein, 11 aa, Borrelia Burgdorferi
KTKTDLNSLPK

SEQ ID NO: 59805 - protein, 11 aa, Borrelia Burgdorferi
KLFGKAGAAAH

SEQ ID NO: 59806 - protein, 11 aa, Borrelia Burgdorferi
ASKETPPALNK

SEQ ID NO: 59807 - protein, 11 aa, Borrelia Burgdorferi
AVAAAKGENNK

SEQ ID NO: 59808 - protein, 11 aa, Borrelia Burgdorferi
KTDLNSLPKEK

SEQ ID NO: 59809 - protein, 11 aa, Borrelia Burgdorferi
AIKEVSELLDK

SEQ ID NO: 59810 - protein, 11 aa, Borrelia Burgdorferi
ELLDKLVKAVK

SEQ ID NO: 59811 - protein, 11 aa, Borrelia Burgdorferi
AAHGDSEAASK

SEQ ID NO: 59812 - protein, 11 aa, Borrelia Burgdorferi
  Xaa can be any naturally occurring amino acid
  VARIANT 2: Xaa = Any Amino Acid
GXAKDGKFAVK

SEQ ID NO: 59813 - protein, 9 aa, Borrelia Burgdorferi
TTVAAKLEK

SEQ ID NO: 59814 - protein, 9 aa, Borrelia Burgdorferi
KTDLNSLPK

SEQ ID NO: 59815 - protein, 9 aa, Borrelia Burgdorferi
LVAEAFGFK

SEQ ID NO: 59816 - protein, 9 aa, Borrelia Burgdorferi
KVADKASVK

SEQ ID NO: 59817 - protein, 9 aa, Borrelia Burgdorferi
  Xaa can be any naturally occurring amino acid
  VARIANT 7: Xaa = Any Amino Acid
AIALRGXAK

SEQ ID NO: 59818 - protein, 9 aa, Borrelia Burgdorferi
GAAESAVRK

SEQ ID NO: 59819 - protein, 9 aa, Borrelia Burgdorferi
VVADADAAK

SEQ ID NO: 59820 - protein, 9 aa, Borrelia Burgdorferi
KASVKGIAK

SEQ ID NO: 59821 - protein, 9 aa, Borrelia Burgdorferi
KLKAVAAAK

SEQ ID NO: 59822 - protein, 9 aa, Borrelia Burgdorferi
GTAVEGAIK

SEQ ID NO: 59823 - protein, 9 aa, Borrelia Burgdorferi
TYFTTVAAK

SEQ ID NO: 59824 - protein, 9 aa, Borrelia Burgdorferi
AAAKGENNK

SEQ ID NO: 59825 - protein, 9 aa, Borrelia Burgdorferi
QIAAAIALR

SEQ ID NO: 59826 - protein, 9 aa, Borrelia Burgdorferi
AAGGSEKLK

SEQ ID NO: 59827 - protein, 9 aa, Borrelia Burgdorferi
AVKDGEKEK

SEQ ID NO: 59828 - protein, 9 aa, Borrelia Burgdorferi
KGAGKLFGK

SEQ ID NO: 59829 - protein, 9 aa, Borrelia Burgdorferi
AFGFKSDPK

SEQ ID NO: 59830 - protein, 9 aa, Borrelia Burgdorferi
DAVSSGLRK

SEQ ID NO: 59831 - protein, 9 aa, Borrelia Burgdorferi
VAAKLEKTK

SEQ ID NO: 59832 - protein, 9 aa, Borrelia Burgdorferi
PIAAAIGDK

SEQ ID NO: 59833 - protein, 9 aa, Borrelia Burgdorferi
AVSAVSGEQ

SEQ ID NO: 59834 - protein, 9 aa, Borrelia Burgdorferi
SDISSTTGK

SEQ ID NO: 59835 - protein, 9 aa, Borrelia Burgdorferi
KTYFTTVAA

SEQ ID NO: 59836 - protein, 9 aa, Borrelia Burgdorferi
KETPPALNK

SEQ ID NO: 59837 - protein, 10 aa, Borrelia Burgdorferi
KTYFTTVAAK

SEQ ID NO: 59838 - protein, 10 aa, Borrelia Burgdorferi
  Xaa can be any naturally occurring amino acid
  VARIANT 8: Xaa = Any Amino Acid
AAIALRGXAK

SEQ ID NO: 59839 - protein, 10 aa, Borrelia Burgdorferi
GLVAEAFGFK

SEQ ID NO: 59840 - protein, 10 aa, Borrelia Burgdorferi
TVAAKLEKTK

SEQ ID NO: 59841 - protein, 10 aa, Borrelia Burgdorferi
KSDISSTTGK

SEQ ID NO: 59842 - protein, 10 aa, Borrelia Burgdorferi
IVEAAGGSEK

SEQ ID NO: 59843 - protein, 10 aa, Borrelia Burgdorferi
SVKGIAKGIK

SEQ ID NO: 59844 - protein, 10 aa, Borrelia Burgdorferi
VAAAKGENNK

SEQ ID NO: 59845 - protein, 10 aa, Borrelia Burgdorferi
FTTVAAKLEK

SEQ ID NO: 59846 - protein, 10 aa, Borrelia Burgdorferi
EAFGFKSDPK

SEQ ID NO: 59847 - protein, 10 aa, Borrelia Burgdorferi
VSELLDKLVK

SEQ ID NO: 59848 - protein, 10 aa, Borrelia Burgdorferi
AADAAEQDGK

SEQ ID NO: 59849 - protein, 10 aa, Borrelia Burgdorferi
  Xaa can be any naturally occurring amino acid
  VARIANT 1: Xaa = Any Amino Acid
XAKDGKFAVK

SEQ ID NO: 59850 - protein, 10 aa, Borrelia Burgdorferi
KSDPKKSDVK

SEQ ID NO: 59851 - protein, 10 aa, Borrelia Burgdorferi
EVVADADAAK

SEQ ID NO: 59852 - protein, 10 aa, Borrelia Burgdorferi
VADKDDPTNK

SEQ ID NO: 59853 - protein, 10 aa, Borrelia Burgdorferi
KGAAESAVRK

SEQ ID NO: 59854 - protein, 10 aa, Borrelia Burgdorferi
TKTDLNSLPK

SEQ ID NO: 59855 - protein, 10 aa, Borrelia Burgdorferi
AFGFKSDPKK

SEQ ID NO: 59856 - protein, 10 aa, Borrelia Burgdorferi
  Xaa can be any naturally occurring amino acid
  VARIANT 9: Xaa = Any Amino Acid
GAEFGQDEXK

SEQ ID NO: 59857 - protein, 11 aa, Borrelia Burgdorferi
AVAAAKGENNK

SEQ ID NO: 59858 - protein, 11 aa, Borrelia Burgdorferi
KTKTDLNSLPK

SEQ ID NO: 59859 - protein, 11 aa, Borrelia Burgdorferi
ASKETPPALNK

SEQ ID NO: 59860 - protein, 11 aa, Borrelia Burgdorferi
TTVAAKLEKTK

SEQ ID NO: 59861 - protein, 11 aa, Borrelia Burgdorferi
KVGDSVKAASK

SEQ ID NO: 59862 - protein, 11 aa, Borrelia Burgdorferi
KTDLNSLPKEK

SEQ ID NO: 59863 - protein, 11 aa, Borrelia Burgdorferi
SVGTAVEGAIK

SEQ ID NO: 59864 - protein, 11 aa, Borrelia Burgdorferi
QVADKDDPTNK

SEQ ID NO: 59865 - protein, 11 aa, Borrelia Burgdorferi
  Xaa can be any naturally occurring amino acid
  VARIANT 9: Xaa = Any Amino Acid
AAAIALRGXAK

SEQ ID NO: 59866 - protein, 11 aa, Borrelia Burgdorferi
TAADAAEQDGK

SEQ ID NO: 59867 - protein, 11 aa, Borrelia Burgdorferi
AIKEVSELLDK

SEQ ID NO: 59868 - protein, 11 aa, Borrelia Burgdorferi
AAHGDSEAASK

SEQ ID NO: 59869 - protein, 11 aa, Borrelia Burgdorferi
ASVKGIAKGIK

SEQ ID NO: 59870 - protein, 11 aa, Borrelia Burgdorferi
EVSELLDKLVK

SEQ ID NO: 59871 - protein, 11 aa, Borrelia Burgdorferi
EAFGFKSDPKK

SEQ ID NO: 59872 - protein, 11 aa, Borrelia Burgdorferi
  Xaa can be any naturally occurring amino acid
  VARIANT 6: Xaa = Any Amino Acid
IALRGXAKDGK

SEQ ID NO: 59873 - protein, 11 aa, Borrelia Burgdorferi
AADAAEQDGKK

SEQ ID NO: 59874 - protein, 11 aa, Borrelia Burgdorferi
AAKVADKASVK

SEQ ID NO: 59875 - protein, 11 aa, Borrelia Burgdorferi
  Xaa can be any naturally occurring amino acid
  VARIANT 2: Xaa = Any Amino Acid
GXAKDGKFAVK

SEQ ID NO: 59876 - protein, 11 aa, Borrelia Burgdorferi
  Xaa can be any naturally occurring amino acid
  VARIANT 9: Xaa = Any Amino Acid
GAEFGQDEXKK

SEQ ID NO: 59877 - protein, 11 aa, Borrelia Burgdorferi
GGLVAEAFGFK

SEQ ID NO: 59878 - protein, 11 aa, Borrelia Burgdorferi
ELLDKLVKAVK

SEQ ID NO: 59879 - protein, 11 aa, Borrelia Burgdorferi
LIGDAVSSGLR

SEQ ID NO: 59880 - protein, 9 aa, Borrelia Burgdorferi
GFLDVFTSF

SEQ ID NO: 59881 - protein, 9 aa, Borrelia Burgdorferi
TYFTTVAAK

SEQ ID NO: 59882 - protein, 9 aa, Borrelia Burgdorferi
YFTTVAAKL

SEQ ID NO: 59883 - protein, 9 aa, Borrelia Burgdorferi
KFYQSVIQL

SEQ ID NO: 59884 - protein, 9 aa, Borrelia Burgdorferi
FYQSVIQLG

SEQ ID NO: 59885 - protein, 10 aa, Borrelia Burgdorferi
TYFTTVAAKL

SEQ ID NO: 59886 - protein, 10 aa, Borrelia Burgdorferi
SFGGLVAEAF

SEQ ID NO: 59887 - protein, 11 aa, Borrelia Burgdorferi
IQLGNGFLDVF

SEQ ID NO: 59888 - protein, 9 aa, Borrelia Burgdorferi
GFLDVFTSF

SEQ ID NO: 59889 - protein, 9 aa, Borrelia Burgdorferi
SVIQLGNGF

SEQ ID NO: 59890 - protein, 9 aa, Borrelia Burgdorferi
TTVAAKLEK

SEQ ID NO: 59891 - protein, 9 aa, Borrelia Burgdorferi
QIAAAIALR

SEQ ID NO: 59892 - protein, 9 aa, Borrelia Burgdorferi
LVAEAFGFK

SEQ ID NO: 59893 - protein, 9 aa, Borrelia Burgdorferi
TYFTTVAAK

SEQ ID NO: 59894 - protein, 9 aa, Borrelia Burgdorferi
VVADADAAK

SEQ ID NO: 59895 - protein, 9 aa, Borrelia Burgdorferi
DAAEQDGKK

SEQ ID NO: 59896 - protein, 9 aa, Borrelia Burgdorferi
DAVSSGLRK

SEQ ID NO: 59897 - protein, 9 aa, Borrelia Burgdorferi
GAAESAVRK

SEQ ID NO: 59898 - protein, 9 aa, Borrelia Burgdorferi
KVADKASVK

SEQ ID NO: 59899 - protein, 9 aa, Borrelia Burgdorferi
FGFKSDPKK

SEQ ID NO: 59900 - protein, 9 aa, Borrelia Burgdorferi
DLNSLPKEK

SEQ ID NO: 59901 - protein, 9 aa, Borrelia Burgdorferi
SDISSTTGK

SEQ ID NO: 59902 - protein, 9 aa, Borrelia Burgdorferi
KLKAVAAAK

SEQ ID NO: 59903 - protein, 9 aa, Borrelia Burgdorferi
GTAVEGAIK

SEQ ID NO: 59904 - protein, 9 aa, Borrelia Burgdorferi
AAAKGENNK

SEQ ID NO: 59905 - protein, 10 aa, Borrelia Burgdorferi
FTTVAAKLEK

SEQ ID NO: 59906 - protein, 10 aa, Borrelia Burgdorferi
EVVADADAAK

SEQ ID NO: 59907 - protein, 10 aa, Borrelia Burgdorferi
EAFGFKSDPK

SEQ ID NO: 59908 - protein, 10 aa, Borrelia Burgdorferi
EAAGGSEKLK

SEQ ID NO: 59909 - protein, 10 aa, Borrelia Burgdorferi
KTYFTTVAAK

SEQ ID NO: 59910 - protein, 10 aa, Borrelia Burgdorferi
DQIAAAIALR

SEQ ID NO: 59911 - protein, 10 aa, Borrelia Burgdorferi
TVAAKLEKTK

SEQ ID NO: 59912 - protein, 10 aa, Borrelia Burgdorferi
SVKGIAKGIK

SEQ ID NO: 59913 - protein, 10 aa, Borrelia Burgdorferi
IVEAAGGSEK

SEQ ID NO: 59914 - protein, 10 aa, Borrelia Burgdorferi
FAVKDGEKEK

SEQ ID NO: 59915 - protein, 10 aa, Borrelia Burgdorferi
NPIAAAIGDK

SEQ ID NO: 59916 - protein, 10 aa, Borrelia Burgdorferi
GLVAEAFGFK

SEQ ID NO: 59917 - protein, 10 aa, Borrelia Burgdorferi
  Xaa can be any naturally occurring amino acid
  VARIANT 1: Xaa = Any Amino Acid
XAKDGKFAVK

SEQ ID NO: 59918 - protein, 10 aa, Borrelia Burgdorferi
VAAAKGENNK

SEQ ID NO: 59919 - protein, 10 aa, Borrelia Burgdorferi
  Xaa can be any naturally occurring amino acid
  VARIANT 8: Xaa = Any Amino Acid
AAIALRGXAK

SEQ ID NO: 59920 - protein, 10 aa, Borrelia Burgdorferi
DADAAKVADK

SEQ ID NO: 59921 - protein, 11 aa, Borrelia Burgdorferi
EAFGFKSDPKK

SEQ ID NO: 59922 - protein, 11 aa, Borrelia Burgdorferi
TTVAAKLEKTK

SEQ ID NO: 59923 - protein, 11 aa, Borrelia Burgdorferi
EIVEAAGGSEK

SEQ ID NO: 59924 - protein, 11 aa, Borrelia Burgdorferi
TAADAAEQDGK

SEQ ID NO: 59925 - protein, 11 aa, Borrelia Burgdorferi
EVSELLDKLVK

SEQ ID NO: 59926 - protein, 11 aa, Borrelia Burgdorferi
YFTTVAAKLEK

SEQ ID NO: 59927 - protein, 11 aa, Borrelia Burgdorferi
LIGDAVSSGLR

SEQ ID NO: 59928 - protein, 11 aa, Borrelia Burgdorferi
AVAAAKGENNK

SEQ ID NO: 59929 - protein, 11 aa, Borrelia Burgdorferi
QVADKDDPTNK

SEQ ID NO: 59930 - protein, 11 aa, Borrelia Burgdorferi
EKSDISSTTGK

SEQ ID NO: 59931 - protein, 11 aa, Borrelia Burgdorferi
ELLDKLVKAVK

SEQ ID NO: 59932 - protein, 11 aa, Borrelia Burgdorferi
AIKGAAESAVR

SEQ ID NO: 59933 - protein, 11 aa, Borrelia Burgdorferi
DDQIAAAIALR

SEQ ID NO: 59934 - protein, 11 aa, Borrelia Burgdorferi
SVGTAVEGAIK

SEQ ID NO: 59935 - protein, 11 aa, Borrelia Burgdorferi
AAHGDSEAASK

SEQ ID NO: 59936 - protein, 9 aa, Borrelia Burgdorferi
AVRKVLGAI

SEQ ID NO: 59937 - protein, 9 aa, Borrelia Burgdorferi
KPEEAKNPI

SEQ ID NO: 59938 - protein, 9 aa, Borrelia Burgdorferi
AASKAAGAV

SEQ ID NO: 59939 - protein, 9 aa, Borrelia Burgdorferi
GASSGTAAI

SEQ ID NO: 59940 - protein, 9 aa, Borrelia Burgdorferi
KAAGAVSAV

SEQ ID NO: 59941 - protein, 9 aa, Borrelia Burgdorferi
KPDSTGSVG

SEQ ID NO: 59942 - protein, 10 aa, Borrelia Burgdorferi
AASKETPPAL

SEQ ID NO: 59943 - protein, 10 aa, Borrelia Burgdorferi
AAESAVRKVL

SEQ ID NO: 59944 - protein, 10 aa, Borrelia Burgdorferi
AVRKVLGAIT

SEQ ID NO: 59945 - protein, 10 aa, Borrelia Burgdorferi
SAVRKVLGAI

SEQ ID NO: 59946 - protein, 10 aa, Borrelia Burgdorferi
KPDSTGSVGT

SEQ ID NO: 59947 - protein, 10 aa, Borrelia Burgdorferi
KPEEAKNPIA

SEQ ID NO: 59948 - protein, 11 aa, Borrelia Burgdorferi
KPEEAKNPIAA

SEQ ID NO: 59949 - protein, 11 aa, Borrelia Burgdorferi
KAASKETPPAL

SEQ ID NO: 59950 - protein, 11 aa, Borrelia Burgdorferi
KPDSTGSVGTA

SEQ ID NO: 59951 - protein, 11 aa, Borrelia Burgdorferi
GAAESAVRKVL

SEQ ID NO: 59952 - protein, 11 aa, Borrelia Burgdorferi
LPKEKSDISST

SEQ ID NO: 59953 - protein, 11 aa, Borrelia Burgdorferi
AVSGEQILSAI

SEQ ID NO: 59954 - protein, 11 aa, Borrelia Burgdorferi
AVSAVSGEQIL

SEQ ID NO: 59955 - protein, 11 aa, Borrelia Burgdorferi
AASKAAGAVSA

SEQ ID NO: 59956 - protein, 9 aa, Borrelia Burgdorferi
SVIQLGNGF

SEQ ID NO: 59957 - protein, 9 aa, Borrelia Burgdorferi
DQIAAAIAL

SEQ ID NO: 59958 - protein, 9 aa, Borrelia Burgdorferi
GLVAEAFGF

SEQ ID NO: 59959 - protein, 9 aa, Borrelia Burgdorferi
FGKAGAAAH

SEQ ID NO: 59960 - protein, 10 aa, Borrelia Burgdorferi
QLGNGFLDVF

SEQ ID NO: 59961 - protein, 10 aa, Borrelia Burgdorferi
QSVIQLGNGF

SEQ ID NO: 59962 - protein, 11 aa, Borrelia Burgdorferi
YQSVIQLGNGF

SEQ ID NO: 59963 - protein, 11 aa, Borrelia Burgdorferi
IQLGNGFLDVF

SEQ ID NO: 59964 - protein, 11 aa, Borrelia Burgdorferi
TSFGGLVAEAF

SEQ ID NO: 59965 - protein, 11 aa, Borrelia Burgdorferi
KLFGKAGAAAH

SEQ ID NO: 59966 - protein, 11 aa, Borrelia Burgdorferi
  Xaa can be any naturally occurring amino acid
  VARIANT 5: Xaa = Any Amino Acid
ALRGXAKDGKF

SEQ ID NO: 59967 - protein, 11 aa, Borrelia Burgdorferi
GLIGDAVSSGL

SEQ ID NO: 59968 - protein, 11 aa, Borrelia Burgdorferi
AIGDKDGGAEF

SEQ ID NO: 59969 - protein, 10 aa, Borrelia Burgdorferi
RKVLGAITGL

SEQ ID NO: 59970 - protein, 9 aa, Borrelia Burgdorferi
SVIQLGNGF

SEQ ID NO: 59971 - protein, 9 aa, Borrelia Burgdorferi
SAVSGEQIL

SEQ ID NO: 59972 - protein, 9 aa, Borrelia Burgdorferi
FGGLVAEAF

SEQ ID NO: 59973 - protein, 9 aa, Borrelia Burgdorferi
EAAGGSEKL

SEQ ID NO: 59974 - protein, 9 aa, Borrelia Burgdorferi
KPEEAKNPI

SEQ ID NO: 59975 - protein, 9 aa, Borrelia Burgdorferi
EVVADADAA

SEQ ID NO: 59976 - protein, 9 aa, Borrelia Burgdorferi
LGNGFLDVF

SEQ ID NO: 59977 - protein, 9 aa, Borrelia Burgdorferi
TAAIGEVVA

SEQ ID NO: 59978 - protein, 10 aa, Borrelia Burgdorferi
DPKKSDVKTY

SEQ ID NO: 59979 - protein, 10 aa, Borrelia Burgdorferi
SFGGLVAEAF

SEQ ID NO: 59980 - protein, 10 aa, Borrelia Burgdorferi
AASKETPPAL

SEQ ID NO: 59981 - protein, 10 aa, Borrelia Burgdorferi
QSVIQLGNGF

SEQ ID NO: 59982 - protein, 10 aa, Borrelia Burgdorferi
QLGNGFLDVF

SEQ ID NO: 59983 - protein, 10 aa, Borrelia Burgdorferi
SAIVTAADAA

SEQ ID NO: 59984 - protein, 11 aa, Borrelia Burgdorferi
TSFGGLVAEAF

SEQ ID NO: 59985 - protein, 11 aa, Borrelia Burgdorferi
DPKKSDVKTYF

SEQ ID NO: 59986 - protein, 11 aa, Borrelia Burgdorferi
TAEGASSGTAA

SEQ ID NO: 59987 - protein, 11 aa, Borrelia Burgdorferi
VADKDDPTNKF

SEQ ID NO: 59988 - protein, 11 aa, Borrelia Burgdorferi
KPEEAKNPIAA

SEQ ID NO: 59989 - protein, 11 aa, Borrelia Burgdorferi
YQSVIQLGNGF

SEQ ID NO: 59990 - protein, 11 aa, Borrelia Burgdorferi
KAASKETPPAL

SEQ ID NO: 59991 - protein, 11 aa, Borrelia Burgdorferi
TAVEGAIKEVS

SEQ ID NO: 59992 - protein, 9 aa, Borrelia Burgdorferi
EEAKNPIAA

SEQ ID NO: 59993 - protein, 9 aa, Borrelia Burgdorferi
GEVVADADA

SEQ ID NO: 59994 - protein, 9 aa, Borrelia Burgdorferi
  Xaa can be any naturally occurring amino acid
  VARIANT 8: Xaa = Any Amino Acid
AEFGQDEXK

SEQ ID NO: 59995 - protein, 9 aa, Borrelia Burgdorferi
AEGAIKGAA

SEQ ID NO: 59996 - protein, 10 aa, Borrelia Burgdorferi
KEIVEAAGGS

SEQ ID NO: 59997 - protein, 10 aa, Borrelia Burgdorferi
EEAKNPIAAA

SEQ ID NO: 59998 - protein, 10 aa, Borrelia Burgdorferi
GEVVADADAA

SEQ ID NO: 59999 - protein, 11 aa, Borrelia Burgdorferi
EEAKNPIAAAI

SEQ ID NO: 60000 - protein, 11 aa, Borrelia Burgdorferi
GENNKGAGKLF

SEQ ID NO: 60001 - protein, 11 aa, Borrelia Burgdorferi
AEGASSGTAAI

SEQ ID NO: 60002 - protein, 11 aa, Borrelia Burgdorferi
KEVSELLDKLV

SEQ ID NO: 60003 - protein, 11 aa, Borrelia Burgdorferi
AEGAIKGAAES

SEQ ID NO: 60004 - protein, 11 aa, Borrelia Burgdorferi
SELLDKLVKAV

SEQ ID NO: 60005 - protein, 11 aa, Borrelia Burgdorferi
  Xaa can be any naturally occurring amino acid
  VARIANT 8: Xaa = Any Amino Acid
AEFGQDEXKKD

SEQ ID NO: 60006 - protein, 9 aa, Borrelia Burgdorferi
KPEEAKNPI

SEQ ID NO: 60007 - protein, 10 aa, Borrelia Burgdorferi
LPKEKSDISS

SEQ ID NO: 60008 - protein, 11 aa, Borrelia Burgdorferi
LPKEKSDISST

SEQ ID NO: 60009 - protein, 9 aa, Borrelia burgdorferi
LSANIEENY

SEQ ID NO: 60010 - protein, 9 aa, Borrelia burgdorferi
YSEDKANTV

SEQ ID NO: 60011 - protein, 10 aa, Borrelia burgdorferi
FLDALEAIEY

SEQ ID NO: 60012 - protein, 11 aa, Borrelia burgdorferi
NSDKIDYAEKY

SEQ ID NO: 60013 - protein, 11 aa, Borrelia burgdorferi
RLDNYDFKNEY

SEQ ID NO: 60014 - protein, 11 aa, Borrelia burgdorferi
STDSIFLSEDM

SEQ ID NO: 60015 - protein, 9 aa, Borrelia burgdorferi
FLSEDMIRL

SEQ ID NO: 60016 - protein, 9 aa, Borrelia burgdorferi
FLFLFVVSL

SEQ ID NO: 60017 - protein, 9 aa, Borrelia burgdorferi
LLIFLFLFV

SEQ ID NO: 60018 - protein, 9 aa, Borrelia burgdorferi
FLFVVSLSA

SEQ ID NO: 60019 - protein, 9 aa, Borrelia burgdorferi
SIFNYLIQL

SEQ ID NO: 60020 - protein, 9 aa, Borrelia burgdorferi
LIFLFLFVV

SEQ ID NO: 60021 - protein, 9 aa, Borrelia burgdorferi
YLIKIKIST

SEQ ID NO: 60022 - protein, 9 aa, Borrelia burgdorferi
KISTDSIFL

SEQ ID NO: 60023 - protein, 9 aa, Borrelia burgdorferi
ALEAIEYLI

SEQ ID NO: 60024 - protein, 9 aa, Borrelia burgdorferi
FVVSLSANI

SEQ ID NO: 60025 - protein, 9 aa, Borrelia burgdorferi
ILKQILADL

SEQ ID NO: 60026 - protein, 9 aa, Borrelia burgdorferi
LIGSYPDSI

SEQ ID NO: 60027 - protein, 9 aa, Borrelia burgdorferi
KKISLLIFL

SEQ ID NO: 60028 - protein, 9 aa, Borrelia burgdorferi
HVFSDAPRI

SEQ ID NO: 60029 - protein, 9 aa, Borrelia burgdorferi
ISLLIFLFL

SEQ ID NO: 60030 - protein, 10 aa, Borrelia burgdorferi
FLSEDMIRLI

SEQ ID NO: 60031 - protein, 10 aa, Borrelia burgdorferi
SLLIFLFLFV

SEQ ID NO: 60032 - protein, 10 aa, Borrelia burgdorferi
LLIFLFLFVV

SEQ ID NO: 60033 - protein, 10 aa, Borrelia burgdorferi
RLIGSYPDSI

SEQ ID NO: 60034 - protein, 10 aa, Borrelia burgdorferi
YLIQLNSDKI

SEQ ID NO: 60035 - protein, 10 aa, Borrelia burgdorferi
KISLLIFLFL

SEQ ID NO: 60036 - protein, 10 aa, Borrelia burgdorferi
FLFLFVVSLS

SEQ ID NO: 60037 - protein, 10 aa, Borrelia burgdorferi
QLNSDKIDYA

SEQ ID NO: 60038 - protein, 10 aa, Borrelia burgdorferi
QILKQILADL

SEQ ID NO: 60039 - protein, 10 aa, Borrelia burgdorferi
SVFLDALEAI

SEQ ID NO: 60040 - protein, 11 aa, Borrelia burgdorferi
FLDALEAIEYL

SEQ ID NO: 60041 - protein, 11 aa, Borrelia burgdorferi
SLLIFLFLFVV

SEQ ID NO: 60042 - protein, 11 aa, Borrelia burgdorferi
FLFVVSLSANI

SEQ ID NO: 60043 - protein, 11 aa, Borrelia burgdorferi
FLFLFVVSLSA

SEQ ID NO: 60044 - protein, 11 aa, Borrelia burgdorferi
LIFLFLFVVSL

SEQ ID NO: 60045 - protein, 11 aa, Borrelia burgdorferi
ALEAIEYLIKI

SEQ ID NO: 60046 - protein, 11 aa, Borrelia burgdorferi
ISLLIFLFLFV

SEQ ID NO: 60047 - protein, 11 aa, Borrelia burgdorferi
SIFLSEDMIRL

SEQ ID NO: 60048 - protein, 11 aa, Borrelia burgdorferi
SLSANIEENYT

SEQ ID NO: 60049 - protein, 11 aa, Borrelia burgdorferi
KKISLLIFLFL

SEQ ID NO: 60050 - protein, 9 aa, Borrelia burgdorferi
YLIQLNSDK

SEQ ID NO: 60051 - protein, 10 aa, Borrelia burgdorferi
KANTVKQILK

SEQ ID NO: 60052 - protein, 10 aa, Borrelia burgdorferi
ALEAIEYLIK

SEQ ID NO: 60053 - protein, 10 aa, Borrelia burgdorferi
YTETKRAFSK

SEQ ID NO: 60054 - protein, 10 aa, Borrelia burgdorferi
NYLIQLNSDK

SEQ ID NO: 60055 - protein, 10 aa, Borrelia burgdorferi
SLLIFLFLFV

SEQ ID NO: 60056 - protein, 10 aa, Borrelia burgdorferi
APRIRGDLRK

SEQ ID NO: 60057 - protein, 10 aa, Borrelia burgdorferi
NLINKRLDNY

SEQ ID NO: 60058 - protein, 11 aa, Borrelia burgdorferi
ILKQILADLPK

SEQ ID NO: 60059 - protein, 11 aa, Borrelia burgdorferi
FSKEDFNLINK

SEQ ID NO: 60060 - protein, 11 aa, Borrelia burgdorferi
FNYLIQLNSDK

SEQ ID NO: 60061 - protein, 9 aa, Borrelia burgdorferi
KQILADLPK

SEQ ID NO: 60062 - protein, 9 aa, Borrelia burgdorferi
AIEYLIKIK

SEQ ID NO: 60063 - protein, 9 aa, Borrelia burgdorferi
YLIQLNSDK

SEQ ID NO: 60064 - protein, 9 aa, Borrelia burgdorferi
TETKRAFSK

SEQ ID NO: 60065 - protein, 9 aa, Borrelia burgdorferi
GDNARNNFK

SEQ ID NO: 60066 - protein, 9 aa, Borrelia burgdorferi
KEDFNLINK

SEQ ID NO: 60067 - protein, 10 aa, Borrelia burgdorferi
KANTVKQILK

SEQ ID NO: 60068 - protein, 10 aa, Borrelia burgdorferi
YTETKRAFSK

SEQ ID NO: 60069 - protein, 10 aa, Borrelia burgdorferi
GSYPDSIFNY

SEQ ID NO: 60070 - protein, 10 aa, Borrelia burgdorferi
SIFLSEDMIR

SEQ ID NO: 60071 - protein, 10 aa, Borrelia burgdorferi
ALEAIEYLIK

SEQ ID NO: 60072 - protein, 10 aa, Borrelia burgdorferi
KSHVFSDAPR

SEQ ID NO: 60073 - protein, 10 aa, Borrelia burgdorferi
HVFSDAPRIR

SEQ ID NO: 60074 - protein, 10 aa, Borrelia burgdorferi
NSDKIDYAEK

SEQ ID NO: 60075 - protein, 10 aa, Borrelia burgdorferi
YSEDKANTVK

SEQ ID NO: 60076 - protein, 10 aa, Borrelia burgdorferi
EAIEYLIKIK

SEQ ID NO: 60077 - protein, 10 aa, Borrelia burgdorferi
SLSANIEENY

SEQ ID NO: 60078 - protein, 10 aa, Borrelia burgdorferi
NIEENYTETK

SEQ ID NO: 60079 - protein, 10 aa, Borrelia burgdorferi
SKEDFNLINK

SEQ ID NO: 60080 - protein, 11 aa, Borrelia burgdorferi
ILKQILADLPK

SEQ ID NO: 60081 - protein, 11 aa, Borrelia burgdorferi
FSKEDFNLINK

SEQ ID NO: 60082 - protein, 11 aa, Borrelia burgdorferi
KYGDNARNNFK

SEQ ID NO: 60083 - protein, 9 aa, Borrelia burgdorferi
SYPDSIFNY

SEQ ID NO: 60084 - protein, 9 aa, Borrelia burgdorferi
KISLLIFLF

SEQ ID NO: 60085 - protein, 9 aa, Borrelia burgdorferi
NYTETKRAF

SEQ ID NO: 60086 - protein, 9 aa, Borrelia burgdorferi
VFLDALEAI

SEQ ID NO: 60087 - protein, 9 aa, Borrelia burgdorferi
SLLIFLFLF

SEQ ID NO: 60088 - protein, 10 aa, Borrelia burgdorferi
SYPDSIFNYL

SEQ ID NO: 60089 - protein, 10 aa, Borrelia burgdorferi
KYGDNARNNF

SEQ ID NO: 60090 - protein, 10 aa, Borrelia burgdorferi
ISLLIFLFLF

SEQ ID NO: 60091 - protein, 10 aa, Borrelia burgdorferi
IFLFLFVVSL

SEQ ID NO: 60092 - protein, 10 aa, Borrelia burgdorferi
AFSKEDFNLI

SEQ ID NO: 60093 - protein, 10 aa, Borrelia burgdorferi
KKISLLIFLF

SEQ ID NO: 60094 - protein, 10 aa, Borrelia burgdorferi
LFVVSLSANI

SEQ ID NO: 60095 - protein, 10 aa, Borrelia burgdorferi
IFLSEDMIRL

SEQ ID NO: 60096 - protein, 11 aa, Borrelia burgdorferi
SYPDSIFNYLI

SEQ ID NO: 60097 - protein, 11 aa, Borrelia burgdorferi
NYLIQLNSDKI

SEQ ID NO: 60098 - protein, 11 aa, Borrelia burgdorferi
IFLSEDMIRLI

SEQ ID NO: 60099 - protein, 11 aa, Borrelia burgdorferi
KISLLIFLFLF

SEQ ID NO: 60100 - protein, 11 aa, Borrelia burgdorferi
KYGDNARNNFK

SEQ ID NO: 60101 - protein, 9 aa, Borrelia burgdorferi
SYPDSIFNY

SEQ ID NO: 60102 - protein, 9 aa, Borrelia burgdorferi
DMIRLIGSY

SEQ ID NO: 60103 - protein, 9 aa, Borrelia burgdorferi
KISLLIFLF

SEQ ID NO: 60104 - protein, 9 aa, Borrelia burgdorferi
SLLIFLFLF

SEQ ID NO: 60105 - protein, 9 aa, Borrelia burgdorferi
QLNSDKIDY

SEQ ID NO: 60106 - protein, 10 aa, Borrelia burgdorferi
FLDALEAIEY

SEQ ID NO: 60107 - protein, 10 aa, Borrelia burgdorferi
GSYPDSIFNY

SEQ ID NO: 60108 - protein, 10 aa, Borrelia burgdorferi
SLSANIEENY

SEQ ID NO: 60109 - protein, 10 aa, Borrelia burgdorferi
NLINKRLDNY

SEQ ID NO: 60110 - protein, 11 aa, Borrelia burgdorferi
VFLDALEAIEY

SEQ ID NO: 60111 - protein, 11 aa, Borrelia burgdorferi
KISLLIFLFLF

SEQ ID NO: 60112 - protein, 11 aa, Borrelia burgdorferi
RLDNYDFKNEY

SEQ ID NO: 60113 - protein, 11 aa, Borrelia burgdorferi
IGSYPDSIFNY

SEQ ID NO: 60114 - protein, 11 aa, Borrelia burgdorferi
VSLSANIEENY

SEQ ID NO: 60115 - protein, 9 aa, Borrelia burgdorferi
YLIQLNSDK

SEQ ID NO: 60116 - protein, 9 aa, Borrelia burgdorferi
EDFNLINKR

SEQ ID NO: 60117 - protein, 9 aa, Borrelia burgdorferi
DNARNNFKK

SEQ ID NO: 60118 - protein, 9 aa, Borrelia burgdorferi
YDFKNEYEK

SEQ ID NO: 60119 - protein, 9 aa, Borrelia burgdorferi
EENYTETKR

SEQ ID NO: 60120 - protein, 9 aa, Borrelia burgdorferi
LSANIEENY

SEQ ID NO: 60121 - protein, 9 aa, Borrelia burgdorferi
SHVFSDAPR

SEQ ID NO: 60122 - protein, 9 aa, Borrelia burgdorferi
TETKRAFSK

SEQ ID NO: 60123 - protein, 9 aa, Borrelia burgdorferi
IFLSEDMIR

SEQ ID NO: 60124 - protein, 9 aa, Borrelia burgdorferi
DNYDFKNEY

SEQ ID NO: 60125 - protein, 10 aa, Borrelia burgdorferi
HVFSDAPRIR

SEQ ID NO: 60126 - protein, 10 aa, Borrelia burgdorferi
SIFLSEDMIR

SEQ ID NO: 60127 - protein, 10 aa, Borrelia burgdorferi
EAIEYLIKIK

SEQ ID NO: 60128 - protein, 10 aa, Borrelia burgdorferi
YTETKRAFSK

SEQ ID NO: 60129 - protein, 10 aa, Borrelia burgdorferi
DAPRIRGDLR

SEQ ID NO: 60130 - protein, 10 aa, Borrelia burgdorferi
YAEKYGDNAR

SEQ ID NO: 60131 - protein, 10 aa, Borrelia burgdorferi
NIEENYTETK

SEQ ID NO: 60132 - protein, 10 aa, Borrelia burgdorferi
NSDKIDYAEK

SEQ ID NO: 60133 - protein, 10 aa, Borrelia burgdorferi
KSHVFSDAPR

SEQ ID NO: 60134 - protein, 10 aa, Borrelia burgdorferi
YSEDKANTVK

SEQ ID NO: 60135 - protein, 10 aa, Borrelia burgdorferi
KANTVKQILK

SEQ ID NO: 60136 - protein, 10 aa, Borrelia burgdorferi
NYDFKNEYEK

SEQ ID NO: 60137 - protein, 10 aa, Borrelia burgdorferi
GSYPDSIFNY

SEQ ID NO: 60138 - protein, 11 aa, Borrelia burgdorferi
DSIFLSEDMIR

SEQ ID NO: 60139 - protein, 11 aa, Borrelia burgdorferi
DNYDFKNEYEK

SEQ ID NO: 60140 - protein, 11 aa, Borrelia burgdorferi
NIEENYTETKR

SEQ ID NO: 60141 - protein, 11 aa, Borrelia burgdorferi
NYTETKRAFSK

SEQ ID NO: 60142 - protein, 11 aa, Borrelia burgdorferi
FNYLIQLNSDK

SEQ ID NO: 60143 - protein, 11 aa, Borrelia burgdorferi
EKSHVFSDAPR

SEQ ID NO: 60144 - protein, 11 aa, Borrelia burgdorferi
DYAEKYGDNAR

SEQ ID NO: 60145 - protein, 11 aa, Borrelia burgdorferi
FSKEDFNLINK

SEQ ID NO: 60146 - protein, 11 aa, Borrelia burgdorferi
DAPRIRGDLRK

SEQ ID NO: 60147 - protein, 11 aa, Borrelia burgdorferi
DALEAIEYLIK

SEQ ID NO: 60148 - protein, 11 aa, Borrelia burgdorferi
DYSEDKANTVK

SEQ ID NO: 60149 - protein, 11 aa, Borrelia burgdorferi
NNFKKDYSEDK

SEQ ID NO: 60150 - protein, 11 aa, Borrelia burgdorferi
ILKQILADLPK

SEQ ID NO: 60151 - protein, 9 aa, Borrelia burgdorferi
YPDSIFNYL

SEQ ID NO: 60152 - protein, 9 aa, Borrelia burgdorferi
APRIRGDLR

SEQ ID NO: 60153 - protein, 10 aa, Borrelia burgdorferi
APRIRGDLRK

SEQ ID NO: 60154 - protein, 10 aa, Borrelia burgdorferi
YPDSIFNYLI

SEQ ID NO: 60155 - protein, 11 aa, Borrelia burgdorferi
APRIRGDLRKI

SEQ ID NO: 60156 - protein, 11 aa, Borrelia burgdorferi
RIRGDLRKIGI

SEQ ID NO: 60157 - protein, 9 aa, Borrelia burgdorferi
DMIRLIGSY

SEQ ID NO: 60158 - protein, 9 aa, Borrelia burgdorferi
FLFLFVVSL

SEQ ID NO: 60159 - protein, 9 aa, Borrelia burgdorferi
LSANIEENY

SEQ ID NO: 60160 - protein, 9 aa, Borrelia burgdorferi
IGSYPDSIF

SEQ ID NO: 60161 - protein, 9 aa, Borrelia burgdorferi
KISLLIFLF

SEQ ID NO: 60162 - protein, 9 aa, Borrelia burgdorferi
NEYEKSHVF

SEQ ID NO: 60163 - protein, 9 aa, Borrelia burgdorferi
QLNSDKIDY

SEQ ID NO: 60164 - protein, 10 aa, Borrelia burgdorferi
IQLNSDKIDY

SEQ ID NO: 60165 - protein, 10 aa, Borrelia burgdorferi
GSYPDSIFNY

SEQ ID NO: 60166 - protein, 10 aa, Borrelia burgdorferi
SLSANIEENY

SEQ ID NO: 60167 - protein, 10 aa, Borrelia burgdorferi
KIKISTDSIF

SEQ ID NO: 60168 - protein, 10 aa, Borrelia burgdorferi
FLDALEAIEY

SEQ ID NO: 60169 - protein, 11 aa, Borrelia burgdorferi
RLIGSYPDSIF

SEQ ID NO: 60170 - protein, 11 aa, Borrelia burgdorferi
KQILKQILADL

SEQ ID NO: 60171 - protein, 11 aa, Borrelia burgdorferi
FKNEYEKSHVF

SEQ ID NO: 60172 - protein, 11 aa, Borrelia burgdorferi
IGSYPDSIFNY

SEQ ID NO: 60173 - protein, 9 aa, Borrelia burgdorferi
KRLDNYDFK

SEQ ID NO: 60174 - protein, 9 aa, Borrelia burgdorferi
KQILADLPK

SEQ ID NO: 60175 - protein, 9 aa, Borrelia burgdorferi
KRAFSKEDF

SEQ ID NO: 60176 - protein, 9 aa, Borrelia burgdorferi
ARNNFKKDY

SEQ ID NO: 60177 - protein, 11 aa, Borrelia burgdorferi
RKIGIKEKSVF

SEQ ID NO: 60178 - protein, 11 aa, Borrelia burgdorferi
KRAFSKEDFNL

SEQ ID NO: 60179 - protein, 11 aa, Borrelia burgdorferi
KQILKQILADL

SEQ ID NO: 60180 - protein, 9 aa, Borrelia burgdorferi
YPDSIFNYL

SEQ ID NO: 60181 - protein, 9 aa, Borrelia burgdorferi
DALEAIEYL

SEQ ID NO: 60182 - protein, 9 aa, Borrelia burgdorferi
LDALEAIEY

SEQ ID NO: 60183 - protein, 9 aa, Borrelia burgdorferi
LSANIEENY

SEQ ID NO: 60184 - protein, 9 aa, Borrelia burgdorferi
NEYEKSHVF

SEQ ID NO: 60185 - protein, 10 aa, Borrelia burgdorferi
YPDSIFNYLI

SEQ ID NO: 60186 - protein, 10 aa, Borrelia burgdorferi
FLDALEAIEY

SEQ ID NO: 60187 - protein, 10 aa, Borrelia burgdorferi
LDNYDFKNEY

SEQ ID NO: 60188 - protein, 10 aa, Borrelia burgdorferi
YAEKYGDNAR

SEQ ID NO: 60189 - protein, 11 aa, Borrelia burgdorferi
VFLDALEAIEY

SEQ ID NO: 60190 - protein, 11 aa, Borrelia burgdorferi
FKNEYEKSHVF

SEQ ID NO: 60191 - protein, 11 aa, Borrelia burgdorferi
YPDSIFNYLIQ

SEQ ID NO: 60192 - protein, 11 aa, Borrelia burgdorferi
RLDNYDFKNEY

SEQ ID NO: 60193 - protein, 9 aa, Borrelia burgdorferi
NEYEKSHVF

SEQ ID NO: 60194 - protein, 10 aa, Borrelia burgdorferi
SEDMIRLIGS

SEQ ID NO: 60195 - protein, 11 aa, Borrelia burgdorferi
EENYTETKRAF

SEQ ID NO: 60196 - protein, 11 aa, Borrelia burgdorferi
SEDMIRLIGSY

SEQ ID NO: 60197 - protein, 11 aa, Borrelia burgdorferi
SEDKANTVKQI

SEQ ID NO: 60198 - protein, 9 aa, Borrelia burgdorferi
EAIEYLIKI

SEQ ID NO: 60199 - protein, 9 aa, Borrelia burgdorferi
YPDSIFNYL

SEQ ID NO: 60200 - protein, 10 aa, Borrelia burgdorferi
YPDSIFNYLI

SEQ ID NO: 60201 - protein, 11 aa, Borrelia burgdorferi
EAIEYLIKIKI

SEQ ID NO: 60202 - protein, 10 aa, Borrelia burgdorferi
GSYPDSIFNY

SEQ ID NO: 60203 - protein, 11 aa, Borrelia burgdorferi
VSLSANIEENY

SEQ ID NO: 60204 - protein, 10 aa, Borrelia burgdorferi
SSNKDIYNSY

SEQ ID NO: 60205 - protein, 11 aa, Borrelia burgdorferi
LSSNKDIYNSY

SEQ ID NO: 60206 - protein, 9 aa, Borrelia burgdorferi
IVYEILEEV

SEQ ID NO: 60207 - protein, 9 aa, Borrelia burgdorferi
KIPEITEEV

SEQ ID NO: 60208 - protein, 9 aa, Borrelia burgdorferi
NLSAIEESV

SEQ ID NO: 60209 - protein, 9 aa, Borrelia burgdorferi
KLKEFLEKL

SEQ ID NO: 60210 - protein, 9 aa, Borrelia burgdorferi
VIMPIPQTI

SEQ ID NO: 60211 - protein, 9 aa, Borrelia burgdorferi
YIPEVKEEI

SEQ ID NO: 60212 - protein, 9 aa, Borrelia burgdorferi
SLNLSTKSV

SEQ ID NO: 60213 - protein, 9 aa, Borrelia burgdorferi
KINNGLNIV

SEQ ID NO: 60214 - protein, 9 aa, Borrelia burgdorferi
IYNSYIPEV

SEQ ID NO: 60215 - protein, 9 aa, Borrelia burgdorferi
FLTQGTSPS

SEQ ID NO: 60216 - protein, 9 aa, Borrelia burgdorferi
NIDNITENL

SEQ ID NO: 60217 - protein, 9 aa, Borrelia burgdorferi
FLLLNLVNC

SEQ ID NO: 60218 - protein, 9 aa, Borrelia burgdorferi
SIAKLLQHL

SEQ ID NO: 60219 - protein, 9 aa, Borrelia burgdorferi
ITEEVIMPI

SEQ ID NO: 60220 - protein, 9 aa, Borrelia burgdorferi
KLSQVAQHA

SEQ ID NO: 60221 - protein, 9 aa, Borrelia burgdorferi
NTWGEGLEI

SEQ ID NO: 60222 - protein, 9 aa, Borrelia burgdorferi
CAFLLLNLV

SEQ ID NO: 60223 - protein, 9 aa, Borrelia burgdorferi
FLEKLKKYL

SEQ ID NO: 60224 - protein, 10 aa, Borrelia burgdorferi
FLTQGTSPSI

SEQ ID NO: 60225 - protein, 10 aa, Borrelia burgdorferi
YLKDTNNLSA

SEQ ID NO: 60226 - protein, 10 aa, Borrelia burgdorferi
ILEEVIIPET

SEQ ID NO: 60227 - protein, 10 aa, Borrelia burgdorferi
YIPEVKEEIV

SEQ ID NO: 60228 - protein, 10 aa, Borrelia burgdorferi
NLVNCKFDSL

SEQ ID NO: 60229 - protein, 10 aa, Borrelia burgdorferi
IIPETKIPEI

SEQ ID NO: 60230 - protein, 10 aa, Borrelia burgdorferi
DIYNSYIPEV

SEQ ID NO: 60231 - protein, 10 aa, Borrelia burgdorferi
IVYEILEEVI

SEQ ID NO: 60232 - protein, 10 aa, Borrelia burgdorferi
KIPEITEEVI

SEQ ID NO: 60233 - protein, 10 aa, Borrelia burgdorferi
EIVYEILEEV

SEQ ID NO: 60234 - protein, 10 aa, Borrelia burgdorferi
MCAFLLLNLV

SEQ ID NO: 60235 - protein, 11 aa, Borrelia burgdorferi
YLKDTNNLSAI

SEQ ID NO: 60236 - protein, 11 aa, Borrelia burgdorferi
VIIPETKIPEI

SEQ ID NO: 60237 - protein, 11 aa, Borrelia burgdorferi
IVYEILEEVII

SEQ ID NO: 60238 - protein, 11 aa, Borrelia burgdorferi
YIEPRPISSFL

SEQ ID NO: 60239 - protein, 11 aa, Borrelia burgdorferi
FLTQGTSPSIT

SEQ ID NO: 60240 - protein, 11 aa, Borrelia burgdorferi
KIPEITEEVIM

SEQ ID NO: 60241 - protein, 11 aa, Borrelia burgdorferi
TIDFYIEPRPI

SEQ ID NO: 60242 - protein, 9 aa, Borrelia burgdorferi
ITSTIKSYK

SEQ ID NO: 60243 - protein, 9 aa, Borrelia burgdorferi
LLLNLVNCK

SEQ ID NO: 60244 - protein, 9 aa, Borrelia burgdorferi
RSSIRTKIK

SEQ ID NO: 60245 - protein, 9 aa, Borrelia burgdorferi
NLNSKETPK

SEQ ID NO: 60246 - protein, 9 aa, Borrelia burgdorferi
KITHPIFDH

SEQ ID NO: 60247 - protein, 9 aa, Borrelia burgdorferi
EVRSSIRTK

SEQ ID NO: 60248 - protein, 9 aa, Borrelia burgdorferi
KTSTSEDQK

SEQ ID NO: 60249 - protein, 9 aa, Borrelia burgdorferi
IIEDLQKLK

SEQ ID NO: 60250 - protein, 10 aa, Borrelia burgdorferi
SITSTIKSYK

SEQ ID NO: 60251 - protein, 10 aa, Borrelia burgdorferi
IAKLLQHLSK

SEQ ID NO: 60252 - protein, 10 aa, Borrelia burgdorferi
TIKSYKELAK

SEQ ID NO: 60253 - protein, 10 aa, Borrelia burgdorferi
FLLLNLVNCK

SEQ ID NO: 60254 - protein, 10 aa, Borrelia burgdorferi
KLKEFLEKLK

SEQ ID NO: 60255 - protein, 10 aa, Borrelia burgdorferi
LQKLKEFLEK

SEQ ID NO: 60256 - protein, 10 aa, Borrelia burgdorferi
QVAQHAPNSK

SEQ ID NO: 60257 - protein, 10 aa, Borrelia burgdorferi
KVSDGTEQTK

SEQ ID NO: 60258 - protein, 10 aa, Borrelia burgdorferi
TSPSITSTIK

SEQ ID NO: 60259 - protein, 10 aa, Borrelia burgdorferi
IYNSYIPEVK

SEQ ID NO: 60260 - protein, 10 aa, Borrelia burgdorferi
KSYKELAKEK

SEQ ID NO: 60261 - protein, 10 aa, Borrelia burgdorferi
FLEKLKKYLK

SEQ ID NO: 60262 - protein, 10 aa, Borrelia burgdorferi
NLSAIEESVK

SEQ ID NO: 60263 - protein, 10 aa, Borrelia burgdorferi
KFDSLNLSTK

SEQ ID NO: 60264 - protein, 10 aa, Borrelia burgdorferi
NLSTKSVDDK

SEQ ID NO: 60265 - protein, 10 aa, Borrelia burgdorferi
KIEKVKSDGK

SEQ ID NO: 60266 - protein, 10 aa, Borrelia burgdorferi
INNGLNIVQK

SEQ ID NO: 60267 - protein, 10 aa, Borrelia burgdorferi
QHAPNSKIEK

SEQ ID NO: 60268 - protein, 11 aa, Borrelia burgdorferi
KINNGLNIVQK

SEQ ID NO: 60269 - protein, 11 aa, Borrelia burgdorferi
SIAKLLQHLSK

SEQ ID NO: 60270 - protein, 11 aa, Borrelia burgdorferi
KLKEFLEKLKK

SEQ ID NO: 60271 - protein, 11 aa, Borrelia burgdorferi
HLSKSEDQANK

SEQ ID NO: 60272 - protein, 11 aa, Borrelia burgdorferi
GTSPSITSTIK

SEQ ID NO: 60273 - protein, 11 aa, Borrelia burgdorferi
AQHAPNSKIEK

SEQ ID NO: 60274 - protein, 11 aa, Borrelia burgdorferi
STIKSYKELAK

SEQ ID NO: 60275 - protein, 11 aa, Borrelia burgdorferi
ILEEVIIPETK

SEQ ID NO: 60276 - protein, 11 aa, Borrelia burgdorferi
PSITSTIKSYK

SEQ ID NO: 60277 - protein, 11 aa, Borrelia burgdorferi
KSDGKPVPGDK

SEQ ID NO: 60278 - protein, 11 aa, Borrelia burgdorferi
DIYNSYIPEVK

SEQ ID NO: 60279 - protein, 9 aa, Borrelia burgdorferi
ITSTIKSYK

SEQ ID NO: 60280 - protein, 9 aa, Borrelia burgdorferi
KTSTSEDQK

SEQ ID NO: 60281 - protein, 9 aa, Borrelia burgdorferi
VAQHAPNSK

SEQ ID NO: 60282 - protein, 9 aa, Borrelia burgdorferi
LLLNLVNCK

SEQ ID NO: 60283 - protein, 9 aa, Borrelia burgdorferi
RSSIRTKIK

SEQ ID NO: 60284 - protein, 9 aa, Borrelia burgdorferi
TIDFYIEPR

SEQ ID NO: 60285 - protein, 9 aa, Borrelia burgdorferi
IIEDLQKLK

SEQ ID NO: 60286 - protein, 9 aa, Borrelia burgdorferi
NLNSKETPK

SEQ ID NO: 60287 - protein, 9 aa, Borrelia burgdorferi
NITENLNSK

SEQ ID NO: 60288 - protein, 9 aa, Borrelia burgdorferi
LSAIEESVK

SEQ ID NO: 60289 - protein, 9 aa, Borrelia burgdorferi
HAPNSKIEK

SEQ ID NO: 60290 - protein, 9 aa, Borrelia burgdorferi
ISGKEVEEK

SEQ ID NO: 60291 - protein, 9 aa, Borrelia burgdorferi
VSDGTEQTK

SEQ ID NO: 60292 - protein, 9 aa, Borrelia burgdorferi
LSTKSVDDK

SEQ ID NO: 60293 - protein, 9 aa, Borrelia burgdorferi
SPSITSTIK

SEQ ID NO: 60294 - protein, 9 aa, Borrelia burgdorferi
SITSTIKSY

SEQ ID NO: 60295 - protein, 9 aa, Borrelia burgdorferi
AKLLQHLSK

SEQ ID NO: 60296 - protein, 10 aa, Borrelia burgdorferi
SITSTIKSYK

SEQ ID NO: 60297 - protein, 10 aa, Borrelia burgdorferi
KSYKELAKEK

SEQ ID NO: 60298 - protein, 10 aa, Borrelia burgdorferi
QVAQHAPNSK

SEQ ID NO: 60299 - protein, 10 aa, Borrelia burgdorferi
KVSDGTEQTK

SEQ ID NO: 60300 - protein, 10 aa, Borrelia burgdorferi
TSPSITSTIK

SEQ ID NO: 60301 - protein, 10 aa, Borrelia burgdorferi
TIKSYKELAK

SEQ ID NO: 60302 - protein, 10 aa, Borrelia burgdorferi
QTIDFYIEPR

SEQ ID NO: 60303 - protein, 10 aa, Borrelia burgdorferi
IAKLLQHLSK

SEQ ID NO: 60304 - protein, 10 aa, Borrelia burgdorferi
FLLLNLVNCK

SEQ ID NO: 60305 - protein, 10 aa, Borrelia burgdorferi
SSNKDIYNSY

SEQ ID NO: 60306 - protein, 10 aa, Borrelia burgdorferi
LQKLKEFLEK

SEQ ID NO: 60307 - protein, 10 aa, Borrelia burgdorferi
KLKEFLEKLK

SEQ ID NO: 60308 - protein, 10 aa, Borrelia burgdorferi
KIEKVKSDGK

SEQ ID NO: 60309 - protein, 10 aa, Borrelia burgdorferi
KFDSLNLSTK

SEQ ID NO: 60310 - protein, 10 aa, Borrelia burgdorferi
NLSAIEESVK

SEQ ID NO: 60311 - protein, 10 aa, Borrelia burgdorferi
IYNSYIPEVK

SEQ ID NO: 60312 - protein, 10 aa, Borrelia burgdorferi
EIIEDLQKLK

SEQ ID NO: 60313 - protein, 10 aa, Borrelia burgdorferi
LSKSEDQANK

SEQ ID NO: 60314 - protein, 10 aa, Borrelia burgdorferi
FLEKLKKYLK

SEQ ID NO: 60315 - protein, 11 aa, Borrelia burgdorferi
SIAKLLQHLSK

SEQ ID NO: 60316 - protein, 11 aa, Borrelia burgdorferi
STIKSYKELAK

SEQ ID NO: 60317 - protein, 11 aa, Borrelia burgdorferi
KINNGLNIVQK

SEQ ID NO: 60318 - protein, 11 aa, Borrelia burgdorferi
SVDDKNNSIAK

SEQ ID NO: 60319 - protein, 11 aa, Borrelia burgdorferi
GTSPSITSTIK

SEQ ID NO: 60320 - protein, 11 aa, Borrelia burgdorferi
AQHAPNSKIEK

SEQ ID NO: 60321 - protein, 11 aa, Borrelia burgdorferi
SQVAQHAPNSK

SEQ ID NO: 60322 - protein, 11 aa, Borrelia burgdorferi
PSITSTIKSYK

SEQ ID NO: 60323 - protein, 11 aa, Borrelia burgdorferi
AFLLLNLVNCK

SEQ ID NO: 60324 - protein, 11 aa, Borrelia burgdorferi
KSDGKPVPGDK

SEQ ID NO: 60325 - protein, 11 aa, Borrelia burgdorferi
ITENKEQEHEK

SEQ ID NO: 60326 - protein, 11 aa, Borrelia burgdorferi
KLKEFLEKLKK

SEQ ID NO: 60327 - protein, 11 aa, Borrelia burgdorferi
DIYNSYIPEVK

SEQ ID NO: 60328 - protein, 11 aa, Borrelia burgdorferi
HLSKSEDQANK

SEQ ID NO: 60329 - protein, 11 aa, Borrelia burgdorferi
ILEEVIIPETK

SEQ ID NO: 60330 - protein, 11 aa, Borrelia burgdorferi
DLQKLKEFLEK

SEQ ID NO: 60331 - protein, 9 aa, Borrelia burgdorferi
KYLKDTNNL

SEQ ID NO: 60332 - protein, 9 aa, Borrelia burgdorferi
VYEILEEVI

SEQ ID NO: 60333 - protein, 9 aa, Borrelia burgdorferi
IYNSYIPEV

SEQ ID NO: 60334 - protein, 9 aa, Borrelia burgdorferi
VIMPIPQTI

SEQ ID NO: 60335 - protein, 9 aa, Borrelia burgdorferi
TSPSITSTI

SEQ ID NO: 60336 - protein, 10 aa, Borrelia burgdorferi
SYIPEVKEEI

SEQ ID NO: 60337 - protein, 10 aa, Borrelia burgdorferi
VYEILEEVII

SEQ ID NO: 60338 - protein, 10 aa, Borrelia burgdorferi
SYKELAKEKI

SEQ ID NO: 60339 - protein, 10 aa, Borrelia burgdorferi
IYNSYIPEVK

SEQ ID NO: 60340 - protein, 10 aa, Borrelia burgdorferi
KYLKDTNNLS

SEQ ID NO: 60341 - protein, 11 aa, Borrelia burgdorferi
FYIEPRPISSF

SEQ ID NO: 60342 - protein, 11 aa, Borrelia burgdorferi
SFLTQGTSPSI

SEQ ID NO: 60343 - protein, 11 aa, Borrelia burgdorferi
SYIPEVKEEIV

SEQ ID NO: 60344 - protein, 9 aa, Borrelia burgdorferi
LLNLVNCKF

SEQ ID NO: 60345 - protein, 9 aa, Borrelia burgdorferi
EFLEKLKKY

SEQ ID NO: 60346 - protein, 10 aa, Borrelia burgdorferi
SSNKDIYNSY

SEQ ID NO: 60347 - protein, 10 aa, Borrelia burgdorferi
IMPIPQTIDF

SEQ ID NO: 60348 - protein, 11 aa, Borrelia burgdorferi
YIPEVKEEIVY

SEQ ID NO: 60349 - protein, 11 aa, Borrelia burgdorferi
IMPIPQTIDFY

SEQ ID NO: 60350 - protein, 11 aa, Borrelia burgdorferi
FYIEPRPISSF

SEQ ID NO: 60351 - protein, 11 aa, Borrelia burgdorferi
FLLLNLVNCKF

SEQ ID NO: 60352 - protein, 9 aa, Borrelia burgdorferi
ITSTIKSYK

SEQ ID NO: 60353 - protein, 9 aa, Borrelia burgdorferi
ETPKEISGK

SEQ ID NO: 60354 - protein, 9 aa, Borrelia burgdorferi
TIDFYIEPR

SEQ ID NO: 60355 - protein, 9 aa, Borrelia burgdorferi
NITENLNSK

SEQ ID NO: 60356 - protein, 9 aa, Borrelia burgdorferi
EVRSSIRTK

SEQ ID NO: 60357 - protein, 9 aa, Borrelia burgdorferi
HAPNSKIEK

SEQ ID NO: 60358 - protein, 9 aa, Borrelia burgdorferi
FFTNLEEVR

SEQ ID NO: 60359 - protein, 9 aa, Borrelia burgdorferi
KTSTSEDQK

SEQ ID NO: 60360 - protein, 9 aa, Borrelia burgdorferi
LSAIEESVK

SEQ ID NO: 60361 - protein, 9 aa, Borrelia burgdorferi
LSTKSVDDK

SEQ ID NO: 60362 - protein, 9 aa, Borrelia burgdorferi
DSNFFTNLE

SEQ ID NO: 60363 - protein, 9 aa, Borrelia burgdorferi
YNSYIPEVK

SEQ ID NO: 60364 - protein, 9 aa, Borrelia burgdorferi
EEVIIPETK

SEQ ID NO: 60365 - protein, 9 aa, Borrelia burgdorferi
NLNSKETPK

SEQ ID NO: 60366 - protein, 9 aa, Borrelia burgdorferi
ENKEQEHEK

SEQ ID NO: 60367 - protein, 9 aa, Borrelia burgdorferi
IIEDLQKLK

SEQ ID NO: 60368 - protein, 10 aa, Borrelia burgdorferi
QTIDFYIEPR

SEQ ID NO: 60369 - protein, 10 aa, Borrelia burgdorferi
SITSTIKSYK

SEQ ID NO: 60370 - protein, 10 aa, Borrelia burgdorferi
EIIEDLQKLK

SEQ ID NO: 60371 - protein, 10 aa, Borrelia burgdorferi
EISGKEVEEK

SEQ ID NO: 60372 - protein, 10 aa, Borrelia burgdorferi
QVAQHAPNSK

SEQ ID NO: 60373 - protein, 10 aa, Borrelia burgdorferi
TSPSITSTIK

SEQ ID NO: 60374 - protein, 10 aa, Borrelia burgdorferi
NFFTNLEEVR

SEQ ID NO: 60375 - protein, 10 aa, Borrelia burgdorferi
NLSAIEESVK

SEQ ID NO: 60376 - protein, 10 aa, Borrelia burgdorferi
NLEEVRSSIR

SEQ ID NO: 60377 - protein, 10 aa, Borrelia burgdorferi
TIKSYKELAK

SEQ ID NO: 60378 - protein, 10 aa, Borrelia burgdorferi
MPIPQTIDFY

SEQ ID NO: 60379 - protein, 10 aa, Borrelia burgdorferi
IYNSYIPEVK

SEQ ID NO: 60380 - protein, 10 aa, Borrelia burgdorferi
IAKLLQHLSK

SEQ ID NO: 60381 - protein, 10 aa, Borrelia burgdorferi
FLEKLKKYLK

SEQ ID NO: 60382 - protein, 10 aa, Borrelia burgdorferi
KVSDGTEQTK

SEQ ID NO: 60383 - protein, 10 aa, Borrelia burgdorferi
FLLLNLVNCK

SEQ ID NO: 60384 - protein, 10 aa, Borrelia burgdorferi
NLSTKSVDDK

SEQ ID NO: 60385 - protein, 10 aa, Borrelia burgdorferi
KSYKELAKEK

SEQ ID NO: 60386 - protein, 10 aa, Borrelia burgdorferi
LSKSEDQANK

SEQ ID NO: 60387 - protein, 10 aa, Borrelia burgdorferi
INNGLNIVQK

SEQ ID NO: 60388 - protein, 10 aa, Borrelia burgdorferi
DTNNLSAIEE

SEQ ID NO: 60389 - protein, 10 aa, Borrelia burgdorferi
DSNFFTNLEE

SEQ ID NO: 60390 - protein, 10 aa, Borrelia burgdorferi
SSNKDIYNSY

SEQ ID NO: 60391 - protein, 11 aa, Borrelia burgdorferi
DIYNSYIPEVK

SEQ ID NO: 60392 - protein, 11 aa, Borrelia burgdorferi
STIKSYKELAK

SEQ ID NO: 60393 - protein, 11 aa, Borrelia burgdorferi
SNFFTNLEEVR

SEQ ID NO: 60394 - protein, 11 aa, Borrelia burgdorferi
SIAKLLQHLSK

SEQ ID NO: 60395 - protein, 11 aa, Borrelia burgdorferi
EIDEIIEDLQK

SEQ ID NO: 60396 - protein, 11 aa, Borrelia burgdorferi
ITENKEQEHEK

SEQ ID NO: 60397 - protein, 11 aa, Borrelia burgdorferi
EVRSSIRTKIK

SEQ ID NO: 60398 - protein, 11 aa, Borrelia burgdorferi
HLSKSEDQANK

SEQ ID NO: 60399 - protein, 11 aa, Borrelia burgdorferi
GTSPSITSTIK

SEQ ID NO: 60400 - protein, 11 aa, Borrelia burgdorferi
HAPNSKIEKVK

SEQ ID NO: 60401 - protein, 11 aa, Borrelia burgdorferi
PSITSTIKSYK

SEQ ID NO: 60402 - protein, 11 aa, Borrelia burgdorferi
CKFDSLNLSTK

SEQ ID NO: 60403 - protein, 11 aa, Borrelia burgdorferi
DLQKLKEFLEK

SEQ ID NO: 60404 - protein, 11 aa, Borrelia burgdorferi
KINNGLNIVQK

SEQ ID NO: 60405 - protein, 11 aa, Borrelia burgdorferi
ILEEVIIPETK

SEQ ID NO: 60406 - protein, 11 aa, Borrelia burgdorferi
EFLEKLKKYLK

SEQ ID NO: 60407 - protein, 9 aa, Borrelia burgdorferi
EPRPISSFL

SEQ ID NO: 60408 - protein, 9 aa, Borrelia burgdorferi
KPVPGDKIL

SEQ ID NO: 60409 - protein, 9 aa, Borrelia burgdorferi
RPISSFLTQ

SEQ ID NO: 60410 - protein, 9 aa, Borrelia burgdorferi
MPIPQTIDF

SEQ ID NO: 60411 - protein, 9 aa, Borrelia burgdorferi
APNSKIEKV

SEQ ID NO: 60412 - protein, 10 aa, Borrelia burgdorferi
RPISSFLTQG

SEQ ID NO: 60413 - protein, 10 aa, Borrelia burgdorferi
TPKEISGKEV

SEQ ID NO: 60414 - protein, 10 aa, Borrelia burgdorferi
SPSITSTIKS

SEQ ID NO: 60415 - protein, 10 aa, Borrelia burgdorferi
IPEITEEVIM

SEQ ID NO: 60416 - protein, 10 aa, Borrelia burgdorferi
EVRSSIRTKI

SEQ ID NO: 60417 - protein, 10 aa, Borrelia burgdorferi
EPRPISSFLT

SEQ ID NO: 60418 - protein, 11 aa, Borrelia burgdorferi
RPISSFLTQGT

SEQ ID NO: 60419 - protein, 11 aa, Borrelia burgdorferi
SPSITSTIKSY

SEQ ID NO: 60420 - protein, 11 aa, Borrelia burgdorferi
KPVPGDKILSS

SEQ ID NO: 60421 - protein, 11 aa, Borrelia burgdorferi
MPIPQTIDFYI

SEQ ID NO: 60422 - protein, 11 aa, Borrelia burgdorferi
HPIFDHITGSG

SEQ ID NO: 60423 - protein, 9 aa, Borrelia burgdorferi
FLEKLKKYL

SEQ ID NO: 60424 - protein, 11 aa, Borrelia burgdorferi
YLKDTNNLSAI

SEQ ID NO: 60425 - protein, 9 aa, Borrelia burgdorferi
SNKDIYNSY

SEQ ID NO: 60426 - protein, 9 aa, Borrelia burgdorferi
SITSTIKSY

SEQ ID NO: 60427 - protein, 9 aa, Borrelia burgdorferi
LLNLVNCKF

SEQ ID NO: 60428 - protein, 9 aa, Borrelia burgdorferi
AQHAPNSKI

SEQ ID NO: 60429 - protein, 9 aa, Borrelia burgdorferi
LEIGGDSNF

SEQ ID NO: 60430 - protein, 10 aa, Borrelia burgdorferi
SSNKDIYNSY

SEQ ID NO: 60431 - protein, 10 aa, Borrelia burgdorferi
YIEPRPISSF

SEQ ID NO: 60432 - protein, 10 aa, Borrelia burgdorferi
IMPIPQTIDF

SEQ ID NO: 60433 - protein, 10 aa, Borrelia burgdorferi
PSITSTIKSY

SEQ ID NO: 60434 - protein, 10 aa, Borrelia burgdorferi
LLLNLVNCKF

SEQ ID NO: 60435 - protein, 10 aa, Borrelia burgdorferi
YLKDTNNLSA

SEQ ID NO: 60436 - protein, 10 aa, Borrelia burgdorferi
LEIGGDSNFF

SEQ ID NO: 60437 - protein, 11 aa, Borrelia burgdorferi
LSSNKDIYNSY

SEQ ID NO: 60438 - protein, 11 aa, Borrelia burgdorferi
YLKDTNNLSAI

SEQ ID NO: 60439 - protein, 11 aa, Borrelia burgdorferi
IMPIPQTIDFY

SEQ ID NO: 60440 - protein, 11 aa, Borrelia burgdorferi
FYIEPRPISSF

SEQ ID NO: 60441 - protein, 11 aa, Borrelia burgdorferi
VIMPIPQTIDF

SEQ ID NO: 60442 - protein, 11 aa, Borrelia burgdorferi
YIPEVKEEIVY

SEQ ID NO: 60443 - protein, 11 aa, Borrelia burgdorferi
TQNIDNITENL

SEQ ID NO: 60444 - protein, 11 aa, Borrelia burgdorferi
FLLLNLVNCKF

SEQ ID NO: 60445 - protein, 10 aa, Borrelia burgdorferi
VRSSIRTKIK

SEQ ID NO: 60446 - protein, 9 aa, Borrelia burgdorferi
MPIPQTIDF

SEQ ID NO: 60447 - protein, 9 aa, Borrelia burgdorferi
KPVPGDKIL

SEQ ID NO: 60448 - protein, 9 aa, Borrelia burgdorferi
EPRPISSFL

SEQ ID NO: 60449 - protein, 9 aa, Borrelia burgdorferi
EIGGDSNFF

SEQ ID NO: 60450 - protein, 9 aa, Borrelia burgdorferi
ILSSNKDIY

SEQ ID NO: 60451 - protein, 9 aa, Borrelia burgdorferi
IPEITEEVI

SEQ ID NO: 60452 - protein, 10 aa, Borrelia burgdorferi
MPIPQTIDFY

SEQ ID NO: 60453 - protein, 10 aa, Borrelia burgdorferi
IPEVKEEIVY

SEQ ID NO: 60454 - protein, 10 aa, Borrelia burgdorferi
IPEITEEVIM

SEQ ID NO: 60455 - protein, 10 aa, Borrelia burgdorferi
LEIGGDSNFF

SEQ ID NO: 60456 - protein, 11 aa, Borrelia burgdorferi
SPSITSTIKSY

SEQ ID NO: 60457 - protein, 11 aa, Borrelia burgdorferi
NPGQDSISNTW

SEQ ID NO: 60458 - protein, 11 aa, Borrelia burgdorferi
MPIPQTIDFYI

SEQ ID NO: 60459 - protein, 11 aa, Borrelia burgdorferi
YIPEVKEEIVY

SEQ ID NO: 60460 - protein, 11 aa, Borrelia burgdorferi
LSSNKDIYNSY

SEQ ID NO: 60461 - protein, 11 aa, Borrelia burgdorferi
EVEEKITHPIF

SEQ ID NO: 60462 - protein, 9 aa, Borrelia burgdorferi
EEVIMPIPQ

SEQ ID NO: 60463 - protein, 9 aa, Borrelia burgdorferi
EEIVYEILE

SEQ ID NO: 60464 - protein, 9 aa, Borrelia burgdorferi
EEKITHPIF

SEQ ID NO: 60465 - protein, 9 aa, Borrelia burgdorferi
EEVRSSIRT

SEQ ID NO: 60466 - protein, 9 aa, Borrelia burgdorferi
YEILEEVII

SEQ ID NO: 60467 - protein, 9 aa, Borrelia burgdorferi
DEIIEDLQK

SEQ ID NO: 60468 - protein, 9 aa, Borrelia burgdorferi
SEDQKELEI

SEQ ID NO: 60469 - protein, 9 aa, Borrelia burgdorferi
PEITEEVIM

SEQ ID NO: 60470 - protein, 9 aa, Borrelia burgdorferi
PEVKEEIVY

SEQ ID NO: 60471 - protein, 9 aa, Borrelia burgdorferi
SEDQANKTS

SEQ ID NO: 60472 - protein, 9 aa, Borrelia burgdorferi
LEIGGDSNF

SEQ ID NO: 60473 - protein, 10 aa, Borrelia burgdorferi
EEVIMPIPQT

SEQ ID NO: 60474 - protein, 10 aa, Borrelia burgdorferi
EEIVYEILEE

SEQ ID NO: 60475 - protein, 10 aa, Borrelia burgdorferi
KEFLEKLKKY

SEQ ID NO: 60476 - protein, 10 aa, Borrelia burgdorferi
EEVIIPETKI

SEQ ID NO: 60477 - protein, 10 aa, Borrelia burgdorferi
EEKITHPIFD

SEQ ID NO: 60478 - protein, 10 aa, Borrelia burgdorferi
VEIDEIIEDL

SEQ ID NO: 60479 - protein, 10 aa, Borrelia burgdorferi
KEKINNGLNI

SEQ ID NO: 60480 - protein, 10 aa, Borrelia burgdorferi
DEIIEDLQKL

SEQ ID NO: 60481 - protein, 11 aa, Borrelia burgdorferi
EEVIMPIPQTI

SEQ ID NO: 60482 - protein, 11 aa, Borrelia burgdorferi
KEFLEKLKKYL

SEQ ID NO: 60483 - protein, 11 aa, Borrelia burgdorferi
EEIVYEILEEV

SEQ ID NO: 60484 - protein, 11 aa, Borrelia burgdorferi
KEVEEKITHPI

SEQ ID NO: 60485 - protein, 11 aa, Borrelia burgdorferi
EEVRSSIRTKI

SEQ ID NO: 60486 - protein, 11 aa, Borrelia burgdorferi
PEITEEVIMPI

SEQ ID NO: 60487 - protein, 11 aa, Borrelia burgdorferi
VEIDEIIEDLQ

SEQ ID NO: 60488 - protein, 11 aa, Borrelia burgdorferi
YEILEEVIIPE

SEQ ID NO: 60489 - protein, 9 aa, Borrelia burgdorferi
IPQTIDFYI

SEQ ID NO: 60490 - protein, 9 aa, Borrelia burgdorferi
MPIPQTIDF

SEQ ID NO: 60491 - protein, 9 aa, Borrelia burgdorferi
IPETKIPEI

SEQ ID NO: 60492 - protein, 9 aa, Borrelia burgdorferi
IPEITEEVI

SEQ ID NO: 60493 - protein, 9 aa, Borrelia burgdorferi
CAFLLLNLV

SEQ ID NO: 60494 - protein, 9 aa, Borrelia burgdorferi
IPEVKEEIV

SEQ ID NO: 60495 - protein, 9 aa, Borrelia burgdorferi
KPVPGDKIL

SEQ ID NO: 60496 - protein, 9 aa, Borrelia burgdorferi
EPRPISSFL

SEQ ID NO: 60497 - protein, 10 aa, Borrelia burgdorferi
MPIPQTIDFY

SEQ ID NO: 60498 - protein, 10 aa, Borrelia burgdorferi
TPKEISGKEV

SEQ ID NO: 60499 - protein, 11 aa, Borrelia burgdorferi
MPIPQTIDFYI

SEQ ID NO: 60500 - protein, 10 aa, Borrelia burgdorferi
PGQDSISNTW

SEQ ID NO: 60501 - protein, 9 aa, Borrelia burgdorferi B31
YSEFLENYY

SEQ ID NO: 60502 - protein, 9 aa, Borrelia burgdorferi B31
HTRDYPGAY

SEQ ID NO: 60503 - protein, 9 aa, Borrelia burgdorferi B31
KSGKADLYY

SEQ ID NO: 60504 - protein, 9 aa, Borrelia burgdorferi B31
YTEINTLIK

SEQ ID NO: 60505 - protein, 9 aa, Borrelia burgdorferi B31
MSDKKIMEL

SEQ ID NO: 60506 - protein, 10 aa, Borrelia burgdorferi B31
LSPKENALQY

SEQ ID NO: 60507 - protein, 10 aa, Borrelia burgdorferi B31
NSNFKILDAY

SEQ ID NO: 60508 - protein, 10 aa, Borrelia burgdorferi B31
MSDKKIMELK

SEQ ID NO: 60509 - protein, 10 aa, Borrelia burgdorferi B31
TSYSEFLENY

SEQ ID NO: 60510 - protein, 11 aa, Borrelia burgdorferi B31
YTSYSEFLENY

SEQ ID NO: 60511 - protein, 11 aa, Borrelia burgdorferi B31
NSNFKILDAYY

SEQ ID NO: 60512 - protein, 11 aa, Borrelia burgdorferi B31
KTPKIGLHFTY

SEQ ID NO: 60513 - protein, 11 aa, Borrelia burgdorferi B31
TSYSEFLENYY

SEQ ID NO: 60514 - protein, 11 aa, Borrelia burgdorferi B31
SLSPKENALQY

SEQ ID NO: 60515 - protein, 11 aa, Borrelia burgdorferi B31
WLHTRDYPGAY

SEQ ID NO: 60516 - protein, 9 aa, Borrelia burgdorferi B31
FLENYYESL

SEQ ID NO: 60517 - protein, 9 aa, Borrelia burgdorferi B31
KLWPSSPNI

SEQ ID NO: 60518 - protein, 9 aa, Borrelia burgdorferi B31
LLGAGNLCV

SEQ ID NO: 60519 - protein, 9 aa, Borrelia burgdorferi B31
KMSLNYTEI

SEQ ID NO: 60520 - protein, 9 aa, Borrelia burgdorferi B31
TLIKEIPFT

SEQ ID NO: 60521 - protein, 9 aa, Borrelia burgdorferi B31
FTYCGFEIL

SEQ ID NO: 60522 - protein, 9 aa, Borrelia burgdorferi B31
ILQKDMIIL

SEQ ID NO: 60523 - protein, 9 aa, Borrelia burgdorferi B31
FTNSLITKI

SEQ ID NO: 60524 - protein, 9 aa, Borrelia burgdorferi B31
KLGLVIPKA

SEQ ID NO: 60525 - protein, 9 aa, Borrelia burgdorferi B31
KADLYYTQV

SEQ ID NO: 60526 - protein, 9 aa, Borrelia burgdorferi B31
ILFIKLWPS

SEQ ID NO: 60527 - protein, 9 aa, Borrelia burgdorferi B31
LVLEIYNKI

SEQ ID NO: 60528 - protein, 9 aa, Borrelia burgdorferi B31
VLEKRIDSL

SEQ ID NO: 60529 - protein, 9 aa, Borrelia burgdorferi B31
LIQSKITML

SEQ ID NO: 60530 - protein, 9 aa, Borrelia burgdorferi B31
TMLKVENLI

SEQ ID NO: 60531 - protein, 9 aa, Borrelia burgdorferi B31
ILICLNPNT

SEQ ID NO: 60532 - protein, 9 aa, Borrelia burgdorferi B31
IQPDYKSLV

SEQ ID NO: 60533 - protein, 9 aa, Borrelia burgdorferi B31
LLNYKEEKI

SEQ ID NO: 60534 - protein, 9 aa, Borrelia burgdorferi B31
SLSPKENAL

SEQ ID NO: 60535 - protein, 9 aa, Borrelia burgdorferi B31
NLCVFYTKL

SEQ ID NO: 60536 - protein, 9 aa, Borrelia burgdorferi B31
KTPSLDVLL

SEQ ID NO: 60537 - protein, 10 aa, Borrelia burgdorferi B31
KMSDKKIMEL

SEQ ID NO: 60538 - protein, 10 aa, Borrelia burgdorferi B31
KLWPSSPNII

SEQ ID NO: 60539 - protein, 10 aa, Borrelia burgdorferi B31
VLLGAGNLCV

SEQ ID NO: 60540 - protein, 10 aa, Borrelia burgdorferi B31
KLDENLIKKI

SEQ ID NO: 60541 - protein, 10 aa, Borrelia burgdorferi B31
FTYCGFEILI

SEQ ID NO: 60542 - protein, 10 aa, Borrelia burgdorferi B31
SLVLEIYNKI

SEQ ID NO: 60543 - protein, 10 aa, Borrelia burgdorferi B31
NLIQSKITML

SEQ ID NO: 60544 - protein, 10 aa, Borrelia burgdorferi B31
NLLNYKEEKI

SEQ ID NO: 60545 - protein, 10 aa, Borrelia burgdorferi B31
SLNYTEINTL

SEQ ID NO: 60546 - protein, 10 aa, Borrelia burgdorferi B31
IIATNSNFKI

SEQ ID NO: 60547 - protein, 10 aa, Borrelia burgdorferi B31
IQSKITMLKV

SEQ ID NO: 60548 - protein, 10 aa, Borrelia burgdorferi B31
WLHTRDYPGA

SEQ ID NO: 60549 - protein, 10 aa, Borrelia burgdorferi B31
LQKDMIILFI

SEQ ID NO: 60550 - protein, 10 aa, Borrelia burgdorferi B31
LLIEKYKKEL

SEQ ID NO: 60551 - protein, 10 aa, Borrelia burgdorferi B31
IVLEKRIDSL

SEQ ID NO: 60552 - protein, 10 aa, Borrelia burgdorferi B31
IIQPDYKSLV

SEQ ID NO: 60553 - protein, 10 aa, Borrelia burgdorferi B31
FTNSLITKII

SEQ ID NO: 60554 - protein, 10 aa, Borrelia burgdorferi B31
YTQVKNLRRV

SEQ ID NO: 60555 - protein, 10 aa, Borrelia burgdorferi B31
QMKNERIISL

SEQ ID NO: 60556 - protein, 10 aa, Borrelia burgdorferi B31
KILICLNPNT

SEQ ID NO: 60557 - protein, 10 aa, Borrelia burgdorferi B31
ILFIKLWPSS

SEQ ID NO: 60558 - protein, 11 aa, Borrelia burgdorferi B31
KLWPSSPNIIA

SEQ ID NO: 60559 - protein, 11 aa, Borrelia burgdorferi B31
ILQKDMIILFI

SEQ ID NO: 60560 - protein, 11 aa, Borrelia burgdorferi B31
FQMKNERIISL

SEQ ID NO: 60561 - protein, 11 aa, Borrelia burgdorferi B31
ILDAYYRRPKI

SEQ ID NO: 60562 - protein, 11 aa, Borrelia burgdorferi B31
LIQSKITMLKV

SEQ ID NO: 60563 - protein, 11 aa, Borrelia burgdorferi B31
SLNYTEINTLI

SEQ ID NO: 60564 - protein, 11 aa, Borrelia burgdorferi B31
LLIEKYKKELI

SEQ ID NO: 60565 - protein, 11 aa, Borrelia burgdorferi B31
KIIQPDYKSLV

SEQ ID NO: 60566 - protein, 11 aa, Borrelia burgdorferi B31
SLNDQIKKTNI

SEQ ID NO: 60567 - protein, 11 aa, Borrelia burgdorferi B31
GLHFTYCGFEI

SEQ ID NO: 60568 - protein, 11 aa, Borrelia burgdorferi B31
CLNPNTTRFHI

SEQ ID NO: 60569 - protein, 11 aa, Borrelia burgdorferi B31
NIIATNSNFKI

SEQ ID NO: 60570 - protein, 11 aa, Borrelia burgdorferi B31
LLNYKEEKIKI

SEQ ID NO: 60571 - protein, 11 aa, Borrelia burgdorferi B31
FLKSKIQNGKI

SEQ ID NO: 60572 - protein, 11 aa, Borrelia burgdorferi B31
KIDNKKFKILI

SEQ ID NO: 60573 - protein, 11 aa, Borrelia burgdorferi B31
MSLNYTEINTL

SEQ ID NO: 60574 - protein, 11 aa, Borrelia burgdorferi B31
LIKEIPFTNSL

SEQ ID NO: 60575 - protein, 11 aa, Borrelia burgdorferi B31
FIKLWPSSPNI

SEQ ID NO: 60576 - protein, 11 aa, Borrelia burgdorferi B31
SLDVLLGAGNL

SEQ ID NO: 60577 - protein, 11 aa, Borrelia burgdorferi B31
QLKDNLDKFNL

SEQ ID NO: 60578 - protein, 11 aa, Borrelia burgdorferi B31
NTSYTSYSEFL

SEQ ID NO: 60579 - protein, 9 aa, Borrelia burgdorferi B31
KLRFSDFLK

SEQ ID NO: 60580 - protein, 9 aa, Borrelia burgdorferi B31
IQSKITMLK

SEQ ID NO: 60581 - protein, 9 aa, Borrelia burgdorferi B31
SLNQSLSPK

SEQ ID NO: 60582 - protein, 9 aa, Borrelia burgdorferi B31
TTRFHITKK

SEQ ID NO: 60583 - protein, 9 aa, Borrelia burgdorferi B31
LQYFKAYKK

SEQ ID NO: 60584 - protein, 9 aa, Borrelia burgdorferi B31
IIATNSNFK

SEQ ID NO: 60585 - protein, 9 aa, Borrelia burgdorferi B31
HITKKNFKK

SEQ ID NO: 60586 - protein, 9 aa, Borrelia burgdorferi B31
KIIKAFQMK

SEQ ID NO: 60587 - protein, 9 aa, Borrelia burgdorferi B31
VFYTKLAKK

SEQ ID NO: 60588 - protein, 9 aa, Borrelia burgdorferi B31
CVFYTKLAK

SEQ ID NO: 60589 - protein, 9 aa, Borrelia burgdorferi B31
LLNINKIQK

SEQ ID NO: 60590 - protein, 9 aa, Borrelia burgdorferi B31
IISLEILQK

SEQ ID NO: 60591 - protein, 9 aa, Borrelia burgdorferi B31
KLDENLIKK

SEQ ID NO: 60592 - protein, 9 aa, Borrelia burgdorferi B31
KNFKKNALK

SEQ ID NO: 60593 - protein, 9 aa, Borrelia burgdorferi B31
ALQYFKAYK

SEQ ID NO: 60594 - protein, 9 aa, Borrelia burgdorferi B31
KIQNGKIIK

SEQ ID NO: 60595 - protein, 9 aa, Borrelia burgdorferi B31
SLVLEIYNK

SEQ ID NO: 60596 - protein, 9 aa, Borrelia burgdorferi B31
NLRRVKNKK

SEQ ID NO: 60597 - protein, 9 aa, Borrelia burgdorferi B31
GLVIPKAEK

SEQ ID NO: 60598 - protein, 9 aa, Borrelia burgdorferi B31
ELILLNINK

SEQ ID NO: 60599 - protein, 9 aa, Borrelia burgdorferi B31
KENALQYFK

SEQ ID NO: 60600 - protein, 9 aa, Borrelia burgdorferi B31
EIYNKIDNK

SEQ ID NO: 60601 - protein, 9 aa, Borrelia burgdorferi B31
KSGKADLYY

SEQ ID NO: 60602 - protein, 9 aa, Borrelia burgdorferi B31
NTTRFHITK

SEQ ID NO: 60603 - protein, 9 aa, Borrelia burgdorferi B31
QVKNLRRVK

SEQ ID NO: 60604 - protein, 9 aa, Borrelia burgdorferi B31
ETTGEIFLK

SEQ ID NO: 60605 - protein, 9 aa, Borrelia burgdorferi B31
KTAIKEKEK

SEQ ID NO: 60606 - protein, 9 aa, Borrelia burgdorferi B31
KILDAYYRR

SEQ ID NO: 60607 - protein, 9 aa, Borrelia burgdorferi B31
AYYRRPKIK

SEQ ID NO: 60608 - protein, 10 aa, Borrelia burgdorferi B31
LIQSKITMLK

SEQ ID NO: 60609 - protein, 10 aa, Borrelia burgdorferi B31
ILLNINKIQK

SEQ ID NO: 60610 - protein, 10 aa, Borrelia burgdorferi B31
ALQYFKAYKK

SEQ ID NO: 60611 - protein, 10 aa, Borrelia burgdorferi B31
ISLNQSLSPK

SEQ ID NO: 60612 - protein, 10 aa, Borrelia burgdorferi B31
CVFYTKLAKK

SEQ ID NO: 60613 - protein, 10 aa, Borrelia burgdorferi B31
RIISLEILQK

SEQ ID NO: 60614 - protein, 10 aa, Borrelia burgdorferi B31
ILDAYYRRPK

SEQ ID NO: 60615 - protein, 10 aa, Borrelia burgdorferi B31
AYKKGKNSFK

SEQ ID NO: 60616 - protein, 10 aa, Borrelia burgdorferi B31
NIIATNSNFK

SEQ ID NO: 60617 - protein, 10 aa, Borrelia burgdorferi B31
LCVFYTKLAK

SEQ ID NO: 60618 - protein, 10 aa, Borrelia burgdorferi B31
NALQYFKAYK

SEQ ID NO: 60619 - protein, 10 aa, Borrelia burgdorferi B31
KSLVLEIYNK

SEQ ID NO: 60620 - protein, 10 aa, Borrelia burgdorferi B31
KKNFKKNALK

SEQ ID NO: 60621 - protein, 10 aa, Borrelia burgdorferi B31
GAYVFIKNQK

SEQ ID NO: 60622 - protein, 10 aa, Borrelia burgdorferi B31
RFHITKKNFK

SEQ ID NO: 60623 - protein, 10 aa, Borrelia burgdorferi B31
YTKLAKKSGK

SEQ ID NO: 60624 - protein, 10 aa, Borrelia burgdorferi B31
IPFTNSLITK

SEQ ID NO: 60625 - protein, 10 aa, Borrelia burgdorferi B31
KLLENIENEK

SEQ ID NO: 60626 - protein, 10 aa, Borrelia burgdorferi B31
ITKIIQPDYK

SEQ ID NO: 60627 - protein, 10 aa, Borrelia burgdorferi B31
NTTRFHITKK

SEQ ID NO: 60628 - protein, 10 aa, Borrelia burgdorferi B31
RIDSLKQQIK

SEQ ID NO: 60629 - protein, 10 aa, Borrelia burgdorferi B31
FLKSKIQNGK

SEQ ID NO: 60630 - protein, 10 aa, Borrelia burgdorferi B31
KADLYYTQVK

SEQ ID NO: 60631 - protein, 10 aa, Borrelia burgdorferi B31
AIKEKEKTPK

SEQ ID NO: 60632 - protein, 10 aa, Borrelia burgdorferi B31
MSDKKIMELK

SEQ ID NO: 60633 - protein, 10 aa, Borrelia burgdorferi B31
LLNYKEEKIK

SEQ ID NO: 60634 - protein, 10 aa, Borrelia burgdorferi B31
AGNLCVFYTK

SEQ ID NO: 60635 - protein, 10 aa, Borrelia burgdorferi B31
VLEKRIDSLK

SEQ ID NO: 60636 - protein, 10 aa, Borrelia burgdorferi B31
YVFIKNQKNK

SEQ ID NO: 60637 - protein, 10 aa, Borrelia burgdorferi B31
SFKTIQNQLK

SEQ ID NO: 60638 - protein, 10 aa, Borrelia burgdorferi B31
GELILLNINK

SEQ ID NO: 60639 - protein, 10 aa, Borrelia burgdorferi B31
LKLRFSDFLK

SEQ ID NO: 60640 - protein, 10 aa, Borrelia burgdorferi B31
TTGEIFLKAK

SEQ ID NO: 60641 - protein, 10 aa, Borrelia burgdorferi B31
GKIIKAFQMK

SEQ ID NO: 60642 - protein, 10 aa, Borrelia burgdorferi B31
HIKLDENLIK

SEQ ID NO: 60643 - protein, 10 aa, Borrelia burgdorferi B31
QYFKAYKKGK

SEQ ID NO: 60644 - protein, 10 aa, Borrelia burgdorferi B31
NINKIQKGIK

SEQ ID NO: 60645 - protein, 10 aa, Borrelia burgdorferi B31
EIYNKIDNKK

SEQ ID NO: 60646 - protein, 10 aa, Borrelia burgdorferi B31
KETTGEIFLK

SEQ ID NO: 60647 - protein, 10 aa, Borrelia burgdorferi B31
LGLVIPKAEK

SEQ ID NO: 60648 - protein, 10 aa, Borrelia burgdorferi B31
KELLIEKYKK

SEQ ID NO: 60649 - protein, 10 aa, Borrelia burgdorferi B31
GLHFTYCGFE

SEQ ID NO: 60650 - protein, 10 aa, Borrelia burgdorferi B31
NYTEINTLIK

SEQ ID NO: 60651 - protein, 10 aa, Borrelia burgdorferi B31
KNLRRVKNKK

SEQ ID NO: 60652 - protein, 11 aa, Borrelia burgdorferi B31
KAYKKGKNSFK

SEQ ID NO: 60653 - protein, 11 aa, Borrelia burgdorferi B31
KLRFSDFLKSK

SEQ ID NO: 60654 - protein, 11 aa, Borrelia burgdorferi B31
KISLNQSLSPK

SEQ ID NO: 60655 - protein, 11 aa, Borrelia burgdorferi B31
KLGLVIPKAEK

SEQ ID NO: 60656 - protein, 11 aa, Borrelia burgdorferi B31
NLIQSKITMLK

SEQ ID NO: 60657 - protein, 11 aa, Borrelia burgdorferi B31
ALKLRFSDFLK

SEQ ID NO: 60658 - protein, 11 aa, Borrelia burgdorferi B31
KMSDKKIMELK

SEQ ID NO: 60659 - protein, 11 aa, Borrelia burgdorferi B31
IVLEKRIDSLK

SEQ ID NO: 60660 - protein, 11 aa, Borrelia burgdorferi B31
KTNIKELLIEK

SEQ ID NO: 60661 - protein, 11 aa, Borrelia burgdorferi B31
NSFKTIQNQLK

SEQ ID NO: 60662 - protein, 11 aa, Borrelia burgdorferi B31
KILDAYYRRPK

SEQ ID NO: 60663 - protein, 11 aa, Borrelia burgdorferi B31
LQYFKAYKKGK

SEQ ID NO: 60664 - protein, 11 aa, Borrelia burgdorferi B31
LILLNINKIQK

SEQ ID NO: 60665 - protein, 11 aa, Borrelia burgdorferi B31
GIKEINLLNYK

SEQ ID NO: 60666 - protein, 11 aa, Borrelia burgdorferi B31
RFHITKKNFKK

SEQ ID NO: 60667 - protein, 11 aa, Borrelia burgdorferi B31
LLGAGNLCVFY

SEQ ID NO: 60668 - protein, 11 aa, Borrelia burgdorferi B31
KSKIQNGKIIK

SEQ ID NO: 60669 - protein, 11 aa, Borrelia burgdorferi B31
KTPKIGLHFTY

SEQ ID NO: 60670 - protein, 11 aa, Borrelia burgdorferi B31
TSYSEFLENYY

SEQ ID NO: 60671 - protein, 11 aa, Borrelia burgdorferi B31
HIKLDENLIKK

SEQ ID NO: 60672 - protein, 11 aa, Borrelia burgdorferi B31
RDYPGAYVFIK

SEQ ID NO: 60673 - protein, 11 aa, Borrelia burgdorferi B31
ILICLNPNTTR

SEQ ID NO: 60674 - protein, 11 aa, Borrelia burgdorferi B31
LITKIIQPDYK

SEQ ID NO: 60675 - protein, 11 aa, Borrelia burgdorferi B31
NLDKFNLIQSK

SEQ ID NO: 60676 - protein, 11 aa, Borrelia burgdorferi B31
KLDENLIKKIK

SEQ ID NO: 60677 - protein, 11 aa, Borrelia burgdorferi B31
SLSPKENALQY

SEQ ID NO: 60678 - protein, 11 aa, Borrelia burgdorferi B31
QVKNLRRVKNK

SEQ ID NO: 60679 - protein, 11 aa, Borrelia burgdorferi B31
SLITKIIQPDY

SEQ ID NO: 60680 - protein, 11 aa, Borrelia burgdorferi B31
EIHESNKMSDK

SEQ ID NO: 60681 - protein, 11 aa, Borrelia burgdorferi B31
NLCVFYTKLAK

SEQ ID NO: 60682 - protein, 11 aa, Borrelia burgdorferi B31
GAGNLCVFYTK

SEQ ID NO: 60683 - protein, 11 aa, Borrelia burgdorferi B31
LQKDMIILFIK

SEQ ID NO: 60684 - protein, 11 aa, Borrelia burgdorferi B31
IQNQLKDNLDK

SEQ ID NO: 60685 - protein, 9 aa, Borrelia burgdorferi B31
SLNQSLSPK

SEQ ID NO: 60686 - protein, 9 aa, Borrelia burgdorferi B31
IQSKITMLK

SEQ ID NO: 60687 - protein, 9 aa, Borrelia burgdorferi B31
IIATNSNFK

SEQ ID NO: 60688 - protein, 9 aa, Borrelia burgdorferi B31
ALQYFKAYK

SEQ ID NO: 60689 - protein, 9 aa, Borrelia burgdorferi B31
CVFYTKLAK

SEQ ID NO: 60690 - protein, 9 aa, Borrelia burgdorferi B31
SLVLEIYNK

SEQ ID NO: 60691 - protein, 9 aa, Borrelia burgdorferi B31
KIIKAFQMK

SEQ ID NO: 60692 - protein, 9 aa, Borrelia burgdorferi B31
LQYFKAYKK

SEQ ID NO: 60693 - protein, 9 aa, Borrelia burgdorferi B31
NTTRFHITK

SEQ ID NO: 60694 - protein, 9 aa, Borrelia burgdorferi B31
IISLEILQK

SEQ ID NO: 60695 - protein, 9 aa, Borrelia burgdorferi B31
TTRFHITKK

SEQ ID NO: 60696 - protein, 9 aa, Borrelia burgdorferi B31
ETTGEIFLK

SEQ ID NO: 60697 - protein, 9 aa, Borrelia burgdorferi B31
KENALQYFK

SEQ ID NO: 60698 - protein, 9 aa, Borrelia burgdorferi B31
KIQNGKIIK

SEQ ID NO: 60699 - protein, 9 aa, Borrelia burgdorferi B31
KLRFSDFLK

SEQ ID NO: 60700 - protein, 9 aa, Borrelia burgdorferi B31
KILDAYYRR

SEQ ID NO: 60701 - protein, 9 aa, Borrelia burgdorferi B31
HITKKNFKK

SEQ ID NO: 60702 - protein, 9 aa, Borrelia burgdorferi B31
YTEINTLIK

SEQ ID NO: 60703 - protein, 9 aa, Borrelia burgdorferi B31
KLDENLIKK

SEQ ID NO: 60704 - protein, 9 aa, Borrelia burgdorferi B31
ELILLNINK

SEQ ID NO: 60705 - protein, 9 aa, Borrelia burgdorferi B31
KTAIKEKEK

SEQ ID NO: 60706 - protein, 9 aa, Borrelia burgdorferi B31
EIYNKIDNK

SEQ ID NO: 60707 - protein, 9 aa, Borrelia burgdorferi B31
KAEKNLHIK

SEQ ID NO: 60708 - protein, 9 aa, Borrelia burgdorferi B31
NIKELLIEK

SEQ ID NO: 60709 - protein, 9 aa, Borrelia burgdorferi B31
LLNINKIQK

SEQ ID NO: 60710 - protein, 9 aa, Borrelia burgdorferi B31
GNLCVFYTK

SEQ ID NO: 60711 - protein, 9 aa, Borrelia burgdorferi B31
YTQVKNLRR

SEQ ID NO: 60712 - protein, 9 aa, Borrelia burgdorferi B31
VFYTKLAKK

SEQ ID NO: 60713 - protein, 9 aa, Borrelia burgdorferi B31
KDMIILFIK

SEQ ID NO: 60714 - protein, 9 aa, Borrelia burgdorferi B31
KAFQMKNER

SEQ ID NO: 60715 - protein, 9 aa, Borrelia burgdorferi B31
RFSDFLKSK

SEQ ID NO: 60716 - protein, 9 aa, Borrelia burgdorferi B31
KEINLLNYK

SEQ ID NO: 60717 - protein, 9 aa, Borrelia burgdorferi B31
GLVIPKAEK

SEQ ID NO: 60718 - protein, 9 aa, Borrelia burgdorferi B31
ESLNDQIKK

SEQ ID NO: 60719 - protein, 9 aa, Borrelia burgdorferi B31
KKLGLVIPK

SEQ ID NO: 60720 - protein, 9 aa, Borrelia burgdorferi B31
KIMELKEEY

SEQ ID NO: 60721 - protein, 9 aa, Borrelia burgdorferi B31
ESNKMSDKK

SEQ ID NO: 60722 - protein, 9 aa, Borrelia burgdorferi B31
KNFKKNALK

SEQ ID NO: 60723 - protein, 9 aa, Borrelia burgdorferi B31
AYYRRPKIK

SEQ ID NO: 60724 - protein, 9 aa, Borrelia burgdorferi B31
NLLNYKEEK

SEQ ID NO: 60725 - protein, 9 aa, Borrelia burgdorferi B31
QVKNLRRVK

SEQ ID NO: 60726 - protein, 9 aa, Borrelia burgdorferi B31
AYVFIKNQK

SEQ ID NO: 60727 - protein, 9 aa, Borrelia burgdorferi B31
YPGAYVFIK

SEQ ID NO: 60728 - protein, 9 aa, Borrelia burgdorferi B31
EILIGRNAK

SEQ ID NO: 60729 - protein, 9 aa, Borrelia burgdorferi B31
NQLKDNLDK

SEQ ID NO: 60730 - protein, 9 aa, Borrelia burgdorferi B31
GAGNLCVFY

SEQ ID NO: 60731 - protein, 9 aa, Borrelia burgdorferi B31
KSGKADLYY

SEQ ID NO: 60732 - protein, 9 aa, Borrelia burgdorferi B31
TSYSEFLEN

SEQ ID NO: 60733 - protein, 10 aa, Borrelia burgdorferi B31
KSLVLEIYNK

SEQ ID NO: 60734 - protein, 10 aa, Borrelia burgdorferi B31
RIISLEILQK

SEQ ID NO: 60735 - protein, 10 aa, Borrelia burgdorferi B31
ISLNQSLSPK

SEQ ID NO: 60736 - protein, 10 aa, Borrelia burgdorferi B31
LIQSKITMLK

SEQ ID NO: 60737 - protein, 10 aa, Borrelia burgdorferi B31
NIIATNSNFK

SEQ ID NO: 60738 - protein, 10 aa, Borrelia burgdorferi B31
TTGEIFLKAK

SEQ ID NO: 60739 - protein, 10 aa, Borrelia burgdorferi B31
ALQYFKAYKK

SEQ ID NO: 60740 - protein, 10 aa, Borrelia burgdorferi B31
CVFYTKLAKK

SEQ ID NO: 60741 - protein, 10 aa, Borrelia burgdorferi B31
GAYVFIKNQK

SEQ ID NO: 60742 - protein, 10 aa, Borrelia burgdorferi B31
TSYSEFLENY

SEQ ID NO: 60743 - protein, 10 aa, Borrelia burgdorferi B31
MSDKKIMELK

SEQ ID NO: 60744 - protein, 10 aa, Borrelia burgdorferi B31
NTTRFHITKK

SEQ ID NO: 60745 - protein, 10 aa, Borrelia burgdorferi B31
YVFIKNQKNK

SEQ ID NO: 60746 - protein, 10 aa, Borrelia burgdorferi B31
ITKIIQPDYK

SEQ ID NO: 60747 - protein, 10 aa, Borrelia burgdorferi B31
AGNLCVFYTK

SEQ ID NO: 60748 - protein, 10 aa, Borrelia burgdorferi B31
NALQYFKAYK

SEQ ID NO: 60749 - protein, 10 aa, Borrelia burgdorferi B31
KLLENIENEK

SEQ ID NO: 60750 - protein, 10 aa, Borrelia burgdorferi B31
KADLYYTQVK

SEQ ID NO: 60751 - protein, 10 aa, Borrelia burgdorferi B31
ILLNINKIQK

SEQ ID NO: 60752 - protein, 10 aa, Borrelia burgdorferi B31
KAKEIHESNK

SEQ ID NO: 60753 - protein, 10 aa, Borrelia burgdorferi B31
RIDSLKQQIK

SEQ ID NO: 60754 - protein, 10 aa, Borrelia burgdorferi B31
ILDAYYRRPK

SEQ ID NO: 60755 - protein, 10 aa, Borrelia burgdorferi B31
AIKEKEKTPK

SEQ ID NO: 60756 - protein, 10 aa, Borrelia burgdorferi B31
VLEKRIDSLK

SEQ ID NO: 60757 - protein, 10 aa, Borrelia burgdorferi B31
EIYNKIDNKK

SEQ ID NO: 60758 - protein, 10 aa, Borrelia burgdorferi B31
IPFTNSLITK

SEQ ID NO: 60759 - protein, 10 aa, Borrelia burgdorferi B31
TQVKNLRRVK

SEQ ID NO: 60760 - protein, 10 aa, Borrelia burgdorferi B31
TNIKELLIEK

SEQ ID NO: 60761 - protein, 10 aa, Borrelia burgdorferi B31
YTKLAKKSGK

SEQ ID NO: 60762 - protein, 10 aa, Borrelia burgdorferi B31
NINKIQKGIK

SEQ ID NO: 60763 - protein, 10 aa, Borrelia burgdorferi B31
HIKLDENLIK

SEQ ID NO: 60764 - protein, 10 aa, Borrelia burgdorferi B31
KETTGEIFLK

SEQ ID NO: 60765 - protein, 10 aa, Borrelia burgdorferi B31
SFKTIQNQLK

SEQ ID NO: 60766 - protein, 10 aa, Borrelia burgdorferi B31
DAYYRRPKIK

SEQ ID NO: 60767 - protein, 10 aa, Borrelia burgdorferi B31
LICLNPNTTR

SEQ ID NO: 60768 - protein, 10 aa, Borrelia burgdorferi B31
GIKEINLLNY

SEQ ID NO: 60769 - protein, 10 aa, Borrelia burgdorferi B31
RFHITKKNFK

SEQ ID NO: 60770 - protein, 11 aa, Borrelia burgdorferi B31
KTNIKELLIEK

SEQ ID NO: 60771 - protein, 11 aa, Borrelia burgdorferi B31
KISLNQSLSPK

SEQ ID NO: 60772 - protein, 11 aa, Borrelia burgdorferi B31
KAYKKGKNSFK

SEQ ID NO: 60773 - protein, 11 aa, Borrelia burgdorferi B31
KILDAYYRRPK

SEQ ID NO: 60774 - protein, 11 aa, Borrelia burgdorferi B31
KMSDKKIMELK

SEQ ID NO: 60775 - protein, 11 aa, Borrelia burgdorferi B31
IVLEKRIDSLK

SEQ ID NO: 60776 - protein, 11 aa, Borrelia burgdorferi B31
ALKLRFSDFLK

SEQ ID NO: 60777 - protein, 11 aa, Borrelia burgdorferi B31
TSYSEFLENYY

SEQ ID NO: 60778 - protein, 11 aa, Borrelia burgdorferi B31
GAGNLCVFYTK

SEQ ID NO: 60779 - protein, 11 aa, Borrelia burgdorferi B31
NLIQSKITMLK

SEQ ID NO: 60780 - protein, 11 aa, Borrelia burgdorferi B31
NSFKTIQNQLK

SEQ ID NO: 60781 - protein, 11 aa, Borrelia burgdorferi B31
GIKEINLLNYK

SEQ ID NO: 60782 - protein, 11 aa, Borrelia burgdorferi B31
TAIKEKEKTPK

SEQ ID NO: 60783 - protein, 11 aa, Borrelia burgdorferi B31
LILLNINKIQK

SEQ ID NO: 60784 - protein, 11 aa, Borrelia burgdorferi B31
KLGLVIPKAEK

SEQ ID NO: 60785 - protein, 11 aa, Borrelia burgdorferi B31
NALQYFKAYKK

SEQ ID NO: 60786 - protein, 11 aa, Borrelia burgdorferi B31
LITKIIQPDYK

SEQ ID NO: 60787 - protein, 11 aa, Borrelia burgdorferi B31
YTQVKNLRRVK

SEQ ID NO: 60788 - protein, 11 aa, Borrelia burgdorferi B31
LQYFKAYKKGK

SEQ ID NO: 60789 - protein, 11 aa, Borrelia burgdorferi B31
NLCVFYTKLAK

SEQ ID NO: 60790 - protein, 11 aa, Borrelia burgdorferi B31
LQKDMIILFIK

SEQ ID NO: 60791 - protein, 11 aa, Borrelia burgdorferi B31
IQNQLKDNLDK

SEQ ID NO: 60792 - protein, 11 aa, Borrelia burgdorferi B31
KSKIQNGKIIK

SEQ ID NO: 60793 - protein, 11 aa, Borrelia burgdorferi B31
KLRFSDFLKSK

SEQ ID NO: 60794 - protein, 11 aa, Borrelia burgdorferi B31
SPKENALQYFK

SEQ ID NO: 60795 - protein, 11 aa, Borrelia burgdorferi B31
EINLLNYKEEK

SEQ ID NO: 60796 - protein, 11 aa, Borrelia burgdorferi B31
KTPKIGLHFTY

SEQ ID NO: 60797 - protein, 11 aa, Borrelia burgdorferi B31
ETTGEIFLKAK

SEQ ID NO: 60798 - protein, 11 aa, Borrelia burgdorferi B31
QVKNLRRVKNK

SEQ ID NO: 60799 - protein, 11 aa, Borrelia burgdorferi B31
HIKLDENLIKK

SEQ ID NO: 60800 - protein, 11 aa, Borrelia burgdorferi B31
YTSYSEFLENY

SEQ ID NO: 60801 - protein, 11 aa, Borrelia burgdorferi B31
NIKELLIEKYK

SEQ ID NO: 60802 - protein, 11 aa, Borrelia burgdorferi B31
EIPFTNSLITK

SEQ ID NO: 60803 - protein, 11 aa, Borrelia burgdorferi B31
RDYPGAYVFIK

SEQ ID NO: 60804 - protein, 11 aa, Borrelia burgdorferi B31
NLDKFNLIQSK

SEQ ID NO: 60805 - protein, 11 aa, Borrelia burgdorferi B31
VLEIYNKIDNK

SEQ ID NO: 60806 - protein, 11 aa, Borrelia burgdorferi B31
ILICLNPNTTR

SEQ ID NO: 60807 - protein, 11 aa, Borrelia burgdorferi B31
IIKAFQMKNER

SEQ ID NO: 60808 - protein, 11 aa, Borrelia burgdorferi B31
KLDENLIKKIK

SEQ ID NO: 60809 - protein, 11 aa, Borrelia burgdorferi B31
KGELILLNINK

SEQ ID NO: 60810 - protein, 11 aa, Borrelia burgdorferi B31
RFHITKKNFKK

SEQ ID NO: 60811 - protein, 11 aa, Borrelia burgdorferi B31
LIPEEEYNQEK

SEQ ID NO: 60812 - protein, 11 aa, Borrelia burgdorferi B31
SNFKILDAYYR

SEQ ID NO: 60813 - protein, 11 aa, Borrelia burgdorferi B31
SLITKIIQPDY

SEQ ID NO: 60814 - protein, 11 aa, Borrelia burgdorferi B31
TYCGFEILIGR

SEQ ID NO: 60815 - protein, 11 aa, Borrelia burgdorferi B31
TSYTSYSEFLE

SEQ ID NO: 60816 - protein, 11 aa, Borrelia burgdorferi B31
SLSPKENALQY

SEQ ID NO: 60817 - protein, 9 aa, Borrelia burgdorferi B31
DYPGAYVFI

SEQ ID NO: 60818 - protein, 9 aa, Borrelia burgdorferi B31
DYKSLVLEI

SEQ ID NO: 60819 - protein, 9 aa, Borrelia burgdorferi B31
LWPSSPNII

SEQ ID NO: 60820 - protein, 9 aa, Borrelia burgdorferi B31
SYTSYSEFL

SEQ ID NO: 60821 - protein, 9 aa, Borrelia burgdorferi B31
YYESLNDQI

SEQ ID NO: 60822 - protein, 9 aa, Borrelia burgdorferi B31
NYTEINTLI

SEQ ID NO: 60823 - protein, 9 aa, Borrelia burgdorferi B31
TYCGFEILI

SEQ ID NO: 60824 - protein, 9 aa, Borrelia burgdorferi B31
KYKKELIVL

SEQ ID NO: 60825 - protein, 9 aa, Borrelia burgdorferi B31
LYYTQVKNL

SEQ ID NO: 60826 - protein, 9 aa, Borrelia burgdorferi B31
TMLKVENLI

SEQ ID NO: 60827 - protein, 9 aa, Borrelia burgdorferi B31
HFTYCGFEI

SEQ ID NO: 60828 - protein, 9 aa, Borrelia burgdorferi B31
AYKKGKNSF

SEQ ID NO: 60829 - protein, 9 aa, Borrelia burgdorferi B31
KTPKIGLHF

SEQ ID NO: 60830 - protein, 9 aa, Borrelia burgdorferi B31
IYNKIDNKK

SEQ ID NO: 60831 - protein, 9 aa, Borrelia burgdorferi B31
EYNQEKTAI

SEQ ID NO: 60832 - protein, 9 aa, Borrelia burgdorferi B31
TSYTSYSEF

SEQ ID NO: 60833 - protein, 9 aa, Borrelia burgdorferi B31
EYNNTSYTS

SEQ ID NO: 60834 - protein, 9 aa, Borrelia burgdorferi B31
KFNLIQSKI

SEQ ID NO: 60835 - protein, 10 aa, Borrelia burgdorferi B31
IYNKIDNKKF

SEQ ID NO: 60836 - protein, 10 aa, Borrelia burgdorferi B31
DYPGAYVFIK

SEQ ID NO: 60837 - protein, 10 aa, Borrelia burgdorferi B31
NYYESLNDQI

SEQ ID NO: 60838 - protein, 10 aa, Borrelia burgdorferi B31
EFLENYYESL

SEQ ID NO: 60839 - protein, 10 aa, Borrelia burgdorferi B31
EYNNTSYTSY

SEQ ID NO: 60840 - protein, 10 aa, Borrelia burgdorferi B31
ITMLKVENLI

SEQ ID NO: 60841 - protein, 10 aa, Borrelia burgdorferi B31
IIATNSNFKI

SEQ ID NO: 60842 - protein, 10 aa, Borrelia burgdorferi B31
SYTSYSEFLE

SEQ ID NO: 60843 - protein, 10 aa, Borrelia burgdorferi B31
NTSYTSYSEF

SEQ ID NO: 60844 - protein, 11 aa, Borrelia burgdorferi B31
HFTYCGFEILI

SEQ ID NO: 60845 - protein, 11 aa, Borrelia burgdorferi B31
NFKKNALKLRF

SEQ ID NO: 60846 - protein, 11 aa, Borrelia burgdorferi B31
YYTQVKNLRRV

SEQ ID NO: 60847 - protein, 11 aa, Borrelia burgdorferi B31
KYKKELIVLEK

SEQ ID NO: 60848 - protein, 9 aa, Borrelia burgdorferi B31
YSEFLENYY

SEQ ID NO: 60849 - protein, 9 aa, Borrelia burgdorferi B31
YNNTSYTSY

SEQ ID NO: 60850 - protein, 9 aa, Borrelia burgdorferi B31
NFKILDAYY

SEQ ID NO: 60851 - protein, 9 aa, Borrelia burgdorferi B31
SYSEFLENY

SEQ ID NO: 60852 - protein, 9 aa, Borrelia burgdorferi B31
PKIGLHFTY

SEQ ID NO: 60853 - protein, 9 aa, Borrelia burgdorferi B31
GAGNLCVFY

SEQ ID NO: 60854 - protein, 9 aa, Borrelia burgdorferi B31
KIMELKEEY

SEQ ID NO: 60855 - protein, 9 aa, Borrelia burgdorferi B31
KSGKADLYY

SEQ ID NO: 60856 - protein, 9 aa, Borrelia burgdorferi B31
KEEYNNTSY

SEQ ID NO: 60857 - protein, 10 aa, Borrelia burgdorferi B31
EYNNTSYTSY

SEQ ID NO: 60858 - protein, 10 aa, Borrelia burgdorferi B31
SYSEFLENYY

SEQ ID NO: 60859 - protein, 10 aa, Borrelia burgdorferi B31
SNFKILDAYY

SEQ ID NO: 60860 - protein, 10 aa, Borrelia burgdorferi B31
TSYSEFLENY

SEQ ID NO: 60861 - protein, 10 aa, Borrelia burgdorferi B31
DYKSLVLEIY

SEQ ID NO: 60862 - protein, 10 aa, Borrelia burgdorferi B31
LSPKENALQY

SEQ ID NO: 60863 - protein, 10 aa, Borrelia burgdorferi B31
GIKEINLLNY

SEQ ID NO: 60864 - protein, 10 aa, Borrelia burgdorferi B31
IYNKIDNKKF

SEQ ID NO: 60865 - protein, 10 aa, Borrelia burgdorferi B31
ENALQYFKAY

SEQ ID NO: 60866 - protein, 10 aa, Borrelia burgdorferi B31
NIKELLIEKY

SEQ ID NO: 60867 - protein, 11 aa, Borrelia burgdorferi B31
KTPKIGLHFTY

SEQ ID NO: 60868 - protein, 11 aa, Borrelia burgdorferi B31
TSYSEFLENYY

SEQ ID NO: 60869 - protein, 11 aa, Borrelia burgdorferi B31
SLSPKENALQY

SEQ ID NO: 60870 - protein, 11 aa, Borrelia burgdorferi B31
YTSYSEFLENY

SEQ ID NO: 60871 - protein, 11 aa, Borrelia burgdorferi B31
ELKEEYNNTSY

SEQ ID NO: 60872 - protein, 11 aa, Borrelia burgdorferi B31
SLITKIIQPDY

SEQ ID NO: 60873 - protein, 11 aa, Borrelia burgdorferi B31
LLGAGNLCVFY

SEQ ID NO: 60874 - protein, 11 aa, Borrelia burgdorferi B31
KVENLIPEEEY

SEQ ID NO: 60875 - protein, 11 aa, Borrelia burgdorferi B31
WLHTRDYPGAY

SEQ ID NO: 60876 - protein, 11 aa, Borrelia burgdorferi B31
EEYNNTSYTSY

SEQ ID NO: 60877 - protein, 11 aa, Borrelia burgdorferi B31
NSNFKILDAYY

SEQ ID NO: 60878 - protein, 11 aa, Borrelia burgdorferi B31
TNIKELLIEKY

SEQ ID NO: 60879 - protein, 9 aa, Borrelia burgdorferi B31
ETTGEIFLK

SEQ ID NO: 60880 - protein, 9 aa, Borrelia burgdorferi B31
NTTRFHITK

SEQ ID NO: 60881 - protein, 9 aa, Borrelia burgdorferi B31
YYTQVKNLR

SEQ ID NO: 60882 - protein, 9 aa, Borrelia burgdorferi B31
CVFYTKLAK

SEQ ID NO: 60883 - protein, 9 aa, Borrelia burgdorferi B31
IIATNSNFK

SEQ ID NO: 60884 - protein, 9 aa, Borrelia burgdorferi B31
EIYNKIDNK

SEQ ID NO: 60885 - protein, 9 aa, Borrelia burgdorferi B31
ESNKMSDKK

SEQ ID NO: 60886 - protein, 9 aa, Borrelia burgdorferi B31
TTRFHITKK

SEQ ID NO: 60887 - protein, 9 aa, Borrelia burgdorferi B31
ELILLNINK

SEQ ID NO: 60888 - protein, 9 aa, Borrelia burgdorferi B31
HITKKNFKK

SEQ ID NO: 60889 - protein, 9 aa, Borrelia burgdorferi B31
KAFQMKNER

SEQ ID NO: 60890 - protein, 9 aa, Borrelia burgdorferi B31
YTQVKNLRR

SEQ ID NO: 60891 - protein, 9 aa, Borrelia burgdorferi B31
FKILDAYYR

SEQ ID NO: 60892 - protein, 9 aa, Borrelia burgdorferi B31
YTEINTLIK

SEQ ID NO: 60893 - protein, 9 aa, Borrelia burgdorferi B31
YTSYSEFLE

SEQ ID NO: 60894 - protein, 9 aa, Borrelia burgdorferi B31
SLVLEIYNK

SEQ ID NO: 60895 - protein, 9 aa, Borrelia burgdorferi B31
IQSKITMLK

SEQ ID NO: 60896 - protein, 9 aa, Borrelia burgdorferi B31
EILIGRNAK

SEQ ID NO: 60897 - protein, 9 aa, Borrelia burgdorferi B31
ESLNDQIKK

SEQ ID NO: 60898 - protein, 9 aa, Borrelia burgdorferi B31
NIKELLIEK

SEQ ID NO: 60899 - protein, 9 aa, Borrelia burgdorferi B31
NLLNYKEEK

SEQ ID NO: 60900 - protein, 9 aa, Borrelia burgdorferi B31
CGFEILIGR

SEQ ID NO: 60901 - protein, 9 aa, Borrelia burgdorferi B31
LQYFKAYKK

SEQ ID NO: 60902 - protein, 9 aa, Borrelia burgdorferi B31
IISLEILQK

SEQ ID NO: 60903 - protein, 9 aa, Borrelia burgdorferi B31
YPGAYVFIK

SEQ ID NO: 60904 - protein, 9 aa, Borrelia burgdorferi B31
LLENIENEK

SEQ ID NO: 60905 - protein, 9 aa, Borrelia burgdorferi B31
ALQYFKAYK

SEQ ID NO: 60906 - protein, 9 aa, Borrelia burgdorferi B31
NTSYTSYSE

SEQ ID NO: 60907 - protein, 9 aa, Borrelia burgdorferi B31
KILDAYYRR

SEQ ID NO: 60908 - protein, 9 aa, Borrelia burgdorferi B31
AYVFIKNQK

SEQ ID NO: 60909 - protein, 9 aa, Borrelia burgdorferi B31
QVKNLRRVK

SEQ ID NO: 60910 - protein, 9 aa, Borrelia burgdorferi B31
IYNKIDNKK

SEQ ID NO: 60911 - protein, 9 aa, Borrelia burgdorferi B31
YSEFLENYY

SEQ ID NO: 60912 - protein, 9 aa, Borrelia burgdorferi B31
SLNQSLSPK

SEQ ID NO: 60913 - protein, 9 aa, Borrelia burgdorferi B31
LLNINKIQK

SEQ ID NO: 60914 - protein, 9 aa, Borrelia burgdorferi B31
ELLIEKYKK

SEQ ID NO: 60915 - protein, 9 aa, Borrelia burgdorferi B31
ENIENEKEK

SEQ ID NO: 60916 - protein, 9 aa, Borrelia burgdorferi B31
KIIKAFQMK

SEQ ID NO: 60917 - protein, 9 aa, Borrelia burgdorferi B31
KLRFSDFLK

SEQ ID NO: 60918 - protein, 9 aa, Borrelia burgdorferi B31
TSYTSYSEF

SEQ ID NO: 60919 - protein, 9 aa, Borrelia burgdorferi B31
DKFNLIQSK

SEQ ID NO: 60920 - protein, 9 aa, Borrelia burgdorferi B31
NLRRVKNKK

SEQ ID NO: 60921 - protein, 9 aa, Borrelia burgdorferi B31
KTAIKEKEK

SEQ ID NO: 60922 - protein, 9 aa, Borrelia burgdorferi B31
ITKIIQPDY

SEQ ID NO: 60923 - protein, 10 aa, Borrelia burgdorferi B31
NIIATNSNFK

SEQ ID NO: 60924 - protein, 10 aa, Borrelia burgdorferi B31
NTTRFHITKK

SEQ ID NO: 60925 - protein, 10 aa, Borrelia burgdorferi B31
CVFYTKLAKK

SEQ ID NO: 60926 - protein, 10 aa, Borrelia burgdorferi B31
EIYNKIDNKK

SEQ ID NO: 60927 - protein, 10 aa, Borrelia burgdorferi B31
YVFIKNQKNK

SEQ ID NO: 60928 - protein, 10 aa, Borrelia burgdorferi B31
NALQYFKAYK

SEQ ID NO: 60929 - protein, 10 aa, Borrelia burgdorferi B31
YTKLAKKSGK

SEQ ID NO: 60930 - protein, 10 aa, Borrelia burgdorferi B31
NFKILDAYYR

SEQ ID NO: 60931 - protein, 10 aa, Borrelia burgdorferi B31
ITKIIQPDYK

SEQ ID NO: 60932 - protein, 10 aa, Borrelia burgdorferi B31
YYTQVKNLRR

SEQ ID NO: 60933 - protein, 10 aa, Borrelia burgdorferi B31
DAYYRRPKIK

SEQ ID NO: 60934 - protein, 10 aa, Borrelia burgdorferi B31
NAKENDKLLR

SEQ ID NO: 60935 - protein, 10 aa, Borrelia burgdorferi B31
TTGEIFLKAK

SEQ ID NO: 60936 - protein, 10 aa, Borrelia burgdorferi B31
LICLNPNTTR

SEQ ID NO: 60937 - protein, 10 aa, Borrelia burgdorferi B31
LYYTQVKNLR

SEQ ID NO: 60938 - protein, 10 aa, Borrelia burgdorferi B31
MSDKKIMELK

SEQ ID NO: 60939 - protein, 10 aa, Borrelia burgdorferi B31
LIQSKITMLK

SEQ ID NO: 60940 - protein, 10 aa, Borrelia burgdorferi B31
TSYSEFLENY

SEQ ID NO: 60941 - protein, 10 aa, Borrelia burgdorferi B31
NINKIQKGIK

SEQ ID NO: 60942 - protein, 10 aa, Borrelia burgdorferi B31
GAYVFIKNQK

SEQ ID NO: 60943 - protein, 10 aa, Borrelia burgdorferi B31
NYTEINTLIK

SEQ ID NO: 60944 - protein, 10 aa, Borrelia burgdorferi B31
FKILDAYYRR

SEQ ID NO: 60945 - protein, 10 aa, Borrelia burgdorferi B31
RIISLEILQK

SEQ ID NO: 60946 - protein, 10 aa, Borrelia burgdorferi B31
DYPGAYVFIK

SEQ ID NO: 60947 - protein, 10 aa, Borrelia burgdorferi B31
IPFTNSLITK

SEQ ID NO: 60948 - protein, 10 aa, Borrelia burgdorferi B31
EYNQEKTAIK

SEQ ID NO: 60949 - protein, 10 aa, Borrelia burgdorferi B31
NFKKNALKLR

SEQ ID NO: 60950 - protein, 10 aa, Borrelia burgdorferi B31
NTSYTSYSEF

SEQ ID NO: 60951 - protein, 10 aa, Borrelia burgdorferi B31
HIKLDENLIK

SEQ ID NO: 60952 - protein, 10 aa, Borrelia burgdorferi B31
IKAFQMKNER

SEQ ID NO: 60953 - protein, 10 aa, Borrelia burgdorferi B31
FLKSKIQNGK

SEQ ID NO: 60954 - protein, 10 aa, Borrelia burgdorferi B31
TSYTSYSEFL

SEQ ID NO: 60955 - protein, 10 aa, Borrelia burgdorferi B31
TNIKELLIEK

SEQ ID NO: 60956 - protein, 10 aa, Borrelia burgdorferi B31
SFKTIQNQLK

SEQ ID NO: 60957 - protein, 10 aa, Borrelia burgdorferi B31
ILLNINKIQK

SEQ ID NO: 60958 - protein, 10 aa, Borrelia burgdorferi B31
EYNNTSYTSY

SEQ ID NO: 60959 - protein, 10 aa, Borrelia burgdorferi B31
QYFKAYKKGK

SEQ ID NO: 60960 - protein, 10 aa, Borrelia burgdorferi B31
NSNFKILDAY

SEQ ID NO: 60961 - protein, 10 aa, Borrelia burgdorferi B31
EKTAIKEKEK

SEQ ID NO: 60962 - protein, 10 aa, Borrelia burgdorferi B31
ISLNQSLSPK

SEQ ID NO: 60963 - protein, 10 aa, Borrelia burgdorferi B31
YYESLNDQIK

SEQ ID NO: 60964 - protein, 10 aa, Borrelia burgdorferi B31
ALQYFKAYKK

SEQ ID NO: 60965 - protein, 10 aa, Borrelia burgdorferi B31
KAKEIHESNK

SEQ ID NO: 60966 - protein, 11 aa, Borrelia burgdorferi B31
DLYYTQVKNLR

SEQ ID NO: 60967 - protein, 11 aa, Borrelia burgdorferi B31
ETTGEIFLKAK

SEQ ID NO: 60968 - protein, 11 aa, Borrelia burgdorferi B31
EINLLNYKEEK

SEQ ID NO: 60969 - protein, 11 aa, Borrelia burgdorferi B31
NSFKTIQNQLK

SEQ ID NO: 60970 - protein, 11 aa, Borrelia burgdorferi B31
TYCGFEILIGR

SEQ ID NO: 60971 - protein, 11 aa, Borrelia burgdorferi B31
IIKAFQMKNER

SEQ ID NO: 60972 - protein, 11 aa, Borrelia burgdorferi B31
NLIQSKITMLK

SEQ ID NO: 60973 - protein, 11 aa, Borrelia burgdorferi B31
SNFKILDAYYR

SEQ ID NO: 60974 - protein, 11 aa, Borrelia burgdorferi B31
EIPFTNSLITK

SEQ ID NO: 60975 - protein, 11 aa, Borrelia burgdorferi B31
ENALQYFKAYK

SEQ ID NO: 60976 - protein, 11 aa, Borrelia burgdorferi B31
YTSYSEFLENY

SEQ ID NO: 60977 - protein, 11 aa, Borrelia burgdorferi B31
TSYSEFLENYY

SEQ ID NO: 60978 - protein, 11 aa, Borrelia burgdorferi B31
ILICLNPNTTR

SEQ ID NO: 60979 - protein, 11 aa, Borrelia burgdorferi B31
EIHESNKMSDK

SEQ ID NO: 60980 - protein, 11 aa, Borrelia burgdorferi B31
LITKIIQPDYK

SEQ ID NO: 60981 - protein, 11 aa, Borrelia burgdorferi B31
NALQYFKAYKK

SEQ ID NO: 60982 - protein, 11 aa, Borrelia burgdorferi B31
NFKILDAYYRR

SEQ ID NO: 60983 - protein, 11 aa, Borrelia burgdorferi B31
TAIKEKEKTPK

SEQ ID NO: 60984 - protein, 11 aa, Borrelia burgdorferi B31
NIKELLIEKYK

SEQ ID NO: 60985 - protein, 11 aa, Borrelia burgdorferi B31
NLCVFYTKLAK

SEQ ID NO: 60986 - protein, 11 aa, Borrelia burgdorferi B31
TSYTSYSEFLE

SEQ ID NO: 60987 - protein, 11 aa, Borrelia burgdorferi B31
IVLEKRIDSLK

SEQ ID NO: 60988 - protein, 11 aa, Borrelia burgdorferi B31
NPNTTRFHITK

SEQ ID NO: 60989 - protein, 11 aa, Borrelia burgdorferi B31
HIKLDENLIKK

SEQ ID NO: 60990 - protein, 11 aa, Borrelia burgdorferi B31
NYYESLNDQIK

SEQ ID NO: 60991 - protein, 11 aa, Borrelia burgdorferi B31
YTQVKNLRRVK

SEQ ID NO: 60992 - protein, 11 aa, Borrelia burgdorferi B31
LYYTQVKNLRR

SEQ ID NO: 60993 - protein, 11 aa, Borrelia burgdorferi B31
NSNFKILDAYY

SEQ ID NO: 60994 - protein, 11 aa, Borrelia burgdorferi B31
IYNKIDNKKFK

SEQ ID NO: 60995 - protein, 11 aa, Borrelia burgdorferi B31
LILLNINKIQK

SEQ ID NO: 60996 - protein, 11 aa, Borrelia burgdorferi B31
KAYKKGKNSFK

SEQ ID NO: 60997 - protein, 11 aa, Borrelia burgdorferi B31
SPKENALQYFK

SEQ ID NO: 60998 - protein, 11 aa, Borrelia burgdorferi B31
FYTKLAKKSGK

SEQ ID NO: 60999 - protein, 11 aa, Borrelia burgdorferi B31
TRFHITKKNFK

SEQ ID NO: 61000 - protein, 11 aa, Borrelia burgdorferi B31
NTSYTSYSEFL

SEQ ID NO: 61001 - protein, 11 aa, Borrelia burgdorferi B31
GIKEINLLNYK

SEQ ID NO: 61002 - protein, 11 aa, Borrelia burgdorferi B31
QVKNLRRVKNK

SEQ ID NO: 61003 - protein, 11 aa, Borrelia burgdorferi B31
KTNIKELLIEK

SEQ ID NO: 61004 - protein, 11 aa, Borrelia burgdorferi B31
EEYNQEKTAIK

SEQ ID NO: 61005 - protein, 11 aa, Borrelia burgdorferi B31
LIPEEEYNQEK

SEQ ID NO: 61006 - protein, 11 aa, Borrelia burgdorferi B31
YYESLNDQIKK

SEQ ID NO: 61007 - protein, 11 aa, Borrelia burgdorferi B31
KISLNQSLSPK

SEQ ID NO: 61008 - protein, 11 aa, Borrelia burgdorferi B31
EEYNNTSYTSY

SEQ ID NO: 61009 - protein, 11 aa, Borrelia burgdorferi B31
LQYFKAYKKGK

SEQ ID NO: 61010 - protein, 11 aa, Borrelia burgdorferi B31
ERIISLEILQK

SEQ ID NO: 61011 - protein, 11 aa, Borrelia burgdorferi B31
LNYTEINTLIK

SEQ ID NO: 61012 - protein, 11 aa, Borrelia burgdorferi B31
GAGNLCVFYTK

SEQ ID NO: 61013 - protein, 11 aa, Borrelia burgdorferi B31
LLENIENEKEK

SEQ ID NO: 61014 - protein, 11 aa, Borrelia burgdorferi B31
NLDKFNLIQSK

SEQ ID NO: 61015 - protein, 11 aa, Borrelia burgdorferi B31
NGKIIKAFQMK

SEQ ID NO: 61016 - protein, 9 aa, Borrelia burgdorferi B31
QPDYKSLVL

SEQ ID NO: 61017 - protein, 9 aa, Borrelia burgdorferi B31
RVKNKKLGL

SEQ ID NO: 61018 - protein, 9 aa, Borrelia burgdorferi B31
NPNTTRFHI

SEQ ID NO: 61019 - protein, 9 aa, Borrelia burgdorferi B31
WPSSPNIIA

SEQ ID NO: 61020 - protein, 9 aa, Borrelia burgdorferi B31
RPKIKETTG

SEQ ID NO: 61021 - protein, 9 aa, Borrelia burgdorferi B31
IPFTNSLIT

SEQ ID NO: 61022 - protein, 10 aa, Borrelia burgdorferi B31
WPSSPNIIAT

SEQ ID NO: 61023 - protein, 10 aa, Borrelia burgdorferi B31
SPKENALQYF

SEQ ID NO: 61024 - protein, 10 aa, Borrelia burgdorferi B31
IPKAEKNLHI

SEQ ID NO: 61025 - protein, 10 aa, Borrelia burgdorferi B31
KAYKKGKNSF

SEQ ID NO: 61026 - protein, 10 aa, Borrelia burgdorferi B31
IVLEKRIDSL

SEQ ID NO: 61027 - protein, 10 aa, Borrelia burgdorferi B31
LAKKSGKADL

SEQ ID NO: 61028 - protein, 10 aa, Borrelia burgdorferi B31
RPKIKETTGE

SEQ ID NO: 61029 - protein, 10 aa, Borrelia burgdorferi B31
NPNTTRFHIT

SEQ ID NO: 61030 - protein, 11 aa, Borrelia burgdorferi B31
RPKIKETTGEI

SEQ ID NO: 61031 - protein, 11 aa, Borrelia burgdorferi B31
SPNIIATNSNF

SEQ ID NO: 61032 - protein, 11 aa, Borrelia burgdorferi B31
RVKNKKLGLVI

SEQ ID NO: 61033 - protein, 11 aa, Borrelia burgdorferi B31
IPFTNSLITKI

SEQ ID NO: 61034 - protein, 11 aa, Borrelia burgdorferi B31
QPDYKSLVLEI

SEQ ID NO: 61035 - protein, 11 aa, Borrelia burgdorferi B31
TPKIGLHFTYC

SEQ ID NO: 61036 - protein, 9 aa, Borrelia burgdorferi B31
ALKLRFSDF

SEQ ID NO: 61037 - protein, 9 aa, Borrelia burgdorferi B31
LRRVKNKKL

SEQ ID NO: 61038 - protein, 10 aa, Borrelia burgdorferi B31
NLRRVKNKKL

SEQ ID NO: 61039 - protein, 10 aa, Borrelia burgdorferi B31
QIKKTNIKEL

SEQ ID NO: 61040 - protein, 10 aa, Borrelia burgdorferi B31
QMKNERIISL

SEQ ID NO: 61041 - protein, 11 aa, Borrelia burgdorferi B31
ITKKNFKKNAL

SEQ ID NO: 61042 - protein, 11 aa, Borrelia burgdorferi B31
FLKSKIQNGKI

SEQ ID NO: 61043 - protein, 11 aa, Borrelia burgdorferi B31
RPKIKETTGEI

SEQ ID NO: 61044 - protein, 11 aa, Borrelia burgdorferi B31
QIKKTNIKELL

SEQ ID NO: 61045 - protein, 9 aa, Borrelia burgdorferi B31
LQKDMIILF

SEQ ID NO: 61046 - protein, 9 aa, Borrelia burgdorferi B31
YNNTSYTSY

SEQ ID NO: 61047 - protein, 9 aa, Borrelia burgdorferi B31
HTRDYPGAY

SEQ ID NO: 61048 - protein, 9 aa, Borrelia burgdorferi B31
NQKNKTPSL

SEQ ID NO: 61049 - protein, 9 aa, Borrelia burgdorferi B31
TSYTSYSEF

SEQ ID NO: 61050 - protein, 9 aa, Borrelia burgdorferi B31
KIMELKEEY

SEQ ID NO: 61051 - protein, 9 aa, Borrelia burgdorferi B31
ALKLRFSDF

SEQ ID NO: 61052 - protein, 9 aa, Borrelia burgdorferi B31
NIIATNSNF

SEQ ID NO: 61053 - protein, 9 aa, Borrelia burgdorferi B31
ITKIIQPDY

SEQ ID NO: 61054 - protein, 9 aa, Borrelia burgdorferi B31
YSEFLENYY

SEQ ID NO: 61055 - protein, 9 aa, Borrelia burgdorferi B31
GLHFTYCGF

SEQ ID NO: 61056 - protein, 9 aa, Borrelia burgdorferi B31
RDYPGAYVF

SEQ ID NO: 61057 - protein, 9 aa, Borrelia burgdorferi B31
KSGKADLYY

SEQ ID NO: 61058 - protein, 10 aa, Borrelia burgdorferi B31
IQNGKIIKAF

SEQ ID NO: 61059 - protein, 10 aa, Borrelia burgdorferi B31
KIKETTGEIF

SEQ ID NO: 61060 - protein, 10 aa, Borrelia burgdorferi B31
LLGAGNLCVF

SEQ ID NO: 61061 - protein, 10 aa, Borrelia burgdorferi B31
QMKNERIISL

SEQ ID NO: 61062 - protein, 10 aa, Borrelia burgdorferi B31
KAYKKGKNSF

SEQ ID NO: 61063 - protein, 10 aa, Borrelia burgdorferi B31
GIKEINLLNY

SEQ ID NO: 61064 - protein, 10 aa, Borrelia burgdorferi B31
ILQKDMIILF

SEQ ID NO: 61065 - protein, 10 aa, Borrelia burgdorferi B31
KMSDKKIMEL

SEQ ID NO: 61066 - protein, 10 aa, Borrelia burgdorferi B31
IQKGIKEINL

SEQ ID NO: 61067 - protein, 10 aa, Borrelia burgdorferi B31
IQPDYKSLVL

SEQ ID NO: 61068 - protein, 10 aa, Borrelia burgdorferi B31
LQKDMIILFI

SEQ ID NO: 61069 - protein, 10 aa, Borrelia burgdorferi B31
TSYSEFLENY

SEQ ID NO: 61070 - protein, 10 aa, Borrelia burgdorferi B31
NTSYTSYSEF

SEQ ID NO: 61071 - protein, 11 aa, Borrelia burgdorferi B31
WLHTRDYPGAY

SEQ ID NO: 61072 - protein, 11 aa, Borrelia burgdorferi B31
LLRHCVKGNDY

SEQ ID NO: 61073 - protein, 11 aa, Borrelia burgdorferi B31
FQMKNERIISL

SEQ ID NO: 61074 - protein, 11 aa, Borrelia burgdorferi B31
ELKEEYNNTSY

SEQ ID NO: 61075 - protein, 11 aa, Borrelia burgdorferi B31
LLGAGNLCVFY

SEQ ID NO: 61076 - protein, 11 aa, Borrelia burgdorferi B31
VLLGAGNLCVF

SEQ ID NO: 61077 - protein, 11 aa, Borrelia burgdorferi B31
HTRDYPGAYVF

SEQ ID NO: 61078 - protein, 11 aa, Borrelia burgdorferi B31
KIQNGKIIKAF

SEQ ID NO: 61079 - protein, 11 aa, Borrelia burgdorferi B31
SLSPKENALQY

SEQ ID NO: 61080 - protein, 11 aa, Borrelia burgdorferi B31
YTSYSEFLENY

SEQ ID NO: 61081 - protein, 11 aa, Borrelia burgdorferi B31
IQKGIKEINLL

SEQ ID NO: 61082 - protein, 11 aa, Borrelia burgdorferi B31
SLITKIIQPDY

SEQ ID NO: 61083 - protein, 11 aa, Borrelia burgdorferi B31
TSYSEFLENYY

SEQ ID NO: 61084 - protein, 11 aa, Borrelia burgdorferi B31
LAKKSGKADLY

SEQ ID NO: 61085 - protein, 11 aa, Borrelia burgdorferi B31
NQSLSPKENAL

SEQ ID NO: 61086 - protein, 11 aa, Borrelia burgdorferi B31
KENALQYFKAY

SEQ ID NO: 61087 - protein, 11 aa, Borrelia burgdorferi B31
KVENLIPEEEY

SEQ ID NO: 61088 - protein, 11 aa, Borrelia burgdorferi B31
KTPKIGLHFTY

SEQ ID NO: 61089 - protein, 11 aa, Borrelia burgdorferi B31
LIKEIPFTNSL

SEQ ID NO: 61090 - protein, 11 aa, Borrelia burgdorferi B31
NSNFKILDAYY

SEQ ID NO: 61091 - protein, 9 aa, Borrelia burgdorferi B31
KKLGLVIPK

SEQ ID NO: 61092 - protein, 9 aa, Borrelia burgdorferi B31
KKNALKLRF

SEQ ID NO: 61093 - protein, 9 aa, Borrelia burgdorferi B31
GRNAKENDK

SEQ ID NO: 61094 - protein, 9 aa, Borrelia burgdorferi B31
LQYFKAYKK

SEQ ID NO: 61095 - protein, 10 aa, Borrelia burgdorferi B31
RRVKNKKLGL

SEQ ID NO: 61096 - protein, 10 aa, Borrelia burgdorferi B31
LRFSDFLKSK

SEQ ID NO: 61097 - protein, 10 aa, Borrelia burgdorferi B31
TRFHITKKNF

SEQ ID NO: 61098 - protein, 10 aa, Borrelia burgdorferi B31
KRIDSLKQQI

SEQ ID NO: 61099 - protein, 11 aa, Borrelia burgdorferi B31
KRIDSLKQQIK

SEQ ID NO: 61100 - protein, 11 aa, Borrelia burgdorferi B31
RRVKNKKLGLV

SEQ ID NO: 61101 - protein, 11 aa, Borrelia burgdorferi B31
TRFHITKKNFK

SEQ ID NO: 61102 - protein, 11 aa, Borrelia burgdorferi B31
LRFSDFLKSKI

SEQ ID NO: 61103 - protein, 11 aa, Borrelia burgdorferi B31
LRRVKNKKLGL

SEQ ID NO: 61104 - protein, 11 aa, Borrelia burgdorferi B31
FQMKNERIISL

SEQ ID NO: 61105 - protein, 9 aa, Borrelia burgdorferi B31
NALQYFKAY

SEQ ID NO: 61106 - protein, 9 aa, Borrelia burgdorferi B31
SPKENALQY

SEQ ID NO: 61107 - protein, 9 aa, Borrelia burgdorferi B31
YSEFLENYY

SEQ ID NO: 61108 - protein, 9 aa, Borrelia burgdorferi B31
QPDYKSLVL

SEQ ID NO: 61109 - protein, 9 aa, Borrelia burgdorferi B31
IPFTNSLIT

SEQ ID NO: 61110 - protein, 9 aa, Borrelia burgdorferi B31
WPSSPNIIA

SEQ ID NO: 61111 - protein, 9 aa, Borrelia burgdorferi B31
HTRDYPGAY

SEQ ID NO: 61112 - protein, 9 aa, Borrelia burgdorferi B31
FTYCGFEIL

SEQ ID NO: 61113 - protein, 9 aa, Borrelia burgdorferi B31
YNNTSYTSY

SEQ ID NO: 61114 - protein, 9 aa, Borrelia burgdorferi B31
NFKILDAYY

SEQ ID NO: 61115 - protein, 9 aa, Borrelia burgdorferi B31
YKSLVLEIY

SEQ ID NO: 61116 - protein, 9 aa, Borrelia burgdorferi B31
TSYTSYSEF

SEQ ID NO: 61117 - protein, 9 aa, Borrelia burgdorferi B31
NLIQSKITM

SEQ ID NO: 61118 - protein, 10 aa, Borrelia burgdorferi B31
TPKIGLHFTY

SEQ ID NO: 61119 - protein, 10 aa, Borrelia burgdorferi B31
WPSSPNIIAT

SEQ ID NO: 61120 - protein, 10 aa, Borrelia burgdorferi B31
SPKENALQYF

SEQ ID NO: 61121 - protein, 10 aa, Borrelia burgdorferi B31
NSNFKILDAY

SEQ ID NO: 61122 - protein, 10 aa, Borrelia burgdorferi B31
NPNTTRFHIT

SEQ ID NO: 61123 - protein, 10 aa, Borrelia burgdorferi B31
LKEEYNNTSY

SEQ ID NO: 61124 - protein, 10 aa, Borrelia burgdorferi B31
ENALQYFKAY

SEQ ID NO: 61125 - protein, 10 aa, Borrelia burgdorferi B31
EYNNTSYTSY

SEQ ID NO: 61126 - protein, 10 aa, Borrelia burgdorferi B31
NTSYTSYSEF

SEQ ID NO: 61127 - protein, 10 aa, Borrelia burgdorferi B31
TPSLDVLLGA

SEQ ID NO: 61128 - protein, 10 aa, Borrelia burgdorferi B31
TSYSEFLENY

SEQ ID NO: 61129 - protein, 10 aa, Borrelia burgdorferi B31
FNLIQSKITM

SEQ ID NO: 61130 - protein, 11 aa, Borrelia burgdorferi B31
SPNIIATNSNF

SEQ ID NO: 61131 - protein, 11 aa, Borrelia burgdorferi B31
WLHTRDYPGAY

SEQ ID NO: 61132 - protein, 11 aa, Borrelia burgdorferi B31
MSLNYTEINTL

SEQ ID NO: 61133 - protein, 11 aa, Borrelia burgdorferi B31
TSYSEFLENYY

SEQ ID NO: 61134 - protein, 11 aa, Borrelia burgdorferi B31
EINTLIKEIPF

SEQ ID NO: 61135 - protein, 11 aa, Borrelia burgdorferi B31
YTSYSEFLENY

SEQ ID NO: 61136 - protein, 11 aa, Borrelia burgdorferi B31
WPSSPNIIATN

SEQ ID NO: 61137 - protein, 11 aa, Borrelia burgdorferi B31
EILQKDMIILF

SEQ ID NO: 61138 - protein, 11 aa, Borrelia burgdorferi B31
LAKKSGKADLY

SEQ ID NO: 61139 - protein, 11 aa, Borrelia burgdorferi B31
NSNFKILDAYY

SEQ ID NO: 61140 - protein, 11 aa, Borrelia burgdorferi B31
TNSNFKILDAY

SEQ ID NO: 61141 - protein, 11 aa, Borrelia burgdorferi B31
KVENLIPEEEY

SEQ ID NO: 61142 - protein, 11 aa, Borrelia burgdorferi B31
HTRDYPGAYVF

SEQ ID NO: 61143 - protein, 11 aa, Borrelia burgdorferi B31
TPSLDVLLGAG

SEQ ID NO: 61144 - protein, 11 aa, Borrelia burgdorferi B31
EEYNNTSYTSY

SEQ ID NO: 61145 - protein, 11 aa, Borrelia burgdorferi B31
VLLGAGNLCVF

SEQ ID NO: 61146 - protein, 11 aa, Borrelia burgdorferi B31
LICLNPNTTRF

SEQ ID NO: 61147 - protein, 11 aa, Borrelia burgdorferi B31
ELKEEYNNTSY

SEQ ID NO: 61148 - protein, 11 aa, Borrelia burgdorferi B31
IPFTNSLITKI

SEQ ID NO: 61149 - protein, 9 aa, Borrelia burgdorferi B31
KEIPFTNSL

SEQ ID NO: 61150 - protein, 9 aa, Borrelia burgdorferi B31
SEFLENYYE

SEQ ID NO: 61151 - protein, 9 aa, Borrelia burgdorferi B31
AEKNLHIKL

SEQ ID NO: 61152 - protein, 9 aa, Borrelia burgdorferi B31
KEIHESNKM

SEQ ID NO: 61153 - protein, 9 aa, Borrelia burgdorferi B31
KETTGEIFL

SEQ ID NO: 61154 - protein, 9 aa, Borrelia burgdorferi B31
EEYNNTSYT

SEQ ID NO: 61155 - protein, 9 aa, Borrelia burgdorferi B31
KEEYNNTSY

SEQ ID NO: 61156 - protein, 9 aa, Borrelia burgdorferi B31
FEILIGRNA

SEQ ID NO: 61157 - protein, 10 aa, Borrelia burgdorferi B31
SEFLENYYES

SEQ ID NO: 61158 - protein, 10 aa, Borrelia burgdorferi B31
KEIPFTNSLI

SEQ ID NO: 61159 - protein, 10 aa, Borrelia burgdorferi B31
KEIHESNKMS

SEQ ID NO: 61160 - protein, 10 aa, Borrelia burgdorferi B31
GEIFLKAKEI

SEQ ID NO: 61161 - protein, 10 aa, Borrelia burgdorferi B31
EEYNQEKTAI

SEQ ID NO: 61162 - protein, 10 aa, Borrelia burgdorferi B31
TEINTLIKEI

SEQ ID NO: 61163 - protein, 10 aa, Borrelia burgdorferi B31
LEILQKDMII

SEQ ID NO: 61164 - protein, 10 aa, Borrelia burgdorferi B31
EEYNNTSYTS

SEQ ID NO: 61165 - protein, 10 aa, Borrelia burgdorferi B31
AEKNLHIKLD

SEQ ID NO: 61166 - protein, 10 aa, Borrelia burgdorferi B31
EEKIKISLNQ

SEQ ID NO: 61167 - protein, 11 aa, Borrelia burgdorferi B31
SEFLENYYESL

SEQ ID NO: 61168 - protein, 11 aa, Borrelia burgdorferi B31
KEIPFTNSLIT

SEQ ID NO: 61169 - protein, 11 aa, Borrelia burgdorferi B31
KENALQYFKAY

SEQ ID NO: 61170 - protein, 11 aa, Borrelia burgdorferi B31
EEYNNTSYTSY

SEQ ID NO: 61171 - protein, 11 aa, Borrelia burgdorferi B31
KEKTPKIGLHF

SEQ ID NO: 61172 - protein, 11 aa, Borrelia burgdorferi B31
KEKEKTPKIGL

SEQ ID NO: 61173 - protein, 9 aa, Borrelia burgdorferi B31
IPFTNSLIT

SEQ ID NO: 61174 - protein, 9 aa, Borrelia burgdorferi B31
WPSSPNIIA

SEQ ID NO: 61175 - protein, 9 aa, Borrelia burgdorferi B31
NPNTTRFHI

SEQ ID NO: 61176 - protein, 10 aa, Borrelia burgdorferi B31
IPFTNSLITK

SEQ ID NO: 61177 - protein, 10 aa, Borrelia burgdorferi B31
IPKAEKNLHI

SEQ ID NO: 61178 - protein, 10 aa, Borrelia burgdorferi B31
WPSSPNIIAT

SEQ ID NO: 61179 - protein, 11 aa, Borrelia burgdorferi B31
IPFTNSLITKI

SEQ ID NO: 61180 - protein, 11 aa, Borrelia burgdorferi B31
QPDYKSLVLEI

SEQ ID NO: 61181 - protein, 10 aa, Borrelia burgdorferi B31
TSYSEFLENY

SEQ ID NO: 61182 - protein, 10 aa, Borrelia burgdorferi B31
LSPKENALQY

SEQ ID NO: 61183 - protein, 11 aa, Borrelia burgdorferi B31
TSYSEFLENYY

SEQ ID NO: 61184 - protein, 11 aa, Borrelia burgdorferi B31
KTPKIGLHFTY

SEQ ID NO: 61185 - protein, 9 aa, Borrelia burgdorferi
TTNDSSTAY

SEQ ID NO: 61186 - protein, 9 aa, Borrelia burgdorferi
ETSSDGTAY

SEQ ID NO: 61187 - protein, 9 aa, Borrelia burgdorferi
DSSTAYKMY

SEQ ID NO: 61188 - protein, 9 aa, Borrelia burgdorferi
ASKMIDTLY

SEQ ID NO: 61189 - protein, 9 aa, Borrelia burgdorferi
ELDAILVPY

SEQ ID NO: 61190 - protein, 10 aa, Borrelia burgdorferi
SSDGTAYPFY

SEQ ID NO: 61191 - protein, 10 aa, Borrelia burgdorferi
YTTNDSSTAY

SEQ ID NO: 61192 - protein, 10 aa, Borrelia burgdorferi
VASKMIDTLY

SEQ ID NO: 61193 - protein, 10 aa, Borrelia burgdorferi
EVELEEITFY

SEQ ID NO: 61194 - protein, 11 aa, Borrelia burgdorferi
TSSDGTAYPFY

SEQ ID NO: 61195 - protein, 11 aa, Borrelia burgdorferi
NVASKMIDTLY

SEQ ID NO: 61196 - protein, 11 aa, Borrelia burgdorferi
VTDKYGQNWTS

SEQ ID NO: 61197 - protein, 9 aa, Borrelia burgdorferi
SLSLIIFSL

SEQ ID NO: 61198 - protein, 9 aa, Borrelia burgdorferi
SLIIFSLTV

SEQ ID NO: 61199 - protein, 9 aa, Borrelia burgdorferi
KLQRSLSLI

SEQ ID NO: 61200 - protein, 9 aa, Borrelia burgdorferi
AIDSKTLEI

SEQ ID NO: 61201 - protein, 9 aa, Borrelia burgdorferi
YVNEELDAI

SEQ ID NO: 61202 - protein, 9 aa, Borrelia burgdorferi
LVHQSFIPV

SEQ ID NO: 61203 - protein, 9 aa, Borrelia burgdorferi
HQSFIPVPV

SEQ ID NO: 61204 - protein, 9 aa, Borrelia burgdorferi
MVTSGPFKL

SEQ ID NO: 61205 - protein, 9 aa, Borrelia burgdorferi
YKMYVNEEL

SEQ ID NO: 61206 - protein, 9 aa, Borrelia burgdorferi
ELEEITFYT

SEQ ID NO: 61207 - protein, 9 aa, Borrelia burgdorferi
LTWSDGVAI

SEQ ID NO: 61208 - protein, 9 aa, Borrelia burgdorferi
LIIFSLTVL

SEQ ID NO: 61209 - protein, 9 aa, Borrelia burgdorferi
YLRDNLTWS

SEQ ID NO: 61210 - protein, 9 aa, Borrelia burgdorferi
KMIDTLYRG

SEQ ID NO: 61211 - protein, 9 aa, Borrelia burgdorferi
SSTAYKMYV

SEQ ID NO: 61212 - protein, 9 aa, Borrelia burgdorferi
MIDTLYRGI

SEQ ID NO: 61213 - protein, 10 aa, Borrelia burgdorferi
KMIDTLYRGI

SEQ ID NO: 61214 - protein, 10 aa, Borrelia burgdorferi
LLVHQSFIPV

SEQ ID NO: 61215 - protein, 10 aa, Borrelia burgdorferi
TLASPKPYFI

SEQ ID NO: 61216 - protein, 10 aa, Borrelia burgdorferi
SLIIFSLTVL

SEQ ID NO: 61217 - protein, 10 aa, Borrelia burgdorferi
KLQRSLSLII

SEQ ID NO: 61218 - protein, 10 aa, Borrelia burgdorferi
RSLSLIIFSL

SEQ ID NO: 61219 - protein, 10 aa, Borrelia burgdorferi
NMVTSGPFKL

SEQ ID NO: 61220 - protein, 10 aa, Borrelia burgdorferi
YVNEELDAIL

SEQ ID NO: 61221 - protein, 10 aa, Borrelia burgdorferi
SLSLIIFSLT

SEQ ID NO: 61222 - protein, 10 aa, Borrelia burgdorferi
KMYVNEELDA

SEQ ID NO: 61223 - protein, 10 aa, Borrelia burgdorferi
LSLIIFSLTV

SEQ ID NO: 61224 - protein, 10 aa, Borrelia burgdorferi
MIDTLYRGIV

SEQ ID NO: 61225 - protein, 10 aa, Borrelia burgdorferi
RAIDSKTLEI

SEQ ID NO: 61226 - protein, 11 aa, Borrelia burgdorferi
SLSLIIFSLTV

SEQ ID NO: 61227 - protein, 11 aa, Borrelia burgdorferi
YVNEELDAILV

SEQ ID NO: 61228 - protein, 11 aa, Borrelia burgdorferi
ILNKETGSTYV

SEQ ID NO: 61229 - protein, 11 aa, Borrelia burgdorferi
KMIDTLYRGIV

SEQ ID NO: 61230 - protein, 11 aa, Borrelia burgdorferi
SLDPQLAEDNV

SEQ ID NO: 61231 - protein, 11 aa, Borrelia burgdorferi
KMYVNEELDAI

SEQ ID NO: 61232 - protein, 11 aa, Borrelia burgdorferi
FIDLLVHQSFI

SEQ ID NO: 61233 - protein, 11 aa, Borrelia burgdorferi
LVHQSFIPVPV

SEQ ID NO: 61234 - protein, 11 aa, Borrelia burgdorferi
AIDSKTLEITL

SEQ ID NO: 61235 - protein, 11 aa, Borrelia burgdorferi
ITLASPKPYFI

SEQ ID NO: 61236 - protein, 11 aa, Borrelia burgdorferi
LTWSDGVAITA

SEQ ID NO: 61237 - protein, 11 aa, Borrelia burgdorferi
QLAEDNVASKM

SEQ ID NO: 61238 - protein, 11 aa, Borrelia burgdorferi
DLLVHQSFIPV

SEQ ID NO: 61239 - protein, 11 aa, Borrelia burgdorferi
SSDGTAYPFYL

SEQ ID NO: 61240 - protein, 9 aa, Borrelia burgdorferi
KSYLRILNK

SEQ ID NO: 61241 - protein, 9 aa, Borrelia burgdorferi
NMVTSGPFK

SEQ ID NO: 61242 - protein, 9 aa, Borrelia burgdorferi
VTSGPFKLK

SEQ ID NO: 61243 - protein, 9 aa, Borrelia burgdorferi
GTAYPFYLR

SEQ ID NO: 61244 - protein, 9 aa, Borrelia burgdorferi
AITAEGIRK

SEQ ID NO: 61245 - protein, 9 aa, Borrelia burgdorferi
TTNDSSTAY

SEQ ID NO: 61246 - protein, 9 aa, Borrelia burgdorferi
GSTYVDMVK

SEQ ID NO: 61247 - protein, 9 aa, Borrelia burgdorferi
GGHKPGLAK

SEQ ID NO: 61248 - protein, 9 aa, Borrelia burgdorferi
RSLSLIIFS

SEQ ID NO: 61249 - protein, 10 aa, Borrelia burgdorferi
TTNDSSTAYK

SEQ ID NO: 61250 - protein, 10 aa, Borrelia burgdorferi
MVTSGPFKLK

SEQ ID NO: 61251 - protein, 10 aa, Borrelia burgdorferi
KLKERIPSEK

SEQ ID NO: 61252 - protein, 10 aa, Borrelia burgdorferi
TLEITLASPK

SEQ ID NO: 61253 - protein, 10 aa, Borrelia burgdorferi
YVDMVKSIIK

SEQ ID NO: 61254 - protein, 10 aa, Borrelia burgdorferi
RKSYLRILNK

SEQ ID NO: 61255 - protein, 10 aa, Borrelia burgdorferi
VAITAEGIRK

SEQ ID NO: 61256 - protein, 10 aa, Borrelia burgdorferi
SLTVLCCDNK

SEQ ID NO: 61257 - protein, 10 aa, Borrelia burgdorferi
ILNKETGSTY

SEQ ID NO: 61258 - protein, 10 aa, Borrelia burgdorferi
ENMVTSGPFK

SEQ ID NO: 61259 - protein, 10 aa, Borrelia burgdorferi
ELGIRAIDSK

SEQ ID NO: 61260 - protein, 10 aa, Borrelia burgdorferi
QLAEDNVASK

SEQ ID NO: 61261 - protein, 10 aa, Borrelia burgdorferi
TGGHKPGLAK

SEQ ID NO: 61262 - protein, 10 aa, Borrelia burgdorferi
SSDGTAYPFY

SEQ ID NO: 61263 - protein, 10 aa, Borrelia burgdorferi
VLCCDNKERK

SEQ ID NO: 61264 - protein, 10 aa, Borrelia burgdorferi
TGSTYVDMVK

SEQ ID NO: 61265 - protein, 11 aa, Borrelia burgdorferi
KTLEITLASPK

SEQ ID NO: 61266 - protein, 11 aa, Borrelia burgdorferi
NMVTSGPFKLK

SEQ ID NO: 61267 - protein, 11 aa, Borrelia burgdorferi
GVAITAEGIRK

SEQ ID NO: 61268 - protein, 11 aa, Borrelia burgdorferi
RIPSEKYVFEK

SEQ ID NO: 61269 - protein, 11 aa, Borrelia burgdorferi
YTTNDSSTAYK

SEQ ID NO: 61270 - protein, 11 aa, Borrelia burgdorferi
RILNKETGSTY

SEQ ID NO: 61271 - protein, 11 aa, Borrelia burgdorferi
KLKERIPSEKY

SEQ ID NO: 61272 - protein, 11 aa, Borrelia burgdorferi
VTGDPNTGGHK

SEQ ID NO: 61273 - protein, 11 aa, Borrelia burgdorferi
NTGGHKPGLAK

SEQ ID NO: 61274 - protein, 11 aa, Borrelia burgdorferi
NVASKMIDTLY

SEQ ID NO: 61275 - protein, 11 aa, Borrelia burgdorferi
TSSDGTAYPFY

SEQ ID NO: 61276 - protein, 11 aa, Borrelia burgdorferi
FSLTVLCCDNK

SEQ ID NO: 61277 - protein, 11 aa, Borrelia burgdorferi
FIPVPVHVTDK

SEQ ID NO: 61278 - protein, 9 aa, Borrelia burgdorferi
KSYLRILNK

SEQ ID NO: 61279 - protein, 9 aa, Borrelia burgdorferi
GTAYPFYLR

SEQ ID NO: 61280 - protein, 9 aa, Borrelia burgdorferi
VTSGPFKLK

SEQ ID NO: 61281 - protein, 9 aa, Borrelia burgdorferi
AITAEGIRK

SEQ ID NO: 61282 - protein, 9 aa, Borrelia burgdorferi
GSTYVDMVK

SEQ ID NO: 61283 - protein, 9 aa, Borrelia burgdorferi
TTNDSSTAY

SEQ ID NO: 61284 - protein, 9 aa, Borrelia burgdorferi
NMVTSGPFK

SEQ ID NO: 61285 - protein, 9 aa, Borrelia burgdorferi
LTVLCCDNK

SEQ ID NO: 61286 - protein, 9 aa, Borrelia burgdorferi
ITLASPKPY

SEQ ID NO: 61287 - protein, 9 aa, Borrelia burgdorferi
PSEKYVFEK

SEQ ID NO: 61288 - protein, 9 aa, Borrelia burgdorferi
KISLGAEPR

SEQ ID NO: 61289 - protein, 9 aa, Borrelia burgdorferi
LAEDNVASK

SEQ ID NO: 61290 - protein, 9 aa, Borrelia burgdorferi
TNDSSTAYK

SEQ ID NO: 61291 - protein, 9 aa, Borrelia burgdorferi
ASKMIDTLY

SEQ ID NO: 61292 - protein, 9 aa, Borrelia burgdorferi
VTDSELGIR

SEQ ID NO: 61293 - protein, 9 aa, Borrelia burgdorferi
SIIKNGQEY

SEQ ID NO: 61294 - protein, 10 aa, Borrelia burgdorferi
TTNDSSTAYK

SEQ ID NO: 61295 - protein, 10 aa, Borrelia burgdorferi
MVTSGPFKLK

SEQ ID NO: 61296 - protein, 10 aa, Borrelia burgdorferi
TLEITLASPK

SEQ ID NO: 61297 - protein, 10 aa, Borrelia burgdorferi
VAITAEGIRK

SEQ ID NO: 61298 - protein, 10 aa, Borrelia burgdorferi
YVDMVKSIIK

SEQ ID NO: 61299 - protein, 10 aa, Borrelia burgdorferi
SLTVLCCDNK

SEQ ID NO: 61300 - protein, 10 aa, Borrelia burgdorferi
KLKERIPSEK

SEQ ID NO: 61301 - protein, 10 aa, Borrelia burgdorferi
ASKMIDTLYR

SEQ ID NO: 61302 - protein, 10 aa, Borrelia burgdorferi
SSDGTAYPFY

SEQ ID NO: 61303 - protein, 10 aa, Borrelia burgdorferi
QLAEDNVASK

SEQ ID NO: 61304 - protein, 10 aa, Borrelia burgdorferi
VLCCDNKERK

SEQ ID NO: 61305 - protein, 10 aa, Borrelia burgdorferi
TVLCCDNKER

SEQ ID NO: 61306 - protein, 10 aa, Borrelia burgdorferi
TGSTYVDMVK

SEQ ID NO: 61307 - protein, 10 aa, Borrelia burgdorferi
RKSYLRILNK

SEQ ID NO: 61308 - protein, 10 aa, Borrelia burgdorferi
IPSEKYVFEK

SEQ ID NO: 61309 - protein, 10 aa, Borrelia burgdorferi
TSGPFKLKER

SEQ ID NO: 61310 - protein, 10 aa, Borrelia burgdorferi
QVTDSELGIR

SEQ ID NO: 61311 - protein, 10 aa, Borrelia burgdorferi
GVAITAEGIR

SEQ ID NO: 61312 - protein, 11 aa, Borrelia burgdorferi
KTLEITLASPK

SEQ ID NO: 61313 - protein, 11 aa, Borrelia burgdorferi
GVAITAEGIRK

SEQ ID NO: 61314 - protein, 11 aa, Borrelia burgdorferi
TVLCCDNKERK

SEQ ID NO: 61315 - protein, 11 aa, Borrelia burgdorferi
YTTNDSSTAYK

SEQ ID NO: 61316 - protein, 11 aa, Borrelia burgdorferi
RIPSEKYVFEK

SEQ ID NO: 61317 - protein, 11 aa, Borrelia burgdorferi
VTGDPNTGGHK

SEQ ID NO: 61318 - protein, 11 aa, Borrelia burgdorferi
TSSDGTAYPFY

SEQ ID NO: 61319 - protein, 11 aa, Borrelia burgdorferi
NTGGHKPGLAK

SEQ ID NO: 61320 - protein, 11 aa, Borrelia burgdorferi
FSLTVLCCDNK

SEQ ID NO: 61321 - protein, 11 aa, Borrelia burgdorferi
NMVTSGPFKLK

SEQ ID NO: 61322 - protein, 11 aa, Borrelia burgdorferi
VASKMIDTLYR

SEQ ID NO: 61323 - protein, 11 aa, Borrelia burgdorferi
STKISLGAEPR

SEQ ID NO: 61324 - protein, 11 aa, Borrelia burgdorferi
VTSGPFKLKER

SEQ ID NO: 61325 - protein, 11 aa, Borrelia burgdorferi
ETGSTYVDMVK

SEQ ID NO: 61326 - protein, 11 aa, Borrelia burgdorferi
TAEGIRKSYLR

SEQ ID NO: 61327 - protein, 11 aa, Borrelia burgdorferi
TYVDMVKSIIK

SEQ ID NO: 61328 - protein, 11 aa, Borrelia burgdorferi
NVASKMIDTLY

SEQ ID NO: 61329 - protein, 9 aa, Borrelia burgdorferi
FYLRDNLTW

SEQ ID NO: 61330 - protein, 9 aa, Borrelia burgdorferi
TYVDMVKSI

SEQ ID NO: 61331 - protein, 9 aa, Borrelia burgdorferi
YYDSNEVEL

SEQ ID NO: 61332 - protein, 9 aa, Borrelia burgdorferi
SFIPVPVHV

SEQ ID NO: 61333 - protein, 9 aa, Borrelia burgdorferi
SYLRILNKE

SEQ ID NO: 61334 - protein, 10 aa, Borrelia burgdorferi
TYVDMVKSII

SEQ ID NO: 61335 - protein, 10 aa, Borrelia burgdorferi
MYVNEELDAI

SEQ ID NO: 61336 - protein, 10 aa, Borrelia burgdorferi
AYPFYLRDNL

SEQ ID NO: 61337 - protein, 10 aa, Borrelia burgdorferi
AYKMYVNEEL

SEQ ID NO: 61338 - protein, 10 aa, Borrelia burgdorferi
KYYDSNEVEL

SEQ ID NO: 61339 - protein, 11 aa, Borrelia burgdorferi
YFIDLLVHQSF

SEQ ID NO: 61340 - protein, 11 aa, Borrelia burgdorferi
MYVNEELDAIL

SEQ ID NO: 61341 - protein, 11 aa, Borrelia burgdorferi
ITLASPKPYFI

SEQ ID NO: 61342 - protein, 11 aa, Borrelia burgdorferi
FYTTNDSSTAY

SEQ ID NO: 61343 - protein, 9 aa, Borrelia burgdorferi
YVFEKDNKY

SEQ ID NO: 61344 - protein, 9 aa, Borrelia burgdorferi
ETSSDGTAY

SEQ ID NO: 61345 - protein, 9 aa, Borrelia burgdorferi
SIIKNGQEY

SEQ ID NO: 61346 - protein, 9 aa, Borrelia burgdorferi
TTNDSSTAY

SEQ ID NO: 61347 - protein, 9 aa, Borrelia burgdorferi
VFEKDNKYY

SEQ ID NO: 61348 - protein, 9 aa, Borrelia burgdorferi
ELDAILVPY

SEQ ID NO: 61349 - protein, 9 aa, Borrelia burgdorferi
FYLRDNLTW

SEQ ID NO: 61350 - protein, 9 aa, Borrelia burgdorferi
ASKMIDTLY

SEQ ID NO: 61351 - protein, 9 aa, Borrelia burgdorferi
YFIDLLVHQ

SEQ ID NO: 61352 - protein, 10 aa, Borrelia burgdorferi
YVFEKDNKYY

SEQ ID NO: 61353 - protein, 10 aa, Borrelia burgdorferi
YTTNDSSTAY

SEQ ID NO: 61354 - protein, 10 aa, Borrelia burgdorferi
EVELEEITFY

SEQ ID NO: 61355 - protein, 10 aa, Borrelia burgdorferi
KYVFEKDNKY

SEQ ID NO: 61356 - protein, 10 aa, Borrelia burgdorferi
VASKMIDTLY

SEQ ID NO: 61357 - protein, 10 aa, Borrelia burgdorferi
ILNKETGSTY

SEQ ID NO: 61358 - protein, 10 aa, Borrelia burgdorferi
KSIIKNGQEY

SEQ ID NO: 61359 - protein, 10 aa, Borrelia burgdorferi
PVPVHVTDKY

SEQ ID NO: 61360 - protein, 11 aa, Borrelia burgdorferi
FYTTNDSSTAY

SEQ ID NO: 61361 - protein, 11 aa, Borrelia burgdorferi
YFIDLLVHQSF

SEQ ID NO: 61362 - protein, 11 aa, Borrelia burgdorferi
NVASKMIDTLY

SEQ ID NO: 61363 - protein, 11 aa, Borrelia burgdorferi
KYVFEKDNKYY

SEQ ID NO: 61364 - protein, 11 aa, Borrelia burgdorferi
GWETSSDGTAY

SEQ ID NO: 61365 - protein, 11 aa, Borrelia burgdorferi
RILNKETGSTY

SEQ ID NO: 61366 - protein, 9 aa, Borrelia burgdorferi
GTAYPFYLR

SEQ ID NO: 61367 - protein, 9 aa, Borrelia burgdorferi
LTVLCCDNK

SEQ ID NO: 61368 - protein, 9 aa, Borrelia burgdorferi
NMVTSGPFK

SEQ ID NO: 61369 - protein, 9 aa, Borrelia burgdorferi
GSTYVDMVK

SEQ ID NO: 61370 - protein, 9 aa, Borrelia burgdorferi
TTNDSSTAY

SEQ ID NO: 61371 - protein, 9 aa, Borrelia burgdorferi
EGIRKSYLR

SEQ ID NO: 61372 - protein, 9 aa, Borrelia burgdorferi
VAITAEGIR

SEQ ID NO: 61373 - protein, 9 aa, Borrelia burgdorferi
ETSSDGTAY

SEQ ID NO: 61374 - protein, 9 aa, Borrelia burgdorferi
VTSGPFKLK

SEQ ID NO: 61375 - protein, 9 aa, Borrelia burgdorferi
LAEDNVASK

SEQ ID NO: 61376 - protein, 9 aa, Borrelia burgdorferi
YVFEKDNKY

SEQ ID NO: 61377 - protein, 9 aa, Borrelia burgdorferi
TNDSSTAYK

SEQ ID NO: 61378 - protein, 9 aa, Borrelia burgdorferi
SKMIDTLYR

SEQ ID NO: 61379 - protein, 9 aa, Borrelia burgdorferi
KISLGAEPR

SEQ ID NO: 61380 - protein, 9 aa, Borrelia burgdorferi
KSYLRILNK

SEQ ID NO: 61381 - protein, 9 aa, Borrelia burgdorferi
VLCCDNKER

SEQ ID NO: 61382 - protein, 9 aa, Borrelia burgdorferi
PSEKYVFEK

SEQ ID NO: 61383 - protein, 10 aa, Borrelia burgdorferi
TTNDSSTAYK

SEQ ID NO: 61384 - protein, 10 aa, Borrelia burgdorferi
MVTSGPFKLK

SEQ ID NO: 61385 - protein, 10 aa, Borrelia burgdorferi
TVLCCDNKER

SEQ ID NO: 61386 - protein, 10 aa, Borrelia burgdorferi
DGTAYPFYLR

SEQ ID NO: 61387 - protein, 10 aa, Borrelia burgdorferi
QVTDSELGIR

SEQ ID NO: 61388 - protein, 10 aa, Borrelia burgdorferi
YTTNDSSTAY

SEQ ID NO: 61389 - protein, 10 aa, Borrelia burgdorferi
ASKMIDTLYR

SEQ ID NO: 61390 - protein, 10 aa, Borrelia burgdorferi
TSGPFKLKER

SEQ ID NO: 61391 - protein, 10 aa, Borrelia burgdorferi
ENMVTSGPFK

SEQ ID NO: 61392 - protein, 10 aa, Borrelia burgdorferi
GVAITAEGIR

SEQ ID NO: 61393 - protein, 10 aa, Borrelia burgdorferi
YVFEKDNKYY

SEQ ID NO: 61394 - protein, 10 aa, Borrelia burgdorferi
YVDMVKSIIK

SEQ ID NO: 61395 - protein, 10 aa, Borrelia burgdorferi
QLAEDNVASK

SEQ ID NO: 61396 - protein, 10 aa, Borrelia burgdorferi
TGSTYVDMVK

SEQ ID NO: 61397 - protein, 10 aa, Borrelia burgdorferi
SLTVLCCDNK

SEQ ID NO: 61398 - protein, 10 aa, Borrelia burgdorferi
IPSEKYVFEK

SEQ ID NO: 61399 - protein, 10 aa, Borrelia burgdorferi
EVELEEITFY

SEQ ID NO: 61400 - protein, 10 aa, Borrelia burgdorferi
TLEITLASPK

SEQ ID NO: 61401 - protein, 10 aa, Borrelia burgdorferi
ITAEGIRKSY

SEQ ID NO: 61402 - protein, 10 aa, Borrelia burgdorferi
TKISLGAEPR

SEQ ID NO: 61403 - protein, 10 aa, Borrelia burgdorferi
VAITAEGIRK

SEQ ID NO: 61404 - protein, 10 aa, Borrelia burgdorferi
ELGIRAIDSK

SEQ ID NO: 61405 - protein, 10 aa, Borrelia burgdorferi
TAYKMYVNEE

SEQ ID NO: 61406 - protein, 10 aa, Borrelia burgdorferi
EKYVFEKDNK

SEQ ID NO: 61407 - protein, 10 aa, Borrelia burgdorferi
STAYKMYVNE

SEQ ID NO: 61408 - protein, 10 aa, Borrelia burgdorferi
MVKSIIKNGQ

SEQ ID NO: 61409 - protein, 10 aa, Borrelia burgdorferi
VASKMIDTLY

SEQ ID NO: 61410 - protein, 10 aa, Borrelia burgdorferi
IPVPVHVTDK

SEQ ID NO: 61411 - protein, 10 aa, Borrelia burgdorferi
EITLASPKPY

SEQ ID NO: 61412 - protein, 11 aa, Borrelia burgdorferi
YTTNDSSTAYK

SEQ ID NO: 61413 - protein, 11 aa, Borrelia burgdorferi
TAEGIRKSYLR

SEQ ID NO: 61414 - protein, 11 aa, Borrelia burgdorferi
LTVLCCDNKER

SEQ ID NO: 61415 - protein, 11 aa, Borrelia burgdorferi
ETGSTYVDMVK

SEQ ID NO: 61416 - protein, 11 aa, Borrelia burgdorferi
STKISLGAEPR

SEQ ID NO: 61417 - protein, 11 aa, Borrelia burgdorferi
TVLCCDNKERK

SEQ ID NO: 61418 - protein, 11 aa, Borrelia burgdorferi
VASKMIDTLYR

SEQ ID NO: 61419 - protein, 11 aa, Borrelia burgdorferi
TSSDGTAYPFY

SEQ ID NO: 61420 - protein, 11 aa, Borrelia burgdorferi
NVASKMIDTLY

SEQ ID NO: 61421 - protein, 11 aa, Borrelia burgdorferi
VTSGPFKLKER

SEQ ID NO: 61422 - protein, 11 aa, Borrelia burgdorferi
DGVAITAEGIR

SEQ ID NO: 61423 - protein, 11 aa, Borrelia burgdorferi
FSLTVLCCDNK

SEQ ID NO: 61424 - protein, 11 aa, Borrelia burgdorferi
NMVTSGPFKLK

SEQ ID NO: 61425 - protein, 11 aa, Borrelia burgdorferi
KTLEITLASPK

SEQ ID NO: 61426 - protein, 11 aa, Borrelia burgdorferi
TYVDMVKSIIK

SEQ ID NO: 61427 - protein, 11 aa, Borrelia burgdorferi
NTGGHKPGLAK

SEQ ID NO: 61428 - protein, 11 aa, Borrelia burgdorferi
GVAITAEGIRK

SEQ ID NO: 61429 - protein, 11 aa, Borrelia burgdorferi
RIPSEKYVFEK

SEQ ID NO: 61430 - protein, 11 aa, Borrelia burgdorferi
STAYKMYVNEE

SEQ ID NO: 61431 - protein, 11 aa, Borrelia burgdorferi
ETSSDGTAYPF

SEQ ID NO: 61432 - protein, 11 aa, Borrelia burgdorferi
FIPVPVHVTDK

SEQ ID NO: 61433 - protein, 11 aa, Borrelia burgdorferi
MVTSGPFKLKE

SEQ ID NO: 61434 - protein, 11 aa, Borrelia burgdorferi
TTNDSSTAYKM

SEQ ID NO: 61435 - protein, 9 aa, Borrelia burgdorferi
YPFYLRDNL

SEQ ID NO: 61436 - protein, 9 aa, Borrelia burgdorferi
SPKPYFIDL

SEQ ID NO: 61437 - protein, 9 aa, Borrelia burgdorferi
KPYFIDLLV

SEQ ID NO: 61438 - protein, 9 aa, Borrelia burgdorferi
EPRSLDPQL

SEQ ID NO: 61439 - protein, 9 aa, Borrelia burgdorferi
SPENMVTSG

SEQ ID NO: 61440 - protein, 10 aa, Borrelia burgdorferi
SPKPYFIDLL

SEQ ID NO: 61441 - protein, 10 aa, Borrelia burgdorferi
RAIDSKTLEI

SEQ ID NO: 61442 - protein, 10 aa, Borrelia burgdorferi
GIRKSYLRIL

SEQ ID NO: 61443 - protein, 10 aa, Borrelia burgdorferi
KPGLAKGWET

SEQ ID NO: 61444 - protein, 11 aa, Borrelia burgdorferi
SPENMVTSGPF

SEQ ID NO: 61445 - protein, 11 aa, Borrelia burgdorferi
YPFYLRDNLTW

SEQ ID NO: 61446 - protein, 11 aa, Borrelia burgdorferi
SPKPYFIDLLV

SEQ ID NO: 61447 - protein, 11 aa, Borrelia burgdorferi
KISLGAEPRSL

SEQ ID NO: 61448 - protein, 9 aa, Borrelia burgdorferi
YVFEKDNKY

SEQ ID NO: 61449 - protein, 9 aa, Borrelia burgdorferi
TTNDSSTAY

SEQ ID NO: 61450 - protein, 9 aa, Borrelia burgdorferi
ITLASPKPY

SEQ ID NO: 61451 - protein, 9 aa, Borrelia burgdorferi
LNKETGSTY

SEQ ID NO: 61452 - protein, 9 aa, Borrelia burgdorferi
SIIKNGQEY

SEQ ID NO: 61453 - protein, 9 aa, Borrelia burgdorferi
IIKNGQEYF

SEQ ID NO: 61454 - protein, 9 aa, Borrelia burgdorferi
ASKMIDTLY

SEQ ID NO: 61455 - protein, 9 aa, Borrelia burgdorferi
LQRSLSLII

SEQ ID NO: 61456 - protein, 9 aa, Borrelia burgdorferi
ETSSDGTAY

SEQ ID NO: 61457 - protein, 9 aa, Borrelia burgdorferi
TLASPKPYF

SEQ ID NO: 61458 - protein, 9 aa, Borrelia burgdorferi
ENMVTSGPF

SEQ ID NO: 61459 - protein, 9 aa, Borrelia burgdorferi
SLSLIIFSL

SEQ ID NO: 61460 - protein, 10 aa, Borrelia burgdorferi
YVFEKDNKYY

SEQ ID NO: 61461 - protein, 10 aa, Borrelia burgdorferi
LQRSLSLIIF

SEQ ID NO: 61462 - protein, 10 aa, Borrelia burgdorferi
ITAEGIRKSY

SEQ ID NO: 61463 - protein, 10 aa, Borrelia burgdorferi
YTTNDSSTAY

SEQ ID NO: 61464 - protein, 10 aa, Borrelia burgdorferi
ILNKETGSTY

SEQ ID NO: 61465 - protein, 10 aa, Borrelia burgdorferi
TSSDGTAYPF

SEQ ID NO: 61466 - protein, 10 aa, Borrelia burgdorferi
KSIIKNGQEY

SEQ ID NO: 61467 - protein, 10 aa, Borrelia burgdorferi
HQSFIPVPVH

SEQ ID NO: 61468 - protein, 10 aa, Borrelia burgdorferi
SIIKNGQEYF

SEQ ID NO: 61469 - protein, 10 aa, Borrelia burgdorferi
GQNWTSPENM

SEQ ID NO: 61470 - protein, 10 aa, Borrelia burgdorferi
ITLASPKPYF

SEQ ID NO: 61471 - protein, 10 aa, Borrelia burgdorferi
YVNEELDAIL

SEQ ID NO: 61472 - protein, 10 aa, Borrelia burgdorferi
SLIIFSLTVL

SEQ ID NO: 61473 - protein, 10 aa, Borrelia burgdorferi
KMIDTLYRGI

SEQ ID NO: 61474 - protein, 10 aa, Borrelia burgdorferi
WETSSDGTAY

SEQ ID NO: 61475 - protein, 11 aa, Borrelia burgdorferi
KLKERIPSEKY

SEQ ID NO: 61476 - protein, 11 aa, Borrelia burgdorferi
YFIDLLVHQSF

SEQ ID NO: 61477 - protein, 11 aa, Borrelia burgdorferi
KLQRSLSLIIF

SEQ ID NO: 61478 - protein, 11 aa, Borrelia burgdorferi
RILNKETGSTY

SEQ ID NO: 61479 - protein, 11 aa, Borrelia burgdorferi
TSSDGTAYPFY

SEQ ID NO: 61480 - protein, 11 aa, Borrelia burgdorferi
AITAEGIRKSY

SEQ ID NO: 61481 - protein, 11 aa, Borrelia burgdorferi
KSIIKNGQEYF

SEQ ID NO: 61482 - protein, 11 aa, Borrelia burgdorferi
LEITLASPKPY

SEQ ID NO: 61483 - protein, 11 aa, Borrelia burgdorferi
QLAEDNVASKM

SEQ ID NO: 61484 - protein, 11 aa, Borrelia burgdorferi
ETSSDGTAYPF

SEQ ID NO: 61485 - protein, 9 aa, Borrelia burgdorferi
QRSLSLIIF

SEQ ID NO: 61486 - protein, 10 aa, Borrelia burgdorferi
RKSYLRILNK

SEQ ID NO: 61487 - protein, 11 aa, Borrelia burgdorferi
QRSLSLIIFSL

SEQ ID NO: 61488 - protein, 11 aa, Borrelia burgdorferi
RKEGVSTKISL

SEQ ID NO: 61489 - protein, 11 aa, Borrelia burgdorferi
IRKSYLRILNK

SEQ ID NO: 61490 - protein, 9 aa, Borrelia burgdorferi
VPVHVTDKY

SEQ ID NO: 61491 - protein, 9 aa, Borrelia burgdorferi
TTNDSSTAY

SEQ ID NO: 61492 - protein, 9 aa, Borrelia burgdorferi
ETSSDGTAY

SEQ ID NO: 61493 - protein, 9 aa, Borrelia burgdorferi
YVFEKDNKY

SEQ ID NO: 61494 - protein, 9 aa, Borrelia burgdorferi
EVELEEITF

SEQ ID NO: 61495 - protein, 9 aa, Borrelia burgdorferi
YPFYLRDNL

SEQ ID NO: 61496 - protein, 9 aa, Borrelia burgdorferi
YVNEELDAI

SEQ ID NO: 61497 - protein, 9 aa, Borrelia burgdorferi
ELDAILVPY

SEQ ID NO: 61498 - protein, 9 aa, Borrelia burgdorferi
TAEGIRKSY

SEQ ID NO: 61499 - protein, 9 aa, Borrelia burgdorferi
LTWSDGVAI

SEQ ID NO: 61500 - protein, 9 aa, Borrelia burgdorferi
EPRSLDPQL

SEQ ID NO: 61501 - protein, 9 aa, Borrelia burgdorferi
DSSTAYKMY

SEQ ID NO: 61502 - protein, 9 aa, Borrelia burgdorferi
VASKMIDTL

SEQ ID NO: 61503 - protein, 9 aa, Borrelia burgdorferi
SSDGTAYPF

SEQ ID NO: 61504 - protein, 9 aa, Borrelia burgdorferi
SIIKNGQEY

SEQ ID NO: 61505 - protein, 9 aa, Borrelia burgdorferi
ENMVTSGPF

SEQ ID NO: 61506 - protein, 10 aa, Borrelia burgdorferi
YTTNDSSTAY

SEQ ID NO: 61507 - protein, 10 aa, Borrelia burgdorferi
YVNEELDAIL

SEQ ID NO: 61508 - protein, 10 aa, Borrelia burgdorferi
VASKMIDTLY

SEQ ID NO: 61509 - protein, 10 aa, Borrelia burgdorferi
TSSDGTAYPF

SEQ ID NO: 61510 - protein, 10 aa, Borrelia burgdorferi
YVFEKDNKYY

SEQ ID NO: 61511 - protein, 10 aa, Borrelia burgdorferi
YPFYLRDNLT

SEQ ID NO: 61512 - protein, 10 aa, Borrelia burgdorferi
WETSSDGTAY

SEQ ID NO: 61513 - protein, 10 aa, Borrelia burgdorferi
LAEDNVASKM

SEQ ID NO: 61514 - protein, 10 aa, Borrelia burgdorferi
EVELEEITFY

SEQ ID NO: 61515 - protein, 10 aa, Borrelia burgdorferi
EELDAILVPY

SEQ ID NO: 61516 - protein, 10 aa, Borrelia burgdorferi
KPYFIDLLVH

SEQ ID NO: 61517 - protein, 10 aa, Borrelia burgdorferi
EITLASPKPY

SEQ ID NO: 61518 - protein, 10 aa, Borrelia burgdorferi
DPQLAEDNVA

SEQ ID NO: 61519 - protein, 10 aa, Borrelia burgdorferi
NEVELEEITF

SEQ ID NO: 61520 - protein, 10 aa, Borrelia burgdorferi
FIDLLVHQSF

SEQ ID NO: 61521 - protein, 10 aa, Borrelia burgdorferi
ILNKETGSTY

SEQ ID NO: 61522 - protein, 10 aa, Borrelia burgdorferi
SPKPYFIDLL

SEQ ID NO: 61523 - protein, 10 aa, Borrelia burgdorferi
LTWSDGVAIT

SEQ ID NO: 61524 - protein, 11 aa, Borrelia burgdorferi
SPENMVTSGPF

SEQ ID NO: 61525 - protein, 11 aa, Borrelia burgdorferi
IPVPVHVTDKY

SEQ ID NO: 61526 - protein, 11 aa, Borrelia burgdorferi
YPFYLRDNLTW

SEQ ID NO: 61527 - protein, 11 aa, Borrelia burgdorferi
FYTTNDSSTAY

SEQ ID NO: 61528 - protein, 11 aa, Borrelia burgdorferi
ETSSDGTAYPF

SEQ ID NO: 61529 - protein, 11 aa, Borrelia burgdorferi
TSSDGTAYPFY

SEQ ID NO: 61530 - protein, 11 aa, Borrelia burgdorferi
DPNTGGHKPGL

SEQ ID NO: 61531 - protein, 11 aa, Borrelia burgdorferi
YFIDLLVHQSF

SEQ ID NO: 61532 - protein, 11 aa, Borrelia burgdorferi
NVASKMIDTLY

SEQ ID NO: 61533 - protein, 11 aa, Borrelia burgdorferi
DPQLAEDNVAS

SEQ ID NO: 61534 - protein, 11 aa, Borrelia burgdorferi
TTNDSSTAYKM

SEQ ID NO: 61535 - protein, 11 aa, Borrelia burgdorferi
MYVNEELDAIL

SEQ ID NO: 61536 - protein, 11 aa, Borrelia burgdorferi
NEVELEEITFY

SEQ ID NO: 61537 - protein, 11 aa, Borrelia burgdorferi
NEELDAILVPY

SEQ ID NO: 61538 - protein, 11 aa, Borrelia burgdorferi
TAYKMYVNEEL

SEQ ID NO: 61539 - protein, 11 aa, Borrelia burgdorferi
YFDGQVTDSEL

SEQ ID NO: 61540 - protein, 11 aa, Borrelia burgdorferi
LEITLASPKPY

SEQ ID NO: 61541 - protein, 9 aa, Borrelia burgdorferi
EELDAILVP

SEQ ID NO: 61542 - protein, 9 aa, Borrelia burgdorferi
EEITFYTTN

SEQ ID NO: 61543 - protein, 9 aa, Borrelia burgdorferi
AEDNVASKM

SEQ ID NO: 61544 - protein, 9 aa, Borrelia burgdorferi
AEGIRKSYL

SEQ ID NO: 61545 - protein, 9 aa, Borrelia burgdorferi
VELEEITFY

SEQ ID NO: 61546 - protein, 10 aa, Borrelia burgdorferi
EELDAILVPY

SEQ ID NO: 61547 - protein, 10 aa, Borrelia burgdorferi
NEVELEEITF

SEQ ID NO: 61548 - protein, 10 aa, Borrelia burgdorferi
EEITFYTTND

SEQ ID NO: 61549 - protein, 10 aa, Borrelia burgdorferi
AEPRSLDPQL

SEQ ID NO: 61550 - protein, 10 aa, Borrelia burgdorferi
AEDNVASKMI

SEQ ID NO: 61551 - protein, 10 aa, Borrelia burgdorferi
PENMVTSGPF

SEQ ID NO: 61552 - protein, 10 aa, Borrelia burgdorferi
WETSSDGTAY

SEQ ID NO: 61553 - protein, 11 aa, Borrelia burgdorferi
EEITFYTTNDS

SEQ ID NO: 61554 - protein, 11 aa, Borrelia burgdorferi
NEVELEEITFY

SEQ ID NO: 61555 - protein, 11 aa, Borrelia burgdorferi
LEITLASPKPY

SEQ ID NO: 61556 - protein, 11 aa, Borrelia burgdorferi
EELDAILVPYP

SEQ ID NO: 61557 - protein, 11 aa, Borrelia burgdorferi
AEGIRKSYLRI

SEQ ID NO: 61558 - protein, 11 aa, Borrelia burgdorferi
NEELDAILVPY

SEQ ID NO: 61559 - protein, 11 aa, Borrelia burgdorferi
AEPRSLDPQLA

SEQ ID NO: 61560 - protein, 9 aa, Borrelia burgdorferi
KPYFIDLLV

SEQ ID NO: 61561 - protein, 9 aa, Borrelia burgdorferi
IPVPVHVTD

SEQ ID NO: 61562 - protein, 9 aa, Borrelia burgdorferi
GPFKLKERI

SEQ ID NO: 61563 - protein, 9 aa, Borrelia burgdorferi
LASPKPYFI

SEQ ID NO: 61564 - protein, 11 aa, Borrelia burgdorferi
IPVPVHVTDKY

SEQ ID NO: 61565 - protein, 11 aa, Borrelia burgdorferi
SPKPYFIDLLV

SEQ ID NO: 61566 - protein, 9 aa, Borrelia burgdorferi
VTDKYGQNW

SEQ ID NO: 61567 - protein, 10 aa, Borrelia burgdorferi B31
FSSVISCKLY

SEQ ID NO: 61568 - protein, 10 aa, Borrelia burgdorferi B31
NSNASRHESY

SEQ ID NO: 61569 - protein, 10 aa, Borrelia burgdorferi B31
MSSTKSLLEV

SEQ ID NO: 61570 - protein, 11 aa, Borrelia burgdorferi B31
MTEIESSKEEY

SEQ ID NO: 61571 - protein, 11 aa, Borrelia burgdorferi B31
NSNASRHESYY

SEQ ID NO: 61572 - protein, 11 aa, Borrelia burgdorferi B31
ISCKLYKKITY

SEQ ID NO: 61573 - protein, 9 aa, Borrelia burgdorferi B31
FMADAKASM

SEQ ID NO: 61574 - protein, 9 aa, Borrelia burgdorferi B31
ALLPSLEEA

SEQ ID NO: 61575 - protein, 9 aa, Borrelia burgdorferi B31
SLEEAIAKV

SEQ ID NO: 61576 - protein, 9 aa, Borrelia burgdorferi B31
NLINKLFIL

SEQ ID NO: 61577 - protein, 9 aa, Borrelia burgdorferi B31
FILTILFSS

SEQ ID NO: 61578 - protein, 9 aa, Borrelia burgdorferi B31
ILTILFSSV

SEQ ID NO: 61579 - protein, 9 aa, Borrelia burgdorferi B31
RINEDLAKV

SEQ ID NO: 61580 - protein, 9 aa, Borrelia burgdorferi B31
LLSTAKSYL

SEQ ID NO: 61581 - protein, 9 aa, Borrelia burgdorferi B31
SLDKIKSLL

SEQ ID NO: 61582 - protein, 9 aa, Borrelia burgdorferi B31
LMADMQPDM

SEQ ID NO: 61583 - protein, 9 aa, Borrelia burgdorferi B31
LLPSLEEAI

SEQ ID NO: 61584 - protein, 9 aa, Borrelia burgdorferi B31
SMSSTKSLL

SEQ ID NO: 61585 - protein, 9 aa, Borrelia burgdorferi B31
ILFSSVISC

SEQ ID NO: 61586 - protein, 9 aa, Borrelia burgdorferi B31
YAGYHQFMA

SEQ ID NO: 61587 - protein, 9 aa, Borrelia burgdorferi B31
KITYNADQV

SEQ ID NO: 61588 - protein, 10 aa, Borrelia burgdorferi B31
FILTILFSSV

SEQ ID NO: 61589 - protein, 10 aa, Borrelia burgdorferi B31
KLYKKITYNA

SEQ ID NO: 61590 - protein, 10 aa, Borrelia burgdorferi B31
ALLPSLEEAI

SEQ ID NO: 61591 - protein, 10 aa, Borrelia burgdorferi B31
SLLSTAKSYL

SEQ ID NO: 61592 - protein, 10 aa, Borrelia burgdorferi B31
KLFILTILFS

SEQ ID NO: 61593 - protein, 10 aa, Borrelia burgdorferi B31
LINKLFILTI

SEQ ID NO: 61594 - protein, 10 aa, Borrelia burgdorferi B31
NLINKLFILT

SEQ ID NO: 61595 - protein, 10 aa, Borrelia burgdorferi B31
FMADAKASMS

SEQ ID NO: 61596 - protein, 10 aa, Borrelia burgdorferi B31
ILTILFSSVI

SEQ ID NO: 61597 - protein, 10 aa, Borrelia burgdorferi B31
MSSTKSLLEV

SEQ ID NO: 61598 - protein, 10 aa, Borrelia burgdorferi B31
KANLALLPSL

SEQ ID NO: 61599 - protein, 10 aa, Borrelia burgdorferi B31
LLPSLEEAIA

SEQ ID NO: 61600 - protein, 11 aa, Borrelia burgdorferi B31
FILTILFSSVI

SEQ ID NO: 61601 - protein, 11 aa, Borrelia burgdorferi B31
SMSSTKSLLEV

SEQ ID NO: 61602 - protein, 11 aa, Borrelia burgdorferi B31
NLINKLFILTI

SEQ ID NO: 61603 - protein, 11 aa, Borrelia burgdorferi B31
ILFSSVISCKL

SEQ ID NO: 61604 - protein, 11 aa, Borrelia burgdorferi B31
KLFILTILFSS

SEQ ID NO: 61605 - protein, 11 aa, Borrelia burgdorferi B31
ALLPSLEEAIA

SEQ ID NO: 61606 - protein, 11 aa, Borrelia burgdorferi B31
YMDQDTGKKPL

SEQ ID NO: 61607 - protein, 11 aa, Borrelia burgdorferi B31
FMADAKASMSS

SEQ ID NO: 61608 - protein, 11 aa, Borrelia burgdorferi B31
LINKLFILTIL

SEQ ID NO: 61609 - protein, 11 aa, Borrelia burgdorferi B31
NLALLPSLEEA

SEQ ID NO: 61610 - protein, 11 aa, Borrelia burgdorferi B31
SLDKIKSLLST

SEQ ID NO: 61611 - protein, 11 aa, Borrelia burgdorferi B31
ALEEALSNSNA

SEQ ID NO: 61612 - protein, 11 aa, Borrelia burgdorferi B31
YYYAGYHQFMA

SEQ ID NO: 61613 - protein, 9 aa, Borrelia burgdorferi B31
SVISCKLYK

SEQ ID NO: 61614 - protein, 9 aa, Borrelia burgdorferi B31
SLLEVAKNK

SEQ ID NO: 61615 - protein, 9 aa, Borrelia burgdorferi B31
VISCKLYKK

SEQ ID NO: 61616 - protein, 9 aa, Borrelia burgdorferi B31
IMTEIESSK

SEQ ID NO: 61617 - protein, 9 aa, Borrelia burgdorferi B31
KSYLEQTRR

SEQ ID NO: 61618 - protein, 9 aa, Borrelia burgdorferi B31
KLYKKITYN

SEQ ID NO: 61619 - protein, 9 aa, Borrelia burgdorferi B31
AIAALKRAK

SEQ ID NO: 61620 - protein, 9 aa, Borrelia burgdorferi B31
LFSSVISCK

SEQ ID NO: 61621 - protein, 9 aa, Borrelia burgdorferi B31
ALSNSNASR

SEQ ID NO: 61622 - protein, 9 aa, Borrelia burgdorferi B31
KLFILTILF

SEQ ID NO: 61623 - protein, 9 aa, Borrelia burgdorferi B31
SLLSTAKSY

SEQ ID NO: 61624 - protein, 10 aa, Borrelia burgdorferi B31
ILFSSVISCK

SEQ ID NO: 61625 - protein, 10 aa, Borrelia burgdorferi B31
KIKSLLSTAK

SEQ ID NO: 61626 - protein, 10 aa, Borrelia burgdorferi B31
QTRRGVGSSK

SEQ ID NO: 61627 - protein, 10 aa, Borrelia burgdorferi B31
SSVISCKLYK

SEQ ID NO: 61628 - protein, 10 aa, Borrelia burgdorferi B31
NIMTEIESSK

SEQ ID NO: 61629 - protein, 10 aa, Borrelia burgdorferi B31
SVISCKLYKK

SEQ ID NO: 61630 - protein, 10 aa, Borrelia burgdorferi B31
KSLLEVAKNK

SEQ ID NO: 61631 - protein, 10 aa, Borrelia burgdorferi B31
LAKVKASLDK

SEQ ID NO: 61632 - protein, 10 aa, Borrelia burgdorferi B31
STKSLLEVAK

SEQ ID NO: 61633 - protein, 10 aa, Borrelia burgdorferi B31
HCNDAIAALK

SEQ ID NO: 61634 - protein, 10 aa, Borrelia burgdorferi B31
KSLLSTAKSY

SEQ ID NO: 61635 - protein, 10 aa, Borrelia burgdorferi B31
SNNGSFNTLK

SEQ ID NO: 61636 - protein, 10 aa, Borrelia burgdorferi B31
LLEVAKNKQK

SEQ ID NO: 61637 - protein, 10 aa, Borrelia burgdorferi B31
GYHQFMADAK

SEQ ID NO: 61638 - protein, 10 aa, Borrelia burgdorferi B31
TYMDQDTGKK

SEQ ID NO: 61639 - protein, 10 aa, Borrelia burgdorferi B31
KLFILTILFS

SEQ ID NO: 61640 - protein, 10 aa, Borrelia burgdorferi B31
SLEEAIAKVK

SEQ ID NO: 61641 - protein, 10 aa, Borrelia burgdorferi B31
NTYMDQDTGK

SEQ ID NO: 61642 - protein, 10 aa, Borrelia burgdorferi B31
DAKASMSSTK

SEQ ID NO: 61643 - protein, 10 aa, Borrelia burgdorferi B31
RINEDLAKVK

SEQ ID NO: 61644 - protein, 10 aa, Borrelia burgdorferi B31
SMSSTKSLLE

SEQ ID NO: 61645 - protein, 11 aa, Borrelia burgdorferi B31
KSNNGSFNTLK

SEQ ID NO: 61646 - protein, 11 aa, Borrelia burgdorferi B31
TILFSSVISCK

SEQ ID NO: 61647 - protein, 11 aa, Borrelia burgdorferi B31
ITYNADQVIDK

SEQ ID NO: 61648 - protein, 11 aa, Borrelia burgdorferi B31
SLLEVAKNKQK

SEQ ID NO: 61649 - protein, 11 aa, Borrelia burgdorferi B31
FSSVISCKLYK

SEQ ID NO: 61650 - protein, 11 aa, Borrelia burgdorferi B31
NTYMDQDTGKK

SEQ ID NO: 61651 - protein, 11 aa, Borrelia burgdorferi B31
ELNENMTKTNK

SEQ ID NO: 61652 - protein, 11 aa, Borrelia burgdorferi B31
KQKELNENMTK

SEQ ID NO: 61653 - protein, 11 aa, Borrelia burgdorferi B31
LLPSLEEAIAK

SEQ ID NO: 61654 - protein, 11 aa, Borrelia burgdorferi B31
SSTKSLLEVAK

SEQ ID NO: 61655 - protein, 11 aa, Borrelia burgdorferi B31
KLFILTILFSS

SEQ ID NO: 61656 - protein, 11 aa, Borrelia burgdorferi B31
DLAKVKASLDK

SEQ ID NO: 61657 - protein, 11 aa, Borrelia burgdorferi B31
AGYHQFMADAK

SEQ ID NO: 61658 - protein, 9 aa, Borrelia burgdorferi B31
SVISCKLYK

SEQ ID NO: 61659 - protein, 9 aa, Borrelia burgdorferi B31
VISCKLYKK

SEQ ID NO: 61660 - protein, 9 aa, Borrelia burgdorferi B31
AIAALKRAK

SEQ ID NO: 61661 - protein, 9 aa, Borrelia burgdorferi B31
SLLEVAKNK

SEQ ID NO: 61662 - protein, 9 aa, Borrelia burgdorferi B31
KSYLEQTRR

SEQ ID NO: 61663 - protein, 9 aa, Borrelia burgdorferi B31
IMTEIESSK

SEQ ID NO: 61664 - protein, 9 aa, Borrelia burgdorferi B31
LFSSVISCK

SEQ ID NO: 61665 - protein, 9 aa, Borrelia burgdorferi B31
ALSNSNASR

SEQ ID NO: 61666 - protein, 9 aa, Borrelia burgdorferi B31
TYMDQDTGK

SEQ ID NO: 61667 - protein, 9 aa, Borrelia burgdorferi B31
PSLEEAIAK

SEQ ID NO: 61668 - protein, 9 aa, Borrelia burgdorferi B31
TLKSNDDSK

SEQ ID NO: 61669 - protein, 9 aa, Borrelia burgdorferi B31
ASRHESYYY

SEQ ID NO: 61670 - protein, 9 aa, Borrelia burgdorferi B31
STAKSYLEQ

SEQ ID NO: 61671 - protein, 9 aa, Borrelia burgdorferi B31
FQELNDIYK

SEQ ID NO: 61672 - protein, 9 aa, Borrelia burgdorferi B31
YMDQDTGKK

SEQ ID NO: 61673 - protein, 10 aa, Borrelia burgdorferi B31
SVISCKLYKK

SEQ ID NO: 61674 - protein, 10 aa, Borrelia burgdorferi B31
ILFSSVISCK

SEQ ID NO: 61675 - protein, 10 aa, Borrelia burgdorferi B31
SSVISCKLYK

SEQ ID NO: 61676 - protein, 10 aa, Borrelia burgdorferi B31
STKSLLEVAK

SEQ ID NO: 61677 - protein, 10 aa, Borrelia burgdorferi B31
KSLLEVAKNK

SEQ ID NO: 61678 - protein, 10 aa, Borrelia burgdorferi B31
KIKSLLSTAK

SEQ ID NO: 61679 - protein, 10 aa, Borrelia burgdorferi B31
NTYMDQDTGK

SEQ ID NO: 61680 - protein, 10 aa, Borrelia burgdorferi B31
NIMTEIESSK

SEQ ID NO: 61681 - protein, 10 aa, Borrelia burgdorferi B31
RINEDLAKVK

SEQ ID NO: 61682 - protein, 10 aa, Borrelia burgdorferi B31
KVKASLDKIK

SEQ ID NO: 61683 - protein, 10 aa, Borrelia burgdorferi B31
SNNGSFNTLK

SEQ ID NO: 61684 - protein, 10 aa, Borrelia burgdorferi B31
NTLKSNDDSK

SEQ ID NO: 61685 - protein, 10 aa, Borrelia burgdorferi B31
TYMDQDTGKK

SEQ ID NO: 61686 - protein, 10 aa, Borrelia burgdorferi B31
TYNADQVIDK

SEQ ID NO: 61687 - protein, 10 aa, Borrelia burgdorferi B31
QTRRGVGSSK

SEQ ID NO: 61688 - protein, 10 aa, Borrelia burgdorferi B31
SLEEAIAKVK

SEQ ID NO: 61689 - protein, 10 aa, Borrelia burgdorferi B31
KSLLSTAKSY

SEQ ID NO: 61690 - protein, 10 aa, Borrelia burgdorferi B31
LAKVKASLDK

SEQ ID NO: 61691 - protein, 10 aa, Borrelia burgdorferi B31
GYHQFMADAK

SEQ ID NO: 61692 - protein, 11 aa, Borrelia burgdorferi B31
TILFSSVISCK

SEQ ID NO: 61693 - protein, 11 aa, Borrelia burgdorferi B31
KSNNGSFNTLK

SEQ ID NO: 61694 - protein, 11 aa, Borrelia burgdorferi B31
SSTKSLLEVAK

SEQ ID NO: 61695 - protein, 11 aa, Borrelia burgdorferi B31
ITYNADQVIDK

SEQ ID NO: 61696 - protein, 11 aa, Borrelia burgdorferi B31
NTYMDQDTGKK

SEQ ID NO: 61697 - protein, 11 aa, Borrelia burgdorferi B31
SSVISCKLYKK

SEQ ID NO: 61698 - protein, 11 aa, Borrelia burgdorferi B31
FSSVISCKLYK

SEQ ID NO: 61699 - protein, 11 aa, Borrelia burgdorferi B31
SLLEVAKNKQK

SEQ ID NO: 61700 - protein, 11 aa, Borrelia burgdorferi B31
STAKSYLEQTR

SEQ ID NO: 61701 - protein, 11 aa, Borrelia burgdorferi B31
AGYHQFMADAK

SEQ ID NO: 61702 - protein, 11 aa, Borrelia burgdorferi B31
KQKELNENMTK

SEQ ID NO: 61703 - protein, 11 aa, Borrelia burgdorferi B31
KSNDDSKRSGR

SEQ ID NO: 61704 - protein, 11 aa, Borrelia burgdorferi B31
NSNASRHESYY

SEQ ID NO: 61705 - protein, 11 aa, Borrelia burgdorferi B31
ELNENMTKTNK

SEQ ID NO: 61706 - protein, 11 aa, Borrelia burgdorferi B31
LLPSLEEAIAK

SEQ ID NO: 61707 - protein, 11 aa, Borrelia burgdorferi B31
RNIMTEIESSK

SEQ ID NO: 61708 - protein, 11 aa, Borrelia burgdorferi B31
TAKSYLEQTRR

SEQ ID NO: 61709 - protein, 11 aa, Borrelia burgdorferi B31
ASMSSTKSLLE

SEQ ID NO: 61710 - protein, 11 aa, Borrelia burgdorferi B31
AKNDFEYAQRK

SEQ ID NO: 61711 - protein, 11 aa, Borrelia burgdorferi B31
THCNDAIAALK

SEQ ID NO: 61712 - protein, 11 aa, Borrelia burgdorferi B31
PSLEEAIAKVK

SEQ ID NO: 61713 - protein, 9 aa, Borrelia burgdorferi B31
YYYAGYHQF

SEQ ID NO: 61714 - protein, 9 aa, Borrelia burgdorferi B31
YYAGYHQFM

SEQ ID NO: 61715 - protein, 9 aa, Borrelia burgdorferi B31
EYNRINEDL

SEQ ID NO: 61716 - protein, 10 aa, Borrelia burgdorferi B31
SYYYAGYHQF

SEQ ID NO: 61717 - protein, 10 aa, Borrelia burgdorferi B31
YYYAGYHQFM

SEQ ID NO: 61718 - protein, 10 aa, Borrelia burgdorferi B31
YYAGYHQFMA

SEQ ID NO: 61719 - protein, 10 aa, Borrelia burgdorferi B31
LFSSVISCKL

SEQ ID NO: 61720 - protein, 11 aa, Borrelia burgdorferi B31
SYYYAGYHQFM

SEQ ID NO: 61721 - protein, 11 aa, Borrelia burgdorferi B31
EYAQRKADRAL

SEQ ID NO: 61722 - protein, 11 aa, Borrelia burgdorferi B31
TYNADQVIDKL

SEQ ID NO: 61723 - protein, 11 aa, Borrelia burgdorferi B31
YYYAGYHQFMA

SEQ ID NO: 61724 - protein, 9 aa, Borrelia burgdorferi B31
YYYAGYHQF

SEQ ID NO: 61725 - protein, 9 aa, Borrelia burgdorferi B31
DFQELNDIY

SEQ ID NO: 61726 - protein, 9 aa, Borrelia burgdorferi B31
ASRHESYYY

SEQ ID NO: 61727 - protein, 9 aa, Borrelia burgdorferi B31
KRAKNDFEY

SEQ ID NO: 61728 - protein, 9 aa, Borrelia burgdorferi B31
KLFILTILF

SEQ ID NO: 61729 - protein, 9 aa, Borrelia burgdorferi B31
SLLSTAKSY

SEQ ID NO: 61730 - protein, 10 aa, Borrelia burgdorferi B31
SYYYAGYHQF

SEQ ID NO: 61731 - protein, 10 aa, Borrelia burgdorferi B31
NASRHESYYY

SEQ ID NO: 61732 - protein, 10 aa, Borrelia burgdorferi B31
FSSVISCKLY

SEQ ID NO: 61733 - protein, 11 aa, Borrelia burgdorferi B31
SNASRHESYYY

SEQ ID NO: 61734 - protein, 11 aa, Borrelia burgdorferi B31
ALKRAKNDFEY

SEQ ID NO: 61735 - protein, 11 aa, Borrelia burgdorferi B31
LFSSVISCKLY

SEQ ID NO: 61736 - protein, 11 aa, Borrelia burgdorferi B31
ISCKLYKKITY

SEQ ID NO: 61737 - protein, 9 aa, Borrelia burgdorferi B31
ESSKEEYNR

SEQ ID NO: 61738 - protein, 9 aa, Borrelia burgdorferi B31
SVISCKLYK

SEQ ID NO: 61739 - protein, 9 aa, Borrelia burgdorferi B31
ESYYYAGYH

SEQ ID NO: 61740 - protein, 9 aa, Borrelia burgdorferi B31
IMTEIESSK

SEQ ID NO: 61741 - protein, 9 aa, Borrelia burgdorferi B31
EYAQRKADR

SEQ ID NO: 61742 - protein, 9 aa, Borrelia burgdorferi B31
LFSSVISCK

SEQ ID NO: 61743 - protein, 9 aa, Borrelia burgdorferi B31
KSYLEQTRR

SEQ ID NO: 61744 - protein, 9 aa, Borrelia burgdorferi B31
MTKTNKDFQ

SEQ ID NO: 61745 - protein, 9 aa, Borrelia burgdorferi B31
TLKSNDDSK

SEQ ID NO: 61746 - protein, 9 aa, Borrelia burgdorferi B31
NNGSFNTLK

SEQ ID NO: 61747 - protein, 9 aa, Borrelia burgdorferi B31
NDAIAALKR

SEQ ID NO: 61748 - protein, 9 aa, Borrelia burgdorferi B31
TYMDQDTGK

SEQ ID NO: 61749 - protein, 9 aa, Borrelia burgdorferi B31
NASRHESYY

SEQ ID NO: 61750 - protein, 9 aa, Borrelia burgdorferi B31
CNDAIAALK

SEQ ID NO: 61751 - protein, 9 aa, Borrelia burgdorferi B31
ALSNSNASR

SEQ ID NO: 61752 - protein, 9 aa, Borrelia burgdorferi B31
NDFEYAQRK

SEQ ID NO: 61753 - protein, 9 aa, Borrelia burgdorferi B31
EIESSKEEY

SEQ ID NO: 61754 - protein, 9 aa, Borrelia burgdorferi B31
VISCKLYKK

SEQ ID NO: 61755 - protein, 9 aa, Borrelia burgdorferi B31
NSSSNHTLQ

SEQ ID NO: 61756 - protein, 10 aa, Borrelia burgdorferi B31
NTYMDQDTGK

SEQ ID NO: 61757 - protein, 10 aa, Borrelia burgdorferi B31
EALSNSNASR

SEQ ID NO: 61758 - protein, 10 aa, Borrelia burgdorferi B31
SVISCKLYKK

SEQ ID NO: 61759 - protein, 10 aa, Borrelia burgdorferi B31
TAKSYLEQTR

SEQ ID NO: 61760 - protein, 10 aa, Borrelia burgdorferi B31
DAKASMSSTK

SEQ ID NO: 61761 - protein, 10 aa, Borrelia burgdorferi B31
NIMTEIESSK

SEQ ID NO: 61762 - protein, 10 aa, Borrelia burgdorferi B31
ILFSSVISCK

SEQ ID NO: 61763 - protein, 10 aa, Borrelia burgdorferi B31
NTLKSNDDSK

SEQ ID NO: 61764 - protein, 10 aa, Borrelia burgdorferi B31
STKSLLEVAK

SEQ ID NO: 61765 - protein, 10 aa, Borrelia burgdorferi B31
ESYYYAGYHQ

SEQ ID NO: 61766 - protein, 10 aa, Borrelia burgdorferi B31
TLKSNDDSKR

SEQ ID NO: 61767 - protein, 10 aa, Borrelia burgdorferi B31
SSVISCKLYK

SEQ ID NO: 61768 - protein, 10 aa, Borrelia burgdorferi B31
DAIAALKRAK

SEQ ID NO: 61769 - protein, 10 aa, Borrelia burgdorferi B31
NADQVIDKLK

SEQ ID NO: 61770 - protein, 10 aa, Borrelia burgdorferi B31
TYMDQDTGKK

SEQ ID NO: 61771 - protein, 10 aa, Borrelia burgdorferi B31
NASRHESYYY

SEQ ID NO: 61772 - protein, 10 aa, Borrelia burgdorferi B31
NSNASRHESY

SEQ ID NO: 61773 - protein, 10 aa, Borrelia burgdorferi B31
SNNGSFNTLK

SEQ ID NO: 61774 - protein, 10 aa, Borrelia burgdorferi B31
HCNDAIAALK

SEQ ID NO: 61775 - protein, 10 aa, Borrelia burgdorferi B31
QTRRGVGSSK

SEQ ID NO: 61776 - protein, 10 aa, Borrelia burgdorferi B31
FSSVISCKLY

SEQ ID NO: 61777 - protein, 10 aa, Borrelia burgdorferi B31
TYNADQVIDK

SEQ ID NO: 61778 - protein, 10 aa, Borrelia burgdorferi B31
DFQELNDIYK

SEQ ID NO: 61779 - protein, 10 aa, Borrelia burgdorferi B31
MTKTNKDFQE

SEQ ID NO: 61780 - protein, 10 aa, Borrelia burgdorferi B31
CNDAIAALKR

SEQ ID NO: 61781 - protein, 10 aa, Borrelia burgdorferi B31
DSKRSGRKPR

SEQ ID NO: 61782 - protein, 10 aa, Borrelia burgdorferi B31
FEYAQRKADR

SEQ ID NO: 61783 - protein, 11 aa, Borrelia burgdorferi B31
NTYMDQDTGKK

SEQ ID NO: 61784 - protein, 11 aa, Borrelia burgdorferi B31
STAKSYLEQTR

SEQ ID NO: 61785 - protein, 11 aa, Borrelia burgdorferi B31
EIESSKEEYNR

SEQ ID NO: 61786 - protein, 11 aa, Borrelia burgdorferi B31
NTLKSNDDSKR

SEQ ID NO: 61787 - protein, 11 aa, Borrelia burgdorferi B31
TAKSYLEQTRR

SEQ ID NO: 61788 - protein, 11 aa, Borrelia burgdorferi B31
FSSVISCKLYK

SEQ ID NO: 61789 - protein, 11 aa, Borrelia burgdorferi B31
TILFSSVISCK

SEQ ID NO: 61790 - protein, 11 aa, Borrelia burgdorferi B31
ITYNADQVIDK

SEQ ID NO: 61791 - protein, 11 aa, Borrelia burgdorferi B31
NIQDNEASEAR

SEQ ID NO: 61792 - protein, 11 aa, Borrelia burgdorferi B31
ELNENMTKTNK

SEQ ID NO: 61793 - protein, 11 aa, Borrelia burgdorferi B31
EEALSNSNASR

SEQ ID NO: 61794 - protein, 11 aa, Borrelia burgdorferi B31
NSNASRHESYY

SEQ ID NO: 61795 - protein, 11 aa, Borrelia burgdorferi B31
SSVISCKLYKK

SEQ ID NO: 61796 - protein, 11 aa, Borrelia burgdorferi B31
MTEIESSKEEY

SEQ ID NO: 61797 - protein, 11 aa, Borrelia burgdorferi B31
ESYYYAGYHQF

SEQ ID NO: 61798 - protein, 11 aa, Borrelia burgdorferi B31
EYNRINEDLAK

SEQ ID NO: 61799 - protein, 11 aa, Borrelia burgdorferi B31
SSTKSLLEVAK

SEQ ID NO: 61800 - protein, 11 aa, Borrelia burgdorferi B31
DLAKVKASLDK

SEQ ID NO: 61801 - protein, 11 aa, Borrelia burgdorferi B31
RAKNDFEYAQR

SEQ ID NO: 61802 - protein, 11 aa, Borrelia burgdorferi B31
KSNNGSFNTLK

SEQ ID NO: 61803 - protein, 11 aa, Borrelia burgdorferi B31
THCNDAIAALK

SEQ ID NO: 61804 - protein, 11 aa, Borrelia burgdorferi B31
YNADQVIDKLK

SEQ ID NO: 61805 - protein, 11 aa, Borrelia burgdorferi B31
HCNDAIAALKR

SEQ ID NO: 61806 - protein, 11 aa, Borrelia burgdorferi B31
KSNDDSKRSGR

SEQ ID NO: 61807 - protein, 11 aa, Borrelia burgdorferi B31
DFEYAQRKADR

SEQ ID NO: 61808 - protein, 11 aa, Borrelia burgdorferi B31
DFQELNDIYKK

SEQ ID NO: 61809 - protein, 11 aa, Borrelia burgdorferi B31
DNTYMDQDTGK

SEQ ID NO: 61810 - protein, 11 aa, Borrelia burgdorferi B31
IYKKLQDMDSR

SEQ ID NO: 61811 - protein, 11 aa, Borrelia burgdorferi B31
EQTRRGVGSSK

SEQ ID NO: 61812 - protein, 9 aa, Borrelia burgdorferi B31
AQRKADRAL

SEQ ID NO: 61813 - protein, 9 aa, Borrelia burgdorferi B31
KPRSVDNTY

SEQ ID NO: 61814 - protein, 9 aa, Borrelia burgdorferi B31
ASMSSTKSL

SEQ ID NO: 61815 - protein, 10 aa, Borrelia burgdorferi B31
KPRSVDNTYM

SEQ ID NO: 61816 - protein, 10 aa, Borrelia burgdorferi B31
KASMSSTKSL

SEQ ID NO: 61817 - protein, 10 aa, Borrelia burgdorferi B31
YAQRKADRAL

SEQ ID NO: 61818 - protein, 10 aa, Borrelia burgdorferi B31
KASLDKIKSL

SEQ ID NO: 61819 - protein, 10 aa, Borrelia burgdorferi B31
KANLALLPSL

SEQ ID NO: 61820 - protein, 11 aa, Borrelia burgdorferi B31
KASMSSTKSLL

SEQ ID NO: 61821 - protein, 11 aa, Borrelia burgdorferi B31
KPRSVDNTYMD

SEQ ID NO: 61822 - protein, 11 aa, Borrelia burgdorferi B31
LPSLEEAIAKV

SEQ ID NO: 61823 - protein, 11 aa, Borrelia burgdorferi B31
GVGSSKANLAL

SEQ ID NO: 61824 - protein, 11 aa, Borrelia burgdorferi B31
KPLMADMQPDM

SEQ ID NO: 61825 - protein, 11 aa, Borrelia burgdorferi B31
KASLDKIKSLL

SEQ ID NO: 61826 - protein, 11 aa, Borrelia burgdorferi B31
RKADRALEEAL

SEQ ID NO: 61827 - protein, 11 aa, Borrelia burgdorferi B31
SKRSGRKPRSV

SEQ ID NO: 61828 - protein, 10 aa, Borrelia burgdorferi B31
YAQRKADRAL

SEQ ID NO: 61829 - protein, 9 aa, Borrelia burgdorferi B31
KLKSNNGSF

SEQ ID NO: 61830 - protein, 9 aa, Borrelia burgdorferi B31
FMADAKASM

SEQ ID NO: 61831 - protein, 9 aa, Borrelia burgdorferi B31
KQKELNENM

SEQ ID NO: 61832 - protein, 9 aa, Borrelia burgdorferi B31
AQRKADRAL

SEQ ID NO: 61833 - protein, 9 aa, Borrelia burgdorferi B31
KLFILTILF

SEQ ID NO: 61834 - protein, 9 aa, Borrelia burgdorferi B31
SLLSTAKSY

SEQ ID NO: 61835 - protein, 9 aa, Borrelia burgdorferi B31
ASRHESYYY

SEQ ID NO: 61836 - protein, 9 aa, Borrelia burgdorferi B31
YYYAGYHQF

SEQ ID NO: 61837 - protein, 9 aa, Borrelia burgdorferi B31
LMADMQPDM

SEQ ID NO: 61838 - protein, 9 aa, Borrelia burgdorferi B31
ALKRAKNDF

SEQ ID NO: 61839 - protein, 9 aa, Borrelia burgdorferi B31
SSVISCKLY

SEQ ID NO: 61840 - protein, 9 aa, Borrelia burgdorferi B31
SNASRHESY

SEQ ID NO: 61841 - protein, 9 aa, Borrelia burgdorferi B31
NMTKTNKDF

SEQ ID NO: 61842 - protein, 10 aa, Borrelia burgdorferi B31
MQNDNSSSNH

SEQ ID NO: 61843 - protein, 10 aa, Borrelia burgdorferi B31
KSLLSTAKSY

SEQ ID NO: 61844 - protein, 10 aa, Borrelia burgdorferi B31
NSNASRHESY

SEQ ID NO: 61845 - protein, 10 aa, Borrelia burgdorferi B31
FSSVISCKLY

SEQ ID NO: 61846 - protein, 10 aa, Borrelia burgdorferi B31
KQKELNENMT

SEQ ID NO: 61847 - protein, 11 aa, Borrelia burgdorferi B31
HQFMADAKASM

SEQ ID NO: 61848 - protein, 11 aa, Borrelia burgdorferi B31
ALKRAKNDFEY

SEQ ID NO: 61849 - protein, 11 aa, Borrelia burgdorferi B31
NSNASRHESYY

SEQ ID NO: 61850 - protein, 11 aa, Borrelia burgdorferi B31
MQNDNSSSNHT

SEQ ID NO: 61851 - protein, 11 aa, Borrelia burgdorferi B31
SNSNASRHESY

SEQ ID NO: 61852 - protein, 11 aa, Borrelia burgdorferi B31
INKLFILTILF

SEQ ID NO: 61853 - protein, 11 aa, Borrelia burgdorferi B31
ISCKLYKKITY

SEQ ID NO: 61854 - protein, 11 aa, Borrelia burgdorferi B31
IKSLLSTAKSY

SEQ ID NO: 61855 - protein, 9 aa, Borrelia burgdorferi B31
TRRGVGSSK

SEQ ID NO: 61856 - protein, 9 aa, Borrelia burgdorferi B31
KRAKNDFEY

SEQ ID NO: 61857 - protein, 9 aa, Borrelia burgdorferi B31
NRINEDLAK

SEQ ID NO: 61858 - protein, 9 aa, Borrelia burgdorferi B31
KRSGRKPRS

SEQ ID NO: 61859 - protein, 10 aa, Borrelia burgdorferi B31
KRSGRKPRSV

SEQ ID NO: 61860 - protein, 11 aa, Borrelia burgdorferi B31
SRHESYYYAGY

SEQ ID NO: 61861 - protein, 11 aa, Borrelia burgdorferi B31
RRGVGSSKANL

SEQ ID NO: 61862 - protein, 11 aa, Borrelia burgdorferi B31
NRINEDLAKVK

SEQ ID NO: 61863 - protein, 11 aa, Borrelia burgdorferi B31
HQFMADAKASM

SEQ ID NO: 61864 - protein, 11 aa, Borrelia burgdorferi B31
KRAKNDFEYAQ

SEQ ID NO: 61865 - protein, 11 aa, Borrelia burgdorferi B31
KQKELNENMTK

SEQ ID NO: 61866 - protein, 11 aa, Borrelia burgdorferi B31
GRKPRSVDNTY

SEQ ID NO: 61867 - protein, 9 aa, Borrelia burgdorferi B31
EASEARNIM

SEQ ID NO: 61868 - protein, 9 aa, Borrelia burgdorferi B31
KPRSVDNTY

SEQ ID NO: 61869 - protein, 9 aa, Borrelia burgdorferi B31
FMADAKASM

SEQ ID NO: 61870 - protein, 9 aa, Borrelia burgdorferi B31
NASRHESYY

SEQ ID NO: 61871 - protein, 9 aa, Borrelia burgdorferi B31
LPSLEEAIA

SEQ ID NO: 61872 - protein, 9 aa, Borrelia burgdorferi B31
DFQELNDIY

SEQ ID NO: 61873 - protein, 9 aa, Borrelia burgdorferi B31
HCNDAIAAL

SEQ ID NO: 61874 - protein, 9 aa, Borrelia burgdorferi B31
EALSNSNAS

SEQ ID NO: 61875 - protein, 9 aa, Borrelia burgdorferi B31
LMADMQPDM

SEQ ID NO: 61876 - protein, 9 aa, Borrelia burgdorferi B31
YYYAGYHQF

SEQ ID NO: 61877 - protein, 9 aa, Borrelia burgdorferi B31
EIESSKEEY

SEQ ID NO: 61878 - protein, 9 aa, Borrelia burgdorferi B31
YYAGYHQFM

SEQ ID NO: 61879 - protein, 9 aa, Borrelia burgdorferi B31
HESYYYAGY

SEQ ID NO: 61880 - protein, 10 aa, Borrelia burgdorferi B31
NASRHESYYY

SEQ ID NO: 61881 - protein, 10 aa, Borrelia burgdorferi B31
KPRSVDNTYM

SEQ ID NO: 61882 - protein, 10 aa, Borrelia burgdorferi B31
YAQRKADRAL

SEQ ID NO: 61883 - protein, 10 aa, Borrelia burgdorferi B31
LPSLEEAIAK

SEQ ID NO: 61884 - protein, 10 aa, Borrelia burgdorferi B31
FSSVISCKLY

SEQ ID NO: 61885 - protein, 10 aa, Borrelia burgdorferi B31
QFMADAKASM

SEQ ID NO: 61886 - protein, 10 aa, Borrelia burgdorferi B31
QPDMQNDNSS

SEQ ID NO: 61887 - protein, 10 aa, Borrelia burgdorferi B31
EASEARNIMT

SEQ ID NO: 61888 - protein, 10 aa, Borrelia burgdorferi B31
THCNDAIAAL

SEQ ID NO: 61889 - protein, 10 aa, Borrelia burgdorferi B31
TEIESSKEEY

SEQ ID NO: 61890 - protein, 11 aa, Borrelia burgdorferi B31
KPLMADMQPDM

SEQ ID NO: 61891 - protein, 11 aa, Borrelia burgdorferi B31
MTEIESSKEEY

SEQ ID NO: 61892 - protein, 11 aa, Borrelia burgdorferi B31
DTHCNDAIAAL

SEQ ID NO: 61893 - protein, 11 aa, Borrelia burgdorferi B31
ESYYYAGYHQF

SEQ ID NO: 61894 - protein, 11 aa, Borrelia burgdorferi B31
HQFMADAKASM

SEQ ID NO: 61895 - protein, 11 aa, Borrelia burgdorferi B31
IAALKRAKNDF

SEQ ID NO: 61896 - protein, 11 aa, Borrelia burgdorferi B31
YMDQDTGKKPL

SEQ ID NO: 61897 - protein, 11 aa, Borrelia burgdorferi B31
LPSLEEAIAKV

SEQ ID NO: 61898 - protein, 11 aa, Borrelia burgdorferi B31
NSNASRHESYY

SEQ ID NO: 61899 - protein, 11 aa, Borrelia burgdorferi B31
EALSNSNASRH

SEQ ID NO: 61900 - protein, 11 aa, Borrelia burgdorferi B31
NKDFQELNDIY

SEQ ID NO: 61901 - protein, 9 aa, Borrelia burgdorferi B31
HESYYYAGY

SEQ ID NO: 61902 - protein, 9 aa, Borrelia burgdorferi B31
EEALSNSNA

SEQ ID NO: 61903 - protein, 10 aa, Borrelia burgdorferi B31
TEIESSKEEY

SEQ ID NO: 61904 - protein, 10 aa, Borrelia burgdorferi B31
EEALSNSNAS

SEQ ID NO: 61905 - protein, 10 aa, Borrelia burgdorferi B31
EEYNRINEDL

SEQ ID NO: 61906 - protein, 11 aa, Borrelia burgdorferi B31
EEYNRINEDLA

SEQ ID NO: 61907 - protein, 9 aa, Borrelia burgdorferi B31
LPSLEEAIA

SEQ ID NO: 61908 - protein, 11 aa, Borrelia burgdorferi B31
LPSLEEAIAKV

SEQ ID NO: 61909 - protein, 11 aa, Borrelia burgdorferi B31
LALLPSLEEAI

SEQ ID NO: 61910 - protein, 11 aa, Borrelia burgdorferi B31
ISCKLYKKITY

SEQ ID NO: 61911 - protein, 9 aa, Borrelia burgdorferi B31
ESIKNSTEY

SEQ ID NO: 61912 - protein, 10 aa, Borrelia burgdorferi B31
KTQEKLSSGY

SEQ ID NO: 61913 - protein, 10 aa, Borrelia burgdorferi B31
MTDEVVAATT

SEQ ID NO: 61914 - protein, 10 aa, Borrelia burgdorferi B31
ASDDAAGMGV

SEQ ID NO: 61915 - protein, 11 aa, Borrelia burgdorferi B31
NQDEAIAVNIY

SEQ ID NO: 61916 - protein, 11 aa, Borrelia burgdorferi B31
RLESIKNSTEY

SEQ ID NO: 61917 - protein, 11 aa, Borrelia burgdorferi B31
ISDQRANLGAF

SEQ ID NO: 61918 - protein, 11 aa, Borrelia burgdorferi B31
ELAVQSGNGTY

SEQ ID NO: 61919 - protein, 11 aa, Borrelia burgdorferi B31
MIAQANQVPQY

SEQ ID NO: 61920 - protein, 9 aa, Borrelia burgdorferi B31
SQASWTLRV

SEQ ID NO: 61921 - protein, 9 aa, Borrelia burgdorferi B31
TMTDEVVAA

SEQ ID NO: 61922 - protein, 9 aa, Borrelia burgdorferi B31
QLTDEINRI

SEQ ID NO: 61923 - protein, 9 aa, Borrelia burgdorferi B31
AMIAQANQV

SEQ ID NO: 61924 - protein, 9 aa, Borrelia burgdorferi B31
MIINHNTSA

SEQ ID NO: 61925 - protein, 9 aa, Borrelia burgdorferi B31
QVPQYVLSL

SEQ ID NO: 61926 - protein, 9 aa, Borrelia burgdorferi B31
AIAVNIYAA

SEQ ID NO: 61927 - protein, 9 aa, Borrelia burgdorferi B31
SLAKIENAI

SEQ ID NO: 61928 - protein, 9 aa, Borrelia burgdorferi B31
AVNIYAANV

SEQ ID NO: 61929 - protein, 9 aa, Borrelia burgdorferi B31
AQYNQMHML

SEQ ID NO: 61930 - protein, 9 aa, Borrelia burgdorferi B31
TTVDANTSL

SEQ ID NO: 61931 - protein, 9 aa, Borrelia burgdorferi B31
NLGAFQNRL

SEQ ID NO: 61932 - protein, 9 aa, Borrelia burgdorferi B31
SQGGVNSPV

SEQ ID NO: 61933 - protein, 9 aa, Borrelia burgdorferi B31
MTDEVVAAT

SEQ ID NO: 61934 - protein, 9 aa, Borrelia burgdorferi B31
SAMAMIAQA

SEQ ID NO: 61935 - protein, 9 aa, Borrelia burgdorferi B31
AQTAQAAPV

SEQ ID NO: 61936 - protein, 9 aa, Borrelia burgdorferi B31
VVAATTNSI

SEQ ID NO: 61937 - protein, 9 aa, Borrelia burgdorferi B31
MISDQRANL

SEQ ID NO: 61938 - protein, 9 aa, Borrelia burgdorferi B31
ILTQSAMAM

SEQ ID NO: 61939 - protein, 9 aa, Borrelia burgdorferi B31
SILTQSAMA

SEQ ID NO: 61940 - protein, 9 aa, Borrelia burgdorferi B31
LTQSAMAMI

SEQ ID NO: 61941 - protein, 10 aa, Borrelia burgdorferi B31
AQANQVPQYV

SEQ ID NO: 61942 - protein, 10 aa, Borrelia burgdorferi B31
MIINHNTSAI

SEQ ID NO: 61943 - protein, 10 aa, Borrelia burgdorferi B31
ILTQSAMAMI

SEQ ID NO: 61944 - protein, 10 aa, Borrelia burgdorferi B31
NIYAANVANL

SEQ ID NO: 61945 - protein, 10 aa, Borrelia burgdorferi B31
TMTDEVVAAT

SEQ ID NO: 61946 - protein, 10 aa, Borrelia burgdorferi B31
RMISDQRANL

SEQ ID NO: 61947 - protein, 10 aa, Borrelia burgdorferi B31
NLNEVEKVLV

SEQ ID NO: 61948 - protein, 10 aa, Borrelia burgdorferi B31
VLVRMKELAV

SEQ ID NO: 61949 - protein, 10 aa, Borrelia burgdorferi B31
MAMIAQANQV

SEQ ID NO: 61950 - protein, 10 aa, Borrelia burgdorferi B31
AQAAPVQEGV

SEQ ID NO: 61951 - protein, 10 aa, Borrelia burgdorferi B31
QLTDEINRIA

SEQ ID NO: 61952 - protein, 10 aa, Borrelia burgdorferi B31
ATMTDEVVAA

SEQ ID NO: 61953 - protein, 10 aa, Borrelia burgdorferi B31
QVPQYVLSLL

SEQ ID NO: 61954 - protein, 10 aa, Borrelia burgdorferi B31
NQVPQYVLSL

SEQ ID NO: 61955 - protein, 10 aa, Borrelia burgdorferi B31
IAVNIYAANV

SEQ ID NO: 61956 - protein, 11 aa, Borrelia burgdorferi B31
SLSGSQASWTL

SEQ ID NO: 61957 - protein, 11 aa, Borrelia burgdorferi B31
MLSNKSASQNV

SEQ ID NO: 61958 - protein, 11 aa, Borrelia burgdorferi B31
AMAMIAQANQV

SEQ ID NO: 61959 - protein, 11 aa, Borrelia burgdorferi B31
AIAVNIYAANV

SEQ ID NO: 61960 - protein, 11 aa, Borrelia burgdorferi B31
SQASWTLRVHV

SEQ ID NO: 61961 - protein, 11 aa, Borrelia burgdorferi B31
KLSSGYRINRA

SEQ ID NO: 61962 - protein, 11 aa, Borrelia burgdorferi B31
SILTQSAMAMI

SEQ ID NO: 61963 - protein, 11 aa, Borrelia burgdorferi B31
GMQPAKINTPA

SEQ ID NO: 61964 - protein, 11 aa, Borrelia burgdorferi B31
KVLVRMKELAV

SEQ ID NO: 61965 - protein, 11 aa, Borrelia burgdorferi B31
TMTDEVVAATT

SEQ ID NO: 61966 - protein, 11 aa, Borrelia burgdorferi B31
MISDQRANLGA

SEQ ID NO: 61967 - protein, 11 aa, Borrelia burgdorferi B31
YAIENLKASYA

SEQ ID NO: 61968 - protein, 11 aa, Borrelia burgdorferi B31
SLAKIENAIRM

SEQ ID NO: 61969 - protein, 11 aa, Borrelia burgdorferi B31
NLFSGEGAQTA

SEQ ID NO: 61970 - protein, 11 aa, Borrelia burgdorferi B31
ILTQSAMAMIA

SEQ ID NO: 61971 - protein, 9 aa, Borrelia burgdorferi B31
GINAANLSK

SEQ ID NO: 61972 - protein, 9 aa, Borrelia burgdorferi B31
SQASRNTSK

SEQ ID NO: 61973 - protein, 9 aa, Borrelia burgdorferi B31
NQMHMLSNK

SEQ ID NO: 61974 - protein, 9 aa, Borrelia burgdorferi B31
GSQASWTLR

SEQ ID NO: 61975 - protein, 9 aa, Borrelia burgdorferi B31
FQNRLESIK

SEQ ID NO: 61976 - protein, 9 aa, Borrelia burgdorferi B31
LSSGYRINR

SEQ ID NO: 61977 - protein, 10 aa, Borrelia burgdorferi B31
TVDANTSLAK

SEQ ID NO: 61978 - protein, 10 aa, Borrelia burgdorferi B31
LSQASRNTSK

SEQ ID NO: 61979 - protein, 10 aa, Borrelia burgdorferi B31
KLSSGYRINR

SEQ ID NO: 61980 - protein, 10 aa, Borrelia burgdorferi B31
NLKASYAQIK

SEQ ID NO: 61981 - protein, 10 aa, Borrelia burgdorferi B31
NGINAANLSK

SEQ ID NO: 61982 - protein, 10 aa, Borrelia burgdorferi B31
AANLSKTQEK

SEQ ID NO: 61983 - protein, 10 aa, Borrelia burgdorferi B31
STEYAIENLK

SEQ ID NO: 61984 - protein, 10 aa, Borrelia burgdorferi B31
KTQEKLSSGY

SEQ ID NO: 61985 - protein, 10 aa, Borrelia burgdorferi B31
YNQMHMLSNK

SEQ ID NO: 61986 - protein, 10 aa, Borrelia burgdorferi B31
AFQNRLESIK

SEQ ID NO: 61987 - protein, 10 aa, Borrelia burgdorferi B31
QIRGLSQASR

SEQ ID NO: 61988 - protein, 10 aa, Borrelia burgdorferi B31
VPQYVLSLLR

SEQ ID NO: 61989 - protein, 11 aa, Borrelia burgdorferi B31
GLSQASRNTSK

SEQ ID NO: 61990 - protein, 11 aa, Borrelia burgdorferi B31
MIAQANQVPQY

SEQ ID NO: 61991 - protein, 11 aa, Borrelia burgdorferi B31
LSGSQASWTLR

SEQ ID NO: 61992 - protein, 11 aa, Borrelia burgdorferi B31
GAFQNRLESIK

SEQ ID NO: 61993 - protein, 11 aa, Borrelia burgdorferi B31
KTQEKLSSGYR

SEQ ID NO: 61994 - protein, 11 aa, Borrelia burgdorferi B31
RLESIKNSTEY

SEQ ID NO: 61995 - protein, 11 aa, Borrelia burgdorferi B31
TTVDANTSLAK

SEQ ID NO: 61996 - protein, 11 aa, Borrelia burgdorferi B31
KINAQIRGLSQ

SEQ ID NO: 61997 - protein, 11 aa, Borrelia burgdorferi B31
LSNKSASQNVR

SEQ ID NO: 61998 - protein, 9 aa, Borrelia burgdorferi B31
GINAANLSK

SEQ ID NO: 61999 - protein, 9 aa, Borrelia burgdorferi B31
SQASRNTSK

SEQ ID NO: 62000 - protein, 9 aa, Borrelia burgdorferi B31
NQMHMLSNK

SEQ ID NO: 62001 - protein, 9 aa, Borrelia burgdorferi B31
GSQASWTLR

SEQ ID NO: 62002 - protein, 9 aa, Borrelia burgdorferi B31
AAGMGVSGK

SEQ ID NO: 62003 - protein, 9 aa, Borrelia burgdorferi B31
LSSGYRINR

SEQ ID NO: 62004 - protein, 9 aa, Borrelia burgdorferi B31
NTSAINASR

SEQ ID NO: 62005 - protein, 9 aa, Borrelia burgdorferi B31
TEYAIENLK

SEQ ID NO: 62006 - protein, 9 aa, Borrelia burgdorferi B31
AVQSGNGTY

SEQ ID NO: 62007 - protein, 9 aa, Borrelia burgdorferi B31
PQYVLSLLR

SEQ ID NO: 62008 - protein, 9 aa, Borrelia burgdorferi B31
FQNRLESIK

SEQ ID NO: 62009 - protein, 9 aa, Borrelia burgdorferi B31
AQANQVPQY

SEQ ID NO: 62010 - protein, 10 aa, Borrelia burgdorferi B31
TVDANTSLAK

SEQ ID NO: 62011 - protein, 10 aa, Borrelia burgdorferi B31
STEYAIENLK

SEQ ID NO: 62012 - protein, 10 aa, Borrelia burgdorferi B31
LSQASRNTSK

SEQ ID NO: 62013 - protein, 10 aa, Borrelia burgdorferi B31
AANLSKTQEK

SEQ ID NO: 62014 - protein, 10 aa, Borrelia burgdorferi B31
RANLGAFQNR

SEQ ID NO: 62015 - protein, 10 aa, Borrelia burgdorferi B31
KTQEKLSSGY

SEQ ID NO: 62016 - protein, 10 aa, Borrelia burgdorferi B31
KLSSGYRINR

SEQ ID NO: 62017 - protein, 10 aa, Borrelia burgdorferi B31
AFQNRLESIK

SEQ ID NO: 62018 - protein, 10 aa, Borrelia burgdorferi B31
YNQMHMLSNK

SEQ ID NO: 62019 - protein, 10 aa, Borrelia burgdorferi B31
IAQANQVPQY

SEQ ID NO: 62020 - protein, 10 aa, Borrelia burgdorferi B31
TQEKLSSGYR

SEQ ID NO: 62021 - protein, 10 aa, Borrelia burgdorferi B31
NLKASYAQIK

SEQ ID NO: 62022 - protein, 10 aa, Borrelia burgdorferi B31
EVEKVLVRMK

SEQ ID NO: 62023 - protein, 11 aa, Borrelia burgdorferi B31
TTVDANTSLAK

SEQ ID NO: 62024 - protein, 11 aa, Borrelia burgdorferi B31
TTEGNLNEVEK

SEQ ID NO: 62025 - protein, 11 aa, Borrelia burgdorferi B31
KTQEKLSSGYR

SEQ ID NO: 62026 - protein, 11 aa, Borrelia burgdorferi B31
GAFQNRLESIK

SEQ ID NO: 62027 - protein, 11 aa, Borrelia burgdorferi B31
TAEELGMQPAK

SEQ ID NO: 62028 - protein, 11 aa, Borrelia burgdorferi B31
NSTEYAIENLK

SEQ ID NO: 62029 - protein, 11 aa, Borrelia burgdorferi B31
GLSQASRNTSK

SEQ ID NO: 62030 - protein, 11 aa, Borrelia burgdorferi B31
TSLAKIENAIR

SEQ ID NO: 62031 - protein, 11 aa, Borrelia burgdorferi B31
QYNQMHMLSNK

SEQ ID NO: 62032 - protein, 11 aa, Borrelia burgdorferi B31
NAANLSKTQEK

SEQ ID NO: 62033 - protein, 11 aa, Borrelia burgdorferi B31
QVPQYVLSLLR

SEQ ID NO: 62034 - protein, 11 aa, Borrelia burgdorferi B31
AQIRGLSQASR

SEQ ID NO: 62035 - protein, 11 aa, Borrelia burgdorferi B31
LSGSQASWTLR

SEQ ID NO: 62036 - protein, 11 aa, Borrelia burgdorferi B31
GVSGKINAQIR

SEQ ID NO: 62037 - protein, 11 aa, Borrelia burgdorferi B31
MIAQANQVPQY

SEQ ID NO: 62038 - protein, 11 aa, Borrelia burgdorferi B31
LSNKSASQNVR

SEQ ID NO: 62039 - protein, 11 aa, Borrelia burgdorferi B31
SAMAMIAQANQ

SEQ ID NO: 62040 - protein, 9 aa, Borrelia burgdorferi B31
IYAANVANL

SEQ ID NO: 62041 - protein, 9 aa, Borrelia burgdorferi B31
YAANVANLF

SEQ ID NO: 62042 - protein, 9 aa, Borrelia burgdorferi B31
AFQNRLESI

SEQ ID NO: 62043 - protein, 10 aa, Borrelia burgdorferi B31
IYAANVANLF

SEQ ID NO: 62044 - protein, 10 aa, Borrelia burgdorferi B31
TYSDADRGSI

SEQ ID NO: 62045 - protein, 10 aa, Borrelia burgdorferi B31
SYAQIKDATM

SEQ ID NO: 62046 - protein, 11 aa, Borrelia burgdorferi B31
IYAANVANLFS

SEQ ID NO: 62047 - protein, 9 aa, Borrelia burgdorferi B31
ESIKNSTEY

SEQ ID NO: 62048 - protein, 9 aa, Borrelia burgdorferi B31
AVQSGNGTY

SEQ ID NO: 62049 - protein, 9 aa, Borrelia burgdorferi B31
YAANVANLF

SEQ ID NO: 62050 - protein, 9 aa, Borrelia burgdorferi B31
AIENLKASY

SEQ ID NO: 62051 - protein, 10 aa, Borrelia burgdorferi B31
YAIENLKASY

SEQ ID NO: 62052 - protein, 10 aa, Borrelia burgdorferi B31
IAQANQVPQY

SEQ ID NO: 62053 - protein, 11 aa, Borrelia burgdorferi B31
EYAIENLKASY

SEQ ID NO: 62054 - protein, 11 aa, Borrelia burgdorferi B31
ELAVQSGNGTY

SEQ ID NO: 62055 - protein, 11 aa, Borrelia burgdorferi B31
RLESIKNSTEY

SEQ ID NO: 62056 - protein, 11 aa, Borrelia burgdorferi B31
EINRIADQAQY

SEQ ID NO: 62057 - protein, 11 aa, Borrelia burgdorferi B31
MIAQANQVPQY

SEQ ID NO: 62058 - protein, 9 aa, Borrelia burgdorferi B31
NTSAINASR

SEQ ID NO: 62059 - protein, 9 aa, Borrelia burgdorferi B31
LSSGYRINR

SEQ ID NO: 62060 - protein, 9 aa, Borrelia burgdorferi B31
ESIKNSTEY

SEQ ID NO: 62061 - protein, 9 aa, Borrelia burgdorferi B31
TEYAIENLK

SEQ ID NO: 62062 - protein, 9 aa, Borrelia burgdorferi B31
AIRMISDQR

SEQ ID NO: 62063 - protein, 9 aa, Borrelia burgdorferi B31
LAKIENAIR

SEQ ID NO: 62064 - protein, 9 aa, Borrelia burgdorferi B31
EGNLNEVEK

SEQ ID NO: 62065 - protein, 9 aa, Borrelia burgdorferi B31
YAANVANLF

SEQ ID NO: 62066 - protein, 9 aa, Borrelia burgdorferi B31
NGTYSDADR

SEQ ID NO: 62067 - protein, 9 aa, Borrelia burgdorferi B31
GSQASWTLR

SEQ ID NO: 62068 - protein, 9 aa, Borrelia burgdorferi B31
NQMHMLSNK

SEQ ID NO: 62069 - protein, 9 aa, Borrelia burgdorferi B31
QTAQAAPVQ

SEQ ID NO: 62070 - protein, 9 aa, Borrelia burgdorferi B31
TSKAINFIQ

SEQ ID NO: 62071 - protein, 9 aa, Borrelia burgdorferi B31
MAMIAQANQ

SEQ ID NO: 62072 - protein, 9 aa, Borrelia burgdorferi B31
NKSASQNVR

SEQ ID NO: 62073 - protein, 9 aa, Borrelia burgdorferi B31
GINAANLSK

SEQ ID NO: 62074 - protein, 9 aa, Borrelia burgdorferi B31
TTNSILTQS

SEQ ID NO: 62075 - protein, 9 aa, Borrelia burgdorferi B31
SQASRNTSK

SEQ ID NO: 62076 - protein, 10 aa, Borrelia burgdorferi B31
NAIRMISDQR

SEQ ID NO: 62077 - protein, 10 aa, Borrelia burgdorferi B31
STEYAIENLK

SEQ ID NO: 62078 - protein, 10 aa, Borrelia burgdorferi B31
DAAGMGVSGK

SEQ ID NO: 62079 - protein, 10 aa, Borrelia burgdorferi B31
HNTSAINASR

SEQ ID NO: 62080 - protein, 10 aa, Borrelia burgdorferi B31
EVEKVLVRMK

SEQ ID NO: 62081 - protein, 10 aa, Borrelia burgdorferi B31
SLAKIENAIR

SEQ ID NO: 62082 - protein, 10 aa, Borrelia burgdorferi B31
TVDANTSLAK

SEQ ID NO: 62083 - protein, 10 aa, Borrelia burgdorferi B31
RANLGAFQNR

SEQ ID NO: 62084 - protein, 10 aa, Borrelia burgdorferi B31
QIRGLSQASR

SEQ ID NO: 62085 - protein, 10 aa, Borrelia burgdorferi B31
NTSKAINFIQ

SEQ ID NO: 62086 - protein, 10 aa, Borrelia burgdorferi B31
LSQASRNTSK

SEQ ID NO: 62087 - protein, 10 aa, Borrelia burgdorferi B31
NLKASYAQIK

SEQ ID NO: 62088 - protein, 10 aa, Borrelia burgdorferi B31
SGSQASWTLR

SEQ ID NO: 62089 - protein, 10 aa, Borrelia burgdorferi B31
TQEKLSSGYR

SEQ ID NO: 62090 - protein, 10 aa, Borrelia burgdorferi B31
VPQYVLSLLR

SEQ ID NO: 62091 - protein, 10 aa, Borrelia burgdorferi B31
NGINAANLSK

SEQ ID NO: 62092 - protein, 10 aa, Borrelia burgdorferi B31
AANLSKTQEK

SEQ ID NO: 62093 - protein, 10 aa, Borrelia burgdorferi B31
YAIENLKASY

SEQ ID NO: 62094 - protein, 10 aa, Borrelia burgdorferi B31
VSGKINAQIR

SEQ ID NO: 62095 - protein, 10 aa, Borrelia burgdorferi B31
TTVDANTSLA

SEQ ID NO: 62096 - protein, 10 aa, Borrelia burgdorferi B31
KLSSGYRINR

SEQ ID NO: 62097 - protein, 10 aa, Borrelia burgdorferi B31
MIAQANQVPQ

SEQ ID NO: 62098 - protein, 10 aa, Borrelia burgdorferi B31
QTAQAAPVQE

SEQ ID NO: 62099 - protein, 10 aa, Borrelia burgdorferi B31
NTSAINASRN

SEQ ID NO: 62100 - protein, 11 aa, Borrelia burgdorferi B31
NSTEYAIENLK

SEQ ID NO: 62101 - protein, 11 aa, Borrelia burgdorferi B31
TTVDANTSLAK

SEQ ID NO: 62102 - protein, 11 aa, Borrelia burgdorferi B31
TTEGNLNEVEK

SEQ ID NO: 62103 - protein, 11 aa, Borrelia burgdorferi B31
EIEQLTDEINR

SEQ ID NO: 62104 - protein, 11 aa, Borrelia burgdorferi B31
QVPQYVLSLLR

SEQ ID NO: 62105 - protein, 11 aa, Borrelia burgdorferi B31
NAANLSKTQEK

SEQ ID NO: 62106 - protein, 11 aa, Borrelia burgdorferi B31
ENAIRMISDQR

SEQ ID NO: 62107 - protein, 11 aa, Borrelia burgdorferi B31
LSNKSASQNVR

SEQ ID NO: 62108 - protein, 11 aa, Borrelia burgdorferi B31
MIAQANQVPQY

SEQ ID NO: 62109 - protein, 11 aa, Borrelia burgdorferi B31
TSLAKIENAIR

SEQ ID NO: 62110 - protein, 11 aa, Borrelia burgdorferi B31
EINRIADQAQY

SEQ ID NO: 62111 - protein, 11 aa, Borrelia burgdorferi B31
NLNEVEKVLVR

SEQ ID NO: 62112 - protein, 11 aa, Borrelia burgdorferi B31
LSGSQASWTLR

SEQ ID NO: 62113 - protein, 11 aa, Borrelia burgdorferi B31
GAFQNRLESIK

SEQ ID NO: 62114 - protein, 11 aa, Borrelia burgdorferi B31
TAEELGMQPAK

SEQ ID NO: 62115 - protein, 11 aa, Borrelia burgdorferi B31
QYNQMHMLSNK

SEQ ID NO: 62116 - protein, 11 aa, Borrelia burgdorferi B31
GVSGKINAQIR

SEQ ID NO: 62117 - protein, 11 aa, Borrelia burgdorferi B31
KTQEKLSSGYR

SEQ ID NO: 62118 - protein, 11 aa, Borrelia burgdorferi B31
NHNTSAINASR

SEQ ID NO: 62119 - protein, 11 aa, Borrelia burgdorferi B31
NIYAANVANLF

SEQ ID NO: 62120 - protein, 11 aa, Borrelia burgdorferi B31
EKLSSGYRINR

SEQ ID NO: 62121 - protein, 11 aa, Borrelia burgdorferi B31
ENLKASYAQIK

SEQ ID NO: 62122 - protein, 9 aa, Borrelia burgdorferi B31
SPVNVTTTV

SEQ ID NO: 62123 - protein, 9 aa, Borrelia burgdorferi B31
VPQYVLSLL

SEQ ID NO: 62124 - protein, 9 aa, Borrelia burgdorferi B31
QPAKINTPA

SEQ ID NO: 62125 - protein, 9 aa, Borrelia burgdorferi B31
VVAATTNSI

SEQ ID NO: 62126 - protein, 9 aa, Borrelia burgdorferi B31
QPAPATAPS

SEQ ID NO: 62127 - protein, 9 aa, Borrelia burgdorferi B31
LVRMKELAV

SEQ ID NO: 62128 - protein, 9 aa, Borrelia burgdorferi B31
ASRNTSKAI

SEQ ID NO: 62129 - protein, 9 aa, Borrelia burgdorferi B31
IINHNTSAI

SEQ ID NO: 62130 - protein, 9 aa, Borrelia burgdorferi B31
TPASLSGSQ

SEQ ID NO: 62131 - protein, 9 aa, Borrelia burgdorferi B31
APSQGGVNS

SEQ ID NO: 62132 - protein, 9 aa, Borrelia burgdorferi B31
VAATTNSIL

SEQ ID NO: 62133 - protein, 9 aa, Borrelia burgdorferi B31
APATAPSQG

SEQ ID NO: 62134 - protein, 9 aa, Borrelia burgdorferi B31
APVQEGVQQ

SEQ ID NO: 62135 - protein, 9 aa, Borrelia burgdorferi B31
ILTQSAMAM

SEQ ID NO: 62136 - protein, 10 aa, Borrelia burgdorferi B31
TPASLSGSQA

SEQ ID NO: 62137 - protein, 10 aa, Borrelia burgdorferi B31
SPVNVTTTVD

SEQ ID NO: 62138 - protein, 10 aa, Borrelia burgdorferi B31
VVAATTNSIL

SEQ ID NO: 62139 - protein, 10 aa, Borrelia burgdorferi B31
APSQGGVNSP

SEQ ID NO: 62140 - protein, 10 aa, Borrelia burgdorferi B31
QPAKINTPAS

SEQ ID NO: 62141 - protein, 10 aa, Borrelia burgdorferi B31
QASRNTSKAI

SEQ ID NO: 62142 - protein, 10 aa, Borrelia burgdorferi B31
MIINHNTSAI

SEQ ID NO: 62143 - protein, 11 aa, Borrelia burgdorferi B31
APSQGGVNSPV

SEQ ID NO: 62144 - protein, 11 aa, Borrelia burgdorferi B31
QPAKINTPASL

SEQ ID NO: 62145 - protein, 11 aa, Borrelia burgdorferi B31
APATAPSQGGV

SEQ ID NO: 62146 - protein, 11 aa, Borrelia burgdorferi B31
SPVNVTTTVDA

SEQ ID NO: 62147 - protein, 11 aa, Borrelia burgdorferi B31
TPASLSGSQAS

SEQ ID NO: 62148 - protein, 11 aa, Borrelia burgdorferi B31
AANLSKTQEKL

SEQ ID NO: 62149 - protein, 11 aa, Borrelia burgdorferi B31
RANLGAFQNRL

SEQ ID NO: 62150 - protein, 9 aa, Borrelia burgdorferi B31
YAQIKDATM

SEQ ID NO: 62151 - protein, 9 aa, Borrelia burgdorferi B31
KVLVRMKEL

SEQ ID NO: 62152 - protein, 11 aa, Borrelia burgdorferi B31
VEKVLVRMKEL

SEQ ID NO: 62153 - protein, 9 aa, Borrelia burgdorferi B31
AQANQVPQY

SEQ ID NO: 62154 - protein, 9 aa, Borrelia burgdorferi B31
DQRANLGAF

SEQ ID NO: 62155 - protein, 9 aa, Borrelia burgdorferi B31
YAANVANLF

SEQ ID NO: 62156 - protein, 9 aa, Borrelia burgdorferi B31
AVQSGNGTY

SEQ ID NO: 62157 - protein, 9 aa, Borrelia burgdorferi B31
TQEKLSSGY

SEQ ID NO: 62158 - protein, 9 aa, Borrelia burgdorferi B31
ILTQSAMAM

SEQ ID NO: 62159 - protein, 9 aa, Borrelia burgdorferi B31
AQYNQMHML

SEQ ID NO: 62160 - protein, 9 aa, Borrelia burgdorferi B31
VVAATTNSI

SEQ ID NO: 62161 - protein, 9 aa, Borrelia burgdorferi B31
AQTAQAAPV

SEQ ID NO: 62162 - protein, 9 aa, Borrelia burgdorferi B31
SQGGVNSPV

SEQ ID NO: 62163 - protein, 9 aa, Borrelia burgdorferi B31
ESIKNSTEY

SEQ ID NO: 62164 - protein, 9 aa, Borrelia burgdorferi B31
SLSGSQASW

SEQ ID NO: 62165 - protein, 9 aa, Borrelia burgdorferi B31
SQASWTLRV

SEQ ID NO: 62166 - protein, 9 aa, Borrelia burgdorferi B31
IQIEIEQLT

SEQ ID NO: 62167 - protein, 9 aa, Borrelia burgdorferi B31
AMIAQANQV

SEQ ID NO: 62168 - protein, 10 aa, Borrelia burgdorferi B31
YAIENLKASY

SEQ ID NO: 62169 - protein, 10 aa, Borrelia burgdorferi B31
LAVQSGNGTY

SEQ ID NO: 62170 - protein, 10 aa, Borrelia burgdorferi B31
SQASWTLRVH

SEQ ID NO: 62171 - protein, 10 aa, Borrelia burgdorferi B31
KTQEKLSSGY

SEQ ID NO: 62172 - protein, 10 aa, Borrelia burgdorferi B31
SQNVRTAEEL

SEQ ID NO: 62173 - protein, 10 aa, Borrelia burgdorferi B31
RMISDQRANL

SEQ ID NO: 62174 - protein, 10 aa, Borrelia burgdorferi B31
VQQEGAQQPA

SEQ ID NO: 62175 - protein, 10 aa, Borrelia burgdorferi B31
IAQANQVPQY

SEQ ID NO: 62176 - protein, 10 aa, Borrelia burgdorferi B31
VVAATTNSIL

SEQ ID NO: 62177 - protein, 10 aa, Borrelia burgdorferi B31
AQAAPVQEGV

SEQ ID NO: 62178 - protein, 10 aa, Borrelia burgdorferi B31
AQIRGLSQAS

SEQ ID NO: 62179 - protein, 10 aa, Borrelia burgdorferi B31
NQVPQYVLSL

SEQ ID NO: 62180 - protein, 10 aa, Borrelia burgdorferi B31
INRIADQAQY

SEQ ID NO: 62181 - protein, 10 aa, Borrelia burgdorferi B31
MQPAKINTPA

SEQ ID NO: 62182 - protein, 11 aa, Borrelia burgdorferi B31
SQASRNTSKAI

SEQ ID NO: 62183 - protein, 11 aa, Borrelia burgdorferi B31
AQANQVPQYVL

SEQ ID NO: 62184 - protein, 11 aa, Borrelia burgdorferi B31
MIAQANQVPQY

SEQ ID NO: 62185 - protein, 11 aa, Borrelia burgdorferi B31
ASRNTSKAINF

SEQ ID NO: 62186 - protein, 11 aa, Borrelia burgdorferi B31
ELAVQSGNGTY

SEQ ID NO: 62187 - protein, 11 aa, Borrelia burgdorferi B31
RLESIKNSTEY

SEQ ID NO: 62188 - protein, 11 aa, Borrelia burgdorferi B31
NIYAANVANLF

SEQ ID NO: 62189 - protein, 11 aa, Borrelia burgdorferi B31
NQDEAIAVNIY

SEQ ID NO: 62190 - protein, 11 aa, Borrelia burgdorferi B31
SLSGSQASWTL

SEQ ID NO: 62191 - protein, 9 aa, Borrelia burgdorferi B31
NRIADQAQY

SEQ ID NO: 62192 - protein, 9 aa, Borrelia burgdorferi B31
IRGLSQASR

SEQ ID NO: 62193 - protein, 9 aa, Borrelia burgdorferi B31
QRANLGAFQ

SEQ ID NO: 62194 - protein, 10 aa, Borrelia burgdorferi B31
SRNTSKAINF

SEQ ID NO: 62195 - protein, 11 aa, Borrelia burgdorferi B31
QRANLGAFQNR

SEQ ID NO: 62196 - protein, 11 aa, Borrelia burgdorferi B31
IRMISDQRANL

SEQ ID NO: 62197 - protein, 11 aa, Borrelia burgdorferi B31
SRNNGINAANL

SEQ ID NO: 62198 - protein, 9 aa, Borrelia burgdorferi B31
YAANVANLF

SEQ ID NO: 62199 - protein, 9 aa, Borrelia burgdorferi B31
YAQIKDATM

SEQ ID NO: 62200 - protein, 9 aa, Borrelia burgdorferi B31
QPAPATAPS

SEQ ID NO: 62201 - protein, 9 aa, Borrelia burgdorferi B31
RASDDAAGM

SEQ ID NO: 62202 - protein, 9 aa, Borrelia burgdorferi B31
SPVNVTTTV

SEQ ID NO: 62203 - protein, 9 aa, Borrelia burgdorferi B31
ESIKNSTEY

SEQ ID NO: 62204 - protein, 9 aa, Borrelia burgdorferi B31
ILTQSAMAM

SEQ ID NO: 62205 - protein, 9 aa, Borrelia burgdorferi B31
DEAIAVNIY

SEQ ID NO: 62206 - protein, 9 aa, Borrelia burgdorferi B31
TTVDANTSL

SEQ ID NO: 62207 - protein, 9 aa, Borrelia burgdorferi B31
LAVQSGNGT

SEQ ID NO: 62208 - protein, 9 aa, Borrelia burgdorferi B31
QPAKINTPA

SEQ ID NO: 62209 - protein, 9 aa, Borrelia burgdorferi B31
NSILTQSAM

SEQ ID NO: 62210 - protein, 9 aa, Borrelia burgdorferi B31
YAIENLKAS

SEQ ID NO: 62211 - protein, 9 aa, Borrelia burgdorferi B31
AVQSGNGTY

SEQ ID NO: 62212 - protein, 9 aa, Borrelia burgdorferi B31
QASWTLRVH

SEQ ID NO: 62213 - protein, 9 aa, Borrelia burgdorferi B31
VAATTNSIL

SEQ ID NO: 62214 - protein, 9 aa, Borrelia burgdorferi B31
IAVNIYAAN

SEQ ID NO: 62215 - protein, 9 aa, Borrelia burgdorferi B31
MTDEVVAAT

SEQ ID NO: 62216 - protein, 9 aa, Borrelia burgdorferi B31
VPQYVLSLL

SEQ ID NO: 62217 - protein, 10 aa, Borrelia burgdorferi B31
LAVQSGNGTY

SEQ ID NO: 62218 - protein, 10 aa, Borrelia burgdorferi B31
YAIENLKASY

SEQ ID NO: 62219 - protein, 10 aa, Borrelia burgdorferi B31
IADQAQYNQM

SEQ ID NO: 62220 - protein, 10 aa, Borrelia burgdorferi B31
SILTQSAMAM

SEQ ID NO: 62221 - protein, 10 aa, Borrelia burgdorferi B31
IAQANQVPQY

SEQ ID NO: 62222 - protein, 10 aa, Borrelia burgdorferi B31
QPAKINTPAS

SEQ ID NO: 62223 - protein, 10 aa, Borrelia burgdorferi B31
LAKIENAIRM

SEQ ID NO: 62224 - protein, 10 aa, Borrelia burgdorferi B31
QANQVPQYVL

SEQ ID NO: 62225 - protein, 10 aa, Borrelia burgdorferi B31
QPAPATAPSQ

SEQ ID NO: 62226 - protein, 10 aa, Borrelia burgdorferi B31
YAANVANLFS

SEQ ID NO: 62227 - protein, 10 aa, Borrelia burgdorferi B31
TAEELGMQPA

SEQ ID NO: 62228 - protein, 10 aa, Borrelia burgdorferi B31
MIINHNTSAI

SEQ ID NO: 62229 - protein, 10 aa, Borrelia burgdorferi B31
EAIAVNIYAA

SEQ ID NO: 62230 - protein, 10 aa, Borrelia burgdorferi B31
NRASDDAAGM

SEQ ID NO: 62231 - protein, 10 aa, Borrelia burgdorferi B31
QAQYNQMHML

SEQ ID NO: 62232 - protein, 10 aa, Borrelia burgdorferi B31
TPASLSGSQA

SEQ ID NO: 62233 - protein, 10 aa, Borrelia burgdorferi B31
SPVNVTTTVD

SEQ ID NO: 62234 - protein, 10 aa, Borrelia burgdorferi B31
SYAQIKDATM

SEQ ID NO: 62235 - protein, 10 aa, Borrelia burgdorferi B31
MAMIAQANQV

SEQ ID NO: 62236 - protein, 11 aa, Borrelia burgdorferi B31
MIAQANQVPQY

SEQ ID NO: 62237 - protein, 11 aa, Borrelia burgdorferi B31
TPASLSGSQAS

SEQ ID NO: 62238 - protein, 11 aa, Borrelia burgdorferi B31
ELAVQSGNGTY

SEQ ID NO: 62239 - protein, 11 aa, Borrelia burgdorferi B31
NQDEAIAVNIY

SEQ ID NO: 62240 - protein, 11 aa, Borrelia burgdorferi B31
QPAKINTPASL

SEQ ID NO: 62241 - protein, 11 aa, Borrelia burgdorferi B31
IAVNIYAANVA

SEQ ID NO: 62242 - protein, 11 aa, Borrelia burgdorferi B31
NSILTQSAMAM

SEQ ID NO: 62243 - protein, 11 aa, Borrelia burgdorferi B31
NIYAANVANLF

SEQ ID NO: 62244 - protein, 11 aa, Borrelia burgdorferi B31
EVVAATTNSIL

SEQ ID NO: 62245 - protein, 11 aa, Borrelia burgdorferi B31
TTNSILTQSAM

SEQ ID NO: 62246 - protein, 11 aa, Borrelia burgdorferi B31
SPVNVTTTVDA

SEQ ID NO: 62247 - protein, 11 aa, Borrelia burgdorferi B31
EINRIADQAQY

SEQ ID NO: 62248 - protein, 11 aa, Borrelia burgdorferi B31
NASRNNGINAA

SEQ ID NO: 62249 - protein, 11 aa, Borrelia burgdorferi B31
IADQAQYNQMH

SEQ ID NO: 62250 - protein, 11 aa, Borrelia burgdorferi B31
ISDQRANLGAF

SEQ ID NO: 62251 - protein, 11 aa, Borrelia burgdorferi B31
APSQGGVNSPV

SEQ ID NO: 62252 - protein, 11 aa, Borrelia burgdorferi B31
LAVQSGNGTYS

SEQ ID NO: 62253 - protein, 11 aa, Borrelia burgdorferi B31
EYAIENLKASY

SEQ ID NO: 62254 - protein, 10 aa, Borrelia burgdorferi B31
EELGMQPAKI

SEQ ID NO: 62255 - protein, 10 aa, Borrelia burgdorferi B31
NEVEKVLVRM

SEQ ID NO: 62256 - protein, 10 aa, Borrelia burgdorferi B31
DEINRIADQA

SEQ ID NO: 62257 - protein, 11 aa, Borrelia burgdorferi B31
EEYNRINEDLA

SEQ ID NO: 62258 - protein, 9 aa, Borrelia burgdorferi B31
LPSLEEAIA

SEQ ID NO: 62259 - protein, 11 aa, Borrelia burgdorferi B31
APATAPSQGGV

SEQ ID NO: 62260 - protein, 11 aa, Borrelia burgdorferi B31
APSQGGVNSPV

SEQ ID NO: 62261 - protein, 10 aa, Borrelia burgdorferi B31
ASLSGSQASW

SEQ ID NO: 62262 - protein, 9 aa, Borrelia burgdorferi B31
YSSAVNAIY

SEQ ID NO: 62263 - protein, 9 aa, Borrelia burgdorferi B31
TTNDSSTAY

SEQ ID NO: 62264 - protein, 9 aa, Borrelia burgdorferi B31
YTQFSSHNY

SEQ ID NO: 62265 - protein, 9 aa, Borrelia burgdorferi B31
AIDRETLTY

SEQ ID NO: 62266 - protein, 9 aa, Borrelia burgdorferi B31
DSSTAYKMY

SEQ ID NO: 62267 - protein, 9 aa, Borrelia burgdorferi B31
FLSIFTQGY

SEQ ID NO: 62268 - protein, 9 aa, Borrelia burgdorferi B31
RSDYYSSAV

SEQ ID NO: 62269 - protein, 9 aa, Borrelia burgdorferi B31
SSDGTVYTF

SEQ ID NO: 62270 - protein, 10 aa, Borrelia burgdorferi B31
YTTNDSSTAY

SEQ ID NO: 62271 - protein, 10 aa, Borrelia burgdorferi B31
SSAVNAIYFY

SEQ ID NO: 62272 - protein, 10 aa, Borrelia burgdorferi B31
SSHNYSNPEY

SEQ ID NO: 62273 - protein, 10 aa, Borrelia burgdorferi B31
YLNTKANGNY

SEQ ID NO: 62274 - protein, 10 aa, Borrelia burgdorferi B31
ATPNFSSYSY

SEQ ID NO: 62275 - protein, 10 aa, Borrelia burgdorferi B31
ELENEEWTTY

SEQ ID NO: 62276 - protein, 10 aa, Borrelia burgdorferi B31
YSSAVNAIYF

SEQ ID NO: 62277 - protein, 10 aa, Borrelia burgdorferi B31
EVELEEITFY

SEQ ID NO: 62278 - protein, 11 aa, Borrelia burgdorferi B31
YSSAVNAIYFY

SEQ ID NO: 62279 - protein, 11 aa, Borrelia burgdorferi B31
FSSHNYSNPEY

SEQ ID NO: 62280 - protein, 11 aa, Borrelia burgdorferi B31
TLAIDRETLTY

SEQ ID NO: 62281 - protein, 11 aa, Borrelia burgdorferi B31
LTFLSIFTQGY

SEQ ID NO: 62282 - protein, 11 aa, Borrelia burgdorferi B31
YADPLTFLSIF

SEQ ID NO: 62283 - protein, 9 aa, Borrelia burgdorferi B31
SLFLIIFFL

SEQ ID NO: 62284 - protein, 9 aa, Borrelia burgdorferi B31
KLQRSLFLI

SEQ ID NO: 62285 - protein, 9 aa, Borrelia burgdorferi B31
IIIEKDFPI

SEQ ID NO: 62286 - protein, 9 aa, Borrelia burgdorferi B31
AVNAIYFYA

SEQ ID NO: 62287 - protein, 9 aa, Borrelia burgdorferi B31
AIDEKTLEI

SEQ ID NO: 62288 - protein, 9 aa, Borrelia burgdorferi B31
LIIFFLTFL

SEQ ID NO: 62289 - protein, 9 aa, Borrelia burgdorferi B31
LVHQSFIPV

SEQ ID NO: 62290 - protein, 9 aa, Borrelia burgdorferi B31
VLDNGTTPT

SEQ ID NO: 62291 - protein, 9 aa, Borrelia burgdorferi B31
SLELFNPEI

SEQ ID NO: 62292 - protein, 9 aa, Borrelia burgdorferi B31
YSYAKSLEL

SEQ ID NO: 62293 - protein, 9 aa, Borrelia burgdorferi B31
SLGAEPSSL

SEQ ID NO: 62294 - protein, 9 aa, Borrelia burgdorferi B31
HQSFIPVPV

SEQ ID NO: 62295 - protein, 9 aa, Borrelia burgdorferi B31
WIGDYADPL

SEQ ID NO: 62296 - protein, 9 aa, Borrelia burgdorferi B31
MVTSGPFKL

SEQ ID NO: 62297 - protein, 9 aa, Borrelia burgdorferi B31
ELEEITFYT

SEQ ID NO: 62298 - protein, 9 aa, Borrelia burgdorferi B31
KMIDTMFRG

SEQ ID NO: 62299 - protein, 9 aa, Borrelia burgdorferi B31
AIYFYAFNT

SEQ ID NO: 62300 - protein, 9 aa, Borrelia burgdorferi B31
KTLEITLES

SEQ ID NO: 62301 - protein, 9 aa, Borrelia burgdorferi B31
ITWSDGVAI

SEQ ID NO: 62302 - protein, 9 aa, Borrelia burgdorferi B31
FLIIFFLTF

SEQ ID NO: 62303 - protein, 9 aa, Borrelia burgdorferi B31
MIDTMFRGI

SEQ ID NO: 62304 - protein, 9 aa, Borrelia burgdorferi B31
RSDYYSSAV

SEQ ID NO: 62305 - protein, 9 aa, Borrelia burgdorferi B31
YKMYENEEL

SEQ ID NO: 62306 - protein, 9 aa, Borrelia burgdorferi B31
YFYAFNTHI

SEQ ID NO: 62307 - protein, 10 aa, Borrelia burgdorferi B31
FLIIFFLTFL

SEQ ID NO: 62308 - protein, 10 aa, Borrelia burgdorferi B31
MLVHQSFIPV

SEQ ID NO: 62309 - protein, 10 aa, Borrelia burgdorferi B31
KMIDTMFRGI

SEQ ID NO: 62310 - protein, 10 aa, Borrelia burgdorferi B31
KLQRSLFLII

SEQ ID NO: 62311 - protein, 10 aa, Borrelia burgdorferi B31
SLFLIIFFLT

SEQ ID NO: 62312 - protein, 10 aa, Borrelia burgdorferi B31
YADPLTFLSI

SEQ ID NO: 62313 - protein, 10 aa, Borrelia burgdorferi B31
KMYENEELDA

SEQ ID NO: 62314 - protein, 10 aa, Borrelia burgdorferi B31
AIFGSIPPDL

SEQ ID NO: 62315 - protein, 10 aa, Borrelia burgdorferi B31
FLSIFTQGYT

SEQ ID NO: 62316 - protein, 10 aa, Borrelia burgdorferi B31
NMVTSGPFKL

SEQ ID NO: 62317 - protein, 10 aa, Borrelia burgdorferi B31
KLRSDYYSSA

SEQ ID NO: 62318 - protein, 10 aa, Borrelia burgdorferi B31
RSLFLIIFFL

SEQ ID NO: 62319 - protein, 10 aa, Borrelia burgdorferi B31
SAVNAIYFYA

SEQ ID NO: 62320 - protein, 10 aa, Borrelia burgdorferi B31
IIIEKDFPIA

SEQ ID NO: 62321 - protein, 10 aa, Borrelia burgdorferi B31
KSLELFNPEI

SEQ ID NO: 62322 - protein, 10 aa, Borrelia burgdorferi B31
YAFNTHIKPL

SEQ ID NO: 62323 - protein, 10 aa, Borrelia burgdorferi B31
MIDTMFRGIV

SEQ ID NO: 62324 - protein, 10 aa, Borrelia burgdorferi B31
TLESPKPYFI

SEQ ID NO: 62325 - protein, 10 aa, Borrelia burgdorferi B31
ILERFDLSQL

SEQ ID NO: 62326 - protein, 10 aa, Borrelia burgdorferi B31
KVLDNGTTPT

SEQ ID NO: 62327 - protein, 10 aa, Borrelia burgdorferi B31
SIPPDLIKNL

SEQ ID NO: 62328 - protein, 10 aa, Borrelia burgdorferi B31
RAIDEKTLEI

SEQ ID NO: 62329 - protein, 10 aa, Borrelia burgdorferi B31
FLIIFFLTFL

SEQ ID NO: 62330 - protein, 10 aa, Borrelia burgdorferi B31
MLVHQSFIPV

SEQ ID NO: 62331 - protein, 10 aa, Borrelia burgdorferi B31
KMIDTMFRGI

SEQ ID NO: 62332 - protein, 10 aa, Borrelia burgdorferi B31
KLQRSLFLII

SEQ ID NO: 62333 - protein, 10 aa, Borrelia burgdorferi B31
SLFLIIFFLT

SEQ ID NO: 62334 - protein, 10 aa, Borrelia burgdorferi B31
YADPLTFLSI

SEQ ID NO: 62335 - protein, 10 aa, Borrelia burgdorferi B31
KMYENEELDA

SEQ ID NO: 62336 - protein, 10 aa, Borrelia burgdorferi B31
AIFGSIPPDL

SEQ ID NO: 62337 - protein, 10 aa, Borrelia burgdorferi B31
FLSIFTQGYT

SEQ ID NO: 62338 - protein, 10 aa, Borrelia burgdorferi B31
NMVTSGPFKL

SEQ ID NO: 62339 - protein, 10 aa, Borrelia burgdorferi B31
KLRSDYYSSA

SEQ ID NO: 62340 - protein, 10 aa, Borrelia burgdorferi B31
RSLFLIIFFL

SEQ ID NO: 62341 - protein, 10 aa, Borrelia burgdorferi B31
SAVNAIYFYA

SEQ ID NO: 62342 - protein, 10 aa, Borrelia burgdorferi B31
IIIEKDFPIA

SEQ ID NO: 62343 - protein, 10 aa, Borrelia burgdorferi B31
KSLELFNPEI

SEQ ID NO: 62344 - protein, 10 aa, Borrelia burgdorferi B31
YAFNTHIKPL

SEQ ID NO: 62345 - protein, 10 aa, Borrelia burgdorferi B31
MIDTMFRGIV

SEQ ID NO: 62346 - protein, 10 aa, Borrelia burgdorferi B31
TLESPKPYFI

SEQ ID NO: 62347 - protein, 10 aa, Borrelia burgdorferi B31
ILERFDLSQL

SEQ ID NO: 62348 - protein, 10 aa, Borrelia burgdorferi B31
KVLDNGTTPT

SEQ ID NO: 62349 - protein, 10 aa, Borrelia burgdorferi B31
SIPPDLIKNL

SEQ ID NO: 62350 - protein, 10 aa, Borrelia burgdorferi B31
RAIDEKTLEI

SEQ ID NO: 62351 - protein, 9 aa, Borrelia burgdorferi B31
KSYLRILNK

SEQ ID NO: 62352 - protein, 9 aa, Borrelia burgdorferi B31
ILNKETGSK

SEQ ID NO: 62353 - protein, 9 aa, Borrelia burgdorferi B31
NMVTSGPFK

SEQ ID NO: 62354 - protein, 9 aa, Borrelia burgdorferi B31
VTSGPFKLK

SEQ ID NO: 62355 - protein, 9 aa, Borrelia burgdorferi B31
ELFNPEIAK

SEQ ID NO: 62356 - protein, 9 aa, Borrelia burgdorferi B31
LTFLCCNNK

SEQ ID NO: 62357 - protein, 9 aa, Borrelia burgdorferi B31
KSVIKNGQK

SEQ ID NO: 62358 - protein, 9 aa, Borrelia burgdorferi B31
GSKYVEMVK

SEQ ID NO: 62359 - protein, 9 aa, Borrelia burgdorferi B31
AITAEGIRK

SEQ ID NO: 62360 - protein, 9 aa, Borrelia burgdorferi B31
TTNDSSTAY

SEQ ID NO: 62361 - protein, 9 aa, Borrelia burgdorferi B31
GSIPPDLIK

SEQ ID NO: 62362 - protein, 9 aa, Borrelia burgdorferi B31
RATPNFSSY

SEQ ID NO: 62363 - protein, 9 aa, Borrelia burgdorferi B31
NSYLFRNDK

SEQ ID NO: 62364 - protein, 9 aa, Borrelia burgdorferi B31
GGNKPGLAK

SEQ ID NO: 62365 - protein, 10 aa, Borrelia burgdorferi B31
RILNKETGSK

SEQ ID NO: 62366 - protein, 10 aa, Borrelia burgdorferi B31
YIYGNSYLFR

SEQ ID NO: 62367 - protein, 10 aa, Borrelia burgdorferi B31
TVYTFNLREK

SEQ ID NO: 62368 - protein, 10 aa, Borrelia burgdorferi B31
TTNDSSTAYK

SEQ ID NO: 62369 - protein, 10 aa, Borrelia burgdorferi B31
MVTSGPFKLK

SEQ ID NO: 62370 - protein, 10 aa, Borrelia burgdorferi B31
AIDRETLTYK

SEQ ID NO: 62371 - protein, 10 aa, Borrelia burgdorferi B31
FLTFLCCNNK

SEQ ID NO: 62372 - protein, 10 aa, Borrelia burgdorferi B31
ATPNFSSYSY

SEQ ID NO: 62373 - protein, 10 aa, Borrelia burgdorferi B31
RKSYLRILNK

SEQ ID NO: 62374 - protein, 10 aa, Borrelia burgdorferi B31
YFYAFNTHIK

SEQ ID NO: 62375 - protein, 10 aa, Borrelia burgdorferi B31
VAITAEGIRK

SEQ ID NO: 62376 - protein, 10 aa, Borrelia burgdorferi B31
KLKERIPNEK

SEQ ID NO: 62377 - protein, 10 aa, Borrelia burgdorferi B31
YVEMVKSVIK

SEQ ID NO: 62378 - protein, 10 aa, Borrelia burgdorferi B31
KPLDNVKIRK

SEQ ID NO: 62379 - protein, 10 aa, Borrelia burgdorferi B31
RQAEEIIIEK

SEQ ID NO: 62380 - protein, 10 aa, Borrelia burgdorferi B31
TLEITLESPK

SEQ ID NO: 62381 - protein, 10 aa, Borrelia burgdorferi B31
SSAVNAIYFY

SEQ ID NO: 62382 - protein, 10 aa, Borrelia burgdorferi B31
GNGFPILKLK

SEQ ID NO: 62383 - protein, 10 aa, Borrelia burgdorferi B31
TGGNKPGLAK

SEQ ID NO: 62384 - protein, 10 aa, Borrelia burgdorferi B31
ENMVTSGPFK

SEQ ID NO: 62385 - protein, 10 aa, Borrelia burgdorferi B31
ILNKETGSKY

SEQ ID NO: 62386 - protein, 10 aa, Borrelia burgdorferi B31
QLAEDNVASK

SEQ ID NO: 62387 - protein, 10 aa, Borrelia burgdorferi B31
RFDLSQLKLK

SEQ ID NO: 62388 - protein, 10 aa, Borrelia burgdorferi B31
AIYFYAFNTH

SEQ ID NO: 62389 - protein, 10 aa, Borrelia burgdorferi B31
IPVPVHVTEK

SEQ ID NO: 62390 - protein, 10 aa, Borrelia burgdorferi B31
YLNTKANGNY

SEQ ID NO: 62391 - protein, 10 aa, Borrelia burgdorferi B31
LELFNPEIAK

SEQ ID NO: 62392 - protein, 10 aa, Borrelia burgdorferi B31
ASKMIDTMFR

SEQ ID NO: 62393 - protein, 10 aa, Borrelia burgdorferi B31
FLCCNNKERK

SEQ ID NO: 62394 - protein, 10 aa, Borrelia burgdorferi B31
VLDNGTTPTR

SEQ ID NO: 62395 - protein, 10 aa, Borrelia burgdorferi B31
ELGIRAIDEK

SEQ ID NO: 62396 - protein, 10 aa, Borrelia burgdorferi B31
KERKEGVSFK

SEQ ID NO: 62397 - protein, 10 aa, Borrelia burgdorferi B31
DLSQLKLKNK

SEQ ID NO: 62398 - protein, 10 aa, Borrelia burgdorferi B31
RRATPNFSSY

SEQ ID NO: 62399 - protein, 10 aa, Borrelia burgdorferi B31
LERFDLSQLK

SEQ ID NO: 62400 - protein, 10 aa, Borrelia burgdorferi B31
LKYNTNEANK

SEQ ID NO: 62401 - protein, 11 aa, Borrelia burgdorferi B31
KTLEITLESPK

SEQ ID NO: 62402 - protein, 11 aa, Borrelia burgdorferi B31
KLKYNTNEANK

SEQ ID NO: 62403 - protein, 11 aa, Borrelia burgdorferi B31
MVKSVIKNGQK

SEQ ID NO: 62404 - protein, 11 aa, Borrelia burgdorferi B31
KICEFIQNQWK

SEQ ID NO: 62405 - protein, 11 aa, Borrelia burgdorferi B31
ILERFDLSQLK

SEQ ID NO: 62406 - protein, 11 aa, Borrelia burgdorferi B31
NMVTSGPFKLK

SEQ ID NO: 62407 - protein, 11 aa, Borrelia burgdorferi B31
GVAITAEGIRK

SEQ ID NO: 62408 - protein, 11 aa, Borrelia burgdorferi B31
RILNKETGSKY

SEQ ID NO: 62409 - protein, 11 aa, Borrelia burgdorferi B31
YTTNDSSTAYK

SEQ ID NO: 62410 - protein, 11 aa, Borrelia burgdorferi B31
RIPNEKYVFEK

SEQ ID NO: 62411 - protein, 11 aa, Borrelia burgdorferi B31
VTGDPNTGGNK

SEQ ID NO: 62412 - protein, 11 aa, Borrelia burgdorferi B31
KVLDNGTTPTR

SEQ ID NO: 62413 - protein, 11 aa, Borrelia burgdorferi B31
KLKERIPNEKY

SEQ ID NO: 62414 - protein, 11 aa, Borrelia burgdorferi B31
TLAIDRETLTY

SEQ ID NO: 62415 - protein, 11 aa, Borrelia burgdorferi B31
SLELFNPEIAK

SEQ ID NO: 62416 - protein, 11 aa, Borrelia burgdorferi B31
IYFYAFNTHIK

SEQ ID NO: 62417 - protein, 11 aa, Borrelia burgdorferi B31
FIPVPVHVTEK

SEQ ID NO: 62418 - protein, 11 aa, Borrelia burgdorferi B31
LTFLSIFTQGY

SEQ ID NO: 62419 - protein, 11 aa, Borrelia burgdorferi B31
LAIDRETLTYK

SEQ ID NO: 62420 - protein, 11 aa, Borrelia burgdorferi B31
GTVYTFNLREK

SEQ ID NO: 62421 - protein, 11 aa, Borrelia burgdorferi B31
IFGSIPPDLIK

SEQ ID NO: 62422 - protein, 11 aa, Borrelia burgdorferi B31
VLDNGTTPTRR

SEQ ID NO: 62423 - protein, 11 aa, Borrelia burgdorferi B31
RATPNFSSYSY

SEQ ID NO: 62424 - protein, 11 aa, Borrelia burgdorferi B31
SIPPDLIKNLK

SEQ ID NO: 62425 - protein, 11 aa, Borrelia burgdorferi B31
NTGGNKPGLAK

SEQ ID NO: 62426 - protein, 11 aa, Borrelia burgdorferi B31
YSSAVNAIYFY

SEQ ID NO: 62427 - protein, 9 aa, Borrelia burgdorferi B31
KSYLRILNK

SEQ ID NO: 62428 - protein, 9 aa, Borrelia burgdorferi B31
VTSGPFKLK

SEQ ID NO: 62429 - protein, 9 aa, Borrelia burgdorferi B31
LTFLCCNNK

SEQ ID NO: 62430 - protein, 9 aa, Borrelia burgdorferi B31
AITAEGIRK

SEQ ID NO: 62431 - protein, 9 aa, Borrelia burgdorferi B31
NSYLFRNDK

SEQ ID NO: 62432 - protein, 9 aa, Borrelia burgdorferi B31
TTNDSSTAY

SEQ ID NO: 62433 - protein, 9 aa, Borrelia burgdorferi B31
GSIPPDLIK

SEQ ID NO: 62434 - protein, 9 aa, Borrelia burgdorferi B31
GTVYTFNLR

SEQ ID NO: 62435 - protein, 9 aa, Borrelia burgdorferi B31
NMVTSGPFK

SEQ ID NO: 62436 - protein, 9 aa, Borrelia burgdorferi B31
GSKYVEMVK

SEQ ID NO: 62437 - protein, 9 aa, Borrelia burgdorferi B31
SAVNAIYFY

SEQ ID NO: 62438 - protein, 9 aa, Borrelia burgdorferi B31
KSVIKNGQK

SEQ ID NO: 62439 - protein, 9 aa, Borrelia burgdorferi B31
YTQFSSHNY

SEQ ID NO: 62440 - protein, 9 aa, Borrelia burgdorferi B31
ILNKETGSK

SEQ ID NO: 62441 - protein, 9 aa, Borrelia burgdorferi B31
LSQLKLKNK

SEQ ID NO: 62442 - protein, 9 aa, Borrelia burgdorferi B31
QAEEIIIEK

SEQ ID NO: 62443 - protein, 9 aa, Borrelia burgdorferi B31
ELFNPEIAK

SEQ ID NO: 62444 - protein, 9 aa, Borrelia burgdorferi B31
AVNAIYFYA

SEQ ID NO: 62445 - protein, 9 aa, Borrelia burgdorferi B31
NFSSYSYAK

SEQ ID NO: 62446 - protein, 9 aa, Borrelia burgdorferi B31
KALTLAIDR

SEQ ID NO: 62447 - protein, 9 aa, Borrelia burgdorferi B31
TVYTFNLRE

SEQ ID NO: 62448 - protein, 9 aa, Borrelia burgdorferi B31
NGNGFPILK

SEQ ID NO: 62449 - protein, 9 aa, Borrelia burgdorferi B31
LAEDNVASK

SEQ ID NO: 62450 - protein, 9 aa, Borrelia burgdorferi B31
TNDSSTAYK

SEQ ID NO: 62451 - protein, 9 aa, Borrelia burgdorferi B31
SVIKNGQKY

SEQ ID NO: 62452 - protein, 9 aa, Borrelia burgdorferi B31
KYNTNEANK

SEQ ID NO: 62453 - protein, 9 aa, Borrelia burgdorferi B31
SKMIDTMFR

SEQ ID NO: 62454 - protein, 9 aa, Borrelia burgdorferi B31
AIYFYAFNT

SEQ ID NO: 62455 - protein, 9 aa, Borrelia burgdorferi B31
ITLESPKPY

SEQ ID NO: 62456 - protein, 9 aa, Borrelia burgdorferi B31
SLFLIIFFL

SEQ ID NO: 62457 - protein, 9 aa, Borrelia burgdorferi B31
KTLLAEAGY

SEQ ID NO: 62458 - protein, 9 aa, Borrelia burgdorferi B31
LTFLSIFTQ

SEQ ID NO: 62459 - protein, 9 aa, Borrelia burgdorferi B31
VTDSELGIR

SEQ ID NO: 62460 - protein, 9 aa, Borrelia burgdorferi B31
PVPVHVTEK

SEQ ID NO: 62461 - protein, 9 aa, Borrelia burgdorferi B31
RATPNFSSY

SEQ ID NO: 62462 - protein, 9 aa, Borrelia burgdorferi B31
AIDRETLTY

SEQ ID NO: 62463 - protein, 9 aa, Borrelia burgdorferi B31
GGNKPGLAK

SEQ ID NO: 62464 - protein, 10 aa, Borrelia burgdorferi B31
TTNDSSTAYK

SEQ ID NO: 62465 - protein, 10 aa, Borrelia burgdorferi B31
TVYTFNLREK

SEQ ID NO: 62466 - protein, 10 aa, Borrelia burgdorferi B31
MVTSGPFKLK

SEQ ID NO: 62467 - protein, 10 aa, Borrelia burgdorferi B31
SSAVNAIYFY

SEQ ID NO: 62468 - protein, 10 aa, Borrelia burgdorferi B31
AIDRETLTYK

SEQ ID NO: 62469 - protein, 10 aa, Borrelia burgdorferi B31
YIYGNSYLFR

SEQ ID NO: 62470 - protein, 10 aa, Borrelia burgdorferi B31
RILNKETGSK

SEQ ID NO: 62471 - protein, 10 aa, Borrelia burgdorferi B31
RQAEEIIIEK

SEQ ID NO: 62472 - protein, 10 aa, Borrelia burgdorferi B31
VAITAEGIRK

SEQ ID NO: 62473 - protein, 10 aa, Borrelia burgdorferi B31
ATPNFSSYSY

SEQ ID NO: 62474 - protein, 10 aa, Borrelia burgdorferi B31
ASKMIDTMFR

SEQ ID NO: 62475 - protein, 10 aa, Borrelia burgdorferi B31
TLEITLESPK

SEQ ID NO: 62476 - protein, 10 aa, Borrelia burgdorferi B31
KSDLELDPIK

SEQ ID NO: 62477 - protein, 10 aa, Borrelia burgdorferi B31
YFYAFNTHIK

SEQ ID NO: 62478 - protein, 10 aa, Borrelia burgdorferi B31
YVEMVKSVIK

SEQ ID NO: 62479 - protein, 10 aa, Borrelia burgdorferi B31
KLKERIPNEK

SEQ ID NO: 62480 - protein, 10 aa, Borrelia burgdorferi B31
AIYFYAFNTH

SEQ ID NO: 62481 - protein, 10 aa, Borrelia burgdorferi B31
SSHNYSNPEY

SEQ ID NO: 62482 - protein, 10 aa, Borrelia burgdorferi B31
QLAEDNVASK

SEQ ID NO: 62483 - protein, 10 aa, Borrelia burgdorferi B31
FLTFLCCNNK

SEQ ID NO: 62484 - protein, 10 aa, Borrelia burgdorferi B31
IPNEKYVFEK

SEQ ID NO: 62485 - protein, 10 aa, Borrelia burgdorferi B31
KANGNYEIAR

SEQ ID NO: 62486 - protein, 10 aa, Borrelia burgdorferi B31
RKSYLRILNK

SEQ ID NO: 62487 - protein, 10 aa, Borrelia burgdorferi B31
TGSKYVEMVK

SEQ ID NO: 62488 - protein, 10 aa, Borrelia burgdorferi B31
AVNAIYFYAF

SEQ ID NO: 62489 - protein, 10 aa, Borrelia burgdorferi B31
KPLDNVKIRK

SEQ ID NO: 62490 - protein, 10 aa, Borrelia burgdorferi B31
TSGPFKLKER

SEQ ID NO: 62491 - protein, 10 aa, Borrelia burgdorferi B31
YVFEKNNKYY

SEQ ID NO: 62492 - protein, 10 aa, Borrelia burgdorferi B31
QVTDSELGIR

SEQ ID NO: 62493 - protein, 10 aa, Borrelia burgdorferi B31
KYNTNEANKK

SEQ ID NO: 62494 - protein, 10 aa, Borrelia burgdorferi B31
GVAITAEGIR

SEQ ID NO: 62495 - protein, 10 aa, Borrelia burgdorferi B31
RFDLSQLKLK

SEQ ID NO: 62496 - protein, 10 aa, Borrelia burgdorferi B31
FLCCNNKERK

SEQ ID NO: 62497 - protein, 11 aa, Borrelia burgdorferi B31
KTLEITLESPK

SEQ ID NO: 62498 - protein, 11 aa, Borrelia burgdorferi B31
KICEFIQNQWK

SEQ ID NO: 62499 - protein, 11 aa, Borrelia burgdorferi B31
GVAITAEGIRK

SEQ ID NO: 62500 - protein, 11 aa, Borrelia burgdorferi B31
YTTNDSSTAYK

SEQ ID NO: 62501 - protein, 11 aa, Borrelia burgdorferi B31
GTVYTFNLREK

SEQ ID NO: 62502 - protein, 11 aa, Borrelia burgdorferi B31
VTGDPNTGGNK

SEQ ID NO: 62503 - protein, 11 aa, Borrelia burgdorferi B31
MVKSVIKNGQK

SEQ ID NO: 62504 - protein, 11 aa, Borrelia burgdorferi B31
SLELFNPEIAK

SEQ ID NO: 62505 - protein, 11 aa, Borrelia burgdorferi B31
LAIDRETLTYK

SEQ ID NO: 62506 - protein, 11 aa, Borrelia burgdorferi B31
TPNFSSYSYAK

SEQ ID NO: 62507 - protein, 11 aa, Borrelia burgdorferi B31
SIPPDLIKNLK

SEQ ID NO: 62508 - protein, 11 aa, Borrelia burgdorferi B31
RIPNEKYVFEK

SEQ ID NO: 62509 - protein, 11 aa, Borrelia burgdorferi B31
KVLDNGTTPTR

SEQ ID NO: 62510 - protein, 11 aa, Borrelia burgdorferi B31
VASKMIDTMFR

SEQ ID NO: 62511 - protein, 11 aa, Borrelia burgdorferi B31
YSSAVNAIYFY

SEQ ID NO: 62512 - protein, 11 aa, Borrelia burgdorferi B31
NTGGNKPGLAK

SEQ ID NO: 62513 - protein, 11 aa, Borrelia burgdorferi B31
NMVTSGPFKLK

SEQ ID NO: 62514 - protein, 11 aa, Borrelia burgdorferi B31
ILERFDLSQLK

SEQ ID NO: 62515 - protein, 11 aa, Borrelia burgdorferi B31
LTFLSIFTQGY

SEQ ID NO: 62516 - protein, 11 aa, Borrelia burgdorferi B31
YSNPEYNELIK

SEQ ID NO: 62517 - protein, 11 aa, Borrelia burgdorferi B31
VTSGPFKLKER

SEQ ID NO: 62518 - protein, 11 aa, Borrelia burgdorferi B31
IYFYAFNTHIK

SEQ ID NO: 62519 - protein, 11 aa, Borrelia burgdorferi B31
ETGSKYVEMVK

SEQ ID NO: 62520 - protein, 11 aa, Borrelia burgdorferi B31
KLKYNTNEANK

SEQ ID NO: 62521 - protein, 11 aa, Borrelia burgdorferi B31
NTHIKPLDNVK

SEQ ID NO: 62522 - protein, 11 aa, Borrelia burgdorferi B31
LTFLCCNNKER

SEQ ID NO: 62523 - protein, 11 aa, Borrelia burgdorferi B31
TAEGIRKSYLR

SEQ ID NO: 62524 - protein, 11 aa, Borrelia burgdorferi B31
AVNAIYFYAFN

SEQ ID NO: 62525 - protein, 11 aa, Borrelia burgdorferi B31
RATPNFSSYSY

SEQ ID NO: 62526 - protein, 11 aa, Borrelia burgdorferi B31
FIPVPVHVTEK

SEQ ID NO: 62527 - protein, 11 aa, Borrelia burgdorferi B31
YPNGNGFPILK

SEQ ID NO: 62528 - protein, 11 aa, Borrelia burgdorferi B31
TFLCCNNKERK

SEQ ID NO: 62529 - protein, 11 aa, Borrelia burgdorferi B31
KSDLELDPIKR

SEQ ID NO: 62530 - protein, 11 aa, Borrelia burgdorferi B31
WTGWNTNILER

SEQ ID NO: 62531 - protein, 11 aa, Borrelia burgdorferi B31
IYIYGNSYLFR

SEQ ID NO: 62532 - protein, 9 aa, Borrelia burgdorferi B31
SYAKSLELF

SEQ ID NO: 62533 - protein, 9 aa, Borrelia burgdorferi B31
YYSSAVNAI

SEQ ID NO: 62534 - protein, 9 aa, Borrelia burgdorferi B31
IYIYGNSYL

SEQ ID NO: 62535 - protein, 9 aa, Borrelia burgdorferi B31
YYDSNEVEL

SEQ ID NO: 62536 - protein, 9 aa, Borrelia burgdorferi B31
FYAFNTHIK

SEQ ID NO: 62537 - protein, 9 aa, Borrelia burgdorferi B31
DFPIAPIYI

SEQ ID NO: 62538 - protein, 9 aa, Borrelia burgdorferi B31
SYLFRNDKW

SEQ ID NO: 62539 - protein, 9 aa, Borrelia burgdorferi B31
DYADPLTFL

SEQ ID NO: 62540 - protein, 9 aa, Borrelia burgdorferi B31
IYGNSYLFR

SEQ ID NO: 62541 - protein, 9 aa, Borrelia burgdorferi B31
IFTQGYTQF

SEQ ID NO: 62542 - protein, 9 aa, Borrelia burgdorferi B31
KLQRSLFLI

SEQ ID NO: 62543 - protein, 9 aa, Borrelia burgdorferi B31
YIYGNSYLF

SEQ ID NO: 62544 - protein, 9 aa, Borrelia burgdorferi B31
SFIPVPVHV

SEQ ID NO: 62545 - protein, 9 aa, Borrelia burgdorferi B31
KYVEMVKSV

SEQ ID NO: 62546 - protein, 9 aa, Borrelia burgdorferi B31
IFGSIPPDL

SEQ ID NO: 62547 - protein, 9 aa, Borrelia burgdorferi B31
RSLFLIIFF

SEQ ID NO: 62548 - protein, 9 aa, Borrelia burgdorferi B31
YFYAFNTHI

SEQ ID NO: 62549 - protein, 9 aa, Borrelia burgdorferi B31
KWTGWNTNI

SEQ ID NO: 62550 - protein, 9 aa, Borrelia burgdorferi B31
SYLRILNKE

SEQ ID NO: 62551 - protein, 9 aa, Borrelia burgdorferi B31
LFLIIFFLT

SEQ ID NO: 62552 - protein, 9 aa, Borrelia burgdorferi B31
IYFYAFNTH

SEQ ID NO: 62553 - protein, 10 aa, Borrelia burgdorferi B31
IYIYGNSYLF

SEQ ID NO: 62554 - protein, 10 aa, Borrelia burgdorferi B31
IYFYAFNTHI

SEQ ID NO: 62555 - protein, 10 aa, Borrelia burgdorferi B31
LFLIIFFLTF

SEQ ID NO: 62556 - protein, 10 aa, Borrelia burgdorferi B31
DYYSSAVNAI

SEQ ID NO: 62557 - protein, 10 aa, Borrelia burgdorferi B31
VYTFNLREKI

SEQ ID NO: 62558 - protein, 10 aa, Borrelia burgdorferi B31
KYVEMVKSVI

SEQ ID NO: 62559 - protein, 10 aa, Borrelia burgdorferi B31
SYSYAKSLEL

SEQ ID NO: 62560 - protein, 10 aa, Borrelia burgdorferi B31
IFGSIPPDLI

SEQ ID NO: 62561 - protein, 10 aa, Borrelia burgdorferi B31
GYPNGNGFPI

SEQ ID NO: 62562 - protein, 10 aa, Borrelia burgdorferi B31
GWNTNILERF

SEQ ID NO: 62563 - protein, 10 aa, Borrelia burgdorferi B31
NYSNPEYNEL

SEQ ID NO: 62564 - protein, 10 aa, Borrelia burgdorferi B31
MYENEELDAI

SEQ ID NO: 62565 - protein, 10 aa, Borrelia burgdorferi B31
KYYDSNEVEL

SEQ ID NO: 62566 - protein, 10 aa, Borrelia burgdorferi B31
NYEIARAGWI

SEQ ID NO: 62567 - protein, 10 aa, Borrelia burgdorferi B31
YYSSAVNAIY

SEQ ID NO: 62568 - protein, 10 aa, Borrelia burgdorferi B31
KWTGWNTNIL

SEQ ID NO: 62569 - protein, 10 aa, Borrelia burgdorferi B31
AYKMYENEEL

SEQ ID NO: 62570 - protein, 10 aa, Borrelia burgdorferi B31
KYNTNEANKK

SEQ ID NO: 62571 - protein, 10 aa, Borrelia burgdorferi B31
AVNAIYFYAF

SEQ ID NO: 62572 - protein, 11 aa, Borrelia burgdorferi B31
YYSSAVNAIYF

SEQ ID NO: 62573 - protein, 11 aa, Borrelia burgdorferi B31
SYSYAKSLELF

SEQ ID NO: 62574 - protein, 11 aa, Borrelia burgdorferi B31
YFIDMLVHQSF

SEQ ID NO: 62575 - protein, 11 aa, Borrelia burgdorferi B31
DYADPLTFLSI

SEQ ID NO: 62576 - protein, 11 aa, Borrelia burgdorferi B31
FYAFNTHIKPL

SEQ ID NO: 62577 - protein, 11 aa, Borrelia burgdorferi B31
NYSNPEYNELI

SEQ ID NO: 62578 - protein, 11 aa, Borrelia burgdorferi B31
KYNTNEANKKI

SEQ ID NO: 62579 - protein, 11 aa, Borrelia burgdorferi B31
MYENEELDAIF

SEQ ID NO: 62580 - protein, 11 aa, Borrelia burgdorferi B31
IYFYAFNTHIK

SEQ ID NO: 62581 - protein, 11 aa, Borrelia burgdorferi B31
LFLIIFFLTFL

SEQ ID NO: 62582 - protein, 11 aa, Borrelia burgdorferi B31
IYIYGNSYLFR

SEQ ID NO: 62583 - protein, 11 aa, Borrelia burgdorferi B31
GYPNGNGFPIL

SEQ ID NO: 62584 - protein, 11 aa, Borrelia burgdorferi B31
ITLESPKPYFI

SEQ ID NO: 62585 - protein, 11 aa, Borrelia burgdorferi B31
TTPTRRATPNF

SEQ ID NO: 62586 - protein, 11 aa, Borrelia burgdorferi B31
FYTTNDSSTAY

SEQ ID NO: 62587 - protein, 9 aa, Borrelia burgdorferi B31
YVFEKNNKY

SEQ ID NO: 62588 - protein, 9 aa, Borrelia burgdorferi B31
SVIKNGQKY

SEQ ID NO: 62589 - protein, 9 aa, Borrelia burgdorferi B31
GFPILKLKY

SEQ ID NO: 62590 - protein, 9 aa, Borrelia burgdorferi B31
DISSDGTVY

SEQ ID NO: 62591 - protein, 9 aa, Borrelia burgdorferi B31
YTQFSSHNY

SEQ ID NO: 62592 - protein, 9 aa, Borrelia burgdorferi B31
YSSAVNAIY

SEQ ID NO: 62593 - protein, 9 aa, Borrelia burgdorferi B31
TTNDSSTAY

SEQ ID NO: 62594 - protein, 9 aa, Borrelia burgdorferi B31
FLSIFTQGY

SEQ ID NO: 62595 - protein, 9 aa, Borrelia burgdorferi B31
YIYGNSYLF

SEQ ID NO: 62596 - protein, 9 aa, Borrelia burgdorferi B31
FLIIFFLTF

SEQ ID NO: 62597 - protein, 9 aa, Borrelia burgdorferi B31
YFYAFNTHI

SEQ ID NO: 62598 - protein, 9 aa, Borrelia burgdorferi B31
VFEKNNKYY

SEQ ID NO: 62599 - protein, 9 aa, Borrelia burgdorferi B31
FPIAPIYIY

SEQ ID NO: 62600 - protein, 9 aa, Borrelia burgdorferi B31
PIYIYGNSY

SEQ ID NO: 62601 - protein, 9 aa, Borrelia burgdorferi B31
IFTQGYTQF

SEQ ID NO: 62602 - protein, 9 aa, Borrelia burgdorferi B31
SAVNAIYFY

SEQ ID NO: 62603 - protein, 9 aa, Borrelia burgdorferi B31
AIDRETLTY

SEQ ID NO: 62604 - protein, 10 aa, Borrelia burgdorferi B31
YVFEKNNKYY

SEQ ID NO: 62605 - protein, 10 aa, Borrelia burgdorferi B31
YYSSAVNAIY

SEQ ID NO: 62606 - protein, 10 aa, Borrelia burgdorferi B31
YTTNDSSTAY

SEQ ID NO: 62607 - protein, 10 aa, Borrelia burgdorferi B31
TFLSIFTQGY

SEQ ID NO: 62608 - protein, 10 aa, Borrelia burgdorferi B31
YLNTKANGNY

SEQ ID NO: 62609 - protein, 10 aa, Borrelia burgdorferi B31
IYIYGNSYLF

SEQ ID NO: 62610 - protein, 10 aa, Borrelia burgdorferi B31
ELENEEWTTY

SEQ ID NO: 62611 - protein, 10 aa, Borrelia burgdorferi B31
EVELEEITFY

SEQ ID NO: 62612 - protein, 10 aa, Borrelia burgdorferi B31
GYTQFSSHNY

SEQ ID NO: 62613 - protein, 10 aa, Borrelia burgdorferi B31
KYVFEKNNKY

SEQ ID NO: 62614 - protein, 10 aa, Borrelia burgdorferi B31
LAIDRETLTY

SEQ ID NO: 62615 - protein, 10 aa, Borrelia burgdorferi B31
SSAVNAIYFY

SEQ ID NO: 62616 - protein, 10 aa, Borrelia burgdorferi B31
ILNKETGSKY

SEQ ID NO: 62617 - protein, 10 aa, Borrelia burgdorferi B31
SIFTQGYTQF

SEQ ID NO: 62618 - protein, 10 aa, Borrelia burgdorferi B31
PVPVHVTEKY

SEQ ID NO: 62619 - protein, 10 aa, Borrelia burgdorferi B31
DFPIAPIYIY

SEQ ID NO: 62620 - protein, 10 aa, Borrelia burgdorferi B31
ATPNFSSYSY

SEQ ID NO: 62621 - protein, 10 aa, Borrelia burgdorferi B31
AVNAIYFYAF

SEQ ID NO: 62622 - protein, 10 aa, Borrelia burgdorferi B31
NGFPILKLKY

SEQ ID NO: 62623 - protein, 10 aa, Borrelia burgdorferi B31
LFLIIFFLTF

SEQ ID NO: 62624 - protein, 10 aa, Borrelia burgdorferi B31
YFYAFNTHIK

SEQ ID NO: 62625 - protein, 10 aa, Borrelia burgdorferi B31
YSSAVNAIYF

SEQ ID NO: 62626 - protein, 10 aa, Borrelia burgdorferi B31
SVIKNGQKYF

SEQ ID NO: 62627 - protein, 10 aa, Borrelia burgdorferi B31
RRATPNFSSY

SEQ ID NO: 62628 - protein, 10 aa, Borrelia burgdorferi B31
WDISSDGTVY

SEQ ID NO: 62629 - protein, 10 aa, Borrelia burgdorferi B31
EITLESPKPY

SEQ ID NO: 62630 - protein, 11 aa, Borrelia burgdorferi B31
FYTTNDSSTAY

SEQ ID NO: 62631 - protein, 11 aa, Borrelia burgdorferi B31
YFIDMLVHQSF

SEQ ID NO: 62632 - protein, 11 aa, Borrelia burgdorferi B31
DYYSSAVNAIY

SEQ ID NO: 62633 - protein, 11 aa, Borrelia burgdorferi B31
YSSAVNAIYFY

SEQ ID NO: 62634 - protein, 11 aa, Borrelia burgdorferi B31
TYLNTKANGNY

SEQ ID NO: 62635 - protein, 11 aa, Borrelia burgdorferi B31
TLAIDRETLTY

SEQ ID NO: 62636 - protein, 11 aa, Borrelia burgdorferi B31
KYVFEKNNKYY

SEQ ID NO: 62637 - protein, 11 aa, Borrelia burgdorferi B31
YYSSAVNAIYF

SEQ ID NO: 62638 - protein, 11 aa, Borrelia burgdorferi B31
SLFLIIFFLTF

SEQ ID NO: 62639 - protein, 11 aa, Borrelia burgdorferi B31
FSSHNYSNPEY

SEQ ID NO: 62640 - protein, 11 aa, Borrelia burgdorferi B31
RILNKETGSKY

SEQ ID NO: 62641 - protein, 11 aa, Borrelia burgdorferi B31
MYENEELDAIF

SEQ ID NO: 62642 - protein, 11 aa, Borrelia burgdorferi B31
EIARAGWIGDY

SEQ ID NO: 62643 - protein, 11 aa, Borrelia burgdorferi B31
KDFPIAPIYIY

SEQ ID NO: 62644 - protein, 11 aa, Borrelia burgdorferi B31
GWDISSDGTVY

SEQ ID NO: 62645 - protein, 11 aa, Borrelia burgdorferi B31
RATPNFSSYSY

SEQ ID NO: 62646 - protein, 11 aa, Borrelia burgdorferi B31
LTFLSIFTQGY

SEQ ID NO: 62647 - protein, 11 aa, Borrelia burgdorferi B31
YADPLTFLSIF

SEQ ID NO: 62648 - protein, 11 aa, Borrelia burgdorferi B31
NVASKMIDTMF

SEQ ID NO: 62649 - protein, 9 aa, Borrelia burgdorferi B31
GTVYTFNLR

SEQ ID NO: 62650 - protein, 9 aa, Borrelia burgdorferi B31
NSYLFRNDK

SEQ ID NO: 62651 - protein, 9 aa, Borrelia burgdorferi B31
FYAFNTHIK

SEQ ID NO: 62652 - protein, 9 aa, Borrelia burgdorferi B31
LTFLCCNNK

SEQ ID NO: 62653 - protein, 9 aa, Borrelia burgdorferi B31
SAVNAIYFY

SEQ ID NO: 62654 - protein, 9 aa, Borrelia burgdorferi B31
ELFNPEIAK

SEQ ID NO: 62655 - protein, 9 aa, Borrelia burgdorferi B31
NFSSYSYAK

SEQ ID NO: 62656 - protein, 9 aa, Borrelia burgdorferi B31
EFIQNQWKK

SEQ ID NO: 62657 - protein, 9 aa, Borrelia burgdorferi B31
DLIKNLKLR

SEQ ID NO: 62658 - protein, 9 aa, Borrelia burgdorferi B31
YTQFSSHNY

SEQ ID NO: 62659 - protein, 9 aa, Borrelia burgdorferi B31
FLCCNNKER

SEQ ID NO: 62660 - protein, 9 aa, Borrelia burgdorferi B31
NMVTSGPFK

SEQ ID NO: 62661 - protein, 9 aa, Borrelia burgdorferi B31
QAEEIIIEK

SEQ ID NO: 62662 - protein, 9 aa, Borrelia burgdorferi B31
TTNDSSTAY

SEQ ID NO: 62663 - protein, 9 aa, Borrelia burgdorferi B31
EGIRKSYLR

SEQ ID NO: 62664 - protein, 9 aa, Borrelia burgdorferi B31
SKMIDTMFR

SEQ ID NO: 62665 - protein, 9 aa, Borrelia burgdorferi B31
YSSAVNAIY

SEQ ID NO: 62666 - protein, 9 aa, Borrelia burgdorferi B31
YIYGNSYLF

SEQ ID NO: 62667 - protein, 9 aa, Borrelia burgdorferi B31
VAITAEGIR

SEQ ID NO: 62668 - protein, 9 aa, Borrelia burgdorferi B31
LTFLSIFTQ

SEQ ID NO: 62669 - protein, 9 aa, Borrelia burgdorferi B31
HIKPLDNVK

SEQ ID NO: 62670 - protein, 9 aa, Borrelia burgdorferi B31
YVFEKNNKY

SEQ ID NO: 62671 - protein, 9 aa, Borrelia burgdorferi B31
TPNFSSYSY

SEQ ID NO: 62672 - protein, 9 aa, Borrelia burgdorferi B31
ERFDLSQLK

SEQ ID NO: 62673 - protein, 9 aa, Borrelia burgdorferi B31
VTSGPFKLK

SEQ ID NO: 62674 - protein, 9 aa, Borrelia burgdorferi B31
NGNGFPILK

SEQ ID NO: 62675 - protein, 9 aa, Borrelia burgdorferi B31
GSKYVEMVK

SEQ ID NO: 62676 - protein, 9 aa, Borrelia burgdorferi B31
NGFPILKLK

SEQ ID NO: 62677 - protein, 9 aa, Borrelia burgdorferi B31
EWTTYLNTK

SEQ ID NO: 62678 - protein, 9 aa, Borrelia burgdorferi B31
LAEDNVASK

SEQ ID NO: 62679 - protein, 9 aa, Borrelia burgdorferi B31
NAIYFYAFN

SEQ ID NO: 62680 - protein, 9 aa, Borrelia burgdorferi B31
TNDSSTAYK

SEQ ID NO: 62681 - protein, 9 aa, Borrelia burgdorferi B31
KSYLRILNK

SEQ ID NO: 62682 - protein, 9 aa, Borrelia burgdorferi B31
IYGNSYLFR

SEQ ID NO: 62683 - protein, 9 aa, Borrelia burgdorferi B31
TVYTFNLRE

SEQ ID NO: 62684 - protein, 9 aa, Borrelia burgdorferi B31
SLFLIIFFL

SEQ ID NO: 62685 - protein, 9 aa, Borrelia burgdorferi B31
DLELDPIKR

SEQ ID NO: 62686 - protein, 9 aa, Borrelia burgdorferi B31
VYTFNLREK

SEQ ID NO: 62687 - protein, 9 aa, Borrelia burgdorferi B31
LDNGTTPTR

SEQ ID NO: 62688 - protein, 9 aa, Borrelia burgdorferi B31
FPIAPIYIY

SEQ ID NO: 62689 - protein, 9 aa, Borrelia burgdorferi B31
KALTLAIDR

SEQ ID NO: 62690 - protein, 9 aa, Borrelia burgdorferi B31
SSTAYKMYE

SEQ ID NO: 62691 - protein, 9 aa, Borrelia burgdorferi B31
ILNKETGSK

SEQ ID NO: 62692 - protein, 9 aa, Borrelia burgdorferi B31
STAYKMYEN

SEQ ID NO: 62693 - protein, 10 aa, Borrelia burgdorferi B31
YIYGNSYLFR

SEQ ID NO: 62694 - protein, 10 aa, Borrelia burgdorferi B31
TTNDSSTAYK

SEQ ID NO: 62695 - protein, 10 aa, Borrelia burgdorferi B31
TVYTFNLREK

SEQ ID NO: 62696 - protein, 10 aa, Borrelia burgdorferi B31
MVTSGPFKLK

SEQ ID NO: 62697 - protein, 10 aa, Borrelia burgdorferi B31
YFYAFNTHIK

SEQ ID NO: 62698 - protein, 10 aa, Borrelia burgdorferi B31
ASKMIDTMFR

SEQ ID NO: 62699 - protein, 10 aa, Borrelia burgdorferi B31
QVTDSELGIR

SEQ ID NO: 62700 - protein, 10 aa, Borrelia burgdorferi B31
FLTFLCCNNK

SEQ ID NO: 62701 - protein, 10 aa, Borrelia burgdorferi B31
DGTVYTFNLR

SEQ ID NO: 62702 - protein, 10 aa, Borrelia burgdorferi B31
SSAVNAIYFY

SEQ ID NO: 62703 - protein, 10 aa, Borrelia burgdorferi B31
YVEMVKSVIK

SEQ ID NO: 62704 - protein, 10 aa, Borrelia burgdorferi B31
YTTNDSSTAY

SEQ ID NO: 62705 - protein, 10 aa, Borrelia burgdorferi B31
YVFEKNNKYY

SEQ ID NO: 62706 - protein, 10 aa, Borrelia burgdorferi B31
TSGPFKLKER

SEQ ID NO: 62707 - protein, 10 aa, Borrelia burgdorferi B31
ENMVTSGPFK

SEQ ID NO: 62708 - protein, 10 aa, Borrelia burgdorferi B31
GVAITAEGIR

SEQ ID NO: 62709 - protein, 10 aa, Borrelia burgdorferi B31
DPIKRQDILR

SEQ ID NO: 62710 - protein, 10 aa, Borrelia burgdorferi B31
FLCCNNKERK

SEQ ID NO: 62711 - protein, 10 aa, Borrelia burgdorferi B31
KANGNYEIAR

SEQ ID NO: 62712 - protein, 10 aa, Borrelia burgdorferi B31
QLAEDNVASK

SEQ ID NO: 62713 - protein, 10 aa, Borrelia burgdorferi B31
TFLCCNNKER

SEQ ID NO: 62714 - protein, 10 aa, Borrelia burgdorferi B31
TGSKYVEMVK

SEQ ID NO: 62715 - protein, 10 aa, Borrelia burgdorferi B31
IPVPVHVTEK

SEQ ID NO: 62716 - protein, 10 aa, Borrelia burgdorferi B31
ELGIRAIDEK

SEQ ID NO: 62717 - protein, 10 aa, Borrelia burgdorferi B31
EVELEEITFY

SEQ ID NO: 62718 - protein, 10 aa, Borrelia burgdorferi B31
IPNEKYVFEK

SEQ ID NO: 62719 - protein, 10 aa, Borrelia burgdorferi B31
TGWNTNILER

SEQ ID NO: 62720 - protein, 10 aa, Borrelia burgdorferi B31
SSHNYSNPEY

SEQ ID NO: 62721 - protein, 10 aa, Borrelia burgdorferi B31
SSYSYAKSLE

SEQ ID NO: 62722 - protein, 10 aa, Borrelia burgdorferi B31
ITAEGIRKSY

SEQ ID NO: 62723 - protein, 10 aa, Borrelia burgdorferi B31
TLEITLESPK

SEQ ID NO: 62724 - protein, 10 aa, Borrelia burgdorferi B31
EKYVFEKNNK

SEQ ID NO: 62725 - protein, 10 aa, Borrelia burgdorferi B31
VAITAEGIRK

SEQ ID NO: 62726 - protein, 10 aa, Borrelia burgdorferi B31
ATPNFSSYSY

SEQ ID NO: 62727 - protein, 10 aa, Borrelia burgdorferi B31
DLSQLKLKNK

SEQ ID NO: 62728 - protein, 10 aa, Borrelia burgdorferi B31
CEFIQNQWKK

SEQ ID NO: 62729 - protein, 10 aa, Borrelia burgdorferi B31
STAYKMYENE

SEQ ID NO: 62730 - protein, 10 aa, Borrelia burgdorferi B31
NAIYFYAFNT

SEQ ID NO: 62731 - protein, 10 aa, Borrelia burgdorferi B31
TAYKMYENEE

SEQ ID NO: 62732 - protein, 11 aa, Borrelia burgdorferi B31
YTTNDSSTAYK

SEQ ID NO: 62733 - protein, 11 aa, Borrelia burgdorferi B31
LTFLCCNNKER

SEQ ID NO: 62734 - protein, 11 aa, Borrelia burgdorferi B31
TAEGIRKSYLR

SEQ ID NO: 62735 - protein, 11 aa, Borrelia burgdorferi B31
MVKSVIKNGQK

SEQ ID NO: 62736 - protein, 11 aa, Borrelia burgdorferi B31
VASKMIDTMFR

SEQ ID NO: 62737 - protein, 11 aa, Borrelia burgdorferi B31
IYIYGNSYLFR

SEQ ID NO: 62738 - protein, 11 aa, Borrelia burgdorferi B31
YSSAVNAIYFY

SEQ ID NO: 62739 - protein, 11 aa, Borrelia burgdorferi B31
WTGWNTNILER

SEQ ID NO: 62740 - protein, 11 aa, Borrelia burgdorferi B31
ETGSKYVEMVK

SEQ ID NO: 62741 - protein, 11 aa, Borrelia burgdorferi B31
TPNFSSYSYAK

SEQ ID NO: 62742 - protein, 11 aa, Borrelia burgdorferi B31
LAIDRETLTYK

SEQ ID NO: 62743 - protein, 11 aa, Borrelia burgdorferi B31
GTVYTFNLREK

SEQ ID NO: 62744 - protein, 11 aa, Borrelia burgdorferi B31
IYFYAFNTHIK

SEQ ID NO: 62745 - protein, 11 aa, Borrelia burgdorferi B31
LTFLSIFTQGY

SEQ ID NO: 62746 - protein, 11 aa, Borrelia burgdorferi B31
NTHIKPLDNVK

SEQ ID NO: 62747 - protein, 11 aa, Borrelia burgdorferi B31
VTSGPFKLKER

SEQ ID NO: 62748 - protein, 11 aa, Borrelia burgdorferi B31
HIKPLDNVKIR

SEQ ID NO: 62749 - protein, 11 aa, Borrelia burgdorferi B31
DGVAITAEGIR

SEQ ID NO: 62750 - protein, 11 aa, Borrelia burgdorferi B31
NMVTSGPFKLK

SEQ ID NO: 62751 - protein, 11 aa, Borrelia burgdorferi B31
YSNPEYNELIK

SEQ ID NO: 62752 - protein, 11 aa, Borrelia burgdorferi B31
YPNGNGFPILK

SEQ ID NO: 62753 - protein, 11 aa, Borrelia burgdorferi B31
FSSHNYSNPEY

SEQ ID NO: 62754 - protein, 11 aa, Borrelia burgdorferi B31
TKANGNYEIAR

SEQ ID NO: 62755 - protein, 11 aa, Borrelia burgdorferi B31
NTGGNKPGLAK

SEQ ID NO: 62756 - protein, 11 aa, Borrelia burgdorferi B31
DYYSSAVNAIY

SEQ ID NO: 62757 - protein, 11 aa, Borrelia burgdorferi B31
FIPVPVHVTEK

SEQ ID NO: 62758 - protein, 11 aa, Borrelia burgdorferi B31
KTLEITLESPK

SEQ ID NO: 62759 - protein, 11 aa, Borrelia burgdorferi B31
SIPPDLIKNLK

SEQ ID NO: 62760 - protein, 11 aa, Borrelia burgdorferi B31
KVLDNGTTPTR

SEQ ID NO: 62761 - protein, 11 aa, Borrelia burgdorferi B31
NAIYFYAFNTH

SEQ ID NO: 62762 - protein, 11 aa, Borrelia burgdorferi B31
GVAITAEGIRK

SEQ ID NO: 62763 - protein, 11 aa, Borrelia burgdorferi B31
RIPNEKYVFEK

SEQ ID NO: 62764 - protein, 11 aa, Borrelia burgdorferi B31
SLELFNPEIAK

SEQ ID NO: 62765 - protein, 11 aa, Borrelia burgdorferi B31
STAYKMYENEE

SEQ ID NO: 62766 - protein, 11 aa, Borrelia burgdorferi B31
NGNGFPILKLK

SEQ ID NO: 62767 - protein, 11 aa, Borrelia burgdorferi B31
ERFDLSQLKLK

SEQ ID NO: 62768 - protein, 11 aa, Borrelia burgdorferi B31
KICEFIQNQWK

SEQ ID NO: 62769 - protein, 11 aa, Borrelia burgdorferi B31
TFLCCNNKERK

SEQ ID NO: 62770 - protein, 11 aa, Borrelia burgdorferi B31
ILERFDLSQLK

SEQ ID NO: 62771 - protein, 11 aa, Borrelia burgdorferi B31
YGNSYLFRNDK

SEQ ID NO: 62772 - protein, 11 aa, Borrelia burgdorferi B31
EIARAGWIGDY

SEQ ID NO: 62773 - protein, 11 aa, Borrelia burgdorferi B31
FFLTFLCCNNK

SEQ ID NO: 62774 - protein, 11 aa, Borrelia burgdorferi B31
MVTSGPFKLKE

SEQ ID NO: 62775 - protein, 11 aa, Borrelia burgdorferi B31
FTQGYTQFSSH

SEQ ID NO: 62776 - protein, 11 aa, Borrelia burgdorferi B31
TTNDSSTAYKM

SEQ ID NO: 62777 - protein, 9 aa, Borrelia burgdorferi B31
YPNGNGFPI

SEQ ID NO: 62778 - protein, 9 aa, Borrelia burgdorferi B31
NPEIAKTLL

SEQ ID NO: 62779 - protein, 9 aa, Borrelia burgdorferi B31
SPKPYFIDM

SEQ ID NO: 62780 - protein, 9 aa, Borrelia burgdorferi B31
TPTRRATPN

SEQ ID NO: 62781 - protein, 9 aa, Borrelia burgdorferi B31
TPNFSSYSY

SEQ ID NO: 62782 - protein, 9 aa, Borrelia burgdorferi B31
SPENMVTSG

SEQ ID NO: 62783 - protein, 9 aa, Borrelia burgdorferi B31
KPYFIDMLV

SEQ ID NO: 62784 - protein, 9 aa, Borrelia burgdorferi B31
DPIKRQDIL

SEQ ID NO: 62785 - protein, 10 aa, Borrelia burgdorferi B31
YPNGNGFPIL

SEQ ID NO: 62786 - protein, 10 aa, Borrelia burgdorferi B31
KIRKALTLAI

SEQ ID NO: 62787 - protein, 10 aa, Borrelia burgdorferi B31
TPTRRATPNF

SEQ ID NO: 62788 - protein, 10 aa, Borrelia burgdorferi B31
SPKPYFIDML

SEQ ID NO: 62789 - protein, 10 aa, Borrelia burgdorferi B31
APIYIYGNSY

SEQ ID NO: 62790 - protein, 10 aa, Borrelia burgdorferi B31
TPNFSSYSYA

SEQ ID NO: 62791 - protein, 10 aa, Borrelia burgdorferi B31
KPGLAKGWDI

SEQ ID NO: 62792 - protein, 10 aa, Borrelia burgdorferi B31
GIRKSYLRIL

SEQ ID NO: 62793 - protein, 11 aa, Borrelia burgdorferi B31
SPENMVTSGPF

SEQ ID NO: 62794 - protein, 11 aa, Borrelia burgdorferi B31
APIYIYGNSYL

SEQ ID NO: 62795 - protein, 11 aa, Borrelia burgdorferi B31
IPPDLIKNLKL

SEQ ID NO: 62796 - protein, 11 aa, Borrelia burgdorferi B31
KPLDNVKIRKA

SEQ ID NO: 62797 - protein, 11 aa, Borrelia burgdorferi B31
KISLGAEPSSL

SEQ ID NO: 62798 - protein, 11 aa, Borrelia burgdorferi B31
TPTRRATPNFS

SEQ ID NO: 62799 - protein, 9 aa, Borrelia burgdorferi B31
FLIIFFLTF

SEQ ID NO: 62800 - protein, 9 aa, Borrelia burgdorferi B31
IRKALTLAI

SEQ ID NO: 62801 - protein, 10 aa, Borrelia burgdorferi B31
NVKIRKALTL

SEQ ID NO: 62802 - protein, 10 aa, Borrelia burgdorferi B31
KIRKALTLAI

SEQ ID NO: 62803 - protein, 9 aa, Borrelia burgdorferi B31
YVFEKNNKY

SEQ ID NO: 62804 - protein, 9 aa, Borrelia burgdorferi B31
YSSAVNAIY

SEQ ID NO: 62805 - protein, 9 aa, Borrelia burgdorferi B31
TTNDSSTAY

SEQ ID NO: 62806 - protein, 9 aa, Borrelia burgdorferi B31
YTQFSSHNY

SEQ ID NO: 62807 - protein, 9 aa, Borrelia burgdorferi B31
FLSIFTQGY

SEQ ID NO: 62808 - protein, 9 aa, Borrelia burgdorferi B31
FLIIFFLTF

SEQ ID NO: 62809 - protein, 9 aa, Borrelia burgdorferi B31
ITLESPKPY

SEQ ID NO: 62810 - protein, 9 aa, Borrelia burgdorferi B31
YIYGNSYLF

SEQ ID NO: 62811 - protein, 9 aa, Borrelia burgdorferi B31
SVIKNGQKY

SEQ ID NO: 62812 - protein, 9 aa, Borrelia burgdorferi B31
VIKNGQKYF

SEQ ID NO: 62813 - protein, 9 aa, Borrelia burgdorferi B31
RATPNFSSY

SEQ ID NO: 62814 - protein, 9 aa, Borrelia burgdorferi B31
LNKETGSKY

SEQ ID NO: 62815 - protein, 9 aa, Borrelia burgdorferi B31
YSYAKSLEL

SEQ ID NO: 62816 - protein, 9 aa, Borrelia burgdorferi B31
IQNQWKKNL

SEQ ID NO: 62817 - protein, 9 aa, Borrelia burgdorferi B31
SSAVNAIYF

SEQ ID NO: 62818 - protein, 9 aa, Borrelia burgdorferi B31
AGYPNGNGF

SEQ ID NO: 62819 - protein, 9 aa, Borrelia burgdorferi B31
NLKLRSDYY

SEQ ID NO: 62820 - protein, 9 aa, Borrelia burgdorferi B31
ASKMIDTMF

SEQ ID NO: 62821 - protein, 9 aa, Borrelia burgdorferi B31
PIYIYGNSY

SEQ ID NO: 62822 - protein, 9 aa, Borrelia burgdorferi B31
ENMVTSGPF

SEQ ID NO: 62823 - protein, 9 aa, Borrelia burgdorferi B31
KERKEGVSF

SEQ ID NO: 62824 - protein, 9 aa, Borrelia burgdorferi B31
RSLFLIIFF

SEQ ID NO: 62825 - protein, 9 aa, Borrelia burgdorferi B31
LENEEWTTY

SEQ ID NO: 62826 - protein, 9 aa, Borrelia burgdorferi B31
RQAEEIIIE

SEQ ID NO: 62827 - protein, 9 aa, Borrelia burgdorferi B31
KTLLAEAGY

SEQ ID NO: 62828 - protein, 9 aa, Borrelia burgdorferi B31
YSNPEYNEL

SEQ ID NO: 62829 - protein, 10 aa, Borrelia burgdorferi B31
YVFEKNNKYY

SEQ ID NO: 62830 - protein, 10 aa, Borrelia burgdorferi B31
ITAEGIRKSY

SEQ ID NO: 62831 - protein, 10 aa, Borrelia burgdorferi B31
YTTNDSSTAY

SEQ ID NO: 62832 - protein, 10 aa, Borrelia burgdorferi B31
YSSAVNAIYF

SEQ ID NO: 62833 - protein, 10 aa, Borrelia burgdorferi B31
IARAGWIGDY

SEQ ID NO: 62834 - protein, 10 aa, Borrelia burgdorferi B31
YLNTKANGNY

SEQ ID NO: 62835 - protein, 10 aa, Borrelia burgdorferi B31
LQRSLFLIIF

SEQ ID NO: 62836 - protein, 10 aa, Borrelia burgdorferi B31
YSYAKSLELF

SEQ ID NO: 62837 - protein, 10 aa, Borrelia burgdorferi B31
ISSDGTVYTF

SEQ ID NO: 62838 - protein, 10 aa, Borrelia burgdorferi B31
AVNAIYFYAF

SEQ ID NO: 62839 - protein, 10 aa, Borrelia burgdorferi B31
SSHNYSNPEY

SEQ ID NO: 62840 - protein, 10 aa, Borrelia burgdorferi B31
LAIDRETLTY

SEQ ID NO: 62841 - protein, 10 aa, Borrelia burgdorferi B31
ILNKETGSKY

SEQ ID NO: 62842 - protein, 10 aa, Borrelia burgdorferi B31
SVIKNGQKYF

SEQ ID NO: 62843 - protein, 10 aa, Borrelia burgdorferi B31
HQSFIPVPVH

SEQ ID NO: 62844 - protein, 10 aa, Borrelia burgdorferi B31
SSAVNAIYFY

SEQ ID NO: 62845 - protein, 10 aa, Borrelia burgdorferi B31
GQNWTSPENM

SEQ ID NO: 62846 - protein, 10 aa, Borrelia burgdorferi B31
YAFNTHIKPL

SEQ ID NO: 62847 - protein, 10 aa, Borrelia burgdorferi B31
ATPNFSSYSY

SEQ ID NO: 62848 - protein, 10 aa, Borrelia burgdorferi B31
SIFTQGYTQF

SEQ ID NO: 62849 - protein, 10 aa, Borrelia burgdorferi B31
KSVIKNGQKY

SEQ ID NO: 62850 - protein, 10 aa, Borrelia burgdorferi B31
ITLESPKPYF

SEQ ID NO: 62851 - protein, 10 aa, Borrelia burgdorferi B31
YENEELDAIF

SEQ ID NO: 62852 - protein, 10 aa, Borrelia burgdorferi B31
YYSSAVNAIY

SEQ ID NO: 62853 - protein, 10 aa, Borrelia burgdorferi B31
WDISSDGTVY

SEQ ID NO: 62854 - protein, 10 aa, Borrelia burgdorferi B31
GQKYFDGQVT

SEQ ID NO: 62855 - protein, 10 aa, Borrelia burgdorferi B31
KMIDTMFRGI

SEQ ID NO: 62856 - protein, 11 aa, Borrelia burgdorferi B31
YSSAVNAIYFY

SEQ ID NO: 62857 - protein, 11 aa, Borrelia burgdorferi B31
LQRSLFLIIFF

SEQ ID NO: 62858 - protein, 11 aa, Borrelia burgdorferi B31
LTFLSIFTQGY

SEQ ID NO: 62859 - protein, 11 aa, Borrelia burgdorferi B31
KLKERIPNEKY

SEQ ID NO: 62860 - protein, 11 aa, Borrelia burgdorferi B31
YFIDMLVHQSF

SEQ ID NO: 62861 - protein, 11 aa, Borrelia burgdorferi B31
FSSHNYSNPEY

SEQ ID NO: 62862 - protein, 11 aa, Borrelia burgdorferi B31
SLFLIIFFLTF

SEQ ID NO: 62863 - protein, 11 aa, Borrelia burgdorferi B31
TLAIDRETLTY

SEQ ID NO: 62864 - protein, 11 aa, Borrelia burgdorferi B31
RATPNFSSYSY

SEQ ID NO: 62865 - protein, 11 aa, Borrelia burgdorferi B31
LSIFTQGYTQF

SEQ ID NO: 62866 - protein, 11 aa, Borrelia burgdorferi B31
KLQRSLFLIIF

SEQ ID NO: 62867 - protein, 11 aa, Borrelia burgdorferi B31
AITAEGIRKSY

SEQ ID NO: 62868 - protein, 11 aa, Borrelia burgdorferi B31
IAKTLLAEAGY

SEQ ID NO: 62869 - protein, 11 aa, Borrelia burgdorferi B31
KSVIKNGQKYF

SEQ ID NO: 62870 - protein, 11 aa, Borrelia burgdorferi B31
RILNKETGSKY

SEQ ID NO: 62871 - protein, 11 aa, Borrelia burgdorferi B31
LIKNLKLRSDY

SEQ ID NO: 62872 - protein, 11 aa, Borrelia burgdorferi B31
LEITLESPKPY

SEQ ID NO: 62873 - protein, 11 aa, Borrelia burgdorferi B31
YLFRNDKWTGW

SEQ ID NO: 62874 - protein, 11 aa, Borrelia burgdorferi B31
WIGDYADPLTF

SEQ ID NO: 62875 - protein, 11 aa, Borrelia burgdorferi B31
QGYTQFSSHNY

SEQ ID NO: 62876 - protein, 11 aa, Borrelia burgdorferi B31
IAPIYIYGNSY

SEQ ID NO: 62877 - protein, 11 aa, Borrelia burgdorferi B31
QLAEDNVASKM

SEQ ID NO: 62878 - protein, 11 aa, Borrelia burgdorferi B31
SAVNAIYFYAF

SEQ ID NO: 62879 - protein, 11 aa, Borrelia burgdorferi B31
IQNQWKKNLNI

SEQ ID NO: 62880 - protein, 11 aa, Borrelia burgdorferi B31
KMYENEELDAI

SEQ ID NO: 62881 - protein, 11 aa, Borrelia burgdorferi B31
IEKDFPIAPIY

SEQ ID NO: 62882 - protein, 9 aa, Borrelia burgdorferi B31
ARAGWIGDY

SEQ ID NO: 62883 - protein, 10 aa, Borrelia burgdorferi B31
RRATPNFSSY

SEQ ID NO: 62884 - protein, 10 aa, Borrelia burgdorferi B31
RQAEEIIIEK

SEQ ID NO: 62885 - protein, 10 aa, Borrelia burgdorferi B31
ERFDLSQLKL

SEQ ID NO: 62886 - protein, 10 aa, Borrelia burgdorferi B31
QRSLFLIIFF

SEQ ID NO: 62887 - protein, 10 aa, Borrelia burgdorferi B31
RKSYLRILNK

SEQ ID NO: 62888 - protein, 10 aa, Borrelia burgdorferi B31
KRQDILRQAE

SEQ ID NO: 62889 - protein, 11 aa, Borrelia burgdorferi B31
LRILNKETGSK

SEQ ID NO: 62890 - protein, 11 aa, Borrelia burgdorferi B31
RRATPNFSSYS

SEQ ID NO: 62891 - protein, 11 aa, Borrelia burgdorferi B31
RKEGVSFKISL

SEQ ID NO: 62892 - protein, 11 aa, Borrelia burgdorferi B31
QRSLFLIIFFL

SEQ ID NO: 62893 - protein, 11 aa, Borrelia burgdorferi B31
LRQAEEIIIEK

SEQ ID NO: 62894 - protein, 11 aa, Borrelia burgdorferi B31
ERFDLSQLKLK

SEQ ID NO: 62895 - protein, 11 aa, Borrelia burgdorferi B31
IRKSYLRILNK

SEQ ID NO: 62896 - protein, 9 aa, Borrelia burgdorferi B31
TPNFSSYSY

SEQ ID NO: 62897 - protein, 9 aa, Borrelia burgdorferi B31
FPIAPIYIY

SEQ ID NO: 62898 - protein, 9 aa, Borrelia burgdorferi B31
TTNDSSTAY

SEQ ID NO: 62899 - protein, 9 aa, Borrelia burgdorferi B31
DPLTFLSIF

SEQ ID NO: 62900 - protein, 9 aa, Borrelia burgdorferi B31
SAVNAIYFY

SEQ ID NO: 62901 - protein, 9 aa, Borrelia burgdorferi B31
YPNGNGFPI

SEQ ID NO: 62902 - protein, 9 aa, Borrelia burgdorferi B31
VPVHVTEKY

SEQ ID NO: 62903 - protein, 9 aa, Borrelia burgdorferi B31
YSSAVNAIY

SEQ ID NO: 62904 - protein, 9 aa, Borrelia burgdorferi B31
DISSDGTVY

SEQ ID NO: 62905 - protein, 9 aa, Borrelia burgdorferi B31
YVFEKNNKY

SEQ ID NO: 62906 - protein, 9 aa, Borrelia burgdorferi B31
EPSSLDPQL

SEQ ID NO: 62907 - protein, 9 aa, Borrelia burgdorferi B31
VASKMIDTM

SEQ ID NO: 62908 - protein, 9 aa, Borrelia burgdorferi B31
EVELEEITF

SEQ ID NO: 62909 - protein, 9 aa, Borrelia burgdorferi B31
FLIIFFLTF

SEQ ID NO: 62910 - protein, 9 aa, Borrelia burgdorferi B31
YIYGNSYLF

SEQ ID NO: 62911 - protein, 9 aa, Borrelia burgdorferi B31
FLSIFTQGY

SEQ ID NO: 62912 - protein, 9 aa, Borrelia burgdorferi B31
WTGWNTNIL

SEQ ID NO: 62913 - protein, 9 aa, Borrelia burgdorferi B31
YTQFSSHNY

SEQ ID NO: 62914 - protein, 9 aa, Borrelia burgdorferi B31
SPKPYFIDM

SEQ ID NO: 62915 - protein, 9 aa, Borrelia burgdorferi B31
NPEIAKTLL

SEQ ID NO: 62916 - protein, 9 aa, Borrelia burgdorferi B31
RATPNFSSY

SEQ ID NO: 62917 - protein, 9 aa, Borrelia burgdorferi B31
WIGDYADPL

SEQ ID NO: 62918 - protein, 9 aa, Borrelia burgdorferi B31
LENEEWTTY

SEQ ID NO: 62919 - protein, 9 aa, Borrelia burgdorferi B31
ENEELDAIF

SEQ ID NO: 62920 - protein, 9 aa, Borrelia burgdorferi B31
TAEGIRKSY

SEQ ID NO: 62921 - protein, 9 aa, Borrelia burgdorferi B31
YSNPEYNEL

SEQ ID NO: 62922 - protein, 9 aa, Borrelia burgdorferi B31
ITLESPKPY

SEQ ID NO: 62923 - protein, 9 aa, Borrelia burgdorferi B31
DSSTAYKMY

SEQ ID NO: 62924 - protein, 9 aa, Borrelia burgdorferi B31
VNAIYFYAF

SEQ ID NO: 62925 - protein, 9 aa, Borrelia burgdorferi B31
ITWSDGVAI

SEQ ID NO: 62926 - protein, 9 aa, Borrelia burgdorferi B31
EANKKICEF

SEQ ID NO: 62927 - protein, 9 aa, Borrelia burgdorferi B31
SHNYSNPEY

SEQ ID NO: 62928 - protein, 9 aa, Borrelia burgdorferi B31
YYSSAVNAI

SEQ ID NO: 62929 - protein, 9 aa, Borrelia burgdorferi B31
ENMVTSGPF

SEQ ID NO: 62930 - protein, 9 aa, Borrelia burgdorferi B31
IFTQGYTQF

SEQ ID NO: 62931 - protein, 10 aa, Borrelia burgdorferi B31
YPNGNGFPIL

SEQ ID NO: 62932 - protein, 10 aa, Borrelia burgdorferi B31
YTTNDSSTAY

SEQ ID NO: 62933 - protein, 10 aa, Borrelia burgdorferi B31
LAIDRETLTY

SEQ ID NO: 62934 - protein, 10 aa, Borrelia burgdorferi B31
APIYIYGNSY

SEQ ID NO: 62935 - protein, 10 aa, Borrelia burgdorferi B31
VASKMIDTMF

SEQ ID NO: 62936 - protein, 10 aa, Borrelia burgdorferi B31
YYSSAVNAIY

SEQ ID NO: 62937 - protein, 10 aa, Borrelia burgdorferi B31
YENEELDAIF

SEQ ID NO: 62938 - protein, 10 aa, Borrelia burgdorferi B31
WDISSDGTVY

SEQ ID NO: 62939 - protein, 10 aa, Borrelia burgdorferi B31
LAEDNVASKM

SEQ ID NO: 62940 - protein, 10 aa, Borrelia burgdorferi B31
YVFEKNNKYY

SEQ ID NO: 62941 - protein, 10 aa, Borrelia burgdorferi B31
YAFNTHIKPL

SEQ ID NO: 62942 - protein, 10 aa, Borrelia burgdorferi B31
EVELEEITFY

SEQ ID NO: 62943 - protein, 10 aa, Borrelia burgdorferi B31
TPTRRATPNF

SEQ ID NO: 62944 - protein, 10 aa, Borrelia burgdorferi B31
ELENEEWTTY

SEQ ID NO: 62945 - protein, 10 aa, Borrelia burgdorferi B31
ISSDGTVYTF

SEQ ID NO: 62946 - protein, 10 aa, Borrelia burgdorferi B31
AVNAIYFYAF

SEQ ID NO: 62947 - protein, 10 aa, Borrelia burgdorferi B31
TFLSIFTQGY

SEQ ID NO: 62948 - protein, 10 aa, Borrelia burgdorferi B31
YSSAVNAIYF

SEQ ID NO: 62949 - protein, 10 aa, Borrelia burgdorferi B31
LFLIIFFLTF

SEQ ID NO: 62950 - protein, 10 aa, Borrelia burgdorferi B31
SSHNYSNPEY

SEQ ID NO: 62951 - protein, 10 aa, Borrelia burgdorferi B31
KPYFIDMLVH

SEQ ID NO: 62952 - protein, 10 aa, Borrelia burgdorferi B31
NVASKMIDTM

SEQ ID NO: 62953 - protein, 10 aa, Borrelia burgdorferi B31
EAGYPNGNGF

SEQ ID NO: 62954 - protein, 10 aa, Borrelia burgdorferi B31
DPQLAEDNVA

SEQ ID NO: 62955 - protein, 10 aa, Borrelia burgdorferi B31
SPKPYFIDML

SEQ ID NO: 62956 - protein, 10 aa, Borrelia burgdorferi B31
NEVELEEITF

SEQ ID NO: 62957 - protein, 10 aa, Borrelia burgdorferi B31
EPSSLDPQLA

SEQ ID NO: 62958 - protein, 10 aa, Borrelia burgdorferi B31
TPNFSSYSYA

SEQ ID NO: 62959 - protein, 10 aa, Borrelia burgdorferi B31
EITLESPKPY

SEQ ID NO: 62960 - protein, 10 aa, Borrelia burgdorferi B31
FIDMLVHQSF

SEQ ID NO: 62961 - protein, 10 aa, Borrelia burgdorferi B31
SSAVNAIYFY

SEQ ID NO: 62962 - protein, 10 aa, Borrelia burgdorferi B31
YLNTKANGNY

SEQ ID NO: 62963 - protein, 10 aa, Borrelia burgdorferi B31
YADPLTFLSI

SEQ ID NO: 62964 - protein, 10 aa, Borrelia burgdorferi B31
DPLTFLSIFT

SEQ ID NO: 62965 - protein, 10 aa, Borrelia burgdorferi B31
IGDYADPLTF

SEQ ID NO: 62966 - protein, 10 aa, Borrelia burgdorferi B31
SIFTQGYTQF

SEQ ID NO: 62967 - protein, 10 aa, Borrelia burgdorferi B31
YSYAKSLELF

SEQ ID NO: 62968 - protein, 10 aa, Borrelia burgdorferi B31
DPNTGGNKPG

SEQ ID NO: 62969 - protein, 10 aa, Borrelia burgdorferi B31
DFPIAPIYIY

SEQ ID NO: 62970 - protein, 11 aa, Borrelia burgdorferi B31
SPENMVTSGPF

SEQ ID NO: 62971 - protein, 11 aa, Borrelia burgdorferi B31
SAVNAIYFYAF

SEQ ID NO: 62972 - protein, 11 aa, Borrelia burgdorferi B31
IPVPVHVTEKY

SEQ ID NO: 62973 - protein, 11 aa, Borrelia burgdorferi B31
YADPLTFLSIF

SEQ ID NO: 62974 - protein, 11 aa, Borrelia burgdorferi B31
FYTTNDSSTAY

SEQ ID NO: 62975 - protein, 11 aa, Borrelia burgdorferi B31
IAPIYIYGNSY

SEQ ID NO: 62976 - protein, 11 aa, Borrelia burgdorferi B31
YSSAVNAIYFY

SEQ ID NO: 62977 - protein, 11 aa, Borrelia burgdorferi B31
YFIDMLVHQSF

SEQ ID NO: 62978 - protein, 11 aa, Borrelia burgdorferi B31
IAKTLLAEAGY

SEQ ID NO: 62979 - protein, 11 aa, Borrelia burgdorferi B31
DPNTGGNKPGL

SEQ ID NO: 62980 - protein, 11 aa, Borrelia burgdorferi B31
FSSHNYSNPEY

SEQ ID NO: 62981 - protein, 11 aa, Borrelia burgdorferi B31
WIGDYADPLTF

SEQ ID NO: 62982 - protein, 11 aa, Borrelia burgdorferi B31
RATPNFSSYSY

SEQ ID NO: 62983 - protein, 11 aa, Borrelia burgdorferi B31
NAIYFYAFNTH

SEQ ID NO: 62984 - protein, 11 aa, Borrelia burgdorferi B31
TPNFSSYSYAK

SEQ ID NO: 62985 - protein, 11 aa, Borrelia burgdorferi B31
NVASKMIDTMF

SEQ ID NO: 62986 - protein, 11 aa, Borrelia burgdorferi B31
MYENEELDAIF

SEQ ID NO: 62987 - protein, 11 aa, Borrelia burgdorferi B31
YYSSAVNAIYF

SEQ ID NO: 62988 - protein, 11 aa, Borrelia burgdorferi B31
DISSDGTVYTF

SEQ ID NO: 62989 - protein, 11 aa, Borrelia burgdorferi B31
TLAIDRETLTY

SEQ ID NO: 62990 - protein, 11 aa, Borrelia burgdorferi B31
DPQLAEDNVAS

SEQ ID NO: 62991 - protein, 11 aa, Borrelia burgdorferi B31
LTFLSIFTQGY

SEQ ID NO: 62992 - protein, 11 aa, Borrelia burgdorferi B31
EPSSLDPQLAE

SEQ ID NO: 62993 - protein, 11 aa, Borrelia burgdorferi B31
TTNDSSTAYKM

SEQ ID NO: 62994 - protein, 11 aa, Borrelia burgdorferi B31
NEVELEEITFY

SEQ ID NO: 62995 - protein, 11 aa, Borrelia burgdorferi B31
QAEEIIIEKDF

SEQ ID NO: 62996 - protein, 11 aa, Borrelia burgdorferi B31
YPNGNGFPILK

SEQ ID NO: 62997 - protein, 11 aa, Borrelia burgdorferi B31
TAYKMYENEEL

SEQ ID NO: 62998 - protein, 11 aa, Borrelia burgdorferi B31
TGWNTNILERF

SEQ ID NO: 62999 - protein, 11 aa, Borrelia burgdorferi B31
YFDGQVTDSEL

SEQ ID NO: 63000 - protein, 11 aa, Borrelia burgdorferi B31
DKWTGWNTNIL

SEQ ID NO: 63001 - protein, 11 aa, Borrelia burgdorferi B31
EIARAGWIGDY

SEQ ID NO: 63002 - protein, 11 aa, Borrelia burgdorferi B31
DYYSSAVNAIY

SEQ ID NO: 63003 - protein, 11 aa, Borrelia burgdorferi B31
LEITLESPKPY

SEQ ID NO: 63004 - protein, 11 aa, Borrelia burgdorferi B31
NPEIAKTLLAE

SEQ ID NO: 63005 - protein, 11 aa, Borrelia burgdorferi B31
AGWIGDYADPL

SEQ ID NO: 63006 - protein, 11 aa, Borrelia burgdorferi B31
APIYIYGNSYL

SEQ ID NO: 63007 - protein, 11 aa, Borrelia burgdorferi B31
DAIFGSIPPDL

SEQ ID NO: 63008 - protein, 11 aa, Borrelia burgdorferi B31
FYAFNTHIKPL

SEQ ID NO: 63009 - protein, 11 aa, Borrelia burgdorferi B31
FPILKLKYNTN

SEQ ID NO: 63010 - protein, 9 aa, Borrelia burgdorferi B31
EELDAIFGS

SEQ ID NO: 63011 - protein, 9 aa, Borrelia burgdorferi B31
EEIIIEKDF

SEQ ID NO: 63012 - protein, 9 aa, Borrelia burgdorferi B31
EEITFYTTN

SEQ ID NO: 63013 - protein, 9 aa, Borrelia burgdorferi B31
AEDNVASKM

SEQ ID NO: 63014 - protein, 9 aa, Borrelia burgdorferi B31
YEIARAGWI

SEQ ID NO: 63015 - protein, 9 aa, Borrelia burgdorferi B31
AEGIRKSYL

SEQ ID NO: 63016 - protein, 9 aa, Borrelia burgdorferi B31
KERKEGVSF

SEQ ID NO: 63017 - protein, 9 aa, Borrelia burgdorferi B31
AEAGYPNGN

SEQ ID NO: 63018 - protein, 9 aa, Borrelia burgdorferi B31
VELEEITFY

SEQ ID NO: 63019 - protein, 10 aa, Borrelia burgdorferi B31
NEVELEEITF

SEQ ID NO: 63020 - protein, 10 aa, Borrelia burgdorferi B31
EELDAIFGSI

SEQ ID NO: 63021 - protein, 10 aa, Borrelia burgdorferi B31
EEITFYTTND

SEQ ID NO: 63022 - protein, 10 aa, Borrelia burgdorferi B31
AEPSSLDPQL

SEQ ID NO: 63023 - protein, 10 aa, Borrelia burgdorferi B31
YENEELDAIF

SEQ ID NO: 63024 - protein, 10 aa, Borrelia burgdorferi B31
AEDNVASKMI

SEQ ID NO: 63025 - protein, 10 aa, Borrelia burgdorferi B31
AEEIIIEKDF

SEQ ID NO: 63026 - protein, 10 aa, Borrelia burgdorferi B31
NEANKKICEF

SEQ ID NO: 63027 - protein, 10 aa, Borrelia burgdorferi B31
PENMVTSGPF

SEQ ID NO: 63028 - protein, 10 aa, Borrelia burgdorferi B31
NEELDAIFGS

SEQ ID NO: 63029 - protein, 11 aa, Borrelia burgdorferi B31
EEIIIEKDFPI

SEQ ID NO: 63030 - protein, 11 aa, Borrelia burgdorferi B31
AEAGYPNGNGF

SEQ ID NO: 63031 - protein, 11 aa, Borrelia burgdorferi B31
EEITFYTTNDS

SEQ ID NO: 63032 - protein, 11 aa, Borrelia burgdorferi B31
NEVELEEITFY

SEQ ID NO: 63033 - protein, 11 aa, Borrelia burgdorferi B31
LEITLESPKPY

SEQ ID NO: 63034 - protein, 11 aa, Borrelia burgdorferi B31
IEKDFPIAPIY

SEQ ID NO: 63035 - protein, 11 aa, Borrelia burgdorferi B31
AEGIRKSYLRI

SEQ ID NO: 63036 - protein, 11 aa, Borrelia burgdorferi B31
NELIKKSDLEL

SEQ ID NO: 63037 - protein, 11 aa, Borrelia burgdorferi B31
EELDAIFGSIP

SEQ ID NO: 63038 - protein, 9 aa, Borrelia burgdorferi B31
KPYFIDMLV

SEQ ID NO: 63039 - protein, 9 aa, Borrelia burgdorferi B31
FPIAPIYIY

SEQ ID NO: 63040 - protein, 9 aa, Borrelia burgdorferi B31
YPNGNGFPI

SEQ ID NO: 63041 - protein, 9 aa, Borrelia burgdorferi B31
IPVPVHVTE

SEQ ID NO: 63042 - protein, 9 aa, Borrelia burgdorferi B31
IPPDLIKNL

SEQ ID NO: 63043 - protein, 9 aa, Borrelia burgdorferi B31
GPFKLKERI

SEQ ID NO: 63044 - protein, 9 aa, Borrelia burgdorferi B31
DPLTFLSIF

SEQ ID NO: 63045 - protein, 10 aa, Borrelia burgdorferi B31
FPIAPIYIYG

SEQ ID NO: 63046 - protein, 10 aa, Borrelia burgdorferi B31
FPILKLKYNT

SEQ ID NO: 63047 - protein, 10 aa, Borrelia burgdorferi B31
DPLTFLSIFT

SEQ ID NO: 63048 - protein, 10 aa, Borrelia burgdorferi B31
IPVPVHVTEK

SEQ ID NO: 63049 - protein, 10 aa, Borrelia burgdorferi B31
YPNGNGFPIL

SEQ ID NO: 63050 - protein, 11 aa, Borrelia burgdorferi B31
IPPDLIKNLKL

SEQ ID NO: 63051 - protein, 11 aa, Borrelia burgdorferi B31
IPVPVHVTEKY

SEQ ID NO: 63052 - protein, 11 aa, Borrelia burgdorferi B31
FPILKLKYNTN

SEQ ID NO: 63053 - protein, 11 aa, Borrelia burgdorferi B31
SPKPYFIDMLV

SEQ ID NO: 63054 - protein, 11 aa, Borrelia burgdorferi B31
FPIAPIYIYGN

SEQ ID NO: 63055 - protein, 9 aa, Borrelia burgdorferi B31
RATPNFSSY

SEQ ID NO: 63056 - protein, 9 aa, Borrelia burgdorferi B31
DVELENEEW

SEQ ID NO: 63057 - protein, 10 aa, Borrelia burgdorferi B31
KICEFIQNQW

SEQ ID NO: 63058 - protein, 10 aa, Borrelia burgdorferi B31
NSYLFRNDKW

SEQ ID NO: 63059 - protein, 11 aa, Borrelia burgdorferi B31
YTFNLREKITW

SEQ ID NO: 63060 - protein, 11 aa, Borrelia burgdorferi B31
LTFLSIFTQGY

SEQ ID NO: 63061 - protein, 9 aa, Borrelia
MSDVAKGTV

SEQ ID NO: 63062 - protein, 10 aa, Borrelia
LTKVMAISLY

SEQ ID NO: 63063 - protein, 10 aa, Borrelia
MSDVAKGTVV

SEQ ID NO: 63064 - protein, 11 aa, Borrelia
FSNLIINGLLF

SEQ ID NO: 63065 - protein, 9 aa, Borrelia
FLIEKQIML

SEQ ID NO: 63066 - protein, 9 aa, Borrelia
KVMAISLYM

SEQ ID NO: 63067 - protein, 9 aa, Borrelia
ALDETVQEA

SEQ ID NO: 63068 - protein, 9 aa, Borrelia
GLLFGFVSL

SEQ ID NO: 63069 - protein, 9 aa, Borrelia
KVLNMVNGL

SEQ ID NO: 63070 - protein, 9 aa, Borrelia
VAGEATFLI

SEQ ID NO: 63071 - protein, 9 aa, Borrelia
KAISNVVKV

SEQ ID NO: 63072 - protein, 9 aa, Borrelia
TLMASERAL

SEQ ID NO: 63073 - protein, 9 aa, Borrelia
QALDTINKV

SEQ ID NO: 63074 - protein, 9 aa, Borrelia
FADSNNANI

SEQ ID NO: 63075 - protein, 9 aa, Borrelia
MVAEGANKV

SEQ ID NO: 63076 - protein, 9 aa, Borrelia
SVAGEATFL

SEQ ID NO: 63077 - protein, 9 aa, Borrelia
TINKVTEDV

SEQ ID NO: 63078 - protein, 9 aa, Borrelia
KVDEVKETL

SEQ ID NO: 63079 - protein, 10 aa, Borrelia
LLFGFVSLNV

SEQ ID NO: 63080 - protein, 10 aa, Borrelia
IINGLLFGFV

SEQ ID NO: 63081 - protein, 10 aa, Borrelia
SVAGEATFLI

SEQ ID NO: 63082 - protein, 10 aa, Borrelia
LMSDVAKGTV

SEQ ID NO: 63083 - protein, 10 aa, Borrelia
GMVAEGANKV

SEQ ID NO: 63084 - protein, 10 aa, Borrelia
SLMSDVAKGT

SEQ ID NO: 63085 - protein, 10 aa, Borrelia
RALDETVQEA

SEQ ID NO: 63086 - protein, 10 aa, Borrelia
KVTEDVSSKL

SEQ ID NO: 63087 - protein, 10 aa, Borrelia
GLNPSNKDQV

SEQ ID NO: 63088 - protein, 10 aa, Borrelia
VVASQEATIV

SEQ ID NO: 63089 - protein, 11 aa, Borrelia
GLLFGFVSLNV

SEQ ID NO: 63090 - protein, 11 aa, Borrelia
SLMSDVAKGTV

SEQ ID NO: 63091 - protein, 11 aa, Borrelia
KIFSNLIINGL

SEQ ID NO: 63092 - protein, 11 aa, Borrelia
LMSDVAKGTVV

SEQ ID NO: 63093 - protein, 11 aa, Borrelia
LIINGLLFGFV

SEQ ID NO: 63094 - protein, 11 aa, Borrelia
FVGSMSLMSDV

SEQ ID NO: 63095 - protein, 11 aa, Borrelia
KLDQKDQVNQA

SEQ ID NO: 63096 - protein, 11 aa, Borrelia
MLNKSPNNKEL

SEQ ID NO: 63097 - protein, 11 aa, Borrelia
GMVAEGANKVV

SEQ ID NO: 63098 - protein, 11 aa, Borrelia
KVDEVKETLMA

SEQ ID NO: 63099 - protein, 11 aa, Borrelia
LMASERALDET

SEQ ID NO: 63100 - protein, 11 aa, Borrelia
FLIEKQIMLNK

SEQ ID NO: 63101 - protein, 11 aa, Borrelia
AVQETQKAVSV

SEQ ID NO: 63102 - protein, 11 aa, Borrelia
MASERALDETV

SEQ ID NO: 63103 - protein, 9 aa, Borrelia
MLNKSPNNK

SEQ ID NO: 63104 - protein, 9 aa, Borrelia
VLAKKDVRK

SEQ ID NO: 63105 - protein, 9 aa, Borrelia
KVTEDVSSK

SEQ ID NO: 63106 - protein, 9 aa, Borrelia
GMVAEGANK

SEQ ID NO: 63107 - protein, 9 aa, Borrelia
KVMAISLYM

SEQ ID NO: 63108 - protein, 9 aa, Borrelia
MSLMSDVAK

SEQ ID NO: 63109 - protein, 9 aa, Borrelia
VMAISLYMR

SEQ ID NO: 63110 - protein, 9 aa, Borrelia
NQALDTINK

SEQ ID NO: 63111 - protein, 10 aa, Borrelia
IMLNKSPNNK

SEQ ID NO: 63112 - protein, 10 aa, Borrelia
KVMAISLYMR

SEQ ID NO: 63113 - protein, 10 aa, Borrelia
MVNGLNPSNK

SEQ ID NO: 63114 - protein, 10 aa, Borrelia
SMSLMSDVAK

SEQ ID NO: 63115 - protein, 10 aa, Borrelia
LIEKQIMLNK

SEQ ID NO: 63116 - protein, 10 aa, Borrelia
ASQEATIVAK

SEQ ID NO: 63117 - protein, 10 aa, Borrelia
QVLAKKDVRK

SEQ ID NO: 63118 - protein, 10 aa, Borrelia
GANKVVEMSK

SEQ ID NO: 63119 - protein, 10 aa, Borrelia
ADSNNANILK

SEQ ID NO: 63120 - protein, 10 aa, Borrelia
SGMVAEGANK

SEQ ID NO: 63121 - protein, 10 aa, Borrelia
VAQGARDLTK

SEQ ID NO: 63122 - protein, 10 aa, Borrelia
LTKVMAISLY

SEQ ID NO: 63123 - protein, 10 aa, Borrelia
ESNDAGVVKK

SEQ ID NO: 63124 - protein, 11 aa, Borrelia
FLIEKQIMLNK

SEQ ID NO: 63125 - protein, 11 aa, Borrelia
KVAQGARDLTK

SEQ ID NO: 63126 - protein, 11 aa, Borrelia
GSMSLMSDVAK

SEQ ID NO: 63127 - protein, 11 aa, Borrelia
QIMLNKSPNNK

SEQ ID NO: 63128 - protein, 11 aa, Borrelia
GANKVVEMSKK

SEQ ID NO: 63129 - protein, 11 aa, Borrelia
MSKKAVQETQK

SEQ ID NO: 63130 - protein, 11 aa, Borrelia
QVNQALDTINK

SEQ ID NO: 63131 - protein, 11 aa, Borrelia
NMVNGLNPSNK

SEQ ID NO: 63132 - protein, 11 aa, Borrelia
CSGMVAEGANK

SEQ ID NO: 63133 - protein, 11 aa, Borrelia
ALDETVQEAQK

SEQ ID NO: 63134 - protein, 11 aa, Borrelia
PSNKDQVLAKK

SEQ ID NO: 63135 - protein, 9 aa, Borrelia
MSLMSDVAK

SEQ ID NO: 63136 - protein, 9 aa, Borrelia
KVTEDVSSK

SEQ ID NO: 63137 - protein, 9 aa, Borrelia
SQEATIVAK

SEQ ID NO: 63138 - protein, 9 aa, Borrelia
MLNKSPNNK

SEQ ID NO: 63139 - protein, 9 aa, Borrelia
AQGARDLTK

SEQ ID NO: 63140 - protein, 9 aa, Borrelia
NVLEHSDQK

SEQ ID NO: 63141 - protein, 9 aa, Borrelia
GMVAEGANK

SEQ ID NO: 63142 - protein, 9 aa, Borrelia
VMAISLYMR

SEQ ID NO: 63143 - protein, 9 aa, Borrelia
DSNNANILK

SEQ ID NO: 63144 - protein, 9 aa, Borrelia
NQALDTINK

SEQ ID NO: 63145 - protein, 9 aa, Borrelia
KVMAISLYM

SEQ ID NO: 63146 - protein, 9 aa, Borrelia
VLAKKDVRK

SEQ ID NO: 63147 - protein, 9 aa, Borrelia
ESNDAGVVK

SEQ ID NO: 63148 - protein, 9 aa, Borrelia
GEATFLIEK

SEQ ID NO: 63149 - protein, 10 aa, Borrelia
MVNGLNPSNK

SEQ ID NO: 63150 - protein, 10 aa, Borrelia
KVMAISLYMR

SEQ ID NO: 63151 - protein, 10 aa, Borrelia
ASQEATIVAK

SEQ ID NO: 63152 - protein, 10 aa, Borrelia
SMSLMSDVAK

SEQ ID NO: 63153 - protein, 10 aa, Borrelia
GANKVVEMSK

SEQ ID NO: 63154 - protein, 10 aa, Borrelia
IMLNKSPNNK

SEQ ID NO: 63155 - protein, 10 aa, Borrelia
QVLAKKDVRK

SEQ ID NO: 63156 - protein, 10 aa, Borrelia
VAQGARDLTK

SEQ ID NO: 63157 - protein, 10 aa, Borrelia
LIEKQIMLNK

SEQ ID NO: 63158 - protein, 10 aa, Borrelia
ESNDAGVVKK

SEQ ID NO: 63159 - protein, 10 aa, Borrelia
AGEATFLIEK

SEQ ID NO: 63160 - protein, 10 aa, Borrelia
PSNKDQVLAK

SEQ ID NO: 63161 - protein, 10 aa, Borrelia
SGMVAEGANK

SEQ ID NO: 63162 - protein, 10 aa, Borrelia
VNQALDTINK

SEQ ID NO: 63163 - protein, 10 aa, Borrelia
LTKVMAISLY

SEQ ID NO: 63164 - protein, 11 aa, Borrelia
GSMSLMSDVAK

SEQ ID NO: 63165 - protein, 11 aa, Borrelia
QVNQALDTINK

SEQ ID NO: 63166 - protein, 11 aa, Borrelia
QIMLNKSPNNK

SEQ ID NO: 63167 - protein, 11 aa, Borrelia
KVAQGARDLTK

SEQ ID NO: 63168 - protein, 11 aa, Borrelia
VAGEATFLIEK

SEQ ID NO: 63169 - protein, 11 aa, Borrelia
GANKVVEMSKK

SEQ ID NO: 63170 - protein, 11 aa, Borrelia
QSNVLEHSDQK

SEQ ID NO: 63171 - protein, 11 aa, Borrelia
VASQEATIVAK

SEQ ID NO: 63172 - protein, 11 aa, Borrelia
FLIEKQIMLNK

SEQ ID NO: 63173 - protein, 11 aa, Borrelia
CSGMVAEGANK

SEQ ID NO: 63174 - protein, 11 aa, Borrelia
NMVNGLNPSNK

SEQ ID NO: 63175 - protein, 11 aa, Borrelia
MSKKAVQETQK

SEQ ID NO: 63176 - protein, 11 aa, Borrelia
ALDETVQEAQK

SEQ ID NO: 63177 - protein, 11 aa, Borrelia
LVESNDAGVVK

SEQ ID NO: 63178 - protein, 11 aa, Borrelia
FADSNNANILK

SEQ ID NO: 63179 - protein, 11 aa, Borrelia
SPNNKELELTK

SEQ ID NO: 63180 - protein, 11 aa, Borrelia
PSNKDQVLAKK

SEQ ID NO: 63181 - protein, 11 aa, Borrelia
VLEHSDQKDNK

SEQ ID NO: 63182 - protein, 10 aa, Borrelia
LFGFVSLNVF

SEQ ID NO: 63183 - protein, 10 aa, Borrelia
VFADSNNANI

SEQ ID NO: 63184 - protein, 10 aa, Borrelia
TFLIEKQIML

SEQ ID NO: 63185 - protein, 11 aa, Borrelia
IFSNLIINGLL

SEQ ID NO: 63186 - protein, 11 aa, Borrelia
VFADSNNANIL

SEQ ID NO: 63187 - protein, 9 aa, Borrelia
IINGLLFGF

SEQ ID NO: 63188 - protein, 10 aa, Borrelia
LIINGLLFGF

SEQ ID NO: 63189 - protein, 11 aa, Borrelia
NLIINGLLFGF

SEQ ID NO: 63190 - protein, 9 aa, Borrelia
DSNNANILK

SEQ ID NO: 63191 - protein, 9 aa, Borrelia
MSLMSDVAK

SEQ ID NO: 63192 - protein, 9 aa, Borrelia
NVLEHSDQK

SEQ ID NO: 63193 - protein, 9 aa, Borrelia
EFAKVDEVK

SEQ ID NO: 63194 - protein, 9 aa, Borrelia
VMAISLYMR

SEQ ID NO: 63195 - protein, 9 aa, Borrelia
ELTKEEFAK

SEQ ID NO: 63196 - protein, 9 aa, Borrelia
ESNDAGVVK

SEQ ID NO: 63197 - protein, 9 aa, Borrelia
MLNKSPNNK

SEQ ID NO: 63198 - protein, 9 aa, Borrelia
VVKVAQGAR

SEQ ID NO: 63199 - protein, 9 aa, Borrelia
KVTEDVSSK

SEQ ID NO: 63200 - protein, 9 aa, Borrelia
QVLAKKDVR

SEQ ID NO: 63201 - protein, 9 aa, Borrelia
EATFLIEKQ

SEQ ID NO: 63202 - protein, 9 aa, Borrelia
VSSKLEGVR

SEQ ID NO: 63203 - protein, 9 aa, Borrelia
NQALDTINK

SEQ ID NO: 63204 - protein, 10 aa, Borrelia
MVNGLNPSNK

SEQ ID NO: 63205 - protein, 10 aa, Borrelia
NVVKVAQGAR

SEQ ID NO: 63206 - protein, 10 aa, Borrelia
KVMAISLYMR

SEQ ID NO: 63207 - protein, 10 aa, Borrelia
DVSSKLEGVR

SEQ ID NO: 63208 - protein, 10 aa, Borrelia
ESNDAGVVKK

SEQ ID NO: 63209 - protein, 10 aa, Borrelia
SMSLMSDVAK

SEQ ID NO: 63210 - protein, 10 aa, Borrelia
GANKVVEMSK

SEQ ID NO: 63211 - protein, 10 aa, Borrelia
LTKVMAISLY

SEQ ID NO: 63212 - protein, 10 aa, Borrelia
EEFAKVDEVK

SEQ ID NO: 63213 - protein, 10 aa, Borrelia
LIEKQIMLNK

SEQ ID NO: 63214 - protein, 10 aa, Borrelia
QVLAKKDVRK

SEQ ID NO: 63215 - protein, 10 aa, Borrelia
VAQGARDLTK

SEQ ID NO: 63216 - protein, 11 aa, Borrelia
EVKETLMASER

SEQ ID NO: 63217 - protein, 11 aa, Borrelia
MSKKAVQETQK

SEQ ID NO: 63218 - protein, 11 aa, Borrelia
QVNQALDTINK

SEQ ID NO: 63219 - protein, 11 aa, Borrelia
TKVMAISLYMR

SEQ ID NO: 63220 - protein, 11 aa, Borrelia
QIMLNKSPNNK

SEQ ID NO: 63221 - protein, 11 aa, Borrelia
QSNVLEHSDQK

SEQ ID NO: 63222 - protein, 11 aa, Borrelia
FADSNNANILK

SEQ ID NO: 63223 - protein, 11 aa, Borrelia
FLIEKQIMLNK

SEQ ID NO: 63224 - protein, 11 aa, Borrelia
EGANKVVEMSK

SEQ ID NO: 63225 - protein, 11 aa, Borrelia
DVRKAISNVVK

SEQ ID NO: 63226 - protein, 11 aa, Borrelia
ELELTKEEFAK

SEQ ID NO: 63227 - protein, 11 aa, Borrelia
NMVNGLNPSNK

SEQ ID NO: 63228 - protein, 11 aa, Borrelia
CSGMVAEGANK

SEQ ID NO: 63229 - protein, 11 aa, Borrelia
DLTKVMAISLY

SEQ ID NO: 63230 - protein, 11 aa, Borrelia
GSMSLMSDVAK

SEQ ID NO: 63231 - protein, 11 aa, Borrelia
LVESNDAGVVK

SEQ ID NO: 63232 - protein, 11 aa, Borrelia
EDVSSKLEGVR

SEQ ID NO: 63233 - protein, 11 aa, Borrelia
GANKVVEMSKK

SEQ ID NO: 63234 - protein, 11 aa, Borrelia
VASQEATIVAK

SEQ ID NO: 63235 - protein, 11 aa, Borrelia
VAGEATFLIEK

SEQ ID NO: 63236 - protein, 11 aa, Borrelia
KVAQGARDLTK

SEQ ID NO: 63237 - protein, 11 aa, Borrelia
MVAEGANKVVE

SEQ ID NO: 63238 - protein, 9 aa, Borrelia
GVRESSLEL

SEQ ID NO: 63239 - protein, 9 aa, Borrelia
SPNNKELEL

SEQ ID NO: 63240 - protein, 9 aa, Borrelia
GARDLTKVM

SEQ ID NO: 63241 - protein, 9 aa, Borrelia
NPSNKDQVL

SEQ ID NO: 63242 - protein, 9 aa, Borrelia
KVAQGARDL

SEQ ID NO: 63243 - protein, 9 aa, Borrelia
VVKKFVGSM

SEQ ID NO: 63244 - protein, 9 aa, Borrelia
KVMAISLYM

SEQ ID NO: 63245 - protein, 9 aa, Borrelia
AVQETQKAV

SEQ ID NO: 63246 - protein, 10 aa, Borrelia
KVVEMSKKAV

SEQ ID NO: 63247 - protein, 10 aa, Borrelia
KVTEDVSSKL

SEQ ID NO: 63248 - protein, 10 aa, Borrelia
KAVQETQKAV

SEQ ID NO: 63249 - protein, 11 aa, Borrelia
GARDLTKVMAI

SEQ ID NO: 63250 - protein, 11 aa, Borrelia
AVSVAGEATFL

SEQ ID NO: 63251 - protein, 11 aa, Borrelia
VVKKFVGSMSL

SEQ ID NO: 63252 - protein, 11 aa, Borrelia
AVQETQKAVSV

SEQ ID NO: 63253 - protein, 9 aa, Borrelia
ILKPQSNVL

SEQ ID NO: 63254 - protein, 9 aa, Borrelia
FLIEKQIML

SEQ ID NO: 63255 - protein, 10 aa, Borrelia
LAKKDVRKAI

SEQ ID NO: 63256 - protein, 11 aa, Borrelia
FAKVDEVKETL

SEQ ID NO: 63257 - protein, 11 aa, Borrelia
VLAKKDVRKAI

SEQ ID NO: 63258 - protein, 11 aa, Borrelia
VVKKFVGSMSL

SEQ ID NO: 63259 - protein, 9 aa, Borrelia
VSVAGEATF

SEQ ID NO: 63260 - protein, 9 aa, Borrelia
KVMAISLYM

SEQ ID NO: 63261 - protein, 9 aa, Borrelia
FGFVSLNVF

SEQ ID NO: 63262 - protein, 9 aa, Borrelia
TLMASERAL

SEQ ID NO: 63263 - protein, 9 aa, Borrelia
ILKPQSNVL

SEQ ID NO: 63264 - protein, 9 aa, Borrelia
GVRESSLEL

SEQ ID NO: 63265 - protein, 9 aa, Borrelia
NLIINGLLF

SEQ ID NO: 63266 - protein, 9 aa, Borrelia
FLIEKQIML

SEQ ID NO: 63267 - protein, 9 aa, Borrelia
IINGLLFGF

SEQ ID NO: 63268 - protein, 9 aa, Borrelia
VVKKFVGSM

SEQ ID NO: 63269 - protein, 10 aa, Borrelia
AVSVAGEATF

SEQ ID NO: 63270 - protein, 10 aa, Borrelia
LTKVMAISLY

SEQ ID NO: 63271 - protein, 10 aa, Borrelia
LIINGLLFGF

SEQ ID NO: 63272 - protein, 10 aa, Borrelia
DQKDQVNQAL

SEQ ID NO: 63273 - protein, 10 aa, Borrelia
MVAEGANKVV

SEQ ID NO: 63274 - protein, 11 aa, Borrelia
LLFGFVSLNVF

SEQ ID NO: 63275 - protein, 11 aa, Borrelia
AQGARDLTKVM

SEQ ID NO: 63276 - protein, 11 aa, Borrelia
FSNLIINGLLF

SEQ ID NO: 63277 - protein, 11 aa, Borrelia
AQKVLNMVNGL

SEQ ID NO: 63278 - protein, 11 aa, Borrelia
LMSDVAKGTVV

SEQ ID NO: 63279 - protein, 11 aa, Borrelia
VVKKFVGSMSL

SEQ ID NO: 63280 - protein, 11 aa, Borrelia
NLIINGLLFGF

SEQ ID NO: 63281 - protein, 11 aa, Borrelia
KAVSVAGEATF

SEQ ID NO: 63282 - protein, 11 aa, Borrelia
ILKPQSNVLEH

SEQ ID NO: 63283 - protein, 11 aa, Borrelia
GMVAEGANKVV

SEQ ID NO: 63284 - protein, 11 aa, Borrelia
TQKAVSVAGEA

SEQ ID NO: 63285 - protein, 9 aa, Borrelia
RKAISNVVK

SEQ ID NO: 63286 - protein, 9 aa, Borrelia
KKFVGSMSL

SEQ ID NO: 63287 - protein, 10 aa, Borrelia
VRKAISNVVK

SEQ ID NO: 63288 - protein, 9 aa, Borrelia
NPSNKDQVL

SEQ ID NO: 63289 - protein, 9 aa, Borrelia
FGFVSLNVF

SEQ ID NO: 63290 - protein, 9 aa, Borrelia
VSVAGEATF

SEQ ID NO: 63291 - protein, 9 aa, Borrelia
SPNNKELEL

SEQ ID NO: 63292 - protein, 9 aa, Borrelia
TKVMAISLY

SEQ ID NO: 63293 - protein, 9 aa, Borrelia
TFLIEKQIM

SEQ ID NO: 63294 - protein, 9 aa, Borrelia
FSNLIINGL

SEQ ID NO: 63295 - protein, 10 aa, Borrelia
AVSVAGEATF

SEQ ID NO: 63296 - protein, 10 aa, Borrelia
LFGFVSLNVF

SEQ ID NO: 63297 - protein, 10 aa, Borrelia
MASERALDET

SEQ ID NO: 63298 - protein, 10 aa, Borrelia
VASQEATIVA

SEQ ID NO: 63299 - protein, 10 aa, Borrelia
NPSNKDQVLA

SEQ ID NO: 63300 - protein, 10 aa, Borrelia
LIINGLLFGF

SEQ ID NO: 63301 - protein, 10 aa, Borrelia
MVAEGANKVV

SEQ ID NO: 63302 - protein, 10 aa, Borrelia
ETLMASERAL

SEQ ID NO: 63303 - protein, 10 aa, Borrelia
LTKVMAISLY

SEQ ID NO: 63304 - protein, 11 aa, Borrelia
KAVSVAGEATF

SEQ ID NO: 63305 - protein, 11 aa, Borrelia
VAEGANKVVEM

SEQ ID NO: 63306 - protein, 11 aa, Borrelia
EATFLIEKQIM

SEQ ID NO: 63307 - protein, 11 aa, Borrelia
FSNLIINGLLF

SEQ ID NO: 63308 - protein, 11 aa, Borrelia
LLFGFVSLNVF

SEQ ID NO: 63309 - protein, 11 aa, Borrelia
FAKVDEVKETL

SEQ ID NO: 63310 - protein, 11 aa, Borrelia
NPSNKDQVLAK

SEQ ID NO: 63311 - protein, 11 aa, Borrelia
ESNDAGVVKKF

SEQ ID NO: 63312 - protein, 11 aa, Borrelia
VFADSNNANIL

SEQ ID NO: 63313 - protein, 11 aa, Borrelia
MASERALDETV

SEQ ID NO: 63314 - protein, 9 aa, Borrelia
DEVKETLMA

SEQ ID NO: 63315 - protein, 9 aa, Borrelia
EEFAKVDEV

SEQ ID NO: 63316 - protein, 9 aa, Borrelia
QEAQKVLNM

SEQ ID NO: 63317 - protein, 10 aa, Borrelia
KELELTKEEF

SEQ ID NO: 63318 - protein, 10 aa, Borrelia
AEGANKVVEM

SEQ ID NO: 63319 - protein, 10 aa, Borrelia
DEVKETLMAS

SEQ ID NO: 63320 - protein, 11 aa, Borrelia
KETLMASERAL

SEQ ID NO: 63321 - protein, 11 aa, Borrelia
GEATFLIEKQI

SEQ ID NO: 63322 - protein, 11 aa, Borrelia
AEGANKVVEMS

SEQ ID NO: 63323 - protein, 9 aa, Borrelia burgdorferi
DLDYYKGFY

SEQ ID NO: 63324 - protein, 9 aa, Borrelia burgdorferi
NSNSNSSYY

SEQ ID NO: 63325 - protein, 9 aa, Borrelia burgdorferi
NMDLEFVNY

SEQ ID NO: 63326 - protein, 9 aa, Borrelia burgdorferi
STQQGIQRY

SEQ ID NO: 63327 - protein, 9 aa, Borrelia burgdorferi
FSVRKNFIY

SEQ ID NO: 63328 - protein, 9 aa, Borrelia burgdorferi
LIAKVITIY

SEQ ID NO: 63329 - protein, 9 aa, Borrelia burgdorferi
ITDIQGETH

SEQ ID NO: 63330 - protein, 10 aa, Borrelia burgdorferi
LTNSNSNSSY

SEQ ID NO: 63331 - protein, 10 aa, Borrelia burgdorferi
NSNSSYYGKY

SEQ ID NO: 63332 - protein, 10 aa, Borrelia burgdorferi
ESTQQGIQRY

SEQ ID NO: 63333 - protein, 10 aa, Borrelia burgdorferi
VTDKVIAALL

SEQ ID NO: 63334 - protein, 10 aa, Borrelia burgdorferi
ESDIDIDSLV

SEQ ID NO: 63335 - protein, 11 aa, Borrelia burgdorferi
LTNSNSNSSYY

SEQ ID NO: 63336 - protein, 11 aa, Borrelia burgdorferi
LTGYIIKSFDY

SEQ ID NO: 63337 - protein, 11 aa, Borrelia burgdorferi
VTDKVIAALLS

SEQ ID NO: 63338 - protein, 11 aa, Borrelia burgdorferi
TSFSVRKNFIY

SEQ ID NO: 63339 - protein, 9 aa, Borrelia burgdorferi
MLLIFSFFL

SEQ ID NO: 63340 - protein, 9 aa, Borrelia burgdorferi
LLIFSFFLI

SEQ ID NO: 63341 - protein, 9 aa, Borrelia burgdorferi
FLNGFPLNA

SEQ ID NO: 63342 - protein, 9 aa, Borrelia burgdorferi
QLIDLNTGV

SEQ ID NO: 63343 - protein, 9 aa, Borrelia burgdorferi
FVNMDLEFV

SEQ ID NO: 63344 - protein, 9 aa, Borrelia burgdorferi
ILPFTSFSV

SEQ ID NO: 63345 - protein, 9 aa, Borrelia burgdorferi
YLQDELKNL

SEQ ID NO: 63346 - protein, 9 aa, Borrelia burgdorferi
LLSENEAGV

SEQ ID NO: 63347 - protein, 9 aa, Borrelia burgdorferi
VVSESNFEI

SEQ ID NO: 63348 - protein, 9 aa, Borrelia burgdorferi
KIQEDINEI

SEQ ID NO: 63349 - protein, 9 aa, Borrelia burgdorferi
YVDSKMILA

SEQ ID NO: 63350 - protein, 9 aa, Borrelia burgdorferi
NLQKIDPKV

SEQ ID NO: 63351 - protein, 9 aa, Borrelia burgdorferi
KVITIYNAV

SEQ ID NO: 63352 - protein, 9 aa, Borrelia burgdorferi
LMLPEDQKL

SEQ ID NO: 63353 - protein, 9 aa, Borrelia burgdorferi
SLTKENAGL

SEQ ID NO: 63354 - protein, 9 aa, Borrelia burgdorferi
SLEDLQEQL

SEQ ID NO: 63355 - protein, 9 aa, Borrelia burgdorferi
LIFLNGFPL

SEQ ID NO: 63356 - protein, 9 aa, Borrelia burgdorferi
KMDSGKAKL

SEQ ID NO: 63357 - protein, 9 aa, Borrelia burgdorferi
KLDSAEDNL

SEQ ID NO: 63358 - protein, 9 aa, Borrelia burgdorferi
FILSENKIL

SEQ ID NO: 63359 - protein, 9 aa, Borrelia burgdorferi
NTYEQIVGI

SEQ ID NO: 63360 - protein, 9 aa, Borrelia burgdorferi
KASVDVFSI

SEQ ID NO: 63361 - protein, 9 aa, Borrelia burgdorferi
SSAELIAKV

SEQ ID NO: 63362 - protein, 9 aa, Borrelia burgdorferi
KIDTELDNI

SEQ ID NO: 63363 - protein, 9 aa, Borrelia burgdorferi
KILPFTSFS

SEQ ID NO: 63364 - protein, 9 aa, Borrelia burgdorferi
ILTGYIIKS

SEQ ID NO: 63365 - protein, 9 aa, Borrelia burgdorferi
MSIDSSSPV

SEQ ID NO: 63366 - protein, 9 aa, Borrelia burgdorferi
LVTDKVIAA

SEQ ID NO: 63367 - protein, 9 aa, Borrelia burgdorferi
VTDKVIAAL

SEQ ID NO: 63368 - protein, 9 aa, Borrelia burgdorferi
ELIAKVITI

SEQ ID NO: 63369 - protein, 9 aa, Borrelia burgdorferi
QILNKLENL

SEQ ID NO: 63370 - protein, 9 aa, Borrelia burgdorferi
FLEVIDPIT

SEQ ID NO: 63371 - protein, 9 aa, Borrelia burgdorferi
NITETIENL

SEQ ID NO: 63372 - protein, 9 aa, Borrelia burgdorferi
QIVGIGEFL

SEQ ID NO: 63373 - protein, 9 aa, Borrelia burgdorferi
SSSPVFLEV

SEQ ID NO: 63374 - protein, 9 aa, Borrelia burgdorferi
KQLQIKESL

SEQ ID NO: 63375 - protein, 9 aa, Borrelia burgdorferi
SLYVDSKMI

SEQ ID NO: 63376 - protein, 9 aa, Borrelia burgdorferi
LQDELKNLV

SEQ ID NO: 63377 - protein, 9 aa, Borrelia burgdorferi
NLDKAQQKL

SEQ ID NO: 63378 - protein, 9 aa, Borrelia burgdorferi
STNTYEQIV

SEQ ID NO: 63379 - protein, 10 aa, Borrelia burgdorferi
KILPFTSFSV

SEQ ID NO: 63380 - protein, 10 aa, Borrelia burgdorferi
KMLLIFSFFL

SEQ ID NO: 63381 - protein, 10 aa, Borrelia burgdorferi
MLLIFSFFLI

SEQ ID NO: 63382 - protein, 10 aa, Borrelia burgdorferi
FLIFLNGFPL

SEQ ID NO: 63383 - protein, 10 aa, Borrelia burgdorferi
YLQDELKNLV

SEQ ID NO: 63384 - protein, 10 aa, Borrelia burgdorferi
ALLSENEAGV

SEQ ID NO: 63385 - protein, 10 aa, Borrelia burgdorferi
LIFSFFLIFL

SEQ ID NO: 63386 - protein, 10 aa, Borrelia burgdorferi
TMSIDSSSPV

SEQ ID NO: 63387 - protein, 10 aa, Borrelia burgdorferi
YVDSKMILAA

SEQ ID NO: 63388 - protein, 10 aa, Borrelia burgdorferi
ILNKLENLKV

SEQ ID NO: 63389 - protein, 10 aa, Borrelia burgdorferi
SIDSSSPVFL

SEQ ID NO: 63390 - protein, 10 aa, Borrelia burgdorferi
ILDVNTLKKV

SEQ ID NO: 63391 - protein, 10 aa, Borrelia burgdorferi
LQLIDLNTGV

SEQ ID NO: 63392 - protein, 10 aa, Borrelia burgdorferi
KVVSESNFEI

SEQ ID NO: 63393 - protein, 10 aa, Borrelia burgdorferi
KLKDFVNMDL

SEQ ID NO: 63394 - protein, 10 aa, Borrelia burgdorferi
SLYVDSKMIL

SEQ ID NO: 63395 - protein, 10 aa, Borrelia burgdorferi
SLVTDKVIAA

SEQ ID NO: 63396 - protein, 10 aa, Borrelia burgdorferi
LVTDKVIAAL

SEQ ID NO: 63397 - protein, 10 aa, Borrelia burgdorferi
ILSGNIESDI

SEQ ID NO: 63398 - protein, 10 aa, Borrelia burgdorferi
KISKSNNNEV

SEQ ID NO: 63399 - protein, 10 aa, Borrelia burgdorferi
RLAKFSPKNL

SEQ ID NO: 63400 - protein, 10 aa, Borrelia burgdorferi
SLNEDLDKDL

SEQ ID NO: 63401 - protein, 10 aa, Borrelia burgdorferi
GIYEREKDLV

SEQ ID NO: 63402 - protein, 10 aa, Borrelia burgdorferi
GLSRVYSQWA

SEQ ID NO: 63403 - protein, 10 aa, Borrelia burgdorferi
VTDKVIAALL

SEQ ID NO: 63404 - protein, 10 aa, Borrelia burgdorferi
NLVILDVNTL

SEQ ID NO: 63405 - protein, 10 aa, Borrelia burgdorferi
FSVRKNFIYL

SEQ ID NO: 63406 - protein, 10 aa, Borrelia burgdorferi
RLKESTQQGI

SEQ ID NO: 63407 - protein, 10 aa, Borrelia burgdorferi
NLGTLQLIDL

SEQ ID NO: 63408 - protein, 10 aa, Borrelia burgdorferi
GIGEFLARPL

SEQ ID NO: 63409 - protein, 10 aa, Borrelia burgdorferi
QIVGIGEFLA

SEQ ID NO: 63410 - protein, 11 aa, Borrelia burgdorferi
KMLLIFSFFLI

SEQ ID NO: 63411 - protein, 11 aa, Borrelia burgdorferi
YVDSKMILAAV

SEQ ID NO: 63412 - protein, 11 aa, Borrelia burgdorferi
LLIFSFFLIFL

SEQ ID NO: 63413 - protein, 11 aa, Borrelia burgdorferi
YLQDELKNLVI

SEQ ID NO: 63414 - protein, 11 aa, Borrelia burgdorferi
FLEVIDPITNL

SEQ ID NO: 63415 - protein, 11 aa, Borrelia burgdorferi
FIDDQDKKASV

SEQ ID NO: 63416 - protein, 11 aa, Borrelia burgdorferi
QLIDLNTGVRL

SEQ ID NO: 63417 - protein, 11 aa, Borrelia burgdorferi
KLDSAEDNLDV

SEQ ID NO: 63418 - protein, 11 aa, Borrelia burgdorferi
TTMSIDSSSPV

SEQ ID NO: 63419 - protein, 11 aa, Borrelia burgdorferi
TLQLIDLNTGV

SEQ ID NO: 63420 - protein, 11 aa, Borrelia burgdorferi
VILDVNTLKKV

SEQ ID NO: 63421 - protein, 11 aa, Borrelia burgdorferi
SLVTDKVIAAL

SEQ ID NO: 63422 - protein, 11 aa, Borrelia burgdorferi
ILSENKILPFT

SEQ ID NO: 63423 - protein, 11 aa, Borrelia burgdorferi
KMDSGKAKLQI

SEQ ID NO: 63424 - protein, 11 aa, Borrelia burgdorferi
KLDGKKEFKPV

SEQ ID NO: 63425 - protein, 11 aa, Borrelia burgdorferi
QILNKLENLKV

SEQ ID NO: 63426 - protein, 11 aa, Borrelia burgdorferi
SQWAGKTQIFI

SEQ ID NO: 63427 - protein, 11 aa, Borrelia burgdorferi
KKMLLIFSFFL

SEQ ID NO: 63428 - protein, 11 aa, Borrelia burgdorferi
GIYEREKDLVV

SEQ ID NO: 63429 - protein, 11 aa, Borrelia burgdorferi
SLYVDSKMILA

SEQ ID NO: 63430 - protein, 11 aa, Borrelia burgdorferi
FIYLQDELKNL

SEQ ID NO: 63431 - protein, 11 aa, Borrelia burgdorferi
KLQILNKLENL

SEQ ID NO: 63432 - protein, 11 aa, Borrelia burgdorferi
LIAKVITIYNA

SEQ ID NO: 63433 - protein, 11 aa, Borrelia burgdorferi
LVTDKVIAALL

SEQ ID NO: 63434 - protein, 11 aa, Borrelia burgdorferi
FFLIFLNGFPL

SEQ ID NO: 63435 - protein, 11 aa, Borrelia burgdorferi
MSIDSSSPVFL

SEQ ID NO: 63436 - protein, 11 aa, Borrelia burgdorferi
ILNKLENLKVV

SEQ ID NO: 63437 - protein, 11 aa, Borrelia burgdorferi
VIDPITNLGTL

SEQ ID NO: 63438 - protein, 11 aa, Borrelia burgdorferi
SLGDLNNDKNL

SEQ ID NO: 63439 - protein, 11 aa, Borrelia burgdorferi
LIFLNGFPLNA

SEQ ID NO: 63440 - protein, 11 aa, Borrelia burgdorferi
SISSKSELDSI

SEQ ID NO: 63441 - protein, 11 aa, Borrelia burgdorferi
VIAALLSENEA

SEQ ID NO: 63442 - protein, 11 aa, Borrelia burgdorferi
FEINKNSSLYV

SEQ ID NO: 63443 - protein, 11 aa, Borrelia burgdorferi
FTSFSVRKNFI

SEQ ID NO: 63444 - protein, 11 aa, Borrelia burgdorferi
KVDKEKLKDFV

SEQ ID NO: 63445 - protein, 9 aa, Borrelia burgdorferi
RVYSQWAGK

SEQ ID NO: 63446 - protein, 9 aa, Borrelia burgdorferi
RILTGYIIK

SEQ ID NO: 63447 - protein, 9 aa, Borrelia burgdorferi
ILNKLENLK

SEQ ID NO: 63448 - protein, 9 aa, Borrelia burgdorferi
KTQIFIPLK

SEQ ID NO: 63449 - protein, 9 aa, Borrelia burgdorferi
ILDVNTLKK

SEQ ID NO: 63450 - protein, 9 aa, Borrelia burgdorferi
VILDVNTLK

SEQ ID NO: 63451 - protein, 9 aa, Borrelia burgdorferi
TQIFIPLKK

SEQ ID NO: 63452 - protein, 9 aa, Borrelia burgdorferi
KAKLQILNK

SEQ ID NO: 63453 - protein, 9 aa, Borrelia burgdorferi
RSSAELIAK

SEQ ID NO: 63454 - protein, 9 aa, Borrelia burgdorferi
KLDGKKEFK

SEQ ID NO: 63455 - protein, 9 aa, Borrelia burgdorferi
MILAAVRDK

SEQ ID NO: 63456 - protein, 9 aa, Borrelia burgdorferi
KVDKQLQIK

SEQ ID NO: 63457 - protein, 9 aa, Borrelia burgdorferi
GFYIEPALK

SEQ ID NO: 63458 - protein, 9 aa, Borrelia burgdorferi
LIAKVITIY

SEQ ID NO: 63459 - protein, 9 aa, Borrelia burgdorferi
RELSKASSK

SEQ ID NO: 63460 - protein, 9 aa, Borrelia burgdorferi
FIYLQDELK

SEQ ID NO: 63461 - protein, 9 aa, Borrelia burgdorferi
KSNNNEVGK

SEQ ID NO: 63462 - protein, 9 aa, Borrelia burgdorferi
AVYRGDLDY

SEQ ID NO: 63463 - protein, 9 aa, Borrelia burgdorferi
KLDSKLDGK

SEQ ID NO: 63464 - protein, 9 aa, Borrelia burgdorferi
KSKDGKVSK

SEQ ID NO: 63465 - protein, 9 aa, Borrelia burgdorferi
PLNARKVDK

SEQ ID NO: 63466 - protein, 9 aa, Borrelia burgdorferi
NSNSSYYGK

SEQ ID NO: 63467 - protein, 9 aa, Borrelia burgdorferi
EINKNSSLY

SEQ ID NO: 63468 - protein, 9 aa, Borrelia burgdorferi
KVKEEEITK

SEQ ID NO: 63469 - protein, 9 aa, Borrelia burgdorferi
DLNTGVRLK

SEQ ID NO: 63470 - protein, 9 aa, Borrelia burgdorferi
ITIYNAVYR

SEQ ID NO: 63471 - protein, 9 aa, Borrelia burgdorferi
NLRRILTGY

SEQ ID NO: 63472 - protein, 9 aa, Borrelia burgdorferi
LSKASSKEK

SEQ ID NO: 63473 - protein, 9 aa, Borrelia burgdorferi
NSNSNSSYY

SEQ ID NO: 63474 - protein, 9 aa, Borrelia burgdorferi
KMLLIFSFF

SEQ ID NO: 63475 - protein, 9 aa, Borrelia burgdorferi
VVIKMDSGK

SEQ ID NO: 63476 - protein, 9 aa, Borrelia burgdorferi
KASSKEKSK

SEQ ID NO: 63477 - protein, 9 aa, Borrelia burgdorferi
DSNAWRLAK

SEQ ID NO: 63478 - protein, 10 aa, Borrelia burgdorferi
KTQIFIPLKK

SEQ ID NO: 63479 - protein, 10 aa, Borrelia burgdorferi
VILDVNTLKK

SEQ ID NO: 63480 - protein, 10 aa, Borrelia burgdorferi
KMILAAVRDK

SEQ ID NO: 63481 - protein, 10 aa, Borrelia burgdorferi
SVDVFSISSK

SEQ ID NO: 63482 - protein, 10 aa, Borrelia burgdorferi
LVILDVNTLK

SEQ ID NO: 63483 - protein, 10 aa, Borrelia burgdorferi
AWRLAKFSPK

SEQ ID NO: 63484 - protein, 10 aa, Borrelia burgdorferi
QILNKLENLK

SEQ ID NO: 63485 - protein, 10 aa, Borrelia burgdorferi
AINLQKIDPK

SEQ ID NO: 63486 - protein, 10 aa, Borrelia burgdorferi
LPFTSFSVRK

SEQ ID NO: 63487 - protein, 10 aa, Borrelia burgdorferi
ILPFTSFSVR

SEQ ID NO: 63488 - protein, 10 aa, Borrelia burgdorferi
SYYGKYFINR

SEQ ID NO: 63489 - protein, 10 aa, Borrelia burgdorferi
ALDLDRELSK

SEQ ID NO: 63490 - protein, 10 aa, Borrelia burgdorferi
LVVIKMDSGK

SEQ ID NO: 63491 - protein, 10 aa, Borrelia burgdorferi
ITDIQGETHK

SEQ ID NO: 63492 - protein, 10 aa, Borrelia burgdorferi
KVITIYNAVY

SEQ ID NO: 63493 - protein, 10 aa, Borrelia burgdorferi
KGFYIEPALK

SEQ ID NO: 63494 - protein, 10 aa, Borrelia burgdorferi
VITIYNAVYR

SEQ ID NO: 63495 - protein, 10 aa, Borrelia burgdorferi
RRILTGYIIK

SEQ ID NO: 63496 - protein, 10 aa, Borrelia burgdorferi
AVYRGDLDYY

SEQ ID NO: 63497 - protein, 10 aa, Borrelia burgdorferi
IDLNTGVRLK

SEQ ID NO: 63498 - protein, 10 aa, Borrelia burgdorferi
SKLDGKKEFK

SEQ ID NO: 63499 - protein, 10 aa, Borrelia burgdorferi
AINLDKAQQK

SEQ ID NO: 63500 - protein, 10 aa, Borrelia burgdorferi
ELSKASSKEK

SEQ ID NO: 63501 - protein, 10 aa, Borrelia burgdorferi
IEPALKSLTK

SEQ ID NO: 63502 - protein, 10 aa, Borrelia burgdorferi
LNGFPLNARK

SEQ ID NO: 63503 - protein, 10 aa, Borrelia burgdorferi
LTNSNSNSSY

SEQ ID NO: 63504 - protein, 10 aa, Borrelia burgdorferi
NMDLEFVNYK

SEQ ID NO: 63505 - protein, 10 aa, Borrelia burgdorferi
EINKEKNLPK

SEQ ID NO: 63506 - protein, 10 aa, Borrelia burgdorferi
SLEDLQEQLK

SEQ ID NO: 63507 - protein, 10 aa, Borrelia burgdorferi
SNSNSSYYGK

SEQ ID NO: 63508 - protein, 10 aa, Borrelia burgdorferi
VIKMDSGKAK

SEQ ID NO: 63509 - protein, 10 aa, Borrelia burgdorferi
KLDSKLDGKK

SEQ ID NO: 63510 - protein, 10 aa, Borrelia burgdorferi
LLIFSFFLIF

SEQ ID NO: 63511 - protein, 10 aa, Borrelia burgdorferi
IVGIGEFLAR

SEQ ID NO: 63512 - protein, 10 aa, Borrelia burgdorferi
FPLNARKVDK

SEQ ID NO: 63513 - protein, 10 aa, Borrelia burgdorferi
SRVYSQWAGK

SEQ ID NO: 63514 - protein, 10 aa, Borrelia burgdorferi
ASSKEKSKVK

SEQ ID NO: 63515 - protein, 10 aa, Borrelia burgdorferi
FLNGFPLNAR

SEQ ID NO: 63516 - protein, 10 aa, Borrelia burgdorferi
ASLGDLNNDK

SEQ ID NO: 63517 - protein, 10 aa, Borrelia burgdorferi
SQVDAKKKEK

SEQ ID NO: 63518 - protein, 10 aa, Borrelia burgdorferi
VYRGDLDYYK

SEQ ID NO: 63519 - protein, 10 aa, Borrelia burgdorferi
KKLDSKLDGK

SEQ ID NO: 63520 - protein, 10 aa, Borrelia burgdorferi
EVGKLSPLDK

SEQ ID NO: 63521 - protein, 10 aa, Borrelia burgdorferi
VDNKAINLQK

SEQ ID NO: 63522 - protein, 10 aa, Borrelia burgdorferi
KLSPLDKPSY

SEQ ID NO: 63523 - protein, 10 aa, Borrelia burgdorferi
KNSSLYVDSK

SEQ ID NO: 63524 - protein, 11 aa, Borrelia burgdorferi
FLNGFPLNARK

SEQ ID NO: 63525 - protein, 11 aa, Borrelia burgdorferi
ILPFTSFSVRK

SEQ ID NO: 63526 - protein, 11 aa, Borrelia burgdorferi
KILPFTSFSVR

SEQ ID NO: 63527 - protein, 11 aa, Borrelia burgdorferi
ILNLRRILTGY

SEQ ID NO: 63528 - protein, 11 aa, Borrelia burgdorferi
AVYRGDLDYYK

SEQ ID NO: 63529 - protein, 11 aa, Borrelia burgdorferi
SSYYGKYFINR

SEQ ID NO: 63530 - protein, 11 aa, Borrelia burgdorferi
LLKSKDGKVSK

SEQ ID NO: 63531 - protein, 11 aa, Borrelia burgdorferi
ASVDVFSISSK

SEQ ID NO: 63532 - protein, 11 aa, Borrelia burgdorferi
VVSESNFEINK

SEQ ID NO: 63533 - protein, 11 aa, Borrelia burgdorferi
LVILDVNTLKK

SEQ ID NO: 63534 - protein, 11 aa, Borrelia burgdorferi
TSFSVRKNFIY

SEQ ID NO: 63535 - protein, 11 aa, Borrelia burgdorferi
LSRVYSQWAGK

SEQ ID NO: 63536 - protein, 11 aa, Borrelia burgdorferi
LTNSNSNSSYY

SEQ ID NO: 63537 - protein, 11 aa, Borrelia burgdorferi
KVITIYNAVYR

SEQ ID NO: 63538 - protein, 11 aa, Borrelia burgdorferi
LIDLNTGVRLK

SEQ ID NO: 63539 - protein, 11 aa, Borrelia burgdorferi
ILDVNTLKKVK

SEQ ID NO: 63540 - protein, 11 aa, Borrelia burgdorferi
KIQEDINEINK

SEQ ID NO: 63541 - protein, 11 aa, Borrelia burgdorferi
NSNSNSSYYGK

SEQ ID NO: 63542 - protein, 11 aa, Borrelia burgdorferi
KAINLDKAQQK

SEQ ID NO: 63543 - protein, 11 aa, Borrelia burgdorferi
NLVILDVNTLK

SEQ ID NO: 63544 - protein, 11 aa, Borrelia burgdorferi
NAWRLAKFSPK

SEQ ID NO: 63545 - protein, 11 aa, Borrelia burgdorferi
KVKEEEITKGK

SEQ ID NO: 63546 - protein, 11 aa, Borrelia burgdorferi
KEFKPVSEVEK

SEQ ID NO: 63547 - protein, 11 aa, Borrelia burgdorferi
RVYSQWAGKTQ

SEQ ID NO: 63548 - protein, 11 aa, Borrelia burgdorferi
LSKASSKEKSK

SEQ ID NO: 63549 - protein, 11 aa, Borrelia burgdorferi
KASSKEKSKVK

SEQ ID NO: 63550 - protein, 11 aa, Borrelia burgdorferi
KLPEDKKLDSK

SEQ ID NO: 63551 - protein, 11 aa, Borrelia burgdorferi
VVIKMDSGKAK

SEQ ID NO: 63552 - protein, 11 aa, Borrelia burgdorferi
KMLLIFSFFLI

SEQ ID NO: 63553 - protein, 11 aa, Borrelia burgdorferi
EVDNKAINLQK

SEQ ID NO: 63554 - protein, 11 aa, Borrelia burgdorferi
ELDKKAINLDK

SEQ ID NO: 63555 - protein, 11 aa, Borrelia burgdorferi
KAINLQKIDPK

SEQ ID NO: 63556 - protein, 9 aa, Borrelia burgdorferi
KTQIFIPLK

SEQ ID NO: 63557 - protein, 9 aa, Borrelia burgdorferi
RVYSQWAGK

SEQ ID NO: 63558 - protein, 9 aa, Borrelia burgdorferi
TQIFIPLKK

SEQ ID NO: 63559 - protein, 9 aa, Borrelia burgdorferi
RSSAELIAK

SEQ ID NO: 63560 - protein, 9 aa, Borrelia burgdorferi
VILDVNTLK

SEQ ID NO: 63561 - protein, 9 aa, Borrelia burgdorferi
NSNSSYYGK

SEQ ID NO: 63562 - protein, 9 aa, Borrelia burgdorferi
VVIKMDSGK

SEQ ID NO: 63563 - protein, 9 aa, Borrelia burgdorferi
RILTGYIIK

SEQ ID NO: 63564 - protein, 9 aa, Borrelia burgdorferi
KSNNNEVGK

SEQ ID NO: 63565 - protein, 9 aa, Borrelia burgdorferi
DSNAWRLAK

SEQ ID NO: 63566 - protein, 9 aa, Borrelia burgdorferi
ITIYNAVYR

SEQ ID NO: 63567 - protein, 9 aa, Borrelia burgdorferi
KAKLQILNK

SEQ ID NO: 63568 - protein, 9 aa, Borrelia burgdorferi
TSLNEDLDK

SEQ ID NO: 63569 - protein, 9 aa, Borrelia burgdorferi
ILNKLENLK

SEQ ID NO: 63570 - protein, 9 aa, Borrelia burgdorferi
NSSLYVDSK

SEQ ID NO: 63571 - protein, 9 aa, Borrelia burgdorferi
MILAAVRDK

SEQ ID NO: 63572 - protein, 9 aa, Borrelia burgdorferi
KSKDGKVSK

SEQ ID NO: 63573 - protein, 9 aa, Borrelia burgdorferi
KVKEEEITK

SEQ ID NO: 63574 - protein, 9 aa, Borrelia burgdorferi
FIYLQDELK

SEQ ID NO: 63575 - protein, 9 aa, Borrelia burgdorferi
KVDKQLQIK

SEQ ID NO: 63576 - protein, 9 aa, Borrelia burgdorferi
ILDVNTLKK

SEQ ID NO: 63577 - protein, 9 aa, Borrelia burgdorferi
KATDEEHKK

SEQ ID NO: 63578 - protein, 9 aa, Borrelia burgdorferi
SLGDLNNDK

SEQ ID NO: 63579 - protein, 9 aa, Borrelia burgdorferi
AVYRGDLDY

SEQ ID NO: 63580 - protein, 9 aa, Borrelia burgdorferi
STQQGIQRY

SEQ ID NO: 63581 - protein, 9 aa, Borrelia burgdorferi
GFYIEPALK

SEQ ID NO: 63582 - protein, 9 aa, Borrelia burgdorferi
NLMLPEDQK

SEQ ID NO: 63583 - protein, 9 aa, Borrelia burgdorferi
PSYDDIDSK

SEQ ID NO: 63584 - protein, 9 aa, Borrelia burgdorferi
KASSKEKSK

SEQ ID NO: 63585 - protein, 9 aa, Borrelia burgdorferi
KLDGKKEFK

SEQ ID NO: 63586 - protein, 9 aa, Borrelia burgdorferi
LSKASSKEK

SEQ ID NO: 63587 - protein, 9 aa, Borrelia burgdorferi
SESNFEINK

SEQ ID NO: 63588 - protein, 9 aa, Borrelia burgdorferi
KLDSKLDGK

SEQ ID NO: 63589 - protein, 9 aa, Borrelia burgdorferi
SSKEKSKVK

SEQ ID NO: 63590 - protein, 9 aa, Borrelia burgdorferi
KPGDVSSPK

SEQ ID NO: 63591 - protein, 9 aa, Borrelia burgdorferi
QVDAKKKEK

SEQ ID NO: 63592 - protein, 9 aa, Borrelia burgdorferi
VSEVEKLDK

SEQ ID NO: 63593 - protein, 9 aa, Borrelia burgdorferi
DVSSPKVDK

SEQ ID NO: 63594 - protein, 9 aa, Borrelia burgdorferi
NSNSNSSYY

SEQ ID NO: 63595 - protein, 9 aa, Borrelia burgdorferi
ITETIENLR

SEQ ID NO: 63596 - protein, 9 aa, Borrelia burgdorferi
KVIAALLSE

SEQ ID NO: 63597 - protein, 9 aa, Borrelia burgdorferi
MDLEFVNYK

SEQ ID NO: 63598 - protein, 10 aa, Borrelia burgdorferi
KTQIFIPLKK

SEQ ID NO: 63599 - protein, 10 aa, Borrelia burgdorferi
SVDVFSISSK

SEQ ID NO: 63600 - protein, 10 aa, Borrelia burgdorferi
VILDVNTLKK

SEQ ID NO: 63601 - protein, 10 aa, Borrelia burgdorferi
AINLQKIDPK

SEQ ID NO: 63602 - protein, 10 aa, Borrelia burgdorferi
LVILDVNTLK

SEQ ID NO: 63603 - protein, 10 aa, Borrelia burgdorferi
TTSLNEDLDK

SEQ ID NO: 63604 - protein, 10 aa, Borrelia burgdorferi
AINLDKAQQK

SEQ ID NO: 63605 - protein, 10 aa, Borrelia burgdorferi
ASLGDLNNDK

SEQ ID NO: 63606 - protein, 10 aa, Borrelia burgdorferi
VSESNFEINK

SEQ ID NO: 63607 - protein, 10 aa, Borrelia burgdorferi
AVYRGDLDYY

SEQ ID NO: 63608 - protein, 10 aa, Borrelia burgdorferi
QILNKLENLK

SEQ ID NO: 63609 - protein, 10 aa, Borrelia burgdorferi
KMILAAVRDK

SEQ ID NO: 63610 - protein, 10 aa, Borrelia burgdorferi
SLEDLQEQLK

SEQ ID NO: 63611 - protein, 10 aa, Borrelia burgdorferi
ALDLDRELSK

SEQ ID NO: 63612 - protein, 10 aa, Borrelia burgdorferi
GIQRYGIYER

SEQ ID NO: 63613 - protein, 10 aa, Borrelia burgdorferi
ASSKEKSKVK

SEQ ID NO: 63614 - protein, 10 aa, Borrelia burgdorferi
NMDLEFVNYK

SEQ ID NO: 63615 - protein, 10 aa, Borrelia burgdorferi
LVVIKMDSGK

SEQ ID NO: 63616 - protein, 10 aa, Borrelia burgdorferi
SNSNSSYYGK

SEQ ID NO: 63617 - protein, 10 aa, Borrelia burgdorferi
SYYGKYFINR

SEQ ID NO: 63618 - protein, 10 aa, Borrelia burgdorferi
KVITIYNAVY

SEQ ID NO: 63619 - protein, 10 aa, Borrelia burgdorferi
KGFYIEPALK

SEQ ID NO: 63620 - protein, 10 aa, Borrelia burgdorferi
ITDIQGETHK

SEQ ID NO: 63621 - protein, 10 aa, Borrelia burgdorferi
EINKEKNLPK

SEQ ID NO: 63622 - protein, 10 aa, Borrelia burgdorferi
LPFTSFSVRK

SEQ ID NO: 63623 - protein, 10 aa, Borrelia burgdorferi
VITIYNAVYR

SEQ ID NO: 63624 - protein, 10 aa, Borrelia burgdorferi
IVGIGEFLAR

SEQ ID NO: 63625 - protein, 10 aa, Borrelia burgdorferi
KLDSKLDGKK

SEQ ID NO: 63626 - protein, 10 aa, Borrelia burgdorferi
VIKMDSGKAK

SEQ ID NO: 63627 - protein, 10 aa, Borrelia burgdorferi
IQEDINEINK

SEQ ID NO: 63628 - protein, 10 aa, Borrelia burgdorferi
LTNSNSNSSY

SEQ ID NO: 63629 - protein, 10 aa, Borrelia burgdorferi
EVGKLSPLDK

SEQ ID NO: 63630 - protein, 10 aa, Borrelia burgdorferi
SQVDAKKKEK

SEQ ID NO: 63631 - protein, 10 aa, Borrelia burgdorferi
YIIKSFDYDR

SEQ ID NO: 63632 - protein, 10 aa, Borrelia burgdorferi
DVQRDTVREK

SEQ ID NO: 63633 - protein, 10 aa, Borrelia burgdorferi
KNSSLYVDSK

SEQ ID NO: 63634 - protein, 10 aa, Borrelia burgdorferi
PVSEVEKLDK

SEQ ID NO: 63635 - protein, 10 aa, Borrelia burgdorferi
LTKENAGLSR

SEQ ID NO: 63636 - protein, 10 aa, Borrelia burgdorferi
ILPFTSFSVR

SEQ ID NO: 63637 - protein, 10 aa, Borrelia burgdorferi
FLNGFPLNAR

SEQ ID NO: 63638 - protein, 11 aa, Borrelia burgdorferi
AVYRGDLDYYK

SEQ ID NO: 63639 - protein, 11 aa, Borrelia burgdorferi
ASVDVFSISSK

SEQ ID NO: 63640 - protein, 11 aa, Borrelia burgdorferi
SSYYGKYFINR

SEQ ID NO: 63641 - protein, 11 aa, Borrelia burgdorferi
VVSESNFEINK

SEQ ID NO: 63642 - protein, 11 aa, Borrelia burgdorferi
LVILDVNTLKK

SEQ ID NO: 63643 - protein, 11 aa, Borrelia burgdorferi
NSNSNSSYYGK

SEQ ID NO: 63644 - protein, 11 aa, Borrelia burgdorferi
KIQEDINEINK

SEQ ID NO: 63645 - protein, 11 aa, Borrelia burgdorferi
KAINLQKIDPK

SEQ ID NO: 63646 - protein, 11 aa, Borrelia burgdorferi
TIENLRDQLEK

SEQ ID NO: 63647 - protein, 11 aa, Borrelia burgdorferi
KVITIYNAVYR

SEQ ID NO: 63648 - protein, 11 aa, Borrelia burgdorferi
TSFSVRKNFIY

SEQ ID NO: 63649 - protein, 11 aa, Borrelia burgdorferi
VVIKMDSGKAK

SEQ ID NO: 63650 - protein, 11 aa, Borrelia burgdorferi
ILPFTSFSVRK

SEQ ID NO: 63651 - protein, 11 aa, Borrelia burgdorferi
KAINLDKAQQK

SEQ ID NO: 63652 - protein, 11 aa, Borrelia burgdorferi
KILPFTSFSVR

SEQ ID NO: 63653 - protein, 11 aa, Borrelia burgdorferi
FLNGFPLNARK

SEQ ID NO: 63654 - protein, 11 aa, Borrelia burgdorferi
QTTSLNEDLDK

SEQ ID NO: 63655 - protein, 11 aa, Borrelia burgdorferi
LQILNKLENLK

SEQ ID NO: 63656 - protein, 11 aa, Borrelia burgdorferi
NAWRLAKFSPK

SEQ ID NO: 63657 - protein, 11 aa, Borrelia burgdorferi
RASLGDLNNDK

SEQ ID NO: 63658 - protein, 11 aa, Borrelia burgdorferi
VNMDLEFVNYK

SEQ ID NO: 63659 - protein, 11 aa, Borrelia burgdorferi
LTNSNSNSSYY

SEQ ID NO: 63660 - protein, 11 aa, Borrelia burgdorferi
EVDNKAINLQK

SEQ ID NO: 63661 - protein, 11 aa, Borrelia burgdorferi
ISKSNNNEVGK

SEQ ID NO: 63662 - protein, 11 aa, Borrelia burgdorferi
KASSKEKSKVK

SEQ ID NO: 63663 - protein, 11 aa, Borrelia burgdorferi
LIDLNTGVRLK

SEQ ID NO: 63664 - protein, 11 aa, Borrelia burgdorferi
KVKEEEITKGK

SEQ ID NO: 63665 - protein, 11 aa, Borrelia burgdorferi
KSKVKEEEITK

SEQ ID NO: 63666 - protein, 11 aa, Borrelia burgdorferi
KSELDSILNLR

SEQ ID NO: 63667 - protein, 11 aa, Borrelia burgdorferi
NLVILDVNTLK

SEQ ID NO: 63668 - protein, 11 aa, Borrelia burgdorferi
NLDEFILSENK

SEQ ID NO: 63669 - protein, 11 aa, Borrelia burgdorferi
YIEPALKSLTK

SEQ ID NO: 63670 - protein, 11 aa, Borrelia burgdorferi
FVNMDLEFVNY

SEQ ID NO: 63671 - protein, 11 aa, Borrelia burgdorferi
EALDLDRELSK

SEQ ID NO: 63672 - protein, 11 aa, Borrelia burgdorferi
LSRVYSQWAGK

SEQ ID NO: 63673 - protein, 11 aa, Borrelia burgdorferi
LSKASSKEKSK

SEQ ID NO: 63674 - protein, 11 aa, Borrelia burgdorferi
ESLEDLQEQLK

SEQ ID NO: 63675 - protein, 11 aa, Borrelia burgdorferi
FINRFIDDQDK

SEQ ID NO: 63676 - protein, 11 aa, Borrelia burgdorferi
KNFIYLQDELK

SEQ ID NO: 63677 - protein, 11 aa, Borrelia burgdorferi
SGKAKLQILNK

SEQ ID NO: 63678 - protein, 11 aa, Borrelia burgdorferi
AGKTQIFIPLK

SEQ ID NO: 63679 - protein, 11 aa, Borrelia burgdorferi
SLTKENAGLSR

SEQ ID NO: 63680 - protein, 11 aa, Borrelia burgdorferi
KEFKPVSEVEK

SEQ ID NO: 63681 - protein, 11 aa, Borrelia burgdorferi
QIVGIGEFLAR

SEQ ID NO: 63682 - protein, 11 aa, Borrelia burgdorferi
ILDVNTLKKVK

SEQ ID NO: 63683 - protein, 11 aa, Borrelia burgdorferi
LIFSFFLIFLN

SEQ ID NO: 63684 - protein, 11 aa, Borrelia burgdorferi
KLPEDKKLDSK

SEQ ID NO: 63685 - protein, 9 aa, Borrelia burgdorferi
QWAGKTQIF

SEQ ID NO: 63686 - protein, 9 aa, Borrelia burgdorferi
KMLLIFSFF

SEQ ID NO: 63687 - protein, 9 aa, Borrelia burgdorferi
DYDRSSAEL

SEQ ID NO: 63688 - protein, 9 aa, Borrelia burgdorferi
VFLEVIDPI

SEQ ID NO: 63689 - protein, 9 aa, Borrelia burgdorferi
DFVNMDLEF

SEQ ID NO: 63690 - protein, 9 aa, Borrelia burgdorferi
FFLIFLNGF

SEQ ID NO: 63691 - protein, 9 aa, Borrelia burgdorferi
LYVDSKMIL

SEQ ID NO: 63692 - protein, 9 aa, Borrelia burgdorferi
EFILSENKI

SEQ ID NO: 63693 - protein, 9 aa, Borrelia burgdorferi
IFSFFLIFL

SEQ ID NO: 63694 - protein, 9 aa, Borrelia burgdorferi
SFSVRKNFI

SEQ ID NO: 63695 - protein, 9 aa, Borrelia burgdorferi
LLIFSFFLI

SEQ ID NO: 63696 - protein, 9 aa, Borrelia burgdorferi
IYEREKDLV

SEQ ID NO: 63697 - protein, 9 aa, Borrelia burgdorferi
GYIIKSFDY

SEQ ID NO: 63698 - protein, 9 aa, Borrelia burgdorferi
KKMLLIFSF

SEQ ID NO: 63699 - protein, 10 aa, Borrelia burgdorferi
YYGKYFINRF

SEQ ID NO: 63700 - protein, 10 aa, Borrelia burgdorferi
DYDRSSAELI

SEQ ID NO: 63701 - protein, 10 aa, Borrelia burgdorferi
QWAGKTQIFI

SEQ ID NO: 63702 - protein, 10 aa, Borrelia burgdorferi
IYLQDELKNL

SEQ ID NO: 63703 - protein, 10 aa, Borrelia burgdorferi
SFFLIFLNGF

SEQ ID NO: 63704 - protein, 10 aa, Borrelia burgdorferi
IYNAVYRGDL

SEQ ID NO: 63705 - protein, 10 aa, Borrelia burgdorferi
KFSPKNLDEF

SEQ ID NO: 63706 - protein, 10 aa, Borrelia burgdorferi
KMLLIFSFFL

SEQ ID NO: 63707 - protein, 10 aa, Borrelia burgdorferi
FYIEPALKSL

SEQ ID NO: 63708 - protein, 10 aa, Borrelia burgdorferi
IYEREKDLVV

SEQ ID NO: 63709 - protein, 10 aa, Borrelia burgdorferi
KKMLLIFSFF

SEQ ID NO: 63710 - protein, 10 aa, Borrelia burgdorferi
MLLIFSFFLI

SEQ ID NO: 63711 - protein, 11 aa, Borrelia burgdorferi
SYYGKYFINRF

SEQ ID NO: 63712 - protein, 11 aa, Borrelia burgdorferi
YYGKYFINRFI

SEQ ID NO: 63713 - protein, 11 aa, Borrelia burgdorferi
IYEREKDLVVI

SEQ ID NO: 63714 - protein, 11 aa, Borrelia burgdorferi
KMLLIFSFFLI

SEQ ID NO: 63715 - protein, 11 aa, Borrelia burgdorferi
YYKGFYIEPAL

SEQ ID NO: 63716 - protein, 11 aa, Borrelia burgdorferi
TYEQIVGIGEF

SEQ ID NO: 63717 - protein, 11 aa, Borrelia burgdorferi
IYLQDELKNLV

SEQ ID NO: 63718 - protein, 11 aa, Borrelia burgdorferi
PYDSTNTYEQI

SEQ ID NO: 63719 - protein, 11 aa, Borrelia burgdorferi
VYSQWAGKTQI

SEQ ID NO: 63720 - protein, 11 aa, Borrelia burgdorferi
KFSPKNLDEFI

SEQ ID NO: 63721 - protein, 11 aa, Borrelia burgdorferi
FFLIFLNGFPL

SEQ ID NO: 63722 - protein, 11 aa, Borrelia burgdorferi
SFSVRKNFIYL

SEQ ID NO: 63723 - protein, 9 aa, Borrelia burgdorferi
GYIIKSFDY

SEQ ID NO: 63724 - protein, 9 aa, Borrelia burgdorferi
FSVRKNFIY

SEQ ID NO: 63725 - protein, 9 aa, Borrelia burgdorferi
AVYRGDLDY

SEQ ID NO: 63726 - protein, 9 aa, Borrelia burgdorferi
LIAKVITIY

SEQ ID NO: 63727 - protein, 9 aa, Borrelia burgdorferi
EFVNYKGPY

SEQ ID NO: 63728 - protein, 9 aa, Borrelia burgdorferi
VITIYNAVY

SEQ ID NO: 63729 - protein, 9 aa, Borrelia burgdorferi
EINKNSSLY

SEQ ID NO: 63730 - protein, 9 aa, Borrelia burgdorferi
NMDLEFVNY

SEQ ID NO: 63731 - protein, 9 aa, Borrelia burgdorferi
LIFSFFLIF

SEQ ID NO: 63732 - protein, 9 aa, Borrelia burgdorferi
DFVNMDLEF

SEQ ID NO: 63733 - protein, 9 aa, Borrelia burgdorferi
NSNSNSSYY

SEQ ID NO: 63734 - protein, 9 aa, Borrelia burgdorferi
ENAGLSRVY

SEQ ID NO: 63735 - protein, 9 aa, Borrelia burgdorferi
VYRGDLDYY

SEQ ID NO: 63736 - protein, 9 aa, Borrelia burgdorferi
NLRRILTGY

SEQ ID NO: 63737 - protein, 10 aa, Borrelia burgdorferi
KVITIYNAVY

SEQ ID NO: 63738 - protein, 10 aa, Borrelia burgdorferi
SFSVRKNFIY

SEQ ID NO: 63739 - protein, 10 aa, Borrelia burgdorferi
VNMDLEFVNY

SEQ ID NO: 63740 - protein, 10 aa, Borrelia burgdorferi
ELIAKVITIY

SEQ ID NO: 63741 - protein, 10 aa, Borrelia burgdorferi
FLIFLNGFPL

SEQ ID NO: 63742 - protein, 10 aa, Borrelia burgdorferi
AVYRGDLDYY

SEQ ID NO: 63743 - protein, 10 aa, Borrelia burgdorferi
KLSPLDKPSY

SEQ ID NO: 63744 - protein, 10 aa, Borrelia burgdorferi
TGYIIKSFDY

SEQ ID NO: 63745 - protein, 10 aa, Borrelia burgdorferi
FEINKNSSLY

SEQ ID NO: 63746 - protein, 10 aa, Borrelia burgdorferi
SFFLIFLNGF

SEQ ID NO: 63747 - protein, 10 aa, Borrelia burgdorferi
LLIFSFFLIF

SEQ ID NO: 63748 - protein, 11 aa, Borrelia burgdorferi
FVNMDLEFVNY

SEQ ID NO: 63749 - protein, 11 aa, Borrelia burgdorferi
TSFSVRKNFIY

SEQ ID NO: 63750 - protein, 11 aa, Borrelia burgdorferi
DLEFVNYKGPY

SEQ ID NO: 63751 - protein, 11 aa, Borrelia burgdorferi
YNAVYRGDLDY

SEQ ID NO: 63752 - protein, 11 aa, Borrelia burgdorferi
MLLIFSFFLIF

SEQ ID NO: 63753 - protein, 11 aa, Borrelia burgdorferi
FILSENKILPF

SEQ ID NO: 63754 - protein, 11 aa, Borrelia burgdorferi
LTNSNSNSSYY

SEQ ID NO: 63755 - protein, 11 aa, Borrelia burgdorferi
ILNLRRILTGY

SEQ ID NO: 63756 - protein, 11 aa, Borrelia burgdorferi
LTGYIIKSFDY

SEQ ID NO: 63757 - protein, 11 aa, Borrelia burgdorferi
FSFFLIFLNGF

SEQ ID NO: 63758 - protein, 11 aa, Borrelia burgdorferi
SYYGKYFINRF

SEQ ID NO: 63759 - protein, 11 aa, Borrelia burgdorferi
NFEINKNSSLY

SEQ ID NO: 63760 - protein, 9 aa, Borrelia burgdorferi
ITIYNAVYR

SEQ ID NO: 63761 - protein, 9 aa, Borrelia burgdorferi
ITETIENLR

SEQ ID NO: 63762 - protein, 9 aa, Borrelia burgdorferi
FIYLQDELK

SEQ ID NO: 63763 - protein, 9 aa, Borrelia burgdorferi
NSNSSYYGK

SEQ ID NO: 63764 - protein, 9 aa, Borrelia burgdorferi
ESTQQGIQR

SEQ ID NO: 63765 - protein, 9 aa, Borrelia burgdorferi
NSSLYVDSK

SEQ ID NO: 63766 - protein, 9 aa, Borrelia burgdorferi
ELDSILNLR

SEQ ID NO: 63767 - protein, 9 aa, Borrelia burgdorferi
ETHKADQDK

SEQ ID NO: 63768 - protein, 9 aa, Borrelia burgdorferi
IIKSFDYDR

SEQ ID NO: 63769 - protein, 9 aa, Borrelia burgdorferi
DINEINKEK

SEQ ID NO: 63770 - protein, 9 aa, Borrelia burgdorferi
NEAGVNFAR

SEQ ID NO: 63771 - protein, 9 aa, Borrelia burgdorferi
DSNAWRLAK

SEQ ID NO: 63772 - protein, 9 aa, Borrelia burgdorferi
NSNSNSSYY

SEQ ID NO: 63773 - protein, 9 aa, Borrelia burgdorferi
VVIKMDSGK

SEQ ID NO: 63774 - protein, 9 aa, Borrelia burgdorferi
LPFTSFSVR

SEQ ID NO: 63775 - protein, 9 aa, Borrelia burgdorferi
EINKNSSLY

SEQ ID NO: 63776 - protein, 9 aa, Borrelia burgdorferi
EIESQVDAK

SEQ ID NO: 63777 - protein, 9 aa, Borrelia burgdorferi
RVYSQWAGK

SEQ ID NO: 63778 - protein, 9 aa, Borrelia burgdorferi
EAGDENQKR

SEQ ID NO: 63779 - protein, 9 aa, Borrelia burgdorferi
KTQIFIPLK

SEQ ID NO: 63780 - protein, 9 aa, Borrelia burgdorferi
DVSSPKVDK

SEQ ID NO: 63781 - protein, 9 aa, Borrelia burgdorferi
TQIFIPLKK

SEQ ID NO: 63782 - protein, 9 aa, Borrelia burgdorferi
DVNTLKKVK

SEQ ID NO: 63783 - protein, 9 aa, Borrelia burgdorferi
EIEKQIEIK

SEQ ID NO: 63784 - protein, 9 aa, Borrelia burgdorferi
MILAAVRDK

SEQ ID NO: 63785 - protein, 9 aa, Borrelia burgdorferi
FSFFLIFLN

SEQ ID NO: 63786 - protein, 9 aa, Borrelia burgdorferi
VILDVNTLK

SEQ ID NO: 63787 - protein, 9 aa, Borrelia burgdorferi
NLMLPEDQK

SEQ ID NO: 63788 - protein, 9 aa, Borrelia burgdorferi
ILNKLENLK

SEQ ID NO: 63789 - protein, 9 aa, Borrelia burgdorferi
MDLEFVNYK

SEQ ID NO: 63790 - protein, 9 aa, Borrelia burgdorferi
EPALKSLTK

SEQ ID NO: 63791 - protein, 9 aa, Borrelia burgdorferi
DNKAINLQK

SEQ ID NO: 63792 - protein, 9 aa, Borrelia burgdorferi
ESQVDAKKK

SEQ ID NO: 63793 - protein, 9 aa, Borrelia burgdorferi
YYGKYFINR

SEQ ID NO: 63794 - protein, 9 aa, Borrelia burgdorferi
DSKEEVDNK

SEQ ID NO: 63795 - protein, 9 aa, Borrelia burgdorferi
NGFPLNARK

SEQ ID NO: 63796 - protein, 9 aa, Borrelia burgdorferi
NARKVDKEK

SEQ ID NO: 63797 - protein, 9 aa, Borrelia burgdorferi
LIDLNTGVR

SEQ ID NO: 63798 - protein, 9 aa, Borrelia burgdorferi
DLNTGVRLK

SEQ ID NO: 63799 - protein, 9 aa, Borrelia burgdorferi
LSKASSKEK

SEQ ID NO: 63800 - protein, 9 aa, Borrelia burgdorferi
TTMSIDSSS

SEQ ID NO: 63801 - protein, 9 aa, Borrelia burgdorferi
DVFSISSKS

SEQ ID NO: 63802 - protein, 9 aa, Borrelia burgdorferi
DYEALDLDR

SEQ ID NO: 63803 - protein, 9 aa, Borrelia burgdorferi
FSVRKNFIY

SEQ ID NO: 63804 - protein, 9 aa, Borrelia burgdorferi
ELLKSKDGK

SEQ ID NO: 63805 - protein, 9 aa, Borrelia burgdorferi
IQRYGIYER

SEQ ID NO: 63806 - protein, 9 aa, Borrelia burgdorferi
LIAKVITIY

SEQ ID NO: 63807 - protein, 9 aa, Borrelia burgdorferi
EKATDEEHK

SEQ ID NO: 63808 - protein, 9 aa, Borrelia burgdorferi
DIDSLVTDK

SEQ ID NO: 63809 - protein, 9 aa, Borrelia burgdorferi
SKMILAAVR

SEQ ID NO: 63810 - protein, 9 aa, Borrelia burgdorferi
TSLNEDLDK

SEQ ID NO: 63811 - protein, 9 aa, Borrelia burgdorferi
PSYDDIDSK

SEQ ID NO: 63812 - protein, 10 aa, Borrelia burgdorferi
NITETIENLR

SEQ ID NO: 63813 - protein, 10 aa, Borrelia burgdorferi
YIIKSFDYDR

SEQ ID NO: 63814 - protein, 10 aa, Borrelia burgdorferi
LVILDVNTLK

SEQ ID NO: 63815 - protein, 10 aa, Borrelia burgdorferi
VITIYNAVYR

SEQ ID NO: 63816 - protein, 10 aa, Borrelia burgdorferi
DSKMILAAVR

SEQ ID NO: 63817 - protein, 10 aa, Borrelia burgdorferi
TTSLNEDLDK

SEQ ID NO: 63818 - protein, 10 aa, Borrelia burgdorferi
SYYGKYFINR

SEQ ID NO: 63819 - protein, 10 aa, Borrelia burgdorferi
QLIDLNTGVR

SEQ ID NO: 63820 - protein, 10 aa, Borrelia burgdorferi
EIESQVDAKK

SEQ ID NO: 63821 - protein, 10 aa, Borrelia burgdorferi
NFIYLQDELK

SEQ ID NO: 63822 - protein, 10 aa, Borrelia burgdorferi
LTKENAGLSR

SEQ ID NO: 63823 - protein, 10 aa, Borrelia burgdorferi
FLNGFPLNAR

SEQ ID NO: 63824 - protein, 10 aa, Borrelia burgdorferi
LVVIKMDSGK

SEQ ID NO: 63825 - protein, 10 aa, Borrelia burgdorferi
SAEDNLDVQR

SEQ ID NO: 63826 - protein, 10 aa, Borrelia burgdorferi
ELDSILNLRR

SEQ ID NO: 63827 - protein, 10 aa, Borrelia burgdorferi
ENEAGVNFAR

SEQ ID NO: 63828 - protein, 10 aa, Borrelia burgdorferi
ELSKASSKEK

SEQ ID NO: 63829 - protein, 10 aa, Borrelia burgdorferi
ILPFTSFSVR

SEQ ID NO: 63830 - protein, 10 aa, Borrelia burgdorferi
EIEKQIEIKK

SEQ ID NO: 63831 - protein, 10 aa, Borrelia burgdorferi
LPFTSFSVRK

SEQ ID NO: 63832 - protein, 10 aa, Borrelia burgdorferi
EFKPVSEVEK

SEQ ID NO: 63833 - protein, 10 aa, Borrelia burgdorferi
LTNSNSNSSY

SEQ ID NO: 63834 - protein, 10 aa, Borrelia burgdorferi
EVEKLDKISK

SEQ ID NO: 63835 - protein, 10 aa, Borrelia burgdorferi
SVDVFSISSK

SEQ ID NO: 63836 - protein, 10 aa, Borrelia burgdorferi
DVQRDTVREK

SEQ ID NO: 63837 - protein, 10 aa, Borrelia burgdorferi
EINKEKNLPK

SEQ ID NO: 63838 - protein, 10 aa, Borrelia burgdorferi
EVGKLSPLDK

SEQ ID NO: 63839 - protein, 10 aa, Borrelia burgdorferi
KTQIFIPLKK

SEQ ID NO: 63840 - protein, 10 aa, Borrelia burgdorferi
IVGIGEFLAR

SEQ ID NO: 63841 - protein, 10 aa, Borrelia burgdorferi
NSNSSYYGKY

SEQ ID NO: 63842 - protein, 10 aa, Borrelia burgdorferi
GIQRYGIYER

SEQ ID NO: 63843 - protein, 10 aa, Borrelia burgdorferi
SNSNSSYYGK

SEQ ID NO: 63844 - protein, 10 aa, Borrelia burgdorferi
NMDLEFVNYK

SEQ ID NO: 63845 - protein, 10 aa, Borrelia burgdorferi
ESTQQGIQRY

SEQ ID NO: 63846 - protein, 10 aa, Borrelia burgdorferi
QILNKLENLK

SEQ ID NO: 63847 - protein, 10 aa, Borrelia burgdorferi
EDINEINKEK

SEQ ID NO: 63848 - protein, 10 aa, Borrelia burgdorferi
ELIAKVITIY

SEQ ID NO: 63849 - protein, 10 aa, Borrelia burgdorferi
ITDIQGETHK

SEQ ID NO: 63850 - protein, 10 aa, Borrelia burgdorferi
VILDVNTLKK

SEQ ID NO: 63851 - protein, 10 aa, Borrelia burgdorferi
TNSNSNSSYY

SEQ ID NO: 63852 - protein, 10 aa, Borrelia burgdorferi
MSIDSSSPVF

SEQ ID NO: 63853 - protein, 10 aa, Borrelia burgdorferi
DVFSISSKSE

SEQ ID NO: 63854 - protein, 10 aa, Borrelia burgdorferi
VSESNFEINK

SEQ ID NO: 63855 - protein, 10 aa, Borrelia burgdorferi
EKATDEEHKK

SEQ ID NO: 63856 - protein, 10 aa, Borrelia burgdorferi
SLEDLQEQLK

SEQ ID NO: 63857 - protein, 10 aa, Borrelia burgdorferi
TGYIIKSFDY

SEQ ID NO: 63858 - protein, 10 aa, Borrelia burgdorferi
NLQKIDPKVK

SEQ ID NO: 63859 - protein, 10 aa, Borrelia burgdorferi
KGFYIEPALK

SEQ ID NO: 63860 - protein, 10 aa, Borrelia burgdorferi
NLDVQRDTVR

SEQ ID NO: 63861 - protein, 11 aa, Borrelia burgdorferi
SSYYGKYFINR

SEQ ID NO: 63862 - protein, 11 aa, Borrelia burgdorferi
NSNSNSSYYGK

SEQ ID NO: 63863 - protein, 11 aa, Borrelia burgdorferi
KVITIYNAVYR

SEQ ID NO: 63864 - protein, 11 aa, Borrelia burgdorferi
DSAEDNLDVQR

SEQ ID NO: 63865 - protein, 11 aa, Borrelia burgdorferi
DITDIQGETHK

SEQ ID NO: 63866 - protein, 11 aa, Borrelia burgdorferi
QIVGIGEFLAR

SEQ ID NO: 63867 - protein, 11 aa, Borrelia burgdorferi
TSFSVRKNFIY

SEQ ID NO: 63868 - protein, 11 aa, Borrelia burgdorferi
NLVILDVNTLK

SEQ ID NO: 63869 - protein, 11 aa, Borrelia burgdorferi
QTTSLNEDLDK

SEQ ID NO: 63870 - protein, 11 aa, Borrelia burgdorferi
LVILDVNTLKK

SEQ ID NO: 63871 - protein, 11 aa, Borrelia burgdorferi
LTNSNSNSSYY

SEQ ID NO: 63872 - protein, 11 aa, Borrelia burgdorferi
DLVVIKMDSGK

SEQ ID NO: 63873 - protein, 11 aa, Borrelia burgdorferi
EVDNKAINLQK

SEQ ID NO: 63874 - protein, 11 aa, Borrelia burgdorferi
FLNGFPLNARK

SEQ ID NO: 63875 - protein, 11 aa, Borrelia burgdorferi
AVYRGDLDYYK

SEQ ID NO: 63876 - protein, 11 aa, Borrelia burgdorferi
ASVDVFSISSK

SEQ ID NO: 63877 - protein, 11 aa, Borrelia burgdorferi
VVSESNFEINK

SEQ ID NO: 63878 - protein, 11 aa, Borrelia burgdorferi
ESLEDLQEQLK

SEQ ID NO: 63879 - protein, 11 aa, Borrelia burgdorferi
TIENLRDQLEK

SEQ ID NO: 63880 - protein, 11 aa, Borrelia burgdorferi
EIEKQIEIKKR

SEQ ID NO: 63881 - protein, 11 aa, Borrelia burgdorferi
EIKKRDEELLK

SEQ ID NO: 63882 - protein, 11 aa, Borrelia burgdorferi
SNITETIENLR

SEQ ID NO: 63883 - protein, 11 aa, Borrelia burgdorferi
EALDLDRELSK

SEQ ID NO: 63884 - protein, 11 aa, Borrelia burgdorferi
FINRFIDDQDK

SEQ ID NO: 63885 - protein, 11 aa, Borrelia burgdorferi
KILPFTSFSVR

SEQ ID NO: 63886 - protein, 11 aa, Borrelia burgdorferi
ILPFTSFSVRK

SEQ ID NO: 63887 - protein, 11 aa, Borrelia burgdorferi
EIESQVDAKKK

SEQ ID NO: 63888 - protein, 11 aa, Borrelia burgdorferi
NAVYRGDLDYY

SEQ ID NO: 63889 - protein, 11 aa, Borrelia burgdorferi
QGIQRYGIYER

SEQ ID NO: 63890 - protein, 11 aa, Borrelia burgdorferi
ISKSNNNEVGK

SEQ ID NO: 63891 - protein, 11 aa, Borrelia burgdorferi
DSKLDGKKEFK

SEQ ID NO: 63892 - protein, 11 aa, Borrelia burgdorferi
ESQVDAKKKEK

SEQ ID NO: 63893 - protein, 11 aa, Borrelia burgdorferi
VVIKMDSGKAK

SEQ ID NO: 63894 - protein, 11 aa, Borrelia burgdorferi
NAWRLAKFSPK

SEQ ID NO: 63895 - protein, 11 aa, Borrelia burgdorferi
FVNMDLEFVNY

SEQ ID NO: 63896 - protein, 11 aa, Borrelia burgdorferi
SLTKENAGLSR

SEQ ID NO: 63897 - protein, 11 aa, Borrelia burgdorferi
NARKVDKEKLK

SEQ ID NO: 63898 - protein, 11 aa, Borrelia burgdorferi
NLDEFILSENK

SEQ ID NO: 63899 - protein, 11 aa, Borrelia burgdorferi
KSELDSILNLR

SEQ ID NO: 63900 - protein, 11 aa, Borrelia burgdorferi
GYIIKSFDYDR

SEQ ID NO: 63901 - protein, 11 aa, Borrelia burgdorferi
VNMDLEFVNYK

SEQ ID NO: 63902 - protein, 11 aa, Borrelia burgdorferi
ETIENLRDQLE

SEQ ID NO: 63903 - protein, 11 aa, Borrelia burgdorferi
KAINLDKAQQK

SEQ ID NO: 63904 - protein, 11 aa, Borrelia burgdorferi
DVFSISSKSEL

SEQ ID NO: 63905 - protein, 11 aa, Borrelia burgdorferi
FSFFLIFLNGF

SEQ ID NO: 63906 - protein, 11 aa, Borrelia burgdorferi
SENEAGVNFAR

SEQ ID NO: 63907 - protein, 11 aa, Borrelia burgdorferi
YIEPALKSLTK

SEQ ID NO: 63908 - protein, 11 aa, Borrelia burgdorferi
MSIDSSSPVFL

SEQ ID NO: 63909 - protein, 11 aa, Borrelia burgdorferi
FSVRKNFIYLQ

SEQ ID NO: 63910 - protein, 11 aa, Borrelia burgdorferi
LQILNKLENLK

SEQ ID NO: 63911 - protein, 11 aa, Borrelia burgdorferi
QLEKATDEEHK

SEQ ID NO: 63912 - protein, 11 aa, Borrelia burgdorferi
LSRVYSQWAGK

SEQ ID NO: 63913 - protein, 9 aa, Borrelia burgdorferi
SVRKNFIYL

SEQ ID NO: 63914 - protein, 9 aa, Borrelia burgdorferi
KVKDQTTSL

SEQ ID NO: 63915 - protein, 9 aa, Borrelia burgdorferi
KPVSEVEKL

SEQ ID NO: 63916 - protein, 9 aa, Borrelia burgdorferi
RPLTNSNSN

SEQ ID NO: 63917 - protein, 9 aa, Borrelia burgdorferi
KVSKDYEAL

SEQ ID NO: 63918 - protein, 9 aa, Borrelia burgdorferi
GPYDSTNTY

SEQ ID NO: 63919 - protein, 9 aa, Borrelia burgdorferi
DPITNLGTL

SEQ ID NO: 63920 - protein, 10 aa, Borrelia burgdorferi
KPGDVSSPKV

SEQ ID NO: 63921 - protein, 10 aa, Borrelia burgdorferi
SPKVDKQLQI

SEQ ID NO: 63922 - protein, 10 aa, Borrelia burgdorferi
LVTDKVIAAL

SEQ ID NO: 63923 - protein, 10 aa, Borrelia burgdorferi
SPKNLDEFIL

SEQ ID NO: 63924 - protein, 10 aa, Borrelia burgdorferi
RPLTNSNSNS

SEQ ID NO: 63925 - protein, 10 aa, Borrelia burgdorferi
ITKGKSRASL

SEQ ID NO: 63926 - protein, 11 aa, Borrelia burgdorferi
RPLTNSNSNSS

SEQ ID NO: 63927 - protein, 11 aa, Borrelia burgdorferi
SPVFLEVIDPI

SEQ ID NO: 63928 - protein, 11 aa, Borrelia burgdorferi
LPEDKKLDSKL

SEQ ID NO: 63929 - protein, 11 aa, Borrelia burgdorferi
DPKVKDQTTSL

SEQ ID NO: 63930 - protein, 11 aa, Borrelia burgdorferi
AVRDKDDSNAW

SEQ ID NO: 63931 - protein, 11 aa, Borrelia burgdorferi
DPITNLGTLQL

SEQ ID NO: 63932 - protein, 11 aa, Borrelia burgdorferi
SPLDKPSYDDI

SEQ ID NO: 63933 - protein, 9 aa, Borrelia burgdorferi
EIKKRDEEL

SEQ ID NO: 63934 - protein, 10 aa, Borrelia burgdorferi
EIKKRDEELL

SEQ ID NO: 63935 - protein, 10 aa, Borrelia burgdorferi
ITKGKSRASL

SEQ ID NO: 63936 - protein, 10 aa, Borrelia burgdorferi
FLIFLNGFPL

SEQ ID NO: 63937 - protein, 11 aa, Borrelia burgdorferi
IAKVITIYNAV

SEQ ID NO: 63938 - protein, 11 aa, Borrelia burgdorferi
DPKVKDQTTSL

SEQ ID NO: 63939 - protein, 11 aa, Borrelia burgdorferi
YYKGFYIEPAL

SEQ ID NO: 63940 - protein, 11 aa, Borrelia burgdorferi
NLRRILTGYII

SEQ ID NO: 63941 - protein, 9 aa, Borrelia burgdorferi
EQIVGIGEF

SEQ ID NO: 63942 - protein, 9 aa, Borrelia burgdorferi
AVYRGDLDY

SEQ ID NO: 63943 - protein, 9 aa, Borrelia burgdorferi
KMLLIFSFF

SEQ ID NO: 63944 - protein, 9 aa, Borrelia burgdorferi
FSVRKNFIY

SEQ ID NO: 63945 - protein, 9 aa, Borrelia burgdorferi
STQQGIQRY

SEQ ID NO: 63946 - protein, 9 aa, Borrelia burgdorferi
LSENKILPF

SEQ ID NO: 63947 - protein, 9 aa, Borrelia burgdorferi
TNSNSNSSY

SEQ ID NO: 63948 - protein, 9 aa, Borrelia burgdorferi
LIAKVITIY

SEQ ID NO: 63949 - protein, 9 aa, Borrelia burgdorferi
QGIQRYGIY

SEQ ID NO: 63950 - protein, 9 aa, Borrelia burgdorferi
YGKYFINRF

SEQ ID NO: 63951 - protein, 9 aa, Borrelia burgdorferi
KVKDQTTSL

SEQ ID NO: 63952 - protein, 9 aa, Borrelia burgdorferi
NLRRILTGY

SEQ ID NO: 63953 - protein, 9 aa, Borrelia burgdorferi
VITIYNAVY

SEQ ID NO: 63954 - protein, 9 aa, Borrelia burgdorferi
LTGYIIKSF

SEQ ID NO: 63955 - protein, 9 aa, Borrelia burgdorferi
LIFSFFLIF

SEQ ID NO: 63956 - protein, 9 aa, Borrelia burgdorferi
LVILDVNTL

SEQ ID NO: 63957 - protein, 9 aa, Borrelia burgdorferi
MSIDSSSPV

SEQ ID NO: 63958 - protein, 9 aa, Borrelia burgdorferi
KQLQIKESL

SEQ ID NO: 63959 - protein, 9 aa, Borrelia burgdorferi
LIFLNGFPL

SEQ ID NO: 63960 - protein, 9 aa, Borrelia burgdorferi
NSNSNSSYY

SEQ ID NO: 63961 - protein, 9 aa, Borrelia burgdorferi
ENAGLSRVY

SEQ ID NO: 63962 - protein, 10 aa, Borrelia burgdorferi
SQWAGKTQIF

SEQ ID NO: 63963 - protein, 10 aa, Borrelia burgdorferi
MSIDSSSPVF

SEQ ID NO: 63964 - protein, 10 aa, Borrelia burgdorferi
KVITIYNAVY

SEQ ID NO: 63965 - protein, 10 aa, Borrelia burgdorferi
ILSENKILPF

SEQ ID NO: 63966 - protein, 10 aa, Borrelia burgdorferi
LTNSNSNSSY

SEQ ID NO: 63967 - protein, 10 aa, Borrelia burgdorferi
KLSPLDKPSY

SEQ ID NO: 63968 - protein, 10 aa, Borrelia burgdorferi
ILTGYIIKSF

SEQ ID NO: 63969 - protein, 10 aa, Borrelia burgdorferi
QQGIQRYGIY

SEQ ID NO: 63970 - protein, 10 aa, Borrelia burgdorferi
LLIFSFFLIF

SEQ ID NO: 63971 - protein, 10 aa, Borrelia burgdorferi
ELIAKVITIY

SEQ ID NO: 63972 - protein, 10 aa, Borrelia burgdorferi
AVYRGDLDYY

SEQ ID NO: 63973 - protein, 10 aa, Borrelia burgdorferi
FLIFLNGFPL

SEQ ID NO: 63974 - protein, 10 aa, Borrelia burgdorferi
LQIKESLEDL

SEQ ID NO: 63975 - protein, 10 aa, Borrelia burgdorferi
KENAGLSRVY

SEQ ID NO: 63976 - protein, 10 aa, Borrelia burgdorferi
YEQIVGIGEF

SEQ ID NO: 63977 - protein, 10 aa, Borrelia burgdorferi
EQIVGIGEFL

SEQ ID NO: 63978 - protein, 10 aa, Borrelia burgdorferi
NLKVVSESNF

SEQ ID NO: 63979 - protein, 10 aa, Borrelia burgdorferi
LQILNKLENL

SEQ ID NO: 63980 - protein, 10 aa, Borrelia burgdorferi
LEFVNYKGPY

SEQ ID NO: 63981 - protein, 10 aa, Borrelia burgdorferi
TNSNSNSSYY

SEQ ID NO: 63982 - protein, 10 aa, Borrelia burgdorferi
FTSFSVRKNF

SEQ ID NO: 63983 - protein, 10 aa, Borrelia burgdorferi
FEINKNSSLY

SEQ ID NO: 63984 - protein, 10 aa, Borrelia burgdorferi
KLKDFVNMDL

SEQ ID NO: 63985 - protein, 10 aa, Borrelia burgdorferi
TMSIDSSSPV

SEQ ID NO: 63986 - protein, 10 aa, Borrelia burgdorferi
RLKESTQQGI

SEQ ID NO: 63987 - protein, 10 aa, Borrelia burgdorferi
ITKGKSRASL

SEQ ID NO: 63988 - protein, 10 aa, Borrelia burgdorferi
LVTDKVIAAL

SEQ ID NO: 63989 - protein, 10 aa, Borrelia burgdorferi
VNMDLEFVNY

SEQ ID NO: 63990 - protein, 11 aa, Borrelia burgdorferi
TQQGIQRYGIY

SEQ ID NO: 63991 - protein, 11 aa, Borrelia burgdorferi
TMSIDSSSPVF

SEQ ID NO: 63992 - protein, 11 aa, Borrelia burgdorferi
YSQWAGKTQIF

SEQ ID NO: 63993 - protein, 11 aa, Borrelia burgdorferi
LLSENEAGVNF

SEQ ID NO: 63994 - protein, 11 aa, Borrelia burgdorferi
ILNLRRILTGY

SEQ ID NO: 63995 - protein, 11 aa, Borrelia burgdorferi
KSKDGKVSKDY

SEQ ID NO: 63996 - protein, 11 aa, Borrelia burgdorferi
LTNSNSNSSYY

SEQ ID NO: 63997 - protein, 11 aa, Borrelia burgdorferi
FSFFLIFLNGF

SEQ ID NO: 63998 - protein, 11 aa, Borrelia burgdorferi
RILTGYIIKSF

SEQ ID NO: 63999 - protein, 11 aa, Borrelia burgdorferi
FILSENKILPF

SEQ ID NO: 64000 - protein, 11 aa, Borrelia burgdorferi
MLLIFSFFLIF

SEQ ID NO: 64001 - protein, 11 aa, Borrelia burgdorferi
YNAVYRGDLDY

SEQ ID NO: 64002 - protein, 11 aa, Borrelia burgdorferi
FVNMDLEFVNY

SEQ ID NO: 64003 - protein, 11 aa, Borrelia burgdorferi
TSFSVRKNFIY

SEQ ID NO: 64004 - protein, 11 aa, Borrelia burgdorferi
PLTNSNSNSSY

SEQ ID NO: 64005 - protein, 11 aa, Borrelia burgdorferi
QQKLDSAEDNL

SEQ ID NO: 64006 - protein, 11 aa, Borrelia burgdorferi
AVRDKDDSNAW

SEQ ID NO: 64007 - protein, 11 aa, Borrelia burgdorferi
QLIDLNTGVRL

SEQ ID NO: 64008 - protein, 11 aa, Borrelia burgdorferi
YLQDELKNLVI

SEQ ID NO: 64009 - protein, 9 aa, Borrelia burgdorferi
WRLAKFSPK

SEQ ID NO: 64010 - protein, 9 aa, Borrelia burgdorferi
RRILTGYII

SEQ ID NO: 64011 - protein, 9 aa, Borrelia burgdorferi
YRGDLDYYK

SEQ ID NO: 64012 - protein, 9 aa, Borrelia burgdorferi
KKMLLIFSF

SEQ ID NO: 64013 - protein, 9 aa, Borrelia burgdorferi
QRYGIYERE

SEQ ID NO: 64014 - protein, 9 aa, Borrelia burgdorferi
KQLQIKESL

SEQ ID NO: 64015 - protein, 10 aa, Borrelia burgdorferi
RRILTGYIIK

SEQ ID NO: 64016 - protein, 10 aa, Borrelia burgdorferi
QRYGIYEREK

SEQ ID NO: 64017 - protein, 10 aa, Borrelia burgdorferi
SRVYSQWAGK

SEQ ID NO: 64018 - protein, 10 aa, Borrelia burgdorferi
KRDEELLKSK

SEQ ID NO: 64019 - protein, 10 aa, Borrelia burgdorferi
SQWAGKTQIF

SEQ ID NO: 64020 - protein, 10 aa, Borrelia burgdorferi
KKMLLIFSFF

SEQ ID NO: 64021 - protein, 10 aa, Borrelia burgdorferi
WRLAKFSPKN

SEQ ID NO: 64022 - protein, 11 aa, Borrelia burgdorferi
RRILTGYIIKS

SEQ ID NO: 64023 - protein, 11 aa, Borrelia burgdorferi
YRGDLDYYKGF

SEQ ID NO: 64024 - protein, 11 aa, Borrelia burgdorferi
WRLAKFSPKNL

SEQ ID NO: 64025 - protein, 11 aa, Borrelia burgdorferi
LRRILTGYIIK

SEQ ID NO: 64026 - protein, 9 aa, Borrelia burgdorferi
GPYDSTNTY

SEQ ID NO: 64027 - protein, 9 aa, Borrelia burgdorferi
DFVNMDLEF

SEQ ID NO: 64028 - protein, 9 aa, Borrelia burgdorferi
EFVNYKGPY

SEQ ID NO: 64029 - protein, 9 aa, Borrelia burgdorferi
DPITNLGTL

SEQ ID NO: 64030 - protein, 9 aa, Borrelia burgdorferi
EALDLDREL

SEQ ID NO: 64031 - protein, 9 aa, Borrelia burgdorferi
FFLIFLNGF

SEQ ID NO: 64032 - protein, 9 aa, Borrelia burgdorferi
LIFSFFLIF

SEQ ID NO: 64033 - protein, 9 aa, Borrelia burgdorferi
LVILDVNTL

SEQ ID NO: 64034 - protein, 9 aa, Borrelia burgdorferi
VITIYNAVY

SEQ ID NO: 64035 - protein, 9 aa, Borrelia burgdorferi
FSVRKNFIY

SEQ ID NO: 64036 - protein, 9 aa, Borrelia burgdorferi
NSNSNSSYY

SEQ ID NO: 64037 - protein, 9 aa, Borrelia burgdorferi
LPEDQKLPE

SEQ ID NO: 64038 - protein, 9 aa, Borrelia burgdorferi
LIAKVITIY

SEQ ID NO: 64039 - protein, 9 aa, Borrelia burgdorferi
LPKPGDVSS

SEQ ID NO: 64040 - protein, 9 aa, Borrelia burgdorferi
SIDSSSPVF

SEQ ID NO: 64041 - protein, 9 aa, Borrelia burgdorferi
LSENKILPF

SEQ ID NO: 64042 - protein, 9 aa, Borrelia burgdorferi
LPFTSFSVR

SEQ ID NO: 64043 - protein, 9 aa, Borrelia burgdorferi
EINKNSSLY

SEQ ID NO: 64044 - protein, 9 aa, Borrelia burgdorferi
ENAGLSRVY

SEQ ID NO: 64045 - protein, 9 aa, Borrelia burgdorferi
LIFLNGFPL

SEQ ID NO: 64046 - protein, 10 aa, Borrelia burgdorferi
MSIDSSSPVF

SEQ ID NO: 64047 - protein, 10 aa, Borrelia burgdorferi
NAVYRGDLDY

SEQ ID NO: 64048 - protein, 10 aa, Borrelia burgdorferi
KVITIYNAVY

SEQ ID NO: 64049 - protein, 10 aa, Borrelia burgdorferi
LTNSNSNSSY

SEQ ID NO: 64050 - protein, 10 aa, Borrelia burgdorferi
ESTQQGIQRY

SEQ ID NO: 64051 - protein, 10 aa, Borrelia burgdorferi
LLIFSFFLIF

SEQ ID NO: 64052 - protein, 10 aa, Borrelia burgdorferi
SPKNLDEFIL

SEQ ID NO: 64053 - protein, 10 aa, Borrelia burgdorferi
FLIFLNGFPL

SEQ ID NO: 64054 - protein, 10 aa, Borrelia burgdorferi
LVTDKVIAAL

SEQ ID NO: 64055 - protein, 10 aa, Borrelia burgdorferi
ILSENKILPF

SEQ ID NO: 64056 - protein, 10 aa, Borrelia burgdorferi
AVYRGDLDYY

SEQ ID NO: 64057 - protein, 10 aa, Borrelia burgdorferi
SQWAGKTQIF

SEQ ID NO: 64058 - protein, 10 aa, Borrelia burgdorferi
LSENEAGVNF

SEQ ID NO: 64059 - protein, 10 aa, Borrelia burgdorferi
ELIAKVITIY

SEQ ID NO: 64060 - protein, 10 aa, Borrelia burgdorferi
NLVILDVNTL

SEQ ID NO: 64061 - protein, 10 aa, Borrelia burgdorferi
EDLDKDLTTM

SEQ ID NO: 64062 - protein, 11 aa, Borrelia burgdorferi
NAVYRGDLDYY

SEQ ID NO: 64063 - protein, 11 aa, Borrelia burgdorferi
FVNMDLEFVNY

SEQ ID NO: 64064 - protein, 11 aa, Borrelia burgdorferi
YSQWAGKTQIF

SEQ ID NO: 64065 - protein, 11 aa, Borrelia burgdorferi
YKGPYDSTNTY

SEQ ID NO: 64066 - protein, 11 aa, Borrelia burgdorferi
TMSIDSSSPVF

SEQ ID NO: 64067 - protein, 11 aa, Borrelia burgdorferi
SPVFLEVIDPI

SEQ ID NO: 64068 - protein, 11 aa, Borrelia burgdorferi
FILSENKILPF

SEQ ID NO: 64069 - protein, 11 aa, Borrelia burgdorferi
MLLIFSFFLIF

SEQ ID NO: 64070 - protein, 11 aa, Borrelia burgdorferi
DPITNLGTLQL

SEQ ID NO: 64071 - protein, 11 aa, Borrelia burgdorferi
LTNSNSNSSYY

SEQ ID NO: 64072 - protein, 11 aa, Borrelia burgdorferi
FSFFLIFLNGF

SEQ ID NO: 64073 - protein, 11 aa, Borrelia burgdorferi
WAGKTQIFIPL

SEQ ID NO: 64074 - protein, 11 aa, Borrelia burgdorferi
FFLIFLNGFPL

SEQ ID NO: 64075 - protein, 11 aa, Borrelia burgdorferi
TKENAGLSRVY

SEQ ID NO: 64076 - protein, 11 aa, Borrelia burgdorferi
DPKVKDQTTSL

SEQ ID NO: 64077 - protein, 11 aa, Borrelia burgdorferi
DLEFVNYKGPY

SEQ ID NO: 64078 - protein, 11 aa, Borrelia burgdorferi
LPEDKKLDSKL

SEQ ID NO: 64079 - protein, 11 aa, Borrelia burgdorferi
LLSENEAGVNF

SEQ ID NO: 64080 - protein, 11 aa, Borrelia burgdorferi
MSIDSSSPVFL

SEQ ID NO: 64081 - protein, 11 aa, Borrelia burgdorferi
NFEINKNSSLY

SEQ ID NO: 64082 - protein, 9 aa, Borrelia burgdorferi
SENEAGVNF

SEQ ID NO: 64083 - protein, 9 aa, Borrelia burgdorferi
SELDSILNL

SEQ ID NO: 64084 - protein, 9 aa, Borrelia burgdorferi
REIEKQIEI

SEQ ID NO: 64085 - protein, 9 aa, Borrelia burgdorferi
GEFLARPLT

SEQ ID NO: 64086 - protein, 9 aa, Borrelia burgdorferi
AEDNLDVQR

SEQ ID NO: 64087 - protein, 9 aa, Borrelia burgdorferi
EEHKKEIES

SEQ ID NO: 64088 - protein, 9 aa, Borrelia burgdorferi
KEIESQVDA

SEQ ID NO: 64089 - protein, 9 aa, Borrelia burgdorferi
AELIAKVIT

SEQ ID NO: 64090 - protein, 9 aa, Borrelia burgdorferi
KESLEDLQE

SEQ ID NO: 64091 - protein, 9 aa, Borrelia burgdorferi
EEVDNKAIN

SEQ ID NO: 64092 - protein, 9 aa, Borrelia burgdorferi
SENKILPFT

SEQ ID NO: 64093 - protein, 9 aa, Borrelia burgdorferi
NEINKEKNL

SEQ ID NO: 64094 - protein, 9 aa, Borrelia burgdorferi
TELDNIHES

SEQ ID NO: 64095 - protein, 10 aa, Borrelia burgdorferi
EEVDNKAINL

SEQ ID NO: 64096 - protein, 10 aa, Borrelia burgdorferi
EELDKKAINL

SEQ ID NO: 64097 - protein, 10 aa, Borrelia burgdorferi
SENKILPFTS

SEQ ID NO: 64098 - protein, 10 aa, Borrelia burgdorferi
GEFLARPLTN

SEQ ID NO: 64099 - protein, 10 aa, Borrelia burgdorferi
AELIAKVITI

SEQ ID NO: 64100 - protein, 10 aa, Borrelia burgdorferi
SENEAGVNFA

SEQ ID NO: 64101 - protein, 10 aa, Borrelia burgdorferi
REKDLVVIKM

SEQ ID NO: 64102 - protein, 10 aa, Borrelia burgdorferi
SEVEKLDKIS

SEQ ID NO: 64103 - protein, 10 aa, Borrelia burgdorferi
FEINKNSSLY

SEQ ID NO: 64104 - protein, 10 aa, Borrelia burgdorferi
KEKLKDFVNM

SEQ ID NO: 64105 - protein, 10 aa, Borrelia burgdorferi
LEFVNYKGPY

SEQ ID NO: 64106 - protein, 10 aa, Borrelia burgdorferi
EEITKGKSRA

SEQ ID NO: 64107 - protein, 10 aa, Borrelia burgdorferi
YEQIVGIGEF

SEQ ID NO: 64108 - protein, 10 aa, Borrelia burgdorferi
SELDSILNLR

SEQ ID NO: 64109 - protein, 11 aa, Borrelia burgdorferi
AELIAKVITIY

SEQ ID NO: 64110 - protein, 11 aa, Borrelia burgdorferi
EEITKGKSRAS

SEQ ID NO: 64111 - protein, 11 aa, Borrelia burgdorferi
EEVDNKAINLQ

SEQ ID NO: 64112 - protein, 11 aa, Borrelia burgdorferi
SENKILPFTSF

SEQ ID NO: 64113 - protein, 11 aa, Borrelia burgdorferi
SENEAGVNFAR

SEQ ID NO: 64114 - protein, 11 aa, Borrelia burgdorferi
KESLEDLQEQL

SEQ ID NO: 64115 - protein, 11 aa, Borrelia burgdorferi
GEFLARPLTNS

SEQ ID NO: 64116 - protein, 11 aa, Borrelia burgdorferi
EEHKKEIESQV

SEQ ID NO: 64117 - protein, 11 aa, Borrelia burgdorferi
SELDSILNLRR

SEQ ID NO: 64118 - protein, 11 aa, Borrelia burgdorferi
FEINKNSSLYV

SEQ ID NO: 64119 - protein, 11 aa, Borrelia burgdorferi
DEFILSENKIL

SEQ ID NO: 64120 - protein, 11 aa, Borrelia burgdorferi
SESNFEINKNS

SEQ ID NO: 64121 - protein, 11 aa, Borrelia burgdorferi
EELLKSKDGKV

SEQ ID NO: 64122 - protein, 11 aa, Borrelia burgdorferi
AEDNLDVQRDT

SEQ ID NO: 64123 - protein, 11 aa, Borrelia burgdorferi
KESTQQGIQRY

SEQ ID NO: 64124 - protein, 11 aa, Borrelia burgdorferi
EELDKKAINLD

SEQ ID NO: 64125 - protein, 9 aa, Borrelia burgdorferi
LPFTSFSVR

SEQ ID NO: 64126 - protein, 9 aa, Borrelia burgdorferi
LPKPGDVSS

SEQ ID NO: 64127 - protein, 9 aa, Borrelia burgdorferi
DPITNLGTL

SEQ ID NO: 64128 - protein, 10 aa, Borrelia burgdorferi
LPFTSFSVRK

SEQ ID NO: 64129 - protein, 10 aa, Borrelia burgdorferi
LPKPGDVSSP

SEQ ID NO: 64130 - protein, 11 aa, Borrelia burgdorferi
SPVFLEVIDPI

SEQ ID NO: 64131 - protein, 11 aa, Borrelia burgdorferi
LPFTSFSVRKN

SEQ ID NO: 64132 - protein, 11 aa, Borrelia burgdorferi
LPKPGDVSSPK

SEQ ID NO: 64133 - protein, 11 aa, Borrelia burgdorferi
SPLDKPSYDDI

SEQ ID NO: 64134 - protein, 9 aa, Borrelia burgdorferi
STQQGIQRY

SEQ ID NO: 64135 - protein, 11 aa, Borrelia burgdorferi
NAGLSRVYSQW

SEQ ID NO: 64136 - protein, 9 aa, Borrelia burgdorferi B31
ETTALGAAY

SEQ ID NO: 64137 - protein, 9 aa, Borrelia burgdorferi B31
SVSDNGGVY

SEQ ID NO: 64138 - protein, 9 aa, Borrelia burgdorferi B31
YLAGLATGY

SEQ ID NO: 64139 - protein, 9 aa, Borrelia burgdorferi B31
SSDAEALAS

SEQ ID NO: 64140 - protein, 9 aa, Borrelia burgdorferi B31
VSDNGGVYF

SEQ ID NO: 64141 - protein, 10 aa, Borrelia burgdorferi B31
SSVSDNGGVY

SEQ ID NO: 64142 - protein, 10 aa, Borrelia burgdorferi B31
FAQKEFTQIY

SEQ ID NO: 64143 - protein, 10 aa, Borrelia burgdorferi B31
VSDNGGVYFV

SEQ ID NO: 64144 - protein, 11 aa, Borrelia burgdorferi B31
ITETTALGAAY

SEQ ID NO: 64145 - protein, 11 aa, Borrelia burgdorferi B31
ASSVSDNGGVY

SEQ ID NO: 64146 - protein, 11 aa, Borrelia burgdorferi B31
LTQKKEHATDY

SEQ ID NO: 64147 - protein, 11 aa, Borrelia burgdorferi B31
SSDAEALASSV

SEQ ID NO: 64148 - protein, 9 aa, Borrelia burgdorferi B31
KIMWILDNV

SEQ ID NO: 64149 - protein, 9 aa, Borrelia burgdorferi B31
YVLEGSVFI

SEQ ID NO: 64150 - protein, 9 aa, Borrelia burgdorferi B31
ALFGAEIPI

SEQ ID NO: 64151 - protein, 9 aa, Borrelia burgdorferi B31
LLMQFQADL

SEQ ID NO: 64152 - protein, 9 aa, Borrelia burgdorferi B31
VLDSYFSGT

SEQ ID NO: 64153 - protein, 9 aa, Borrelia burgdorferi B31
KTLEWDDEL

SEQ ID NO: 64154 - protein, 9 aa, Borrelia burgdorferi B31
MVFDKNANI

SEQ ID NO: 64155 - protein, 9 aa, Borrelia burgdorferi B31
ILPNEIDAI

SEQ ID NO: 64156 - protein, 9 aa, Borrelia burgdorferi B31
WILDNVEGA

SEQ ID NO: 64157 - protein, 9 aa, Borrelia burgdorferi B31
GVYFVPAFV

SEQ ID NO: 64158 - protein, 9 aa, Borrelia burgdorferi B31
KTDKALFGA

SEQ ID NO: 64159 - protein, 9 aa, Borrelia burgdorferi B31
IILEKTGLV

SEQ ID NO: 64160 - protein, 9 aa, Borrelia burgdorferi B31
SQLGVITEA

SEQ ID NO: 64161 - protein, 9 aa, Borrelia burgdorferi B31
KLLENWNKA

SEQ ID NO: 64162 - protein, 9 aa, Borrelia burgdorferi B31
QIYPQPSWV

SEQ ID NO: 64163 - protein, 9 aa, Borrelia burgdorferi B31
YILSIDQGT

SEQ ID NO: 64164 - protein, 9 aa, Borrelia burgdorferi B31
GMAKNTYGT

SEQ ID NO: 64165 - protein, 9 aa, Borrelia burgdorferi B31
EIWGSQLGV

SEQ ID NO: 64166 - protein, 9 aa, Borrelia burgdorferi B31
VITEAMANA

SEQ ID NO: 64167 - protein, 9 aa, Borrelia burgdorferi B31
LLENWNKAV

SEQ ID NO: 64168 - protein, 9 aa, Borrelia burgdorferi B31
LMQFQADLL

SEQ ID NO: 64169 - protein, 9 aa, Borrelia burgdorferi B31
GIAGDQFAA

SEQ ID NO: 64170 - protein, 9 aa, Borrelia burgdorferi B31
TLEWDDELL

SEQ ID NO: 64171 - protein, 9 aa, Borrelia burgdorferi B31
FQSFDILNT

SEQ ID NO: 64172 - protein, 9 aa, Borrelia burgdorferi B31
KLLTSIAWG

SEQ ID NO: 64173 - protein, 9 aa, Borrelia burgdorferi B31
SIAFQSFDI

SEQ ID NO: 64174 - protein, 9 aa, Borrelia burgdorferi B31
QLGVITEAM

SEQ ID NO: 64175 - protein, 9 aa, Borrelia burgdorferi B31
FSGTKIMWI

SEQ ID NO: 64176 - protein, 9 aa, Borrelia burgdorferi B31
TLLLNIKTL

SEQ ID NO: 64177 - protein, 10 aa, Borrelia burgdorferi B31
TIDTWILWNL

SEQ ID NO: 64178 - protein, 10 aa, Borrelia burgdorferi B31
ALGAAYLAGL

SEQ ID NO: 64179 - protein, 10 aa, Borrelia burgdorferi B31
LLMQFQADLL

SEQ ID NO: 64180 - protein, 10 aa, Borrelia burgdorferi B31
ALFGAEIPIA

SEQ ID NO: 64181 - protein, 10 aa, Borrelia burgdorferi B31
FIGGAVIQWL

SEQ ID NO: 64182 - protein, 10 aa, Borrelia burgdorferi B31
FQADLLECKV

SEQ ID NO: 64183 - protein, 10 aa, Borrelia burgdorferi B31
KLLENWNKAV

SEQ ID NO: 64184 - protein, 10 aa, Borrelia burgdorferi B31
KTLEWDDELL

SEQ ID NO: 64185 - protein, 10 aa, Borrelia burgdorferi B31
LLSILNVPRA

SEQ ID NO: 64186 - protein, 10 aa, Borrelia burgdorferi B31
GLATGYWQSA

SEQ ID NO: 64187 - protein, 10 aa, Borrelia burgdorferi B31
LVLDSYFSGT

SEQ ID NO: 64188 - protein, 10 aa, Borrelia burgdorferi B31
FVPAFVGLGA

SEQ ID NO: 64189 - protein, 10 aa, Borrelia burgdorferi B31
KITETTALGA

SEQ ID NO: 64190 - protein, 10 aa, Borrelia burgdorferi B31
FQSFDILNTM

SEQ ID NO: 64191 - protein, 10 aa, Borrelia burgdorferi B31
FAATFGQACL

SEQ ID NO: 64192 - protein, 10 aa, Borrelia burgdorferi B31
IILEKTGLVL

SEQ ID NO: 64193 - protein, 10 aa, Borrelia burgdorferi B31
AMVFDKNANI

SEQ ID NO: 64194 - protein, 10 aa, Borrelia burgdorferi B31
NLLMQFQADL

SEQ ID NO: 64195 - protein, 10 aa, Borrelia burgdorferi B31
RILPNEIDAI

SEQ ID NO: 64196 - protein, 10 aa, Borrelia burgdorferi B31
SIPNFEIQEL

SEQ ID NO: 64197 - protein, 10 aa, Borrelia burgdorferi B31
SVTYVLEGSV

SEQ ID NO: 64198 - protein, 10 aa, Borrelia burgdorferi B31
KIILEKTGLV

SEQ ID NO: 64199 - protein, 10 aa, Borrelia burgdorferi B31
VSDNGGVYFV

SEQ ID NO: 64200 - protein, 10 aa, Borrelia burgdorferi B31
FSGTKIMWIL

SEQ ID NO: 64201 - protein, 10 aa, Borrelia burgdorferi B31
WQSAEEIVSL

SEQ ID NO: 64202 - protein, 10 aa, Borrelia burgdorferi B31
SIAFQSFDIL

SEQ ID NO: 64203 - protein, 10 aa, Borrelia burgdorferi B31
TQIYPQPSWV

SEQ ID NO: 64204 - protein, 10 aa, Borrelia burgdorferi B31
SQLGVITEAM

SEQ ID NO: 64205 - protein, 10 aa, Borrelia burgdorferi B31
NVPRAILPEL

SEQ ID NO: 64206 - protein, 11 aa, Borrelia burgdorferi B31
VLDSYFSGTKI

SEQ ID NO: 64207 - protein, 11 aa, Borrelia burgdorferi B31
FLTVNIGKEPI

SEQ ID NO: 64208 - protein, 11 aa, Borrelia burgdorferi B31
IMWILDNVEGA

SEQ ID NO: 64209 - protein, 11 aa, Borrelia burgdorferi B31
FTQIYPQPSWV

SEQ ID NO: 64210 - protein, 11 aa, Borrelia burgdorferi B31
FQADLLECKVV

SEQ ID NO: 64211 - protein, 11 aa, Borrelia burgdorferi B31
ILPNEIDAIGI

SEQ ID NO: 64212 - protein, 11 aa, Borrelia burgdorferi B31
SVSDNGGVYFV

SEQ ID NO: 64213 - protein, 11 aa, Borrelia burgdorferi B31
NTYGTGCFLTV

SEQ ID NO: 64214 - protein, 11 aa, Borrelia burgdorferi B31
TLEWDDELLSI

SEQ ID NO: 64215 - protein, 11 aa, Borrelia burgdorferi B31
GTIDTWILWNL

SEQ ID NO: 64216 - protein, 11 aa, Borrelia burgdorferi B31
ILPELKESSTI

SEQ ID NO: 64217 - protein, 11 aa, Borrelia burgdorferi B31
VITEAMANARI

SEQ ID NO: 64218 - protein, 11 aa, Borrelia burgdorferi B31
VIWEKNTGKPI

SEQ ID NO: 64219 - protein, 11 aa, Borrelia burgdorferi B31
KTDKALFGAEI

SEQ ID NO: 64220 - protein, 11 aa, Borrelia burgdorferi B31
GVYFVPAFVGL

SEQ ID NO: 64221 - protein, 11 aa, Borrelia burgdorferi B31
TMKKSIPNFEI

SEQ ID NO: 64222 - protein, 11 aa, Borrelia burgdorferi B31
YLAGLATGYWQ

SEQ ID NO: 64223 - protein, 11 aa, Borrelia burgdorferi B31
LLSILNVPRAI

SEQ ID NO: 64224 - protein, 11 aa, Borrelia burgdorferi B31
GLGAPHWDSYA

SEQ ID NO: 64225 - protein, 11 aa, Borrelia burgdorferi B31
ELLSILNVPRA

SEQ ID NO: 64226 - protein, 11 aa, Borrelia burgdorferi B31
TALGAAYLAGL

SEQ ID NO: 64227 - protein, 11 aa, Borrelia burgdorferi B31
NLLMQFQADLL

SEQ ID NO: 64228 - protein, 11 aa, Borrelia burgdorferi B31
LLECKVVRPKI

SEQ ID NO: 64229 - protein, 11 aa, Borrelia burgdorferi B31
VLEGSVFIGGA

SEQ ID NO: 64230 - protein, 11 aa, Borrelia burgdorferi B31
IISHDKLLTSI

SEQ ID NO: 64231 - protein, 11 aa, Borrelia burgdorferi B31
WQVDKIFEPSM

SEQ ID NO: 64232 - protein, 11 aa, Borrelia burgdorferi B31
KSVTYVLEGSV

SEQ ID NO: 64233 - protein, 11 aa, Borrelia burgdorferi B31
SAEEIVSLWQV

SEQ ID NO: 64234 - protein, 11 aa, Borrelia burgdorferi B31
ALGAAYLAGLA

SEQ ID NO: 64235 - protein, 11 aa, Borrelia burgdorferi B31
KITETTALGAA

SEQ ID NO: 64236 - protein, 11 aa, Borrelia burgdorferi B31
SQLGVITEAMA

SEQ ID NO: 64237 - protein, 11 aa, Borrelia burgdorferi B31
GLVLDSYFSGT

SEQ ID NO: 64238 - protein, 9 aa, Borrelia burgdorferi B31
KIFEPSMPK

SEQ ID NO: 64239 - protein, 9 aa, Borrelia burgdorferi B31
ILWNLTQKK

SEQ ID NO: 64240 - protein, 9 aa, Borrelia burgdorferi B31
ATFGQACLK

SEQ ID NO: 64241 - protein, 9 aa, Borrelia burgdorferi B31
TSIAWGRKK

SEQ ID NO: 64242 - protein, 9 aa, Borrelia burgdorferi B31
IVSLWQVDK

SEQ ID NO: 64243 - protein, 9 aa, Borrelia burgdorferi B31
VIWEKNTGK

SEQ ID NO: 64244 - protein, 9 aa, Borrelia burgdorferi B31
SSRAMVFDK

SEQ ID NO: 64245 - protein, 9 aa, Borrelia burgdorferi B31
LTSIAWGRK

SEQ ID NO: 64246 - protein, 9 aa, Borrelia burgdorferi B31
WILWNLTQK

SEQ ID NO: 64247 - protein, 9 aa, Borrelia burgdorferi B31
YLAGLATGY

SEQ ID NO: 64248 - protein, 9 aa, Borrelia burgdorferi B31
CFLTVNIGK

SEQ ID NO: 64249 - protein, 9 aa, Borrelia burgdorferi B31
STIYGKTDK

SEQ ID NO: 64250 - protein, 10 aa, Borrelia burgdorferi B31
ATFGQACLKK

SEQ ID NO: 64251 - protein, 10 aa, Borrelia burgdorferi B31
LLTSIAWGRK

SEQ ID NO: 64252 - protein, 10 aa, Borrelia burgdorferi B31
IIGITRGSTK

SEQ ID NO: 64253 - protein, 10 aa, Borrelia burgdorferi B31
VLDSYFSGTK

SEQ ID NO: 64254 - protein, 10 aa, Borrelia burgdorferi B31
AATFGQACLK

SEQ ID NO: 64255 - protein, 10 aa, Borrelia burgdorferi B31
KLLTSIAWGR

SEQ ID NO: 64256 - protein, 10 aa, Borrelia burgdorferi B31
QACLKKGMAK

SEQ ID NO: 64257 - protein, 10 aa, Borrelia burgdorferi B31
LTSIAWGRKK

SEQ ID NO: 64258 - protein, 10 aa, Borrelia burgdorferi B31
QSFDILNTMK

SEQ ID NO: 64259 - protein, 10 aa, Borrelia burgdorferi B31
LLECKVVRPK

SEQ ID NO: 64260 - protein, 10 aa, Borrelia burgdorferi B31
WILWNLTQKK

SEQ ID NO: 64261 - protein, 10 aa, Borrelia burgdorferi B31
TVIWEKNTGK

SEQ ID NO: 64262 - protein, 10 aa, Borrelia burgdorferi B31
MVFDKNANIK

SEQ ID NO: 64263 - protein, 10 aa, Borrelia burgdorferi B31
ASRTLLLNIK

SEQ ID NO: 64264 - protein, 10 aa, Borrelia burgdorferi B31
SSTIYGKTDK

SEQ ID NO: 64265 - protein, 10 aa, Borrelia burgdorferi B31
TSSRAMVFDK

SEQ ID NO: 64266 - protein, 10 aa, Borrelia burgdorferi B31
AYLAGLATGY

SEQ ID NO: 64267 - protein, 10 aa, Borrelia burgdorferi B31
SFDILNTMKK

SEQ ID NO: 64268 - protein, 10 aa, Borrelia burgdorferi B31
NANIKGFAQK

SEQ ID NO: 64269 - protein, 10 aa, Borrelia burgdorferi B31
IVWQDRRTAK

SEQ ID NO: 64270 - protein, 10 aa, Borrelia burgdorferi B31
GCFLTVNIGK

SEQ ID NO: 64271 - protein, 10 aa, Borrelia burgdorferi B31
TWILWNLTQK

SEQ ID NO: 64272 - protein, 10 aa, Borrelia burgdorferi B31
RTAKICDQLK

SEQ ID NO: 64273 - protein, 10 aa, Borrelia burgdorferi B31
GLGAPHWDSY

SEQ ID NO: 64274 - protein, 10 aa, Borrelia burgdorferi B31
DKIFEPSMPK

SEQ ID NO: 64275 - protein, 10 aa, Borrelia burgdorferi B31
LLLNIKTLEW

SEQ ID NO: 64276 - protein, 10 aa, Borrelia burgdorferi B31
SIDQGTTSSR

SEQ ID NO: 64277 - protein, 10 aa, Borrelia burgdorferi B31
ELLSILNVPR

SEQ ID NO: 64278 - protein, 10 aa, Borrelia burgdorferi B31
WLRDGLEFFR

SEQ ID NO: 64279 - protein, 10 aa, Borrelia burgdorferi B31
EIVSLWQVDK

SEQ ID NO: 64280 - protein, 11 aa, Borrelia burgdorferi B31
KLLTSIAWGRK

SEQ ID NO: 64281 - protein, 11 aa, Borrelia burgdorferi B31
RTAKICDQLKK

SEQ ID NO: 64282 - protein, 11 aa, Borrelia burgdorferi B31
LLTSIAWGRKK

SEQ ID NO: 64283 - protein, 11 aa, Borrelia burgdorferi B31
TIIGITRGSTK

SEQ ID NO: 64284 - protein, 11 aa, Borrelia burgdorferi B31
QSFDILNTMKK

SEQ ID NO: 64285 - protein, 11 aa, Borrelia burgdorferi B31
TTSSRAMVFDK

SEQ ID NO: 64286 - protein, 11 aa, Borrelia burgdorferi B31
LVLDSYFSGTK

SEQ ID NO: 64287 - protein, 11 aa, Borrelia burgdorferi B31
FAATFGQACLK

SEQ ID NO: 64288 - protein, 11 aa, Borrelia burgdorferi B31
GQACLKKGMAK

SEQ ID NO: 64289 - protein, 11 aa, Borrelia burgdorferi B31
LLENWNKAVGK

SEQ ID NO: 64290 - protein, 11 aa, Borrelia burgdorferi B31
FQSFDILNTMK

SEQ ID NO: 64291 - protein, 11 aa, Borrelia burgdorferi B31
KNANIKGFAQK

SEQ ID NO: 64292 - protein, 11 aa, Borrelia burgdorferi B31
AIVWQDRRTAK

SEQ ID NO: 64293 - protein, 11 aa, Borrelia burgdorferi B31
MQFQADLLECK

SEQ ID NO: 64294 - protein, 11 aa, Borrelia burgdorferi B31
AATFGQACLKK

SEQ ID NO: 64295 - protein, 11 aa, Borrelia burgdorferi B31
QIYPQPSWVEH

SEQ ID NO: 64296 - protein, 11 aa, Borrelia burgdorferi B31
AMVFDKNANIK

SEQ ID NO: 64297 - protein, 11 aa, Borrelia burgdorferi B31
WLRDGLEFFRK

SEQ ID NO: 64298 - protein, 11 aa, Borrelia burgdorferi B31
AAYLAGLATGY

SEQ ID NO: 64299 - protein, 9 aa, Borrelia burgdorferi B31
KIFEPSMPK

SEQ ID NO: 64300 - protein, 9 aa, Borrelia burgdorferi B31
ATFGQACLK

SEQ ID NO: 64301 - protein, 9 aa, Borrelia burgdorferi B31
SSRAMVFDK

SEQ ID NO: 64302 - protein, 9 aa, Borrelia burgdorferi B31
TSIAWGRKK

SEQ ID NO: 64303 - protein, 9 aa, Borrelia burgdorferi B31
LTSIAWGRK

SEQ ID NO: 64304 - protein, 9 aa, Borrelia burgdorferi B31
STIYGKTDK

SEQ ID NO: 64305 - protein, 9 aa, Borrelia burgdorferi B31
IVSLWQVDK

SEQ ID NO: 64306 - protein, 9 aa, Borrelia burgdorferi B31
WILWNLTQK

SEQ ID NO: 64307 - protein, 9 aa, Borrelia burgdorferi B31
ATDYSNASR

SEQ ID NO: 64308 - protein, 9 aa, Borrelia burgdorferi B31
ILWNLTQKK

SEQ ID NO: 64309 - protein, 9 aa, Borrelia burgdorferi B31
VIWEKNTGK

SEQ ID NO: 64310 - protein, 9 aa, Borrelia burgdorferi B31
TAKICDQLK

SEQ ID NO: 64311 - protein, 9 aa, Borrelia burgdorferi B31
ITEAMANAR

SEQ ID NO: 64312 - protein, 9 aa, Borrelia burgdorferi B31
FQADLLECK

SEQ ID NO: 64313 - protein, 9 aa, Borrelia burgdorferi B31
SVSDNGGVY

SEQ ID NO: 64314 - protein, 9 aa, Borrelia burgdorferi B31
KTGLVLDSY

SEQ ID NO: 64315 - protein, 9 aa, Borrelia burgdorferi B31
KESSTIYGK

SEQ ID NO: 64316 - protein, 9 aa, Borrelia burgdorferi B31
SFDILNTMK

SEQ ID NO: 64317 - protein, 9 aa, Borrelia burgdorferi B31
CFLTVNIGK

SEQ ID NO: 64318 - protein, 9 aa, Borrelia burgdorferi B31
SMPKNQKEK

SEQ ID NO: 64319 - protein, 9 aa, Borrelia burgdorferi B31
ANIKGFAQK

SEQ ID NO: 64320 - protein, 9 aa, Borrelia burgdorferi B31
TFGQACLKK

SEQ ID NO: 64321 - protein, 9 aa, Borrelia burgdorferi B31
LLSILNVPR

SEQ ID NO: 64322 - protein, 9 aa, Borrelia burgdorferi B31
GSTKAHITR

SEQ ID NO: 64323 - protein, 9 aa, Borrelia burgdorferi B31
VWQDRRTAK

SEQ ID NO: 64324 - protein, 10 aa, Borrelia burgdorferi B31
ATFGQACLKK

SEQ ID NO: 64325 - protein, 10 aa, Borrelia burgdorferi B31
TSSRAMVFDK

SEQ ID NO: 64326 - protein, 10 aa, Borrelia burgdorferi B31
MVFDKNANIK

SEQ ID NO: 64327 - protein, 10 aa, Borrelia burgdorferi B31
TVIWEKNTGK

SEQ ID NO: 64328 - protein, 10 aa, Borrelia burgdorferi B31
QSFDILNTMK

SEQ ID NO: 64329 - protein, 10 aa, Borrelia burgdorferi B31
RTAKICDQLK

SEQ ID NO: 64330 - protein, 10 aa, Borrelia burgdorferi B31
AATFGQACLK

SEQ ID NO: 64331 - protein, 10 aa, Borrelia burgdorferi B31
LTSIAWGRKK

SEQ ID NO: 64332 - protein, 10 aa, Borrelia burgdorferi B31
VLDSYFSGTK

SEQ ID NO: 64333 - protein, 10 aa, Borrelia burgdorferi B31
ASRTLLLNIK

SEQ ID NO: 64334 - protein, 10 aa, Borrelia burgdorferi B31
QACLKKGMAK

SEQ ID NO: 64335 - protein, 10 aa, Borrelia burgdorferi B31
SSTIYGKTDK

SEQ ID NO: 64336 - protein, 10 aa, Borrelia burgdorferi B31
NANIKGFAQK

SEQ ID NO: 64337 - protein, 10 aa, Borrelia burgdorferi B31
LLTSIAWGRK

SEQ ID NO: 64338 - protein, 10 aa, Borrelia burgdorferi B31
IVWQDRRTAK

SEQ ID NO: 64339 - protein, 10 aa, Borrelia burgdorferi B31
WILWNLTQKK

SEQ ID NO: 64340 - protein, 10 aa, Borrelia burgdorferi B31
IIGITRGSTK

SEQ ID NO: 64341 - protein, 10 aa, Borrelia burgdorferi B31
TWILWNLTQK

SEQ ID NO: 64342 - protein, 10 aa, Borrelia burgdorferi B31
TAKICDQLKK

SEQ ID NO: 64343 - protein, 10 aa, Borrelia burgdorferi B31
SFDILNTMKK

SEQ ID NO: 64344 - protein, 10 aa, Borrelia burgdorferi B31
SIDQGTTSSR

SEQ ID NO: 64345 - protein, 10 aa, Borrelia burgdorferi B31
KLLTSIAWGR

SEQ ID NO: 64346 - protein, 10 aa, Borrelia burgdorferi B31
QFQADLLECK

SEQ ID NO: 64347 - protein, 10 aa, Borrelia burgdorferi B31
VITEAMANAR

SEQ ID NO: 64348 - protein, 10 aa, Borrelia burgdorferi B31
EIVSLWQVDK

SEQ ID NO: 64349 - protein, 10 aa, Borrelia burgdorferi B31
LLECKVVRPK

SEQ ID NO: 64350 - protein, 10 aa, Borrelia burgdorferi B31
PSMPKNQKEK

SEQ ID NO: 64351 - protein, 10 aa, Borrelia burgdorferi B31
GCFLTVNIGK

SEQ ID NO: 64352 - protein, 11 aa, Borrelia burgdorferi B31
TTSSRAMVFDK

SEQ ID NO: 64353 - protein, 11 aa, Borrelia burgdorferi B31
QSFDILNTMKK

SEQ ID NO: 64354 - protein, 11 aa, Borrelia burgdorferi B31
LVLDSYFSGTK

SEQ ID NO: 64355 - protein, 11 aa, Borrelia burgdorferi B31
TIIGITRGSTK

SEQ ID NO: 64356 - protein, 11 aa, Borrelia burgdorferi B31
RTAKICDQLKK

SEQ ID NO: 64357 - protein, 11 aa, Borrelia burgdorferi B31
KLLTSIAWGRK

SEQ ID NO: 64358 - protein, 11 aa, Borrelia burgdorferi B31
MQFQADLLECK

SEQ ID NO: 64359 - protein, 11 aa, Borrelia burgdorferi B31
TTVIWEKNTGK

SEQ ID NO: 64360 - protein, 11 aa, Borrelia burgdorferi B31
AATFGQACLKK

SEQ ID NO: 64361 - protein, 11 aa, Borrelia burgdorferi B31
AIVWQDRRTAK

SEQ ID NO: 64362 - protein, 11 aa, Borrelia burgdorferi B31
KICDQLKKEGK

SEQ ID NO: 64363 - protein, 11 aa, Borrelia burgdorferi B31
AMVFDKNANIK

SEQ ID NO: 64364 - protein, 11 aa, Borrelia burgdorferi B31
GQACLKKGMAK

SEQ ID NO: 64365 - protein, 11 aa, Borrelia burgdorferi B31
GVITEAMANAR

SEQ ID NO: 64366 - protein, 11 aa, Borrelia burgdorferi B31
TGCFLTVNIGK

SEQ ID NO: 64367 - protein, 11 aa, Borrelia burgdorferi B31
NASRTLLLNIK

SEQ ID NO: 64368 - protein, 11 aa, Borrelia burgdorferi B31
FAATFGQACLK

SEQ ID NO: 64369 - protein, 11 aa, Borrelia burgdorferi B31
NVPRAILPELK

SEQ ID NO: 64370 - protein, 11 aa, Borrelia burgdorferi B31
FQSFDILNTMK

SEQ ID NO: 64371 - protein, 11 aa, Borrelia burgdorferi B31
AAYLAGLATGY

SEQ ID NO: 64372 - protein, 11 aa, Borrelia burgdorferi B31
TWILWNLTQKK

SEQ ID NO: 64373 - protein, 11 aa, Borrelia burgdorferi B31
DTWILWNLTQK

SEQ ID NO: 64374 - protein, 11 aa, Borrelia burgdorferi B31
SIPNFEIQELR

SEQ ID NO: 64375 - protein, 11 aa, Borrelia burgdorferi B31
LLTSIAWGRKK

SEQ ID NO: 64376 - protein, 11 aa, Borrelia burgdorferi B31
LSIDQGTTSSR

SEQ ID NO: 64377 - protein, 11 aa, Borrelia burgdorferi B31
LLENWNKAVGK

SEQ ID NO: 64378 - protein, 11 aa, Borrelia burgdorferi B31
WLRDGLEFFRK

SEQ ID NO: 64379 - protein, 11 aa, Borrelia burgdorferi B31
KNANIKGFAQK

SEQ ID NO: 64380 - protein, 11 aa, Borrelia burgdorferi B31
ASQNNLLMQFQ

SEQ ID NO: 64381 - protein, 9 aa, Borrelia burgdorferi B31
QWLRDGLEF

SEQ ID NO: 64382 - protein, 9 aa, Borrelia burgdorferi B31
TYVLEGSVF

SEQ ID NO: 64383 - protein, 9 aa, Borrelia burgdorferi B31
DYSNASRTL

SEQ ID NO: 64384 - protein, 9 aa, Borrelia burgdorferi B31
IWGSQLGVI

SEQ ID NO: 64385 - protein, 9 aa, Borrelia burgdorferi B31
IYGKTDKAL

SEQ ID NO: 64386 - protein, 9 aa, Borrelia burgdorferi B31
CFGTIDTWI

SEQ ID NO: 64387 - protein, 9 aa, Borrelia burgdorferi B31
IYPQPSWVE

SEQ ID NO: 64388 - protein, 9 aa, Borrelia burgdorferi B31
YWQSAEEIV

SEQ ID NO: 64389 - protein, 9 aa, Borrelia burgdorferi B31
EWDDELLSI

SEQ ID NO: 64390 - protein, 9 aa, Borrelia burgdorferi B31
YFVPAFVGL

SEQ ID NO: 64391 - protein, 9 aa, Borrelia burgdorferi B31
TYGTGCFLT

SEQ ID NO: 64392 - protein, 9 aa, Borrelia burgdorferi B31
GYWQSAEEI

SEQ ID NO: 64393 - protein, 10 aa, Borrelia burgdorferi B31
IYGKTDKALF

SEQ ID NO: 64394 - protein, 10 aa, Borrelia burgdorferi B31
QWLRDGLEFF

SEQ ID NO: 64395 - protein, 10 aa, Borrelia burgdorferi B31
TYVLEGSVFI

SEQ ID NO: 64396 - protein, 10 aa, Borrelia burgdorferi B31
SYARGTIIGI

SEQ ID NO: 64397 - protein, 10 aa, Borrelia burgdorferi B31
DYSNASRTLL

SEQ ID NO: 64398 - protein, 10 aa, Borrelia burgdorferi B31
TYGTGCFLTV

SEQ ID NO: 64399 - protein, 10 aa, Borrelia burgdorferi B31
VWQDRRTAKI

SEQ ID NO: 64400 - protein, 10 aa, Borrelia burgdorferi B31
VYFVPAFVGL

SEQ ID NO: 64401 - protein, 10 aa, Borrelia burgdorferi B31
SWVEHDPTEI

SEQ ID NO: 64402 - protein, 10 aa, Borrelia burgdorferi B31
YFSGTKIMWI

SEQ ID NO: 64403 - protein, 10 aa, Borrelia burgdorferi B31
IWEKNTGKPI

SEQ ID NO: 64404 - protein, 10 aa, Borrelia burgdorferi B31
SYFSGTKIMW

SEQ ID NO: 64405 - protein, 10 aa, Borrelia burgdorferi B31
CFGTIDTWIL

SEQ ID NO: 64406 - protein, 10 aa, Borrelia burgdorferi B31
GFAQKEFTQI

SEQ ID NO: 64407 - protein, 10 aa, Borrelia burgdorferi B31
IYNAIVWQDR

SEQ ID NO: 64408 - protein, 11 aa, Borrelia burgdorferi B31
DYSNASRTLLL

SEQ ID NO: 64409 - protein, 11 aa, Borrelia burgdorferi B31
SYFSGTKIMWI

SEQ ID NO: 64410 - protein, 11 aa, Borrelia burgdorferi B31
YWQSAEEIVSL

SEQ ID NO: 64411 - protein, 11 aa, Borrelia burgdorferi B31
YFSGTKIMWIL

SEQ ID NO: 64412 - protein, 11 aa, Borrelia burgdorferi B31
AYLAGLATGYW

SEQ ID NO: 64413 - protein, 11 aa, Borrelia burgdorferi B31
VFIGGAVIQWL

SEQ ID NO: 64414 - protein, 11 aa, Borrelia burgdorferi B31
VFDKNANIKGF

SEQ ID NO: 64415 - protein, 9 aa, Borrelia burgdorferi B31
YLAGLATGY

SEQ ID NO: 64416 - protein, 9 aa, Borrelia burgdorferi B31
SVSDNGGVY

SEQ ID NO: 64417 - protein, 9 aa, Borrelia burgdorferi B31
ETTALGAAY

SEQ ID NO: 64418 - protein, 9 aa, Borrelia burgdorferi B31
ELKESSTIY

SEQ ID NO: 64419 - protein, 9 aa, Borrelia burgdorferi B31
QWLRDGLEF

SEQ ID NO: 64420 - protein, 10 aa, Borrelia burgdorferi B31
FAQKEFTQIY

SEQ ID NO: 64421 - protein, 10 aa, Borrelia burgdorferi B31
AYLAGLATGY

SEQ ID NO: 64422 - protein, 10 aa, Borrelia burgdorferi B31
SVSDNGGVYF

SEQ ID NO: 64423 - protein, 10 aa, Borrelia burgdorferi B31
SSVSDNGGVY

SEQ ID NO: 64424 - protein, 10 aa, Borrelia burgdorferi B31
VTYVLEGSVF

SEQ ID NO: 64425 - protein, 10 aa, Borrelia burgdorferi B31
AWGRKKSVTY

SEQ ID NO: 64426 - protein, 11 aa, Borrelia burgdorferi B31
GFAQKEFTQIY

SEQ ID NO: 64427 - protein, 11 aa, Borrelia burgdorferi B31
ITETTALGAAY

SEQ ID NO: 64428 - protein, 11 aa, Borrelia burgdorferi B31
AAYLAGLATGY

SEQ ID NO: 64429 - protein, 11 aa, Borrelia burgdorferi B31
IWEKNTGKPIY

SEQ ID NO: 64430 - protein, 9 aa, Borrelia burgdorferi B31
DAIGITNQR

SEQ ID NO: 64431 - protein, 9 aa, Borrelia burgdorferi B31
ATFGQACLK

SEQ ID NO: 64432 - protein, 9 aa, Borrelia burgdorferi B31
LLTSIAWGR

SEQ ID NO: 64433 - protein, 9 aa, Borrelia burgdorferi B31
ITEAMANAR

SEQ ID NO: 64434 - protein, 9 aa, Borrelia burgdorferi B31
STIYGKTDK

SEQ ID NO: 64435 - protein, 9 aa, Borrelia burgdorferi B31
NAIVWQDRR

SEQ ID NO: 64436 - protein, 9 aa, Borrelia burgdorferi B31
TAKICDQLK

SEQ ID NO: 64437 - protein, 9 aa, Borrelia burgdorferi B31
ETTALGAAY

SEQ ID NO: 64438 - protein, 9 aa, Borrelia burgdorferi B31
TSIAWGRKK

SEQ ID NO: 64439 - protein, 9 aa, Borrelia burgdorferi B31
LTSIAWGRK

SEQ ID NO: 64440 - protein, 9 aa, Borrelia burgdorferi B31
IVSLWQVDK

SEQ ID NO: 64441 - protein, 9 aa, Borrelia burgdorferi B31
LLSILNVPR

SEQ ID NO: 64442 - protein, 9 aa, Borrelia burgdorferi B31
ATDYSNASR

SEQ ID NO: 64443 - protein, 9 aa, Borrelia burgdorferi B31
SSRAMVFDK

SEQ ID NO: 64444 - protein, 9 aa, Borrelia burgdorferi B31
WILWNLTQK

SEQ ID NO: 64445 - protein, 9 aa, Borrelia burgdorferi B31
EPSMPKNQK

SEQ ID NO: 64446 - protein, 9 aa, Borrelia burgdorferi B31
GSTKAHITR

SEQ ID NO: 64447 - protein, 9 aa, Borrelia burgdorferi B31
NTYGTGCFL

SEQ ID NO: 64448 - protein, 9 aa, Borrelia burgdorferi B31
ESIAFQSFD

SEQ ID NO: 64449 - protein, 9 aa, Borrelia burgdorferi B31
DLLECKVVR

SEQ ID NO: 64450 - protein, 9 aa, Borrelia burgdorferi B31
TTSSRAMVF

SEQ ID NO: 64451 - protein, 9 aa, Borrelia burgdorferi B31
FDILNTMKK

SEQ ID NO: 64452 - protein, 9 aa, Borrelia burgdorferi B31
GGAVIQWLR

SEQ ID NO: 64453 - protein, 9 aa, Borrelia burgdorferi B31
KIFEPSMPK

SEQ ID NO: 64454 - protein, 9 aa, Borrelia burgdorferi B31
YNAIVWQDR

SEQ ID NO: 64455 - protein, 9 aa, Borrelia burgdorferi B31
TTALGAAYL

SEQ ID NO: 64456 - protein, 9 aa, Borrelia burgdorferi B31
CFLTVNIGK

SEQ ID NO: 64457 - protein, 9 aa, Borrelia burgdorferi B31
PNFEIQELR

SEQ ID NO: 64458 - protein, 9 aa, Borrelia burgdorferi B31
FQADLLECK

SEQ ID NO: 64459 - protein, 9 aa, Borrelia burgdorferi B31
APHWDSYAR

SEQ ID NO: 64460 - protein, 9 aa, Borrelia burgdorferi B31
DNVEGARQR

SEQ ID NO: 64461 - protein, 9 aa, Borrelia burgdorferi B31
YLAGLATGY

SEQ ID NO: 64462 - protein, 9 aa, Borrelia burgdorferi B31
ILDNVEGAR

SEQ ID NO: 64463 - protein, 9 aa, Borrelia burgdorferi B31
ENWNKAVGK

SEQ ID NO: 64464 - protein, 10 aa, Borrelia burgdorferi B31
MVFDKNANIK

SEQ ID NO: 64465 - protein, 10 aa, Borrelia burgdorferi B31
HATDYSNASR

SEQ ID NO: 64466 - protein, 10 aa, Borrelia burgdorferi B31
TVIWEKNTGK

SEQ ID NO: 64467 - protein, 10 aa, Borrelia burgdorferi B31
QSFDILNTMK

SEQ ID NO: 64468 - protein, 10 aa, Borrelia burgdorferi B31
TSSRAMVFDK

SEQ ID NO: 64469 - protein, 10 aa, Borrelia burgdorferi B31
ATFGQACLKK

SEQ ID NO: 64470 - protein, 10 aa, Borrelia burgdorferi B31
EIVSLWQVDK

SEQ ID NO: 64471 - protein, 10 aa, Borrelia burgdorferi B31
RTAKICDQLK

SEQ ID NO: 64472 - protein, 10 aa, Borrelia burgdorferi B31
ELLSILNVPR

SEQ ID NO: 64473 - protein, 10 aa, Borrelia burgdorferi B31
IPNFEIQELR

SEQ ID NO: 64474 - protein, 10 aa, Borrelia burgdorferi B31
VITEAMANAR

SEQ ID NO: 64475 - protein, 10 aa, Borrelia burgdorferi B31
AATFGQACLK

SEQ ID NO: 64476 - protein, 10 aa, Borrelia burgdorferi B31
NANIKGFAQK

SEQ ID NO: 64477 - protein, 10 aa, Borrelia burgdorferi B31
LLTSIAWGRK

SEQ ID NO: 64478 - protein, 10 aa, Borrelia burgdorferi B31
WLRDGLEFFR

SEQ ID NO: 64479 - protein, 10 aa, Borrelia burgdorferi B31
LTSIAWGRKK

SEQ ID NO: 64480 - protein, 10 aa, Borrelia burgdorferi B31
TAKICDQLKK

SEQ ID NO: 64481 - protein, 10 aa, Borrelia burgdorferi B31
YNAIVWQDRR

SEQ ID NO: 64482 - protein, 10 aa, Borrelia burgdorferi B31
WILDNVEGAR

SEQ ID NO: 64483 - protein, 10 aa, Borrelia burgdorferi B31
IYNAIVWQDR

SEQ ID NO: 64484 - protein, 10 aa, Borrelia burgdorferi B31
TWILWNLTQK

SEQ ID NO: 64485 - protein, 10 aa, Borrelia burgdorferi B31
SIDQGTTSSR

SEQ ID NO: 64486 - protein, 10 aa, Borrelia burgdorferi B31
NTYGTGCFLT

SEQ ID NO: 64487 - protein, 10 aa, Borrelia burgdorferi B31
SSTIYGKTDK

SEQ ID NO: 64488 - protein, 10 aa, Borrelia burgdorferi B31
IVWQDRRTAK

SEQ ID NO: 64489 - protein, 10 aa, Borrelia burgdorferi B31
WILWNLTQKK

SEQ ID NO: 64490 - protein, 10 aa, Borrelia burgdorferi B31
GAPHWDSYAR

SEQ ID NO: 64491 - protein, 10 aa, Borrelia burgdorferi B31
TTALGAAYLA

SEQ ID NO: 64492 - protein, 10 aa, Borrelia burgdorferi B31
IDAIGITNQR

SEQ ID NO: 64493 - protein, 10 aa, Borrelia burgdorferi B31
IGGAVIQWLR

SEQ ID NO: 64494 - protein, 10 aa, Borrelia burgdorferi B31
QACLKKGMAK

SEQ ID NO: 64495 - protein, 10 aa, Borrelia burgdorferi B31
ETTALGAAYL

SEQ ID NO: 64496 - protein, 10 aa, Borrelia burgdorferi B31
EGKDKIILEK

SEQ ID NO: 64497 - protein, 10 aa, Borrelia burgdorferi B31
TTSSRAMVFD

SEQ ID NO: 64498 - protein, 10 aa, Borrelia burgdorferi B31
KLLTSIAWGR

SEQ ID NO: 64499 - protein, 10 aa, Borrelia burgdorferi B31
DKIFEPSMPK

SEQ ID NO: 64500 - protein, 11 aa, Borrelia burgdorferi B31
TTSSRAMVFDK

SEQ ID NO: 64501 - protein, 11 aa, Borrelia burgdorferi B31
QSFDILNTMKK

SEQ ID NO: 64502 - protein, 11 aa, Borrelia burgdorferi B31
FAATFGQACLK

SEQ ID NO: 64503 - protein, 11 aa, Borrelia burgdorferi B31
TTVIWEKNTGK

SEQ ID NO: 64504 - protein, 11 aa, Borrelia burgdorferi B31
SIPNFEIQELR

SEQ ID NO: 64505 - protein, 11 aa, Borrelia burgdorferi B31
EIDAIGITNQR

SEQ ID NO: 64506 - protein, 11 aa, Borrelia burgdorferi B31
TIIGITRGSTK

SEQ ID NO: 64507 - protein, 11 aa, Borrelia burgdorferi B31
FIGGAVIQWLR

SEQ ID NO: 64508 - protein, 11 aa, Borrelia burgdorferi B31
ESSTIYGKTDK

SEQ ID NO: 64509 - protein, 11 aa, Borrelia burgdorferi B31
LSIDQGTTSSR

SEQ ID NO: 64510 - protein, 11 aa, Borrelia burgdorferi B31
GVITEAMANAR

SEQ ID NO: 64511 - protein, 11 aa, Borrelia burgdorferi B31
DTWILWNLTQK

SEQ ID NO: 64512 - protein, 11 aa, Borrelia burgdorferi B31
RTAKICDQLKK

SEQ ID NO: 64513 - protein, 11 aa, Borrelia burgdorferi B31
MWILDNVEGAR

SEQ ID NO: 64514 - protein, 11 aa, Borrelia burgdorferi B31
IYNAIVWQDRR

SEQ ID NO: 64515 - protein, 11 aa, Borrelia burgdorferi B31
MQFQADLLECK

SEQ ID NO: 64516 - protein, 11 aa, Borrelia burgdorferi B31
YARGTIIGITR

SEQ ID NO: 64517 - protein, 11 aa, Borrelia burgdorferi B31
NVPRAILPELK

SEQ ID NO: 64518 - protein, 11 aa, Borrelia burgdorferi B31
LVLDSYFSGTK

SEQ ID NO: 64519 - protein, 11 aa, Borrelia burgdorferi B31
ELKESSTIYGK

SEQ ID NO: 64520 - protein, 11 aa, Borrelia burgdorferi B31
EHATDYSNASR

SEQ ID NO: 64521 - protein, 11 aa, Borrelia burgdorferi B31
NASRTLLLNIK

SEQ ID NO: 64522 - protein, 11 aa, Borrelia burgdorferi B31
TGCFLTVNIGK

SEQ ID NO: 64523 - protein, 11 aa, Borrelia burgdorferi B31
LLTSIAWGRKK

SEQ ID NO: 64524 - protein, 11 aa, Borrelia burgdorferi B31
FQSFDILNTMK

SEQ ID NO: 64525 - protein, 11 aa, Borrelia burgdorferi B31
EPSMPKNQKEK

SEQ ID NO: 64526 - protein, 11 aa, Borrelia burgdorferi B31
QADLLECKVVR

SEQ ID NO: 64527 - protein, 11 aa, Borrelia burgdorferi B31
AATFGQACLKK

SEQ ID NO: 64528 - protein, 11 aa, Borrelia burgdorferi B31
TWILWNLTQKK

SEQ ID NO: 64529 - protein, 11 aa, Borrelia burgdorferi B31
ETTALGAAYLA

SEQ ID NO: 64530 - protein, 11 aa, Borrelia burgdorferi B31
EEIVSLWQVDK

SEQ ID NO: 64531 - protein, 11 aa, Borrelia burgdorferi B31
NTMKKSIPNFE

SEQ ID NO: 64532 - protein, 11 aa, Borrelia burgdorferi B31
AIVWQDRRTAK

SEQ ID NO: 64533 - protein, 11 aa, Borrelia burgdorferi B31
PIYNAIVWQDR

SEQ ID NO: 64534 - protein, 11 aa, Borrelia burgdorferi B31
LGAPHWDSYAR

SEQ ID NO: 64535 - protein, 11 aa, Borrelia burgdorferi B31
TIYGKTDKALF

SEQ ID NO: 64536 - protein, 11 aa, Borrelia burgdorferi B31
ILDNVEGARQR

SEQ ID NO: 64537 - protein, 11 aa, Borrelia burgdorferi B31
QWLRDGLEFFR

SEQ ID NO: 64538 - protein, 9 aa, Borrelia burgdorferi B31
KAHITRAAL

SEQ ID NO: 64539 - protein, 9 aa, Borrelia burgdorferi B31
KPIYNAIVW

SEQ ID NO: 64540 - protein, 9 aa, Borrelia burgdorferi B31
VPRAILPEL

SEQ ID NO: 64541 - protein, 9 aa, Borrelia burgdorferi B31
MPKNQKEKL

SEQ ID NO: 64542 - protein, 9 aa, Borrelia burgdorferi B31
RAALESIAF

SEQ ID NO: 64543 - protein, 9 aa, Borrelia burgdorferi B31
RPKITETTA

SEQ ID NO: 64544 - protein, 9 aa, Borrelia burgdorferi B31
VPAFVGLGA

SEQ ID NO: 64545 - protein, 9 aa, Borrelia burgdorferi B31
AAYLAGLAT

SEQ ID NO: 64546 - protein, 9 aa, Borrelia burgdorferi B31
IPNFEIQEL

SEQ ID NO: 64547 - protein, 9 aa, Borrelia burgdorferi B31
EPIISHDKL

SEQ ID NO: 64548 - protein, 9 aa, Borrelia burgdorferi B31
LPELKESST

SEQ ID NO: 64549 - protein, 9 aa, Borrelia burgdorferi B31
IAWGRKKSV

SEQ ID NO: 64550 - protein, 10 aa, Borrelia burgdorferi B31
RPKITETTAL

SEQ ID NO: 64551 - protein, 10 aa, Borrelia burgdorferi B31
MPKNQKEKLL

SEQ ID NO: 64552 - protein, 10 aa, Borrelia burgdorferi B31
LPELKESSTI

SEQ ID NO: 64553 - protein, 10 aa, Borrelia burgdorferi B31
DPTEIWGSQL

SEQ ID NO: 64554 - protein, 10 aa, Borrelia burgdorferi B31
VPAFVGLGAP

SEQ ID NO: 64555 - protein, 10 aa, Borrelia burgdorferi B31
TKAHITRAAL

SEQ ID NO: 64556 - protein, 10 aa, Borrelia burgdorferi B31
SVSDNGGVYF

SEQ ID NO: 64557 - protein, 10 aa, Borrelia burgdorferi B31
EPIISHDKLL

SEQ ID NO: 64558 - protein, 11 aa, Borrelia burgdorferi B31
IPIAGIAGDQF

SEQ ID NO: 64559 - protein, 11 aa, Borrelia burgdorferi B31
GARQRAENGEL

SEQ ID NO: 64560 - protein, 11 aa, Borrelia burgdorferi B31
VPAFVGLGAPH

SEQ ID NO: 64561 - protein, 11 aa, Borrelia burgdorferi B31
APHWDSYARGT

SEQ ID NO: 64562 - protein, 11 aa, Borrelia burgdorferi B31
FFRKSSDAEAL

SEQ ID NO: 64563 - protein, 11 aa, Borrelia burgdorferi B31
WGRKKSVTYVL

SEQ ID NO: 64564 - protein, 11 aa, Borrelia burgdorferi B31
IVWQDRRTAKI

SEQ ID NO: 64565 - protein, 11 aa, Borrelia burgdorferi B31
RPKITETTALG

SEQ ID NO: 64566 - protein, 11 aa, Borrelia burgdorferi B31
STKAHITRAAL

SEQ ID NO: 64567 - protein, 9 aa, Borrelia burgdorferi B31
KAHITRAAL

SEQ ID NO: 64568 - protein, 9 aa, Borrelia burgdorferi B31
MPKNQKEKL

SEQ ID NO: 64569 - protein, 9 aa, Borrelia burgdorferi B31
RKKSVTYVL

SEQ ID NO: 64570 - protein, 10 aa, Borrelia burgdorferi B31
RPKITETTAL

SEQ ID NO: 64571 - protein, 10 aa, Borrelia burgdorferi B31
FRKSSDAEAL

SEQ ID NO: 64572 - protein, 10 aa, Borrelia burgdorferi B31
MPKNQKEKLL

SEQ ID NO: 64573 - protein, 10 aa, Borrelia burgdorferi B31
WGRKKSVTYV

SEQ ID NO: 64574 - protein, 11 aa, Borrelia burgdorferi B31
WGRKKSVTYVL

SEQ ID NO: 64575 - protein, 11 aa, Borrelia burgdorferi B31
FFRKSSDAEAL

SEQ ID NO: 64576 - protein, 9 aa, Borrelia burgdorferi B31
AQKEFTQIY

SEQ ID NO: 64577 - protein, 9 aa, Borrelia burgdorferi B31
YLAGLATGY

SEQ ID NO: 64578 - protein, 9 aa, Borrelia burgdorferi B31
RQRAENGEL

SEQ ID NO: 64579 - protein, 9 aa, Borrelia burgdorferi B31
SVSDNGGVY

SEQ ID NO: 64580 - protein, 9 aa, Borrelia burgdorferi B31
RAALESIAF

SEQ ID NO: 64581 - protein, 9 aa, Borrelia burgdorferi B31
TMKKSIPNF

SEQ ID NO: 64582 - protein, 9 aa, Borrelia burgdorferi B31
SQNNLLMQF

SEQ ID NO: 64583 - protein, 9 aa, Borrelia burgdorferi B31
WLRDGLEFF

SEQ ID NO: 64584 - protein, 9 aa, Borrelia burgdorferi B31
ELKESSTIY

SEQ ID NO: 64585 - protein, 9 aa, Borrelia burgdorferi B31
TQIYPQPSW

SEQ ID NO: 64586 - protein, 9 aa, Borrelia burgdorferi B31
ETTALGAAY

SEQ ID NO: 64587 - protein, 9 aa, Borrelia burgdorferi B31
NQRETTVIW

SEQ ID NO: 64588 - protein, 9 aa, Borrelia burgdorferi B31
WGRKKSVTY

SEQ ID NO: 64589 - protein, 9 aa, Borrelia burgdorferi B31
ITRGSTKAH

SEQ ID NO: 64590 - protein, 9 aa, Borrelia burgdorferi B31
TTSSRAMVF

SEQ ID NO: 64591 - protein, 9 aa, Borrelia burgdorferi B31
SLWQVDKIF

SEQ ID NO: 64592 - protein, 9 aa, Borrelia burgdorferi B31
QSFDILNTM

SEQ ID NO: 64593 - protein, 9 aa, Borrelia burgdorferi B31
SVFIGGAVI

SEQ ID NO: 64594 - protein, 9 aa, Borrelia burgdorferi B31
QSAEEIVSL

SEQ ID NO: 64595 - protein, 9 aa, Borrelia burgdorferi B31
LGAPHWDSY

SEQ ID NO: 64596 - protein, 9 aa, Borrelia burgdorferi B31
WQSAEEIVS

SEQ ID NO: 64597 - protein, 9 aa, Borrelia burgdorferi B31
YSNASRTLL

SEQ ID NO: 64598 - protein, 9 aa, Borrelia burgdorferi B31
GGVYFVPAF

SEQ ID NO: 64599 - protein, 10 aa, Borrelia burgdorferi B31
IQWLRDGLEF

SEQ ID NO: 64600 - protein, 10 aa, Borrelia burgdorferi B31
WQSAEEIVSL

SEQ ID NO: 64601 - protein, 10 aa, Borrelia burgdorferi B31
TQKKEHATDY

SEQ ID NO: 64602 - protein, 10 aa, Borrelia burgdorferi B31
SQLGVITEAM

SEQ ID NO: 64603 - protein, 10 aa, Borrelia burgdorferi B31
SVSDNGGVYF

SEQ ID NO: 64604 - protein, 10 aa, Borrelia burgdorferi B31
FQSFDILNTM

SEQ ID NO: 64605 - protein, 10 aa, Borrelia burgdorferi B31
VTYVLEGSVF

SEQ ID NO: 64606 - protein, 10 aa, Borrelia burgdorferi B31
SSVSDNGGVY

SEQ ID NO: 64607 - protein, 10 aa, Borrelia burgdorferi B31
GLGAPHWDSY

SEQ ID NO: 64608 - protein, 10 aa, Borrelia burgdorferi B31
YLAGLATGYW

SEQ ID NO: 64609 - protein, 10 aa, Borrelia burgdorferi B31
FAQKEFTQIY

SEQ ID NO: 64610 - protein, 10 aa, Borrelia burgdorferi B31
WEKNTGKPIY

SEQ ID NO: 64611 - protein, 10 aa, Borrelia burgdorferi B31
YSNASRTLLL

SEQ ID NO: 64612 - protein, 10 aa, Borrelia burgdorferi B31
IAGDQFAATF

SEQ ID NO: 64613 - protein, 10 aa, Borrelia burgdorferi B31
RQRAENGELC

SEQ ID NO: 64614 - protein, 10 aa, Borrelia burgdorferi B31
ALESIAFQSF

SEQ ID NO: 64615 - protein, 10 aa, Borrelia burgdorferi B31
NIKGFAQKEF

SEQ ID NO: 64616 - protein, 10 aa, Borrelia burgdorferi B31
ASQNNLLMQF

SEQ ID NO: 64617 - protein, 11 aa, Borrelia burgdorferi B31
RQRAENGELCF

SEQ ID NO: 64618 - protein, 11 aa, Borrelia burgdorferi B31
ITRAALESIAF

SEQ ID NO: 64619 - protein, 11 aa, Borrelia burgdorferi B31
WQVDKIFEPSM

SEQ ID NO: 64620 - protein, 11 aa, Borrelia burgdorferi B31
IQWLRDGLEFF

SEQ ID NO: 64621 - protein, 11 aa, Borrelia burgdorferi B31
ASSVSDNGGVY

SEQ ID NO: 64622 - protein, 11 aa, Borrelia burgdorferi B31
MAKNTYGTGCF

SEQ ID NO: 64623 - protein, 11 aa, Borrelia burgdorferi B31
WQSAEEIVSLW

SEQ ID NO: 64624 - protein, 11 aa, Borrelia burgdorferi B31
ITETTALGAAY

SEQ ID NO: 64625 - protein, 11 aa, Borrelia burgdorferi B31
IVSLWQVDKIF

SEQ ID NO: 64626 - protein, 11 aa, Borrelia burgdorferi B31
AAYLAGLATGY

SEQ ID NO: 64627 - protein, 11 aa, Borrelia burgdorferi B31
GIAGDQFAATF

SEQ ID NO: 64628 - protein, 11 aa, Borrelia burgdorferi B31
IAWGRKKSVTY

SEQ ID NO: 64629 - protein, 11 aa, Borrelia burgdorferi B31
AALESIAFQSF

SEQ ID NO: 64630 - protein, 11 aa, Borrelia burgdorferi B31
FQADLLECKVV

SEQ ID NO: 64631 - protein, 11 aa, Borrelia burgdorferi B31
SVTYVLEGSVF

SEQ ID NO: 64632 - protein, 11 aa, Borrelia burgdorferi B31
VIQWLRDGLEF

SEQ ID NO: 64633 - protein, 11 aa, Borrelia burgdorferi B31
SSVSDNGGVYF

SEQ ID NO: 64634 - protein, 11 aa, Borrelia burgdorferi B31
LTQKKEHATDY

SEQ ID NO: 64635 - protein, 11 aa, Borrelia burgdorferi B31
AQKEFTQIYPQ

SEQ ID NO: 64636 - protein, 11 aa, Borrelia burgdorferi B31
CLKKGMAKNTY

SEQ ID NO: 64637 - protein, 11 aa, Borrelia burgdorferi B31
STKAHITRAAL

SEQ ID NO: 64638 - protein, 11 aa, Borrelia burgdorferi B31
GFAQKEFTQIY

SEQ ID NO: 64639 - protein, 9 aa, Borrelia burgdorferi B31
RKKSVTYVL

SEQ ID NO: 64640 - protein, 10 aa, Borrelia burgdorferi B31
GRKKSVTYVL

SEQ ID NO: 64641 - protein, 10 aa, Borrelia burgdorferi B31
QRAENGELCF

SEQ ID NO: 64642 - protein, 10 aa, Borrelia burgdorferi B31
RRTAKICDQL

SEQ ID NO: 64643 - protein, 10 aa, Borrelia burgdorferi B31
TRAALESIAF

SEQ ID NO: 64644 - protein, 10 aa, Borrelia burgdorferi B31
QRETTVIWEK

SEQ ID NO: 64645 - protein, 10 aa, Borrelia burgdorferi B31
LRDGLEFFRK

SEQ ID NO: 64646 - protein, 10 aa, Borrelia burgdorferi B31
ARGTIIGITR

SEQ ID NO: 64647 - protein, 11 aa, Borrelia burgdorferi B31
RRTAKICDQLK

SEQ ID NO: 64648 - protein, 11 aa, Borrelia burgdorferi B31
GQACLKKGMAK

SEQ ID NO: 64649 - protein, 11 aa, Borrelia burgdorferi B31
RQRAENGELCF

SEQ ID NO: 64650 - protein, 9 aa, Borrelia burgdorferi B31
RAALESIAF

SEQ ID NO: 64651 - protein, 9 aa, Borrelia burgdorferi B31
IPNFEIQEL

SEQ ID NO: 64652 - protein, 9 aa, Borrelia burgdorferi B31
ETTALGAAY

SEQ ID NO: 64653 - protein, 9 aa, Borrelia burgdorferi B31
SVSDNGGVY

SEQ ID NO: 64654 - protein, 9 aa, Borrelia burgdorferi B31
YPQPSWVEH

SEQ ID NO: 64655 - protein, 9 aa, Borrelia burgdorferi B31
LPNEIDAIG

SEQ ID NO: 64656 - protein, 9 aa, Borrelia burgdorferi B31
IAFQSFDIL

SEQ ID NO: 64657 - protein, 9 aa, Borrelia burgdorferi B31
YLAGLATGY

SEQ ID NO: 64658 - protein, 9 aa, Borrelia burgdorferi B31
FAATFGQAC

SEQ ID NO: 64659 - protein, 9 aa, Borrelia burgdorferi B31
YFVPAFVGL

SEQ ID NO: 64660 - protein, 9 aa, Borrelia burgdorferi B31
IAGDQFAAT

SEQ ID NO: 64661 - protein, 9 aa, Borrelia burgdorferi B31
QSFDILNTM

SEQ ID NO: 64662 - protein, 9 aa, Borrelia burgdorferi B31
IAGIAGDQF

SEQ ID NO: 64663 - protein, 9 aa, Borrelia burgdorferi B31
KPIYNAIVW

SEQ ID NO: 64664 - protein, 9 aa, Borrelia burgdorferi B31
HATDYSNAS

SEQ ID NO: 64665 - protein, 9 aa, Borrelia burgdorferi B31
MPKNQKEKL

SEQ ID NO: 64666 - protein, 9 aa, Borrelia burgdorferi B31
SLWQVDKIF

SEQ ID NO: 64667 - protein, 9 aa, Borrelia burgdorferi B31
RAENGELCF

SEQ ID NO: 64668 - protein, 9 aa, Borrelia burgdorferi B31
ELKESSTIY

SEQ ID NO: 64669 - protein, 9 aa, Borrelia burgdorferi B31
EKNTGKPIY

SEQ ID NO: 64670 - protein, 9 aa, Borrelia burgdorferi B31
TYVLEGSVF

SEQ ID NO: 64671 - protein, 9 aa, Borrelia burgdorferi B31
APHWDSYAR

SEQ ID NO: 64672 - protein, 9 aa, Borrelia burgdorferi B31
QLGVITEAM

SEQ ID NO: 64673 - protein, 9 aa, Borrelia burgdorferi B31
LESIAFQSF

SEQ ID NO: 64674 - protein, 9 aa, Borrelia burgdorferi B31
YVLEGSVFI

SEQ ID NO: 64675 - protein, 9 aa, Borrelia burgdorferi B31
GASQNNLLM

SEQ ID NO: 64676 - protein, 9 aa, Borrelia burgdorferi B31
LGAPHWDSY

SEQ ID NO: 64677 - protein, 9 aa, Borrelia burgdorferi B31
EAMANARIL

SEQ ID NO: 64678 - protein, 9 aa, Borrelia burgdorferi B31
VPRAILPEL

SEQ ID NO: 64679 - protein, 9 aa, Borrelia burgdorferi B31
AAYLAGLAT

SEQ ID NO: 64680 - protein, 9 aa, Borrelia burgdorferi B31
TTSSRAMVF

SEQ ID NO: 64681 - protein, 9 aa, Borrelia burgdorferi B31
TLEWDDELL

SEQ ID NO: 64682 - protein, 9 aa, Borrelia burgdorferi B31
EPIISHDKL

SEQ ID NO: 64683 - protein, 9 aa, Borrelia burgdorferi B31
VSDNGGVYF

SEQ ID NO: 64684 - protein, 10 aa, Borrelia burgdorferi B31
FAQKEFTQIY

SEQ ID NO: 64685 - protein, 10 aa, Borrelia burgdorferi B31
IAGDQFAATF

SEQ ID NO: 64686 - protein, 10 aa, Borrelia burgdorferi B31
FAATFGQACL

SEQ ID NO: 64687 - protein, 10 aa, Borrelia burgdorferi B31
QPSWVEHDPT

SEQ ID NO: 64688 - protein, 10 aa, Borrelia burgdorferi B31
LPNEIDAIGI

SEQ ID NO: 64689 - protein, 10 aa, Borrelia burgdorferi B31
FQSFDILNTM

SEQ ID NO: 64690 - protein, 10 aa, Borrelia burgdorferi B31
SVSDNGGVYF

SEQ ID NO: 64691 - protein, 10 aa, Borrelia burgdorferi B31
TETTALGAAY

SEQ ID NO: 64692 - protein, 10 aa, Borrelia burgdorferi B31
RPKITETTAL

SEQ ID NO: 64693 - protein, 10 aa, Borrelia burgdorferi B31
SSVSDNGGVY

SEQ ID NO: 64694 - protein, 10 aa, Borrelia burgdorferi B31
MPKNQKEKLL

SEQ ID NO: 64695 - protein, 10 aa, Borrelia burgdorferi B31
EPIISHDKLL

SEQ ID NO: 64696 - protein, 10 aa, Borrelia burgdorferi B31
VSLWQVDKIF

SEQ ID NO: 64697 - protein, 10 aa, Borrelia burgdorferi B31
TRAALESIAF

SEQ ID NO: 64698 - protein, 10 aa, Borrelia burgdorferi B31
NGGVYFVPAF

SEQ ID NO: 64699 - protein, 10 aa, Borrelia burgdorferi B31
IQWLRDGLEF

SEQ ID NO: 64700 - protein, 10 aa, Borrelia burgdorferi B31
DPTEIWGSQL

SEQ ID NO: 64701 - protein, 10 aa, Borrelia burgdorferi B31
SQLGVITEAM

SEQ ID NO: 64702 - protein, 10 aa, Borrelia burgdorferi B31
DSYFSGTKIM

SEQ ID NO: 64703 - protein, 10 aa, Borrelia burgdorferi B31
QVDKIFEPSM

SEQ ID NO: 64704 - protein, 10 aa, Borrelia burgdorferi B31
LPELKESSTI

SEQ ID NO: 64705 - protein, 11 aa, Borrelia burgdorferi B31
LPELKESSTIY

SEQ ID NO: 64706 - protein, 11 aa, Borrelia burgdorferi B31
IPIAGIAGDQF

SEQ ID NO: 64707 - protein, 11 aa, Borrelia burgdorferi B31
IAWGRKKSVTY

SEQ ID NO: 64708 - protein, 11 aa, Borrelia burgdorferi B31
VPAFVGLGAPH

SEQ ID NO: 64709 - protein, 11 aa, Borrelia burgdorferi B31
LPNEIDAIGIT

SEQ ID NO: 64710 - protein, 11 aa, Borrelia burgdorferi B31
AAYLAGLATGY

SEQ ID NO: 64711 - protein, 11 aa, Borrelia burgdorferi B31
MAKNTYGTGCF

SEQ ID NO: 64712 - protein, 11 aa, Borrelia burgdorferi B31
ITETTALGAAY

SEQ ID NO: 64713 - protein, 11 aa, Borrelia burgdorferi B31
AALESIAFQSF

SEQ ID NO: 64714 - protein, 11 aa, Borrelia burgdorferi B31
TALGAAYLAGL

SEQ ID NO: 64715 - protein, 11 aa, Borrelia burgdorferi B31
IVSLWQVDKIF

SEQ ID NO: 64716 - protein, 11 aa, Borrelia burgdorferi B31
QPSWVEHDPTE

SEQ ID NO: 64717 - protein, 11 aa, Borrelia burgdorferi B31
ASSVSDNGGVY

SEQ ID NO: 64718 - protein, 11 aa, Borrelia burgdorferi B31
WQVDKIFEPSM

SEQ ID NO: 64719 - protein, 11 aa, Borrelia burgdorferi B31
ITRAALESIAF

SEQ ID NO: 64720 - protein, 11 aa, Borrelia burgdorferi B31
SVTYVLEGSVF

SEQ ID NO: 64721 - protein, 11 aa, Borrelia burgdorferi B31
MANARILPNEI

SEQ ID NO: 64722 - protein, 11 aa, Borrelia burgdorferi B31
SSVSDNGGVYF

SEQ ID NO: 64723 - protein, 11 aa, Borrelia burgdorferi B31
YFSGTKIMWIL

SEQ ID NO: 64724 - protein, 11 aa, Borrelia burgdorferi B31
APHWDSYARGT

SEQ ID NO: 64725 - protein, 11 aa, Borrelia burgdorferi B31
FFRKSSDAEAL

SEQ ID NO: 64726 - protein, 11 aa, Borrelia burgdorferi B31
GASQNNLLMQF

SEQ ID NO: 64727 - protein, 9 aa, Borrelia burgdorferi B31
AEIPIAGIA

SEQ ID NO: 64728 - protein, 9 aa, Borrelia burgdorferi B31
EEIVSLWQV

SEQ ID NO: 64729 - protein, 9 aa, Borrelia burgdorferi B31
NEIDAIGIT

SEQ ID NO: 64730 - protein, 9 aa, Borrelia burgdorferi B31
KEFTQIYPQ

SEQ ID NO: 64731 - protein, 9 aa, Borrelia burgdorferi B31
AEALASSVS

SEQ ID NO: 64732 - protein, 9 aa, Borrelia burgdorferi B31
AEEIVSLWQ

SEQ ID NO: 64733 - protein, 9 aa, Borrelia burgdorferi B31
QELRVDGGA

SEQ ID NO: 64734 - protein, 9 aa, Borrelia burgdorferi B31
TEIWGSQLG

SEQ ID NO: 64735 - protein, 9 aa, Borrelia burgdorferi B31
DELLSILNV

SEQ ID NO: 64736 - protein, 10 aa, Borrelia burgdorferi B31
AEIPIAGIAG

SEQ ID NO: 64737 - protein, 10 aa, Borrelia burgdorferi B31
TEIWGSQLGV

SEQ ID NO: 64738 - protein, 10 aa, Borrelia burgdorferi B31
AEEIVSLWQV

SEQ ID NO: 64739 - protein, 10 aa, Borrelia burgdorferi B31
NEIDAIGITN

SEQ ID NO: 64740 - protein, 10 aa, Borrelia burgdorferi B31
TETTALGAAY

SEQ ID NO: 64741 - protein, 10 aa, Borrelia burgdorferi B31
EEIVSLWQVD

SEQ ID NO: 64742 - protein, 10 aa, Borrelia burgdorferi B31
AENGELCFGT

SEQ ID NO: 64743 - protein, 10 aa, Borrelia burgdorferi B31
KEFTQIYPQP

SEQ ID NO: 64744 - protein, 10 aa, Borrelia burgdorferi B31
QELRVDGGAS

SEQ ID NO: 64745 - protein, 11 aa, Borrelia burgdorferi B31
KEFTQIYPQPS

SEQ ID NO: 64746 - protein, 11 aa, Borrelia burgdorferi B31
AEIPIAGIAGD

SEQ ID NO: 64747 - protein, 11 aa, Borrelia burgdorferi B31
NEIDAIGITNQ

SEQ ID NO: 64748 - protein, 11 aa, Borrelia burgdorferi B31
TEIWGSQLGVI

SEQ ID NO: 64749 - protein, 11 aa, Borrelia burgdorferi B31
KEPIISHDKLL

SEQ ID NO: 64750 - protein, 11 aa, Borrelia burgdorferi B31
AENGELCFGTI

SEQ ID NO: 64751 - protein, 11 aa, Borrelia burgdorferi B31
TETTALGAAYL

SEQ ID NO: 64752 - protein, 11 aa, Borrelia burgdorferi B31
KEHATDYSNAS

SEQ ID NO: 64753 - protein, 11 aa, Borrelia burgdorferi B31
GELCFGTIDTW

SEQ ID NO: 64754 - protein, 9 aa, Borrelia burgdorferi B31
VPAFVGLGA

SEQ ID NO: 64755 - protein, 9 aa, Borrelia burgdorferi B31
VPRAILPEL

SEQ ID NO: 64756 - protein, 9 aa, Borrelia burgdorferi B31
LPNEIDAIG

SEQ ID NO: 64757 - protein, 10 aa, Borrelia burgdorferi B31
LPELKESSTI

SEQ ID NO: 64758 - protein, 10 aa, Borrelia burgdorferi B31
EPIISHDKLL

SEQ ID NO: 64759 - protein, 11 aa, Borrelia burgdorferi B31
LPNEIDAIGIT

SEQ ID NO: 64760 - protein, 11 aa, Borrelia burgdorferi B31
IPIAGIAGDQF

SEQ ID NO: 64761 - protein, 11 aa, Borrelia burgdorferi B31
IPNFEIQELRV

SEQ ID NO: 64762 - protein, 9 aa, Borrelia burgdorferi B31
GTIDTWILW

SEQ ID NO: 64763 - protein, 9 aa, Borrelia burgdorferi B31
SAEEIVSLW

SEQ ID NO: 64764 - protein, 9 aa, Borrelia burgdorferi B31
KTGLVLDSY

SEQ ID NO: 64765 - protein, 9 aa, Borrelia burgdorferi B31
LCFGTIDTW

SEQ ID NO: 64766 - protein, 10 aa, Borrelia burgdorferi B31
FTQIYPQPSW

SEQ ID NO: 64767 - protein, 10 aa, Borrelia burgdorferi B31
QSAEEIVSLW

SEQ ID NO: 64768 - protein, 10 aa, Borrelia burgdorferi B31
TNQRETTVIW

SEQ ID NO: 64769 - protein, 10 aa, Borrelia burgdorferi B31
FAQKEFTQIY

SEQ ID NO: 64770 - protein, 11 aa, Borrelia burgdorferi B31
ITNQRETTVIW

SEQ ID NO: 64771 - protein, 11 aa, Borrelia burgdorferi B31
TGKPIYNAIVW

SEQ ID NO: 64772 - protein, 11 aa, Borrelia burgdorferi B31
DSYFSGTKIMW

SEQ ID NO: 64773 - protein, 11 aa, Borrelia burgdorferi B31
KNQKEKLLENW

SEQ ID NO: 64774 - protein, 9 aa, Borrelia burgdorferi B31
YIEEKVLKY

SEQ ID NO: 64775 - protein, 9 aa, Borrelia burgdorferi B31
NTSLEECYY

SEQ ID NO: 64776 - protein, 9 aa, Borrelia burgdorferi B31
YSQEKKDIY

SEQ ID NO: 64777 - protein, 9 aa, Borrelia burgdorferi B31
ESSIFKERY

SEQ ID NO: 64778 - protein, 9 aa, Borrelia burgdorferi B31
LIEIQNSPY

SEQ ID NO: 64779 - protein, 9 aa, Borrelia burgdorferi B31
NTKKLGTTY

SEQ ID NO: 64780 - protein, 9 aa, Borrelia burgdorferi B31
ESFIDALEY

SEQ ID NO: 64781 - protein, 9 aa, Borrelia burgdorferi B31
LSFYPNIEY

SEQ ID NO: 64782 - protein, 9 aa, Borrelia burgdorferi B31
SSKNISFNY

SEQ ID NO: 64783 - protein, 9 aa, Borrelia burgdorferi B31
ETYGWIAFY

SEQ ID NO: 64784 - protein, 9 aa, Borrelia burgdorferi B31
QTEDFFISF

SEQ ID NO: 64785 - protein, 9 aa, Borrelia burgdorferi B31
TLSLNEIFY

SEQ ID NO: 64786 - protein, 10 aa, Borrelia burgdorferi B31
FQDTLKCYLY

SEQ ID NO: 64787 - protein, 10 aa, Borrelia burgdorferi B31
GSSKNISFNY

SEQ ID NO: 64788 - protein, 10 aa, Borrelia burgdorferi B31
FLSFYPNIEY

SEQ ID NO: 64789 - protein, 10 aa, Borrelia burgdorferi B31
LIEIQNSPYY

SEQ ID NO: 64790 - protein, 10 aa, Borrelia burgdorferi B31
KTLSLNEIFY

SEQ ID NO: 64791 - protein, 10 aa, Borrelia burgdorferi B31
KTIKKDSEFY

SEQ ID NO: 64792 - protein, 10 aa, Borrelia burgdorferi B31
ATLKKHINKY

SEQ ID NO: 64793 - protein, 11 aa, Borrelia burgdorferi B31
YLEEEILALKY

SEQ ID NO: 64794 - protein, 11 aa, Borrelia burgdorferi B31
NIETYGWIAFY

SEQ ID NO: 64795 - protein, 11 aa, Borrelia burgdorferi B31
KSAFLEIIMHY

SEQ ID NO: 64796 - protein, 11 aa, Borrelia burgdorferi B31
NLNTKKLGTTY

SEQ ID NO: 64797 - protein, 11 aa, Borrelia burgdorferi B31
ETYGWIAFYIY

SEQ ID NO: 64798 - protein, 11 aa, Borrelia burgdorferi B31
ISFDKTNFNPY

SEQ ID NO: 64799 - protein, 9 aa, Borrelia burgdorferi B31
FISDILLYL

SEQ ID NO: 64800 - protein, 9 aa, Borrelia burgdorferi B31
MLILTYWPV

SEQ ID NO: 64801 - protein, 9 aa, Borrelia burgdorferi B31
YLEEEILAL

SEQ ID NO: 64802 - protein, 9 aa, Borrelia burgdorferi B31
FLEIIMHYV

SEQ ID NO: 64803 - protein, 9 aa, Borrelia burgdorferi B31
KLLPAMCYL

SEQ ID NO: 64804 - protein, 9 aa, Borrelia burgdorferi B31
YLIYCENLV

SEQ ID NO: 64805 - protein, 9 aa, Borrelia burgdorferi B31
YLDENKITI

SEQ ID NO: 64806 - protein, 9 aa, Borrelia burgdorferi B31
LLPAMCYLI

SEQ ID NO: 64807 - protein, 9 aa, Borrelia burgdorferi B31
QTIDILVAV

SEQ ID NO: 64808 - protein, 9 aa, Borrelia burgdorferi B31
YLYVIEKTI

SEQ ID NO: 64809 - protein, 9 aa, Borrelia burgdorferi B31
KLINIKEKI

SEQ ID NO: 64810 - protein, 9 aa, Borrelia burgdorferi B31
SISSQLYKL

SEQ ID NO: 64811 - protein, 9 aa, Borrelia burgdorferi B31
YIKSAFLEI

SEQ ID NO: 64812 - protein, 9 aa, Borrelia burgdorferi B31
YLLIKSLKT

SEQ ID NO: 64813 - protein, 9 aa, Borrelia burgdorferi B31
FFSDFTQYA

SEQ ID NO: 64814 - protein, 9 aa, Borrelia burgdorferi B31
TLKCYLYVI

SEQ ID NO: 64815 - protein, 9 aa, Borrelia burgdorferi B31
FISFFKTKL

SEQ ID NO: 64816 - protein, 9 aa, Borrelia burgdorferi B31
FQDTLKCYL

SEQ ID NO: 64817 - protein, 9 aa, Borrelia burgdorferi B31
  Xaa can be any naturally occurring amino acid
  VARIANT 5: Xaa = Any Amino Acid
ILIKXYKYL

SEQ ID NO: 64818 - protein, 9 aa, Borrelia burgdorferi B31
SLLEFISFF

SEQ ID NO: 64819 - protein, 9 aa, Borrelia burgdorferi B31
IILNFSSNI

SEQ ID NO: 64820 - protein, 9 aa, Borrelia burgdorferi B31
KTFEIQNQI

SEQ ID NO: 64821 - protein, 9 aa, Borrelia burgdorferi B31
AIKKWILEI

SEQ ID NO: 64822 - protein, 9 aa, Borrelia burgdorferi B31
YFLSFYPNI

SEQ ID NO: 64823 - protein, 9 aa, Borrelia burgdorferi B31
SLEQTIDIL

SEQ ID NO: 64824 - protein, 9 aa, Borrelia burgdorferi B31
QLDYQKSYL

SEQ ID NO: 64825 - protein, 9 aa, Borrelia burgdorferi B31
ILALKYNEI

SEQ ID NO: 64826 - protein, 9 aa, Borrelia burgdorferi B31
SFIDALEYI

SEQ ID NO: 64827 - protein, 9 aa, Borrelia burgdorferi B31
LLYLDENKI

SEQ ID NO: 64828 - protein, 9 aa, Borrelia burgdorferi B31
LALKYNEIL

SEQ ID NO: 64829 - protein, 9 aa, Borrelia burgdorferi B31
FQTEDFFIS

SEQ ID NO: 64830 - protein, 10 aa, Borrelia burgdorferi B31
RMLILTYWPV

SEQ ID NO: 64831 - protein, 10 aa, Borrelia burgdorferi B31
KLLPAMCYLI

SEQ ID NO: 64832 - protein, 10 aa, Borrelia burgdorferi B31
YLTWFFKDKI

SEQ ID NO: 64833 - protein, 10 aa, Borrelia burgdorferi B31
LIYCENLVEL

SEQ ID NO: 64834 - protein, 10 aa, Borrelia burgdorferi B31
YLRALKTLSL

SEQ ID NO: 64835 - protein, 10 aa, Borrelia burgdorferi B31
SLEQTIDILV

SEQ ID NO: 64836 - protein, 10 aa, Borrelia burgdorferi B31
AFLEIIMHYV

SEQ ID NO: 64837 - protein, 10 aa, Borrelia burgdorferi B31
CLSKNIFIKI

SEQ ID NO: 64838 - protein, 10 aa, Borrelia burgdorferi B31
IQNQIFVYFL

SEQ ID NO: 64839 - protein, 10 aa, Borrelia burgdorferi B31
ILNFSSNINI

SEQ ID NO: 64840 - protein, 10 aa, Borrelia burgdorferi B31
  Xaa can be any naturally occurring amino acid
  VARIANT 2: Xaa = Any Amino Acid
KXYKYLEEEI

SEQ ID NO: 64841 - protein, 10 aa, Borrelia burgdorferi B31
ILTYWPVGCL

SEQ ID NO: 64842 - protein, 10 aa, Borrelia burgdorferi B31
QLDYQKSYLL

SEQ ID NO: 64843 - protein, 10 aa, Borrelia burgdorferi B31
HINKYIEEKV

SEQ ID NO: 64844 - protein, 10 aa, Borrelia burgdorferi B31
ETYGWIAFYI

SEQ ID NO: 64845 - protein, 10 aa, Borrelia burgdorferi B31
KFISDILLYL

SEQ ID NO: 64846 - protein, 10 aa, Borrelia burgdorferi B31
KLKSSNFLKL

SEQ ID NO: 64847 - protein, 10 aa, Borrelia burgdorferi B31
RILKIIIKNI

SEQ ID NO: 64848 - protein, 10 aa, Borrelia burgdorferi B31
KLEKPEIIEL

SEQ ID NO: 64849 - protein, 10 aa, Borrelia burgdorferi B31
ILALKYNEIL

SEQ ID NO: 64850 - protein, 10 aa, Borrelia burgdorferi B31
YFFSDFTQYA

SEQ ID NO: 64851 - protein, 10 aa, Borrelia burgdorferi B31
YIKSAFLEII

SEQ ID NO: 64852 - protein, 10 aa, Borrelia burgdorferi B31
QLYKLEKPEI

SEQ ID NO: 64853 - protein, 10 aa, Borrelia burgdorferi B31
ILLYLDENKI

SEQ ID NO: 64854 - protein, 10 aa, Borrelia burgdorferi B31
AIKKWILEIV

SEQ ID NO: 64855 - protein, 10 aa, Borrelia burgdorferi B31
KILNILNKNL

SEQ ID NO: 64856 - protein, 10 aa, Borrelia burgdorferi B31
  Xaa can be any naturally occurring amino acid
  VARIANT 6: Xaa = Any Amino Acid
KILIKXYKYL

SEQ ID NO: 64857 - protein, 10 aa, Borrelia burgdorferi B31
NQLDYQKSYL

SEQ ID NO: 64858 - protein, 10 aa, Borrelia burgdorferi B31
KISNNWESFI

SEQ ID NO: 64859 - protein, 10 aa, Borrelia burgdorferi B31
YGWIAFYIYA

SEQ ID NO: 64860 - protein, 10 aa, Borrelia burgdorferi B31
IIIKNIRFNL

SEQ ID NO: 64861 - protein, 10 aa, Borrelia burgdorferi B31
YSISSQLYKL

SEQ ID NO: 64862 - protein, 10 aa, Borrelia burgdorferi B31
YLYVIEKTIT

SEQ ID NO: 64863 - protein, 10 aa, Borrelia burgdorferi B31
SLLEFISFFK

SEQ ID NO: 64864 - protein, 10 aa, Borrelia burgdorferi B31
LLEFISFFKT

SEQ ID NO: 64865 - protein, 10 aa, Borrelia burgdorferi B31
FIQISKEANL

SEQ ID NO: 64866 - protein, 10 aa, Borrelia burgdorferi B31
VLKYSISSQL

SEQ ID NO: 64867 - protein, 10 aa, Borrelia burgdorferi B31
ALKTLSLNEI

SEQ ID NO: 64868 - protein, 10 aa, Borrelia burgdorferi B31
RLIKLKRMLI

SEQ ID NO: 64869 - protein, 10 aa, Borrelia burgdorferi B31
FSSNINIDSL

SEQ ID NO: 64870 - protein, 11 aa, Borrelia burgdorferi B31
YLIYCENLVEL

SEQ ID NO: 64871 - protein, 11 aa, Borrelia burgdorferi B31
FQDTLKCYLYV

SEQ ID NO: 64872 - protein, 11 aa, Borrelia burgdorferi B31
KTFEIQNQIFV

SEQ ID NO: 64873 - protein, 11 aa, Borrelia burgdorferi B31
FVYFLSFYPNI

SEQ ID NO: 64874 - protein, 11 aa, Borrelia burgdorferi B31
SLLEFISFFKT

SEQ ID NO: 64875 - protein, 11 aa, Borrelia burgdorferi B31
SAFLEIIMHYV

SEQ ID NO: 64876 - protein, 11 aa, Borrelia burgdorferi B31
AMCYLIYCENL

SEQ ID NO: 64877 - protein, 11 aa, Borrelia burgdorferi B31
IILNFSSNINI

SEQ ID NO: 64878 - protein, 11 aa, Borrelia burgdorferi B31
KVLKYSISSQL

SEQ ID NO: 64879 - protein, 11 aa, Borrelia burgdorferi B31
NQLDYQKSYLL

SEQ ID NO: 64880 - protein, 11 aa, Borrelia burgdorferi B31
YIEEKVLKYSI

SEQ ID NO: 64881 - protein, 11 aa, Borrelia burgdorferi B31
QLDYQKSYLLI

SEQ ID NO: 64882 - protein, 11 aa, Borrelia burgdorferi B31
LLYLDENKITI

SEQ ID NO: 64883 - protein, 11 aa, Borrelia burgdorferi B31
KIIIKNIRFNL

SEQ ID NO: 64884 - protein, 11 aa, Borrelia burgdorferi B31
ALKYNEILNYL

SEQ ID NO: 64885 - protein, 11 aa, Borrelia burgdorferi B31
KLEKPEIIELI

SEQ ID NO: 64886 - protein, 11 aa, Borrelia burgdorferi B31
  Xaa can be any naturally occurring amino acid
  VARIANT 2: Xaa = Any Amino Acid
KXYKYLEEEIL

SEQ ID NO: 64887 - protein, 11 aa, Borrelia burgdorferi B31
RLIKLKRMLIL

SEQ ID NO: 64888 - protein, 11 aa, Borrelia burgdorferi B31
KLKSSNFLKLI

SEQ ID NO: 64889 - protein, 11 aa, Borrelia burgdorferi B31
LILTYWPVGCL

SEQ ID NO: 64890 - protein, 11 aa, Borrelia burgdorferi B31
FKFISDILLYL

SEQ ID NO: 64891 - protein, 11 aa, Borrelia burgdorferi B31
KRMLILTYWPV

SEQ ID NO: 64892 - protein, 11 aa, Borrelia burgdorferi B31
QLYKLEKPEII

SEQ ID NO: 64893 - protein, 11 aa, Borrelia burgdorferi B31
ILNYLRALKTL

SEQ ID NO: 64894 - protein, 11 aa, Borrelia burgdorferi B31
KQIILNFSSNI

SEQ ID NO: 64895 - protein, 11 aa, Borrelia burgdorferi B31
LLPAMCYLIYC

SEQ ID NO: 64896 - protein, 11 aa, Borrelia burgdorferi B31
YIYADNKDKKI

SEQ ID NO: 64897 - protein, 11 aa, Borrelia burgdorferi B31
CLSKNIFIKIL

SEQ ID NO: 64898 - protein, 11 aa, Borrelia burgdorferi B31
YKLEKPEIIEL

SEQ ID NO: 64899 - protein, 11 aa, Borrelia burgdorferi B31
KLEDENEKKLL

SEQ ID NO: 64900 - protein, 11 aa, Borrelia burgdorferi B31
YQKSYLLIKSL

SEQ ID NO: 64901 - protein, 11 aa, Borrelia burgdorferi B31
SQLYKLEKPEI

SEQ ID NO: 64902 - protein, 11 aa, Borrelia burgdorferi B31
IIIKNIRFNLI

SEQ ID NO: 64903 - protein, 9 aa, Borrelia burgdorferi B31
KLKSSNFLK

SEQ ID NO: 64904 - protein, 9 aa, Borrelia burgdorferi B31
ILNYLRALK

SEQ ID NO: 64905 - protein, 9 aa, Borrelia burgdorferi B31
ISFFKTKLK

SEQ ID NO: 64906 - protein, 9 aa, Borrelia burgdorferi B31
LLEFISFFK

SEQ ID NO: 64907 - protein, 9 aa, Borrelia burgdorferi B31
KLKQKINFK

SEQ ID NO: 64908 - protein, 9 aa, Borrelia burgdorferi B31
KLGTTYKLK

SEQ ID NO: 64909 - protein, 9 aa, Borrelia burgdorferi B31
CLSKNIFIK

SEQ ID NO: 64910 - protein, 9 aa, Borrelia burgdorferi B31
LSLNEIFYK

SEQ ID NO: 64911 - protein, 9 aa, Borrelia burgdorferi B31
YSISSQLYK

SEQ ID NO: 64912 - protein, 9 aa, Borrelia burgdorferi B31
RMKEFFKSK

SEQ ID NO: 64913 - protein, 9 aa, Borrelia burgdorferi B31
NIFIKILIK

SEQ ID NO: 64914 - protein, 9 aa, Borrelia burgdorferi B31
ATLKKHINK

SEQ ID NO: 64915 - protein, 9 aa, Borrelia burgdorferi B31
KIKEIITAK

SEQ ID NO: 64916 - protein, 9 aa, Borrelia burgdorferi B31
EIFYKGSSK

SEQ ID NO: 64917 - protein, 9 aa, Borrelia burgdorferi B31
HINKYIEEK

SEQ ID NO: 64918 - protein, 9 aa, Borrelia burgdorferi B31
SIFKERYIK

SEQ ID NO: 64919 - protein, 9 aa, Borrelia burgdorferi B31
KINPNQLDY

SEQ ID NO: 64920 - protein, 9 aa, Borrelia burgdorferi B31
KKYLTWFFK

SEQ ID NO: 64921 - protein, 9 aa, Borrelia burgdorferi B31
ITIPKKIIK

SEQ ID NO: 64922 - protein, 9 aa, Borrelia burgdorferi B31
VIEKTITKK

SEQ ID NO: 64923 - protein, 9 aa, Borrelia burgdorferi B31
ETYGWIAFY

SEQ ID NO: 64924 - protein, 9 aa, Borrelia burgdorferi B31
LVAVRNRNK

SEQ ID NO: 64925 - protein, 9 aa, Borrelia burgdorferi B31
KCYLYVIEK

SEQ ID NO: 64926 - protein, 9 aa, Borrelia burgdorferi B31
ILNKNLKYR

SEQ ID NO: 64927 - protein, 9 aa, Borrelia burgdorferi B31
YVIEKTITK

SEQ ID NO: 64928 - protein, 9 aa, Borrelia burgdorferi B31
VFKSSLTNK

SEQ ID NO: 64929 - protein, 9 aa, Borrelia burgdorferi B31
TLSLNEIFY

SEQ ID NO: 64930 - protein, 9 aa, Borrelia burgdorferi B31
KFISDILLY

SEQ ID NO: 64931 - protein, 9 aa, Borrelia burgdorferi B31
TLKKHINKY

SEQ ID NO: 64932 - protein, 9 aa, Borrelia burgdorferi B31
SFYPNIEYK

SEQ ID NO: 64933 - protein, 9 aa, Borrelia burgdorferi B31
CQRMKEFFK

SEQ ID NO: 64934 - protein, 9 aa, Borrelia burgdorferi B31
EIIMHYVKK

SEQ ID NO: 64935 - protein, 9 aa, Borrelia burgdorferi B31
NIRFNLIEK

SEQ ID NO: 64936 - protein, 9 aa, Borrelia burgdorferi B31
SSKNISFNY

SEQ ID NO: 64937 - protein, 9 aa, Borrelia burgdorferi B31
  Xaa can be any naturally occurring amino acid
  VARIANT 6: Xaa = Any Amino Acid
KILIKXYKY

SEQ ID NO: 64938 - protein, 9 aa, Borrelia burgdorferi B31
KVFKSSLTN

SEQ ID NO: 64939 - protein, 9 aa, Borrelia burgdorferi B31
AVRNRNKIK

SEQ ID NO: 64940 - protein, 9 aa, Borrelia burgdorferi B31
YQKSYLLIK

SEQ ID NO: 64941 - protein, 9 aa, Borrelia burgdorferi B31
YLTWFFKDK

SEQ ID NO: 64942 - protein, 9 aa, Borrelia burgdorferi B31
SSQLYKLEK

SEQ ID NO: 64943 - protein, 9 aa, Borrelia burgdorferi B31
NPYESSIFK

SEQ ID NO: 64944 - protein, 9 aa, Borrelia burgdorferi B31
YIYADNKDK

SEQ ID NO: 64945 - protein, 9 aa, Borrelia burgdorferi B31
ILLYLDENK

SEQ ID NO: 64946 - protein, 9 aa, Borrelia burgdorferi B31
NILNKNLKY

SEQ ID NO: 64947 - protein, 9 aa, Borrelia burgdorferi B31
KEANLNTKK

SEQ ID NO: 64948 - protein, 9 aa, Borrelia burgdorferi B31
SYLLIKSLK

SEQ ID NO: 64949 - protein, 9 aa, Borrelia burgdorferi B31
AFYIYADNK

SEQ ID NO: 64950 - protein, 9 aa, Borrelia burgdorferi B31
LSFYPNIEY

SEQ ID NO: 64951 - protein, 9 aa, Borrelia burgdorferi B31
NTQNEAIKK

SEQ ID NO: 64952 - protein, 10 aa, Borrelia burgdorferi B31
SLLEFISFFK

SEQ ID NO: 64953 - protein, 10 aa, Borrelia burgdorferi B31
KSYLLIKSLK

SEQ ID NO: 64954 - protein, 10 aa, Borrelia burgdorferi B31
FISFFKTKLK

SEQ ID NO: 64955 - protein, 10 aa, Borrelia burgdorferi B31
KINFKKELMK

SEQ ID NO: 64956 - protein, 10 aa, Borrelia burgdorferi B31
KYSISSQLYK

SEQ ID NO: 64957 - protein, 10 aa, Borrelia burgdorferi B31
SLKTRSRILK

SEQ ID NO: 64958 - protein, 10 aa, Borrelia burgdorferi B31
ILVAVRNRNK

SEQ ID NO: 64959 - protein, 10 aa, Borrelia burgdorferi B31
TLSLNEIFYK

SEQ ID NO: 64960 - protein, 10 aa, Borrelia burgdorferi B31
KVFKSSLTNK

SEQ ID NO: 64961 - protein, 10 aa, Borrelia burgdorferi B31
KITIPKKIIK

SEQ ID NO: 64962 - protein, 10 aa, Borrelia burgdorferi B31
  Xaa can be any naturally occurring amino acid
  VARIANT 8: Xaa = Any Amino Acid
FIKILIKXYK

SEQ ID NO: 64963 - protein, 10 aa, Borrelia burgdorferi B31
KLKQKINFKK

SEQ ID NO: 64964 - protein, 10 aa, Borrelia burgdorferi B31
KIKILNILNK

SEQ ID NO: 64965 - protein, 10 aa, Borrelia burgdorferi B31
RSRILKIIIK

SEQ ID NO: 64966 - protein, 10 aa, Borrelia burgdorferi B31
EILNYLRALK

SEQ ID NO: 64967 - protein, 10 aa, Borrelia burgdorferi B31
KYLTWFFKDK

SEQ ID NO: 64968 - protein, 10 aa, Borrelia burgdorferi B31
QIFVYFLSFY

SEQ ID NO: 64969 - protein, 10 aa, Borrelia burgdorferi B31
ILNILNKNLK

SEQ ID NO: 64970 - protein, 10 aa, Borrelia burgdorferi B31
LSFYPNIEYK

SEQ ID NO: 64971 - protein, 10 aa, Borrelia burgdorferi B31
FLSFYPNIEY

SEQ ID NO: 64972 - protein, 10 aa, Borrelia burgdorferi B31
TYWPVGCLSK

SEQ ID NO: 64973 - protein, 10 aa, Borrelia burgdorferi B31
ISSQLYKLEK

SEQ ID NO: 64974 - protein, 10 aa, Borrelia burgdorferi B31
NTKKLGTTYK

SEQ ID NO: 64975 - protein, 10 aa, Borrelia burgdorferi B31
TKKYLTWFFK

SEQ ID NO: 64976 - protein, 10 aa, Borrelia burgdorferi B31
FSDFTQYAPK

SEQ ID NO: 64977 - protein, 10 aa, Borrelia burgdorferi B31
KLINIKEKIK

SEQ ID NO: 64978 - protein, 10 aa, Borrelia burgdorferi B31
RNKNFIQISK

SEQ ID NO: 64979 - protein, 10 aa, Borrelia burgdorferi B31
KKLGTTYKLK

SEQ ID NO: 64980 - protein, 10 aa, Borrelia burgdorferi B31
LYVIEKTITK

SEQ ID NO: 64981 - protein, 10 aa, Borrelia burgdorferi B31
KLKRMLILTY

SEQ ID NO: 64982 - protein, 10 aa, Borrelia burgdorferi B31
FLEIIMHYVK

SEQ ID NO: 64983 - protein, 10 aa, Borrelia burgdorferi B31
SSIFKERYIK

SEQ ID NO: 64984 - protein, 10 aa, Borrelia burgdorferi B31
KTLSLNEIFY

SEQ ID NO: 64985 - protein, 10 aa, Borrelia burgdorferi B31
KNIFIKILIK

SEQ ID NO: 64986 - protein, 10 aa, Borrelia burgdorferi B31
NEIFYKGSSK

SEQ ID NO: 64987 - protein, 10 aa, Borrelia burgdorferi B31
NTSLEECYYK

SEQ ID NO: 64988 - protein, 10 aa, Borrelia burgdorferi B31
ALKYNEILNY

SEQ ID NO: 64989 - protein, 10 aa, Borrelia burgdorferi B31
IAFYIYADNK

SEQ ID NO: 64990 - protein, 10 aa, Borrelia burgdorferi B31
YVIEKTITKK

SEQ ID NO: 64991 - protein, 10 aa, Borrelia burgdorferi B31
LATLKKHINK

SEQ ID NO: 64992 - protein, 10 aa, Borrelia burgdorferi B31
FIDALEYIEK

SEQ ID NO: 64993 - protein, 10 aa, Borrelia burgdorferi B31
KLIEIQNSPY

SEQ ID NO: 64994 - protein, 10 aa, Borrelia burgdorferi B31
FYDSLATLKK

SEQ ID NO: 64995 - protein, 10 aa, Borrelia burgdorferi B31
YLEEEILALK

SEQ ID NO: 64996 - protein, 10 aa, Borrelia burgdorferi B31
EFYDSLATLK

SEQ ID NO: 64997 - protein, 10 aa, Borrelia burgdorferi B31
LTNKESRLIK

SEQ ID NO: 64998 - protein, 10 aa, Borrelia burgdorferi B31
LKCYLYVIEK

SEQ ID NO: 64999 - protein, 10 aa, Borrelia burgdorferi B31
SAFLEIIMHY

SEQ ID NO: 65000 - protein, 10 aa, Borrelia burgdorferi B31
KNIRFNLIEK

SEQ ID NO: 65001 - protein, 10 aa, Borrelia burgdorferi B31
YLLIKSLKTR

SEQ ID NO: 65002 - protein, 10 aa, Borrelia burgdorferi B31
NLVELKNNRK

SEQ ID NO: 65003 - protein, 10 aa, Borrelia burgdorferi B31
NLKYRPENQK

SEQ ID NO: 65004 - protein, 10 aa, Borrelia burgdorferi B31
LLPAMCYLIY

SEQ ID NO: 65005 - protein, 10 aa, Borrelia burgdorferi B31
FNPYESSIFK

SEQ ID NO: 65006 - protein, 10 aa, Borrelia burgdorferi B31
YKLKSSNFLK

SEQ ID NO: 65007 - protein, 10 aa, Borrelia burgdorferi B31
TEDFFISFDK

SEQ ID NO: 65008 - protein, 10 aa, Borrelia burgdorferi B31
SFFKTKLKQK

SEQ ID NO: 65009 - protein, 10 aa, Borrelia burgdorferi B31
IYCENLVELK

SEQ ID NO: 65010 - protein, 10 aa, Borrelia burgdorferi B31
YIYADNKDKK

SEQ ID NO: 65011 - protein, 10 aa, Borrelia burgdorferi B31
TKLKQKINFK

SEQ ID NO: 65012 - protein, 10 aa, Borrelia burgdorferi B31
KISNDYEKEK

SEQ ID NO: 65013 - protein, 10 aa, Borrelia burgdorferi B31
LEIIMHYVKK

SEQ ID NO: 65014 - protein, 10 aa, Borrelia burgdorferi B31
YSQEKKDIYK

SEQ ID NO: 65015 - protein, 10 aa, Borrelia burgdorferi B31
LKYSISSQLY

SEQ ID NO: 65016 - protein, 10 aa, Borrelia burgdorferi B31
KHINKYIEEK

SEQ ID NO: 65017 - protein, 10 aa, Borrelia burgdorferi B31
NILNKNLKYR

SEQ ID NO: 65018 - protein, 10 aa, Borrelia burgdorferi B31
QNSPYYSQEK

SEQ ID NO: 65019 - protein, 10 aa, Borrelia burgdorferi B31
ISKEANLNTK

SEQ ID NO: 65020 - protein, 10 aa, Borrelia burgdorferi B31
LEFISFFKTK

SEQ ID NO: 65021 - protein, 10 aa, Borrelia burgdorferi B31
LDENKITIPK

SEQ ID NO: 65022 - protein, 11 aa, Borrelia burgdorferi B31
YLYVIEKTITK

SEQ ID NO: 65023 - protein, 11 aa, Borrelia burgdorferi B31
FLSFYPNIEYK

SEQ ID NO: 65024 - protein, 11 aa, Borrelia burgdorferi B31
KSAFLEIIMHY

SEQ ID NO: 65025 - protein, 11 aa, Borrelia burgdorferi B31
KTKLKQKINFK

SEQ ID NO: 65026 - protein, 11 aa, Borrelia burgdorferi B31
KLLPAMCYLIY

SEQ ID NO: 65027 - protein, 11 aa, Borrelia burgdorferi B31
TLKCYLYVIEK

SEQ ID NO: 65028 - protein, 11 aa, Borrelia burgdorferi B31
NSLLEFISFFK

SEQ ID NO: 65029 - protein, 11 aa, Borrelia burgdorferi B31
IQNSPYYSQEK

SEQ ID NO: 65030 - protein, 11 aa, Borrelia burgdorferi B31
KINPNQLDYQK

SEQ ID NO: 65031 - protein, 11 aa, Borrelia burgdorferi B31
KLIEIQNSPYY

SEQ ID NO: 65032 - protein, 11 aa, Borrelia burgdorferi B31
SLTNKESRLIK

SEQ ID NO: 65033 - protein, 11 aa, Borrelia burgdorferi B31
LLEFISFFKTK

SEQ ID NO: 65034 - protein, 11 aa, Borrelia burgdorferi B31
FLEIIMHYVKK

SEQ ID NO: 65035 - protein, 11 aa, Borrelia burgdorferi B31
ILNILNKNLKY

SEQ ID NO: 65036 - protein, 11 aa, Borrelia burgdorferi B31
SISSQLYKLEK

SEQ ID NO: 65037 - protein, 11 aa, Borrelia burgdorferi B31
TIPKKIIKIQK

SEQ ID NO: 65038 - protein, 11 aa, Borrelia burgdorferi B31
  Xaa can be any naturally occurring amino acid
  VARIANT 9: Xaa = Any Amino Acid
IFIKILIKXYK

SEQ ID NO: 65039 - protein, 11 aa, Borrelia burgdorferi B31
ISKEANLNTKK

SEQ ID NO: 65040 - protein, 11 aa, Borrelia burgdorferi B31
VLKYSISSQLY

SEQ ID NO: 65041 - protein, 11 aa, Borrelia burgdorferi B31
RILKIIIKNIR

SEQ ID NO: 65042 - protein, 11 aa, Borrelia burgdorferi B31
LVAVRNRNKIK

SEQ ID NO: 65043 - protein, 11 aa, Borrelia burgdorferi B31
LKYSISSQLYK

SEQ ID NO: 65044 - protein, 11 aa, Borrelia burgdorferi B31
EFYDSLATLKK

SEQ ID NO: 65045 - protein, 11 aa, Borrelia burgdorferi B31
LLIKSLKTRSR

SEQ ID NO: 65046 - protein, 11 aa, Borrelia burgdorferi B31
IFCQRMKEFFK

SEQ ID NO: 65047 - protein, 11 aa, Borrelia burgdorferi B31
NFNPYESSIFK

SEQ ID NO: 65048 - protein, 11 aa, Borrelia burgdorferi B31
ISFDKTNFNPY

SEQ ID NO: 65049 - protein, 11 aa, Borrelia burgdorferi B31
NLNTKKLGTTY

SEQ ID NO: 65050 - protein, 11 aa, Borrelia burgdorferi B31
YLDENKITIPK

SEQ ID NO: 65051 - protein, 11 aa, Borrelia burgdorferi B31
QISKEANLNTK

SEQ ID NO: 65052 - protein, 11 aa, Borrelia burgdorferi B31
ETYGWIAFYIY

SEQ ID NO: 65053 - protein, 11 aa, Borrelia burgdorferi B31
SEFYDSLATLK

SEQ ID NO: 65054 - protein, 11 aa, Borrelia burgdorferi B31
AFLEIIMHYVK

SEQ ID NO: 65055 - protein, 11 aa, Borrelia burgdorferi B31
HFKFISDILLY

SEQ ID NO: 65056 - protein, 11 aa, Borrelia burgdorferi B31
KYLEEEILALK

SEQ ID NO: 65057 - protein, 11 aa, Borrelia burgdorferi B31
WIAFYIYADNK

SEQ ID NO: 65058 - protein, 9 aa, Borrelia burgdorferi B31
SSQLYKLEK

SEQ ID NO: 65059 - protein, 9 aa, Borrelia burgdorferi B31
ATLKKHINK

SEQ ID NO: 65060 - protein, 9 aa, Borrelia burgdorferi B31
YSISSQLYK

SEQ ID NO: 65061 - protein, 9 aa, Borrelia burgdorferi B31
SIFKERYIK

SEQ ID NO: 65062 - protein, 9 aa, Borrelia burgdorferi B31
TSLEECYYK

SEQ ID NO: 65063 - protein, 9 aa, Borrelia burgdorferi B31
LSLNEIFYK

SEQ ID NO: 65064 - protein, 9 aa, Borrelia burgdorferi B31
LLEFISFFK

SEQ ID NO: 65065 - protein, 9 aa, Borrelia burgdorferi B31
ISFFKTKLK

SEQ ID NO: 65066 - protein, 9 aa, Borrelia burgdorferi B31
KLKSSNFLK

SEQ ID NO: 65067 - protein, 9 aa, Borrelia burgdorferi B31
ILNYLRALK

SEQ ID NO: 65068 - protein, 9 aa, Borrelia burgdorferi B31
YVIEKTITK

SEQ ID NO: 65069 - protein, 9 aa, Borrelia burgdorferi B31
KKYLTWFFK

SEQ ID NO: 65070 - protein, 9 aa, Borrelia burgdorferi B31
ITIPKKIIK

SEQ ID NO: 65071 - protein, 9 aa, Borrelia burgdorferi B31
NTQNEAIKK

SEQ ID NO: 65072 - protein, 9 aa, Borrelia burgdorferi B31
NIFIKILIK

SEQ ID NO: 65073 - protein, 9 aa, Borrelia burgdorferi B31
SSKNISFNY

SEQ ID NO: 65074 - protein, 9 aa, Borrelia burgdorferi B31
SFYPNIEYK

SEQ ID NO: 65075 - protein, 9 aa, Borrelia burgdorferi B31
HINKYIEEK

SEQ ID NO: 65076 - protein, 9 aa, Borrelia burgdorferi B31
AFYIYADNK

SEQ ID NO: 65077 - protein, 9 aa, Borrelia burgdorferi B31
RMKEFFKSK

SEQ ID NO: 65078 - protein, 9 aa, Borrelia burgdorferi B31
LVAVRNRNK

SEQ ID NO: 65079 - protein, 9 aa, Borrelia burgdorferi B31
ETYGWIAFY

SEQ ID NO: 65080 - protein, 9 aa, Borrelia burgdorferi B31
SYLLIKSLK

SEQ ID NO: 65081 - protein, 9 aa, Borrelia burgdorferi B31
EIIMHYVKK

SEQ ID NO: 65082 - protein, 9 aa, Borrelia burgdorferi B31
ISNDYEKEK

SEQ ID NO: 65083 - protein, 9 aa, Borrelia burgdorferi B31
KLKQKINFK

SEQ ID NO: 65084 - protein, 9 aa, Borrelia burgdorferi B31
KIKEIITAK

SEQ ID NO: 65085 - protein, 9 aa, Borrelia burgdorferi B31
CLSKNIFIK

SEQ ID NO: 65086 - protein, 9 aa, Borrelia burgdorferi B31
CQRMKEFFK

SEQ ID NO: 65087 - protein, 9 aa, Borrelia burgdorferi B31
SQEKKDIYK

SEQ ID NO: 65088 - protein, 9 aa, Borrelia burgdorferi B31
NPYESSIFK

SEQ ID NO: 65089 - protein, 9 aa, Borrelia burgdorferi B31
EIFYKGSSK

SEQ ID NO: 65090 - protein, 9 aa, Borrelia burgdorferi B31
KCYLYVIEK

SEQ ID NO: 65091 - protein, 9 aa, Borrelia burgdorferi B31
YQKSYLLIK

SEQ ID NO: 65092 - protein, 9 aa, Borrelia burgdorferi B31
VIEKTITKK

SEQ ID NO: 65093 - protein, 9 aa, Borrelia burgdorferi B31
ILLYLDENK

SEQ ID NO: 65094 - protein, 9 aa, Borrelia burgdorferi B31
LVELKNNRK

SEQ ID NO: 65095 - protein, 9 aa, Borrelia burgdorferi B31
YIYADNKDK

SEQ ID NO: 65096 - protein, 9 aa, Borrelia burgdorferi B31
KLGTTYKLK

SEQ ID NO: 65097 - protein, 9 aa, Borrelia burgdorferi B31
NIRFNLIEK

SEQ ID NO: 65098 - protein, 9 aa, Borrelia burgdorferi B31
TLSLNEIFY

SEQ ID NO: 65099 - protein, 9 aa, Borrelia burgdorferi B31
YLTWFFKDK

SEQ ID NO: 65100 - protein, 9 aa, Borrelia burgdorferi B31
LSFYPNIEY

SEQ ID NO: 65101 - protein, 9 aa, Borrelia burgdorferi B31
SPYYSQEKK

SEQ ID NO: 65102 - protein, 9 aa, Borrelia burgdorferi B31
  Xaa can be any naturally occurring amino acid
  VARIANT 6: Xaa = Any Amino Acid
KILIKXYKY

SEQ ID NO: 65103 - protein, 9 aa, Borrelia burgdorferi B31
WILEIVRNK

SEQ ID NO: 65104 - protein, 9 aa, Borrelia burgdorferi B31
NSPYYSQEK

SEQ ID NO: 65105 - protein, 9 aa, Borrelia burgdorferi B31
AVRNRNKIK

SEQ ID NO: 65106 - protein, 9 aa, Borrelia burgdorferi B31
KYIEEKVLK

SEQ ID NO: 65107 - protein, 9 aa, Borrelia burgdorferi B31
SSLTNKESR

SEQ ID NO: 65108 - protein, 9 aa, Borrelia burgdorferi B31
SDFTQYAPK

SEQ ID NO: 65109 - protein, 9 aa, Borrelia burgdorferi B31
VFKSSLTNK

SEQ ID NO: 65110 - protein, 9 aa, Borrelia burgdorferi B31
KFISDILLY

SEQ ID NO: 65111 - protein, 9 aa, Borrelia burgdorferi B31
KINPNQLDY

SEQ ID NO: 65112 - protein, 9 aa, Borrelia burgdorferi B31
TIDILVAVR

SEQ ID NO: 65113 - protein, 9 aa, Borrelia burgdorferi B31
ALEYIEKHK

SEQ ID NO: 65114 - protein, 9 aa, Borrelia burgdorferi B31
SAFLEIIMH

SEQ ID NO: 65115 - protein, 10 aa, Borrelia burgdorferi B31
SLLEFISFFK

SEQ ID NO: 65116 - protein, 10 aa, Borrelia burgdorferi B31
KVFKSSLTNK

SEQ ID NO: 65117 - protein, 10 aa, Borrelia burgdorferi B31
KSYLLIKSLK

SEQ ID NO: 65118 - protein, 10 aa, Borrelia burgdorferi B31
TLSLNEIFYK

SEQ ID NO: 65119 - protein, 10 aa, Borrelia burgdorferi B31
SSIFKERYIK

SEQ ID NO: 65120 - protein, 10 aa, Borrelia burgdorferi B31
LSFYPNIEYK

SEQ ID NO: 65121 - protein, 10 aa, Borrelia burgdorferi B31
KINFKKELMK

SEQ ID NO: 65122 - protein, 10 aa, Borrelia burgdorferi B31
IAFYIYADNK

SEQ ID NO: 65123 - protein, 10 aa, Borrelia burgdorferi B31
ISSQLYKLEK

SEQ ID NO: 65124 - protein, 10 aa, Borrelia burgdorferi B31
KIKILNILNK

SEQ ID NO: 65125 - protein, 10 aa, Borrelia burgdorferi B31
YVIEKTITKK

SEQ ID NO: 65126 - protein, 10 aa, Borrelia burgdorferi B31
QIFVYFLSFY

SEQ ID NO: 65127 - protein, 10 aa, Borrelia burgdorferi B31
LTNKESRLIK

SEQ ID NO: 65128 - protein, 10 aa, Borrelia burgdorferi B31
KTLSLNEIFY

SEQ ID NO: 65129 - protein, 10 aa, Borrelia burgdorferi B31
NTSLEECYYK

SEQ ID NO: 65130 - protein, 10 aa, Borrelia burgdorferi B31
SLKTRSRILK

SEQ ID NO: 65131 - protein, 10 aa, Borrelia burgdorferi B31
SAFLEIIMHY

SEQ ID NO: 65132 - protein, 10 aa, Borrelia burgdorferi B31
ILNILNKNLK

SEQ ID NO: 65133 - protein, 10 aa, Borrelia burgdorferi B31
KYSISSQLYK

SEQ ID NO: 65134 - protein, 10 aa, Borrelia burgdorferi B31
FISFFKTKLK

SEQ ID NO: 65135 - protein, 10 aa, Borrelia burgdorferi B31
YIYADNKDKK

SEQ ID NO: 65136 - protein, 10 aa, Borrelia burgdorferi B31
YSQEKKDIYK

SEQ ID NO: 65137 - protein, 10 aa, Borrelia burgdorferi B31
ILVAVRNRNK

SEQ ID NO: 65138 - protein, 10 aa, Borrelia burgdorferi B31
KLKQKINFKK

SEQ ID NO: 65139 - protein, 10 aa, Borrelia burgdorferi B31
KISNDYEKEK

SEQ ID NO: 65140 - protein, 10 aa, Borrelia burgdorferi B31
FSDFTQYAPK

SEQ ID NO: 65141 - protein, 10 aa, Borrelia burgdorferi B31
KITIPKKIIK

SEQ ID NO: 65142 - protein, 10 aa, Borrelia burgdorferi B31
NTKKLGTTYK

SEQ ID NO: 65143 - protein, 10 aa, Borrelia burgdorferi B31
EILNYLRALK

SEQ ID NO: 65144 - protein, 10 aa, Borrelia burgdorferi B31
FIDALEYIEK

SEQ ID NO: 65145 - protein, 10 aa, Borrelia burgdorferi B31
QTIDILVAVR

SEQ ID NO: 65146 - protein, 10 aa, Borrelia burgdorferi B31
ISKEANLNTK

SEQ ID NO: 65147 - protein, 10 aa, Borrelia burgdorferi B31
LATLKKHINK

SEQ ID NO: 65148 - protein, 10 aa, Borrelia burgdorferi B31
SFFKTKLKQK

SEQ ID NO: 65149 - protein, 10 aa, Borrelia burgdorferi B31
KTIKKDSEFY

SEQ ID NO: 65150 - protein, 10 aa, Borrelia burgdorferi B31
GSSKNISFNY

SEQ ID NO: 65151 - protein, 10 aa, Borrelia burgdorferi B31
KNIRFNLIEK

SEQ ID NO: 65152 - protein, 10 aa, Borrelia burgdorferi B31
RSRILKIIIK

SEQ ID NO: 65153 - protein, 10 aa, Borrelia burgdorferi B31
KYLTWFFKDK

SEQ ID NO: 65154 - protein, 10 aa, Borrelia burgdorferi B31
LIKISNDYEK

SEQ ID NO: 65155 - protein, 10 aa, Borrelia burgdorferi B31
TKKYLTWFFK

SEQ ID NO: 65156 - protein, 10 aa, Borrelia burgdorferi B31
ATLKKHINKY

SEQ ID NO: 65157 - protein, 10 aa, Borrelia burgdorferi B31
KLINIKEKIK

SEQ ID NO: 65158 - protein, 10 aa, Borrelia burgdorferi B31
KNIFIKILIK

SEQ ID NO: 65159 - protein, 10 aa, Borrelia burgdorferi B31
IYCENLVELK

SEQ ID NO: 65160 - protein, 10 aa, Borrelia burgdorferi B31
FLEIIMHYVK

SEQ ID NO: 65161 - protein, 10 aa, Borrelia burgdorferi B31
EFYDSLATLK

SEQ ID NO: 65162 - protein, 10 aa, Borrelia burgdorferi B31
TYWPVGCLSK

SEQ ID NO: 65163 - protein, 10 aa, Borrelia burgdorferi B31
YLEEEILALK

SEQ ID NO: 65164 - protein, 10 aa, Borrelia burgdorferi B31
  Xaa can be any naturally occurring amino acid
  VARIANT 8: Xaa = Any Amino Acid
FIKILIKXYK

SEQ ID NO: 65165 - protein, 10 aa, Borrelia burgdorferi B31
TEDFFISFDK

SEQ ID NO: 65166 - protein, 10 aa, Borrelia burgdorferi B31
KSSLTNKESR

SEQ ID NO: 65167 - protein, 10 aa, Borrelia burgdorferi B31
VAVRNRNKIK

SEQ ID NO: 65168 - protein, 10 aa, Borrelia burgdorferi B31
KLIEIQNSPY

SEQ ID NO: 65169 - protein, 10 aa, Borrelia burgdorferi B31
KYNEILNYLR

SEQ ID NO: 65170 - protein, 10 aa, Borrelia burgdorferi B31
DILLYLDENK

SEQ ID NO: 65171 - protein, 10 aa, Borrelia burgdorferi B31
NSPYYSQEKK

SEQ ID NO: 65172 - protein, 10 aa, Borrelia burgdorferi B31
FVYFLSFYPN

SEQ ID NO: 65173 - protein, 10 aa, Borrelia burgdorferi B31
KWILEIVRNK

SEQ ID NO: 65174 - protein, 10 aa, Borrelia burgdorferi B31
LEFISFFKTK

SEQ ID NO: 65175 - protein, 11 aa, Borrelia burgdorferi B31
KTLSLNEIFYK

SEQ ID NO: 65176 - protein, 11 aa, Borrelia burgdorferi B31
LTYWPVGCLSK

SEQ ID NO: 65177 - protein, 11 aa, Borrelia burgdorferi B31
SISSQLYKLEK

SEQ ID NO: 65178 - protein, 11 aa, Borrelia burgdorferi B31
KSLKTRSRILK

SEQ ID NO: 65179 - protein, 11 aa, Borrelia burgdorferi B31
NSLLEFISFFK

SEQ ID NO: 65180 - protein, 11 aa, Borrelia burgdorferi B31
ITKKYLTWFFK

SEQ ID NO: 65181 - protein, 11 aa, Borrelia burgdorferi B31
KILNILNKNLK

SEQ ID NO: 65182 - protein, 11 aa, Borrelia burgdorferi B31
QTEDFFISFDK

SEQ ID NO: 65183 - protein, 11 aa, Borrelia burgdorferi B31
KINPNQLDYQK

SEQ ID NO: 65184 - protein, 11 aa, Borrelia burgdorferi B31
LIYCENLVELK

SEQ ID NO: 65185 - protein, 11 aa, Borrelia burgdorferi B31
ISFFKTKLKQK

SEQ ID NO: 65186 - protein, 11 aa, Borrelia burgdorferi B31
SLATLKKHINK

SEQ ID NO: 65187 - protein, 11 aa, Borrelia burgdorferi B31
TLKCYLYVIEK

SEQ ID NO: 65188 - protein, 11 aa, Borrelia burgdorferi B31
IQNSPYYSQEK

SEQ ID NO: 65189 - protein, 11 aa, Borrelia burgdorferi B31
KTKLKQKINFK

SEQ ID NO: 65190 - protein, 11 aa, Borrelia burgdorferi B31
SLTNKESRLIK

SEQ ID NO: 65191 - protein, 11 aa, Borrelia burgdorferi B31
WIAFYIYADNK

SEQ ID NO: 65192 - protein, 11 aa, Borrelia burgdorferi B31
TIPKKIIKIQK

SEQ ID NO: 65193 - protein, 11 aa, Borrelia burgdorferi B31
SFIDALEYIEK

SEQ ID NO: 65194 - protein, 11 aa, Borrelia burgdorferi B31
AFLEIIMHYVK

SEQ ID NO: 65195 - protein, 11 aa, Borrelia burgdorferi B31
KSAFLEIIMHY

SEQ ID NO: 65196 - protein, 11 aa, Borrelia burgdorferi B31
IFCQRMKEFFK

SEQ ID NO: 65197 - protein, 11 aa, Borrelia burgdorferi B31
ISFDKTNFNPY

SEQ ID NO: 65198 - protein, 11 aa, Borrelia burgdorferi B31
YLYVIEKTITK

SEQ ID NO: 65199 - protein, 11 aa, Borrelia burgdorferi B31
FLSFYPNIEYK

SEQ ID NO: 65200 - protein, 11 aa, Borrelia burgdorferi B31
SEFYDSLATLK

SEQ ID NO: 65201 - protein, 11 aa, Borrelia burgdorferi B31
QISKEANLNTK

SEQ ID NO: 65202 - protein, 11 aa, Borrelia burgdorferi B31
TYKLKSSNFLK

SEQ ID NO: 65203 - protein, 11 aa, Borrelia burgdorferi B31
ISKEANLNTKK

SEQ ID NO: 65204 - protein, 11 aa, Borrelia burgdorferi B31
LLEFISFFKTK

SEQ ID NO: 65205 - protein, 11 aa, Borrelia burgdorferi B31
LVAVRNRNKIK

SEQ ID NO: 65206 - protein, 11 aa, Borrelia burgdorferi B31
ETYGWIAFYIY

SEQ ID NO: 65207 - protein, 11 aa, Borrelia burgdorferi B31
  Xaa can be any naturally occurring amino acid
  VARIANT 9: Xaa = Any Amino Acid
IFIKILIKXYK

SEQ ID NO: 65208 - protein, 11 aa, Borrelia burgdorferi B31
KYLEEEILALK

SEQ ID NO: 65209 - protein, 11 aa, Borrelia burgdorferi B31
YLDENKITIPK

SEQ ID NO: 65210 - protein, 11 aa, Borrelia burgdorferi B31
NQIFVYFLSFY

SEQ ID NO: 65211 - protein, 11 aa, Borrelia burgdorferi B31
KLIEIQNSPYY

SEQ ID NO: 65212 - protein, 11 aa, Borrelia burgdorferi B31
NFNPYESSIFK

SEQ ID NO: 65213 - protein, 11 aa, Borrelia burgdorferi B31
ESSIFKERYIK

SEQ ID NO: 65214 - protein, 11 aa, Borrelia burgdorferi B31
LKYSISSQLYK

SEQ ID NO: 65215 - protein, 11 aa, Borrelia burgdorferi B31
EFYDSLATLKK

SEQ ID NO: 65216 - protein, 11 aa, Borrelia burgdorferi B31
AFYIYADNKDK

SEQ ID NO: 65217 - protein, 11 aa, Borrelia burgdorferi B31
ELIKISNDYEK

SEQ ID NO: 65218 - protein, 11 aa, Borrelia burgdorferi B31
FLEIIMHYVKK

SEQ ID NO: 65219 - protein, 11 aa, Borrelia burgdorferi B31
AIKKWILEIVR

SEQ ID NO: 65220 - protein, 11 aa, Borrelia burgdorferi B31
FFSDFTQYAPK

SEQ ID NO: 65221 - protein, 11 aa, Borrelia burgdorferi B31
LVELKNNRKIK

SEQ ID NO: 65222 - protein, 11 aa, Borrelia burgdorferi B31
KKYLTWFFKDK

SEQ ID NO: 65223 - protein, 11 aa, Borrelia burgdorferi B31
RILKIIIKNIR

SEQ ID NO: 65224 - protein, 11 aa, Borrelia burgdorferi B31
YIEKHKLINIK

SEQ ID NO: 65225 - protein, 11 aa, Borrelia burgdorferi B31
KLLPAMCYLIY

SEQ ID NO: 65226 - protein, 11 aa, Borrelia burgdorferi B31
VGCLSKNIFIK

SEQ ID NO: 65227 - protein, 11 aa, Borrelia burgdorferi B31
CQRMKEFFKSK

SEQ ID NO: 65228 - protein, 11 aa, Borrelia burgdorferi B31
SKNIFIKILIK

SEQ ID NO: 65229 - protein, 11 aa, Borrelia burgdorferi B31
TIDILVAVRNR

SEQ ID NO: 65230 - protein, 11 aa, Borrelia burgdorferi B31
YAPKDFQDTLK

SEQ ID NO: 65231 - protein, 9 aa, Borrelia burgdorferi B31
DYQKSYLLI

SEQ ID NO: 65232 - protein, 9 aa, Borrelia burgdorferi B31
TYGWIAFYI

SEQ ID NO: 65233 - protein, 9 aa, Borrelia burgdorferi B31
IYKQIILNF

SEQ ID NO: 65234 - protein, 9 aa, Borrelia burgdorferi B31
TYKLKSSNF

SEQ ID NO: 65235 - protein, 9 aa, Borrelia burgdorferi B31
KFQTEDFFI

SEQ ID NO: 65236 - protein, 9 aa, Borrelia burgdorferi B31
EYIEKHKLI

SEQ ID NO: 65237 - protein, 9 aa, Borrelia burgdorferi B31
YFLSFYPNI

SEQ ID NO: 65238 - protein, 9 aa, Borrelia burgdorferi B31
NYLRALKTL

SEQ ID NO: 65239 - protein, 9 aa, Borrelia burgdorferi B31
  Xaa can be any naturally occurring amino acid
  VARIANT 1: Xaa = Any Amino Acid
XYKYLEEEI

SEQ ID NO: 65240 - protein, 9 aa, Borrelia burgdorferi B31
KYNEILNYL

SEQ ID NO: 65241 - protein, 9 aa, Borrelia burgdorferi B31
IYCENLVEL

SEQ ID NO: 65242 - protein, 9 aa, Borrelia burgdorferi B31
KYSISSQLY

SEQ ID NO: 65243 - protein, 9 aa, Borrelia burgdorferi B31
RYIKSAFLE

SEQ ID NO: 65244 - protein, 9 aa, Borrelia burgdorferi B31
SFNYFFSDF

SEQ ID NO: 65245 - protein, 9 aa, Borrelia burgdorferi B31
DYEKEKNAF

SEQ ID NO: 65246 - protein, 9 aa, Borrelia burgdorferi B31
FFKSKTFEI

SEQ ID NO: 65247 - protein, 9 aa, Borrelia burgdorferi B31
SYLLIKSLK

SEQ ID NO: 65248 - protein, 9 aa, Borrelia burgdorferi B31
FYKGSSKNI

SEQ ID NO: 65249 - protein, 9 aa, Borrelia burgdorferi B31
TFEIQNQIF

SEQ ID NO: 65250 - protein, 9 aa, Borrelia burgdorferi B31
KYLTWFFKD

SEQ ID NO: 65251 - protein, 9 aa, Borrelia burgdorferi B31
SFIDALEYI

SEQ ID NO: 65252 - protein, 9 aa, Borrelia burgdorferi B31
LYKLEKPEI

SEQ ID NO: 65253 - protein, 9 aa, Borrelia burgdorferi B31
IQNQIFVYF

SEQ ID NO: 65254 - protein, 9 aa, Borrelia burgdorferi B31
CYLIYCENL

SEQ ID NO: 65255 - protein, 9 aa, Borrelia burgdorferi B31
FYDSLATLK

SEQ ID NO: 65256 - protein, 9 aa, Borrelia burgdorferi B31
TKKYLTWFF

SEQ ID NO: 65257 - protein, 9 aa, Borrelia burgdorferi B31
IFCQRMKEF

SEQ ID NO: 65258 - protein, 10 aa, Borrelia burgdorferi B31
RYIKSAFLEI

SEQ ID NO: 65259 - protein, 10 aa, Borrelia burgdorferi B31
FYPNIEYKHF

SEQ ID NO: 65260 - protein, 10 aa, Borrelia burgdorferi B31
VYFLSFYPNI

SEQ ID NO: 65261 - protein, 10 aa, Borrelia burgdorferi B31
CYLYVIEKTI

SEQ ID NO: 65262 - protein, 10 aa, Borrelia burgdorferi B31
YYKNTQNEAI

SEQ ID NO: 65263 - protein, 10 aa, Borrelia burgdorferi B31
TYKLKSSNFL

SEQ ID NO: 65264 - protein, 10 aa, Borrelia burgdorferi B31
LYLDENKITI

SEQ ID NO: 65265 - protein, 10 aa, Borrelia burgdorferi B31
HYVKKNSQNI

SEQ ID NO: 65266 - protein, 10 aa, Borrelia burgdorferi B31
IYADNKDKKI

SEQ ID NO: 65267 - protein, 10 aa, Borrelia burgdorferi B31
KYLEEEILAL

SEQ ID NO: 65268 - protein, 10 aa, Borrelia burgdorferi B31
TYGWIAFYIY

SEQ ID NO: 65269 - protein, 10 aa, Borrelia burgdorferi B31
KYRPENQKVF

SEQ ID NO: 65270 - protein, 10 aa, Borrelia burgdorferi B31
NQIFVYFLSF

SEQ ID NO: 65271 - protein, 10 aa, Borrelia burgdorferi B31
KFISDILLYL

SEQ ID NO: 65272 - protein, 10 aa, Borrelia burgdorferi B31
LYKLEKPEII

SEQ ID NO: 65273 - protein, 10 aa, Borrelia burgdorferi B31
  Xaa can be any naturally occurring amino acid
  VARIANT 1: Xaa = Any Amino Acid
XYKYLEEEIL

SEQ ID NO: 65274 - protein, 10 aa, Borrelia burgdorferi B31
KYLTWFFKDK

SEQ ID NO: 65275 - protein, 10 aa, Borrelia burgdorferi B31
CYLIYCENLV

SEQ ID NO: 65276 - protein, 10 aa, Borrelia burgdorferi B31
DYQKSYLLIK

SEQ ID NO: 65277 - protein, 10 aa, Borrelia burgdorferi B31
IFCQRMKEFF

SEQ ID NO: 65278 - protein, 10 aa, Borrelia burgdorferi B31
ITKKYLTWFF

SEQ ID NO: 65279 - protein, 10 aa, Borrelia burgdorferi B31
FFISFDKTNF

SEQ ID NO: 65280 - protein, 10 aa, Borrelia burgdorferi B31
IYCENLVELK

SEQ ID NO: 65281 - protein, 10 aa, Borrelia burgdorferi B31
EFFKSKTFEI

SEQ ID NO: 65282 - protein, 10 aa, Borrelia burgdorferi B31
KYSISSQLYK

SEQ ID NO: 65283 - protein, 10 aa, Borrelia burgdorferi B31
NFNPYESSIF

SEQ ID NO: 65284 - protein, 10 aa, Borrelia burgdorferi B31
KYIEEKVLKY

SEQ ID NO: 65285 - protein, 10 aa, Borrelia burgdorferi B31
KYNEILNYLR

SEQ ID NO: 65286 - protein, 11 aa, Borrelia burgdorferi B31
RYIKSAFLEII

SEQ ID NO: 65287 - protein, 11 aa, Borrelia burgdorferi B31
KYLTWFFKDKI

SEQ ID NO: 65288 - protein, 11 aa, Borrelia burgdorferi B31
KYSISSQLYKL

SEQ ID NO: 65289 - protein, 11 aa, Borrelia burgdorferi B31
KFQTEDFFISF

SEQ ID NO: 65290 - protein, 11 aa, Borrelia burgdorferi B31
EYIEKHKLINI

SEQ ID NO: 65291 - protein, 11 aa, Borrelia burgdorferi B31
NYLRALKTLSL

SEQ ID NO: 65292 - protein, 11 aa, Borrelia burgdorferi B31
IYADNKDKKIF

SEQ ID NO: 65293 - protein, 11 aa, Borrelia burgdorferi B31
CYYKNTQNEAI

SEQ ID NO: 65294 - protein, 11 aa, Borrelia burgdorferi B31
FYKGSSKNISF

SEQ ID NO: 65295 - protein, 11 aa, Borrelia burgdorferi B31
QYAPKDFQDTL

SEQ ID NO: 65296 - protein, 11 aa, Borrelia burgdorferi B31
YWPVGCLSKNI

SEQ ID NO: 65297 - protein, 11 aa, Borrelia burgdorferi B31
EYKHFKFISDI

SEQ ID NO: 65298 - protein, 11 aa, Borrelia burgdorferi B31
IFKERYIKSAF

SEQ ID NO: 65299 - protein, 11 aa, Borrelia burgdorferi B31
SFYPNIEYKHF

SEQ ID NO: 65300 - protein, 11 aa, Borrelia burgdorferi B31
FYPNIEYKHFK

SEQ ID NO: 65301 - protein, 11 aa, Borrelia burgdorferi B31
TYKLKSSNFLK

SEQ ID NO: 65302 - protein, 11 aa, Borrelia burgdorferi B31
TYGWIAFYIYA

SEQ ID NO: 65303 - protein, 11 aa, Borrelia burgdorferi B31
KYLEEEILALK

SEQ ID NO: 65304 - protein, 11 aa, Borrelia burgdorferi B31
KTITKKYLTWF

SEQ ID NO: 65305 - protein, 11 aa, Borrelia burgdorferi B31
TITKKYLTWFF

SEQ ID NO: 65306 - protein, 11 aa, Borrelia burgdorferi B31
IIIKNIRFNLI

SEQ ID NO: 65307 - protein, 11 aa, Borrelia burgdorferi B31
SSKNISFNYFF

SEQ ID NO: 65308 - protein, 11 aa, Borrelia burgdorferi B31
YYKNTQNEAIK

SEQ ID NO: 65309 - protein, 11 aa, Borrelia burgdorferi B31
FYIYADNKDKK

SEQ ID NO: 65310 - protein, 11 aa, Borrelia burgdorferi B31
ITAKFQTEDFF

SEQ ID NO: 65311 - protein, 9 aa, Borrelia burgdorferi B31
YFFSDFTQY

SEQ ID NO: 65312 - protein, 9 aa, Borrelia burgdorferi B31
KFISDILLY

SEQ ID NO: 65313 - protein, 9 aa, Borrelia burgdorferi B31
EIQNQIFVY

SEQ ID NO: 65314 - protein, 9 aa, Borrelia burgdorferi B31
LSFYPNIEY

SEQ ID NO: 65315 - protein, 9 aa, Borrelia burgdorferi B31
YIEEKVLKY

SEQ ID NO: 65316 - protein, 9 aa, Borrelia burgdorferi B31
NILNKNLKY

SEQ ID NO: 65317 - protein, 9 aa, Borrelia burgdorferi B31
SSKNISFNY

SEQ ID NO: 65318 - protein, 9 aa, Borrelia burgdorferi B31
ESFIDALEY

SEQ ID NO: 65319 - protein, 9 aa, Borrelia burgdorferi B31
AFLEIIMHY

SEQ ID NO: 65320 - protein, 9 aa, Borrelia burgdorferi B31
IFVYFLSFY

SEQ ID NO: 65321 - protein, 9 aa, Borrelia burgdorferi B31
KINPNQLDY

SEQ ID NO: 65322 - protein, 9 aa, Borrelia burgdorferi B31
TLSLNEIFY

SEQ ID NO: 65323 - protein, 9 aa, Borrelia burgdorferi B31
ELIKISNDY

SEQ ID NO: 65324 - protein, 9 aa, Borrelia burgdorferi B31
  Xaa can be any naturally occurring amino acid
  VARIANT 6: Xaa = Any Amino Acid
KILIKXYKY

SEQ ID NO: 65325 - protein, 9 aa, Borrelia burgdorferi B31
KYSISSQLY

SEQ ID NO: 65326 - protein, 9 aa, Borrelia burgdorferi B31
ETYGWIAFY

SEQ ID NO: 65327 - protein, 9 aa, Borrelia burgdorferi B31
YGWIAFYIY

SEQ ID NO: 65328 - protein, 9 aa, Borrelia burgdorferi B31
NTKKLGTTY

SEQ ID NO: 65329 - protein, 9 aa, Borrelia burgdorferi B31
NTSLEECYY

SEQ ID NO: 65330 - protein, 9 aa, Borrelia burgdorferi B31
KNISFNYFF

SEQ ID NO: 65331 - protein, 9 aa, Borrelia burgdorferi B31
FNTSLEECY

SEQ ID NO: 65332 - protein, 9 aa, Borrelia burgdorferi B31
FVYFLSFYP

SEQ ID NO: 65333 - protein, 9 aa, Borrelia burgdorferi B31
QIFVYFLSF

SEQ ID NO: 65334 - protein, 9 aa, Borrelia burgdorferi B31
IEIQNSPYY

SEQ ID NO: 65335 - protein, 9 aa, Borrelia burgdorferi B31
FYPNIEYKH

SEQ ID NO: 65336 - protein, 9 aa, Borrelia burgdorferi B31
LIEIQNSPY

SEQ ID NO: 65337 - protein, 9 aa, Borrelia burgdorferi B31
  Xaa can be any naturally occurring amino acid
  VARIANT 8: Xaa = Any Amino Acid
FIKILIKXY

SEQ ID NO: 65338 - protein, 9 aa, Borrelia burgdorferi B31
FISFDKTNF

SEQ ID NO: 65339 - protein, 10 aa, Borrelia burgdorferi B31
NYFFSDFTQY

SEQ ID NO: 65340 - protein, 10 aa, Borrelia burgdorferi B31
KYIEEKVLKY

SEQ ID NO: 65341 - protein, 10 aa, Borrelia burgdorferi B31
KLIEIQNSPY

SEQ ID NO: 65342 - protein, 10 aa, Borrelia burgdorferi B31
TYGWIAFYIY

SEQ ID NO: 65343 - protein, 10 aa, Borrelia burgdorferi B31
  Xaa can be any naturally occurring amino acid
  VARIANT 9: Xaa = Any Amino Acid
IFIKILIKXY

SEQ ID NO: 65344 - protein, 10 aa, Borrelia burgdorferi B31
FEIQNQIFVY

SEQ ID NO: 65345 - protein, 10 aa, Borrelia burgdorferi B31
FLSFYPNIEY

SEQ ID NO: 65346 - protein, 10 aa, Borrelia burgdorferi B31
QIFVYFLSFY

SEQ ID NO: 65347 - protein, 10 aa, Borrelia burgdorferi B31
SAFLEIIMHY

SEQ ID NO: 65348 - protein, 10 aa, Borrelia burgdorferi B31
FFISFDKTNF

SEQ ID NO: 65349 - protein, 10 aa, Borrelia burgdorferi B31
SFDKTNFNPY

SEQ ID NO: 65350 - protein, 10 aa, Borrelia burgdorferi B31
YYSQEKKDIY

SEQ ID NO: 65351 - protein, 10 aa, Borrelia burgdorferi B31
FYPNIEYKHF

SEQ ID NO: 65352 - protein, 10 aa, Borrelia burgdorferi B31
KTLSLNEIFY

SEQ ID NO: 65353 - protein, 10 aa, Borrelia burgdorferi B31
FNTSLEECYY

SEQ ID NO: 65354 - protein, 10 aa, Borrelia burgdorferi B31
LLPAMCYLIY

SEQ ID NO: 65355 - protein, 10 aa, Borrelia burgdorferi B31
FQDTLKCYLY

SEQ ID NO: 65356 - protein, 10 aa, Borrelia burgdorferi B31
QKINPNQLDY

SEQ ID NO: 65357 - protein, 10 aa, Borrelia burgdorferi B31
KLKRMLILTY

SEQ ID NO: 65358 - protein, 10 aa, Borrelia burgdorferi B31
FKFISDILLY

SEQ ID NO: 65359 - protein, 10 aa, Borrelia burgdorferi B31
KTIKKDSEFY

SEQ ID NO: 65360 - protein, 10 aa, Borrelia burgdorferi B31
LNILNKNLKY

SEQ ID NO: 65361 - protein, 10 aa, Borrelia burgdorferi B31
  Xaa can be any naturally occurring amino acid
  VARIANT 7: Xaa = Any Amino Acid
IKILIKXYKY

SEQ ID NO: 65362 - protein, 10 aa, Borrelia burgdorferi B31
VIEKTITKKY

SEQ ID NO: 65363 - protein, 10 aa, Borrelia burgdorferi B31
GSSKNISFNY

SEQ ID NO: 65364 - protein, 10 aa, Borrelia burgdorferi B31
ALKYNEILNY

SEQ ID NO: 65365 - protein, 10 aa, Borrelia burgdorferi B31
AFNTSLEECY

SEQ ID NO: 65366 - protein, 10 aa, Borrelia burgdorferi B31
EIQNQIFVYF

SEQ ID NO: 65367 - protein, 10 aa, Borrelia burgdorferi B31
LIEIQNSPYY

SEQ ID NO: 65368 - protein, 11 aa, Borrelia burgdorferi B31
YFLSFYPNIEY

SEQ ID NO: 65369 - protein, 11 aa, Borrelia burgdorferi B31
YLEEEILALKY

SEQ ID NO: 65370 - protein, 11 aa, Borrelia burgdorferi B31
YVIEKTITKKY

SEQ ID NO: 65371 - protein, 11 aa, Borrelia burgdorferi B31
ILNILNKNLKY

SEQ ID NO: 65372 - protein, 11 aa, Borrelia burgdorferi B31
KLIEIQNSPYY

SEQ ID NO: 65373 - protein, 11 aa, Borrelia burgdorferi B31
TFEIQNQIFVY

SEQ ID NO: 65374 - protein, 11 aa, Borrelia burgdorferi B31
FNYFFSDFTQY

SEQ ID NO: 65375 - protein, 11 aa, Borrelia burgdorferi B31
HFKFISDILLY

SEQ ID NO: 65376 - protein, 11 aa, Borrelia burgdorferi B31
KSAFLEIIMHY

SEQ ID NO: 65377 - protein, 11 aa, Borrelia burgdorferi B31
NLNTKKLGTTY

SEQ ID NO: 65378 - protein, 11 aa, Borrelia burgdorferi B31
ISFDKTNFNPY

SEQ ID NO: 65379 - protein, 11 aa, Borrelia burgdorferi B31
NQIFVYFLSFY

SEQ ID NO: 65380 - protein, 11 aa, Borrelia burgdorferi B31
  Xaa can be any naturally occurring amino acid
  VARIANT 8: Xaa = Any Amino Acid
FIKILIKXYKY

SEQ ID NO: 65381 - protein, 11 aa, Borrelia burgdorferi B31
KLLPAMCYLIY

SEQ ID NO: 65382 - protein, 11 aa, Borrelia burgdorferi B31
NAFNTSLEECY

SEQ ID NO: 65383 - protein, 11 aa, Borrelia burgdorferi B31
NWESFIDALEY

SEQ ID NO: 65384 - protein, 11 aa, Borrelia burgdorferi B31
PYYSQEKKDIY

SEQ ID NO: 65385 - protein, 11 aa, Borrelia burgdorferi B31
DFQDTLKCYLY

SEQ ID NO: 65386 - protein, 11 aa, Borrelia burgdorferi B31
ETYGWIAFYIY

SEQ ID NO: 65387 - protein, 11 aa, Borrelia burgdorferi B31
AFNTSLEECYY

SEQ ID NO: 65388 - protein, 11 aa, Borrelia burgdorferi B31
KGSSKNISFNY

SEQ ID NO: 65389 - protein, 11 aa, Borrelia burgdorferi B31
KFQTEDFFISF

SEQ ID NO: 65390 - protein, 11 aa, Borrelia burgdorferi B31
PYESSIFKERY

SEQ ID NO: 65391 - protein, 11 aa, Borrelia burgdorferi B31
SFYPNIEYKHF

SEQ ID NO: 65392 - protein, 11 aa, Borrelia burgdorferi B31
  Xaa can be any naturally occurring amino acid
  VARIANT 10: Xaa = Any Amino Acid
NIFIKILIKXY

SEQ ID NO: 65393 - protein, 11 aa, Borrelia burgdorferi B31
NIETYGWIAFY

SEQ ID NO: 65394 - protein, 11 aa, Borrelia burgdorferi B31
IIELIKISNDY

SEQ ID NO: 65395 - protein, 9 aa, Borrelia burgdorferi B31
ETYGWIAFY

SEQ ID NO: 65396 - protein, 9 aa, Borrelia burgdorferi B31
YSISSQLYK

SEQ ID NO: 65397 - protein, 9 aa, Borrelia burgdorferi B31
LLEFISFFK

SEQ ID NO: 65398 - protein, 9 aa, Borrelia burgdorferi B31
HINKYIEEK

SEQ ID NO: 65399 - protein, 9 aa, Borrelia burgdorferi B31
EIIMHYVKK

SEQ ID NO: 65400 - protein, 9 aa, Borrelia burgdorferi B31
EIFYKGSSK

SEQ ID NO: 65401 - protein, 9 aa, Borrelia burgdorferi B31
EDFFISFDK

SEQ ID NO: 65402 - protein, 9 aa, Borrelia burgdorferi B31
YVIEKTITK

SEQ ID NO: 65403 - protein, 9 aa, Borrelia burgdorferi B31
ISFFKTKLK

SEQ ID NO: 65404 - protein, 9 aa, Borrelia burgdorferi B31
NSPYYSQEK

SEQ ID NO: 65405 - protein, 9 aa, Borrelia burgdorferi B31
ESRLIKLKR

SEQ ID NO: 65406 - protein, 9 aa, Borrelia burgdorferi B31
NPYESSIFK

SEQ ID NO: 65407 - protein, 9 aa, Borrelia burgdorferi B31
SIFKERYIK

SEQ ID NO: 65408 - protein, 9 aa, Borrelia burgdorferi B31
ESFIDALEY

SEQ ID NO: 65409 - protein, 9 aa, Borrelia burgdorferi B31
ILNYLRALK

SEQ ID NO: 65410 - protein, 9 aa, Borrelia burgdorferi B31
EFISFFKTK

SEQ ID NO: 65411 - protein, 9 aa, Borrelia burgdorferi B31
NLVELKNNR

SEQ ID NO: 65412 - protein, 9 aa, Borrelia burgdorferi B31
NTQNEAIKK

SEQ ID NO: 65413 - protein, 9 aa, Borrelia burgdorferi B31
TSLEECYYK

SEQ ID NO: 65414 - protein, 9 aa, Borrelia burgdorferi B31
LSLNEIFYK

SEQ ID NO: 65415 - protein, 9 aa, Borrelia burgdorferi B31
SFYPNIEYK

SEQ ID NO: 65416 - protein, 9 aa, Borrelia burgdorferi B31
NTSLEECYY

SEQ ID NO: 65417 - protein, 9 aa, Borrelia burgdorferi B31
YIYADNKDK

SEQ ID NO: 65418 - protein, 9 aa, Borrelia burgdorferi B31
YNEILNYLR

SEQ ID NO: 65419 - protein, 9 aa, Borrelia burgdorferi B31
NIRFNLIEK

SEQ ID NO: 65420 - protein, 9 aa, Borrelia burgdorferi B31
NPNQLDYQK

SEQ ID NO: 65421 - protein, 9 aa, Borrelia burgdorferi B31
ESSIFKERY

SEQ ID NO: 65422 - protein, 9 aa, Borrelia burgdorferi B31
SPYYSQEKK

SEQ ID NO: 65423 - protein, 9 aa, Borrelia burgdorferi B31
LVAVRNRNK

SEQ ID NO: 65424 - protein, 9 aa, Borrelia burgdorferi B31
NIFIKILIK

SEQ ID NO: 65425 - protein, 9 aa, Borrelia burgdorferi B31
CLSKNIFIK

SEQ ID NO: 65426 - protein, 9 aa, Borrelia burgdorferi B31
ITIPKKIIK

SEQ ID NO: 65427 - protein, 9 aa, Borrelia burgdorferi B31
TIDILVAVR

SEQ ID NO: 65428 - protein, 9 aa, Borrelia burgdorferi B31
YLTWFFKDK

SEQ ID NO: 65429 - protein, 9 aa, Borrelia burgdorferi B31
SSQLYKLEK

SEQ ID NO: 65430 - protein, 9 aa, Borrelia burgdorferi B31
SSLTNKESR

SEQ ID NO: 65431 - protein, 9 aa, Borrelia burgdorferi B31
SYLLIKSLK

SEQ ID NO: 65432 - protein, 9 aa, Borrelia burgdorferi B31
LSFYPNIEY

SEQ ID NO: 65433 - protein, 9 aa, Borrelia burgdorferi B31
SSKNISFNY

SEQ ID NO: 65434 - protein, 9 aa, Borrelia burgdorferi B31
IFVYFLSFY

SEQ ID NO: 65435 - protein, 9 aa, Borrelia burgdorferi B31
DILVAVRNR

SEQ ID NO: 65436 - protein, 9 aa, Borrelia burgdorferi B31
EIQNQIFVY

SEQ ID NO: 65437 - protein, 9 aa, Borrelia burgdorferi B31
ILNKNLKYR

SEQ ID NO: 65438 - protein, 9 aa, Borrelia burgdorferi B31
FVYFLSFYP

SEQ ID NO: 65439 - protein, 9 aa, Borrelia burgdorferi B31
ISNDYEKEK

SEQ ID NO: 65440 - protein, 9 aa, Borrelia burgdorferi B31
NKNFIQISK

SEQ ID NO: 65441 - protein, 9 aa, Borrelia burgdorferi B31
YESSIFKER

SEQ ID NO: 65442 - protein, 9 aa, Borrelia burgdorferi B31
LNILNKNLK

SEQ ID NO: 65443 - protein, 9 aa, Borrelia burgdorferi B31
ELIKISNDY

SEQ ID NO: 65444 - protein, 9 aa, Borrelia burgdorferi B31
NYFFSDFTQ

SEQ ID NO: 65445 - protein, 9 aa, Borrelia burgdorferi B31
TLSLNEIFY

SEQ ID NO: 65446 - protein, 9 aa, Borrelia burgdorferi B31
FYDSLATLK

SEQ ID NO: 65447 - protein, 9 aa, Borrelia burgdorferi B31
YFFSDFTQY

SEQ ID NO: 65448 - protein, 9 aa, Borrelia burgdorferi B31
KLKSSNFLK

SEQ ID NO: 65449 - protein, 9 aa, Borrelia burgdorferi B31
LVELKNNRK

SEQ ID NO: 65450 - protein, 9 aa, Borrelia burgdorferi B31
LLIKSLKTR

SEQ ID NO: 65451 - protein, 9 aa, Borrelia burgdorferi B31
TIKKDSEFY

SEQ ID NO: 65452 - protein, 9 aa, Borrelia burgdorferi B31
IYADNKDKK

SEQ ID NO: 65453 - protein, 9 aa, Borrelia burgdorferi B31
  Xaa can be any naturally occurring amino acid
  VARIANT 7: Xaa = Any Amino Acid
IKILIKXYK

SEQ ID NO: 65454 - protein, 9 aa, Borrelia burgdorferi B31
NISFNYFFS

SEQ ID NO: 65455 - protein, 9 aa, Borrelia burgdorferi B31
ILLYLDENK

SEQ ID NO: 65456 - protein, 9 aa, Borrelia burgdorferi B31
ELKNNRKIK

SEQ ID NO: 65457 - protein, 9 aa, Borrelia burgdorferi B31
IKISNDYEK

SEQ ID NO: 65458 - protein, 9 aa, Borrelia burgdorferi B31
WILEIVRNK

SEQ ID NO: 65459 - protein, 9 aa, Borrelia burgdorferi B31
ENKITIPKK

SEQ ID NO: 65460 - protein, 9 aa, Borrelia burgdorferi B31
DENKITIPK

SEQ ID NO: 65461 - protein, 9 aa, Borrelia burgdorferi B31
AFYIYADNK

SEQ ID NO: 65462 - protein, 9 aa, Borrelia burgdorferi B31
KIKEIITAK

SEQ ID NO: 65463 - protein, 9 aa, Borrelia burgdorferi B31
LKIIIKNIR

SEQ ID NO: 65464 - protein, 9 aa, Borrelia burgdorferi B31
CQRMKEFFK

SEQ ID NO: 65465 - protein, 9 aa, Borrelia burgdorferi B31
LEIIMHYVK

SEQ ID NO: 65466 - protein, 10 aa, Borrelia burgdorferi B31
QTIDILVAVR

SEQ ID NO: 65467 - protein, 10 aa, Borrelia burgdorferi B31
NTSLEECYYK

SEQ ID NO: 65468 - protein, 10 aa, Borrelia burgdorferi B31
EFYDSLATLK

SEQ ID NO: 65469 - protein, 10 aa, Borrelia burgdorferi B31
IAFYIYADNK

SEQ ID NO: 65470 - protein, 10 aa, Borrelia burgdorferi B31
LSFYPNIEYK

SEQ ID NO: 65471 - protein, 10 aa, Borrelia burgdorferi B31
YVIEKTITKK

SEQ ID NO: 65472 - protein, 10 aa, Borrelia burgdorferi B31
FISFFKTKLK

SEQ ID NO: 65473 - protein, 10 aa, Borrelia burgdorferi B31
SLLEFISFFK

SEQ ID NO: 65474 - protein, 10 aa, Borrelia burgdorferi B31
EILNYLRALK

SEQ ID NO: 65475 - protein, 10 aa, Borrelia burgdorferi B31
TLSLNEIFYK

SEQ ID NO: 65476 - protein, 10 aa, Borrelia burgdorferi B31
YIYADNKDKK

SEQ ID NO: 65477 - protein, 10 aa, Borrelia burgdorferi B31
NTKKLGTTYK

SEQ ID NO: 65478 - protein, 10 aa, Borrelia burgdorferi B31
ETYGWIAFYI

SEQ ID NO: 65479 - protein, 10 aa, Borrelia burgdorferi B31
NSPYYSQEKK

SEQ ID NO: 65480 - protein, 10 aa, Borrelia burgdorferi B31
SSIFKERYIK

SEQ ID NO: 65481 - protein, 10 aa, Borrelia burgdorferi B31
LIKISNDYEK

SEQ ID NO: 65482 - protein, 10 aa, Borrelia burgdorferi B31
QIFVYFLSFY

SEQ ID NO: 65483 - protein, 10 aa, Borrelia burgdorferi B31
SAFLEIIMHY

SEQ ID NO: 65484 - protein, 10 aa, Borrelia burgdorferi B31
  Xaa can be any naturally occurring amino acid
  VARIANT 8: Xaa = Any Amino Acid
FIKILIKXYK

SEQ ID NO: 65485 - protein, 10 aa, Borrelia burgdorferi B31
NYFFSDFTQY

SEQ ID NO: 65486 - protein, 10 aa, Borrelia burgdorferi B31
FLEIIMHYVK

SEQ ID NO: 65487 - protein, 10 aa, Borrelia burgdorferi B31
NILNKNLKYR

SEQ ID NO: 65488 - protein, 10 aa, Borrelia burgdorferi B31
KSYLLIKSLK

SEQ ID NO: 65489 - protein, 10 aa, Borrelia burgdorferi B31
DALEYIEKHK

SEQ ID NO: 65490 - protein, 10 aa, Borrelia burgdorferi B31
KVFKSSLTNK

SEQ ID NO: 65491 - protein, 10 aa, Borrelia burgdorferi B31
YPNIEYKHFK

SEQ ID NO: 65492 - protein, 10 aa, Borrelia burgdorferi B31
ISSQLYKLEK

SEQ ID NO: 65493 - protein, 10 aa, Borrelia burgdorferi B31
LTNKESRLIK

SEQ ID NO: 65494 - protein, 10 aa, Borrelia burgdorferi B31
DILLYLDENK

SEQ ID NO: 65495 - protein, 10 aa, Borrelia burgdorferi B31
KYNEILNYLR

SEQ ID NO: 65496 - protein, 10 aa, Borrelia burgdorferi B31
ILVAVRNRNK

SEQ ID NO: 65497 - protein, 10 aa, Borrelia burgdorferi B31
NLVELKNNRK

SEQ ID NO: 65498 - protein, 10 aa, Borrelia burgdorferi B31
TKKYLTWFFK

SEQ ID NO: 65499 - protein, 10 aa, Borrelia burgdorferi B31
FYIYADNKDK

SEQ ID NO: 65500 - protein, 10 aa, Borrelia burgdorferi B31
ILNILNKNLK

SEQ ID NO: 65501 - protein, 10 aa, Borrelia burgdorferi B31
LIKSLKTRSR

SEQ ID NO: 65502 - protein, 10 aa, Borrelia burgdorferi B31
LATLKKHINK

SEQ ID NO: 65503 - protein, 10 aa, Borrelia burgdorferi B31
FSDFTQYAPK

SEQ ID NO: 65504 - protein, 10 aa, Borrelia burgdorferi B31
ILKIIIKNIR

SEQ ID NO: 65505 - protein, 10 aa, Borrelia burgdorferi B31
YSQEKKDIYK

SEQ ID NO: 65506 - protein, 10 aa, Borrelia burgdorferi B31
FIDALEYIEK

SEQ ID NO: 65507 - protein, 10 aa, Borrelia burgdorferi B31
IYCENLVELK

SEQ ID NO: 65508 - protein, 10 aa, Borrelia burgdorferi B31
NLKYRPENQK

SEQ ID NO: 65509 - protein, 10 aa, Borrelia burgdorferi B31
KSSLTNKESR

SEQ ID NO: 65510 - protein, 10 aa, Borrelia burgdorferi B31
YLEEEILALK

SEQ ID NO: 65511 - protein, 10 aa, Borrelia burgdorferi B31
FNPYESSIFK

SEQ ID NO: 65512 - protein, 10 aa, Borrelia burgdorferi B31
TTYKLKSSNF

SEQ ID NO: 65513 - protein, 10 aa, Borrelia burgdorferi B31
EKIKEIITAK

SEQ ID NO: 65514 - protein, 10 aa, Borrelia burgdorferi B31
ISKEANLNTK

SEQ ID NO: 65515 - protein, 10 aa, Borrelia burgdorferi B31
FLSFYPNIEY

SEQ ID NO: 65516 - protein, 10 aa, Borrelia burgdorferi B31
QNSPYYSQEK

SEQ ID NO: 65517 - protein, 10 aa, Borrelia burgdorferi B31
TYGWIAFYIY

SEQ ID NO: 65518 - protein, 10 aa, Borrelia burgdorferi B31
TYWPVGCLSK

SEQ ID NO: 65519 - protein, 10 aa, Borrelia burgdorferi B31
TEDFFISFDK

SEQ ID NO: 65520 - protein, 10 aa, Borrelia burgdorferi B31
SFFKTKLKQK

SEQ ID NO: 65521 - protein, 10 aa, Borrelia burgdorferi B31
FVYFLSFYPN

SEQ ID NO: 65522 - protein, 10 aa, Borrelia burgdorferi B31
NEIFYKGSSK

SEQ ID NO: 65523 - protein, 10 aa, Borrelia burgdorferi B31
IDILVAVRNR

SEQ ID NO: 65524 - protein, 10 aa, Borrelia burgdorferi B31
FNYFFSDFTQ

SEQ ID NO: 65525 - protein, 10 aa, Borrelia burgdorferi B31
LTYWPVGCLS

SEQ ID NO: 65526 - protein, 10 aa, Borrelia burgdorferi B31
IPKKIIKIQK

SEQ ID NO: 65527 - protein, 10 aa, Borrelia burgdorferi B31
YKLKSSNFLK

SEQ ID NO: 65528 - protein, 10 aa, Borrelia burgdorferi B31
KTIKKDSEFY

SEQ ID NO: 65529 - protein, 10 aa, Borrelia burgdorferi B31
SLKTRSRILK

SEQ ID NO: 65530 - protein, 10 aa, Borrelia burgdorferi B31
DENKITIPKK

SEQ ID NO: 65531 - protein, 10 aa, Borrelia burgdorferi B31
LYVIEKTITK

SEQ ID NO: 65532 - protein, 11 aa, Borrelia burgdorferi B31
ETYGWIAFYIY

SEQ ID NO: 65533 - protein, 11 aa, Borrelia burgdorferi B31
ELIKISNDYEK

SEQ ID NO: 65534 - protein, 11 aa, Borrelia burgdorferi B31
WIAFYIYADNK

SEQ ID NO: 65535 - protein, 11 aa, Borrelia burgdorferi B31
ESSIFKERYIK

SEQ ID NO: 65536 - protein, 11 aa, Borrelia burgdorferi B31
LTYWPVGCLSK

SEQ ID NO: 65537 - protein, 11 aa, Borrelia burgdorferi B31
QTEDFFISFDK

SEQ ID NO: 65538 - protein, 11 aa, Borrelia burgdorferi B31
FLSFYPNIEYK

SEQ ID NO: 65539 - protein, 11 aa, Borrelia burgdorferi B31
EFYDSLATLKK

SEQ ID NO: 65540 - protein, 11 aa, Borrelia burgdorferi B31
NSLLEFISFFK

SEQ ID NO: 65541 - protein, 11 aa, Borrelia burgdorferi B31
NPYESSIFKER

SEQ ID NO: 65542 - protein, 11 aa, Borrelia burgdorferi B31
ITKKYLTWFFK

SEQ ID NO: 65543 - protein, 11 aa, Borrelia burgdorferi B31
EFISFFKTKLK

SEQ ID NO: 65544 - protein, 11 aa, Borrelia burgdorferi B31
LIYCENLVELK

SEQ ID NO: 65545 - protein, 11 aa, Borrelia burgdorferi B31
FYPNIEYKHFK

SEQ ID NO: 65546 - protein, 11 aa, Borrelia burgdorferi B31
NFNPYESSIFK

SEQ ID NO: 65547 - protein, 11 aa, Borrelia burgdorferi B31
YLYVIEKTITK

SEQ ID NO: 65548 - protein, 11 aa, Borrelia burgdorferi B31
ISFFKTKLKQK

SEQ ID NO: 65549 - protein, 11 aa, Borrelia burgdorferi B31
SISSQLYKLEK

SEQ ID NO: 65550 - protein, 11 aa, Borrelia burgdorferi B31
KTLSLNEIFYK

SEQ ID NO: 65551 - protein, 11 aa, Borrelia burgdorferi B31
FYIYADNKDKK

SEQ ID NO: 65552 - protein, 11 aa, Borrelia burgdorferi B31
TLKCYLYVIEK

SEQ ID NO: 65553 - protein, 11 aa, Borrelia burgdorferi B31
NQIFVYFLSFY

SEQ ID NO: 65554 - protein, 11 aa, Borrelia burgdorferi B31
  Xaa can be any naturally occurring amino acid
  VARIANT 9: Xaa = Any Amino Acid
IFIKILIKXYK

SEQ ID NO: 65555 - protein, 11 aa, Borrelia burgdorferi B31
FNTSLEECYYK

SEQ ID NO: 65556 - protein, 11 aa, Borrelia burgdorferi B31
NAFNTSLEECY

SEQ ID NO: 65557 - protein, 11 aa, Borrelia burgdorferi B31
TYKLKSSNFLK

SEQ ID NO: 65558 - protein, 11 aa, Borrelia burgdorferi B31
IFCQRMKEFFK

SEQ ID NO: 65559 - protein, 11 aa, Borrelia burgdorferi B31
EQTIDILVAVR

SEQ ID NO: 65560 - protein, 11 aa, Borrelia burgdorferi B31
QISKEANLNTK

SEQ ID NO: 65561 - protein, 11 aa, Borrelia burgdorferi B31
YAPKDFQDTLK

SEQ ID NO: 65562 - protein, 11 aa, Borrelia burgdorferi B31
LKYNEILNYLR

SEQ ID NO: 65563 - protein, 11 aa, Borrelia burgdorferi B31
FFSDFTQYAPK

SEQ ID NO: 65564 - protein, 11 aa, Borrelia burgdorferi B31
SFIDALEYIEK

SEQ ID NO: 65565 - protein, 11 aa, Borrelia burgdorferi B31
TIPKKIIKIQK

SEQ ID NO: 65566 - protein, 11 aa, Borrelia burgdorferi B31
FNYFFSDFTQY

SEQ ID NO: 65567 - protein, 11 aa, Borrelia burgdorferi B31
LKYSISSQLYK

SEQ ID NO: 65568 - protein, 11 aa, Borrelia burgdorferi B31
TTYKLKSSNFL

SEQ ID NO: 65569 - protein, 11 aa, Borrelia burgdorferi B31
TIDILVAVRNR

SEQ ID NO: 65570 - protein, 11 aa, Borrelia burgdorferi B31
LLEFISFFKTK

SEQ ID NO: 65571 - protein, 11 aa, Borrelia burgdorferi B31
LVAVRNRNKIK

SEQ ID NO: 65572 - protein, 11 aa, Borrelia burgdorferi B31
FLEIIMHYVKK

SEQ ID NO: 65573 - protein, 11 aa, Borrelia burgdorferi B31
LNILNKNLKYR

SEQ ID NO: 65574 - protein, 11 aa, Borrelia burgdorferi B31
SEFYDSLATLK

SEQ ID NO: 65575 - protein, 11 aa, Borrelia burgdorferi B31
DNKDKKIFCQR

SEQ ID NO: 65576 - protein, 11 aa, Borrelia burgdorferi B31
LLIKSLKTRSR

SEQ ID NO: 65577 - protein, 11 aa, Borrelia burgdorferi B31
NEILNYLRALK

SEQ ID NO: 65578 - protein, 11 aa, Borrelia burgdorferi B31
YVIEKTITKKY

SEQ ID NO: 65579 - protein, 11 aa, Borrelia burgdorferi B31
RILKIIIKNIR

SEQ ID NO: 65580 - protein, 11 aa, Borrelia burgdorferi B31
ISFDKTNFNPY

SEQ ID NO: 65581 - protein, 11 aa, Borrelia burgdorferi B31
SLATLKKHINK

SEQ ID NO: 65582 - protein, 11 aa, Borrelia burgdorferi B31
YYSQEKKDIYK

SEQ ID NO: 65583 - protein, 11 aa, Borrelia burgdorferi B31
FKSSLTNKESR

SEQ ID NO: 65584 - protein, 11 aa, Borrelia burgdorferi B31
ITAKFQTEDFF

SEQ ID NO: 65585 - protein, 11 aa, Borrelia burgdorferi B31
ISKEANLNTKK

SEQ ID NO: 65586 - protein, 11 aa, Borrelia burgdorferi B31
LIEKLEDENEK

SEQ ID NO: 65587 - protein, 11 aa, Borrelia burgdorferi B31
KTKLKQKINFK

SEQ ID NO: 65588 - protein, 11 aa, Borrelia burgdorferi B31
ESFIDALEYIE

SEQ ID NO: 65589 - protein, 11 aa, Borrelia burgdorferi B31
KINPNQLDYQK

SEQ ID NO: 65590 - protein, 11 aa, Borrelia burgdorferi B31
YYKNTQNEAIK

SEQ ID NO: 65591 - protein, 11 aa, Borrelia burgdorferi B31
KSAFLEIIMHY

SEQ ID NO: 65592 - protein, 11 aa, Borrelia burgdorferi B31
YIEKHKLINIK

SEQ ID NO: 65593 - protein, 11 aa, Borrelia burgdorferi B31
NIETYGWIAFY

SEQ ID NO: 65594 - protein, 11 aa, Borrelia burgdorferi B31
INKYIEEKVLK

SEQ ID NO: 65595 - protein, 11 aa, Borrelia burgdorferi B31
SYLLIKSLKTR

SEQ ID NO: 65596 - protein, 11 aa, Borrelia burgdorferi B31
AIKKWILEIVR

SEQ ID NO: 65597 - protein, 11 aa, Borrelia burgdorferi B31
DILVAVRNRNK

SEQ ID NO: 65598 - protein, 11 aa, Borrelia burgdorferi B31
SSKNISFNYFF

SEQ ID NO: 65599 - protein, 11 aa, Borrelia burgdorferi B31
HFKFISDILLY

SEQ ID NO: 65600 - protein, 11 aa, Borrelia burgdorferi B31
KILNILNKNLK

SEQ ID NO: 65601 - protein, 11 aa, Borrelia burgdorferi B31
QKSYLLIKSLK

SEQ ID NO: 65602 - protein, 11 aa, Borrelia burgdorferi B31
NKIKILNILNK

SEQ ID NO: 65603 - protein, 11 aa, Borrelia burgdorferi B31
LYVIEKTITKK

SEQ ID NO: 65604 - protein, 11 aa, Borrelia burgdorferi B31
SLTNKESRLIK

SEQ ID NO: 65605 - protein, 11 aa, Borrelia burgdorferi B31
ISFNYFFSDFT

SEQ ID NO: 65606 - protein, 11 aa, Borrelia burgdorferi B31
QNSPYYSQEKK

SEQ ID NO: 65607 - protein, 11 aa, Borrelia burgdorferi B31
FSSNINIDSLE

SEQ ID NO: 65608 - protein, 11 aa, Borrelia burgdorferi B31
LSFYPNIEYKH

SEQ ID NO: 65609 - protein, 11 aa, Borrelia burgdorferi B31
CENLVELKNNR

SEQ ID NO: 65610 - protein, 9 aa, Borrelia burgdorferi B31
APKDFQDTL

SEQ ID NO: 65611 - protein, 9 aa, Borrelia burgdorferi B31
KERYIKSAF

SEQ ID NO: 65612 - protein, 9 aa, Borrelia burgdorferi B31
YPNIEYKHF

SEQ ID NO: 65613 - protein, 9 aa, Borrelia burgdorferi B31
VAVRNRNKI

SEQ ID NO: 65614 - protein, 10 aa, Borrelia burgdorferi B31
AVRNRNKIKI

SEQ ID NO: 65615 - protein, 10 aa, Borrelia burgdorferi B31
YLRALKTLSL

SEQ ID NO: 65616 - protein, 10 aa, Borrelia burgdorferi B31
IVRNKNFIQI

SEQ ID NO: 65617 - protein, 10 aa, Borrelia burgdorferi B31
WPVGCLSKNI

SEQ ID NO: 65618 - protein, 10 aa, Borrelia burgdorferi B31
LPAMCYLIYC

SEQ ID NO: 65619 - protein, 11 aa, Borrelia burgdorferi B31
AVRNRNKIKIL

SEQ ID NO: 65620 - protein, 11 aa, Borrelia burgdorferi B31
WPVGCLSKNIF

SEQ ID NO: 65621 - protein, 11 aa, Borrelia burgdorferi B31
SPYYSQEKKDI

SEQ ID NO: 65622 - protein, 11 aa, Borrelia burgdorferi B31
YPNIEYKHFKF

SEQ ID NO: 65623 - protein, 11 aa, Borrelia burgdorferi B31
RPENQKVFKSS

SEQ ID NO: 65624 - protein, 11 aa, Borrelia burgdorferi B31
APKDFQDTLKC

SEQ ID NO: 65625 - protein, 11 aa, Borrelia burgdorferi B31
IPKKIIKIQKI

SEQ ID NO: 65626 - protein, 11 aa, Borrelia burgdorferi B31
KVLKYSISSQL

SEQ ID NO: 65627 - protein, 9 aa, Borrelia burgdorferi B31
SLKTRSRIL

SEQ ID NO: 65628 - protein, 9 aa, Borrelia burgdorferi B31
FFKSKTFEI

SEQ ID NO: 65629 - protein, 9 aa, Borrelia burgdorferi B31
LIKLKRMLI

SEQ ID NO: 65630 - protein, 9 aa, Borrelia burgdorferi B31
RLIKLKRML

SEQ ID NO: 65631 - protein, 9 aa, Borrelia burgdorferi B31
YLYVIEKTI

SEQ ID NO: 65632 - protein, 9 aa, Borrelia burgdorferi B31
  Xaa can be any naturally occurring amino acid
  VARIANT 5: Xaa = Any Amino Acid
ILIKXYKYL

SEQ ID NO: 65633 - protein, 9 aa, Borrelia burgdorferi B31
YIKSAFLEI

SEQ ID NO: 65634 - protein, 10 aa, Borrelia burgdorferi B31
YLRALKTLSL

SEQ ID NO: 65635 - protein, 10 aa, Borrelia burgdorferi B31
LIKLKRMLIL

SEQ ID NO: 65636 - protein, 10 aa, Borrelia burgdorferi B31
FFKTKLKQKI

SEQ ID NO: 65637 - protein, 10 aa, Borrelia burgdorferi B31
ILALKYNEIL

SEQ ID NO: 65638 - protein, 10 aa, Borrelia burgdorferi B31
YIKSAFLEII

SEQ ID NO: 65639 - protein, 10 aa, Borrelia burgdorferi B31
YYKNTQNEAI

SEQ ID NO: 65640 - protein, 10 aa, Borrelia burgdorferi B31
FKERYIKSAF

SEQ ID NO: 65641 - protein, 11 aa, Borrelia burgdorferi B31
IFKERYIKSAF

SEQ ID NO: 65642 - protein, 11 aa, Borrelia burgdorferi B31
RMKEFFKSKTF

SEQ ID NO: 65643 - protein, 11 aa, Borrelia burgdorferi B31
RLIKLKRMLIL

SEQ ID NO: 65644 - protein, 11 aa, Borrelia burgdorferi B31
YIKSAFLEIIM

SEQ ID NO: 65645 - protein, 11 aa, Borrelia burgdorferi B31
IPKKIIKIQKI

SEQ ID NO: 65646 - protein, 11 aa, Borrelia burgdorferi B31
YQKSYLLIKSL

SEQ ID NO: 65647 - protein, 9 aa, Borrelia burgdorferi B31
LSFYPNIEY

SEQ ID NO: 65648 - protein, 9 aa, Borrelia burgdorferi B31
IQNQIFVYF

SEQ ID NO: 65649 - protein, 9 aa, Borrelia burgdorferi B31
NQLDYQKSY

SEQ ID NO: 65650 - protein, 9 aa, Borrelia burgdorferi B31
QIFVYFLSF

SEQ ID NO: 65651 - protein, 9 aa, Borrelia burgdorferi B31
SSKNISFNY

SEQ ID NO: 65652 - protein, 9 aa, Borrelia burgdorferi B31
SLLEFISFF

SEQ ID NO: 65653 - protein, 9 aa, Borrelia burgdorferi B31
  Xaa can be any naturally occurring amino acid
  VARIANT 8: Xaa = Any Amino Acid
FIKILIKXY

SEQ ID NO: 65654 - protein, 9 aa, Borrelia burgdorferi B31
YLEEEILAL

SEQ ID NO: 65655 - protein, 9 aa, Borrelia burgdorferi B31
ETYGWIAFY

SEQ ID NO: 65656 - protein, 9 aa, Borrelia burgdorferi B31
KISNNWESF

SEQ ID NO: 65657 - protein, 9 aa, Borrelia burgdorferi B31
TLKKHINKY

SEQ ID NO: 65658 - protein, 9 aa, Borrelia burgdorferi B31
KTIKKDSEF

SEQ ID NO: 65659 - protein, 9 aa, Borrelia burgdorferi B31
KINPNQLDY

SEQ ID NO: 65660 - protein, 9 aa, Borrelia burgdorferi B31
ELIKISNDY

SEQ ID NO: 65661 - protein, 9 aa, Borrelia burgdorferi B31
NTKKLGTTY

SEQ ID NO: 65662 - protein, 9 aa, Borrelia burgdorferi B31
ESFIDALEY

SEQ ID NO: 65663 - protein, 9 aa, Borrelia burgdorferi B31
LIEIQNSPY

SEQ ID NO: 65664 - protein, 9 aa, Borrelia burgdorferi B31
IQISKEANL

SEQ ID NO: 65665 - protein, 9 aa, Borrelia burgdorferi B31
YSQEKKDIY

SEQ ID NO: 65666 - protein, 9 aa, Borrelia burgdorferi B31
YIEEKVLKY

SEQ ID NO: 65667 - protein, 9 aa, Borrelia burgdorferi B31
IQKINPNQL

SEQ ID NO: 65668 - protein, 9 aa, Borrelia burgdorferi B31
NQKVFKSSL

SEQ ID NO: 65669 - protein, 9 aa, Borrelia burgdorferi B31
YFFSDFTQY

SEQ ID NO: 65670 - protein, 9 aa, Borrelia burgdorferi B31
IEIQNSPYY

SEQ ID NO: 65671 - protein, 9 aa, Borrelia burgdorferi B31
AFLEIIMHY

SEQ ID NO: 65672 - protein, 9 aa, Borrelia burgdorferi B31
KFISDILLY

SEQ ID NO: 65673 - protein, 9 aa, Borrelia burgdorferi B31
QTEDFFISF

SEQ ID NO: 65674 - protein, 9 aa, Borrelia burgdorferi B31
TQNEAIKKW

SEQ ID NO: 65675 - protein, 9 aa, Borrelia burgdorferi B31
KIIIKNIRF

SEQ ID NO: 65676 - protein, 9 aa, Borrelia burgdorferi B31
KQIILNFSS

SEQ ID NO: 65677 - protein, 9 aa, Borrelia burgdorferi B31
IETYGWIAF

SEQ ID NO: 65678 - protein, 9 aa, Borrelia burgdorferi B31
TLSLNEIFY

SEQ ID NO: 65679 - protein, 9 aa, Borrelia burgdorferi B31
KNSQNIETY

SEQ ID NO: 65680 - protein, 9 aa, Borrelia burgdorferi B31
FDKTNFNPY

SEQ ID NO: 65681 - protein, 9 aa, Borrelia burgdorferi B31
SQNIETYGW

SEQ ID NO: 65682 - protein, 10 aa, Borrelia burgdorferi B31
KLIEIQNSPY

SEQ ID NO: 65683 - protein, 10 aa, Borrelia burgdorferi B31
FQTEDFFISF

SEQ ID NO: 65684 - protein, 10 aa, Borrelia burgdorferi B31
NQIFVYFLSF

SEQ ID NO: 65685 - protein, 10 aa, Borrelia burgdorferi B31
KTFEIQNQIF

SEQ ID NO: 65686 - protein, 10 aa, Borrelia burgdorferi B31
KLKRMLILTY

SEQ ID NO: 65687 - protein, 10 aa, Borrelia burgdorferi B31
FLSFYPNIEY

SEQ ID NO: 65688 - protein, 10 aa, Borrelia burgdorferi B31
YLRALKTLSL

SEQ ID NO: 65689 - protein, 10 aa, Borrelia burgdorferi B31
ALKYNEILNY

SEQ ID NO: 65690 - protein, 10 aa, Borrelia burgdorferi B31
KIKEIITAKF

SEQ ID NO: 65691 - protein, 10 aa, Borrelia burgdorferi B31
SSKNISFNYF

SEQ ID NO: 65692 - protein, 10 aa, Borrelia burgdorferi B31
SAFLEIIMHY

SEQ ID NO: 65693 - protein, 10 aa, Borrelia burgdorferi B31
ISFNYFFSDF

SEQ ID NO: 65694 - protein, 10 aa, Borrelia burgdorferi B31
QIFVYFLSFY

SEQ ID NO: 65695 - protein, 10 aa, Borrelia burgdorferi B31
KQKINFKKEL

SEQ ID NO: 65696 - protein, 10 aa, Borrelia burgdorferi B31
LLPAMCYLIY

SEQ ID NO: 65697 - protein, 10 aa, Borrelia burgdorferi B31
KTIKKDSEFY

SEQ ID NO: 65698 - protein, 10 aa, Borrelia burgdorferi B31
IQNQIFVYFL

SEQ ID NO: 65699 - protein, 10 aa, Borrelia burgdorferi B31
FEIQNQIFVY

SEQ ID NO: 65700 - protein, 10 aa, Borrelia burgdorferi B31
KIFCQRMKEF

SEQ ID NO: 65701 - protein, 10 aa, Borrelia burgdorferi B31
  Xaa can be any naturally occurring amino acid
  VARIANT 9: Xaa = Any Amino Acid
IFIKILIKXY

SEQ ID NO: 65702 - protein, 10 aa, Borrelia burgdorferi B31
ITAKFQTEDF

SEQ ID NO: 65703 - protein, 10 aa, Borrelia burgdorferi B31
GSSKNISFNY

SEQ ID NO: 65704 - protein, 10 aa, Borrelia burgdorferi B31
FQDTLKCYLY

SEQ ID NO: 65705 - protein, 10 aa, Borrelia burgdorferi B31
WESFIDALEY

SEQ ID NO: 65706 - protein, 10 aa, Borrelia burgdorferi B31
VLKYSISSQL

SEQ ID NO: 65707 - protein, 11 aa, Borrelia burgdorferi B31
RMKEFFKSKTF

SEQ ID NO: 65708 - protein, 11 aa, Borrelia burgdorferi B31
ISFDKTNFNPY

SEQ ID NO: 65709 - protein, 11 aa, Borrelia burgdorferi B31
YVIEKTITKKY

SEQ ID NO: 65710 - protein, 11 aa, Borrelia burgdorferi B31
KLIEIQNSPYY

SEQ ID NO: 65711 - protein, 11 aa, Borrelia burgdorferi B31
IQKINPNQLDY

SEQ ID NO: 65712 - protein, 11 aa, Borrelia burgdorferi B31
VLKYSISSQLY

SEQ ID NO: 65713 - protein, 11 aa, Borrelia burgdorferi B31
YQKSYLLIKSL

SEQ ID NO: 65714 - protein, 11 aa, Borrelia burgdorferi B31
QNIETYGWIAF

SEQ ID NO: 65715 - protein, 11 aa, Borrelia burgdorferi B31
KSNEKNSLLEF

SEQ ID NO: 65716 - protein, 11 aa, Borrelia burgdorferi B31
NQIFVYFLSFY

SEQ ID NO: 65717 - protein, 11 aa, Borrelia burgdorferi B31
YLEEEILALKY

SEQ ID NO: 65718 - protein, 11 aa, Borrelia burgdorferi B31
ILNILNKNLKY

SEQ ID NO: 65719 - protein, 11 aa, Borrelia burgdorferi B31
IFKERYIKSAF

SEQ ID NO: 65720 - protein, 11 aa, Borrelia burgdorferi B31
KSAFLEIIMHY

SEQ ID NO: 65721 - protein, 11 aa, Borrelia burgdorferi B31
ALKTLSLNEIF

SEQ ID NO: 65722 - protein, 11 aa, Borrelia burgdorferi B31
KLLPAMCYLIY

SEQ ID NO: 65723 - protein, 11 aa, Borrelia burgdorferi B31
ILKIIIKNIRF

SEQ ID NO: 65724 - protein, 11 aa, Borrelia burgdorferi B31
YFLSFYPNIEY

SEQ ID NO: 65725 - protein, 11 aa, Borrelia burgdorferi B31
WILEIVRNKNF

SEQ ID NO: 65726 - protein, 11 aa, Borrelia burgdorferi B31
KQIILNFSSNI

SEQ ID NO: 65727 - protein, 11 aa, Borrelia burgdorferi B31
YLIYCENLVEL

SEQ ID NO: 65728 - protein, 11 aa, Borrelia burgdorferi B31
SSKNISFNYFF

SEQ ID NO: 65729 - protein, 11 aa, Borrelia burgdorferi B31
ETYGWIAFYIY

SEQ ID NO: 65730 - protein, 11 aa, Borrelia burgdorferi B31
FYKGSSKNISF

SEQ ID NO: 65731 - protein, 11 aa, Borrelia burgdorferi B31
  Xaa can be any naturally occurring amino acid
  VARIANT 8: Xaa = Any Amino Acid
FIKILIKXYKY

SEQ ID NO: 65732 - protein, 11 aa, Borrelia burgdorferi B31
NLNTKKLGTTY

SEQ ID NO: 65733 - protein, 11 aa, Borrelia burgdorferi B31
KQKINFKKELM

SEQ ID NO: 65734 - protein, 11 aa, Borrelia burgdorferi B31
TNFNPYESSIF

SEQ ID NO: 65735 - protein, 11 aa, Borrelia burgdorferi B31
KFQTEDFFISF

SEQ ID NO: 65736 - protein, 11 aa, Borrelia burgdorferi B31
NAFNTSLEECY

SEQ ID NO: 65737 - protein, 11 aa, Borrelia burgdorferi B31
TQNEAIKKWIL

SEQ ID NO: 65738 - protein, 11 aa, Borrelia burgdorferi B31
GSSKNISFNYF

SEQ ID NO: 65739 - protein, 11 aa, Borrelia burgdorferi B31
HFKFISDILLY

SEQ ID NO: 65740 - protein, 9 aa, Borrelia burgdorferi B31
SRILKIIIK

SEQ ID NO: 65741 - protein, 9 aa, Borrelia burgdorferi B31
LRALKTLSL

SEQ ID NO: 65742 - protein, 9 aa, Borrelia burgdorferi B31
KRMLILTYW

SEQ ID NO: 65743 - protein, 9 aa, Borrelia burgdorferi B31
IRFNLIEKL

SEQ ID NO: 65744 - protein, 9 aa, Borrelia burgdorferi B31
KKLGTTYKL

SEQ ID NO: 65745 - protein, 9 aa, Borrelia burgdorferi B31
ERYIKSAFL

SEQ ID NO: 65746 - protein, 9 aa, Borrelia burgdorferi B31
YRPENQKVF

SEQ ID NO: 65747 - protein, 9 aa, Borrelia burgdorferi B31
SRLIKLKRM

SEQ ID NO: 65748 - protein, 9 aa, Borrelia burgdorferi B31
KKWILEIVR

SEQ ID NO: 65749 - protein, 9 aa, Borrelia burgdorferi B31
KKYLTWFFK

SEQ ID NO: 65750 - protein, 10 aa, Borrelia burgdorferi B31
QRMKEFFKSK

SEQ ID NO: 65751 - protein, 10 aa, Borrelia burgdorferi B31
KRMLILTYWP

SEQ ID NO: 65752 - protein, 10 aa, Borrelia burgdorferi B31
SRLIKLKRML

SEQ ID NO: 65753 - protein, 10 aa, Borrelia burgdorferi B31
YRPENQKVFK

SEQ ID NO: 65754 - protein, 10 aa, Borrelia burgdorferi B31
KKLGTTYKLK

SEQ ID NO: 65755 - protein, 10 aa, Borrelia burgdorferi B31
NQIFVYFLSF

SEQ ID NO: 65756 - protein, 10 aa, Borrelia burgdorferi B31
NRNKIKILNI

SEQ ID NO: 65757 - protein, 11 aa, Borrelia burgdorferi B31
KRMLILTYWPV

SEQ ID NO: 65758 - protein, 11 aa, Borrelia burgdorferi B31
VRNKNFIQISK

SEQ ID NO: 65759 - protein, 11 aa, Borrelia burgdorferi B31
KKWILEIVRNK

SEQ ID NO: 65760 - protein, 11 aa, Borrelia burgdorferi B31
SRLIKLKRMLI

SEQ ID NO: 65761 - protein, 11 aa, Borrelia burgdorferi B31
SRILKIIIKNI

SEQ ID NO: 65762 - protein, 9 aa, Borrelia burgdorferi B31
LPAMCYLIY

SEQ ID NO: 65763 - protein, 9 aa, Borrelia burgdorferi B31
YGWIAFYIY

SEQ ID NO: 65764 - protein, 9 aa, Borrelia burgdorferi B31
YPNIEYKHF

SEQ ID NO: 65765 - protein, 9 aa, Borrelia burgdorferi B31
YFFSDFTQY

SEQ ID NO: 65766 - protein, 9 aa, Borrelia burgdorferi B31
LIEIQNSPY

SEQ ID NO: 65767 - protein, 9 aa, Borrelia burgdorferi B31
FDKTNFNPY

SEQ ID NO: 65768 - protein, 9 aa, Borrelia burgdorferi B31
EIQNQIFVY

SEQ ID NO: 65769 - protein, 9 aa, Borrelia burgdorferi B31
ETYGWIAFY

SEQ ID NO: 65770 - protein, 9 aa, Borrelia burgdorferi B31
ESFIDALEY

SEQ ID NO: 65771 - protein, 9 aa, Borrelia burgdorferi B31
TFEIQNQIF

SEQ ID NO: 65772 - protein, 9 aa, Borrelia burgdorferi B31
YLEEEILAL

SEQ ID NO: 65773 - protein, 9 aa, Borrelia burgdorferi B31
TAKFQTEDF

SEQ ID NO: 65774 - protein, 9 aa, Borrelia burgdorferi B31
LSFYPNIEY

SEQ ID NO: 65775 - protein, 9 aa, Borrelia burgdorferi B31
IFVYFLSFY

SEQ ID NO: 65776 - protein, 9 aa, Borrelia burgdorferi B31
QTEDFFISF

SEQ ID NO: 65777 - protein, 9 aa, Borrelia burgdorferi B31
QIFVYFLSF

SEQ ID NO: 65778 - protein, 9 aa, Borrelia burgdorferi B31
EFYDSLATL

SEQ ID NO: 65779 - protein, 9 aa, Borrelia burgdorferi B31
NSLLEFISF

SEQ ID NO: 65780 - protein, 9 aa, Borrelia burgdorferi B31
IQNQIFVYF

SEQ ID NO: 65781 - protein, 9 aa, Borrelia burgdorferi B31
FISFDKTNF

SEQ ID NO: 65782 - protein, 9 aa, Borrelia burgdorferi B31
YSQEKKDIY

SEQ ID NO: 65783 - protein, 9 aa, Borrelia burgdorferi B31
LALKYNEIL

SEQ ID NO: 65784 - protein, 9 aa, Borrelia burgdorferi B31
TLSLNEIFY

SEQ ID NO: 65785 - protein, 9 aa, Borrelia burgdorferi B31
IEIQNSPYY

SEQ ID NO: 65786 - protein, 9 aa, Borrelia burgdorferi B31
APKDFQDTL

SEQ ID NO: 65787 - protein, 9 aa, Borrelia burgdorferi B31
IETYGWIAF

SEQ ID NO: 65788 - protein, 9 aa, Borrelia burgdorferi B31
NTKKLGTTY

SEQ ID NO: 65789 - protein, 9 aa, Borrelia burgdorferi B31
YIEEKVLKY

SEQ ID NO: 65790 - protein, 10 aa, Borrelia burgdorferi B31
FLSFYPNIEY

SEQ ID NO: 65791 - protein, 10 aa, Borrelia burgdorferi B31
NIETYGWIAF

SEQ ID NO: 65792 - protein, 10 aa, Borrelia burgdorferi B31
WESFIDALEY

SEQ ID NO: 65793 - protein, 10 aa, Borrelia burgdorferi B31
YADNKDKKIF

SEQ ID NO: 65794 - protein, 10 aa, Borrelia burgdorferi B31
FEIQNQIFVY

SEQ ID NO: 65795 - protein, 10 aa, Borrelia burgdorferi B31
NFNPYESSIF

SEQ ID NO: 65796 - protein, 10 aa, Borrelia burgdorferi B31
TAKFQTEDFF

SEQ ID NO: 65797 - protein, 10 aa, Borrelia burgdorferi B31
SAFLEIIMHY

SEQ ID NO: 65798 - protein, 10 aa, Borrelia burgdorferi B31
LIEIQNSPYY

SEQ ID NO: 65799 - protein, 10 aa, Borrelia burgdorferi B31
FQTEDFFISF

SEQ ID NO: 65800 - protein, 10 aa, Borrelia burgdorferi B31
TYGWIAFYIY

SEQ ID NO: 65801 - protein, 10 aa, Borrelia burgdorferi B31
FFISFDKTNF

SEQ ID NO: 65802 - protein, 10 aa, Borrelia burgdorferi B31
SFDKTNFNPY

SEQ ID NO: 65803 - protein, 10 aa, Borrelia burgdorferi B31
FKFISDILLY

SEQ ID NO: 65804 - protein, 10 aa, Borrelia burgdorferi B31
YAPKDFQDTL

SEQ ID NO: 65805 - protein, 10 aa, Borrelia burgdorferi B31
EIQNQIFVYF

SEQ ID NO: 65806 - protein, 10 aa, Borrelia burgdorferi B31
NYFFSDFTQY

SEQ ID NO: 65807 - protein, 10 aa, Borrelia burgdorferi B31
KLIEIQNSPY

SEQ ID NO: 65808 - protein, 10 aa, Borrelia burgdorferi B31
NPNQLDYQKS

SEQ ID NO: 65809 - protein, 10 aa, Borrelia burgdorferi B31
QIFVYFLSFY

SEQ ID NO: 65810 - protein, 10 aa, Borrelia burgdorferi B31
WPVGCLSKNI

SEQ ID NO: 65811 - protein, 10 aa, Borrelia burgdorferi B31
YYSQEKKDIY

SEQ ID NO: 65812 - protein, 10 aa, Borrelia burgdorferi B31
NNWESFIDAL

SEQ ID NO: 65813 - protein, 10 aa, Borrelia burgdorferi B31
FKERYIKSAF

SEQ ID NO: 65814 - protein, 10 aa, Borrelia burgdorferi B31
LPAMCYLIYC

SEQ ID NO: 65815 - protein, 10 aa, Borrelia burgdorferi B31
FSSNINIDSL

SEQ ID NO: 65816 - protein, 10 aa, Borrelia burgdorferi B31
YESSIFKERY

SEQ ID NO: 65817 - protein, 11 aa, Borrelia burgdorferi B31
WPVGCLSKNIF

SEQ ID NO: 65818 - protein, 11 aa, Borrelia burgdorferi B31
NPNQLDYQKSY

SEQ ID NO: 65819 - protein, 11 aa, Borrelia burgdorferi B31
YPNIEYKHFKF

SEQ ID NO: 65820 - protein, 11 aa, Borrelia burgdorferi B31
NAFNTSLEECY

SEQ ID NO: 65821 - protein, 11 aa, Borrelia burgdorferi B31
ETYGWIAFYIY

SEQ ID NO: 65822 - protein, 11 aa, Borrelia burgdorferi B31
ISFDKTNFNPY

SEQ ID NO: 65823 - protein, 11 aa, Borrelia burgdorferi B31
TFEIQNQIFVY

SEQ ID NO: 65824 - protein, 11 aa, Borrelia burgdorferi B31
YFLSFYPNIEY

SEQ ID NO: 65825 - protein, 11 aa, Borrelia burgdorferi B31
YVIEKTITKKY

SEQ ID NO: 65826 - protein, 11 aa, Borrelia burgdorferi B31
NIETYGWIAFY

SEQ ID NO: 65827 - protein, 11 aa, Borrelia burgdorferi B31
LALKYNEILNY

SEQ ID NO: 65828 - protein, 11 aa, Borrelia burgdorferi B31
YLEEEILALKY

SEQ ID NO: 65829 - protein, 11 aa, Borrelia burgdorferi B31
YIKSAFLEIIM

SEQ ID NO: 65830 - protein, 11 aa, Borrelia burgdorferi B31
LATLKKHINKY

SEQ ID NO: 65831 - protein, 11 aa, Borrelia burgdorferi B31
FEIQNQIFVYF

SEQ ID NO: 65832 - protein, 11 aa, Borrelia burgdorferi B31
FNYFFSDFTQY

SEQ ID NO: 65833 - protein, 11 aa, Borrelia burgdorferi B31
NLNTKKLGTTY

SEQ ID NO: 65834 - protein, 11 aa, Borrelia burgdorferi B31
LKLIEIQNSPY

SEQ ID NO: 65835 - protein, 11 aa, Borrelia burgdorferi B31
YLIYCENLVEL

SEQ ID NO: 65836 - protein, 11 aa, Borrelia burgdorferi B31
HFKFISDILLY

SEQ ID NO: 65837 - protein, 9 aa, Borrelia burgdorferi B31
EEEILALKY

SEQ ID NO: 65838 - protein, 9 aa, Borrelia burgdorferi B31
SEFYDSLAT

SEQ ID NO: 65839 - protein, 9 aa, Borrelia burgdorferi B31
IEIQNSPYY

SEQ ID NO: 65840 - protein, 9 aa, Borrelia burgdorferi B31
NEILNYLRA

SEQ ID NO: 65841 - protein, 9 aa, Borrelia burgdorferi B31
EEILALKYN

SEQ ID NO: 65842 - protein, 9 aa, Borrelia burgdorferi B31
FEIQNQIFV

SEQ ID NO: 65843 - protein, 9 aa, Borrelia burgdorferi B31
KEFFKSKTF

SEQ ID NO: 65844 - protein, 9 aa, Borrelia burgdorferi B31
NEKNSLLEF

SEQ ID NO: 65845 - protein, 9 aa, Borrelia burgdorferi B31
LEIVRNKNF

SEQ ID NO: 65846 - protein, 9 aa, Borrelia burgdorferi B31
IETYGWIAF

SEQ ID NO: 65847 - protein, 9 aa, Borrelia burgdorferi B31
NEIFYKGSS

SEQ ID NO: 65848 - protein, 9 aa, Borrelia burgdorferi B31
KEIITAKFQ

SEQ ID NO: 65849 - protein, 10 aa, Borrelia burgdorferi B31
FEIQNQIFVY

SEQ ID NO: 65850 - protein, 10 aa, Borrelia burgdorferi B31
SEFYDSLATL

SEQ ID NO: 65851 - protein, 10 aa, Borrelia burgdorferi B31
NEILNYLRAL

SEQ ID NO: 65852 - protein, 10 aa, Borrelia burgdorferi B31
KEIITAKFQT

SEQ ID NO: 65853 - protein, 10 aa, Borrelia burgdorferi B31
WESFIDALEY

SEQ ID NO: 65854 - protein, 10 aa, Borrelia burgdorferi B31
EEILALKYNE

SEQ ID NO: 65855 - protein, 10 aa, Borrelia burgdorferi B31
IEIQNSPYYS

SEQ ID NO: 65856 - protein, 11 aa, Borrelia burgdorferi B31
EEILALKYNEI

SEQ ID NO: 65857 - protein, 11 aa, Borrelia burgdorferi B31
FEIQNQIFVYF

SEQ ID NO: 65858 - protein, 11 aa, Borrelia burgdorferi B31
KEFFKSKTFEI

SEQ ID NO: 65859 - protein, 11 aa, Borrelia burgdorferi B31
NEKKLLPAMCY

SEQ ID NO: 65860 - protein, 11 aa, Borrelia burgdorferi B31
SEFYDSLATLK

SEQ ID NO: 65861 - protein, 11 aa, Borrelia burgdorferi B31
EEKVLKYSISS

SEQ ID NO: 65862 - protein, 11 aa, Borrelia burgdorferi B31
DENEKKLLPAM

SEQ ID NO: 65863 - protein, 11 aa, Borrelia burgdorferi B31
NEILNYLRALK

SEQ ID NO: 65864 - protein, 9 aa, Borrelia burgdorferi B31
LPAMCYLIY

SEQ ID NO: 65865 - protein, 10 aa, Borrelia burgdorferi B31
WPVGCLSKNI

SEQ ID NO: 65866 - protein, 10 aa, Borrelia burgdorferi B31
LPAMCYLIYC

SEQ ID NO: 65867 - protein, 10 aa, Borrelia burgdorferi B31
KPEIIELIKI

SEQ ID NO: 65868 - protein, 11 aa, Borrelia burgdorferi B31
IPKKIIKIQKI

SEQ ID NO: 65869 - protein, 11 aa, Borrelia burgdorferi B31
WPVGCLSKNIF

SEQ ID NO: 65870 - protein, 11 aa, Borrelia burgdorferi B31
SPYYSQEKKDI

SEQ ID NO: 65871 - protein, 9 aa, Borrelia burgdorferi B31
KTLSLNEIF

SEQ ID NO: 65872 - protein, 9 aa, Borrelia burgdorferi B31
TITKKYLTW

SEQ ID NO: 65873 - protein, 9 aa, Borrelia burgdorferi B31
NTKKLGTTY

SEQ ID NO: 65874 - protein, 10 aa, Borrelia burgdorferi B31
KTITKKYLTW

SEQ ID NO: 65875 - protein, 10 aa, Borrelia burgdorferi B31
NSQNIETYGW

SEQ ID NO: 65876 - protein, 9 aa, Borrelia burgdorferi B31
KTFEIQNQI

SEQ ID NO: 65877 - protein, 10 aa, Borrelia burgdorferi B31
NTQNEAIKKW

SEQ ID NO: 65878 - protein, 10 aa, Borrelia burgdorferi B31
KTLSLNEIFY

SEQ ID NO: 65879 - protein, 11 aa, Borrelia burgdorferi B31
ITAKFQTEDFF

SEQ ID NO: 65880 - protein, 11 aa, Borrelia burgdorferi B31
KNSQNIETYGW

SEQ ID NO: 65881 - protein, 11 aa, Borrelia burgdorferi B31
ISFDKTNFNPY

SEQ ID NO: 65882 - protein, 9 aa, Borrelia burgdorferi B31
SADTWYTWY

SEQ ID NO: 65883 - protein, 9 aa, Borrelia burgdorferi B31
YLEHMILFF

SEQ ID NO: 65884 - protein, 9 aa, Borrelia burgdorferi B31
ETKPKNTCY

SEQ ID NO: 65885 - protein, 10 aa, Borrelia burgdorferi B31
NTCYISFYRY

SEQ ID NO: 65886 - protein, 10 aa, Borrelia burgdorferi B31
RSADTWYTWY

SEQ ID NO: 65887 - protein, 10 aa, Borrelia burgdorferi B31
MSPFITGYSY

SEQ ID NO: 65888 - protein, 10 aa, Borrelia burgdorferi B31
YSYEEIDPEY

SEQ ID NO: 65889 - protein, 9 aa, Borrelia burgdorferi B31
SLDSLIEYL

SEQ ID NO: 65890 - protein, 9 aa, Borrelia burgdorferi B31
SLIEYLEHM

SEQ ID NO: 65891 - protein, 9 aa, Borrelia burgdorferi B31
YTWYWAEEI

SEQ ID NO: 65892 - protein, 9 aa, Borrelia burgdorferi B31
KLVKRMTMI

SEQ ID NO: 65893 - protein, 9 aa, Borrelia burgdorferi B31
FAMEGSILT

SEQ ID NO: 65894 - protein, 9 aa, Borrelia burgdorferi B31
KLIQAFTNT

SEQ ID NO: 65895 - protein, 9 aa, Borrelia burgdorferi B31
YLLPPFTSQ

SEQ ID NO: 65896 - protein, 9 aa, Borrelia burgdorferi B31
YISFYRYDL

SEQ ID NO: 65897 - protein, 9 aa, Borrelia burgdorferi B31
FTNTNKFCI

SEQ ID NO: 65898 - protein, 9 aa, Borrelia burgdorferi B31
MILFFLEKT

SEQ ID NO: 65899 - protein, 9 aa, Borrelia burgdorferi B31
RMTMIYRSA

SEQ ID NO: 65900 - protein, 9 aa, Borrelia burgdorferi B31
YQGSLGEPI

SEQ ID NO: 65901 - protein, 9 aa, Borrelia burgdorferi B31
FLEKTPVGT

SEQ ID NO: 65902 - protein, 10 aa, Borrelia burgdorferi B31
YLEHMILFFL

SEQ ID NO: 65903 - protein, 10 aa, Borrelia burgdorferi B31
SLIEYLEHMI

SEQ ID NO: 65904 - protein, 10 aa, Borrelia burgdorferi B31
FITGYSYEEI

SEQ ID NO: 65905 - protein, 10 aa, Borrelia burgdorferi B31
LLKDKLTFSI

SEQ ID NO: 65906 - protein, 10 aa, Borrelia burgdorferi B31
ILFFLEKTPV

SEQ ID NO: 65907 - protein, 10 aa, Borrelia burgdorferi B31
YLLPPFTSQS

SEQ ID NO: 65908 - protein, 10 aa, Borrelia burgdorferi B31
YTWYWAEEIM

SEQ ID NO: 65909 - protein, 10 aa, Borrelia burgdorferi B31
FLEKTPVGTL

SEQ ID NO: 65910 - protein, 10 aa, Borrelia burgdorferi B31
VLGISSAPKL

SEQ ID NO: 65911 - protein, 10 aa, Borrelia burgdorferi B31
MITQQDYTEI

SEQ ID NO: 65912 - protein, 10 aa, Borrelia burgdorferi B31
HMILFFLEKT

SEQ ID NO: 65913 - protein, 10 aa, Borrelia burgdorferi B31
IMSPFITGYS

SEQ ID NO: 65914 - protein, 10 aa, Borrelia burgdorferi B31
ILTRSKLIQA

SEQ ID NO: 65915 - protein, 11 aa, Borrelia burgdorferi B31
SLIEYLEHMIL

SEQ ID NO: 65916 - protein, 11 aa, Borrelia burgdorferi B31
MILFFLEKTPV

SEQ ID NO: 65917 - protein, 11 aa, Borrelia burgdorferi B31
ILLKDKLTFSI

SEQ ID NO: 65918 - protein, 11 aa, Borrelia burgdorferi B31
SLPSNCYAYKV

SEQ ID NO: 65919 - protein, 11 aa, Borrelia burgdorferi B31
YSYEEIDPEYL

SEQ ID NO: 65920 - protein, 11 aa, Borrelia burgdorferi B31
KVLGISSAPKL

SEQ ID NO: 65921 - protein, 11 aa, Borrelia burgdorferi B31
MIYRSADTWYT

SEQ ID NO: 65922 - protein, 11 aa, Borrelia burgdorferi B31
YQGSLGEPILL

SEQ ID NO: 65923 - protein, 11 aa, Borrelia burgdorferi B31
YAYKVLGISSA

SEQ ID NO: 65924 - protein, 11 aa, Borrelia burgdorferi B31
KIDSLGYQGSL

SEQ ID NO: 65925 - protein, 11 aa, Borrelia burgdorferi B31
YWAEEIMSPFI

SEQ ID NO: 65926 - protein, 11 aa, Borrelia burgdorferi B31
FAMEGSILTRS

SEQ ID NO: 65927 - protein, 11 aa, Borrelia burgdorferi B31
SILTRSKLIQA

SEQ ID NO: 65928 - protein, 9 aa, Borrelia burgdorferi B31
HMILFFLEK

SEQ ID NO: 65929 - protein, 9 aa, Borrelia burgdorferi B31
SLGEPILLK

SEQ ID NO: 65930 - protein, 9 aa, Borrelia burgdorferi B31
RIQFRNGNK

SEQ ID NO: 65931 - protein, 9 aa, Borrelia burgdorferi B31
KLSGRFLRH

SEQ ID NO: 65932 - protein, 9 aa, Borrelia burgdorferi B31
VLGISSAPK

SEQ ID NO: 65933 - protein, 9 aa, Borrelia burgdorferi B31
IQAFTNTNK

SEQ ID NO: 65934 - protein, 9 aa, Borrelia burgdorferi B31
LVKRMTMIY

SEQ ID NO: 65935 - protein, 9 aa, Borrelia burgdorferi B31
IMSPFITGY

SEQ ID NO: 65936 - protein, 9 aa, Borrelia burgdorferi B31
LTFSICDGK

SEQ ID NO: 65937 - protein, 9 aa, Borrelia burgdorferi B31
LDFSRINFK

SEQ ID NO: 65938 - protein, 9 aa, Borrelia burgdorferi B31
INFKGKLVK

SEQ ID NO: 65939 - protein, 9 aa, Borrelia burgdorferi B31
AMEGSILTR

SEQ ID NO: 65940 - protein, 10 aa, Borrelia burgdorferi B31
KVLGISSAPK

SEQ ID NO: 65941 - protein, 10 aa, Borrelia burgdorferi B31
RINFKGKLVK

SEQ ID NO: 65942 - protein, 10 aa, Borrelia burgdorferi B31
LIQAFTNTNK

SEQ ID NO: 65943 - protein, 10 aa, Borrelia burgdorferi B31
KLTFSICDGK

SEQ ID NO: 65944 - protein, 10 aa, Borrelia burgdorferi B31
SLPSNCYAYK

SEQ ID NO: 65945 - protein, 10 aa, Borrelia burgdorferi B31
GSLGEPILLK

SEQ ID NO: 65946 - protein, 10 aa, Borrelia burgdorferi B31
KLSGRFLRHY

SEQ ID NO: 65947 - protein, 10 aa, Borrelia burgdorferi B31
KLVKRMTMIY

SEQ ID NO: 65948 - protein, 10 aa, Borrelia burgdorferi B31
KTPVGTLTAK

SEQ ID NO: 65949 - protein, 10 aa, Borrelia burgdorferi B31
RSADTWYTWY

SEQ ID NO: 65950 - protein, 10 aa, Borrelia burgdorferi B31
LVKRMTMIYR

SEQ ID NO: 65951 - protein, 10 aa, Borrelia burgdorferi B31
EHMILFFLEK

SEQ ID NO: 65952 - protein, 10 aa, Borrelia burgdorferi B31
MIYRSADTWY

SEQ ID NO: 65953 - protein, 10 aa, Borrelia burgdorferi B31
DLDFSRINFK

SEQ ID NO: 65954 - protein, 10 aa, Borrelia burgdorferi B31
NTCYISFYRY

SEQ ID NO: 65955 - protein, 10 aa, Borrelia burgdorferi B31
MSPFITGYSY

SEQ ID NO: 65956 - protein, 10 aa, Borrelia burgdorferi B31
RSLPSNCYAY

SEQ ID NO: 65957 - protein, 10 aa, Borrelia burgdorferi B31
EIMSPFITGY

SEQ ID NO: 65958 - protein, 10 aa, Borrelia burgdorferi B31
TQQDYTEIKK

SEQ ID NO: 65959 - protein, 10 aa, Borrelia burgdorferi B31
ISSAPKLSGR

SEQ ID NO: 65960 - protein, 10 aa, Borrelia burgdorferi B31
TSQSGSKETK

SEQ ID NO: 65961 - protein, 10 aa, Borrelia burgdorferi B31
QSGSKETKPK

SEQ ID NO: 65962 - protein, 10 aa, Borrelia burgdorferi B31
KNTCYISFYR

SEQ ID NO: 65963 - protein, 11 aa, Borrelia burgdorferi B31
KLIQAFTNTNK

SEQ ID NO: 65964 - protein, 11 aa, Borrelia burgdorferi B31
RSLPSNCYAYK

SEQ ID NO: 65965 - protein, 11 aa, Borrelia burgdorferi B31
KLVKRMTMIYR

SEQ ID NO: 65966 - protein, 11 aa, Borrelia burgdorferi B31
KTRIQFRNGNK

SEQ ID NO: 65967 - protein, 11 aa, Borrelia burgdorferi B31
RINFKGKLVKR

SEQ ID NO: 65968 - protein, 11 aa, Borrelia burgdorferi B31
AMEGSILTRSK

SEQ ID NO: 65969 - protein, 11 aa, Borrelia burgdorferi B31
SLGHTQEDSYK

SEQ ID NO: 65970 - protein, 11 aa, Borrelia burgdorferi B31
IMSPFITGYSY

SEQ ID NO: 65971 - protein, 11 aa, Borrelia burgdorferi B31
SLGEPILLKDK

SEQ ID NO: 65972 - protein, 11 aa, Borrelia burgdorferi B31
TMIYRSADTWY

SEQ ID NO: 65973 - protein, 11 aa, Borrelia burgdorferi B31
ITQQDYTEIKK

SEQ ID NO: 65974 - protein, 11 aa, Borrelia burgdorferi B31
FTSQSGSKETK

SEQ ID NO: 65975 - protein, 11 aa, Borrelia burgdorferi B31
RSLGHTQEDSY

SEQ ID NO: 65976 - protein, 11 aa, Borrelia burgdorferi B31
MITQQDYTEIK

SEQ ID NO: 65977 - protein, 9 aa, Borrelia burgdorferi B31
HMILFFLEK

SEQ ID NO: 65978 - protein, 9 aa, Borrelia burgdorferi B31
SLGEPILLK

SEQ ID NO: 65979 - protein, 9 aa, Borrelia burgdorferi B31
RIQFRNGNK

SEQ ID NO: 65980 - protein, 9 aa, Borrelia burgdorferi B31
LTFSICDGK

SEQ ID NO: 65981 - protein, 9 aa, Borrelia burgdorferi B31
NTCYISFYR

SEQ ID NO: 65982 - protein, 9 aa, Borrelia burgdorferi B31
TQQDYTEIK

SEQ ID NO: 65983 - protein, 9 aa, Borrelia burgdorferi B31
IQAFTNTNK

SEQ ID NO: 65984 - protein, 9 aa, Borrelia burgdorferi B31
VLGISSAPK

SEQ ID NO: 65985 - protein, 9 aa, Borrelia burgdorferi B31
SQSGSKETK

SEQ ID NO: 65986 - protein, 9 aa, Borrelia burgdorferi B31
SSAPKLSGR

SEQ ID NO: 65987 - protein, 9 aa, Borrelia burgdorferi B31
AMEGSILTR

SEQ ID NO: 65988 - protein, 9 aa, Borrelia burgdorferi B31
NTKTRIQFR

SEQ ID NO: 65989 - protein, 9 aa, Borrelia burgdorferi B31
KLSGRFLRH

SEQ ID NO: 65990 - protein, 9 aa, Borrelia burgdorferi B31
QQDYTEIKK

SEQ ID NO: 65991 - protein, 9 aa, Borrelia burgdorferi B31
LVKRMTMIY

SEQ ID NO: 65992 - protein, 9 aa, Borrelia burgdorferi B31
LDFSRINFK

SEQ ID NO: 65993 - protein, 9 aa, Borrelia burgdorferi B31
SADTWYTWY

SEQ ID NO: 65994 - protein, 9 aa, Borrelia burgdorferi B31
TPVGTLTAK

SEQ ID NO: 65995 - protein, 9 aa, Borrelia burgdorferi B31
IMSPFITGY

SEQ ID NO: 65996 - protein, 10 aa, Borrelia burgdorferi B31
MITQQDYTEI

SEQ ID NO: 65997 - protein, 10 aa, Borrelia burgdorferi B31
ITQQDYTEIK

SEQ ID NO: 65998 - protein, 10 aa, Borrelia burgdorferi B31
KVLGISSAPK

SEQ ID NO: 65999 - protein, 10 aa, Borrelia burgdorferi B31
GSLGEPILLK

SEQ ID NO: 66000 - protein, 10 aa, Borrelia burgdorferi B31
LIQAFTNTNK

SEQ ID NO: 66001 - protein, 10 aa, Borrelia burgdorferi B31
TQQDYTEIKK

SEQ ID NO: 66002 - protein, 10 aa, Borrelia burgdorferi B31
TSQSGSKETK

SEQ ID NO: 66003 - protein, 10 aa, Borrelia burgdorferi B31
RINFKGKLVK

SEQ ID NO: 66004 - protein, 10 aa, Borrelia burgdorferi B31
KTPVGTLTAK

SEQ ID NO: 66005 - protein, 10 aa, Borrelia burgdorferi B31
SLPSNCYAYK

SEQ ID NO: 66006 - protein, 10 aa, Borrelia burgdorferi B31
NTCYISFYRY

SEQ ID NO: 66007 - protein, 10 aa, Borrelia burgdorferi B31
KLTFSICDGK

SEQ ID NO: 66008 - protein, 10 aa, Borrelia burgdorferi B31
RSADTWYTWY

SEQ ID NO: 66009 - protein, 10 aa, Borrelia burgdorferi B31
LVKRMTMIYR

SEQ ID NO: 66010 - protein, 10 aa, Borrelia burgdorferi B31
ISSAPKLSGR

SEQ ID NO: 66011 - protein, 10 aa, Borrelia burgdorferi B31
MIYRSADTWY

SEQ ID NO: 66012 - protein, 10 aa, Borrelia burgdorferi B31
RSLPSNCYAY

SEQ ID NO: 66013 - protein, 10 aa, Borrelia burgdorferi B31
QSGSKETKPK

SEQ ID NO: 66014 - protein, 10 aa, Borrelia burgdorferi B31
FAMEGSILTR

SEQ ID NO: 66015 - protein, 10 aa, Borrelia burgdorferi B31
MSPFITGYSY

SEQ ID NO: 66016 - protein, 10 aa, Borrelia burgdorferi B31
EIMSPFITGY

SEQ ID NO: 66017 - protein, 10 aa, Borrelia burgdorferi B31
KLSGRFLRHY

SEQ ID NO: 66018 - protein, 10 aa, Borrelia burgdorferi B31
DLDFSRINFK

SEQ ID NO: 66019 - protein, 10 aa, Borrelia burgdorferi B31
KLVKRMTMIY

SEQ ID NO: 66020 - protein, 11 aa, Borrelia burgdorferi B31
MITQQDYTEIK

SEQ ID NO: 66021 - protein, 11 aa, Borrelia burgdorferi B31
RSLPSNCYAYK

SEQ ID NO: 66022 - protein, 11 aa, Borrelia burgdorferi B31
KLIQAFTNTNK

SEQ ID NO: 66023 - protein, 11 aa, Borrelia burgdorferi B31
ITQQDYTEIKK

SEQ ID NO: 66024 - protein, 11 aa, Borrelia burgdorferi B31
AMEGSILTRSK

SEQ ID NO: 66025 - protein, 11 aa, Borrelia burgdorferi B31
SQSGSKETKPK

SEQ ID NO: 66026 - protein, 11 aa, Borrelia burgdorferi B31
KTRIQFRNGNK

SEQ ID NO: 66027 - protein, 11 aa, Borrelia burgdorferi B31
TQQDYTEIKKK

SEQ ID NO: 66028 - protein, 11 aa, Borrelia burgdorferi B31
SLGHTQEDSYK

SEQ ID NO: 66029 - protein, 11 aa, Borrelia burgdorferi B31
FTSQSGSKETK

SEQ ID NO: 66030 - protein, 11 aa, Borrelia burgdorferi B31
KLVKRMTMIYR

SEQ ID NO: 66031 - protein, 11 aa, Borrelia burgdorferi B31
SICDGKNIDNR

SEQ ID NO: 66032 - protein, 11 aa, Borrelia burgdorferi B31
SLGEPILLKDK

SEQ ID NO: 66033 - protein, 11 aa, Borrelia burgdorferi B31
SAPKLSGRFLR

SEQ ID NO: 66034 - protein, 11 aa, Borrelia burgdorferi B31
RINFKGKLVKR

SEQ ID NO: 66035 - protein, 11 aa, Borrelia burgdorferi B31
NTNKFCIPDGR

SEQ ID NO: 66036 - protein, 11 aa, Borrelia burgdorferi B31
LEHMILFFLEK

SEQ ID NO: 66037 - protein, 11 aa, Borrelia burgdorferi B31
IMSPFITGYSY

SEQ ID NO: 66038 - protein, 11 aa, Borrelia burgdorferi B31
GISSAPKLSGR

SEQ ID NO: 66039 - protein, 11 aa, Borrelia burgdorferi B31
TMIYRSADTWY

SEQ ID NO: 66040 - protein, 9 aa, Borrelia burgdorferi B31
EYLEHMILF

SEQ ID NO: 66041 - protein, 9 aa, Borrelia burgdorferi B31
CYAYKVLGI

SEQ ID NO: 66042 - protein, 9 aa, Borrelia burgdorferi B31
SYKNHDHDL

SEQ ID NO: 66043 - protein, 9 aa, Borrelia burgdorferi B31
EYLLPPFTS

SEQ ID NO: 66044 - protein, 10 aa, Borrelia burgdorferi B31
EYLEHMILFF

SEQ ID NO: 66045 - protein, 10 aa, Borrelia burgdorferi B31
YWAEEIMSPF

SEQ ID NO: 66046 - protein, 10 aa, Borrelia burgdorferi B31
WYTWYWAEEI

SEQ ID NO: 66047 - protein, 10 aa, Borrelia burgdorferi B31
CYISFYRYDL

SEQ ID NO: 66048 - protein, 10 aa, Borrelia burgdorferi B31
IQAFTNTNKF

SEQ ID NO: 66049 - protein, 10 aa, Borrelia burgdorferi B31
GYQGSLGEPI

SEQ ID NO: 66050 - protein, 10 aa, Borrelia burgdorferi B31
AFTNTNKFCI

SEQ ID NO: 66051 - protein, 10 aa, Borrelia burgdorferi B31
SYEEIDPEYL

SEQ ID NO: 66052 - protein, 11 aa, Borrelia burgdorferi B31
EYLEHMILFFL

SEQ ID NO: 66053 - protein, 11 aa, Borrelia burgdorferi B31
YWAEEIMSPFI

SEQ ID NO: 66054 - protein, 11 aa, Borrelia burgdorferi B31
WYWAEEIMSPF

SEQ ID NO: 66055 - protein, 11 aa, Borrelia burgdorferi B31
TWYTWYWAEEI

SEQ ID NO: 66056 - protein, 11 aa, Borrelia burgdorferi B31
IYRSADTWYTW

SEQ ID NO: 66057 - protein, 11 aa, Borrelia burgdorferi B31
SYKNHDHDLDF

SEQ ID NO: 66058 - protein, 11 aa, Borrelia burgdorferi B31
SYEEIDPEYLL

SEQ ID NO: 66059 - protein, 11 aa, Borrelia burgdorferi B31
EYEITKNAPSL

SEQ ID NO: 66060 - protein, 11 aa, Borrelia burgdorferi B31
PFITGYSYEEI

SEQ ID NO: 66061 - protein, 11 aa, Borrelia burgdorferi B31
WYTWYWAEEIM

SEQ ID NO: 66062 - protein, 9 aa, Borrelia burgdorferi B31
SLPSNCYAY

SEQ ID NO: 66063 - protein, 9 aa, Borrelia burgdorferi B31
IMSPFITGY

SEQ ID NO: 66064 - protein, 9 aa, Borrelia burgdorferi B31
IYRSADTWY

SEQ ID NO: 66065 - protein, 9 aa, Borrelia burgdorferi B31
SYEEIDPEY

SEQ ID NO: 66066 - protein, 9 aa, Borrelia burgdorferi B31
SADTWYTWY

SEQ ID NO: 66067 - protein, 9 aa, Borrelia burgdorferi B31
YLEHMILFF

SEQ ID NO: 66068 - protein, 9 aa, Borrelia burgdorferi B31
SPFITGYSY

SEQ ID NO: 66069 - protein, 9 aa, Borrelia burgdorferi B31
ETKPKNTCY

SEQ ID NO: 66070 - protein, 9 aa, Borrelia burgdorferi B31
TCYISFYRY

SEQ ID NO: 66071 - protein, 9 aa, Borrelia burgdorferi B31
LVKRMTMIY

SEQ ID NO: 66072 - protein, 10 aa, Borrelia burgdorferi B31
EIMSPFITGY

SEQ ID NO: 66073 - protein, 10 aa, Borrelia burgdorferi B31
YSYEEIDPEY

SEQ ID NO: 66074 - protein, 10 aa, Borrelia burgdorferi B31
MSPFITGYSY

SEQ ID NO: 66075 - protein, 10 aa, Borrelia burgdorferi B31
YWAEEIMSPF

SEQ ID NO: 66076 - protein, 10 aa, Borrelia burgdorferi B31
MIYRSADTWY

SEQ ID NO: 66077 - protein, 10 aa, Borrelia burgdorferi B31
RSADTWYTWY

SEQ ID NO: 66078 - protein, 10 aa, Borrelia burgdorferi B31
NTCYISFYRY

SEQ ID NO: 66079 - protein, 10 aa, Borrelia burgdorferi B31
RSLPSNCYAY

SEQ ID NO: 66080 - protein, 10 aa, Borrelia burgdorferi B31
EYLEHMILFF

SEQ ID NO: 66081 - protein, 10 aa, Borrelia burgdorferi B31
KLVKRMTMIY

SEQ ID NO: 66082 - protein, 10 aa, Borrelia burgdorferi B31
SLGHTQEDSY

SEQ ID NO: 66083 - protein, 11 aa, Borrelia burgdorferi B31
TMIYRSADTWY

SEQ ID NO: 66084 - protein, 11 aa, Borrelia burgdorferi B31
IMSPFITGYSY

SEQ ID NO: 66085 - protein, 11 aa, Borrelia burgdorferi B31
GYSYEEIDPEY

SEQ ID NO: 66086 - protein, 11 aa, Borrelia burgdorferi B31
YRSADTWYTWY

SEQ ID NO: 66087 - protein, 11 aa, Borrelia burgdorferi B31
NAPSLDSLIEY

SEQ ID NO: 66088 - protein, 11 aa, Borrelia burgdorferi B31
WYWAEEIMSPF

SEQ ID NO: 66089 - protein, 9 aa, Borrelia burgdorferi B31
NTCYISFYR

SEQ ID NO: 66090 - protein, 9 aa, Borrelia burgdorferi B31
LTFSICDGK

SEQ ID NO: 66091 - protein, 9 aa, Borrelia burgdorferi B31
NTKTRIQFR

SEQ ID NO: 66092 - protein, 9 aa, Borrelia burgdorferi B31
HMILFFLEK

SEQ ID NO: 66093 - protein, 9 aa, Borrelia burgdorferi B31
SSAPKLSGR

SEQ ID NO: 66094 - protein, 9 aa, Borrelia burgdorferi B31
LDFSRINFK

SEQ ID NO: 66095 - protein, 9 aa, Borrelia burgdorferi B31
LPSNCYAYK

SEQ ID NO: 66096 - protein, 9 aa, Borrelia burgdorferi B31
TPVGTLTAK

SEQ ID NO: 66097 - protein, 9 aa, Borrelia burgdorferi B31
NKFCIPDGR

SEQ ID NO: 66098 - protein, 9 aa, Borrelia burgdorferi B31
GSTDSDGTR

SEQ ID NO: 66099 - protein, 9 aa, Borrelia burgdorferi B31
HDHDLDFSR

SEQ ID NO: 66100 - protein, 9 aa, Borrelia burgdorferi B31
IQAFTNTNK

SEQ ID NO: 66101 - protein, 9 aa, Borrelia burgdorferi B31
MSPFITGYS

SEQ ID NO: 66102 - protein, 9 aa, Borrelia burgdorferi B31
ETKPKNTCY

SEQ ID NO: 66103 - protein, 9 aa, Borrelia burgdorferi B31
TQQDYTEIK

SEQ ID NO: 66104 - protein, 9 aa, Borrelia burgdorferi B31
NFKGKLVKR

SEQ ID NO: 66105 - protein, 9 aa, Borrelia burgdorferi B31
FITGYSYEE

SEQ ID NO: 66106 - protein, 9 aa, Borrelia burgdorferi B31
MTMIYRSAD

SEQ ID NO: 66107 - protein, 9 aa, Borrelia burgdorferi B31
RIQFRNGNK

SEQ ID NO: 66108 - protein, 9 aa, Borrelia burgdorferi B31
LVKRMTMIY

SEQ ID NO: 66109 - protein, 10 aa, Borrelia burgdorferi B31
NTCYISFYRY

SEQ ID NO: 66110 - protein, 10 aa, Borrelia burgdorferi B31
FAMEGSILTR

SEQ ID NO: 66111 - protein, 10 aa, Borrelia burgdorferi B31
LVKRMTMIYR

SEQ ID NO: 66112 - protein, 10 aa, Borrelia burgdorferi B31
ENTKTRIQFR

SEQ ID NO: 66113 - protein, 10 aa, Borrelia burgdorferi B31
MIYRSADTWY

SEQ ID NO: 66114 - protein, 10 aa, Borrelia burgdorferi B31
MSPFITGYSY

SEQ ID NO: 66115 - protein, 10 aa, Borrelia burgdorferi B31
KNTCYISFYR

SEQ ID NO: 66116 - protein, 10 aa, Borrelia burgdorferi B31
ISSAPKLSGR

SEQ ID NO: 66117 - protein, 10 aa, Borrelia burgdorferi B31
LIQAFTNTNK

SEQ ID NO: 66118 - protein, 10 aa, Borrelia burgdorferi B31
ITQQDYTEIK

SEQ ID NO: 66119 - protein, 10 aa, Borrelia burgdorferi B31
YSYEEIDPEY

SEQ ID NO: 66120 - protein, 10 aa, Borrelia burgdorferi B31
TSQSGSKETK

SEQ ID NO: 66121 - protein, 10 aa, Borrelia burgdorferi B31
DLDFSRINFK

SEQ ID NO: 66122 - protein, 10 aa, Borrelia burgdorferi B31
EHMILFFLEK

SEQ ID NO: 66123 - protein, 10 aa, Borrelia burgdorferi B31
EIKKKLENTK

SEQ ID NO: 66124 - protein, 10 aa, Borrelia burgdorferi B31
EIMSPFITGY

SEQ ID NO: 66125 - protein, 10 aa, Borrelia burgdorferi B31
SLPSNCYAYK

SEQ ID NO: 66126 - protein, 10 aa, Borrelia burgdorferi B31
TNKFCIPDGR

SEQ ID NO: 66127 - protein, 10 aa, Borrelia burgdorferi B31
DFSRINFKGK

SEQ ID NO: 66128 - protein, 10 aa, Borrelia burgdorferi B31
KLTFSICDGK

SEQ ID NO: 66129 - protein, 10 aa, Borrelia burgdorferi B31
INFKGKLVKR

SEQ ID NO: 66130 - protein, 10 aa, Borrelia burgdorferi B31
KVLGISSAPK

SEQ ID NO: 66131 - protein, 10 aa, Borrelia burgdorferi B31
TRIQFRNGNK

SEQ ID NO: 66132 - protein, 10 aa, Borrelia burgdorferi B31
TQQDYTEIKK

SEQ ID NO: 66133 - protein, 11 aa, Borrelia burgdorferi B31
NTNKFCIPDGR

SEQ ID NO: 66134 - protein, 11 aa, Borrelia burgdorferi B31
MITQQDYTEIK

SEQ ID NO: 66135 - protein, 11 aa, Borrelia burgdorferi B31
FTSQSGSKETK

SEQ ID NO: 66136 - protein, 11 aa, Borrelia burgdorferi B31
SAPKLSGRFLR

SEQ ID NO: 66137 - protein, 11 aa, Borrelia burgdorferi B31
SICDGKNIDNR

SEQ ID NO: 66138 - protein, 11 aa, Borrelia burgdorferi B31
ITQQDYTEIKK

SEQ ID NO: 66139 - protein, 11 aa, Borrelia burgdorferi B31
MSPFITGYSYE

SEQ ID NO: 66140 - protein, 11 aa, Borrelia burgdorferi B31
KLVKRMTMIYR

SEQ ID NO: 66141 - protein, 11 aa, Borrelia burgdorferi B31
MTMIYRSADTW

SEQ ID NO: 66142 - protein, 11 aa, Borrelia burgdorferi B31
GISSAPKLSGR

SEQ ID NO: 66143 - protein, 11 aa, Borrelia burgdorferi B31
TMIYRSADTWY

SEQ ID NO: 66144 - protein, 11 aa, Borrelia burgdorferi B31
RSLPSNCYAYK

SEQ ID NO: 66145 - protein, 11 aa, Borrelia burgdorferi B31
RINFKGKLVKR

SEQ ID NO: 66146 - protein, 11 aa, Borrelia burgdorferi B31
MIYRSADTWYT

SEQ ID NO: 66147 - protein, 11 aa, Borrelia burgdorferi B31
NTCYISFYRYD

SEQ ID NO: 66148 - protein, 11 aa, Borrelia burgdorferi B31
EKTPVGTLTAK

SEQ ID NO: 66149 - protein, 11 aa, Borrelia burgdorferi B31
NAPSLDSLIEY

SEQ ID NO: 66150 - protein, 11 aa, Borrelia burgdorferi B31
KLIQAFTNTNK

SEQ ID NO: 66151 - protein, 9 aa, Borrelia burgdorferi B31
APKLSGRFL

SEQ ID NO: 66152 - protein, 9 aa, Borrelia burgdorferi B31
IPDGRSLPS

SEQ ID NO: 66153 - protein, 9 aa, Borrelia burgdorferi B31
TPVGTLTAK

SEQ ID NO: 66154 - protein, 10 aa, Borrelia burgdorferi B31
TPVGTLTAKF

SEQ ID NO: 66155 - protein, 10 aa, Borrelia burgdorferi B31
KPKNTCYISF

SEQ ID NO: 66156 - protein, 10 aa, Borrelia burgdorferi B31
LPSNCYAYKV

SEQ ID NO: 66157 - protein, 11 aa, Borrelia burgdorferi B31
LPSNCYAYKVL

SEQ ID NO: 66158 - protein, 11 aa, Borrelia burgdorferi B31
APSLDSLIEYL

SEQ ID NO: 66159 - protein, 11 aa, Borrelia burgdorferi B31
TPVGTLTAKFA

SEQ ID NO: 66160 - protein, 11 aa, Borrelia burgdorferi B31
APKLSGRFLRH

SEQ ID NO: 66161 - protein, 11 aa, Borrelia burgdorferi B31
IPDGRSLPSNC

SEQ ID NO: 66162 - protein, 11 aa, Borrelia burgdorferi B31
EPILLKDKLTF

SEQ ID NO: 66163 - protein, 10 aa, Borrelia burgdorferi B31
KGKLVKRMTM

SEQ ID NO: 66164 - protein, 10 aa, Borrelia burgdorferi B31
LTRSKLIQAF

SEQ ID NO: 66165 - protein, 11 aa, Borrelia burgdorferi B31
ILTRSKLIQAF

SEQ ID NO: 66166 - protein, 9 aa, Borrelia burgdorferi B31
IMSPFITGY

SEQ ID NO: 66167 - protein, 9 aa, Borrelia burgdorferi B31
LVKRMTMIY

SEQ ID NO: 66168 - protein, 9 aa, Borrelia burgdorferi B31
WAEEIMSPF

SEQ ID NO: 66169 - protein, 9 aa, Borrelia burgdorferi B31
YLEHMILFF

SEQ ID NO: 66170 - protein, 9 aa, Borrelia burgdorferi B31
IQFRNGNKI

SEQ ID NO: 66171 - protein, 9 aa, Borrelia burgdorferi B31
YQGSLGEPI

SEQ ID NO: 66172 - protein, 9 aa, Borrelia burgdorferi B31
KNIDNRKEY

SEQ ID NO: 66173 - protein, 9 aa, Borrelia burgdorferi B31
QAFTNTNKF

SEQ ID NO: 66174 - protein, 9 aa, Borrelia burgdorferi B31
SLPSNCYAY

SEQ ID NO: 66175 - protein, 9 aa, Borrelia burgdorferi B31
ETKPKNTCY

SEQ ID NO: 66176 - protein, 9 aa, Borrelia burgdorferi B31
ILLKDKLTF

SEQ ID NO: 66177 - protein, 10 aa, Borrelia burgdorferi B31
IQAFTNTNKF

SEQ ID NO: 66178 - protein, 10 aa, Borrelia burgdorferi B31
YSYEEIDPEY

SEQ ID NO: 66179 - protein, 10 aa, Borrelia burgdorferi B31
RSLPSNCYAY

SEQ ID NO: 66180 - protein, 10 aa, Borrelia burgdorferi B31
RSADTWYTWY

SEQ ID NO: 66181 - protein, 10 aa, Borrelia burgdorferi B31
KLSGRFLRHY

SEQ ID NO: 66182 - protein, 10 aa, Borrelia burgdorferi B31
LTRSKLIQAF

SEQ ID NO: 66183 - protein, 10 aa, Borrelia burgdorferi B31
KLVKRMTMIY

SEQ ID NO: 66184 - protein, 10 aa, Borrelia burgdorferi B31
YQGSLGEPIL

SEQ ID NO: 66185 - protein, 10 aa, Borrelia burgdorferi B31
MSPFITGYSY

SEQ ID NO: 66186 - protein, 10 aa, Borrelia burgdorferi B31
MIYRSADTWY

SEQ ID NO: 66187 - protein, 10 aa, Borrelia burgdorferi B31
YWAEEIMSPF

SEQ ID NO: 66188 - protein, 10 aa, Borrelia burgdorferi B31
TMIYRSADTW

SEQ ID NO: 66189 - protein, 10 aa, Borrelia burgdorferi B31
EIMSPFITGY

SEQ ID NO: 66190 - protein, 10 aa, Borrelia burgdorferi B31
SLGHTQEDSY

SEQ ID NO: 66191 - protein, 10 aa, Borrelia burgdorferi B31
SSAPKLSGRF

SEQ ID NO: 66192 - protein, 11 aa, Borrelia burgdorferi B31
IMSPFITGYSY

SEQ ID NO: 66193 - protein, 11 aa, Borrelia burgdorferi B31
TMIYRSADTWY

SEQ ID NO: 66194 - protein, 11 aa, Borrelia burgdorferi B31
ILTRSKLIQAF

SEQ ID NO: 66195 - protein, 11 aa, Borrelia burgdorferi B31
LIQAFTNTNKF

SEQ ID NO: 66196 - protein, 11 aa, Borrelia burgdorferi B31
RSLGHTQEDSY

SEQ ID NO: 66197 - protein, 11 aa, Borrelia burgdorferi B31
ISSAPKLSGRF

SEQ ID NO: 66198 - protein, 11 aa, Borrelia burgdorferi B31
YQGSLGEPILL

SEQ ID NO: 66199 - protein, 9 aa, Borrelia burgdorferi B31
KRMTMIYRS

SEQ ID NO: 66200 - protein, 9 aa, Borrelia burgdorferi B31
SRINFKGKL

SEQ ID NO: 66201 - protein, 9 aa, Borrelia burgdorferi B31
NRKEYEITK

SEQ ID NO: 66202 - protein, 9 aa, Borrelia burgdorferi B31
TRSKLIQAF

SEQ ID NO: 66203 - protein, 9 aa, Borrelia burgdorferi B31
GRFLRHYDS

SEQ ID NO: 66204 - protein, 10 aa, Borrelia burgdorferi B31
KRMTMIYRSA

SEQ ID NO: 66205 - protein, 10 aa, Borrelia burgdorferi B31
FRNGNKIDSL

SEQ ID NO: 66206 - protein, 10 aa, Borrelia burgdorferi B31
TRIQFRNGNK

SEQ ID NO: 66207 - protein, 11 aa, Borrelia burgdorferi B31
SRINFKGKLVK

SEQ ID NO: 66208 - protein, 11 aa, Borrelia burgdorferi B31
YRSADTWYTWY

SEQ ID NO: 66209 - protein, 11 aa, Borrelia burgdorferi B31
KRMTMIYRSAD

SEQ ID NO: 66210 - protein, 11 aa, Borrelia burgdorferi B31
GRSLPSNCYAY

SEQ ID NO: 66211 - protein, 11 aa, Borrelia burgdorferi B31
YKVLGISSAPK

SEQ ID NO: 66212 - protein, 9 aa, Borrelia burgdorferi B31
DPEYLLPPF

SEQ ID NO: 66213 - protein, 9 aa, Borrelia burgdorferi B31
WAEEIMSPF

SEQ ID NO: 66214 - protein, 9 aa, Borrelia burgdorferi B31
SPFITGYSY

SEQ ID NO: 66215 - protein, 9 aa, Borrelia burgdorferi B31
QAFTNTNKF

SEQ ID NO: 66216 - protein, 9 aa, Borrelia burgdorferi B31
FAMEGSILT

SEQ ID NO: 66217 - protein, 9 aa, Borrelia burgdorferi B31
LVKRMTMIY

SEQ ID NO: 66218 - protein, 9 aa, Borrelia burgdorferi B31
SADTWYTWY

SEQ ID NO: 66219 - protein, 9 aa, Borrelia burgdorferi B31
TPVGTLTAK

SEQ ID NO: 66220 - protein, 9 aa, Borrelia burgdorferi B31
SYEEIDPEY

SEQ ID NO: 66221 - protein, 9 aa, Borrelia burgdorferi B31
YLEHMILFF

SEQ ID NO: 66222 - protein, 9 aa, Borrelia burgdorferi B31
IMSPFITGY

SEQ ID NO: 66223 - protein, 9 aa, Borrelia burgdorferi B31
YTWYWAEEI

SEQ ID NO: 66224 - protein, 9 aa, Borrelia burgdorferi B31
TWYWAEEIM

SEQ ID NO: 66225 - protein, 9 aa, Borrelia burgdorferi B31
EPILLKDKL

SEQ ID NO: 66226 - protein, 9 aa, Borrelia burgdorferi B31
LGHTQEDSY

SEQ ID NO: 66227 - protein, 9 aa, Borrelia burgdorferi B31
TCYISFYRY

SEQ ID NO: 66228 - protein, 9 aa, Borrelia burgdorferi B31
IPDGRSLPS

SEQ ID NO: 66229 - protein, 9 aa, Borrelia burgdorferi B31
TRSKLIQAF

SEQ ID NO: 66230 - protein, 10 aa, Borrelia burgdorferi B31
TPVGTLTAKF

SEQ ID NO: 66231 - protein, 10 aa, Borrelia burgdorferi B31
APSLDSLIEY

SEQ ID NO: 66232 - protein, 10 aa, Borrelia burgdorferi B31
YTWYWAEEIM

SEQ ID NO: 66233 - protein, 10 aa, Borrelia burgdorferi B31
YSYEEIDPEY

SEQ ID NO: 66234 - protein, 10 aa, Borrelia burgdorferi B31
MIYRSADTWY

SEQ ID NO: 66235 - protein, 10 aa, Borrelia burgdorferi B31
MSPFITGYSY

SEQ ID NO: 66236 - protein, 10 aa, Borrelia burgdorferi B31
YWAEEIMSPF

SEQ ID NO: 66237 - protein, 10 aa, Borrelia burgdorferi B31
KPKNTCYISF

SEQ ID NO: 66238 - protein, 10 aa, Borrelia burgdorferi B31
EIMSPFITGY

SEQ ID NO: 66239 - protein, 10 aa, Borrelia burgdorferi B31
RSLPSNCYAY

SEQ ID NO: 66240 - protein, 10 aa, Borrelia burgdorferi B31
NTCYISFYRY

SEQ ID NO: 66241 - protein, 10 aa, Borrelia burgdorferi B31
WAEEIMSPFI

SEQ ID NO: 66242 - protein, 10 aa, Borrelia burgdorferi B31
DPEYLLPPFT

SEQ ID NO: 66243 - protein, 10 aa, Borrelia burgdorferi B31
LPSNCYAYKV

SEQ ID NO: 66244 - protein, 11 aa, Borrelia burgdorferi B31
EPILLKDKLTF

SEQ ID NO: 66245 - protein, 11 aa, Borrelia burgdorferi B31
LPSNCYAYKVL

SEQ ID NO: 66246 - protein, 11 aa, Borrelia burgdorferi B31
NAPSLDSLIEY

SEQ ID NO: 66247 - protein, 11 aa, Borrelia burgdorferi B31
WYWAEEIMSPF

SEQ ID NO: 66248 - protein, 11 aa, Borrelia burgdorferi B31
WYTWYWAEEIM

SEQ ID NO: 66249 - protein, 11 aa, Borrelia burgdorferi B31
IMSPFITGYSY

SEQ ID NO: 66250 - protein, 11 aa, Borrelia burgdorferi B31
EIDPEYLLPPF

SEQ ID NO: 66251 - protein, 11 aa, Borrelia burgdorferi B31
KPKNTCYISFY

SEQ ID NO: 66252 - protein, 11 aa, Borrelia burgdorferi B31
TMIYRSADTWY

SEQ ID NO: 66253 - protein, 11 aa, Borrelia burgdorferi B31
APSLDSLIEYL

SEQ ID NO: 66254 - protein, 11 aa, Borrelia burgdorferi B31
WAEEIMSPFIT

SEQ ID NO: 66255 - protein, 11 aa, Borrelia burgdorferi B31
LIEYLEHMILF

SEQ ID NO: 66256 - protein, 11 aa, Borrelia burgdorferi B31
TPVGTLTAKFA

SEQ ID NO: 66257 - protein, 11 aa, Borrelia burgdorferi B31
FAMEGSILTRS

SEQ ID NO: 66258 - protein, 11 aa, Borrelia burgdorferi B31
YRSADTWYTWY

SEQ ID NO: 66259 - protein, 11 aa, Borrelia burgdorferi B31
RSLGHTQEDSY

SEQ ID NO: 66260 - protein, 11 aa, Borrelia burgdorferi B31
DPEYLLPPFTS

SEQ ID NO: 66261 - protein, 11 aa, Borrelia burgdorferi B31
LIQAFTNTNKF

SEQ ID NO: 66262 - protein, 11 aa, Borrelia burgdorferi B31
MTMIYRSADTW

SEQ ID NO: 66263 - protein, 11 aa, Borrelia burgdorferi B31
PVGTLTAKFAM

SEQ ID NO: 66264 - protein, 9 aa, Borrelia burgdorferi B31
EEIDPEYLL

SEQ ID NO: 66265 - protein, 9 aa, Borrelia burgdorferi B31
EEIMSPFIT

SEQ ID NO: 66266 - protein, 9 aa, Borrelia burgdorferi B31
AEEIMSPFI

SEQ ID NO: 66267 - protein, 9 aa, Borrelia burgdorferi B31
YEITKNAPS

SEQ ID NO: 66268 - protein, 10 aa, Borrelia burgdorferi B31
EEIDPEYLLP

SEQ ID NO: 66269 - protein, 10 aa, Borrelia burgdorferi B31
EEIMSPFITG

SEQ ID NO: 66270 - protein, 10 aa, Borrelia burgdorferi B31
AEEIMSPFIT

SEQ ID NO: 66271 - protein, 10 aa, Borrelia burgdorferi B31
IEYLEHMILF

SEQ ID NO: 66272 - protein, 10 aa, Borrelia burgdorferi B31
YEITKNAPSL

SEQ ID NO: 66273 - protein, 10 aa, Borrelia burgdorferi B31
KETKPKNTCY

SEQ ID NO: 66274 - protein, 11 aa, Borrelia burgdorferi B31
EEIMSPFITGY

SEQ ID NO: 66275 - protein, 11 aa, Borrelia burgdorferi B31
EEIDPEYLLPP

SEQ ID NO: 66276 - protein, 11 aa, Borrelia burgdorferi B31
IEYLEHMILFF

SEQ ID NO: 66277 - protein, 11 aa, Borrelia burgdorferi B31
KEYEITKNAPS

SEQ ID NO: 66278 - protein, 9 aa, Borrelia burgdorferi B31
LPPFTSQSG

SEQ ID NO: 66279 - protein, 10 aa, Borrelia burgdorferi B31
LPSNCYAYKV

SEQ ID NO: 66280 - protein, 10 aa, Borrelia burgdorferi B31
LPPFTSQSGS

SEQ ID NO: 66281 - protein, 11 aa, Borrelia burgdorferi B31
LPSNCYAYKVL

SEQ ID NO: 66282 - protein, 11 aa, Borrelia burgdorferi B31
LPPFTSQSGSK

SEQ ID NO: 66283 - protein, 11 aa, Borrelia burgdorferi B31
EPILLKDKLTF

SEQ ID NO: 66284 - protein, 9 aa, Borrelia burgdorferi B31
RSADTWYTW

SEQ ID NO: 66285 - protein, 9 aa, Borrelia burgdorferi B31
ETKPKNTCY

SEQ ID NO: 66286 - protein, 9 aa, Borrelia burgdorferi B31
IMSPFITGY

SEQ ID NO: 66287 - protein, 9 aa, Borrelia burgdorferi B31
MIYRSADTW

SEQ ID NO: 66288 - protein, 10 aa, Borrelia burgdorferi B31
YSYEEIDPEY

SEQ ID NO: 66289 - protein, 11 aa, Borrelia burgdorferi B31
MTMIYRSADTW

SEQ ID NO: 66290 - protein, 11 aa, Borrelia burgdorferi B31
RSADTWYTWYW

SEQ ID NO: 66291 - protein, 9 aa, Borrelia burgdorferi B31
KIDDYNLQY

SEQ ID NO: 66292 - protein, 9 aa, Borrelia burgdorferi B31
LTKNIFLSY

SEQ ID NO: 66293 - protein, 9 aa, Borrelia burgdorferi B31
FLSYKGNSY

SEQ ID NO: 66294 - protein, 9 aa, Borrelia burgdorferi B31
YTTSKWTFF

SEQ ID NO: 66295 - protein, 10 aa, Borrelia burgdorferi B31
EIDKSKIDDY

SEQ ID NO: 66296 - protein, 10 aa, Borrelia burgdorferi B31
YLTKNIFLSY

SEQ ID NO: 66297 - protein, 10 aa, Borrelia burgdorferi B31
FSDTTLFQEK

SEQ ID NO: 66298 - protein, 11 aa, Borrelia burgdorferi B31
LTSTFLLGIIF

SEQ ID NO: 66299 - protein, 11 aa, Borrelia burgdorferi B31
TTSKWTFFDVF

SEQ ID NO: 66300 - protein, 11 aa, Borrelia burgdorferi B31
KSGEGDSRLAY

SEQ ID NO: 66301 - protein, 9 aa, Borrelia burgdorferi B31
KLFDNNNKL

SEQ ID NO: 66302 - protein, 9 aa, Borrelia burgdorferi B31
VVLTSTFLL

SEQ ID NO: 66303 - protein, 9 aa, Borrelia burgdorferi B31
SLIKALDEL

SEQ ID NO: 66304 - protein, 9 aa, Borrelia burgdorferi B31
FLLGIIFSN

SEQ ID NO: 66305 - protein, 9 aa, Borrelia burgdorferi B31
KLENLSFKI

SEQ ID NO: 66306 - protein, 9 aa, Borrelia burgdorferi B31
YLTKNIFLS

SEQ ID NO: 66307 - protein, 9 aa, Borrelia burgdorferi B31
LTSTFLLGI

SEQ ID NO: 66308 - protein, 9 aa, Borrelia burgdorferi B31
KFFDFDFNL

SEQ ID NO: 66309 - protein, 9 aa, Borrelia burgdorferi B31
KILIIVVLT

SEQ ID NO: 66310 - protein, 9 aa, Borrelia burgdorferi B31
WTFFDVFDL

SEQ ID NO: 66311 - protein, 9 aa, Borrelia burgdorferi B31
IIFSNENKV

SEQ ID NO: 66312 - protein, 9 aa, Borrelia burgdorferi B31
LISKIETEL

SEQ ID NO: 66313 - protein, 9 aa, Borrelia burgdorferi B31
MTKPKIFSI

SEQ ID NO: 66314 - protein, 9 aa, Borrelia burgdorferi B31
KIKILIIVV

SEQ ID NO: 66315 - protein, 9 aa, Borrelia burgdorferi B31
KLLTEIFVG

SEQ ID NO: 66316 - protein, 10 aa, Borrelia burgdorferi B31
FMTKPKIFSI

SEQ ID NO: 66317 - protein, 10 aa, Borrelia burgdorferi B31
VLTSTFLLGI

SEQ ID NO: 66318 - protein, 10 aa, Borrelia burgdorferi B31
KLFDNNNKLL

SEQ ID NO: 66319 - protein, 10 aa, Borrelia burgdorferi B31
NLISKIETEL

SEQ ID NO: 66320 - protein, 10 aa, Borrelia burgdorferi B31
LTYNKQNIPV

SEQ ID NO: 66321 - protein, 10 aa, Borrelia burgdorferi B31
IISKDGLYFL

SEQ ID NO: 66322 - protein, 10 aa, Borrelia burgdorferi B31
TTSKWTFFDV

SEQ ID NO: 66323 - protein, 10 aa, Borrelia burgdorferi B31
KMTKERPLNI

SEQ ID NO: 66324 - protein, 10 aa, Borrelia burgdorferi B31
TLFQEKNTKL

SEQ ID NO: 66325 - protein, 10 aa, Borrelia burgdorferi B31
ILIIVVLTST

SEQ ID NO: 66326 - protein, 10 aa, Borrelia burgdorferi B31
FLLGIIFSNE

SEQ ID NO: 66327 - protein, 10 aa, Borrelia burgdorferi B31
KIFSINKEKI

SEQ ID NO: 66328 - protein, 10 aa, Borrelia burgdorferi B31
KLNKENENNI

SEQ ID NO: 66329 - protein, 10 aa, Borrelia burgdorferi B31
IVVLTSTFLL

SEQ ID NO: 66330 - protein, 10 aa, Borrelia burgdorferi B31
NLSFKIIRKL

SEQ ID NO: 66331 - protein, 10 aa, Borrelia burgdorferi B31
ALDELQKNKL

SEQ ID NO: 66332 - protein, 10 aa, Borrelia burgdorferi B31
IIVVLTSTFL

SEQ ID NO: 66333 - protein, 10 aa, Borrelia burgdorferi B31
KFFDFDFNLI

SEQ ID NO: 66334 - protein, 10 aa, Borrelia burgdorferi B31
IIAEFKADGL

SEQ ID NO: 66335 - protein, 10 aa, Borrelia burgdorferi B31
KLENLSFKII

SEQ ID NO: 66336 - protein, 10 aa, Borrelia burgdorferi B31
GIIFSNENKV

SEQ ID NO: 66337 - protein, 11 aa, Borrelia burgdorferi B31
KIDDYNLQYKI

SEQ ID NO: 66338 - protein, 11 aa, Borrelia burgdorferi B31
VVLTSTFLLGI

SEQ ID NO: 66339 - protein, 11 aa, Borrelia burgdorferi B31
ILTYNKQNIPV

SEQ ID NO: 66340 - protein, 11 aa, Borrelia burgdorferi B31
KLFDNNNKLLT

SEQ ID NO: 66341 - protein, 11 aa, Borrelia burgdorferi B31
ALDELQKNKLV

SEQ ID NO: 66342 - protein, 11 aa, Borrelia burgdorferi B31
IIVVLTSTFLL

SEQ ID NO: 66343 - protein, 11 aa, Borrelia burgdorferi B31
YTTSKWTFFDV

SEQ ID NO: 66344 - protein, 11 aa, Borrelia burgdorferi B31
FLSYKGNSYNT

SEQ ID NO: 66345 - protein, 11 aa, Borrelia burgdorferi B31
LIIVVLTSTFL

SEQ ID NO: 66346 - protein, 11 aa, Borrelia burgdorferi B31
VLTSTFLLGII

SEQ ID NO: 66347 - protein, 11 aa, Borrelia burgdorferi B31
YIKGSDENVYL

SEQ ID NO: 66348 - protein, 11 aa, Borrelia burgdorferi B31
KILIIVVLTST

SEQ ID NO: 66349 - protein, 11 aa, Borrelia burgdorferi B31
KMTKERPLNII

SEQ ID NO: 66350 - protein, 11 aa, Borrelia burgdorferi B31
FLLGIIFSNEN

SEQ ID NO: 66351 - protein, 11 aa, Borrelia burgdorferi B31
TLTKLGKDWIL

SEQ ID NO: 66352 - protein, 11 aa, Borrelia burgdorferi B31
KLLTEIFVGKS

SEQ ID NO: 66353 - protein, 9 aa, Borrelia burgdorferi B31
GLYFLNNQK

SEQ ID NO: 66354 - protein, 9 aa, Borrelia burgdorferi B31
FLNNQKMTK

SEQ ID NO: 66355 - protein, 9 aa, Borrelia burgdorferi B31
KIFSINKEK

SEQ ID NO: 66356 - protein, 9 aa, Borrelia burgdorferi B31
NLSFKIIRK

SEQ ID NO: 66357 - protein, 9 aa, Borrelia burgdorferi B31
KIEVKWSNK

SEQ ID NO: 66358 - protein, 9 aa, Borrelia burgdorferi B31
KLVSRDQKK

SEQ ID NO: 66359 - protein, 9 aa, Borrelia burgdorferi B31
LLTEIFVGK

SEQ ID NO: 66360 - protein, 9 aa, Borrelia burgdorferi B31
GIGENPSFK

SEQ ID NO: 66361 - protein, 9 aa, Borrelia burgdorferi B31
KVARILEEK

SEQ ID NO: 66362 - protein, 9 aa, Borrelia burgdorferi B31
LTKNIFLSY

SEQ ID NO: 66363 - protein, 9 aa, Borrelia burgdorferi B31
TLFQEKNTK

SEQ ID NO: 66364 - protein, 9 aa, Borrelia burgdorferi B31
KNKGVFMTK

SEQ ID NO: 66365 - protein, 9 aa, Borrelia burgdorferi B31
GIIFSNENK

SEQ ID NO: 66366 - protein, 9 aa, Borrelia burgdorferi B31
PLNIIAEFK

SEQ ID NO: 66367 - protein, 9 aa, Borrelia burgdorferi B31
KIDDYNLQY

SEQ ID NO: 66368 - protein, 9 aa, Borrelia burgdorferi B31
KQNIPVDNK

SEQ ID NO: 66369 - protein, 9 aa, Borrelia burgdorferi B31
ALDELQKNK

SEQ ID NO: 66370 - protein, 10 aa, Borrelia burgdorferi B31
KLLTEIFVGK

SEQ ID NO: 66371 - protein, 10 aa, Borrelia burgdorferi B31
LTKNIFLSYK

SEQ ID NO: 66372 - protein, 10 aa, Borrelia burgdorferi B31
RPLNIIAEFK

SEQ ID NO: 66373 - protein, 10 aa, Borrelia burgdorferi B31
KIDDYNLQYK

SEQ ID NO: 66374 - protein, 10 aa, Borrelia burgdorferi B31
YFLNNQKMTK

SEQ ID NO: 66375 - protein, 10 aa, Borrelia burgdorferi B31
TTLFQEKNTK

SEQ ID NO: 66376 - protein, 10 aa, Borrelia burgdorferi B31
YLTKNIFLSY

SEQ ID NO: 66377 - protein, 10 aa, Borrelia burgdorferi B31
NTKLENLSFK

SEQ ID NO: 66378 - protein, 10 aa, Borrelia burgdorferi B31
SFKIIRKLNK

SEQ ID NO: 66379 - protein, 10 aa, Borrelia burgdorferi B31
GSDENVYLTK

SEQ ID NO: 66380 - protein, 10 aa, Borrelia burgdorferi B31
INNNYEIISK

SEQ ID NO: 66381 - protein, 10 aa, Borrelia burgdorferi B31
TFFDVFDLEK

SEQ ID NO: 66382 - protein, 10 aa, Borrelia burgdorferi B31
KDEYYYTTSK

SEQ ID NO: 66383 - protein, 10 aa, Borrelia burgdorferi B31
IFLSYKGNSY

SEQ ID NO: 66384 - protein, 10 aa, Borrelia burgdorferi B31
LIKALDELQK

SEQ ID NO: 66385 - protein, 10 aa, Borrelia burgdorferi B31
NKNKGVFMTK

SEQ ID NO: 66386 - protein, 10 aa, Borrelia burgdorferi B31
LEGTLTKLGK

SEQ ID NO: 66387 - protein, 10 aa, Borrelia burgdorferi B31
FDFDFNLISK

SEQ ID NO: 66388 - protein, 10 aa, Borrelia burgdorferi B31
KLGKDWILTY

SEQ ID NO: 66389 - protein, 10 aa, Borrelia burgdorferi B31
FSDTTLFQEK

SEQ ID NO: 66390 - protein, 10 aa, Borrelia burgdorferi B31
LLEKEKQINK

SEQ ID NO: 66391 - protein, 10 aa, Borrelia burgdorferi B31
KALDELQKNK

SEQ ID NO: 66392 - protein, 10 aa, Borrelia burgdorferi B31
LGIGENPSFK

SEQ ID NO: 66393 - protein, 10 aa, Borrelia burgdorferi B31
ENLSFKIIRK

SEQ ID NO: 66394 - protein, 10 aa, Borrelia burgdorferi B31
LVSRDQKKHK

SEQ ID NO: 66395 - protein, 11 aa, Borrelia burgdorferi B31
LSFKIIRKLNK

SEQ ID NO: 66396 - protein, 11 aa, Borrelia burgdorferi B31
MTKPKIFSINK

SEQ ID NO: 66397 - protein, 11 aa, Borrelia burgdorferi B31
KIFSINKEKIK

SEQ ID NO: 66398 - protein, 11 aa, Borrelia burgdorferi B31
YLTKNIFLSYK

SEQ ID NO: 66399 - protein, 11 aa, Borrelia burgdorferi B31
SVNNIEVYFNK

SEQ ID NO: 66400 - protein, 11 aa, Borrelia burgdorferi B31
KLVSRDQKKHK

SEQ ID NO: 66401 - protein, 11 aa, Borrelia burgdorferi B31
LLGIIFSNENK

SEQ ID NO: 66402 - protein, 11 aa, Borrelia burgdorferi B31
SLIKALDELQK

SEQ ID NO: 66403 - protein, 11 aa, Borrelia burgdorferi B31
NINNNYEIISK

SEQ ID NO: 66404 - protein, 11 aa, Borrelia burgdorferi B31
KLENLSFKIIR

SEQ ID NO: 66405 - protein, 11 aa, Borrelia burgdorferi B31
FLNNQKMTKER

SEQ ID NO: 66406 - protein, 11 aa, Borrelia burgdorferi B31
LYFLNNQKMTK

SEQ ID NO: 66407 - protein, 11 aa, Borrelia burgdorferi B31
IIFSNENKVAR

SEQ ID NO: 66408 - protein, 11 aa, Borrelia burgdorferi B31
WTFFDVFDLEK

SEQ ID NO: 66409 - protein, 11 aa, Borrelia burgdorferi B31
TFFDVFDLEKK

SEQ ID NO: 66410 - protein, 11 aa, Borrelia burgdorferi B31
ELGIGENPSFK

SEQ ID NO: 66411 - protein, 9 aa, Borrelia burgdorferi B31
GLYFLNNQK

SEQ ID NO: 66412 - protein, 9 aa, Borrelia burgdorferi B31
GIIFSNENK

SEQ ID NO: 66413 - protein, 9 aa, Borrelia burgdorferi B31
KVARILEEK

SEQ ID NO: 66414 - protein, 9 aa, Borrelia burgdorferi B31
KIFSINKEK

SEQ ID NO: 66415 - protein, 9 aa, Borrelia burgdorferi B31
GIGENPSFK

SEQ ID NO: 66416 - protein, 9 aa, Borrelia burgdorferi B31
KQNIPVDNK

SEQ ID NO: 66417 - protein, 9 aa, Borrelia burgdorferi B31
KIEVKWSNK

SEQ ID NO: 66418 - protein, 9 aa, Borrelia burgdorferi B31
NLSFKIIRK

SEQ ID NO: 66419 - protein, 9 aa, Borrelia burgdorferi B31
TLFQEKNTK

SEQ ID NO: 66420 - protein, 9 aa, Borrelia burgdorferi B31
LLTEIFVGK

SEQ ID NO: 66421 - protein, 9 aa, Borrelia burgdorferi B31
TKNIFLSYK

SEQ ID NO: 66422 - protein, 9 aa, Borrelia burgdorferi B31
FLNNQKMTK

SEQ ID NO: 66423 - protein, 9 aa, Borrelia burgdorferi B31
KADGLEIDK

SEQ ID NO: 66424 - protein, 9 aa, Borrelia burgdorferi B31
LTKNIFLSY

SEQ ID NO: 66425 - protein, 9 aa, Borrelia burgdorferi B31
KLVSRDQKK

SEQ ID NO: 66426 - protein, 9 aa, Borrelia burgdorferi B31
KIDDYNLQY

SEQ ID NO: 66427 - protein, 9 aa, Borrelia burgdorferi B31
PLNIIAEFK

SEQ ID NO: 66428 - protein, 9 aa, Borrelia burgdorferi B31
KNKGVFMTK

SEQ ID NO: 66429 - protein, 9 aa, Borrelia burgdorferi B31
ALDELQKNK

SEQ ID NO: 66430 - protein, 9 aa, Borrelia burgdorferi B31
TKLENLSFK

SEQ ID NO: 66431 - protein, 9 aa, Borrelia burgdorferi B31
NNIEVYFNK

SEQ ID NO: 66432 - protein, 9 aa, Borrelia burgdorferi B31
KPKIFSINK

SEQ ID NO: 66433 - protein, 9 aa, Borrelia burgdorferi B31
TELEGTLTK

SEQ ID NO: 66434 - protein, 9 aa, Borrelia burgdorferi B31
NLQYKIEVK

SEQ ID NO: 66435 - protein, 9 aa, Borrelia burgdorferi B31
KDWILTYNK

SEQ ID NO: 66436 - protein, 9 aa, Borrelia burgdorferi B31
KGVFMTKPK

SEQ ID NO: 66437 - protein, 10 aa, Borrelia burgdorferi B31
LTKNIFLSYK

SEQ ID NO: 66438 - protein, 10 aa, Borrelia burgdorferi B31
TTLFQEKNTK

SEQ ID NO: 66439 - protein, 10 aa, Borrelia burgdorferi B31
KIDDYNLQYK

SEQ ID NO: 66440 - protein, 10 aa, Borrelia burgdorferi B31
TFFDVFDLEK

SEQ ID NO: 66441 - protein, 10 aa, Borrelia burgdorferi B31
KLLTEIFVGK

SEQ ID NO: 66442 - protein, 10 aa, Borrelia burgdorferi B31
GSDENVYLTK

SEQ ID NO: 66443 - protein, 10 aa, Borrelia burgdorferi B31
NTKLENLSFK

SEQ ID NO: 66444 - protein, 10 aa, Borrelia burgdorferi B31
KALDELQKNK

SEQ ID NO: 66445 - protein, 10 aa, Borrelia burgdorferi B31
KQNIPVDNKK

SEQ ID NO: 66446 - protein, 10 aa, Borrelia burgdorferi B31
FSDTTLFQEK

SEQ ID NO: 66447 - protein, 10 aa, Borrelia burgdorferi B31
LIKALDELQK

SEQ ID NO: 66448 - protein, 10 aa, Borrelia burgdorferi B31
VNNIEVYFNK

SEQ ID NO: 66449 - protein, 10 aa, Borrelia burgdorferi B31
RPLNIIAEFK

SEQ ID NO: 66450 - protein, 10 aa, Borrelia burgdorferi B31
LVSRDQKKHK

SEQ ID NO: 66451 - protein, 10 aa, Borrelia burgdorferi B31
ETELEGTLTK

SEQ ID NO: 66452 - protein, 10 aa, Borrelia burgdorferi B31
SFKIIRKLNK

SEQ ID NO: 66453 - protein, 10 aa, Borrelia burgdorferi B31
STFLLGIIFS

SEQ ID NO: 66454 - protein, 10 aa, Borrelia burgdorferi B31
NTFSDTTLFQ

SEQ ID NO: 66455 - protein, 10 aa, Borrelia burgdorferi B31
SFKLFDNNNK

SEQ ID NO: 66456 - protein, 10 aa, Borrelia burgdorferi B31
INNNYEIISK

SEQ ID NO: 66457 - protein, 11 aa, Borrelia burgdorferi B31
SVNNIEVYFNK

SEQ ID NO: 66458 - protein, 11 aa, Borrelia burgdorferi B31
MTKPKIFSINK

SEQ ID NO: 66459 - protein, 11 aa, Borrelia burgdorferi B31
WTFFDVFDLEK

SEQ ID NO: 66460 - protein, 11 aa, Borrelia burgdorferi B31
LSFKIIRKLNK

SEQ ID NO: 66461 - protein, 11 aa, Borrelia burgdorferi B31
SLIKALDELQK

SEQ ID NO: 66462 - protein, 11 aa, Borrelia burgdorferi B31
KIFSINKEKIK

SEQ ID NO: 66463 - protein, 11 aa, Borrelia burgdorferi B31
TFSDTTLFQEK

SEQ ID NO: 66464 - protein, 11 aa, Borrelia burgdorferi B31
YLTKNIFLSYK

SEQ ID NO: 66465 - protein, 11 aa, Borrelia burgdorferi B31
TFFDVFDLEKK

SEQ ID NO: 66466 - protein, 11 aa, Borrelia burgdorferi B31
NINNNYEIISK

SEQ ID NO: 66467 - protein, 11 aa, Borrelia burgdorferi B31
PSFKLFDNNNK

SEQ ID NO: 66468 - protein, 11 aa, Borrelia burgdorferi B31
LLGIIFSNENK

SEQ ID NO: 66469 - protein, 11 aa, Borrelia burgdorferi B31
IIFSNENKVAR

SEQ ID NO: 66470 - protein, 11 aa, Borrelia burgdorferi B31
KADGLEIDKSK

SEQ ID NO: 66471 - protein, 11 aa, Borrelia burgdorferi B31
KLVSRDQKKHK

SEQ ID NO: 66472 - protein, 11 aa, Borrelia burgdorferi B31
STFLLGIIFSN

SEQ ID NO: 66473 - protein, 11 aa, Borrelia burgdorferi B31
LYFLNNQKMTK

SEQ ID NO: 66474 - protein, 11 aa, Borrelia burgdorferi B31
KGSDENVYLTK

SEQ ID NO: 66475 - protein, 11 aa, Borrelia burgdorferi B31
KLENLSFKIIR

SEQ ID NO: 66476 - protein, 11 aa, Borrelia burgdorferi B31
SKIDDYNLQYK

SEQ ID NO: 66477 - protein, 11 aa, Borrelia burgdorferi B31
KNTKLENLSFK

SEQ ID NO: 66478 - protein, 11 aa, Borrelia burgdorferi B31
DTTLFQEKNTK

SEQ ID NO: 66479 - protein, 9 aa, Borrelia burgdorferi B31
YYTTSKWTF

SEQ ID NO: 66480 - protein, 9 aa, Borrelia burgdorferi B31
VYLTKNIFL

SEQ ID NO: 66481 - protein, 9 aa, Borrelia burgdorferi B31
VFMTKPKIF

SEQ ID NO: 66482 - protein, 9 aa, Borrelia burgdorferi B31
EYYYTTSKW

SEQ ID NO: 66483 - protein, 9 aa, Borrelia burgdorferi B31
VVLTSTFLL

SEQ ID NO: 66484 - protein, 9 aa, Borrelia burgdorferi B31
FFDFDFNLI

SEQ ID NO: 66485 - protein, 9 aa, Borrelia burgdorferi B31
YYYTTSKWT

SEQ ID NO: 66486 - protein, 9 aa, Borrelia burgdorferi B31
LYFLNNQKM

SEQ ID NO: 66487 - protein, 9 aa, Borrelia burgdorferi B31
YTTSKWTFF

SEQ ID NO: 66488 - protein, 9 aa, Borrelia burgdorferi B31
TYNKQNIPV

SEQ ID NO: 66489 - protein, 10 aa, Borrelia burgdorferi B31
YYYTTSKWTF

SEQ ID NO: 66490 - protein, 10 aa, Borrelia burgdorferi B31
SYKGNSYNTF

SEQ ID NO: 66491 - protein, 10 aa, Borrelia burgdorferi B31
YYTTSKWTFF

SEQ ID NO: 66492 - protein, 10 aa, Borrelia burgdorferi B31
KWSNKSVNNI

SEQ ID NO: 66493 - protein, 10 aa, Borrelia burgdorferi B31
SYNTFSDTTL

SEQ ID NO: 66494 - protein, 10 aa, Borrelia burgdorferi B31
KFFDFDFNLI

SEQ ID NO: 66495 - protein, 10 aa, Borrelia burgdorferi B31
VYLTKNIFLS

SEQ ID NO: 66496 - protein, 10 aa, Borrelia burgdorferi B31
KWTFFDVFDL

SEQ ID NO: 66497 - protein, 10 aa, Borrelia burgdorferi B31
IVVLTSTFLL

SEQ ID NO: 66498 - protein, 10 aa, Borrelia burgdorferi B31
TSKWTFFDVF

SEQ ID NO: 66499 - protein, 11 aa, Borrelia burgdorferi B31
EYYYTTSKWTF

SEQ ID NO: 66500 - protein, 11 aa, Borrelia burgdorferi B31
YYYTTSKWTFF

SEQ ID NO: 66501 - protein, 11 aa, Borrelia burgdorferi B31
SYNTFSDTTLF

SEQ ID NO: 66502 - protein, 11 aa, Borrelia burgdorferi B31
VFMTKPKIFSI

SEQ ID NO: 66503 - protein, 11 aa, Borrelia burgdorferi B31
DWILTYNKQNI

SEQ ID NO: 66504 - protein, 11 aa, Borrelia burgdorferi B31
VYLTKNIFLSY

SEQ ID NO: 66505 - protein, 11 aa, Borrelia burgdorferi B31
ILIIVVLTSTF

SEQ ID NO: 66506 - protein, 11 aa, Borrelia burgdorferi B31
IFSNENKVARI

SEQ ID NO: 66507 - protein, 11 aa, Borrelia burgdorferi B31
TTSKWTFFDVF

SEQ ID NO: 66508 - protein, 9 aa, Borrelia burgdorferi B31
KIDDYNLQY

SEQ ID NO: 66509 - protein, 9 aa, Borrelia burgdorferi B31
SVNNIEVYF

SEQ ID NO: 66510 - protein, 9 aa, Borrelia burgdorferi B31
EIISKDGLY

SEQ ID NO: 66511 - protein, 9 aa, Borrelia burgdorferi B31
FLSYKGNSY

SEQ ID NO: 66512 - protein, 9 aa, Borrelia burgdorferi B31
YYTTSKWTF

SEQ ID NO: 66513 - protein, 9 aa, Borrelia burgdorferi B31
KFFDFDFNL

SEQ ID NO: 66514 - protein, 9 aa, Borrelia burgdorferi B31
LTKNIFLSY

SEQ ID NO: 66515 - protein, 9 aa, Borrelia burgdorferi B31
IISKDGLYF

SEQ ID NO: 66516 - protein, 9 aa, Borrelia burgdorferi B31
STFLLGIIF

SEQ ID NO: 66517 - protein, 10 aa, Borrelia burgdorferi B31
YLTKNIFLSY

SEQ ID NO: 66518 - protein, 10 aa, Borrelia burgdorferi B31
YYYTTSKWTF

SEQ ID NO: 66519 - protein, 10 aa, Borrelia burgdorferi B31
IFLSYKGNSY

SEQ ID NO: 66520 - protein, 10 aa, Borrelia burgdorferi B31
YYTTSKWTFF

SEQ ID NO: 66521 - protein, 10 aa, Borrelia burgdorferi B31
KLGKDWILTY

SEQ ID NO: 66522 - protein, 10 aa, Borrelia burgdorferi B31
SKIDDYNLQY

SEQ ID NO: 66523 - protein, 10 aa, Borrelia burgdorferi B31
EIISKDGLYF

SEQ ID NO: 66524 - protein, 10 aa, Borrelia burgdorferi B31
YIKGSDENVY

SEQ ID NO: 66525 - protein, 10 aa, Borrelia burgdorferi B31
ILIKKDKDEY

SEQ ID NO: 66526 - protein, 11 aa, Borrelia burgdorferi B31
VYLTKNIFLSY

SEQ ID NO: 66527 - protein, 11 aa, Borrelia burgdorferi B31
YYYTTSKWTFF

SEQ ID NO: 66528 - protein, 11 aa, Borrelia burgdorferi B31
AYIKGSDENVY

SEQ ID NO: 66529 - protein, 11 aa, Borrelia burgdorferi B31
ILIKKDKDEYY

SEQ ID NO: 66530 - protein, 11 aa, Borrelia burgdorferi B31
SYNTFSDTTLF

SEQ ID NO: 66531 - protein, 11 aa, Borrelia burgdorferi B31
EYYYTTSKWTF

SEQ ID NO: 66532 - protein, 11 aa, Borrelia burgdorferi B31
NYEIISKDGLY

SEQ ID NO: 66533 - protein, 11 aa, Borrelia burgdorferi B31
LIKKDKDEYYY

SEQ ID NO: 66534 - protein, 11 aa, Borrelia burgdorferi B31
KSKIDDYNLQY

SEQ ID NO: 66535 - protein, 11 aa, Borrelia burgdorferi B31
NIFLSYKGNSY

SEQ ID NO: 66536 - protein, 11 aa, Borrelia burgdorferi B31
ILIIVVLTSTF

SEQ ID NO: 66537 - protein, 11 aa, Borrelia burgdorferi B31
ILEEKFFDFDF

SEQ ID NO: 66538 - protein, 9 aa, Borrelia burgdorferi B31
FSNENKVAR

SEQ ID NO: 66539 - protein, 9 aa, Borrelia burgdorferi B31
NNIEVYFNK

SEQ ID NO: 66540 - protein, 9 aa, Borrelia burgdorferi B31
NTFSDTTLF

SEQ ID NO: 66541 - protein, 9 aa, Borrelia burgdorferi B31
TLFQEKNTK

SEQ ID NO: 66542 - protein, 9 aa, Borrelia burgdorferi B31
GIIFSNENK

SEQ ID NO: 66543 - protein, 9 aa, Borrelia burgdorferi B31
KVARILEEK

SEQ ID NO: 66544 - protein, 9 aa, Borrelia burgdorferi B31
KIFSINKEK

SEQ ID NO: 66545 - protein, 9 aa, Borrelia burgdorferi B31
EVYFNKNEE

SEQ ID NO: 66546 - protein, 9 aa, Borrelia burgdorferi B31
ENLSFKIIR

SEQ ID NO: 66547 - protein, 9 aa, Borrelia burgdorferi B31
GLYFLNNQK

SEQ ID NO: 66548 - protein, 9 aa, Borrelia burgdorferi B31
DEYYYTTSK

SEQ ID NO: 66549 - protein, 9 aa, Borrelia burgdorferi B31
LLTEIFVGK

SEQ ID NO: 66550 - protein, 9 aa, Borrelia burgdorferi B31
TKNIFLSYK

SEQ ID NO: 66551 - protein, 9 aa, Borrelia burgdorferi B31
FLNNQKMTK

SEQ ID NO: 66552 - protein, 9 aa, Borrelia burgdorferi B31
NLSFKIIRK

SEQ ID NO: 66553 - protein, 9 aa, Borrelia burgdorferi B31
TTSKWTFFD

SEQ ID NO: 66554 - protein, 9 aa, Borrelia burgdorferi B31
PLNIIAEFK

SEQ ID NO: 66555 - protein, 9 aa, Borrelia burgdorferi B31
FSINKEKIK

SEQ ID NO: 66556 - protein, 9 aa, Borrelia burgdorferi B31
NNNYEIISK

SEQ ID NO: 66557 - protein, 9 aa, Borrelia burgdorferi B31
NLQYKIEVK

SEQ ID NO: 66558 - protein, 9 aa, Borrelia burgdorferi B31
EIISKDGLY

SEQ ID NO: 66559 - protein, 9 aa, Borrelia burgdorferi B31
LTKNIFLSY

SEQ ID NO: 66560 - protein, 9 aa, Borrelia burgdorferi B31
YTTSKWTFF

SEQ ID NO: 66561 - protein, 9 aa, Borrelia burgdorferi B31
EGTLTKLGK

SEQ ID NO: 66562 - protein, 9 aa, Borrelia burgdorferi B31
SVNNIEVYF

SEQ ID NO: 66563 - protein, 9 aa, Borrelia burgdorferi B31
QNIPVDNKK

SEQ ID NO: 66564 - protein, 9 aa, Borrelia burgdorferi B31
NNQKMTKER

SEQ ID NO: 66565 - protein, 9 aa, Borrelia burgdorferi B31
FFDVFDLEK

SEQ ID NO: 66566 - protein, 10 aa, Borrelia burgdorferi B31
NTKLENLSFK

SEQ ID NO: 66567 - protein, 10 aa, Borrelia burgdorferi B31
TFFDVFDLEK

SEQ ID NO: 66568 - protein, 10 aa, Borrelia burgdorferi B31
LTKNIFLSYK

SEQ ID NO: 66569 - protein, 10 aa, Borrelia burgdorferi B31
TTLFQEKNTK

SEQ ID NO: 66570 - protein, 10 aa, Borrelia burgdorferi B31
NTFSDTTLFQ

SEQ ID NO: 66571 - protein, 10 aa, Borrelia burgdorferi B31
ETELEGTLTK

SEQ ID NO: 66572 - protein, 10 aa, Borrelia burgdorferi B31
ELQKNKLVSR

SEQ ID NO: 66573 - protein, 10 aa, Borrelia burgdorferi B31
WTFFDVFDLE

SEQ ID NO: 66574 - protein, 10 aa, Borrelia burgdorferi B31
LIKALDELQK

SEQ ID NO: 66575 - protein, 10 aa, Borrelia burgdorferi B31
FDFDFNLISK

SEQ ID NO: 66576 - protein, 10 aa, Borrelia burgdorferi B31
ENLSFKIIRK

SEQ ID NO: 66577 - protein, 10 aa, Borrelia burgdorferi B31
EVYFNKNEEN

SEQ ID NO: 66578 - protein, 10 aa, Borrelia burgdorferi B31
LGIGENPSFK

SEQ ID NO: 66579 - protein, 10 aa, Borrelia burgdorferi B31
IFSNENKVAR

SEQ ID NO: 66580 - protein, 10 aa, Borrelia burgdorferi B31
LVSRDQKKHK

SEQ ID NO: 66581 - protein, 10 aa, Borrelia burgdorferi B31
FSDTTLFQEK

SEQ ID NO: 66582 - protein, 10 aa, Borrelia burgdorferi B31
LGIIFSNENK

SEQ ID NO: 66583 - protein, 10 aa, Borrelia burgdorferi B31
SFKLFDNNNK

SEQ ID NO: 66584 - protein, 10 aa, Borrelia burgdorferi B31
RPLNIIAEFK

SEQ ID NO: 66585 - protein, 10 aa, Borrelia burgdorferi B31
YLTKNIFLSY

SEQ ID NO: 66586 - protein, 10 aa, Borrelia burgdorferi B31
YTTSKWTFFD

SEQ ID NO: 66587 - protein, 10 aa, Borrelia burgdorferi B31
NKVARILEEK

SEQ ID NO: 66588 - protein, 10 aa, Borrelia burgdorferi B31
NKNKGVFMTK

SEQ ID NO: 66589 - protein, 10 aa, Borrelia burgdorferi B31
YKIEVKWSNK

SEQ ID NO: 66590 - protein, 11 aa, Borrelia burgdorferi B31
WTFFDVFDLEK

SEQ ID NO: 66591 - protein, 11 aa, Borrelia burgdorferi B31
SVNNIEVYFNK

SEQ ID NO: 66592 - protein, 11 aa, Borrelia burgdorferi B31
DTTLFQEKNTK

SEQ ID NO: 66593 - protein, 11 aa, Borrelia burgdorferi B31
IIFSNENKVAR

SEQ ID NO: 66594 - protein, 11 aa, Borrelia burgdorferi B31
MTKPKIFSINK

SEQ ID NO: 66595 - protein, 11 aa, Borrelia burgdorferi B31
YLTKNIFLSYK

SEQ ID NO: 66596 - protein, 11 aa, Borrelia burgdorferi B31
TFFDVFDLEKK

SEQ ID NO: 66597 - protein, 11 aa, Borrelia burgdorferi B31
NTFSDTTLFQE

SEQ ID NO: 66598 - protein, 11 aa, Borrelia burgdorferi B31
LSFKIIRKLNK

SEQ ID NO: 66599 - protein, 11 aa, Borrelia burgdorferi B31
FLNNQKMTKER

SEQ ID NO: 66600 - protein, 11 aa, Borrelia burgdorferi B31
NINNNYEIISK

SEQ ID NO: 66601 - protein, 11 aa, Borrelia burgdorferi B31
LYFLNNQKMTK

SEQ ID NO: 66602 - protein, 11 aa, Borrelia burgdorferi B31
TFSDTTLFQEK

SEQ ID NO: 66603 - protein, 11 aa, Borrelia burgdorferi B31
FVGKSGEGDSR

SEQ ID NO: 66604 - protein, 11 aa, Borrelia burgdorferi B31
SLIKALDELQK

SEQ ID NO: 66605 - protein, 11 aa, Borrelia burgdorferi B31
ELGIGENPSFK

SEQ ID NO: 66606 - protein, 11 aa, Borrelia burgdorferi B31
ELEGTLTKLGK

SEQ ID NO: 66607 - protein, 11 aa, Borrelia burgdorferi B31
ENKVARILEEK

SEQ ID NO: 66608 - protein, 11 aa, Borrelia burgdorferi B31
KIFSINKEKIK

SEQ ID NO: 66609 - protein, 11 aa, Borrelia burgdorferi B31
TTSKWTFFDVF

SEQ ID NO: 66610 - protein, 11 aa, Borrelia burgdorferi B31
LLGIIFSNENK

SEQ ID NO: 66611 - protein, 11 aa, Borrelia burgdorferi B31
PSFKLFDNNNK

SEQ ID NO: 66612 - protein, 11 aa, Borrelia burgdorferi B31
ERPLNIIAEFK

SEQ ID NO: 66613 - protein, 11 aa, Borrelia burgdorferi B31
NVYLTKNIFLS

SEQ ID NO: 66614 - protein, 11 aa, Borrelia burgdorferi B31
NIFLSYKGNSY

SEQ ID NO: 66615 - protein, 11 aa, Borrelia burgdorferi B31
EFKADGLEIDK

SEQ ID NO: 66616 - protein, 11 aa, Borrelia burgdorferi B31
DYNLQYKIEVK

SEQ ID NO: 66617 - protein, 11 aa, Borrelia burgdorferi B31
STFLLGIIFSN

SEQ ID NO: 66618 - protein, 9 aa, Borrelia burgdorferi B31
RPLNIIAEF

SEQ ID NO: 66619 - protein, 9 aa, Borrelia burgdorferi B31
KVNSLIKAL

SEQ ID NO: 66620 - protein, 9 aa, Borrelia burgdorferi B31
IVVLTSTFL

SEQ ID NO: 66621 - protein, 10 aa, Borrelia burgdorferi B31
IVVLTSTFLL

SEQ ID NO: 66622 - protein, 11 aa, Borrelia burgdorferi B31
IPVDNKKVNSL

SEQ ID NO: 66623 - protein, 11 aa, Borrelia burgdorferi B31
RPLNIIAEFKA

SEQ ID NO: 66624 - protein, 9 aa, Borrelia burgdorferi B31
RDQKKHKEL

SEQ ID NO: 66625 - protein, 10 aa, Borrelia burgdorferi B31
KIKILIIVVL

SEQ ID NO: 66626 - protein, 11 aa, Borrelia burgdorferi B31
NKKVNSLIKAL

SEQ ID NO: 66627 - protein, 11 aa, Borrelia burgdorferi B31
YIKGSDENVYL

SEQ ID NO: 66628 - protein, 9 aa, Borrelia burgdorferi B31
FLSYKGNSY

SEQ ID NO: 66629 - protein, 9 aa, Borrelia burgdorferi B31
LTKNIFLSY

SEQ ID NO: 66630 - protein, 9 aa, Borrelia burgdorferi B31
LGKDWILTY

SEQ ID NO: 66631 - protein, 9 aa, Borrelia burgdorferi B31
KSVNNIEVY

SEQ ID NO: 66632 - protein, 9 aa, Borrelia burgdorferi B31
STFLLGIIF

SEQ ID NO: 66633 - protein, 9 aa, Borrelia burgdorferi B31
IIVVLTSTF

SEQ ID NO: 66634 - protein, 9 aa, Borrelia burgdorferi B31
LGIGENPSF

SEQ ID NO: 66635 - protein, 9 aa, Borrelia burgdorferi B31
IISKDGLYF

SEQ ID NO: 66636 - protein, 9 aa, Borrelia burgdorferi B31
NTKLENLSF

SEQ ID NO: 66637 - protein, 9 aa, Borrelia burgdorferi B31
SVNNIEVYF

SEQ ID NO: 66638 - protein, 9 aa, Borrelia burgdorferi B31
KQINKNKGV

SEQ ID NO: 66639 - protein, 9 aa, Borrelia burgdorferi B31
KLFDNNNKL

SEQ ID NO: 66640 - protein, 9 aa, Borrelia burgdorferi B31
KVNSLIKAL

SEQ ID NO: 66641 - protein, 10 aa, Borrelia burgdorferi B31
KQINKNKGVF

SEQ ID NO: 66642 - protein, 10 aa, Borrelia burgdorferi B31
YIKGSDENVY

SEQ ID NO: 66643 - protein, 10 aa, Borrelia burgdorferi B31
YLTKNIFLSY

SEQ ID NO: 66644 - protein, 10 aa, Borrelia burgdorferi B31
LIIVVLTSTF

SEQ ID NO: 66645 - protein, 10 aa, Borrelia burgdorferi B31
KLGKDWILTY

SEQ ID NO: 66646 - protein, 10 aa, Borrelia burgdorferi B31
KSVNNIEVYF

SEQ ID NO: 66647 - protein, 10 aa, Borrelia burgdorferi B31
ILIKKDKDEY

SEQ ID NO: 66648 - protein, 10 aa, Borrelia burgdorferi B31
TSKWTFFDVF

SEQ ID NO: 66649 - protein, 10 aa, Borrelia burgdorferi B31
KLFDNNNKLL

SEQ ID NO: 66650 - protein, 10 aa, Borrelia burgdorferi B31
KVARILEEKF

SEQ ID NO: 66651 - protein, 10 aa, Borrelia burgdorferi B31
IFLSYKGNSY

SEQ ID NO: 66652 - protein, 10 aa, Borrelia burgdorferi B31
GVFMTKPKIF

SEQ ID NO: 66653 - protein, 10 aa, Borrelia burgdorferi B31
NQKMTKERPL

SEQ ID NO: 66654 - protein, 10 aa, Borrelia burgdorferi B31
KQINKNKGVF

SEQ ID NO: 66655 - protein, 10 aa, Borrelia burgdorferi B31
YIKGSDENVY

SEQ ID NO: 66656 - protein, 10 aa, Borrelia burgdorferi B31
YLTKNIFLSY

SEQ ID NO: 66657 - protein, 10 aa, Borrelia burgdorferi B31
LIIVVLTSTF

SEQ ID NO: 66658 - protein, 10 aa, Borrelia burgdorferi B31
KLGKDWILTY

SEQ ID NO: 66659 - protein, 10 aa, Borrelia burgdorferi B31
KSVNNIEVYF

SEQ ID NO: 66660 - protein, 10 aa, Borrelia burgdorferi B31
ILIKKDKDEY

SEQ ID NO: 66661 - protein, 10 aa, Borrelia burgdorferi B31
TSKWTFFDVF

SEQ ID NO: 66662 - protein, 10 aa, Borrelia burgdorferi B31
KLFDNNNKLL

SEQ ID NO: 66663 - protein, 10 aa, Borrelia burgdorferi B31
KVARILEEKF

SEQ ID NO: 66664 - protein, 10 aa, Borrelia burgdorferi B31
IFLSYKGNSY

SEQ ID NO: 66665 - protein, 10 aa, Borrelia burgdorferi B31
GVFMTKPKIF

SEQ ID NO: 66666 - protein, 10 aa, Borrelia burgdorferi B31
NQKMTKERPL

SEQ ID NO: 66667 - protein, 10 aa, Borrelia burgdorferi B31
KQINKNKGVF

SEQ ID NO: 66668 - protein, 11 aa, Borrelia burgdorferi B31
ARILEEKFFDF

SEQ ID NO: 66669 - protein, 11 aa, Borrelia burgdorferi B31
KQINKNKGVFM

SEQ ID NO: 66670 - protein, 9 aa, Borrelia burgdorferi B31
RPLNIIAEF

SEQ ID NO: 66671 - protein, 9 aa, Borrelia burgdorferi B31
IIVVLTSTF

SEQ ID NO: 66672 - protein, 9 aa, Borrelia burgdorferi B31
SKWTFFDVF

SEQ ID NO: 66673 - protein, 9 aa, Borrelia burgdorferi B31
FLSYKGNSY

SEQ ID NO: 66674 - protein, 9 aa, Borrelia burgdorferi B31
NVYLTKNIF

SEQ ID NO: 66675 - protein, 9 aa, Borrelia burgdorferi B31
NTFSDTTLF

SEQ ID NO: 66676 - protein, 9 aa, Borrelia burgdorferi B31
SVNNIEVYF

SEQ ID NO: 66677 - protein, 9 aa, Borrelia burgdorferi B31
KSVNNIEVY

SEQ ID NO: 66678 - protein, 9 aa, Borrelia burgdorferi B31
YKGNSYNTF

SEQ ID NO: 66679 - protein, 9 aa, Borrelia burgdorferi B31
LTKNIFLSY

SEQ ID NO: 66680 - protein, 9 aa, Borrelia burgdorferi B31
LGKDWILTY

SEQ ID NO: 66681 - protein, 9 aa, Borrelia burgdorferi B31
STFLLGIIF

SEQ ID NO: 66682 - protein, 9 aa, Borrelia burgdorferi B31
YYTTSKWTF

SEQ ID NO: 66683 - protein, 9 aa, Borrelia burgdorferi B31
IKGSDENVY

SEQ ID NO: 66684 - protein, 9 aa, Borrelia burgdorferi B31
IVVLTSTFL

SEQ ID NO: 66685 - protein, 9 aa, Borrelia burgdorferi B31
NENNINNNY

SEQ ID NO: 66686 - protein, 10 aa, Borrelia burgdorferi B31
YIKGSDENVY

SEQ ID NO: 66687 - protein, 10 aa, Borrelia burgdorferi B31
TSKWTFFDVF

SEQ ID NO: 66688 - protein, 10 aa, Borrelia burgdorferi B31
LIIVVLTSTF

SEQ ID NO: 66689 - protein, 10 aa, Borrelia burgdorferi B31
NKSVNNIEVY

SEQ ID NO: 66690 - protein, 10 aa, Borrelia burgdorferi B31
YYYTTSKWTF

SEQ ID NO: 66691 - protein, 10 aa, Borrelia burgdorferi B31
YLTKNIFLSY

SEQ ID NO: 66692 - protein, 10 aa, Borrelia burgdorferi B31
IFLSYKGNSY

SEQ ID NO: 66693 - protein, 10 aa, Borrelia burgdorferi B31
YNTFSDTTLF

SEQ ID NO: 66694 - protein, 10 aa, Borrelia burgdorferi B31
SGEGDSRLAY

SEQ ID NO: 66695 - protein, 10 aa, Borrelia burgdorferi B31
TSTFLLGIIF

SEQ ID NO: 66696 - protein, 10 aa, Borrelia burgdorferi B31
IVVLTSTFLL

SEQ ID NO: 66697 - protein, 11 aa, Borrelia burgdorferi B31
IPVDNKKVNSL

SEQ ID NO: 66698 - protein, 11 aa, Borrelia burgdorferi B31
TTSKWTFFDVF

SEQ ID NO: 66699 - protein, 11 aa, Borrelia burgdorferi B31
LTSTFLLGIIF

SEQ ID NO: 66700 - protein, 11 aa, Borrelia burgdorferi B31
LSYKGNSYNTF

SEQ ID NO: 66701 - protein, 11 aa, Borrelia burgdorferi B31
NIFLSYKGNSY

SEQ ID NO: 66702 - protein, 11 aa, Borrelia burgdorferi B31
KSGEGDSRLAY

SEQ ID NO: 66703 - protein, 11 aa, Borrelia burgdorferi B31
TKLGKDWILTY

SEQ ID NO: 66704 - protein, 11 aa, Borrelia burgdorferi B31
ILIIVVLTSTF

SEQ ID NO: 66705 - protein, 11 aa, Borrelia burgdorferi B31
FSNENKVARIL

SEQ ID NO: 66706 - protein, 11 aa, Borrelia burgdorferi B31
NSYNTFSDTTL

SEQ ID NO: 66707 - protein, 9 aa, Borrelia burgdorferi B31
EENDKDILI

SEQ ID NO: 66708 - protein, 9 aa, Borrelia burgdorferi B31
EEKFFDFDF

SEQ ID NO: 66709 - protein, 9 aa, Borrelia burgdorferi B31
AEFKADGLE

SEQ ID NO: 66710 - protein, 9 aa, Borrelia burgdorferi B31
GEGDSRLAY

SEQ ID NO: 66711 - protein, 9 aa, Borrelia burgdorferi B31
GENPSFKLF

SEQ ID NO: 66712 - protein, 9 aa, Borrelia burgdorferi B31
NENNINNNY

SEQ ID NO: 66713 - protein, 9 aa, Borrelia burgdorferi B31
NENKVARIL

SEQ ID NO: 66714 - protein, 9 aa, Borrelia burgdorferi B31
KENENNINN

SEQ ID NO: 66715 - protein, 9 aa, Borrelia burgdorferi B31
KERPLNIIA

SEQ ID NO: 66716 - protein, 9 aa, Borrelia burgdorferi B31
YEIISKDGL

SEQ ID NO: 66717 - protein, 10 aa, Borrelia burgdorferi B31
AEFKADGLEI

SEQ ID NO: 66718 - protein, 10 aa, Borrelia burgdorferi B31
YEIISKDGLY

SEQ ID NO: 66719 - protein, 10 aa, Borrelia burgdorferi B31
EENDKDILIK

SEQ ID NO: 66720 - protein, 10 aa, Borrelia burgdorferi B31
GEGDSRLAYI

SEQ ID NO: 66721 - protein, 11 aa, Borrelia burgdorferi B31
YEIISKDGLYF

SEQ ID NO: 66722 - protein, 11 aa, Borrelia burgdorferi B31
EEKFFDFDFNL

SEQ ID NO: 66723 - protein, 11 aa, Borrelia burgdorferi B31
KENENNINNNY

SEQ ID NO: 66724 - protein, 11 aa, Borrelia burgdorferi B31
AEFKADGLEID

SEQ ID NO: 66725 - protein, 11 aa, Borrelia burgdorferi B31
KERPLNIIAEF

SEQ ID NO: 66726 - protein, 11 aa, Borrelia burgdorferi B31
KELGIGENPSF

SEQ ID NO: 66727 - protein, 11 aa, Borrelia burgdorferi B31
NENNINNNYEI

SEQ ID NO: 66728 - protein, 11 aa, Borrelia burgdorferi B31
EENDKDILIKK

SEQ ID NO: 66729 - protein, 11 aa, Borrelia burgdorferi B31
IPVDNKKVNSL

SEQ ID NO: 66730 - protein, 9 aa, Borrelia burgdorferi B31
LTKNIFLSY

SEQ ID NO: 66731 - protein, 9 aa, Borrelia burgdorferi B31
KSVNNIEVY

SEQ ID NO: 66732 - protein, 11 aa, Borrelia burgdorferi B31
KSKIDDYNLQY

SEQ ID NO: 66733 - protein, 11 aa, Borrelia burgdorferi B31
KSGEGDSRLAY

SEQ ID NO: 66734 - protein, 11 aa, Borrelia burgdorferi B31
LSYKGNSYNTF

SEQ ID NO: 66735 - protein, 9 aa, Borrelia burgdorferi B31
TTDNIDIFV

SEQ ID NO: 66736 - protein, 9 aa, Borrelia burgdorferi B31
TLEKVAKEY

SEQ ID NO: 66737 - protein, 10 aa, Borrelia burgdorferi B31
NTDTDKIGGY

SEQ ID NO: 66738 - protein, 10 aa, Borrelia burgdorferi B31
TTDNIDIFVV

SEQ ID NO: 66739 - protein, 10 aa, Borrelia burgdorferi B31
TTPMQRIHKY

SEQ ID NO: 66740 - protein, 10 aa, Borrelia burgdorferi B31
DTKEDMKILY

SEQ ID NO: 66741 - protein, 11 aa, Borrelia burgdorferi B31
GTTPMQRIHKY

SEQ ID NO: 66742 - protein, 11 aa, Borrelia burgdorferi B31
TTDNIDIFVVL

SEQ ID NO: 66743 - protein, 9 aa, Borrelia burgdorferi B31
ILYSEIAEL

SEQ ID NO: 66744 - protein, 9 aa, Borrelia burgdorferi B31
LIIIFTLFL

SEQ ID NO: 66745 - protein, 9 aa, Borrelia burgdorferi B31
TTDNIDIFV

SEQ ID NO: 66746 - protein, 9 aa, Borrelia burgdorferi B31
KLNLNHLEI

SEQ ID NO: 66747 - protein, 9 aa, Borrelia burgdorferi B31
KKLIIIFTL

SEQ ID NO: 66748 - protein, 9 aa, Borrelia burgdorferi B31
FLSQACNLS

SEQ ID NO: 66749 - protein, 9 aa, Borrelia burgdorferi B31
TLFGTTPMQ

SEQ ID NO: 66750 - protein, 10 aa, Borrelia burgdorferi B31
KLIIIFTLFL

SEQ ID NO: 66751 - protein, 10 aa, Borrelia burgdorferi B31
FLSQACNLST

SEQ ID NO: 66752 - protein, 10 aa, Borrelia burgdorferi B31
KILYSEIAEL

SEQ ID NO: 66753 - protein, 10 aa, Borrelia burgdorferi B31
KTTDNIDIFV

SEQ ID NO: 66754 - protein, 10 aa, Borrelia burgdorferi B31
TTDNIDIFVV

SEQ ID NO: 66755 - protein, 10 aa, Borrelia burgdorferi B31
ALINTDTDKI

SEQ ID NO: 66756 - protein, 10 aa, Borrelia burgdorferi B31
TLFLSQACNL

SEQ ID NO: 66757 - protein, 10 aa, Borrelia burgdorferi B31
IIFTLFLSQA

SEQ ID NO: 66758 - protein, 10 aa, Borrelia burgdorferi B31
KVAKEYAIKL

SEQ ID NO: 66759 - protein, 11 aa, Borrelia burgdorferi B31
ILASGIELNRV

SEQ ID NO: 66760 - protein, 11 aa, Borrelia burgdorferi B31
FLSQACNLSTM

SEQ ID NO: 66761 - protein, 11 aa, Borrelia burgdorferi B31
TLFGTTPMQRI

SEQ ID NO: 66762 - protein, 11 aa, Borrelia burgdorferi B31
KTTDNIDIFVV

SEQ ID NO: 66763 - protein, 11 aa, Borrelia burgdorferi B31
KLIIIFTLFLS

SEQ ID NO: 66764 - protein, 11 aa, Borrelia burgdorferi B31
FTLFLSQACNL

SEQ ID NO: 66765 - protein, 11 aa, Borrelia burgdorferi B31
RIHKYDQSFNL

SEQ ID NO: 66766 - protein, 11 aa, Borrelia burgdorferi B31
KKLIIIFTLFL

SEQ ID NO: 66767 - protein, 11 aa, Borrelia burgdorferi B31
WLNSPSHKEAL

SEQ ID NO: 66768 - protein, 11 aa, Borrelia burgdorferi B31
NLTREILASGI

SEQ ID NO: 66769 - protein, 11 aa, Borrelia burgdorferi B31
NLNHLEIDDTL

SEQ ID NO: 66770 - protein, 11 aa, Borrelia burgdorferi B31
HLEIDDTLEKV

SEQ ID NO: 66771 - protein, 11 aa, Borrelia burgdorferi B31
IIIFTLFLSQA

SEQ ID NO: 66772 - protein, 9 aa, Borrelia burgdorferi B31
VLFGKRKYK

SEQ ID NO: 66773 - protein, 9 aa, Borrelia burgdorferi B31
KVAKEYAIK

SEQ ID NO: 66774 - protein, 9 aa, Borrelia burgdorferi B31
STMHKIDTK

SEQ ID NO: 66775 - protein, 9 aa, Borrelia burgdorferi B31
ACNLSTMHK

SEQ ID NO: 66776 - protein, 9 aa, Borrelia burgdorferi B31
TTPMQRIHK

SEQ ID NO: 66777 - protein, 9 aa, Borrelia burgdorferi B31
IIFTLFLSQ

SEQ ID NO: 66778 - protein, 9 aa, Borrelia burgdorferi B31
DIFVVLFGK

SEQ ID NO: 66779 - protein, 10 aa, Borrelia burgdorferi B31
VVLFGKRKYK

SEQ ID NO: 66780 - protein, 10 aa, Borrelia burgdorferi B31
QACNLSTMHK

SEQ ID NO: 66781 - protein, 10 aa, Borrelia burgdorferi B31
TLFGTTPMQR

SEQ ID NO: 66782 - protein, 10 aa, Borrelia burgdorferi B31
GTTPMQRIHK

SEQ ID NO: 66783 - protein, 10 aa, Borrelia burgdorferi B31
IDIFVVLFGK

SEQ ID NO: 66784 - protein, 10 aa, Borrelia burgdorferi B31
ILYSEIAELR

SEQ ID NO: 66785 - protein, 10 aa, Borrelia burgdorferi B31
LSTMHKIDTK

SEQ ID NO: 66786 - protein, 10 aa, Borrelia burgdorferi B31
IFVVLFGKRK

SEQ ID NO: 66787 - protein, 10 aa, Borrelia burgdorferi B31
IIIFTLFLSQ

SEQ ID NO: 66788 - protein, 10 aa, Borrelia burgdorferi B31
ILASGIELNR

SEQ ID NO: 66789 - protein, 10 aa, Borrelia burgdorferi B31
LYSEIAELRK

SEQ ID NO: 66790 - protein, 10 aa, Borrelia burgdorferi B31
NAWLNSPSHK

SEQ ID NO: 66791 - protein, 11 aa, Borrelia burgdorferi B31
ILYSEIAELRK

SEQ ID NO: 66792 - protein, 11 aa, Borrelia burgdorferi B31
HTLFGTTPMQR

SEQ ID NO: 66793 - protein, 11 aa, Borrelia burgdorferi B31
SQACNLSTMHK

SEQ ID NO: 66794 - protein, 11 aa, Borrelia burgdorferi B31
KILYSEIAELR

SEQ ID NO: 66795 - protein, 11 aa, Borrelia burgdorferi B31
VVNAWLNSPSH

SEQ ID NO: 66796 - protein, 11 aa, Borrelia burgdorferi B31
FVVLFGKRKYK

SEQ ID NO: 66797 - protein, 9 aa, Borrelia burgdorferi B31
STMHKIDTK

SEQ ID NO: 66798 - protein, 9 aa, Borrelia burgdorferi B31
TTPMQRIHK

SEQ ID NO: 66799 - protein, 9 aa, Borrelia burgdorferi B31
DIFVVLFGK

SEQ ID NO: 66800 - protein, 9 aa, Borrelia burgdorferi B31
KVAKEYAIK

SEQ ID NO: 66801 - protein, 9 aa, Borrelia burgdorferi B31
VLFGKRKYK

SEQ ID NO: 66802 - protein, 9 aa, Borrelia burgdorferi B31
ACNLSTMHK

SEQ ID NO: 66803 - protein, 9 aa, Borrelia burgdorferi B31
ALINTDTDK

SEQ ID NO: 66804 - protein, 9 aa, Borrelia burgdorferi B31
YSEIAELRK

SEQ ID NO: 66805 - protein, 9 aa, Borrelia burgdorferi B31
FVVLFGKRK

SEQ ID NO: 66806 - protein, 9 aa, Borrelia burgdorferi B31
KIDTKEDMK

SEQ ID NO: 66807 - protein, 9 aa, Borrelia burgdorferi B31
AWLNSPSHK

SEQ ID NO: 66808 - protein, 9 aa, Borrelia burgdorferi B31
IIFTLFLSQ

SEQ ID NO: 66809 - protein, 9 aa, Borrelia burgdorferi B31
LASGIELNR

SEQ ID NO: 66810 - protein, 10 aa, Borrelia burgdorferi B31
QACNLSTMHK

SEQ ID NO: 66811 - protein, 10 aa, Borrelia burgdorferi B31
TLFGTTPMQR

SEQ ID NO: 66812 - protein, 10 aa, Borrelia burgdorferi B31
GTTPMQRIHK

SEQ ID NO: 66813 - protein, 10 aa, Borrelia burgdorferi B31
VVLFGKRKYK

SEQ ID NO: 66814 - protein, 10 aa, Borrelia burgdorferi B31
LSTMHKIDTK

SEQ ID NO: 66815 - protein, 10 aa, Borrelia burgdorferi B31
ILYSEIAELR

SEQ ID NO: 66816 - protein, 10 aa, Borrelia burgdorferi B31
NAWLNSPSHK

SEQ ID NO: 66817 - protein, 10 aa, Borrelia burgdorferi B31
TTPMQRIHKY

SEQ ID NO: 66818 - protein, 10 aa, Borrelia burgdorferi B31
IDIFVVLFGK

SEQ ID NO: 66819 - protein, 10 aa, Borrelia burgdorferi B31
ILASGIELNR

SEQ ID NO: 66820 - protein, 10 aa, Borrelia burgdorferi B31
HLEIDDTLEK

SEQ ID NO: 66821 - protein, 10 aa, Borrelia burgdorferi B31
IIIFTLFLSQ

SEQ ID NO: 66822 - protein, 10 aa, Borrelia burgdorferi B31
LYSEIAELRK

SEQ ID NO: 66823 - protein, 10 aa, Borrelia burgdorferi B31
DIFVVLFGKR

SEQ ID NO: 66824 - protein, 10 aa, Borrelia burgdorferi B31
YSEIAELRKK

SEQ ID NO: 66825 - protein, 11 aa, Borrelia burgdorferi B31
SQACNLSTMHK

SEQ ID NO: 66826 - protein, 11 aa, Borrelia burgdorferi B31
ILYSEIAELRK

SEQ ID NO: 66827 - protein, 11 aa, Borrelia burgdorferi B31
HTLFGTTPMQR

SEQ ID NO: 66828 - protein, 11 aa, Borrelia burgdorferi B31
NIDIFVVLFGK

SEQ ID NO: 66829 - protein, 11 aa, Borrelia burgdorferi B31
KILYSEIAELR

SEQ ID NO: 66830 - protein, 11 aa, Borrelia burgdorferi B31
FVVLFGKRKYK

SEQ ID NO: 66831 - protein, 11 aa, Borrelia burgdorferi B31
DIFVVLFGKRK

SEQ ID NO: 66832 - protein, 11 aa, Borrelia burgdorferi B31
VVNAWLNSPSH

SEQ ID NO: 66833 - protein, 11 aa, Borrelia burgdorferi B31
NLSTMHKIDTK

SEQ ID NO: 66834 - protein, 11 aa, Borrelia burgdorferi B31
EILASGIELNR

SEQ ID NO: 66835 - protein, 11 aa, Borrelia burgdorferi B31
VNAWLNSPSHK

SEQ ID NO: 66836 - protein, 9 aa, Borrelia burgdorferi B31
KLIIIFTLF

SEQ ID NO: 66837 - protein, 9 aa, Borrelia burgdorferi B31
KYDQSFNLT

SEQ ID NO: 66838 - protein, 10 aa, Borrelia burgdorferi B31
LFGTTPMQRI

SEQ ID NO: 66839 - protein, 10 aa, Borrelia burgdorferi B31
KKLIIIFTLF

SEQ ID NO: 66840 - protein, 10 aa, Borrelia burgdorferi B31
GYRLKTTDNI

SEQ ID NO: 66841 - protein, 9 aa, Borrelia burgdorferi B31
VVLFGKRKY

SEQ ID NO: 66842 - protein, 9 aa, Borrelia burgdorferi B31
KLIIIFTLF

SEQ ID NO: 66843 - protein, 10 aa, Borrelia burgdorferi B31
FVVLFGKRKY

SEQ ID NO: 66844 - protein, 10 aa, Borrelia burgdorferi B31
TTPMQRIHKY

SEQ ID NO: 66845 - protein, 11 aa, Borrelia burgdorferi B31
IFVVLFGKRKY

SEQ ID NO: 66846 - protein, 11 aa, Borrelia burgdorferi B31
GTTPMQRIHKY

SEQ ID NO: 66847 - protein, 9 aa, Borrelia burgdorferi B31
DIFVVLFGK

SEQ ID NO: 66848 - protein, 9 aa, Borrelia burgdorferi B31
LASGIELNR

SEQ ID NO: 66849 - protein, 9 aa, Borrelia burgdorferi B31
TTPMQRIHK

SEQ ID NO: 66850 - protein, 9 aa, Borrelia burgdorferi B31
LYSEIAELR

SEQ ID NO: 66851 - protein, 9 aa, Borrelia burgdorferi B31
YAIKLGENR

SEQ ID NO: 66852 - protein, 9 aa, Borrelia burgdorferi B31
DTDKIGGYR

SEQ ID NO: 66853 - protein, 9 aa, Borrelia burgdorferi B31
STMHKIDTK

SEQ ID NO: 66854 - protein, 9 aa, Borrelia burgdorferi B31
FVVLFGKRK

SEQ ID NO: 66855 - protein, 9 aa, Borrelia burgdorferi B31
YSEIAELRK

SEQ ID NO: 66856 - protein, 9 aa, Borrelia burgdorferi B31
TLFGTTPMQ

SEQ ID NO: 66857 - protein, 9 aa, Borrelia burgdorferi B31
IFVVLFGKR

SEQ ID NO: 66858 - protein, 9 aa, Borrelia burgdorferi B31
YDQSFNLTR

SEQ ID NO: 66859 - protein, 9 aa, Borrelia burgdorferi B31
VLFGKRKYK

SEQ ID NO: 66860 - protein, 9 aa, Borrelia burgdorferi B31
KVAKEYAIK

SEQ ID NO: 66861 - protein, 10 aa, Borrelia burgdorferi B31
TLFGTTPMQR

SEQ ID NO: 66862 - protein, 10 aa, Borrelia burgdorferi B31
DIFVVLFGKR

SEQ ID NO: 66863 - protein, 10 aa, Borrelia burgdorferi B31
ILYSEIAELR

SEQ ID NO: 66864 - protein, 10 aa, Borrelia burgdorferi B31
QACNLSTMHK

SEQ ID NO: 66865 - protein, 10 aa, Borrelia burgdorferi B31
ILASGIELNR

SEQ ID NO: 66866 - protein, 10 aa, Borrelia burgdorferi B31
NAWLNSPSHK

SEQ ID NO: 66867 - protein, 10 aa, Borrelia burgdorferi B31
EYAIKLGENR

SEQ ID NO: 66868 - protein, 10 aa, Borrelia burgdorferi B31
EALINTDTDK

SEQ ID NO: 66869 - protein, 10 aa, Borrelia burgdorferi B31
GTTPMQRIHK

SEQ ID NO: 66870 - protein, 10 aa, Borrelia burgdorferi B31
TTPMQRIHKY

SEQ ID NO: 66871 - protein, 10 aa, Borrelia burgdorferi B31
LSTMHKIDTK

SEQ ID NO: 66872 - protein, 10 aa, Borrelia burgdorferi B31
IDIFVVLFGK

SEQ ID NO: 66873 - protein, 10 aa, Borrelia burgdorferi B31
LYSEIAELRK

SEQ ID NO: 66874 - protein, 10 aa, Borrelia burgdorferi B31
DTKEDMKILY

SEQ ID NO: 66875 - protein, 10 aa, Borrelia burgdorferi B31
HTLFGTTPMQ

SEQ ID NO: 66876 - protein, 10 aa, Borrelia burgdorferi B31
HLEIDDTLEK

SEQ ID NO: 66877 - protein, 10 aa, Borrelia burgdorferi B31
TDTDKIGGYR

SEQ ID NO: 66878 - protein, 10 aa, Borrelia burgdorferi B31
YSEIAELRKK

SEQ ID NO: 66879 - protein, 10 aa, Borrelia burgdorferi B31
VVLFGKRKYK

SEQ ID NO: 66880 - protein, 11 aa, Borrelia burgdorferi B31
HTLFGTTPMQR

SEQ ID NO: 66881 - protein, 11 aa, Borrelia burgdorferi B31
EILASGIELNR

SEQ ID NO: 66882 - protein, 11 aa, Borrelia burgdorferi B31
FVVLFGKRKYK

SEQ ID NO: 66883 - protein, 11 aa, Borrelia burgdorferi B31
DIFVVLFGKRK

SEQ ID NO: 66884 - protein, 11 aa, Borrelia burgdorferi B31
NTDTDKIGGYR

SEQ ID NO: 66885 - protein, 11 aa, Borrelia burgdorferi B31
HKYDQSFNLTR

SEQ ID NO: 66886 - protein, 11 aa, Borrelia burgdorferi B31
NIDIFVVLFGK

SEQ ID NO: 66887 - protein, 11 aa, Borrelia burgdorferi B31
ILYSEIAELRK

SEQ ID NO: 66888 - protein, 11 aa, Borrelia burgdorferi B31
KILYSEIAELR

SEQ ID NO: 66889 - protein, 11 aa, Borrelia burgdorferi B31
DTDKIGGYRLK

SEQ ID NO: 66890 - protein, 11 aa, Borrelia burgdorferi B31
NLSTMHKIDTK

SEQ ID NO: 66891 - protein, 11 aa, Borrelia burgdorferi B31
SQACNLSTMHK

SEQ ID NO: 66892 - protein, 11 aa, Borrelia burgdorferi B31
IDIFVVLFGKR

SEQ ID NO: 66893 - protein, 11 aa, Borrelia burgdorferi B31
EIDDTLEKVAK

SEQ ID NO: 66894 - protein, 11 aa, Borrelia burgdorferi B31
LYSEIAELRKK

SEQ ID NO: 66895 - protein, 11 aa, Borrelia burgdorferi B31
VNAWLNSPSHK

SEQ ID NO: 66896 - protein, 9 aa, Borrelia burgdorferi B31
SPSHKEALI

SEQ ID NO: 66897 - protein, 9 aa, Borrelia burgdorferi B31
TPMQRIHKY

SEQ ID NO: 66898 - protein, 9 aa, Borrelia burgdorferi B31
RIHKYDQSF

SEQ ID NO: 66899 - protein, 11 aa, Borrelia burgdorferi B31
ELRKKLNLNHL

SEQ ID NO: 66900 - protein, 9 aa, Borrelia burgdorferi B31
RIHKYDQSF

SEQ ID NO: 66901 - protein, 9 aa, Borrelia burgdorferi B31
SQACNLSTM

SEQ ID NO: 66902 - protein, 9 aa, Borrelia burgdorferi B31
KLIIIFTLF

SEQ ID NO: 66903 - protein, 9 aa, Borrelia burgdorferi B31
ILYSEIAEL

SEQ ID NO: 66904 - protein, 10 aa, Borrelia burgdorferi B31
FVVLFGKRKY

SEQ ID NO: 66905 - protein, 10 aa, Borrelia burgdorferi B31
SQACNLSTMH

SEQ ID NO: 66906 - protein, 10 aa, Borrelia burgdorferi B31
LSQACNLSTM

SEQ ID NO: 66907 - protein, 11 aa, Borrelia burgdorferi B31
MQRIHKYDQSF

SEQ ID NO: 66908 - protein, 11 aa, Borrelia burgdorferi B31
RLKTTDNIDIF

SEQ ID NO: 66909 - protein, 11 aa, Borrelia burgdorferi B31
VVNAWLNSPSH

SEQ ID NO: 66910 - protein, 11 aa, Borrelia burgdorferi B31
FLSQACNLSTM

SEQ ID NO: 66911 - protein, 11 aa, Borrelia burgdorferi B31
WLNSPSHKEAL

SEQ ID NO: 66912 - protein, 9 aa, Borrelia burgdorferi B31
YRLKTTDNI

SEQ ID NO: 66913 - protein, 10 aa, Borrelia burgdorferi B31
QRIHKYDQSF

SEQ ID NO: 66914 - protein, 11 aa, Borrelia burgdorferi B31
YRLKTTDNIDI

SEQ ID NO: 66915 - protein, 9 aa, Borrelia burgdorferi B31
TPMQRIHKY

SEQ ID NO: 66916 - protein, 9 aa, Borrelia burgdorferi B31
HTLFGTTPM

SEQ ID NO: 66917 - protein, 9 aa, Borrelia burgdorferi B31
NAWLNSPSH

SEQ ID NO: 66918 - protein, 9 aa, Borrelia burgdorferi B31
QACNLSTMH

SEQ ID NO: 66919 - protein, 10 aa, Borrelia burgdorferi B31
FVVLFGKRKY

SEQ ID NO: 66920 - protein, 10 aa, Borrelia burgdorferi B31
THTLFGTTPM

SEQ ID NO: 66921 - protein, 11 aa, Borrelia burgdorferi B31
FLSQACNLSTM

SEQ ID NO: 66922 - protein, 11 aa, Borrelia burgdorferi B31
ITHTLFGTTPM

SEQ ID NO: 66923 - protein, 11 aa, Borrelia burgdorferi B31
TTDNIDIFVVL

SEQ ID NO: 66924 - protein, 11 aa, Borrelia burgdorferi B31
WLNSPSHKEAL

SEQ ID NO: 66925 - protein, 9 aa, Borrelia burgdorferi B31
AELRKKLNL

SEQ ID NO: 66926 - protein, 9 aa, Borrelia burgdorferi B31
REILASGIE

SEQ ID NO: 66927 - protein, 9 aa, Borrelia burgdorferi B31
KEDMKILYS

SEQ ID NO: 66928 - protein, 10 aa, Borrelia burgdorferi B31
REILASGIEL

SEQ ID NO: 66929 - protein, 10 aa, Borrelia burgdorferi B31
SEIAELRKKL

SEQ ID NO: 66930 - protein, 11 aa, Borrelia burgdorferi B31
GENRTITHTLF

SEQ ID NO: 66931 - protein, 11 aa, Borrelia burgdorferi B31
AELRKKLNLNH

SEQ ID NO: 66932 - protein, 11 aa, Borrelia burgdorferi B31
REILASGIELN

SEQ ID NO: 66933 - protein, 9 aa, Borrelia burgdorferi B31
ELNRVVNAW

SEQ ID NO: 66934 - protein, 9 aa, Borrelia burgdorferi B31
KTTDNIDIF

SEQ ID NO: 66935 - protein, 10 aa, Borrelia burgdorferi 1
VVDAFGADPY

SEQ ID NO: 66936 - protein, 9 aa, Borrelia burgdorferi 1
MMQRISILL

SEQ ID NO: 66937 - protein, 9 aa, Borrelia burgdorferi 1
SILLMLLAV

SEQ ID NO: 66938 - protein, 9 aa, Borrelia burgdorferi 1
ALSLFFQKV

SEQ ID NO: 66939 - protein, 9 aa, Borrelia burgdorferi 1
KLESLKVFL

SEQ ID NO: 66940 - protein, 9 aa, Borrelia burgdorferi 1
RISILLMLL

SEQ ID NO: 66941 - protein, 9 aa, Borrelia burgdorferi 1
LMLLAVFSC

SEQ ID NO: 66942 - protein, 9 aa, Borrelia burgdorferi 1
LLMLLAVFS

SEQ ID NO: 66943 - protein, 9 aa, Borrelia burgdorferi 1
KCNEEIFKV

SEQ ID NO: 66944 - protein, 9 aa, Borrelia burgdorferi 1
KQFGDVKSL

SEQ ID NO: 66945 - protein, 10 aa, Borrelia burgdorferi 1
MMQRISILLM

SEQ ID NO: 66946 - protein, 10 aa, Borrelia burgdorferi 1
KVFLKDAMSV

SEQ ID NO: 66947 - protein, 10 aa, Borrelia burgdorferi 1
ALSLFFQKVV

SEQ ID NO: 66948 - protein, 10 aa, Borrelia burgdorferi 1
SLTPEEAEKL

SEQ ID NO: 66949 - protein, 10 aa, Borrelia burgdorferi 1
SSFDNISSIV

SEQ ID NO: 66950 - protein, 10 aa, Borrelia burgdorferi 1
LLMLLAVFSC

SEQ ID NO: 66951 - protein, 10 aa, Borrelia burgdorferi 1
SLFFQKVVDA

SEQ ID NO: 66952 - protein, 10 aa, Borrelia burgdorferi 1
RISILLMLLA

SEQ ID NO: 66953 - protein, 10 aa, Borrelia burgdorferi 1
NISSIVSKAV

SEQ ID NO: 66954 - protein, 10 aa, Borrelia burgdorferi 1
MLLAVFSCKQ

SEQ ID NO: 66955 - protein, 10 aa, Borrelia burgdorferi 1
ISILLMLLAV

SEQ ID NO: 66956 - protein, 11 aa, Borrelia burgdorferi 1
MMQRISILLML

SEQ ID NO: 66957 - protein, 11 aa, Borrelia burgdorferi 1
FISSFDNISSI

SEQ ID NO: 66958 - protein, 11 aa, Borrelia burgdorferi 1
SLTEIDSGNGI

SEQ ID NO: 66959 - protein, 11 aa, Borrelia burgdorferi 1
RISILLMLLAV

SEQ ID NO: 66960 - protein, 11 aa, Borrelia burgdorferi 1
VLTESESNNEL

SEQ ID NO: 66961 - protein, 9 aa, Borrelia burgdorferi 1
MLLAVFSCK

SEQ ID NO: 66962 - protein, 9 aa, Borrelia burgdorferi 1
KEFFDWLSK

SEQ ID NO: 66963 - protein, 9 aa, Borrelia burgdorferi 1
EALSLFFQK

SEQ ID NO: 66964 - protein, 9 aa, Borrelia burgdorferi 1
VSKAVDASK

SEQ ID NO: 66965 - protein, 9 aa, Borrelia burgdorferi 1
VCYKIKNSK

SEQ ID NO: 66966 - protein, 10 aa, Borrelia burgdorferi 1
LMLLAVFSCK

SEQ ID NO: 66967 - protein, 10 aa, Borrelia burgdorferi 1
KLESLKVFLK

SEQ ID NO: 66968 - protein, 10 aa, Borrelia burgdorferi 1
YVCYKIKNSK

SEQ ID NO: 66969 - protein, 10 aa, Borrelia burgdorferi 1
SLGFKEYVCY

SEQ ID NO: 66970 - protein, 10 aa, Borrelia burgdorferi 1
SVNGREEALK

SEQ ID NO: 66971 - protein, 10 aa, Borrelia burgdorferi 1
ISLTPEEAEK

SEQ ID NO: 66972 - protein, 10 aa, Borrelia burgdorferi 1
IVSKAVDASK

SEQ ID NO: 66973 - protein, 10 aa, Borrelia burgdorferi 1
WLSKDVNRQK

SEQ ID NO: 66974 - protein, 10 aa, Borrelia burgdorferi 1
PTEQQSLGFK

SEQ ID NO: 66975 - protein, 10 aa, Borrelia burgdorferi 1
IPLVVSDVVK

SEQ ID NO: 66976 - protein, 10 aa, Borrelia burgdorferi 1
MLLAVFSCKQ

SEQ ID NO: 66977 - protein, 10 aa, Borrelia burgdorferi 1
VSKAVDASKK

SEQ ID NO: 66978 - protein, 10 aa, Borrelia burgdorferi 1
LKAEYEKSYK

SEQ ID NO: 66979 - protein, 11 aa, Borrelia burgdorferi 1
LLMLLAVFSCK

SEQ ID NO: 66980 - protein, 11 aa, Borrelia burgdorferi 1
SLGFKEYVCYK

SEQ ID NO: 66981 - protein, 11 aa, Borrelia burgdorferi 1
IVSKAVDASKK

SEQ ID NO: 66982 - protein, 11 aa, Borrelia burgdorferi 1
ALKAEYEKSYK

SEQ ID NO: 66983 - protein, 11 aa, Borrelia burgdorferi 1
SIVSKAVDASK

SEQ ID NO: 66984 - protein, 11 aa, Borrelia burgdorferi 1
MSVNGREEALK

SEQ ID NO: 66985 - protein, 11 aa, Borrelia burgdorferi 1
VVDAFGADPYK

SEQ ID NO: 66986 - protein, 11 aa, Borrelia burgdorferi 1
KGEALSLFFQK

SEQ ID NO: 66987 - protein, 11 aa, Borrelia burgdorferi 1
GIPLVVSDVVK

SEQ ID NO: 66988 - protein, 9 aa, Borrelia burgdorferi 1
MLLAVFSCK

SEQ ID NO: 66989 - protein, 9 aa, Borrelia burgdorferi 1
EALSLFFQK

SEQ ID NO: 66990 - protein, 9 aa, Borrelia burgdorferi 1
VSKAVDASK

SEQ ID NO: 66991 - protein, 9 aa, Borrelia burgdorferi 1
KEFFDWLSK

SEQ ID NO: 66992 - protein, 9 aa, Borrelia burgdorferi 1
KAEYEKSYK

SEQ ID NO: 66993 - protein, 9 aa, Borrelia burgdorferi 1
DVVKDLIPK

SEQ ID NO: 66994 - protein, 9 aa, Borrelia burgdorferi 1
AFGADPYKK

SEQ ID NO: 66995 - protein, 9 aa, Borrelia burgdorferi 1
TEQQSLGFK

SEQ ID NO: 66996 - protein, 9 aa, Borrelia burgdorferi 1
SLTPEEAEK

SEQ ID NO: 66997 - protein, 9 aa, Borrelia burgdorferi 1
DAFGADPYK

SEQ ID NO: 66998 - protein, 9 aa, Borrelia burgdorferi 1
LSKDVNRQK

SEQ ID NO: 66999 - protein, 9 aa, Borrelia burgdorferi 1
SNNELKNLK

SEQ ID NO: 67000 - protein, 9 aa, Borrelia burgdorferi 1
LESLKVFLK

SEQ ID NO: 67001 - protein, 9 aa, Borrelia burgdorferi 1
AVDASKKRR

SEQ ID NO: 67002 - protein, 9 aa, Borrelia burgdorferi 1
EALKAEYEK

SEQ ID NO: 67003 - protein, 9 aa, Borrelia burgdorferi 1
GFKEYVCYK

SEQ ID NO: 67004 - protein, 10 aa, Borrelia burgdorferi 1
SVNGREEALK

SEQ ID NO: 67005 - protein, 10 aa, Borrelia burgdorferi 1
LMLLAVFSCK

SEQ ID NO: 67006 - protein, 10 aa, Borrelia burgdorferi 1
KLESLKVFLK

SEQ ID NO: 67007 - protein, 10 aa, Borrelia burgdorferi 1
IVSKAVDASK

SEQ ID NO: 67008 - protein, 10 aa, Borrelia burgdorferi 1
YVCYKIKNSK

SEQ ID NO: 67009 - protein, 10 aa, Borrelia burgdorferi 1
ISLTPEEAEK

SEQ ID NO: 67010 - protein, 10 aa, Borrelia burgdorferi 1
VSKAVDASKK

SEQ ID NO: 67011 - protein, 10 aa, Borrelia burgdorferi 1
GEALSLFFQK

SEQ ID NO: 67012 - protein, 10 aa, Borrelia burgdorferi 1
PTEQQSLGFK

SEQ ID NO: 67013 - protein, 10 aa, Borrelia burgdorferi 1
FSCKQFGDVK

SEQ ID NO: 67014 - protein, 10 aa, Borrelia burgdorferi 1
ESNNELKNLK

SEQ ID NO: 67015 - protein, 10 aa, Borrelia burgdorferi 1
DAFGADPYKK

SEQ ID NO: 67016 - protein, 10 aa, Borrelia burgdorferi 1
VVDAFGADPY

SEQ ID NO: 67017 - protein, 10 aa, Borrelia burgdorferi 1
PVKCNEEIFK

SEQ ID NO: 67018 - protein, 10 aa, Borrelia burgdorferi 1
LGFKEYVCYK

SEQ ID NO: 67019 - protein, 11 aa, Borrelia burgdorferi 1
LLMLLAVFSCK

SEQ ID NO: 67020 - protein, 11 aa, Borrelia burgdorferi 1
SIVSKAVDASK

SEQ ID NO: 67021 - protein, 11 aa, Borrelia burgdorferi 1
VVDAFGADPYK

SEQ ID NO: 67022 - protein, 11 aa, Borrelia burgdorferi 1
SLGFKEYVCYK

SEQ ID NO: 67023 - protein, 11 aa, Borrelia burgdorferi 1
MSVNGREEALK

SEQ ID NO: 67024 - protein, 11 aa, Borrelia burgdorferi 1
IVSKAVDASKK

SEQ ID NO: 67025 - protein, 11 aa, Borrelia burgdorferi 1
VSDVVKDLIPK

SEQ ID NO: 67026 - protein, 11 aa, Borrelia burgdorferi 1
LTESESNNELK

SEQ ID NO: 67027 - protein, 11 aa, Borrelia burgdorferi 1
KGEALSLFFQK

SEQ ID NO: 67028 - protein, 11 aa, Borrelia burgdorferi 1
ALKAEYEKSYK

SEQ ID NO: 67029 - protein, 11 aa, Borrelia burgdorferi 1
SYKEFFDWLSK

SEQ ID NO: 67030 - protein, 11 aa, Borrelia burgdorferi 1
KVVDAFGADPY

SEQ ID NO: 67031 - protein, 11 aa, Borrelia burgdorferi 1
SFDNISSIVSK

SEQ ID NO: 67032 - protein, 11 aa, Borrelia burgdorferi 1
GIPLVVSDVVK

SEQ ID NO: 67033 - protein, 11 aa, Borrelia burgdorferi 1
EISLTPEEAEK

SEQ ID NO: 67034 - protein, 11 aa, Borrelia burgdorferi 1
VFSCKQFGDVK

SEQ ID NO: 67035 - protein, 11 aa, Borrelia burgdorferi 1
RPTEQQSLGFK

SEQ ID NO: 67036 - protein, 9 aa, Borrelia burgdorferi 1
FFQKVVDAF

SEQ ID NO: 67037 - protein, 9 aa, Borrelia burgdorferi 1
EYEKSYKEF

SEQ ID NO: 67038 - protein, 9 aa, Borrelia burgdorferi 1
SYKEFFDWL

SEQ ID NO: 67039 - protein, 9 aa, Borrelia burgdorferi 1
EFISSFDNI

SEQ ID NO: 67040 - protein, 9 aa, Borrelia burgdorferi 1
MMQRISILL

SEQ ID NO: 67041 - protein, 10 aa, Borrelia burgdorferi 1
EYEKSYKEFF

SEQ ID NO: 67042 - protein, 10 aa, Borrelia burgdorferi 1
LFFQKVVDAF

SEQ ID NO: 67043 - protein, 11 aa, Borrelia burgdorferi 1
ISILLMLLAVF

SEQ ID NO: 67044 - protein, 9 aa, Borrelia burgdorferi 1
LGFKEYVCY

SEQ ID NO: 67045 - protein, 10 aa, Borrelia burgdorferi 1
SLGFKEYVCY

SEQ ID NO: 67046 - protein, 10 aa, Borrelia burgdorferi 1
VVDAFGADPY

SEQ ID NO: 67047 - protein, 10 aa, Borrelia burgdorferi 1
EQQSLGFKEY

SEQ ID NO: 67048 - protein, 11 aa, Borrelia burgdorferi 1
KVVDAFGADPY

SEQ ID NO: 67049 - protein, 9 aa, Borrelia burgdorferi 1
DAFGADPYK

SEQ ID NO: 67050 - protein, 9 aa, Borrelia burgdorferi 1
EALSLFFQK

SEQ ID NO: 67051 - protein, 9 aa, Borrelia burgdorferi 1
ESESNNELK

SEQ ID NO: 67052 - protein, 9 aa, Borrelia burgdorferi 1
EAEKLESLK

SEQ ID NO: 67053 - protein, 9 aa, Borrelia burgdorferi 1
EALKAEYEK

SEQ ID NO: 67054 - protein, 9 aa, Borrelia burgdorferi 1
MLLAVFSCK

SEQ ID NO: 67055 - protein, 9 aa, Borrelia burgdorferi 1
DNISSIVSK

SEQ ID NO: 67056 - protein, 9 aa, Borrelia burgdorferi 1
DVVKDLIPK

SEQ ID NO: 67057 - protein, 9 aa, Borrelia burgdorferi 1
VSKAVDASK

SEQ ID NO: 67058 - protein, 9 aa, Borrelia burgdorferi 1
EEIFKVIKK

SEQ ID NO: 67059 - protein, 9 aa, Borrelia burgdorferi 1
LSKDVNRQK

SEQ ID NO: 67060 - protein, 9 aa, Borrelia burgdorferi 1
GFKEYVCYK

SEQ ID NO: 67061 - protein, 9 aa, Borrelia burgdorferi 1
KAVDASKKR

SEQ ID NO: 67062 - protein, 9 aa, Borrelia burgdorferi 1
SLTPEEAEK

SEQ ID NO: 67063 - protein, 9 aa, Borrelia burgdorferi 1
KAEYEKSYK

SEQ ID NO: 67064 - protein, 10 aa, Borrelia burgdorferi 1
DAFGADPYKK

SEQ ID NO: 67065 - protein, 10 aa, Borrelia burgdorferi 1
YVCYKIKNSK

SEQ ID NO: 67066 - protein, 10 aa, Borrelia burgdorferi 1
ESNNELKNLK

SEQ ID NO: 67067 - protein, 10 aa, Borrelia burgdorferi 1
SVNGREEALK

SEQ ID NO: 67068 - protein, 10 aa, Borrelia burgdorferi 1
IVSKAVDASK

SEQ ID NO: 67069 - protein, 10 aa, Borrelia burgdorferi 1
FSCKQFGDVK

SEQ ID NO: 67070 - protein, 10 aa, Borrelia burgdorferi 1
EEALKAEYEK

SEQ ID NO: 67071 - protein, 10 aa, Borrelia burgdorferi 1
LGFKEYVCYK

SEQ ID NO: 67072 - protein, 10 aa, Borrelia burgdorferi 1
VSKAVDASKK

SEQ ID NO: 67073 - protein, 10 aa, Borrelia burgdorferi 1
LMLLAVFSCK

SEQ ID NO: 67074 - protein, 10 aa, Borrelia burgdorferi 1
EEAEKLESLK

SEQ ID NO: 67075 - protein, 10 aa, Borrelia burgdorferi 1
KAVDASKKRR

SEQ ID NO: 67076 - protein, 10 aa, Borrelia burgdorferi 1
TESESNNELK

SEQ ID NO: 67077 - protein, 10 aa, Borrelia burgdorferi 1
WLSKDVNRQK

SEQ ID NO: 67078 - protein, 10 aa, Borrelia burgdorferi 1
ISLTPEEAEK

SEQ ID NO: 67079 - protein, 11 aa, Borrelia burgdorferi 1
MSVNGREEALK

SEQ ID NO: 67080 - protein, 11 aa, Borrelia burgdorferi 1
EISLTPEEAEK

SEQ ID NO: 67081 - protein, 11 aa, Borrelia burgdorferi 1
LTESESNNELK

SEQ ID NO: 67082 - protein, 11 aa, Borrelia burgdorferi 1
EYVCYKIKNSK

SEQ ID NO: 67083 - protein, 11 aa, Borrelia burgdorferi 1
IVSKAVDASKK

SEQ ID NO: 67084 - protein, 11 aa, Borrelia burgdorferi 1
FLKDAMSVNGR

SEQ ID NO: 67085 - protein, 11 aa, Borrelia burgdorferi 1
SIVSKAVDASK

SEQ ID NO: 67086 - protein, 11 aa, Borrelia burgdorferi 1
LLMLLAVFSCK

SEQ ID NO: 67087 - protein, 11 aa, Borrelia burgdorferi 1
SLGFKEYVCYK

SEQ ID NO: 67088 - protein, 11 aa, Borrelia burgdorferi 1
VSKAVDASKKR

SEQ ID NO: 67089 - protein, 11 aa, Borrelia burgdorferi 1
VVDAFGADPYK

SEQ ID NO: 67090 - protein, 11 aa, Borrelia burgdorferi 1
SYKEFFDWLSK

SEQ ID NO: 67091 - protein, 11 aa, Borrelia burgdorferi 1
FFDWLSKDVNR

SEQ ID NO: 67092 - protein, 9 aa, Borrelia burgdorferi 1
KPVKCNEEI

SEQ ID NO: 67093 - protein, 9 aa, Borrelia burgdorferi 1
IPLVVSDVV

SEQ ID NO: 67094 - protein, 9 aa, Borrelia burgdorferi 1
SVNGREEAL

SEQ ID NO: 67095 - protein, 10 aa, Borrelia burgdorferi 1
RPTEQQSLGF

SEQ ID NO: 67096 - protein, 10 aa, Borrelia burgdorferi 1
KPVKCNEEIF

SEQ ID NO: 67097 - protein, 10 aa, Borrelia burgdorferi 1
KIKNSKGEAL

SEQ ID NO: 67098 - protein, 10 aa, Borrelia burgdorferi 1
IPKEISLTPE

SEQ ID NO: 67099 - protein, 11 aa, Borrelia burgdorferi 1
TPEEAEKLESL

SEQ ID NO: 67100 - protein, 11 aa, Borrelia burgdorferi 1
KKRRPTEQQSL

SEQ ID NO: 67101 - protein, 9 aa, Borrelia burgdorferi 1
IFKVIKKVL

SEQ ID NO: 67102 - protein, 9 aa, Borrelia burgdorferi 1
FFQKVVDAF

SEQ ID NO: 67103 - protein, 9 aa, Borrelia burgdorferi 1
MMQRISILL

SEQ ID NO: 67104 - protein, 10 aa, Borrelia burgdorferi 1
KIKNSKGEAL

SEQ ID NO: 67105 - protein, 11 aa, Borrelia burgdorferi 1
YKIKNSKGEAL

SEQ ID NO: 67106 - protein, 11 aa, Borrelia burgdorferi 1
MMQRISILLML

SEQ ID NO: 67107 - protein, 9 aa, Borrelia burgdorferi 1
RQKEFISSF

SEQ ID NO: 67108 - protein, 9 aa, Borrelia burgdorferi 1
QQSLGFKEY

SEQ ID NO: 67109 - protein, 9 aa, Borrelia burgdorferi 1
KQFGDVKSL

SEQ ID NO: 67110 - protein, 9 aa, Borrelia burgdorferi 1
MQRISILLM

SEQ ID NO: 67111 - protein, 9 aa, Borrelia burgdorferi 1
ILLMLLAVF

SEQ ID NO: 67112 - protein, 9 aa, Borrelia burgdorferi 1
MMQRISILL

SEQ ID NO: 67113 - protein, 9 aa, Borrelia burgdorferi 1
FFQKVVDAF

SEQ ID NO: 67114 - protein, 9 aa, Borrelia burgdorferi 1
LGFKEYVCY

SEQ ID NO: 67115 - protein, 10 aa, Borrelia burgdorferi 1
ALKAEYEKSY

SEQ ID NO: 67116 - protein, 10 aa, Borrelia burgdorferi 1
MQRISILLML

SEQ ID NO: 67117 - protein, 10 aa, Borrelia burgdorferi 1
EQQSLGFKEY

SEQ ID NO: 67118 - protein, 10 aa, Borrelia burgdorferi 1
MMQRISILLM

SEQ ID NO: 67119 - protein, 10 aa, Borrelia burgdorferi 1
LLAVFSCKQF

SEQ ID NO: 67120 - protein, 10 aa, Borrelia burgdorferi 1
VVDAFGADPY

SEQ ID NO: 67121 - protein, 10 aa, Borrelia burgdorferi 1
LFFQKVVDAF

SEQ ID NO: 67122 - protein, 10 aa, Borrelia burgdorferi 1
NSKGEALSLF

SEQ ID NO: 67123 - protein, 11 aa, Borrelia burgdorferi 1
KVVDAFGADPY

SEQ ID NO: 67124 - protein, 11 aa, Borrelia burgdorferi 1
ISILLMLLAVF

SEQ ID NO: 67125 - protein, 11 aa, Borrelia burgdorferi 1
LSKDVNRQKEF

SEQ ID NO: 67126 - protein, 11 aa, Borrelia burgdorferi 1
MQRISILLMLL

SEQ ID NO: 67127 - protein, 11 aa, Borrelia burgdorferi 1
MLLAVFSCKQF

SEQ ID NO: 67128 - protein, 11 aa, Borrelia burgdorferi 1
SLFFQKVVDAF

SEQ ID NO: 67129 - protein, 11 aa, Borrelia burgdorferi 1
AMSVNGREEAL

SEQ ID NO: 67130 - protein, 11 aa, Borrelia burgdorferi 1
MMQRISILLML

SEQ ID NO: 67131 - protein, 11 aa, Borrelia burgdorferi 1
QSLGFKEYVCY

SEQ ID NO: 67132 - protein, 11 aa, Borrelia burgdorferi 1
NSKGEALSLFF

SEQ ID NO: 67133 - protein, 11 aa, Borrelia burgdorferi 1
KQFGDVKSLTE

SEQ ID NO: 67134 - protein, 11 aa, Borrelia burgdorferi 1
VNRQKEFISSF

SEQ ID NO: 67135 - protein, 9 aa, Borrelia burgdorferi 1
QRISILLML

SEQ ID NO: 67136 - protein, 9 aa, Borrelia burgdorferi 1
RQKEFISSF

SEQ ID NO: 67137 - protein, 9 aa, Borrelia burgdorferi 1
RRPTEQQSL

SEQ ID NO: 67138 - protein, 9 aa, Borrelia burgdorferi 1
KQFGDVKSL

SEQ ID NO: 67139 - protein, 10 aa, Borrelia burgdorferi 1
QRISILLMLL

SEQ ID NO: 67140 - protein, 10 aa, Borrelia burgdorferi 1
NRQKEFISSF

SEQ ID NO: 67141 - protein, 10 aa, Borrelia burgdorferi 1
GREEALKAEY

SEQ ID NO: 67142 - protein, 10 aa, Borrelia burgdorferi 1
KRRPTEQQSL

SEQ ID NO: 67143 - protein, 11 aa, Borrelia burgdorferi 1
RRPTEQQSLGF

SEQ ID NO: 67144 - protein, 11 aa, Borrelia burgdorferi 1
QRISILLMLLA

SEQ ID NO: 67145 - protein, 9 aa, Borrelia burgdorferi 1
FFQKVVDAF

SEQ ID NO: 67146 - protein, 9 aa, Borrelia burgdorferi 1
VDAFGADPY

SEQ ID NO: 67147 - protein, 9 aa, Borrelia burgdorferi 1
LAVFSCKQF

SEQ ID NO: 67148 - protein, 9 aa, Borrelia burgdorferi 1
LKVFLKDAM

SEQ ID NO: 67149 - protein, 9 aa, Borrelia burgdorferi 1
ILLMLLAVF

SEQ ID NO: 67150 - protein, 9 aa, Borrelia burgdorferi 1
IPLVVSDVV

SEQ ID NO: 67151 - protein, 9 aa, Borrelia burgdorferi 1
QQSLGFKEY

SEQ ID NO: 67152 - protein, 10 aa, Borrelia burgdorferi 1
RPTEQQSLGF

SEQ ID NO: 67153 - protein, 10 aa, Borrelia burgdorferi 1
KPVKCNEEIF

SEQ ID NO: 67154 - protein, 10 aa, Borrelia burgdorferi 1
VVDAFGADPY

SEQ ID NO: 67155 - protein, 10 aa, Borrelia burgdorferi 1
LFFQKVVDAF

SEQ ID NO: 67156 - protein, 10 aa, Borrelia burgdorferi 1
MSVNGREEAL

SEQ ID NO: 67157 - protein, 10 aa, Borrelia burgdorferi 1
SILLMLLAVF

SEQ ID NO: 67158 - protein, 10 aa, Borrelia burgdorferi 1
MMQRISILLM

SEQ ID NO: 67159 - protein, 10 aa, Borrelia burgdorferi 1
TPEEAEKLES

SEQ ID NO: 67160 - protein, 11 aa, Borrelia burgdorferi 1
KVVDAFGADPY

SEQ ID NO: 67161 - protein, 11 aa, Borrelia burgdorferi 1
EALKAEYEKSY

SEQ ID NO: 67162 - protein, 11 aa, Borrelia burgdorferi 1
TPEEAEKLESL

SEQ ID NO: 67163 - protein, 11 aa, Borrelia burgdorferi 1
EAEKLESLKVF

SEQ ID NO: 67164 - protein, 11 aa, Borrelia burgdorferi 1
ISILLMLLAVF

SEQ ID NO: 67165 - protein, 11 aa, Borrelia burgdorferi 1
ESLKVFLKDAM

SEQ ID NO: 67166 - protein, 11 aa, Borrelia burgdorferi 1
SLFFQKVVDAF

SEQ ID NO: 67167 - protein, 9 aa, Borrelia burgdorferi 1
TEIDSGNGI

SEQ ID NO: 67168 - protein, 9 aa, Borrelia burgdorferi 1
AEKLESLKV

SEQ ID NO: 67169 - protein, 9 aa, Borrelia burgdorferi 1
KEISLTPEE

SEQ ID NO: 67170 - protein, 10 aa, Borrelia burgdorferi 1
AEKLESLKVF

SEQ ID NO: 67171 - protein, 10 aa, Borrelia burgdorferi 1
AEYEKSYKEF

SEQ ID NO: 67172 - protein, 10 aa, Borrelia burgdorferi 1
KEFISSFDNI

SEQ ID NO: 67173 - protein, 10 aa, Borrelia burgdorferi 1
KEISLTPEEA

SEQ ID NO: 67174 - protein, 10 aa, Borrelia burgdorferi 1
EEIFKVIKKV

SEQ ID NO: 67175 - protein, 11 aa, Borrelia burgdorferi 1
TEIDSGNGIPL

SEQ ID NO: 67176 - protein, 11 aa, Borrelia burgdorferi 1
KEFISSFDNIS

SEQ ID NO: 67177 - protein, 11 aa, Borrelia burgdorferi 1
AEYEKSYKEFF

SEQ ID NO: 67178 - protein, 11 aa, Borrelia burgdorferi 1
AEKLESLKVFL

SEQ ID NO: 67179 - protein, 11 aa, Borrelia burgdorferi 1
EEIFKVIKKVL

SEQ ID NO: 67180 - protein, 11 aa, Borrelia burgdorferi 1
KEFFDWLSKDV

SEQ ID NO: 67181 - protein, 9 aa, Borrelia burgdorferi 1
IPLVVSDVV

SEQ ID NO: 67182 - protein, 9 aa, Borrelia burgdorferi 1
IPKEISLTP

SEQ ID NO: 67183 - protein, 10 aa, Borrelia burgdorferi 1
IPLVVSDVVK

SEQ ID NO: 67184 - protein, 11 aa, Borrelia burgdorferi 1
DPYKKDNDESV

SEQ ID NO: 67185 - protein, 11 aa, Borrelia burgdorferi 1
IPLVVSDVVKD

SEQ ID NO: 67186 - protein, 9 aa, Borrelia burgdorferi 1
KSYKEFFDW

SEQ ID NO: 67187 - protein, 10 aa, Borrelia garinii PBi
VADAFGTQEY

SEQ ID NO: 67188 - protein, 10 aa, Borrelia garinii PBi
FTESENNNEL

SEQ ID NO: 67189 - protein, 10 aa, Borrelia garinii PBi
ATDLEDDNSF

SEQ ID NO: 67190 - protein, 9 aa, Borrelia garinii PBi
SILSILLLL

SEQ ID NO: 67191 - protein, 9 aa, Borrelia garinii PBi
KSLGFNEYV

SEQ ID NO: 67192 - protein, 9 aa, Borrelia garinii PBi
ILSILLLLL

SEQ ID NO: 67193 - protein, 9 aa, Borrelia garinii PBi
SLTEVATDL

SEQ ID NO: 67194 - protein, 9 aa, Borrelia garinii PBi
RISILSILL

SEQ ID NO: 67195 - protein, 9 aa, Borrelia garinii PBi
ILLLLLLFS

SEQ ID NO: 67196 - protein, 9 aa, Borrelia garinii PBi
LLLLLLFSC

SEQ ID NO: 67197 - protein, 9 aa, Borrelia garinii PBi
RLEALKTFL

SEQ ID NO: 67198 - protein, 9 aa, Borrelia garinii PBi
KQYGDVKSL

SEQ ID NO: 67199 - protein, 9 aa, Borrelia garinii PBi
KCNEEIFKV

SEQ ID NO: 67200 - protein, 9 aa, Borrelia garinii PBi
LTSEEFERL

SEQ ID NO: 67201 - protein, 10 aa, Borrelia garinii PBi
SILSILLLLL

SEQ ID NO: 67202 - protein, 10 aa, Borrelia garinii PBi
ILSILLLLLL

SEQ ID NO: 67203 - protein, 10 aa, Borrelia garinii PBi
VLTSEEFERL

SEQ ID NO: 67204 - protein, 10 aa, Borrelia garinii PBi
KTFLKDAMGV

SEQ ID NO: 67205 - protein, 10 aa, Borrelia garinii PBi
RISILSILLL

SEQ ID NO: 67206 - protein, 10 aa, Borrelia garinii PBi
SLFFQKVADA

SEQ ID NO: 67207 - protein, 11 aa, Borrelia garinii PBi
SILSILLLLLL

SEQ ID NO: 67208 - protein, 11 aa, Borrelia garinii PBi
FVSFFNNICGI

SEQ ID NO: 67209 - protein, 11 aa, Borrelia garinii PBi
LLFSCKQYGDV

SEQ ID NO: 67210 - protein, 11 aa, Borrelia garinii PBi
RISILSILLLL

SEQ ID NO: 67211 - protein, 9 aa, Borrelia garinii PBi
LLLLLFSCK

SEQ ID NO: 67212 - protein, 9 aa, Borrelia garinii PBi
KEFFDWLSK

SEQ ID NO: 67213 - protein, 9 aa, Borrelia garinii PBi
ITKAVDASK

SEQ ID NO: 67214 - protein, 9 aa, Borrelia garinii PBi
LEALKTFLK

SEQ ID NO: 67215 - protein, 10 aa, Borrelia garinii PBi
RLEALKTFLK

SEQ ID NO: 67216 - protein, 10 aa, Borrelia garinii PBi
LLLLLLFSCK

SEQ ID NO: 67217 - protein, 10 aa, Borrelia garinii PBi
LLLLFSCKQY

SEQ ID NO: 67218 - protein, 10 aa, Borrelia garinii PBi
NSYNLNSNNK

SEQ ID NO: 67219 - protein, 10 aa, Borrelia garinii PBi
IITKAVDASK

SEQ ID NO: 67220 - protein, 10 aa, Borrelia garinii PBi
ADAFGTQEYK

SEQ ID NO: 67221 - protein, 10 aa, Borrelia garinii PBi
SLGFNEYVCY

SEQ ID NO: 67222 - protein, 10 aa, Borrelia garinii PBi
ITKAVDASKK

SEQ ID NO: 67223 - protein, 10 aa, Borrelia garinii PBi
GVNGREGDTK

SEQ ID NO: 67224 - protein, 10 aa, Borrelia garinii PBi
SFASGSVESK

SEQ ID NO: 67225 - protein, 10 aa, Borrelia garinii PBi
WLSKDVNRQK

SEQ ID NO: 67226 - protein, 10 aa, Borrelia garinii PBi
TKAEYEKSYK

SEQ ID NO: 67227 - protein, 11 aa, Borrelia garinii PBi
ILLLLLLFSCK

SEQ ID NO: 67228 - protein, 11 aa, Borrelia garinii PBi
NSFASGSVESK

SEQ ID NO: 67229 - protein, 11 aa, Borrelia garinii PBi
IITKAVDASKK

SEQ ID NO: 67230 - protein, 11 aa, Borrelia garinii PBi
GIITKAVDASK

SEQ ID NO: 67231 - protein, 11 aa, Borrelia garinii PBi
KVADAFGTQEY

SEQ ID NO: 67232 - protein, 11 aa, Borrelia garinii PBi
FFNNICGIITK

SEQ ID NO: 67233 - protein, 11 aa, Borrelia garinii PBi
ASKKRYNSNPK

SEQ ID NO: 67234 - protein, 11 aa, Borrelia garinii PBi
RISILSILLLL

SEQ ID NO: 67235 - protein, 9 aa, Borrelia garinii PBi
LLLLLFSCK

SEQ ID NO: 67236 - protein, 9 aa, Borrelia garinii PBi
ITKAVDASK

SEQ ID NO: 67237 - protein, 9 aa, Borrelia garinii PBi
KEFFDWLSK

SEQ ID NO: 67238 - protein, 9 aa, Borrelia garinii PBi
SYNLNSNNK

SEQ ID NO: 67239 - protein, 9 aa, Borrelia garinii PBi
KAEYEKSYK

SEQ ID NO: 67240 - protein, 9 aa, Borrelia garinii PBi
FASGSVESK

SEQ ID NO: 67241 - protein, 9 aa, Borrelia garinii PBi
DAFGTQEYK

SEQ ID NO: 67242 - protein, 9 aa, Borrelia garinii PBi
ESKDQIIEK

SEQ ID NO: 67243 - protein, 9 aa, Borrelia garinii PBi
LSKDVNRQK

SEQ ID NO: 67244 - protein, 9 aa, Borrelia garinii PBi
LEALKTFLK

SEQ ID NO: 67245 - protein, 9 aa, Borrelia garinii PBi
VLTSEEFER

SEQ ID NO: 67246 - protein, 10 aa, Borrelia garinii PBi
NSYNLNSNNK

SEQ ID NO: 67247 - protein, 10 aa, Borrelia garinii PBi
RLEALKTFLK

SEQ ID NO: 67248 - protein, 10 aa, Borrelia garinii PBi
LLLLLLFSCK

SEQ ID NO: 67249 - protein, 10 aa, Borrelia garinii PBi
ITKAVDASKK

SEQ ID NO: 67250 - protein, 10 aa, Borrelia garinii PBi
GVNGREGDTK

SEQ ID NO: 67251 - protein, 10 aa, Borrelia garinii PBi
IITKAVDASK

SEQ ID NO: 67252 - protein, 10 aa, Borrelia garinii PBi
SFASGSVESK

SEQ ID NO: 67253 - protein, 10 aa, Borrelia garinii PBi
FSCKQYGDVK

SEQ ID NO: 67254 - protein, 10 aa, Borrelia garinii PBi
SILLLLLLFS

SEQ ID NO: 67255 - protein, 11 aa, Borrelia garinii PBi
ILLLLLLFSCK

SEQ ID NO: 67256 - protein, 11 aa, Borrelia garinii PBi
NSFASGSVESK

SEQ ID NO: 67257 - protein, 11 aa, Borrelia garinii PBi
SVESKDQIIEK

SEQ ID NO: 67258 - protein, 11 aa, Borrelia garinii PBi
GIITKAVDASK

SEQ ID NO: 67259 - protein, 11 aa, Borrelia garinii PBi
ASKKRYNSNPK

SEQ ID NO: 67260 - protein, 11 aa, Borrelia garinii PBi
VADAFGTQEYK

SEQ ID NO: 67261 - protein, 11 aa, Borrelia garinii PBi
TGDDLSLFFQK

SEQ ID NO: 67262 - protein, 11 aa, Borrelia garinii PBi
KVADAFGTQEY

SEQ ID NO: 67263 - protein, 11 aa, Borrelia garinii PBi
IITKAVDASKK

SEQ ID NO: 67264 - protein, 11 aa, Borrelia garinii PBi
SYKEFFDWLSK

SEQ ID NO: 67265 - protein, 11 aa, Borrelia garinii PBi
KSLGFNEYVCY

SEQ ID NO: 67266 - protein, 11 aa, Borrelia garinii PBi
SENNNELANLK

SEQ ID NO: 67267 - protein, 11 aa, Borrelia garinii PBi
RTGDDLSLFFQ

SEQ ID NO: 67268 - protein, 11 aa, Borrelia garinii PBi
DTKAEYEKSYK

SEQ ID NO: 67269 - protein, 11 aa, Borrelia garinii PBi
GFNEYVCYDIK

SEQ ID NO: 67270 - protein, 9 aa, Borrelia garinii PBi
EYEKSYKEF

SEQ ID NO: 67271 - protein, 9 aa, Borrelia garinii PBi
RYNSNPKSL

SEQ ID NO: 67272 - protein, 9 aa, Borrelia garinii PBi
FFQKVADAF

SEQ ID NO: 67273 - protein, 9 aa, Borrelia garinii PBi
SYKEFFDWL

SEQ ID NO: 67274 - protein, 9 aa, Borrelia garinii PBi
EFVSFFNNI

SEQ ID NO: 67275 - protein, 9 aa, Borrelia garinii PBi
IFKVIKRVF

SEQ ID NO: 67276 - protein, 9 aa, Borrelia garinii PBi
SYNLNSNNK

SEQ ID NO: 67277 - protein, 9 aa, Borrelia garinii PBi
SILLLLLLF

SEQ ID NO: 67278 - protein, 10 aa, Borrelia garinii PBi
EYEKSYKEFF

SEQ ID NO: 67279 - protein, 10 aa, Borrelia garinii PBi
LSILLLLLLF

SEQ ID NO: 67280 - protein, 10 aa, Borrelia garinii PBi
LFFQKVADAF

SEQ ID NO: 67281 - protein, 11 aa, Borrelia garinii PBi
RYNSNPKSLGF

SEQ ID NO: 67282 - protein, 11 aa, Borrelia garinii PBi
EFERLEALKTF

SEQ ID NO: 67283 - protein, 11 aa, Borrelia garinii PBi
ILSILLLLLLF

SEQ ID NO: 67284 - protein, 9 aa, Borrelia garinii PBi
LGFNEYVCY

SEQ ID NO: 67285 - protein, 10 aa, Borrelia garinii PBi
SLGFNEYVCY

SEQ ID NO: 67286 - protein, 10 aa, Borrelia garinii PBi
VADAFGTQEY

SEQ ID NO: 67287 - protein, 10 aa, Borrelia garinii PBi
LLLLFSCKQY

SEQ ID NO: 67288 - protein, 11 aa, Borrelia garinii PBi
KVADAFGTQEY

SEQ ID NO: 67289 - protein, 11 aa, Borrelia garinii PBi
ELANLKNLNSY

SEQ ID NO: 67290 - protein, 11 aa, Borrelia garinii PBi
KSLGFNEYVCY

SEQ ID NO: 67291 - protein, 11 aa, Borrelia garinii PBi
ILSILLLLLLF

SEQ ID NO: 67292 - protein, 9 aa, Borrelia garinii PBi
DAFGTQEYK

SEQ ID NO: 67293 - protein, 9 aa, Borrelia garinii PBi
YVCYDIKTR

SEQ ID NO: 67294 - protein, 9 aa, Borrelia garinii PBi
ITKAVDASK

SEQ ID NO: 67295 - protein, 9 aa, Borrelia garinii PBi
FASGSVESK

SEQ ID NO: 67296 - protein, 9 aa, Borrelia garinii PBi
ESKDQIIEK

SEQ ID NO: 67297 - protein, 9 aa, Borrelia garinii PBi
VLTSEEFER

SEQ ID NO: 67298 - protein, 9 aa, Borrelia garinii PBi
EEIFKVIKR

SEQ ID NO: 67299 - protein, 9 aa, Borrelia garinii PBi
NNNELANLK

SEQ ID NO: 67300 - protein, 9 aa, Borrelia garinii PBi
EFERLEALK

SEQ ID NO: 67301 - protein, 9 aa, Borrelia garinii PBi
LSKDVNRQK

SEQ ID NO: 67302 - protein, 9 aa, Borrelia garinii PBi
SYNLNSNNK

SEQ ID NO: 67303 - protein, 9 aa, Borrelia garinii PBi
EKCNEEIFK

SEQ ID NO: 67304 - protein, 9 aa, Borrelia garinii PBi
NNICGIITK

SEQ ID NO: 67305 - protein, 9 aa, Borrelia garinii PBi
KAVDASKKR

SEQ ID NO: 67306 - protein, 9 aa, Borrelia garinii PBi
LEALKTFLK

SEQ ID NO: 67307 - protein, 9 aa, Borrelia garinii PBi
DDLSLFFQK

SEQ ID NO: 67308 - protein, 9 aa, Borrelia garinii PBi
TKAVDASKK

SEQ ID NO: 67309 - protein, 9 aa, Borrelia garinii PBi
KAEYEKSYK

SEQ ID NO: 67310 - protein, 10 aa, Borrelia garinii PBi
NSYNLNSNNK

SEQ ID NO: 67311 - protein, 10 aa, Borrelia garinii PBi
ITKAVDASKK

SEQ ID NO: 67312 - protein, 10 aa, Borrelia garinii PBi
EYVCYDIKTR

SEQ ID NO: 67313 - protein, 10 aa, Borrelia garinii PBi
IITKAVDASK

SEQ ID NO: 67314 - protein, 10 aa, Borrelia garinii PBi
ENNNELANLK

SEQ ID NO: 67315 - protein, 10 aa, Borrelia garinii PBi
EEFERLEALK

SEQ ID NO: 67316 - protein, 10 aa, Borrelia garinii PBi
FSCKQYGDVK

SEQ ID NO: 67317 - protein, 10 aa, Borrelia garinii PBi
SFASGSVESK

SEQ ID NO: 67318 - protein, 10 aa, Borrelia garinii PBi
TKAEYEKSYK

SEQ ID NO: 67319 - protein, 10 aa, Borrelia garinii PBi
PVLTSEEFER

SEQ ID NO: 67320 - protein, 10 aa, Borrelia garinii PBi
WLSKDVNRQK

SEQ ID NO: 67321 - protein, 10 aa, Borrelia garinii PBi
TKAVDASKKR

SEQ ID NO: 67322 - protein, 10 aa, Borrelia garinii PBi
RLEALKTFLK

SEQ ID NO: 67323 - protein, 10 aa, Borrelia garinii PBi
FNEYVCYDIK

SEQ ID NO: 67324 - protein, 11 aa, Borrelia garinii PBi
NSFASGSVESK

SEQ ID NO: 67325 - protein, 11 aa, Borrelia garinii PBi
DTKAEYEKSYK

SEQ ID NO: 67326 - protein, 11 aa, Borrelia garinii PBi
ITKAVDASKKR

SEQ ID NO: 67327 - protein, 11 aa, Borrelia garinii PBi
DAFGTQEYKNK

SEQ ID NO: 67328 - protein, 11 aa, Borrelia garinii PBi
IITKAVDASKK

SEQ ID NO: 67329 - protein, 11 aa, Borrelia garinii PBi
FLKDAMGVNGR

SEQ ID NO: 67330 - protein, 11 aa, Borrelia garinii PBi
FFNNICGIITK

SEQ ID NO: 67331 - protein, 11 aa, Borrelia garinii PBi
SVESKDQIIEK

SEQ ID NO: 67332 - protein, 11 aa, Borrelia garinii PBi
ELANLKNLNSY

SEQ ID NO: 67333 - protein, 11 aa, Borrelia garinii PBi
GPVLTSEEFER

SEQ ID NO: 67334 - protein, 11 aa, Borrelia garinii PBi
GIITKAVDASK

SEQ ID NO: 67335 - protein, 11 aa, Borrelia garinii PBi
VADAFGTQEYK

SEQ ID NO: 67336 - protein, 11 aa, Borrelia garinii PBi
LNSYNLNSNNK

SEQ ID NO: 67337 - protein, 11 aa, Borrelia garinii PBi
SYKEFFDWLSK

SEQ ID NO: 67338 - protein, 11 aa, Borrelia garinii PBi
MGVNGREGDTK

SEQ ID NO: 67339 - protein, 11 aa, Borrelia garinii PBi
FFDWLSKDVNR

SEQ ID NO: 67340 - protein, 11 aa, Borrelia garinii PBi
NEYVCYDIKTR

SEQ ID NO: 67341 - protein, 9 aa, Borrelia garinii PBi
GPVLTSEEF

SEQ ID NO: 67342 - protein, 9 aa, Borrelia garinii PBi
KPEKCNEEI

SEQ ID NO: 67343 - protein, 10 aa, Borrelia garinii PBi
KPEKCNEEIF

SEQ ID NO: 67344 - protein, 10 aa, Borrelia garinii PBi
KTRTGDDLSL

SEQ ID NO: 67345 - protein, 11 aa, Borrelia garinii PBi
KKRYNSNPKSL

SEQ ID NO: 67346 - protein, 9 aa, Borrelia garinii PBi
IFKVIKRVF

SEQ ID NO: 67347 - protein, 9 aa, Borrelia garinii PBi
FFQKVADAF

SEQ ID NO: 67348 - protein, 9 aa, Borrelia garinii PBi
RQKEFVSFF

SEQ ID NO: 67349 - protein, 9 aa, Borrelia garinii PBi
KQYGDVKSL

SEQ ID NO: 67350 - protein, 9 aa, Borrelia garinii PBi
LLLFSCKQY

SEQ ID NO: 67351 - protein, 9 aa, Borrelia garinii PBi
LGFNEYVCY

SEQ ID NO: 67352 - protein, 9 aa, Borrelia garinii PBi
QIIEKGPVL

SEQ ID NO: 67353 - protein, 9 aa, Borrelia garinii PBi
FFQKVADAF

SEQ ID NO: 67354 - protein, 9 aa, Borrelia garinii PBi
IFKVIKRVF

SEQ ID NO: 67355 - protein, 9 aa, Borrelia garinii PBi
NSNPKSLGF

SEQ ID NO: 67356 - protein, 10 aa, Borrelia garinii PBi
LANLKNLNSY

SEQ ID NO: 67357 - protein, 10 aa, Borrelia garinii PBi
LLLLFSCKQY

SEQ ID NO: 67358 - protein, 10 aa, Borrelia garinii PBi
LFFQKVADAF

SEQ ID NO: 67359 - protein, 10 aa, Borrelia garinii PBi
LSILLLLLLF

SEQ ID NO: 67360 - protein, 10 aa, Borrelia garinii PBi
YNSNPKSLGF

SEQ ID NO: 67361 - protein, 10 aa, Borrelia garinii PBi
RTGDDLSLFF

SEQ ID NO: 67362 - protein, 10 aa, Borrelia garinii PBi
SLGFNEYVCY

SEQ ID NO: 67363 - protein, 10 aa, Borrelia garinii PBi
VADAFGTQEY

SEQ ID NO: 67364 - protein, 11 aa, Borrelia garinii PBi
KVADAFGTQEY

SEQ ID NO: 67365 - protein, 11 aa, Borrelia garinii PBi
LSKDVNRQKEF

SEQ ID NO: 67366 - protein, 11 aa, Borrelia garinii PBi
KSLGFNEYVCY

SEQ ID NO: 67367 - protein, 11 aa, Borrelia garinii PBi
SLFFQKVADAF

SEQ ID NO: 67368 - protein, 11 aa, Borrelia garinii PBi
ELANLKNLNSY

SEQ ID NO: 67369 - protein, 11 aa, Borrelia garinii PBi
ILSILLLLLLF

SEQ ID NO: 67370 - protein, 11 aa, Borrelia garinii PBi
LLLLLFSCKQY

SEQ ID NO: 67371 - protein, 11 aa, Borrelia garinii PBi
KTRTGDDLSLF

SEQ ID NO: 67372 - protein, 11 aa, Borrelia garinii PBi
KQYGDVKSLTE

SEQ ID NO: 67373 - protein, 11 aa, Borrelia garinii PBi
VATDLEDDNSF

SEQ ID NO: 67374 - protein, 9 aa, Borrelia garinii PBi
KRISILSIL

SEQ ID NO: 67375 - protein, 9 aa, Borrelia garinii PBi
NRQKEFVSF

SEQ ID NO: 67376 - protein, 9 aa, Borrelia garinii PBi
KRYNSNPKS

SEQ ID NO: 67377 - protein, 9 aa, Borrelia garinii PBi
KQYGDVKSL

SEQ ID NO: 67378 - protein, 9 aa, Borrelia garinii PBi
RQKEFVSFF

SEQ ID NO: 67379 - protein, 9 aa, Borrelia garinii PBi
ERLEALKTF

SEQ ID NO: 67380 - protein, 9 aa, Borrelia garinii PBi
TRTGDDLSL

SEQ ID NO: 67381 - protein, 10 aa, Borrelia garinii PBi
KRYNSNPKSL

SEQ ID NO: 67382 - protein, 10 aa, Borrelia garinii PBi
KRISILSILL

SEQ ID NO: 67383 - protein, 10 aa, Borrelia garinii PBi
GREGDTKAEY

SEQ ID NO: 67384 - protein, 10 aa, Borrelia garinii PBi
NRQKEFVSFF

SEQ ID NO: 67385 - protein, 11 aa, Borrelia garinii PBi
KRISILSILLL

SEQ ID NO: 67386 - protein, 11 aa, Borrelia garinii PBi
ERLEALKTFLK

SEQ ID NO: 67387 - protein, 11 aa, Borrelia garinii PBi
TRTGDDLSLFF

SEQ ID NO: 67388 - protein, 9 aa, Borrelia garinii PBi
GPVLTSEEF

SEQ ID NO: 67389 - protein, 9 aa, Borrelia garinii PBi
FFQKVADAF

SEQ ID NO: 67390 - protein, 9 aa, Borrelia garinii PBi
TDLEDDNSF

SEQ ID NO: 67391 - protein, 9 aa, Borrelia garinii PBi
ADAFGTQEY

SEQ ID NO: 67392 - protein, 10 aa, Borrelia garinii PBi
NPKSLGFNEY

SEQ ID NO: 67393 - protein, 10 aa, Borrelia garinii PBi
VADAFGTQEY

SEQ ID NO: 67394 - protein, 10 aa, Borrelia garinii PBi
LANLKNLNSY

SEQ ID NO: 67395 - protein, 10 aa, Borrelia garinii PBi
LFFQKVADAF

SEQ ID NO: 67396 - protein, 10 aa, Borrelia garinii PBi
KPEKCNEEIF

SEQ ID NO: 67397 - protein, 10 aa, Borrelia garinii PBi
KAVDASKKRY

SEQ ID NO: 67398 - protein, 10 aa, Borrelia garinii PBi
FTESENNNEL

SEQ ID NO: 67399 - protein, 11 aa, Borrelia garinii PBi
KVADAFGTQEY

SEQ ID NO: 67400 - protein, 11 aa, Borrelia garinii PBi
EALKTFLKDAM

SEQ ID NO: 67401 - protein, 11 aa, Borrelia garinii PBi
VATDLEDDNSF

SEQ ID NO: 67402 - protein, 11 aa, Borrelia garinii PBi
ELANLKNLNSY

SEQ ID NO: 67403 - protein, 11 aa, Borrelia garinii PBi
SLFFQKVADAF

SEQ ID NO: 67404 - protein, 11 aa, Borrelia garinii PBi
DVNRQKEFVSF

SEQ ID NO: 67405 - protein, 11 aa, Borrelia garinii PBi
EFERLEALKTF

SEQ ID NO: 67406 - protein, 11 aa, Borrelia garinii PBi
NGREGDTKAEY

SEQ ID NO: 67407 - protein, 9 aa, Borrelia garinii PBi
EEFERLEAL

SEQ ID NO: 67408 - protein, 9 aa, Borrelia garinii PBi
SENNNELAN

SEQ ID NO: 67409 - protein, 9 aa, Borrelia garinii PBi
REGDTKAEY

SEQ ID NO: 67410 - protein, 9 aa, Borrelia garinii PBi
TEVATDLED

SEQ ID NO: 67411 - protein, 10 aa, Borrelia garinii PBi
AEYEKSYKEF

SEQ ID NO: 67412 - protein, 10 aa, Borrelia garinii PBi
SENNNELANL

SEQ ID NO: 67413 - protein, 10 aa, Borrelia garinii PBi
KEFVSFFNNI

SEQ ID NO: 67414 - protein, 10 aa, Borrelia garinii PBi
EEFERLEALK

SEQ ID NO: 67415 - protein, 10 aa, Borrelia garinii PBi
EEIFKVIKRV

SEQ ID NO: 67416 - protein, 11 aa, Borrelia garinii PBi
EEIFKVIKRVF

SEQ ID NO: 67417 - protein, 11 aa, Borrelia garinii PBi
EEFERLEALKT

SEQ ID NO: 67418 - protein, 11 aa, Borrelia garinii PBi
AEYEKSYKEFF

SEQ ID NO: 67419 - protein, 11 aa, Borrelia garinii PBi
KEFFDWLSKDV

SEQ ID NO: 67420 - protein, 11 aa, Borrelia garinii PBi
SENNNELANLK

SEQ ID NO: 67421 - protein, 9 aa, Borrelia garinii PBi
KSYKEFFDW

SEQ ID NO: 67422 - protein, 11 aa, Borrelia garinii PBi
KSLGFNEYVCY

SEQ ID NO: 67423 - protein, 9 aa, Borrelia burgdorferi B31
KIEIFNQDY

SEQ ID NO: 67424 - protein, 10 aa, Borrelia burgdorferi B31
LSDSKSLAEY

SEQ ID NO: 67425 - protein, 10 aa, Borrelia burgdorferi B31
TIDANLNEDY

SEQ ID NO: 67426 - protein, 10 aa, Borrelia burgdorferi B31
SSAKVYDRSY

SEQ ID NO: 67427 - protein, 11 aa, Borrelia burgdorferi B31
CTIDANLNEDY

SEQ ID NO: 67428 - protein, 11 aa, Borrelia burgdorferi B31
LLDVISSAKVY

SEQ ID NO: 67429 - protein, 11 aa, Borrelia burgdorferi B31
NSGLPTFALNY

SEQ ID NO: 67430 - protein, 11 aa, Borrelia burgdorferi B31
ISSAKVYDRSY

SEQ ID NO: 67431 - protein, 11 aa, Borrelia burgdorferi B31
SLSDSKSLAEY

SEQ ID NO: 67432 - protein, 11 aa, Borrelia burgdorferi B31
LSDSKSLAEYI

SEQ ID NO: 67433 - protein, 9 aa, Borrelia burgdorferi B31
FLFSCTIDA

SEQ ID NO: 67434 - protein, 9 aa, Borrelia burgdorferi B31
KMKDSAFEL

SEQ ID NO: 67435 - protein, 9 aa, Borrelia burgdorferi B31
LMDFDQYKI

SEQ ID NO: 67436 - protein, 9 aa, Borrelia burgdorferi B31
QLQSLSFSA

SEQ ID NO: 67437 - protein, 9 aa, Borrelia burgdorferi B31
KLLGLFLFS

SEQ ID NO: 67438 - protein, 9 aa, Borrelia burgdorferi B31
SVLEAYISI

SEQ ID NO: 67439 - protein, 9 aa, Borrelia burgdorferi B31
QLNSNTPEA

SEQ ID NO: 67440 - protein, 9 aa, Borrelia burgdorferi B31
ELLDVISSA

SEQ ID NO: 67441 - protein, 9 aa, Borrelia burgdorferi B31
KINSFDFTM

SEQ ID NO: 67442 - protein, 9 aa, Borrelia burgdorferi B31
GLFLFSCTI

SEQ ID NO: 67443 - protein, 9 aa, Borrelia burgdorferi B31
VLEAYISIM

SEQ ID NO: 67444 - protein, 9 aa, Borrelia burgdorferi B31
SLSDSKSLA

SEQ ID NO: 67445 - protein, 9 aa, Borrelia burgdorferi B31
NMQNARQSV

SEQ ID NO: 67446 - protein, 9 aa, Borrelia burgdorferi B31
FALNYSFSQ

SEQ ID NO: 67447 - protein, 9 aa, Borrelia burgdorferi B31
KLQTLKNEL

SEQ ID NO: 67448 - protein, 9 aa, Borrelia burgdorferi B31
NSFDFTMKL

SEQ ID NO: 67449 - protein, 9 aa, Borrelia burgdorferi B31
TQISFELAL

SEQ ID NO: 67450 - protein, 9 aa, Borrelia burgdorferi B31
ALMDFDQYK

SEQ ID NO: 67451 - protein, 9 aa, Borrelia burgdorferi B31
SLTKQRIPI

SEQ ID NO: 67452 - protein, 9 aa, Borrelia burgdorferi B31
MISGLGTQI

SEQ ID NO: 67453 - protein, 9 aa, Borrelia burgdorferi B31
LIQLKLLGL

SEQ ID NO: 67454 - protein, 10 aa, Borrelia burgdorferi B31
ALMDFDQYKI

SEQ ID NO: 67455 - protein, 10 aa, Borrelia burgdorferi B31
LLDVISSAKV

SEQ ID NO: 67456 - protein, 10 aa, Borrelia burgdorferi B31
GLGTQISFEL

SEQ ID NO: 67457 - protein, 10 aa, Borrelia burgdorferi B31
KMKDSAFELL

SEQ ID NO: 67458 - protein, 10 aa, Borrelia burgdorferi B31
LMISGLGTQI

SEQ ID NO: 67459 - protein, 10 aa, Borrelia burgdorferi B31
KLLGLFLFSC

SEQ ID NO: 67460 - protein, 10 aa, Borrelia burgdorferi B31
KLQTLKNELI

SEQ ID NO: 67461 - protein, 10 aa, Borrelia burgdorferi B31
FKMKDSAFEL

SEQ ID NO: 67462 - protein, 10 aa, Borrelia burgdorferi B31
RQADGLIANA

SEQ ID NO: 67463 - protein, 10 aa, Borrelia burgdorferi B31
SVLEAYISIM

SEQ ID NO: 67464 - protein, 10 aa, Borrelia burgdorferi B31
NLNEDYKNKV

SEQ ID NO: 67465 - protein, 10 aa, Borrelia burgdorferi B31
IQLKLLGLFL

SEQ ID NO: 67466 - protein, 10 aa, Borrelia burgdorferi B31
ALNYSFSQPT

SEQ ID NO: 67467 - protein, 10 aa, Borrelia burgdorferi B31
LLGLFLFSCT

SEQ ID NO: 67468 - protein, 10 aa, Borrelia burgdorferi B31
RIPIQAVTTV

SEQ ID NO: 67469 - protein, 10 aa, Borrelia burgdorferi B31
LIRELMISGL

SEQ ID NO: 67470 - protein, 11 aa, Borrelia burgdorferi B31
FLFSCTIDANL

SEQ ID NO: 67471 - protein, 11 aa, Borrelia burgdorferi B31
ALYNENQNHSL

SEQ ID NO: 67472 - protein, 11 aa, Borrelia burgdorferi B31
KVYDRSYAPQL

SEQ ID NO: 67473 - protein, 11 aa, Borrelia burgdorferi B31
SLIRELMISGL

SEQ ID NO: 67474 - protein, 11 aa, Borrelia burgdorferi B31
KINSFDFTMKL

SEQ ID NO: 67475 - protein, 11 aa, Borrelia burgdorferi B31
SLAEYIKKRYL

SEQ ID NO: 67476 - protein, 11 aa, Borrelia burgdorferi B31
KLLGLFLFSCT

SEQ ID NO: 67477 - protein, 11 aa, Borrelia burgdorferi B31
ELLDVISSAKV

SEQ ID NO: 67478 - protein, 11 aa, Borrelia burgdorferi B31
SLSFSADLSNL

SEQ ID NO: 67479 - protein, 11 aa, Borrelia burgdorferi B31
LLGLFLFSCTI

SEQ ID NO: 67480 - protein, 11 aa, Borrelia burgdorferi B31
QLQSLSFSADL

SEQ ID NO: 67481 - protein, 11 aa, Borrelia burgdorferi B31
GLFLFSCTIDA

SEQ ID NO: 67482 - protein, 11 aa, Borrelia burgdorferi B31
FALNYSFSQPT

SEQ ID NO: 67483 - protein, 11 aa, Borrelia burgdorferi B31
LIANASSNSSL

SEQ ID NO: 67484 - protein, 11 aa, Borrelia burgdorferi B31
ALEEINKKIEI

SEQ ID NO: 67485 - protein, 11 aa, Borrelia burgdorferi B31
GLGTQISFELA

SEQ ID NO: 67486 - protein, 11 aa, Borrelia burgdorferi B31
YALMDFDQYKI

SEQ ID NO: 67487 - protein, 11 aa, Borrelia burgdorferi B31
FKMKDSAFELL

SEQ ID NO: 67488 - protein, 11 aa, Borrelia burgdorferi B31
MQNARQSVLEA

SEQ ID NO: 67489 - protein, 11 aa, Borrelia burgdorferi B31
QISFELALEEI

SEQ ID NO: 67490 - protein, 11 aa, Borrelia burgdorferi B31
RQSVLEAYISI

SEQ ID NO: 67491 - protein, 11 aa, Borrelia burgdorferi B31
KAADDQETTSA

SEQ ID NO: 67492 - protein, 11 aa, Borrelia burgdorferi B31
SIMEALYNENQ

SEQ ID NO: 67493 - protein, 9 aa, Borrelia burgdorferi B31
KIKPLIQLK

SEQ ID NO: 67494 - protein, 9 aa, Borrelia burgdorferi B31
KSLAEYIKK

SEQ ID NO: 67495 - protein, 9 aa, Borrelia burgdorferi B31
KTVAAAPNK

SEQ ID NO: 67496 - protein, 9 aa, Borrelia burgdorferi B31
LLDVISSAK

SEQ ID NO: 67497 - protein, 9 aa, Borrelia burgdorferi B31
QTTTSSGSK

SEQ ID NO: 67498 - protein, 9 aa, Borrelia burgdorferi B31
KTQNNFGFR

SEQ ID NO: 67499 - protein, 9 aa, Borrelia burgdorferi B31
FTMKLKELK

SEQ ID NO: 67500 - protein, 9 aa, Borrelia burgdorferi B31
KLLGLFLFS

SEQ ID NO: 67501 - protein, 9 aa, Borrelia burgdorferi B31
ALMDFDQYK

SEQ ID NO: 67502 - protein, 9 aa, Borrelia burgdorferi B31
RSYAPQLNS

SEQ ID NO: 67503 - protein, 9 aa, Borrelia burgdorferi B31
KLNQILDKR

SEQ ID NO: 67504 - protein, 9 aa, Borrelia burgdorferi B31
AARAASLTK

SEQ ID NO: 67505 - protein, 9 aa, Borrelia burgdorferi B31
LIRAISEEK

SEQ ID NO: 67506 - protein, 9 aa, Borrelia burgdorferi B31
GLPTFALNY

SEQ ID NO: 67507 - protein, 9 aa, Borrelia burgdorferi B31
ETYDQFKMK

SEQ ID NO: 67508 - protein, 9 aa, Borrelia burgdorferi B31
RAASLTKQR

SEQ ID NO: 67509 - protein, 9 aa, Borrelia burgdorferi B31
SLAEYIKKR

SEQ ID NO: 67510 - protein, 9 aa, Borrelia burgdorferi B31
ALYNENQNH

SEQ ID NO: 67511 - protein, 10 aa, Borrelia burgdorferi B31
ELLDVISSAK

SEQ ID NO: 67512 - protein, 10 aa, Borrelia burgdorferi B31
KINSFDFTMK

SEQ ID NO: 67513 - protein, 10 aa, Borrelia burgdorferi B31
TAARAASLTK

SEQ ID NO: 67514 - protein, 10 aa, Borrelia burgdorferi B31
FSADLSNLPK

SEQ ID NO: 67515 - protein, 10 aa, Borrelia burgdorferi B31
NSFDFTMKLK

SEQ ID NO: 67516 - protein, 10 aa, Borrelia burgdorferi B31
VQTTTSSGSK

SEQ ID NO: 67517 - protein, 10 aa, Borrelia burgdorferi B31
SSGSKLQTLK

SEQ ID NO: 67518 - protein, 10 aa, Borrelia burgdorferi B31
TMKLKELKSK

SEQ ID NO: 67519 - protein, 10 aa, Borrelia burgdorferi B31
KSKLNQILDK

SEQ ID NO: 67520 - protein, 10 aa, Borrelia burgdorferi B31
ELIRAISEEK

SEQ ID NO: 67521 - protein, 10 aa, Borrelia burgdorferi B31
SSNSSLSDSK

SEQ ID NO: 67522 - protein, 10 aa, Borrelia burgdorferi B31
KLNQILDKRK

SEQ ID NO: 67523 - protein, 10 aa, Borrelia burgdorferi B31
KVYDRSYAPQ

SEQ ID NO: 67524 - protein, 10 aa, Borrelia burgdorferi B31
SKSLAEYIKK

SEQ ID NO: 67525 - protein, 10 aa, Borrelia burgdorferi B31
SLAEYIKKRY

SEQ ID NO: 67526 - protein, 10 aa, Borrelia burgdorferi B31
SADTNSNAAK

SEQ ID NO: 67527 - protein, 10 aa, Borrelia burgdorferi B31
KNKVKGILNK

SEQ ID NO: 67528 - protein, 10 aa, Borrelia burgdorferi B31
ELKKQSQAAK

SEQ ID NO: 67529 - protein, 10 aa, Borrelia burgdorferi B31
MKIKPLIQLK

SEQ ID NO: 67530 - protein, 10 aa, Borrelia burgdorferi B31
AVTTVPGNTR

SEQ ID NO: 67531 - protein, 11 aa, Borrelia burgdorferi B31
TTAARAASLTK

SEQ ID NO: 67532 - protein, 11 aa, Borrelia burgdorferi B31
TSSGSKLQTLK

SEQ ID NO: 67533 - protein, 11 aa, Borrelia burgdorferi B31
ALNYSFSQPTR

SEQ ID NO: 67534 - protein, 11 aa, Borrelia burgdorferi B31
AVQTTTSSGSK

SEQ ID NO: 67535 - protein, 11 aa, Borrelia burgdorferi B31
SQNQPQTTPNK

SEQ ID NO: 67536 - protein, 11 aa, Borrelia burgdorferi B31
FTMKLKELKSK

SEQ ID NO: 67537 - protein, 11 aa, Borrelia burgdorferi B31
ASSNSSLSDSK

SEQ ID NO: 67538 - protein, 11 aa, Borrelia burgdorferi B31
TSADTNSNAAK

SEQ ID NO: 67539 - protein, 11 aa, Borrelia burgdorferi B31
LIRAISEEKNK

SEQ ID NO: 67540 - protein, 11 aa, Borrelia burgdorferi B31
AAKTVAAAPNK

SEQ ID NO: 67541 - protein, 11 aa, Borrelia burgdorferi B31
SLSDSKSLAEY

SEQ ID NO: 67542 - protein, 11 aa, Borrelia burgdorferi B31
SFSADLSNLPK

SEQ ID NO: 67543 - protein, 11 aa, Borrelia burgdorferi B31
EIFNQDYLNAK

SEQ ID NO: 67544 - protein, 11 aa, Borrelia burgdorferi B31
KLQTLKNELIR

SEQ ID NO: 67545 - protein, 11 aa, Borrelia burgdorferi B31
KFYALMDFDQY

SEQ ID NO: 67546 - protein, 11 aa, Borrelia burgdorferi B31
KSLAEYIKKRY

SEQ ID NO: 67547 - protein, 11 aa, Borrelia burgdorferi B31
LSNLPKTTAAR

SEQ ID NO: 67548 - protein, 9 aa, Borrelia burgdorferi B31
KTVAAAPNK

SEQ ID NO: 67549 - protein, 9 aa, Borrelia burgdorferi B31
ALMDFDQYK

SEQ ID NO: 67550 - protein, 9 aa, Borrelia burgdorferi B31
KSLAEYIKK

SEQ ID NO: 67551 - protein, 9 aa, Borrelia burgdorferi B31
KTQNNFGFR

SEQ ID NO: 67552 - protein, 9 aa, Borrelia burgdorferi B31
SADLSNLPK

SEQ ID NO: 67553 - protein, 9 aa, Borrelia burgdorferi B31
QTTTSSGSK

SEQ ID NO: 67554 - protein, 9 aa, Borrelia burgdorferi B31
FTMKLKELK

SEQ ID NO: 67555 - protein, 9 aa, Borrelia burgdorferi B31
KIKPLIQLK

SEQ ID NO: 67556 - protein, 9 aa, Borrelia burgdorferi B31
AARAASLTK

SEQ ID NO: 67557 - protein, 9 aa, Borrelia burgdorferi B31
ETYDQFKMK

SEQ ID NO: 67558 - protein, 9 aa, Borrelia burgdorferi B31
ISSAKVYDR

SEQ ID NO: 67559 - protein, 9 aa, Borrelia burgdorferi B31
RAISEEKNK

SEQ ID NO: 67560 - protein, 9 aa, Borrelia burgdorferi B31
SFDFTMKLK

SEQ ID NO: 67561 - protein, 9 aa, Borrelia burgdorferi B31
SGSKLQTLK

SEQ ID NO: 67562 - protein, 9 aa, Borrelia burgdorferi B31
LLDVISSAK

SEQ ID NO: 67563 - protein, 9 aa, Borrelia burgdorferi B31
LIRAISEEK

SEQ ID NO: 67564 - protein, 9 aa, Borrelia burgdorferi B31
LALEEINKK

SEQ ID NO: 67565 - protein, 9 aa, Borrelia burgdorferi B31
SNSSLSDSK

SEQ ID NO: 67566 - protein, 9 aa, Borrelia burgdorferi B31
NQPQTTPNK

SEQ ID NO: 67567 - protein, 9 aa, Borrelia burgdorferi B31
RAASLTKQR

SEQ ID NO: 67568 - protein, 9 aa, Borrelia burgdorferi B31
VTTVPGNTR

SEQ ID NO: 67569 - protein, 9 aa, Borrelia burgdorferi B31
QTLKNELIR

SEQ ID NO: 67570 - protein, 9 aa, Borrelia burgdorferi B31
SIMEALYNE

SEQ ID NO: 67571 - protein, 9 aa, Borrelia burgdorferi B31
KLNQILDKR

SEQ ID NO: 67572 - protein, 9 aa, Borrelia burgdorferi B31
INSFDFTMK

SEQ ID NO: 67573 - protein, 9 aa, Borrelia burgdorferi B31
KVYDRSYAP

SEQ ID NO: 67574 - protein, 9 aa, Borrelia burgdorferi B31
GLPTFALNY

SEQ ID NO: 67575 - protein, 10 aa, Borrelia burgdorferi B31
SSNSSLSDSK

SEQ ID NO: 67576 - protein, 10 aa, Borrelia burgdorferi B31
KINSFDFTMK

SEQ ID NO: 67577 - protein, 10 aa, Borrelia burgdorferi B31
NSFDFTMKLK

SEQ ID NO: 67578 - protein, 10 aa, Borrelia burgdorferi B31
TAARAASLTK

SEQ ID NO: 67579 - protein, 10 aa, Borrelia burgdorferi B31
SSGSKLQTLK

SEQ ID NO: 67580 - protein, 10 aa, Borrelia burgdorferi B31
FSADLSNLPK

SEQ ID NO: 67581 - protein, 10 aa, Borrelia burgdorferi B31
YALMDFDQYK

SEQ ID NO: 67582 - protein, 10 aa, Borrelia burgdorferi B31
SADTNSNAAK

SEQ ID NO: 67583 - protein, 10 aa, Borrelia burgdorferi B31
KSKLNQILDK

SEQ ID NO: 67584 - protein, 10 aa, Borrelia burgdorferi B31
VQTTTSSGSK

SEQ ID NO: 67585 - protein, 10 aa, Borrelia burgdorferi B31
KLNQILDKRK

SEQ ID NO: 67586 - protein, 10 aa, Borrelia burgdorferi B31
AVTTVPGNTR

SEQ ID NO: 67587 - protein, 10 aa, Borrelia burgdorferi B31
KVYDRSYAPQ

SEQ ID NO: 67588 - protein, 10 aa, Borrelia burgdorferi B31
TMKLKELKSK

SEQ ID NO: 67589 - protein, 10 aa, Borrelia burgdorferi B31
ELLDVISSAK

SEQ ID NO: 67590 - protein, 10 aa, Borrelia burgdorferi B31
KSLAEYIKKR

SEQ ID NO: 67591 - protein, 10 aa, Borrelia burgdorferi B31
VISSAKVYDR

SEQ ID NO: 67592 - protein, 10 aa, Borrelia burgdorferi B31
IFNQDYLNAK

SEQ ID NO: 67593 - protein, 10 aa, Borrelia burgdorferi B31
ELIRAISEEK

SEQ ID NO: 67594 - protein, 10 aa, Borrelia burgdorferi B31
MKIKPLIQLK

SEQ ID NO: 67595 - protein, 10 aa, Borrelia burgdorferi B31
KTQNNFGFRE

SEQ ID NO: 67596 - protein, 11 aa, Borrelia burgdorferi B31
TTAARAASLTK

SEQ ID NO: 67597 - protein, 11 aa, Borrelia burgdorferi B31
AVQTTTSSGSK

SEQ ID NO: 67598 - protein, 11 aa, Borrelia burgdorferi B31
TSSGSKLQTLK

SEQ ID NO: 67599 - protein, 11 aa, Borrelia burgdorferi B31
ASSNSSLSDSK

SEQ ID NO: 67600 - protein, 11 aa, Borrelia burgdorferi B31
TSADTNSNAAK

SEQ ID NO: 67601 - protein, 11 aa, Borrelia burgdorferi B31
SQNQPQTTPNK

SEQ ID NO: 67602 - protein, 11 aa, Borrelia burgdorferi B31
SFSADLSNLPK

SEQ ID NO: 67603 - protein, 11 aa, Borrelia burgdorferi B31
TIDANLNEDYK

SEQ ID NO: 67604 - protein, 11 aa, Borrelia burgdorferi B31
AAKTVAAAPNK

SEQ ID NO: 67605 - protein, 11 aa, Borrelia burgdorferi B31
FTMKLKELKSK

SEQ ID NO: 67606 - protein, 11 aa, Borrelia burgdorferi B31
ALNYSFSQPTR

SEQ ID NO: 67607 - protein, 11 aa, Borrelia burgdorferi B31
EIFNQDYLNAK

SEQ ID NO: 67608 - protein, 11 aa, Borrelia burgdorferi B31
SLSDSKSLAEY

SEQ ID NO: 67609 - protein, 11 aa, Borrelia burgdorferi B31
TQNNFGFRETY

SEQ ID NO: 67610 - protein, 11 aa, Borrelia burgdorferi B31
KFYALMDFDQY

SEQ ID NO: 67611 - protein, 11 aa, Borrelia burgdorferi B31
AKINSFDFTMK

SEQ ID NO: 67612 - protein, 11 aa, Borrelia burgdorferi B31
LSNLPKTTAAR

SEQ ID NO: 67613 - protein, 11 aa, Borrelia burgdorferi B31
SFELALEEINK

SEQ ID NO: 67614 - protein, 11 aa, Borrelia burgdorferi B31
KSLAEYIKKRY

SEQ ID NO: 67615 - protein, 11 aa, Borrelia burgdorferi B31
LIRAISEEKNK

SEQ ID NO: 67616 - protein, 11 aa, Borrelia burgdorferi B31
KLQTLKNELIR

SEQ ID NO: 67617 - protein, 11 aa, Borrelia burgdorferi B31
SIMEALYNENQ

SEQ ID NO: 67618 - protein, 11 aa, Borrelia burgdorferi B31
NSGLPTFALNY

SEQ ID NO: 67619 - protein, 11 aa, Borrelia burgdorferi B31
INSFDFTMKLK

SEQ ID NO: 67620 - protein, 9 aa, Borrelia burgdorferi B31
IQLKLLGLF

SEQ ID NO: 67621 - protein, 9 aa, Borrelia burgdorferi B31
DYKNKVKGI

SEQ ID NO: 67622 - protein, 10 aa, Borrelia burgdorferi B31
DYLNAKINSF

SEQ ID NO: 67623 - protein, 10 aa, Borrelia burgdorferi B31
VYDRSYAPQL

SEQ ID NO: 67624 - protein, 10 aa, Borrelia burgdorferi B31
QYKIEQFGSI

SEQ ID NO: 67625 - protein, 10 aa, Borrelia burgdorferi B31
EWSRQADGLI

SEQ ID NO: 67626 - protein, 10 aa, Borrelia burgdorferi B31
LYNENQNHSL

SEQ ID NO: 67627 - protein, 10 aa, Borrelia burgdorferi B31
FYALMDFDQY

SEQ ID NO: 67628 - protein, 10 aa, Borrelia burgdorferi B31
DYKNKVKGIL

SEQ ID NO: 67629 - protein, 10 aa, Borrelia burgdorferi B31
RYLDNMQNAR

SEQ ID NO: 67630 - protein, 11 aa, Borrelia burgdorferi B31
LYNENQNHSLI

SEQ ID NO: 67631 - protein, 11 aa, Borrelia burgdorferi B31
IQLKLLGLFLF

SEQ ID NO: 67632 - protein, 11 aa, Borrelia burgdorferi B31
EYIKKRYLDNM

SEQ ID NO: 67633 - protein, 11 aa, Borrelia burgdorferi B31
NFGFRETYDQF

SEQ ID NO: 67634 - protein, 11 aa, Borrelia burgdorferi B31
IFNQDYLNAKI

SEQ ID NO: 67635 - protein, 11 aa, Borrelia burgdorferi B31
FYALMDFDQYK

SEQ ID NO: 67636 - protein, 11 aa, Borrelia burgdorferi B31
SYAPQLNSNTP

SEQ ID NO: 67637 - protein, 9 aa, Borrelia burgdorferi B31
GLPTFALNY

SEQ ID NO: 67638 - protein, 9 aa, Borrelia burgdorferi B31
PTFALNYSF

SEQ ID NO: 67639 - protein, 9 aa, Borrelia burgdorferi B31
YALMDFDQY

SEQ ID NO: 67640 - protein, 9 aa, Borrelia burgdorferi B31
DVISSAKVY

SEQ ID NO: 67641 - protein, 9 aa, Borrelia burgdorferi B31
KIEIFNQDY

SEQ ID NO: 67642 - protein, 9 aa, Borrelia burgdorferi B31
IDANLNEDY

SEQ ID NO: 67643 - protein, 10 aa, Borrelia burgdorferi B31
FYALMDFDQY

SEQ ID NO: 67644 - protein, 10 aa, Borrelia burgdorferi B31
QFGSIMEALY

SEQ ID NO: 67645 - protein, 11 aa, Borrelia burgdorferi B31
KFYALMDFDQY

SEQ ID NO: 67646 - protein, 11 aa, Borrelia burgdorferi B31
CTIDANLNEDY

SEQ ID NO: 67647 - protein, 11 aa, Borrelia burgdorferi B31
NSGLPTFALNY

SEQ ID NO: 67648 - protein, 11 aa, Borrelia burgdorferi B31
TQNNFGFRETY

SEQ ID NO: 67649 - protein, 11 aa, Borrelia burgdorferi B31
YLNAKINSFDF

SEQ ID NO: 67650 - protein, 9 aa, Borrelia burgdorferi B31
ETYDQFKMK

SEQ ID NO: 67651 - protein, 9 aa, Borrelia burgdorferi B31
FTMKLKELK

SEQ ID NO: 67652 - protein, 9 aa, Borrelia burgdorferi B31
NTPEAENER

SEQ ID NO: 67653 - protein, 9 aa, Borrelia burgdorferi B31
NYSFSQPTR

SEQ ID NO: 67654 - protein, 9 aa, Borrelia burgdorferi B31
DANLNEDYK

SEQ ID NO: 67655 - protein, 9 aa, Borrelia burgdorferi B31
QTTTSSGSK

SEQ ID NO: 67656 - protein, 9 aa, Borrelia burgdorferi B31
KTVAAAPNK

SEQ ID NO: 67657 - protein, 9 aa, Borrelia burgdorferi B31
KTQNNFGFR

SEQ ID NO: 67658 - protein, 9 aa, Borrelia burgdorferi B31
RAASLTKQR

SEQ ID NO: 67659 - protein, 9 aa, Borrelia burgdorferi B31
ISSAKVYDR

SEQ ID NO: 67660 - protein, 9 aa, Borrelia burgdorferi B31
SLAEYIKKR

SEQ ID NO: 67661 - protein, 9 aa, Borrelia burgdorferi B31
QTLKNELIR

SEQ ID NO: 67662 - protein, 9 aa, Borrelia burgdorferi B31
LIRAISEEK

SEQ ID NO: 67663 - protein, 9 aa, Borrelia burgdorferi B31
ELALEEINK

SEQ ID NO: 67664 - protein, 9 aa, Borrelia burgdorferi B31
NLPKTTAAR

SEQ ID NO: 67665 - protein, 9 aa, Borrelia burgdorferi B31
VTTVPGNTR

SEQ ID NO: 67666 - protein, 9 aa, Borrelia burgdorferi B31
YLDNMQNAR

SEQ ID NO: 67667 - protein, 9 aa, Borrelia burgdorferi B31
NIPIADNDK

SEQ ID NO: 67668 - protein, 9 aa, Borrelia burgdorferi B31
ALMDFDQYK

SEQ ID NO: 67669 - protein, 9 aa, Borrelia burgdorferi B31
DVISSAKVY

SEQ ID NO: 67670 - protein, 9 aa, Borrelia burgdorferi B31
NNFGFRETY

SEQ ID NO: 67671 - protein, 9 aa, Borrelia burgdorferi B31
KLNQILDKR

SEQ ID NO: 67672 - protein, 9 aa, Borrelia burgdorferi B31
INSFDFTMK

SEQ ID NO: 67673 - protein, 9 aa, Borrelia burgdorferi B31
LLDVISSAK

SEQ ID NO: 67674 - protein, 9 aa, Borrelia burgdorferi B31
NSFDFTMKL

SEQ ID NO: 67675 - protein, 9 aa, Borrelia burgdorferi B31
ENQNHSLIR

SEQ ID NO: 67676 - protein, 9 aa, Borrelia burgdorferi B31
TTSSGSKLQ

SEQ ID NO: 67677 - protein, 9 aa, Borrelia burgdorferi B31
QTNSSSAVQ

SEQ ID NO: 67678 - protein, 9 aa, Borrelia burgdorferi B31
EIFNQDYLN

SEQ ID NO: 67679 - protein, 9 aa, Borrelia burgdorferi B31
LALEEINKK

SEQ ID NO: 67680 - protein, 10 aa, Borrelia burgdorferi B31
NSFDFTMKLK

SEQ ID NO: 67681 - protein, 10 aa, Borrelia burgdorferi B31
ELIRAISEEK

SEQ ID NO: 67682 - protein, 10 aa, Borrelia burgdorferi B31
TAARAASLTK

SEQ ID NO: 67683 - protein, 10 aa, Borrelia burgdorferi B31
FSADLSNLPK

SEQ ID NO: 67684 - protein, 10 aa, Borrelia burgdorferi B31
ELLDVISSAK

SEQ ID NO: 67685 - protein, 10 aa, Borrelia burgdorferi B31
YALMDFDQYK

SEQ ID NO: 67686 - protein, 10 aa, Borrelia burgdorferi B31
DSKSLAEYIK

SEQ ID NO: 67687 - protein, 10 aa, Borrelia burgdorferi B31
SSNSSLSDSK

SEQ ID NO: 67688 - protein, 10 aa, Borrelia burgdorferi B31
LNYSFSQPTR

SEQ ID NO: 67689 - protein, 10 aa, Borrelia burgdorferi B31
ELALEEINKK

SEQ ID NO: 67690 - protein, 10 aa, Borrelia burgdorferi B31
NKTQNNFGFR

SEQ ID NO: 67691 - protein, 10 aa, Borrelia burgdorferi B31
VISSAKVYDR

SEQ ID NO: 67692 - protein, 10 aa, Borrelia burgdorferi B31
KINSFDFTMK

SEQ ID NO: 67693 - protein, 10 aa, Borrelia burgdorferi B31
AVTTVPGNTR

SEQ ID NO: 67694 - protein, 10 aa, Borrelia burgdorferi B31
TTAARAASLT

SEQ ID NO: 67695 - protein, 10 aa, Borrelia burgdorferi B31
ELKKQSQAAK

SEQ ID NO: 67696 - protein, 10 aa, Borrelia burgdorferi B31
DFTMKLKELK

SEQ ID NO: 67697 - protein, 10 aa, Borrelia burgdorferi B31
MKIKPLIQLK

SEQ ID NO: 67698 - protein, 10 aa, Borrelia burgdorferi B31
SNTPEAENER

SEQ ID NO: 67699 - protein, 10 aa, Borrelia burgdorferi B31
TTTSSGSKLQ

SEQ ID NO: 67700 - protein, 10 aa, Borrelia burgdorferi B31
FYALMDFDQY

SEQ ID NO: 67701 - protein, 10 aa, Borrelia burgdorferi B31
SSGSKLQTLK

SEQ ID NO: 67702 - protein, 10 aa, Borrelia burgdorferi B31
NENQNHSLIR

SEQ ID NO: 67703 - protein, 10 aa, Borrelia burgdorferi B31
SADTNSNAAK

SEQ ID NO: 67704 - protein, 10 aa, Borrelia burgdorferi B31
ETYDQFKMKD

SEQ ID NO: 67705 - protein, 11 aa, Borrelia burgdorferi B31
TTAARAASLTK

SEQ ID NO: 67706 - protein, 11 aa, Borrelia burgdorferi B31
DVISSAKVYDR

SEQ ID NO: 67707 - protein, 11 aa, Borrelia burgdorferi B31
EIFNQDYLNAK

SEQ ID NO: 67708 - protein, 11 aa, Borrelia burgdorferi B31
TSADTNSNAAK

SEQ ID NO: 67709 - protein, 11 aa, Borrelia burgdorferi B31
TSSGSKLQTLK

SEQ ID NO: 67710 - protein, 11 aa, Borrelia burgdorferi B31
NSNTPEAENER

SEQ ID NO: 67711 - protein, 11 aa, Borrelia burgdorferi B31
FYALMDFDQYK

SEQ ID NO: 67712 - protein, 11 aa, Borrelia burgdorferi B31
FTMKLKELKSK

SEQ ID NO: 67713 - protein, 11 aa, Borrelia burgdorferi B31
LSNLPKTTAAR

SEQ ID NO: 67714 - protein, 11 aa, Borrelia burgdorferi B31
QAVTTVPGNTR

SEQ ID NO: 67715 - protein, 11 aa, Borrelia burgdorferi B31
NTPEAENERNK

SEQ ID NO: 67716 - protein, 11 aa, Borrelia burgdorferi B31
TIDANLNEDYK

SEQ ID NO: 67717 - protein, 11 aa, Borrelia burgdorferi B31
EQFGSIMEALY

SEQ ID NO: 67718 - protein, 11 aa, Borrelia burgdorferi B31
DSKSLAEYIKK

SEQ ID NO: 67719 - protein, 11 aa, Borrelia burgdorferi B31
FGFRETYDQFK

SEQ ID NO: 67720 - protein, 11 aa, Borrelia burgdorferi B31
ALNYSFSQPTR

SEQ ID NO: 67721 - protein, 11 aa, Borrelia burgdorferi B31
CTIDANLNEDY

SEQ ID NO: 67722 - protein, 11 aa, Borrelia burgdorferi B31
DANLNEDYKNK

SEQ ID NO: 67723 - protein, 11 aa, Borrelia burgdorferi B31
FDFTMKLKELK

SEQ ID NO: 67724 - protein, 11 aa, Borrelia burgdorferi B31
QILDKRKEWSR

SEQ ID NO: 67725 - protein, 11 aa, Borrelia burgdorferi B31
INSFDFTMKLK

SEQ ID NO: 67726 - protein, 11 aa, Borrelia burgdorferi B31
AAKTVAAAPNK

SEQ ID NO: 67727 - protein, 11 aa, Borrelia burgdorferi B31
NSFDFTMKLKE

SEQ ID NO: 67728 - protein, 11 aa, Borrelia burgdorferi B31
KSKLNQILDKR

SEQ ID NO: 67729 - protein, 11 aa, Borrelia burgdorferi B31
SFSADLSNLPK

SEQ ID NO: 67730 - protein, 11 aa, Borrelia burgdorferi B31
AVQTTTSSGSK

SEQ ID NO: 67731 - protein, 11 aa, Borrelia burgdorferi B31
LIRAISEEKNK

SEQ ID NO: 67732 - protein, 11 aa, Borrelia burgdorferi B31
ASSNSSLSDSK

SEQ ID NO: 67733 - protein, 11 aa, Borrelia burgdorferi B31
AARAASLTKQR

SEQ ID NO: 67734 - protein, 11 aa, Borrelia burgdorferi B31
TTVPGNTRTFN

SEQ ID NO: 67735 - protein, 9 aa, Borrelia burgdorferi B31
SPQLQSLSF

SEQ ID NO: 67736 - protein, 9 aa, Borrelia burgdorferi B31
APSPQLQSL

SEQ ID NO: 67737 - protein, 9 aa, Borrelia burgdorferi B31
IPIQAVTTV

SEQ ID NO: 67738 - protein, 9 aa, Borrelia burgdorferi B31
KPLIQLKLL

SEQ ID NO: 67739 - protein, 9 aa, Borrelia burgdorferi B31
APQLNSNTP

SEQ ID NO: 67740 - protein, 10 aa, Borrelia burgdorferi B31
KPEKCNEEIF

SEQ ID NO: 67741 - protein, 10 aa, Borrelia burgdorferi B31
KTRTGDDLSL

SEQ ID NO: 67742 - protein, 11 aa, Borrelia burgdorferi B31
APSPQLQSLSF

SEQ ID NO: 67743 - protein, 11 aa, Borrelia burgdorferi B31
APQLNSNTPEA

SEQ ID NO: 67744 - protein, 11 aa, Borrelia burgdorferi B31
SPQLQSLSFSA

SEQ ID NO: 67745 - protein, 11 aa, Borrelia burgdorferi B31
KPLIQLKLLGL

SEQ ID NO: 67746 - protein, 11 aa, Borrelia burgdorferi B31
IPIADNDKVAA

SEQ ID NO: 67747 - protein, 11 aa, Borrelia burgdorferi B31
IPIQAVTTVPG

SEQ ID NO: 67748 - protein, 11 aa, Borrelia burgdorferi B31
AASLTKQRIPI

SEQ ID NO: 67749 - protein, 11 aa, Borrelia burgdorferi B31
LPKTTAARAAS

SEQ ID NO: 67750 - protein, 11 aa, Borrelia burgdorferi B31
LIANASSNSSL

SEQ ID NO: 67751 - protein, 11 aa, Borrelia burgdorferi B31
TPEAENERNKF

SEQ ID NO: 67752 - protein, 11 aa, Borrelia burgdorferi B31
KVYDRSYAPQL

SEQ ID NO: 67753 - protein, 11 aa, Borrelia burgdorferi B31
APNKGSQNQPQ

SEQ ID NO: 67754 - protein, 9 aa, Borrelia burgdorferi B31
QFKMKDSAF

SEQ ID NO: 67755 - protein, 9 aa, Borrelia burgdorferi B31
ELKKQSQAA

SEQ ID NO: 67756 - protein, 9 aa, Borrelia burgdorferi B31
NERNKFYAL

SEQ ID NO: 67757 - protein, 9 aa, Borrelia burgdorferi B31
QLKLLGLFL

SEQ ID NO: 67758 - protein, 9 aa, Borrelia burgdorferi B31
KLKELKSKL

SEQ ID NO: 67759 - protein, 10 aa, Borrelia burgdorferi B31
YIKKRYLDNM

SEQ ID NO: 67760 - protein, 10 aa, Borrelia burgdorferi B31
ELKSKLNQIL

SEQ ID NO: 67761 - protein, 11 aa, Borrelia burgdorferi B31
YDQFKMKDSAF

SEQ ID NO: 67762 - protein, 9 aa, Borrelia burgdorferi B31
YLNAKINSF

SEQ ID NO: 67763 - protein, 9 aa, Borrelia burgdorferi B31
MQNARQSVL

SEQ ID NO: 67764 - protein, 9 aa, Borrelia burgdorferi B31
QQAAPSPQL

SEQ ID NO: 67765 - protein, 9 aa, Borrelia burgdorferi B31
KQRIPIQAV

SEQ ID NO: 67766 - protein, 9 aa, Borrelia burgdorferi B31
KMKDSAFEL

SEQ ID NO: 67767 - protein, 9 aa, Borrelia burgdorferi B31
TQISFELAL

SEQ ID NO: 67768 - protein, 9 aa, Borrelia burgdorferi B31
IQLKLLGLF

SEQ ID NO: 67769 - protein, 9 aa, Borrelia burgdorferi B31
SAKVYDRSY

SEQ ID NO: 67770 - protein, 9 aa, Borrelia burgdorferi B31
SQAAKTVAA

SEQ ID NO: 67771 - protein, 9 aa, Borrelia burgdorferi B31
QQTNSSSAV

SEQ ID NO: 67772 - protein, 9 aa, Borrelia burgdorferi B31
QFKMKDSAF

SEQ ID NO: 67773 - protein, 9 aa, Borrelia burgdorferi B31
RQQTNSSSA

SEQ ID NO: 67774 - protein, 9 aa, Borrelia burgdorferi B31
RQADGLIAN

SEQ ID NO: 67775 - protein, 9 aa, Borrelia burgdorferi B31
TVPGNTRTF

SEQ ID NO: 67776 - protein, 9 aa, Borrelia burgdorferi B31
PTFALNYSF

SEQ ID NO: 67777 - protein, 9 aa, Borrelia burgdorferi B31
KQSQAAKTV

SEQ ID NO: 67778 - protein, 9 aa, Borrelia burgdorferi B31
RQSVLEAYI

SEQ ID NO: 67779 - protein, 9 aa, Borrelia burgdorferi B31
SGLGTQISF

SEQ ID NO: 67780 - protein, 9 aa, Borrelia burgdorferi B31
DVISSAKVY

SEQ ID NO: 67781 - protein, 9 aa, Borrelia burgdorferi B31
TTAARAASL

SEQ ID NO: 67782 - protein, 10 aa, Borrelia burgdorferi B31
RQQTNSSSAV

SEQ ID NO: 67783 - protein, 10 aa, Borrelia burgdorferi B31
EQFGSIMEAL

SEQ ID NO: 67784 - protein, 10 aa, Borrelia burgdorferi B31
QLKLLGLFLF

SEQ ID NO: 67785 - protein, 10 aa, Borrelia burgdorferi B31
ISGLGTQISF

SEQ ID NO: 67786 - protein, 10 aa, Borrelia burgdorferi B31
SQAAKTVAAA

SEQ ID NO: 67787 - protein, 10 aa, Borrelia burgdorferi B31
LQSLSFSADL

SEQ ID NO: 67788 - protein, 10 aa, Borrelia burgdorferi B31
TTVPGNTRTF

SEQ ID NO: 67789 - protein, 10 aa, Borrelia burgdorferi B31
SSAKVYDRSY

SEQ ID NO: 67790 - protein, 10 aa, Borrelia burgdorferi B31
NSRNSGLPTF

SEQ ID NO: 67791 - protein, 10 aa, Borrelia burgdorferi B31
KQRIPIQAVT

SEQ ID NO: 67792 - protein, 10 aa, Borrelia burgdorferi B31
SLAEYIKKRY

SEQ ID NO: 67793 - protein, 10 aa, Borrelia burgdorferi B31
KMKDSAFELL

SEQ ID NO: 67794 - protein, 10 aa, Borrelia burgdorferi B31
RQADGLIANA

SEQ ID NO: 67795 - protein, 10 aa, Borrelia burgdorferi B31
DQFKMKDSAF

SEQ ID NO: 67796 - protein, 10 aa, Borrelia burgdorferi B31
NARQSVLEAY

SEQ ID NO: 67797 - protein, 10 aa, Borrelia burgdorferi B31
IANASSNSSL

SEQ ID NO: 67798 - protein, 10 aa, Borrelia burgdorferi B31
NQQAAPSPQL

SEQ ID NO: 67799 - protein, 10 aa, Borrelia burgdorferi B31
NMQNARQSVL

SEQ ID NO: 67800 - protein, 10 aa, Borrelia burgdorferi B31
IQLKLLGLFL

SEQ ID NO: 67801 - protein, 10 aa, Borrelia burgdorferi B31
NQNHSLIREL

SEQ ID NO: 67802 - protein, 10 aa, Borrelia burgdorferi B31
QNNFGFRETY

SEQ ID NO: 67803 - protein, 10 aa, Borrelia burgdorferi B31
RTFNSRNSGL

SEQ ID NO: 67804 - protein, 10 aa, Borrelia burgdorferi B31
LMISGLGTQI

SEQ ID NO: 67805 - protein, 11 aa, Borrelia burgdorferi B31
YLNAKINSFDF

SEQ ID NO: 67806 - protein, 11 aa, Borrelia burgdorferi B31
TQNNFGFRETY

SEQ ID NO: 67807 - protein, 11 aa, Borrelia burgdorferi B31
EQFGSIMEALY

SEQ ID NO: 67808 - protein, 11 aa, Borrelia burgdorferi B31
MISGLGTQISF

SEQ ID NO: 67809 - protein, 11 aa, Borrelia burgdorferi B31
ISSAKVYDRSY

SEQ ID NO: 67810 - protein, 11 aa, Borrelia burgdorferi B31
SLSDSKSLAEY

SEQ ID NO: 67811 - protein, 11 aa, Borrelia burgdorferi B31
IQLKLLGLFLF

SEQ ID NO: 67812 - protein, 11 aa, Borrelia burgdorferi B31
RQADGLIANAS

SEQ ID NO: 67813 - protein, 11 aa, Borrelia burgdorferi B31
VTTVPGNTRTF

SEQ ID NO: 67814 - protein, 11 aa, Borrelia burgdorferi B31
RQSVLEAYISI

SEQ ID NO: 67815 - protein, 11 aa, Borrelia burgdorferi B31
MQNARQSVLEA

SEQ ID NO: 67816 - protein, 11 aa, Borrelia burgdorferi B31
ALYNENQNHSL

SEQ ID NO: 67817 - protein, 11 aa, Borrelia burgdorferi B31
KQSQAAKTVAA

SEQ ID NO: 67818 - protein, 11 aa, Borrelia burgdorferi B31
LLDVISSAKVY

SEQ ID NO: 67819 - protein, 11 aa, Borrelia burgdorferi B31
KQRIPIQAVTT

SEQ ID NO: 67820 - protein, 11 aa, Borrelia burgdorferi B31
RQQTNSSSAVQ

SEQ ID NO: 67821 - protein, 11 aa, Borrelia burgdorferi B31
QNARQSVLEAY

SEQ ID NO: 67822 - protein, 11 aa, Borrelia burgdorferi B31
VQTTTSSGSKL

SEQ ID NO: 67823 - protein, 11 aa, Borrelia burgdorferi B31
GLPTFALNYSF

SEQ ID NO: 67824 - protein, 11 aa, Borrelia burgdorferi B31
KSLAEYIKKRY

SEQ ID NO: 67825 - protein, 11 aa, Borrelia burgdorferi B31
FNSRNSGLPTF

SEQ ID NO: 67826 - protein, 11 aa, Borrelia burgdorferi B31
KVYDRSYAPQL

SEQ ID NO: 67827 - protein, 9 aa, Borrelia burgdorferi B31
SRNSGLPTF

SEQ ID NO: 67828 - protein, 9 aa, Borrelia burgdorferi B31
ERNKFYALM

SEQ ID NO: 67829 - protein, 9 aa, Borrelia burgdorferi B31
KRKEWSRQA

SEQ ID NO: 67830 - protein, 9 aa, Borrelia burgdorferi B31
KRYLDNMQN

SEQ ID NO: 67831 - protein, 9 aa, Borrelia burgdorferi B31
ARQSVLEAY

SEQ ID NO: 67832 - protein, 10 aa, Borrelia burgdorferi B31
KRYLDNMQNA

SEQ ID NO: 67833 - protein, 10 aa, Borrelia burgdorferi B31
ARAASLTKQR

SEQ ID NO: 67834 - protein, 10 aa, Borrelia burgdorferi B31
RQQTNSSSAV

SEQ ID NO: 67835 - protein, 11 aa, Borrelia burgdorferi B31
KRYLDNMQNAR

SEQ ID NO: 67836 - protein, 11 aa, Borrelia burgdorferi B31
QRIPIQAVTTV

SEQ ID NO: 67837 - protein, 11 aa, Borrelia burgdorferi B31
ERNKFYALMDF

SEQ ID NO: 67838 - protein, 11 aa, Borrelia burgdorferi B31
RQSVLEAYISI

SEQ ID NO: 67839 - protein, 11 aa, Borrelia burgdorferi B31
SRNSGLPTFAL

SEQ ID NO: 67840 - protein, 11 aa, Borrelia burgdorferi B31
FRETYDQFKMK

SEQ ID NO: 67841 - protein, 9 aa, Borrelia burgdorferi B31
YALMDFDQY

SEQ ID NO: 67842 - protein, 9 aa, Borrelia burgdorferi B31
SPQLQSLSF

SEQ ID NO: 67843 - protein, 9 aa, Borrelia burgdorferi B31
DVISSAKVY

SEQ ID NO: 67844 - protein, 9 aa, Borrelia burgdorferi B31
FGSIMEALY

SEQ ID NO: 67845 - protein, 9 aa, Borrelia burgdorferi B31
IPIQAVTTV

SEQ ID NO: 67846 - protein, 9 aa, Borrelia burgdorferi B31
EAENERNKF

SEQ ID NO: 67847 - protein, 9 aa, Borrelia burgdorferi B31
APSPQLQSL

SEQ ID NO: 67848 - protein, 9 aa, Borrelia burgdorferi B31
SAKVYDRSY

SEQ ID NO: 67849 - protein, 9 aa, Borrelia burgdorferi B31
TVPGNTRTF

SEQ ID NO: 67850 - protein, 9 aa, Borrelia burgdorferi B31
LAEYIKKRY

SEQ ID NO: 67851 - protein, 9 aa, Borrelia burgdorferi B31
LPTFALNYS

SEQ ID NO: 67852 - protein, 9 aa, Borrelia burgdorferi B31
SADTNSNAA

SEQ ID NO: 67853 - protein, 9 aa, Borrelia burgdorferi B31
YLNAKINSF

SEQ ID NO: 67854 - protein, 9 aa, Borrelia burgdorferi B31
KINSFDFTM

SEQ ID NO: 67855 - protein, 9 aa, Borrelia burgdorferi B31
FALNYSFSQ

SEQ ID NO: 67856 - protein, 9 aa, Borrelia burgdorferi B31
NAKINSFDF

SEQ ID NO: 67857 - protein, 10 aa, Borrelia burgdorferi B31
LPTFALNYSF

SEQ ID NO: 67858 - protein, 10 aa, Borrelia burgdorferi B31
NARQSVLEAY

SEQ ID NO: 67859 - protein, 10 aa, Borrelia burgdorferi B31
TTVPGNTRTF

SEQ ID NO: 67860 - protein, 10 aa, Borrelia burgdorferi B31
FYALMDFDQY

SEQ ID NO: 67861 - protein, 10 aa, Borrelia burgdorferi B31
EAENERNKFY

SEQ ID NO: 67862 - protein, 10 aa, Borrelia burgdorferi B31
SVLEAYISIM

SEQ ID NO: 67863 - protein, 10 aa, Borrelia burgdorferi B31
YKIEQFGSIM

SEQ ID NO: 67864 - protein, 10 aa, Borrelia burgdorferi B31
LPKTTAARAA

SEQ ID NO: 67865 - protein, 10 aa, Borrelia burgdorferi B31
IANASSNSSL

SEQ ID NO: 67866 - protein, 10 aa, Borrelia burgdorferi B31
LSDSKSLAEY

SEQ ID NO: 67867 - protein, 10 aa, Borrelia burgdorferi B31
IPIADNDKVA

SEQ ID NO: 67868 - protein, 10 aa, Borrelia burgdorferi B31
QFGSIMEALY

SEQ ID NO: 67869 - protein, 10 aa, Borrelia burgdorferi B31
LDVISSAKVY

SEQ ID NO: 67870 - protein, 10 aa, Borrelia burgdorferi B31
NSRNSGLPTF

SEQ ID NO: 67871 - protein, 10 aa, Borrelia burgdorferi B31
IPIQAVTTVP

SEQ ID NO: 67872 - protein, 11 aa, Borrelia burgdorferi B31
APSPQLQSLSF

SEQ ID NO: 67873 - protein, 11 aa, Borrelia burgdorferi B31
TPEAENERNKF

SEQ ID NO: 67874 - protein, 11 aa, Borrelia burgdorferi B31
FALNYSFSQPT

SEQ ID NO: 67875 - protein, 11 aa, Borrelia burgdorferi B31
NAKINSFDFTM

SEQ ID NO: 67876 - protein, 11 aa, Borrelia burgdorferi B31
IPIADNDKVAA

SEQ ID NO: 67877 - protein, 11 aa, Borrelia burgdorferi B31
IPIQAVTTVPG

SEQ ID NO: 67878 - protein, 11 aa, Borrelia burgdorferi B31
MISGLGTQISF

SEQ ID NO: 67879 - protein, 11 aa, Borrelia burgdorferi B31
LPKTTAARAAS

SEQ ID NO: 67880 - protein, 11 aa, Borrelia burgdorferi B31
IADNDKVAAEL

SEQ ID NO: 67881 - protein, 11 aa, Borrelia burgdorferi B31
EQFGSIMEALY

SEQ ID NO: 67882 - protein, 11 aa, Borrelia burgdorferi B31
LLDVISSAKVY

SEQ ID NO: 67883 - protein, 11 aa, Borrelia burgdorferi B31
QSVLEAYISIM

SEQ ID NO: 67884 - protein, 11 aa, Borrelia burgdorferi B31
TQNNFGFRETY

SEQ ID NO: 67885 - protein, 11 aa, Borrelia burgdorferi B31
QAAPSPQLQSL

SEQ ID NO: 67886 - protein, 11 aa, Borrelia burgdorferi B31
SLSDSKSLAEY

SEQ ID NO: 67887 - protein, 11 aa, Borrelia burgdorferi B31
QNARQSVLEAY

SEQ ID NO: 67888 - protein, 11 aa, Borrelia burgdorferi B31
FNSRNSGLPTF

SEQ ID NO: 67889 - protein, 9 aa, Borrelia burgdorferi B31
AENERNKFY

SEQ ID NO: 67890 - protein, 9 aa, Borrelia burgdorferi B31
EEINKKIEI

SEQ ID NO: 67891 - protein, 9 aa, Borrelia burgdorferi B31
NENQNHSLI

SEQ ID NO: 67892 - protein, 10 aa, Borrelia burgdorferi B31
EEINKKIEIF

SEQ ID NO: 67893 - protein, 10 aa, Borrelia burgdorferi B31
AENERNKFYA

SEQ ID NO: 67894 - protein, 10 aa, Borrelia burgdorferi B31
EEKNKTQNNF

SEQ ID NO: 67895 - protein, 10 aa, Borrelia burgdorferi B31
RELMISGLGT

SEQ ID NO: 67896 - protein, 10 aa, Borrelia burgdorferi B31
AELKKQSQAA

SEQ ID NO: 67897 - protein, 11 aa, Borrelia burgdorferi B31
EEIFKVIKRVF

SEQ ID NO: 67898 - protein, 11 aa, Borrelia burgdorferi B31
EEFERLEALKT

SEQ ID NO: 67899 - protein, 11 aa, Borrelia burgdorferi B31
AEYEKSYKEFF

SEQ ID NO: 67900 - protein, 11 aa, Borrelia burgdorferi B31
KEFFDWLSKDV

SEQ ID NO: 67901 - protein, 11 aa, Borrelia burgdorferi B31
SENNNELANLK

SEQ ID NO: 67902 - protein, 9 aa, Borrelia burgdorferi B31
IPIQAVTTV

SEQ ID NO: 67903 - protein, 9 aa, Borrelia burgdorferi B31
LPKTTAARA

SEQ ID NO: 67904 - protein, 9 aa, Borrelia burgdorferi B31
LPTFALNYS

SEQ ID NO: 67905 - protein, 9 aa, Borrelia burgdorferi B31
IPIADNDKV

SEQ ID NO: 67906 - protein, 9 aa, Borrelia burgdorferi B31
APSPQLQSL

SEQ ID NO: 67907 - protein, 9 aa, Borrelia burgdorferi B31
KPLIQLKLL

SEQ ID NO: 67908 - protein, 10 aa, Borrelia burgdorferi B31
LPTFALNYSF

SEQ ID NO: 67909 - protein, 10 aa, Borrelia burgdorferi B31
LPKTTAARAA

SEQ ID NO: 67910 - protein, 10 aa, Borrelia burgdorferi B31
IPIQAVTTVP

SEQ ID NO: 67911 - protein, 10 aa, Borrelia burgdorferi B31
LALEEINKKI

SEQ ID NO: 67912 - protein, 11 aa, Borrelia burgdorferi B31
IPIQAVTTVPG

SEQ ID NO: 67913 - protein, 11 aa, Borrelia burgdorferi B31
LPTFALNYSFS

SEQ ID NO: 67914 - protein, 11 aa, Borrelia burgdorferi B31
KPLIQLKLLGL

SEQ ID NO: 67915 - protein, 11 aa, Borrelia burgdorferi B31
KTHNHGFRETY

SEQ ID NO: 67916 - protein, 11 aa, Borrelia burgdorferi B31
QTQPSFVVPVY

SEQ ID NO: 67917 - protein, 9 aa, Borrelia garinii PBi
QSNNVLTNY

SEQ ID NO: 67918 - protein, 9 aa, Borrelia garinii PBi
YLNTIINSY

SEQ ID NO: 67919 - protein, 9 aa, Borrelia garinii PBi
KIESFNTQY

SEQ ID NO: 67920 - protein, 10 aa, Borrelia garinii PBi
LAEKKEWLNY

SEQ ID NO: 67921 - protein, 10 aa, Borrelia garinii PBi
TIDANLNKDY

SEQ ID NO: 67922 - protein, 10 aa, Borrelia garinii PBi
EAESERNRLY

SEQ ID NO: 67923 - protein, 11 aa, Borrelia garinii PBi
NSQSNNVLTNY

SEQ ID NO: 67924 - protein, 11 aa, Borrelia garinii PBi
CTIDANLNKDY

SEQ ID NO: 67925 - protein, 11 aa, Borrelia garinii PBi
QTQPSFVVPVY

SEQ ID NO: 67926 - protein, 11 aa, Borrelia garinii PBi
KTHNHGFRETY

SEQ ID NO: 67927 - protein, 9 aa, Borrelia garinii PBi
TLLDVISNI

SEQ ID NO: 67928 - protein, 9 aa, Borrelia garinii PBi
KMKDSAFTL

SEQ ID NO: 67929 - protein, 9 aa, Borrelia garinii PBi
QLSSNTPEA

SEQ ID NO: 67930 - protein, 9 aa, Borrelia garinii PBi
TQPSFVVPV

SEQ ID NO: 67931 - protein, 9 aa, Borrelia garinii PBi
ILAEKKEWL

SEQ ID NO: 67932 - protein, 9 aa, Borrelia garinii PBi
KMQDARQSA

SEQ ID NO: 67933 - protein, 9 aa, Borrelia garinii PBi
SLIISGLGI

SEQ ID NO: 67934 - protein, 9 aa, Borrelia garinii PBi
SLESTLEEI

SEQ ID NO: 67935 - protein, 9 aa, Borrelia garinii PBi
RQSALDLYL

SEQ ID NO: 67936 - protein, 9 aa, Borrelia garinii PBi
WLNYADAII

SEQ ID NO: 67937 - protein, 9 aa, Borrelia garinii PBi
SALDLYLNI

SEQ ID NO: 67938 - protein, 9 aa, Borrelia garinii PBi
MMDFDQAKT

SEQ ID NO: 67939 - protein, 9 aa, Borrelia garinii PBi
ALDLYLNIT

SEQ ID NO: 67940 - protein, 9 aa, Borrelia garinii PBi
YADAIITNT

SEQ ID NO: 67941 - protein, 9 aa, Borrelia garinii PBi
YAMMDFDQA

SEQ ID NO: 67942 - protein, 9 aa, Borrelia garinii PBi
YTFSSSFSQ

SEQ ID NO: 67943 - protein, 9 aa, Borrelia garinii PBi
ASAQAIQTV

SEQ ID NO: 67944 - protein, 10 aa, Borrelia garinii PBi
YLNTIINSYT

SEQ ID NO: 67945 - protein, 10 aa, Borrelia garinii PBi
LLDVISNISV

SEQ ID NO: 67946 - protein, 10 aa, Borrelia garinii PBi
AMMDFDQAKT

SEQ ID NO: 67947 - protein, 10 aa, Borrelia garinii PBi
KMKDSAFTLL

SEQ ID NO: 67948 - protein, 10 aa, Borrelia garinii PBi
KMQDARQSAL

SEQ ID NO: 67949 - protein, 10 aa, Borrelia garinii PBi
FTLLDVISNI

SEQ ID NO: 67950 - protein, 10 aa, Borrelia garinii PBi
KIESFNTQYL

SEQ ID NO: 67951 - protein, 10 aa, Borrelia garinii PBi
FKMKDSAFTL

SEQ ID NO: 67952 - protein, 10 aa, Borrelia garinii PBi
QTQPSFVVPV

SEQ ID NO: 67953 - protein, 10 aa, Borrelia garinii PBi
LIISGLGIQI

SEQ ID NO: 67954 - protein, 10 aa, Borrelia garinii PBi
YTFKDKLKEL

SEQ ID NO: 67955 - protein, 10 aa, Borrelia garinii PBi
LLNSSTDDQA

SEQ ID NO: 67956 - protein, 10 aa, Borrelia garinii PBi
TLLDVISNIS

SEQ ID NO: 67957 - protein, 10 aa, Borrelia garinii PBi
LIRSLIISGL

SEQ ID NO: 67958 - protein, 10 aa, Borrelia garinii PBi
ISLESTLEEI

SEQ ID NO: 67959 - protein, 11 aa, Borrelia garinii PBi
TLLDVISNISV

SEQ ID NO: 67960 - protein, 11 aa, Borrelia garinii PBi
ALDLYLNITEI

SEQ ID NO: 67961 - protein, 11 aa, Borrelia garinii PBi
SLIRSLIISGL

SEQ ID NO: 67962 - protein, 11 aa, Borrelia garinii PBi
ILYQENQNHSL

SEQ ID NO: 67963 - protein, 11 aa, Borrelia garinii PBi
RLYAMMDFDQA

SEQ ID NO: 67964 - protein, 11 aa, Borrelia garinii PBi
QIASAQAIQTV

SEQ ID NO: 67965 - protein, 11 aa, Borrelia garinii PBi
SLGQYIKNKYL

SEQ ID NO: 67966 - protein, 11 aa, Borrelia garinii PBi
AMMDFDQAKTT

SEQ ID NO: 67967 - protein, 11 aa, Borrelia garinii PBi
IISGLGIQISL

SEQ ID NO: 67968 - protein, 11 aa, Borrelia garinii PBi
SLIISGLGIQI

SEQ ID NO: 67969 - protein, 11 aa, Borrelia garinii PBi
SVFDRGSAPQL

SEQ ID NO: 67970 - protein, 11 aa, Borrelia garinii PBi
YTFSSSFSQPT

SEQ ID NO: 67971 - protein, 11 aa, Borrelia garinii PBi
IINSYTFKDKL

SEQ ID NO: 67972 - protein, 11 aa, Borrelia garinii PBi
FKMKDSAFTLL

SEQ ID NO: 67973 - protein, 11 aa, Borrelia garinii PBi
NLQGLNPANQV

SEQ ID NO: 67974 - protein, 11 aa, Borrelia garinii PBi
YLNTIINSYTF

SEQ ID NO: 67975 - protein, 11 aa, Borrelia garinii PBi
KTTEFGSIMNI

SEQ ID NO: 67976 - protein, 11 aa, Borrelia garinii PBi
HQTQPSFVVPV

SEQ ID NO: 67977 - protein, 11 aa, Borrelia garinii PBi
RQSALDLYLNI

SEQ ID NO: 67978 - protein, 9 aa, Borrelia garinii PBi
KLNSILAEK

SEQ ID NO: 67979 - protein, 9 aa, Borrelia garinii PBi
TIINSYTFK

SEQ ID NO: 67980 - protein, 9 aa, Borrelia garinii PBi
ITNTSSNSK

SEQ ID NO: 67981 - protein, 9 aa, Borrelia garinii PBi
GLQKNTQSK

SEQ ID NO: 67982 - protein, 9 aa, Borrelia garinii PBi
KLKNNLLRR

SEQ ID NO: 67983 - protein, 9 aa, Borrelia garinii PBi
SLGQYIKNK

SEQ ID NO: 67984 - protein, 9 aa, Borrelia garinii PBi
YSGNSPLQK

SEQ ID NO: 67985 - protein, 9 aa, Borrelia garinii PBi
LLRRIAEEK

SEQ ID NO: 67986 - protein, 9 aa, Borrelia garinii PBi
STPNQSIIK

SEQ ID NO: 67987 - protein, 9 aa, Borrelia garinii PBi
QSNNVLTNY

SEQ ID NO: 67988 - protein, 9 aa, Borrelia garinii PBi
CTIDANLNK

SEQ ID NO: 67989 - protein, 9 aa, Borrelia garinii PBi
ATKNKTNIK

SEQ ID NO: 67990 - protein, 9 aa, Borrelia garinii PBi
KIESFNTQY

SEQ ID NO: 67991 - protein, 9 aa, Borrelia garinii PBi
LQKNTQSKK

SEQ ID NO: 67992 - protein, 9 aa, Borrelia garinii PBi
YIKNKYLDK

SEQ ID NO: 67993 - protein, 9 aa, Borrelia garinii PBi
ETYDQFKMK

SEQ ID NO: 67994 - protein, 9 aa, Borrelia garinii PBi
NLNKDYKNK

SEQ ID NO: 67995 - protein, 9 aa, Borrelia garinii PBi
YLNTIINSY

SEQ ID NO: 67996 - protein, 9 aa, Borrelia garinii PBi
ISNISVFDR

SEQ ID NO: 67997 - protein, 9 aa, Borrelia garinii PBi
NIKVAGLQK

SEQ ID NO: 67998 - protein, 10 aa, Borrelia garinii PBi
NTIINSYTFK

SEQ ID NO: 67999 - protein, 10 aa, Borrelia garinii PBi
IITNTSSNSK

SEQ ID NO: 68000 - protein, 10 aa, Borrelia garinii PBi
IINSYTFKDK

SEQ ID NO: 68001 - protein, 10 aa, Borrelia garinii PBi
SINTGSNATK

SEQ ID NO: 68002 - protein, 10 aa, Borrelia garinii PBi
ATNVQATPPK

SEQ ID NO: 68003 - protein, 10 aa, Borrelia garinii PBi
KLNSILAEKK

SEQ ID NO: 68004 - protein, 10 aa, Borrelia garinii PBi
VYSGNSPLQK

SEQ ID NO: 68005 - protein, 10 aa, Borrelia garinii PBi
NLLRRIAEEK

SEQ ID NO: 68006 - protein, 10 aa, Borrelia garinii PBi
GLQKNTQSKK

SEQ ID NO: 68007 - protein, 10 aa, Borrelia garinii PBi
SKLNSILAEK

SEQ ID NO: 68008 - protein, 10 aa, Borrelia garinii PBi
TSTPNQSIIK

SEQ ID NO: 68009 - protein, 10 aa, Borrelia garinii PBi
NSYTFKDKLK

SEQ ID NO: 68010 - protein, 10 aa, Borrelia garinii PBi
QSLGQYIKNK

SEQ ID NO: 68011 - protein, 10 aa, Borrelia garinii PBi
TNIKVAGLQK

SEQ ID NO: 68012 - protein, 10 aa, Borrelia garinii PBi
QYIKNKYLDK

SEQ ID NO: 68013 - protein, 10 aa, Borrelia garinii PBi
QYLNTIINSY

SEQ ID NO: 68014 - protein, 10 aa, Borrelia garinii PBi
SQSNNVLTNY

SEQ ID NO: 68015 - protein, 10 aa, Borrelia garinii PBi
NTGSNATKNK

SEQ ID NO: 68016 - protein, 10 aa, Borrelia garinii PBi
SLGQYIKNKY

SEQ ID NO: 68017 - protein, 10 aa, Borrelia garinii PBi
AGLQKNTQSK

SEQ ID NO: 68018 - protein, 10 aa, Borrelia garinii PBi
VISNISVFDR

SEQ ID NO: 68019 - protein, 11 aa, Borrelia garinii PBi
KTNIKVAGLQK

SEQ ID NO: 68020 - protein, 11 aa, Borrelia garinii PBi
PVYSGNSPLQK

SEQ ID NO: 68021 - protein, 11 aa, Borrelia garinii PBi
ISINTGSNATK

SEQ ID NO: 68022 - protein, 11 aa, Borrelia garinii PBi
AIITNTSSNSK

SEQ ID NO: 68023 - protein, 11 aa, Borrelia garinii PBi
LLNSSTDDQAK

SEQ ID NO: 68024 - protein, 11 aa, Borrelia garinii PBi
GQYIKNKYLDK

SEQ ID NO: 68025 - protein, 11 aa, Borrelia garinii PBi
ILAEKKEWLNY

SEQ ID NO: 68026 - protein, 11 aa, Borrelia garinii PBi
LLRRIAEEKNK

SEQ ID NO: 68027 - protein, 11 aa, Borrelia garinii PBi
TIINSYTFKDK

SEQ ID NO: 68028 - protein, 11 aa, Borrelia garinii PBi
KTHNHGFRETY

SEQ ID NO: 68029 - protein, 11 aa, Borrelia garinii PBi
NTSTPNQSIIK

SEQ ID NO: 68030 - protein, 11 aa, Borrelia garinii PBi
YSGNSPLQKLK

SEQ ID NO: 68031 - protein, 11 aa, Borrelia garinii PBi
IITNTSSNSKR

SEQ ID NO: 68032 - protein, 11 aa, Borrelia garinii PBi
TQYLNTIINSY

SEQ ID NO: 68033 - protein, 11 aa, Borrelia garinii PBi
HGFRETYDQFK

SEQ ID NO: 68034 - protein, 11 aa, Borrelia garinii PBi
SSCTIDANLNK

SEQ ID NO: 68035 - protein, 9 aa, Borrelia garinii PBi
TIINSYTFK

SEQ ID NO: 68036 - protein, 9 aa, Borrelia garinii PBi
ITNTSSNSK

SEQ ID NO: 68037 - protein, 9 aa, Borrelia garinii PBi
CTIDANLNK

SEQ ID NO: 68038 - protein, 9 aa, Borrelia garinii PBi
AMMDFDQAK

SEQ ID NO: 68039 - protein, 9 aa, Borrelia garinii PBi
KLNSILAEK

SEQ ID NO: 68040 - protein, 9 aa, Borrelia garinii PBi
STLEEIEKK

SEQ ID NO: 68041 - protein, 9 aa, Borrelia garinii PBi
STPNQSIIK

SEQ ID NO: 68042 - protein, 9 aa, Borrelia garinii PBi
YSGNSPLQK

SEQ ID NO: 68043 - protein, 9 aa, Borrelia garinii PBi
ATKNKTNIK

SEQ ID NO: 68044 - protein, 9 aa, Borrelia garinii PBi
ETYDQFKMK

SEQ ID NO: 68045 - protein, 9 aa, Borrelia garinii PBi
ISNISVFDR

SEQ ID NO: 68046 - protein, 9 aa, Borrelia garinii PBi
SLGQYIKNK

SEQ ID NO: 68047 - protein, 9 aa, Borrelia garinii PBi
GLQKNTQSK

SEQ ID NO: 68048 - protein, 9 aa, Borrelia garinii PBi
YTFSSSFSQ

SEQ ID NO: 68049 - protein, 9 aa, Borrelia garinii PBi
QSNNVLTNY

SEQ ID NO: 68050 - protein, 9 aa, Borrelia garinii PBi
NIKVAGLQK

SEQ ID NO: 68051 - protein, 9 aa, Borrelia garinii PBi
SIMNILYQE

SEQ ID NO: 68052 - protein, 9 aa, Borrelia garinii PBi
KIESFNTQY

SEQ ID NO: 68053 - protein, 9 aa, Borrelia garinii PBi
KLKNNLLRR

SEQ ID NO: 68054 - protein, 9 aa, Borrelia garinii PBi
YIKNKYLDK

SEQ ID NO: 68055 - protein, 9 aa, Borrelia garinii PBi
TNVQATPPK

SEQ ID NO: 68056 - protein, 9 aa, Borrelia garinii PBi
NSSTDDQAK

SEQ ID NO: 68057 - protein, 9 aa, Borrelia garinii PBi
ESTLEEIEK

SEQ ID NO: 68058 - protein, 10 aa, Borrelia garinii PBi
ATNVQATPPK

SEQ ID NO: 68059 - protein, 10 aa, Borrelia garinii PBi
SINTGSNATK

SEQ ID NO: 68060 - protein, 10 aa, Borrelia garinii PBi
NTIINSYTFK

SEQ ID NO: 68061 - protein, 10 aa, Borrelia garinii PBi
IITNTSSNSK

SEQ ID NO: 68062 - protein, 10 aa, Borrelia garinii PBi
KLNSILAEKK

SEQ ID NO: 68063 - protein, 10 aa, Borrelia garinii PBi
TSTPNQSIIK

SEQ ID NO: 68064 - protein, 10 aa, Borrelia garinii PBi
IINSYTFKDK

SEQ ID NO: 68065 - protein, 10 aa, Borrelia garinii PBi
YAMMDFDQAK

SEQ ID NO: 68066 - protein, 10 aa, Borrelia garinii PBi
NSYTFKDKLK

SEQ ID NO: 68067 - protein, 10 aa, Borrelia garinii PBi
ITNTSSNSKR

SEQ ID NO: 68068 - protein, 10 aa, Borrelia garinii PBi
QSLGQYIKNK

SEQ ID NO: 68069 - protein, 10 aa, Borrelia garinii PBi
QSNNVLTNYR

SEQ ID NO: 68070 - protein, 10 aa, Borrelia garinii PBi
GLQKNTQSKK

SEQ ID NO: 68071 - protein, 10 aa, Borrelia garinii PBi
VISNISVFDR

SEQ ID NO: 68072 - protein, 10 aa, Borrelia garinii PBi
NTGSNATKNK

SEQ ID NO: 68073 - protein, 10 aa, Borrelia garinii PBi
VYSGNSPLQK

SEQ ID NO: 68074 - protein, 10 aa, Borrelia garinii PBi
SQSNNVLTNY

SEQ ID NO: 68075 - protein, 10 aa, Borrelia garinii PBi
SVFDRGSAPQ

SEQ ID NO: 68076 - protein, 10 aa, Borrelia garinii PBi
NLLRRIAEEK

SEQ ID NO: 68077 - protein, 10 aa, Borrelia garinii PBi
SGNSPLQKLK

SEQ ID NO: 68078 - protein, 10 aa, Borrelia garinii PBi
TNIKVAGLQK

SEQ ID NO: 68079 - protein, 10 aa, Borrelia garinii PBi
SKLNSILAEK

SEQ ID NO: 68080 - protein, 10 aa, Borrelia garinii PBi
TQPSFVVPVY

SEQ ID NO: 68081 - protein, 11 aa, Borrelia garinii PBi
MSSCTIDANLN

SEQ ID NO: 68082 - protein, 11 aa, Borrelia garinii PBi
SSCTIDANLNK

SEQ ID NO: 68083 - protein, 11 aa, Borrelia garinii PBi
KTNIKVAGLQK

SEQ ID NO: 68084 - protein, 11 aa, Borrelia garinii PBi
AIITNTSSNSK

SEQ ID NO: 68085 - protein, 11 aa, Borrelia garinii PBi
ISINTGSNATK

SEQ ID NO: 68086 - protein, 11 aa, Borrelia garinii PBi
TIINSYTFKDK

SEQ ID NO: 68087 - protein, 11 aa, Borrelia garinii PBi
TIDANLNKDYK

SEQ ID NO: 68088 - protein, 11 aa, Borrelia garinii PBi
PVYSGNSPLQK

SEQ ID NO: 68089 - protein, 11 aa, Borrelia garinii PBi
NTSTPNQSIIK

SEQ ID NO: 68090 - protein, 11 aa, Borrelia garinii PBi
SLESTLEEIEK

SEQ ID NO: 68091 - protein, 11 aa, Borrelia garinii PBi
GQYIKNKYLDK

SEQ ID NO: 68092 - protein, 11 aa, Borrelia garinii PBi
SQSNNVLTNYR

SEQ ID NO: 68093 - protein, 11 aa, Borrelia garinii PBi
SSNTPEAESER

SEQ ID NO: 68094 - protein, 11 aa, Borrelia garinii PBi
YSGNSPLQKLK

SEQ ID NO: 68095 - protein, 11 aa, Borrelia garinii PBi
TQYLNTIINSY

SEQ ID NO: 68096 - protein, 11 aa, Borrelia garinii PBi
QTQPSFVVPVY

SEQ ID NO: 68097 - protein, 11 aa, Borrelia garinii PBi
LLNSSTDDQAK

SEQ ID NO: 68098 - protein, 11 aa, Borrelia garinii PBi
KTHNHGFRETY

SEQ ID NO: 68099 - protein, 11 aa, Borrelia garinii PBi
PATNVQATPPK

SEQ ID NO: 68100 - protein, 11 aa, Borrelia garinii PBi
VAGLQKNTQSK

SEQ ID NO: 68101 - protein, 11 aa, Borrelia garinii PBi
ESKLNSILAEK

SEQ ID NO: 68102 - protein, 11 aa, Borrelia garinii PBi
IITNTSSNSKR

SEQ ID NO: 68103 - protein, 11 aa, Borrelia garinii PBi
SIMNILYQENQ

SEQ ID NO: 68104 - protein, 11 aa, Borrelia garinii PBi
HGFRETYDQFK

SEQ ID NO: 68105 - protein, 9 aa, Borrelia garinii PBi
EWLNYADAI

SEQ ID NO: 68106 - protein, 9 aa, Borrelia garinii PBi
NTIINSYTF

SEQ ID NO: 68107 - protein, 9 aa, Borrelia garinii PBi
DYKNKVEEL

SEQ ID NO: 68108 - protein, 9 aa, Borrelia garinii PBi
VYSGNSPLQ

SEQ ID NO: 68109 - protein, 9 aa, Borrelia garinii PBi
EFGSIMNIL

SEQ ID NO: 68110 - protein, 10 aa, Borrelia garinii PBi
NYRHQTQPSF

SEQ ID NO: 68111 - protein, 10 aa, Borrelia garinii PBi
EWLNYADAII

SEQ ID NO: 68112 - protein, 10 aa, Borrelia garinii PBi
LYQENQNHSL

SEQ ID NO: 68113 - protein, 10 aa, Borrelia garinii PBi
SFNTQYLNTI

SEQ ID NO: 68114 - protein, 10 aa, Borrelia garinii PBi
DYKNKVEELL

SEQ ID NO: 68115 - protein, 10 aa, Borrelia garinii PBi
VYSGNSPLQK

SEQ ID NO: 68116 - protein, 10 aa, Borrelia garinii PBi
QYLNTIINSY

SEQ ID NO: 68117 - protein, 10 aa, Borrelia garinii PBi
QYIKNKYLDK

SEQ ID NO: 68118 - protein, 10 aa, Borrelia garinii PBi
PQQYTFSSSF

SEQ ID NO: 68119 - protein, 11 aa, Borrelia garinii PBi
LYQENQNHSLI

SEQ ID NO: 68120 - protein, 11 aa, Borrelia garinii PBi
VYSGNSPLQKL

SEQ ID NO: 68121 - protein, 11 aa, Borrelia garinii PBi
SFNTQYLNTII

SEQ ID NO: 68122 - protein, 11 aa, Borrelia garinii PBi
QYIKNKYLDKM

SEQ ID NO: 68123 - protein, 11 aa, Borrelia garinii PBi
YLNTIINSYTF

SEQ ID NO: 68124 - protein, 11 aa, Borrelia garinii PBi
NYRHQTQPSFV

SEQ ID NO: 68125 - protein, 11 aa, Borrelia garinii PBi
SYTFKDKLKEL

SEQ ID NO: 68126 - protein, 11 aa, Borrelia garinii PBi
LYAMMDFDQAK

SEQ ID NO: 68127 - protein, 11 aa, Borrelia garinii PBi
SFSQPTSQTNF

SEQ ID NO: 68128 - protein, 9 aa, Borrelia garinii PBi
YLNTIINSY

SEQ ID NO: 68129 - protein, 9 aa, Borrelia garinii PBi
KIESFNTQY

SEQ ID NO: 68130 - protein, 9 aa, Borrelia garinii PBi
QSNNVLTNY

SEQ ID NO: 68131 - protein, 9 aa, Borrelia garinii PBi
FGSIMNILY

SEQ ID NO: 68132 - protein, 10 aa, Borrelia garinii PBi
EFGSIMNILY

SEQ ID NO: 68133 - protein, 10 aa, Borrelia garinii PBi
QYLNTIINSY

SEQ ID NO: 68134 - protein, 10 aa, Borrelia garinii PBi
SIIKPQQYTF

SEQ ID NO: 68135 - protein, 10 aa, Borrelia garinii PBi
SQSNNVLTNY

SEQ ID NO: 68136 - protein, 10 aa, Borrelia garinii PBi
KKIESFNTQY

SEQ ID NO: 68137 - protein, 10 aa, Borrelia garinii PBi
SLGQYIKNKY

SEQ ID NO: 68138 - protein, 10 aa, Borrelia garinii PBi
TQPSFVVPVY

SEQ ID NO: 68139 - protein, 11 aa, Borrelia garinii PBi
YLNTIINSYTF

SEQ ID NO: 68140 - protein, 11 aa, Borrelia garinii PBi
CTIDANLNKDY

SEQ ID NO: 68141 - protein, 11 aa, Borrelia garinii PBi
ILAEKKEWLNY

SEQ ID NO: 68142 - protein, 11 aa, Borrelia garinii PBi
NSQSNNVLTNY

SEQ ID NO: 68143 - protein, 11 aa, Borrelia garinii PBi
SFSQPTSQTNF

SEQ ID NO: 68144 - protein, 11 aa, Borrelia garinii PBi
TQYLNTIINSY

SEQ ID NO: 68145 - protein, 11 aa, Borrelia garinii PBi
KTHNHGFRETY

SEQ ID NO: 68146 - protein, 11 aa, Borrelia garinii PBi
QTQPSFVVPVY

SEQ ID NO: 68147 - protein, 9 aa, Borrelia garinii PBi
ETYDQFKMK

SEQ ID NO: 68148 - protein, 9 aa, Borrelia garinii PBi
TIINSYTFK

SEQ ID NO: 68149 - protein, 9 aa, Borrelia garinii PBi
NTPEAESER

SEQ ID NO: 68150 - protein, 9 aa, Borrelia garinii PBi
CTIDANLNK

SEQ ID NO: 68151 - protein, 9 aa, Borrelia garinii PBi
YTFSSSFSQ

SEQ ID NO: 68152 - protein, 9 aa, Borrelia garinii PBi
ITNTSSNSK

SEQ ID NO: 68153 - protein, 9 aa, Borrelia garinii PBi
ISNISVFDR

SEQ ID NO: 68154 - protein, 9 aa, Borrelia garinii PBi
DANLNKDYK

SEQ ID NO: 68155 - protein, 9 aa, Borrelia garinii PBi
ESTLEEIEK

SEQ ID NO: 68156 - protein, 9 aa, Borrelia garinii PBi
TNTSSNSKR

SEQ ID NO: 68157 - protein, 9 aa, Borrelia garinii PBi
STLEEIEKK

SEQ ID NO: 68158 - protein, 9 aa, Borrelia garinii PBi
SNNVLTNYR

SEQ ID NO: 68159 - protein, 9 aa, Borrelia garinii PBi
LYLNITEIR

SEQ ID NO: 68160 - protein, 9 aa, Borrelia garinii PBi
NKTHNHGFR

SEQ ID NO: 68161 - protein, 9 aa, Borrelia garinii PBi
STPNQSIIK

SEQ ID NO: 68162 - protein, 9 aa, Borrelia garinii PBi
NSSTDDQAK

SEQ ID NO: 68163 - protein, 9 aa, Borrelia garinii PBi
TNVQATPPK

SEQ ID NO: 68164 - protein, 9 aa, Borrelia garinii PBi
KLNSILAEK

SEQ ID NO: 68165 - protein, 9 aa, Borrelia garinii PBi
NTIINSYTF

SEQ ID NO: 68166 - protein, 9 aa, Borrelia garinii PBi
ESFNTQYLN

SEQ ID NO: 68167 - protein, 9 aa, Borrelia garinii PBi
NIKVAGLQK

SEQ ID NO: 68168 - protein, 9 aa, Borrelia garinii PBi
LLRRIAEEK

SEQ ID NO: 68169 - protein, 9 aa, Borrelia garinii PBi
YLDKMQDAR

SEQ ID NO: 68170 - protein, 9 aa, Borrelia garinii PBi
YSGNSPLQK

SEQ ID NO: 68171 - protein, 9 aa, Borrelia garinii PBi
DVISNISVF

SEQ ID NO: 68172 - protein, 9 aa, Borrelia garinii PBi
ENQNHSLIR

SEQ ID NO: 68173 - protein, 9 aa, Borrelia garinii PBi
QSNNVLTNY

SEQ ID NO: 68174 - protein, 9 aa, Borrelia garinii PBi
INTGSNATK

SEQ ID NO: 68175 - protein, 9 aa, Borrelia garinii PBi
SYTFKDKLK

SEQ ID NO: 68176 - protein, 9 aa, Borrelia garinii PBi
YLNTIINSY

SEQ ID NO: 68177 - protein, 9 aa, Borrelia garinii PBi
ATKNKTNIK

SEQ ID NO: 68178 - protein, 10 aa, Borrelia garinii PBi
NTIINSYTFK

SEQ ID NO: 68179 - protein, 10 aa, Borrelia garinii PBi
ITNTSSNSKR

SEQ ID NO: 68180 - protein, 10 aa, Borrelia garinii PBi
QSNNVLTNYR

SEQ ID NO: 68181 - protein, 10 aa, Borrelia garinii PBi
DLYLNITEIR

SEQ ID NO: 68182 - protein, 10 aa, Borrelia garinii PBi
NSYTFKDKLK

SEQ ID NO: 68183 - protein, 10 aa, Borrelia garinii PBi
YAMMDFDQAK

SEQ ID NO: 68184 - protein, 10 aa, Borrelia garinii PBi
ESTLEEIEKK

SEQ ID NO: 68185 - protein, 10 aa, Borrelia garinii PBi
VISNISVFDR

SEQ ID NO: 68186 - protein, 10 aa, Borrelia garinii PBi
NTGSNATKNK

SEQ ID NO: 68187 - protein, 10 aa, Borrelia garinii PBi
TSTPNQSIIK

SEQ ID NO: 68188 - protein, 10 aa, Borrelia garinii PBi
NATKNKTNIK

SEQ ID NO: 68189 - protein, 10 aa, Borrelia garinii PBi
IITNTSSNSK

SEQ ID NO: 68190 - protein, 10 aa, Borrelia garinii PBi
SINTGSNATK

SEQ ID NO: 68191 - protein, 10 aa, Borrelia garinii PBi
IINSYTFKDK

SEQ ID NO: 68192 - protein, 10 aa, Borrelia garinii PBi
TNIKVAGLQK

SEQ ID NO: 68193 - protein, 10 aa, Borrelia garinii PBi
ATNVQATPPK

SEQ ID NO: 68194 - protein, 10 aa, Borrelia garinii PBi
NLLRRIAEEK

SEQ ID NO: 68195 - protein, 10 aa, Borrelia garinii PBi
SNTPEAESER

SEQ ID NO: 68196 - protein, 10 aa, Borrelia garinii PBi
YTFSSSFSQP

SEQ ID NO: 68197 - protein, 10 aa, Borrelia garinii PBi
QYIKNKYLDK

SEQ ID NO: 68198 - protein, 10 aa, Borrelia garinii PBi
KLNSILAEKK

SEQ ID NO: 68199 - protein, 10 aa, Borrelia garinii PBi
TPEAESERNR

SEQ ID NO: 68200 - protein, 10 aa, Borrelia garinii PBi
QSLGQYIKNK

SEQ ID NO: 68201 - protein, 10 aa, Borrelia garinii PBi
ETYDQFKMKD

SEQ ID NO: 68202 - protein, 10 aa, Borrelia garinii PBi
EFGSIMNILY

SEQ ID NO: 68203 - protein, 11 aa, Borrelia garinii PBi
DVISNISVFDR

SEQ ID NO: 68204 - protein, 11 aa, Borrelia garinii PBi
IITNTSSNSKR

SEQ ID NO: 68205 - protein, 11 aa, Borrelia garinii PBi
ESKLNSILAEK

SEQ ID NO: 68206 - protein, 11 aa, Borrelia garinii PBi
NTPEAESERNR

SEQ ID NO: 68207 - protein, 11 aa, Borrelia garinii PBi
SSNTPEAESER

SEQ ID NO: 68208 - protein, 11 aa, Borrelia garinii PBi
NTSTPNQSIIK

SEQ ID NO: 68209 - protein, 11 aa, Borrelia garinii PBi
TIINSYTFKDK

SEQ ID NO: 68210 - protein, 11 aa, Borrelia garinii PBi
SSCTIDANLNK

SEQ ID NO: 68211 - protein, 11 aa, Borrelia garinii PBi
ISINTGSNATK

SEQ ID NO: 68212 - protein, 11 aa, Borrelia garinii PBi
LNTIINSYTFK

SEQ ID NO: 68213 - protein, 11 aa, Borrelia garinii PBi
TIDANLNKDYK

SEQ ID NO: 68214 - protein, 11 aa, Borrelia garinii PBi
EKNKTHNHGFR

SEQ ID NO: 68215 - protein, 11 aa, Borrelia garinii PBi
HGFRETYDQFK

SEQ ID NO: 68216 - protein, 11 aa, Borrelia garinii PBi
LYAMMDFDQAK

SEQ ID NO: 68217 - protein, 11 aa, Borrelia garinii PBi
SQSNNVLTNYR

SEQ ID NO: 68218 - protein, 11 aa, Borrelia garinii PBi
DANLNKDYKNK

SEQ ID NO: 68219 - protein, 11 aa, Borrelia garinii PBi
AIITNTSSNSK

SEQ ID NO: 68220 - protein, 11 aa, Borrelia garinii PBi
PVYSGNSPLQK

SEQ ID NO: 68221 - protein, 11 aa, Borrelia garinii PBi
NKYLDKMQDAR

SEQ ID NO: 68222 - protein, 11 aa, Borrelia garinii PBi
YTFKDKLKELE

SEQ ID NO: 68223 - protein, 11 aa, Borrelia garinii PBi
LLNSSTDDQAK

SEQ ID NO: 68224 - protein, 11 aa, Borrelia garinii PBi
QTQPSFVVPVY

SEQ ID NO: 68225 - protein, 11 aa, Borrelia garinii PBi
CTIDANLNKDY

SEQ ID NO: 68226 - protein, 11 aa, Borrelia garinii PBi
TEFGSIMNILY

SEQ ID NO: 68227 - protein, 11 aa, Borrelia garinii PBi
YSGNSPLQKLK

SEQ ID NO: 68228 - protein, 11 aa, Borrelia garinii PBi
KTNIKVAGLQK

SEQ ID NO: 68229 - protein, 11 aa, Borrelia garinii PBi
YTFSSSFSQPT

SEQ ID NO: 68230 - protein, 11 aa, Borrelia garinii PBi
SLESTLEEIEK

SEQ ID NO: 68231 - protein, 11 aa, Borrelia garinii PBi
PATNVQATPPK

SEQ ID NO: 68232 - protein, 11 aa, Borrelia garinii PBi
NSQSNNVLTNY

SEQ ID NO: 68233 - protein, 9 aa, Borrelia garinii PBi
SPATNVQAT

SEQ ID NO: 68234 - protein, 9 aa, Borrelia garinii PBi
VPVYSGNSP

SEQ ID NO: 68235 - protein, 9 aa, Borrelia garinii PBi
KPQQYTFSS

SEQ ID NO: 68236 - protein, 9 aa, Borrelia garinii PBi
VPNNTSTPN

SEQ ID NO: 68237 - protein, 9 aa, Borrelia garinii PBi
SERNRLYAM

SEQ ID NO: 68238 - protein, 9 aa, Borrelia garinii PBi
SPVASPATN

SEQ ID NO: 68239 - protein, 9 aa, Borrelia garinii PBi
NPMQIANQA

SEQ ID NO: 68240 - protein, 9 aa, Borrelia garinii PBi
APQLSSNTP

SEQ ID NO: 68241 - protein, 9 aa, Borrelia garinii PBi
SKRNDPQSL

SEQ ID NO: 68242 - protein, 10 aa, Borrelia garinii PBi
VPVYSGNSPL

SEQ ID NO: 68243 - protein, 10 aa, Borrelia garinii PBi
SPVASPATNV

SEQ ID NO: 68244 - protein, 10 aa, Borrelia garinii PBi
KPQQYTFSSS

SEQ ID NO: 68245 - protein, 10 aa, Borrelia garinii PBi
APQLSSNTPE

SEQ ID NO: 68246 - protein, 10 aa, Borrelia garinii PBi
SPLQKLKNNL

SEQ ID NO: 68247 - protein, 10 aa, Borrelia garinii PBi
KMQDARQSAL

SEQ ID NO: 68248 - protein, 11 aa, Borrelia garinii PBi
KPQQYTFSSSF

SEQ ID NO: 68249 - protein, 11 aa, Borrelia garinii PBi
SPLQKLKNNLL

SEQ ID NO: 68250 - protein, 11 aa, Borrelia garinii PBi
APQLSSNTPEA

SEQ ID NO: 68251 - protein, 11 aa, Borrelia garinii PBi
SPVASPATNVQ

SEQ ID NO: 68252 - protein, 11 aa, Borrelia garinii PBi
TPEAESERNRL

SEQ ID NO: 68253 - protein, 11 aa, Borrelia garinii PBi
PPKQIASAQAI

SEQ ID NO: 68254 - protein, 11 aa, Borrelia garinii PBi
SPATNVQATPP

SEQ ID NO: 68255 - protein, 11 aa, Borrelia garinii PBi
VPVYSGNSPLQ

SEQ ID NO: 68256 - protein, 11 aa, Borrelia garinii PBi
VASSASQASPV

SEQ ID NO: 68257 - protein, 11 aa, Borrelia garinii PBi
VPNNTSTPNQS

SEQ ID NO: 68258 - protein, 9 aa, Borrelia garinii PBi
QFKMKDSAF

SEQ ID NO: 68259 - protein, 9 aa, Borrelia garinii PBi
IIKPQQYTF

SEQ ID NO: 68260 - protein, 10 aa, Borrelia garinii PBi
YIKNKYLDKM

SEQ ID NO: 68261 - protein, 11 aa, Borrelia garinii PBi
YDQFKMKDSAF

SEQ ID NO: 68262 - protein, 9 aa, Borrelia garinii PBi
QQYTFSSSF

SEQ ID NO: 68263 - protein, 9 aa, Borrelia garinii PBi
YLNTIINSY

SEQ ID NO: 68264 - protein, 9 aa, Borrelia garinii PBi
KQIASAQAI

SEQ ID NO: 68265 - protein, 9 aa, Borrelia garinii PBi
NQVNPGNPM

SEQ ID NO: 68266 - protein, 9 aa, Borrelia garinii PBi
RQSALDLYL

SEQ ID NO: 68267 - protein, 9 aa, Borrelia garinii PBi
KMKDSAFTL

SEQ ID NO: 68268 - protein, 9 aa, Borrelia garinii PBi
YQENQNHSL

SEQ ID NO: 68269 - protein, 9 aa, Borrelia garinii PBi
IQISLESTL

SEQ ID NO: 68270 - protein, 9 aa, Borrelia garinii PBi
LQKLKNNLL

SEQ ID NO: 68271 - protein, 9 aa, Borrelia garinii PBi
SQPTSQTNF

SEQ ID NO: 68272 - protein, 9 aa, Borrelia garinii PBi
MQDARQSAL

SEQ ID NO: 68273 - protein, 9 aa, Borrelia garinii PBi
SQVASSASQ

SEQ ID NO: 68274 - protein, 9 aa, Borrelia garinii PBi
QFKMKDSAF

SEQ ID NO: 68275 - protein, 9 aa, Borrelia garinii PBi
QSNNVLTNY

SEQ ID NO: 68276 - protein, 9 aa, Borrelia garinii PBi
IIKPQQYTF

SEQ ID NO: 68277 - protein, 9 aa, Borrelia garinii PBi
GQYIKNKYL

SEQ ID NO: 68278 - protein, 9 aa, Borrelia garinii PBi
HQTQPSFVV

SEQ ID NO: 68279 - protein, 9 aa, Borrelia garinii PBi
KNKTHNHGF

SEQ ID NO: 68280 - protein, 9 aa, Borrelia garinii PBi
QSIIKPQQY

SEQ ID NO: 68281 - protein, 9 aa, Borrelia garinii PBi
HNHGFRETY

SEQ ID NO: 68282 - protein, 9 aa, Borrelia garinii PBi
TQSKKNNNL

SEQ ID NO: 68283 - protein, 9 aa, Borrelia garinii PBi
KMQDARQSA

SEQ ID NO: 68284 - protein, 9 aa, Borrelia garinii PBi
MQIANQANQ

SEQ ID NO: 68285 - protein, 10 aa, Borrelia garinii PBi
SQSNNVLTNY

SEQ ID NO: 68286 - protein, 10 aa, Borrelia garinii PBi
KMQDARQSAL

SEQ ID NO: 68287 - protein, 10 aa, Borrelia garinii PBi
PQQYTFSSSF

SEQ ID NO: 68288 - protein, 10 aa, Borrelia garinii PBi
TQPSFVVPVY

SEQ ID NO: 68289 - protein, 10 aa, Borrelia garinii PBi
FSQPTSQTNF

SEQ ID NO: 68290 - protein, 10 aa, Borrelia garinii PBi
KMKDSAFTLL

SEQ ID NO: 68291 - protein, 10 aa, Borrelia garinii PBi
DQFKMKDSAF

SEQ ID NO: 68292 - protein, 10 aa, Borrelia garinii PBi
KQIASAQAIQ

SEQ ID NO: 68293 - protein, 10 aa, Borrelia garinii PBi
SIIKPQQYTF

SEQ ID NO: 68294 - protein, 10 aa, Borrelia garinii PBi
NQNHSLIRSL

SEQ ID NO: 68295 - protein, 10 aa, Borrelia garinii PBi
SQASPVASPA

SEQ ID NO: 68296 - protein, 10 aa, Borrelia garinii PBi
NQSIIKPQQY

SEQ ID NO: 68297 - protein, 10 aa, Borrelia garinii PBi
MQIANQANQA

SEQ ID NO: 68298 - protein, 10 aa, Borrelia garinii PBi
IQTVPNNTST

SEQ ID NO: 68299 - protein, 10 aa, Borrelia garinii PBi
SQVASSASQA

SEQ ID NO: 68300 - protein, 11 aa, Borrelia garinii PBi
TQYLNTIINSY

SEQ ID NO: 68301 - protein, 11 aa, Borrelia garinii PBi
YLNTIINSYTF

SEQ ID NO: 68302 - protein, 11 aa, Borrelia garinii PBi
QTQPSFVVPVY

SEQ ID NO: 68303 - protein, 11 aa, Borrelia garinii PBi
KTHNHGFRETY

SEQ ID NO: 68304 - protein, 11 aa, Borrelia garinii PBi
ILAEKKEWLNY

SEQ ID NO: 68305 - protein, 11 aa, Borrelia garinii PBi
RQSALDLYLNI

SEQ ID NO: 68306 - protein, 11 aa, Borrelia garinii PBi
ILYQENQNHSL

SEQ ID NO: 68307 - protein, 11 aa, Borrelia garinii PBi
SQVASSASQAS

SEQ ID NO: 68308 - protein, 11 aa, Borrelia garinii PBi
KQIASAQAIQT

SEQ ID NO: 68309 - protein, 11 aa, Borrelia garinii PBi
MQIANQANQAN

SEQ ID NO: 68310 - protein, 11 aa, Borrelia garinii PBi
SQASPVASPAT

SEQ ID NO: 68311 - protein, 11 aa, Borrelia garinii PBi
HQTQPSFVVPV

SEQ ID NO: 68312 - protein, 11 aa, Borrelia garinii PBi
QSIIKPQQYTF

SEQ ID NO: 68313 - protein, 11 aa, Borrelia garinii PBi
SVFDRGSAPQL

SEQ ID NO: 68314 - protein, 11 aa, Borrelia garinii PBi
LLDVISNISVF

SEQ ID NO: 68315 - protein, 11 aa, Borrelia garinii PBi
QQYTFSSSFSQ

SEQ ID NO: 68316 - protein, 11 aa, Borrelia garinii PBi
TNYRHQTQPSF

SEQ ID NO: 68317 - protein, 11 aa, Borrelia garinii PBi
SLIRSLIISGL

SEQ ID NO: 68318 - protein, 11 aa, Borrelia garinii PBi
AMMDFDQAKTT

SEQ ID NO: 68319 - protein, 9 aa, Borrelia garinii PBi
RRIAEEKNK

SEQ ID NO: 68320 - protein, 9 aa, Borrelia garinii PBi
YRHQTQPSF

SEQ ID NO: 68321 - protein, 9 aa, Borrelia garinii PBi
NRLYAMMDF

SEQ ID NO: 68322 - protein, 9 aa, Borrelia garinii PBi
QQYTFSSSF

SEQ ID NO: 68323 - protein, 9 aa, Borrelia garinii PBi
RQSALDLYL

SEQ ID NO: 68324 - protein, 9 aa, Borrelia garinii PBi
ERNRLYAMM

SEQ ID NO: 68325 - protein, 9 aa, Borrelia garinii PBi
IRSLIISGL

SEQ ID NO: 68326 - protein, 10 aa, Borrelia garinii PBi
KRNDPQSLGQ

SEQ ID NO: 68327 - protein, 10 aa, Borrelia garinii PBi
ARQSALDLYL

SEQ ID NO: 68328 - protein, 11 aa, Borrelia garinii PBi
RRIAEEKNKTH

SEQ ID NO: 68329 - protein, 11 aa, Borrelia garinii PBi
KRNDPQSLGQY

SEQ ID NO: 68330 - protein, 11 aa, Borrelia garinii PBi
GQYIKNKYLDK

SEQ ID NO: 68331 - protein, 11 aa, Borrelia garinii PBi
ERNRLYAMMDF

SEQ ID NO: 68332 - protein, 11 aa, Borrelia garinii PBi
RQSALDLYLNI

SEQ ID NO: 68333 - protein, 11 aa, Borrelia garinii PBi
YRHQTQPSFVV

SEQ ID NO: 68334 - protein, 11 aa, Borrelia garinii PBi
FRETYDQFKMK

SEQ ID NO: 68335 - protein, 9 aa, Borrelia garinii PBi
QPSFVVPVY

SEQ ID NO: 68336 - protein, 9 aa, Borrelia garinii PBi
YLNTIINSY

SEQ ID NO: 68337 - protein, 9 aa, Borrelia garinii PBi
NPANQVNPG

SEQ ID NO: 68338 - protein, 9 aa, Borrelia garinii PBi
SPATNVQAT

SEQ ID NO: 68339 - protein, 9 aa, Borrelia garinii PBi
QANQASQAS

SEQ ID NO: 68340 - protein, 9 aa, Borrelia garinii PBi
QASQASQAS

SEQ ID NO: 68341 - protein, 9 aa, Borrelia garinii PBi
DVISNISVF

SEQ ID NO: 68342 - protein, 9 aa, Borrelia garinii PBi
QANQANQAS

SEQ ID NO: 68343 - protein, 9 aa, Borrelia garinii PBi
NTIINSYTF

SEQ ID NO: 68344 - protein, 9 aa, Borrelia garinii PBi
FGSIMNILY

SEQ ID NO: 68345 - protein, 9 aa, Borrelia garinii PBi
NPMQIANQA

SEQ ID NO: 68346 - protein, 9 aa, Borrelia garinii PBi
QASQASQVA

SEQ ID NO: 68347 - protein, 9 aa, Borrelia garinii PBi
NQVNPGNPM

SEQ ID NO: 68348 - protein, 9 aa, Borrelia garinii PBi
VPNNTSTPN

SEQ ID NO: 68349 - protein, 9 aa, Borrelia garinii PBi
SASQASPVA

SEQ ID NO: 68350 - protein, 9 aa, Borrelia garinii PBi
VASSASQAS

SEQ ID NO: 68351 - protein, 9 aa, Borrelia garinii PBi
IANQANQAN

SEQ ID NO: 68352 - protein, 9 aa, Borrelia garinii PBi
WLNYADAII

SEQ ID NO: 68353 - protein, 9 aa, Borrelia garinii PBi
QANQANQAN

SEQ ID NO: 68354 - protein, 9 aa, Borrelia garinii PBi
QANQANQAN

SEQ ID NO: 68355 - protein, 9 aa, Borrelia garinii PBi
QANQANQAN

SEQ ID NO: 68356 - protein, 9 aa, Borrelia garinii PBi
YAMMDFDQA

SEQ ID NO: 68357 - protein, 9 aa, Borrelia garinii PBi
YQENQNHSL

SEQ ID NO: 68358 - protein, 9 aa, Borrelia garinii PBi
VASPATNVQ

SEQ ID NO: 68359 - protein, 9 aa, Borrelia garinii PBi
FSSSFSQPT

SEQ ID NO: 68360 - protein, 10 aa, Borrelia garinii PBi
VPVYSGNSPL

SEQ ID NO: 68361 - protein, 10 aa, Borrelia garinii PBi
DARQSALDLY

SEQ ID NO: 68362 - protein, 10 aa, Borrelia garinii PBi
NPMQIANQAN

SEQ ID NO: 68363 - protein, 10 aa, Borrelia garinii PBi
EAESERNRLY

SEQ ID NO: 68364 - protein, 10 aa, Borrelia garinii PBi
QASPVASPAT

SEQ ID NO: 68365 - protein, 10 aa, Borrelia garinii PBi
EFGSIMNILY

SEQ ID NO: 68366 - protein, 10 aa, Borrelia garinii PBi
DFDQAKTTEF

SEQ ID NO: 68367 - protein, 10 aa, Borrelia garinii PBi
YAMMDFDQAK

SEQ ID NO: 68368 - protein, 10 aa, Borrelia garinii PBi
QASQASQVAS

SEQ ID NO: 68369 - protein, 10 aa, Borrelia garinii PBi
TPNQSIIKPQ

SEQ ID NO: 68370 - protein, 10 aa, Borrelia garinii PBi
SASQASPVAS

SEQ ID NO: 68371 - protein, 10 aa, Borrelia garinii PBi
YADAIITNTS

SEQ ID NO: 68372 - protein, 10 aa, Borrelia garinii PBi
FSQPTSQTNF

SEQ ID NO: 68373 - protein, 10 aa, Borrelia garinii PBi
MSSCTIDANL

SEQ ID NO: 68374 - protein, 10 aa, Borrelia garinii PBi
QASQVASSAS

SEQ ID NO: 68375 - protein, 10 aa, Borrelia garinii PBi
ESERNRLYAM

SEQ ID NO: 68376 - protein, 10 aa, Borrelia garinii PBi
THNHGFRETY

SEQ ID NO: 68377 - protein, 10 aa, Borrelia garinii PBi
LDVISNISVF

SEQ ID NO: 68378 - protein, 10 aa, Borrelia garinii PBi
FNNSQSNNVL

SEQ ID NO: 68379 - protein, 10 aa, Borrelia garinii PBi
NPANQVNPGN

SEQ ID NO: 68380 - protein, 11 aa, Borrelia garinii PBi
KPQQYTFSSSF

SEQ ID NO: 68381 - protein, 11 aa, Borrelia garinii PBi
YLNTIINSYTF

SEQ ID NO: 68382 - protein, 11 aa, Borrelia garinii PBi
PANQVNPGNPM

SEQ ID NO: 68383 - protein, 11 aa, Borrelia garinii PBi
TPEAESERNRL

SEQ ID NO: 68384 - protein, 11 aa, Borrelia garinii PBi
VASPATNVQAT

SEQ ID NO: 68385 - protein, 11 aa, Borrelia garinii PBi
SPVASPATNVQ

SEQ ID NO: 68386 - protein, 11 aa, Borrelia garinii PBi
QTQPSFVVPVY

SEQ ID NO: 68387 - protein, 11 aa, Borrelia garinii PBi
MDFDQAKTTEF

SEQ ID NO: 68388 - protein, 11 aa, Borrelia garinii PBi
TQYLNTIINSY

SEQ ID NO: 68389 - protein, 11 aa, Borrelia garinii PBi
QAKTTEFGSIM

SEQ ID NO: 68390 - protein, 11 aa, Borrelia garinii PBi
LLDVISNISVF

SEQ ID NO: 68391 - protein, 11 aa, Borrelia garinii PBi
YAMMDFDQAKT

SEQ ID NO: 68392 - protein, 11 aa, Borrelia garinii PBi
VPVYSGNSPLQ

SEQ ID NO: 68393 - protein, 11 aa, Borrelia garinii PBi
IANQANQANQA

SEQ ID NO: 68394 - protein, 11 aa, Borrelia garinii PBi
NFNNSQSNNVL

SEQ ID NO: 68395 - protein, 11 aa, Borrelia garinii PBi
VPNNTSTPNQS

SEQ ID NO: 68396 - protein, 11 aa, Borrelia garinii PBi
QANQANQANQA

SEQ ID NO: 68397 - protein, 11 aa, Borrelia garinii PBi
QANQANQANQA

SEQ ID NO: 68398 - protein, 11 aa, Borrelia garinii PBi
QANQANQANQA

SEQ ID NO: 68399 - protein, 11 aa, Borrelia garinii PBi
SPLQKLKNNLL

SEQ ID NO: 68400 - protein, 9 aa, Borrelia garinii PBi
AEKKEWLNY

SEQ ID NO: 68401 - protein, 9 aa, Borrelia garinii PBi
EEIEKKIES

SEQ ID NO: 68402 - protein, 9 aa, Borrelia garinii PBi
AESERNRLY

SEQ ID NO: 68403 - protein, 9 aa, Borrelia garinii PBi
TEFGSIMNI

SEQ ID NO: 68404 - protein, 9 aa, Borrelia garinii PBi
KELESKLNS

SEQ ID NO: 68405 - protein, 9 aa, Borrelia garinii PBi
QENQNHSLI

SEQ ID NO: 68406 - protein, 10 aa, Borrelia garinii PBi
EEINKKIEIF

SEQ ID NO: 68407 - protein, 10 aa, Borrelia garinii PBi
AENERNKFYA

SEQ ID NO: 68408 - protein, 10 aa, Borrelia garinii PBi
EEKNKTQNNF

SEQ ID NO: 68409 - protein, 10 aa, Borrelia garinii PBi
RELMISGLGT

SEQ ID NO: 68410 - protein, 10 aa, Borrelia garinii PBi
AELKKQSQAA

SEQ ID NO: 68411 - protein, 11 aa, Borrelia garinii PBi
TEFGSIMNILY

SEQ ID NO: 68412 - protein, 11 aa, Borrelia garinii PBi
EEKNKTHNHGF

SEQ ID NO: 68413 - protein, 11 aa, Borrelia garinii PBi
AESERNRLYAM

SEQ ID NO: 68414 - protein, 11 aa, Borrelia garinii PBi
EEIEKKIESFN

SEQ ID NO: 68415 - protein, 11 aa, Borrelia garinii PBi
KELESKLNSIL

SEQ ID NO: 68416 - protein, 11 aa, Borrelia garinii PBi
AEKKEWLNYAD

SEQ ID NO: 68417 - protein, 11 aa, Borrelia garinii PBi
EELLNSSTDDQ

SEQ ID NO: 68418 - protein, 9 aa, Borrelia garinii PBi
VPVYSGNSP

SEQ ID NO: 68419 - protein, 9 aa, Borrelia garinii PBi
DPQSLGQYI

SEQ ID NO: 68420 - protein, 9 aa, Borrelia garinii PBi
TPPKQIASA

SEQ ID NO: 68421 - protein, 10 aa, Borrelia garinii PBi
SPVASPATNV

SEQ ID NO: 68422 - protein, 10 aa, Borrelia garinii PBi
VPVYSGNSPL

SEQ ID NO: 68423 - protein, 11 aa, Borrelia garinii PBi
PPKQIASAQAI

SEQ ID NO: 68424 - protein, 10 aa, Borrelia garinii PBi
FSQPTSQTNF

SEQ ID NO: 68425 - protein, 10 aa, Borrelia garinii PBi
NSILAEKKEW

SEQ ID NO: 68426 - protein, 9 aa, Borrelia burgdorferi B31
LLDTYIRAY

SEQ ID NO: 68427 - protein, 9 aa, Borrelia burgdorferi B31
LAEHFNKYY

SEQ ID NO: 68428 - protein, 9 aa, Borrelia burgdorferi B31
DSDSLQSAF

SEQ ID NO: 68429 - protein, 9 aa, Borrelia burgdorferi B31
ILEKLINNY

SEQ ID NO: 68430 - protein, 10 aa, Borrelia burgdorferi B31
DSDSLQSAFY

SEQ ID NO: 68431 - protein, 10 aa, Borrelia burgdorferi B31
KTLNKTLEDY

SEQ ID NO: 68432 - protein, 9 aa, Borrelia burgdorferi B31
FLYRIALDI

SEQ ID NO: 68433 - protein, 9 aa, Borrelia burgdorferi B31
NLLDTYIRA

SEQ ID NO: 68434 - protein, 9 aa, Borrelia burgdorferi B31
FMGTTASEL

SEQ ID NO: 68435 - protein, 9 aa, Borrelia burgdorferi B31
KMLLKRFLL

SEQ ID NO: 68436 - protein, 9 aa, Borrelia burgdorferi B31
NIITMILTL

SEQ ID NO: 68437 - protein, 9 aa, Borrelia burgdorferi B31
ALLEQVKSA

SEQ ID NO: 68438 - protein, 9 aa, Borrelia burgdorferi B31
TMILTLICI

SEQ ID NO: 68439 - protein, 9 aa, Borrelia burgdorferi B31
TLKEILEKL

SEQ ID NO: 68440 - protein, 9 aa, Borrelia burgdorferi B31
KLNIIKINI

SEQ ID NO: 68441 - protein, 9 aa, Borrelia burgdorferi B31
IITMILTLI

SEQ ID NO: 68442 - protein, 9 aa, Borrelia burgdorferi B31
IALDIQLKL

SEQ ID NO: 68443 - protein, 9 aa, Borrelia burgdorferi B31
KINIITMIL

SEQ ID NO: 68444 - protein, 9 aa, Borrelia burgdorferi B31
FLLSSLDYK

SEQ ID NO: 68445 - protein, 9 aa, Borrelia burgdorferi B31
SINEKLDTL

SEQ ID NO: 68446 - protein, 9 aa, Borrelia burgdorferi B31
MLLKRFLLS

SEQ ID NO: 68447 - protein, 9 aa, Borrelia burgdorferi B31
IAANFLYRI

SEQ ID NO: 68448 - protein, 9 aa, Borrelia burgdorferi B31
LTLICISCA

SEQ ID NO: 68449 - protein, 9 aa, Borrelia burgdorferi B31
SLDYKKENI

SEQ ID NO: 68450 - protein, 10 aa, Borrelia burgdorferi B31
KIAANFLYRI

SEQ ID NO: 68451 - protein, 10 aa, Borrelia burgdorferi B31
ALLEQVKSAL

SEQ ID NO: 68452 - protein, 10 aa, Borrelia burgdorferi B31
NIITMILTLI

SEQ ID NO: 68453 - protein, 10 aa, Borrelia burgdorferi B31
MLLKRFLLSS

SEQ ID NO: 68454 - protein, 10 aa, Borrelia burgdorferi B31
ILTLICISCA

SEQ ID NO: 68455 - protein, 10 aa, Borrelia burgdorferi B31
ITMILTLICI

SEQ ID NO: 68456 - protein, 10 aa, Borrelia burgdorferi B31
KLNIIKINII

SEQ ID NO: 68457 - protein, 10 aa, Borrelia burgdorferi B31
NQYDIQIAKI

SEQ ID NO: 68458 - protein, 10 aa, Borrelia burgdorferi B31
LLKRFLLSSL

SEQ ID NO: 68459 - protein, 10 aa, Borrelia burgdorferi B31
RIALDIQLKL

SEQ ID NO: 68460 - protein, 10 aa, Borrelia burgdorferi B31
FLYRIALDIQ

SEQ ID NO: 68461 - protein, 10 aa, Borrelia burgdorferi B31
NIIKINIITM

SEQ ID NO: 68462 - protein, 11 aa, Borrelia burgdorferi B31
FLYRIALDIQL

SEQ ID NO: 68463 - protein, 11 aa, Borrelia burgdorferi B31
MLLKRFLLSSL

SEQ ID NO: 68464 - protein, 11 aa, Borrelia burgdorferi B31
LLDTYIRAYEL

SEQ ID NO: 68465 - protein, 11 aa, Borrelia burgdorferi B31
MILTLICISCA

SEQ ID NO: 68466 - protein, 11 aa, Borrelia burgdorferi B31
FMGTTASELKA

SEQ ID NO: 68467 - protein, 11 aa, Borrelia burgdorferi B31
KINIITMILTL

SEQ ID NO: 68468 - protein, 11 aa, Borrelia burgdorferi B31
NIIKINIITMI

SEQ ID NO: 68469 - protein, 11 aa, Borrelia burgdorferi B31
IITMILTLICI

SEQ ID NO: 68470 - protein, 11 aa, Borrelia burgdorferi B31
KLNIIKINIIT

SEQ ID NO: 68471 - protein, 11 aa, Borrelia burgdorferi B31
KMLLKRFLLSS

SEQ ID NO: 68472 - protein, 9 aa, Borrelia burgdorferi B31
KLKKNTRLK

SEQ ID NO: 68473 - protein, 9 aa, Borrelia burgdorferi B31
KVLAEHFNK

SEQ ID NO: 68474 - protein, 9 aa, Borrelia burgdorferi B31
RIALDIQLK

SEQ ID NO: 68475 - protein, 9 aa, Borrelia burgdorferi B31
KIAANFLYR

SEQ ID NO: 68476 - protein, 9 aa, Borrelia burgdorferi B31
FLLSSLDYK

SEQ ID NO: 68477 - protein, 9 aa, Borrelia burgdorferi B31
KSALQLQEK

SEQ ID NO: 68478 - protein, 9 aa, Borrelia burgdorferi B31
CISCAPFNK

SEQ ID NO: 68479 - protein, 9 aa, Borrelia burgdorferi B31
KANENTKLK

SEQ ID NO: 68480 - protein, 9 aa, Borrelia burgdorferi B31
MLLKRFLLS

SEQ ID NO: 68481 - protein, 9 aa, Borrelia burgdorferi B31
VLAEHFNKY

SEQ ID NO: 68482 - protein, 9 aa, Borrelia burgdorferi B31
LLSSLDYKK

SEQ ID NO: 68483 - protein, 9 aa, Borrelia burgdorferi B31
NQYDIQIAK

SEQ ID NO: 68484 - protein, 9 aa, Borrelia burgdorferi B31
QLKLEKHLK

SEQ ID NO: 68485 - protein, 9 aa, Borrelia burgdorferi B31
ALQLQEKFK

SEQ ID NO: 68486 - protein, 9 aa, Borrelia burgdorferi B31
RFLLSSLDY

SEQ ID NO: 68487 - protein, 9 aa, Borrelia burgdorferi B31
NTNNIQENK

SEQ ID NO: 68488 - protein, 9 aa, Borrelia burgdorferi B31
ETLKEILEK

SEQ ID NO: 68489 - protein, 10 aa, Borrelia burgdorferi B31
RFLLSSLDYK

SEQ ID NO: 68490 - protein, 10 aa, Borrelia burgdorferi B31
KLKKNTRLKK

SEQ ID NO: 68491 - protein, 10 aa, Borrelia burgdorferi B31
ALDIQLKLEK

SEQ ID NO: 68492 - protein, 10 aa, Borrelia burgdorferi B31
FMGTTASELK

SEQ ID NO: 68493 - protein, 10 aa, Borrelia burgdorferi B31
ALQLQEKFKK

SEQ ID NO: 68494 - protein, 10 aa, Borrelia burgdorferi B31
LINNYENDPK

SEQ ID NO: 68495 - protein, 10 aa, Borrelia burgdorferi B31
IQLKLEKHLK

SEQ ID NO: 68496 - protein, 10 aa, Borrelia burgdorferi B31
KTLNKTLEDY

SEQ ID NO: 68497 - protein, 10 aa, Borrelia burgdorferi B31
FLLSSLDYKK

SEQ ID NO: 68498 - protein, 10 aa, Borrelia burgdorferi B31
VLAEHFNKYY

SEQ ID NO: 68499 - protein, 10 aa, Borrelia burgdorferi B31
KANENTKLKK

SEQ ID NO: 68500 - protein, 10 aa, Borrelia burgdorferi B31
QEKFKKTLNK

SEQ ID NO: 68501 - protein, 10 aa, Borrelia burgdorferi B31
SALQLQEKFK

SEQ ID NO: 68502 - protein, 10 aa, Borrelia burgdorferi B31
TASELKAIGK

SEQ ID NO: 68503 - protein, 10 aa, Borrelia burgdorferi B31
LAEHFNKYYK

SEQ ID NO: 68504 - protein, 10 aa, Borrelia burgdorferi B31
KVLAEHFNKY

SEQ ID NO: 68505 - protein, 10 aa, Borrelia burgdorferi B31
CAPFNKINPK

SEQ ID NO: 68506 - protein, 10 aa, Borrelia burgdorferi B31
ICISCAPFNK

SEQ ID NO: 68507 - protein, 10 aa, Borrelia burgdorferi B31
NLLDTYIRAY

SEQ ID NO: 68508 - protein, 10 aa, Borrelia burgdorferi B31
ANENEKMLLK

SEQ ID NO: 68509 - protein, 10 aa, Borrelia burgdorferi B31
KRFLLSSLDY

SEQ ID NO: 68510 - protein, 10 aa, Borrelia burgdorferi B31
TKLKKNTRLK

SEQ ID NO: 68511 - protein, 10 aa, Borrelia burgdorferi B31
KMLLKRFLLS

SEQ ID NO: 68512 - protein, 10 aa, Borrelia burgdorferi B31
KNQYDIQIAK

SEQ ID NO: 68513 - protein, 11 aa, Borrelia burgdorferi B31
VLAEHFNKYYK

SEQ ID NO: 68514 - protein, 11 aa, Borrelia burgdorferi B31
KSALQLQEKFK

SEQ ID NO: 68515 - protein, 11 aa, Borrelia burgdorferi B31
KINPKANENTK

SEQ ID NO: 68516 - protein, 11 aa, Borrelia burgdorferi B31
KLDTLSKENSK

SEQ ID NO: 68517 - protein, 11 aa, Borrelia burgdorferi B31
SINEKLDTLSK

SEQ ID NO: 68518 - protein, 11 aa, Borrelia burgdorferi B31
KFMGTTASELK

SEQ ID NO: 68519 - protein, 11 aa, Borrelia burgdorferi B31
RAYELANENEK

SEQ ID NO: 68520 - protein, 11 aa, Borrelia burgdorferi B31
KVLAEHFNKYY

SEQ ID NO: 68521 - protein, 11 aa, Borrelia burgdorferi B31
TTASELKAIGK

SEQ ID NO: 68522 - protein, 11 aa, Borrelia burgdorferi B31
TLNKTLEDYRK

SEQ ID NO: 68523 - protein, 11 aa, Borrelia burgdorferi B31
KLINNYENDPK

SEQ ID NO: 68524 - protein, 11 aa, Borrelia burgdorferi B31
RFLLSSLDYKK

SEQ ID NO: 68525 - protein, 11 aa, Borrelia burgdorferi B31
LICISCAPFNK

SEQ ID NO: 68526 - protein, 11 aa, Borrelia burgdorferi B31
LANENEKMLLK

SEQ ID NO: 68527 - protein, 11 aa, Borrelia burgdorferi B31
IALDIQLKLEK

SEQ ID NO: 68528 - protein, 11 aa, Borrelia burgdorferi B31
QVKSALQLQEK

SEQ ID NO: 68529 - protein, 11 aa, Borrelia burgdorferi B31
KTLNKTLEDYR

SEQ ID NO: 68530 - protein, 11 aa, Borrelia burgdorferi B31
NTKLKKNTRLK

SEQ ID NO: 68531 - protein, 9 aa, Borrelia burgdorferi B31
KVLAEHFNK

SEQ ID NO: 68532 - protein, 9 aa, Borrelia burgdorferi B31
KIAANFLYR

SEQ ID NO: 68533 - protein, 9 aa, Borrelia burgdorferi B31
CISCAPFNK

SEQ ID NO: 68534 - protein, 9 aa, Borrelia burgdorferi B31
RIALDIQLK

SEQ ID NO: 68535 - protein, 9 aa, Borrelia burgdorferi B31
KSALQLQEK

SEQ ID NO: 68536 - protein, 9 aa, Borrelia burgdorferi B31
NTNNIQENK

SEQ ID NO: 68537 - protein, 9 aa, Borrelia burgdorferi B31
NQYDIQIAK

SEQ ID NO: 68538 - protein, 9 aa, Borrelia burgdorferi B31
ASELKAIGK

SEQ ID NO: 68539 - protein, 9 aa, Borrelia burgdorferi B31
KANENTKLK

SEQ ID NO: 68540 - protein, 9 aa, Borrelia burgdorferi B31
FLLSSLDYK

SEQ ID NO: 68541 - protein, 9 aa, Borrelia burgdorferi B31
LLSSLDYKK

SEQ ID NO: 68542 - protein, 9 aa, Borrelia burgdorferi B31
ETLKEILEK

SEQ ID NO: 68543 - protein, 9 aa, Borrelia burgdorferi B31
ALQLQEKFK

SEQ ID NO: 68544 - protein, 9 aa, Borrelia burgdorferi B31
APFNKINPK

SEQ ID NO: 68545 - protein, 9 aa, Borrelia burgdorferi B31
LQLQEKFKK

SEQ ID NO: 68546 - protein, 9 aa, Borrelia burgdorferi B31
KLKKNTRLK

SEQ ID NO: 68547 - protein, 9 aa, Borrelia burgdorferi B31
AEHFNKYYK

SEQ ID NO: 68548 - protein, 9 aa, Borrelia burgdorferi B31
QLKLEKHLK

SEQ ID NO: 68549 - protein, 9 aa, Borrelia burgdorferi B31
DTLSKENSK

SEQ ID NO: 68550 - protein, 10 aa, Borrelia burgdorferi B31
TASELKAIGK

SEQ ID NO: 68551 - protein, 10 aa, Borrelia burgdorferi B31
SALQLQEKFK

SEQ ID NO: 68552 - protein, 10 aa, Borrelia burgdorferi B31
KANENTKLKK

SEQ ID NO: 68553 - protein, 10 aa, Borrelia burgdorferi B31
KVLAEHFNKY

SEQ ID NO: 68554 - protein, 10 aa, Borrelia burgdorferi B31
ALQLQEKFKK

SEQ ID NO: 68555 - protein, 10 aa, Borrelia burgdorferi B31
LINNYENDPK

SEQ ID NO: 68556 - protein, 10 aa, Borrelia burgdorferi B31
RFLLSSLDYK

SEQ ID NO: 68557 - protein, 10 aa, Borrelia burgdorferi B31
LAEHFNKYYK

SEQ ID NO: 68558 - protein, 10 aa, Borrelia burgdorferi B31
FLLSSLDYKK

SEQ ID NO: 68559 - protein, 10 aa, Borrelia burgdorferi B31
IQLKLEKHLK

SEQ ID NO: 68560 - protein, 10 aa, Borrelia burgdorferi B31
ALDIQLKLEK

SEQ ID NO: 68561 - protein, 10 aa, Borrelia burgdorferi B31
AIGKELEDRK

SEQ ID NO: 68562 - protein, 10 aa, Borrelia burgdorferi B31
KLKKNTRLKK

SEQ ID NO: 68563 - protein, 10 aa, Borrelia burgdorferi B31
ICISCAPFNK

SEQ ID NO: 68564 - protein, 10 aa, Borrelia burgdorferi B31
FMGTTASELK

SEQ ID NO: 68565 - protein, 10 aa, Borrelia burgdorferi B31
CAPFNKINPK

SEQ ID NO: 68566 - protein, 10 aa, Borrelia burgdorferi B31
KTLNKTLEDY

SEQ ID NO: 68567 - protein, 10 aa, Borrelia burgdorferi B31
TLNKTLEDYR

SEQ ID NO: 68568 - protein, 11 aa, Borrelia burgdorferi B31
SINEKLDTLSK

SEQ ID NO: 68569 - protein, 11 aa, Borrelia burgdorferi B31
TTASELKAIGK

SEQ ID NO: 68570 - protein, 11 aa, Borrelia burgdorferi B31
LICISCAPFNK

SEQ ID NO: 68571 - protein, 11 aa, Borrelia burgdorferi B31
RAYELANENEK

SEQ ID NO: 68572 - protein, 11 aa, Borrelia burgdorferi B31
SALQLQEKFKK

SEQ ID NO: 68573 - protein, 11 aa, Borrelia burgdorferi B31
VLAEHFNKYYK

SEQ ID NO: 68574 - protein, 11 aa, Borrelia burgdorferi B31
IALDIQLKLEK

SEQ ID NO: 68575 - protein, 11 aa, Borrelia burgdorferi B31
KSALQLQEKFK

SEQ ID NO: 68576 - protein, 11 aa, Borrelia burgdorferi B31
TLNKTLEDYRK

SEQ ID NO: 68577 - protein, 11 aa, Borrelia burgdorferi B31
KLINNYENDPK

SEQ ID NO: 68578 - protein, 11 aa, Borrelia burgdorferi B31
KTLNKTLEDYR

SEQ ID NO: 68579 - protein, 11 aa, Borrelia burgdorferi B31
KSGDLGASDEK

SEQ ID NO: 68580 - protein, 11 aa, Borrelia burgdorferi B31
KINPKANENTK

SEQ ID NO: 68581 - protein, 11 aa, Borrelia burgdorferi B31
KFMGTTASELK

SEQ ID NO: 68582 - protein, 11 aa, Borrelia burgdorferi B31
LANENEKMLLK

SEQ ID NO: 68583 - protein, 11 aa, Borrelia burgdorferi B31
KAIGKELEDRK

SEQ ID NO: 68584 - protein, 11 aa, Borrelia burgdorferi B31
KVLAEHFNKYY

SEQ ID NO: 68585 - protein, 11 aa, Borrelia burgdorferi B31
RFLLSSLDYKK

SEQ ID NO: 68586 - protein, 11 aa, Borrelia burgdorferi B31
QVKSALQLQEK

SEQ ID NO: 68587 - protein, 11 aa, Borrelia burgdorferi B31
KLDTLSKENSK

SEQ ID NO: 68588 - protein, 11 aa, Borrelia burgdorferi B31
NTKLKKNTRLK

SEQ ID NO: 68589 - protein, 11 aa, Borrelia burgdorferi B31
NIETLKEILEK

SEQ ID NO: 68590 - protein, 11 aa, Borrelia burgdorferi B31
LQEKFKKTLNK

SEQ ID NO: 68591 - protein, 11 aa, Borrelia burgdorferi B31
DIQLKLEKHLK

SEQ ID NO: 68592 - protein, 11 aa, Borrelia burgdorferi B31
KRFLLSSLDYK

SEQ ID NO: 68593 - protein, 9 aa, Borrelia burgdorferi B31
DYRKNTNNI

SEQ ID NO: 68594 - protein, 9 aa, Borrelia burgdorferi B31
TYIRAYELA

SEQ ID NO: 68595 - protein, 9 aa, Borrelia burgdorferi B31
KYYKDSDSL

SEQ ID NO: 68596 - protein, 9 aa, Borrelia burgdorferi B31
QYDIQIAKI

SEQ ID NO: 68597 - protein, 10 aa, Borrelia burgdorferi B31
NFLYRIALDI

SEQ ID NO: 68598 - protein, 10 aa, Borrelia burgdorferi B31
DYKKENIETL

SEQ ID NO: 68599 - protein, 10 aa, Borrelia burgdorferi B31
KFMGTTASEL

SEQ ID NO: 68600 - protein, 10 aa, Borrelia burgdorferi B31
LYRIALDIQL

SEQ ID NO: 68601 - protein, 10 aa, Borrelia burgdorferi B31
ITMILTLICI

SEQ ID NO: 68602 - protein, 9 aa, Borrelia burgdorferi B31
VLAEHFNKY

SEQ ID NO: 68603 - protein, 9 aa, Borrelia burgdorferi B31
RFLLSSLDY

SEQ ID NO: 68604 - protein, 9 aa, Borrelia burgdorferi B31
PKIAANFLY

SEQ ID NO: 68605 - protein, 9 aa, Borrelia burgdorferi B31
LAEHFNKYY

SEQ ID NO: 68606 - protein, 9 aa, Borrelia burgdorferi B31
ILEKLINNY

SEQ ID NO: 68607 - protein, 10 aa, Borrelia burgdorferi B31
VLAEHFNKYY

SEQ ID NO: 68608 - protein, 10 aa, Borrelia burgdorferi B31
KVLAEHFNKY

SEQ ID NO: 68609 - protein, 10 aa, Borrelia burgdorferi B31
NLLDTYIRAY

SEQ ID NO: 68610 - protein, 10 aa, Borrelia burgdorferi B31
TLICISCAPF

SEQ ID NO: 68611 - protein, 10 aa, Borrelia burgdorferi B31
EILEKLINNY

SEQ ID NO: 68612 - protein, 11 aa, Borrelia burgdorferi B31
KVLAEHFNKYY

SEQ ID NO: 68613 - protein, 9 aa, Borrelia burgdorferi B31
NTNNIQENK

SEQ ID NO: 68614 - protein, 9 aa, Borrelia burgdorferi B31
ETLKEILEK

SEQ ID NO: 68615 - protein, 9 aa, Borrelia burgdorferi B31
NTKLKKNTR

SEQ ID NO: 68616 - protein, 9 aa, Borrelia burgdorferi B31
CISCAPFNK

SEQ ID NO: 68617 - protein, 9 aa, Borrelia burgdorferi B31
KIAANFLYR

SEQ ID NO: 68618 - protein, 9 aa, Borrelia burgdorferi B31
MGTTASELK

SEQ ID NO: 68619 - protein, 9 aa, Borrelia burgdorferi B31
NQYDIQIAK

SEQ ID NO: 68620 - protein, 9 aa, Borrelia burgdorferi B31
DTLSKENSK

SEQ ID NO: 68621 - protein, 9 aa, Borrelia burgdorferi B31
LLSSLDYKK

SEQ ID NO: 68622 - protein, 9 aa, Borrelia burgdorferi B31
FLLSSLDYK

SEQ ID NO: 68623 - protein, 9 aa, Borrelia burgdorferi B31
RIALDIQLK

SEQ ID NO: 68624 - protein, 9 aa, Borrelia burgdorferi B31
KVLAEHFNK

SEQ ID NO: 68625 - protein, 9 aa, Borrelia burgdorferi B31
DTYIRAYEL

SEQ ID NO: 68626 - protein, 9 aa, Borrelia burgdorferi B31
EKFKKTLNK

SEQ ID NO: 68627 - protein, 9 aa, Borrelia burgdorferi B31
ENEKMLLKR

SEQ ID NO: 68628 - protein, 9 aa, Borrelia burgdorferi B31
NPKANENTK

SEQ ID NO: 68629 - protein, 9 aa, Borrelia burgdorferi B31
ENIQNFKDK

SEQ ID NO: 68630 - protein, 9 aa, Borrelia burgdorferi B31
LNKTLEDYR

SEQ ID NO: 68631 - protein, 9 aa, Borrelia burgdorferi B31
QLKLEKHLK

SEQ ID NO: 68632 - protein, 9 aa, Borrelia burgdorferi B31
KSALQLQEK

SEQ ID NO: 68633 - protein, 9 aa, Borrelia burgdorferi B31
KANENTKLK

SEQ ID NO: 68634 - protein, 10 aa, Borrelia burgdorferi B31
ESNLLDTYIR

SEQ ID NO: 68635 - protein, 10 aa, Borrelia burgdorferi B31
TLNKTLEDYR

SEQ ID NO: 68636 - protein, 10 aa, Borrelia burgdorferi B31
TASELKAIGK

SEQ ID NO: 68637 - protein, 10 aa, Borrelia burgdorferi B31
LAEHFNKYYK

SEQ ID NO: 68638 - protein, 10 aa, Borrelia burgdorferi B31
LINNYENDPK

SEQ ID NO: 68639 - protein, 10 aa, Borrelia burgdorferi B31
CAPFNKINPK

SEQ ID NO: 68640 - protein, 10 aa, Borrelia burgdorferi B31
FMGTTASELK

SEQ ID NO: 68641 - protein, 10 aa, Borrelia burgdorferi B31
FLLSSLDYKK

SEQ ID NO: 68642 - protein, 10 aa, Borrelia burgdorferi B31
SALQLQEKFK

SEQ ID NO: 68643 - protein, 10 aa, Borrelia burgdorferi B31
ENTKLKKNTR

SEQ ID NO: 68644 - protein, 10 aa, Borrelia burgdorferi B31
NPGENIQNFK

SEQ ID NO: 68645 - protein, 10 aa, Borrelia burgdorferi B31
NKVLAEHFNK

SEQ ID NO: 68646 - protein, 10 aa, Borrelia burgdorferi B31
KAIGKELEDR

SEQ ID NO: 68647 - protein, 10 aa, Borrelia burgdorferi B31
ICISCAPFNK

SEQ ID NO: 68648 - protein, 10 aa, Borrelia burgdorferi B31
DTYIRAYELA

SEQ ID NO: 68649 - protein, 10 aa, Borrelia burgdorferi B31
DLEALLEQVK

SEQ ID NO: 68650 - protein, 11 aa, Borrelia burgdorferi B31
TTASELKAIGK

SEQ ID NO: 68651 - protein, 11 aa, Borrelia burgdorferi B31
NTKLKKNTRLK

SEQ ID NO: 68652 - protein, 11 aa, Borrelia burgdorferi B31
LICISCAPFNK

SEQ ID NO: 68653 - protein, 11 aa, Borrelia burgdorferi B31
RAYELANENEK

SEQ ID NO: 68654 - protein, 11 aa, Borrelia burgdorferi B31
DPKIAANFLYR

SEQ ID NO: 68655 - protein, 11 aa, Borrelia burgdorferi B31
QVKSALQLQEK

SEQ ID NO: 68656 - protein, 11 aa, Borrelia burgdorferi B31
KTLNKTLEDYR

SEQ ID NO: 68657 - protein, 11 aa, Borrelia burgdorferi B31
TLNKTLEDYRK

SEQ ID NO: 68658 - protein, 11 aa, Borrelia burgdorferi B31
LANENEKMLLK

SEQ ID NO: 68659 - protein, 11 aa, Borrelia burgdorferi B31
NIETLKEILEK

SEQ ID NO: 68660 - protein, 11 aa, Borrelia burgdorferi B31
VLAEHFNKYYK

SEQ ID NO: 68661 - protein, 11 aa, Borrelia burgdorferi B31
IALDIQLKLEK

SEQ ID NO: 68662 - protein, 11 aa, Borrelia burgdorferi B31
SALQLQEKFKK

SEQ ID NO: 68663 - protein, 11 aa, Borrelia burgdorferi B31
DIQLKLEKHLK

SEQ ID NO: 68664 - protein, 11 aa, Borrelia burgdorferi B31
EESNLLDTYIR

SEQ ID NO: 68665 - protein, 11 aa, Borrelia burgdorferi B31
SINEKLDTLSK

SEQ ID NO: 68666 - protein, 11 aa, Borrelia burgdorferi B31
ENKVLAEHFNK

SEQ ID NO: 68667 - protein, 11 aa, Borrelia burgdorferi B31
DYKKENIETLK

SEQ ID NO: 68668 - protein, 11 aa, Borrelia burgdorferi B31
NPKANENTKLK

SEQ ID NO: 68669 - protein, 11 aa, Borrelia burgdorferi B31
KSALQLQEKFK

SEQ ID NO: 68670 - protein, 11 aa, Borrelia burgdorferi B31
KFMGTTASELK

SEQ ID NO: 68671 - protein, 9 aa, Borrelia burgdorferi B31
KPANPGENI

SEQ ID NO: 68672 - protein, 10 aa, Borrelia burgdorferi B31
AANFLYRIAL

SEQ ID NO: 68673 - protein, 10 aa, Borrelia burgdorferi B31
NPKANENTKL

SEQ ID NO: 68674 - protein, 11 aa, Borrelia burgdorferi B31
IAANFLYRIAL

SEQ ID NO: 68675 - protein, 9 aa, Borrelia burgdorferi B31
FKKTLNKTL

SEQ ID NO: 68676 - protein, 9 aa, Borrelia burgdorferi B31
ELKAIGKEL

SEQ ID NO: 68677 - protein, 9 aa, Borrelia burgdorferi B31
HLKSINEKL

SEQ ID NO: 68678 - protein, 10 aa, Borrelia burgdorferi B31
LLKRFLLSSL

SEQ ID NO: 68679 - protein, 10 aa, Borrelia burgdorferi B31
QLQEKFKKTL

SEQ ID NO: 68680 - protein, 10 aa, Borrelia burgdorferi B31
KFKKTLNKTL

SEQ ID NO: 68681 - protein, 11 aa, Borrelia burgdorferi B31
MLLKRFLLSSL

SEQ ID NO: 68682 - protein, 11 aa, Borrelia burgdorferi B31
FLYRIALDIQL

SEQ ID NO: 68683 - protein, 11 aa, Borrelia burgdorferi B31
IIKINIITMIL

SEQ ID NO: 68684 - protein, 9 aa, Borrelia burgdorferi B31
VLAEHFNKY

SEQ ID NO: 68685 - protein, 9 aa, Borrelia burgdorferi B31
LICISCAPF

SEQ ID NO: 68686 - protein, 9 aa, Borrelia burgdorferi B31
RFLLSSLDY

SEQ ID NO: 68687 - protein, 9 aa, Borrelia burgdorferi B31
ILEKLINNY

SEQ ID NO: 68688 - protein, 9 aa, Borrelia burgdorferi B31
FMGTTASEL

SEQ ID NO: 68689 - protein, 9 aa, Borrelia burgdorferi B31
LLDTYIRAY

SEQ ID NO: 68690 - protein, 9 aa, Borrelia burgdorferi B31
TLNKTLEDY

SEQ ID NO: 68691 - protein, 10 aa, Borrelia burgdorferi B31
TLICISCAPF

SEQ ID NO: 68692 - protein, 10 aa, Borrelia burgdorferi B31
VLAEHFNKYY

SEQ ID NO: 68693 - protein, 10 aa, Borrelia burgdorferi B31
KVLAEHFNKY

SEQ ID NO: 68694 - protein, 10 aa, Borrelia burgdorferi B31
NLLDTYIRAY

SEQ ID NO: 68695 - protein, 10 aa, Borrelia burgdorferi B31
IQIAKITNEE

SEQ ID NO: 68696 - protein, 10 aa, Borrelia burgdorferi B31
LLKRFLLSSL

SEQ ID NO: 68697 - protein, 10 aa, Borrelia burgdorferi B31
IQENKVLAEH

SEQ ID NO: 68698 - protein, 10 aa, Borrelia burgdorferi B31
KTLNKTLEDY

SEQ ID NO: 68699 - protein, 11 aa, Borrelia burgdorferi B31
KVLAEHFNKYY

SEQ ID NO: 68700 - protein, 11 aa, Borrelia burgdorferi B31
IQENKVLAEHF

SEQ ID NO: 68701 - protein, 11 aa, Borrelia burgdorferi B31
LTLICISCAPF

SEQ ID NO: 68702 - protein, 11 aa, Borrelia burgdorferi B31
IQNFKDKSGDL

SEQ ID NO: 68703 - protein, 11 aa, Borrelia burgdorferi B31
YENDPKIAANF

SEQ ID NO: 68704 - protein, 11 aa, Borrelia burgdorferi B31
IQIAKITNEES

SEQ ID NO: 68705 - protein, 11 aa, Borrelia burgdorferi B31
FLYRIALDIQL

SEQ ID NO: 68706 - protein, 9 aa, Borrelia burgdorferi B31
YRIALDIQL

SEQ ID NO: 68707 - protein, 9 aa, Borrelia burgdorferi B31
NQYDIQIAK

SEQ ID NO: 68708 - protein, 9 aa, Borrelia burgdorferi B31
KRFLLSSLD

SEQ ID NO: 68709 - protein, 10 aa, Borrelia burgdorferi B31
KRFLLSSLDY

SEQ ID NO: 68710 - protein, 10 aa, Borrelia burgdorferi B31
YRIALDIQLK

SEQ ID NO: 68711 - protein, 11 aa, Borrelia burgdorferi B31
YRIALDIQLKL

SEQ ID NO: 68712 - protein, 11 aa, Borrelia burgdorferi B31
KRFLLSSLDYK

SEQ ID NO: 68713 - protein, 11 aa, Borrelia burgdorferi B31
RKNQYDIQIAK

SEQ ID NO: 68714 - protein, 9 aa, Borrelia burgdorferi B31
NPGENIQNF

SEQ ID NO: 68715 - protein, 9 aa, Borrelia burgdorferi B31
LLDTYIRAY

SEQ ID NO: 68716 - protein, 9 aa, Borrelia burgdorferi B31
LAEHFNKYY

SEQ ID NO: 68717 - protein, 9 aa, Borrelia burgdorferi B31
EESNLLDTY

SEQ ID NO: 68718 - protein, 9 aa, Borrelia burgdorferi B31
DPKIAANFL

SEQ ID NO: 68719 - protein, 9 aa, Borrelia burgdorferi B31
VLAEHFNKY

SEQ ID NO: 68720 - protein, 9 aa, Borrelia burgdorferi B31
LICISCAPF

SEQ ID NO: 68721 - protein, 9 aa, Borrelia burgdorferi B31
LANENEKML

SEQ ID NO: 68722 - protein, 9 aa, Borrelia burgdorferi B31
SALQLQEKF

SEQ ID NO: 68723 - protein, 9 aa, Borrelia burgdorferi B31
DSDSLQSAF

SEQ ID NO: 68724 - protein, 9 aa, Borrelia burgdorferi B31
NIITMILTL

SEQ ID NO: 68725 - protein, 9 aa, Borrelia burgdorferi B31
SDSLQSAFY

SEQ ID NO: 68726 - protein, 10 aa, Borrelia burgdorferi B31
DPKIAANFLY

SEQ ID NO: 68727 - protein, 10 aa, Borrelia burgdorferi B31
NLLDTYIRAY

SEQ ID NO: 68728 - protein, 10 aa, Borrelia burgdorferi B31
TLICISCAPF

SEQ ID NO: 68729 - protein, 10 aa, Borrelia burgdorferi B31
LANENEKMLL

SEQ ID NO: 68730 - protein, 10 aa, Borrelia burgdorferi B31
DSDSLQSAFY

SEQ ID NO: 68731 - protein, 10 aa, Borrelia burgdorferi B31
AANFLYRIAL

SEQ ID NO: 68732 - protein, 10 aa, Borrelia burgdorferi B31
NPKANENTKL

SEQ ID NO: 68733 - protein, 10 aa, Borrelia burgdorferi B31
NIIKINIITM

SEQ ID NO: 68734 - protein, 10 aa, Borrelia burgdorferi B31
VLAEHFNKYY

SEQ ID NO: 68735 - protein, 11 aa, Borrelia burgdorferi B31
IAANFLYRIAL

SEQ ID NO: 68736 - protein, 11 aa, Borrelia burgdorferi B31
EALLEQVKSAL

SEQ ID NO: 68737 - protein, 11 aa, Borrelia burgdorferi B31
YKDSDSLQSAF

SEQ ID NO: 68738 - protein, 11 aa, Borrelia burgdorferi B31
LTLICISCAPF

SEQ ID NO: 68739 - protein, 11 aa, Borrelia burgdorferi B31
NKVLAEHFNKY

SEQ ID NO: 68740 - protein, 11 aa, Borrelia burgdorferi B31
TNEESNLLDTY

SEQ ID NO: 68741 - protein, 11 aa, Borrelia burgdorferi B31
PANPGENIQNF

SEQ ID NO: 68742 - protein, 9 aa, Borrelia burgdorferi B31
KEILEKLIN

SEQ ID NO: 68743 - protein, 9 aa, Borrelia burgdorferi B31
EESNLLDTY

SEQ ID NO: 68744 - protein, 10 aa, Borrelia burgdorferi B31
SELKAIGKEL

SEQ ID NO: 68745 - protein, 10 aa, Borrelia burgdorferi B31
EESNLLDTYI

SEQ ID NO: 68746 - protein, 10 aa, Borrelia burgdorferi B31
KELEDRKNQY

SEQ ID NO: 68747 - protein, 10 aa, Borrelia burgdorferi B31
KEILEKLINN

SEQ ID NO: 68748 - protein, 10 aa, Borrelia burgdorferi B31
QENKVLAEHF

SEQ ID NO: 68749 - protein, 10 aa, Borrelia burgdorferi B31
KENSKEDLEA

SEQ ID NO: 68750 - protein, 10 aa, Borrelia burgdorferi B31
KEDLEALLEQ

SEQ ID NO: 68751 - protein, 11 aa, Borrelia burgdorferi B31
KEILEKLINNY

SEQ ID NO: 68752 - protein, 11 aa, Borrelia burgdorferi B31
YENDPKIAANF

SEQ ID NO: 68753 - protein, 11 aa, Borrelia burgdorferi B31
KENIETLKEIL

SEQ ID NO: 68754 - protein, 11 aa, Borrelia burgdorferi B31
NENEKMLLKRF

SEQ ID NO: 68755 - protein, 11 aa, Borrelia burgdorferi B31
AEHFNKYYKDS

SEQ ID NO: 68756 - protein, 9 aa, Borrelia burgdorferi B31
KPANPGENI

SEQ ID NO: 68757 - protein, 9 aa, Borrelia burgdorferi B31
IAANFLYRI

SEQ ID NO: 68758 - protein, 10 aa, Borrelia garinii PBi
QLEKHINENY

SEQ ID NO: 68759 - protein, 9 aa, Borrelia garinii PBi
FIYDIPIII

SEQ ID NO: 68760 - protein, 9 aa, Borrelia garinii PBi
ILQEILEKL

SEQ ID NO: 68761 - protein, 9 aa, Borrelia garinii PBi
TLICISCAV

SEQ ID NO: 68762 - protein, 9 aa, Borrelia garinii PBi
LLMRIESEL

SEQ ID NO: 68763 - protein, 9 aa, Borrelia garinii PBi
KLNILTTTL

SEQ ID NO: 68764 - protein, 9 aa, Borrelia garinii PBi
ILTTTLTLI

SEQ ID NO: 68765 - protein, 9 aa, Borrelia garinii PBi
SLNYETEKI

SEQ ID NO: 68766 - protein, 9 aa, Borrelia garinii PBi
NILTTTLTL

SEQ ID NO: 68767 - protein, 9 aa, Borrelia garinii PBi
KLNIIKLNI

SEQ ID NO: 68768 - protein, 9 aa, Borrelia garinii PBi
MQMKKIIYS

SEQ ID NO: 68769 - protein, 9 aa, Borrelia garinii PBi
KQNKDLEPL

SEQ ID NO: 68770 - protein, 9 aa, Borrelia garinii PBi
LTLICISCA

SEQ ID NO: 68771 - protein, 10 aa, Borrelia garinii PBi
KILQEILEKL

SEQ ID NO: 68772 - protein, 10 aa, Borrelia garinii PBi
ILNQKEIEEL

SEQ ID NO: 68773 - protein, 10 aa, Borrelia garinii PBi
LTLICISCAV

SEQ ID NO: 68774 - protein, 10 aa, Borrelia garinii PBi
KIAKNFIYDI

SEQ ID NO: 68775 - protein, 10 aa, Borrelia garinii PBi
KIDNTQIDFL

SEQ ID NO: 68776 - protein, 10 aa, Borrelia garinii PBi
NILTTTLTLI

SEQ ID NO: 68777 - protein, 10 aa, Borrelia garinii PBi
FIYDIPIIIQ

SEQ ID NO: 68778 - protein, 10 aa, Borrelia garinii PBi
KLNILTTTLT

SEQ ID NO: 68779 - protein, 10 aa, Borrelia garinii PBi
IIYSSLNYET

SEQ ID NO: 68780 - protein, 10 aa, Borrelia garinii PBi
TLTLICISCA

SEQ ID NO: 68781 - protein, 10 aa, Borrelia garinii PBi
KLNIIKLNIL

SEQ ID NO: 68782 - protein, 10 aa, Borrelia garinii PBi
QMKKIIYSSL

SEQ ID NO: 68783 - protein, 10 aa, Borrelia garinii PBi
MQMKKIIYSS

SEQ ID NO: 68784 - protein, 10 aa, Borrelia garinii PBi
LTTTLTLICI

SEQ ID NO: 68785 - protein, 11 aa, Borrelia garinii PBi
LLMRIESELKI

SEQ ID NO: 68786 - protein, 11 aa, Borrelia garinii PBi
MQMKKIIYSSL

SEQ ID NO: 68787 - protein, 11 aa, Borrelia garinii PBi
KLNILTTTLTL

SEQ ID NO: 68788 - protein, 11 aa, Borrelia garinii PBi
ILTTTLTLICI

SEQ ID NO: 68789 - protein, 11 aa, Borrelia garinii PBi
TLTLICISCAV

SEQ ID NO: 68790 - protein, 11 aa, Borrelia garinii PBi
FIYDIPIIIQS

SEQ ID NO: 68791 - protein, 11 aa, Borrelia garinii PBi
ILNQKEIEELL

SEQ ID NO: 68792 - protein, 11 aa, Borrelia garinii PBi
SLNYETEKIKI

SEQ ID NO: 68793 - protein, 11 aa, Borrelia garinii PBi
KLETTLKILEA

SEQ ID NO: 68794 - protein, 11 aa, Borrelia garinii PBi
KIIYSSLNYET

SEQ ID NO: 68795 - protein, 11 aa, Borrelia garinii PBi
KLNIIKLNILT

SEQ ID NO: 68796 - protein, 11 aa, Borrelia garinii PBi
QILNQKEIEEL

SEQ ID NO: 68797 - protein, 11 aa, Borrelia garinii PBi
KLDKNLQHKKI

SEQ ID NO: 68798 - protein, 9 aa, Borrelia garinii PBi
KIIYSSLNY

SEQ ID NO: 68799 - protein, 9 aa, Borrelia garinii PBi
KLDKNLQHK

SEQ ID NO: 68800 - protein, 9 aa, Borrelia garinii PBi
KILQEILEK

SEQ ID NO: 68801 - protein, 9 aa, Borrelia garinii PBi
KTSAEQLEK

SEQ ID NO: 68802 - protein, 9 aa, Borrelia garinii PBi
QIDFLKTFK

SEQ ID NO: 68803 - protein, 9 aa, Borrelia garinii PBi
KTNKKENIK

SEQ ID NO: 68804 - protein, 9 aa, Borrelia garinii PBi
ASKLETTLK

SEQ ID NO: 68805 - protein, 9 aa, Borrelia garinii PBi
KMQMKKIIY

SEQ ID NO: 68806 - protein, 9 aa, Borrelia garinii PBi
TLKILEAQK

SEQ ID NO: 68807 - protein, 9 aa, Borrelia garinii PBi
KILEAQKEK

SEQ ID NO: 68808 - protein, 9 aa, Borrelia garinii PBi
SSLNYETEK

SEQ ID NO: 68809 - protein, 9 aa, Borrelia garinii PBi
NLQHKKIAK

SEQ ID NO: 68810 - protein, 9 aa, Borrelia garinii PBi
LMRIESELK

SEQ ID NO: 68811 - protein, 9 aa, Borrelia garinii PBi
QSRLDIISK

SEQ ID NO: 68812 - protein, 9 aa, Borrelia garinii PBi
KIDPEPKSK

SEQ ID NO: 68813 - protein, 10 aa, Borrelia garinii PBi
LLMRIESELK

SEQ ID NO: 68814 - protein, 10 aa, Borrelia garinii PBi
TQIDFLKTFK

SEQ ID NO: 68815 - protein, 10 aa, Borrelia garinii PBi
RLDIISKVIK

SEQ ID NO: 68816 - protein, 10 aa, Borrelia garinii PBi
LICISCAVNK

SEQ ID NO: 68817 - protein, 10 aa, Borrelia garinii PBi
KENFKKALNK

SEQ ID NO: 68818 - protein, 10 aa, Borrelia garinii PBi
KNLQHKKIAK

SEQ ID NO: 68819 - protein, 10 aa, Borrelia garinii PBi
TTLKILEAQK

SEQ ID NO: 68820 - protein, 10 aa, Borrelia garinii PBi
TASKLETTLK

SEQ ID NO: 68821 - protein, 10 aa, Borrelia garinii PBi
SLNYETEKIK

SEQ ID NO: 68822 - protein, 10 aa, Borrelia garinii PBi
IQSRLDIISK

SEQ ID NO: 68823 - protein, 10 aa, Borrelia garinii PBi
KLDKNLQHKK

SEQ ID NO: 68824 - protein, 10 aa, Borrelia garinii PBi
KKIIYSSLNY

SEQ ID NO: 68825 - protein, 10 aa, Borrelia garinii PBi
YSSLNYETEK

SEQ ID NO: 68826 - protein, 10 aa, Borrelia garinii PBi
KENIKNFVNK

SEQ ID NO: 68827 - protein, 10 aa, Borrelia garinii PBi
ISKVIKNPIK

SEQ ID NO: 68828 - protein, 10 aa, Borrelia garinii PBi
KFQDLEPSKK

SEQ ID NO: 68829 - protein, 10 aa, Borrelia garinii PBi
ELKIKENFKK

SEQ ID NO: 68830 - protein, 10 aa, Borrelia garinii PBi
IKILQEILEK

SEQ ID NO: 68831 - protein, 10 aa, Borrelia garinii PBi
KALNKTIDAY

SEQ ID NO: 68832 - protein, 10 aa, Borrelia garinii PBi
IKTSAEQLEK

SEQ ID NO: 68833 - protein, 11 aa, Borrelia garinii PBi
TLICISCAVNK

SEQ ID NO: 68834 - protein, 11 aa, Borrelia garinii PBi
ATASKLETTLK

SEQ ID NO: 68835 - protein, 11 aa, Borrelia garinii PBi
IISKVIKNPIK

SEQ ID NO: 68836 - protein, 11 aa, Borrelia garinii PBi
IIQSRLDIISK

SEQ ID NO: 68837 - protein, 11 aa, Borrelia garinii PBi
KIDNTQIDFLK

SEQ ID NO: 68838 - protein, 11 aa, Borrelia garinii PBi
KIKILQEILEK

SEQ ID NO: 68839 - protein, 11 aa, Borrelia garinii PBi
ILQEILEKLDK

SEQ ID NO: 68840 - protein, 11 aa, Borrelia garinii PBi
QLEKHINENYK

SEQ ID NO: 68841 - protein, 11 aa, Borrelia garinii PBi
ELLMRIESELK

SEQ ID NO: 68842 - protein, 11 aa, Borrelia garinii PBi
NTQIDFLKTFK

SEQ ID NO: 68843 - protein, 11 aa, Borrelia garinii PBi
TLKILEAQKEK

SEQ ID NO: 68844 - protein, 11 aa, Borrelia garinii PBi
NIKTSAEQLEK

SEQ ID NO: 68845 - protein, 11 aa, Borrelia garinii PBi
LMRIESELKIK

SEQ ID NO: 68846 - protein, 9 aa, Borrelia garinii PBi
KTSAEQLEK

SEQ ID NO: 68847 - protein, 9 aa, Borrelia garinii PBi
SSLNYETEK

SEQ ID NO: 68848 - protein, 9 aa, Borrelia garinii PBi
KILQEILEK

SEQ ID NO: 68849 - protein, 9 aa, Borrelia garinii PBi
KIIYSSLNY

SEQ ID NO: 68850 - protein, 9 aa, Borrelia garinii PBi
ASKLETTLK

SEQ ID NO: 68851 - protein, 9 aa, Borrelia garinii PBi
QIDFLKTFK

SEQ ID NO: 68852 - protein, 9 aa, Borrelia garinii PBi
KTNKKENIK

SEQ ID NO: 68853 - protein, 9 aa, Borrelia garinii PBi
KILEAQKEK

SEQ ID NO: 68854 - protein, 9 aa, Borrelia garinii PBi
KFQDLEPSK

SEQ ID NO: 68855 - protein, 9 aa, Borrelia garinii PBi
TLKILEAQK

SEQ ID NO: 68856 - protein, 9 aa, Borrelia garinii PBi
KLDKNLQHK

SEQ ID NO: 68857 - protein, 9 aa, Borrelia garinii PBi
QSRLDIISK

SEQ ID NO: 68858 - protein, 9 aa, Borrelia garinii PBi
NLQHKKIAK

SEQ ID NO: 68859 - protein, 9 aa, Borrelia garinii PBi
KIDPEPKSK

SEQ ID NO: 68860 - protein, 9 aa, Borrelia garinii PBi
RIESELKIK

SEQ ID NO: 68861 - protein, 9 aa, Borrelia garinii PBi
KMQMKKIIY

SEQ ID NO: 68862 - protein, 9 aa, Borrelia garinii PBi
ICISCAVNK

SEQ ID NO: 68863 - protein, 10 aa, Borrelia garinii PBi
TQIDFLKTFK

SEQ ID NO: 68864 - protein, 10 aa, Borrelia garinii PBi
TTLKILEAQK

SEQ ID NO: 68865 - protein, 10 aa, Borrelia garinii PBi
AVNKIDPEPK

SEQ ID NO: 68866 - protein, 10 aa, Borrelia garinii PBi
TASKLETTLK

SEQ ID NO: 68867 - protein, 10 aa, Borrelia garinii PBi
LICISCAVNK

SEQ ID NO: 68868 - protein, 10 aa, Borrelia garinii PBi
LLMRIESELK

SEQ ID NO: 68869 - protein, 10 aa, Borrelia garinii PBi
IQSRLDIISK

SEQ ID NO: 68870 - protein, 10 aa, Borrelia garinii PBi
YSSLNYETEK

SEQ ID NO: 68871 - protein, 10 aa, Borrelia garinii PBi
SLNYETEKIK

SEQ ID NO: 68872 - protein, 10 aa, Borrelia garinii PBi
KLDKNLQHKK

SEQ ID NO: 68873 - protein, 10 aa, Borrelia garinii PBi
KFQDLEPSKK

SEQ ID NO: 68874 - protein, 10 aa, Borrelia garinii PBi
ISKVIKNPIK

SEQ ID NO: 68875 - protein, 10 aa, Borrelia garinii PBi
KQNKDLEPLR

SEQ ID NO: 68876 - protein, 10 aa, Borrelia garinii PBi
RLDIISKVIK

SEQ ID NO: 68877 - protein, 10 aa, Borrelia garinii PBi
KENIKNFVNK

SEQ ID NO: 68878 - protein, 10 aa, Borrelia garinii PBi
KENFKKALNK

SEQ ID NO: 68879 - protein, 10 aa, Borrelia garinii PBi
AYNQDSENIK

SEQ ID NO: 68880 - protein, 11 aa, Borrelia garinii PBi
ATASKLETTLK

SEQ ID NO: 68881 - protein, 11 aa, Borrelia garinii PBi
TLICISCAVNK

SEQ ID NO: 68882 - protein, 11 aa, Borrelia garinii PBi
IIQSRLDIISK

SEQ ID NO: 68883 - protein, 11 aa, Borrelia garinii PBi
NTQIDFLKTFK

SEQ ID NO: 68884 - protein, 11 aa, Borrelia garinii PBi
KIDNTQIDFLK

SEQ ID NO: 68885 - protein, 11 aa, Borrelia garinii PBi
SSLNYETEKIK

SEQ ID NO: 68886 - protein, 11 aa, Borrelia garinii PBi
IISKVIKNPIK

SEQ ID NO: 68887 - protein, 11 aa, Borrelia garinii PBi
KIKILQEILEK

SEQ ID NO: 68888 - protein, 11 aa, Borrelia garinii PBi
ILQEILEKLDK

SEQ ID NO: 68889 - protein, 11 aa, Borrelia garinii PBi
ETTLKILEAQK

SEQ ID NO: 68890 - protein, 11 aa, Borrelia garinii PBi
NIKTSAEQLEK

SEQ ID NO: 68891 - protein, 11 aa, Borrelia garinii PBi
CAVNKIDPEPK

SEQ ID NO: 68892 - protein, 11 aa, Borrelia garinii PBi
IYSSLNYETEK

SEQ ID NO: 68893 - protein, 11 aa, Borrelia garinii PBi
ELLMRIESELK

SEQ ID NO: 68894 - protein, 11 aa, Borrelia garinii PBi
SLPEDEKMQMK

SEQ ID NO: 68895 - protein, 11 aa, Borrelia garinii PBi
TLKILEAQKEK

SEQ ID NO: 68896 - protein, 11 aa, Borrelia garinii PBi
KSKTNKKENIK

SEQ ID NO: 68897 - protein, 11 aa, Borrelia garinii PBi
QLEKHINENYK

SEQ ID NO: 68898 - protein, 9 aa, Borrelia garinii PBi
NFIYDIPII

SEQ ID NO: 68899 - protein, 9 aa, Borrelia garinii PBi
AYNQDSENI

SEQ ID NO: 68900 - protein, 9 aa, Borrelia garinii PBi
NYETEKIKI

SEQ ID NO: 68901 - protein, 9 aa, Borrelia garinii PBi
IYSSLNYET

SEQ ID NO: 68902 - protein, 9 aa, Borrelia garinii PBi
KYPEATASK

SEQ ID NO: 68903 - protein, 10 aa, Borrelia garinii PBi
KYPEATASKL

SEQ ID NO: 68904 - protein, 10 aa, Borrelia garinii PBi
NFIYDIPIII

SEQ ID NO: 68905 - protein, 10 aa, Borrelia garinii PBi
IYSSLNYETE

SEQ ID NO: 68906 - protein, 11 aa, Borrelia garinii PBi
NYKEFNSLKPI

SEQ ID NO: 68907 - protein, 11 aa, Borrelia garinii PBi
IYSSLNYETEK

SEQ ID NO: 68908 - protein, 9 aa, Borrelia garinii PBi
KIIYSSLNY

SEQ ID NO: 68909 - protein, 9 aa, Borrelia garinii PBi
EFNSLKPIY

SEQ ID NO: 68910 - protein, 9 aa, Borrelia garinii PBi
KKIAKNFIY

SEQ ID NO: 68911 - protein, 9 aa, Borrelia garinii PBi
KMQMKKIIY

SEQ ID NO: 68912 - protein, 9 aa, Borrelia garinii PBi
DLEPLREKY

SEQ ID NO: 68913 - protein, 11 aa, Borrelia garinii PBi
YKEFNSLKPIY

SEQ ID NO: 68914 - protein, 9 aa, Borrelia garinii PBi
DNTQIDFLK

SEQ ID NO: 68915 - protein, 9 aa, Borrelia garinii PBi
DIPIIIQSR

SEQ ID NO: 68916 - protein, 9 aa, Borrelia garinii PBi
NYKEFNSLK

SEQ ID NO: 68917 - protein, 9 aa, Borrelia garinii PBi
QIDFLKTFK

SEQ ID NO: 68918 - protein, 9 aa, Borrelia garinii PBi
ENIKNFVNK

SEQ ID NO: 68919 - protein, 9 aa, Borrelia garinii PBi
SSLNYETEK

SEQ ID NO: 68920 - protein, 9 aa, Borrelia garinii PBi
TLKILEAQK

SEQ ID NO: 68921 - protein, 9 aa, Borrelia garinii PBi
ELKIKENFK

SEQ ID NO: 68922 - protein, 9 aa, Borrelia garinii PBi
ENFKKALNK

SEQ ID NO: 68923 - protein, 9 aa, Borrelia garinii PBi
KTSAEQLEK

SEQ ID NO: 68924 - protein, 9 aa, Borrelia garinii PBi
ETEKIKILQ

SEQ ID NO: 68925 - protein, 9 aa, Borrelia garinii PBi
QNKDLEPLR

SEQ ID NO: 68926 - protein, 9 aa, Borrelia garinii PBi
EPKSKTNKK

SEQ ID NO: 68927 - protein, 9 aa, Borrelia garinii PBi
EKHINENYK

SEQ ID NO: 68928 - protein, 9 aa, Borrelia garinii PBi
EIAKIDNTQ

SEQ ID NO: 68929 - protein, 9 aa, Borrelia garinii PBi
EKENIEIAK

SEQ ID NO: 68930 - protein, 10 aa, Borrelia garinii PBi
TTLKILEAQK

SEQ ID NO: 68931 - protein, 10 aa, Borrelia garinii PBi
TASKLETTLK

SEQ ID NO: 68932 - protein, 10 aa, Borrelia garinii PBi
YSSLNYETEK

SEQ ID NO: 68933 - protein, 10 aa, Borrelia garinii PBi
ENYKEFNSLK

SEQ ID NO: 68934 - protein, 10 aa, Borrelia garinii PBi
TQIDFLKTFK

SEQ ID NO: 68935 - protein, 10 aa, Borrelia garinii PBi
LLMRIESELK

SEQ ID NO: 68936 - protein, 10 aa, Borrelia garinii PBi
LICISCAVNK

SEQ ID NO: 68937 - protein, 10 aa, Borrelia garinii PBi
YDIPIIIQSR

SEQ ID NO: 68938 - protein, 10 aa, Borrelia garinii PBi
EKYPEATASK

SEQ ID NO: 68939 - protein, 10 aa, Borrelia garinii PBi
ELKIKENFKK

SEQ ID NO: 68940 - protein, 10 aa, Borrelia garinii PBi
AVNKIDPEPK

SEQ ID NO: 68941 - protein, 10 aa, Borrelia garinii PBi
ISKVIKNPIK

SEQ ID NO: 68942 - protein, 10 aa, Borrelia garinii PBi
ETTLKILEAQ

SEQ ID NO: 68943 - protein, 10 aa, Borrelia garinii PBi
SLNYETEKIK

SEQ ID NO: 68944 - protein, 10 aa, Borrelia garinii PBi
IDNTQIDFLK

SEQ ID NO: 68945 - protein, 11 aa, Borrelia garinii PBi
ETTLKILEAQK

SEQ ID NO: 68946 - protein, 11 aa, Borrelia garinii PBi
TLICISCAVNK

SEQ ID NO: 68947 - protein, 11 aa, Borrelia garinii PBi
NTQIDFLKTFK

SEQ ID NO: 68948 - protein, 11 aa, Borrelia garinii PBi
DAYNQDSENIK

SEQ ID NO: 68949 - protein, 11 aa, Borrelia garinii PBi
ATASKLETTLK

SEQ ID NO: 68950 - protein, 11 aa, Borrelia garinii PBi
ESELKIKENFK

SEQ ID NO: 68951 - protein, 11 aa, Borrelia garinii PBi
NIKTSAEQLEK

SEQ ID NO: 68952 - protein, 11 aa, Borrelia garinii PBi
IYSSLNYETEK

SEQ ID NO: 68953 - protein, 11 aa, Borrelia garinii PBi
ELLMRIESELK

SEQ ID NO: 68954 - protein, 11 aa, Borrelia garinii PBi
IISKVIKNPIK

SEQ ID NO: 68955 - protein, 11 aa, Borrelia garinii PBi
CAVNKIDPEPK

SEQ ID NO: 68956 - protein, 11 aa, Borrelia garinii PBi
NENYKEFNSLK

SEQ ID NO: 68957 - protein, 11 aa, Borrelia garinii PBi
TLKILEAQKEK

SEQ ID NO: 68958 - protein, 11 aa, Borrelia garinii PBi
NQKEIEELLMR

SEQ ID NO: 68959 - protein, 11 aa, Borrelia garinii PBi
DPHDSLPEDEK

SEQ ID NO: 68960 - protein, 11 aa, Borrelia garinii PBi
IIQSRLDIISK

SEQ ID NO: 68961 - protein, 11 aa, Borrelia garinii PBi
QLEKHINENYK

SEQ ID NO: 68962 - protein, 11 aa, Borrelia garinii PBi
SSLNYETEKIK

SEQ ID NO: 68963 - protein, 9 aa, Borrelia garinii PBi
YPEATASKL

SEQ ID NO: 68964 - protein, 9 aa, Borrelia garinii PBi
IPIIIQSRL

SEQ ID NO: 68965 - protein, 9 aa, Borrelia garinii PBi
LPEDEKMQM

SEQ ID NO: 68966 - protein, 10 aa, Borrelia garinii PBi
KIKENFKKAL

SEQ ID NO: 68967 - protein, 10 aa, Borrelia garinii PBi
EPSKKQNKDL

SEQ ID NO: 68968 - protein, 10 aa, Borrelia garinii PBi
NPIKDELQIL

SEQ ID NO: 68969 - protein, 11 aa, Borrelia garinii PBi
IPIIIQSRLDI

SEQ ID NO: 68970 - protein, 11 aa, Borrelia garinii PBi
YPEATASKLET

SEQ ID NO: 68971 - protein, 9 aa, Borrelia garinii PBi
MKKIIYSSL

SEQ ID NO: 68972 - protein, 9 aa, Borrelia garinii PBi
FKKALNKTI

SEQ ID NO: 68973 - protein, 9 aa, Borrelia garinii PBi
KIKILQEIL

SEQ ID NO: 68974 - protein, 10 aa, Borrelia garinii PBi
QMKKIIYSSL

SEQ ID NO: 68975 - protein, 10 aa, Borrelia garinii PBi
KIKENFKKAL

SEQ ID NO: 68976 - protein, 11 aa, Borrelia garinii PBi
IIKLNILTTTL

SEQ ID NO: 68977 - protein, 9 aa, Borrelia garinii PBi
TQIDFLKTF

SEQ ID NO: 68978 - protein, 9 aa, Borrelia garinii PBi
KIIYSSLNY

SEQ ID NO: 68979 - protein, 9 aa, Borrelia garinii PBi
ALNKTIDAY

SEQ ID NO: 68980 - protein, 9 aa, Borrelia garinii PBi
KMQMKKIIY

SEQ ID NO: 68981 - protein, 9 aa, Borrelia garinii PBi
HINENYKEF

SEQ ID NO: 68982 - protein, 9 aa, Borrelia garinii PBi
KQNKDLEPL

SEQ ID NO: 68983 - protein, 9 aa, Borrelia garinii PBi
LQILNQKEI

SEQ ID NO: 68984 - protein, 9 aa, Borrelia garinii PBi
KLNILTTTL

SEQ ID NO: 68985 - protein, 9 aa, Borrelia garinii PBi
KKIAKNFIY

SEQ ID NO: 68986 - protein, 10 aa, Borrelia garinii PBi
LQHKKIAKNF

SEQ ID NO: 68987 - protein, 10 aa, Borrelia garinii PBi
QMKKIIYSSL

SEQ ID NO: 68988 - protein, 10 aa, Borrelia garinii PBi
KALNKTIDAY

SEQ ID NO: 68989 - protein, 10 aa, Borrelia garinii PBi
AQKEKENIEI

SEQ ID NO: 68990 - protein, 10 aa, Borrelia garinii PBi
NQKEIEELLM

SEQ ID NO: 68991 - protein, 10 aa, Borrelia garinii PBi
QLEKHINENY

SEQ ID NO: 68992 - protein, 11 aa, Borrelia garinii PBi
MQMKKIIYSSL

SEQ ID NO: 68993 - protein, 11 aa, Borrelia garinii PBi
EQLEKHINENY

SEQ ID NO: 68994 - protein, 11 aa, Borrelia garinii PBi
KLNILTTTLTL

SEQ ID NO: 68995 - protein, 11 aa, Borrelia garinii PBi
IAKIDNTQIDF

SEQ ID NO: 68996 - protein, 9 aa, Borrelia garinii PBi
SRLDIISKV

SEQ ID NO: 68997 - protein, 9 aa, Borrelia garinii PBi
MRIESELKI

SEQ ID NO: 68998 - protein, 10 aa, Borrelia garinii PBi
MRIESELKIK

SEQ ID NO: 68999 - protein, 10 aa, Borrelia garinii PBi
SRLDIISKVI

SEQ ID NO: 69000 - protein, 11 aa, Borrelia garinii PBi
SRLDIISKVIK

SEQ ID NO: 69001 - protein, 11 aa, Borrelia garinii PBi
MQMKKIIYSSL

SEQ ID NO: 69002 - protein, 9 aa, Borrelia garinii PBi
LPEDEKMQM

SEQ ID NO: 69003 - protein, 9 aa, Borrelia garinii PBi
YPEATASKL

SEQ ID NO: 69004 - protein, 9 aa, Borrelia garinii PBi
EFNSLKPIY

SEQ ID NO: 69005 - protein, 9 aa, Borrelia garinii PBi
TASKLETTL

SEQ ID NO: 69006 - protein, 9 aa, Borrelia garinii PBi
IPIIIQSRL

SEQ ID NO: 69007 - protein, 10 aa, Borrelia garinii PBi
KALNKTIDAY

SEQ ID NO: 69008 - protein, 10 aa, Borrelia garinii PBi
NPIKDELQIL

SEQ ID NO: 69009 - protein, 10 aa, Borrelia garinii PBi
EKMQMKKIIY

SEQ ID NO: 69010 - protein, 11 aa, Borrelia garinii PBi
YPEATASKLET

SEQ ID NO: 69011 - protein, 11 aa, Borrelia garinii PBi
EPLREKYPEAT

SEQ ID NO: 69012 - protein, 11 aa, Borrelia garinii PBi
YKEFNSLKPIY

SEQ ID NO: 69013 - protein, 11 aa, Borrelia garinii PBi
EATASKLETTL

SEQ ID NO: 69014 - protein, 9 aa, Borrelia garinii PBi
EELLMRIES

SEQ ID NO: 69015 - protein, 9 aa, Borrelia garinii PBi
SELKIKENF

SEQ ID NO: 69016 - protein, 9 aa, Borrelia garinii PBi
KEIEELLMR

SEQ ID NO: 69017 - protein, 9 aa, Borrelia garinii PBi
KEFNSLKPI

SEQ ID NO: 69018 - protein, 10 aa, Borrelia garinii PBi
KEFNSLKPIY

SEQ ID NO: 69019 - protein, 10 aa, Borrelia garinii PBi
KEIEELLMRI

SEQ ID NO: 69020 - protein, 11 aa, Borrelia garinii PBi
QEILEKLDKNL

SEQ ID NO: 69021 - protein, 11 aa, Borrelia garinii PBi
EELLMRIESEL

SEQ ID NO: 69022 - protein, 11 aa, Borrelia garinii PBi
SENIKTSAEQL

SEQ ID NO: 69023 - protein, 11 aa, Borrelia garinii PBi
KENIKNFVNKF

SEQ ID NO: 69024 - protein, 9 aa, Borrelia garinii PBi
IPIIIQSRL

SEQ ID NO: 69025 - protein, 9 aa, Borrelia garinii PBi
NPIKDELQI

SEQ ID NO: 69026 - protein, 11 aa, Borrelia garinii PBi
IPIIIQSRLDI

SEQ ID NO: 69027 - protein, 9 aa, Borrelia burgdorferi B31
PVSDYNEEY

SEQ ID NO: 69028 - protein, 9 aa, Borrelia burgdorferi B31
FMRIVRWLY

SEQ ID NO: 69029 - protein, 9 aa, Borrelia burgdorferi B31
VSDYNEEYF

SEQ ID NO: 69030 - protein, 10 aa, Borrelia burgdorferi B31
YSGEEGSPEY

SEQ ID NO: 69031 - protein, 10 aa, Borrelia burgdorferi B31
SSDMGSDEIV

SEQ ID NO: 69032 - protein, 11 aa, Borrelia burgdorferi B31
YSGEEGSPEYY

SEQ ID NO: 69033 - protein, 11 aa, Borrelia burgdorferi B31
GSDEIVTEGIF

SEQ ID NO: 69034 - protein, 9 aa, Borrelia burgdorferi B31
WLYSCIEEL

SEQ ID NO: 69035 - protein, 9 aa, Borrelia burgdorferi B31
KLYASEHRL

SEQ ID NO: 69036 - protein, 9 aa, Borrelia burgdorferi B31
YLPDNQEQA

SEQ ID NO: 69037 - protein, 9 aa, Borrelia burgdorferi B31
ILVGVCIIA

SEQ ID NO: 69038 - protein, 9 aa, Borrelia burgdorferi B31
ALALLGCYL

SEQ ID NO: 69039 - protein, 9 aa, Borrelia burgdorferi B31
YASEHRLLV

SEQ ID NO: 69040 - protein, 9 aa, Borrelia burgdorferi B31
LVGVCIIAL

SEQ ID NO: 69041 - protein, 9 aa, Borrelia burgdorferi B31
LLVEIKKTL

SEQ ID NO: 69042 - protein, 9 aa, Borrelia burgdorferi B31
DLIKLFIMV

SEQ ID NO: 69043 - protein, 9 aa, Borrelia burgdorferi B31
TAYQQYLKV

SEQ ID NO: 69044 - protein, 10 aa, Borrelia burgdorferi B31
YLPDNQEQAV

SEQ ID NO: 69045 - protein, 10 aa, Borrelia burgdorferi B31
ILVGVCIIAL

SEQ ID NO: 69046 - protein, 10 aa, Borrelia burgdorferi B31
KLYASEHRLL

SEQ ID NO: 69047 - protein, 10 aa, Borrelia burgdorferi B31
LLVEIKKTLI

SEQ ID NO: 69048 - protein, 10 aa, Borrelia burgdorferi B31
GIFSSLKLYA

SEQ ID NO: 69049 - protein, 10 aa, Borrelia burgdorferi B31
IVTEGIFSSL

SEQ ID NO: 69050 - protein, 10 aa, Borrelia burgdorferi B31
RIVRWLYSCI

SEQ ID NO: 69051 - protein, 10 aa, Borrelia burgdorferi B31
SLKDPNYRGV

SEQ ID NO: 69052 - protein, 10 aa, Borrelia burgdorferi B31
RLLVEIKKTL

SEQ ID NO: 69053 - protein, 10 aa, Borrelia burgdorferi B31
LVGVCIIALA

SEQ ID NO: 69054 - protein, 10 aa, Borrelia burgdorferi B31
RILVGVCIIA

SEQ ID NO: 69055 - protein, 11 aa, Borrelia burgdorferi B31
KLYASEHRLLV

SEQ ID NO: 69056 - protein, 11 aa, Borrelia burgdorferi B31
ILVGVCIIALA

SEQ ID NO: 69057 - protein, 11 aa, Borrelia burgdorferi B31
RILVGVCIIAL

SEQ ID NO: 69058 - protein, 11 aa, Borrelia burgdorferi B31
WLYSCIEELYS

SEQ ID NO: 69059 - protein, 11 aa, Borrelia burgdorferi B31
YASEHRLLVEI

SEQ ID NO: 69060 - protein, 11 aa, Borrelia burgdorferi B31
RLLVEIKKTLI

SEQ ID NO: 69061 - protein, 11 aa, Borrelia burgdorferi B31
IIALALLGCYL

SEQ ID NO: 69062 - protein, 9 aa, Borrelia burgdorferi B31
LIKLFIMVK

SEQ ID NO: 69063 - protein, 9 aa, Borrelia burgdorferi B31
GIFSSLKLY

SEQ ID NO: 69064 - protein, 9 aa, Borrelia burgdorferi B31
PTAYQQYLK

SEQ ID NO: 69065 - protein, 9 aa, Borrelia burgdorferi B31
ELYSPDIKY

SEQ ID NO: 69066 - protein, 10 aa, Borrelia burgdorferi B31
VTEGIFSSLK

SEQ ID NO: 69067 - protein, 10 aa, Borrelia burgdorferi B31
KFMRIVRWLY

SEQ ID NO: 69068 - protein, 10 aa, Borrelia burgdorferi B31
RPTAYQQYLK

SEQ ID NO: 69069 - protein, 10 aa, Borrelia burgdorferi B31
DLIKLFIMVK

SEQ ID NO: 69070 - protein, 10 aa, Borrelia burgdorferi B31
TAYQQYLKVK

SEQ ID NO: 69071 - protein, 10 aa, Borrelia burgdorferi B31
SLKLYASEHR

SEQ ID NO: 69072 - protein, 10 aa, Borrelia burgdorferi B31
FLDLGSEQSK

SEQ ID NO: 69073 - protein, 10 aa, Borrelia burgdorferi B31
IIALALLGCY

SEQ ID NO: 69074 - protein, 10 aa, Borrelia burgdorferi B31
EIKKTLISLK

SEQ ID NO: 69075 - protein, 10 aa, Borrelia burgdorferi B31
WLYSCIEELY

SEQ ID NO: 69076 - protein, 10 aa, Borrelia burgdorferi B31
MVKNEQNNNK

SEQ ID NO: 69077 - protein, 10 aa, Borrelia burgdorferi B31
SDYNEEYFNK

SEQ ID NO: 69078 - protein, 11 aa, Borrelia burgdorferi B31
IVTEGIFSSLK

SEQ ID NO: 69079 - protein, 11 aa, Borrelia burgdorferi B31
KLYASEHRLLV

SEQ ID NO: 69080 - protein, 11 aa, Borrelia burgdorferi B31
IMVKNEQNNNK

SEQ ID NO: 69081 - protein, 11 aa, Borrelia burgdorferi B31
CIIALALLGCY

SEQ ID NO: 69082 - protein, 11 aa, Borrelia burgdorferi B31
TAYQQYLKVKR

SEQ ID NO: 69083 - protein, 9 aa, Borrelia burgdorferi B31
LIKLFIMVK

SEQ ID NO: 69084 - protein, 9 aa, Borrelia burgdorferi B31
PTAYQQYLK

SEQ ID NO: 69085 - protein, 9 aa, Borrelia burgdorferi B31
GIFSSLKLY

SEQ ID NO: 69086 - protein, 9 aa, Borrelia burgdorferi B31
IALALLGCY

SEQ ID NO: 69087 - protein, 9 aa, Borrelia burgdorferi B31
KVKRYDYNR

SEQ ID NO: 69088 - protein, 9 aa, Borrelia burgdorferi B31
ISLKDPNYR

SEQ ID NO: 69089 - protein, 9 aa, Borrelia burgdorferi B31
TEGIFSSLK

SEQ ID NO: 69090 - protein, 9 aa, Borrelia burgdorferi B31
AYQQYLKVK

SEQ ID NO: 69091 - protein, 10 aa, Borrelia burgdorferi B31
VTEGIFSSLK

SEQ ID NO: 69092 - protein, 10 aa, Borrelia burgdorferi B31
TAYQQYLKVK

SEQ ID NO: 69093 - protein, 10 aa, Borrelia burgdorferi B31
MVKNEQNNNK

SEQ ID NO: 69094 - protein, 10 aa, Borrelia burgdorferi B31
DLIKLFIMVK

SEQ ID NO: 69095 - protein, 10 aa, Borrelia burgdorferi B31
SDYNEEYFNK

SEQ ID NO: 69096 - protein, 10 aa, Borrelia burgdorferi B31
RPTAYQQYLK

SEQ ID NO: 69097 - protein, 10 aa, Borrelia burgdorferi B31
GSEQSKDLIK

SEQ ID NO: 69098 - protein, 10 aa, Borrelia burgdorferi B31
IIALALLGCY

SEQ ID NO: 69099 - protein, 10 aa, Borrelia burgdorferi B31
EIKKTLISLK

SEQ ID NO: 69100 - protein, 10 aa, Borrelia burgdorferi B31
TLISLKDPNY

SEQ ID NO: 69101 - protein, 10 aa, Borrelia burgdorferi B31
LISLKDPNYR

SEQ ID NO: 69102 - protein, 10 aa, Borrelia burgdorferi B31
KFMRIVRWLY

SEQ ID NO: 69103 - protein, 11 aa, Borrelia burgdorferi B31
IVTEGIFSSLK

SEQ ID NO: 69104 - protein, 11 aa, Borrelia burgdorferi B31
ASEHRLLVEIK

SEQ ID NO: 69105 - protein, 11 aa, Borrelia burgdorferi B31
VSDYNEEYFNK

SEQ ID NO: 69106 - protein, 11 aa, Borrelia burgdorferi B31
TAYQQYLKVKR

SEQ ID NO: 69107 - protein, 11 aa, Borrelia burgdorferi B31
TLISLKDPNYR

SEQ ID NO: 69108 - protein, 11 aa, Borrelia burgdorferi B31
SSLKLYASEHR

SEQ ID NO: 69109 - protein, 11 aa, Borrelia burgdorferi B31
CIIALALLGCY

SEQ ID NO: 69110 - protein, 11 aa, Borrelia burgdorferi B31
KTLISLKDPNY

SEQ ID NO: 69111 - protein, 11 aa, Borrelia burgdorferi B31
IMVKNEQNNNK

SEQ ID NO: 69112 - protein, 11 aa, Borrelia burgdorferi B31
PTAYQQYLKVK

SEQ ID NO: 69113 - protein, 11 aa, Borrelia burgdorferi B31
GSPEYYRNMPR

SEQ ID NO: 69114 - protein, 11 aa, Borrelia burgdorferi B31
CIEELYSPDIK

SEQ ID NO: 69115 - protein, 11 aa, Borrelia burgdorferi B31
KDLIKLFIMVK

SEQ ID NO: 69116 - protein, 9 aa, Borrelia burgdorferi B31
LYASEHRLL

SEQ ID NO: 69117 - protein, 9 aa, Borrelia burgdorferi B31
KFMRIVRWL

SEQ ID NO: 69118 - protein, 9 aa, Borrelia burgdorferi B31
DYNRPVPIL

SEQ ID NO: 69119 - protein, 9 aa, Borrelia burgdorferi B31
DYNEEYFNK

SEQ ID NO: 69120 - protein, 9 aa, Borrelia burgdorferi B31
NYRGVVLPV

SEQ ID NO: 69121 - protein, 10 aa, Borrelia burgdorferi B31
DYNEEYFNKF

SEQ ID NO: 69122 - protein, 10 aa, Borrelia burgdorferi B31
RYDYNRPVPI

SEQ ID NO: 69123 - protein, 10 aa, Borrelia burgdorferi B31
EYFNKFFLDL

SEQ ID NO: 69124 - protein, 10 aa, Borrelia burgdorferi B31
LYASEHRLLV

SEQ ID NO: 69125 - protein, 10 aa, Borrelia burgdorferi B31
RWLYSCIEEL

SEQ ID NO: 69126 - protein, 10 aa, Borrelia burgdorferi B31
KFMRIVRWLY

SEQ ID NO: 69127 - protein, 11 aa, Borrelia burgdorferi B31
DYNEEYFNKFF

SEQ ID NO: 69128 - protein, 11 aa, Borrelia burgdorferi B31
RYDYNRPVPIL

SEQ ID NO: 69129 - protein, 11 aa, Borrelia burgdorferi B31
RWLYSCIEELY

SEQ ID NO: 69130 - protein, 11 aa, Borrelia burgdorferi B31
CYLPDNQEQAV

SEQ ID NO: 69131 - protein, 11 aa, Borrelia burgdorferi B31
YYRNMPRPTAY

SEQ ID NO: 69132 - protein, 9 aa, Borrelia burgdorferi B31
ELYSPDIKY

SEQ ID NO: 69133 - protein, 9 aa, Borrelia burgdorferi B31
FMRIVRWLY

SEQ ID NO: 69134 - protein, 9 aa, Borrelia burgdorferi B31
LYSCIEELY

SEQ ID NO: 69135 - protein, 9 aa, Borrelia burgdorferi B31
PVSDYNEEY

SEQ ID NO: 69136 - protein, 9 aa, Borrelia burgdorferi B31
YLKVKRYDY

SEQ ID NO: 69137 - protein, 9 aa, Borrelia burgdorferi B31
IALALLGCY

SEQ ID NO: 69138 - protein, 10 aa, Borrelia burgdorferi B31
KFMRIVRWLY

SEQ ID NO: 69139 - protein, 10 aa, Borrelia burgdorferi B31
QYLKVKRYDY

SEQ ID NO: 69140 - protein, 10 aa, Borrelia burgdorferi B31
TLISLKDPNY

SEQ ID NO: 69141 - protein, 10 aa, Borrelia burgdorferi B31
YSGEEGSPEY

SEQ ID NO: 69142 - protein, 10 aa, Borrelia burgdorferi B31
WLYSCIEELY

SEQ ID NO: 69143 - protein, 10 aa, Borrelia burgdorferi B31
YRNMPRPTAY

SEQ ID NO: 69144 - protein, 10 aa, Borrelia burgdorferi B31
IIALALLGCY

SEQ ID NO: 69145 - protein, 10 aa, Borrelia burgdorferi B31
YQQYLKVKRY

SEQ ID NO: 69146 - protein, 10 aa, Borrelia burgdorferi B31
DYNEEYFNKF

SEQ ID NO: 69147 - protein, 11 aa, Borrelia burgdorferi B31
YYRNMPRPTAY

SEQ ID NO: 69148 - protein, 11 aa, Borrelia burgdorferi B31
CIIALALLGCY

SEQ ID NO: 69149 - protein, 11 aa, Borrelia burgdorferi B31
NMPRPTAYQQY

SEQ ID NO: 69150 - protein, 11 aa, Borrelia burgdorferi B31
VLPVSDYNEEY

SEQ ID NO: 69151 - protein, 11 aa, Borrelia burgdorferi B31
KYSGEEGSPEY

SEQ ID NO: 69152 - protein, 11 aa, Borrelia burgdorferi B31
YSGEEGSPEYY

SEQ ID NO: 69153 - protein, 11 aa, Borrelia burgdorferi B31
RWLYSCIEELY

SEQ ID NO: 69154 - protein, 11 aa, Borrelia burgdorferi B31
DYNEEYFNKFF

SEQ ID NO: 69155 - protein, 9 aa, Borrelia burgdorferi B31
EQNNNKFMR

SEQ ID NO: 69156 - protein, 9 aa, Borrelia burgdorferi B31
PTAYQQYLK

SEQ ID NO: 69157 - protein, 9 aa, Borrelia burgdorferi B31
KVKRYDYNR

SEQ ID NO: 69158 - protein, 9 aa, Borrelia burgdorferi B31
NNKFMRIVR

SEQ ID NO: 69159 - protein, 9 aa, Borrelia burgdorferi B31
LIKLFIMVK

SEQ ID NO: 69160 - protein, 9 aa, Borrelia burgdorferi B31
DYNEEYFNK

SEQ ID NO: 69161 - protein, 9 aa, Borrelia burgdorferi B31
ISLKDPNYR

SEQ ID NO: 69162 - protein, 9 aa, Borrelia burgdorferi B31
YQQYLKVKR

SEQ ID NO: 69163 - protein, 9 aa, Borrelia burgdorferi B31
EEGSPEYYR

SEQ ID NO: 69164 - protein, 9 aa, Borrelia burgdorferi B31
LYSCIEELY

SEQ ID NO: 69165 - protein, 9 aa, Borrelia burgdorferi B31
ELYSPDIKY

SEQ ID NO: 69166 - protein, 9 aa, Borrelia burgdorferi B31
QTFFENSES

SEQ ID NO: 69167 - protein, 9 aa, Borrelia burgdorferi B31
TEGIFSSLK

SEQ ID NO: 69168 - protein, 9 aa, Borrelia burgdorferi B31
FMRIVRWLY

SEQ ID NO: 69169 - protein, 10 aa, Borrelia burgdorferi B31
MVKNEQNNNK

SEQ ID NO: 69170 - protein, 10 aa, Borrelia burgdorferi B31
EIKKTLISLK

SEQ ID NO: 69171 - protein, 10 aa, Borrelia burgdorferi B31
VTEGIFSSLK

SEQ ID NO: 69172 - protein, 10 aa, Borrelia burgdorferi B31
TAYQQYLKVK

SEQ ID NO: 69173 - protein, 10 aa, Borrelia burgdorferi B31
SLKLYASEHR

SEQ ID NO: 69174 - protein, 10 aa, Borrelia burgdorferi B31
DLIKLFIMVK

SEQ ID NO: 69175 - protein, 10 aa, Borrelia burgdorferi B31
LISLKDPNYR

SEQ ID NO: 69176 - protein, 10 aa, Borrelia burgdorferi B31
NNNKFMRIVR

SEQ ID NO: 69177 - protein, 10 aa, Borrelia burgdorferi B31
SPEYYRNMPR

SEQ ID NO: 69178 - protein, 10 aa, Borrelia burgdorferi B31
RPTAYQQYLK

SEQ ID NO: 69179 - protein, 10 aa, Borrelia burgdorferi B31
WLYSCIEELY

SEQ ID NO: 69180 - protein, 10 aa, Borrelia burgdorferi B31
SDYNEEYFNK

SEQ ID NO: 69181 - protein, 10 aa, Borrelia burgdorferi B31
NEQNNNKFMR

SEQ ID NO: 69182 - protein, 10 aa, Borrelia burgdorferi B31
EGIFSSLKLY

SEQ ID NO: 69183 - protein, 11 aa, Borrelia burgdorferi B31
TAYQQYLKVKR

SEQ ID NO: 69184 - protein, 11 aa, Borrelia burgdorferi B31
IVTEGIFSSLK

SEQ ID NO: 69185 - protein, 11 aa, Borrelia burgdorferi B31
TLISLKDPNYR

SEQ ID NO: 69186 - protein, 11 aa, Borrelia burgdorferi B31
SSLKLYASEHR

SEQ ID NO: 69187 - protein, 11 aa, Borrelia burgdorferi B31
YLKVKRYDYNR

SEQ ID NO: 69188 - protein, 11 aa, Borrelia burgdorferi B31
IMVKNEQNNNK

SEQ ID NO: 69189 - protein, 11 aa, Borrelia burgdorferi B31
PTAYQQYLKVK

SEQ ID NO: 69190 - protein, 11 aa, Borrelia burgdorferi B31
CIEELYSPDIK

SEQ ID NO: 69191 - protein, 11 aa, Borrelia burgdorferi B31
QNNNKFMRIVR

SEQ ID NO: 69192 - protein, 11 aa, Borrelia burgdorferi B31
CIIALALLGCY

SEQ ID NO: 69193 - protein, 11 aa, Borrelia burgdorferi B31
GSPEYYRNMPR

SEQ ID NO: 69194 - protein, 11 aa, Borrelia burgdorferi B31
NKFMRIVRWLY

SEQ ID NO: 69195 - protein, 9 aa, Borrelia burgdorferi B31
DPNYRGVVL

SEQ ID NO: 69196 - protein, 9 aa, Borrelia burgdorferi B31
RPTAYQQYL

SEQ ID NO: 69197 - protein, 9 aa, Borrelia burgdorferi B31
YASEHRLLV

SEQ ID NO: 69198 - protein, 9 aa, Borrelia burgdorferi B31
MPRPTAYQQ

SEQ ID NO: 69199 - protein, 9 aa, Borrelia burgdorferi B31
SPEYYRNMP

SEQ ID NO: 69200 - protein, 10 aa, Borrelia burgdorferi B31
IVTEGIFSSL

SEQ ID NO: 69201 - protein, 10 aa, Borrelia burgdorferi B31
SPEYYRNMPR

SEQ ID NO: 69202 - protein, 10 aa, Borrelia burgdorferi B31
MPRPTAYQQY

SEQ ID NO: 69203 - protein, 11 aa, Borrelia burgdorferi B31
MPRPTAYQQYL

SEQ ID NO: 69204 - protein, 11 aa, Borrelia burgdorferi B31
RPTAYQQYLKV

SEQ ID NO: 69205 - protein, 11 aa, Borrelia burgdorferi B31
DPNYRGVVLPV

SEQ ID NO: 69206 - protein, 11 aa, Borrelia burgdorferi B31
LPVSDYNEEYF

SEQ ID NO: 69207 - protein, 11 aa, Borrelia burgdorferi B31
RILVGVCIIAL

SEQ ID NO: 69208 - protein, 11 aa, Borrelia burgdorferi B31
YASEHRLLVEI

SEQ ID NO: 69209 - protein, 9 aa, Borrelia burgdorferi B31
YLKVKRYDY

SEQ ID NO: 69210 - protein, 9 aa, Borrelia burgdorferi B31
EIKKTLISL

SEQ ID NO: 69211 - protein, 11 aa, Borrelia burgdorferi B31
MPRPTAYQQYL

SEQ ID NO: 69212 - protein, 11 aa, Borrelia burgdorferi B31
FMRIVRWLYSC

SEQ ID NO: 69213 - protein, 9 aa, Borrelia burgdorferi B31
QQYLKVKRY

SEQ ID NO: 69214 - protein, 9 aa, Borrelia burgdorferi B31
FMRIVRWLY

SEQ ID NO: 69215 - protein, 9 aa, Borrelia burgdorferi B31
YLKVKRYDY

SEQ ID NO: 69216 - protein, 9 aa, Borrelia burgdorferi B31
RNMPRPTAY

SEQ ID NO: 69217 - protein, 9 aa, Borrelia burgdorferi B31
QSKDLIKLF

SEQ ID NO: 69218 - protein, 9 aa, Borrelia burgdorferi B31
NQEQAVQTF

SEQ ID NO: 69219 - protein, 9 aa, Borrelia burgdorferi B31
GVVLPVSDY

SEQ ID NO: 69220 - protein, 9 aa, Borrelia burgdorferi B31
IALALLGCY

SEQ ID NO: 69221 - protein, 9 aa, Borrelia burgdorferi B31
ELYSPDIKY

SEQ ID NO: 69222 - protein, 9 aa, Borrelia burgdorferi B31
KLYASEHRL

SEQ ID NO: 69223 - protein, 9 aa, Borrelia burgdorferi B31
SGEEGSPEY

SEQ ID NO: 69224 - protein, 10 aa, Borrelia burgdorferi B31
YQQYLKVKRY

SEQ ID NO: 69225 - protein, 10 aa, Borrelia burgdorferi B31
YSGEEGSPEY

SEQ ID NO: 69226 - protein, 10 aa, Borrelia burgdorferi B31
WLYSCIEELY

SEQ ID NO: 69227 - protein, 10 aa, Borrelia burgdorferi B31
IIALALLGCY

SEQ ID NO: 69228 - protein, 10 aa, Borrelia burgdorferi B31
ILVGVCIIAL

SEQ ID NO: 69229 - protein, 10 aa, Borrelia burgdorferi B31
EQSKDLIKLF

SEQ ID NO: 69230 - protein, 10 aa, Borrelia burgdorferi B31
NQEQAVQTFF

SEQ ID NO: 69231 - protein, 10 aa, Borrelia burgdorferi B31
IVTEGIFSSL

SEQ ID NO: 69232 - protein, 10 aa, Borrelia burgdorferi B31
TLISLKDPNY

SEQ ID NO: 69233 - protein, 10 aa, Borrelia burgdorferi B31
KLYASEHRLL

SEQ ID NO: 69234 - protein, 10 aa, Borrelia burgdorferi B31
RGVVLPVSDY

SEQ ID NO: 69235 - protein, 11 aa, Borrelia burgdorferi B31
QQYLKVKRYDY

SEQ ID NO: 69236 - protein, 11 aa, Borrelia burgdorferi B31
YSGEEGSPEYY

SEQ ID NO: 69237 - protein, 11 aa, Borrelia burgdorferi B31
MVKNEQNNNKF

SEQ ID NO: 69238 - protein, 11 aa, Borrelia burgdorferi B31
NMPRPTAYQQY

SEQ ID NO: 69239 - protein, 11 aa, Borrelia burgdorferi B31
YYRNMPRPTAY

SEQ ID NO: 69240 - protein, 11 aa, Borrelia burgdorferi B31
VLPVSDYNEEY

SEQ ID NO: 69241 - protein, 11 aa, Borrelia burgdorferi B31
CIIALALLGCY

SEQ ID NO: 69242 - protein, 9 aa, Borrelia burgdorferi B31
HRLLVEIKK

SEQ ID NO: 69243 - protein, 9 aa, Borrelia burgdorferi B31
KRYDYNRPV

SEQ ID NO: 69244 - protein, 9 aa, Borrelia burgdorferi B31
MRILVGVCI

SEQ ID NO: 69245 - protein, 9 aa, Borrelia burgdorferi B31
YQQYLKVKR

SEQ ID NO: 69246 - protein, 9 aa, Borrelia burgdorferi B31
QQYLKVKRY

SEQ ID NO: 69247 - protein, 10 aa, Borrelia burgdorferi B31
YRNMPRPTAY

SEQ ID NO: 69248 - protein, 10 aa, Borrelia burgdorferi B31
KRYDYNRPVP

SEQ ID NO: 69249 - protein, 11 aa, Borrelia burgdorferi B31
KRYDYNRPVPI

SEQ ID NO: 69250 - protein, 11 aa, Borrelia burgdorferi B31
HRLLVEIKKTL

SEQ ID NO: 69251 - protein, 11 aa, Borrelia burgdorferi B31
YRGVVLPVSDY

SEQ ID NO: 69252 - protein, 11 aa, Borrelia burgdorferi B31
VRWLYSCIEEL

SEQ ID NO: 69253 - protein, 11 aa, Borrelia burgdorferi B31
QQYLKVKRYDY

SEQ ID NO: 69254 - protein, 11 aa, Borrelia burgdorferi B31
MRIVRWLYSCI

SEQ ID NO: 69255 - protein, 9 aa, Borrelia burgdorferi B31
DPNYRGVVL

SEQ ID NO: 69256 - protein, 9 aa, Borrelia burgdorferi B31
LPDNQEQAV

SEQ ID NO: 69257 - protein, 9 aa, Borrelia burgdorferi B31
NQEQAVQTF

SEQ ID NO: 69258 - protein, 9 aa, Borrelia burgdorferi B31
IALALLGCY

SEQ ID NO: 69259 - protein, 9 aa, Borrelia burgdorferi B31
LPVSDYNEE

SEQ ID NO: 69260 - protein, 9 aa, Borrelia burgdorferi B31
PVSDYNEEY

SEQ ID NO: 69261 - protein, 9 aa, Borrelia burgdorferi B31
SGEEGSPEY

SEQ ID NO: 69262 - protein, 9 aa, Borrelia burgdorferi B31
YNEEYFNKF

SEQ ID NO: 69263 - protein, 9 aa, Borrelia burgdorferi B31
LVGVCIIAL

SEQ ID NO: 69264 - protein, 10 aa, Borrelia burgdorferi B31
LPVSDYNEEY

SEQ ID NO: 69265 - protein, 10 aa, Borrelia burgdorferi B31
MPRPTAYQQY

SEQ ID NO: 69266 - protein, 10 aa, Borrelia burgdorferi B31
YSGEEGSPEY

SEQ ID NO: 69267 - protein, 10 aa, Borrelia burgdorferi B31
LPDNQEQAVQ

SEQ ID NO: 69268 - protein, 10 aa, Borrelia burgdorferi B31
WLYSCIEELY

SEQ ID NO: 69269 - protein, 10 aa, Borrelia burgdorferi B31
YRNMPRPTAY

SEQ ID NO: 69270 - protein, 10 aa, Borrelia burgdorferi B31
FFENSESSDM

SEQ ID NO: 69271 - protein, 10 aa, Borrelia burgdorferi B31
IIALALLGCY

SEQ ID NO: 69272 - protein, 11 aa, Borrelia burgdorferi B31
LPVSDYNEEYF

SEQ ID NO: 69273 - protein, 11 aa, Borrelia burgdorferi B31
MPRPTAYQQYL

SEQ ID NO: 69274 - protein, 11 aa, Borrelia burgdorferi B31
LPDNQEQAVQT

SEQ ID NO: 69275 - protein, 11 aa, Borrelia burgdorferi B31
YSGEEGSPEYY

SEQ ID NO: 69276 - protein, 11 aa, Borrelia burgdorferi B31
MVKNEQNNNKF

SEQ ID NO: 69277 - protein, 11 aa, Borrelia burgdorferi B31
YYRNMPRPTAY

SEQ ID NO: 69278 - protein, 11 aa, Borrelia burgdorferi B31
YASEHRLLVEI

SEQ ID NO: 69279 - protein, 11 aa, Borrelia burgdorferi B31
LVGVCIIALAL

SEQ ID NO: 69280 - protein, 11 aa, Borrelia burgdorferi B31
DPNYRGVVLPV

SEQ ID NO: 69281 - protein, 11 aa, Borrelia burgdorferi B31
TFFENSESSDM

SEQ ID NO: 69282 - protein, 9 aa, Borrelia burgdorferi B31
NEEYFNKFF

SEQ ID NO: 69283 - protein, 9 aa, Borrelia burgdorferi B31
EEYFNKFFL

SEQ ID NO: 69284 - protein, 9 aa, Borrelia burgdorferi B31
VEIKKTLIS

SEQ ID NO: 69285 - protein, 9 aa, Borrelia burgdorferi B31
DEIVTEGIF

SEQ ID NO: 69286 - protein, 9 aa, Borrelia burgdorferi B31
SEHRLLVEI

SEQ ID NO: 69287 - protein, 9 aa, Borrelia burgdorferi B31
GEEGSPEYY

SEQ ID NO: 69288 - protein, 10 aa, Borrelia burgdorferi B31
EELYSPDIKY

SEQ ID NO: 69289 - protein, 10 aa, Borrelia burgdorferi B31
DEIVTEGIFS

SEQ ID NO: 69290 - protein, 10 aa, Borrelia burgdorferi B31
VEIKKTLISL

SEQ ID NO: 69291 - protein, 11 aa, Borrelia burgdorferi B31
SEQSKDLIKLF

SEQ ID NO: 69292 - protein, 11 aa, Borrelia burgdorferi B31
EELYSPDIKYS

SEQ ID NO: 69293 - protein, 11 aa, Borrelia burgdorferi B31
EEYFNKFFLDL

SEQ ID NO: 69294 - protein, 11 aa, Borrelia burgdorferi B31
EEGSPEYYRNM

SEQ ID NO: 69295 - protein, 11 aa, Borrelia burgdorferi B31
TEGIFSSLKLY

SEQ ID NO: 69296 - protein, 9 aa, Borrelia burgdorferi B31
LPDNQEQAV

SEQ ID NO: 69297 - protein, 10 aa, Borrelia burgdorferi B31
LPVSDYNEEY

SEQ ID NO: 69298 - protein, 11 aa, Borrelia burgdorferi B31
LPVSDYNEEYF

SEQ ID NO: 69299 - protein, 11 aa, Borrelia burgdorferi B31
MPRPTAYQQYL

SEQ ID NO: 69300 - protein, 9 aa, Borrelia burgdorferi B31
SLMEDVLAL

SEQ ID NO: 69301 - protein, 9 aa, Borrelia burgdorferi B31
FVMACKAYV

SEQ ID NO: 69302 - protein, 9 aa, Borrelia burgdorferi B31
KLVGVTVPL

SEQ ID NO: 69303 - protein, 9 aa, Borrelia burgdorferi B31
LMEDVLALV

SEQ ID NO: 69304 - protein, 9 aa, Borrelia burgdorferi B31
KLAAKLAAL

SEQ ID NO: 69305 - protein, 9 aa, Borrelia burgdorferi B31
KIWSEAKLV

SEQ ID NO: 69306 - protein, 9 aa, Borrelia burgdorferi B31
LFFASMLFV

SEQ ID NO: 69307 - protein, 9 aa, Borrelia burgdorferi B31
MLFVMACKA

SEQ ID NO: 69308 - protein, 9 aa, Borrelia burgdorferi B31
FQDKLAAKL

SEQ ID NO: 69309 - protein, 9 aa, Borrelia burgdorferi B31
LVGVTVPLL

SEQ ID NO: 69310 - protein, 9 aa, Borrelia burgdorferi B31
FASMLFVMA

SEQ ID NO: 69311 - protein, 9 aa, Borrelia burgdorferi B31
FFASMLFVM

SEQ ID NO: 69312 - protein, 10 aa, Borrelia burgdorferi B31
SLMEDVLALV

SEQ ID NO: 69313 - protein, 10 aa, Borrelia burgdorferi B31
KLFFASMLFV

SEQ ID NO: 69314 - protein, 10 aa, Borrelia burgdorferi B31
KLVGVTVPLL

SEQ ID NO: 69315 - protein, 10 aa, Borrelia burgdorferi B31
KMSKNAVEQI

SEQ ID NO: 69316 - protein, 10 aa, Borrelia burgdorferi B31
SMLFVMACKA

SEQ ID NO: 69317 - protein, 10 aa, Borrelia burgdorferi B31
NIFKLFFASM

SEQ ID NO: 69318 - protein, 10 aa, Borrelia burgdorferi B31
NLKDIGNAEL

SEQ ID NO: 69319 - protein, 10 aa, Borrelia burgdorferi B31
NLQNSFQDKL

SEQ ID NO: 69320 - protein, 10 aa, Borrelia burgdorferi B31
FFASMLFVMA

SEQ ID NO: 69321 - protein, 11 aa, Borrelia burgdorferi B31
MLFVMACKAYV

SEQ ID NO: 69322 - protein, 11 aa, Borrelia burgdorferi B31
KIWSEAKLVGV

SEQ ID NO: 69323 - protein, 11 aa, Borrelia burgdorferi B31
KLFFASMLFVM

SEQ ID NO: 69324 - protein, 11 aa, Borrelia burgdorferi B31
KLAAKLAALKA

SEQ ID NO: 69325 - protein, 11 aa, Borrelia burgdorferi B31
FKLFFASMLFV

SEQ ID NO: 69326 - protein, 11 aa, Borrelia burgdorferi B31
NIFKLFFASML

SEQ ID NO: 69327 - protein, 11 aa, Borrelia burgdorferi B31
FQDKLAAKLAA

SEQ ID NO: 69328 - protein, 9 aa, Borrelia burgdorferi B31
SMLFVMACK

SEQ ID NO: 69329 - protein, 9 aa, Borrelia burgdorferi B31
KLAALKAAK

SEQ ID NO: 69330 - protein, 9 aa, Borrelia burgdorferi B31
LAAKLAALK

SEQ ID NO: 69331 - protein, 9 aa, Borrelia burgdorferi B31
LVNDSSGGK

SEQ ID NO: 69332 - protein, 9 aa, Borrelia burgdorferi B31
KLFFASMLF

SEQ ID NO: 69333 - protein, 9 aa, Borrelia burgdorferi B31
NLQNSFQDK

SEQ ID NO: 69334 - protein, 10 aa, Borrelia burgdorferi B31
KLAAKLAALK

SEQ ID NO: 69335 - protein, 10 aa, Borrelia burgdorferi B31
ASMLFVMACK

SEQ ID NO: 69336 - protein, 10 aa, Borrelia burgdorferi B31
ALVNDSSGGK

SEQ ID NO: 69337 - protein, 10 aa, Borrelia burgdorferi B31
SSGGKFKDYK

SEQ ID NO: 69338 - protein, 10 aa, Borrelia burgdorferi B31
KLFFASMLFV

SEQ ID NO: 69339 - protein, 10 aa, Borrelia burgdorferi B31
KLLNLQNSFQ

SEQ ID NO: 69340 - protein, 10 aa, Borrelia burgdorferi B31
AKLAALKAAK

SEQ ID NO: 69341 - protein, 10 aa, Borrelia burgdorferi B31
TSGNGDKMSK

SEQ ID NO: 69342 - protein, 10 aa, Borrelia burgdorferi B31
MLFVMACKAY

SEQ ID NO: 69343 - protein, 10 aa, Borrelia burgdorferi B31
KINELKENLK

SEQ ID NO: 69344 - protein, 10 aa, Borrelia burgdorferi B31
GSNTSGNGDK

SEQ ID NO: 69345 - protein, 10 aa, Borrelia burgdorferi B31
NSFQDKLAAK

SEQ ID NO: 69346 - protein, 11 aa, Borrelia burgdorferi B31
LLNLQNSFQDK

SEQ ID NO: 69347 - protein, 11 aa, Borrelia burgdorferi B31
LVNDSSGGKFK

SEQ ID NO: 69348 - protein, 11 aa, Borrelia burgdorferi B31
VMACKAYVEEK

SEQ ID NO: 69349 - protein, 11 aa, Borrelia burgdorferi B31
FASMLFVMACK

SEQ ID NO: 69350 - protein, 11 aa, Borrelia burgdorferi B31
KLFFASMLFVM

SEQ ID NO: 69351 - protein, 11 aa, Borrelia burgdorferi B31
ISKRKIWSEAK

SEQ ID NO: 69352 - protein, 11 aa, Borrelia burgdorferi B31
KLAAKLAALKA

SEQ ID NO: 69353 - protein, 11 aa, Borrelia burgdorferi B31
SMLFVMACKAY

SEQ ID NO: 69354 - protein, 11 aa, Borrelia burgdorferi B31
MSKNAVEQIDK

SEQ ID NO: 69355 - protein, 11 aa, Borrelia burgdorferi B31
NTSGNGDKMSK

SEQ ID NO: 69356 - protein, 9 aa, Borrelia burgdorferi B31
SMLFVMACK

SEQ ID NO: 69357 - protein, 9 aa, Borrelia burgdorferi B31
LVNDSSGGK

SEQ ID NO: 69358 - protein, 9 aa, Borrelia burgdorferi B31
KLAALKAAK

SEQ ID NO: 69359 - protein, 9 aa, Borrelia burgdorferi B31
LAAKLAALK

SEQ ID NO: 69360 - protein, 9 aa, Borrelia burgdorferi B31
NTIENITDK

SEQ ID NO: 69361 - protein, 9 aa, Borrelia burgdorferi B31
SFQDKLAAK

SEQ ID NO: 69362 - protein, 9 aa, Borrelia burgdorferi B31
SGNGDKMSK

SEQ ID NO: 69363 - protein, 9 aa, Borrelia burgdorferi B31
NLQNSFQDK

SEQ ID NO: 69364 - protein, 10 aa, Borrelia burgdorferi B31
ASMLFVMACK

SEQ ID NO: 69365 - protein, 10 aa, Borrelia burgdorferi B31
KLAAKLAALK

SEQ ID NO: 69366 - protein, 10 aa, Borrelia burgdorferi B31
KINELKENLK

SEQ ID NO: 69367 - protein, 10 aa, Borrelia burgdorferi B31
MACKAYVEEK

SEQ ID NO: 69368 - protein, 10 aa, Borrelia burgdorferi B31
SSGGKFKDYK

SEQ ID NO: 69369 - protein, 10 aa, Borrelia burgdorferi B31
NSFQDKLAAK

SEQ ID NO: 69370 - protein, 10 aa, Borrelia burgdorferi B31
TSGNGDKMSK

SEQ ID NO: 69371 - protein, 10 aa, Borrelia burgdorferi B31
GSNTSGNGDK

SEQ ID NO: 69372 - protein, 10 aa, Borrelia burgdorferi B31
ALVNDSSGGK

SEQ ID NO: 69373 - protein, 10 aa, Borrelia burgdorferi B31
ITDKDQDISK

SEQ ID NO: 69374 - protein, 10 aa, Borrelia burgdorferi B31
AVEQIDKVIK

SEQ ID NO: 69375 - protein, 11 aa, Borrelia burgdorferi B31
LVNDSSGGKFK

SEQ ID NO: 69376 - protein, 11 aa, Borrelia burgdorferi B31
FASMLFVMACK

SEQ ID NO: 69377 - protein, 11 aa, Borrelia burgdorferi B31
VMACKAYVEEK

SEQ ID NO: 69378 - protein, 11 aa, Borrelia burgdorferi B31
NTSGNGDKMSK

SEQ ID NO: 69379 - protein, 11 aa, Borrelia burgdorferi B31
MACKAYVEEKK

SEQ ID NO: 69380 - protein, 11 aa, Borrelia burgdorferi B31
AAKLAALKAAK

SEQ ID NO: 69381 - protein, 11 aa, Borrelia burgdorferi B31
MSKNAVEQIDK

SEQ ID NO: 69382 - protein, 11 aa, Borrelia burgdorferi B31
LLNLQNSFQDK

SEQ ID NO: 69383 - protein, 11 aa, Borrelia burgdorferi B31
ISKRKIWSEAK

SEQ ID NO: 69384 - protein, 11 aa, Borrelia burgdorferi B31
LALVNDSSGGK

SEQ ID NO: 69385 - protein, 11 aa, Borrelia burgdorferi B31
SMLFVMACKAY

SEQ ID NO: 69386 - protein, 11 aa, Borrelia burgdorferi B31
NITDKDQDISK

SEQ ID NO: 69387 - protein, 11 aa, Borrelia burgdorferi B31
DSSGGKFKDYK

SEQ ID NO: 69388 - protein, 9 aa, Borrelia burgdorferi B31
FFASMLFVM

SEQ ID NO: 69389 - protein, 9 aa, Borrelia burgdorferi B31
DYKDKINEL

SEQ ID NO: 69390 - protein, 9 aa, Borrelia burgdorferi B31
KLFFASMLF

SEQ ID NO: 69391 - protein, 10 aa, Borrelia burgdorferi B31
IFKLFFASML

SEQ ID NO: 69392 - protein, 11 aa, Borrelia burgdorferi B31
IFKLFFASMLF

SEQ ID NO: 69393 - protein, 9 aa, Borrelia burgdorferi B31
FFASMLFVM

SEQ ID NO: 69394 - protein, 9 aa, Borrelia burgdorferi B31
KLLNLQNSF

SEQ ID NO: 69395 - protein, 10 aa, Borrelia burgdorferi B31
MLFVMACKAY

SEQ ID NO: 69396 - protein, 11 aa, Borrelia burgdorferi B31
SMLFVMACKAY

SEQ ID NO: 69397 - protein, 9 aa, Borrelia burgdorferi B31
NTIENITDK

SEQ ID NO: 69398 - protein, 9 aa, Borrelia burgdorferi B31
LAAKLAALK

SEQ ID NO: 69399 - protein, 9 aa, Borrelia burgdorferi B31
LVNDSSGGK

SEQ ID NO: 69400 - protein, 9 aa, Borrelia burgdorferi B31
SMLFVMACK

SEQ ID NO: 69401 - protein, 9 aa, Borrelia burgdorferi B31
CKAYVEEKK

SEQ ID NO: 69402 - protein, 9 aa, Borrelia burgdorferi B31
KLAALKAAK

SEQ ID NO: 69403 - protein, 9 aa, Borrelia burgdorferi B31
NLQNSFQDK

SEQ ID NO: 69404 - protein, 10 aa, Borrelia burgdorferi B31
MACKAYVEEK

SEQ ID NO: 69405 - protein, 10 aa, Borrelia burgdorferi B31
NSFQDKLAAK

SEQ ID NO: 69406 - protein, 10 aa, Borrelia burgdorferi B31
ASMLFVMACK

SEQ ID NO: 69407 - protein, 10 aa, Borrelia burgdorferi B31
MLFVMACKAY

SEQ ID NO: 69408 - protein, 10 aa, Borrelia burgdorferi B31
DYKDKINELK

SEQ ID NO: 69409 - protein, 10 aa, Borrelia burgdorferi B31
TSGNGDKMSK

SEQ ID NO: 69410 - protein, 10 aa, Borrelia burgdorferi B31
SSGGKFKDYK

SEQ ID NO: 69411 - protein, 10 aa, Borrelia burgdorferi B31
KLAAKLAALK

SEQ ID NO: 69412 - protein, 10 aa, Borrelia burgdorferi B31
KINELKENLK

SEQ ID NO: 69413 - protein, 10 aa, Borrelia burgdorferi B31
DIGNAELKEK

SEQ ID NO: 69414 - protein, 10 aa, Borrelia burgdorferi B31
ITDKDQDISK

SEQ ID NO: 69415 - protein, 11 aa, Borrelia burgdorferi B31
MACKAYVEEKK

SEQ ID NO: 69416 - protein, 11 aa, Borrelia burgdorferi B31
NTSGNGDKMSK

SEQ ID NO: 69417 - protein, 11 aa, Borrelia burgdorferi B31
FASMLFVMACK

SEQ ID NO: 69418 - protein, 11 aa, Borrelia burgdorferi B31
DSSGGKFKDYK

SEQ ID NO: 69419 - protein, 11 aa, Borrelia burgdorferi B31
LVNDSSGGKFK

SEQ ID NO: 69420 - protein, 11 aa, Borrelia burgdorferi B31
MSKNAVEQIDK

SEQ ID NO: 69421 - protein, 11 aa, Borrelia burgdorferi B31
NLKDIGNAELK

SEQ ID NO: 69422 - protein, 11 aa, Borrelia burgdorferi B31
NAVEQIDKVIK

SEQ ID NO: 69423 - protein, 11 aa, Borrelia burgdorferi B31
ITDKDQDISKR

SEQ ID NO: 69424 - protein, 11 aa, Borrelia burgdorferi B31
VMACKAYVEEK

SEQ ID NO: 69425 - protein, 11 aa, Borrelia burgdorferi B31
NITDKDQDISK

SEQ ID NO: 69426 - protein, 11 aa, Borrelia burgdorferi B31
LALVNDSSGGK

SEQ ID NO: 69427 - protein, 11 aa, Borrelia burgdorferi B31
LLNLQNSFQDK

SEQ ID NO: 69428 - protein, 11 aa, Borrelia burgdorferi B31
ISKRKIWSEAK

SEQ ID NO: 69429 - protein, 9 aa, Borrelia burgdorferi B31
KLAAKLAAL

SEQ ID NO: 69430 - protein, 10 aa, Borrelia burgdorferi B31
VPLLGSNTSG

SEQ ID NO: 69431 - protein, 9 aa, Borrelia burgdorferi B31
IFKLFFASM

SEQ ID NO: 69432 - protein, 9 aa, Borrelia burgdorferi B31
KLAAKLAAL

SEQ ID NO: 69433 - protein, 10 aa, Borrelia burgdorferi B31
IFKLFFASML

SEQ ID NO: 69434 - protein, 11 aa, Borrelia burgdorferi B31
EAKLVGVTVPL

SEQ ID NO: 69435 - protein, 11 aa, Borrelia burgdorferi B31
QDKLAAKLAAL

SEQ ID NO: 69436 - protein, 9 aa, Borrelia burgdorferi B31
KLLNLQNSF

SEQ ID NO: 69437 - protein, 9 aa, Borrelia burgdorferi B31
KLFFASMLF

SEQ ID NO: 69438 - protein, 9 aa, Borrelia burgdorferi B31
SLMEDVLAL

SEQ ID NO: 69439 - protein, 9 aa, Borrelia burgdorferi B31
EQIDKVIKF

SEQ ID NO: 69440 - protein, 9 aa, Borrelia burgdorferi B31
KLVGVTVPL

SEQ ID NO: 69441 - protein, 9 aa, Borrelia burgdorferi B31
KLAAKLAAL

SEQ ID NO: 69442 - protein, 9 aa, Borrelia burgdorferi B31
LFVMACKAY

SEQ ID NO: 69443 - protein, 10 aa, Borrelia burgdorferi B31
MLFVMACKAY

SEQ ID NO: 69444 - protein, 10 aa, Borrelia burgdorferi B31
LVNDSSGGKF

SEQ ID NO: 69445 - protein, 10 aa, Borrelia burgdorferi B31
NLKDIGNAEL

SEQ ID NO: 69446 - protein, 10 aa, Borrelia burgdorferi B31
KLVGVTVPLL

SEQ ID NO: 69447 - protein, 10 aa, Borrelia burgdorferi B31
EQIDKVIKFL

SEQ ID NO: 69448 - protein, 11 aa, Borrelia burgdorferi B31
SMLFVMACKAY

SEQ ID NO: 69449 - protein, 11 aa, Borrelia burgdorferi B31
ALVNDSSGGKF

SEQ ID NO: 69450 - protein, 11 aa, Borrelia burgdorferi B31
KLFFASMLFVM

SEQ ID NO: 69451 - protein, 11 aa, Borrelia burgdorferi B31
IFKLFFASMLF

SEQ ID NO: 69452 - protein, 11 aa, Borrelia burgdorferi B31
KEKLLNLQNSF

SEQ ID NO: 69453 - protein, 9 aa, Borrelia burgdorferi B31
KRKIWSEAK

SEQ ID NO: 69454 - protein, 9 aa, Borrelia burgdorferi B31
RKIWSEAKL

SEQ ID NO: 69455 - protein, 9 aa, Borrelia burgdorferi B31
MRNKNIFKL

SEQ ID NO: 69456 - protein, 10 aa, Borrelia burgdorferi B31
KRKIWSEAKL

SEQ ID NO: 69457 - protein, 10 aa, Borrelia burgdorferi B31
MRNKNIFKLF

SEQ ID NO: 69458 - protein, 11 aa, Borrelia burgdorferi B31
MRNKNIFKLFF

SEQ ID NO: 69459 - protein, 9 aa, Borrelia burgdorferi B31
FFASMLFVM

SEQ ID NO: 69460 - protein, 9 aa, Borrelia burgdorferi B31
LFVMACKAY

SEQ ID NO: 69461 - protein, 9 aa, Borrelia burgdorferi B31
VPLLGSNTS

SEQ ID NO: 69462 - protein, 9 aa, Borrelia burgdorferi B31
FASMLFVMA

SEQ ID NO: 69463 - protein, 10 aa, Borrelia burgdorferi B31
MLFVMACKAY

SEQ ID NO: 69464 - protein, 10 aa, Borrelia burgdorferi B31
FASMLFVMAC

SEQ ID NO: 69465 - protein, 10 aa, Borrelia burgdorferi B31
LVNDSSGGKF

SEQ ID NO: 69466 - protein, 10 aa, Borrelia burgdorferi B31
LFFASMLFVM

SEQ ID NO: 69467 - protein, 10 aa, Borrelia burgdorferi B31
FKLFFASMLF

SEQ ID NO: 69468 - protein, 10 aa, Borrelia burgdorferi B31
NAVEQIDKVI

SEQ ID NO: 69469 - protein, 10 aa, Borrelia burgdorferi B31
NIFKLFFASM

SEQ ID NO: 69470 - protein, 10 aa, Borrelia burgdorferi B31
DSLMEDVLAL

SEQ ID NO: 69471 - protein, 11 aa, Borrelia burgdorferi B31
EAKLVGVTVPL

SEQ ID NO: 69472 - protein, 11 aa, Borrelia burgdorferi B31
SMLFVMACKAY

SEQ ID NO: 69473 - protein, 9 aa, Borrelia burgdorferi B31
AELKEKLLN

SEQ ID NO: 69474 - protein, 9 aa, Borrelia burgdorferi B31
KEKLLNLQN

SEQ ID NO: 69475 - protein, 9 aa, Borrelia burgdorferi B31
KENLKDIGN

SEQ ID NO: 69476 - protein, 9 aa, Borrelia burgdorferi B31
KEIDSLMED

SEQ ID NO: 69477 - protein, 9 aa, Borrelia burgdorferi B31
EEKKEIDSL

SEQ ID NO: 69478 - protein, 10 aa, Borrelia burgdorferi B31
AELKEKLLNL

SEQ ID NO: 69479 - protein, 10 aa, Borrelia burgdorferi B31
EEKKEIDSLM

SEQ ID NO: 69480 - protein, 10 aa, Borrelia burgdorferi B31
KENLKDIGNA

SEQ ID NO: 69481 - protein, 10 aa, Borrelia burgdorferi B31
SEAKLVGVTV

SEQ ID NO: 69482 - protein, 11 aa, Borrelia burgdorferi B31
KEIDSLMEDVL

SEQ ID NO: 69483 - protein, 11 aa, Borrelia burgdorferi B31
KEKLLNLQNSF

SEQ ID NO: 69484 - protein, 11 aa, Borrelia burgdorferi B31
AELKEKLLNLQ

SEQ ID NO: 69485 - protein, 9 aa, Borrelia burgdorferi B31
VPLLGSNTS

SEQ ID NO: 69486 - protein, 11 aa, Borrelia burgdorferi B31
LAALKAAKNTI

SEQ ID NO: 69487 - protein, 9 aa, Borrelia burgdorferi B31
YTEERRMLY

SEQ ID NO: 69488 - protein, 9 aa, Borrelia burgdorferi B31
DTDDLIDEY

SEQ ID NO: 69489 - protein, 10 aa, Borrelia burgdorferi B31
STVHFDSHEY

SEQ ID NO: 69490 - protein, 11 aa, Borrelia burgdorferi B31
NSTVHFDSHEY

SEQ ID NO: 69491 - protein, 11 aa, Borrelia burgdorferi B31
QTDVSKLNDTL

SEQ ID NO: 69492 - protein, 11 aa, Borrelia burgdorferi B31
LKDTDDLIDEY

SEQ ID NO: 69493 - protein, 11 aa, Borrelia burgdorferi B31
QLNKPNLETLY

SEQ ID NO: 69494 - protein, 9 aa, Borrelia burgdorferi B31
ILISCSLEV

SEQ ID NO: 69495 - protein, 9 aa, Borrelia burgdorferi B31
FLLHVLTVL

SEQ ID NO: 69496 - protein, 9 aa, Borrelia burgdorferi B31
ILDPEVAKL

SEQ ID NO: 69497 - protein, 9 aa, Borrelia burgdorferi B31
TLINRGFSI

SEQ ID NO: 69498 - protein, 9 aa, Borrelia burgdorferi B31
TLYNDFEKL

SEQ ID NO: 69499 - protein, 9 aa, Borrelia burgdorferi B31
LIAIFLLHV

SEQ ID NO: 69500 - protein, 9 aa, Borrelia burgdorferi B31
KILDRSENI

SEQ ID NO: 69501 - protein, 9 aa, Borrelia burgdorferi B31
VLILISCSL

SEQ ID NO: 69502 - protein, 9 aa, Borrelia burgdorferi B31
LLHVLTVLI

SEQ ID NO: 69503 - protein, 9 aa, Borrelia burgdorferi B31
HVLTVLILI

SEQ ID NO: 69504 - protein, 9 aa, Borrelia burgdorferi B31
AMEEISAKI

SEQ ID NO: 69505 - protein, 9 aa, Borrelia burgdorferi B31
NLLVAINNL

SEQ ID NO: 69506 - protein, 9 aa, Borrelia burgdorferi B31
NIHDIILDL

SEQ ID NO: 69507 - protein, 9 aa, Borrelia burgdorferi B31
NLGQILSKL

SEQ ID NO: 69508 - protein, 9 aa, Borrelia burgdorferi B31
KIFNLGQIL

SEQ ID NO: 69509 - protein, 9 aa, Borrelia burgdorferi B31
IILDLVNTT

SEQ ID NO: 69510 - protein, 9 aa, Borrelia burgdorferi B31
QLAMEEISA

SEQ ID NO: 69511 - protein, 9 aa, Borrelia burgdorferi B31
TTTNILAPI

SEQ ID NO: 69512 - protein, 9 aa, Borrelia burgdorferi B31
AQFANIHDI

SEQ ID NO: 69513 - protein, 10 aa, Borrelia burgdorferi B31
KLIAIFLLHV

SEQ ID NO: 69514 - protein, 10 aa, Borrelia burgdorferi B31
FLLHVLTVLI

SEQ ID NO: 69515 - protein, 10 aa, Borrelia burgdorferi B31
LILISCSLEV

SEQ ID NO: 69516 - protein, 10 aa, Borrelia burgdorferi B31
NIHDIILDLV

SEQ ID NO: 69517 - protein, 10 aa, Borrelia burgdorferi B31
AIFLLHVLTV

SEQ ID NO: 69518 - protein, 10 aa, Borrelia burgdorferi B31
KIFFNANSTV

SEQ ID NO: 69519 - protein, 10 aa, Borrelia burgdorferi B31
KILDPEVAKL

SEQ ID NO: 69520 - protein, 10 aa, Borrelia burgdorferi B31
ILDPEVAKLI

SEQ ID NO: 69521 - protein, 10 aa, Borrelia burgdorferi B31
LLHVLTVLIL

SEQ ID NO: 69522 - protein, 10 aa, Borrelia burgdorferi B31
LAMEEISAKI

SEQ ID NO: 69523 - protein, 10 aa, Borrelia burgdorferi B31
KILDRSENII

SEQ ID NO: 69524 - protein, 10 aa, Borrelia burgdorferi B31
GMRAEIFSKI

SEQ ID NO: 69525 - protein, 10 aa, Borrelia burgdorferi B31
KLQQLNKPNL

SEQ ID NO: 69526 - protein, 10 aa, Borrelia burgdorferi B31
LIAIFLLHVL

SEQ ID NO: 69527 - protein, 10 aa, Borrelia burgdorferi B31
QLNKPNLETL

SEQ ID NO: 69528 - protein, 10 aa, Borrelia burgdorferi B31
IILDLVNTTT

SEQ ID NO: 69529 - protein, 10 aa, Borrelia burgdorferi B31
TVLILISCSL

SEQ ID NO: 69530 - protein, 10 aa, Borrelia burgdorferi B31
EIFSKIFFNA

SEQ ID NO: 69531 - protein, 10 aa, Borrelia burgdorferi B31
KLTSLKEKWL

SEQ ID NO: 69532 - protein, 10 aa, Borrelia burgdorferi B31
FSIQLAMEEI

SEQ ID NO: 69533 - protein, 11 aa, Borrelia burgdorferi B31
FLLHVLTVLIL

SEQ ID NO: 69534 - protein, 11 aa, Borrelia burgdorferi B31
KLIAIFLLHVL

SEQ ID NO: 69535 - protein, 11 aa, Borrelia burgdorferi B31
VLILISCSLEV

SEQ ID NO: 69536 - protein, 11 aa, Borrelia burgdorferi B31
TLINRGFSIQL

SEQ ID NO: 69537 - protein, 11 aa, Borrelia burgdorferi B31
LLHVLTVLILI

SEQ ID NO: 69538 - protein, 11 aa, Borrelia burgdorferi B31
ILDLVNTTTNI

SEQ ID NO: 69539 - protein, 11 aa, Borrelia burgdorferi B31
LIDEYNTNPDL

SEQ ID NO: 69540 - protein, 11 aa, Borrelia burgdorferi B31
ILDRSENIIQI

SEQ ID NO: 69541 - protein, 11 aa, Borrelia burgdorferi B31
QLAMEEISAKI

SEQ ID NO: 69542 - protein, 11 aa, Borrelia burgdorferi B31
KLSQDSNYRGL

SEQ ID NO: 69543 - protein, 11 aa, Borrelia burgdorferi B31
IAIFLLHVLTV

SEQ ID NO: 69544 - protein, 11 aa, Borrelia burgdorferi B31
KILDPEVAKLI

SEQ ID NO: 69545 - protein, 11 aa, Borrelia burgdorferi B31
AQFANIHDIIL

SEQ ID NO: 69546 - protein, 11 aa, Borrelia burgdorferi B31
AIFLLHVLTVL

SEQ ID NO: 69547 - protein, 11 aa, Borrelia burgdorferi B31
LTVLILISCSL

SEQ ID NO: 69548 - protein, 11 aa, Borrelia burgdorferi B31
ILNVKDKLQQL

SEQ ID NO: 69549 - protein, 11 aa, Borrelia burgdorferi B31
NILKNNKLIAI

SEQ ID NO: 69550 - protein, 11 aa, Borrelia burgdorferi B31
FANIHDIILDL

SEQ ID NO: 69551 - protein, 9 aa, Borrelia burgdorferi B31
KLIAIFLLH

SEQ ID NO: 69552 - protein, 9 aa, Borrelia burgdorferi B31
GMRAEIFSK

SEQ ID NO: 69553 - protein, 9 aa, Borrelia burgdorferi B31
KLNDTLRSK

SEQ ID NO: 69554 - protein, 9 aa, Borrelia burgdorferi B31
LLVAINNLK

SEQ ID NO: 69555 - protein, 9 aa, Borrelia burgdorferi B31
ISAKILNVK

SEQ ID NO: 69556 - protein, 9 aa, Borrelia burgdorferi B31
KILDPEVAK

SEQ ID NO: 69557 - protein, 9 aa, Borrelia burgdorferi B31
KLIQKILDR

SEQ ID NO: 69558 - protein, 9 aa, Borrelia burgdorferi B31
LISCSLEVK

SEQ ID NO: 69559 - protein, 9 aa, Borrelia burgdorferi B31
KLSQDSNYR

SEQ ID NO: 69560 - protein, 9 aa, Borrelia burgdorferi B31
TSLKEKWLK

SEQ ID NO: 69561 - protein, 9 aa, Borrelia burgdorferi B31
TVHFDSHEY

SEQ ID NO: 69562 - protein, 9 aa, Borrelia burgdorferi B31
KLIAIFLLH

SEQ ID NO: 69563 - protein, 9 aa, Borrelia burgdorferi B31
GMRAEIFSK

SEQ ID NO: 69564 - protein, 9 aa, Borrelia burgdorferi B31
KLNDTLRSK

SEQ ID NO: 69565 - protein, 9 aa, Borrelia burgdorferi B31
LLVAINNLK

SEQ ID NO: 69566 - protein, 9 aa, Borrelia burgdorferi B31
ISAKILNVK

SEQ ID NO: 69567 - protein, 9 aa, Borrelia burgdorferi B31
KILDPEVAK

SEQ ID NO: 69568 - protein, 9 aa, Borrelia burgdorferi B31
KLIQKILDR

SEQ ID NO: 69569 - protein, 9 aa, Borrelia burgdorferi B31
LISCSLEVK

SEQ ID NO: 69570 - protein, 9 aa, Borrelia burgdorferi B31
KLSQDSNYR

SEQ ID NO: 69571 - protein, 9 aa, Borrelia burgdorferi B31
TSLKEKWLK

SEQ ID NO: 69572 - protein, 9 aa, Borrelia burgdorferi B31
TVHFDSHEY

SEQ ID NO: 69573 - protein, 11 aa, Borrelia burgdorferi B31
KIFNLGQILSK

SEQ ID NO: 69574 - protein, 11 aa, Borrelia burgdorferi B31
KLTSLKEKWLK

SEQ ID NO: 69575 - protein, 11 aa, Borrelia burgdorferi B31
QLNKPNLETLY

SEQ ID NO: 69576 - protein, 11 aa, Borrelia burgdorferi B31
KIFFNANSTVH

SEQ ID NO: 69577 - protein, 11 aa, Borrelia burgdorferi B31
LILISCSLEVK

SEQ ID NO: 69578 - protein, 11 aa, Borrelia burgdorferi B31
ISAKILNVKDK

SEQ ID NO: 69579 - protein, 11 aa, Borrelia burgdorferi B31
ILSKLSQDSNY

SEQ ID NO: 69580 - protein, 11 aa, Borrelia burgdorferi B31
IQLAMEEISAK

SEQ ID NO: 69581 - protein, 11 aa, Borrelia burgdorferi B31
NVKDKLQQLNK

SEQ ID NO: 69582 - protein, 9 aa, Borrelia burgdorferi B31
TSLNFNEGK

SEQ ID NO: 69583 - protein, 9 aa, Borrelia burgdorferi B31
TSLKEKWLK

SEQ ID NO: 69584 - protein, 9 aa, Borrelia burgdorferi B31
KILDPEVAK

SEQ ID NO: 69585 - protein, 9 aa, Borrelia burgdorferi B31
GMRAEIFSK

SEQ ID NO: 69586 - protein, 9 aa, Borrelia burgdorferi B31
NANANNAPK

SEQ ID NO: 69587 - protein, 9 aa, Borrelia burgdorferi B31
ISAKILNVK

SEQ ID NO: 69588 - protein, 9 aa, Borrelia burgdorferi B31
KLNDTLRSK

SEQ ID NO: 69589 - protein, 9 aa, Borrelia burgdorferi B31
LAMEEISAK

SEQ ID NO: 69590 - protein, 9 aa, Borrelia burgdorferi B31
ETLYNDFEK

SEQ ID NO: 69591 - protein, 9 aa, Borrelia burgdorferi B31
LLVAINNLK

SEQ ID NO: 69592 - protein, 9 aa, Borrelia burgdorferi B31
LISCSLEVK

SEQ ID NO: 69593 - protein, 9 aa, Borrelia burgdorferi B31
KLIAIFLLH

SEQ ID NO: 69594 - protein, 9 aa, Borrelia burgdorferi B31
TVHFDSHEY

SEQ ID NO: 69595 - protein, 9 aa, Borrelia burgdorferi B31
DSNYRGLVK

SEQ ID NO: 69596 - protein, 9 aa, Borrelia burgdorferi B31
YTEERRMLY

SEQ ID NO: 69597 - protein, 9 aa, Borrelia burgdorferi B31
KLSQDSNYR

SEQ ID NO: 69598 - protein, 9 aa, Borrelia burgdorferi B31
LVKETLINR

SEQ ID NO: 69599 - protein, 9 aa, Borrelia burgdorferi B31
KLIQKILDR

SEQ ID NO: 69600 - protein, 9 aa, Borrelia burgdorferi B31
EVKDSNESK

SEQ ID NO: 69601 - protein, 10 aa, Borrelia burgdorferi B31
AINNLKNPTK

SEQ ID NO: 69602 - protein, 10 aa, Borrelia burgdorferi B31
YTSLNFNEGK

SEQ ID NO: 69603 - protein, 10 aa, Borrelia burgdorferi B31
ILISCSLEVK

SEQ ID NO: 69604 - protein, 10 aa, Borrelia burgdorferi B31
LTSLKEKWLK

SEQ ID NO: 69605 - protein, 10 aa, Borrelia burgdorferi B31
KANSKASKQK

SEQ ID NO: 69606 - protein, 10 aa, Borrelia burgdorferi B31
NANANNAPKK

SEQ ID NO: 69607 - protein, 10 aa, Borrelia burgdorferi B31
STVHFDSHEY

SEQ ID NO: 69608 - protein, 10 aa, Borrelia burgdorferi B31
NLLVAINNLK

SEQ ID NO: 69609 - protein, 10 aa, Borrelia burgdorferi B31
QLAMEEISAK

SEQ ID NO: 69610 - protein, 10 aa, Borrelia burgdorferi B31
EISAKILNVK

SEQ ID NO: 69611 - protein, 10 aa, Borrelia burgdorferi B31
IFNLGQILSK

SEQ ID NO: 69612 - protein, 10 aa, Borrelia burgdorferi B31
AAGKNKANSK

SEQ ID NO: 69613 - protein, 10 aa, Borrelia burgdorferi B31
SAKILNVKDK

SEQ ID NO: 69614 - protein, 10 aa, Borrelia burgdorferi B31
FGMRAEIFSK

SEQ ID NO: 69615 - protein, 10 aa, Borrelia burgdorferi B31
IQISEMDSSR

SEQ ID NO: 69616 - protein, 10 aa, Borrelia burgdorferi B31
EVKDSNESKK

SEQ ID NO: 69617 - protein, 11 aa, Borrelia burgdorferi B31
KIFNLGQILSK

SEQ ID NO: 69618 - protein, 11 aa, Borrelia burgdorferi B31
VAINNLKNPTK

SEQ ID NO: 69619 - protein, 11 aa, Borrelia burgdorferi B31
KLTSLKEKWLK

SEQ ID NO: 69620 - protein, 11 aa, Borrelia burgdorferi B31
IQLAMEEISAK

SEQ ID NO: 69621 - protein, 11 aa, Borrelia burgdorferi B31
LILISCSLEVK

SEQ ID NO: 69622 - protein, 11 aa, Borrelia burgdorferi B31
SQDSNYRGLVK

SEQ ID NO: 69623 - protein, 11 aa, Borrelia burgdorferi B31
NVKDKLQQLNK

SEQ ID NO: 69624 - protein, 11 aa, Borrelia burgdorferi B31
ISAKILNVKDK

SEQ ID NO: 69625 - protein, 11 aa, Borrelia burgdorferi B31
VSKLNDTLRSK

SEQ ID NO: 69626 - protein, 11 aa, Borrelia burgdorferi B31
SLEVKDSNESK

SEQ ID NO: 69627 - protein, 11 aa, Borrelia burgdorferi B31
IIQISEMDSSR

SEQ ID NO: 69628 - protein, 11 aa, Borrelia burgdorferi B31
QFGMRAEIFSK

SEQ ID NO: 69629 - protein, 11 aa, Borrelia burgdorferi B31
NLETLYNDFEK

SEQ ID NO: 69630 - protein, 11 aa, Borrelia burgdorferi B31
KIFFNANSTVH

SEQ ID NO: 69631 - protein, 9 aa, Borrelia burgdorferi B31
RMLYTSLNF

SEQ ID NO: 69632 - protein, 9 aa, Borrelia burgdorferi B31
QFANIHDII

SEQ ID NO: 69633 - protein, 9 aa, Borrelia burgdorferi B31
IFLLHVLTV

SEQ ID NO: 69634 - protein, 9 aa, Borrelia burgdorferi B31
EYNTNPDLQ

SEQ ID NO: 69635 - protein, 9 aa, Borrelia burgdorferi B31
KWLKDTDDL

SEQ ID NO: 69636 - protein, 9 aa, Borrelia burgdorferi B31
QFGMRAEIF

SEQ ID NO: 69637 - protein, 10 aa, Borrelia burgdorferi B31
KWLKDTDDLI

SEQ ID NO: 69638 - protein, 10 aa, Borrelia burgdorferi B31
IFLLHVLTVL

SEQ ID NO: 69639 - protein, 10 aa, Borrelia burgdorferi B31
FFNANSTVHF

SEQ ID NO: 69640 - protein, 10 aa, Borrelia burgdorferi B31
QFANIHDIIL

SEQ ID NO: 69641 - protein, 10 aa, Borrelia burgdorferi B31
NYRGLVKETL

SEQ ID NO: 69642 - protein, 11 aa, Borrelia burgdorferi B31
IFLLHVLTVLI

SEQ ID NO: 69643 - protein, 11 aa, Borrelia burgdorferi B31
IFFNANSTVHF

SEQ ID NO: 69644 - protein, 11 aa, Borrelia burgdorferi B31
NYRGLVKETLI

SEQ ID NO: 69645 - protein, 11 aa, Borrelia burgdorferi B31
LYNDFEKLTSL

SEQ ID NO: 69646 - protein, 9 aa, Borrelia burgdorferi B31
TVHFDSHEY

SEQ ID NO: 69647 - protein, 9 aa, Borrelia burgdorferi B31
NKPNLETLY

SEQ ID NO: 69648 - protein, 9 aa, Borrelia burgdorferi B31
YTEERRMLY

SEQ ID NO: 69649 - protein, 9 aa, Borrelia burgdorferi B31
RMLYTSLNF

SEQ ID NO: 69650 - protein, 10 aa, Borrelia burgdorferi B31
STVHFDSHEY

SEQ ID NO: 69651 - protein, 10 aa, Borrelia burgdorferi B31
FFNANSTVHF

SEQ ID NO: 69652 - protein, 10 aa, Borrelia burgdorferi B31
EYTEERRMLY

SEQ ID NO: 69653 - protein, 11 aa, Borrelia burgdorferi B31
QLNKPNLETLY

SEQ ID NO: 69654 - protein, 11 aa, Borrelia burgdorferi B31
IFFNANSTVHF

SEQ ID NO: 69655 - protein, 11 aa, Borrelia burgdorferi B31
ILSKLSQDSNY

SEQ ID NO: 69656 - protein, 9 aa, Borrelia burgdorferi B31
ETLYNDFEK

SEQ ID NO: 69657 - protein, 9 aa, Borrelia burgdorferi B31
DSHEYTEER

SEQ ID NO: 69658 - protein, 9 aa, Borrelia burgdorferi B31
EVKDSNESK

SEQ ID NO: 69659 - protein, 9 aa, Borrelia burgdorferi B31
QISEMDSSR

SEQ ID NO: 69660 - protein, 9 aa, Borrelia burgdorferi B31
LLVAINNLK

SEQ ID NO: 69661 - protein, 9 aa, Borrelia burgdorferi B31
TSLNFNEGK

SEQ ID NO: 69662 - protein, 9 aa, Borrelia burgdorferi B31
DTLRSKNSR

SEQ ID NO: 69663 - protein, 9 aa, Borrelia burgdorferi B31
NANANNAPK

SEQ ID NO: 69664 - protein, 9 aa, Borrelia burgdorferi B31
TVHFDSHEY

SEQ ID NO: 69665 - protein, 9 aa, Borrelia burgdorferi B31
ISAKILNVK

SEQ ID NO: 69666 - protein, 9 aa, Borrelia burgdorferi B31
EPNDQFGMR

SEQ ID NO: 69667 - protein, 9 aa, Borrelia burgdorferi B31
LAMEEISAK

SEQ ID NO: 69668 - protein, 9 aa, Borrelia burgdorferi B31
TSLKEKWLK

SEQ ID NO: 69669 - protein, 9 aa, Borrelia burgdorferi B31
YTEERRMLY

SEQ ID NO: 69670 - protein, 9 aa, Borrelia burgdorferi B31
VSKLNDTLR

SEQ ID NO: 69671 - protein, 9 aa, Borrelia burgdorferi B31
DFEKLTSLK

SEQ ID NO: 69672 - protein, 9 aa, Borrelia burgdorferi B31
LISCSLEVK

SEQ ID NO: 69673 - protein, 9 aa, Borrelia burgdorferi B31
LVKETLINR

SEQ ID NO: 69674 - protein, 9 aa, Borrelia burgdorferi B31
EIFSKIFFN

SEQ ID NO: 69675 - protein, 9 aa, Borrelia burgdorferi B31
DSNESKKHK

SEQ ID NO: 69676 - protein, 9 aa, Borrelia burgdorferi B31
DSNYRGLVK

SEQ ID NO: 69677 - protein, 9 aa, Borrelia burgdorferi B31
ESKKHKKEK

SEQ ID NO: 69678 - protein, 9 aa, Borrelia burgdorferi B31
TTNILAPIQ

SEQ ID NO: 69679 - protein, 9 aa, Borrelia burgdorferi B31
KLSQDSNYR

SEQ ID NO: 69680 - protein, 9 aa, Borrelia burgdorferi B31
NPTKPAAGK

SEQ ID NO: 69681 - protein, 9 aa, Borrelia burgdorferi B31
STVHFDSHE

SEQ ID NO: 69682 - protein, 9 aa, Borrelia burgdorferi B31
FSIQLAMEE

SEQ ID NO: 69683 - protein, 9 aa, Borrelia burgdorferi B31
DTDDLIDEY

SEQ ID NO: 69684 - protein, 10 aa, Borrelia burgdorferi B31
YTSLNFNEGK

SEQ ID NO: 69685 - protein, 10 aa, Borrelia burgdorferi B31
DVSKLNDTLR

SEQ ID NO: 69686 - protein, 10 aa, Borrelia burgdorferi B31
DSHEYTEERR

SEQ ID NO: 69687 - protein, 10 aa, Borrelia burgdorferi B31
EVKDSNESKK

SEQ ID NO: 69688 - protein, 10 aa, Borrelia burgdorferi B31
NANANNAPKK

SEQ ID NO: 69689 - protein, 10 aa, Borrelia burgdorferi B31
EISAKILNVK

SEQ ID NO: 69690 - protein, 10 aa, Borrelia burgdorferi B31
STVHFDSHEY

SEQ ID NO: 69691 - protein, 10 aa, Borrelia burgdorferi B31
LTSLKEKWLK

SEQ ID NO: 69692 - protein, 10 aa, Borrelia burgdorferi B31
ESKKHKKEKR

SEQ ID NO: 69693 - protein, 10 aa, Borrelia burgdorferi B31
NLLVAINNLK

SEQ ID NO: 69694 - protein, 10 aa, Borrelia burgdorferi B31
DSNESKKHKK

SEQ ID NO: 69695 - protein, 10 aa, Borrelia burgdorferi B31
TTTNILAPIQ

SEQ ID NO: 69696 - protein, 10 aa, Borrelia burgdorferi B31
ILISCSLEVK

SEQ ID NO: 69697 - protein, 10 aa, Borrelia burgdorferi B31
QLAMEEISAK

SEQ ID NO: 69698 - protein, 10 aa, Borrelia burgdorferi B31
IQISEMDSSR

SEQ ID NO: 69699 - protein, 10 aa, Borrelia burgdorferi B31
FGMRAEIFSK

SEQ ID NO: 69700 - protein, 10 aa, Borrelia burgdorferi B31
NDFEKLTSLK

SEQ ID NO: 69701 - protein, 10 aa, Borrelia burgdorferi B31
LETLYNDFEK

SEQ ID NO: 69702 - protein, 10 aa, Borrelia burgdorferi B31
FDSHEYTEER

SEQ ID NO: 69703 - protein, 10 aa, Borrelia burgdorferi B31
EYTEERRMLY

SEQ ID NO: 69704 - protein, 10 aa, Borrelia burgdorferi B31
MLYTSLNFNE

SEQ ID NO: 69705 - protein, 10 aa, Borrelia burgdorferi B31
IFNLGQILSK

SEQ ID NO: 69706 - protein, 10 aa, Borrelia burgdorferi B31
AINNLKNPTK

SEQ ID NO: 69707 - protein, 10 aa, Borrelia burgdorferi B31
SAKILNVKDK

SEQ ID NO: 69708 - protein, 11 aa, Borrelia burgdorferi B31
LSKLSQDSNYR

SEQ ID NO: 69709 - protein, 11 aa, Borrelia burgdorferi B31
IIQISEMDSSR

SEQ ID NO: 69710 - protein, 11 aa, Borrelia burgdorferi B31
LYTSLNFNEGK

SEQ ID NO: 69711 - protein, 11 aa, Borrelia burgdorferi B31
ENLLVAINNLK

SEQ ID NO: 69712 - protein, 11 aa, Borrelia burgdorferi B31
NLETLYNDFEK

SEQ ID NO: 69713 - protein, 11 aa, Borrelia burgdorferi B31
ISAKILNVKDK

SEQ ID NO: 69714 - protein, 11 aa, Borrelia burgdorferi B31
NVKDKLQQLNK

SEQ ID NO: 69715 - protein, 11 aa, Borrelia burgdorferi B31
NPNANANNAPK

SEQ ID NO: 69716 - protein, 11 aa, Borrelia burgdorferi B31
HFDSHEYTEER

SEQ ID NO: 69717 - protein, 11 aa, Borrelia burgdorferi B31
VAINNLKNPTK

SEQ ID NO: 69718 - protein, 11 aa, Borrelia burgdorferi B31
NSTVHFDSHEY

SEQ ID NO: 69719 - protein, 11 aa, Borrelia burgdorferi B31
EEISAKILNVK

SEQ ID NO: 69720 - protein, 11 aa, Borrelia burgdorferi B31
TDVSKLNDTLR

SEQ ID NO: 69721 - protein, 11 aa, Borrelia burgdorferi B31
KIFNLGQILSK

SEQ ID NO: 69722 - protein, 11 aa, Borrelia burgdorferi B31
LILISCSLEVK

SEQ ID NO: 69723 - protein, 11 aa, Borrelia burgdorferi B31
NTTTNILAPIQ

SEQ ID NO: 69724 - protein, 11 aa, Borrelia burgdorferi B31
VAKLIQKILDR

SEQ ID NO: 69725 - protein, 11 aa, Borrelia burgdorferi B31
KLTSLKEKWLK

SEQ ID NO: 69726 - protein, 11 aa, Borrelia burgdorferi B31
ESKKHKKEKRK

SEQ ID NO: 69727 - protein, 11 aa, Borrelia burgdorferi B31
ETLINRGFSIQ

SEQ ID NO: 69728 - protein, 9 aa, Borrelia burgdorferi B31
KPAAGKNKA

SEQ ID NO: 69729 - protein, 9 aa, Borrelia burgdorferi B31
LVNTTTNIL

SEQ ID NO: 69730 - protein, 10 aa, Borrelia burgdorferi B31
KPAAGKNKAN

SEQ ID NO: 69731 - protein, 10 aa, Borrelia burgdorferi B31
APKKILDPEV

SEQ ID NO: 69732 - protein, 11 aa, Borrelia burgdorferi B31
KPNLETLYNDF

SEQ ID NO: 69733 - protein, 11 aa, Borrelia burgdorferi B31
APKKILDPEVA

SEQ ID NO: 69734 - protein, 11 aa, Borrelia burgdorferi B31
NPDLQTDVSKL

SEQ ID NO: 69735 - protein, 11 aa, Borrelia burgdorferi B31
KPAAGKNKANS

SEQ ID NO: 69736 - protein, 9 aa, Borrelia burgdorferi B31
VAKLIQKIL

SEQ ID NO: 69737 - protein, 10 aa, Borrelia burgdorferi B31
ILKNNKLIAI

SEQ ID NO: 69738 - protein, 10 aa, Borrelia burgdorferi B31
LLHVLTVLIL

SEQ ID NO: 69739 - protein, 9 aa, Borrelia burgdorferi B31
RMLYTSLNF

SEQ ID NO: 69740 - protein, 9 aa, Borrelia burgdorferi B31
TVHFDSHEY

SEQ ID NO: 69741 - protein, 9 aa, Borrelia burgdorferi B31
RSKNSRAQF

SEQ ID NO: 69742 - protein, 9 aa, Borrelia burgdorferi B31
AQFANIHDI

SEQ ID NO: 69743 - protein, 9 aa, Borrelia burgdorferi B31
YTEERRMLY

SEQ ID NO: 69744 - protein, 9 aa, Borrelia burgdorferi B31
FNANSTVHF

SEQ ID NO: 69745 - protein, 9 aa, Borrelia burgdorferi B31
LNFNEGKIF

SEQ ID NO: 69746 - protein, 9 aa, Borrelia burgdorferi B31
VLILISCSL

SEQ ID NO: 69747 - protein, 9 aa, Borrelia burgdorferi B31
KLIAIFLLH

SEQ ID NO: 69748 - protein, 9 aa, Borrelia burgdorferi B31
KIFNLGQIL

SEQ ID NO: 69749 - protein, 9 aa, Borrelia burgdorferi B31
TLINRGFSI

SEQ ID NO: 69750 - protein, 10 aa, Borrelia burgdorferi B31
STVHFDSHEY

SEQ ID NO: 69751 - protein, 10 aa, Borrelia burgdorferi B31
FFNANSTVHF

SEQ ID NO: 69752 - protein, 10 aa, Borrelia burgdorferi B31
DQFGMRAEIF

SEQ ID NO: 69753 - protein, 10 aa, Borrelia burgdorferi B31
LSKLSQDSNY

SEQ ID NO: 69754 - protein, 10 aa, Borrelia burgdorferi B31
SLNFNEGKIF

SEQ ID NO: 69755 - protein, 10 aa, Borrelia burgdorferi B31
AQFANIHDII

SEQ ID NO: 69756 - protein, 10 aa, Borrelia burgdorferi B31
SSRGEPNDQF

SEQ ID NO: 69757 - protein, 11 aa, Borrelia burgdorferi B31
GMRAEIFSKIF

SEQ ID NO: 69758 - protein, 11 aa, Borrelia burgdorferi B31
AQFANIHDIIL

SEQ ID NO: 69759 - protein, 11 aa, Borrelia burgdorferi B31
LVKETLINRGF

SEQ ID NO: 69760 - protein, 11 aa, Borrelia burgdorferi B31
QLNKPNLETLY

SEQ ID NO: 69761 - protein, 11 aa, Borrelia burgdorferi B31
ILKNNKLIAIF

SEQ ID NO: 69762 - protein, 11 aa, Borrelia burgdorferi B31
ILSKLSQDSNY

SEQ ID NO: 69763 - protein, 11 aa, Borrelia burgdorferi B31
KLIAIFLLHVL

SEQ ID NO: 69764 - protein, 11 aa, Borrelia burgdorferi B31
IFFNANSTVHF

SEQ ID NO: 69765 - protein, 11 aa, Borrelia burgdorferi B31
TLRSKNSRAQF

SEQ ID NO: 69766 - protein, 11 aa, Borrelia burgdorferi B31
IQKILDRSENI

SEQ ID NO: 69767 - protein, 11 aa, Borrelia burgdorferi B31
TLINRGFSIQL

SEQ ID NO: 69768 - protein, 11 aa, Borrelia burgdorferi B31
QQLNKPNLETL

SEQ ID NO: 69769 - protein, 11 aa, Borrelia burgdorferi B31
INRGFSIQLAM

SEQ ID NO: 69770 - protein, 11 aa, Borrelia burgdorferi B31
TSLNFNEGKIF

SEQ ID NO: 69771 - protein, 9 aa, Borrelia burgdorferi B31
KRKGKVENL

SEQ ID NO: 69772 - protein, 9 aa, Borrelia burgdorferi B31
RRMLYTSLN

SEQ ID NO: 69773 - protein, 9 aa, Borrelia burgdorferi B31
YRGLVKETL

SEQ ID NO: 69774 - protein, 9 aa, Borrelia burgdorferi B31
ERRMLYTSL

SEQ ID NO: 69775 - protein, 9 aa, Borrelia burgdorferi B31
MRAEIFSKI

SEQ ID NO: 69776 - protein, 9 aa, Borrelia burgdorferi B31
RMLYTSLNF

SEQ ID NO: 69777 - protein, 10 aa, Borrelia burgdorferi B31
RRMLYTSLNF

SEQ ID NO: 69778 - protein, 10 aa, Borrelia burgdorferi B31
MRAEIFSKIF

SEQ ID NO: 69779 - protein, 10 aa, Borrelia burgdorferi B31
LRSKNSRAQF

SEQ ID NO: 69780 - protein, 10 aa, Borrelia burgdorferi B31
KRKGKVENLL

SEQ ID NO: 69781 - protein, 11 aa, Borrelia burgdorferi B31
MRAEIFSKIFF

SEQ ID NO: 69782 - protein, 11 aa, Borrelia burgdorferi B31
KRKGKVENLLV

SEQ ID NO: 69783 - protein, 11 aa, Borrelia burgdorferi B31
ERRMLYTSLNF

SEQ ID NO: 69784 - protein, 11 aa, Borrelia burgdorferi B31
RRMLYTSLNFN

SEQ ID NO: 69785 - protein, 9 aa, Borrelia burgdorferi B31
TVHFDSHEY

SEQ ID NO: 69786 - protein, 9 aa, Borrelia burgdorferi B31
FANIHDIIL

SEQ ID NO: 69787 - protein, 9 aa, Borrelia burgdorferi B31
IAIFLLHVL

SEQ ID NO: 69788 - protein, 9 aa, Borrelia burgdorferi B31
NPDLQTDVS

SEQ ID NO: 69789 - protein, 9 aa, Borrelia burgdorferi B31
LVNTTTNIL

SEQ ID NO: 69790 - protein, 9 aa, Borrelia burgdorferi B31
DTDDLIDEY

SEQ ID NO: 69791 - protein, 9 aa, Borrelia burgdorferi B31
FFNANSTVH

SEQ ID NO: 69792 - protein, 9 aa, Borrelia burgdorferi B31
RAEIFSKIF

SEQ ID NO: 69793 - protein, 9 aa, Borrelia burgdorferi B31
EPNDQFGMR

SEQ ID NO: 69794 - protein, 9 aa, Borrelia burgdorferi B31
FNANSTVHF

SEQ ID NO: 69795 - protein, 9 aa, Borrelia burgdorferi B31
NPNANANNA

SEQ ID NO: 69796 - protein, 10 aa, Borrelia burgdorferi B31
FFNANSTVHF

SEQ ID NO: 69797 - protein, 10 aa, Borrelia burgdorferi B31
STVHFDSHEY

SEQ ID NO: 69798 - protein, 10 aa, Borrelia burgdorferi B31
EPNDQFGMRA

SEQ ID NO: 69799 - protein, 10 aa, Borrelia burgdorferi B31
MRAEIFSKIF

SEQ ID NO: 69800 - protein, 10 aa, Borrelia burgdorferi B31
NPNANANNAP

SEQ ID NO: 69801 - protein, 10 aa, Borrelia burgdorferi B31
RAEIFSKIFF

SEQ ID NO: 69802 - protein, 10 aa, Borrelia burgdorferi B31
DLVNTTTNIL

SEQ ID NO: 69803 - protein, 11 aa, Borrelia burgdorferi B31
KPNLETLYNDF

SEQ ID NO: 69804 - protein, 11 aa, Borrelia burgdorferi B31
FANIHDIILDL

SEQ ID NO: 69805 - protein, 11 aa, Borrelia burgdorferi B31
NSTVHFDSHEY

SEQ ID NO: 69806 - protein, 11 aa, Borrelia burgdorferi B31
EPNDQFGMRAE

SEQ ID NO: 69807 - protein, 11 aa, Borrelia burgdorferi B31
NPDLQTDVSKL

SEQ ID NO: 69808 - protein, 11 aa, Borrelia burgdorferi B31
LAMEEISAKIL

SEQ ID NO: 69809 - protein, 11 aa, Borrelia burgdorferi B31
IFFNANSTVHF

SEQ ID NO: 69810 - protein, 11 aa, Borrelia burgdorferi B31
LKDTDDLIDEY

SEQ ID NO: 69811 - protein, 11 aa, Borrelia burgdorferi B31
NPNANANNAPK

SEQ ID NO: 69812 - protein, 11 aa, Borrelia burgdorferi B31
NANSTVHFDSH

SEQ ID NO: 69813 - protein, 11 aa, Borrelia burgdorferi B31
MRAEIFSKIFF

SEQ ID NO: 69814 - protein, 11 aa, Borrelia burgdorferi B31
TSLNFNEGKIF

SEQ ID NO: 69815 - protein, 9 aa, Borrelia burgdorferi B31
AEIFSKIFF

SEQ ID NO: 69816 - protein, 9 aa, Borrelia burgdorferi B31
EEISAKILN

SEQ ID NO: 69817 - protein, 9 aa, Borrelia burgdorferi B31
KETLINRGF

SEQ ID NO: 69818 - protein, 9 aa, Borrelia burgdorferi B31
SEMDSSRGE

SEQ ID NO: 69819 - protein, 9 aa, Borrelia burgdorferi B31
GEPNDQFGM

SEQ ID NO: 69820 - protein, 10 aa, Borrelia burgdorferi B31
EEISAKILNV

SEQ ID NO: 69821 - protein, 10 aa, Borrelia burgdorferi B31
SENIIQISEM

SEQ ID NO: 69822 - protein, 10 aa, Borrelia burgdorferi B31
AEIFSKIFFN

SEQ ID NO: 69823 - protein, 11 aa, Borrelia burgdorferi B31
AEIFSKIFFNA

SEQ ID NO: 69824 - protein, 11 aa, Borrelia burgdorferi B31
SEMDSSRGEPN

SEQ ID NO: 69825 - protein, 11 aa, Borrelia burgdorferi B31
EEISAKILNVK

SEQ ID NO: 69826 - protein, 11 aa, Borrelia burgdorferi B31
KETLINRGFSI

SEQ ID NO: 69827 - protein, 11 aa, Borrelia burgdorferi B31
HEYTEERRMLY

SEQ ID NO: 69828 - protein, 11 aa, Borrelia burgdorferi B31
SENIIQISEMD

SEQ ID NO: 69829 - protein, 9 aa, Borrelia burgdorferi B31
IAIFLLHVL

SEQ ID NO: 69830 - protein, 10 aa, Borrelia burgdorferi B31
LAMEEISAKI

SEQ ID NO: 69831 - protein, 10 aa, Borrelia burgdorferi B31
LHVLTVLILI

SEQ ID NO: 69832 - protein, 11 aa, Borrelia burgdorferi B31
IAIFLLHVLTV

SEQ ID NO: 69833 - protein, 9 aa, Borrelia burgdorferi B31
KLTSLKEKW

SEQ ID NO: 69834 - protein, 10 aa, Borrelia burgdorferi B31
STVHFDSHEY

SEQ ID NO: 69835 - protein, 11 aa, Borrelia burgdorferi B31
NSTVHFDSHEY

SEQ ID NO: 69836 - protein, 9 aa, Borrelia garinii PBi
FTDIHNIIL

SEQ ID NO: 69837 - protein, 9 aa, Borrelia garinii PBi
YVNERRILY

SEQ ID NO: 69838 - protein, 9 aa, Borrelia garinii PBi
DVDDIIKDY

SEQ ID NO: 69839 - protein, 10 aa, Borrelia garinii PBi
RTDISKLNDY

SEQ ID NO: 69840 - protein, 10 aa, Borrelia garinii PBi
STVTFDDNEY

SEQ ID NO: 69841 - protein, 10 aa, Borrelia garinii PBi
FTDIHNIILN

SEQ ID NO: 69842 - protein, 11 aa, Borrelia garinii PBi
FTDIHNIILNL

SEQ ID NO: 69843 - protein, 11 aa, Borrelia garinii PBi
HLNKPNLKTLY

SEQ ID NO: 69844 - protein, 11 aa, Borrelia garinii PBi
GSTVTFDDNEY

SEQ ID NO: 69845 - protein, 11 aa, Borrelia garinii PBi
RTDISKLNDYI

SEQ ID NO: 69846 - protein, 9 aa, Borrelia garinii PBi
FLLHILTGL

SEQ ID NO: 69847 - protein, 9 aa, Borrelia garinii PBi
ILLSCSLEV

SEQ ID NO: 69848 - protein, 9 aa, Borrelia garinii PBi
VTFDDNEYV

SEQ ID NO: 69849 - protein, 9 aa, Borrelia garinii PBi
ILINRGFSI

SEQ ID NO: 69850 - protein, 9 aa, Borrelia garinii PBi
NLINTTTNI

SEQ ID NO: 69851 - protein, 9 aa, Borrelia garinii PBi
HILTGLILL

SEQ ID NO: 69852 - protein, 9 aa, Borrelia garinii PBi
NLLVAINTL

SEQ ID NO: 69853 - protein, 9 aa, Borrelia garinii PBi
TLYHDFNKL

SEQ ID NO: 69854 - protein, 9 aa, Borrelia garinii PBi
KLNDYIISK

SEQ ID NO: 69855 - protein, 9 aa, Borrelia garinii PBi
AQFTDIHNI

SEQ ID NO: 69856 - protein, 9 aa, Borrelia garinii PBi
LIAIFLLHI

SEQ ID NO: 69857 - protein, 9 aa, Borrelia garinii PBi
GLILLSCSL

SEQ ID NO: 69858 - protein, 9 aa, Borrelia garinii PBi
QLAIEEISL

SEQ ID NO: 69859 - protein, 9 aa, Borrelia garinii PBi
FTDIHNIIL

SEQ ID NO: 69860 - protein, 9 aa, Borrelia garinii PBi
YIISKNSKA

SEQ ID NO: 69861 - protein, 9 aa, Borrelia garinii PBi
NLGKILSKL

SEQ ID NO: 69862 - protein, 9 aa, Borrelia garinii PBi
KILERSEDI

SEQ ID NO: 69863 - protein, 9 aa, Borrelia garinii PBi
SIQLAIEEI

SEQ ID NO: 69864 - protein, 9 aa, Borrelia garinii PBi
TTTNILAPI

SEQ ID NO: 69865 - protein, 9 aa, Borrelia garinii PBi
LLHILTGLI

SEQ ID NO: 69866 - protein, 9 aa, Borrelia garinii PBi
TVDNLLVAI

SEQ ID NO: 69867 - protein, 9 aa, Borrelia garinii PBi
ALKQIDPEA

SEQ ID NO: 69868 - protein, 9 aa, Borrelia garinii PBi
ILTGLILLS

SEQ ID NO: 69869 - protein, 9 aa, Borrelia garinii PBi
ILNLINTTT

SEQ ID NO: 69870 - protein, 10 aa, Borrelia garinii PBi
KLIAIFLLHI

SEQ ID NO: 69871 - protein, 10 aa, Borrelia garinii PBi
FLLHILTGLI

SEQ ID NO: 69872 - protein, 10 aa, Borrelia garinii PBi
LILLSCSLEV

SEQ ID NO: 69873 - protein, 10 aa, Borrelia garinii PBi
TLYHDFNKLI

SEQ ID NO: 69874 - protein, 10 aa, Borrelia garinii PBi
KIFFNAGSTV

SEQ ID NO: 69875 - protein, 10 aa, Borrelia garinii PBi
KILERSEDIV

SEQ ID NO: 69876 - protein, 10 aa, Borrelia garinii PBi
NLINTTTNIL

SEQ ID NO: 69877 - protein, 10 aa, Borrelia garinii PBi
LIAIFLLHIL

SEQ ID NO: 69878 - protein, 10 aa, Borrelia garinii PBi
YVNERRILYT

SEQ ID NO: 69879 - protein, 10 aa, Borrelia garinii PBi
KLIPLKEKWL

SEQ ID NO: 69880 - protein, 10 aa, Borrelia garinii PBi
IQLAIEEISL

SEQ ID NO: 69881 - protein, 10 aa, Borrelia garinii PBi
KTLYHDFNKL

SEQ ID NO: 69882 - protein, 10 aa, Borrelia garinii PBi
TVTFDDNEYV

SEQ ID NO: 69883 - protein, 10 aa, Borrelia garinii PBi
FSIQLAIEEI

SEQ ID NO: 69884 - protein, 10 aa, Borrelia garinii PBi
LLHILTGLIL

SEQ ID NO: 69885 - protein, 10 aa, Borrelia garinii PBi
SQDSNYRSLV

SEQ ID NO: 69886 - protein, 10 aa, Borrelia garinii PBi
LINTTTNILA

SEQ ID NO: 69887 - protein, 10 aa, Borrelia garinii PBi
EIFSKIFFNA

SEQ ID NO: 69888 - protein, 10 aa, Borrelia garinii PBi
AQFTDIHNII

SEQ ID NO: 69889 - protein, 11 aa, Borrelia garinii PBi
FLLHILTGLIL

SEQ ID NO: 69890 - protein, 11 aa, Borrelia garinii PBi
KLIAIFLLHIL

SEQ ID NO: 69891 - protein, 11 aa, Borrelia garinii PBi
GLILLSCSLEV

SEQ ID NO: 69892 - protein, 11 aa, Borrelia garinii PBi
ILINRGFSIQL

SEQ ID NO: 69893 - protein, 11 aa, Borrelia garinii PBi
ILNLINTTTNI

SEQ ID NO: 69894 - protein, 11 aa, Borrelia garinii PBi
FTDIHNIILNL

SEQ ID NO: 69895 - protein, 11 aa, Borrelia garinii PBi
STVTFDDNEYV

SEQ ID NO: 69896 - protein, 11 aa, Borrelia garinii PBi
NLINTTTNILA

SEQ ID NO: 69897 - protein, 11 aa, Borrelia garinii PBi
AIFLLHILTGL

SEQ ID NO: 69898 - protein, 11 aa, Borrelia garinii PBi
LLHILTGLILL

SEQ ID NO: 69899 - protein, 11 aa, Borrelia garinii PBi
KLSQDSNYRSL

SEQ ID NO: 69900 - protein, 11 aa, Borrelia garinii PBi
AQFTDIHNIIL

SEQ ID NO: 69901 - protein, 11 aa, Borrelia garinii PBi
IIKDYNANPEL

SEQ ID NO: 69902 - protein, 11 aa, Borrelia garinii PBi
KLNDYIISKNS

SEQ ID NO: 69903 - protein, 11 aa, Borrelia garinii PBi
ILNLGKILSKL

SEQ ID NO: 69904 - protein, 11 aa, Borrelia garinii PBi
KTLYHDFNKLI

SEQ ID NO: 69905 - protein, 11 aa, Borrelia garinii PBi
SIQLAIEEISL

SEQ ID NO: 69906 - protein, 11 aa, Borrelia garinii PBi
ILERSEDIVQI

SEQ ID NO: 69907 - protein, 9 aa, Borrelia garinii PBi
KLNDYIISK

SEQ ID NO: 69908 - protein, 9 aa, Borrelia garinii PBi
KSNSAAALK

SEQ ID NO: 69909 - protein, 9 aa, Borrelia garinii PBi
KLIAIFLLH

SEQ ID NO: 69910 - protein, 9 aa, Borrelia garinii PBi
LLVAINTLK

SEQ ID NO: 69911 - protein, 9 aa, Borrelia garinii PBi
KTLYHDFNK

SEQ ID NO: 69912 - protein, 9 aa, Borrelia garinii PBi
KLSKNAKNK

SEQ ID NO: 69913 - protein, 9 aa, Borrelia garinii PBi
ISLRTLNVK

SEQ ID NO: 69914 - protein, 9 aa, Borrelia garinii PBi
YVNERRILY

SEQ ID NO: 69915 - protein, 9 aa, Borrelia garinii PBi
SSKMKKLSK

SEQ ID NO: 69916 - protein, 9 aa, Borrelia garinii PBi
EMKAEIFSK

SEQ ID NO: 69917 - protein, 9 aa, Borrelia garinii PBi
KLSQDSNYR

SEQ ID NO: 69918 - protein, 9 aa, Borrelia garinii PBi
TSLNFNENK

SEQ ID NO: 69919 - protein, 9 aa, Borrelia garinii PBi
DSNYRSLVK

SEQ ID NO: 69920 - protein, 9 aa, Borrelia garinii PBi
LNLGKILSK

SEQ ID NO: 69921 - protein, 10 aa, Borrelia garinii PBi
ILNLGKILSK

SEQ ID NO: 69922 - protein, 10 aa, Borrelia garinii PBi
NLLVAINTLK

SEQ ID NO: 69923 - protein, 10 aa, Borrelia garinii PBi
AINTLKNPPK

SEQ ID NO: 69924 - protein, 10 aa, Borrelia garinii PBi
LIPLKEKWLK

SEQ ID NO: 69925 - protein, 10 aa, Borrelia garinii PBi
KQPNNANALK

SEQ ID NO: 69926 - protein, 10 aa, Borrelia garinii PBi
KMKKLSKNAK

SEQ ID NO: 69927 - protein, 10 aa, Borrelia garinii PBi
QDSNYRSLVK

SEQ ID NO: 69928 - protein, 10 aa, Borrelia garinii PBi
KLSKNAKNKK

SEQ ID NO: 69929 - protein, 10 aa, Borrelia garinii PBi
NSSKMKKLSK

SEQ ID NO: 69930 - protein, 10 aa, Borrelia garinii PBi
SLRTLNVKDK

SEQ ID NO: 69931 - protein, 10 aa, Borrelia garinii PBi
KSENNSSKMK

SEQ ID NO: 69932 - protein, 10 aa, Borrelia garinii PBi
SENNSSKMKK

SEQ ID NO: 69933 - protein, 10 aa, Borrelia garinii PBi
EISLRTLNVK

SEQ ID NO: 69934 - protein, 10 aa, Borrelia garinii PBi
SKLNDYIISK

SEQ ID NO: 69935 - protein, 10 aa, Borrelia garinii PBi
IQHLNKPNLK

SEQ ID NO: 69936 - protein, 10 aa, Borrelia garinii PBi
YTSLNFNENK

SEQ ID NO: 69937 - protein, 10 aa, Borrelia garinii PBi
NKSNSAAALK

SEQ ID NO: 69938 - protein, 10 aa, Borrelia garinii PBi
LKNPPKTAGK

SEQ ID NO: 69939 - protein, 10 aa, Borrelia garinii PBi
TSKSENNSSK

SEQ ID NO: 69940 - protein, 10 aa, Borrelia garinii PBi
QKKAKTKTSK

SEQ ID NO: 69941 - protein, 10 aa, Borrelia garinii PBi
HDFNKLIPLK

SEQ ID NO: 69942 - protein, 10 aa, Borrelia garinii PBi
SLVKEILINR

SEQ ID NO: 69943 - protein, 10 aa, Borrelia garinii PBi
ALKQIDPEAK

SEQ ID NO: 69944 - protein, 10 aa, Borrelia garinii PBi
FEMKAEIFSK

SEQ ID NO: 69945 - protein, 11 aa, Borrelia garinii PBi
KILNLGKILSK

SEQ ID NO: 69946 - protein, 11 aa, Borrelia garinii PBi
HLNKPNLKTLY

SEQ ID NO: 69947 - protein, 11 aa, Borrelia garinii PBi
KLIPLKEKWLK

SEQ ID NO: 69948 - protein, 11 aa, Borrelia garinii PBi
KIQHLNKPNLK

SEQ ID NO: 69949 - protein, 11 aa, Borrelia garinii PBi
KTSKSENNSSK

SEQ ID NO: 69950 - protein, 11 aa, Borrelia garinii PBi
TLKNPPKTAGK

SEQ ID NO: 69951 - protein, 11 aa, Borrelia garinii PBi
KSENNSSKMKK

SEQ ID NO: 69952 - protein, 11 aa, Borrelia garinii PBi
KQKKAKTKTSK

SEQ ID NO: 69953 - protein, 11 aa, Borrelia garinii PBi
NLKTLYHDFNK

SEQ ID NO: 69954 - protein, 11 aa, Borrelia garinii PBi
ILSKLSQDSNY

SEQ ID NO: 69955 - protein, 11 aa, Borrelia garinii PBi
ISKLNDYIISK

SEQ ID NO: 69956 - protein, 11 aa, Borrelia garinii PBi
RSLVKEILINR

SEQ ID NO: 69957 - protein, 11 aa, Borrelia garinii PBi
ISLRTLNVKDK

SEQ ID NO: 69958 - protein, 11 aa, Borrelia garinii PBi
IVQISEIDANK

SEQ ID NO: 69959 - protein, 11 aa, Borrelia garinii PBi
NVKDKIQHLNK

SEQ ID NO: 69960 - protein, 9 aa, Borrelia garinii PBi
KTLYHDFNK

SEQ ID NO: 69961 - protein, 9 aa, Borrelia garinii PBi
KSNSAAALK

SEQ ID NO: 69962 - protein, 9 aa, Borrelia garinii PBi
KLNDYIISK

SEQ ID NO: 69963 - protein, 9 aa, Borrelia garinii PBi
TSLNFNENK

SEQ ID NO: 69964 - protein, 9 aa, Borrelia garinii PBi
SSKMKKLSK

SEQ ID NO: 69965 - protein, 9 aa, Borrelia garinii PBi
ISLRTLNVK

SEQ ID NO: 69966 - protein, 9 aa, Borrelia garinii PBi
LLVAINTLK

SEQ ID NO: 69967 - protein, 9 aa, Borrelia garinii PBi
KLIAIFLLH

SEQ ID NO: 69968 - protein, 9 aa, Borrelia garinii PBi
QISEIDANK

SEQ ID NO: 69969 - protein, 9 aa, Borrelia garinii PBi
DSNYRSLVK

SEQ ID NO: 69970 - protein, 9 aa, Borrelia garinii PBi
YVNERRILY

SEQ ID NO: 69971 - protein, 9 aa, Borrelia garinii PBi
EMKAEIFSK

SEQ ID NO: 69972 - protein, 9 aa, Borrelia garinii PBi
KLSKNAKNK

SEQ ID NO: 69973 - protein, 9 aa, Borrelia garinii PBi
LVKEILINR

SEQ ID NO: 69974 - protein, 9 aa, Borrelia garinii PBi
KLSQDSNYR

SEQ ID NO: 69975 - protein, 9 aa, Borrelia garinii PBi
LAIEEISLR

SEQ ID NO: 69976 - protein, 10 aa, Borrelia garinii PBi
AINTLKNPPK

SEQ ID NO: 69977 - protein, 10 aa, Borrelia garinii PBi
YTSLNFNENK

SEQ ID NO: 69978 - protein, 10 aa, Borrelia garinii PBi
ILNLGKILSK

SEQ ID NO: 69979 - protein, 10 aa, Borrelia garinii PBi
TSKSENNSSK

SEQ ID NO: 69980 - protein, 10 aa, Borrelia garinii PBi
VQISEIDANK

SEQ ID NO: 69981 - protein, 10 aa, Borrelia garinii PBi
NSSKMKKLSK

SEQ ID NO: 69982 - protein, 10 aa, Borrelia garinii PBi
KSENNSSKMK

SEQ ID NO: 69983 - protein, 10 aa, Borrelia garinii PBi
IQHLNKPNLK

SEQ ID NO: 69984 - protein, 10 aa, Borrelia garinii PBi
NLLVAINTLK

SEQ ID NO: 69985 - protein, 10 aa, Borrelia garinii PBi
KQPNNANALK

SEQ ID NO: 69986 - protein, 10 aa, Borrelia garinii PBi
EISLRTLNVK

SEQ ID NO: 69987 - protein, 10 aa, Borrelia garinii PBi
KLSKNAKNKK

SEQ ID NO: 69988 - protein, 10 aa, Borrelia garinii PBi
KMKKLSKNAK

SEQ ID NO: 69989 - protein, 10 aa, Borrelia garinii PBi
SLVKEILINR

SEQ ID NO: 69990 - protein, 10 aa, Borrelia garinii PBi
ALKQIDPEAK

SEQ ID NO: 69991 - protein, 10 aa, Borrelia garinii PBi
STVTFDDNEY

SEQ ID NO: 69992 - protein, 10 aa, Borrelia garinii PBi
SENNSSKMKK

SEQ ID NO: 69993 - protein, 10 aa, Borrelia garinii PBi
SKLNDYIISK

SEQ ID NO: 69994 - protein, 10 aa, Borrelia garinii PBi
EVNQDDNQEK

SEQ ID NO: 69995 - protein, 10 aa, Borrelia garinii PBi
LIPLKEKWLK

SEQ ID NO: 69996 - protein, 10 aa, Borrelia garinii PBi
SLRTLNVKDK

SEQ ID NO: 69997 - protein, 10 aa, Borrelia garinii PBi
HDFNKLIPLK

SEQ ID NO: 69998 - protein, 11 aa, Borrelia garinii PBi
KTSKSENNSSK

SEQ ID NO: 69999 - protein, 11 aa, Borrelia garinii PBi
KIQHLNKPNLK

SEQ ID NO: 70000 - protein, 11 aa, Borrelia garinii PBi
KILNLGKILSK

SEQ ID NO: 70001 - protein, 11 aa, Borrelia garinii PBi
VAINTLKNPPK

SEQ ID NO: 70002 - protein, 11 aa, Borrelia garinii PBi
IVQISEIDANK

SEQ ID NO: 70003 - protein, 11 aa, Borrelia garinii PBi
KSENNSSKMKK

SEQ ID NO: 70004 - protein, 11 aa, Borrelia garinii PBi
KLIPLKEKWLK

SEQ ID NO: 70005 - protein, 11 aa, Borrelia garinii PBi
SQDSNYRSLVK

SEQ ID NO: 70006 - protein, 11 aa, Borrelia garinii PBi
ISKLNDYIISK

SEQ ID NO: 70007 - protein, 11 aa, Borrelia garinii PBi
RSLVKEILINR

SEQ ID NO: 70008 - protein, 11 aa, Borrelia garinii PBi
NVKDKIQHLNK

SEQ ID NO: 70009 - protein, 11 aa, Borrelia garinii PBi
ISLRTLNVKDK

SEQ ID NO: 70010 - protein, 11 aa, Borrelia garinii PBi
TLKNPPKTAGK

SEQ ID NO: 70011 - protein, 11 aa, Borrelia garinii PBi
NLKTLYHDFNK

SEQ ID NO: 70012 - protein, 11 aa, Borrelia garinii PBi
IQLAIEEISLR

SEQ ID NO: 70013 - protein, 11 aa, Borrelia garinii PBi
KQKKAKTKTSK

SEQ ID NO: 70014 - protein, 11 aa, Borrelia garinii PBi
NALKQIDPEAK

SEQ ID NO: 70015 - protein, 11 aa, Borrelia garinii PBi
LYTSLNFNENK

SEQ ID NO: 70016 - protein, 9 aa, Borrelia garinii PBi
LYHDFNKLI

SEQ ID NO: 70017 - protein, 9 aa, Borrelia garinii PBi
KWLKDVDDI

SEQ ID NO: 70018 - protein, 9 aa, Borrelia garinii PBi
NYRSLVKEI

SEQ ID NO: 70019 - protein, 9 aa, Borrelia garinii PBi
QFTDIHNII

SEQ ID NO: 70020 - protein, 9 aa, Borrelia garinii PBi
RILYTSLNF

SEQ ID NO: 70021 - protein, 9 aa, Borrelia garinii PBi
EYVNERRIL

SEQ ID NO: 70022 - protein, 10 aa, Borrelia garinii PBi
KWLKDVDDII

SEQ ID NO: 70023 - protein, 10 aa, Borrelia garinii PBi
FFNAGSTVTF

SEQ ID NO: 70024 - protein, 10 aa, Borrelia garinii PBi
IFLLHILTGL

SEQ ID NO: 70025 - protein, 10 aa, Borrelia garinii PBi
NYRSLVKEIL

SEQ ID NO: 70026 - protein, 11 aa, Borrelia garinii PBi
IFLLHILTGLI

SEQ ID NO: 70027 - protein, 11 aa, Borrelia garinii PBi
IFFNAGSTVTF

SEQ ID NO: 70028 - protein, 11 aa, Borrelia garinii PBi
NYRSLVKEILI

SEQ ID NO: 70029 - protein, 11 aa, Borrelia garinii PBi
LYHDFNKLIPL

SEQ ID NO: 70030 - protein, 9 aa, Borrelia garinii PBi
YVNERRILY

SEQ ID NO: 70031 - protein, 9 aa, Borrelia garinii PBi
TVTFDDNEY

SEQ ID NO: 70032 - protein, 10 aa, Borrelia garinii PBi
EYVNERRILY

SEQ ID NO: 70033 - protein, 10 aa, Borrelia garinii PBi
FFNAGSTVTF

SEQ ID NO: 70034 - protein, 10 aa, Borrelia garinii PBi
STVTFDDNEY

SEQ ID NO: 70035 - protein, 11 aa, Borrelia garinii PBi
HLNKPNLKTLY

SEQ ID NO: 70036 - protein, 11 aa, Borrelia garinii PBi
ILSKLSQDSNY

SEQ ID NO: 70037 - protein, 11 aa, Borrelia garinii PBi
YIISKNSKAQF

SEQ ID NO: 70038 - protein, 11 aa, Borrelia garinii PBi
IFFNAGSTVTF

SEQ ID NO: 70039 - protein, 9 aa, Borrelia garinii PBi
LAIEEISLR

SEQ ID NO: 70040 - protein, 9 aa, Borrelia garinii PBi
ELIQKILER

SEQ ID NO: 70041 - protein, 9 aa, Borrelia garinii PBi
TSLNFNENK

SEQ ID NO: 70042 - protein, 9 aa, Borrelia garinii PBi
LLVAINTLK

SEQ ID NO: 70043 - protein, 9 aa, Borrelia garinii PBi
QISEIDANK

SEQ ID NO: 70044 - protein, 9 aa, Borrelia garinii PBi
EMKAEIFSK

SEQ ID NO: 70045 - protein, 9 aa, Borrelia garinii PBi
LVKEILINR

SEQ ID NO: 70046 - protein, 9 aa, Borrelia garinii PBi
DYNANPELR

SEQ ID NO: 70047 - protein, 9 aa, Borrelia garinii PBi
TVTFDDNEY

SEQ ID NO: 70048 - protein, 9 aa, Borrelia garinii PBi
DSNYRSLVK

SEQ ID NO: 70049 - protein, 9 aa, Borrelia garinii PBi
KSNSAAALK

SEQ ID NO: 70050 - protein, 9 aa, Borrelia garinii PBi
DFNKLIPLK

SEQ ID NO: 70051 - protein, 9 aa, Borrelia garinii PBi
ENNSSKMKK

SEQ ID NO: 70052 - protein, 9 aa, Borrelia garinii PBi
KTLYHDFNK

SEQ ID NO: 70053 - protein, 9 aa, Borrelia garinii PBi
QPNNANALK

SEQ ID NO: 70054 - protein, 9 aa, Borrelia garinii PBi
EIFSKIFFN

SEQ ID NO: 70055 - protein, 9 aa, Borrelia garinii PBi
DNEYVNERR

SEQ ID NO: 70056 - protein, 9 aa, Borrelia garinii PBi
DYIISKNSK

SEQ ID NO: 70057 - protein, 9 aa, Borrelia garinii PBi
YVNERRILY

SEQ ID NO: 70058 - protein, 9 aa, Borrelia garinii PBi
DDNEYVNER

SEQ ID NO: 70059 - protein, 9 aa, Borrelia garinii PBi
LSKNAKNKK

SEQ ID NO: 70060 - protein, 9 aa, Borrelia garinii PBi
TTNILAPIQ

SEQ ID NO: 70061 - protein, 9 aa, Borrelia garinii PBi
KLSQDSNYR

SEQ ID NO: 70062 - protein, 9 aa, Borrelia garinii PBi
KLNDYIISK

SEQ ID NO: 70063 - protein, 9 aa, Borrelia garinii PBi
ENKILNLGK

SEQ ID NO: 70064 - protein, 10 aa, Borrelia garinii PBi
YTSLNFNENK

SEQ ID NO: 70065 - protein, 10 aa, Borrelia garinii PBi
EVNQDDNQEK

SEQ ID NO: 70066 - protein, 10 aa, Borrelia garinii PBi
EISLRTLNVK

SEQ ID NO: 70067 - protein, 10 aa, Borrelia garinii PBi
QLAIEEISLR

SEQ ID NO: 70068 - protein, 10 aa, Borrelia garinii PBi
TSKSENNSSK

SEQ ID NO: 70069 - protein, 10 aa, Borrelia garinii PBi
STVTFDDNEY

SEQ ID NO: 70070 - protein, 10 aa, Borrelia garinii PBi
SLVKEILINR

SEQ ID NO: 70071 - protein, 10 aa, Borrelia garinii PBi
NLLVAINTLK

SEQ ID NO: 70072 - protein, 10 aa, Borrelia garinii PBi
NSSKMKKLSK

SEQ ID NO: 70073 - protein, 10 aa, Borrelia garinii PBi
TTTNILAPIQ

SEQ ID NO: 70074 - protein, 10 aa, Borrelia garinii PBi
DDNEYVNERR

SEQ ID NO: 70075 - protein, 10 aa, Borrelia garinii PBi
HDFNKLIPLK

SEQ ID NO: 70076 - protein, 10 aa, Borrelia garinii PBi
NKSNSAAALK

SEQ ID NO: 70077 - protein, 10 aa, Borrelia garinii PBi
FEMKAEIFSK

SEQ ID NO: 70078 - protein, 10 aa, Borrelia garinii PBi
LIPLKEKWLK

SEQ ID NO: 70079 - protein, 10 aa, Borrelia garinii PBi
ILNLGKILSK

SEQ ID NO: 70080 - protein, 10 aa, Borrelia garinii PBi
NDYIISKNSK

SEQ ID NO: 70081 - protein, 10 aa, Borrelia garinii PBi
LKTLYHDFNK

SEQ ID NO: 70082 - protein, 11 aa, Borrelia garinii PBi
LSKLSQDSNYR

SEQ ID NO: 70083 - protein, 11 aa, Borrelia garinii PBi
LYTSLNFNENK

SEQ ID NO: 70084 - protein, 11 aa, Borrelia garinii PBi
IVQISEIDANK

SEQ ID NO: 70085 - protein, 11 aa, Borrelia garinii PBi
KTSKSENNSSK

SEQ ID NO: 70086 - protein, 11 aa, Borrelia garinii PBi
NVKDKIQHLNK

SEQ ID NO: 70087 - protein, 11 aa, Borrelia garinii PBi
NLKTLYHDFNK

SEQ ID NO: 70088 - protein, 11 aa, Borrelia garinii PBi
TFDDNEYVNER

SEQ ID NO: 70089 - protein, 11 aa, Borrelia garinii PBi
ISKLNDYIISK

SEQ ID NO: 70090 - protein, 11 aa, Borrelia garinii PBi
DNLLVAINTLK

SEQ ID NO: 70091 - protein, 11 aa, Borrelia garinii PBi
IQLAIEEISLR

SEQ ID NO: 70092 - protein, 11 aa, Borrelia garinii PBi
EEISLRTLNVK

SEQ ID NO: 70093 - protein, 11 aa, Borrelia garinii PBi
VAINTLKNPPK

SEQ ID NO: 70094 - protein, 11 aa, Borrelia garinii PBi
NALKQIDPEAK

SEQ ID NO: 70095 - protein, 11 aa, Borrelia garinii PBi
DFNKLIPLKEK

SEQ ID NO: 70096 - protein, 11 aa, Borrelia garinii PBi
NTTTNILAPIQ

SEQ ID NO: 70097 - protein, 11 aa, Borrelia garinii PBi
TLKNPPKTAGK

SEQ ID NO: 70098 - protein, 9 aa, Borrelia garinii PBi
KPTVDNLLV

SEQ ID NO: 70099 - protein, 9 aa, Borrelia garinii PBi
KPNLKTLYH

SEQ ID NO: 70100 - protein, 10 aa, Borrelia garinii PBi
KPTVDNLLVA

SEQ ID NO: 70101 - protein, 11 aa, Borrelia garinii PBi
KPTVDNLLVAI

SEQ ID NO: 70102 - protein, 11 aa, Borrelia garinii PBi
NPELRTDISKL

SEQ ID NO: 70103 - protein, 11 aa, Borrelia garinii PBi
KPNLKTLYHDF

SEQ ID NO: 70104 - protein, 11 aa, Borrelia garinii PBi
QPNNANALKQI

SEQ ID NO: 70105 - protein, 9 aa, Borrelia garinii PBi
YVNERRILY

SEQ ID NO: 70106 - protein, 9 aa, Borrelia garinii PBi
FNAGSTVTF

SEQ ID NO: 70107 - protein, 9 aa, Borrelia garinii PBi
KQPNNANAL

SEQ ID NO: 70108 - protein, 9 aa, Borrelia garinii PBi
RILYTSLNF

SEQ ID NO: 70109 - protein, 9 aa, Borrelia garinii PBi
ISKNSKAQF

SEQ ID NO: 70110 - protein, 9 aa, Borrelia garinii PBi
ILINRGFSI

SEQ ID NO: 70111 - protein, 9 aa, Borrelia garinii PBi
TVTFDDNEY

SEQ ID NO: 70112 - protein, 9 aa, Borrelia garinii PBi
NLKTLYHDF

SEQ ID NO: 70113 - protein, 9 aa, Borrelia garinii PBi
AQFTDIHNI

SEQ ID NO: 70114 - protein, 9 aa, Borrelia garinii PBi
KLIAIFLLH

SEQ ID NO: 70115 - protein, 9 aa, Borrelia garinii PBi
GLILLSCSL

SEQ ID NO: 70116 - protein, 9 aa, Borrelia garinii PBi
IQHLNKPNL

SEQ ID NO: 70117 - protein, 10 aa, Borrelia garinii PBi
FFNAGSTVTF

SEQ ID NO: 70118 - protein, 10 aa, Borrelia garinii PBi
KQIDPEAKEL

SEQ ID NO: 70119 - protein, 10 aa, Borrelia garinii PBi
IQLAIEEISL

SEQ ID NO: 70120 - protein, 10 aa, Borrelia garinii PBi
LSKLSQDSNY

SEQ ID NO: 70121 - protein, 10 aa, Borrelia garinii PBi
DQFEMKAEIF

SEQ ID NO: 70122 - protein, 10 aa, Borrelia garinii PBi
AQFTDIHNII

SEQ ID NO: 70123 - protein, 10 aa, Borrelia garinii PBi
STVTFDDNEY

SEQ ID NO: 70124 - protein, 10 aa, Borrelia garinii PBi
IISKNSKAQF

SEQ ID NO: 70125 - protein, 11 aa, Borrelia garinii PBi
EMKAEIFSKIF

SEQ ID NO: 70126 - protein, 11 aa, Borrelia garinii PBi
IFFNAGSTVTF

SEQ ID NO: 70127 - protein, 11 aa, Borrelia garinii PBi
LVKEILINRGF

SEQ ID NO: 70128 - protein, 11 aa, Borrelia garinii PBi
AQFTDIHNIIL

SEQ ID NO: 70129 - protein, 11 aa, Borrelia garinii PBi
ALKQPNNANAL

SEQ ID NO: 70130 - protein, 11 aa, Borrelia garinii PBi
ILSKLSQDSNY

SEQ ID NO: 70131 - protein, 11 aa, Borrelia garinii PBi
HLNKPNLKTLY

SEQ ID NO: 70132 - protein, 11 aa, Borrelia garinii PBi
YIISKNSKAQF

SEQ ID NO: 70133 - protein, 11 aa, Borrelia garinii PBi
ILINRGFSIQL

SEQ ID NO: 70134 - protein, 11 aa, Borrelia garinii PBi
KLIAIFLLHIL

SEQ ID NO: 70135 - protein, 11 aa, Borrelia garinii PBi
KLSQDSNYRSL

SEQ ID NO: 70136 - protein, 11 aa, Borrelia garinii PBi
KQIDPEAKELI

SEQ ID NO: 70137 - protein, 9 aa, Borrelia garinii PBi
RRILYTSLN

SEQ ID NO: 70138 - protein, 9 aa, Borrelia garinii PBi
KKAKTKTSK

SEQ ID NO: 70139 - protein, 9 aa, Borrelia garinii PBi
ERRILYTSL

SEQ ID NO: 70140 - protein, 9 aa, Borrelia garinii PBi
YRSLVKEIL

SEQ ID NO: 70141 - protein, 10 aa, Borrelia garinii PBi
RRILYTSLNF

SEQ ID NO: 70142 - protein, 11 aa, Borrelia garinii PBi
KQKKAKTKTSK

SEQ ID NO: 70143 - protein, 11 aa, Borrelia garinii PBi
ERRILYTSLNF

SEQ ID NO: 70144 - protein, 11 aa, Borrelia garinii PBi
RRILYTSLNFN

SEQ ID NO: 70145 - protein, 9 aa, Borrelia garinii PBi
TVTFDDNEY

SEQ ID NO: 70146 - protein, 9 aa, Borrelia garinii PBi
YVNERRILY

SEQ ID NO: 70147 - protein, 9 aa, Borrelia garinii PBi
FNAGSTVTF

SEQ ID NO: 70148 - protein, 9 aa, Borrelia garinii PBi
IAIFLLHIL

SEQ ID NO: 70149 - protein, 9 aa, Borrelia garinii PBi
FFNAGSTVT

SEQ ID NO: 70150 - protein, 9 aa, Borrelia garinii PBi
LINTTTNIL

SEQ ID NO: 70151 - protein, 9 aa, Borrelia garinii PBi
NKSNSAAAL

SEQ ID NO: 70152 - protein, 9 aa, Borrelia garinii PBi
NLLVAINTL

SEQ ID NO: 70153 - protein, 9 aa, Borrelia garinii PBi
EPDDQFEMK

SEQ ID NO: 70154 - protein, 9 aa, Borrelia garinii PBi
KAEIFSKIF

SEQ ID NO: 70155 - protein, 10 aa, Borrelia garinii PBi
FFNAGSTVTF

SEQ ID NO: 70156 - protein, 10 aa, Borrelia garinii PBi
STVTFDDNEY

SEQ ID NO: 70157 - protein, 10 aa, Borrelia garinii PBi
MKAEIFSKIF

SEQ ID NO: 70158 - protein, 10 aa, Borrelia garinii PBi
MKNNKLIAIF

SEQ ID NO: 70159 - protein, 10 aa, Borrelia garinii PBi
EPDDQFEMKA

SEQ ID NO: 70160 - protein, 10 aa, Borrelia garinii PBi
DQFEMKAEIF

SEQ ID NO: 70161 - protein, 11 aa, Borrelia garinii PBi
IFFNAGSTVTF

SEQ ID NO: 70162 - protein, 11 aa, Borrelia garinii PBi
KPNLKTLYHDF

SEQ ID NO: 70163 - protein, 11 aa, Borrelia garinii PBi
DANKGEPDDQF

SEQ ID NO: 70164 - protein, 11 aa, Borrelia garinii PBi
LAIEEISLRTL

SEQ ID NO: 70165 - protein, 11 aa, Borrelia garinii PBi
EPDDQFEMKAE

SEQ ID NO: 70166 - protein, 11 aa, Borrelia garinii PBi
MKAEIFSKIFF

SEQ ID NO: 70167 - protein, 11 aa, Borrelia garinii PBi
NPELRTDISKL

SEQ ID NO: 70168 - protein, 11 aa, Borrelia garinii PBi
YIISKNSKAQF

SEQ ID NO: 70169 - protein, 9 aa, Borrelia garinii PBi
KEILINRGF

SEQ ID NO: 70170 - protein, 9 aa, Borrelia garinii PBi
AEIFSKIFF

SEQ ID NO: 70171 - protein, 9 aa, Borrelia garinii PBi
SEIDANKGE

SEQ ID NO: 70172 - protein, 9 aa, Borrelia garinii PBi
FEMKAEIFS

SEQ ID NO: 70173 - protein, 9 aa, Borrelia garinii PBi
GEPDDQFEM

SEQ ID NO: 70174 - protein, 9 aa, Borrelia garinii PBi
EEISLRTLN

SEQ ID NO: 70175 - protein, 10 aa, Borrelia garinii PBi
EEISLRTLNV

SEQ ID NO: 70176 - protein, 10 aa, Borrelia garinii PBi
KEILINRGFS

SEQ ID NO: 70177 - protein, 10 aa, Borrelia garinii PBi
AEIFSKIFFN

SEQ ID NO: 70178 - protein, 10 aa, Borrelia garinii PBi
SEIDANKGEP

SEQ ID NO: 70179 - protein, 10 aa, Borrelia garinii PBi
SEDIVQISEI

SEQ ID NO: 70180 - protein, 11 aa, Borrelia garinii PBi
KEILINRGFSI

SEQ ID NO: 70181 - protein, 11 aa, Borrelia garinii PBi
AEIFSKIFFNA

SEQ ID NO: 70182 - protein, 11 aa, Borrelia garinii PBi
SEIDANKGEPD

SEQ ID NO: 70183 - protein, 11 aa, Borrelia garinii PBi
NEYVNERRILY

SEQ ID NO: 70184 - protein, 9 aa, Borrelia garinii PBi
IAIFLLHIL

SEQ ID NO: 70185 - protein, 11 aa, Borrelia garinii PBi
IPLKEKWLKDV

SEQ ID NO: 70186 - protein, 11 aa, Borrelia garinii PBi
KPTVDNLLVAI

SEQ ID NO: 70187 - protein, 9 aa, Borrelia garinii PBi
KLIPLKEKW

SEQ ID NO: 70188 - protein, 10 aa, Borrelia garinii PBi
STVTFDDNEY

SEQ ID NO: 70189 - protein, 11 aa, Borrelia garinii PBi
GSTVTFDDNEY

SEQ ID NO: 70190 - protein, 9 aa, Borrelia burgdorferi
FSTKLTQMY

SEQ ID NO: 70191 - protein, 9 aa, Borrelia burgdorferi
ISCDLFIRY

SEQ ID NO: 70192 - protein, 9 aa, Borrelia burgdorferi
IIDKNGVWY

SEQ ID NO: 70193 - protein, 10 aa, Borrelia burgdorferi
YTDEIEEEDY

SEQ ID NO: 70194 - protein, 10 aa, Borrelia burgdorferi
NTINKIYDTY

SEQ ID NO: 70195 - protein, 10 aa, Borrelia burgdorferi
FISCDLFIRY

SEQ ID NO: 70196 - protein, 11 aa, Borrelia burgdorferi
YLDEDDEDDEY

SEQ ID NO: 70197 - protein, 11 aa, Borrelia burgdorferi
DSAINTINKIY

SEQ ID NO: 70198 - protein, 9 aa, Borrelia burgdorferi
LLNYIQVSV

SEQ ID NO: 70199 - protein, 9 aa, Borrelia burgdorferi
GLFDKGNSI

SEQ ID NO: 70200 - protein, 9 aa, Borrelia burgdorferi
YLEGVKYNV

SEQ ID NO: 70201 - protein, 9 aa, Borrelia burgdorferi
KTAANFVYI

SEQ ID NO: 70202 - protein, 9 aa, Borrelia burgdorferi
KLENIEAEI

SEQ ID NO: 70203 - protein, 9 aa, Borrelia burgdorferi
NLYEAYKAI

SEQ ID NO: 70204 - protein, 9 aa, Borrelia burgdorferi
AIVTSILLM

SEQ ID NO: 70205 - protein, 9 aa, Borrelia burgdorferi
KTLLNYIQV

SEQ ID NO: 70206 - protein, 9 aa, Borrelia burgdorferi
LMRDSLKEV

SEQ ID NO: 70207 - protein, 9 aa, Borrelia burgdorferi
YLALGLLFG

SEQ ID NO: 70208 - protein, 9 aa, Borrelia burgdorferi
TLLNYIQVS

SEQ ID NO: 70209 - protein, 9 aa, Borrelia burgdorferi
ILETSEESI

SEQ ID NO: 70210 - protein, 9 aa, Borrelia burgdorferi
ALGLLFGFI

SEQ ID NO: 70211 - protein, 9 aa, Borrelia burgdorferi
SLSGESGEL

SEQ ID NO: 70212 - protein, 9 aa, Borrelia burgdorferi
MTQGSLNSL

SEQ ID NO: 70213 - protein, 10 aa, Borrelia burgdorferi
TLLNYIQVSV

SEQ ID NO: 70214 - protein, 10 aa, Borrelia burgdorferi
LLMRDSLKEV

SEQ ID NO: 70215 - protein, 10 aa, Borrelia burgdorferi
LLFGFISCDL

SEQ ID NO: 70216 - protein, 10 aa, Borrelia burgdorferi
GLFDKGNSIL

SEQ ID NO: 70217 - protein, 10 aa, Borrelia burgdorferi
RLSNRYQSYL

SEQ ID NO: 70218 - protein, 10 aa, Borrelia burgdorferi
NLYEAYKAIV

SEQ ID NO: 70219 - protein, 10 aa, Borrelia burgdorferi
KLTQMYSTRL

SEQ ID NO: 70220 - protein, 10 aa, Borrelia burgdorferi
QMYSTRLDNL

SEQ ID NO: 70221 - protein, 10 aa, Borrelia burgdorferi
KIYDTYTLFS

SEQ ID NO: 70222 - protein, 10 aa, Borrelia burgdorferi
GMTQGSLNSL

SEQ ID NO: 70223 - protein, 10 aa, Borrelia burgdorferi
SILETSEESI

SEQ ID NO: 70224 - protein, 10 aa, Borrelia burgdorferi
YLALGLLFGF

SEQ ID NO: 70225 - protein, 10 aa, Borrelia burgdorferi
TLFSTKLTQM

SEQ ID NO: 70226 - protein, 10 aa, Borrelia burgdorferi
LALGLLFGFI

SEQ ID NO: 70227 - protein, 11 aa, Borrelia burgdorferi
YLALGLLFGFI

SEQ ID NO: 70228 - protein, 11 aa, Borrelia burgdorferi
KIYDTYTLFST

SEQ ID NO: 70229 - protein, 11 aa, Borrelia burgdorferi
SLQDIAGSNSI

SEQ ID NO: 70230 - protein, 11 aa, Borrelia burgdorferi
KTLLNYIQVSV

SEQ ID NO: 70231 - protein, 11 aa, Borrelia burgdorferi
ILLMRDSLKEV

SEQ ID NO: 70232 - protein, 11 aa, Borrelia burgdorferi
GLLFGFISCDL

SEQ ID NO: 70233 - protein, 11 aa, Borrelia burgdorferi
YTDEIEEEDYA

SEQ ID NO: 70234 - protein, 11 aa, Borrelia burgdorferi
ILEEESLKTEL

SEQ ID NO: 70235 - protein, 11 aa, Borrelia burgdorferi
TINKIYDTYTL

SEQ ID NO: 70236 - protein, 11 aa, Borrelia burgdorferi
QMYSTRLDNLA

SEQ ID NO: 70237 - protein, 11 aa, Borrelia burgdorferi
LLNYIQVSVKT

SEQ ID NO: 70238 - protein, 11 aa, Borrelia burgdorferi
TQMYSTRLDNL

SEQ ID NO: 70239 - protein, 11 aa, Borrelia burgdorferi
NLYEAYKAIVT

SEQ ID NO: 70240 - protein, 11 aa, Borrelia burgdorferi
YINDTHAKRKL

SEQ ID NO: 70241 - protein, 9 aa, Borrelia burgdorferi
ILLMRDSLK

SEQ ID NO: 70242 - protein, 9 aa, Borrelia burgdorferi
RLSNRYQSY

SEQ ID NO: 70243 - protein, 9 aa, Borrelia burgdorferi
SIKKPMNKK

SEQ ID NO: 70244 - protein, 9 aa, Borrelia burgdorferi
SLKRDSANK

SEQ ID NO: 70245 - protein, 9 aa, Borrelia burgdorferi
RLDNLAKAK

SEQ ID NO: 70246 - protein, 9 aa, Borrelia burgdorferi
DTYTLFSTK

SEQ ID NO: 70247 - protein, 9 aa, Borrelia burgdorferi
QSNLYEAYK

SEQ ID NO: 70248 - protein, 9 aa, Borrelia burgdorferi
IVTSILLMR

SEQ ID NO: 70249 - protein, 9 aa, Borrelia burgdorferi
KLTQMYSTR

SEQ ID NO: 70250 - protein, 9 aa, Borrelia burgdorferi
KIKEQSNLY

SEQ ID NO: 70251 - protein, 9 aa, Borrelia burgdorferi
VILEEESLK

SEQ ID NO: 70252 - protein, 9 aa, Borrelia burgdorferi
ESIKKPMNK

SEQ ID NO: 70253 - protein, 9 aa, Borrelia burgdorferi
STRLDNLAK

SEQ ID NO: 70254 - protein, 9 aa, Borrelia burgdorferi
ISCDLFIRY

SEQ ID NO: 70255 - protein, 9 aa, Borrelia burgdorferi
ESLKTELLK

SEQ ID NO: 70256 - protein, 9 aa, Borrelia burgdorferi
KGKSKVSRK

SEQ ID NO: 70257 - protein, 9 aa, Borrelia burgdorferi
IARKKGKSK

SEQ ID NO: 70258 - protein, 9 aa, Borrelia burgdorferi
KNFKTLLNY

SEQ ID NO: 70259 - protein, 9 aa, Borrelia burgdorferi
QSYLEGVKY

SEQ ID NO: 70260 - protein, 9 aa, Borrelia burgdorferi
LNYIQVSVK

SEQ ID NO: 70261 - protein, 10 aa, Borrelia burgdorferi
LLNYIQVSVK

SEQ ID NO: 70262 - protein, 10 aa, Borrelia burgdorferi
SLSGESGELK

SEQ ID NO: 70263 - protein, 10 aa, Borrelia burgdorferi
SILLMRDSLK

SEQ ID NO: 70264 - protein, 10 aa, Borrelia burgdorferi
KIARKKGKSK

SEQ ID NO: 70265 - protein, 10 aa, Borrelia burgdorferi
KPMNKKGKGK

SEQ ID NO: 70266 - protein, 10 aa, Borrelia burgdorferi
AIVTSILLMR

SEQ ID NO: 70267 - protein, 10 aa, Borrelia burgdorferi
RYQSYLEGVK

SEQ ID NO: 70268 - protein, 10 aa, Borrelia burgdorferi
GIIDKNGVWY

SEQ ID NO: 70269 - protein, 10 aa, Borrelia burgdorferi
FVYINDTHAK

SEQ ID NO: 70270 - protein, 10 aa, Borrelia burgdorferi
SANKSNFLQK

SEQ ID NO: 70271 - protein, 10 aa, Borrelia burgdorferi
ITIDSDLRPK

SEQ ID NO: 70272 - protein, 10 aa, Borrelia burgdorferi
RKEPYIHSLK

SEQ ID NO: 70273 - protein, 10 aa, Borrelia burgdorferi
LLKEQSETRK

SEQ ID NO: 70274 - protein, 10 aa, Borrelia burgdorferi
CDLFIRYEMK

SEQ ID NO: 70275 - protein, 10 aa, Borrelia burgdorferi
YDTYTLFSTK

SEQ ID NO: 70276 - protein, 10 aa, Borrelia burgdorferi
EQSNLYEAYK

SEQ ID NO: 70277 - protein, 10 aa, Borrelia burgdorferi
YINDTHAKRK

SEQ ID NO: 70278 - protein, 10 aa, Borrelia burgdorferi
KLENIEAEIK

SEQ ID NO: 70279 - protein, 10 aa, Borrelia burgdorferi
HSLKRDSANK

SEQ ID NO: 70280 - protein, 10 aa, Borrelia burgdorferi
SVKTAANFVY

SEQ ID NO: 70281 - protein, 10 aa, Borrelia burgdorferi
KIQKQQDEYK

SEQ ID NO: 70282 - protein, 10 aa, Borrelia burgdorferi
NVILEEESLK

SEQ ID NO: 70283 - protein, 10 aa, Borrelia burgdorferi
KIYDTYTLFS

SEQ ID NO: 70284 - protein, 10 aa, Borrelia burgdorferi
YSTRLDNLAK

SEQ ID NO: 70285 - protein, 10 aa, Borrelia burgdorferi
FISCDLFIRY

SEQ ID NO: 70286 - protein, 10 aa, Borrelia burgdorferi
ILETSEESIK

SEQ ID NO: 70287 - protein, 10 aa, Borrelia burgdorferi
YTLFSTKLTQ

SEQ ID NO: 70288 - protein, 11 aa, Borrelia burgdorferi
TLLNYIQVSVK

SEQ ID NO: 70289 - protein, 11 aa, Borrelia burgdorferi
TLFSTKLTQMY

SEQ ID NO: 70290 - protein, 11 aa, Borrelia burgdorferi
RLDNLAKAKAK

SEQ ID NO: 70291 - protein, 11 aa, Borrelia burgdorferi
TSILLMRDSLK

SEQ ID NO: 70292 - protein, 11 aa, Borrelia burgdorferi
SLKEVQGIIDK

SEQ ID NO: 70293 - protein, 11 aa, Borrelia burgdorferi
ILETSEESIKK

SEQ ID NO: 70294 - protein, 11 aa, Borrelia burgdorferi
ELLKEQSETRK

SEQ ID NO: 70295 - protein, 11 aa, Borrelia burgdorferi
SIKKPMNKKGK

SEQ ID NO: 70296 - protein, 11 aa, Borrelia burgdorferi
SILETSEESIK

SEQ ID NO: 70297 - protein, 11 aa, Borrelia burgdorferi
FVYINDTHAKR

SEQ ID NO: 70298 - protein, 11 aa, Borrelia burgdorferi
KAKEEAAKFTK

SEQ ID NO: 70299 - protein, 11 aa, Borrelia burgdorferi
STRLDNLAKAK

SEQ ID NO: 70300 - protein, 11 aa, Borrelia burgdorferi
DSANKSNFLQK

SEQ ID NO: 70301 - protein, 11 aa, Borrelia burgdorferi
NVDSAINTINK

SEQ ID NO: 70302 - protein, 9 aa, Borrelia burgdorferi
DTYTLFSTK

SEQ ID NO: 70303 - protein, 9 aa, Borrelia burgdorferi
QSNLYEAYK

SEQ ID NO: 70304 - protein, 9 aa, Borrelia burgdorferi
STRLDNLAK

SEQ ID NO: 70305 - protein, 9 aa, Borrelia burgdorferi
ILLMRDSLK

SEQ ID NO: 70306 - protein, 9 aa, Borrelia burgdorferi
SIKKPMNKK

SEQ ID NO: 70307 - protein, 9 aa, Borrelia burgdorferi
ISCDLFIRY

SEQ ID NO: 70308 - protein, 9 aa, Borrelia burgdorferi
VILEEESLK

SEQ ID NO: 70309 - protein, 9 aa, Borrelia burgdorferi
IVTSILLMR

SEQ ID NO: 70310 - protein, 9 aa, Borrelia burgdorferi
TIDSDLRPK

SEQ ID NO: 70311 - protein, 9 aa, Borrelia burgdorferi
ESIKKPMNK

SEQ ID NO: 70312 - protein, 9 aa, Borrelia burgdorferi
ESLKTELLK

SEQ ID NO: 70313 - protein, 9 aa, Borrelia burgdorferi
SLKRDSANK

SEQ ID NO: 70314 - protein, 9 aa, Borrelia burgdorferi
ETSEESIKK

SEQ ID NO: 70315 - protein, 9 aa, Borrelia burgdorferi
DSAINTINK

SEQ ID NO: 70316 - protein, 9 aa, Borrelia burgdorferi
LSGESGELK

SEQ ID NO: 70317 - protein, 9 aa, Borrelia burgdorferi
VYINDTHAK

SEQ ID NO: 70318 - protein, 9 aa, Borrelia burgdorferi
ANKSNFLQK

SEQ ID NO: 70319 - protein, 9 aa, Borrelia burgdorferi
RLDNLAKAK

SEQ ID NO: 70320 - protein, 9 aa, Borrelia burgdorferi
YQSYLEGVK

SEQ ID NO: 70321 - protein, 9 aa, Borrelia burgdorferi
AEIKTLIAK

SEQ ID NO: 70322 - protein, 9 aa, Borrelia burgdorferi
FISCDLFIR

SEQ ID NO: 70323 - protein, 9 aa, Borrelia burgdorferi
YINDTHAKR

SEQ ID NO: 70324 - protein, 9 aa, Borrelia burgdorferi
KLTQMYSTR

SEQ ID NO: 70325 - protein, 9 aa, Borrelia burgdorferi
SANKSNFLQ

SEQ ID NO: 70326 - protein, 10 aa, Borrelia burgdorferi
SANKSNFLQK

SEQ ID NO: 70327 - protein, 10 aa, Borrelia burgdorferi
SILLMRDSLK

SEQ ID NO: 70328 - protein, 10 aa, Borrelia burgdorferi
ITIDSDLRPK

SEQ ID NO: 70329 - protein, 10 aa, Borrelia burgdorferi
SLSGESGELK

SEQ ID NO: 70330 - protein, 10 aa, Borrelia burgdorferi
FVYINDTHAK

SEQ ID NO: 70331 - protein, 10 aa, Borrelia burgdorferi
KIQKQQDEYK

SEQ ID NO: 70332 - protein, 10 aa, Borrelia burgdorferi
AIVTSILLMR

SEQ ID NO: 70333 - protein, 10 aa, Borrelia burgdorferi
NVILEEESLK

SEQ ID NO: 70334 - protein, 10 aa, Borrelia burgdorferi
HSLKRDSANK

SEQ ID NO: 70335 - protein, 10 aa, Borrelia burgdorferi
YINDTHAKRK

SEQ ID NO: 70336 - protein, 10 aa, Borrelia burgdorferi
YSTRLDNLAK

SEQ ID NO: 70337 - protein, 10 aa, Borrelia burgdorferi
LLNYIQVSVK

SEQ ID NO: 70338 - protein, 10 aa, Borrelia burgdorferi
KIARKKGKSK

SEQ ID NO: 70339 - protein, 10 aa, Borrelia burgdorferi
SVKTAANFVY

SEQ ID NO: 70340 - protein, 10 aa, Borrelia burgdorferi
ESIKKPMNKK

SEQ ID NO: 70341 - protein, 10 aa, Borrelia burgdorferi
KAKAKEEAAK

SEQ ID NO: 70342 - protein, 10 aa, Borrelia burgdorferi
EQSNLYEAYK

SEQ ID NO: 70343 - protein, 10 aa, Borrelia burgdorferi
RYQSYLEGVK

SEQ ID NO: 70344 - protein, 10 aa, Borrelia burgdorferi
KIYDTYTLFS

SEQ ID NO: 70345 - protein, 10 aa, Borrelia burgdorferi
KLENIEAEIK

SEQ ID NO: 70346 - protein, 10 aa, Borrelia burgdorferi
FISCDLFIRY

SEQ ID NO: 70347 - protein, 11 aa, Borrelia burgdorferi
TSILLMRDSLK

SEQ ID NO: 70348 - protein, 11 aa, Borrelia burgdorferi
SILETSEESIK

SEQ ID NO: 70349 - protein, 11 aa, Borrelia burgdorferi
TLLNYIQVSVK

SEQ ID NO: 70350 - protein, 11 aa, Borrelia burgdorferi
NVDSAINTINK

SEQ ID NO: 70351 - protein, 11 aa, Borrelia burgdorferi
KAIVTSILLMR

SEQ ID NO: 70352 - protein, 11 aa, Borrelia burgdorferi
STRLDNLAKAK

SEQ ID NO: 70353 - protein, 11 aa, Borrelia burgdorferi
STKLTQMYSTR

SEQ ID NO: 70354 - protein, 11 aa, Borrelia burgdorferi
NSLSGESGELK

SEQ ID NO: 70355 - protein, 11 aa, Borrelia burgdorferi
KAKEEAAKFTK

SEQ ID NO: 70356 - protein, 11 aa, Borrelia burgdorferi
AAKFTKEDLEK

SEQ ID NO: 70357 - protein, 11 aa, Borrelia burgdorferi
TLFSTKLTQMY

SEQ ID NO: 70358 - protein, 11 aa, Borrelia burgdorferi
SIKKPMNKKGK

SEQ ID NO: 70359 - protein, 11 aa, Borrelia burgdorferi
DSANKSNFLQK

SEQ ID NO: 70360 - protein, 11 aa, Borrelia burgdorferi
SLKEVQGIIDK

SEQ ID NO: 70361 - protein, 11 aa, Borrelia burgdorferi
MYSTRLDNLAK

SEQ ID NO: 70362 - protein, 11 aa, Borrelia burgdorferi
FTKEDLEKNFK

SEQ ID NO: 70363 - protein, 11 aa, Borrelia burgdorferi
KEQSNLYEAYK

SEQ ID NO: 70364 - protein, 11 aa, Borrelia burgdorferi
ILETSEESIKK

SEQ ID NO: 70365 - protein, 11 aa, Borrelia burgdorferi
QSETRKEKIQK

SEQ ID NO: 70366 - protein, 11 aa, Borrelia burgdorferi
IYDTYTLFSTK

SEQ ID NO: 70367 - protein, 11 aa, Borrelia burgdorferi
RLDNLAKAKAK

SEQ ID NO: 70368 - protein, 11 aa, Borrelia burgdorferi
FVYINDTHAKR

SEQ ID NO: 70369 - protein, 11 aa, Borrelia burgdorferi
VYINDTHAKRK

SEQ ID NO: 70370 - protein, 11 aa, Borrelia burgdorferi
VSVKTAANFVY

SEQ ID NO: 70371 - protein, 9 aa, Borrelia burgdorferi
KYLALGLLF

SEQ ID NO: 70372 - protein, 9 aa, Borrelia burgdorferi
AYKAIVTSI

SEQ ID NO: 70373 - protein, 9 aa, Borrelia burgdorferi
YYEDDYEEI

SEQ ID NO: 70374 - protein, 9 aa, Borrelia burgdorferi
TYTLFSTKL

SEQ ID NO: 70375 - protein, 9 aa, Borrelia burgdorferi
MYSTRLDNL

SEQ ID NO: 70376 - protein, 9 aa, Borrelia burgdorferi
VYINDTHAK

SEQ ID NO: 70377 - protein, 9 aa, Borrelia burgdorferi
GFISCDLFI

SEQ ID NO: 70378 - protein, 9 aa, Borrelia burgdorferi
NFKTLLNYI

SEQ ID NO: 70379 - protein, 9 aa, Borrelia burgdorferi
RYQSYLEGV

SEQ ID NO: 70380 - protein, 9 aa, Borrelia burgdorferi
KIYDTYTLF

SEQ ID NO: 70381 - protein, 10 aa, Borrelia burgdorferi
LFGFISCDLF

SEQ ID NO: 70382 - protein, 10 aa, Borrelia burgdorferi
EYYEDDYEEI

SEQ ID NO: 70383 - protein, 10 aa, Borrelia burgdorferi
AYKAIVTSIL

SEQ ID NO: 70384 - protein, 10 aa, Borrelia burgdorferi
EYKGMTQGSL

SEQ ID NO: 70385 - protein, 10 aa, Borrelia burgdorferi
IYDTYTLFST

SEQ ID NO: 70386 - protein, 10 aa, Borrelia burgdorferi
SYLEGVKYNV

SEQ ID NO: 70387 - protein, 10 aa, Borrelia burgdorferi
RYQSYLEGVK

SEQ ID NO: 70388 - protein, 10 aa, Borrelia burgdorferi
VYINDTHAKR

SEQ ID NO: 70389 - protein, 11 aa, Borrelia burgdorferi
KYLALGLLFGF

SEQ ID NO: 70390 - protein, 11 aa, Borrelia burgdorferi
KYNVDSAINTI

SEQ ID NO: 70391 - protein, 11 aa, Borrelia burgdorferi
AYKAIVTSILL

SEQ ID NO: 70392 - protein, 11 aa, Borrelia burgdorferi
YYEDDYEEIRL

SEQ ID NO: 70393 - protein, 11 aa, Borrelia burgdorferi
IYDTYTLFSTK

SEQ ID NO: 70394 - protein, 11 aa, Borrelia burgdorferi
LFGFISCDLFI

SEQ ID NO: 70395 - protein, 11 aa, Borrelia burgdorferi
VYINDTHAKRK

SEQ ID NO: 70396 - protein, 11 aa, Borrelia burgdorferi
RYQSYLEGVKY

SEQ ID NO: 70397 - protein, 11 aa, Borrelia burgdorferi
MYSTRLDNLAK

SEQ ID NO: 70398 - protein, 9 aa, Borrelia burgdorferi
QSYLEGVKY

SEQ ID NO: 70399 - protein, 9 aa, Borrelia burgdorferi
FSTKLTQMY

SEQ ID NO: 70400 - protein, 9 aa, Borrelia burgdorferi
IAGSNSISY

SEQ ID NO: 70401 - protein, 9 aa, Borrelia burgdorferi
KYLALGLLF

SEQ ID NO: 70402 - protein, 9 aa, Borrelia burgdorferi
ISCDLFIRY

SEQ ID NO: 70403 - protein, 9 aa, Borrelia burgdorferi
IIDKNGVWY

SEQ ID NO: 70404 - protein, 9 aa, Borrelia burgdorferi
EQSNLYEAY

SEQ ID NO: 70405 - protein, 9 aa, Borrelia burgdorferi
AINTINKIY

SEQ ID NO: 70406 - protein, 9 aa, Borrelia burgdorferi
VKTAANFVY

SEQ ID NO: 70407 - protein, 9 aa, Borrelia burgdorferi
KIYDTYTLF

SEQ ID NO: 70408 - protein, 9 aa, Borrelia burgdorferi
TINKIYDTY

SEQ ID NO: 70409 - protein, 9 aa, Borrelia burgdorferi
RLSNRYQSY

SEQ ID NO: 70410 - protein, 9 aa, Borrelia burgdorferi
KNFKTLLNY

SEQ ID NO: 70411 - protein, 10 aa, Borrelia burgdorferi
YQSYLEGVKY

SEQ ID NO: 70412 - protein, 10 aa, Borrelia burgdorferi
FISCDLFIRY

SEQ ID NO: 70413 - protein, 10 aa, Borrelia burgdorferi
SVKTAANFVY

SEQ ID NO: 70414 - protein, 10 aa, Borrelia burgdorferi
GIIDKNGVWY

SEQ ID NO: 70415 - protein, 10 aa, Borrelia burgdorferi
LFSTKLTQMY

SEQ ID NO: 70416 - protein, 10 aa, Borrelia burgdorferi
YLALGLLFGF

SEQ ID NO: 70417 - protein, 10 aa, Borrelia burgdorferi
SAINTINKIY

SEQ ID NO: 70418 - protein, 10 aa, Borrelia burgdorferi
EIEEEDYARY

SEQ ID NO: 70419 - protein, 10 aa, Borrelia burgdorferi
YTDEIEEEDY

SEQ ID NO: 70420 - protein, 10 aa, Borrelia burgdorferi
DIAGSNSISY

SEQ ID NO: 70421 - protein, 10 aa, Borrelia burgdorferi
NTINKIYDTY

SEQ ID NO: 70422 - protein, 11 aa, Borrelia burgdorferi
TLFSTKLTQMY

SEQ ID NO: 70423 - protein, 11 aa, Borrelia burgdorferi
GFISCDLFIRY

SEQ ID NO: 70424 - protein, 11 aa, Borrelia burgdorferi
RYQSYLEGVKY

SEQ ID NO: 70425 - protein, 11 aa, Borrelia burgdorferi
VSVKTAANFVY

SEQ ID NO: 70426 - protein, 11 aa, Borrelia burgdorferi
YLDEDDEDDEY

SEQ ID NO: 70427 - protein, 11 aa, Borrelia burgdorferi
EIEEEDYARYY

SEQ ID NO: 70428 - protein, 11 aa, Borrelia burgdorferi
KYLALGLLFGF

SEQ ID NO: 70429 - protein, 11 aa, Borrelia burgdorferi
SYTDEIEEEDY

SEQ ID NO: 70430 - protein, 11 aa, Borrelia burgdorferi
DYEEIRLSNRY

SEQ ID NO: 70431 - protein, 9 aa, Borrelia burgdorferi
DTYTLFSTK

SEQ ID NO: 70432 - protein, 9 aa, Borrelia burgdorferi
IVTSILLMR

SEQ ID NO: 70433 - protein, 9 aa, Borrelia burgdorferi
YINDTHAKR

SEQ ID NO: 70434 - protein, 9 aa, Borrelia burgdorferi
ETSEESIKK

SEQ ID NO: 70435 - protein, 9 aa, Borrelia burgdorferi
DITIDSDLR

SEQ ID NO: 70436 - protein, 9 aa, Borrelia burgdorferi
QSNLYEAYK

SEQ ID NO: 70437 - protein, 9 aa, Borrelia burgdorferi
FISCDLFIR

SEQ ID NO: 70438 - protein, 9 aa, Borrelia burgdorferi
DSAINTINK

SEQ ID NO: 70439 - protein, 9 aa, Borrelia burgdorferi
EPYIHSLKR

SEQ ID NO: 70440 - protein, 9 aa, Borrelia burgdorferi
ESIKKPMNK

SEQ ID NO: 70441 - protein, 9 aa, Borrelia burgdorferi
EIEEEDYAR

SEQ ID NO: 70442 - protein, 9 aa, Borrelia burgdorferi
DLFIRYEMK

SEQ ID NO: 70443 - protein, 9 aa, Borrelia burgdorferi
ETRKEKIQK

SEQ ID NO: 70444 - protein, 9 aa, Borrelia burgdorferi
ESLKTELLK

SEQ ID NO: 70445 - protein, 9 aa, Borrelia burgdorferi
KLTQMYSTR

SEQ ID NO: 70446 - protein, 9 aa, Borrelia burgdorferi
FSTKLTQMY

SEQ ID NO: 70447 - protein, 9 aa, Borrelia burgdorferi
TINKIYDTY

SEQ ID NO: 70448 - protein, 9 aa, Borrelia burgdorferi
STRLDNLAK

SEQ ID NO: 70449 - protein, 9 aa, Borrelia burgdorferi
ILLMRDSLK

SEQ ID NO: 70450 - protein, 9 aa, Borrelia burgdorferi
LLKEQSETR

SEQ ID NO: 70451 - protein, 9 aa, Borrelia burgdorferi
VYINDTHAK

SEQ ID NO: 70452 - protein, 9 aa, Borrelia burgdorferi
LNYIQVSVK

SEQ ID NO: 70453 - protein, 9 aa, Borrelia burgdorferi
SIKKPMNKK

SEQ ID NO: 70454 - protein, 9 aa, Borrelia burgdorferi
SANKSNFLQ

SEQ ID NO: 70455 - protein, 9 aa, Borrelia burgdorferi
EQSETRKEK

SEQ ID NO: 70456 - protein, 9 aa, Borrelia burgdorferi
TAANFVYIN

SEQ ID NO: 70457 - protein, 9 aa, Borrelia burgdorferi
EESPGLFDK

SEQ ID NO: 70458 - protein, 9 aa, Borrelia burgdorferi
VILEEESLK

SEQ ID NO: 70459 - protein, 9 aa, Borrelia burgdorferi
YQSYLEGVK

SEQ ID NO: 70460 - protein, 10 aa, Borrelia burgdorferi
FVYINDTHAK

SEQ ID NO: 70461 - protein, 10 aa, Borrelia burgdorferi
NVILEEESLK

SEQ ID NO: 70462 - protein, 10 aa, Borrelia burgdorferi
ESIKKPMNKK

SEQ ID NO: 70463 - protein, 10 aa, Borrelia burgdorferi
NTINKIYDTY

SEQ ID NO: 70464 - protein, 10 aa, Borrelia burgdorferi
SANKSNFLQK

SEQ ID NO: 70465 - protein, 10 aa, Borrelia burgdorferi
ITIDSDLRPK

SEQ ID NO: 70466 - protein, 10 aa, Borrelia burgdorferi
EQSNLYEAYK

SEQ ID NO: 70467 - protein, 10 aa, Borrelia burgdorferi
YSTRLDNLAK

SEQ ID NO: 70468 - protein, 10 aa, Borrelia burgdorferi
LLNYIQVSVK

SEQ ID NO: 70469 - protein, 10 aa, Borrelia burgdorferi
EIKTLIAKIK

SEQ ID NO: 70470 - protein, 10 aa, Borrelia burgdorferi
AIVTSILLMR

SEQ ID NO: 70471 - protein, 10 aa, Borrelia burgdorferi
SILLMRDSLK

SEQ ID NO: 70472 - protein, 10 aa, Borrelia burgdorferi
YINDTHAKRK

SEQ ID NO: 70473 - protein, 10 aa, Borrelia burgdorferi
ELLKEQSETR

SEQ ID NO: 70474 - protein, 10 aa, Borrelia burgdorferi
DYEEIRLSNR

SEQ ID NO: 70475 - protein, 10 aa, Borrelia burgdorferi
VYINDTHAKR

SEQ ID NO: 70476 - protein, 10 aa, Borrelia burgdorferi
EAEIKTLIAK

SEQ ID NO: 70477 - protein, 10 aa, Borrelia burgdorferi
HSLKRDSANK

SEQ ID NO: 70478 - protein, 10 aa, Borrelia burgdorferi
DIAGSNSISY

SEQ ID NO: 70479 - protein, 10 aa, Borrelia burgdorferi
IDITIDSDLR

SEQ ID NO: 70480 - protein, 10 aa, Borrelia burgdorferi
GFISCDLFIR

SEQ ID NO: 70481 - protein, 10 aa, Borrelia burgdorferi
YYEDDYEEIR

SEQ ID NO: 70482 - protein, 10 aa, Borrelia burgdorferi
SVKTAANFVY

SEQ ID NO: 70483 - protein, 10 aa, Borrelia burgdorferi
SLSGESGELK

SEQ ID NO: 70484 - protein, 10 aa, Borrelia burgdorferi
YDTYTLFSTK

SEQ ID NO: 70485 - protein, 10 aa, Borrelia burgdorferi
DSANKSNFLQ

SEQ ID NO: 70486 - protein, 10 aa, Borrelia burgdorferi
FISCDLFIRY

SEQ ID NO: 70487 - protein, 10 aa, Borrelia burgdorferi
SAINTINKIY

SEQ ID NO: 70488 - protein, 10 aa, Borrelia burgdorferi
EESLKTELLK

SEQ ID NO: 70489 - protein, 10 aa, Borrelia burgdorferi
DEIEEEDYAR

SEQ ID NO: 70490 - protein, 10 aa, Borrelia burgdorferi
CDLFIRYEMK

SEQ ID NO: 70491 - protein, 11 aa, Borrelia burgdorferi
FVYINDTHAKR

SEQ ID NO: 70492 - protein, 11 aa, Borrelia burgdorferi
STKLTQMYSTR

SEQ ID NO: 70493 - protein, 11 aa, Borrelia burgdorferi
EYYEDDYEEIR

SEQ ID NO: 70494 - protein, 11 aa, Borrelia burgdorferi
TSILLMRDSLK

SEQ ID NO: 70495 - protein, 11 aa, Borrelia burgdorferi
FTKEDLEKNFK

SEQ ID NO: 70496 - protein, 11 aa, Borrelia burgdorferi
DSANKSNFLQK

SEQ ID NO: 70497 - protein, 11 aa, Borrelia burgdorferi
NFVYINDTHAK

SEQ ID NO: 70498 - protein, 11 aa, Borrelia burgdorferi
EIDITIDSDLR

SEQ ID NO: 70499 - protein, 11 aa, Borrelia burgdorferi
FGFISCDLFIR

SEQ ID NO: 70500 - protein, 11 aa, Borrelia burgdorferi
NVDSAINTINK

SEQ ID NO: 70501 - protein, 11 aa, Borrelia burgdorferi
KAIVTSILLMR

SEQ ID NO: 70502 - protein, 11 aa, Borrelia burgdorferi
NSLSGESGELK

SEQ ID NO: 70503 - protein, 11 aa, Borrelia burgdorferi
TLLNYIQVSVK

SEQ ID NO: 70504 - protein, 11 aa, Borrelia burgdorferi
MYSTRLDNLAK

SEQ ID NO: 70505 - protein, 11 aa, Borrelia burgdorferi
TLFSTKLTQMY

SEQ ID NO: 70506 - protein, 11 aa, Borrelia burgdorferi
DITIDSDLRPK

SEQ ID NO: 70507 - protein, 11 aa, Borrelia burgdorferi
STRLDNLAKAK

SEQ ID NO: 70508 - protein, 11 aa, Borrelia burgdorferi
ELLKEQSETRK

SEQ ID NO: 70509 - protein, 11 aa, Borrelia burgdorferi
SILETSEESIK

SEQ ID NO: 70510 - protein, 11 aa, Borrelia burgdorferi
DSAINTINKIY

SEQ ID NO: 70511 - protein, 11 aa, Borrelia burgdorferi
DDYEEIRLSNR

SEQ ID NO: 70512 - protein, 11 aa, Borrelia burgdorferi
EKIQKQQDEYK

SEQ ID NO: 70513 - protein, 11 aa, Borrelia burgdorferi
MNKKGKGKIAR

SEQ ID NO: 70514 - protein, 11 aa, Borrelia burgdorferi
EAAKFTKEDLE

SEQ ID NO: 70515 - protein, 11 aa, Borrelia burgdorferi
QSETRKEKIQK

SEQ ID NO: 70516 - protein, 11 aa, Borrelia burgdorferi
DTYTLFSTKLT

SEQ ID NO: 70517 - protein, 9 aa, Borrelia burgdorferi
KVKSKYLAL

SEQ ID NO: 70518 - protein, 9 aa, Borrelia burgdorferi
RPKSSLQDI

SEQ ID NO: 70519 - protein, 9 aa, Borrelia burgdorferi
KPMNKKGKG

SEQ ID NO: 70520 - protein, 10 aa, Borrelia burgdorferi
IARKKGKSKV

SEQ ID NO: 70521 - protein, 10 aa, Borrelia burgdorferi
RPKSSLQDIA

SEQ ID NO: 70522 - protein, 11 aa, Borrelia burgdorferi
KPMNKKGKGKI

SEQ ID NO: 70523 - protein, 11 aa, Borrelia burgdorferi
SPGLFDKGNSI

SEQ ID NO: 70524 - protein, 11 aa, Borrelia burgdorferi
RPKSSLQDIAG

SEQ ID NO: 70525 - protein, 11 aa, Borrelia burgdorferi
KVKSKYLALGL

SEQ ID NO: 70526 - protein, 9 aa, Borrelia burgdorferi
KVKSKYLAL

SEQ ID NO: 70527 - protein, 9 aa, Borrelia burgdorferi
MKKVKSKYL

SEQ ID NO: 70528 - protein, 9 aa, Borrelia burgdorferi
HAKRKLENI

SEQ ID NO: 70529 - protein, 10 aa, Borrelia burgdorferi
YIQVSVKTAA

SEQ ID NO: 70530 - protein, 11 aa, Borrelia burgdorferi
MKKVKSKYLAL

SEQ ID NO: 70531 - protein, 9 aa, Borrelia burgdorferi
RLSNRYQSY

SEQ ID NO: 70532 - protein, 9 aa, Borrelia burgdorferi
EQSNLYEAY

SEQ ID NO: 70533 - protein, 9 aa, Borrelia burgdorferi
KIKEQSNLY

SEQ ID NO: 70534 - protein, 9 aa, Borrelia burgdorferi
KQQDEYKGM

SEQ ID NO: 70535 - protein, 9 aa, Borrelia burgdorferi
KIYDTYTLF

SEQ ID NO: 70536 - protein, 9 aa, Borrelia burgdorferi
QSYLEGVKY

SEQ ID NO: 70537 - protein, 9 aa, Borrelia burgdorferi
FSTKLTQMY

SEQ ID NO: 70538 - protein, 9 aa, Borrelia burgdorferi
KAKEEAAKF

SEQ ID NO: 70539 - protein, 9 aa, Borrelia burgdorferi
IAGSNSISY

SEQ ID NO: 70540 - protein, 9 aa, Borrelia burgdorferi
AINTINKIY

SEQ ID NO: 70541 - protein, 9 aa, Borrelia burgdorferi
KVKSKYLAL

SEQ ID NO: 70542 - protein, 9 aa, Borrelia burgdorferi
VSVKTAANF

SEQ ID NO: 70543 - protein, 9 aa, Borrelia burgdorferi
LMRDSLKEV

SEQ ID NO: 70544 - protein, 9 aa, Borrelia burgdorferi
GLFDKGNSI

SEQ ID NO: 70545 - protein, 9 aa, Borrelia burgdorferi
EMKEESPGL

SEQ ID NO: 70546 - protein, 9 aa, Borrelia burgdorferi
LQKNVILEE

SEQ ID NO: 70547 - protein, 9 aa, Borrelia burgdorferi
ISCDLFIRY

SEQ ID NO: 70548 - protein, 9 aa, Borrelia burgdorferi
KNFKTLLNY

SEQ ID NO: 70549 - protein, 10 aa, Borrelia burgdorferi
YQSYLEGVKY

SEQ ID NO: 70550 - protein, 10 aa, Borrelia burgdorferi
YLALGLLFGF

SEQ ID NO: 70551 - protein, 10 aa, Borrelia burgdorferi
SVKTAANFVY

SEQ ID NO: 70552 - protein, 10 aa, Borrelia burgdorferi
KSKVSRKEPY

SEQ ID NO: 70553 - protein, 10 aa, Borrelia burgdorferi
EMKEESPGLF

SEQ ID NO: 70554 - protein, 10 aa, Borrelia burgdorferi
QVSVKTAANF

SEQ ID NO: 70555 - protein, 10 aa, Borrelia burgdorferi
SAINTINKIY

SEQ ID NO: 70556 - protein, 10 aa, Borrelia burgdorferi
GMTQGSLNSL

SEQ ID NO: 70557 - protein, 10 aa, Borrelia burgdorferi
GIIDKNGVWY

SEQ ID NO: 70558 - protein, 10 aa, Borrelia burgdorferi
FTKEDLEKNF

SEQ ID NO: 70559 - protein, 10 aa, Borrelia burgdorferi
GLFDKGNSIL

SEQ ID NO: 70560 - protein, 10 aa, Borrelia burgdorferi
RLSNRYQSYL

SEQ ID NO: 70561 - protein, 10 aa, Borrelia burgdorferi
DIAGSNSISY

SEQ ID NO: 70562 - protein, 10 aa, Borrelia burgdorferi
LLFGFISCDL

SEQ ID NO: 70563 - protein, 11 aa, Borrelia burgdorferi
IQVSVKTAANF

SEQ ID NO: 70564 - protein, 11 aa, Borrelia burgdorferi
LLFGFISCDLF

SEQ ID NO: 70565 - protein, 11 aa, Borrelia burgdorferi
TLFSTKLTQMY

SEQ ID NO: 70566 - protein, 11 aa, Borrelia burgdorferi
KSKYLALGLLF

SEQ ID NO: 70567 - protein, 11 aa, Borrelia burgdorferi
IQKQQDEYKGM

SEQ ID NO: 70568 - protein, 11 aa, Borrelia burgdorferi
VSVKTAANFVY

SEQ ID NO: 70569 - protein, 11 aa, Borrelia burgdorferi
EIRLSNRYQSY

SEQ ID NO: 70570 - protein, 11 aa, Borrelia burgdorferi
QDIAGSNSISY

SEQ ID NO: 70571 - protein, 11 aa, Borrelia burgdorferi
IAKIKEQSNLY

SEQ ID NO: 70572 - protein, 11 aa, Borrelia burgdorferi
KAKAKEEAAKF

SEQ ID NO: 70573 - protein, 11 aa, Borrelia burgdorferi
TQMYSTRLDNL

SEQ ID NO: 70574 - protein, 11 aa, Borrelia burgdorferi
YLDEDDEDDEY

SEQ ID NO: 70575 - protein, 10 aa, Borrelia burgdorferi
IRLSNRYQSY

SEQ ID NO: 70576 - protein, 10 aa, Borrelia burgdorferi
TRLDNLAKAK

SEQ ID NO: 70577 - protein, 10 aa, Borrelia burgdorferi
KRDSANKSNF

SEQ ID NO: 70578 - protein, 10 aa, Borrelia burgdorferi
RKKGKSKVSR

SEQ ID NO: 70579 - protein, 10 aa, Borrelia burgdorferi
NRYQSYLEGV

SEQ ID NO: 70580 - protein, 11 aa, Borrelia burgdorferi
NRYQSYLEGVK

SEQ ID NO: 70581 - protein, 11 aa, Borrelia burgdorferi
IRLSNRYQSYL

SEQ ID NO: 70582 - protein, 11 aa, Borrelia burgdorferi
RKKGKSKVSRK

SEQ ID NO: 70583 - protein, 11 aa, Borrelia burgdorferi
ARKKGKSKVSR

SEQ ID NO: 70584 - protein, 11 aa, Borrelia burgdorferi
SRKEPYIHSLK

SEQ ID NO: 70585 - protein, 11 aa, Borrelia burgdorferi
KRKLENIEAEI

SEQ ID NO: 70586 - protein, 9 aa, Borrelia burgdorferi
IAGSNSISY

SEQ ID NO: 70587 - protein, 9 aa, Borrelia burgdorferi
EQSNLYEAY

SEQ ID NO: 70588 - protein, 9 aa, Borrelia burgdorferi
LALGLLFGF

SEQ ID NO: 70589 - protein, 9 aa, Borrelia burgdorferi
FSTKLTQMY

SEQ ID NO: 70590 - protein, 9 aa, Borrelia burgdorferi
TINKIYDTY

SEQ ID NO: 70591 - protein, 9 aa, Borrelia burgdorferi
DEDDEDDEY

SEQ ID NO: 70592 - protein, 9 aa, Borrelia burgdorferi
ISCDLFIRY

SEQ ID NO: 70593 - protein, 9 aa, Borrelia burgdorferi
EDDEDDEYY

SEQ ID NO: 70594 - protein, 9 aa, Borrelia burgdorferi
NFVYINDTH

SEQ ID NO: 70595 - protein, 10 aa, Borrelia burgdorferi
SAINTINKIY

SEQ ID NO: 70596 - protein, 10 aa, Borrelia burgdorferi
FISCDLFIRY

SEQ ID NO: 70597 - protein, 10 aa, Borrelia burgdorferi
EIEEEDYARY

SEQ ID NO: 70598 - protein, 10 aa, Borrelia burgdorferi
SVKTAANFVY

SEQ ID NO: 70599 - protein, 10 aa, Borrelia burgdorferi
DIAGSNSISY

SEQ ID NO: 70600 - protein, 10 aa, Borrelia burgdorferi
LFSTKLTQMY

SEQ ID NO: 70601 - protein, 10 aa, Borrelia burgdorferi
YQSYLEGVKY

SEQ ID NO: 70602 - protein, 10 aa, Borrelia burgdorferi
YLALGLLFGF

SEQ ID NO: 70603 - protein, 10 aa, Borrelia burgdorferi
YTDEIEEEDY

SEQ ID NO: 70604 - protein, 10 aa, Borrelia burgdorferi
LDEDDEDDEY

SEQ ID NO: 70605 - protein, 10 aa, Borrelia burgdorferi
NTINKIYDTY

SEQ ID NO: 70606 - protein, 10 aa, Borrelia burgdorferi
KAIVTSILLM

SEQ ID NO: 70607 - protein, 10 aa, Borrelia burgdorferi
QVSVKTAANF

SEQ ID NO: 70608 - protein, 10 aa, Borrelia burgdorferi
DEDDEDDEYY

SEQ ID NO: 70609 - protein, 11 aa, Borrelia burgdorferi
YLDEDDEDDEY

SEQ ID NO: 70610 - protein, 11 aa, Borrelia burgdorferi
EIEEEDYARYY

SEQ ID NO: 70611 - protein, 11 aa, Borrelia burgdorferi
ETSEESIKKPM

SEQ ID NO: 70612 - protein, 11 aa, Borrelia burgdorferi
IAKIKEQSNLY

SEQ ID NO: 70613 - protein, 11 aa, Borrelia burgdorferi
EAYKAIVTSIL

SEQ ID NO: 70614 - protein, 11 aa, Borrelia burgdorferi
VSVKTAANFVY

SEQ ID NO: 70615 - protein, 11 aa, Borrelia burgdorferi
IKEQSNLYEAY

SEQ ID NO: 70616 - protein, 11 aa, Borrelia burgdorferi
TLFSTKLTQMY

SEQ ID NO: 70617 - protein, 11 aa, Borrelia burgdorferi
DSAINTINKIY

SEQ ID NO: 70618 - protein, 11 aa, Borrelia burgdorferi
YTLFSTKLTQM

SEQ ID NO: 70619 - protein, 11 aa, Borrelia burgdorferi
ISCDLFIRYEM

SEQ ID NO: 70620 - protein, 11 aa, Borrelia burgdorferi
LDEDDEDDEYY

SEQ ID NO: 70621 - protein, 11 aa, Borrelia burgdorferi
YKAIVTSILLM

SEQ ID NO: 70622 - protein, 11 aa, Borrelia burgdorferi
QDIAGSNSISY

SEQ ID NO: 70623 - protein, 9 aa, Borrelia burgdorferi
EEEDYARYY

SEQ ID NO: 70624 - protein, 9 aa, Borrelia burgdorferi
EEIRLSNRY

SEQ ID NO: 70625 - protein, 9 aa, Borrelia burgdorferi
NEIDITIDS

SEQ ID NO: 70626 - protein, 9 aa, Borrelia burgdorferi
GELKETIES

SEQ ID NO: 70627 - protein, 9 aa, Borrelia burgdorferi
EEDYARYYL

SEQ ID NO: 70628 - protein, 9 aa, Borrelia burgdorferi
DEDDEDDEY

SEQ ID NO: 70629 - protein, 9 aa, Borrelia burgdorferi
EESLKTELL

SEQ ID NO: 70630 - protein, 9 aa, Borrelia burgdorferi
AEIKTLIAK

SEQ ID NO: 70631 - protein, 9 aa, Borrelia burgdorferi
DEIEEEDYA

SEQ ID NO: 70632 - protein, 9 aa, Borrelia burgdorferi
SEESIKKPM

SEQ ID NO: 70633 - protein, 10 aa, Borrelia burgdorferi
EEIRLSNRYQ

SEQ ID NO: 70634 - protein, 10 aa, Borrelia burgdorferi
EEEDYARYYL

SEQ ID NO: 70635 - protein, 10 aa, Borrelia burgdorferi
AEIKTLIAKI

SEQ ID NO: 70636 - protein, 10 aa, Borrelia burgdorferi
DEDDEDDEYY

SEQ ID NO: 70637 - protein, 10 aa, Borrelia burgdorferi
YEMKEESPGL

SEQ ID NO: 70638 - protein, 10 aa, Borrelia burgdorferi
NEIDITIDSD

SEQ ID NO: 70639 - protein, 10 aa, Borrelia burgdorferi
EEESLKTELL

SEQ ID NO: 70640 - protein, 11 aa, Borrelia burgdorferi
EEIRLSNRYQS

SEQ ID NO: 70641 - protein, 11 aa, Borrelia burgdorferi
NEIDITIDSDL

SEQ ID NO: 70642 - protein, 11 aa, Borrelia burgdorferi
YEMKEESPGLF

SEQ ID NO: 70643 - protein, 11 aa, Borrelia burgdorferi
DEIEEEDYARY

SEQ ID NO: 70644 - protein, 11 aa, Borrelia burgdorferi
EEEDYARYYLD

SEQ ID NO: 70645 - protein, 11 aa, Borrelia burgdorferi
AEIKTLIAKIK

SEQ ID NO: 70646 - protein, 11 aa, Borrelia burgdorferi
KEKIQKQQDEY

SEQ ID NO: 70647 - protein, 11 aa, Borrelia burgdorferi
DEDDEYYEDDY

SEQ ID NO: 70648 - protein, 10 aa, Borrelia burgdorferi
LALGLLFGFI

SEQ ID NO: 70649 - protein, 11 aa, Borrelia burgdorferi
SPGLFDKGNSI

SEQ ID NO: 70650 - protein, 9 aa, Borrelia burgdorferi
ISCDLFIRY

SEQ ID NO: 70651 - protein, 11 aa, Borrelia burgdorferi
VSVKTAANFVY

SEQ ID NO: 70652 - protein, 9 aa, Borrelia afzelii
LSTKQTQMY

SEQ ID NO: 70653 - protein, 9 aa, Borrelia afzelii
YSLEEDYYY

SEQ ID NO: 70654 - protein, 9 aa, Borrelia afzelii
VIDKNGVWY

SEQ ID NO: 70655 - protein, 9 aa, Borrelia afzelii
ISGSNSISY

SEQ ID NO: 70656 - protein, 10 aa, Borrelia afzelii
YTDEIEEEDY

SEQ ID NO: 70657 - protein, 10 aa, Borrelia afzelii
LLSTKQTQMY

SEQ ID NO: 70658 - protein, 11 aa, Borrelia afzelii
SSAIKTIVKIY

SEQ ID NO: 70659 - protein, 11 aa, Borrelia afzelii
ATNFVYAREIY

SEQ ID NO: 70660 - protein, 11 aa, Borrelia afzelii
VSARTATNFVY

SEQ ID NO: 70661 - protein, 9 aa, Borrelia afzelii
LLMKDSLKI

SEQ ID NO: 70662 - protein, 9 aa, Borrelia afzelii
KIYDNYTLL

SEQ ID NO: 70663 - protein, 9 aa, Borrelia afzelii
MLQGSLSFL

SEQ ID NO: 70664 - protein, 9 aa, Borrelia afzelii
KLDAIETEI

SEQ ID NO: 70665 - protein, 9 aa, Borrelia afzelii
FTIDSDLRL

SEQ ID NO: 70666 - protein, 9 aa, Borrelia afzelii
LLNYIQVSA

SEQ ID NO: 70667 - protein, 9 aa, Borrelia afzelii
YLEGVKYNV

SEQ ID NO: 70668 - protein, 9 aa, Borrelia afzelii
FLSGESGEL

SEQ ID NO: 70669 - protein, 9 aa, Borrelia afzelii
KTLLNYIQV

SEQ ID NO: 70670 - protein, 9 aa, Borrelia afzelii
GLCDEESSI

SEQ ID NO: 70671 - protein, 9 aa, Borrelia afzelii
RTATNFVYA

SEQ ID NO: 70672 - protein, 9 aa, Borrelia afzelii
TLLNYIQVS

SEQ ID NO: 70673 - protein, 9 aa, Borrelia afzelii
RLKSDLQAI

SEQ ID NO: 70674 - protein, 9 aa, Borrelia afzelii
LLSTKQTQM

SEQ ID NO: 70675 - protein, 9 aa, Borrelia afzelii
AIVRSILLM

SEQ ID NO: 70676 - protein, 9 aa, Borrelia afzelii
ALGLLFGFI

SEQ ID NO: 70677 - protein, 10 aa, Borrelia afzelii
RMLQGSLSFL

SEQ ID NO: 70678 - protein, 10 aa, Borrelia afzelii
TLLNYIQVSA

SEQ ID NO: 70679 - protein, 10 aa, Borrelia afzelii
LLFGFISCDL

SEQ ID NO: 70680 - protein, 10 aa, Borrelia afzelii
LLMKDSLKII

SEQ ID NO: 70681 - protein, 10 aa, Borrelia afzelii
RLSNRYESYL

SEQ ID NO: 70682 - protein, 10 aa, Borrelia afzelii
QMYSTRLDNL

SEQ ID NO: 70683 - protein, 10 aa, Borrelia afzelii
ILLMKDSLKI

SEQ ID NO: 70684 - protein, 10 aa, Borrelia afzelii
SILETGDKSV

SEQ ID NO: 70685 - protein, 10 aa, Borrelia afzelii
KIYDNYTLLS

SEQ ID NO: 70686 - protein, 10 aa, Borrelia afzelii
MLQGSLSFLS

SEQ ID NO: 70687 - protein, 10 aa, Borrelia afzelii
GLCDEESSIL

SEQ ID NO: 70688 - protein, 10 aa, Borrelia afzelii
LALGLLFGFI

SEQ ID NO: 70689 - protein, 11 aa, Borrelia afzelii
KIYDNYTLLST

SEQ ID NO: 70690 - protein, 11 aa, Borrelia afzelii
LMKDSLKIIEI

SEQ ID NO: 70691 - protein, 11 aa, Borrelia afzelii
GLLFGFISCDL

SEQ ID NO: 70692 - protein, 11 aa, Borrelia afzelii
QVSARTATNFV

SEQ ID NO: 70693 - protein, 11 aa, Borrelia afzelii
ILLMKDSLKII

SEQ ID NO: 70694 - protein, 11 aa, Borrelia afzelii
RMLQGSLSFLS

SEQ ID NO: 70695 - protein, 11 aa, Borrelia afzelii
QMYSTRLDNLA

SEQ ID NO: 70696 - protein, 11 aa, Borrelia afzelii
LLNYIQVSART

SEQ ID NO: 70697 - protein, 11 aa, Borrelia afzelii
TQMYSTRLDNL

SEQ ID NO: 70698 - protein, 11 aa, Borrelia afzelii
TIVKIYDNYTL

SEQ ID NO: 70699 - protein, 11 aa, Borrelia afzelii
CLALGLLFGFI

SEQ ID NO: 70700 - protein, 11 aa, Borrelia afzelii
SLGLCDEESSI

SEQ ID NO: 70701 - protein, 11 aa, Borrelia afzelii
KTLLNYIQVSA

SEQ ID NO: 70702 - protein, 9 aa, Borrelia afzelii
KSVKKSLNK

SEQ ID NO: 70703 - protein, 9 aa, Borrelia afzelii
IVRSILLMK

SEQ ID NO: 70704 - protein, 9 aa, Borrelia afzelii
ILLMKDSLK

SEQ ID NO: 70705 - protein, 9 aa, Borrelia afzelii
SSAIKTIVK

SEQ ID NO: 70706 - protein, 9 aa, Borrelia afzelii
KIIEIVIDK

SEQ ID NO: 70707 - protein, 9 aa, Borrelia afzelii
RLDNLAKAK

SEQ ID NO: 70708 - protein, 9 aa, Borrelia afzelii
KVEGNAVKK

SEQ ID NO: 70709 - protein, 9 aa, Borrelia afzelii
RLSNRYESY

SEQ ID NO: 70710 - protein, 9 aa, Borrelia afzelii
SVKKSLNKK

SEQ ID NO: 70711 - protein, 9 aa, Borrelia afzelii
SLNKKGKDK

SEQ ID NO: 70712 - protein, 9 aa, Borrelia afzelii
ISGSNSISY

SEQ ID NO: 70713 - protein, 9 aa, Borrelia afzelii
TIDSDLRLK

SEQ ID NO: 70714 - protein, 9 aa, Borrelia afzelii
STRLDNLAK

SEQ ID NO: 70715 - protein, 9 aa, Borrelia afzelii
KYNVSSAIK

SEQ ID NO: 70716 - protein, 9 aa, Borrelia afzelii
VISEEEILK

SEQ ID NO: 70717 - protein, 9 aa, Borrelia afzelii
KIKGQSDLY

SEQ ID NO: 70718 - protein, 10 aa, Borrelia afzelii
AIVRSILLMK

SEQ ID NO: 70719 - protein, 10 aa, Borrelia afzelii
FVYAREIYSK

SEQ ID NO: 70720 - protein, 10 aa, Borrelia afzelii
SILLMKDSLK

SEQ ID NO: 70721 - protein, 10 aa, Borrelia afzelii
FLSGESGELK

SEQ ID NO: 70722 - protein, 10 aa, Borrelia afzelii
VSSAIKTIVK

SEQ ID NO: 70723 - protein, 10 aa, Borrelia afzelii
KSLNKKGKDK

SEQ ID NO: 70724 - protein, 10 aa, Borrelia afzelii
VKYNVSSAIK

SEQ ID NO: 70725 - protein, 10 aa, Borrelia afzelii
AISGSNSISY

SEQ ID NO: 70726 - protein, 10 aa, Borrelia afzelii
SVNNSNLSQK

SEQ ID NO: 70727 - protein, 10 aa, Borrelia afzelii
GQSDLYEAYK

SEQ ID NO: 70728 - protein, 10 aa, Borrelia afzelii
LLRERPETRK

SEQ ID NO: 70729 - protein, 10 aa, Borrelia afzelii
IVIDKNGVWY

SEQ ID NO: 70730 - protein, 10 aa, Borrelia afzelii
KLDAIETEIK

SEQ ID NO: 70731 - protein, 10 aa, Borrelia afzelii
LLNYIQVSAR

SEQ ID NO: 70732 - protein, 10 aa, Borrelia afzelii
KSVKKSLNKK

SEQ ID NO: 70733 - protein, 10 aa, Borrelia afzelii
LLSTKQTQMY

SEQ ID NO: 70734 - protein, 10 aa, Borrelia afzelii
YDNYTLLSTK

SEQ ID NO: 70735 - protein, 10 aa, Borrelia afzelii
RTATNFVYAR

SEQ ID NO: 70736 - protein, 10 aa, Borrelia afzelii
FTIDSDLRLK

SEQ ID NO: 70737 - protein, 10 aa, Borrelia afzelii
ILETGDKSVK

SEQ ID NO: 70738 - protein, 10 aa, Borrelia afzelii
NVISEEEILK

SEQ ID NO: 70739 - protein, 10 aa, Borrelia afzelii
KTIVKIYDNY

SEQ ID NO: 70740 - protein, 10 aa, Borrelia afzelii
EIKNLILKIK

SEQ ID NO: 70741 - protein, 10 aa, Borrelia afzelii
YSTRLDNLAK

SEQ ID NO: 70742 - protein, 10 aa, Borrelia afzelii
ILKTKLLRER

SEQ ID NO: 70743 - protein, 10 aa, Borrelia afzelii
KKFTKEELEK

SEQ ID NO: 70744 - protein, 10 aa, Borrelia afzelii
RYESYLEGVK

SEQ ID NO: 70745 - protein, 10 aa, Borrelia afzelii
ETEIKNLILK

SEQ ID NO: 70746 - protein, 11 aa, Borrelia afzelii
KLLRERPETRK

SEQ ID NO: 70747 - protein, 11 aa, Borrelia afzelii
RSILLMKDSLK

SEQ ID NO: 70748 - protein, 11 aa, Borrelia afzelii
FVYAREIYSKR

SEQ ID NO: 70749 - protein, 11 aa, Borrelia afzelii
KAIVRSILLMK

SEQ ID NO: 70750 - protein, 11 aa, Borrelia afzelii
TLLNYIQVSAR

SEQ ID NO: 70751 - protein, 11 aa, Borrelia afzelii
GVKYNVSSAIK

SEQ ID NO: 70752 - protein, 11 aa, Borrelia afzelii
SLKIIEIVIDK

SEQ ID NO: 70753 - protein, 11 aa, Borrelia afzelii
ILETGDKSVKK

SEQ ID NO: 70754 - protein, 11 aa, Borrelia afzelii
VSARTATNFVY

SEQ ID NO: 70755 - protein, 11 aa, Borrelia afzelii
TLLSTKQTQMY

SEQ ID NO: 70756 - protein, 11 aa, Borrelia afzelii
NVSSAIKTIVK

SEQ ID NO: 70757 - protein, 11 aa, Borrelia afzelii
SILETGDKSVK

SEQ ID NO: 70758 - protein, 11 aa, Borrelia afzelii
RMLQGSLSFLS

SEQ ID NO: 70759 - protein, 11 aa, Borrelia afzelii
KAREEAKKFTK

SEQ ID NO: 70760 - protein, 11 aa, Borrelia afzelii
STRLDNLAKAK

SEQ ID NO: 70761 - protein, 11 aa, Borrelia afzelii
SVKKSLNKKGK

SEQ ID NO: 70762 - protein, 9 aa, Borrelia afzelii
SSAIKTIVK

SEQ ID NO: 70763 - protein, 9 aa, Borrelia afzelii
KSVKKSLNK

SEQ ID NO: 70764 - protein, 9 aa, Borrelia afzelii
SSILETGDK

SEQ ID NO: 70765 - protein, 9 aa, Borrelia afzelii
KIIEIVIDK

SEQ ID NO: 70766 - protein, 9 aa, Borrelia afzelii
SVKKSLNKK

SEQ ID NO: 70767 - protein, 9 aa, Borrelia afzelii
IVRSILLMK

SEQ ID NO: 70768 - protein, 9 aa, Borrelia afzelii
STRLDNLAK

SEQ ID NO: 70769 - protein, 9 aa, Borrelia afzelii
VISEEEILK

SEQ ID NO: 70770 - protein, 9 aa, Borrelia afzelii
TATNFVYAR

SEQ ID NO: 70771 - protein, 9 aa, Borrelia afzelii
TIDSDLRLK

SEQ ID NO: 70772 - protein, 9 aa, Borrelia afzelii
KVEGNAVKK

SEQ ID NO: 70773 - protein, 9 aa, Borrelia afzelii
ILLMKDSLK

SEQ ID NO: 70774 - protein, 9 aa, Borrelia afzelii
QSDLYEAYK

SEQ ID NO: 70775 - protein, 9 aa, Borrelia afzelii
KAKAREEAK

SEQ ID NO: 70776 - protein, 9 aa, Borrelia afzelii
LSGESGELK

SEQ ID NO: 70777 - protein, 9 aa, Borrelia afzelii
TEIKNLILK

SEQ ID NO: 70778 - protein, 9 aa, Borrelia afzelii
VYAREIYSK

SEQ ID NO: 70779 - protein, 9 aa, Borrelia afzelii
ETGDKSVKK

SEQ ID NO: 70780 - protein, 9 aa, Borrelia afzelii
KYNVSSAIK

SEQ ID NO: 70781 - protein, 9 aa, Borrelia afzelii
SVNNSNLSQ

SEQ ID NO: 70782 - protein, 9 aa, Borrelia afzelii
RLDNLAKAK

SEQ ID NO: 70783 - protein, 9 aa, Borrelia afzelii
FISCDLFIR

SEQ ID NO: 70784 - protein, 9 aa, Borrelia afzelii
SLNKKGKDK

SEQ ID NO: 70785 - protein, 9 aa, Borrelia afzelii
ISGSNSISY

SEQ ID NO: 70786 - protein, 9 aa, Borrelia afzelii
VNNSNLSQK

SEQ ID NO: 70787 - protein, 10 aa, Borrelia afzelii
SVNNSNLSQK

SEQ ID NO: 70788 - protein, 10 aa, Borrelia afzelii
FVYAREIYSK

SEQ ID NO: 70789 - protein, 10 aa, Borrelia afzelii
AIVRSILLMK

SEQ ID NO: 70790 - protein, 10 aa, Borrelia afzelii
SILLMKDSLK

SEQ ID NO: 70791 - protein, 10 aa, Borrelia afzelii
VSSAIKTIVK

SEQ ID NO: 70792 - protein, 10 aa, Borrelia afzelii
RTATNFVYAR

SEQ ID NO: 70793 - protein, 10 aa, Borrelia afzelii
FTIDSDLRLK

SEQ ID NO: 70794 - protein, 10 aa, Borrelia afzelii
KSVKKSLNKK

SEQ ID NO: 70795 - protein, 10 aa, Borrelia afzelii
GQSDLYEAYK

SEQ ID NO: 70796 - protein, 10 aa, Borrelia afzelii
NVISEEEILK

SEQ ID NO: 70797 - protein, 10 aa, Borrelia afzelii
YSTRLDNLAK

SEQ ID NO: 70798 - protein, 10 aa, Borrelia afzelii
AISGSNSISY

SEQ ID NO: 70799 - protein, 10 aa, Borrelia afzelii
KTIVKIYDNY

SEQ ID NO: 70800 - protein, 10 aa, Borrelia afzelii
ETEIKNLILK

SEQ ID NO: 70801 - protein, 10 aa, Borrelia afzelii
KSLNKKGKDK

SEQ ID NO: 70802 - protein, 10 aa, Borrelia afzelii
KLDAIETEIK

SEQ ID NO: 70803 - protein, 10 aa, Borrelia afzelii
KAKAREEAKK

SEQ ID NO: 70804 - protein, 10 aa, Borrelia afzelii
ISEEEILKTK

SEQ ID NO: 70805 - protein, 10 aa, Borrelia afzelii
IVIDKNGVWY

SEQ ID NO: 70806 - protein, 10 aa, Borrelia afzelii
FLSGESGELK

SEQ ID NO: 70807 - protein, 11 aa, Borrelia afzelii
KAIVRSILLMK

SEQ ID NO: 70808 - protein, 11 aa, Borrelia afzelii
RSILLMKDSLK

SEQ ID NO: 70809 - protein, 11 aa, Borrelia afzelii
SILETGDKSVK

SEQ ID NO: 70810 - protein, 11 aa, Borrelia afzelii
NVSSAIKTIVK

SEQ ID NO: 70811 - protein, 11 aa, Borrelia afzelii
KLLRERPETRK

SEQ ID NO: 70812 - protein, 11 aa, Borrelia afzelii
GVKYNVSSAIK

SEQ ID NO: 70813 - protein, 11 aa, Borrelia afzelii
STRLDNLAKAK

SEQ ID NO: 70814 - protein, 11 aa, Borrelia afzelii
SVKKSLNKKGK

SEQ ID NO: 70815 - protein, 11 aa, Borrelia afzelii
FVYAREIYSKR

SEQ ID NO: 70816 - protein, 11 aa, Borrelia afzelii
ATNFVYAREIY

SEQ ID NO: 70817 - protein, 11 aa, Borrelia afzelii
STKQTQMYSTR

SEQ ID NO: 70818 - protein, 11 aa, Borrelia afzelii
VISEEEILKTK

SEQ ID NO: 70819 - protein, 11 aa, Borrelia afzelii
SFLSGESGELK

SEQ ID NO: 70820 - protein, 11 aa, Borrelia afzelii
SLKIIEIVIDK

SEQ ID NO: 70821 - protein, 11 aa, Borrelia afzelii
MYSTRLDNLAK

SEQ ID NO: 70822 - protein, 11 aa, Borrelia afzelii
VSARTATNFVY

SEQ ID NO: 70823 - protein, 11 aa, Borrelia afzelii
KGQSDLYEAYK

SEQ ID NO: 70824 - protein, 11 aa, Borrelia afzelii
TLLNYIQVSAR

SEQ ID NO: 70825 - protein, 11 aa, Borrelia afzelii
ESVNNSNLSQK

SEQ ID NO: 70826 - protein, 11 aa, Borrelia afzelii
KAREEAKKFTK

SEQ ID NO: 70827 - protein, 11 aa, Borrelia afzelii
FTKEELEKDLK

SEQ ID NO: 70828 - protein, 11 aa, Borrelia afzelii
IYDNYTLLSTK

SEQ ID NO: 70829 - protein, 11 aa, Borrelia afzelii
QAISGSNSISY

SEQ ID NO: 70830 - protein, 11 aa, Borrelia afzelii
SSAIKTIVKIY

SEQ ID NO: 70831 - protein, 11 aa, Borrelia afzelii
ILETGDKSVKK

SEQ ID NO: 70832 - protein, 11 aa, Borrelia afzelii
LAKAKAREEAK

SEQ ID NO: 70833 - protein, 9 aa, Borrelia afzelii
AYKAIVRSI

SEQ ID NO: 70834 - protein, 9 aa, Borrelia afzelii
MYSTRLDNL

SEQ ID NO: 70835 - protein, 9 aa, Borrelia afzelii
VYAREIYSK

SEQ ID NO: 70836 - protein, 9 aa, Borrelia afzelii
GFISCDLFI

SEQ ID NO: 70837 - protein, 9 aa, Borrelia afzelii
KYNVSSAIK

SEQ ID NO: 70838 - protein, 9 aa, Borrelia afzelii
YYYDGETRL

SEQ ID NO: 70839 - protein, 10 aa, Borrelia afzelii
IYSKRKLDAI

SEQ ID NO: 70840 - protein, 10 aa, Borrelia afzelii
LFGFISCDLF

SEQ ID NO: 70841 - protein, 10 aa, Borrelia afzelii
AYKAIVRSIL

SEQ ID NO: 70842 - protein, 10 aa, Borrelia afzelii
VYAREIYSKR

SEQ ID NO: 70843 - protein, 10 aa, Borrelia afzelii
DYYYDGETRL

SEQ ID NO: 70844 - protein, 10 aa, Borrelia afzelii
SYLEGVKYNV

SEQ ID NO: 70845 - protein, 11 aa, Borrelia afzelii
KYNVSSAIKTI

SEQ ID NO: 70846 - protein, 11 aa, Borrelia afzelii
AYKAIVRSILL

SEQ ID NO: 70847 - protein, 11 aa, Borrelia afzelii
LFGFISCDLFI

SEQ ID NO: 70848 - protein, 11 aa, Borrelia afzelii
IYDNYTLLSTK

SEQ ID NO: 70849 - protein, 11 aa, Borrelia afzelii
VYAREIYSKRK

SEQ ID NO: 70850 - protein, 11 aa, Borrelia afzelii
MYSTRLDNLAK

SEQ ID NO: 70851 - protein, 9 aa, Borrelia afzelii
YSLEEDYYY

SEQ ID NO: 70852 - protein, 9 aa, Borrelia afzelii
ESYLEGVKY

SEQ ID NO: 70853 - protein, 9 aa, Borrelia afzelii
QYSLEEDYY

SEQ ID NO: 70854 - protein, 9 aa, Borrelia afzelii
VIDKNGVWY

SEQ ID NO: 70855 - protein, 9 aa, Borrelia afzelii
ISGSNSISY

SEQ ID NO: 70856 - protein, 9 aa, Borrelia afzelii
YYYDGETRL

SEQ ID NO: 70857 - protein, 9 aa, Borrelia afzelii
DQYSLEEDY

SEQ ID NO: 70858 - protein, 9 aa, Borrelia afzelii
RMLQGSLSF

SEQ ID NO: 70859 - protein, 9 aa, Borrelia afzelii
TIVKIYDNY

SEQ ID NO: 70860 - protein, 10 aa, Borrelia afzelii
IVIDKNGVWY

SEQ ID NO: 70861 - protein, 10 aa, Borrelia afzelii
QYSLEEDYYY

SEQ ID NO: 70862 - protein, 10 aa, Borrelia afzelii
YESYLEGVKY

SEQ ID NO: 70863 - protein, 10 aa, Borrelia afzelii
SARTATNFVY

SEQ ID NO: 70864 - protein, 10 aa, Borrelia afzelii
LLSTKQTQMY

SEQ ID NO: 70865 - protein, 10 aa, Borrelia afzelii
YTDEIEEEDY

SEQ ID NO: 70866 - protein, 10 aa, Borrelia afzelii
DQYSLEEDYY

SEQ ID NO: 70867 - protein, 10 aa, Borrelia afzelii
EIEEEDYDQY

SEQ ID NO: 70868 - protein, 10 aa, Borrelia afzelii
KTIVKIYDNY

SEQ ID NO: 70869 - protein, 10 aa, Borrelia afzelii
SAIKTIVKIY

SEQ ID NO: 70870 - protein, 11 aa, Borrelia afzelii
VSARTATNFVY

SEQ ID NO: 70871 - protein, 11 aa, Borrelia afzelii
DQYSLEEDYYY

SEQ ID NO: 70872 - protein, 11 aa, Borrelia afzelii
QAISGSNSISY

SEQ ID NO: 70873 - protein, 11 aa, Borrelia afzelii
RYESYLEGVKY

SEQ ID NO: 70874 - protein, 11 aa, Borrelia afzelii
SYTDEIEEEDY

SEQ ID NO: 70875 - protein, 11 aa, Borrelia afzelii
TLLSTKQTQMY

SEQ ID NO: 70876 - protein, 11 aa, Borrelia afzelii
EIVIDKNGVWY

SEQ ID NO: 70877 - protein, 11 aa, Borrelia afzelii
DYDQYSLEEDY

SEQ ID NO: 70878 - protein, 9 aa, Borrelia afzelii
TATNFVYAR

SEQ ID NO: 70879 - protein, 9 aa, Borrelia afzelii
FISCDLFIR

SEQ ID NO: 70880 - protein, 9 aa, Borrelia afzelii
DPFNHHVKR

SEQ ID NO: 70881 - protein, 9 aa, Borrelia afzelii
YAREIYSKR

SEQ ID NO: 70882 - protein, 9 aa, Borrelia afzelii
EILKTKLLR

SEQ ID NO: 70883 - protein, 9 aa, Borrelia afzelii
DYYYDGETR

SEQ ID NO: 70884 - protein, 9 aa, Borrelia afzelii
ETRKEEIQK

SEQ ID NO: 70885 - protein, 9 aa, Borrelia afzelii
ETGDKSVKK

SEQ ID NO: 70886 - protein, 9 aa, Borrelia afzelii
DFTIDSDLR

SEQ ID NO: 70887 - protein, 9 aa, Borrelia afzelii
DLFIRDEIK

SEQ ID NO: 70888 - protein, 9 aa, Borrelia afzelii
QSDLYEAYK

SEQ ID NO: 70889 - protein, 9 aa, Borrelia afzelii
SVKKSLNKK

SEQ ID NO: 70890 - protein, 9 aa, Borrelia afzelii
SSILETGDK

SEQ ID NO: 70891 - protein, 9 aa, Borrelia afzelii
IVRSILLMK

SEQ ID NO: 70892 - protein, 9 aa, Borrelia afzelii
LNYIQVSAR

SEQ ID NO: 70893 - protein, 9 aa, Borrelia afzelii
SSAIKTIVK

SEQ ID NO: 70894 - protein, 9 aa, Borrelia afzelii
TIVKIYDNY

SEQ ID NO: 70895 - protein, 9 aa, Borrelia afzelii
DNYTLLSTK

SEQ ID NO: 70896 - protein, 9 aa, Borrelia afzelii
ESYLEGVKY

SEQ ID NO: 70897 - protein, 9 aa, Borrelia afzelii
STRLDNLAK

SEQ ID NO: 70898 - protein, 9 aa, Borrelia afzelii
KIIEIVIDK

SEQ ID NO: 70899 - protein, 9 aa, Borrelia afzelii
YEAYKAIVR

SEQ ID NO: 70900 - protein, 9 aa, Borrelia afzelii
VISEEEILK

SEQ ID NO: 70901 - protein, 9 aa, Borrelia afzelii
KVEGNAVKK

SEQ ID NO: 70902 - protein, 9 aa, Borrelia afzelii
TIDSDLRLK

SEQ ID NO: 70903 - protein, 9 aa, Borrelia afzelii
TEIKNLILK

SEQ ID NO: 70904 - protein, 9 aa, Borrelia afzelii
ILLMKDSLK

SEQ ID NO: 70905 - protein, 9 aa, Borrelia afzelii
NFVYAREIY

SEQ ID NO: 70906 - protein, 9 aa, Borrelia afzelii
VYAREIYSK

SEQ ID NO: 70907 - protein, 10 aa, Borrelia afzelii
FVYAREIYSK

SEQ ID NO: 70908 - protein, 10 aa, Borrelia afzelii
RTATNFVYAR

SEQ ID NO: 70909 - protein, 10 aa, Borrelia afzelii
FTIDSDLRLK

SEQ ID NO: 70910 - protein, 10 aa, Borrelia afzelii
NVISEEEILK

SEQ ID NO: 70911 - protein, 10 aa, Borrelia afzelii
SVNNSNLSQK

SEQ ID NO: 70912 - protein, 10 aa, Borrelia afzelii
LLNYIQVSAR

SEQ ID NO: 70913 - protein, 10 aa, Borrelia afzelii
ETEIKNLILK

SEQ ID NO: 70914 - protein, 10 aa, Borrelia afzelii
ESSILETGDK

SEQ ID NO: 70915 - protein, 10 aa, Borrelia afzelii
EDYYYDGETR

SEQ ID NO: 70916 - protein, 10 aa, Borrelia afzelii
YSTRLDNLAK

SEQ ID NO: 70917 - protein, 10 aa, Borrelia afzelii
EIQKQQDEHK

SEQ ID NO: 70918 - protein, 10 aa, Borrelia afzelii
FLSGESGELK

SEQ ID NO: 70919 - protein, 10 aa, Borrelia afzelii
EIKNLILKIK

SEQ ID NO: 70920 - protein, 10 aa, Borrelia afzelii
IDFTIDSDLR

SEQ ID NO: 70921 - protein, 10 aa, Borrelia afzelii
SILLMKDSLK

SEQ ID NO: 70922 - protein, 10 aa, Borrelia afzelii
EEILKTKLLR

SEQ ID NO: 70923 - protein, 10 aa, Borrelia afzelii
YAREIYSKRK

SEQ ID NO: 70924 - protein, 10 aa, Borrelia afzelii
VYAREIYSKR

SEQ ID NO: 70925 - protein, 10 aa, Borrelia afzelii
VSSAIKTIVK

SEQ ID NO: 70926 - protein, 10 aa, Borrelia afzelii
GFISCDLFIR

SEQ ID NO: 70927 - protein, 10 aa, Borrelia afzelii
LYEAYKAIVR

SEQ ID NO: 70928 - protein, 10 aa, Borrelia afzelii
AIVRSILLMK

SEQ ID NO: 70929 - protein, 10 aa, Borrelia afzelii
TATNFVYARE

SEQ ID NO: 70930 - protein, 10 aa, Borrelia afzelii
ESVNNSNLSQ

SEQ ID NO: 70931 - protein, 10 aa, Borrelia afzelii
TKQTQMYSTR

SEQ ID NO: 70932 - protein, 11 aa, Borrelia afzelii
FVYAREIYSKR

SEQ ID NO: 70933 - protein, 11 aa, Borrelia afzelii
ESVNNSNLSQK

SEQ ID NO: 70934 - protein, 11 aa, Borrelia afzelii
STKQTQMYSTR

SEQ ID NO: 70935 - protein, 11 aa, Borrelia afzelii
EIDFTIDSDLR

SEQ ID NO: 70936 - protein, 11 aa, Borrelia afzelii
DLYEAYKAIVR

SEQ ID NO: 70937 - protein, 11 aa, Borrelia afzelii
NVSSAIKTIVK

SEQ ID NO: 70938 - protein, 11 aa, Borrelia afzelii
EIQKQQDEHKR

SEQ ID NO: 70939 - protein, 11 aa, Borrelia afzelii
FTKEELEKDLK

SEQ ID NO: 70940 - protein, 11 aa, Borrelia afzelii
TLLNYIQVSAR

SEQ ID NO: 70941 - protein, 11 aa, Borrelia afzelii
FGFISCDLFIR

SEQ ID NO: 70942 - protein, 11 aa, Borrelia afzelii
EILKTKLLRER

SEQ ID NO: 70943 - protein, 11 aa, Borrelia afzelii
NFVYAREIYSK

SEQ ID NO: 70944 - protein, 11 aa, Borrelia afzelii
DLFIRDEIKEK

SEQ ID NO: 70945 - protein, 11 aa, Borrelia afzelii
MYSTRLDNLAK

SEQ ID NO: 70946 - protein, 11 aa, Borrelia afzelii
RSILLMKDSLK

SEQ ID NO: 70947 - protein, 11 aa, Borrelia afzelii
GVKYNVSSAIK

SEQ ID NO: 70948 - protein, 11 aa, Borrelia afzelii
ATNFVYAREIY

SEQ ID NO: 70949 - protein, 11 aa, Borrelia afzelii
ETRLSNRYESY

SEQ ID NO: 70950 - protein, 11 aa, Borrelia afzelii
DFTIDSDLRLK

SEQ ID NO: 70951 - protein, 11 aa, Borrelia afzelii
STRLDNLAKAK

SEQ ID NO: 70952 - protein, 11 aa, Borrelia afzelii
SVKKSLNKKGK

SEQ ID NO: 70953 - protein, 11 aa, Borrelia afzelii
KAIVRSILLMK

SEQ ID NO: 70954 - protein, 11 aa, Borrelia afzelii
LAKAKAREEAK

SEQ ID NO: 70955 - protein, 11 aa, Borrelia afzelii
QAISGSNSISY

SEQ ID NO: 70956 - protein, 11 aa, Borrelia afzelii
SLKIIEIVIDK

SEQ ID NO: 70957 - protein, 11 aa, Borrelia afzelii
EESSILETGDK

SEQ ID NO: 70958 - protein, 11 aa, Borrelia afzelii
EIVIDKNGVWY

SEQ ID NO: 70959 - protein, 11 aa, Borrelia afzelii
DQYSLEEDYYY

SEQ ID NO: 70960 - protein, 11 aa, Borrelia afzelii
YYDGETRLSNR

SEQ ID NO: 70961 - protein, 11 aa, Borrelia afzelii
SILETGDKSVK

SEQ ID NO: 70962 - protein, 11 aa, Borrelia afzelii
DTIESNEIDFT

SEQ ID NO: 70963 - protein, 9 aa, Borrelia afzelii
RPETRKEEI

SEQ ID NO: 70964 - protein, 9 aa, Borrelia afzelii
SARTATNFV

SEQ ID NO: 70965 - protein, 9 aa, Borrelia afzelii
KAIVRSILL

SEQ ID NO: 70966 - protein, 9 aa, Borrelia afzelii
KIKSKCLAL

SEQ ID NO: 70967 - protein, 10 aa, Borrelia afzelii
GVKYNVSSAI

SEQ ID NO: 70968 - protein, 11 aa, Borrelia afzelii
YAREIYSKRKL

SEQ ID NO: 70969 - protein, 11 aa, Borrelia afzelii
VARKKVEGNAV

SEQ ID NO: 70970 - protein, 11 aa, Borrelia afzelii
SARTATNFVYA

SEQ ID NO: 70971 - protein, 9 aa, Borrelia afzelii
YSKRKLDAI

SEQ ID NO: 70972 - protein, 9 aa, Borrelia afzelii
KIKSKCLAL

SEQ ID NO: 70973 - protein, 9 aa, Borrelia afzelii
EIKEKSLGL

SEQ ID NO: 70974 - protein, 9 aa, Borrelia afzelii
RLKSDLQAI

SEQ ID NO: 70975 - protein, 10 aa, Borrelia afzelii
EAKKFTKEEL

SEQ ID NO: 70976 - protein, 10 aa, Borrelia afzelii
ILKIKGQSDL

SEQ ID NO: 70977 - protein, 10 aa, Borrelia afzelii
YIQVSARTAT

SEQ ID NO: 70978 - protein, 11 aa, Borrelia afzelii
YAREIYSKRKL

SEQ ID NO: 70979 - protein, 11 aa, Borrelia afzelii
VARKKVEGNAV

SEQ ID NO: 70980 - protein, 9 aa, Borrelia afzelii
RMLQGSLSF

SEQ ID NO: 70981 - protein, 9 aa, Borrelia afzelii
GQSDLYEAY

SEQ ID NO: 70982 - protein, 9 aa, Borrelia afzelii
RLSNRYESY

SEQ ID NO: 70983 - protein, 9 aa, Borrelia afzelii
YSLEEDYYY

SEQ ID NO: 70984 - protein, 9 aa, Borrelia afzelii
VSARTATNF

SEQ ID NO: 70985 - protein, 9 aa, Borrelia afzelii
ISGSNSISY

SEQ ID NO: 70986 - protein, 9 aa, Borrelia afzelii
KQQDEHKRM

SEQ ID NO: 70987 - protein, 9 aa, Borrelia afzelii
AIKTIVKIY

SEQ ID NO: 70988 - protein, 9 aa, Borrelia afzelii
FLSGESGEL

SEQ ID NO: 70989 - protein, 9 aa, Borrelia afzelii
KIKGQSDLY

SEQ ID NO: 70990 - protein, 9 aa, Borrelia afzelii
KAREEAKKF

SEQ ID NO: 70991 - protein, 9 aa, Borrelia afzelii
IVIDKNGVW

SEQ ID NO: 70992 - protein, 9 aa, Borrelia afzelii
LSTKQTQMY

SEQ ID NO: 70993 - protein, 10 aa, Borrelia afzelii
AISGSNSISY

SEQ ID NO: 70994 - protein, 10 aa, Borrelia afzelii
QVSARTATNF

SEQ ID NO: 70995 - protein, 10 aa, Borrelia afzelii
IVIDKNGVWY

SEQ ID NO: 70996 - protein, 10 aa, Borrelia afzelii
LQAISGSNSI

SEQ ID NO: 70997 - protein, 10 aa, Borrelia afzelii
SARTATNFVY

SEQ ID NO: 70998 - protein, 10 aa, Borrelia afzelii
LLSTKQTQMY

SEQ ID NO: 70999 - protein, 10 aa, Borrelia afzelii
RMLQGSLSFL

SEQ ID NO: 71000 - protein, 10 aa, Borrelia afzelii
KQQDEHKRML

SEQ ID NO: 71001 - protein, 10 aa, Borrelia afzelii
SAIKTIVKIY

SEQ ID NO: 71002 - protein, 10 aa, Borrelia afzelii
KTIVKIYDNY

SEQ ID NO: 71003 - protein, 10 aa, Borrelia afzelii
KQTQMYSTRL

SEQ ID NO: 71004 - protein, 10 aa, Borrelia afzelii
LLFGFISCDL

SEQ ID NO: 71005 - protein, 11 aa, Borrelia afzelii
IQVSARTATNF

SEQ ID NO: 71006 - protein, 11 aa, Borrelia afzelii
QAISGSNSISY

SEQ ID NO: 71007 - protein, 11 aa, Borrelia afzelii
VSARTATNFVY

SEQ ID NO: 71008 - protein, 11 aa, Borrelia afzelii
LLFGFISCDLF

SEQ ID NO: 71009 - protein, 11 aa, Borrelia afzelii
ILKIKGQSDLY

SEQ ID NO: 71010 - protein, 11 aa, Borrelia afzelii
KSKCLALGLLF

SEQ ID NO: 71011 - protein, 11 aa, Borrelia afzelii
SSAIKTIVKIY

SEQ ID NO: 71012 - protein, 11 aa, Borrelia afzelii
IQKQQDEHKRM

SEQ ID NO: 71013 - protein, 11 aa, Borrelia afzelii
ETRLSNRYESY

SEQ ID NO: 71014 - protein, 11 aa, Borrelia afzelii
KAKAREEAKKF

SEQ ID NO: 71015 - protein, 11 aa, Borrelia afzelii
TLLSTKQTQMY

SEQ ID NO: 71016 - protein, 11 aa, Borrelia afzelii
TQMYSTRLDNL

SEQ ID NO: 71017 - protein, 11 aa, Borrelia afzelii
DQYSLEEDYYY

SEQ ID NO: 71018 - protein, 11 aa, Borrelia afzelii
LMKDSLKIIEI

SEQ ID NO: 71019 - protein, 11 aa, Borrelia afzelii
ATNFVYAREIY

SEQ ID NO: 71020 - protein, 11 aa, Borrelia afzelii
SQKNVISEEEI

SEQ ID NO: 71021 - protein, 9 aa, Borrelia afzelii
RMLQGSLSF

SEQ ID NO: 71022 - protein, 9 aa, Borrelia afzelii
ARTATNFVY

SEQ ID NO: 71023 - protein, 9 aa, Borrelia afzelii
KRMLQGSLS

SEQ ID NO: 71024 - protein, 9 aa, Borrelia afzelii
KQTQMYSTR

SEQ ID NO: 71025 - protein, 10 aa, Borrelia afzelii
KRMLQGSLSF

SEQ ID NO: 71026 - protein, 10 aa, Borrelia afzelii
TRLSNRYESY

SEQ ID NO: 71027 - protein, 10 aa, Borrelia afzelii
TRLDNLAKAK

SEQ ID NO: 71028 - protein, 10 aa, Borrelia afzelii
AREEAKKFTK

SEQ ID NO: 71029 - protein, 10 aa, Borrelia afzelii
KRESVNNSNL

SEQ ID NO: 71030 - protein, 10 aa, Borrelia afzelii
NRYESYLEGV

SEQ ID NO: 71031 - protein, 10 aa, Borrelia afzelii
KKVEGNAVKK

SEQ ID NO: 71032 - protein, 11 aa, Borrelia afzelii
KRMLQGSLSFL

SEQ ID NO: 71033 - protein, 11 aa, Borrelia afzelii
NRYESYLEGVK

SEQ ID NO: 71034 - protein, 11 aa, Borrelia afzelii
TRLSNRYESYL

SEQ ID NO: 71035 - protein, 11 aa, Borrelia afzelii
ARTATNFVYAR

SEQ ID NO: 71036 - protein, 11 aa, Borrelia afzelii
ARKKVEGNAVK

SEQ ID NO: 71037 - protein, 9 aa, Borrelia afzelii
YSLEEDYYY

SEQ ID NO: 71038 - protein, 9 aa, Borrelia afzelii
NFVYAREIY

SEQ ID NO: 71039 - protein, 9 aa, Borrelia afzelii
LALGLLFGF

SEQ ID NO: 71040 - protein, 9 aa, Borrelia afzelii
LSTKQTQMY

SEQ ID NO: 71041 - protein, 9 aa, Borrelia afzelii
FTIDSDLRL

SEQ ID NO: 71042 - protein, 9 aa, Borrelia afzelii
ESYLEGVKY

SEQ ID NO: 71043 - protein, 9 aa, Borrelia afzelii
RMLQGSLSF

SEQ ID NO: 71044 - protein, 9 aa, Borrelia afzelii
ISGSNSISY

SEQ ID NO: 71045 - protein, 10 aa, Borrelia afzelii
SARTATNFVY

SEQ ID NO: 71046 - protein, 10 aa, Borrelia afzelii
EIEEEDYDQY

SEQ ID NO: 71047 - protein, 10 aa, Borrelia afzelii
YTDEIEEEDY

SEQ ID NO: 71048 - protein, 10 aa, Borrelia afzelii
SAIKTIVKIY

SEQ ID NO: 71049 - protein, 10 aa, Borrelia afzelii
YESYLEGVKY

SEQ ID NO: 71050 - protein, 10 aa, Borrelia afzelii
LLSTKQTQMY

SEQ ID NO: 71051 - protein, 10 aa, Borrelia afzelii
IVIDKNGVWY

SEQ ID NO: 71052 - protein, 11 aa, Borrelia afzelii
QAISGSNSISY

SEQ ID NO: 71053 - protein, 11 aa, Borrelia afzelii
TLLSTKQTQMY

SEQ ID NO: 71054 - protein, 11 aa, Borrelia afzelii
EIVIDKNGVWY

SEQ ID NO: 71055 - protein, 11 aa, Borrelia afzelii
IKGQSDLYEAY

SEQ ID NO: 71056 - protein, 11 aa, Borrelia afzelii
VSARTATNFVY

SEQ ID NO: 71057 - protein, 11 aa, Borrelia afzelii
YTLLSTKQTQM

SEQ ID NO: 71058 - protein, 11 aa, Borrelia afzelii
YDQYSLEEDYY

SEQ ID NO: 71059 - protein, 11 aa, Borrelia afzelii
EAYKAIVRSIL

SEQ ID NO: 71060 - protein, 9 aa, Borrelia afzelii
EEILKTKLL

SEQ ID NO: 71061 - protein, 9 aa, Borrelia afzelii
NEIDFTIDS

SEQ ID NO: 71062 - protein, 9 aa, Borrelia afzelii
EEEDYDQYS

SEQ ID NO: 71063 - protein, 9 aa, Borrelia afzelii
EELEKDLKT

SEQ ID NO: 71064 - protein, 9 aa, Borrelia afzelii
GELKDTIES

SEQ ID NO: 71065 - protein, 9 aa, Borrelia afzelii
GETRLSNRY

SEQ ID NO: 71066 - protein, 9 aa, Borrelia afzelii
REIYSKRKL

SEQ ID NO: 71067 - protein, 9 aa, Borrelia afzelii
KEKSLGLCD

SEQ ID NO: 71068 - protein, 10 aa, Borrelia afzelii
EEILKTKLLR

SEQ ID NO: 71069 - protein, 10 aa, Borrelia afzelii
EEEDYDQYSL

SEQ ID NO: 71070 - protein, 10 aa, Borrelia afzelii
TEIKNLILKI

SEQ ID NO: 71071 - protein, 10 aa, Borrelia afzelii
DEIKEKSLGL

SEQ ID NO: 71072 - protein, 10 aa, Borrelia afzelii
EEIQKQQDEH

SEQ ID NO: 71073 - protein, 10 aa, Borrelia afzelii
EEDYYYDGET

SEQ ID NO: 71074 - protein, 10 aa, Borrelia afzelii
EELEKDLKTL

SEQ ID NO: 71075 - protein, 10 aa, Borrelia afzelii
EEEILKTKLL

SEQ ID NO: 71076 - protein, 10 aa, Borrelia afzelii
NEIDFTIDSD

SEQ ID NO: 71077 - protein, 11 aa, Borrelia afzelii
NEIDFTIDSDL

SEQ ID NO: 71078 - protein, 11 aa, Borrelia afzelii
DEIEEEDYDQY

SEQ ID NO: 71079 - protein, 11 aa, Borrelia afzelii
EELEKDLKTLL

SEQ ID NO: 71080 - protein, 11 aa, Borrelia afzelii
IEIVIDKNGVW

SEQ ID NO: 71081 - protein, 11 aa, Borrelia afzelii
EEILKTKLLRE

SEQ ID NO: 71082 - protein, 11 aa, Borrelia afzelii
REIYSKRKLDA

SEQ ID NO: 71083 - protein, 11 aa, Borrelia afzelii
EEEDYDQYSLE

SEQ ID NO: 71084 - protein, 11 aa, Borrelia afzelii
SEEEILKTKLL

SEQ ID NO: 71085 - protein, 10 aa, Borrelia afzelii
LALGLLFGFI

SEQ ID NO: 71086 - protein, 9 aa, Borrelia afzelii
VSARTATNF

SEQ ID NO: 71087 - protein, 11 aa, Borrelia afzelii
VSARTATNFVY

SEQ ID NO: 71088 - protein, 9 aa, Borrelia garinii
FSTKLTQMY

SEQ ID NO: 71089 - protein, 9 aa, Borrelia garinii
AIDKNGIWY

SEQ ID NO: 71090 - protein, 9 aa, Borrelia garinii
ISCDLFIRY

SEQ ID NO: 71091 - protein, 10 aa, Borrelia garinii
YTDEIEEEDY

SEQ ID NO: 71092 - protein, 10 aa, Borrelia garinii
NTINKIYDTY

SEQ ID NO: 71093 - protein, 10 aa, Borrelia garinii
FISCDLFIRY

SEQ ID NO: 71094 - protein, 11 aa, Borrelia garinii
YLDEDDEDDEY

SEQ ID NO: 71095 - protein, 11 aa, Borrelia garinii
DSAINTINKIY

SEQ ID NO: 71096 - protein, 11 aa, Borrelia garinii
VSVKTATNFVY

SEQ ID NO: 71097 - protein, 9 aa, Borrelia garinii
LLNYIQVSV

SEQ ID NO: 71098 - protein, 9 aa, Borrelia garinii
GLFDKGNSI

SEQ ID NO: 71099 - protein, 9 aa, Borrelia garinii
YLEGVKYNV

SEQ ID NO: 71100 - protein, 9 aa, Borrelia garinii
KTATNFVYI

SEQ ID NO: 71101 - protein, 9 aa, Borrelia garinii
SLKEVQYAI

SEQ ID NO: 71102 - protein, 9 aa, Borrelia garinii
AIVSSILLM

SEQ ID NO: 71103 - protein, 9 aa, Borrelia garinii
KTLLNYIQV

SEQ ID NO: 71104 - protein, 9 aa, Borrelia garinii
LMRDSLKEV

SEQ ID NO: 71105 - protein, 9 aa, Borrelia garinii
NLYSAYKAI

SEQ ID NO: 71106 - protein, 9 aa, Borrelia garinii
KLENIEAKI

SEQ ID NO: 71107 - protein, 9 aa, Borrelia garinii
YLALGLLFG

SEQ ID NO: 71108 - protein, 9 aa, Borrelia garinii
KVSGKEPFI

SEQ ID NO: 71109 - protein, 9 aa, Borrelia garinii
TLLNYIQVS

SEQ ID NO: 71110 - protein, 9 aa, Borrelia garinii
ILETSEESI

SEQ ID NO: 71111 - protein, 9 aa, Borrelia garinii
ALGLLFGFI

SEQ ID NO: 71112 - protein, 9 aa, Borrelia garinii
SLSGESGEL

SEQ ID NO: 71113 - protein, 9 aa, Borrelia garinii
KAIVSSILL

SEQ ID NO: 71114 - protein, 9 aa, Borrelia garinii
MLEEESLKT

SEQ ID NO: 71115 - protein, 10 aa, Borrelia garinii
TLLNYIQVSV

SEQ ID NO: 71116 - protein, 10 aa, Borrelia garinii
LLMRDSLKEV

SEQ ID NO: 71117 - protein, 10 aa, Borrelia garinii
LLFGFISCDL

SEQ ID NO: 71118 - protein, 10 aa, Borrelia garinii
GLFDKGNSIL

SEQ ID NO: 71119 - protein, 10 aa, Borrelia garinii
RLSNRYQSYL

SEQ ID NO: 71120 - protein, 10 aa, Borrelia garinii
NLYSAYKAIV

SEQ ID NO: 71121 - protein, 10 aa, Borrelia garinii
KLTQMYSTRL

SEQ ID NO: 71122 - protein, 10 aa, Borrelia garinii
QMYSTRLDNL

SEQ ID NO: 71123 - protein, 10 aa, Borrelia garinii
KIYDTYTLFS

SEQ ID NO: 71124 - protein, 10 aa, Borrelia garinii
GMTKGSLNSL

SEQ ID NO: 71125 - protein, 10 aa, Borrelia garinii
SILETSEESI

SEQ ID NO: 71126 - protein, 10 aa, Borrelia garinii
VMLEEESLKT

SEQ ID NO: 71127 - protein, 10 aa, Borrelia garinii
YLALGLLFGF

SEQ ID NO: 71128 - protein, 10 aa, Borrelia garinii
TLFSTKLTQM

SEQ ID NO: 71129 - protein, 10 aa, Borrelia garinii
SAYKAIVSSI

SEQ ID NO: 71130 - protein, 10 aa, Borrelia garinii
LALGLLFGFI

SEQ ID NO: 71131 - protein, 11 aa, Borrelia garinii
YLALGLLFGFI

SEQ ID NO: 71132 - protein, 11 aa, Borrelia garinii
KIYDTYTLFST

SEQ ID NO: 71133 - protein, 11 aa, Borrelia garinii
SLQDIAGSNSI

SEQ ID NO: 71134 - protein, 11 aa, Borrelia garinii
KTLLNYIQVSV

SEQ ID NO: 71135 - protein, 11 aa, Borrelia garinii
ILLMRDSLKEV

SEQ ID NO: 71136 - protein, 11 aa, Borrelia garinii
MLEEESLKTEL

SEQ ID NO: 71137 - protein, 11 aa, Borrelia garinii
GLLFGFISCDL

SEQ ID NO: 71138 - protein, 11 aa, Borrelia garinii
YTDEIEEEDYA

SEQ ID NO: 71139 - protein, 11 aa, Borrelia garinii
TINKIYDTYTL

SEQ ID NO: 71140 - protein, 11 aa, Borrelia garinii
QMYSTRLDNLA

SEQ ID NO: 71141 - protein, 11 aa, Borrelia garinii
LLNYIQVSVKT

SEQ ID NO: 71142 - protein, 11 aa, Borrelia garinii
TQMYSTRLDNL

SEQ ID NO: 71143 - protein, 11 aa, Borrelia garinii
QVSVKTATNFV

SEQ ID NO: 71144 - protein, 11 aa, Borrelia garinii
YINEMHAKRKL

SEQ ID NO: 71145 - protein, 9 aa, Borrelia garinii
KSNLYSAYK

SEQ ID NO: 71146 - protein, 9 aa, Borrelia garinii
ILLMRDSLK

SEQ ID NO: 71147 - protein, 9 aa, Borrelia garinii
RLSNRYQSY

SEQ ID NO: 71148 - protein, 9 aa, Borrelia garinii
SIKKPMNKK

SEQ ID NO: 71149 - protein, 9 aa, Borrelia garinii
TLIAKIKEK

SEQ ID NO: 71150 - protein, 9 aa, Borrelia garinii
RLDNLAKAK

SEQ ID NO: 71151 - protein, 9 aa, Borrelia garinii
DTYTLFSTK

SEQ ID NO: 71152 - protein, 9 aa, Borrelia garinii
VMLEEESLK

SEQ ID NO: 71153 - protein, 9 aa, Borrelia garinii
IVSSILLMR

SEQ ID NO: 71154 - protein, 9 aa, Borrelia garinii
KLTQMYSTR

SEQ ID NO: 71155 - protein, 9 aa, Borrelia garinii
KIKEKSNLY

SEQ ID NO: 71156 - protein, 9 aa, Borrelia garinii
ESIKKPMNK

SEQ ID NO: 71157 - protein, 9 aa, Borrelia garinii
STRLDNLAK

SEQ ID NO: 71158 - protein, 9 aa, Borrelia garinii
KEPFIHSFK

SEQ ID NO: 71159 - protein, 9 aa, Borrelia garinii
ISCDLFIRY

SEQ ID NO: 71160 - protein, 9 aa, Borrelia garinii
ESLKTELLK

SEQ ID NO: 71161 - protein, 9 aa, Borrelia garinii
KNFKTLLNY

SEQ ID NO: 71162 - protein, 9 aa, Borrelia garinii
QSYLEGVKY

SEQ ID NO: 71163 - protein, 9 aa, Borrelia garinii
LNYIQVSVK

SEQ ID NO: 71164 - protein, 9 aa, Borrelia garinii
AIDKNGIWY

SEQ ID NO: 71165 - protein, 10 aa, Borrelia garinii
LLNYIQVSVK

SEQ ID NO: 71166 - protein, 10 aa, Borrelia garinii
SLSGESGELK

SEQ ID NO: 71167 - protein, 10 aa, Borrelia garinii
SILLMRDSLK

SEQ ID NO: 71168 - protein, 10 aa, Borrelia garinii
KTLIAKIKEK

SEQ ID NO: 71169 - protein, 10 aa, Borrelia garinii
FVYINEMHAK

SEQ ID NO: 71170 - protein, 10 aa, Borrelia garinii
KIARKNGKSK

SEQ ID NO: 71171 - protein, 10 aa, Borrelia garinii
KPMNKKGKGK

SEQ ID NO: 71172 - protein, 10 aa, Borrelia garinii
KIKTLIAKIK

SEQ ID NO: 71173 - protein, 10 aa, Borrelia garinii
QQDEYKGMTK

SEQ ID NO: 71174 - protein, 10 aa, Borrelia garinii
AIVSSILLMR

SEQ ID NO: 71175 - protein, 10 aa, Borrelia garinii
AANKSNFLQK

SEQ ID NO: 71176 - protein, 10 aa, Borrelia garinii
RYQSYLEGVK

SEQ ID NO: 71177 - protein, 10 aa, Borrelia garinii
NVMLEEESLK

SEQ ID NO: 71178 - protein, 10 aa, Borrelia garinii
ITIDSDLRPK

SEQ ID NO: 71179 - protein, 10 aa, Borrelia garinii
GKEPFIHSFK

SEQ ID NO: 71180 - protein, 10 aa, Borrelia garinii
LLKEQSETRK

SEQ ID NO: 71181 - protein, 10 aa, Borrelia garinii
CDLFIRYEMK

SEQ ID NO: 71182 - protein, 10 aa, Borrelia garinii
YDTYTLFSTK

SEQ ID NO: 71183 - protein, 10 aa, Borrelia garinii
EKSNLYSAYK

SEQ ID NO: 71184 - protein, 10 aa, Borrelia garinii
KLENIEAKIK

SEQ ID NO: 71185 - protein, 10 aa, Borrelia garinii
SVKTATNFVY

SEQ ID NO: 71186 - protein, 10 aa, Borrelia garinii
KIQKQQDEYK

SEQ ID NO: 71187 - protein, 10 aa, Borrelia garinii
EAKIKTLIAK

SEQ ID NO: 71188 - protein, 10 aa, Borrelia garinii
KIYDTYTLFS

SEQ ID NO: 71189 - protein, 10 aa, Borrelia garinii
YINEMHAKRK

SEQ ID NO: 71190 - protein, 10 aa, Borrelia garinii
YSTRLDNLAK

SEQ ID NO: 71191 - protein, 10 aa, Borrelia garinii
FISCDLFIRY

SEQ ID NO: 71192 - protein, 10 aa, Borrelia garinii
ILETSEESIK

SEQ ID NO: 71193 - protein, 10 aa, Borrelia garinii
HSFKRDAANK

SEQ ID NO: 71194 - protein, 10 aa, Borrelia garinii
YTLFSTKLTQ

SEQ ID NO: 71195 - protein, 11 aa, Borrelia garinii
TLLNYIQVSVK

SEQ ID NO: 71196 - protein, 11 aa, Borrelia garinii
TLFSTKLTQMY

SEQ ID NO: 71197 - protein, 11 aa, Borrelia garinii
RLDNLAKAKAK

SEQ ID NO: 71198 - protein, 11 aa, Borrelia garinii
SLKEVQYAIDK

SEQ ID NO: 71199 - protein, 11 aa, Borrelia garinii
SSILLMRDSLK

SEQ ID NO: 71200 - protein, 11 aa, Borrelia garinii
ILETSEESIKK

SEQ ID NO: 71201 - protein, 11 aa, Borrelia garinii
FVYINEMHAKR

SEQ ID NO: 71202 - protein, 11 aa, Borrelia garinii
ELLKEQSETRK

SEQ ID NO: 71203 - protein, 11 aa, Borrelia garinii
SIKKPMNKKGK

SEQ ID NO: 71204 - protein, 11 aa, Borrelia garinii
SILETSEESIK

SEQ ID NO: 71205 - protein, 11 aa, Borrelia garinii
KQQDEYKGMTK

SEQ ID NO: 71206 - protein, 11 aa, Borrelia garinii
KAKEEAAKFTK

SEQ ID NO: 71207 - protein, 11 aa, Borrelia garinii
STRLDNLAKAK

SEQ ID NO: 71208 - protein, 11 aa, Borrelia garinii
NVDSAINTINK

SEQ ID NO: 71209 - protein, 9 aa, Borrelia garinii
KSNLYSAYK

SEQ ID NO: 71210 - protein, 9 aa, Borrelia garinii
DTYTLFSTK

SEQ ID NO: 71211 - protein, 9 aa, Borrelia garinii
IVSSILLMR

SEQ ID NO: 71212 - protein, 9 aa, Borrelia garinii
STRLDNLAK

SEQ ID NO: 71213 - protein, 9 aa, Borrelia garinii
ILLMRDSLK

SEQ ID NO: 71214 - protein, 9 aa, Borrelia garinii
SIKKPMNKK

SEQ ID NO: 71215 - protein, 9 aa, Borrelia garinii
TLIAKIKEK

SEQ ID NO: 71216 - protein, 9 aa, Borrelia garinii
ISCDLFIRY

SEQ ID NO: 71217 - protein, 9 aa, Borrelia garinii
TIDSDLRPK

SEQ ID NO: 71218 - protein, 9 aa, Borrelia garinii
ESIKKPMNK

SEQ ID NO: 71219 - protein, 9 aa, Borrelia garinii
VMLEEESLK

SEQ ID NO: 71220 - protein, 9 aa, Borrelia garinii
ESLKTELLK

SEQ ID NO: 71221 - protein, 9 aa, Borrelia garinii
ETSEESIKK

SEQ ID NO: 71222 - protein, 9 aa, Borrelia garinii
VYINEMHAK

SEQ ID NO: 71223 - protein, 9 aa, Borrelia garinii
DSAINTINK

SEQ ID NO: 71224 - protein, 9 aa, Borrelia garinii
LSGESGELK

SEQ ID NO: 71225 - protein, 9 aa, Borrelia garinii
ANKSNFLQK

SEQ ID NO: 71226 - protein, 9 aa, Borrelia garinii
RLDNLAKAK

SEQ ID NO: 71227 - protein, 9 aa, Borrelia garinii
YQSYLEGVK

SEQ ID NO: 71228 - protein, 9 aa, Borrelia garinii
FISCDLFIR

SEQ ID NO: 71229 - protein, 9 aa, Borrelia garinii
YINEMHAKR

SEQ ID NO: 71230 - protein, 9 aa, Borrelia garinii
AKIKTLIAK

SEQ ID NO: 71231 - protein, 9 aa, Borrelia garinii
KEPFIHSFK

SEQ ID NO: 71232 - protein, 9 aa, Borrelia garinii
KLTQMYSTR

SEQ ID NO: 71233 - protein, 9 aa, Borrelia garinii
SFKRDAANK

SEQ ID NO: 71234 - protein, 9 aa, Borrelia garinii
ATNFVYINE

SEQ ID NO: 71235 - protein, 10 aa, Borrelia garinii
AANKSNFLQK

SEQ ID NO: 71236 - protein, 10 aa, Borrelia garinii
SILLMRDSLK

SEQ ID NO: 71237 - protein, 10 aa, Borrelia garinii
ITIDSDLRPK

SEQ ID NO: 71238 - protein, 10 aa, Borrelia garinii
FVYINEMHAK

SEQ ID NO: 71239 - protein, 10 aa, Borrelia garinii
KTLIAKIKEK

SEQ ID NO: 71240 - protein, 10 aa, Borrelia garinii
HSFKRDAANK

SEQ ID NO: 71241 - protein, 10 aa, Borrelia garinii
SLSGESGELK

SEQ ID NO: 71242 - protein, 10 aa, Borrelia garinii
NVMLEEESLK

SEQ ID NO: 71243 - protein, 10 aa, Borrelia garinii
AIVSSILLMR

SEQ ID NO: 71244 - protein, 10 aa, Borrelia garinii
KIQKQQDEYK

SEQ ID NO: 71245 - protein, 10 aa, Borrelia garinii
YINEMHAKRK

SEQ ID NO: 71246 - protein, 10 aa, Borrelia garinii
KIARKNGKSK

SEQ ID NO: 71247 - protein, 10 aa, Borrelia garinii
YSTRLDNLAK

SEQ ID NO: 71248 - protein, 10 aa, Borrelia garinii
LLNYIQVSVK

SEQ ID NO: 71249 - protein, 10 aa, Borrelia garinii
SVKTATNFVY

SEQ ID NO: 71250 - protein, 10 aa, Borrelia garinii
ESIKKPMNKK

SEQ ID NO: 71251 - protein, 10 aa, Borrelia garinii
KIKTLIAKIK

SEQ ID NO: 71252 - protein, 10 aa, Borrelia garinii
KAKAKEEAAK

SEQ ID NO: 71253 - protein, 10 aa, Borrelia garinii
RYQSYLEGVK

SEQ ID NO: 71254 - protein, 10 aa, Borrelia garinii
QQDEYKGMTK

SEQ ID NO: 71255 - protein, 10 aa, Borrelia garinii
KIYDTYTLFS

SEQ ID NO: 71256 - protein, 10 aa, Borrelia garinii
FISCDLFIRY

SEQ ID NO: 71257 - protein, 11 aa, Borrelia garinii
SSILLMRDSLK

SEQ ID NO: 71258 - protein, 11 aa, Borrelia garinii
SILETSEESIK

SEQ ID NO: 71259 - protein, 11 aa, Borrelia garinii
TLLNYIQVSVK

SEQ ID NO: 71260 - protein, 11 aa, Borrelia garinii
KAIVSSILLMR

SEQ ID NO: 71261 - protein, 11 aa, Borrelia garinii
NVDSAINTINK

SEQ ID NO: 71262 - protein, 11 aa, Borrelia garinii
KQQDEYKGMTK

SEQ ID NO: 71263 - protein, 11 aa, Borrelia garinii
SLKEVQYAIDK

SEQ ID NO: 71264 - protein, 11 aa, Borrelia garinii
STRLDNLAKAK

SEQ ID NO: 71265 - protein, 11 aa, Borrelia garinii
STKLTQMYSTR

SEQ ID NO: 71266 - protein, 11 aa, Borrelia garinii
NSLSGESGELK

SEQ ID NO: 71267 - protein, 11 aa, Borrelia garinii
KAKEEAAKFTK

SEQ ID NO: 71268 - protein, 11 aa, Borrelia garinii
AAKFTKEDLEK

SEQ ID NO: 71269 - protein, 11 aa, Borrelia garinii
TLFSTKLTQMY

SEQ ID NO: 71270 - protein, 11 aa, Borrelia garinii
SIKKPMNKKGK

SEQ ID NO: 71271 - protein, 11 aa, Borrelia garinii
MYSTRLDNLAK

SEQ ID NO: 71272 - protein, 11 aa, Borrelia garinii
SGKEPFIHSFK

SEQ ID NO: 71273 - protein, 11 aa, Borrelia garinii
FTKEDLEKNFK

SEQ ID NO: 71274 - protein, 11 aa, Borrelia garinii
FVYINEMHAKR

SEQ ID NO: 71275 - protein, 11 aa, Borrelia garinii
DAANKSNFLQK

SEQ ID NO: 71276 - protein, 11 aa, Borrelia garinii
ILETSEESIKK

SEQ ID NO: 71277 - protein, 11 aa, Borrelia garinii
QSETRKEKIQK

SEQ ID NO: 71278 - protein, 11 aa, Borrelia garinii
ATNFVYINEMH

SEQ ID NO: 71279 - protein, 11 aa, Borrelia garinii
VYINEMHAKRK

SEQ ID NO: 71280 - protein, 11 aa, Borrelia garinii
IYDTYTLFSTK

SEQ ID NO: 71281 - protein, 11 aa, Borrelia garinii
RLDNLAKAKAK

SEQ ID NO: 71282 - protein, 11 aa, Borrelia garinii
VSVKTATNFVY

SEQ ID NO: 71283 - protein, 9 aa, Borrelia garinii
KYLALGLLF

SEQ ID NO: 71284 - protein, 9 aa, Borrelia garinii
AYKAIVSSI

SEQ ID NO: 71285 - protein, 9 aa, Borrelia garinii
YYEDDYEEI

SEQ ID NO: 71286 - protein, 9 aa, Borrelia garinii
TYTLFSTKL

SEQ ID NO: 71287 - protein, 9 aa, Borrelia garinii
MYSTRLDNL

SEQ ID NO: 71288 - protein, 9 aa, Borrelia garinii
GFISCDLFI

SEQ ID NO: 71289 - protein, 9 aa, Borrelia garinii
VYINEMHAK

SEQ ID NO: 71290 - protein, 9 aa, Borrelia garinii
NFKTLLNYI

SEQ ID NO: 71291 - protein, 9 aa, Borrelia garinii
KTATNFVYI

SEQ ID NO: 71292 - protein, 9 aa, Borrelia garinii
RYQSYLEGV

SEQ ID NO: 71293 - protein, 9 aa, Borrelia garinii
QYAIDKNGI

SEQ ID NO: 71294 - protein, 9 aa, Borrelia garinii
KIYDTYTLF

SEQ ID NO: 71295 - protein, 10 aa, Borrelia garinii
LFGFISCDLF

SEQ ID NO: 71296 - protein, 10 aa, Borrelia garinii
AYKAIVSSIL

SEQ ID NO: 71297 - protein, 10 aa, Borrelia garinii
EYYEDDYEEI

SEQ ID NO: 71298 - protein, 10 aa, Borrelia garinii
IYDTYTLFST

SEQ ID NO: 71299 - protein, 10 aa, Borrelia garinii
SYLEGVKYNV

SEQ ID NO: 71300 - protein, 10 aa, Borrelia garinii
RYQSYLEGVK

SEQ ID NO: 71301 - protein, 11 aa, Borrelia garinii
KYLALGLLFGF

SEQ ID NO: 71302 - protein, 11 aa, Borrelia garinii
KYNVDSAINTI

SEQ ID NO: 71303 - protein, 11 aa, Borrelia garinii
AYKAIVSSILL

SEQ ID NO: 71304 - protein, 11 aa, Borrelia garinii
YYEDDYEEIRL

SEQ ID NO: 71305 - protein, 11 aa, Borrelia garinii
IYDTYTLFSTK

SEQ ID NO: 71306 - protein, 11 aa, Borrelia garinii
LFGFISCDLFI

SEQ ID NO: 71307 - protein, 11 aa, Borrelia garinii
RYQSYLEGVKY

SEQ ID NO: 71308 - protein, 11 aa, Borrelia garinii
VYINEMHAKRK

SEQ ID NO: 71309 - protein, 11 aa, Borrelia garinii
MYSTRLDNLAK

SEQ ID NO: 71310 - protein, 9 aa, Borrelia garinii
QSYLEGVKY

SEQ ID NO: 71311 - protein, 9 aa, Borrelia garinii
FSTKLTQMY

SEQ ID NO: 71312 - protein, 9 aa, Borrelia garinii
IAGSNSISY

SEQ ID NO: 71313 - protein, 9 aa, Borrelia garinii
VKTATNFVY

SEQ ID NO: 71314 - protein, 9 aa, Borrelia garinii
KYLALGLLF

SEQ ID NO: 71315 - protein, 9 aa, Borrelia garinii
ISCDLFIRY

SEQ ID NO: 71316 - protein, 9 aa, Borrelia garinii
AINTINKIY

SEQ ID NO: 71317 - protein, 9 aa, Borrelia garinii
KIYDTYTLF

SEQ ID NO: 71318 - protein, 9 aa, Borrelia garinii
TINKIYDTY

SEQ ID NO: 71319 - protein, 9 aa, Borrelia garinii
RLSNRYQSY

SEQ ID NO: 71320 - protein, 9 aa, Borrelia garinii
KNFKTLLNY

SEQ ID NO: 71321 - protein, 9 aa, Borrelia garinii
VYINEMHAK

SEQ ID NO: 71322 - protein, 9 aa, Borrelia garinii
EKSNLYSAY

SEQ ID NO: 71323 - protein, 10 aa, Borrelia garinii
YAIDKNGIWY

SEQ ID NO: 71324 - protein, 10 aa, Borrelia garinii
YQSYLEGVKY

SEQ ID NO: 71325 - protein, 10 aa, Borrelia garinii
SVKTATNFVY

SEQ ID NO: 71326 - protein, 10 aa, Borrelia garinii
FISCDLFIRY

SEQ ID NO: 71327 - protein, 10 aa, Borrelia garinii
LFSTKLTQMY

SEQ ID NO: 71328 - protein, 10 aa, Borrelia garinii
YLALGLLFGF

SEQ ID NO: 71329 - protein, 10 aa, Borrelia garinii
SAINTINKIY

SEQ ID NO: 71330 - protein, 10 aa, Borrelia garinii
EIEEEDYARY

SEQ ID NO: 71331 - protein, 10 aa, Borrelia garinii
YTDEIEEEDY

SEQ ID NO: 71332 - protein, 10 aa, Borrelia garinii
DIAGSNSISY

SEQ ID NO: 71333 - protein, 10 aa, Borrelia garinii
NTINKIYDTY

SEQ ID NO: 71334 - protein, 11 aa, Borrelia garinii
TLFSTKLTQMY

SEQ ID NO: 71335 - protein, 11 aa, Borrelia garinii
GFISCDLFIRY

SEQ ID NO: 71336 - protein, 11 aa, Borrelia garinii
VSVKTATNFVY

SEQ ID NO: 71337 - protein, 11 aa, Borrelia garinii
QYAIDKNGIWY

SEQ ID NO: 71338 - protein, 11 aa, Borrelia garinii
RYQSYLEGVKY

SEQ ID NO: 71339 - protein, 11 aa, Borrelia garinii
YLDEDDEDDEY

SEQ ID NO: 71340 - protein, 11 aa, Borrelia garinii
EIEEEDYARYY

SEQ ID NO: 71341 - protein, 11 aa, Borrelia garinii
KYLALGLLFGF

SEQ ID NO: 71342 - protein, 11 aa, Borrelia garinii
SYTDEIEEEDY

SEQ ID NO: 71343 - protein, 11 aa, Borrelia garinii
DYEEIRLSNRY

SEQ ID NO: 71344 - protein, 11 aa, Borrelia garinii
LMRDSLKEVQY

SEQ ID NO: 71345 - protein, 9 aa, Borrelia garinii
DTYTLFSTK

SEQ ID NO: 71346 - protein, 9 aa, Borrelia garinii
EPFIHSFKR

SEQ ID NO: 71347 - protein, 9 aa, Borrelia garinii
YINEMHAKR

SEQ ID NO: 71348 - protein, 9 aa, Borrelia garinii
IVSSILLMR

SEQ ID NO: 71349 - protein, 9 aa, Borrelia garinii
ETSEESIKK

SEQ ID NO: 71350 - protein, 9 aa, Borrelia garinii
DITIDSDLR

SEQ ID NO: 71351 - protein, 9 aa, Borrelia garinii
FISCDLFIR

SEQ ID NO: 71352 - protein, 9 aa, Borrelia garinii
DSAINTINK

SEQ ID NO: 71353 - protein, 9 aa, Borrelia garinii
ESIKKPMNK

SEQ ID NO: 71354 - protein, 9 aa, Borrelia garinii
EIEEEDYAR

SEQ ID NO: 71355 - protein, 9 aa, Borrelia garinii
DLFIRYEMK

SEQ ID NO: 71356 - protein, 9 aa, Borrelia garinii
ETRKEKIQK

SEQ ID NO: 71357 - protein, 9 aa, Borrelia garinii
ESLKTELLK

SEQ ID NO: 71358 - protein, 9 aa, Borrelia garinii
KSNLYSAYK

SEQ ID NO: 71359 - protein, 9 aa, Borrelia garinii
TLIAKIKEK

SEQ ID NO: 71360 - protein, 9 aa, Borrelia garinii
KLTQMYSTR

SEQ ID NO: 71361 - protein, 9 aa, Borrelia garinii
FSTKLTQMY

SEQ ID NO: 71362 - protein, 9 aa, Borrelia garinii
TINKIYDTY

SEQ ID NO: 71363 - protein, 9 aa, Borrelia garinii
STRLDNLAK

SEQ ID NO: 71364 - protein, 9 aa, Borrelia garinii
ILLMRDSLK

SEQ ID NO: 71365 - protein, 9 aa, Borrelia garinii
LLKEQSETR

SEQ ID NO: 71366 - protein, 9 aa, Borrelia garinii
LNYIQVSVK

SEQ ID NO: 71367 - protein, 9 aa, Borrelia garinii
VYINEMHAK

SEQ ID NO: 71368 - protein, 9 aa, Borrelia garinii
SIKKPMNKK

SEQ ID NO: 71369 - protein, 9 aa, Borrelia garinii
EQSETRKEK

SEQ ID NO: 71370 - protein, 9 aa, Borrelia garinii
EESPGLFDK

SEQ ID NO: 71371 - protein, 9 aa, Borrelia garinii
YQSYLEGVK

SEQ ID NO: 71372 - protein, 10 aa, Borrelia garinii
FVYINEMHAK

SEQ ID NO: 71373 - protein, 10 aa, Borrelia garinii
HSFKRDAANK

SEQ ID NO: 71374 - protein, 10 aa, Borrelia garinii
NVMLEEESLK

SEQ ID NO: 71375 - protein, 10 aa, Borrelia garinii
ESIKKPMNKK

SEQ ID NO: 71376 - protein, 10 aa, Borrelia garinii
NTINKIYDTY

SEQ ID NO: 71377 - protein, 10 aa, Borrelia garinii
ITIDSDLRPK

SEQ ID NO: 71378 - protein, 10 aa, Borrelia garinii
AIVSSILLMR

SEQ ID NO: 71379 - protein, 10 aa, Borrelia garinii
YINEMHAKRK

SEQ ID NO: 71380 - protein, 10 aa, Borrelia garinii
YSTRLDNLAK

SEQ ID NO: 71381 - protein, 10 aa, Borrelia garinii
LLNYIQVSVK

SEQ ID NO: 71382 - protein, 10 aa, Borrelia garinii
SILLMRDSLK

SEQ ID NO: 71383 - protein, 10 aa, Borrelia garinii
EKSNLYSAYK

SEQ ID NO: 71384 - protein, 10 aa, Borrelia garinii
ELLKEQSETR

SEQ ID NO: 71385 - protein, 10 aa, Borrelia garinii
DYEEIRLSNR

SEQ ID NO: 71386 - protein, 10 aa, Borrelia garinii
VYINEMHAKR

SEQ ID NO: 71387 - protein, 10 aa, Borrelia garinii
EAKIKTLIAK

SEQ ID NO: 71388 - protein, 10 aa, Borrelia garinii
DIAGSNSISY

SEQ ID NO: 71389 - protein, 10 aa, Borrelia garinii
AANKSNFLQK

SEQ ID NO: 71390 - protein, 10 aa, Borrelia garinii
IDITIDSDLR

SEQ ID NO: 71391 - protein, 10 aa, Borrelia garinii
GFISCDLFIR

SEQ ID NO: 71392 - protein, 10 aa, Borrelia garinii
YYEDDYEEIR

SEQ ID NO: 71393 - protein, 10 aa, Borrelia garinii
SVKTATNFVY

SEQ ID NO: 71394 - protein, 10 aa, Borrelia garinii
SLSGESGELK

SEQ ID NO: 71395 - protein, 10 aa, Borrelia garinii
DAANKSNFLQ

SEQ ID NO: 71396 - protein, 10 aa, Borrelia garinii
YDTYTLFSTK

SEQ ID NO: 71397 - protein, 10 aa, Borrelia garinii
FISCDLFIRY

SEQ ID NO: 71398 - protein, 10 aa, Borrelia garinii
SAINTINKIY

SEQ ID NO: 71399 - protein, 10 aa, Borrelia garinii
EESLKTELLK

SEQ ID NO: 71400 - protein, 10 aa, Borrelia garinii
TATNFVYINE

SEQ ID NO: 71401 - protein, 10 aa, Borrelia garinii
DEIEEEDYAR

SEQ ID NO: 71402 - protein, 10 aa, Borrelia garinii
CDLFIRYEMK

SEQ ID NO: 71403 - protein, 11 aa, Borrelia garinii
FVYINEMHAKR

SEQ ID NO: 71404 - protein, 11 aa, Borrelia garinii
STKLTQMYSTR

SEQ ID NO: 71405 - protein, 11 aa, Borrelia garinii
EYYEDDYEEIR

SEQ ID NO: 71406 - protein, 11 aa, Borrelia garinii
FTKEDLEKNFK

SEQ ID NO: 71407 - protein, 11 aa, Borrelia garinii
DAANKSNFLQK

SEQ ID NO: 71408 - protein, 11 aa, Borrelia garinii
NFVYINEMHAK

SEQ ID NO: 71409 - protein, 11 aa, Borrelia garinii
SSILLMRDSLK

SEQ ID NO: 71410 - protein, 11 aa, Borrelia garinii
EIDITIDSDLR

SEQ ID NO: 71411 - protein, 11 aa, Borrelia garinii
FGFISCDLFIR

SEQ ID NO: 71412 - protein, 11 aa, Borrelia garinii
KAIVSSILLMR

SEQ ID NO: 71413 - protein, 11 aa, Borrelia garinii
NVDSAINTINK

SEQ ID NO: 71414 - protein, 11 aa, Borrelia garinii
NSLSGESGELK

SEQ ID NO: 71415 - protein, 11 aa, Borrelia garinii
TLLNYIQVSVK

SEQ ID NO: 71416 - protein, 11 aa, Borrelia garinii
MYSTRLDNLAK

SEQ ID NO: 71417 - protein, 11 aa, Borrelia garinii
TLFSTKLTQMY

SEQ ID NO: 71418 - protein, 11 aa, Borrelia garinii
DITIDSDLRPK

SEQ ID NO: 71419 - protein, 11 aa, Borrelia garinii
STRLDNLAKAK

SEQ ID NO: 71420 - protein, 11 aa, Borrelia garinii
ELLKEQSETRK

SEQ ID NO: 71421 - protein, 11 aa, Borrelia garinii
SILETSEESIK

SEQ ID NO: 71422 - protein, 11 aa, Borrelia garinii
DSAINTINKIY

SEQ ID NO: 71423 - protein, 11 aa, Borrelia garinii
SLKEVQYAIDK

SEQ ID NO: 71424 - protein, 11 aa, Borrelia garinii
DDYEEIRLSNR

SEQ ID NO: 71425 - protein, 11 aa, Borrelia garinii
EKIQKQQDEYK

SEQ ID NO: 71426 - protein, 11 aa, Borrelia garinii
MNKKGKGKIAR

SEQ ID NO: 71427 - protein, 11 aa, Borrelia garinii
EAAKFTKEDLE

SEQ ID NO: 71428 - protein, 11 aa, Borrelia garinii
QSETRKEKIQK

SEQ ID NO: 71429 - protein, 11 aa, Borrelia garinii
SGKEPFIHSFK

SEQ ID NO: 71430 - protein, 11 aa, Borrelia garinii
DTYTLFSTKLT

SEQ ID NO: 71431 - protein, 9 aa, Borrelia garinii
KVKSKYLAL

SEQ ID NO: 71432 - protein, 9 aa, Borrelia garinii
RPKSSLQDI

SEQ ID NO: 71433 - protein, 9 aa, Borrelia garinii
KPMNKKGKG

SEQ ID NO: 71434 - protein, 10 aa, Borrelia garinii
IARKNGKSKV

SEQ ID NO: 71435 - protein, 10 aa, Borrelia garinii
RPKSSLQDIA

SEQ ID NO: 71436 - protein, 10 aa, Borrelia garinii
SAYKAIVSSI

SEQ ID NO: 71437 - protein, 11 aa, Borrelia garinii
KPMNKKGKGKI

SEQ ID NO: 71438 - protein, 11 aa, Borrelia garinii
SPGLFDKGNSI

SEQ ID NO: 71439 - protein, 11 aa, Borrelia garinii
SAYKAIVSSIL

SEQ ID NO: 71440 - protein, 11 aa, Borrelia garinii
RPKSSLQDIAG

SEQ ID NO: 71441 - protein, 11 aa, Borrelia garinii
KVKSKYLALGL

SEQ ID NO: 71442 - protein, 9 aa, Borrelia garinii
KVKSKYLAL

SEQ ID NO: 71443 - protein, 9 aa, Borrelia garinii
MKKVKSKYL

SEQ ID NO: 71444 - protein, 9 aa, Borrelia garinii
HAKRKLENI

SEQ ID NO: 71445 - protein, 11 aa, Borrelia garinii
MKKVKSKYLAL

SEQ ID NO: 71446 - protein, 9 aa, Borrelia garinii
RLSNRYQSY

SEQ ID NO: 71447 - protein, 9 aa, Borrelia garinii
KIKEKSNLY

SEQ ID NO: 71448 - protein, 9 aa, Borrelia garinii
KQQDEYKGM

SEQ ID NO: 71449 - protein, 9 aa, Borrelia garinii
KIYDTYTLF

SEQ ID NO: 71450 - protein, 9 aa, Borrelia garinii
QSYLEGVKY

SEQ ID NO: 71451 - protein, 9 aa, Borrelia garinii
FSTKLTQMY

SEQ ID NO: 71452 - protein, 9 aa, Borrelia garinii
KAKEEAAKF

SEQ ID NO: 71453 - protein, 9 aa, Borrelia garinii
IAGSNSISY

SEQ ID NO: 71454 - protein, 9 aa, Borrelia garinii
AINTINKIY

SEQ ID NO: 71455 - protein, 9 aa, Borrelia garinii
KVKSKYLAL

SEQ ID NO: 71456 - protein, 9 aa, Borrelia garinii
LMRDSLKEV

SEQ ID NO: 71457 - protein, 9 aa, Borrelia garinii
MTKGSLNSL

SEQ ID NO: 71458 - protein, 9 aa, Borrelia garinii
VSVKTATNF

SEQ ID NO: 71459 - protein, 9 aa, Borrelia garinii
GLFDKGNSI

SEQ ID NO: 71460 - protein, 9 aa, Borrelia garinii
EMKEESPGL

SEQ ID NO: 71461 - protein, 9 aa, Borrelia garinii
ISCDLFIRY

SEQ ID NO: 71462 - protein, 9 aa, Borrelia garinii
KNFKTLLNY

SEQ ID NO: 71463 - protein, 10 aa, Borrelia garinii
YQSYLEGVKY

SEQ ID NO: 71464 - protein, 10 aa, Borrelia garinii
YLALGLLFGF

SEQ ID NO: 71465 - protein, 10 aa, Borrelia garinii
SVKTATNFVY

SEQ ID NO: 71466 - protein, 10 aa, Borrelia garinii
KSKVSGKEPF

SEQ ID NO: 71467 - protein, 10 aa, Borrelia garinii
YAIDKNGIWY

SEQ ID NO: 71468 - protein, 10 aa, Borrelia garinii
EMKEESPGLF

SEQ ID NO: 71469 - protein, 10 aa, Borrelia garinii
SAINTINKIY

SEQ ID NO: 71470 - protein, 10 aa, Borrelia garinii
SGKEPFIHSF

SEQ ID NO: 71471 - protein, 10 aa, Borrelia garinii
QVSVKTATNF

SEQ ID NO: 71472 - protein, 10 aa, Borrelia garinii
FTKEDLEKNF

SEQ ID NO: 71473 - protein, 10 aa, Borrelia garinii
GMTKGSLNSL

SEQ ID NO: 71474 - protein, 10 aa, Borrelia garinii
GLFDKGNSIL

SEQ ID NO: 71475 - protein, 10 aa, Borrelia garinii
VQYAIDKNGI

SEQ ID NO: 71476 - protein, 10 aa, Borrelia garinii
RLSNRYQSYL

SEQ ID NO: 71477 - protein, 10 aa, Borrelia garinii
DIAGSNSISY

SEQ ID NO: 71478 - protein, 10 aa, Borrelia garinii
KEKSNLYSAY

SEQ ID NO: 71479 - protein, 10 aa, Borrelia garinii
LLFGFISCDL

SEQ ID NO: 71480 - protein, 11 aa, Borrelia garinii
LMRDSLKEVQY

SEQ ID NO: 71481 - protein, 11 aa, Borrelia garinii
IQVSVKTATNF

SEQ ID NO: 71482 - protein, 11 aa, Borrelia garinii
LLFGFISCDLF

SEQ ID NO: 71483 - protein, 11 aa, Borrelia garinii
TLFSTKLTQMY

SEQ ID NO: 71484 - protein, 11 aa, Borrelia garinii
KSKYLALGLLF

SEQ ID NO: 71485 - protein, 11 aa, Borrelia garinii
IQKQQDEYKGM

SEQ ID NO: 71486 - protein, 11 aa, Borrelia garinii
VSVKTATNFVY

SEQ ID NO: 71487 - protein, 11 aa, Borrelia garinii
VQYAIDKNGIW

SEQ ID NO: 71488 - protein, 11 aa, Borrelia garinii
EIRLSNRYQSY

SEQ ID NO: 71489 - protein, 11 aa, Borrelia garinii
QDIAGSNSISY

SEQ ID NO: 71490 - protein, 11 aa, Borrelia garinii
IAKIKEKSNLY

SEQ ID NO: 71491 - protein, 11 aa, Borrelia garinii
KAKAKEEAAKF

SEQ ID NO: 71492 - protein, 11 aa, Borrelia garinii
TQMYSTRLDNL

SEQ ID NO: 71493 - protein, 11 aa, Borrelia garinii
YLDEDDEDDEY

SEQ ID NO: 71494 - protein, 11 aa, Borrelia garinii
VSGKEPFIHSF

SEQ ID NO: 71495 - protein, 9 aa, Borrelia garinii
RKLENIEAK

SEQ ID NO: 71496 - protein, 10 aa, Borrelia garinii
IRLSNRYQSY

SEQ ID NO: 71497 - protein, 10 aa, Borrelia garinii
KRKLENIEAK

SEQ ID NO: 71498 - protein, 10 aa, Borrelia garinii
KRDAANKSNF

SEQ ID NO: 71499 - protein, 10 aa, Borrelia garinii
TRLDNLAKAK

SEQ ID NO: 71500 - protein, 10 aa, Borrelia garinii
NRYQSYLEGV

SEQ ID NO: 71501 - protein, 11 aa, Borrelia garinii
NRYQSYLEGVK

SEQ ID NO: 71502 - protein, 11 aa, Borrelia garinii
RKNGKSKVSGK

SEQ ID NO: 71503 - protein, 11 aa, Borrelia garinii
IRLSNRYQSYL

SEQ ID NO: 71504 - protein, 11 aa, Borrelia garinii
KRKLENIEAKI

SEQ ID NO: 71505 - protein, 11 aa, Borrelia garinii
KQQDEYKGMTK

SEQ ID NO: 71506 - protein, 9 aa, Borrelia garinii
IAGSNSISY

SEQ ID NO: 71507 - protein, 9 aa, Borrelia garinii
LALGLLFGF

SEQ ID NO: 71508 - protein, 9 aa, Borrelia garinii
EKSNLYSAY

SEQ ID NO: 71509 - protein, 9 aa, Borrelia garinii
FSTKLTQMY

SEQ ID NO: 71510 - protein, 9 aa, Borrelia garinii
TINKIYDTY

SEQ ID NO: 71511 - protein, 9 aa, Borrelia garinii
DEDDEDDEY

SEQ ID NO: 71512 - protein, 9 aa, Borrelia garinii
ISCDLFIRY

SEQ ID NO: 71513 - protein, 9 aa, Borrelia garinii
EDDEDDEYY

SEQ ID NO: 71514 - protein, 9 aa, Borrelia garinii
YAIDKNGIW

SEQ ID NO: 71515 - protein, 9 aa, Borrelia garinii
DAANKSNFL

SEQ ID NO: 71516 - protein, 9 aa, Borrelia garinii
TNFVYINEM

SEQ ID NO: 71517 - protein, 10 aa, Borrelia garinii
YAIDKNGIWY

SEQ ID NO: 71518 - protein, 10 aa, Borrelia garinii
SAINTINKIY

SEQ ID NO: 71519 - protein, 10 aa, Borrelia garinii
FISCDLFIRY

SEQ ID NO: 71520 - protein, 10 aa, Borrelia garinii
EIEEEDYARY

SEQ ID NO: 71521 - protein, 10 aa, Borrelia garinii
SVKTATNFVY

SEQ ID NO: 71522 - protein, 10 aa, Borrelia garinii
DIAGSNSISY

SEQ ID NO: 71523 - protein, 10 aa, Borrelia garinii
LFSTKLTQMY

SEQ ID NO: 71524 - protein, 10 aa, Borrelia garinii
YQSYLEGVKY

SEQ ID NO: 71525 - protein, 10 aa, Borrelia garinii
YLALGLLFGF

SEQ ID NO: 71526 - protein, 10 aa, Borrelia garinii
YTDEIEEEDY

SEQ ID NO: 71527 - protein, 10 aa, Borrelia garinii
LDEDDEDDEY

SEQ ID NO: 71528 - protein, 10 aa, Borrelia garinii
NTINKIYDTY

SEQ ID NO: 71529 - protein, 10 aa, Borrelia garinii
KAIVSSILLM

SEQ ID NO: 71530 - protein, 10 aa, Borrelia garinii
DEDDEDDEYY

SEQ ID NO: 71531 - protein, 10 aa, Borrelia garinii
QVSVKTATNF

SEQ ID NO: 71532 - protein, 11 aa, Borrelia garinii
TATNFVYINEM

SEQ ID NO: 71533 - protein, 11 aa, Borrelia garinii
YLDEDDEDDEY

SEQ ID NO: 71534 - protein, 11 aa, Borrelia garinii
EIEEEDYARYY

SEQ ID NO: 71535 - protein, 11 aa, Borrelia garinii
ETSEESIKKPM

SEQ ID NO: 71536 - protein, 11 aa, Borrelia garinii
TLFSTKLTQMY

SEQ ID NO: 71537 - protein, 11 aa, Borrelia garinii
DSAINTINKIY

SEQ ID NO: 71538 - protein, 11 aa, Borrelia garinii
VSVKTATNFVY

SEQ ID NO: 71539 - protein, 11 aa, Borrelia garinii
YTLFSTKLTQM

SEQ ID NO: 71540 - protein, 11 aa, Borrelia garinii
ISCDLFIRYEM

SEQ ID NO: 71541 - protein, 11 aa, Borrelia garinii
LDEDDEDDEYY

SEQ ID NO: 71542 - protein, 11 aa, Borrelia garinii
IAKIKEKSNLY

SEQ ID NO: 71543 - protein, 11 aa, Borrelia garinii
QDIAGSNSISY

SEQ ID NO: 71544 - protein, 11 aa, Borrelia garinii
NKSNFLQKNVM

SEQ ID NO: 71545 - protein, 11 aa, Borrelia garinii
YKAIVSSILLM

SEQ ID NO: 71546 - protein, 9 aa, Borrelia garinii
EEEDYARYY

SEQ ID NO: 71547 - protein, 9 aa, Borrelia garinii
EEIRLSNRY

SEQ ID NO: 71548 - protein, 9 aa, Borrelia garinii
NEIDITIDS

SEQ ID NO: 71549 - protein, 9 aa, Borrelia garinii
GELKETIES

SEQ ID NO: 71550 - protein, 9 aa, Borrelia garinii
EEDYARYYL

SEQ ID NO: 71551 - protein, 9 aa, Borrelia garinii
DEDDEDDEY

SEQ ID NO: 71552 - protein, 9 aa, Borrelia garinii
EESLKTELL

SEQ ID NO: 71553 - protein, 9 aa, Borrelia garinii
KEVQYAIDK

SEQ ID NO: 71554 - protein, 9 aa, Borrelia garinii
DEIEEEDYA

SEQ ID NO: 71555 - protein, 9 aa, Borrelia garinii
SEESIKKPM

SEQ ID NO: 71556 - protein, 10 aa, Borrelia garinii
EEIRLSNRYQ

SEQ ID NO: 71557 - protein, 10 aa, Borrelia garinii
EEEDYARYYL

SEQ ID NO: 71558 - protein, 10 aa, Borrelia garinii
DEDDEDDEYY

SEQ ID NO: 71559 - protein, 10 aa, Borrelia garinii
YEMKEESPGL

SEQ ID NO: 71560 - protein, 10 aa, Borrelia garinii
NEIDITIDSD

SEQ ID NO: 71561 - protein, 10 aa, Borrelia garinii
EEESLKTELL

SEQ ID NO: 71562 - protein, 11 aa, Borrelia garinii
EEIRLSNRYQS

SEQ ID NO: 71563 - protein, 11 aa, Borrelia garinii
NEIDITIDSDL

SEQ ID NO: 71564 - protein, 11 aa, Borrelia garinii
YEMKEESPGLF

SEQ ID NO: 71565 - protein, 11 aa, Borrelia garinii
DEIEEEDYARY

SEQ ID NO: 71566 - protein, 11 aa, Borrelia garinii
EEEDYARYYLD

SEQ ID NO: 71567 - protein, 11 aa, Borrelia garinii
KEKIQKQQDEY

SEQ ID NO: 71568 - protein, 11 aa, Borrelia garinii
KEVQYAIDKNG

SEQ ID NO: 71569 - protein, 11 aa, Borrelia garinii
DEDDEYYEDDY

SEQ ID NO: 71570 - protein, 10 aa, Borrelia garinii
LALGLLFGFI

SEQ ID NO: 71571 - protein, 11 aa, Borrelia garinii
SPGLFDKGNSI

SEQ ID NO: 71572 - protein, 9 aa, Borrelia garinii
VSVKTATNF

SEQ ID NO: 71573 - protein, 9 aa, Borrelia garinii
ISCDLFIRY

SEQ ID NO: 71574 - protein, 11 aa, Borrelia garinii
VSGKEPFIHSF

SEQ ID NO: 71575 - protein, 11 aa, Borrelia garinii
VSVKTATNFVY

SEQ ID NO: 71576 - protein, 13 aa, Borrelia burgdorferi B31
MNKILLLILLESI

SEQ ID NO: 71577 - protein, 13 aa, Borrelia burgdorferi B31
NKILLLILLESIV

SEQ ID NO: 71578 - protein, 13 aa, Borrelia burgdorferi B31
KILLLILLESIVF

SEQ ID NO: 71579 - protein, 13 aa, Borrelia burgdorferi B31
ILLLILLESIVFL

SEQ ID NO: 71580 - protein, 13 aa, Borrelia burgdorferi B31
LLLILLESIVFLS

SEQ ID NO: 71581 - protein, 13 aa, Borrelia burgdorferi B31
LLILLESIVFLSC

SEQ ID NO: 71582 - protein, 13 aa, Borrelia burgdorferi B31
LILLESIVFLSCS

SEQ ID NO: 71583 - protein, 13 aa, Borrelia burgdorferi B31
ILLESIVFLSCSG

SEQ ID NO: 71584 - protein, 13 aa, Borrelia burgdorferi B31
LLESIVFLSCSGK

SEQ ID NO: 71585 - protein, 13 aa, Borrelia burgdorferi B31
LESIVFLSCSGKG

SEQ ID NO: 71586 - protein, 13 aa, Borrelia burgdorferi B31
ESIVFLSCSGKGS

SEQ ID NO: 71587 - protein, 13 aa, Borrelia burgdorferi B31
SIVFLSCSGKGSL

SEQ ID NO: 71588 - protein, 13 aa, Borrelia burgdorferi B31
IVFLSCSGKGSLG

SEQ ID NO: 71589 - protein, 13 aa, Borrelia burgdorferi B31
VFLSCSGKGSLGS

SEQ ID NO: 71590 - protein, 13 aa, Borrelia burgdorferi B31
FLSCSGKGSLGSE

SEQ ID NO: 71591 - protein, 13 aa, Borrelia burgdorferi B31
LSCSGKGSLGSEI

SEQ ID NO: 71592 - protein, 13 aa, Borrelia burgdorferi B31
SCSGKGSLGSEIP

SEQ ID NO: 71593 - protein, 13 aa, Borrelia burgdorferi B31
CSGKGSLGSEIPK

SEQ ID NO: 71594 - protein, 13 aa, Borrelia burgdorferi B31
SGKGSLGSEIPKV

SEQ ID NO: 71595 - protein, 13 aa, Borrelia burgdorferi B31
GKGSLGSEIPKVS

SEQ ID NO: 71596 - protein, 13 aa, Borrelia burgdorferi B31
KGSLGSEIPKVSL

SEQ ID NO: 71597 - protein, 13 aa, Borrelia burgdorferi B31
GSLGSEIPKVSLI

SEQ ID NO: 71598 - protein, 13 aa, Borrelia burgdorferi B31
SLGSEIPKVSLII

SEQ ID NO: 71599 - protein, 13 aa, Borrelia burgdorferi B31
LGSEIPKVSLIID

SEQ ID NO: 71600 - protein, 13 aa, Borrelia burgdorferi B31
GSEIPKVSLIIDG

SEQ ID NO: 71601 - protein, 13 aa, Borrelia burgdorferi B31
SEIPKVSLIIDGT

SEQ ID NO: 71602 - protein, 13 aa, Borrelia burgdorferi B31
EIPKVSLIIDGTF

SEQ ID NO: 71603 - protein, 13 aa, Borrelia burgdorferi B31
IPKVSLIIDGTFD

SEQ ID NO: 71604 - protein, 13 aa, Borrelia burgdorferi B31
PKVSLIIDGTFDD

SEQ ID NO: 71605 - protein, 13 aa, Borrelia burgdorferi B31
KVSLIIDGTFDDK

SEQ ID NO: 71606 - protein, 13 aa, Borrelia burgdorferi B31
VSLIIDGTFDDKS

SEQ ID NO: 71607 - protein, 13 aa, Borrelia burgdorferi B31
SLIIDGTFDDKSF

SEQ ID NO: 71608 - protein, 13 aa, Borrelia burgdorferi B31
LIIDGTFDDKSFN

SEQ ID NO: 71609 - protein, 13 aa, Borrelia burgdorferi B31
IIDGTFDDKSFNE

SEQ ID NO: 71610 - protein, 13 aa, Borrelia burgdorferi B31
IDGTFDDKSFNES

SEQ ID NO: 71611 - protein, 13 aa, Borrelia burgdorferi B31
DGTFDDKSFNESA

SEQ ID NO: 71612 - protein, 13 aa, Borrelia burgdorferi B31
GTFDDKSFNESAL

SEQ ID NO: 71613 - protein, 13 aa, Borrelia burgdorferi B31
TFDDKSFNESALN

SEQ ID NO: 71614 - protein, 13 aa, Borrelia burgdorferi B31
FDDKSFNESALNG

SEQ ID NO: 71615 - protein, 13 aa, Borrelia burgdorferi B31
DDKSFNESALNGV

SEQ ID NO: 71616 - protein, 13 aa, Borrelia burgdorferi B31
DKSFNESALNGVK

SEQ ID NO: 71617 - protein, 13 aa, Borrelia burgdorferi B31
KSFNESALNGVKK

SEQ ID NO: 71618 - protein, 13 aa, Borrelia burgdorferi B31
SFNESALNGVKKV

SEQ ID NO: 71619 - protein, 13 aa, Borrelia burgdorferi B31
FNESALNGVKKVK

SEQ ID NO: 71620 - protein, 13 aa, Borrelia burgdorferi B31
NESALNGVKKVKE

SEQ ID NO: 71621 - protein, 13 aa, Borrelia burgdorferi B31
ESALNGVKKVKEE

SEQ ID NO: 71622 - protein, 13 aa, Borrelia burgdorferi B31
SALNGVKKVKEEF

SEQ ID NO: 71623 - protein, 13 aa, Borrelia burgdorferi B31
ALNGVKKVKEEFK

SEQ ID NO: 71624 - protein, 13 aa, Borrelia burgdorferi B31
LNGVKKVKEEFKI

SEQ ID NO: 71625 - protein, 13 aa, Borrelia burgdorferi B31
NGVKKVKEEFKIE

SEQ ID NO: 71626 - protein, 13 aa, Borrelia burgdorferi B31
GVKKVKEEFKIEL

SEQ ID NO: 71627 - protein, 13 aa, Borrelia burgdorferi B31
VKKVKEEFKIELV

SEQ ID NO: 71628 - protein, 13 aa, Borrelia burgdorferi B31
KKVKEEFKIELVL

SEQ ID NO: 71629 - protein, 13 aa, Borrelia burgdorferi B31
KVKEEFKIELVLK

SEQ ID NO: 71630 - protein, 13 aa, Borrelia burgdorferi B31
VKEEFKIELVLKE

SEQ ID NO: 71631 - protein, 13 aa, Borrelia burgdorferi B31
KEEFKIELVLKES

SEQ ID NO: 71632 - protein, 13 aa, Borrelia burgdorferi B31
EEFKIELVLKESS

SEQ ID NO: 71633 - protein, 13 aa, Borrelia burgdorferi B31
EFKIELVLKESSS

SEQ ID NO: 71634 - protein, 13 aa, Borrelia burgdorferi B31
FKIELVLKESSSN

SEQ ID NO: 71635 - protein, 13 aa, Borrelia burgdorferi B31
KIELVLKESSSNS

SEQ ID NO: 71636 - protein, 13 aa, Borrelia burgdorferi B31
IELVLKESSSNSY

SEQ ID NO: 71637 - protein, 13 aa, Borrelia burgdorferi B31
ELVLKESSSNSYL

SEQ ID NO: 71638 - protein, 13 aa, Borrelia burgdorferi B31
LVLKESSSNSYLS

SEQ ID NO: 71639 - protein, 13 aa, Borrelia burgdorferi B31
VLKESSSNSYLSD

SEQ ID NO: 71640 - protein, 13 aa, Borrelia burgdorferi B31
LKESSSNSYLSDL

SEQ ID NO: 71641 - protein, 13 aa, Borrelia burgdorferi B31
KESSSNSYLSDLE

SEQ ID NO: 71642 - protein, 13 aa, Borrelia burgdorferi B31
ESSSNSYLSDLEG

SEQ ID NO: 71643 - protein, 13 aa, Borrelia burgdorferi B31
SSSNSYLSDLEGL

SEQ ID NO: 71644 - protein, 13 aa, Borrelia burgdorferi B31
SSNSYLSDLEGLK

SEQ ID NO: 71645 - protein, 13 aa, Borrelia burgdorferi B31
SNSYLSDLEGLKD

SEQ ID NO: 71646 - protein, 13 aa, Borrelia burgdorferi B31
NSYLSDLEGLKDA

SEQ ID NO: 71647 - protein, 13 aa, Borrelia burgdorferi B31
SYLSDLEGLKDAG

SEQ ID NO: 71648 - protein, 13 aa, Borrelia burgdorferi B31
YLSDLEGLKDAGS

SEQ ID NO: 71649 - protein, 13 aa, Borrelia burgdorferi B31
LSDLEGLKDAGSD

SEQ ID NO: 71650 - protein, 13 aa, Borrelia burgdorferi B31
SDLEGLKDAGSDL

SEQ ID NO: 71651 - protein, 13 aa, Borrelia burgdorferi B31
DLEGLKDAGSDLI

SEQ ID NO: 71652 - protein, 13 aa, Borrelia burgdorferi B31
LEGLKDAGSDLIW

SEQ ID NO: 71653 - protein, 13 aa, Borrelia burgdorferi B31
EGLKDAGSDLIWL

SEQ ID NO: 71654 - protein, 13 aa, Borrelia burgdorferi B31
GLKDAGSDLIWLI

SEQ ID NO: 71655 - protein, 13 aa, Borrelia burgdorferi B31
LKDAGSDLIWLIG

SEQ ID NO: 71656 - protein, 13 aa, Borrelia burgdorferi B31
KDAGSDLIWLIGY

SEQ ID NO: 71657 - protein, 13 aa, Borrelia burgdorferi B31
DAGSDLIWLIGYR

SEQ ID NO: 71658 - protein, 13 aa, Borrelia burgdorferi B31
AGSDLIWLIGYRF

SEQ ID NO: 71659 - protein, 13 aa, Borrelia burgdorferi B31
GSDLIWLIGYRFS

SEQ ID NO: 71660 - protein, 13 aa, Borrelia burgdorferi B31
SDLIWLIGYRFSD

SEQ ID NO: 71661 - protein, 13 aa, Borrelia burgdorferi B31
DLIWLIGYRFSDV

SEQ ID NO: 71662 - protein, 13 aa, Borrelia burgdorferi B31
LIWLIGYRFSDVA

SEQ ID NO: 71663 - protein, 13 aa, Borrelia burgdorferi B31
IWLIGYRFSDVAK

SEQ ID NO: 71664 - protein, 13 aa, Borrelia burgdorferi B31
WLIGYRFSDVAKV

SEQ ID NO: 71665 - protein, 13 aa, Borrelia burgdorferi B31
LIGYRFSDVAKVA

SEQ ID NO: 71666 - protein, 13 aa, Borrelia burgdorferi B31
IGYRFSDVAKVAA

SEQ ID NO: 71667 - protein, 13 aa, Borrelia burgdorferi B31
GYRFSDVAKVAAL

SEQ ID NO: 71668 - protein, 13 aa, Borrelia burgdorferi B31
YRFSDVAKVAALQ

SEQ ID NO: 71669 - protein, 13 aa, Borrelia burgdorferi B31
RFSDVAKVAALQN

SEQ ID NO: 71670 - protein, 13 aa, Borrelia burgdorferi B31
FSDVAKVAALQNP

SEQ ID NO: 71671 - protein, 13 aa, Borrelia burgdorferi B31
SDVAKVAALQNPD

SEQ ID NO: 71672 - protein, 13 aa, Borrelia burgdorferi B31
DVAKVAALQNPDM

SEQ ID NO: 71673 - protein, 13 aa, Borrelia burgdorferi B31
VAKVAALQNPDMK

SEQ ID NO: 71674 - protein, 13 aa, Borrelia burgdorferi B31
AKVAALQNPDMKY

SEQ ID NO: 71675 - protein, 13 aa, Borrelia burgdorferi B31
KVAALQNPDMKYA

SEQ ID NO: 71676 - protein, 13 aa, Borrelia burgdorferi B31
VAALQNPDMKYAI

SEQ ID NO: 71677 - protein, 13 aa, Borrelia burgdorferi B31
AALQNPDMKYAII

SEQ ID NO: 71678 - protein, 13 aa, Borrelia burgdorferi B31
ALQNPDMKYAIID

SEQ ID NO: 71679 - protein, 13 aa, Borrelia burgdorferi B31
LQNPDMKYAIIDP

SEQ ID NO: 71680 - protein, 13 aa, Borrelia burgdorferi B31
QNPDMKYAIIDPI

SEQ ID NO: 71681 - protein, 13 aa, Borrelia burgdorferi B31
NPDMKYAIIDPIY

SEQ ID NO: 71682 - protein, 13 aa, Borrelia burgdorferi B31
PDMKYAIIDPIYS

SEQ ID NO: 71683 - protein, 13 aa, Borrelia burgdorferi B31
DMKYAIIDPIYSN

SEQ ID NO: 71684 - protein, 13 aa, Borrelia burgdorferi B31
MKYAIIDPIYSND

SEQ ID NO: 71685 - protein, 13 aa, Borrelia burgdorferi B31
KYAIIDPIYSNDP

SEQ ID NO: 71686 - protein, 13 aa, Borrelia burgdorferi B31
YAIIDPIYSNDPI

SEQ ID NO: 71687 - protein, 13 aa, Borrelia burgdorferi B31
AIIDPIYSNDPIP

SEQ ID NO: 71688 - protein, 13 aa, Borrelia burgdorferi B31
IIDPIYSNDPIPA

SEQ ID NO: 71689 - protein, 13 aa, Borrelia burgdorferi B31
IDPIYSNDPIPAN

SEQ ID NO: 71690 - protein, 13 aa, Borrelia burgdorferi B31
DPIYSNDPIPANL

SEQ ID NO: 71691 - protein, 13 aa, Borrelia burgdorferi B31
PIYSNDPIPANLV

SEQ ID NO: 71692 - protein, 13 aa, Borrelia burgdorferi B31
IYSNDPIPANLVG

SEQ ID NO: 71693 - protein, 13 aa, Borrelia burgdorferi B31
YSNDPIPANLVGM

SEQ ID NO: 71694 - protein, 13 aa, Borrelia burgdorferi B31
SNDPIPANLVGMT

SEQ ID NO: 71695 - protein, 13 aa, Borrelia burgdorferi B31
NDPIPANLVGMTF

SEQ ID NO: 71696 - protein, 13 aa, Borrelia burgdorferi B31
DPIPANLVGMTFR

SEQ ID NO: 71697 - protein, 13 aa, Borrelia burgdorferi B31
PIPANLVGMTFRA

SEQ ID NO: 71698 - protein, 13 aa, Borrelia burgdorferi B31
IPANLVGMTFRAQ

SEQ ID NO: 71699 - protein, 13 aa, Borrelia burgdorferi B31
PANLVGMTFRAQE

SEQ ID NO: 71700 - protein, 13 aa, Borrelia burgdorferi B31
ANLVGMTFRAQEG

SEQ ID NO: 71701 - protein, 13 aa, Borrelia burgdorferi B31
NLVGMTFRAQEGA

SEQ ID NO: 71702 - protein, 13 aa, Borrelia burgdorferi B31
LVGMTFRAQEGAF

SEQ ID NO: 71703 - protein, 13 aa, Borrelia burgdorferi B31
VGMTFRAQEGAFL

SEQ ID NO: 71704 - protein, 13 aa, Borrelia burgdorferi B31
GMTFRAQEGAFLT

SEQ ID NO: 71705 - protein, 13 aa, Borrelia burgdorferi B31
MTFRAQEGAFLTG

SEQ ID NO: 71706 - protein, 13 aa, Borrelia burgdorferi B31
TFRAQEGAFLTGY

SEQ ID NO: 71707 - protein, 13 aa, Borrelia burgdorferi B31
FRAQEGAFLTGYI

SEQ ID NO: 71708 - protein, 13 aa, Borrelia burgdorferi B31
RAQEGAFLTGYIA

SEQ ID NO: 71709 - protein, 13 aa, Borrelia burgdorferi B31
AQEGAFLTGYIAA

SEQ ID NO: 71710 - protein, 13 aa, Borrelia burgdorferi B31
QEGAFLTGYIAAK

SEQ ID NO: 71711 - protein, 13 aa, Borrelia burgdorferi B31
EGAFLTGYIAAKL

SEQ ID NO: 71712 - protein, 13 aa, Borrelia burgdorferi B31
GAFLTGYIAAKLS

SEQ ID NO: 71713 - protein, 13 aa, Borrelia burgdorferi B31
AFLTGYIAAKLSK

SEQ ID NO: 71714 - protein, 13 aa, Borrelia burgdorferi B31
FLTGYIAAKLSKT

SEQ ID NO: 71715 - protein, 13 aa, Borrelia burgdorferi B31
LTGYIAAKLSKTG

SEQ ID NO: 71716 - protein, 13 aa, Borrelia burgdorferi B31
TGYIAAKLSKTGK

SEQ ID NO: 71717 - protein, 13 aa, Borrelia burgdorferi B31
GYIAAKLSKTGKI

SEQ ID NO: 71718 - protein, 13 aa, Borrelia burgdorferi B31
YIAAKLSKTGKIG

SEQ ID NO: 71719 - protein, 13 aa, Borrelia burgdorferi B31
IAAKLSKTGKIGF

SEQ ID NO: 71720 - protein, 13 aa, Borrelia burgdorferi B31
AAKLSKTGKIGFL

SEQ ID NO: 71721 - protein, 13 aa, Borrelia burgdorferi B31
AKLSKTGKIGFLG

SEQ ID NO: 71722 - protein, 13 aa, Borrelia burgdorferi B31
KLSKTGKIGFLGG

SEQ ID NO: 71723 - protein, 13 aa, Borrelia burgdorferi B31
LSKTGKIGFLGGI

SEQ ID NO: 71724 - protein, 13 aa, Borrelia burgdorferi B31
SKTGKIGFLGGIE

SEQ ID NO: 71725 - protein, 13 aa, Borrelia burgdorferi B31
KTGKIGFLGGIEG

SEQ ID NO: 71726 - protein, 13 aa, Borrelia burgdorferi B31
TGKIGFLGGIEGE

SEQ ID NO: 71727 - protein, 13 aa, Borrelia burgdorferi B31
GKIGFLGGIEGEI

SEQ ID NO: 71728 - protein, 13 aa, Borrelia burgdorferi B31
KIGFLGGIEGEIV

SEQ ID NO: 71729 - protein, 13 aa, Borrelia burgdorferi B31
IGFLGGIEGEIVD

SEQ ID NO: 71730 - protein, 13 aa, Borrelia burgdorferi B31
GFLGGIEGEIVDA

SEQ ID NO: 71731 - protein, 13 aa, Borrelia burgdorferi B31
FLGGIEGEIVDAF

SEQ ID NO: 71732 - protein, 13 aa, Borrelia burgdorferi B31
LGGIEGEIVDAFR

SEQ ID NO: 71733 - protein, 13 aa, Borrelia burgdorferi B31
GGIEGEIVDAFRY

SEQ ID NO: 71734 - protein, 13 aa, Borrelia burgdorferi B31
GIEGEIVDAFRYG

SEQ ID NO: 71735 - protein, 13 aa, Borrelia burgdorferi B31
IEGEIVDAFRYGY

SEQ ID NO: 71736 - protein, 13 aa, Borrelia burgdorferi B31
EGEIVDAFRYGYE

SEQ ID NO: 71737 - protein, 13 aa, Borrelia burgdorferi B31
GEIVDAFRYGYEA

SEQ ID NO: 71738 - protein, 13 aa, Borrelia burgdorferi B31
EIVDAFRYGYEAG

SEQ ID NO: 71739 - protein, 13 aa, Borrelia burgdorferi B31
IVDAFRYGYEAGA

SEQ ID NO: 71740 - protein, 13 aa, Borrelia burgdorferi B31
VDAFRYGYEAGAK

SEQ ID NO: 71741 - protein, 13 aa, Borrelia burgdorferi B31
DAFRYGYEAGAKY

SEQ ID NO: 71742 - protein, 13 aa, Borrelia burgdorferi B31
AFRYGYEAGAKYA

SEQ ID NO: 71743 - protein, 13 aa, Borrelia burgdorferi B31
FRYGYEAGAKYAN

SEQ ID NO: 71744 - protein, 13 aa, Borrelia burgdorferi B31
RYGYEAGAKYANK

SEQ ID NO: 71745 - protein, 13 aa, Borrelia burgdorferi B31
YGYEAGAKYANKD

SEQ ID NO: 71746 - protein, 13 aa, Borrelia burgdorferi B31
GYEAGAKYANKDI

SEQ ID NO: 71747 - protein, 13 aa, Borrelia burgdorferi B31
YEAGAKYANKDIK

SEQ ID NO: 71748 - protein, 13 aa, Borrelia burgdorferi B31
EAGAKYANKDIKI

SEQ ID NO: 71749 - protein, 13 aa, Borrelia burgdorferi B31
AGAKYANKDIKIS

SEQ ID NO: 71750 - protein, 13 aa, Borrelia burgdorferi B31
GAKYANKDIKIST

SEQ ID NO: 71751 - protein, 13 aa, Borrelia burgdorferi B31
AKYANKDIKISTQ

SEQ ID NO: 71752 - protein, 13 aa, Borrelia burgdorferi B31
KYANKDIKISTQY

SEQ ID NO: 71753 - protein, 13 aa, Borrelia burgdorferi B31
YANKDIKISTQYI

SEQ ID NO: 71754 - protein, 13 aa, Borrelia burgdorferi B31
ANKDIKISTQYIG

SEQ ID NO: 71755 - protein, 13 aa, Borrelia burgdorferi B31
NKDIKISTQYIGS

SEQ ID NO: 71756 - protein, 13 aa, Borrelia burgdorferi B31
KDIKISTQYIGSF

SEQ ID NO: 71757 - protein, 13 aa, Borrelia burgdorferi B31
DIKISTQYIGSFA

SEQ ID NO: 71758 - protein, 13 aa, Borrelia burgdorferi B31
IKISTQYIGSFAD

SEQ ID NO: 71759 - protein, 13 aa, Borrelia burgdorferi B31
KISTQYIGSFADL

SEQ ID NO: 71760 - protein, 13 aa, Borrelia burgdorferi B31
ISTQYIGSFADLE

SEQ ID NO: 71761 - protein, 13 aa, Borrelia burgdorferi B31
STQYIGSFADLEA

SEQ ID NO: 71762 - protein, 13 aa, Borrelia burgdorferi B31
TQYIGSFADLEAG

SEQ ID NO: 71763 - protein, 13 aa, Borrelia burgdorferi B31
QYIGSFADLEAGR

SEQ ID NO: 71764 - protein, 13 aa, Borrelia burgdorferi B31
YIGSFADLEAGRS

SEQ ID NO: 71765 - protein, 13 aa, Borrelia burgdorferi B31
IGSFADLEAGRSV

SEQ ID NO: 71766 - protein, 13 aa, Borrelia burgdorferi B31
GSFADLEAGRSVA

SEQ ID NO: 71767 - protein, 13 aa, Borrelia burgdorferi B31
SFADLEAGRSVAT

SEQ ID NO: 71768 - protein, 13 aa, Borrelia burgdorferi B31
FADLEAGRSVATR

SEQ ID NO: 71769 - protein, 13 aa, Borrelia burgdorferi B31
ADLEAGRSVATRM

SEQ ID NO: 71770 - protein, 13 aa, Borrelia burgdorferi B31
DLEAGRSVATRMY

SEQ ID NO: 71771 - protein, 13 aa, Borrelia burgdorferi B31
LEAGRSVATRMYS

SEQ ID NO: 71772 - protein, 13 aa, Borrelia burgdorferi B31
EAGRSVATRMYSD

SEQ ID NO: 71773 - protein, 13 aa, Borrelia burgdorferi B31
AGRSVATRMYSDE

SEQ ID NO: 71774 - protein, 13 aa, Borrelia burgdorferi B31
GRSVATRMYSDEI

SEQ ID NO: 71775 - protein, 13 aa, Borrelia burgdorferi B31
RSVATRMYSDEID

SEQ ID NO: 71776 - protein, 13 aa, Borrelia burgdorferi B31
SVATRMYSDEIDI

SEQ ID NO: 71777 - protein, 13 aa, Borrelia burgdorferi B31
VATRMYSDEIDII

SEQ ID NO: 71778 - protein, 13 aa, Borrelia burgdorferi B31
ATRMYSDEIDIIH

SEQ ID NO: 71779 - protein, 13 aa, Borrelia burgdorferi B31
TRMYSDEIDIIHH

SEQ ID NO: 71780 - protein, 13 aa, Borrelia burgdorferi B31
RMYSDEIDIIHHA

SEQ ID NO: 71781 - protein, 13 aa, Borrelia burgdorferi B31
MYSDEIDIIHHAA

SEQ ID NO: 71782 - protein, 13 aa, Borrelia burgdorferi B31
YSDEIDIIHHAAG

SEQ ID NO: 71783 - protein, 13 aa, Borrelia burgdorferi B31
SDEIDIIHHAAGL

SEQ ID NO: 71784 - protein, 13 aa, Borrelia burgdorferi B31
DEIDIIHHAAGLG

SEQ ID NO: 71785 - protein, 13 aa, Borrelia burgdorferi B31
EIDIIHHAAGLGG

SEQ ID NO: 71786 - protein, 13 aa, Borrelia burgdorferi B31
IDIIHHAAGLGGI

SEQ ID NO: 71787 - protein, 13 aa, Borrelia burgdorferi B31
DIIHHAAGLGGIG

SEQ ID NO: 71788 - protein, 13 aa, Borrelia burgdorferi B31
IIHHAAGLGGIGA

SEQ ID NO: 71789 - protein, 13 aa, Borrelia burgdorferi B31
IHHAAGLGGIGAI

SEQ ID NO: 71790 - protein, 13 aa, Borrelia burgdorferi B31
HHAAGLGGIGAIE

SEQ ID NO: 71791 - protein, 13 aa, Borrelia burgdorferi B31
HAAGLGGIGAIEV

SEQ ID NO: 71792 - protein, 13 aa, Borrelia burgdorferi B31
AAGLGGIGAIEVA

SEQ ID NO: 71793 - protein, 13 aa, Borrelia burgdorferi B31
AGLGGIGAIEVAK

SEQ ID NO: 71794 - protein, 13 aa, Borrelia burgdorferi B31
GLGGIGAIEVAKE

SEQ ID NO: 71795 - protein, 13 aa, Borrelia burgdorferi B31
LGGIGAIEVAKEL

SEQ ID NO: 71796 - protein, 13 aa, Borrelia burgdorferi B31
GGIGAIEVAKELG

SEQ ID NO: 71797 - protein, 13 aa, Borrelia burgdorferi B31
GIGAIEVAKELGS

SEQ ID NO: 71798 - protein, 13 aa, Borrelia burgdorferi B31
IGAIEVAKELGSG

SEQ ID NO: 71799 - protein, 13 aa, Borrelia burgdorferi B31
GAIEVAKELGSGH

SEQ ID NO: 71800 - protein, 13 aa, Borrelia burgdorferi B31
AIEVAKELGSGHY

SEQ ID NO: 71801 - protein, 13 aa, Borrelia burgdorferi B31
IEVAKELGSGHYI

SEQ ID NO: 71802 - protein, 13 aa, Borrelia burgdorferi B31
EVAKELGSGHYII

SEQ ID NO: 71803 - protein, 13 aa, Borrelia burgdorferi B31
VAKELGSGHYIIG

SEQ ID NO: 71804 - protein, 13 aa, Borrelia burgdorferi B31
AKELGSGHYIIGV

SEQ ID NO: 71805 - protein, 13 aa, Borrelia burgdorferi B31
KELGSGHYIIGVD

SEQ ID NO: 71806 - protein, 13 aa, Borrelia burgdorferi B31
ELGSGHYIIGVDE

SEQ ID NO: 71807 - protein, 13 aa, Borrelia burgdorferi B31
LGSGHYIIGVDED

SEQ ID NO: 71808 - protein, 13 aa, Borrelia burgdorferi B31
GSGHYIIGVDEDQ

SEQ ID NO: 71809 - protein, 13 aa, Borrelia burgdorferi B31
SGHYIIGVDEDQA

SEQ ID NO: 71810 - protein, 13 aa, Borrelia burgdorferi B31
GHYIIGVDEDQAY

SEQ ID NO: 71811 - protein, 13 aa, Borrelia burgdorferi B31
HYIIGVDEDQAYL

SEQ ID NO: 71812 - protein, 13 aa, Borrelia burgdorferi B31
YIIGVDEDQAYLA

SEQ ID NO: 71813 - protein, 13 aa, Borrelia burgdorferi B31
IIGVDEDQAYLAP

SEQ ID NO: 71814 - protein, 13 aa, Borrelia burgdorferi B31
IGVDEDQAYLAPD

SEQ ID NO: 71815 - protein, 13 aa, Borrelia burgdorferi B31
GVDEDQAYLAPDN

SEQ ID NO: 71816 - protein, 13 aa, Borrelia burgdorferi B31
VDEDQAYLAPDNV

SEQ ID NO: 71817 - protein, 13 aa, Borrelia burgdorferi B31
DEDQAYLAPDNVI

SEQ ID NO: 71818 - protein, 13 aa, Borrelia burgdorferi B31
EDQAYLAPDNVIT

SEQ ID NO: 71819 - protein, 13 aa, Borrelia burgdorferi B31
DQAYLAPDNVITS

SEQ ID NO: 71820 - protein, 13 aa, Borrelia burgdorferi B31
QAYLAPDNVITST

SEQ ID NO: 71821 - protein, 13 aa, Borrelia burgdorferi B31
AYLAPDNVITSTT

SEQ ID NO: 71822 - protein, 13 aa, Borrelia burgdorferi B31
YLAPDNVITSTTK

SEQ ID NO: 71823 - protein, 13 aa, Borrelia burgdorferi B31
LAPDNVITSTTKD

SEQ ID NO: 71824 - protein, 13 aa, Borrelia burgdorferi B31
APDNVITSTTKDV

SEQ ID NO: 71825 - protein, 13 aa, Borrelia burgdorferi B31
PDNVITSTTKDVG

SEQ ID NO: 71826 - protein, 13 aa, Borrelia burgdorferi B31
DNVITSTTKDVGR

SEQ ID NO: 71827 - protein, 13 aa, Borrelia burgdorferi B31
NVITSTTKDVGRA

SEQ ID NO: 71828 - protein, 13 aa, Borrelia burgdorferi B31
VITSTTKDVGRAL

SEQ ID NO: 71829 - protein, 13 aa, Borrelia burgdorferi B31
ITSTTKDVGRALN

SEQ ID NO: 71830 - protein, 13 aa, Borrelia burgdorferi B31
TSTTKDVGRALNI

SEQ ID NO: 71831 - protein, 13 aa, Borrelia burgdorferi B31
STTKDVGRALNIF

SEQ ID NO: 71832 - protein, 13 aa, Borrelia burgdorferi B31
TTKDVGRALNIFT

SEQ ID NO: 71833 - protein, 13 aa, Borrelia burgdorferi B31
TKDVGRALNIFTS

SEQ ID NO: 71834 - protein, 13 aa, Borrelia burgdorferi B31
KDVGRALNIFTSN

SEQ ID NO: 71835 - protein, 13 aa, Borrelia burgdorferi B31
DVGRALNIFTSNH

SEQ ID NO: 71836 - protein, 13 aa, Borrelia burgdorferi B31
VGRALNIFTSNHL

SEQ ID NO: 71837 - protein, 13 aa, Borrelia burgdorferi B31
GRALNIFTSNHLK

SEQ ID NO: 71838 - protein, 13 aa, Borrelia burgdorferi B31
RALNIFTSNHLKT

SEQ ID NO: 71839 - protein, 13 aa, Borrelia burgdorferi B31
ALNIFTSNHLKTN

SEQ ID NO: 71840 - protein, 13 aa, Borrelia burgdorferi B31
LNIFTSNHLKTNT

SEQ ID NO: 71841 - protein, 13 aa, Borrelia burgdorferi B31
NIFTSNHLKTNTF

SEQ ID NO: 71842 - protein, 13 aa, Borrelia burgdorferi B31
IFTSNHLKTNTFE

SEQ ID NO: 71843 - protein, 13 aa, Borrelia burgdorferi B31
FTSNHLKTNTFEG

SEQ ID NO: 71844 - protein, 13 aa, Borrelia burgdorferi B31
TSNHLKTNTFEGG

SEQ ID NO: 71845 - protein, 13 aa, Borrelia burgdorferi B31
SNHLKTNTFEGGK

SEQ ID NO: 71846 - protein, 13 aa, Borrelia burgdorferi B31
NHLKTNTFEGGKL

SEQ ID NO: 71847 - protein, 13 aa, Borrelia burgdorferi B31
HLKTNTFEGGKLI

SEQ ID NO: 71848 - protein, 13 aa, Borrelia burgdorferi B31
LKTNTFEGGKLIN

SEQ ID NO: 71849 - protein, 13 aa, Borrelia burgdorferi B31
KTNTFEGGKLINY

SEQ ID NO: 71850 - protein, 13 aa, Borrelia burgdorferi B31
TNTFEGGKLINYG

SEQ ID NO: 71851 - protein, 13 aa, Borrelia burgdorferi B31
NTFEGGKLINYGL

SEQ ID NO: 71852 - protein, 13 aa, Borrelia burgdorferi B31
TFEGGKLINYGLK

SEQ ID NO: 71853 - protein, 13 aa, Borrelia burgdorferi B31
FEGGKLINYGLKE

SEQ ID NO: 71854 - protein, 13 aa, Borrelia burgdorferi B31
EGGKLINYGLKEG

SEQ ID NO: 71855 - protein, 13 aa, Borrelia burgdorferi B31
GGKLINYGLKEGV

SEQ ID NO: 71856 - protein, 13 aa, Borrelia burgdorferi B31
GKLINYGLKEGVV

SEQ ID NO: 71857 - protein, 13 aa, Borrelia burgdorferi B31
KLINYGLKEGVVG

SEQ ID NO: 71858 - protein, 13 aa, Borrelia burgdorferi B31
LINYGLKEGVVGF

SEQ ID NO: 71859 - protein, 13 aa, Borrelia burgdorferi B31
INYGLKEGVVGFV

SEQ ID NO: 71860 - protein, 13 aa, Borrelia burgdorferi B31
NYGLKEGVVGFVR

SEQ ID NO: 71861 - protein, 13 aa, Borrelia burgdorferi B31
YGLKEGVVGFVRN

SEQ ID NO: 71862 - protein, 13 aa, Borrelia burgdorferi B31
GLKEGVVGFVRNP

SEQ ID NO: 71863 - protein, 13 aa, Borrelia burgdorferi B31
LKEGVVGFVRNPK

SEQ ID NO: 71864 - protein, 13 aa, Borrelia burgdorferi B31
KEGVVGFVRNPKM

SEQ ID NO: 71865 - protein, 13 aa, Borrelia burgdorferi B31
EGVVGFVRNPKMI

SEQ ID NO: 71866 - protein, 13 aa, Borrelia burgdorferi B31
GVVGFVRNPKMIS

SEQ ID NO: 71867 - protein, 13 aa, Borrelia burgdorferi B31
VVGFVRNPKMISF

SEQ ID NO: 71868 - protein, 13 aa, Borrelia burgdorferi B31
VGFVRNPKMISFE

SEQ ID NO: 71869 - protein, 13 aa, Borrelia burgdorferi B31
GFVRNPKMISFEL

SEQ ID NO: 71870 - protein, 13 aa, Borrelia burgdorferi B31
FVRNPKMISFELE

SEQ ID NO: 71871 - protein, 13 aa, Borrelia burgdorferi B31
VRNPKMISFELEK

SEQ ID NO: 71872 - protein, 13 aa, Borrelia burgdorferi B31
RNPKMISFELEKE

SEQ ID NO: 71873 - protein, 13 aa, Borrelia burgdorferi B31
NPKMISFELEKEI

SEQ ID NO: 71874 - protein, 13 aa, Borrelia burgdorferi B31
PKMISFELEKEID

SEQ ID NO: 71875 - protein, 13 aa, Borrelia burgdorferi B31
KMISFELEKEIDN

SEQ ID NO: 71876 - protein, 13 aa, Borrelia burgdorferi B31
MISFELEKEIDNL

SEQ ID NO: 71877 - protein, 13 aa, Borrelia burgdorferi B31
ISFELEKEIDNLS

SEQ ID NO: 71878 - protein, 13 aa, Borrelia burgdorferi B31
SFELEKEIDNLSS

SEQ ID NO: 71879 - protein, 13 aa, Borrelia burgdorferi B31
FELEKEIDNLSSK

SEQ ID NO: 71880 - protein, 13 aa, Borrelia burgdorferi B31
ELEKEIDNLSSKI

SEQ ID NO: 71881 - protein, 13 aa, Borrelia burgdorferi B31
LEKEIDNLSSKII

SEQ ID NO: 71882 - protein, 13 aa, Borrelia burgdorferi B31
EKEIDNLSSKIIN

SEQ ID NO: 71883 - protein, 13 aa, Borrelia burgdorferi B31
KEIDNLSSKIINK

SEQ ID NO: 71884 - protein, 13 aa, Borrelia burgdorferi B31
EIDNLSSKIINKE

SEQ ID NO: 71885 - protein, 13 aa, Borrelia burgdorferi B31
IDNLSSKIINKEI

SEQ ID NO: 71886 - protein, 13 aa, Borrelia burgdorferi B31
DNLSSKIINKEII

SEQ ID NO: 71887 - protein, 13 aa, Borrelia burgdorferi B31
NLSSKIINKEIIV

SEQ ID NO: 71888 - protein, 13 aa, Borrelia burgdorferi B31
LSSKIINKEIIVP

SEQ ID NO: 71889 - protein, 13 aa, Borrelia burgdorferi B31
SSKIINKEIIVPS

SEQ ID NO: 71890 - protein, 13 aa, Borrelia burgdorferi B31
SKIINKEIIVPSN

SEQ ID NO: 71891 - protein, 13 aa, Borrelia burgdorferi B31
KIINKEIIVPSNK

SEQ ID NO: 71892 - protein, 13 aa, Borrelia burgdorferi B31
IINKEIIVPSNKE

SEQ ID NO: 71893 - protein, 13 aa, Borrelia burgdorferi B31
INKEIIVPSNKES

SEQ ID NO: 71894 - protein, 13 aa, Borrelia burgdorferi B31
NKEIIVPSNKESY

SEQ ID NO: 71895 - protein, 13 aa, Borrelia burgdorferi B31
KEIIVPSNKESYE

SEQ ID NO: 71896 - protein, 13 aa, Borrelia burgdorferi B31
EIIVPSNKESYEK

SEQ ID NO: 71897 - protein, 13 aa, Borrelia burgdorferi B31
IIVPSNKESYEKF

SEQ ID NO: 71898 - protein, 13 aa, Borrelia burgdorferi B31
IVPSNKESYEKFL

SEQ ID NO: 71899 - protein, 13 aa, Borrelia burgdorferi B31
VPSNKESYEKFLK

SEQ ID NO: 71900 - protein, 13 aa, Borrelia burgdorferi B31
PSNKESYEKFLKE

SEQ ID NO: 71901 - protein, 13 aa, Borrelia burgdorferi B31
SNKESYEKFLKEF

SEQ ID NO: 71902 - protein, 13 aa, Borrelia burgdorferi B31
NKESYEKFLKEFI

SEQ ID NO: 71903 - protein, 14 aa, Borrelia burgdorferi B31
MNKILLLILLESIV

SEQ ID NO: 71904 - protein, 14 aa, Borrelia burgdorferi B31
NKILLLILLESIVF

SEQ ID NO: 71905 - protein, 14 aa, Borrelia burgdorferi B31
KILLLILLESIVFL

SEQ ID NO: 71906 - protein, 14 aa, Borrelia burgdorferi B31
ILLLILLESIVFLS

SEQ ID NO: 71907 - protein, 14 aa, Borrelia burgdorferi B31
LLLILLESIVFLSC

SEQ ID NO: 71908 - protein, 14 aa, Borrelia burgdorferi B31
LLILLESIVFLSCS

SEQ ID NO: 71909 - protein, 14 aa, Borrelia burgdorferi B31
LILLESIVFLSCSG

SEQ ID NO: 71910 - protein, 14 aa, Borrelia burgdorferi B31
ILLESIVFLSCSGK

SEQ ID NO: 71911 - protein, 14 aa, Borrelia burgdorferi B31
LLESIVFLSCSGKG

SEQ ID NO: 71912 - protein, 14 aa, Borrelia burgdorferi B31
LESIVFLSCSGKGS

SEQ ID NO: 71913 - protein, 14 aa, Borrelia burgdorferi B31
ESIVFLSCSGKGSL

SEQ ID NO: 71914 - protein, 14 aa, Borrelia burgdorferi B31
SIVFLSCSGKGSLG

SEQ ID NO: 71915 - protein, 14 aa, Borrelia burgdorferi B31
IVFLSCSGKGSLGS

SEQ ID NO: 71916 - protein, 14 aa, Borrelia burgdorferi B31
VFLSCSGKGSLGSE

SEQ ID NO: 71917 - protein, 14 aa, Borrelia burgdorferi B31
FLSCSGKGSLGSEI

SEQ ID NO: 71918 - protein, 14 aa, Borrelia burgdorferi B31
LSCSGKGSLGSEIP

SEQ ID NO: 71919 - protein, 14 aa, Borrelia burgdorferi B31
SCSGKGSLGSEIPK

SEQ ID NO: 71920 - protein, 14 aa, Borrelia burgdorferi B31
CSGKGSLGSEIPKV

SEQ ID NO: 71921 - protein, 14 aa, Borrelia burgdorferi B31
SGKGSLGSEIPKVS

SEQ ID NO: 71922 - protein, 14 aa, Borrelia burgdorferi B31
GKGSLGSEIPKVSL

SEQ ID NO: 71923 - protein, 14 aa, Borrelia burgdorferi B31
KGSLGSEIPKVSLI

SEQ ID NO: 71924 - protein, 14 aa, Borrelia burgdorferi B31
GSLGSEIPKVSLII

SEQ ID NO: 71925 - protein, 14 aa, Borrelia burgdorferi B31
SLGSEIPKVSLIID

SEQ ID NO: 71926 - protein, 14 aa, Borrelia burgdorferi B31
LGSEIPKVSLIIDG

SEQ ID NO: 71927 - protein, 14 aa, Borrelia burgdorferi B31
GSEIPKVSLIIDGT

SEQ ID NO: 71928 - protein, 14 aa, Borrelia burgdorferi B31
SEIPKVSLIIDGTF

SEQ ID NO: 71929 - protein, 14 aa, Borrelia burgdorferi B31
EIPKVSLIIDGTFD

SEQ ID NO: 71930 - protein, 14 aa, Borrelia burgdorferi B31
IPKVSLIIDGTFDD

SEQ ID NO: 71931 - protein, 14 aa, Borrelia burgdorferi B31
PKVSLIIDGTFDDK

SEQ ID NO: 71932 - protein, 14 aa, Borrelia burgdorferi B31
KVSLIIDGTFDDKS

SEQ ID NO: 71933 - protein, 14 aa, Borrelia burgdorferi B31
VSLIIDGTFDDKSF

SEQ ID NO: 71934 - protein, 14 aa, Borrelia burgdorferi B31
SLIIDGTFDDKSFN

SEQ ID NO: 71935 - protein, 14 aa, Borrelia burgdorferi B31
LIIDGTFDDKSFNE

SEQ ID NO: 71936 - protein, 14 aa, Borrelia burgdorferi B31
IIDGTFDDKSFNES

SEQ ID NO: 71937 - protein, 14 aa, Borrelia burgdorferi B31
IDGTFDDKSFNESA

SEQ ID NO: 71938 - protein, 14 aa, Borrelia burgdorferi B31
DGTFDDKSFNESAL

SEQ ID NO: 71939 - protein, 14 aa, Borrelia burgdorferi B31
GTFDDKSFNESALN

SEQ ID NO: 71940 - protein, 14 aa, Borrelia burgdorferi B31
TFDDKSFNESALNG

SEQ ID NO: 71941 - protein, 14 aa, Borrelia burgdorferi B31
FDDKSFNESALNGV

SEQ ID NO: 71942 - protein, 14 aa, Borrelia burgdorferi B31
DDKSFNESALNGVK

SEQ ID NO: 71943 - protein, 14 aa, Borrelia burgdorferi B31
DKSFNESALNGVKK

SEQ ID NO: 71944 - protein, 14 aa, Borrelia burgdorferi B31
KSFNESALNGVKKV

SEQ ID NO: 71945 - protein, 14 aa, Borrelia burgdorferi B31
SFNESALNGVKKVK

SEQ ID NO: 71946 - protein, 14 aa, Borrelia burgdorferi B31
FNESALNGVKKVKE

SEQ ID NO: 71947 - protein, 14 aa, Borrelia burgdorferi B31
NESALNGVKKVKEE

SEQ ID NO: 71948 - protein, 14 aa, Borrelia burgdorferi B31
ESALNGVKKVKEEF

SEQ ID NO: 71949 - protein, 14 aa, Borrelia burgdorferi B31
SALNGVKKVKEEFK

SEQ ID NO: 71950 - protein, 14 aa, Borrelia burgdorferi B31
ALNGVKKVKEEFKI

SEQ ID NO: 71951 - protein, 14 aa, Borrelia burgdorferi B31
LNGVKKVKEEFKIE

SEQ ID NO: 71952 - protein, 14 aa, Borrelia burgdorferi B31
NGVKKVKEEFKIEL

SEQ ID NO: 71953 - protein, 14 aa, Borrelia burgdorferi B31
GVKKVKEEFKIELV

SEQ ID NO: 71954 - protein, 14 aa, Borrelia burgdorferi B31
VKKVKEEFKIELVL

SEQ ID NO: 71955 - protein, 14 aa, Borrelia burgdorferi B31
KKVKEEFKIELVLK

SEQ ID NO: 71956 - protein, 14 aa, Borrelia burgdorferi B31
KVKEEFKIELVLKE

SEQ ID NO: 71957 - protein, 14 aa, Borrelia burgdorferi B31
VKEEFKIELVLKES

SEQ ID NO: 71958 - protein, 14 aa, Borrelia burgdorferi B31
KEEFKIELVLKESS

SEQ ID NO: 71959 - protein, 14 aa, Borrelia burgdorferi B31
EEFKIELVLKESSS

SEQ ID NO: 71960 - protein, 14 aa, Borrelia burgdorferi B31
EFKIELVLKESSSN

SEQ ID NO: 71961 - protein, 14 aa, Borrelia burgdorferi B31
FKIELVLKESSSNS

SEQ ID NO: 71962 - protein, 14 aa, Borrelia burgdorferi B31
KIELVLKESSSNSY

SEQ ID NO: 71963 - protein, 14 aa, Borrelia burgdorferi B31
IELVLKESSSNSYL

SEQ ID NO: 71964 - protein, 14 aa, Borrelia burgdorferi B31
ELVLKESSSNSYLS

SEQ ID NO: 71965 - protein, 14 aa, Borrelia burgdorferi B31
LVLKESSSNSYLSD

SEQ ID NO: 71966 - protein, 14 aa, Borrelia burgdorferi B31
VLKESSSNSYLSDL

SEQ ID NO: 71967 - protein, 14 aa, Borrelia burgdorferi B31
LKESSSNSYLSDLE

SEQ ID NO: 71968 - protein, 14 aa, Borrelia burgdorferi B31
KESSSNSYLSDLEG

SEQ ID NO: 71969 - protein, 14 aa, Borrelia burgdorferi B31
ESSSNSYLSDLEGL

SEQ ID NO: 71970 - protein, 14 aa, Borrelia burgdorferi B31
SSSNSYLSDLEGLK

SEQ ID NO: 71971 - protein, 14 aa, Borrelia burgdorferi B31
SSNSYLSDLEGLKD

SEQ ID NO: 71972 - protein, 14 aa, Borrelia burgdorferi B31
SNSYLSDLEGLKDA

SEQ ID NO: 71973 - protein, 14 aa, Borrelia burgdorferi B31
NSYLSDLEGLKDAG

SEQ ID NO: 71974 - protein, 14 aa, Borrelia burgdorferi B31
SYLSDLEGLKDAGS

SEQ ID NO: 71975 - protein, 14 aa, Borrelia burgdorferi B31
YLSDLEGLKDAGSD

SEQ ID NO: 71976 - protein, 14 aa, Borrelia burgdorferi B31
LSDLEGLKDAGSDL

SEQ ID NO: 71977 - protein, 14 aa, Borrelia burgdorferi B31
SDLEGLKDAGSDLI

SEQ ID NO: 71978 - protein, 14 aa, Borrelia burgdorferi B31
DLEGLKDAGSDLIW

SEQ ID NO: 71979 - protein, 14 aa, Borrelia burgdorferi B31
LEGLKDAGSDLIWL

SEQ ID NO: 71980 - protein, 14 aa, Borrelia burgdorferi B31
EGLKDAGSDLIWLI

SEQ ID NO: 71981 - protein, 14 aa, Borrelia burgdorferi B31
GLKDAGSDLIWLIG

SEQ ID NO: 71982 - protein, 14 aa, Borrelia burgdorferi B31
LKDAGSDLIWLIGY

SEQ ID NO: 71983 - protein, 14 aa, Borrelia burgdorferi B31
KDAGSDLIWLIGYR

SEQ ID NO: 71984 - protein, 14 aa, Borrelia burgdorferi B31
DAGSDLIWLIGYRF

SEQ ID NO: 71985 - protein, 14 aa, Borrelia burgdorferi B31
AGSDLIWLIGYRFS

SEQ ID NO: 71986 - protein, 14 aa, Borrelia burgdorferi B31
GSDLIWLIGYRFSD

SEQ ID NO: 71987 - protein, 14 aa, Borrelia burgdorferi B31
SDLIWLIGYRFSDV

SEQ ID NO: 71988 - protein, 14 aa, Borrelia burgdorferi B31
DLIWLIGYRFSDVA

SEQ ID NO: 71989 - protein, 14 aa, Borrelia burgdorferi B31
LIWLIGYRFSDVAK

SEQ ID NO: 71990 - protein, 14 aa, Borrelia burgdorferi B31
IWLIGYRFSDVAKV

SEQ ID NO: 71991 - protein, 14 aa, Borrelia burgdorferi B31
WLIGYRFSDVAKVA

SEQ ID NO: 71992 - protein, 14 aa, Borrelia burgdorferi B31
LIGYRFSDVAKVAA

SEQ ID NO: 71993 - protein, 14 aa, Borrelia burgdorferi B31
IGYRFSDVAKVAAL

SEQ ID NO: 71994 - protein, 14 aa, Borrelia burgdorferi B31
GYRFSDVAKVAALQ

SEQ ID NO: 71995 - protein, 14 aa, Borrelia burgdorferi B31
YRFSDVAKVAALQN

SEQ ID NO: 71996 - protein, 14 aa, Borrelia burgdorferi B31
RFSDVAKVAALQNP

SEQ ID NO: 71997 - protein, 14 aa, Borrelia burgdorferi B31
FSDVAKVAALQNPD

SEQ ID NO: 71998 - protein, 14 aa, Borrelia burgdorferi B31
SDVAKVAALQNPDM

SEQ ID NO: 71999 - protein, 14 aa, Borrelia burgdorferi B31
DVAKVAALQNPDMK

SEQ ID NO: 72000 - protein, 14 aa, Borrelia burgdorferi B31
VAKVAALQNPDMKY

SEQ ID NO: 72001 - protein, 14 aa, Borrelia burgdorferi B31
AKVAALQNPDMKYA

SEQ ID NO: 72002 - protein, 14 aa, Borrelia burgdorferi B31
KVAALQNPDMKYAI

SEQ ID NO: 72003 - protein, 14 aa, Borrelia burgdorferi B31
VAALQNPDMKYAII

SEQ ID NO: 72004 - protein, 14 aa, Borrelia burgdorferi B31
AALQNPDMKYAIID

SEQ ID NO: 72005 - protein, 14 aa, Borrelia burgdorferi B31
ALQNPDMKYAIIDP

SEQ ID NO: 72006 - protein, 14 aa, Borrelia burgdorferi B31
LQNPDMKYAIIDPI

SEQ ID NO: 72007 - protein, 14 aa, Borrelia burgdorferi B31
QNPDMKYAIIDPIY

SEQ ID NO: 72008 - protein, 14 aa, Borrelia burgdorferi B31
NPDMKYAIIDPIYS

SEQ ID NO: 72009 - protein, 14 aa, Borrelia burgdorferi B31
PDMKYAIIDPIYSN

SEQ ID NO: 72010 - protein, 14 aa, Borrelia burgdorferi B31
DMKYAIIDPIYSND

SEQ ID NO: 72011 - protein, 14 aa, Borrelia burgdorferi B31
MKYAIIDPIYSNDP

SEQ ID NO: 72012 - protein, 14 aa, Borrelia burgdorferi B31
KYAIIDPIYSNDPI

SEQ ID NO: 72013 - protein, 14 aa, Borrelia burgdorferi B31
YAIIDPIYSNDPIP

SEQ ID NO: 72014 - protein, 14 aa, Borrelia burgdorferi B31
AIIDPIYSNDPIPA

SEQ ID NO: 72015 - protein, 14 aa, Borrelia burgdorferi B31
IIDPIYSNDPIPAN

SEQ ID NO: 72016 - protein, 14 aa, Borrelia burgdorferi B31
IDPIYSNDPIPANL

SEQ ID NO: 72017 - protein, 14 aa, Borrelia burgdorferi B31
DPIYSNDPIPANLV

SEQ ID NO: 72018 - protein, 14 aa, Borrelia burgdorferi B31
PIYSNDPIPANLVG

SEQ ID NO: 72019 - protein, 14 aa, Borrelia burgdorferi B31
IYSNDPIPANLVGM

SEQ ID NO: 72020 - protein, 14 aa, Borrelia burgdorferi B31
YSNDPIPANLVGMT

SEQ ID NO: 72021 - protein, 14 aa, Borrelia burgdorferi B31
SNDPIPANLVGMTF

SEQ ID NO: 72022 - protein, 14 aa, Borrelia burgdorferi B31
NDPIPANLVGMTFR

SEQ ID NO: 72023 - protein, 14 aa, Borrelia burgdorferi B31
DPIPANLVGMTFRA

SEQ ID NO: 72024 - protein, 14 aa, Borrelia burgdorferi B31
PIPANLVGMTFRAQ

SEQ ID NO: 72025 - protein, 14 aa, Borrelia burgdorferi B31
IPANLVGMTFRAQE

SEQ ID NO: 72026 - protein, 14 aa, Borrelia burgdorferi B31
PANLVGMTFRAQEG

SEQ ID NO: 72027 - protein, 14 aa, Borrelia burgdorferi B31
ANLVGMTFRAQEGA

SEQ ID NO: 72028 - protein, 14 aa, Borrelia burgdorferi B31
NLVGMTFRAQEGAF

SEQ ID NO: 72029 - protein, 14 aa, Borrelia burgdorferi B31
LVGMTFRAQEGAFL

SEQ ID NO: 72030 - protein, 14 aa, Borrelia burgdorferi B31
VGMTFRAQEGAFLT

SEQ ID NO: 72031 - protein, 14 aa, Borrelia burgdorferi B31
GMTFRAQEGAFLTG

SEQ ID NO: 72032 - protein, 14 aa, Borrelia burgdorferi B31
MTFRAQEGAFLTGY

SEQ ID NO: 72033 - protein, 14 aa, Borrelia burgdorferi B31
TFRAQEGAFLTGYI

SEQ ID NO: 72034 - protein, 14 aa, Borrelia burgdorferi B31
FRAQEGAFLTGYIA

SEQ ID NO: 72035 - protein, 14 aa, Borrelia burgdorferi B31
RAQEGAFLTGYIAA

SEQ ID NO: 72036 - protein, 14 aa, Borrelia burgdorferi B31
AQEGAFLTGYIAAK

SEQ ID NO: 72037 - protein, 14 aa, Borrelia burgdorferi B31
QEGAFLTGYIAAKL

SEQ ID NO: 72038 - protein, 14 aa, Borrelia burgdorferi B31
EGAFLTGYIAAKLS

SEQ ID NO: 72039 - protein, 14 aa, Borrelia burgdorferi B31
GAFLTGYIAAKLSK

SEQ ID NO: 72040 - protein, 14 aa, Borrelia burgdorferi B31
AFLTGYIAAKLSKT

SEQ ID NO: 72041 - protein, 14 aa, Borrelia burgdorferi B31
FLTGYIAAKLSKTG

SEQ ID NO: 72042 - protein, 14 aa, Borrelia burgdorferi B31
LTGYIAAKLSKTGK

SEQ ID NO: 72043 - protein, 14 aa, Borrelia burgdorferi B31
TGYIAAKLSKTGKI

SEQ ID NO: 72044 - protein, 14 aa, Borrelia burgdorferi B31
GYIAAKLSKTGKIG

SEQ ID NO: 72045 - protein, 14 aa, Borrelia burgdorferi B31
YIAAKLSKTGKIGF

SEQ ID NO: 72046 - protein, 14 aa, Borrelia burgdorferi B31
IAAKLSKTGKIGFL

SEQ ID NO: 72047 - protein, 14 aa, Borrelia burgdorferi B31
AAKLSKTGKIGFLG

SEQ ID NO: 72048 - protein, 14 aa, Borrelia burgdorferi B31
AKLSKTGKIGFLGG

SEQ ID NO: 72049 - protein, 14 aa, Borrelia burgdorferi B31
KLSKTGKIGFLGGI

SEQ ID NO: 72050 - protein, 14 aa, Borrelia burgdorferi B31
LSKTGKIGFLGGIE

SEQ ID NO: 72051 - protein, 14 aa, Borrelia burgdorferi B31
SKTGKIGFLGGIEG

SEQ ID NO: 72052 - protein, 14 aa, Borrelia burgdorferi B31
KTGKIGFLGGIEGE

SEQ ID NO: 72053 - protein, 14 aa, Borrelia burgdorferi B31
TGKIGFLGGIEGEI

SEQ ID NO: 72054 - protein, 14 aa, Borrelia burgdorferi B31
GKIGFLGGIEGEIV

SEQ ID NO: 72055 - protein, 14 aa, Borrelia burgdorferi B31
KIGFLGGIEGEIVD

SEQ ID NO: 72056 - protein, 14 aa, Borrelia burgdorferi B31
IGFLGGIEGEIVDA

SEQ ID NO: 72057 - protein, 14 aa, Borrelia burgdorferi B31
GFLGGIEGEIVDAF

SEQ ID NO: 72058 - protein, 14 aa, Borrelia burgdorferi B31
FLGGIEGEIVDAFR

SEQ ID NO: 72059 - protein, 14 aa, Borrelia burgdorferi B31
LGGIEGEIVDAFRY

SEQ ID NO: 72060 - protein, 14 aa, Borrelia burgdorferi B31
GGIEGEIVDAFRYG

SEQ ID NO: 72061 - protein, 14 aa, Borrelia burgdorferi B31
GIEGEIVDAFRYGY

SEQ ID NO: 72062 - protein, 14 aa, Borrelia burgdorferi B31
IEGEIVDAFRYGYE

SEQ ID NO: 72063 - protein, 14 aa, Borrelia burgdorferi B31
EGEIVDAFRYGYEA

SEQ ID NO: 72064 - protein, 14 aa, Borrelia burgdorferi B31
GEIVDAFRYGYEAG

SEQ ID NO: 72065 - protein, 14 aa, Borrelia burgdorferi B31
EIVDAFRYGYEAGA

SEQ ID NO: 72066 - protein, 14 aa, Borrelia burgdorferi B31
IVDAFRYGYEAGAK

SEQ ID NO: 72067 - protein, 14 aa, Borrelia burgdorferi B31
VDAFRYGYEAGAKY

SEQ ID NO: 72068 - protein, 14 aa, Borrelia burgdorferi B31
DAFRYGYEAGAKYA

SEQ ID NO: 72069 - protein, 14 aa, Borrelia burgdorferi B31
AFRYGYEAGAKYAN

SEQ ID NO: 72070 - protein, 14 aa, Borrelia burgdorferi B31
FRYGYEAGAKYANK

SEQ ID NO: 72071 - protein, 14 aa, Borrelia burgdorferi B31
RYGYEAGAKYANKD

SEQ ID NO: 72072 - protein, 14 aa, Borrelia burgdorferi B31
YGYEAGAKYANKDI

SEQ ID NO: 72073 - protein, 14 aa, Borrelia burgdorferi B31
GYEAGAKYANKDIK

SEQ ID NO: 72074 - protein, 14 aa, Borrelia burgdorferi B31
YEAGAKYANKDIKI

SEQ ID NO: 72075 - protein, 14 aa, Borrelia burgdorferi B31
EAGAKYANKDIKIS

SEQ ID NO: 72076 - protein, 14 aa, Borrelia burgdorferi B31
AGAKYANKDIKIST

SEQ ID NO: 72077 - protein, 14 aa, Borrelia burgdorferi B31
GAKYANKDIKISTQ

SEQ ID NO: 72078 - protein, 14 aa, Borrelia burgdorferi B31
AKYANKDIKISTQY

SEQ ID NO: 72079 - protein, 14 aa, Borrelia burgdorferi B31
KYANKDIKISTQYI

SEQ ID NO: 72080 - protein, 14 aa, Borrelia burgdorferi B31
YANKDIKISTQYIG

SEQ ID NO: 72081 - protein, 14 aa, Borrelia burgdorferi B31
ANKDIKISTQYIGS

SEQ ID NO: 72082 - protein, 14 aa, Borrelia burgdorferi B31
NKDIKISTQYIGSF

SEQ ID NO: 72083 - protein, 14 aa, Borrelia burgdorferi B31
KDIKISTQYIGSFA

SEQ ID NO: 72084 - protein, 14 aa, Borrelia burgdorferi B31
DIKISTQYIGSFAD

SEQ ID NO: 72085 - protein, 14 aa, Borrelia burgdorferi B31
IKISTQYIGSFADL

SEQ ID NO: 72086 - protein, 14 aa, Borrelia burgdorferi B31
KISTQYIGSFADLE

SEQ ID NO: 72087 - protein, 14 aa, Borrelia burgdorferi B31
ISTQYIGSFADLEA

SEQ ID NO: 72088 - protein, 14 aa, Borrelia burgdorferi B31
STQYIGSFADLEAG

SEQ ID NO: 72089 - protein, 14 aa, Borrelia burgdorferi B31
TQYIGSFADLEAGR

SEQ ID NO: 72090 - protein, 14 aa, Borrelia burgdorferi B31
QYIGSFADLEAGRS

SEQ ID NO: 72091 - protein, 14 aa, Borrelia burgdorferi B31
YIGSFADLEAGRSV

SEQ ID NO: 72092 - protein, 14 aa, Borrelia burgdorferi B31
IGSFADLEAGRSVA

SEQ ID NO: 72093 - protein, 14 aa, Borrelia burgdorferi B31
GSFADLEAGRSVAT

SEQ ID NO: 72094 - protein, 14 aa, Borrelia burgdorferi B31
SFADLEAGRSVATR

SEQ ID NO: 72095 - protein, 14 aa, Borrelia burgdorferi B31
FADLEAGRSVATRM

SEQ ID NO: 72096 - protein, 14 aa, Borrelia burgdorferi B31
ADLEAGRSVATRMY

SEQ ID NO: 72097 - protein, 14 aa, Borrelia burgdorferi B31
DLEAGRSVATRMYS

SEQ ID NO: 72098 - protein, 14 aa, Borrelia burgdorferi B31
LEAGRSVATRMYSD

SEQ ID NO: 72099 - protein, 14 aa, Borrelia burgdorferi B31
EAGRSVATRMYSDE

SEQ ID NO: 72100 - protein, 14 aa, Borrelia burgdorferi B31
AGRSVATRMYSDEI

SEQ ID NO: 72101 - protein, 14 aa, Borrelia burgdorferi B31
GRSVATRMYSDEID

SEQ ID NO: 72102 - protein, 14 aa, Borrelia burgdorferi B31
RSVATRMYSDEIDI

SEQ ID NO: 72103 - protein, 14 aa, Borrelia burgdorferi B31
SVATRMYSDEIDII

SEQ ID NO: 72104 - protein, 14 aa, Borrelia burgdorferi B31
VATRMYSDEIDIIH

SEQ ID NO: 72105 - protein, 14 aa, Borrelia burgdorferi B31
ATRMYSDEIDIIHH

SEQ ID NO: 72106 - protein, 14 aa, Borrelia burgdorferi B31
TRMYSDEIDIIHHA

SEQ ID NO: 72107 - protein, 14 aa, Borrelia burgdorferi B31
RMYSDEIDIIHHAA

SEQ ID NO: 72108 - protein, 14 aa, Borrelia burgdorferi B31
MYSDEIDIIHHAAG

SEQ ID NO: 72109 - protein, 14 aa, Borrelia burgdorferi B31
YSDEIDIIHHAAGL

SEQ ID NO: 72110 - protein, 14 aa, Borrelia burgdorferi B31
SDEIDIIHHAAGLG

SEQ ID NO: 72111 - protein, 14 aa, Borrelia burgdorferi B31
DEIDIIHHAAGLGG

SEQ ID NO: 72112 - protein, 14 aa, Borrelia burgdorferi B31
EIDIIHHAAGLGGI

SEQ ID NO: 72113 - protein, 14 aa, Borrelia burgdorferi B31
IDIIHHAAGLGGIG

SEQ ID NO: 72114 - protein, 14 aa, Borrelia burgdorferi B31
DIIHHAAGLGGIGA

SEQ ID NO: 72115 - protein, 14 aa, Borrelia burgdorferi B31
IIHHAAGLGGIGAI

SEQ ID NO: 72116 - protein, 14 aa, Borrelia burgdorferi B31
IHHAAGLGGIGAIE

SEQ ID NO: 72117 - protein, 14 aa, Borrelia burgdorferi B31
HHAAGLGGIGAIEV

SEQ ID NO: 72118 - protein, 14 aa, Borrelia burgdorferi B31
HAAGLGGIGAIEVA

SEQ ID NO: 72119 - protein, 14 aa, Borrelia burgdorferi B31
AAGLGGIGAIEVAK

SEQ ID NO: 72120 - protein, 14 aa, Borrelia burgdorferi B31
AGLGGIGAIEVAKE

SEQ ID NO: 72121 - protein, 14 aa, Borrelia burgdorferi B31
GLGGIGAIEVAKEL

SEQ ID NO: 72122 - protein, 14 aa, Borrelia burgdorferi B31
LGGIGAIEVAKELG

SEQ ID NO: 72123 - protein, 14 aa, Borrelia burgdorferi B31
GGIGAIEVAKELGS

SEQ ID NO: 72124 - protein, 14 aa, Borrelia burgdorferi B31
GIGAIEVAKELGSG

SEQ ID NO: 72125 - protein, 14 aa, Borrelia burgdorferi B31
IGAIEVAKELGSGH

SEQ ID NO: 72126 - protein, 14 aa, Borrelia burgdorferi B31
GAIEVAKELGSGHY

SEQ ID NO: 72127 - protein, 14 aa, Borrelia burgdorferi B31
AIEVAKELGSGHYI

SEQ ID NO: 72128 - protein, 14 aa, Borrelia burgdorferi B31
IEVAKELGSGHYII

SEQ ID NO: 72129 - protein, 14 aa, Borrelia burgdorferi B31
EVAKELGSGHYIIG

SEQ ID NO: 72130 - protein, 14 aa, Borrelia burgdorferi B31
VAKELGSGHYIIGV

SEQ ID NO: 72131 - protein, 14 aa, Borrelia burgdorferi B31
AKELGSGHYIIGVD

SEQ ID NO: 72132 - protein, 14 aa, Borrelia burgdorferi B31
KELGSGHYIIGVDE

SEQ ID NO: 72133 - protein, 14 aa, Borrelia burgdorferi B31
ELGSGHYIIGVDED

SEQ ID NO: 72134 - protein, 14 aa, Borrelia burgdorferi B31
LGSGHYIIGVDEDQ

SEQ ID NO: 72135 - protein, 14 aa, Borrelia burgdorferi B31
GSGHYIIGVDEDQA

SEQ ID NO: 72136 - protein, 14 aa, Borrelia burgdorferi B31
SGHYIIGVDEDQAY

SEQ ID NO: 72137 - protein, 14 aa, Borrelia burgdorferi B31
GHYIIGVDEDQAYL

SEQ ID NO: 72138 - protein, 14 aa, Borrelia burgdorferi B31
HYIIGVDEDQAYLA

SEQ ID NO: 72139 - protein, 14 aa, Borrelia burgdorferi B31
YIIGVDEDQAYLAP

SEQ ID NO: 72140 - protein, 14 aa, Borrelia burgdorferi B31
IIGVDEDQAYLAPD

SEQ ID NO: 72141 - protein, 14 aa, Borrelia burgdorferi B31
IGVDEDQAYLAPDN

SEQ ID NO: 72142 - protein, 14 aa, Borrelia burgdorferi B31
GVDEDQAYLAPDNV

SEQ ID NO: 72143 - protein, 14 aa, Borrelia burgdorferi B31
VDEDQAYLAPDNVI

SEQ ID NO: 72144 - protein, 14 aa, Borrelia burgdorferi B31
DEDQAYLAPDNVIT

SEQ ID NO: 72145 - protein, 14 aa, Borrelia burgdorferi B31
EDQAYLAPDNVITS

SEQ ID NO: 72146 - protein, 14 aa, Borrelia burgdorferi B31
DQAYLAPDNVITST

SEQ ID NO: 72147 - protein, 14 aa, Borrelia burgdorferi B31
QAYLAPDNVITSTT

SEQ ID NO: 72148 - protein, 14 aa, Borrelia burgdorferi B31
AYLAPDNVITSTTK

SEQ ID NO: 72149 - protein, 14 aa, Borrelia burgdorferi B31
YLAPDNVITSTTKD

SEQ ID NO: 72150 - protein, 14 aa, Borrelia burgdorferi B31
LAPDNVITSTTKDV

SEQ ID NO: 72151 - protein, 14 aa, Borrelia burgdorferi B31
APDNVITSTTKDVG

SEQ ID NO: 72152 - protein, 14 aa, Borrelia burgdorferi B31
PDNVITSTTKDVGR

SEQ ID NO: 72153 - protein, 14 aa, Borrelia burgdorferi B31
DNVITSTTKDVGRA

SEQ ID NO: 72154 - protein, 14 aa, Borrelia burgdorferi B31
NVITSTTKDVGRAL

SEQ ID NO: 72155 - protein, 14 aa, Borrelia burgdorferi B31
VITSTTKDVGRALN

SEQ ID NO: 72156 - protein, 14 aa, Borrelia burgdorferi B31
ITSTTKDVGRALNI

SEQ ID NO: 72157 - protein, 14 aa, Borrelia burgdorferi B31
TSTTKDVGRALNIF

SEQ ID NO: 72158 - protein, 14 aa, Borrelia burgdorferi B31
STTKDVGRALNIFT

SEQ ID NO: 72159 - protein, 14 aa, Borrelia burgdorferi B31
TTKDVGRALNIFTS

SEQ ID NO: 72160 - protein, 14 aa, Borrelia burgdorferi B31
TKDVGRALNIFTSN

SEQ ID NO: 72161 - protein, 14 aa, Borrelia burgdorferi B31
KDVGRALNIFTSNH

SEQ ID NO: 72162 - protein, 14 aa, Borrelia burgdorferi B31
DVGRALNIFTSNHL

SEQ ID NO: 72163 - protein, 14 aa, Borrelia burgdorferi B31
VGRALNIFTSNHLK

SEQ ID NO: 72164 - protein, 14 aa, Borrelia burgdorferi B31
GRALNIFTSNHLKT

SEQ ID NO: 72165 - protein, 14 aa, Borrelia burgdorferi B31
RALNIFTSNHLKTN

SEQ ID NO: 72166 - protein, 14 aa, Borrelia burgdorferi B31
ALNIFTSNHLKTNT

SEQ ID NO: 72167 - protein, 14 aa, Borrelia burgdorferi B31
LNIFTSNHLKTNTF

SEQ ID NO: 72168 - protein, 14 aa, Borrelia burgdorferi B31
NIFTSNHLKTNTFE

SEQ ID NO: 72169 - protein, 14 aa, Borrelia burgdorferi B31
IFTSNHLKTNTFEG

SEQ ID NO: 72170 - protein, 14 aa, Borrelia burgdorferi B31
FTSNHLKTNTFEGG

SEQ ID NO: 72171 - protein, 14 aa, Borrelia burgdorferi B31
TSNHLKTNTFEGGK

SEQ ID NO: 72172 - protein, 14 aa, Borrelia burgdorferi B31
SNHLKTNTFEGGKL

SEQ ID NO: 72173 - protein, 14 aa, Borrelia burgdorferi B31
NHLKTNTFEGGKLI

SEQ ID NO: 72174 - protein, 14 aa, Borrelia burgdorferi B31
HLKTNTFEGGKLIN

SEQ ID NO: 72175 - protein, 14 aa, Borrelia burgdorferi B31
LKTNTFEGGKLINY

SEQ ID NO: 72176 - protein, 14 aa, Borrelia burgdorferi B31
KTNTFEGGKLINYG

SEQ ID NO: 72177 - protein, 14 aa, Borrelia burgdorferi B31
TNTFEGGKLINYGL

SEQ ID NO: 72178 - protein, 14 aa, Borrelia burgdorferi B31
NTFEGGKLINYGLK

SEQ ID NO: 72179 - protein, 14 aa, Borrelia burgdorferi B31
TFEGGKLINYGLKE

SEQ ID NO: 72180 - protein, 14 aa, Borrelia burgdorferi B31
FEGGKLINYGLKEG

SEQ ID NO: 72181 - protein, 14 aa, Borrelia burgdorferi B31
EGGKLINYGLKEGV

SEQ ID NO: 72182 - protein, 14 aa, Borrelia burgdorferi B31
GGKLINYGLKEGVV

SEQ ID NO: 72183 - protein, 14 aa, Borrelia burgdorferi B31
GKLINYGLKEGVVG

SEQ ID NO: 72184 - protein, 14 aa, Borrelia burgdorferi B31
KLINYGLKEGVVGF

SEQ ID NO: 72185 - protein, 14 aa, Borrelia burgdorferi B31
LINYGLKEGVVGFV

SEQ ID NO: 72186 - protein, 14 aa, Borrelia burgdorferi B31
INYGLKEGVVGFVR

SEQ ID NO: 72187 - protein, 14 aa, Borrelia burgdorferi B31
NYGLKEGVVGFVRN

SEQ ID NO: 72188 - protein, 14 aa, Borrelia burgdorferi B31
YGLKEGVVGFVRNP

SEQ ID NO: 72189 - protein, 14 aa, Borrelia burgdorferi B31
GLKEGVVGFVRNPK

SEQ ID NO: 72190 - protein, 14 aa, Borrelia burgdorferi B31
LKEGVVGFVRNPKM

SEQ ID NO: 72191 - protein, 14 aa, Borrelia burgdorferi B31
KEGVVGFVRNPKMI

SEQ ID NO: 72192 - protein, 14 aa, Borrelia burgdorferi B31
EGVVGFVRNPKMIS

SEQ ID NO: 72193 - protein, 14 aa, Borrelia burgdorferi B31
GVVGFVRNPKMISF

SEQ ID NO: 72194 - protein, 14 aa, Borrelia burgdorferi B31
VVGFVRNPKMISFE

SEQ ID NO: 72195 - protein, 14 aa, Borrelia burgdorferi B31
VGFVRNPKMISFEL

SEQ ID NO: 72196 - protein, 14 aa, Borrelia burgdorferi B31
GFVRNPKMISFELE

SEQ ID NO: 72197 - protein, 14 aa, Borrelia burgdorferi B31
FVRNPKMISFELEK

SEQ ID NO: 72198 - protein, 14 aa, Borrelia burgdorferi B31
VRNPKMISFELEKE

SEQ ID NO: 72199 - protein, 14 aa, Borrelia burgdorferi B31
RNPKMISFELEKEI

SEQ ID NO: 72200 - protein, 14 aa, Borrelia burgdorferi B31
NPKMISFELEKEID

SEQ ID NO: 72201 - protein, 14 aa, Borrelia burgdorferi B31
PKMISFELEKEIDN

SEQ ID NO: 72202 - protein, 14 aa, Borrelia burgdorferi B31
KMISFELEKEIDNL

SEQ ID NO: 72203 - protein, 14 aa, Borrelia burgdorferi B31
MISFELEKEIDNLS

SEQ ID NO: 72204 - protein, 14 aa, Borrelia burgdorferi B31
ISFELEKEIDNLSS

SEQ ID NO: 72205 - protein, 14 aa, Borrelia burgdorferi B31
SFELEKEIDNLSSK

SEQ ID NO: 72206 - protein, 14 aa, Borrelia burgdorferi B31
FELEKEIDNLSSKI

SEQ ID NO: 72207 - protein, 14 aa, Borrelia burgdorferi B31
ELEKEIDNLSSKII

SEQ ID NO: 72208 - protein, 14 aa, Borrelia burgdorferi B31
LEKEIDNLSSKIIN

SEQ ID NO: 72209 - protein, 14 aa, Borrelia burgdorferi B31
EKEIDNLSSKIINK

SEQ ID NO: 72210 - protein, 14 aa, Borrelia burgdorferi B31
KEIDNLSSKIINKE

SEQ ID NO: 72211 - protein, 14 aa, Borrelia burgdorferi B31
EIDNLSSKIINKEI

SEQ ID NO: 72212 - protein, 14 aa, Borrelia burgdorferi B31
IDNLSSKIINKEII

SEQ ID NO: 72213 - protein, 14 aa, Borrelia burgdorferi B31
DNLSSKIINKEIIV

SEQ ID NO: 72214 - protein, 14 aa, Borrelia burgdorferi B31
NLSSKIINKEIIVP

SEQ ID NO: 72215 - protein, 14 aa, Borrelia burgdorferi B31
LSSKIINKEIIVPS

SEQ ID NO: 72216 - protein, 14 aa, Borrelia burgdorferi B31
SSKIINKEIIVPSN

SEQ ID NO: 72217 - protein, 14 aa, Borrelia burgdorferi B31
SKIINKEIIVPSNK

SEQ ID NO: 72218 - protein, 14 aa, Borrelia burgdorferi B31
KIINKEIIVPSNKE

SEQ ID NO: 72219 - protein, 14 aa, Borrelia burgdorferi B31
IINKEIIVPSNKES

SEQ ID NO: 72220 - protein, 14 aa, Borrelia burgdorferi B31
INKEIIVPSNKESY

SEQ ID NO: 72221 - protein, 14 aa, Borrelia burgdorferi B31
NKEIIVPSNKESYE

SEQ ID NO: 72222 - protein, 14 aa, Borrelia burgdorferi B31
KEIIVPSNKESYEK

SEQ ID NO: 72223 - protein, 14 aa, Borrelia burgdorferi B31
EIIVPSNKESYEKF

SEQ ID NO: 72224 - protein, 14 aa, Borrelia burgdorferi B31
IIVPSNKESYEKFL

SEQ ID NO: 72225 - protein, 14 aa, Borrelia burgdorferi B31
IVPSNKESYEKFLK

SEQ ID NO: 72226 - protein, 14 aa, Borrelia burgdorferi B31
VPSNKESYEKFLKE

SEQ ID NO: 72227 - protein, 14 aa, Borrelia burgdorferi B31
PSNKESYEKFLKEF

SEQ ID NO: 72228 - protein, 14 aa, Borrelia burgdorferi B31
SNKESYEKFLKEFI

SEQ ID NO: 72229 - protein, 15 aa, Borrelia burgdorferi B31
MNKILLLILLESIVF

SEQ ID NO: 72230 - protein, 15 aa, Borrelia burgdorferi B31
NKILLLILLESIVFL

SEQ ID NO: 72231 - protein, 15 aa, Borrelia burgdorferi B31
KILLLILLESIVFLS

SEQ ID NO: 72232 - protein, 15 aa, Borrelia burgdorferi B31
ILLLILLESIVFLSC

SEQ ID NO: 72233 - protein, 15 aa, Borrelia burgdorferi B31
LLLILLESIVFLSCS

SEQ ID NO: 72234 - protein, 15 aa, Borrelia burgdorferi B31
LLILLESIVFLSCSG

SEQ ID NO: 72235 - protein, 15 aa, Borrelia burgdorferi B31
LILLESIVFLSCSGK

SEQ ID NO: 72236 - protein, 15 aa, Borrelia burgdorferi B31
ILLESIVFLSCSGKG

SEQ ID NO: 72237 - protein, 15 aa, Borrelia burgdorferi B31
LLESIVFLSCSGKGS

SEQ ID NO: 72238 - protein, 15 aa, Borrelia burgdorferi B31
LESIVFLSCSGKGSL

SEQ ID NO: 72239 - protein, 15 aa, Borrelia burgdorferi B31
ESIVFLSCSGKGSLG

SEQ ID NO: 72240 - protein, 15 aa, Borrelia burgdorferi B31
SIVFLSCSGKGSLGS

SEQ ID NO: 72241 - protein, 15 aa, Borrelia burgdorferi B31
IVFLSCSGKGSLGSE

SEQ ID NO: 72242 - protein, 15 aa, Borrelia burgdorferi B31
VFLSCSGKGSLGSEI

SEQ ID NO: 72243 - protein, 15 aa, Borrelia burgdorferi B31
FLSCSGKGSLGSEIP

SEQ ID NO: 72244 - protein, 15 aa, Borrelia burgdorferi B31
LSCSGKGSLGSEIPK

SEQ ID NO: 72245 - protein, 15 aa, Borrelia burgdorferi B31
SCSGKGSLGSEIPKV

SEQ ID NO: 72246 - protein, 15 aa, Borrelia burgdorferi B31
CSGKGSLGSEIPKVS

SEQ ID NO: 72247 - protein, 15 aa, Borrelia burgdorferi B31
SGKGSLGSEIPKVSL

SEQ ID NO: 72248 - protein, 15 aa, Borrelia burgdorferi B31
GKGSLGSEIPKVSLI

SEQ ID NO: 72249 - protein, 15 aa, Borrelia burgdorferi B31
KGSLGSEIPKVSLII

SEQ ID NO: 72250 - protein, 15 aa, Borrelia burgdorferi B31
GSLGSEIPKVSLIID

SEQ ID NO: 72251 - protein, 15 aa, Borrelia burgdorferi B31
SLGSEIPKVSLIIDG

SEQ ID NO: 72252 - protein, 15 aa, Borrelia burgdorferi B31
LGSEIPKVSLIIDGT

SEQ ID NO: 72253 - protein, 15 aa, Borrelia burgdorferi B31
GSEIPKVSLIIDGTF

SEQ ID NO: 72254 - protein, 15 aa, Borrelia burgdorferi B31
SEIPKVSLIIDGTFD

SEQ ID NO: 72255 - protein, 15 aa, Borrelia burgdorferi B31
EIPKVSLIIDGTFDD

SEQ ID NO: 72256 - protein, 15 aa, Borrelia burgdorferi B31
IPKVSLIIDGTFDDK

SEQ ID NO: 72257 - protein, 15 aa, Borrelia burgdorferi B31
PKVSLIIDGTFDDKS

SEQ ID NO: 72258 - protein, 15 aa, Borrelia burgdorferi B31
KVSLIIDGTFDDKSF

SEQ ID NO: 72259 - protein, 15 aa, Borrelia burgdorferi B31
VSLIIDGTFDDKSFN

SEQ ID NO: 72260 - protein, 15 aa, Borrelia burgdorferi B31
SLIIDGTFDDKSFNE

SEQ ID NO: 72261 - protein, 15 aa, Borrelia burgdorferi B31
LIIDGTFDDKSFNES

SEQ ID NO: 72262 - protein, 15 aa, Borrelia burgdorferi B31
IIDGTFDDKSFNESA

SEQ ID NO: 72263 - protein, 15 aa, Borrelia burgdorferi B31
IDGTFDDKSFNESAL

SEQ ID NO: 72264 - protein, 15 aa, Borrelia burgdorferi B31
DGTFDDKSFNESALN

SEQ ID NO: 72265 - protein, 15 aa, Borrelia burgdorferi B31
GTFDDKSFNESALNG

SEQ ID NO: 72266 - protein, 15 aa, Borrelia burgdorferi B31
TFDDKSFNESALNGV

SEQ ID NO: 72267 - protein, 15 aa, Borrelia burgdorferi B31
FDDKSFNESALNGVK

SEQ ID NO: 72268 - protein, 15 aa, Borrelia burgdorferi B31
DDKSFNESALNGVKK

SEQ ID NO: 72269 - protein, 15 aa, Borrelia burgdorferi B31
DKSFNESALNGVKKV

SEQ ID NO: 72270 - protein, 15 aa, Borrelia burgdorferi B31
KSFNESALNGVKKVK

SEQ ID NO: 72271 - protein, 15 aa, Borrelia burgdorferi B31
SFNESALNGVKKVKE

SEQ ID NO: 72272 - protein, 15 aa, Borrelia burgdorferi B31
FNESALNGVKKVKEE

SEQ ID NO: 72273 - protein, 15 aa, Borrelia burgdorferi B31
NESALNGVKKVKEEF

SEQ ID NO: 72274 - protein, 15 aa, Borrelia burgdorferi B31
ESALNGVKKVKEEFK

SEQ ID NO: 72275 - protein, 15 aa, Borrelia burgdorferi B31
SALNGVKKVKEEFKI

SEQ ID NO: 72276 - protein, 15 aa, Borrelia burgdorferi B31
ALNGVKKVKEEFKIE

SEQ ID NO: 72277 - protein, 15 aa, Borrelia burgdorferi B31
LNGVKKVKEEFKIEL

SEQ ID NO: 72278 - protein, 15 aa, Borrelia burgdorferi B31
NGVKKVKEEFKIELV

SEQ ID NO: 72279 - protein, 15 aa, Borrelia burgdorferi B31
GVKKVKEEFKIELVL

SEQ ID NO: 72280 - protein, 15 aa, Borrelia burgdorferi B31
VKKVKEEFKIELVLK

SEQ ID NO: 72281 - protein, 15 aa, Borrelia burgdorferi B31
KKVKEEFKIELVLKE

SEQ ID NO: 72282 - protein, 15 aa, Borrelia burgdorferi B31
KVKEEFKIELVLKES

SEQ ID NO: 72283 - protein, 15 aa, Borrelia burgdorferi B31
VKEEFKIELVLKESS

SEQ ID NO: 72284 - protein, 15 aa, Borrelia burgdorferi B31
KEEFKIELVLKESSS

SEQ ID NO: 72285 - protein, 15 aa, Borrelia burgdorferi B31
EEFKIELVLKESSSN

SEQ ID NO: 72286 - protein, 15 aa, Borrelia burgdorferi B31
EFKIELVLKESSSNS

SEQ ID NO: 72287 - protein, 15 aa, Borrelia burgdorferi B31
FKIELVLKESSSNSY

SEQ ID NO: 72288 - protein, 15 aa, Borrelia burgdorferi B31
KIELVLKESSSNSYL

SEQ ID NO: 72289 - protein, 15 aa, Borrelia burgdorferi B31
IELVLKESSSNSYLS

SEQ ID NO: 72290 - protein, 15 aa, Borrelia burgdorferi B31
ELVLKESSSNSYLSD

SEQ ID NO: 72291 - protein, 15 aa, Borrelia burgdorferi B31
LVLKESSSNSYLSDL

SEQ ID NO: 72292 - protein, 15 aa, Borrelia burgdorferi B31
VLKESSSNSYLSDLE

SEQ ID NO: 72293 - protein, 15 aa, Borrelia burgdorferi B31
LKESSSNSYLSDLEG

SEQ ID NO: 72294 - protein, 15 aa, Borrelia burgdorferi B31
KESSSNSYLSDLEGL

SEQ ID NO: 72295 - protein, 15 aa, Borrelia burgdorferi B31
ESSSNSYLSDLEGLK

SEQ ID NO: 72296 - protein, 15 aa, Borrelia burgdorferi B31
SSSNSYLSDLEGLKD

SEQ ID NO: 72297 - protein, 15 aa, Borrelia burgdorferi B31
SSNSYLSDLEGLKDA

SEQ ID NO: 72298 - protein, 15 aa, Borrelia burgdorferi B31
SNSYLSDLEGLKDAG

SEQ ID NO: 72299 - protein, 15 aa, Borrelia burgdorferi B31
NSYLSDLEGLKDAGS

SEQ ID NO: 72300 - protein, 15 aa, Borrelia burgdorferi B31
SYLSDLEGLKDAGSD

SEQ ID NO: 72301 - protein, 15 aa, Borrelia burgdorferi B31
YLSDLEGLKDAGSDL

SEQ ID NO: 72302 - protein, 15 aa, Borrelia burgdorferi B31
LSDLEGLKDAGSDLI

SEQ ID NO: 72303 - protein, 15 aa, Borrelia burgdorferi B31
SDLEGLKDAGSDLIW

SEQ ID NO: 72304 - protein, 15 aa, Borrelia burgdorferi B31
DLEGLKDAGSDLIWL

SEQ ID NO: 72305 - protein, 15 aa, Borrelia burgdorferi B31
LEGLKDAGSDLIWLI

SEQ ID NO: 72306 - protein, 15 aa, Borrelia burgdorferi B31
EGLKDAGSDLIWLIG

SEQ ID NO: 72307 - protein, 15 aa, Borrelia burgdorferi B31
GLKDAGSDLIWLIGY

SEQ ID NO: 72308 - protein, 15 aa, Borrelia burgdorferi B31
LKDAGSDLIWLIGYR

SEQ ID NO: 72309 - protein, 15 aa, Borrelia burgdorferi B31
KDAGSDLIWLIGYRF

SEQ ID NO: 72310 - protein, 15 aa, Borrelia burgdorferi B31
DAGSDLIWLIGYRFS

SEQ ID NO: 72311 - protein, 15 aa, Borrelia burgdorferi B31
AGSDLIWLIGYRFSD

SEQ ID NO: 72312 - protein, 15 aa, Borrelia burgdorferi B31
GSDLIWLIGYRFSDV

SEQ ID NO: 72313 - protein, 15 aa, Borrelia burgdorferi B31
SDLIWLIGYRFSDVA

SEQ ID NO: 72314 - protein, 15 aa, Borrelia burgdorferi B31
DLIWLIGYRFSDVAK

SEQ ID NO: 72315 - protein, 15 aa, Borrelia burgdorferi B31
LIWLIGYRFSDVAKV

SEQ ID NO: 72316 - protein, 15 aa, Borrelia burgdorferi B31
IWLIGYRFSDVAKVA

SEQ ID NO: 72317 - protein, 15 aa, Borrelia burgdorferi B31
WLIGYRFSDVAKVAA

SEQ ID NO: 72318 - protein, 15 aa, Borrelia burgdorferi B31
LIGYRFSDVAKVAAL

SEQ ID NO: 72319 - protein, 15 aa, Borrelia burgdorferi B31
IGYRFSDVAKVAALQ

SEQ ID NO: 72320 - protein, 15 aa, Borrelia burgdorferi B31
GYRFSDVAKVAALQN

SEQ ID NO: 72321 - protein, 15 aa, Borrelia burgdorferi B31
YRFSDVAKVAALQNP

SEQ ID NO: 72322 - protein, 15 aa, Borrelia burgdorferi B31
RFSDVAKVAALQNPD

SEQ ID NO: 72323 - protein, 15 aa, Borrelia burgdorferi B31
FSDVAKVAALQNPDM

SEQ ID NO: 72324 - protein, 15 aa, Borrelia burgdorferi B31
SDVAKVAALQNPDMK

SEQ ID NO: 72325 - protein, 15 aa, Borrelia burgdorferi B31
DVAKVAALQNPDMKY

SEQ ID NO: 72326 - protein, 15 aa, Borrelia burgdorferi B31
VAKVAALQNPDMKYA

SEQ ID NO: 72327 - protein, 15 aa, Borrelia burgdorferi B31
AKVAALQNPDMKYAI

SEQ ID NO: 72328 - protein, 15 aa, Borrelia burgdorferi B31
KVAALQNPDMKYAII

SEQ ID NO: 72329 - protein, 15 aa, Borrelia burgdorferi B31
VAALQNPDMKYAIID

SEQ ID NO: 72330 - protein, 15 aa, Borrelia burgdorferi B31
AALQNPDMKYAIIDP

SEQ ID NO: 72331 - protein, 15 aa, Borrelia burgdorferi B31
ALQNPDMKYAIIDPI

SEQ ID NO: 72332 - protein, 15 aa, Borrelia burgdorferi B31
LQNPDMKYAIIDPIY

SEQ ID NO: 72333 - protein, 15 aa, Borrelia burgdorferi B31
QNPDMKYAIIDPIYS

SEQ ID NO: 72334 - protein, 15 aa, Borrelia burgdorferi B31
NPDMKYAIIDPIYSN

SEQ ID NO: 72335 - protein, 15 aa, Borrelia burgdorferi B31
PDMKYAIIDPIYSND

SEQ ID NO: 72336 - protein, 15 aa, Borrelia burgdorferi B31
DMKYAIIDPIYSNDP

SEQ ID NO: 72337 - protein, 15 aa, Borrelia burgdorferi B31
MKYAIIDPIYSNDPI

SEQ ID NO: 72338 - protein, 15 aa, Borrelia burgdorferi B31
KYAIIDPIYSNDPIP

SEQ ID NO: 72339 - protein, 15 aa, Borrelia burgdorferi B31
YAIIDPIYSNDPIPA

SEQ ID NO: 72340 - protein, 15 aa, Borrelia burgdorferi B31
AIIDPIYSNDPIPAN

SEQ ID NO: 72341 - protein, 15 aa, Borrelia burgdorferi B31
IIDPIYSNDPIPANL

SEQ ID NO: 72342 - protein, 15 aa, Borrelia burgdorferi B31
IDPIYSNDPIPANLV

SEQ ID NO: 72343 - protein, 15 aa, Borrelia burgdorferi B31
DPIYSNDPIPANLVG

SEQ ID NO: 72344 - protein, 15 aa, Borrelia burgdorferi B31
PIYSNDPIPANLVGM

SEQ ID NO: 72345 - protein, 15 aa, Borrelia burgdorferi B31
IYSNDPIPANLVGMT

SEQ ID NO: 72346 - protein, 15 aa, Borrelia burgdorferi B31
YSNDPIPANLVGMTF

SEQ ID NO: 72347 - protein, 15 aa, Borrelia burgdorferi B31
SNDPIPANLVGMTFR

SEQ ID NO: 72348 - protein, 15 aa, Borrelia burgdorferi B31
NDPIPANLVGMTFRA

SEQ ID NO: 72349 - protein, 15 aa, Borrelia burgdorferi B31
DPIPANLVGMTFRAQ

SEQ ID NO: 72350 - protein, 15 aa, Borrelia burgdorferi B31
PIPANLVGMTFRAQE

SEQ ID NO: 72351 - protein, 15 aa, Borrelia burgdorferi B31
IPANLVGMTFRAQEG

SEQ ID NO: 72352 - protein, 15 aa, Borrelia burgdorferi B31
PANLVGMTFRAQEGA

SEQ ID NO: 72353 - protein, 15 aa, Borrelia burgdorferi B31
ANLVGMTFRAQEGAF

SEQ ID NO: 72354 - protein, 15 aa, Borrelia burgdorferi B31
NLVGMTFRAQEGAFL

SEQ ID NO: 72355 - protein, 15 aa, Borrelia burgdorferi B31
LVGMTFRAQEGAFLT

SEQ ID NO: 72356 - protein, 15 aa, Borrelia burgdorferi B31
VGMTFRAQEGAFLTG

SEQ ID NO: 72357 - protein, 15 aa, Borrelia burgdorferi B31
GMTFRAQEGAFLTGY

SEQ ID NO: 72358 - protein, 15 aa, Borrelia burgdorferi B31
MTFRAQEGAFLTGYI

SEQ ID NO: 72359 - protein, 15 aa, Borrelia burgdorferi B31
TFRAQEGAFLTGYIA

SEQ ID NO: 72360 - protein, 15 aa, Borrelia burgdorferi B31
FRAQEGAFLTGYIAA

SEQ ID NO: 72361 - protein, 15 aa, Borrelia burgdorferi B31
RAQEGAFLTGYIAAK

SEQ ID NO: 72362 - protein, 15 aa, Borrelia burgdorferi B31
AQEGAFLTGYIAAKL

SEQ ID NO: 72363 - protein, 15 aa, Borrelia burgdorferi B31
QEGAFLTGYIAAKLS

SEQ ID NO: 72364 - protein, 15 aa, Borrelia burgdorferi B31
EGAFLTGYIAAKLSK

SEQ ID NO: 72365 - protein, 15 aa, Borrelia burgdorferi B31
GAFLTGYIAAKLSKT

SEQ ID NO: 72366 - protein, 15 aa, Borrelia burgdorferi B31
AFLTGYIAAKLSKTG

SEQ ID NO: 72367 - protein, 15 aa, Borrelia burgdorferi B31
FLTGYIAAKLSKTGK

SEQ ID NO: 72368 - protein, 15 aa, Borrelia burgdorferi B31
LTGYIAAKLSKTGKI

SEQ ID NO: 72369 - protein, 15 aa, Borrelia burgdorferi B31
TGYIAAKLSKTGKIG

SEQ ID NO: 72370 - protein, 15 aa, Borrelia burgdorferi B31
GYIAAKLSKTGKIGF

SEQ ID NO: 72371 - protein, 15 aa, Borrelia burgdorferi B31
YIAAKLSKTGKIGFL

SEQ ID NO: 72372 - protein, 15 aa, Borrelia burgdorferi B31
IAAKLSKTGKIGFLG

SEQ ID NO: 72373 - protein, 15 aa, Borrelia burgdorferi B31
AAKLSKTGKIGFLGG

SEQ ID NO: 72374 - protein, 15 aa, Borrelia burgdorferi B31
AKLSKTGKIGFLGGI

SEQ ID NO: 72375 - protein, 15 aa, Borrelia burgdorferi B31
KLSKTGKIGFLGGIE

SEQ ID NO: 72376 - protein, 15 aa, Borrelia burgdorferi B31
LSKTGKIGFLGGIEG

SEQ ID NO: 72377 - protein, 15 aa, Borrelia burgdorferi B31
SKTGKIGFLGGIEGE

SEQ ID NO: 72378 - protein, 15 aa, Borrelia burgdorferi B31
KTGKIGFLGGIEGEI

SEQ ID NO: 72379 - protein, 15 aa, Borrelia burgdorferi B31
TGKIGFLGGIEGEIV

SEQ ID NO: 72380 - protein, 15 aa, Borrelia burgdorferi B31
GKIGFLGGIEGEIVD

SEQ ID NO: 72381 - protein, 15 aa, Borrelia burgdorferi B31
KIGFLGGIEGEIVDA

SEQ ID NO: 72382 - protein, 15 aa, Borrelia burgdorferi B31
IGFLGGIEGEIVDAF

SEQ ID NO: 72383 - protein, 15 aa, Borrelia burgdorferi B31
GFLGGIEGEIVDAFR

SEQ ID NO: 72384 - protein, 15 aa, Borrelia burgdorferi B31
FLGGIEGEIVDAFRY

SEQ ID NO: 72385 - protein, 15 aa, Borrelia burgdorferi B31
LGGIEGEIVDAFRYG

SEQ ID NO: 72386 - protein, 15 aa, Borrelia burgdorferi B31
GGIEGEIVDAFRYGY

SEQ ID NO: 72387 - protein, 15 aa, Borrelia burgdorferi B31
GIEGEIVDAFRYGYE

SEQ ID NO: 72388 - protein, 15 aa, Borrelia burgdorferi B31
IEGEIVDAFRYGYEA

SEQ ID NO: 72389 - protein, 15 aa, Borrelia burgdorferi B31
EGEIVDAFRYGYEAG

SEQ ID NO: 72390 - protein, 15 aa, Borrelia burgdorferi B31
GEIVDAFRYGYEAGA

SEQ ID NO: 72391 - protein, 15 aa, Borrelia burgdorferi B31
EIVDAFRYGYEAGAK

SEQ ID NO: 72392 - protein, 15 aa, Borrelia burgdorferi B31
IVDAFRYGYEAGAKY

SEQ ID NO: 72393 - protein, 15 aa, Borrelia burgdorferi B31
VDAFRYGYEAGAKYA

SEQ ID NO: 72394 - protein, 15 aa, Borrelia burgdorferi B31
DAFRYGYEAGAKYAN

SEQ ID NO: 72395 - protein, 15 aa, Borrelia burgdorferi B31
AFRYGYEAGAKYANK

SEQ ID NO: 72396 - protein, 15 aa, Borrelia burgdorferi B31
FRYGYEAGAKYANKD

SEQ ID NO: 72397 - protein, 15 aa, Borrelia burgdorferi B31
RYGYEAGAKYANKDI

SEQ ID NO: 72398 - protein, 15 aa, Borrelia burgdorferi B31
YGYEAGAKYANKDIK

SEQ ID NO: 72399 - protein, 15 aa, Borrelia burgdorferi B31
GYEAGAKYANKDIKI

SEQ ID NO: 72400 - protein, 15 aa, Borrelia burgdorferi B31
YEAGAKYANKDIKIS

SEQ ID NO: 72401 - protein, 15 aa, Borrelia burgdorferi B31
EAGAKYANKDIKIST

SEQ ID NO: 72402 - protein, 15 aa, Borrelia burgdorferi B31
AGAKYANKDIKISTQ

SEQ ID NO: 72403 - protein, 15 aa, Borrelia burgdorferi B31
GAKYANKDIKISTQY

SEQ ID NO: 72404 - protein, 15 aa, Borrelia burgdorferi B31
AKYANKDIKISTQYI

SEQ ID NO: 72405 - protein, 15 aa, Borrelia burgdorferi B31
KYANKDIKISTQYIG

SEQ ID NO: 72406 - protein, 15 aa, Borrelia burgdorferi B31
YANKDIKISTQYIGS

SEQ ID NO: 72407 - protein, 15 aa, Borrelia burgdorferi B31
ANKDIKISTQYIGSF

SEQ ID NO: 72408 - protein, 15 aa, Borrelia burgdorferi B31
NKDIKISTQYIGSFA

SEQ ID NO: 72409 - protein, 15 aa, Borrelia burgdorferi B31
KDIKISTQYIGSFAD

SEQ ID NO: 72410 - protein, 15 aa, Borrelia burgdorferi B31
DIKISTQYIGSFADL

SEQ ID NO: 72411 - protein, 15 aa, Borrelia burgdorferi B31
IKISTQYIGSFADLE

SEQ ID NO: 72412 - protein, 15 aa, Borrelia burgdorferi B31
KISTQYIGSFADLEA

SEQ ID NO: 72413 - protein, 15 aa, Borrelia burgdorferi B31
ISTQYIGSFADLEAG

SEQ ID NO: 72414 - protein, 15 aa, Borrelia burgdorferi B31
STQYIGSFADLEAGR

SEQ ID NO: 72415 - protein, 15 aa, Borrelia burgdorferi B31
TQYIGSFADLEAGRS

SEQ ID NO: 72416 - protein, 15 aa, Borrelia burgdorferi B31
QYIGSFADLEAGRSV

SEQ ID NO: 72417 - protein, 15 aa, Borrelia burgdorferi B31
YIGSFADLEAGRSVA

SEQ ID NO: 72418 - protein, 15 aa, Borrelia burgdorferi B31
IGSFADLEAGRSVAT

SEQ ID NO: 72419 - protein, 15 aa, Borrelia burgdorferi B31
GSFADLEAGRSVATR

SEQ ID NO: 72420 - protein, 15 aa, Borrelia burgdorferi B31
SFADLEAGRSVATRM

SEQ ID NO: 72421 - protein, 15 aa, Borrelia burgdorferi B31
FADLEAGRSVATRMY

SEQ ID NO: 72422 - protein, 15 aa, Borrelia burgdorferi B31
ADLEAGRSVATRMYS

SEQ ID NO: 72423 - protein, 15 aa, Borrelia burgdorferi B31
DLEAGRSVATRMYSD

SEQ ID NO: 72424 - protein, 15 aa, Borrelia burgdorferi B31
LEAGRSVATRMYSDE

SEQ ID NO: 72425 - protein, 15 aa, Borrelia burgdorferi B31
EAGRSVATRMYSDEI

SEQ ID NO: 72426 - protein, 15 aa, Borrelia burgdorferi B31
AGRSVATRMYSDEID

SEQ ID NO: 72427 - protein, 15 aa, Borrelia burgdorferi B31
GRSVATRMYSDEIDI

SEQ ID NO: 72428 - protein, 15 aa, Borrelia burgdorferi B31
RSVATRMYSDEIDII

SEQ ID NO: 72429 - protein, 15 aa, Borrelia burgdorferi B31
SVATRMYSDEIDIIH

SEQ ID NO: 72430 - protein, 15 aa, Borrelia burgdorferi B31
VATRMYSDEIDIIHH

SEQ ID NO: 72431 - protein, 15 aa, Borrelia burgdorferi B31
ATRMYSDEIDIIHHA

SEQ ID NO: 72432 - protein, 15 aa, Borrelia burgdorferi B31
TRMYSDEIDIIHHAA

SEQ ID NO: 72433 - protein, 15 aa, Borrelia burgdorferi B31
RMYSDEIDIIHHAAG

SEQ ID NO: 72434 - protein, 15 aa, Borrelia burgdorferi B31
MYSDEIDIIHHAAGL

SEQ ID NO: 72435 - protein, 15 aa, Borrelia burgdorferi B31
YSDEIDIIHHAAGLG

SEQ ID NO: 72436 - protein, 15 aa, Borrelia burgdorferi B31
SDEIDIIHHAAGLGG

SEQ ID NO: 72437 - protein, 15 aa, Borrelia burgdorferi B31
DEIDIIHHAAGLGGI

SEQ ID NO: 72438 - protein, 15 aa, Borrelia burgdorferi B31
EIDIIHHAAGLGGIG

SEQ ID NO: 72439 - protein, 15 aa, Borrelia burgdorferi B31
IDIIHHAAGLGGIGA

SEQ ID NO: 72440 - protein, 15 aa, Borrelia burgdorferi B31
DIIHHAAGLGGIGAI

SEQ ID NO: 72441 - protein, 15 aa, Borrelia burgdorferi B31
IIHHAAGLGGIGAIE

SEQ ID NO: 72442 - protein, 15 aa, Borrelia burgdorferi B31
IHHAAGLGGIGAIEV

SEQ ID NO: 72443 - protein, 15 aa, Borrelia burgdorferi B31
HHAAGLGGIGAIEVA

SEQ ID NO: 72444 - protein, 15 aa, Borrelia burgdorferi B31
HAAGLGGIGAIEVAK

SEQ ID NO: 72445 - protein, 15 aa, Borrelia burgdorferi B31
AAGLGGIGAIEVAKE

SEQ ID NO: 72446 - protein, 15 aa, Borrelia burgdorferi B31
AGLGGIGAIEVAKEL

SEQ ID NO: 72447 - protein, 15 aa, Borrelia burgdorferi B31
GLGGIGAIEVAKELG

SEQ ID NO: 72448 - protein, 15 aa, Borrelia burgdorferi B31
LGGIGAIEVAKELGS

SEQ ID NO: 72449 - protein, 15 aa, Borrelia burgdorferi B31
GGIGAIEVAKELGSG

SEQ ID NO: 72450 - protein, 15 aa, Borrelia burgdorferi B31
GIGAIEVAKELGSGH

SEQ ID NO: 72451 - protein, 15 aa, Borrelia burgdorferi B31
IGAIEVAKELGSGHY

SEQ ID NO: 72452 - protein, 15 aa, Borrelia burgdorferi B31
GAIEVAKELGSGHYI

SEQ ID NO: 72453 - protein, 15 aa, Borrelia burgdorferi B31
AIEVAKELGSGHYII

SEQ ID NO: 72454 - protein, 15 aa, Borrelia burgdorferi B31
IEVAKELGSGHYIIG

SEQ ID NO: 72455 - protein, 15 aa, Borrelia burgdorferi B31
EVAKELGSGHYIIGV

SEQ ID NO: 72456 - protein, 15 aa, Borrelia burgdorferi B31
VAKELGSGHYIIGVD

SEQ ID NO: 72457 - protein, 15 aa, Borrelia burgdorferi B31
AKELGSGHYIIGVDE

SEQ ID NO: 72458 - protein, 15 aa, Borrelia burgdorferi B31
KELGSGHYIIGVDED

SEQ ID NO: 72459 - protein, 15 aa, Borrelia burgdorferi B31
ELGSGHYIIGVDEDQ

SEQ ID NO: 72460 - protein, 15 aa, Borrelia burgdorferi B31
LGSGHYIIGVDEDQA

SEQ ID NO: 72461 - protein, 15 aa, Borrelia burgdorferi B31
GSGHYIIGVDEDQAY

SEQ ID NO: 72462 - protein, 15 aa, Borrelia burgdorferi B31
SGHYIIGVDEDQAYL

SEQ ID NO: 72463 - protein, 15 aa, Borrelia burgdorferi B31
GHYIIGVDEDQAYLA

SEQ ID NO: 72464 - protein, 15 aa, Borrelia burgdorferi B31
HYIIGVDEDQAYLAP

SEQ ID NO: 72465 - protein, 15 aa, Borrelia burgdorferi B31
YIIGVDEDQAYLAPD

SEQ ID NO: 72466 - protein, 15 aa, Borrelia burgdorferi B31
IIGVDEDQAYLAPDN

SEQ ID NO: 72467 - protein, 15 aa, Borrelia burgdorferi B31
IGVDEDQAYLAPDNV

SEQ ID NO: 72468 - protein, 15 aa, Borrelia burgdorferi B31
GVDEDQAYLAPDNVI

SEQ ID NO: 72469 - protein, 15 aa, Borrelia burgdorferi B31
VDEDQAYLAPDNVIT

SEQ ID NO: 72470 - protein, 15 aa, Borrelia burgdorferi B31
DEDQAYLAPDNVITS

SEQ ID NO: 72471 - protein, 15 aa, Borrelia burgdorferi B31
EDQAYLAPDNVITST

SEQ ID NO: 72472 - protein, 15 aa, Borrelia burgdorferi B31
DQAYLAPDNVITSTT

SEQ ID NO: 72473 - protein, 15 aa, Borrelia burgdorferi B31
QAYLAPDNVITSTTK

SEQ ID NO: 72474 - protein, 15 aa, Borrelia burgdorferi B31
AYLAPDNVITSTTKD

SEQ ID NO: 72475 - protein, 15 aa, Borrelia burgdorferi B31
YLAPDNVITSTTKDV

SEQ ID NO: 72476 - protein, 15 aa, Borrelia burgdorferi B31
LAPDNVITSTTKDVG

SEQ ID NO: 72477 - protein, 15 aa, Borrelia burgdorferi B31
APDNVITSTTKDVGR

SEQ ID NO: 72478 - protein, 15 aa, Borrelia burgdorferi B31
PDNVITSTTKDVGRA

SEQ ID NO: 72479 - protein, 15 aa, Borrelia burgdorferi B31
DNVITSTTKDVGRAL

SEQ ID NO: 72480 - protein, 15 aa, Borrelia burgdorferi B31
NVITSTTKDVGRALN

SEQ ID NO: 72481 - protein, 15 aa, Borrelia burgdorferi B31
VITSTTKDVGRALNI

SEQ ID NO: 72482 - protein, 15 aa, Borrelia burgdorferi B31
ITSTTKDVGRALNIF

SEQ ID NO: 72483 - protein, 15 aa, Borrelia burgdorferi B31
TSTTKDVGRALNIFT

SEQ ID NO: 72484 - protein, 15 aa, Borrelia burgdorferi B31
STTKDVGRALNIFTS

SEQ ID NO: 72485 - protein, 15 aa, Borrelia burgdorferi B31
TTKDVGRALNIFTSN

SEQ ID NO: 72486 - protein, 15 aa, Borrelia burgdorferi B31
TKDVGRALNIFTSNH

SEQ ID NO: 72487 - protein, 15 aa, Borrelia burgdorferi B31
KDVGRALNIFTSNHL

SEQ ID NO: 72488 - protein, 15 aa, Borrelia burgdorferi B31
DVGRALNIFTSNHLK

SEQ ID NO: 72489 - protein, 15 aa, Borrelia burgdorferi B31
VGRALNIFTSNHLKT

SEQ ID NO: 72490 - protein, 15 aa, Borrelia burgdorferi B31
GRALNIFTSNHLKTN

SEQ ID NO: 72491 - protein, 15 aa, Borrelia burgdorferi B31
RALNIFTSNHLKTNT

SEQ ID NO: 72492 - protein, 15 aa, Borrelia burgdorferi B31
ALNIFTSNHLKTNTF

SEQ ID NO: 72493 - protein, 15 aa, Borrelia burgdorferi B31
LNIFTSNHLKTNTFE

SEQ ID NO: 72494 - protein, 15 aa, Borrelia burgdorferi B31
NIFTSNHLKTNTFEG

SEQ ID NO: 72495 - protein, 15 aa, Borrelia burgdorferi B31
IFTSNHLKTNTFEGG

SEQ ID NO: 72496 - protein, 15 aa, Borrelia burgdorferi B31
FTSNHLKTNTFEGGK

SEQ ID NO: 72497 - protein, 15 aa, Borrelia burgdorferi B31
TSNHLKTNTFEGGKL

SEQ ID NO: 72498 - protein, 15 aa, Borrelia burgdorferi B31
SNHLKTNTFEGGKLI

SEQ ID NO: 72499 - protein, 15 aa, Borrelia burgdorferi B31
NHLKTNTFEGGKLIN

SEQ ID NO: 72500 - protein, 15 aa, Borrelia burgdorferi B31
HLKTNTFEGGKLINY

SEQ ID NO: 72501 - protein, 15 aa, Borrelia burgdorferi B31
LKTNTFEGGKLINYG

SEQ ID NO: 72502 - protein, 15 aa, Borrelia burgdorferi B31
KTNTFEGGKLINYGL

SEQ ID NO: 72503 - protein, 15 aa, Borrelia burgdorferi B31
TNTFEGGKLINYGLK

SEQ ID NO: 72504 - protein, 15 aa, Borrelia burgdorferi B31
NTFEGGKLINYGLKE

SEQ ID NO: 72505 - protein, 15 aa, Borrelia burgdorferi B31
TFEGGKLINYGLKEG

SEQ ID NO: 72506 - protein, 15 aa, Borrelia burgdorferi B31
FEGGKLINYGLKEGV

SEQ ID NO: 72507 - protein, 15 aa, Borrelia burgdorferi B31
EGGKLINYGLKEGVV

SEQ ID NO: 72508 - protein, 15 aa, Borrelia burgdorferi B31
GGKLINYGLKEGVVG

SEQ ID NO: 72509 - protein, 15 aa, Borrelia burgdorferi B31
GKLINYGLKEGVVGF

SEQ ID NO: 72510 - protein, 15 aa, Borrelia burgdorferi B31
KLINYGLKEGVVGFV

SEQ ID NO: 72511 - protein, 15 aa, Borrelia burgdorferi B31
LINYGLKEGVVGFVR

SEQ ID NO: 72512 - protein, 15 aa, Borrelia burgdorferi B31
INYGLKEGVVGFVRN

SEQ ID NO: 72513 - protein, 15 aa, Borrelia burgdorferi B31
NYGLKEGVVGFVRNP

SEQ ID NO: 72514 - protein, 15 aa, Borrelia burgdorferi B31
YGLKEGVVGFVRNPK

SEQ ID NO: 72515 - protein, 15 aa, Borrelia burgdorferi B31
GLKEGVVGFVRNPKM

SEQ ID NO: 72516 - protein, 15 aa, Borrelia burgdorferi B31
LKEGVVGFVRNPKMI

SEQ ID NO: 72517 - protein, 15 aa, Borrelia burgdorferi B31
KEGVVGFVRNPKMIS

SEQ ID NO: 72518 - protein, 15 aa, Borrelia burgdorferi B31
EGVVGFVRNPKMISF

SEQ ID NO: 72519 - protein, 15 aa, Borrelia burgdorferi B31
GVVGFVRNPKMISFE

SEQ ID NO: 72520 - protein, 15 aa, Borrelia burgdorferi B31
VVGFVRNPKMISFEL

SEQ ID NO: 72521 - protein, 15 aa, Borrelia burgdorferi B31
VGFVRNPKMISFELE

SEQ ID NO: 72522 - protein, 15 aa, Borrelia burgdorferi B31
GFVRNPKMISFELEK

SEQ ID NO: 72523 - protein, 15 aa, Borrelia burgdorferi B31
FVRNPKMISFELEKE

SEQ ID NO: 72524 - protein, 15 aa, Borrelia burgdorferi B31
VRNPKMISFELEKEI

SEQ ID NO: 72525 - protein, 15 aa, Borrelia burgdorferi B31
RNPKMISFELEKEID

SEQ ID NO: 72526 - protein, 15 aa, Borrelia burgdorferi B31
NPKMISFELEKEIDN

SEQ ID NO: 72527 - protein, 15 aa, Borrelia burgdorferi B31
PKMISFELEKEIDNL

SEQ ID NO: 72528 - protein, 15 aa, Borrelia burgdorferi B31
KMISFELEKEIDNLS

SEQ ID NO: 72529 - protein, 15 aa, Borrelia burgdorferi B31
MISFELEKEIDNLSS

SEQ ID NO: 72530 - protein, 15 aa, Borrelia burgdorferi B31
ISFELEKEIDNLSSK

SEQ ID NO: 72531 - protein, 15 aa, Borrelia burgdorferi B31
SFELEKEIDNLSSKI

SEQ ID NO: 72532 - protein, 15 aa, Borrelia burgdorferi B31
FELEKEIDNLSSKII

SEQ ID NO: 72533 - protein, 15 aa, Borrelia burgdorferi B31
ELEKEIDNLSSKIIN

SEQ ID NO: 72534 - protein, 15 aa, Borrelia burgdorferi B31
LEKEIDNLSSKIINK

SEQ ID NO: 72535 - protein, 15 aa, Borrelia burgdorferi B31
EKEIDNLSSKIINKE

SEQ ID NO: 72536 - protein, 15 aa, Borrelia burgdorferi B31
KEIDNLSSKIINKEI

SEQ ID NO: 72537 - protein, 15 aa, Borrelia burgdorferi B31
EIDNLSSKIINKEII

SEQ ID NO: 72538 - protein, 15 aa, Borrelia burgdorferi B31
IDNLSSKIINKEIIV

SEQ ID NO: 72539 - protein, 15 aa, Borrelia burgdorferi B31
DNLSSKIINKEIIVP

SEQ ID NO: 72540 - protein, 15 aa, Borrelia burgdorferi B31
NLSSKIINKEIIVPS

SEQ ID NO: 72541 - protein, 15 aa, Borrelia burgdorferi B31
LSSKIINKEIIVPSN

SEQ ID NO: 72542 - protein, 15 aa, Borrelia burgdorferi B31
SSKIINKEIIVPSNK

SEQ ID NO: 72543 - protein, 15 aa, Borrelia burgdorferi B31
SKIINKEIIVPSNKE

SEQ ID NO: 72544 - protein, 15 aa, Borrelia burgdorferi B31
KIINKEIIVPSNKES

SEQ ID NO: 72545 - protein, 15 aa, Borrelia burgdorferi B31
IINKEIIVPSNKESY

SEQ ID NO: 72546 - protein, 15 aa, Borrelia burgdorferi B31
INKEIIVPSNKESYE

SEQ ID NO: 72547 - protein, 15 aa, Borrelia burgdorferi B31
NKEIIVPSNKESYEK

SEQ ID NO: 72548 - protein, 15 aa, Borrelia burgdorferi B31
KEIIVPSNKESYEKF

SEQ ID NO: 72549 - protein, 15 aa, Borrelia burgdorferi B31
EIIVPSNKESYEKFL

SEQ ID NO: 72550 - protein, 15 aa, Borrelia burgdorferi B31
IIVPSNKESYEKFLK

SEQ ID NO: 72551 - protein, 15 aa, Borrelia burgdorferi B31
IVPSNKESYEKFLKE

SEQ ID NO: 72552 - protein, 15 aa, Borrelia burgdorferi B31
VPSNKESYEKFLKEF

SEQ ID NO: 72553 - protein, 15 aa, Borrelia burgdorferi B31
PSNKESYEKFLKEFI

SEQ ID NO: 72554 - protein, 16 aa, Borrelia burgdorferi B31
MNKILLLILLESIVFL

SEQ ID NO: 72555 - protein, 16 aa, Borrelia burgdorferi B31
NKILLLILLESIVFLS

SEQ ID NO: 72556 - protein, 16 aa, Borrelia burgdorferi B31
KILLLILLESIVFLSC

SEQ ID NO: 72557 - protein, 16 aa, Borrelia burgdorferi B31
ILLLILLESIVFLSCS

SEQ ID NO: 72558 - protein, 16 aa, Borrelia burgdorferi B31
LLLILLESIVFLSCSG

SEQ ID NO: 72559 - protein, 16 aa, Borrelia burgdorferi B31
LLILLESIVFLSCSGK

SEQ ID NO: 72560 - protein, 16 aa, Borrelia burgdorferi B31
LILLESIVFLSCSGKG

SEQ ID NO: 72561 - protein, 16 aa, Borrelia burgdorferi B31
ILLESIVFLSCSGKGS

SEQ ID NO: 72562 - protein, 16 aa, Borrelia burgdorferi B31
LLESIVFLSCSGKGSL

SEQ ID NO: 72563 - protein, 16 aa, Borrelia burgdorferi B31
LESIVFLSCSGKGSLG

SEQ ID NO: 72564 - protein, 16 aa, Borrelia burgdorferi B31
ESIVFLSCSGKGSLGS

SEQ ID NO: 72565 - protein, 16 aa, Borrelia burgdorferi B31
SIVFLSCSGKGSLGSE

SEQ ID NO: 72566 - protein, 16 aa, Borrelia burgdorferi B31
IVFLSCSGKGSLGSEI

SEQ ID NO: 72567 - protein, 16 aa, Borrelia burgdorferi B31
VFLSCSGKGSLGSEIP

SEQ ID NO: 72568 - protein, 16 aa, Borrelia burgdorferi B31
FLSCSGKGSLGSEIPK

SEQ ID NO: 72569 - protein, 16 aa, Borrelia burgdorferi B31
LSCSGKGSLGSEIPKV

SEQ ID NO: 72570 - protein, 16 aa, Borrelia burgdorferi B31
SCSGKGSLGSEIPKVS

SEQ ID NO: 72571 - protein, 16 aa, Borrelia burgdorferi B31
CSGKGSLGSEIPKVSL

SEQ ID NO: 72572 - protein, 16 aa, Borrelia burgdorferi B31
SGKGSLGSEIPKVSLI

SEQ ID NO: 72573 - protein, 16 aa, Borrelia burgdorferi B31
GKGSLGSEIPKVSLII

SEQ ID NO: 72574 - protein, 16 aa, Borrelia burgdorferi B31
KGSLGSEIPKVSLIID

SEQ ID NO: 72575 - protein, 16 aa, Borrelia burgdorferi B31
GSLGSEIPKVSLIIDG

SEQ ID NO: 72576 - protein, 16 aa, Borrelia burgdorferi B31
SLGSEIPKVSLIIDGT

SEQ ID NO: 72577 - protein, 16 aa, Borrelia burgdorferi B31
LGSEIPKVSLIIDGTF

SEQ ID NO: 72578 - protein, 16 aa, Borrelia burgdorferi B31
GSEIPKVSLIIDGTFD

SEQ ID NO: 72579 - protein, 16 aa, Borrelia burgdorferi B31
SEIPKVSLIIDGTFDD

SEQ ID NO: 72580 - protein, 16 aa, Borrelia burgdorferi B31
EIPKVSLIIDGTFDDK

SEQ ID NO: 72581 - protein, 16 aa, Borrelia burgdorferi B31
IPKVSLIIDGTFDDKS

SEQ ID NO: 72582 - protein, 16 aa, Borrelia burgdorferi B31
PKVSLIIDGTFDDKSF

SEQ ID NO: 72583 - protein, 16 aa, Borrelia burgdorferi B31
KVSLIIDGTFDDKSFN

SEQ ID NO: 72584 - protein, 16 aa, Borrelia burgdorferi B31
VSLIIDGTFDDKSFNE

SEQ ID NO: 72585 - protein, 16 aa, Borrelia burgdorferi B31
SLIIDGTFDDKSFNES

SEQ ID NO: 72586 - protein, 16 aa, Borrelia burgdorferi B31
LIIDGTFDDKSFNESA

SEQ ID NO: 72587 - protein, 16 aa, Borrelia burgdorferi B31
IIDGTFDDKSFNESAL

SEQ ID NO: 72588 - protein, 16 aa, Borrelia burgdorferi B31
IDGTFDDKSFNESALN

SEQ ID NO: 72589 - protein, 16 aa, Borrelia burgdorferi B31
DGTFDDKSFNESALNG

SEQ ID NO: 72590 - protein, 16 aa, Borrelia burgdorferi B31
GTFDDKSFNESALNGV

SEQ ID NO: 72591 - protein, 16 aa, Borrelia burgdorferi B31
TFDDKSFNESALNGVK

SEQ ID NO: 72592 - protein, 16 aa, Borrelia burgdorferi B31
FDDKSFNESALNGVKK

SEQ ID NO: 72593 - protein, 16 aa, Borrelia burgdorferi B31
DDKSFNESALNGVKKV

SEQ ID NO: 72594 - protein, 16 aa, Borrelia burgdorferi B31
DKSFNESALNGVKKVK

SEQ ID NO: 72595 - protein, 16 aa, Borrelia burgdorferi B31
KSFNESALNGVKKVKE

SEQ ID NO: 72596 - protein, 16 aa, Borrelia burgdorferi B31
SFNESALNGVKKVKEE

SEQ ID NO: 72597 - protein, 16 aa, Borrelia burgdorferi B31
FNESALNGVKKVKEEF

SEQ ID NO: 72598 - protein, 16 aa, Borrelia burgdorferi B31
NESALNGVKKVKEEFK

SEQ ID NO: 72599 - protein, 16 aa, Borrelia burgdorferi B31
ESALNGVKKVKEEFKI

SEQ ID NO: 72600 - protein, 16 aa, Borrelia burgdorferi B31
SALNGVKKVKEEFKIE

SEQ ID NO: 72601 - protein, 16 aa, Borrelia burgdorferi B31
ALNGVKKVKEEFKIEL

SEQ ID NO: 72602 - protein, 16 aa, Borrelia burgdorferi B31
LNGVKKVKEEFKIELV

SEQ ID NO: 72603 - protein, 16 aa, Borrelia burgdorferi B31
NGVKKVKEEFKIELVL

SEQ ID NO: 72604 - protein, 16 aa, Borrelia burgdorferi B31
GVKKVKEEFKIELVLK

SEQ ID NO: 72605 - protein, 16 aa, Borrelia burgdorferi B31
VKKVKEEFKIELVLKE

SEQ ID NO: 72606 - protein, 16 aa, Borrelia burgdorferi B31
KKVKEEFKIELVLKES

SEQ ID NO: 72607 - protein, 16 aa, Borrelia burgdorferi B31
KVKEEFKIELVLKESS

SEQ ID NO: 72608 - protein, 16 aa, Borrelia burgdorferi B31
VKEEFKIELVLKESSS

SEQ ID NO: 72609 - protein, 16 aa, Borrelia burgdorferi B31
KEEFKIELVLKESSSN

SEQ ID NO: 72610 - protein, 16 aa, Borrelia burgdorferi B31
EEFKIELVLKESSSNS

SEQ ID NO: 72611 - protein, 16 aa, Borrelia burgdorferi B31
EFKIELVLKESSSNSY

SEQ ID NO: 72612 - protein, 16 aa, Borrelia burgdorferi B31
FKIELVLKESSSNSYL

SEQ ID NO: 72613 - protein, 16 aa, Borrelia burgdorferi B31
KIELVLKESSSNSYLS

SEQ ID NO: 72614 - protein, 16 aa, Borrelia burgdorferi B31
IELVLKESSSNSYLSD

SEQ ID NO: 72615 - protein, 16 aa, Borrelia burgdorferi B31
ELVLKESSSNSYLSDL

SEQ ID NO: 72616 - protein, 16 aa, Borrelia burgdorferi B31
LVLKESSSNSYLSDLE

SEQ ID NO: 72617 - protein, 16 aa, Borrelia burgdorferi B31
VLKESSSNSYLSDLEG

SEQ ID NO: 72618 - protein, 16 aa, Borrelia burgdorferi B31
LKESSSNSYLSDLEGL

SEQ ID NO: 72619 - protein, 16 aa, Borrelia burgdorferi B31
KESSSNSYLSDLEGLK

SEQ ID NO: 72620 - protein, 16 aa, Borrelia burgdorferi B31
ESSSNSYLSDLEGLKD

SEQ ID NO: 72621 - protein, 16 aa, Borrelia burgdorferi B31
SSSNSYLSDLEGLKDA

SEQ ID NO: 72622 - protein, 16 aa, Borrelia burgdorferi B31
SSNSYLSDLEGLKDAG

SEQ ID NO: 72623 - protein, 16 aa, Borrelia burgdorferi B31
SNSYLSDLEGLKDAGS

SEQ ID NO: 72624 - protein, 16 aa, Borrelia burgdorferi B31
NSYLSDLEGLKDAGSD

SEQ ID NO: 72625 - protein, 16 aa, Borrelia burgdorferi B31
SYLSDLEGLKDAGSDL

SEQ ID NO: 72626 - protein, 16 aa, Borrelia burgdorferi B31
YLSDLEGLKDAGSDLI

SEQ ID NO: 72627 - protein, 16 aa, Borrelia burgdorferi B31
LSDLEGLKDAGSDLIW

SEQ ID NO: 72628 - protein, 16 aa, Borrelia burgdorferi B31
SDLEGLKDAGSDLIWL

SEQ ID NO: 72629 - protein, 16 aa, Borrelia burgdorferi B31
DLEGLKDAGSDLIWLI

SEQ ID NO: 72630 - protein, 16 aa, Borrelia burgdorferi B31
LEGLKDAGSDLIWLIG

SEQ ID NO: 72631 - protein, 16 aa, Borrelia burgdorferi B31
EGLKDAGSDLIWLIGY

SEQ ID NO: 72632 - protein, 16 aa, Borrelia burgdorferi B31
GLKDAGSDLIWLIGYR

SEQ ID NO: 72633 - protein, 16 aa, Borrelia burgdorferi B31
LKDAGSDLIWLIGYRF

SEQ ID NO: 72634 - protein, 16 aa, Borrelia burgdorferi B31
KDAGSDLIWLIGYRFS

SEQ ID NO: 72635 - protein, 16 aa, Borrelia burgdorferi B31
DAGSDLIWLIGYRFSD

SEQ ID NO: 72636 - protein, 16 aa, Borrelia burgdorferi B31
AGSDLIWLIGYRFSDV

SEQ ID NO: 72637 - protein, 16 aa, Borrelia burgdorferi B31
GSDLIWLIGYRFSDVA

SEQ ID NO: 72638 - protein, 16 aa, Borrelia burgdorferi B31
SDLIWLIGYRFSDVAK

SEQ ID NO: 72639 - protein, 16 aa, Borrelia burgdorferi B31
DLIWLIGYRFSDVAKV

SEQ ID NO: 72640 - protein, 16 aa, Borrelia burgdorferi B31
LIWLIGYRFSDVAKVA

SEQ ID NO: 72641 - protein, 16 aa, Borrelia burgdorferi B31
IWLIGYRFSDVAKVAA

SEQ ID NO: 72642 - protein, 16 aa, Borrelia burgdorferi B31
WLIGYRFSDVAKVAAL

SEQ ID NO: 72643 - protein, 16 aa, Borrelia burgdorferi B31
LIGYRFSDVAKVAALQ

SEQ ID NO: 72644 - protein, 16 aa, Borrelia burgdorferi B31
IGYRFSDVAKVAALQN

SEQ ID NO: 72645 - protein, 16 aa, Borrelia burgdorferi B31
GYRFSDVAKVAALQNP

SEQ ID NO: 72646 - protein, 16 aa, Borrelia burgdorferi B31
YRFSDVAKVAALQNPD

SEQ ID NO: 72647 - protein, 16 aa, Borrelia burgdorferi B31
RFSDVAKVAALQNPDM

SEQ ID NO: 72648 - protein, 16 aa, Borrelia burgdorferi B31
FSDVAKVAALQNPDMK

SEQ ID NO: 72649 - protein, 16 aa, Borrelia burgdorferi B31
SDVAKVAALQNPDMKY

SEQ ID NO: 72650 - protein, 16 aa, Borrelia burgdorferi B31
DVAKVAALQNPDMKYA

SEQ ID NO: 72651 - protein, 16 aa, Borrelia burgdorferi B31
VAKVAALQNPDMKYAI

SEQ ID NO: 72652 - protein, 16 aa, Borrelia burgdorferi B31
AKVAALQNPDMKYAII

SEQ ID NO: 72653 - protein, 16 aa, Borrelia burgdorferi B31
KVAALQNPDMKYAIID

SEQ ID NO: 72654 - protein, 16 aa, Borrelia burgdorferi B31
VAALQNPDMKYAIIDP

SEQ ID NO: 72655 - protein, 16 aa, Borrelia burgdorferi B31
AALQNPDMKYAIIDPI

SEQ ID NO: 72656 - protein, 16 aa, Borrelia burgdorferi B31
ALQNPDMKYAIIDPIY

SEQ ID NO: 72657 - protein, 16 aa, Borrelia burgdorferi B31
LQNPDMKYAIIDPIYS

SEQ ID NO: 72658 - protein, 16 aa, Borrelia burgdorferi B31
QNPDMKYAIIDPIYSN

SEQ ID NO: 72659 - protein, 16 aa, Borrelia burgdorferi B31
NPDMKYAIIDPIYSND

SEQ ID NO: 72660 - protein, 16 aa, Borrelia burgdorferi B31
PDMKYAIIDPIYSNDP

SEQ ID NO: 72661 - protein, 16 aa, Borrelia burgdorferi B31
DMKYAIIDPIYSNDPI

SEQ ID NO: 72662 - protein, 16 aa, Borrelia burgdorferi B31
MKYAIIDPIYSNDPIP

SEQ ID NO: 72663 - protein, 16 aa, Borrelia burgdorferi B31
KYAIIDPIYSNDPIPA

SEQ ID NO: 72664 - protein, 16 aa, Borrelia burgdorferi B31
YAIIDPIYSNDPIPAN

SEQ ID NO: 72665 - protein, 16 aa, Borrelia burgdorferi B31
AIIDPIYSNDPIPANL

SEQ ID NO: 72666 - protein, 16 aa, Borrelia burgdorferi B31
IIDPIYSNDPIPANLV

SEQ ID NO: 72667 - protein, 16 aa, Borrelia burgdorferi B31
IDPIYSNDPIPANLVG

SEQ ID NO: 72668 - protein, 16 aa, Borrelia burgdorferi B31
DPIYSNDPIPANLVGM

SEQ ID NO: 72669 - protein, 16 aa, Borrelia burgdorferi B31
PIYSNDPIPANLVGMT

SEQ ID NO: 72670 - protein, 16 aa, Borrelia burgdorferi B31
IYSNDPIPANLVGMTF

SEQ ID NO: 72671 - protein, 16 aa, Borrelia burgdorferi B31
YSNDPIPANLVGMTFR

SEQ ID NO: 72672 - protein, 16 aa, Borrelia burgdorferi B31
SNDPIPANLVGMTFRA

SEQ ID NO: 72673 - protein, 16 aa, Borrelia burgdorferi B31
NDPIPANLVGMTFRAQ

SEQ ID NO: 72674 - protein, 16 aa, Borrelia burgdorferi B31
DPIPANLVGMTFRAQE

SEQ ID NO: 72675 - protein, 16 aa, Borrelia burgdorferi B31
PIPANLVGMTFRAQEG

SEQ ID NO: 72676 - protein, 16 aa, Borrelia burgdorferi B31
IPANLVGMTFRAQEGA

SEQ ID NO: 72677 - protein, 16 aa, Borrelia burgdorferi B31
PANLVGMTFRAQEGAF

SEQ ID NO: 72678 - protein, 16 aa, Borrelia burgdorferi B31
ANLVGMTFRAQEGAFL

SEQ ID NO: 72679 - protein, 16 aa, Borrelia burgdorferi B31
NLVGMTFRAQEGAFLT

SEQ ID NO: 72680 - protein, 16 aa, Borrelia burgdorferi B31
LVGMTFRAQEGAFLTG

SEQ ID NO: 72681 - protein, 16 aa, Borrelia burgdorferi B31
VGMTFRAQEGAFLTGY

SEQ ID NO: 72682 - protein, 16 aa, Borrelia burgdorferi B31
GMTFRAQEGAFLTGYI

SEQ ID NO: 72683 - protein, 16 aa, Borrelia burgdorferi B31
MTFRAQEGAFLTGYIA

SEQ ID NO: 72684 - protein, 16 aa, Borrelia burgdorferi B31
TFRAQEGAFLTGYIAA

SEQ ID NO: 72685 - protein, 16 aa, Borrelia burgdorferi B31
FRAQEGAFLTGYIAAK

SEQ ID NO: 72686 - protein, 16 aa, Borrelia burgdorferi B31
RAQEGAFLTGYIAAKL

SEQ ID NO: 72687 - protein, 16 aa, Borrelia burgdorferi B31
AQEGAFLTGYIAAKLS

SEQ ID NO: 72688 - protein, 16 aa, Borrelia burgdorferi B31
QEGAFLTGYIAAKLSK

SEQ ID NO: 72689 - protein, 16 aa, Borrelia burgdorferi B31
EGAFLTGYIAAKLSKT

SEQ ID NO: 72690 - protein, 16 aa, Borrelia burgdorferi B31
GAFLTGYIAAKLSKTG

SEQ ID NO: 72691 - protein, 16 aa, Borrelia burgdorferi B31
AFLTGYIAAKLSKTGK

SEQ ID NO: 72692 - protein, 16 aa, Borrelia burgdorferi B31
FLTGYIAAKLSKTGKI

SEQ ID NO: 72693 - protein, 16 aa, Borrelia burgdorferi B31
LTGYIAAKLSKTGKIG

SEQ ID NO: 72694 - protein, 16 aa, Borrelia burgdorferi B31
TGYIAAKLSKTGKIGF

SEQ ID NO: 72695 - protein, 16 aa, Borrelia burgdorferi B31
GYIAAKLSKTGKIGFL

SEQ ID NO: 72696 - protein, 16 aa, Borrelia burgdorferi B31
YIAAKLSKTGKIGFLG

SEQ ID NO: 72697 - protein, 16 aa, Borrelia burgdorferi B31
IAAKLSKTGKIGFLGG

SEQ ID NO: 72698 - protein, 16 aa, Borrelia burgdorferi B31
AAKLSKTGKIGFLGGI

SEQ ID NO: 72699 - protein, 16 aa, Borrelia burgdorferi B31
AKLSKTGKIGFLGGIE

SEQ ID NO: 72700 - protein, 16 aa, Borrelia burgdorferi B31
KLSKTGKIGFLGGIEG

SEQ ID NO: 72701 - protein, 16 aa, Borrelia burgdorferi B31
LSKTGKIGFLGGIEGE

SEQ ID NO: 72702 - protein, 16 aa, Borrelia burgdorferi B31
SKTGKIGFLGGIEGEI

SEQ ID NO: 72703 - protein, 16 aa, Borrelia burgdorferi B31
KTGKIGFLGGIEGEIV

SEQ ID NO: 72704 - protein, 16 aa, Borrelia burgdorferi B31
TGKIGFLGGIEGEIVD

SEQ ID NO: 72705 - protein, 16 aa, Borrelia burgdorferi B31
GKIGFLGGIEGEIVDA

SEQ ID NO: 72706 - protein, 16 aa, Borrelia burgdorferi B31
KIGFLGGIEGEIVDAF

SEQ ID NO: 72707 - protein, 16 aa, Borrelia burgdorferi B31
IGFLGGIEGEIVDAFR

SEQ ID NO: 72708 - protein, 16 aa, Borrelia burgdorferi B31
GFLGGIEGEIVDAFRY

SEQ ID NO: 72709 - protein, 16 aa, Borrelia burgdorferi B31
FLGGIEGEIVDAFRYG

SEQ ID NO: 72710 - protein, 16 aa, Borrelia burgdorferi B31
LGGIEGEIVDAFRYGY

SEQ ID NO: 72711 - protein, 16 aa, Borrelia burgdorferi B31
GGIEGEIVDAFRYGYE

SEQ ID NO: 72712 - protein, 16 aa, Borrelia burgdorferi B31
GIEGEIVDAFRYGYEA

SEQ ID NO: 72713 - protein, 16 aa, Borrelia burgdorferi B31
IEGEIVDAFRYGYEAG

SEQ ID NO: 72714 - protein, 16 aa, Borrelia burgdorferi B31
EGEIVDAFRYGYEAGA

SEQ ID NO: 72715 - protein, 16 aa, Borrelia burgdorferi B31
GEIVDAFRYGYEAGAK

SEQ ID NO: 72716 - protein, 16 aa, Borrelia burgdorferi B31
EIVDAFRYGYEAGAKY

SEQ ID NO: 72717 - protein, 16 aa, Borrelia burgdorferi B31
IVDAFRYGYEAGAKYA

SEQ ID NO: 72718 - protein, 16 aa, Borrelia burgdorferi B31
VDAFRYGYEAGAKYAN

SEQ ID NO: 72719 - protein, 16 aa, Borrelia burgdorferi B31
DAFRYGYEAGAKYANK

SEQ ID NO: 72720 - protein, 16 aa, Borrelia burgdorferi B31
AFRYGYEAGAKYANKD

SEQ ID NO: 72721 - protein, 16 aa, Borrelia burgdorferi B31
FRYGYEAGAKYANKDI

SEQ ID NO: 72722 - protein, 16 aa, Borrelia burgdorferi B31
RYGYEAGAKYANKDIK

SEQ ID NO: 72723 - protein, 16 aa, Borrelia burgdorferi B31
YGYEAGAKYANKDIKI

SEQ ID NO: 72724 - protein, 16 aa, Borrelia burgdorferi B31
GYEAGAKYANKDIKIS

SEQ ID NO: 72725 - protein, 16 aa, Borrelia burgdorferi B31
YEAGAKYANKDIKIST

SEQ ID NO: 72726 - protein, 16 aa, Borrelia burgdorferi B31
EAGAKYANKDIKISTQ

SEQ ID NO: 72727 - protein, 16 aa, Borrelia burgdorferi B31
AGAKYANKDIKISTQY

SEQ ID NO: 72728 - protein, 16 aa, Borrelia burgdorferi B31
GAKYANKDIKISTQYI

SEQ ID NO: 72729 - protein, 16 aa, Borrelia burgdorferi B31
AKYANKDIKISTQYIG

SEQ ID NO: 72730 - protein, 16 aa, Borrelia burgdorferi B31
KYANKDIKISTQYIGS

SEQ ID NO: 72731 - protein, 16 aa, Borrelia burgdorferi B31
YANKDIKISTQYIGSF

SEQ ID NO: 72732 - protein, 16 aa, Borrelia burgdorferi B31
ANKDIKISTQYIGSFA

SEQ ID NO: 72733 - protein, 16 aa, Borrelia burgdorferi B31
NKDIKISTQYIGSFAD

SEQ ID NO: 72734 - protein, 16 aa, Borrelia burgdorferi B31
KDIKISTQYIGSFADL

SEQ ID NO: 72735 - protein, 16 aa, Borrelia burgdorferi B31
DIKISTQYIGSFADLE

SEQ ID NO: 72736 - protein, 16 aa, Borrelia burgdorferi B31
IKISTQYIGSFADLEA

SEQ ID NO: 72737 - protein, 16 aa, Borrelia burgdorferi B31
KISTQYIGSFADLEAG

SEQ ID NO: 72738 - protein, 16 aa, Borrelia burgdorferi B31
ISTQYIGSFADLEAGR

SEQ ID NO: 72739 - protein, 16 aa, Borrelia burgdorferi B31
STQYIGSFADLEAGRS

SEQ ID NO: 72740 - protein, 16 aa, Borrelia burgdorferi B31
TQYIGSFADLEAGRSV

SEQ ID NO: 72741 - protein, 16 aa, Borrelia burgdorferi B31
QYIGSFADLEAGRSVA

SEQ ID NO: 72742 - protein, 16 aa, Borrelia burgdorferi B31
YIGSFADLEAGRSVAT

SEQ ID NO: 72743 - protein, 16 aa, Borrelia burgdorferi B31
IGSFADLEAGRSVATR

SEQ ID NO: 72744 - protein, 16 aa, Borrelia burgdorferi B31
GSFADLEAGRSVATRM

SEQ ID NO: 72745 - protein, 16 aa, Borrelia burgdorferi B31
SFADLEAGRSVATRMY

SEQ ID NO: 72746 - protein, 16 aa, Borrelia burgdorferi B31
FADLEAGRSVATRMYS

SEQ ID NO: 72747 - protein, 16 aa, Borrelia burgdorferi B31
ADLEAGRSVATRMYSD

SEQ ID NO: 72748 - protein, 16 aa, Borrelia burgdorferi B31
DLEAGRSVATRMYSDE

SEQ ID NO: 72749 - protein, 16 aa, Borrelia burgdorferi B31
LEAGRSVATRMYSDEI

SEQ ID NO: 72750 - protein, 16 aa, Borrelia burgdorferi B31
EAGRSVATRMYSDEID

SEQ ID NO: 72751 - protein, 16 aa, Borrelia burgdorferi B31
AGRSVATRMYSDEIDI

SEQ ID NO: 72752 - protein, 16 aa, Borrelia burgdorferi B31
GRSVATRMYSDEIDII

SEQ ID NO: 72753 - protein, 16 aa, Borrelia burgdorferi B31
RSVATRMYSDEIDIIH

SEQ ID NO: 72754 - protein, 16 aa, Borrelia burgdorferi B31
SVATRMYSDEIDIIHH

SEQ ID NO: 72755 - protein, 16 aa, Borrelia burgdorferi B31
VATRMYSDEIDIIHHA

SEQ ID NO: 72756 - protein, 16 aa, Borrelia burgdorferi B31
ATRMYSDEIDIIHHAA

SEQ ID NO: 72757 - protein, 16 aa, Borrelia burgdorferi B31
TRMYSDEIDIIHHAAG

SEQ ID NO: 72758 - protein, 16 aa, Borrelia burgdorferi B31
RMYSDEIDIIHHAAGL

SEQ ID NO: 72759 - protein, 16 aa, Borrelia burgdorferi B31
MYSDEIDIIHHAAGLG

SEQ ID NO: 72760 - protein, 16 aa, Borrelia burgdorferi B31
YSDEIDIIHHAAGLGG

SEQ ID NO: 72761 - protein, 16 aa, Borrelia burgdorferi B31
SDEIDIIHHAAGLGGI

SEQ ID NO: 72762 - protein, 16 aa, Borrelia burgdorferi B31
DEIDIIHHAAGLGGIG

SEQ ID NO: 72763 - protein, 16 aa, Borrelia burgdorferi B31
EIDIIHHAAGLGGIGA

SEQ ID NO: 72764 - protein, 16 aa, Borrelia burgdorferi B31
IDIIHHAAGLGGIGAI

SEQ ID NO: 72765 - protein, 16 aa, Borrelia burgdorferi B31
DIIHHAAGLGGIGAIE

SEQ ID NO: 72766 - protein, 16 aa, Borrelia burgdorferi B31
IIHHAAGLGGIGAIEV

SEQ ID NO: 72767 - protein, 16 aa, Borrelia burgdorferi B31
IHHAAGLGGIGAIEVA

SEQ ID NO: 72768 - protein, 16 aa, Borrelia burgdorferi B31
HHAAGLGGIGAIEVAK

SEQ ID NO: 72769 - protein, 16 aa, Borrelia burgdorferi B31
HAAGLGGIGAIEVAKE

SEQ ID NO: 72770 - protein, 16 aa, Borrelia burgdorferi B31
AAGLGGIGAIEVAKEL

SEQ ID NO: 72771 - protein, 16 aa, Borrelia burgdorferi B31
AGLGGIGAIEVAKELG

SEQ ID NO: 72772 - protein, 16 aa, Borrelia burgdorferi B31
GLGGIGAIEVAKELGS

SEQ ID NO: 72773 - protein, 16 aa, Borrelia burgdorferi B31
LGGIGAIEVAKELGSG

SEQ ID NO: 72774 - protein, 16 aa, Borrelia burgdorferi B31
GGIGAIEVAKELGSGH

SEQ ID NO: 72775 - protein, 16 aa, Borrelia burgdorferi B31
GIGAIEVAKELGSGHY

SEQ ID NO: 72776 - protein, 16 aa, Borrelia burgdorferi B31
IGAIEVAKELGSGHYI

SEQ ID NO: 72777 - protein, 16 aa, Borrelia burgdorferi B31
GAIEVAKELGSGHYII

SEQ ID NO: 72778 - protein, 16 aa, Borrelia burgdorferi B31
AIEVAKELGSGHYIIG

SEQ ID NO: 72779 - protein, 16 aa, Borrelia burgdorferi B31
IEVAKELGSGHYIIGV

SEQ ID NO: 72780 - protein, 16 aa, Borrelia burgdorferi B31
EVAKELGSGHYIIGVD

SEQ ID NO: 72781 - protein, 16 aa, Borrelia burgdorferi B31
VAKELGSGHYIIGVDE

SEQ ID NO: 72782 - protein, 16 aa, Borrelia burgdorferi B31
AKELGSGHYIIGVDED

SEQ ID NO: 72783 - protein, 16 aa, Borrelia burgdorferi B31
KELGSGHYIIGVDEDQ

SEQ ID NO: 72784 - protein, 16 aa, Borrelia burgdorferi B31
ELGSGHYIIGVDEDQA

SEQ ID NO: 72785 - protein, 16 aa, Borrelia burgdorferi B31
LGSGHYIIGVDEDQAY

SEQ ID NO: 72786 - protein, 16 aa, Borrelia burgdorferi B31
GSGHYIIGVDEDQAYL

SEQ ID NO: 72787 - protein, 16 aa, Borrelia burgdorferi B31
SGHYIIGVDEDQAYLA

SEQ ID NO: 72788 - protein, 16 aa, Borrelia burgdorferi B31
GHYIIGVDEDQAYLAP

SEQ ID NO: 72789 - protein, 16 aa, Borrelia burgdorferi B31
HYIIGVDEDQAYLAPD

SEQ ID NO: 72790 - protein, 16 aa, Borrelia burgdorferi B31
YIIGVDEDQAYLAPDN

SEQ ID NO: 72791 - protein, 16 aa, Borrelia burgdorferi B31
IIGVDEDQAYLAPDNV

SEQ ID NO: 72792 - protein, 16 aa, Borrelia burgdorferi B31
IGVDEDQAYLAPDNVI

SEQ ID NO: 72793 - protein, 16 aa, Borrelia burgdorferi B31
GVDEDQAYLAPDNVIT

SEQ ID NO: 72794 - protein, 16 aa, Borrelia burgdorferi B31
VDEDQAYLAPDNVITS

SEQ ID NO: 72795 - protein, 16 aa, Borrelia burgdorferi B31
DEDQAYLAPDNVITST

SEQ ID NO: 72796 - protein, 16 aa, Borrelia burgdorferi B31
EDQAYLAPDNVITSTT

SEQ ID NO: 72797 - protein, 16 aa, Borrelia burgdorferi B31
DQAYLAPDNVITSTTK

SEQ ID NO: 72798 - protein, 16 aa, Borrelia burgdorferi B31
QAYLAPDNVITSTTKD

SEQ ID NO: 72799 - protein, 16 aa, Borrelia burgdorferi B31
AYLAPDNVITSTTKDV

SEQ ID NO: 72800 - protein, 16 aa, Borrelia burgdorferi B31
YLAPDNVITSTTKDVG

SEQ ID NO: 72801 - protein, 16 aa, Borrelia burgdorferi B31
LAPDNVITSTTKDVGR

SEQ ID NO: 72802 - protein, 16 aa, Borrelia burgdorferi B31
APDNVITSTTKDVGRA

SEQ ID NO: 72803 - protein, 16 aa, Borrelia burgdorferi B31
PDNVITSTTKDVGRAL

SEQ ID NO: 72804 - protein, 16 aa, Borrelia burgdorferi B31
DNVITSTTKDVGRALN

SEQ ID NO: 72805 - protein, 16 aa, Borrelia burgdorferi B31
NVITSTTKDVGRALNI

SEQ ID NO: 72806 - protein, 16 aa, Borrelia burgdorferi B31
VITSTTKDVGRALNIF

SEQ ID NO: 72807 - protein, 16 aa, Borrelia burgdorferi B31
ITSTTKDVGRALNIFT

SEQ ID NO: 72808 - protein, 16 aa, Borrelia burgdorferi B31
TSTTKDVGRALNIFTS

SEQ ID NO: 72809 - protein, 16 aa, Borrelia burgdorferi B31
STTKDVGRALNIFTSN

SEQ ID NO: 72810 - protein, 16 aa, Borrelia burgdorferi B31
TTKDVGRALNIFTSNH

SEQ ID NO: 72811 - protein, 16 aa, Borrelia burgdorferi B31
TKDVGRALNIFTSNHL

SEQ ID NO: 72812 - protein, 16 aa, Borrelia burgdorferi B31
KDVGRALNIFTSNHLK

SEQ ID NO: 72813 - protein, 16 aa, Borrelia burgdorferi B31
DVGRALNIFTSNHLKT

SEQ ID NO: 72814 - protein, 16 aa, Borrelia burgdorferi B31
VGRALNIFTSNHLKTN

SEQ ID NO: 72815 - protein, 16 aa, Borrelia burgdorferi B31
GRALNIFTSNHLKTNT

SEQ ID NO: 72816 - protein, 16 aa, Borrelia burgdorferi B31
RALNIFTSNHLKTNTF

SEQ ID NO: 72817 - protein, 16 aa, Borrelia burgdorferi B31
ALNIFTSNHLKTNTFE

SEQ ID NO: 72818 - protein, 16 aa, Borrelia burgdorferi B31
LNIFTSNHLKTNTFEG

SEQ ID NO: 72819 - protein, 16 aa, Borrelia burgdorferi B31
NIFTSNHLKTNTFEGG

SEQ ID NO: 72820 - protein, 16 aa, Borrelia burgdorferi B31
IFTSNHLKTNTFEGGK

SEQ ID NO: 72821 - protein, 16 aa, Borrelia burgdorferi B31
FTSNHLKTNTFEGGKL

SEQ ID NO: 72822 - protein, 16 aa, Borrelia burgdorferi B31
TSNHLKTNTFEGGKLI

SEQ ID NO: 72823 - protein, 16 aa, Borrelia burgdorferi B31
SNHLKTNTFEGGKLIN

SEQ ID NO: 72824 - protein, 16 aa, Borrelia burgdorferi B31
NHLKTNTFEGGKLINY

SEQ ID NO: 72825 - protein, 16 aa, Borrelia burgdorferi B31
HLKTNTFEGGKLINYG

SEQ ID NO: 72826 - protein, 16 aa, Borrelia burgdorferi B31
LKTNTFEGGKLINYGL

SEQ ID NO: 72827 - protein, 16 aa, Borrelia burgdorferi B31
KTNTFEGGKLINYGLK

SEQ ID NO: 72828 - protein, 16 aa, Borrelia burgdorferi B31
TNTFEGGKLINYGLKE

SEQ ID NO: 72829 - protein, 16 aa, Borrelia burgdorferi B31
NTFEGGKLINYGLKEG

SEQ ID NO: 72830 - protein, 16 aa, Borrelia burgdorferi B31
TFEGGKLINYGLKEGV

SEQ ID NO: 72831 - protein, 16 aa, Borrelia burgdorferi B31
FEGGKLINYGLKEGVV

SEQ ID NO: 72832 - protein, 16 aa, Borrelia burgdorferi B31
EGGKLINYGLKEGVVG

SEQ ID NO: 72833 - protein, 16 aa, Borrelia burgdorferi B31
GGKLINYGLKEGVVGF

SEQ ID NO: 72834 - protein, 16 aa, Borrelia burgdorferi B31
GKLINYGLKEGVVGFV

SEQ ID NO: 72835 - protein, 16 aa, Borrelia burgdorferi B31
KLINYGLKEGVVGFVR

SEQ ID NO: 72836 - protein, 16 aa, Borrelia burgdorferi B31
LINYGLKEGVVGFVRN

SEQ ID NO: 72837 - protein, 16 aa, Borrelia burgdorferi B31
INYGLKEGVVGFVRNP

SEQ ID NO: 72838 - protein, 16 aa, Borrelia burgdorferi B31
NYGLKEGVVGFVRNPK

SEQ ID NO: 72839 - protein, 16 aa, Borrelia burgdorferi B31
YGLKEGVVGFVRNPKM

SEQ ID NO: 72840 - protein, 16 aa, Borrelia burgdorferi B31
GLKEGVVGFVRNPKMI

SEQ ID NO: 72841 - protein, 16 aa, Borrelia burgdorferi B31
LKEGVVGFVRNPKMIS

SEQ ID NO: 72842 - protein, 16 aa, Borrelia burgdorferi B31
KEGVVGFVRNPKMISF

SEQ ID NO: 72843 - protein, 16 aa, Borrelia burgdorferi B31
EGVVGFVRNPKMISFE

SEQ ID NO: 72844 - protein, 16 aa, Borrelia burgdorferi B31
GVVGFVRNPKMISFEL

SEQ ID NO: 72845 - protein, 16 aa, Borrelia burgdorferi B31
VVGFVRNPKMISFELE

SEQ ID NO: 72846 - protein, 16 aa, Borrelia burgdorferi B31
VGFVRNPKMISFELEK

SEQ ID NO: 72847 - protein, 16 aa, Borrelia burgdorferi B31
GFVRNPKMISFELEKE

SEQ ID NO: 72848 - protein, 16 aa, Borrelia burgdorferi B31
FVRNPKMISFELEKEI

SEQ ID NO: 72849 - protein, 16 aa, Borrelia burgdorferi B31
VRNPKMISFELEKEID

SEQ ID NO: 72850 - protein, 16 aa, Borrelia burgdorferi B31
RNPKMISFELEKEIDN

SEQ ID NO: 72851 - protein, 16 aa, Borrelia burgdorferi B31
NPKMISFELEKEIDNL

SEQ ID NO: 72852 - protein, 16 aa, Borrelia burgdorferi B31
PKMISFELEKEIDNLS

SEQ ID NO: 72853 - protein, 16 aa, Borrelia burgdorferi B31
KMISFELEKEIDNLSS

SEQ ID NO: 72854 - protein, 16 aa, Borrelia burgdorferi B31
MISFELEKEIDNLSSK

SEQ ID NO: 72855 - protein, 16 aa, Borrelia burgdorferi B31
ISFELEKEIDNLSSKI

SEQ ID NO: 72856 - protein, 16 aa, Borrelia burgdorferi B31
SFELEKEIDNLSSKII

SEQ ID NO: 72857 - protein, 16 aa, Borrelia burgdorferi B31
FELEKEIDNLSSKIIN

SEQ ID NO: 72858 - protein, 16 aa, Borrelia burgdorferi B31
ELEKEIDNLSSKIINK

SEQ ID NO: 72859 - protein, 16 aa, Borrelia burgdorferi B31
LEKEIDNLSSKIINKE

SEQ ID NO: 72860 - protein, 16 aa, Borrelia burgdorferi B31
EKEIDNLSSKIINKEI

SEQ ID NO: 72861 - protein, 16 aa, Borrelia burgdorferi B31
KEIDNLSSKIINKEII

SEQ ID NO: 72862 - protein, 16 aa, Borrelia burgdorferi B31
EIDNLSSKIINKEIIV

SEQ ID NO: 72863 - protein, 16 aa, Borrelia burgdorferi B31
IDNLSSKIINKEIIVP

SEQ ID NO: 72864 - protein, 16 aa, Borrelia burgdorferi B31
DNLSSKIINKEIIVPS

SEQ ID NO: 72865 - protein, 16 aa, Borrelia burgdorferi B31
NLSSKIINKEIIVPSN

SEQ ID NO: 72866 - protein, 16 aa, Borrelia burgdorferi B31
LSSKIINKEIIVPSNK

SEQ ID NO: 72867 - protein, 16 aa, Borrelia burgdorferi B31
SSKIINKEIIVPSNKE

SEQ ID NO: 72868 - protein, 16 aa, Borrelia burgdorferi B31
SKIINKEIIVPSNKES

SEQ ID NO: 72869 - protein, 16 aa, Borrelia burgdorferi B31
KIINKEIIVPSNKESY

SEQ ID NO: 72870 - protein, 16 aa, Borrelia burgdorferi B31
IINKEIIVPSNKESYE

SEQ ID NO: 72871 - protein, 16 aa, Borrelia burgdorferi B31
INKEIIVPSNKESYEK

SEQ ID NO: 72872 - protein, 16 aa, Borrelia burgdorferi B31
NKEIIVPSNKESYEKF

SEQ ID NO: 72873 - protein, 16 aa, Borrelia burgdorferi B31
KEIIVPSNKESYEKFL

SEQ ID NO: 72874 - protein, 16 aa, Borrelia burgdorferi B31
EIIVPSNKESYEKFLK

SEQ ID NO: 72875 - protein, 16 aa, Borrelia burgdorferi B31
IIVPSNKESYEKFLKE

SEQ ID NO: 72876 - protein, 16 aa, Borrelia burgdorferi B31
IVPSNKESYEKFLKEF

SEQ ID NO: 72877 - protein, 16 aa, Borrelia burgdorferi B31
VPSNKESYEKFLKEFI

SEQ ID NO: 72878 - protein, 13 aa, Borrelia burgdorferi B31
MRIVIFIFGILLT

SEQ ID NO: 72879 - protein, 13 aa, Borrelia burgdorferi B31
RIVIFIFGILLTS

SEQ ID NO: 72880 - protein, 13 aa, Borrelia burgdorferi B31
IVIFIFGILLTSC

SEQ ID NO: 72881 - protein, 13 aa, Borrelia burgdorferi B31
VIFIFGILLTSCF

SEQ ID NO: 72882 - protein, 13 aa, Borrelia burgdorferi B31
IFIFGILLTSCFS

SEQ ID NO: 72883 - protein, 13 aa, Borrelia burgdorferi B31
FIFGILLTSCFSR

SEQ ID NO: 72884 - protein, 13 aa, Borrelia burgdorferi B31
IFGILLTSCFSRN

SEQ ID NO: 72885 - protein, 13 aa, Borrelia burgdorferi B31
FGILLTSCFSRNG

SEQ ID NO: 72886 - protein, 13 aa, Borrelia burgdorferi B31
GILLTSCFSRNGI

SEQ ID NO: 72887 - protein, 13 aa, Borrelia burgdorferi B31
ILLTSCFSRNGIE

SEQ ID NO: 72888 - protein, 13 aa, Borrelia burgdorferi B31
LLTSCFSRNGIES

SEQ ID NO: 72889 - protein, 13 aa, Borrelia burgdorferi B31
LTSCFSRNGIESS

SEQ ID NO: 72890 - protein, 13 aa, Borrelia burgdorferi B31
TSCFSRNGIESSS

SEQ ID NO: 72891 - protein, 13 aa, Borrelia burgdorferi B31
SCFSRNGIESSSK

SEQ ID NO: 72892 - protein, 13 aa, Borrelia burgdorferi B31
CFSRNGIESSSKK

SEQ ID NO: 72893 - protein, 13 aa, Borrelia burgdorferi B31
FSRNGIESSSKKI

SEQ ID NO: 72894 - protein, 13 aa, Borrelia burgdorferi B31
SRNGIESSSKKIK

SEQ ID NO: 72895 - protein, 13 aa, Borrelia burgdorferi B31
RNGIESSSKKIKI

SEQ ID NO: 72896 - protein, 13 aa, Borrelia burgdorferi B31
NGIESSSKKIKIS

SEQ ID NO: 72897 - protein, 13 aa, Borrelia burgdorferi B31
GIESSSKKIKISM

SEQ ID NO: 72898 - protein, 13 aa, Borrelia burgdorferi B31
IESSSKKIKISML

SEQ ID NO: 72899 - protein, 13 aa, Borrelia burgdorferi B31
ESSSKKIKISMLV

SEQ ID NO: 72900 - protein, 13 aa, Borrelia burgdorferi B31
SSSKKIKISMLVD

SEQ ID NO: 72901 - protein, 13 aa, Borrelia burgdorferi B31
SSKKIKISMLVDG

SEQ ID NO: 72902 - protein, 13 aa, Borrelia burgdorferi B31
SKKIKISMLVDGV

SEQ ID NO: 72903 - protein, 13 aa, Borrelia burgdorferi B31
KKIKISMLVDGVL

SEQ ID NO: 72904 - protein, 13 aa, Borrelia burgdorferi B31
KIKISMLVDGVLD

SEQ ID NO: 72905 - protein, 13 aa, Borrelia burgdorferi B31
IKISMLVDGVLDD

SEQ ID NO: 72906 - protein, 13 aa, Borrelia burgdorferi B31
KISMLVDGVLDDK

SEQ ID NO: 72907 - protein, 13 aa, Borrelia burgdorferi B31
ISMLVDGVLDDKS

SEQ ID NO: 72908 - protein, 13 aa, Borrelia burgdorferi B31
SMLVDGVLDDKSF

SEQ ID NO: 72909 - protein, 13 aa, Borrelia burgdorferi B31
MLVDGVLDDKSFN

SEQ ID NO: 72910 - protein, 13 aa, Borrelia burgdorferi B31
LVDGVLDDKSFNS

SEQ ID NO: 72911 - protein, 13 aa, Borrelia burgdorferi B31
VDGVLDDKSFNSS

SEQ ID NO: 72912 - protein, 13 aa, Borrelia burgdorferi B31
DGVLDDKSFNSSA

SEQ ID NO: 72913 - protein, 13 aa, Borrelia burgdorferi B31
GVLDDKSFNSSAN

SEQ ID NO: 72914 - protein, 13 aa, Borrelia burgdorferi B31
VLDDKSFNSSANE

SEQ ID NO: 72915 - protein, 13 aa, Borrelia burgdorferi B31
LDDKSFNSSANEA

SEQ ID NO: 72916 - protein, 13 aa, Borrelia burgdorferi B31
DDKSFNSSANEAL

SEQ ID NO: 72917 - protein, 13 aa, Borrelia burgdorferi B31
DKSFNSSANEALL

SEQ ID NO: 72918 - protein, 13 aa, Borrelia burgdorferi B31
KSFNSSANEALLR

SEQ ID NO: 72919 - protein, 13 aa, Borrelia burgdorferi B31
SFNSSANEALLRL

SEQ ID NO: 72920 - protein, 13 aa, Borrelia burgdorferi B31
FNSSANEALLRLK

SEQ ID NO: 72921 - protein, 13 aa, Borrelia burgdorferi B31
NSSANEALLRLKK

SEQ ID NO: 72922 - protein, 13 aa, Borrelia burgdorferi B31
SSANEALLRLKKD

SEQ ID NO: 72923 - protein, 13 aa, Borrelia burgdorferi B31
SANEALLRLKKDF

SEQ ID NO: 72924 - protein, 13 aa, Borrelia burgdorferi B31
ANEALLRLKKDFP

SEQ ID NO: 72925 - protein, 13 aa, Borrelia burgdorferi B31
NEALLRLKKDFPE

SEQ ID NO: 72926 - protein, 13 aa, Borrelia burgdorferi B31
EALLRLKKDFPEN

SEQ ID NO: 72927 - protein, 13 aa, Borrelia burgdorferi B31
ALLRLKKDFPENI

SEQ ID NO: 72928 - protein, 13 aa, Borrelia burgdorferi B31
LLRLKKDFPENIE

SEQ ID NO: 72929 - protein, 13 aa, Borrelia burgdorferi B31
LRLKKDFPENIEE

SEQ ID NO: 72930 - protein, 13 aa, Borrelia burgdorferi B31
RLKKDFPENIEEV

SEQ ID NO: 72931 - protein, 13 aa, Borrelia burgdorferi B31
LKKDFPENIEEVF

SEQ ID NO: 72932 - protein, 13 aa, Borrelia burgdorferi B31
KKDFPENIEEVFS

SEQ ID NO: 72933 - protein, 13 aa, Borrelia burgdorferi B31
KDFPENIEEVFSC

SEQ ID NO: 72934 - protein, 13 aa, Borrelia burgdorferi B31
DFPENIEEVFSCA

SEQ ID NO: 72935 - protein, 13 aa, Borrelia burgdorferi B31
FPENIEEVFSCAI

SEQ ID NO: 72936 - protein, 13 aa, Borrelia burgdorferi B31
PENIEEVFSCAIS

SEQ ID NO: 72937 - protein, 13 aa, Borrelia burgdorferi B31
ENIEEVFSCAISG

SEQ ID NO: 72938 - protein, 13 aa, Borrelia burgdorferi B31
NIEEVFSCAISGV

SEQ ID NO: 72939 - protein, 13 aa, Borrelia burgdorferi B31
IEEVFSCAISGVY

SEQ ID NO: 72940 - protein, 13 aa, Borrelia burgdorferi B31
EEVFSCAISGVYS

SEQ ID NO: 72941 - protein, 13 aa, Borrelia burgdorferi B31
EVFSCAISGVYSS

SEQ ID NO: 72942 - protein, 13 aa, Borrelia burgdorferi B31
VFSCAISGVYSSY

SEQ ID NO: 72943 - protein, 13 aa, Borrelia burgdorferi B31
FSCAISGVYSSYV

SEQ ID NO: 72944 - protein, 13 aa, Borrelia burgdorferi B31
SCAISGVYSSYVS

SEQ ID NO: 72945 - protein, 13 aa, Borrelia burgdorferi B31
CAISGVYSSYVSD

SEQ ID NO: 72946 - protein, 13 aa, Borrelia burgdorferi B31
AISGVYSSYVSDL

SEQ ID NO: 72947 - protein, 13 aa, Borrelia burgdorferi B31
ISGVYSSYVSDLD

SEQ ID NO: 72948 - protein, 13 aa, Borrelia burgdorferi B31
SGVYSSYVSDLDN

SEQ ID NO: 72949 - protein, 13 aa, Borrelia burgdorferi B31
GVYSSYVSDLDNL

SEQ ID NO: 72950 - protein, 13 aa, Borrelia burgdorferi B31
VYSSYVSDLDNLK

SEQ ID NO: 72951 - protein, 13 aa, Borrelia burgdorferi B31
YSSYVSDLDNLKR

SEQ ID NO: 72952 - protein, 13 aa, Borrelia burgdorferi B31
SSYVSDLDNLKRN

SEQ ID NO: 72953 - protein, 13 aa, Borrelia burgdorferi B31
SYVSDLDNLKRNG

SEQ ID NO: 72954 - protein, 13 aa, Borrelia burgdorferi B31
YVSDLDNLKRNGS

SEQ ID NO: 72955 - protein, 13 aa, Borrelia burgdorferi B31
VSDLDNLKRNGSD

SEQ ID NO: 72956 - protein, 13 aa, Borrelia burgdorferi B31
SDLDNLKRNGSDL

SEQ ID NO: 72957 - protein, 13 aa, Borrelia burgdorferi B31
DLDNLKRNGSDLI

SEQ ID NO: 72958 - protein, 13 aa, Borrelia burgdorferi B31
LDNLKRNGSDLIW

SEQ ID NO: 72959 - protein, 13 aa, Borrelia burgdorferi B31
DNLKRNGSDLIWL

SEQ ID NO: 72960 - protein, 13 aa, Borrelia burgdorferi B31
NLKRNGSDLIWLV

SEQ ID NO: 72961 - protein, 13 aa, Borrelia burgdorferi B31
LKRNGSDLIWLVG

SEQ ID NO: 72962 - protein, 13 aa, Borrelia burgdorferi B31
KRNGSDLIWLVGY

SEQ ID NO: 72963 - protein, 13 aa, Borrelia burgdorferi B31
RNGSDLIWLVGYM

SEQ ID NO: 72964 - protein, 13 aa, Borrelia burgdorferi B31
NGSDLIWLVGYML

SEQ ID NO: 72965 - protein, 13 aa, Borrelia burgdorferi B31
GSDLIWLVGYMLT

SEQ ID NO: 72966 - protein, 13 aa, Borrelia burgdorferi B31
SDLIWLVGYMLTD

SEQ ID NO: 72967 - protein, 13 aa, Borrelia burgdorferi B31
DLIWLVGYMLTDA

SEQ ID NO: 72968 - protein, 13 aa, Borrelia burgdorferi B31
LIWLVGYMLTDAS

SEQ ID NO: 72969 - protein, 13 aa, Borrelia burgdorferi B31
IWLVGYMLTDASL

SEQ ID NO: 72970 - protein, 13 aa, Borrelia burgdorferi B31
WLVGYMLTDASLL

SEQ ID NO: 72971 - protein, 13 aa, Borrelia burgdorferi B31
LVGYMLTDASLLV

SEQ ID NO: 72972 - protein, 13 aa, Borrelia burgdorferi B31
VGYMLTDASLLVS

SEQ ID NO: 72973 - protein, 13 aa, Borrelia burgdorferi B31
GYMLTDASLLVSS

SEQ ID NO: 72974 - protein, 13 aa, Borrelia burgdorferi B31
YMLTDASLLVSSE

SEQ ID NO: 72975 - protein, 13 aa, Borrelia burgdorferi B31
MLTDASLLVSSEN

SEQ ID NO: 72976 - protein, 13 aa, Borrelia burgdorferi B31
LTDASLLVSSENP

SEQ ID NO: 72977 - protein, 13 aa, Borrelia burgdorferi B31
TDASLLVSSENPK

SEQ ID NO: 72978 - protein, 13 aa, Borrelia burgdorferi B31
DASLLVSSENPKI

SEQ ID NO: 72979 - protein, 13 aa, Borrelia burgdorferi B31
ASLLVSSENPKIS

SEQ ID NO: 72980 - protein, 13 aa, Borrelia burgdorferi B31
SLLVSSENPKISY

SEQ ID NO: 72981 - protein, 13 aa, Borrelia burgdorferi B31
LLVSSENPKISYG

SEQ ID NO: 72982 - protein, 13 aa, Borrelia burgdorferi B31
LVSSENPKISYGI

SEQ ID NO: 72983 - protein, 13 aa, Borrelia burgdorferi B31
VSSENPKISYGII

SEQ ID NO: 72984 - protein, 13 aa, Borrelia burgdorferi B31
SSENPKISYGIID

SEQ ID NO: 72985 - protein, 13 aa, Borrelia burgdorferi B31
SENPKISYGIIDP

SEQ ID NO: 72986 - protein, 13 aa, Borrelia burgdorferi B31
ENPKISYGIIDPI

SEQ ID NO: 72987 - protein, 13 aa, Borrelia burgdorferi B31
NPKISYGIIDPIY

SEQ ID NO: 72988 - protein, 13 aa, Borrelia burgdorferi B31
PKISYGIIDPIYG

SEQ ID NO: 72989 - protein, 13 aa, Borrelia burgdorferi B31
KISYGIIDPIYGD

SEQ ID NO: 72990 - protein, 13 aa, Borrelia burgdorferi B31
ISYGIIDPIYGDD

SEQ ID NO: 72991 - protein, 13 aa, Borrelia burgdorferi B31
SYGIIDPIYGDDV

SEQ ID NO: 72992 - protein, 13 aa, Borrelia burgdorferi B31
YGIIDPIYGDDVQ

SEQ ID NO: 72993 - protein, 13 aa, Borrelia burgdorferi B31
GIIDPIYGDDVQI

SEQ ID NO: 72994 - protein, 13 aa, Borrelia burgdorferi B31
IIDPIYGDDVQIP

SEQ ID NO: 72995 - protein, 13 aa, Borrelia burgdorferi B31
IDPIYGDDVQIPE

SEQ ID NO: 72996 - protein, 13 aa, Borrelia burgdorferi B31
DPIYGDDVQIPEN

SEQ ID NO: 72997 - protein, 13 aa, Borrelia burgdorferi B31
PIYGDDVQIPENL

SEQ ID NO: 72998 - protein, 13 aa, Borrelia burgdorferi B31
IYGDDVQIPENLI

SEQ ID NO: 72999 - protein, 13 aa, Borrelia burgdorferi B31
YGDDVQIPENLIA

SEQ ID NO: 73000 - protein, 13 aa, Borrelia burgdorferi B31
GDDVQIPENLIAV

SEQ ID NO: 73001 - protein, 13 aa, Borrelia burgdorferi B31
DDVQIPENLIAVV

SEQ ID NO: 73002 - protein, 13 aa, Borrelia burgdorferi B31
DVQIPENLIAVVF

SEQ ID NO: 73003 - protein, 13 aa, Borrelia burgdorferi B31
VQIPENLIAVVFR

SEQ ID NO: 73004 - protein, 13 aa, Borrelia burgdorferi B31
QIPENLIAVVFRV

SEQ ID NO: 73005 - protein, 13 aa, Borrelia burgdorferi B31
IPENLIAVVFRVE

SEQ ID NO: 73006 - protein, 13 aa, Borrelia burgdorferi B31
PENLIAVVFRVEQ

SEQ ID NO: 73007 - protein, 13 aa, Borrelia burgdorferi B31
ENLIAVVFRVEQG

SEQ ID NO: 73008 - protein, 13 aa, Borrelia burgdorferi B31
NLIAVVFRVEQGA

SEQ ID NO: 73009 - protein, 13 aa, Borrelia burgdorferi B31
LIAVVFRVEQGAF

SEQ ID NO: 73010 - protein, 13 aa, Borrelia burgdorferi B31
IAVVFRVEQGAFL

SEQ ID NO: 73011 - protein, 13 aa, Borrelia burgdorferi B31
AVVFRVEQGAFLA

SEQ ID NO: 73012 - protein, 13 aa, Borrelia burgdorferi B31
VVFRVEQGAFLAG

SEQ ID NO: 73013 - protein, 13 aa, Borrelia burgdorferi B31
VFRVEQGAFLAGY

SEQ ID NO: 73014 - protein, 13 aa, Borrelia burgdorferi B31
FRVEQGAFLAGYI

SEQ ID NO: 73015 - protein, 13 aa, Borrelia burgdorferi B31
RVEQGAFLAGYIA

SEQ ID NO: 73016 - protein, 13 aa, Borrelia burgdorferi B31
VEQGAFLAGYIAA

SEQ ID NO: 73017 - protein, 13 aa, Borrelia burgdorferi B31
EQGAFLAGYIAAK

SEQ ID NO: 73018 - protein, 13 aa, Borrelia burgdorferi B31
QGAFLAGYIAAKK

SEQ ID NO: 73019 - protein, 13 aa, Borrelia burgdorferi B31
GAFLAGYIAAKKS

SEQ ID NO: 73020 - protein, 13 aa, Borrelia burgdorferi B31
AFLAGYIAAKKSF

SEQ ID NO: 73021 - protein, 13 aa, Borrelia burgdorferi B31
FLAGYIAAKKSFS

SEQ ID NO: 73022 - protein, 13 aa, Borrelia burgdorferi B31
LAGYIAAKKSFSG

SEQ ID NO: 73023 - protein, 13 aa, Borrelia burgdorferi B31
AGYIAAKKSFSGK

SEQ ID NO: 73024 - protein, 13 aa, Borrelia burgdorferi B31
GYIAAKKSFSGKI

SEQ ID NO: 73025 - protein, 13 aa, Borrelia burgdorferi B31
YIAAKKSFSGKIG

SEQ ID NO: 73026 - protein, 13 aa, Borrelia burgdorferi B31
IAAKKSFSGKIGF

SEQ ID NO: 73027 - protein, 13 aa, Borrelia burgdorferi B31
AAKKSFSGKIGFI

SEQ ID NO: 73028 - protein, 13 aa, Borrelia burgdorferi B31
AKKSFSGKIGFIG

SEQ ID NO: 73029 - protein, 13 aa, Borrelia burgdorferi B31
KKSFSGKIGFIGG

SEQ ID NO: 73030 - protein, 13 aa, Borrelia burgdorferi B31
KSFSGKIGFIGGM

SEQ ID NO: 73031 - protein, 13 aa, Borrelia burgdorferi B31
SFSGKIGFIGGMK

SEQ ID NO: 73032 - protein, 13 aa, Borrelia burgdorferi B31
FSGKIGFIGGMKG

SEQ ID NO: 73033 - protein, 13 aa, Borrelia burgdorferi B31
SGKIGFIGGMKGN

SEQ ID NO: 73034 - protein, 13 aa, Borrelia burgdorferi B31
GKIGFIGGMKGNI

SEQ ID NO: 73035 - protein, 13 aa, Borrelia burgdorferi B31
KIGFIGGMKGNIV

SEQ ID NO: 73036 - protein, 13 aa, Borrelia burgdorferi B31
IGFIGGMKGNIVD

SEQ ID NO: 73037 - protein, 13 aa, Borrelia burgdorferi B31
GFIGGMKGNIVDA

SEQ ID NO: 73038 - protein, 13 aa, Borrelia burgdorferi B31
FIGGMKGNIVDAF

SEQ ID NO: 73039 - protein, 13 aa, Borrelia burgdorferi B31
IGGMKGNIVDAFR

SEQ ID NO: 73040 - protein, 13 aa, Borrelia burgdorferi B31
GGMKGNIVDAFRY

SEQ ID NO: 73041 - protein, 13 aa, Borrelia burgdorferi B31
GMKGNIVDAFRYG

SEQ ID NO: 73042 - protein, 13 aa, Borrelia burgdorferi B31
MKGNIVDAFRYGY

SEQ ID NO: 73043 - protein, 13 aa, Borrelia burgdorferi B31
KGNIVDAFRYGYE

SEQ ID NO: 73044 - protein, 13 aa, Borrelia burgdorferi B31
GNIVDAFRYGYES

SEQ ID NO: 73045 - protein, 13 aa, Borrelia burgdorferi B31
NIVDAFRYGYESG

SEQ ID NO: 73046 - protein, 13 aa, Borrelia burgdorferi B31
IVDAFRYGYESGA

SEQ ID NO: 73047 - protein, 13 aa, Borrelia burgdorferi B31
VDAFRYGYESGAK

SEQ ID NO: 73048 - protein, 13 aa, Borrelia burgdorferi B31
DAFRYGYESGAKY

SEQ ID NO: 73049 - protein, 13 aa, Borrelia burgdorferi B31
AFRYGYESGAKYA

SEQ ID NO: 73050 - protein, 13 aa, Borrelia burgdorferi B31
FRYGYESGAKYAN

SEQ ID NO: 73051 - protein, 13 aa, Borrelia burgdorferi B31
RYGYESGAKYANK

SEQ ID NO: 73052 - protein, 13 aa, Borrelia burgdorferi B31
YGYESGAKYANKD

SEQ ID NO: 73053 - protein, 13 aa, Borrelia burgdorferi B31
GYESGAKYANKDI

SEQ ID NO: 73054 - protein, 13 aa, Borrelia burgdorferi B31
YESGAKYANKDIE

SEQ ID NO: 73055 - protein, 13 aa, Borrelia burgdorferi B31
ESGAKYANKDIEI

SEQ ID NO: 73056 - protein, 13 aa, Borrelia burgdorferi B31
SGAKYANKDIEII

SEQ ID NO: 73057 - protein, 13 aa, Borrelia burgdorferi B31
GAKYANKDIEIIS

SEQ ID NO: 73058 - protein, 13 aa, Borrelia burgdorferi B31
AKYANKDIEIISE

SEQ ID NO: 73059 - protein, 13 aa, Borrelia burgdorferi B31
KYANKDIEIISEY

SEQ ID NO: 73060 - protein, 13 aa, Borrelia burgdorferi B31
YANKDIEIISEYS

SEQ ID NO: 73061 - protein, 13 aa, Borrelia burgdorferi B31
ANKDIEIISEYSN

SEQ ID NO: 73062 - protein, 13 aa, Borrelia burgdorferi B31
NKDIEIISEYSNS

SEQ ID NO: 73063 - protein, 13 aa, Borrelia burgdorferi B31
KDIEIISEYSNSF

SEQ ID NO: 73064 - protein, 13 aa, Borrelia burgdorferi B31
DIEIISEYSNSFS

SEQ ID NO: 73065 - protein, 13 aa, Borrelia burgdorferi B31
IEIISEYSNSFSD

SEQ ID NO: 73066 - protein, 13 aa, Borrelia burgdorferi B31
EIISEYSNSFSDV

SEQ ID NO: 73067 - protein, 13 aa, Borrelia burgdorferi B31
IISEYSNSFSDVD

SEQ ID NO: 73068 - protein, 13 aa, Borrelia burgdorferi B31
ISEYSNSFSDVDI

SEQ ID NO: 73069 - protein, 13 aa, Borrelia burgdorferi B31
SEYSNSFSDVDIG

SEQ ID NO: 73070 - protein, 13 aa, Borrelia burgdorferi B31
EYSNSFSDVDIGR

SEQ ID NO: 73071 - protein, 13 aa, Borrelia burgdorferi B31
YSNSFSDVDIGRT

SEQ ID NO: 73072 - protein, 13 aa, Borrelia burgdorferi B31
SNSFSDVDIGRTI

SEQ ID NO: 73073 - protein, 13 aa, Borrelia burgdorferi B31
NSFSDVDIGRTIA

SEQ ID NO: 73074 - protein, 13 aa, Borrelia burgdorferi B31
SFSDVDIGRTIAS

SEQ ID NO: 73075 - protein, 13 aa, Borrelia burgdorferi B31
FSDVDIGRTIASK

SEQ ID NO: 73076 - protein, 13 aa, Borrelia burgdorferi B31
SDVDIGRTIASKM

SEQ ID NO: 73077 - protein, 13 aa, Borrelia burgdorferi B31
DVDIGRTIASKMY

SEQ ID NO: 73078 - protein, 13 aa, Borrelia burgdorferi B31
VDIGRTIASKMYS

SEQ ID NO: 73079 - protein, 13 aa, Borrelia burgdorferi B31
DIGRTIASKMYSK

SEQ ID NO: 73080 - protein, 13 aa, Borrelia burgdorferi B31
IGRTIASKMYSKG

SEQ ID NO: 73081 - protein, 13 aa, Borrelia burgdorferi B31
GRTIASKMYSKGI

SEQ ID NO: 73082 - protein, 13 aa, Borrelia burgdorferi B31
RTIASKMYSKGID

SEQ ID NO: 73083 - protein, 13 aa, Borrelia burgdorferi B31
TIASKMYSKGIDV

SEQ ID NO: 73084 - protein, 13 aa, Borrelia burgdorferi B31
IASKMYSKGIDVI

SEQ ID NO: 73085 - protein, 13 aa, Borrelia burgdorferi B31
ASKMYSKGIDVIH

SEQ ID NO: 73086 - protein, 13 aa, Borrelia burgdorferi B31
SKMYSKGIDVIHF

SEQ ID NO: 73087 - protein, 13 aa, Borrelia burgdorferi B31
KMYSKGIDVIHFA

SEQ ID NO: 73088 - protein, 13 aa, Borrelia burgdorferi B31
MYSKGIDVIHFAA

SEQ ID NO: 73089 - protein, 13 aa, Borrelia burgdorferi B31
YSKGIDVIHFAAG

SEQ ID NO: 73090 - protein, 13 aa, Borrelia burgdorferi B31
SKGIDVIHFAAGL

SEQ ID NO: 73091 - protein, 13 aa, Borrelia burgdorferi B31
KGIDVIHFAAGLA

SEQ ID NO: 73092 - protein, 13 aa, Borrelia burgdorferi B31
GIDVIHFAAGLAG

SEQ ID NO: 73093 - protein, 13 aa, Borrelia burgdorferi B31
IDVIHFAAGLAGI

SEQ ID NO: 73094 - protein, 13 aa, Borrelia burgdorferi B31
DVIHFAAGLAGIG

SEQ ID NO: 73095 - protein, 13 aa, Borrelia burgdorferi B31
VIHFAAGLAGIGV

SEQ ID NO: 73096 - protein, 13 aa, Borrelia burgdorferi B31
IHFAAGLAGIGVI

SEQ ID NO: 73097 - protein, 13 aa, Borrelia burgdorferi B31
HFAAGLAGIGVIE

SEQ ID NO: 73098 - protein, 13 aa, Borrelia burgdorferi B31
FAAGLAGIGVIET

SEQ ID NO: 73099 - protein, 13 aa, Borrelia burgdorferi B31
AAGLAGIGVIETA

SEQ ID NO: 73100 - protein, 13 aa, Borrelia burgdorferi B31
AGLAGIGVIETAK

SEQ ID NO: 73101 - protein, 13 aa, Borrelia burgdorferi B31
GLAGIGVIETAKN

SEQ ID NO: 73102 - protein, 13 aa, Borrelia burgdorferi B31
LAGIGVIETAKNL

SEQ ID NO: 73103 - protein, 13 aa, Borrelia burgdorferi B31
AGIGVIETAKNLG

SEQ ID NO: 73104 - protein, 13 aa, Borrelia burgdorferi B31
GIGVIETAKNLGD

SEQ ID NO: 73105 - protein, 13 aa, Borrelia burgdorferi B31
IGVIETAKNLGDG

SEQ ID NO: 73106 - protein, 13 aa, Borrelia burgdorferi B31
GVIETAKNLGDGY

SEQ ID NO: 73107 - protein, 13 aa, Borrelia burgdorferi B31
VIETAKNLGDGYY

SEQ ID NO: 73108 - protein, 13 aa, Borrelia burgdorferi B31
IETAKNLGDGYYV

SEQ ID NO: 73109 - protein, 13 aa, Borrelia burgdorferi B31
ETAKNLGDGYYVI

SEQ ID NO: 73110 - protein, 13 aa, Borrelia burgdorferi B31
TAKNLGDGYYVIG

SEQ ID NO: 73111 - protein, 13 aa, Borrelia burgdorferi B31
AKNLGDGYYVIGA

SEQ ID NO: 73112 - protein, 13 aa, Borrelia burgdorferi B31
KNLGDGYYVIGAD

SEQ ID NO: 73113 - protein, 13 aa, Borrelia burgdorferi B31
NLGDGYYVIGADQ

SEQ ID NO: 73114 - protein, 13 aa, Borrelia burgdorferi B31
LGDGYYVIGADQD

SEQ ID NO: 73115 - protein, 13 aa, Borrelia burgdorferi B31
GDGYYVIGADQDQ

SEQ ID NO: 73116 - protein, 13 aa, Borrelia burgdorferi B31
DGYYVIGADQDQS

SEQ ID NO: 73117 - protein, 13 aa, Borrelia burgdorferi B31
GYYVIGADQDQSY

SEQ ID NO: 73118 - protein, 13 aa, Borrelia burgdorferi B31
YYVIGADQDQSYL

SEQ ID NO: 73119 - protein, 13 aa, Borrelia burgdorferi B31
YVIGADQDQSYLA

SEQ ID NO: 73120 - protein, 13 aa, Borrelia burgdorferi B31
VIGADQDQSYLAP

SEQ ID NO: 73121 - protein, 13 aa, Borrelia burgdorferi B31
IGADQDQSYLAPK

SEQ ID NO: 73122 - protein, 13 aa, Borrelia burgdorferi B31
GADQDQSYLAPKN

SEQ ID NO: 73123 - protein, 13 aa, Borrelia burgdorferi B31
ADQDQSYLAPKNF

SEQ ID NO: 73124 - protein, 13 aa, Borrelia burgdorferi B31
DQDQSYLAPKNFI

SEQ ID NO: 73125 - protein, 13 aa, Borrelia burgdorferi B31
QDQSYLAPKNFIT

SEQ ID NO: 73126 - protein, 13 aa, Borrelia burgdorferi B31
DQSYLAPKNFITS

SEQ ID NO: 73127 - protein, 13 aa, Borrelia burgdorferi B31
QSYLAPKNFITSV

SEQ ID NO: 73128 - protein, 13 aa, Borrelia burgdorferi B31
SYLAPKNFITSVI

SEQ ID NO: 73129 - protein, 13 aa, Borrelia burgdorferi B31
YLAPKNFITSVIK

SEQ ID NO: 73130 - protein, 13 aa, Borrelia burgdorferi B31
LAPKNFITSVIKN

SEQ ID NO: 73131 - protein, 13 aa, Borrelia burgdorferi B31
APKNFITSVIKNI

SEQ ID NO: 73132 - protein, 13 aa, Borrelia burgdorferi B31
PKNFITSVIKNIG

SEQ ID NO: 73133 - protein, 13 aa, Borrelia burgdorferi B31
KNFITSVIKNIGD

SEQ ID NO: 73134 - protein, 13 aa, Borrelia burgdorferi B31
NFITSVIKNIGDA

SEQ ID NO: 73135 - protein, 13 aa, Borrelia burgdorferi B31
FITSVIKNIGDAL

SEQ ID NO: 73136 - protein, 13 aa, Borrelia burgdorferi B31
ITSVIKNIGDALY

SEQ ID NO: 73137 - protein, 13 aa, Borrelia burgdorferi B31
TSVIKNIGDALYL

SEQ ID NO: 73138 - protein, 13 aa, Borrelia burgdorferi B31
SVIKNIGDALYLI

SEQ ID NO: 73139 - protein, 13 aa, Borrelia burgdorferi B31
VIKNIGDALYLIT

SEQ ID NO: 73140 - protein, 13 aa, Borrelia burgdorferi B31
IKNIGDALYLITG

SEQ ID NO: 73141 - protein, 13 aa, Borrelia burgdorferi B31
KNIGDALYLITGE

SEQ ID NO: 73142 - protein, 13 aa, Borrelia burgdorferi B31
NIGDALYLITGEY

SEQ ID NO: 73143 - protein, 13 aa, Borrelia burgdorferi B31
IGDALYLITGEYI

SEQ ID NO: 73144 - protein, 13 aa, Borrelia burgdorferi B31
GDALYLITGEYIK

SEQ ID NO: 73145 - protein, 13 aa, Borrelia burgdorferi B31
DALYLITGEYIKN

SEQ ID NO: 73146 - protein, 13 aa, Borrelia burgdorferi B31
ALYLITGEYIKNN

SEQ ID NO: 73147 - protein, 13 aa, Borrelia burgdorferi B31
LYLITGEYIKNNN

SEQ ID NO: 73148 - protein, 13 aa, Borrelia burgdorferi B31
YLITGEYIKNNNV

SEQ ID NO: 73149 - protein, 13 aa, Borrelia burgdorferi B31
LITGEYIKNNNVW

SEQ ID NO: 73150 - protein, 13 aa, Borrelia burgdorferi B31
ITGEYIKNNNVWE

SEQ ID NO: 73151 - protein, 13 aa, Borrelia burgdorferi B31
TGEYIKNNNVWEG

SEQ ID NO: 73152 - protein, 13 aa, Borrelia burgdorferi B31
GEYIKNNNVWEGG

SEQ ID NO: 73153 - protein, 13 aa, Borrelia burgdorferi B31
EYIKNNNVWEGGK

SEQ ID NO: 73154 - protein, 13 aa, Borrelia burgdorferi B31
YIKNNNVWEGGKV

SEQ ID NO: 73155 - protein, 13 aa, Borrelia burgdorferi B31
IKNNNVWEGGKVV

SEQ ID NO: 73156 - protein, 13 aa, Borrelia burgdorferi B31
KNNNVWEGGKVVQ

SEQ ID NO: 73157 - protein, 13 aa, Borrelia burgdorferi B31
NNNVWEGGKVVQM

SEQ ID NO: 73158 - protein, 13 aa, Borrelia burgdorferi B31
NNVWEGGKVVQMG

SEQ ID NO: 73159 - protein, 13 aa, Borrelia burgdorferi B31
NVWEGGKVVQMGL

SEQ ID NO: 73160 - protein, 13 aa, Borrelia burgdorferi B31
VWEGGKVVQMGLR

SEQ ID NO: 73161 - protein, 13 aa, Borrelia burgdorferi B31
WEGGKVVQMGLRD

SEQ ID NO: 73162 - protein, 13 aa, Borrelia burgdorferi B31
EGGKVVQMGLRDG

SEQ ID NO: 73163 - protein, 13 aa, Borrelia burgdorferi B31
GGKVVQMGLRDGV

SEQ ID NO: 73164 - protein, 13 aa, Borrelia burgdorferi B31
GKVVQMGLRDGVI

SEQ ID NO: 73165 - protein, 13 aa, Borrelia burgdorferi B31
KVVQMGLRDGVIG

SEQ ID NO: 73166 - protein, 13 aa, Borrelia burgdorferi B31
VVQMGLRDGVIGL

SEQ ID NO: 73167 - protein, 13 aa, Borrelia burgdorferi B31
VQMGLRDGVIGLP

SEQ ID NO: 73168 - protein, 13 aa, Borrelia burgdorferi B31
QMGLRDGVIGLPN

SEQ ID NO: 73169 - protein, 13 aa, Borrelia burgdorferi B31
MGLRDGVIGLPNA

SEQ ID NO: 73170 - protein, 13 aa, Borrelia burgdorferi B31
GLRDGVIGLPNAN

SEQ ID NO: 73171 - protein, 13 aa, Borrelia burgdorferi B31
LRDGVIGLPNANE

SEQ ID NO: 73172 - protein, 13 aa, Borrelia burgdorferi B31
RDGVIGLPNANEF

SEQ ID NO: 73173 - protein, 13 aa, Borrelia burgdorferi B31
DGVIGLPNANEFE

SEQ ID NO: 73174 - protein, 13 aa, Borrelia burgdorferi B31
GVIGLPNANEFEY

SEQ ID NO: 73175 - protein, 13 aa, Borrelia burgdorferi B31
VIGLPNANEFEYI

SEQ ID NO: 73176 - protein, 13 aa, Borrelia burgdorferi B31
IGLPNANEFEYIK

SEQ ID NO: 73177 - protein, 13 aa, Borrelia burgdorferi B31
GLPNANEFEYIKV

SEQ ID NO: 73178 - protein, 13 aa, Borrelia burgdorferi B31
LPNANEFEYIKVL

SEQ ID NO: 73179 - protein, 13 aa, Borrelia burgdorferi B31
PNANEFEYIKVLE

SEQ ID NO: 73180 - protein, 13 aa, Borrelia burgdorferi B31
NANEFEYIKVLER

SEQ ID NO: 73181 - protein, 13 aa, Borrelia burgdorferi B31
ANEFEYIKVLERK

SEQ ID NO: 73182 - protein, 13 aa, Borrelia burgdorferi B31
NEFEYIKVLERKI

SEQ ID NO: 73183 - protein, 13 aa, Borrelia burgdorferi B31
EFEYIKVLERKII

SEQ ID NO: 73184 - protein, 13 aa, Borrelia burgdorferi B31
FEYIKVLERKIIN

SEQ ID NO: 73185 - protein, 13 aa, Borrelia burgdorferi B31
EYIKVLERKIINK

SEQ ID NO: 73186 - protein, 13 aa, Borrelia burgdorferi B31
YIKVLERKIINKE

SEQ ID NO: 73187 - protein, 13 aa, Borrelia burgdorferi B31
IKVLERKIINKEI

SEQ ID NO: 73188 - protein, 13 aa, Borrelia burgdorferi B31
KVLERKIINKEII

SEQ ID NO: 73189 - protein, 13 aa, Borrelia burgdorferi B31
VLERKIINKEIIV

SEQ ID NO: 73190 - protein, 13 aa, Borrelia burgdorferi B31
LERKIINKEIIVP

SEQ ID NO: 73191 - protein, 13 aa, Borrelia burgdorferi B31
ERKIINKEIIVPC

SEQ ID NO: 73192 - protein, 13 aa, Borrelia burgdorferi B31
RKIINKEIIVPCN

SEQ ID NO: 73193 - protein, 13 aa, Borrelia burgdorferi B31
KIINKEIIVPCNQ

SEQ ID NO: 73194 - protein, 13 aa, Borrelia burgdorferi B31
IINKEIIVPCNQE

SEQ ID NO: 73195 - protein, 13 aa, Borrelia burgdorferi B31
INKEIIVPCNQEE

SEQ ID NO: 73196 - protein, 13 aa, Borrelia burgdorferi B31
NKEIIVPCNQEEY

SEQ ID NO: 73197 - protein, 13 aa, Borrelia burgdorferi B31
KEIIVPCNQEEYE

SEQ ID NO: 73198 - protein, 13 aa, Borrelia burgdorferi B31
EIIVPCNQEEYEI

SEQ ID NO: 73199 - protein, 13 aa, Borrelia burgdorferi B31
IIVPCNQEEYEIF

SEQ ID NO: 73200 - protein, 13 aa, Borrelia burgdorferi B31
IVPCNQEEYEIFI

SEQ ID NO: 73201 - protein, 13 aa, Borrelia burgdorferi B31
VPCNQEEYEIFIK

SEQ ID NO: 73202 - protein, 13 aa, Borrelia burgdorferi B31
PCNQEEYEIFIKQ

SEQ ID NO: 73203 - protein, 13 aa, Borrelia burgdorferi B31
CNQEEYEIFIKQI

SEQ ID NO: 73204 - protein, 13 aa, Borrelia burgdorferi B31
NQEEYEIFIKQIL

SEQ ID NO: 73205 - protein, 13 aa, Borrelia burgdorferi B31
QEEYEIFIKQILK

SEQ ID NO: 73206 - protein, 13 aa, Borrelia burgdorferi B31
EEYEIFIKQILKL

SEQ ID NO: 73207 - protein, 14 aa, Borrelia burgdorferi B31
MRIVIFIFGILLTS

SEQ ID NO: 73208 - protein, 14 aa, Borrelia burgdorferi B31
RIVIFIFGILLTSC

SEQ ID NO: 73209 - protein, 14 aa, Borrelia burgdorferi B31
IVIFIFGILLTSCF

SEQ ID NO: 73210 - protein, 14 aa, Borrelia burgdorferi B31
VIFIFGILLTSCFS

SEQ ID NO: 73211 - protein, 14 aa, Borrelia burgdorferi B31
IFIFGILLTSCFSR

SEQ ID NO: 73212 - protein, 14 aa, Borrelia burgdorferi B31
FIFGILLTSCFSRN

SEQ ID NO: 73213 - protein, 14 aa, Borrelia burgdorferi B31
IFGILLTSCFSRNG

SEQ ID NO: 73214 - protein, 14 aa, Borrelia burgdorferi B31
FGILLTSCFSRNGI

SEQ ID NO: 73215 - protein, 14 aa, Borrelia burgdorferi B31
GILLTSCFSRNGIE

SEQ ID NO: 73216 - protein, 14 aa, Borrelia burgdorferi B31
ILLTSCFSRNGIES

SEQ ID NO: 73217 - protein, 14 aa, Borrelia burgdorferi B31
LLTSCFSRNGIESS

SEQ ID NO: 73218 - protein, 14 aa, Borrelia burgdorferi B31
LTSCFSRNGIESSS

SEQ ID NO: 73219 - protein, 14 aa, Borrelia burgdorferi B31
TSCFSRNGIESSSK

SEQ ID NO: 73220 - protein, 14 aa, Borrelia burgdorferi B31
SCFSRNGIESSSKK

SEQ ID NO: 73221 - protein, 14 aa, Borrelia burgdorferi B31
CFSRNGIESSSKKI

SEQ ID NO: 73222 - protein, 14 aa, Borrelia burgdorferi B31
FSRNGIESSSKKIK

SEQ ID NO: 73223 - protein, 14 aa, Borrelia burgdorferi B31
SRNGIESSSKKIKI

SEQ ID NO: 73224 - protein, 14 aa, Borrelia burgdorferi B31
RNGIESSSKKIKIS

SEQ ID NO: 73225 - protein, 14 aa, Borrelia burgdorferi B31
NGIESSSKKIKISM

SEQ ID NO: 73226 - protein, 14 aa, Borrelia burgdorferi B31
GIESSSKKIKISML

SEQ ID NO: 73227 - protein, 14 aa, Borrelia burgdorferi B31
IESSSKKIKISMLV

SEQ ID NO: 73228 - protein, 14 aa, Borrelia burgdorferi B31
ESSSKKIKISMLVD

SEQ ID NO: 73229 - protein, 14 aa, Borrelia burgdorferi B31
SSSKKIKISMLVDG

SEQ ID NO: 73230 - protein, 14 aa, Borrelia burgdorferi B31
SSKKIKISMLVDGV

SEQ ID NO: 73231 - protein, 14 aa, Borrelia burgdorferi B31
SKKIKISMLVDGVL

SEQ ID NO: 73232 - protein, 14 aa, Borrelia burgdorferi B31
KKIKISMLVDGVLD

SEQ ID NO: 73233 - protein, 14 aa, Borrelia burgdorferi B31
KIKISMLVDGVLDD

SEQ ID NO: 73234 - protein, 14 aa, Borrelia burgdorferi B31
IKISMLVDGVLDDK

SEQ ID NO: 73235 - protein, 14 aa, Borrelia burgdorferi B31
KISMLVDGVLDDKS

SEQ ID NO: 73236 - protein, 14 aa, Borrelia burgdorferi B31
ISMLVDGVLDDKSF

SEQ ID NO: 73237 - protein, 14 aa, Borrelia burgdorferi B31
SMLVDGVLDDKSFN

SEQ ID NO: 73238 - protein, 14 aa, Borrelia burgdorferi B31
MLVDGVLDDKSFNS

SEQ ID NO: 73239 - protein, 14 aa, Borrelia burgdorferi B31
LVDGVLDDKSFNSS

SEQ ID NO: 73240 - protein, 14 aa, Borrelia burgdorferi B31
VDGVLDDKSFNSSA

SEQ ID NO: 73241 - protein, 14 aa, Borrelia burgdorferi B31
DGVLDDKSFNSSAN

SEQ ID NO: 73242 - protein, 14 aa, Borrelia burgdorferi B31
GVLDDKSFNSSANE

SEQ ID NO: 73243 - protein, 14 aa, Borrelia burgdorferi B31
VLDDKSFNSSANEA

SEQ ID NO: 73244 - protein, 14 aa, Borrelia burgdorferi B31
LDDKSFNSSANEAL

SEQ ID NO: 73245 - protein, 14 aa, Borrelia burgdorferi B31
DDKSFNSSANEALL

SEQ ID NO: 73246 - protein, 14 aa, Borrelia burgdorferi B31
DKSFNSSANEALLR

SEQ ID NO: 73247 - protein, 14 aa, Borrelia burgdorferi B31
KSFNSSANEALLRL

SEQ ID NO: 73248 - protein, 14 aa, Borrelia burgdorferi B31
SFNSSANEALLRLK

SEQ ID NO: 73249 - protein, 14 aa, Borrelia burgdorferi B31
FNSSANEALLRLKK

SEQ ID NO: 73250 - protein, 14 aa, Borrelia burgdorferi B31
NSSANEALLRLKKD

SEQ ID NO: 73251 - protein, 14 aa, Borrelia burgdorferi B31
SSANEALLRLKKDF

SEQ ID NO: 73252 - protein, 14 aa, Borrelia burgdorferi B31
SANEALLRLKKDFP

SEQ ID NO: 73253 - protein, 14 aa, Borrelia burgdorferi B31
ANEALLRLKKDFPE

SEQ ID NO: 73254 - protein, 14 aa, Borrelia burgdorferi B31
NEALLRLKKDFPEN

SEQ ID NO: 73255 - protein, 14 aa, Borrelia burgdorferi B31
EALLRLKKDFPENI

SEQ ID NO: 73256 - protein, 14 aa, Borrelia burgdorferi B31
ALLRLKKDFPENIE

SEQ ID NO: 73257 - protein, 14 aa, Borrelia burgdorferi B31
LLRLKKDFPENIEE

SEQ ID NO: 73258 - protein, 14 aa, Borrelia burgdorferi B31
LRLKKDFPENIEEV

SEQ ID NO: 73259 - protein, 14 aa, Borrelia burgdorferi B31
RLKKDFPENIEEVF

SEQ ID NO: 73260 - protein, 14 aa, Borrelia burgdorferi B31
LKKDFPENIEEVFS

SEQ ID NO: 73261 - protein, 14 aa, Borrelia burgdorferi B31
KKDFPENIEEVFSC

SEQ ID NO: 73262 - protein, 14 aa, Borrelia burgdorferi B31
KDFPENIEEVFSCA

SEQ ID NO: 73263 - protein, 14 aa, Borrelia burgdorferi B31
DFPENIEEVFSCAI

SEQ ID NO: 73264 - protein, 14 aa, Borrelia burgdorferi B31
FPENIEEVFSCAIS

SEQ ID NO: 73265 - protein, 14 aa, Borrelia burgdorferi B31
PENIEEVFSCAISG

SEQ ID NO: 73266 - protein, 14 aa, Borrelia burgdorferi B31
ENIEEVFSCAISGV

SEQ ID NO: 73267 - protein, 14 aa, Borrelia burgdorferi B31
NIEEVFSCAISGVY

SEQ ID NO: 73268 - protein, 14 aa, Borrelia burgdorferi B31
IEEVFSCAISGVYS

SEQ ID NO: 73269 - protein, 14 aa, Borrelia burgdorferi B31
EEVFSCAISGVYSS

SEQ ID NO: 73270 - protein, 14 aa, Borrelia burgdorferi B31
EVFSCAISGVYSSY

SEQ ID NO: 73271 - protein, 14 aa, Borrelia burgdorferi B31
VFSCAISGVYSSYV

SEQ ID NO: 73272 - protein, 14 aa, Borrelia burgdorferi B31
FSCAISGVYSSYVS

SEQ ID NO: 73273 - protein, 14 aa, Borrelia burgdorferi B31
SCAISGVYSSYVSD

SEQ ID NO: 73274 - protein, 14 aa, Borrelia burgdorferi B31
CAISGVYSSYVSDL

SEQ ID NO: 73275 - protein, 14 aa, Borrelia burgdorferi B31
AISGVYSSYVSDLD

SEQ ID NO: 73276 - protein, 14 aa, Borrelia burgdorferi B31
ISGVYSSYVSDLDN

SEQ ID NO: 73277 - protein, 14 aa, Borrelia burgdorferi B31
SGVYSSYVSDLDNL

SEQ ID NO: 73278 - protein, 14 aa, Borrelia burgdorferi B31
GVYSSYVSDLDNLK

SEQ ID NO: 73279 - protein, 14 aa, Borrelia burgdorferi B31
VYSSYVSDLDNLKR

SEQ ID NO: 73280 - protein, 14 aa, Borrelia burgdorferi B31
YSSYVSDLDNLKRN

SEQ ID NO: 73281 - protein, 14 aa, Borrelia burgdorferi B31
SSYVSDLDNLKRNG

SEQ ID NO: 73282 - protein, 14 aa, Borrelia burgdorferi B31
SYVSDLDNLKRNGS

SEQ ID NO: 73283 - protein, 14 aa, Borrelia burgdorferi B31
YVSDLDNLKRNGSD

SEQ ID NO: 73284 - protein, 14 aa, Borrelia burgdorferi B31
VSDLDNLKRNGSDL

SEQ ID NO: 73285 - protein, 14 aa, Borrelia burgdorferi B31
SDLDNLKRNGSDLI

SEQ ID NO: 73286 - protein, 14 aa, Borrelia burgdorferi B31
DLDNLKRNGSDLIW

SEQ ID NO: 73287 - protein, 14 aa, Borrelia burgdorferi B31
LDNLKRNGSDLIWL

SEQ ID NO: 73288 - protein, 14 aa, Borrelia burgdorferi B31
DNLKRNGSDLIWLV

SEQ ID NO: 73289 - protein, 14 aa, Borrelia burgdorferi B31
NLKRNGSDLIWLVG

SEQ ID NO: 73290 - protein, 14 aa, Borrelia burgdorferi B31
LKRNGSDLIWLVGY

SEQ ID NO: 73291 - protein, 14 aa, Borrelia burgdorferi B31
KRNGSDLIWLVGYM

SEQ ID NO: 73292 - protein, 14 aa, Borrelia burgdorferi B31
RNGSDLIWLVGYML

SEQ ID NO: 73293 - protein, 14 aa, Borrelia burgdorferi B31
NGSDLIWLVGYMLT

SEQ ID NO: 73294 - protein, 14 aa, Borrelia burgdorferi B31
GSDLIWLVGYMLTD

SEQ ID NO: 73295 - protein, 14 aa, Borrelia burgdorferi B31
SDLIWLVGYMLTDA

SEQ ID NO: 73296 - protein, 14 aa, Borrelia burgdorferi B31
DLIWLVGYMLTDAS

SEQ ID NO: 73297 - protein, 14 aa, Borrelia burgdorferi B31
LIWLVGYMLTDASL

SEQ ID NO: 73298 - protein, 14 aa, Borrelia burgdorferi B31
IWLVGYMLTDASLL

SEQ ID NO: 73299 - protein, 14 aa, Borrelia burgdorferi B31
WLVGYMLTDASLLV

SEQ ID NO: 73300 - protein, 14 aa, Borrelia burgdorferi B31
LVGYMLTDASLLVS

SEQ ID NO: 73301 - protein, 14 aa, Borrelia burgdorferi B31
VGYMLTDASLLVSS

SEQ ID NO: 73302 - protein, 14 aa, Borrelia burgdorferi B31
GYMLTDASLLVSSE

SEQ ID NO: 73303 - protein, 14 aa, Borrelia burgdorferi B31
YMLTDASLLVSSEN

SEQ ID NO: 73304 - protein, 14 aa, Borrelia burgdorferi B31
MLTDASLLVSSENP

SEQ ID NO: 73305 - protein, 14 aa, Borrelia burgdorferi B31
LTDASLLVSSENPK

SEQ ID NO: 73306 - protein, 14 aa, Borrelia burgdorferi B31
TDASLLVSSENPKI

SEQ ID NO: 73307 - protein, 14 aa, Borrelia burgdorferi B31
DASLLVSSENPKIS

SEQ ID NO: 73308 - protein, 14 aa, Borrelia burgdorferi B31
ASLLVSSENPKISY

SEQ ID NO: 73309 - protein, 14 aa, Borrelia burgdorferi B31
SLLVSSENPKISYG

SEQ ID NO: 73310 - protein, 14 aa, Borrelia burgdorferi B31
LLVSSENPKISYGI

SEQ ID NO: 73311 - protein, 14 aa, Borrelia burgdorferi B31
LVSSENPKISYGII

SEQ ID NO: 73312 - protein, 14 aa, Borrelia burgdorferi B31
VSSENPKISYGIID

SEQ ID NO: 73313 - protein, 14 aa, Borrelia burgdorferi B31
SSENPKISYGIIDP

SEQ ID NO: 73314 - protein, 14 aa, Borrelia burgdorferi B31
SENPKISYGIIDPI

SEQ ID NO: 73315 - protein, 14 aa, Borrelia burgdorferi B31
ENPKISYGIIDPIY

SEQ ID NO: 73316 - protein, 14 aa, Borrelia burgdorferi B31
NPKISYGIIDPIYG

SEQ ID NO: 73317 - protein, 14 aa, Borrelia burgdorferi B31
PKISYGIIDPIYGD

SEQ ID NO: 73318 - protein, 14 aa, Borrelia burgdorferi B31
KISYGIIDPIYGDD

SEQ ID NO: 73319 - protein, 14 aa, Borrelia burgdorferi B31
ISYGIIDPIYGDDV

SEQ ID NO: 73320 - protein, 14 aa, Borrelia burgdorferi B31
SYGIIDPIYGDDVQ

SEQ ID NO: 73321 - protein, 14 aa, Borrelia burgdorferi B31
YGIIDPIYGDDVQI

SEQ ID NO: 73322 - protein, 14 aa, Borrelia burgdorferi B31
GIIDPIYGDDVQIP

SEQ ID NO: 73323 - protein, 14 aa, Borrelia burgdorferi B31
IIDPIYGDDVQIPE

SEQ ID NO: 73324 - protein, 14 aa, Borrelia burgdorferi B31
IDPIYGDDVQIPEN

SEQ ID NO: 73325 - protein, 14 aa, Borrelia burgdorferi B31
DPIYGDDVQIPENL

SEQ ID NO: 73326 - protein, 14 aa, Borrelia burgdorferi B31
PIYGDDVQIPENLI

SEQ ID NO: 73327 - protein, 14 aa, Borrelia burgdorferi B31
IYGDDVQIPENLIA

SEQ ID NO: 73328 - protein, 14 aa, Borrelia burgdorferi B31
YGDDVQIPENLIAV

SEQ ID NO: 73329 - protein, 14 aa, Borrelia burgdorferi B31
GDDVQIPENLIAVV

SEQ ID NO: 73330 - protein, 14 aa, Borrelia burgdorferi B31
DDVQIPENLIAVVF

SEQ ID NO: 73331 - protein, 14 aa, Borrelia burgdorferi B31
DVQIPENLIAVVFR

SEQ ID NO: 73332 - protein, 14 aa, Borrelia burgdorferi B31
VQIPENLIAVVFRV

SEQ ID NO: 73333 - protein, 14 aa, Borrelia burgdorferi B31
QIPENLIAVVFRVE

SEQ ID NO: 73334 - protein, 14 aa, Borrelia burgdorferi B31
IPENLIAVVFRVEQ

SEQ ID NO: 73335 - protein, 14 aa, Borrelia burgdorferi B31
PENLIAVVFRVEQG

SEQ ID NO: 73336 - protein, 14 aa, Borrelia burgdorferi B31
ENLIAVVFRVEQGA

SEQ ID NO: 73337 - protein, 14 aa, Borrelia burgdorferi B31
NLIAVVFRVEQGAF

SEQ ID NO: 73338 - protein, 14 aa, Borrelia burgdorferi B31
LIAVVFRVEQGAFL

SEQ ID NO: 73339 - protein, 14 aa, Borrelia burgdorferi B31
IAVVFRVEQGAFLA

SEQ ID NO: 73340 - protein, 14 aa, Borrelia burgdorferi B31
AVVFRVEQGAFLAG

SEQ ID NO: 73341 - protein, 14 aa, Borrelia burgdorferi B31
VVFRVEQGAFLAGY

SEQ ID NO: 73342 - protein, 14 aa, Borrelia burgdorferi B31
VFRVEQGAFLAGYI

SEQ ID NO: 73343 - protein, 14 aa, Borrelia burgdorferi B31
FRVEQGAFLAGYIA

SEQ ID NO: 73344 - protein, 14 aa, Borrelia burgdorferi B31
RVEQGAFLAGYIAA

SEQ ID NO: 73345 - protein, 14 aa, Borrelia burgdorferi B31
VEQGAFLAGYIAAK

SEQ ID NO: 73346 - protein, 14 aa, Borrelia burgdorferi B31
EQGAFLAGYIAAKK

SEQ ID NO: 73347 - protein, 14 aa, Borrelia burgdorferi B31
QGAFLAGYIAAKKS

SEQ ID NO: 73348 - protein, 14 aa, Borrelia burgdorferi B31
GAFLAGYIAAKKSF

SEQ ID NO: 73349 - protein, 14 aa, Borrelia burgdorferi B31
AFLAGYIAAKKSFS

SEQ ID NO: 73350 - protein, 14 aa, Borrelia burgdorferi B31
FLAGYIAAKKSFSG

SEQ ID NO: 73351 - protein, 14 aa, Borrelia burgdorferi B31
LAGYIAAKKSFSGK

SEQ ID NO: 73352 - protein, 14 aa, Borrelia burgdorferi B31
AGYIAAKKSFSGKI

SEQ ID NO: 73353 - protein, 14 aa, Borrelia burgdorferi B31
GYIAAKKSFSGKIG

SEQ ID NO: 73354 - protein, 14 aa, Borrelia burgdorferi B31
YIAAKKSFSGKIGF

SEQ ID NO: 73355 - protein, 14 aa, Borrelia burgdorferi B31
IAAKKSFSGKIGFI

SEQ ID NO: 73356 - protein, 14 aa, Borrelia burgdorferi B31
AAKKSFSGKIGFIG

SEQ ID NO: 73357 - protein, 14 aa, Borrelia burgdorferi B31
AKKSFSGKIGFIGG

SEQ ID NO: 73358 - protein, 14 aa, Borrelia burgdorferi B31
KKSFSGKIGFIGGM

SEQ ID NO: 73359 - protein, 14 aa, Borrelia burgdorferi B31
KSFSGKIGFIGGMK

SEQ ID NO: 73360 - protein, 14 aa, Borrelia burgdorferi B31
SFSGKIGFIGGMKG

SEQ ID NO: 73361 - protein, 14 aa, Borrelia burgdorferi B31
FSGKIGFIGGMKGN

SEQ ID NO: 73362 - protein, 14 aa, Borrelia burgdorferi B31
SGKIGFIGGMKGNI

SEQ ID NO: 73363 - protein, 14 aa, Borrelia burgdorferi B31
GKIGFIGGMKGNIV

SEQ ID NO: 73364 - protein, 14 aa, Borrelia burgdorferi B31
KIGFIGGMKGNIVD

SEQ ID NO: 73365 - protein, 14 aa, Borrelia burgdorferi B31
IGFIGGMKGNIVDA

SEQ ID NO: 73366 - protein, 14 aa, Borrelia burgdorferi B31
GFIGGMKGNIVDAF

SEQ ID NO: 73367 - protein, 14 aa, Borrelia burgdorferi B31
FIGGMKGNIVDAFR

SEQ ID NO: 73368 - protein, 14 aa, Borrelia burgdorferi B31
IGGMKGNIVDAFRY

SEQ ID NO: 73369 - protein, 14 aa, Borrelia burgdorferi B31
GGMKGNIVDAFRYG

SEQ ID NO: 73370 - protein, 14 aa, Borrelia burgdorferi B31
GMKGNIVDAFRYGY

SEQ ID NO: 73371 - protein, 14 aa, Borrelia burgdorferi B31
MKGNIVDAFRYGYE

SEQ ID NO: 73372 - protein, 14 aa, Borrelia burgdorferi B31
KGNIVDAFRYGYES

SEQ ID NO: 73373 - protein, 14 aa, Borrelia burgdorferi B31
GNIVDAFRYGYESG

SEQ ID NO: 73374 - protein, 14 aa, Borrelia burgdorferi B31
NIVDAFRYGYESGA

SEQ ID NO: 73375 - protein, 14 aa, Borrelia burgdorferi B31
IVDAFRYGYESGAK

SEQ ID NO: 73376 - protein, 14 aa, Borrelia burgdorferi B31
VDAFRYGYESGAKY

SEQ ID NO: 73377 - protein, 14 aa, Borrelia burgdorferi B31
DAFRYGYESGAKYA

SEQ ID NO: 73378 - protein, 14 aa, Borrelia burgdorferi B31
AFRYGYESGAKYAN

SEQ ID NO: 73379 - protein, 14 aa, Borrelia burgdorferi B31
FRYGYESGAKYANK

SEQ ID NO: 73380 - protein, 14 aa, Borrelia burgdorferi B31
RYGYESGAKYANKD

SEQ ID NO: 73381 - protein, 14 aa, Borrelia burgdorferi B31
YGYESGAKYANKDI

SEQ ID NO: 73382 - protein, 14 aa, Borrelia burgdorferi B31
GYESGAKYANKDIE

SEQ ID NO: 73383 - protein, 14 aa, Borrelia burgdorferi B31
YESGAKYANKDIEI

SEQ ID NO: 73384 - protein, 14 aa, Borrelia burgdorferi B31
ESGAKYANKDIEII

SEQ ID NO: 73385 - protein, 14 aa, Borrelia burgdorferi B31
SGAKYANKDIEIIS

SEQ ID NO: 73386 - protein, 14 aa, Borrelia burgdorferi B31
GAKYANKDIEIISE

SEQ ID NO: 73387 - protein, 14 aa, Borrelia burgdorferi B31
AKYANKDIEIISEY

SEQ ID NO: 73388 - protein, 14 aa, Borrelia burgdorferi B31
KYANKDIEIISEYS

SEQ ID NO: 73389 - protein, 14 aa, Borrelia burgdorferi B31
YANKDIEIISEYSN

SEQ ID NO: 73390 - protein, 14 aa, Borrelia burgdorferi B31
ANKDIEIISEYSNS

SEQ ID NO: 73391 - protein, 14 aa, Borrelia burgdorferi B31
NKDIEIISEYSNSF

SEQ ID NO: 73392 - protein, 14 aa, Borrelia burgdorferi B31
KDIEIISEYSNSFS

SEQ ID NO: 73393 - protein, 14 aa, Borrelia burgdorferi B31
DIEIISEYSNSFSD

SEQ ID NO: 73394 - protein, 14 aa, Borrelia burgdorferi B31
IEIISEYSNSFSDV

SEQ ID NO: 73395 - protein, 14 aa, Borrelia burgdorferi B31
EIISEYSNSFSDVD

SEQ ID NO: 73396 - protein, 14 aa, Borrelia burgdorferi B31
IISEYSNSFSDVDI

SEQ ID NO: 73397 - protein, 14 aa, Borrelia burgdorferi B31
ISEYSNSFSDVDIG

SEQ ID NO: 73398 - protein, 14 aa, Borrelia burgdorferi B31
SEYSNSFSDVDIGR

SEQ ID NO: 73399 - protein, 14 aa, Borrelia burgdorferi B31
EYSNSFSDVDIGRT

SEQ ID NO: 73400 - protein, 14 aa, Borrelia burgdorferi B31
YSNSFSDVDIGRTI

SEQ ID NO: 73401 - protein, 14 aa, Borrelia burgdorferi B31
SNSFSDVDIGRTIA

SEQ ID NO: 73402 - protein, 14 aa, Borrelia burgdorferi B31
NSFSDVDIGRTIAS

SEQ ID NO: 73403 - protein, 14 aa, Borrelia burgdorferi B31
SFSDVDIGRTIASK

SEQ ID NO: 73404 - protein, 14 aa, Borrelia burgdorferi B31
FSDVDIGRTIASKM

SEQ ID NO: 73405 - protein, 14 aa, Borrelia burgdorferi B31
SDVDIGRTIASKMY

SEQ ID NO: 73406 - protein, 14 aa, Borrelia burgdorferi B31
DVDIGRTIASKMYS

SEQ ID NO: 73407 - protein, 14 aa, Borrelia burgdorferi B31
VDIGRTIASKMYSK

SEQ ID NO: 73408 - protein, 14 aa, Borrelia burgdorferi B31
DIGRTIASKMYSKG

SEQ ID NO: 73409 - protein, 14 aa, Borrelia burgdorferi B31
IGRTIASKMYSKGI

SEQ ID NO: 73410 - protein, 14 aa, Borrelia burgdorferi B31
GRTIASKMYSKGID

SEQ ID NO: 73411 - protein, 14 aa, Borrelia burgdorferi B31
RTIASKMYSKGIDV

SEQ ID NO: 73412 - protein, 14 aa, Borrelia burgdorferi B31
TIASKMYSKGIDVI

SEQ ID NO: 73413 - protein, 14 aa, Borrelia burgdorferi B31
IASKMYSKGIDVIH

SEQ ID NO: 73414 - protein, 14 aa, Borrelia burgdorferi B31
ASKMYSKGIDVIHF

SEQ ID NO: 73415 - protein, 14 aa, Borrelia burgdorferi B31
SKMYSKGIDVIHFA

SEQ ID NO: 73416 - protein, 14 aa, Borrelia burgdorferi B31
KMYSKGIDVIHFAA

SEQ ID NO: 73417 - protein, 14 aa, Borrelia burgdorferi B31
MYSKGIDVIHFAAG

SEQ ID NO: 73418 - protein, 14 aa, Borrelia burgdorferi B31
YSKGIDVIHFAAGL

SEQ ID NO: 73419 - protein, 14 aa, Borrelia burgdorferi B31
SKGIDVIHFAAGLA

SEQ ID NO: 73420 - protein, 14 aa, Borrelia burgdorferi B31
KGIDVIHFAAGLAG

SEQ ID NO: 73421 - protein, 14 aa, Borrelia burgdorferi B31
GIDVIHFAAGLAGI

SEQ ID NO: 73422 - protein, 14 aa, Borrelia burgdorferi B31
IDVIHFAAGLAGIG

SEQ ID NO: 73423 - protein, 14 aa, Borrelia burgdorferi B31
DVIHFAAGLAGIGV

SEQ ID NO: 73424 - protein, 14 aa, Borrelia burgdorferi B31
VIHFAAGLAGIGVI

SEQ ID NO: 73425 - protein, 14 aa, Borrelia burgdorferi B31
IHFAAGLAGIGVIE

SEQ ID NO: 73426 - protein, 14 aa, Borrelia burgdorferi B31
HFAAGLAGIGVIET

SEQ ID NO: 73427 - protein, 14 aa, Borrelia burgdorferi B31
FAAGLAGIGVIETA

SEQ ID NO: 73428 - protein, 14 aa, Borrelia burgdorferi B31
AAGLAGIGVIETAK

SEQ ID NO: 73429 - protein, 14 aa, Borrelia burgdorferi B31
AGLAGIGVIETAKN

SEQ ID NO: 73430 - protein, 14 aa, Borrelia burgdorferi B31
GLAGIGVIETAKNL

SEQ ID NO: 73431 - protein, 14 aa, Borrelia burgdorferi B31
LAGIGVIETAKNLG

SEQ ID NO: 73432 - protein, 14 aa, Borrelia burgdorferi B31
AGIGVIETAKNLGD

SEQ ID NO: 73433 - protein, 14 aa, Borrelia burgdorferi B31
GIGVIETAKNLGDG

SEQ ID NO: 73434 - protein, 14 aa, Borrelia burgdorferi B31
IGVIETAKNLGDGY

SEQ ID NO: 73435 - protein, 14 aa, Borrelia burgdorferi B31
GVIETAKNLGDGYY

SEQ ID NO: 73436 - protein, 14 aa, Borrelia burgdorferi B31
VIETAKNLGDGYYV

SEQ ID NO: 73437 - protein, 14 aa, Borrelia burgdorferi B31
IETAKNLGDGYYVI

SEQ ID NO: 73438 - protein, 14 aa, Borrelia burgdorferi B31
ETAKNLGDGYYVIG

SEQ ID NO: 73439 - protein, 14 aa, Borrelia burgdorferi B31
TAKNLGDGYYVIGA

SEQ ID NO: 73440 - protein, 14 aa, Borrelia burgdorferi B31
AKNLGDGYYVIGAD

SEQ ID NO: 73441 - protein, 14 aa, Borrelia burgdorferi B31
KNLGDGYYVIGADQ

SEQ ID NO: 73442 - protein, 14 aa, Borrelia burgdorferi B31
NLGDGYYVIGADQD

SEQ ID NO: 73443 - protein, 14 aa, Borrelia burgdorferi B31
LGDGYYVIGADQDQ

SEQ ID NO: 73444 - protein, 14 aa, Borrelia burgdorferi B31
GDGYYVIGADQDQS

SEQ ID NO: 73445 - protein, 14 aa, Borrelia burgdorferi B31
DGYYVIGADQDQSY

SEQ ID NO: 73446 - protein, 14 aa, Borrelia burgdorferi B31
GYYVIGADQDQSYL

SEQ ID NO: 73447 - protein, 14 aa, Borrelia burgdorferi B31
YYVIGADQDQSYLA

SEQ ID NO: 73448 - protein, 14 aa, Borrelia burgdorferi B31
YVIGADQDQSYLAP

SEQ ID NO: 73449 - protein, 14 aa, Borrelia burgdorferi B31
VIGADQDQSYLAPK

SEQ ID NO: 73450 - protein, 14 aa, Borrelia burgdorferi B31
IGADQDQSYLAPKN

SEQ ID NO: 73451 - protein, 14 aa, Borrelia burgdorferi B31
GADQDQSYLAPKNF

SEQ ID NO: 73452 - protein, 14 aa, Borrelia burgdorferi B31
ADQDQSYLAPKNFI

SEQ ID NO: 73453 - protein, 14 aa, Borrelia burgdorferi B31
DQDQSYLAPKNFIT

SEQ ID NO: 73454 - protein, 14 aa, Borrelia burgdorferi B31
QDQSYLAPKNFITS

SEQ ID NO: 73455 - protein, 14 aa, Borrelia burgdorferi B31
DQSYLAPKNFITSV

SEQ ID NO: 73456 - protein, 14 aa, Borrelia burgdorferi B31
QSYLAPKNFITSVI

SEQ ID NO: 73457 - protein, 14 aa, Borrelia burgdorferi B31
SYLAPKNFITSVIK

SEQ ID NO: 73458 - protein, 14 aa, Borrelia burgdorferi B31
YLAPKNFITSVIKN

SEQ ID NO: 73459 - protein, 14 aa, Borrelia burgdorferi B31
LAPKNFITSVIKNI

SEQ ID NO: 73460 - protein, 14 aa, Borrelia burgdorferi B31
APKNFITSVIKNIG

SEQ ID NO: 73461 - protein, 14 aa, Borrelia burgdorferi B31
PKNFITSVIKNIGD

SEQ ID NO: 73462 - protein, 14 aa, Borrelia burgdorferi B31
KNFITSVIKNIGDA

SEQ ID NO: 73463 - protein, 14 aa, Borrelia burgdorferi B31
NFITSVIKNIGDAL

SEQ ID NO: 73464 - protein, 14 aa, Borrelia burgdorferi B31
FITSVIKNIGDALY

SEQ ID NO: 73465 - protein, 14 aa, Borrelia burgdorferi B31
ITSVIKNIGDALYL

SEQ ID NO: 73466 - protein, 14 aa, Borrelia burgdorferi B31
TSVIKNIGDALYLI

SEQ ID NO: 73467 - protein, 14 aa, Borrelia burgdorferi B31
SVIKNIGDALYLIT

SEQ ID NO: 73468 - protein, 14 aa, Borrelia burgdorferi B31
VIKNIGDALYLITG

SEQ ID NO: 73469 - protein, 14 aa, Borrelia burgdorferi B31
IKNIGDALYLITGE

SEQ ID NO: 73470 - protein, 14 aa, Borrelia burgdorferi B31
KNIGDALYLITGEY

SEQ ID NO: 73471 - protein, 14 aa, Borrelia burgdorferi B31
NIGDALYLITGEYI

SEQ ID NO: 73472 - protein, 14 aa, Borrelia burgdorferi B31
IGDALYLITGEYIK

SEQ ID NO: 73473 - protein, 14 aa, Borrelia burgdorferi B31
GDALYLITGEYIKN

SEQ ID NO: 73474 - protein, 14 aa, Borrelia burgdorferi B31
DALYLITGEYIKNN

SEQ ID NO: 73475 - protein, 14 aa, Borrelia burgdorferi B31
ALYLITGEYIKNNN

SEQ ID NO: 73476 - protein, 14 aa, Borrelia burgdorferi B31
LYLITGEYIKNNNV

SEQ ID NO: 73477 - protein, 14 aa, Borrelia burgdorferi B31
YLITGEYIKNNNVW

SEQ ID NO: 73478 - protein, 14 aa, Borrelia burgdorferi B31
LITGEYIKNNNVWE

SEQ ID NO: 73479 - protein, 14 aa, Borrelia burgdorferi B31
ITGEYIKNNNVWEG

SEQ ID NO: 73480 - protein, 14 aa, Borrelia burgdorferi B31
TGEYIKNNNVWEGG

SEQ ID NO: 73481 - protein, 14 aa, Borrelia burgdorferi B31
GEYIKNNNVWEGGK

SEQ ID NO: 73482 - protein, 14 aa, Borrelia burgdorferi B31
EYIKNNNVWEGGKV

SEQ ID NO: 73483 - protein, 14 aa, Borrelia burgdorferi B31
YIKNNNVWEGGKVV

SEQ ID NO: 73484 - protein, 14 aa, Borrelia burgdorferi B31
IKNNNVWEGGKVVQ

SEQ ID NO: 73485 - protein, 14 aa, Borrelia burgdorferi B31
KNNNVWEGGKVVQM

SEQ ID NO: 73486 - protein, 14 aa, Borrelia burgdorferi B31
NNNVWEGGKVVQMG

SEQ ID NO: 73487 - protein, 14 aa, Borrelia burgdorferi B31
NNVWEGGKVVQMGL

SEQ ID NO: 73488 - protein, 14 aa, Borrelia burgdorferi B31
NVWEGGKVVQMGLR

SEQ ID NO: 73489 - protein, 14 aa, Borrelia burgdorferi B31
VWEGGKVVQMGLRD

SEQ ID NO: 73490 - protein, 14 aa, Borrelia burgdorferi B31
WEGGKVVQMGLRDG

SEQ ID NO: 73491 - protein, 14 aa, Borrelia burgdorferi B31
EGGKVVQMGLRDGV

SEQ ID NO: 73492 - protein, 14 aa, Borrelia burgdorferi B31
GGKVVQMGLRDGVI

SEQ ID NO: 73493 - protein, 14 aa, Borrelia burgdorferi B31
GKVVQMGLRDGVIG

SEQ ID NO: 73494 - protein, 14 aa, Borrelia burgdorferi B31
KVVQMGLRDGVIGL

SEQ ID NO: 73495 - protein, 14 aa, Borrelia burgdorferi B31
VVQMGLRDGVIGLP

SEQ ID NO: 73496 - protein, 14 aa, Borrelia burgdorferi B31
VQMGLRDGVIGLPN

SEQ ID NO: 73497 - protein, 14 aa, Borrelia burgdorferi B31
QMGLRDGVIGLPNA

SEQ ID NO: 73498 - protein, 14 aa, Borrelia burgdorferi B31
MGLRDGVIGLPNAN

SEQ ID NO: 73499 - protein, 14 aa, Borrelia burgdorferi B31
GLRDGVIGLPNANE

SEQ ID NO: 73500 - protein, 14 aa, Borrelia burgdorferi B31
LRDGVIGLPNANEF

SEQ ID NO: 73501 - protein, 14 aa, Borrelia burgdorferi B31
RDGVIGLPNANEFE

SEQ ID NO: 73502 - protein, 14 aa, Borrelia burgdorferi B31
DGVIGLPNANEFEY

SEQ ID NO: 73503 - protein, 14 aa, Borrelia burgdorferi B31
GVIGLPNANEFEYI

SEQ ID NO: 73504 - protein, 14 aa, Borrelia burgdorferi B31
VIGLPNANEFEYIK

SEQ ID NO: 73505 - protein, 14 aa, Borrelia burgdorferi B31
IGLPNANEFEYIKV

SEQ ID NO: 73506 - protein, 14 aa, Borrelia burgdorferi B31
GLPNANEFEYIKVL

SEQ ID NO: 73507 - protein, 14 aa, Borrelia burgdorferi B31
LPNANEFEYIKVLE

SEQ ID NO: 73508 - protein, 14 aa, Borrelia burgdorferi B31
PNANEFEYIKVLER

SEQ ID NO: 73509 - protein, 14 aa, Borrelia burgdorferi B31
NANEFEYIKVLERK

SEQ ID NO: 73510 - protein, 14 aa, Borrelia burgdorferi B31
ANEFEYIKVLERKI

SEQ ID NO: 73511 - protein, 14 aa, Borrelia burgdorferi B31
NEFEYIKVLERKII

SEQ ID NO: 73512 - protein, 14 aa, Borrelia burgdorferi B31
EFEYIKVLERKIIN

SEQ ID NO: 73513 - protein, 14 aa, Borrelia burgdorferi B31
FEYIKVLERKIINK

SEQ ID NO: 73514 - protein, 14 aa, Borrelia burgdorferi B31
EYIKVLERKIINKE

SEQ ID NO: 73515 - protein, 14 aa, Borrelia burgdorferi B31
YIKVLERKIINKEI

SEQ ID NO: 73516 - protein, 14 aa, Borrelia burgdorferi B31
IKVLERKIINKEII

SEQ ID NO: 73517 - protein, 14 aa, Borrelia burgdorferi B31
KVLERKIINKEIIV

SEQ ID NO: 73518 - protein, 14 aa, Borrelia burgdorferi B31
VLERKIINKEIIVP

SEQ ID NO: 73519 - protein, 14 aa, Borrelia burgdorferi B31
LERKIINKEIIVPC

SEQ ID NO: 73520 - protein, 14 aa, Borrelia burgdorferi B31
ERKIINKEIIVPCN

SEQ ID NO: 73521 - protein, 14 aa, Borrelia burgdorferi B31
RKIINKEIIVPCNQ

SEQ ID NO: 73522 - protein, 14 aa, Borrelia burgdorferi B31
KIINKEIIVPCNQE

SEQ ID NO: 73523 - protein, 14 aa, Borrelia burgdorferi B31
IINKEIIVPCNQEE

SEQ ID NO: 73524 - protein, 14 aa, Borrelia burgdorferi B31
INKEIIVPCNQEEY

SEQ ID NO: 73525 - protein, 14 aa, Borrelia burgdorferi B31
NKEIIVPCNQEEYE

SEQ ID NO: 73526 - protein, 14 aa, Borrelia burgdorferi B31
KEIIVPCNQEEYEI

SEQ ID NO: 73527 - protein, 14 aa, Borrelia burgdorferi B31
EIIVPCNQEEYEIF

SEQ ID NO: 73528 - protein, 14 aa, Borrelia burgdorferi B31
IIVPCNQEEYEIFI

SEQ ID NO: 73529 - protein, 14 aa, Borrelia burgdorferi B31
IVPCNQEEYEIFIK

SEQ ID NO: 73530 - protein, 14 aa, Borrelia burgdorferi B31
VPCNQEEYEIFIKQ

SEQ ID NO: 73531 - protein, 14 aa, Borrelia burgdorferi B31
PCNQEEYEIFIKQI

SEQ ID NO: 73532 - protein, 14 aa, Borrelia burgdorferi B31
CNQEEYEIFIKQIL

SEQ ID NO: 73533 - protein, 14 aa, Borrelia burgdorferi B31
NQEEYEIFIKQILK

SEQ ID NO: 73534 - protein, 14 aa, Borrelia burgdorferi B31
QEEYEIFIKQILKL

SEQ ID NO: 73535 - protein, 15 aa, Borrelia burgdorferi B31
MRIVIFIFGILLTSC

SEQ ID NO: 73536 - protein, 15 aa, Borrelia burgdorferi B31
RIVIFIFGILLTSCF

SEQ ID NO: 73537 - protein, 15 aa, Borrelia burgdorferi B31
IVIFIFGILLTSCFS

SEQ ID NO: 73538 - protein, 15 aa, Borrelia burgdorferi B31
VIFIFGILLTSCFSR

SEQ ID NO: 73539 - protein, 15 aa, Borrelia burgdorferi B31
IFIFGILLTSCFSRN

SEQ ID NO: 73540 - protein, 15 aa, Borrelia burgdorferi B31
FIFGILLTSCFSRNG

SEQ ID NO: 73541 - protein, 15 aa, Borrelia burgdorferi B31
IFGILLTSCFSRNGI

SEQ ID NO: 73542 - protein, 15 aa, Borrelia burgdorferi B31
FGILLTSCFSRNGIE

SEQ ID NO: 73543 - protein, 15 aa, Borrelia burgdorferi B31
GILLTSCFSRNGIES

SEQ ID NO: 73544 - protein, 15 aa, Borrelia burgdorferi B31
ILLTSCFSRNGIESS

SEQ ID NO: 73545 - protein, 15 aa, Borrelia burgdorferi B31
LLTSCFSRNGIESSS

SEQ ID NO: 73546 - protein, 15 aa, Borrelia burgdorferi B31
LTSCFSRNGIESSSK

SEQ ID NO: 73547 - protein, 15 aa, Borrelia burgdorferi B31
TSCFSRNGIESSSKK

SEQ ID NO: 73548 - protein, 15 aa, Borrelia burgdorferi B31
SCFSRNGIESSSKKI

SEQ ID NO: 73549 - protein, 15 aa, Borrelia burgdorferi B31
CFSRNGIESSSKKIK

SEQ ID NO: 73550 - protein, 15 aa, Borrelia burgdorferi B31
FSRNGIESSSKKIKI

SEQ ID NO: 73551 - protein, 15 aa, Borrelia burgdorferi B31
SRNGIESSSKKIKIS

SEQ ID NO: 73552 - protein, 15 aa, Borrelia burgdorferi B31
RNGIESSSKKIKISM

SEQ ID NO: 73553 - protein, 15 aa, Borrelia burgdorferi B31
NGIESSSKKIKISML

SEQ ID NO: 73554 - protein, 15 aa, Borrelia burgdorferi B31
GIESSSKKIKISMLV

SEQ ID NO: 73555 - protein, 15 aa, Borrelia burgdorferi B31
IESSSKKIKISMLVD

SEQ ID NO: 73556 - protein, 15 aa, Borrelia burgdorferi B31
ESSSKKIKISMLVDG

SEQ ID NO: 73557 - protein, 15 aa, Borrelia burgdorferi B31
SSSKKIKISMLVDGV

SEQ ID NO: 73558 - protein, 15 aa, Borrelia burgdorferi B31
SSKKIKISMLVDGVL

SEQ ID NO: 73559 - protein, 15 aa, Borrelia burgdorferi B31
SKKIKISMLVDGVLD

SEQ ID NO: 73560 - protein, 15 aa, Borrelia burgdorferi B31
KKIKISMLVDGVLDD

SEQ ID NO: 73561 - protein, 15 aa, Borrelia burgdorferi B31
KIKISMLVDGVLDDK

SEQ ID NO: 73562 - protein, 15 aa, Borrelia burgdorferi B31
IKISMLVDGVLDDKS

SEQ ID NO: 73563 - protein, 15 aa, Borrelia burgdorferi B31
KISMLVDGVLDDKSF

SEQ ID NO: 73564 - protein, 15 aa, Borrelia burgdorferi B31
ISMLVDGVLDDKSFN

SEQ ID NO: 73565 - protein, 15 aa, Borrelia burgdorferi B31
SMLVDGVLDDKSFNS

SEQ ID NO: 73566 - protein, 15 aa, Borrelia burgdorferi B31
MLVDGVLDDKSFNSS

SEQ ID NO: 73567 - protein, 15 aa, Borrelia burgdorferi B31
LVDGVLDDKSFNSSA

SEQ ID NO: 73568 - protein, 15 aa, Borrelia burgdorferi B31
VDGVLDDKSFNSSAN

SEQ ID NO: 73569 - protein, 15 aa, Borrelia burgdorferi B31
DGVLDDKSFNSSANE

SEQ ID NO: 73570 - protein, 15 aa, Borrelia burgdorferi B31
GVLDDKSFNSSANEA

SEQ ID NO: 73571 - protein, 15 aa, Borrelia burgdorferi B31
VLDDKSFNSSANEAL

SEQ ID NO: 73572 - protein, 15 aa, Borrelia burgdorferi B31
LDDKSFNSSANEALL

SEQ ID NO: 73573 - protein, 15 aa, Borrelia burgdorferi B31
DDKSFNSSANEALLR

SEQ ID NO: 73574 - protein, 15 aa, Borrelia burgdorferi B31
DKSFNSSANEALLRL

SEQ ID NO: 73575 - protein, 15 aa, Borrelia burgdorferi B31
KSFNSSANEALLRLK

SEQ ID NO: 73576 - protein, 15 aa, Borrelia burgdorferi B31
SFNSSANEALLRLKK

SEQ ID NO: 73577 - protein, 15 aa, Borrelia burgdorferi B31
FNSSANEALLRLKKD

SEQ ID NO: 73578 - protein, 15 aa, Borrelia burgdorferi B31
NSSANEALLRLKKDF

SEQ ID NO: 73579 - protein, 15 aa, Borrelia burgdorferi B31
SSANEALLRLKKDFP

SEQ ID NO: 73580 - protein, 15 aa, Borrelia burgdorferi B31
SANEALLRLKKDFPE

SEQ ID NO: 73581 - protein, 15 aa, Borrelia burgdorferi B31
ANEALLRLKKDFPEN

SEQ ID NO: 73582 - protein, 15 aa, Borrelia burgdorferi B31
NEALLRLKKDFPENI

SEQ ID NO: 73583 - protein, 15 aa, Borrelia burgdorferi B31
EALLRLKKDFPENIE

SEQ ID NO: 73584 - protein, 15 aa, Borrelia burgdorferi B31
ALLRLKKDFPENIEE

SEQ ID NO: 73585 - protein, 15 aa, Borrelia burgdorferi B31
LLRLKKDFPENIEEV

SEQ ID NO: 73586 - protein, 15 aa, Borrelia burgdorferi B31
LRLKKDFPENIEEVF

SEQ ID NO: 73587 - protein, 15 aa, Borrelia burgdorferi B31
RLKKDFPENIEEVFS

SEQ ID NO: 73588 - protein, 15 aa, Borrelia burgdorferi B31
LKKDFPENIEEVFSC

SEQ ID NO: 73589 - protein, 15 aa, Borrelia burgdorferi B31
KKDFPENIEEVFSCA

SEQ ID NO: 73590 - protein, 15 aa, Borrelia burgdorferi B31
KDFPENIEEVFSCAI

SEQ ID NO: 73591 - protein, 15 aa, Borrelia burgdorferi B31
DFPENIEEVFSCAIS

SEQ ID NO: 73592 - protein, 15 aa, Borrelia burgdorferi B31
FPENIEEVFSCAISG

SEQ ID NO: 73593 - protein, 15 aa, Borrelia burgdorferi B31
PENIEEVFSCAISGV

SEQ ID NO: 73594 - protein, 15 aa, Borrelia burgdorferi B31
ENIEEVFSCAISGVY

SEQ ID NO: 73595 - protein, 15 aa, Borrelia burgdorferi B31
NIEEVFSCAISGVYS

SEQ ID NO: 73596 - protein, 15 aa, Borrelia burgdorferi B31
IEEVFSCAISGVYSS

SEQ ID NO: 73597 - protein, 15 aa, Borrelia burgdorferi B31
EEVFSCAISGVYSSY

SEQ ID NO: 73598 - protein, 15 aa, Borrelia burgdorferi B31
EVFSCAISGVYSSYV

SEQ ID NO: 73599 - protein, 15 aa, Borrelia burgdorferi B31
VFSCAISGVYSSYVS

SEQ ID NO: 73600 - protein, 15 aa, Borrelia burgdorferi B31
FSCAISGVYSSYVSD

SEQ ID NO: 73601 - protein, 15 aa, Borrelia burgdorferi B31
SCAISGVYSSYVSDL

SEQ ID NO: 73602 - protein, 15 aa, Borrelia burgdorferi B31
CAISGVYSSYVSDLD

SEQ ID NO: 73603 - protein, 15 aa, Borrelia burgdorferi B31
AISGVYSSYVSDLDN

SEQ ID NO: 73604 - protein, 15 aa, Borrelia burgdorferi B31
ISGVYSSYVSDLDNL

SEQ ID NO: 73605 - protein, 15 aa, Borrelia burgdorferi B31
SGVYSSYVSDLDNLK

SEQ ID NO: 73606 - protein, 15 aa, Borrelia burgdorferi B31
GVYSSYVSDLDNLKR

SEQ ID NO: 73607 - protein, 15 aa, Borrelia burgdorferi B31
VYSSYVSDLDNLKRN

SEQ ID NO: 73608 - protein, 15 aa, Borrelia burgdorferi B31
YSSYVSDLDNLKRNG

SEQ ID NO: 73609 - protein, 15 aa, Borrelia burgdorferi B31
SSYVSDLDNLKRNGS

SEQ ID NO: 73610 - protein, 15 aa, Borrelia burgdorferi B31
SYVSDLDNLKRNGSD

SEQ ID NO: 73611 - protein, 15 aa, Borrelia burgdorferi B31
YVSDLDNLKRNGSDL

SEQ ID NO: 73612 - protein, 15 aa, Borrelia burgdorferi B31
VSDLDNLKRNGSDLI

SEQ ID NO: 73613 - protein, 15 aa, Borrelia burgdorferi B31
SDLDNLKRNGSDLIW

SEQ ID NO: 73614 - protein, 15 aa, Borrelia burgdorferi B31
DLDNLKRNGSDLIWL

SEQ ID NO: 73615 - protein, 15 aa, Borrelia burgdorferi B31
LDNLKRNGSDLIWLV

SEQ ID NO: 73616 - protein, 15 aa, Borrelia burgdorferi B31
DNLKRNGSDLIWLVG

SEQ ID NO: 73617 - protein, 15 aa, Borrelia burgdorferi B31
NLKRNGSDLIWLVGY

SEQ ID NO: 73618 - protein, 15 aa, Borrelia burgdorferi B31
LKRNGSDLIWLVGYM

SEQ ID NO: 73619 - protein, 15 aa, Borrelia burgdorferi B31
KRNGSDLIWLVGYML

SEQ ID NO: 73620 - protein, 15 aa, Borrelia burgdorferi B31
RNGSDLIWLVGYMLT

SEQ ID NO: 73621 - protein, 15 aa, Borrelia burgdorferi B31
NGSDLIWLVGYMLTD

SEQ ID NO: 73622 - protein, 15 aa, Borrelia burgdorferi B31
GSDLIWLVGYMLTDA

SEQ ID NO: 73623 - protein, 15 aa, Borrelia burgdorferi B31
SDLIWLVGYMLTDAS

SEQ ID NO: 73624 - protein, 15 aa, Borrelia burgdorferi B31
DLIWLVGYMLTDASL

SEQ ID NO: 73625 - protein, 15 aa, Borrelia burgdorferi B31
LIWLVGYMLTDASLL

SEQ ID NO: 73626 - protein, 15 aa, Borrelia burgdorferi B31
IWLVGYMLTDASLLV

SEQ ID NO: 73627 - protein, 15 aa, Borrelia burgdorferi B31
WLVGYMLTDASLLVS

SEQ ID NO: 73628 - protein, 15 aa, Borrelia burgdorferi B31
LVGYMLTDASLLVSS

SEQ ID NO: 73629 - protein, 15 aa, Borrelia burgdorferi B31
VGYMLTDASLLVSSE

SEQ ID NO: 73630 - protein, 15 aa, Borrelia burgdorferi B31
GYMLTDASLLVSSEN

SEQ ID NO: 73631 - protein, 15 aa, Borrelia burgdorferi B31
YMLTDASLLVSSENP

SEQ ID NO: 73632 - protein, 15 aa, Borrelia burgdorferi B31
MLTDASLLVSSENPK

SEQ ID NO: 73633 - protein, 15 aa, Borrelia burgdorferi B31
LTDASLLVSSENPKI

SEQ ID NO: 73634 - protein, 15 aa, Borrelia burgdorferi B31
TDASLLVSSENPKIS

SEQ ID NO: 73635 - protein, 15 aa, Borrelia burgdorferi B31
DASLLVSSENPKISY

SEQ ID NO: 73636 - protein, 15 aa, Borrelia burgdorferi B31
ASLLVSSENPKISYG

SEQ ID NO: 73637 - protein, 15 aa, Borrelia burgdorferi B31
SLLVSSENPKISYGI

SEQ ID NO: 73638 - protein, 15 aa, Borrelia burgdorferi B31
LLVSSENPKISYGII

SEQ ID NO: 73639 - protein, 15 aa, Borrelia burgdorferi B31
LVSSENPKISYGIID

SEQ ID NO: 73640 - protein, 15 aa, Borrelia burgdorferi B31
VSSENPKISYGIIDP

SEQ ID NO: 73641 - protein, 15 aa, Borrelia burgdorferi B31
SSENPKISYGIIDPI

SEQ ID NO: 73642 - protein, 15 aa, Borrelia burgdorferi B31
SENPKISYGIIDPIY

SEQ ID NO: 73643 - protein, 15 aa, Borrelia burgdorferi B31
ENPKISYGIIDPIYG

SEQ ID NO: 73644 - protein, 15 aa, Borrelia burgdorferi B31
NPKISYGIIDPIYGD

SEQ ID NO: 73645 - protein, 15 aa, Borrelia burgdorferi B31
PKISYGIIDPIYGDD

SEQ ID NO: 73646 - protein, 15 aa, Borrelia burgdorferi B31
KISYGIIDPIYGDDV

SEQ ID NO: 73647 - protein, 15 aa, Borrelia burgdorferi B31
ISYGIIDPIYGDDVQ

SEQ ID NO: 73648 - protein, 15 aa, Borrelia burgdorferi B31
SYGIIDPIYGDDVQI

SEQ ID NO: 73649 - protein, 15 aa, Borrelia burgdorferi B31
YGIIDPIYGDDVQIP

SEQ ID NO: 73650 - protein, 15 aa, Borrelia burgdorferi B31
GIIDPIYGDDVQIPE

SEQ ID NO: 73651 - protein, 15 aa, Borrelia burgdorferi B31
IIDPIYGDDVQIPEN

SEQ ID NO: 73652 - protein, 15 aa, Borrelia burgdorferi B31
IDPIYGDDVQIPENL

SEQ ID NO: 73653 - protein, 15 aa, Borrelia burgdorferi B31
DPIYGDDVQIPENLI

SEQ ID NO: 73654 - protein, 15 aa, Borrelia burgdorferi B31
PIYGDDVQIPENLIA

SEQ ID NO: 73655 - protein, 15 aa, Borrelia burgdorferi B31
IYGDDVQIPENLIAV

SEQ ID NO: 73656 - protein, 15 aa, Borrelia burgdorferi B31
YGDDVQIPENLIAVV

SEQ ID NO: 73657 - protein, 15 aa, Borrelia burgdorferi B31
GDDVQIPENLIAVVF

SEQ ID NO: 73658 - protein, 15 aa, Borrelia burgdorferi B31
DDVQIPENLIAVVFR

SEQ ID NO: 73659 - protein, 15 aa, Borrelia burgdorferi B31
DVQIPENLIAVVFRV

SEQ ID NO: 73660 - protein, 15 aa, Borrelia burgdorferi B31
VQIPENLIAVVFRVE

SEQ ID NO: 73661 - protein, 15 aa, Borrelia burgdorferi B31
QIPENLIAVVFRVEQ

SEQ ID NO: 73662 - protein, 15 aa, Borrelia burgdorferi B31
IPENLIAVVFRVEQG

SEQ ID NO: 73663 - protein, 15 aa, Borrelia burgdorferi B31
PENLIAVVFRVEQGA

SEQ ID NO: 73664 - protein, 15 aa, Borrelia burgdorferi B31
ENLIAVVFRVEQGAF

SEQ ID NO: 73665 - protein, 15 aa, Borrelia burgdorferi B31
NLIAVVFRVEQGAFL

SEQ ID NO: 73666 - protein, 15 aa, Borrelia burgdorferi B31
LIAVVFRVEQGAFLA

SEQ ID NO: 73667 - protein, 15 aa, Borrelia burgdorferi B31
IAVVFRVEQGAFLAG

SEQ ID NO: 73668 - protein, 15 aa, Borrelia burgdorferi B31
AVVFRVEQGAFLAGY

SEQ ID NO: 73669 - protein, 15 aa, Borrelia burgdorferi B31
VVFRVEQGAFLAGYI

SEQ ID NO: 73670 - protein, 15 aa, Borrelia burgdorferi B31
VFRVEQGAFLAGYIA

SEQ ID NO: 73671 - protein, 15 aa, Borrelia burgdorferi B31
FRVEQGAFLAGYIAA

SEQ ID NO: 73672 - protein, 15 aa, Borrelia burgdorferi B31
RVEQGAFLAGYIAAK

SEQ ID NO: 73673 - protein, 15 aa, Borrelia burgdorferi B31
VEQGAFLAGYIAAKK

SEQ ID NO: 73674 - protein, 15 aa, Borrelia burgdorferi B31
EQGAFLAGYIAAKKS

SEQ ID NO: 73675 - protein, 15 aa, Borrelia burgdorferi B31
QGAFLAGYIAAKKSF

SEQ ID NO: 73676 - protein, 15 aa, Borrelia burgdorferi B31
GAFLAGYIAAKKSFS

SEQ ID NO: 73677 - protein, 15 aa, Borrelia burgdorferi B31
AFLAGYIAAKKSFSG

SEQ ID NO: 73678 - protein, 15 aa, Borrelia burgdorferi B31
FLAGYIAAKKSFSGK

SEQ ID NO: 73679 - protein, 15 aa, Borrelia burgdorferi B31
LAGYIAAKKSFSGKI

SEQ ID NO: 73680 - protein, 15 aa, Borrelia burgdorferi B31
AGYIAAKKSFSGKIG

SEQ ID NO: 73681 - protein, 15 aa, Borrelia burgdorferi B31
GYIAAKKSFSGKIGF

SEQ ID NO: 73682 - protein, 15 aa, Borrelia burgdorferi B31
YIAAKKSFSGKIGFI

SEQ ID NO: 73683 - protein, 15 aa, Borrelia burgdorferi B31
IAAKKSFSGKIGFIG

SEQ ID NO: 73684 - protein, 15 aa, Borrelia burgdorferi B31
AAKKSFSGKIGFIGG

SEQ ID NO: 73685 - protein, 15 aa, Borrelia burgdorferi B31
AKKSFSGKIGFIGGM

SEQ ID NO: 73686 - protein, 15 aa, Borrelia burgdorferi B31
KKSFSGKIGFIGGMK

SEQ ID NO: 73687 - protein, 15 aa, Borrelia burgdorferi B31
KSFSGKIGFIGGMKG

SEQ ID NO: 73688 - protein, 15 aa, Borrelia burgdorferi B31
SFSGKIGFIGGMKGN

SEQ ID NO: 73689 - protein, 15 aa, Borrelia burgdorferi B31
FSGKIGFIGGMKGNI

SEQ ID NO: 73690 - protein, 15 aa, Borrelia burgdorferi B31
SGKIGFIGGMKGNIV

SEQ ID NO: 73691 - protein, 15 aa, Borrelia burgdorferi B31
GKIGFIGGMKGNIVD

SEQ ID NO: 73692 - protein, 15 aa, Borrelia burgdorferi B31
KIGFIGGMKGNIVDA

SEQ ID NO: 73693 - protein, 15 aa, Borrelia burgdorferi B31
IGFIGGMKGNIVDAF

SEQ ID NO: 73694 - protein, 15 aa, Borrelia burgdorferi B31
GFIGGMKGNIVDAFR

SEQ ID NO: 73695 - protein, 15 aa, Borrelia burgdorferi B31
FIGGMKGNIVDAFRY

SEQ ID NO: 73696 - protein, 15 aa, Borrelia burgdorferi B31
IGGMKGNIVDAFRYG

SEQ ID NO: 73697 - protein, 15 aa, Borrelia burgdorferi B31
GGMKGNIVDAFRYGY

SEQ ID NO: 73698 - protein, 15 aa, Borrelia burgdorferi B31
GMKGNIVDAFRYGYE

SEQ ID NO: 73699 - protein, 15 aa, Borrelia burgdorferi B31
MKGNIVDAFRYGYES

SEQ ID NO: 73700 - protein, 15 aa, Borrelia burgdorferi B31
KGNIVDAFRYGYESG

SEQ ID NO: 73701 - protein, 15 aa, Borrelia burgdorferi B31
GNIVDAFRYGYESGA

SEQ ID NO: 73702 - protein, 15 aa, Borrelia burgdorferi B31
NIVDAFRYGYESGAK

SEQ ID NO: 73703 - protein, 15 aa, Borrelia burgdorferi B31
IVDAFRYGYESGAKY

SEQ ID NO: 73704 - protein, 15 aa, Borrelia burgdorferi B31
VDAFRYGYESGAKYA

SEQ ID NO: 73705 - protein, 15 aa, Borrelia burgdorferi B31
DAFRYGYESGAKYAN

SEQ ID NO: 73706 - protein, 15 aa, Borrelia burgdorferi B31
AFRYGYESGAKYANK

SEQ ID NO: 73707 - protein, 15 aa, Borrelia burgdorferi B31
FRYGYESGAKYANKD

SEQ ID NO: 73708 - protein, 15 aa, Borrelia burgdorferi B31
RYGYESGAKYANKDI

SEQ ID NO: 73709 - protein, 15 aa, Borrelia burgdorferi B31
YGYESGAKYANKDIE

SEQ ID NO: 73710 - protein, 15 aa, Borrelia burgdorferi B31
GYESGAKYANKDIEI

SEQ ID NO: 73711 - protein, 15 aa, Borrelia burgdorferi B31
YESGAKYANKDIEII

SEQ ID NO: 73712 - protein, 15 aa, Borrelia burgdorferi B31
ESGAKYANKDIEIIS

SEQ ID NO: 73713 - protein, 15 aa, Borrelia burgdorferi B31
SGAKYANKDIEIISE

SEQ ID NO: 73714 - protein, 15 aa, Borrelia burgdorferi B31
GAKYANKDIEIISEY

SEQ ID NO: 73715 - protein, 15 aa, Borrelia burgdorferi B31
AKYANKDIEIISEYS

SEQ ID NO: 73716 - protein, 15 aa, Borrelia burgdorferi B31
KYANKDIEIISEYSN

SEQ ID NO: 73717 - protein, 15 aa, Borrelia burgdorferi B31
YANKDIEIISEYSNS

SEQ ID NO: 73718 - protein, 15 aa, Borrelia burgdorferi B31
ANKDIEIISEYSNSF

SEQ ID NO: 73719 - protein, 15 aa, Borrelia burgdorferi B31
NKDIEIISEYSNSFS

SEQ ID NO: 73720 - protein, 15 aa, Borrelia burgdorferi B31
KDIEIISEYSNSFSD

SEQ ID NO: 73721 - protein, 15 aa, Borrelia burgdorferi B31
DIEIISEYSNSFSDV

SEQ ID NO: 73722 - protein, 15 aa, Borrelia burgdorferi B31
IEIISEYSNSFSDVD

SEQ ID NO: 73723 - protein, 15 aa, Borrelia burgdorferi B31
EIISEYSNSFSDVDI

SEQ ID NO: 73724 - protein, 15 aa, Borrelia burgdorferi B31
IISEYSNSFSDVDIG

SEQ ID NO: 73725 - protein, 15 aa, Borrelia burgdorferi B31
ISEYSNSFSDVDIGR

SEQ ID NO: 73726 - protein, 15 aa, Borrelia burgdorferi B31
SEYSNSFSDVDIGRT

SEQ ID NO: 73727 - protein, 15 aa, Borrelia burgdorferi B31
EYSNSFSDVDIGRTI

SEQ ID NO: 73728 - protein, 15 aa, Borrelia burgdorferi B31
YSNSFSDVDIGRTIA

SEQ ID NO: 73729 - protein, 15 aa, Borrelia burgdorferi B31
SNSFSDVDIGRTIAS

SEQ ID NO: 73730 - protein, 15 aa, Borrelia burgdorferi B31
NSFSDVDIGRTIASK

SEQ ID NO: 73731 - protein, 15 aa, Borrelia burgdorferi B31
SFSDVDIGRTIASKM

SEQ ID NO: 73732 - protein, 15 aa, Borrelia burgdorferi B31
FSDVDIGRTIASKMY

SEQ ID NO: 73733 - protein, 15 aa, Borrelia burgdorferi B31
SDVDIGRTIASKMYS

SEQ ID NO: 73734 - protein, 15 aa, Borrelia burgdorferi B31
DVDIGRTIASKMYSK

SEQ ID NO: 73735 - protein, 15 aa, Borrelia burgdorferi B31
VDIGRTIASKMYSKG

SEQ ID NO: 73736 - protein, 15 aa, Borrelia burgdorferi B31
DIGRTIASKMYSKGI

SEQ ID NO: 73737 - protein, 15 aa, Borrelia burgdorferi B31
IGRTIASKMYSKGID

SEQ ID NO: 73738 - protein, 15 aa, Borrelia burgdorferi B31
GRTIASKMYSKGIDV

SEQ ID NO: 73739 - protein, 15 aa, Borrelia burgdorferi B31
RTIASKMYSKGIDVI

SEQ ID NO: 73740 - protein, 15 aa, Borrelia burgdorferi B31
TIASKMYSKGIDVIH

SEQ ID NO: 73741 - protein, 15 aa, Borrelia burgdorferi B31
IASKMYSKGIDVIHF

SEQ ID NO: 73742 - protein, 15 aa, Borrelia burgdorferi B31
ASKMYSKGIDVIHFA

SEQ ID NO: 73743 - protein, 15 aa, Borrelia burgdorferi B31
SKMYSKGIDVIHFAA

SEQ ID NO: 73744 - protein, 15 aa, Borrelia burgdorferi B31
KMYSKGIDVIHFAAG

SEQ ID NO: 73745 - protein, 15 aa, Borrelia burgdorferi B31
MYSKGIDVIHFAAGL

SEQ ID NO: 73746 - protein, 15 aa, Borrelia burgdorferi B31
YSKGIDVIHFAAGLA

SEQ ID NO: 73747 - protein, 15 aa, Borrelia burgdorferi B31
SKGIDVIHFAAGLAG

SEQ ID NO: 73748 - protein, 15 aa, Borrelia burgdorferi B31
KGIDVIHFAAGLAGI

SEQ ID NO: 73749 - protein, 15 aa, Borrelia burgdorferi B31
GIDVIHFAAGLAGIG

SEQ ID NO: 73750 - protein, 15 aa, Borrelia burgdorferi B31
IDVIHFAAGLAGIGV

SEQ ID NO: 73751 - protein, 15 aa, Borrelia burgdorferi B31
DVIHFAAGLAGIGVI

SEQ ID NO: 73752 - protein, 15 aa, Borrelia burgdorferi B31
VIHFAAGLAGIGVIE

SEQ ID NO: 73753 - protein, 15 aa, Borrelia burgdorferi B31
IHFAAGLAGIGVIET

SEQ ID NO: 73754 - protein, 15 aa, Borrelia burgdorferi B31
HFAAGLAGIGVIETA

SEQ ID NO: 73755 - protein, 15 aa, Borrelia burgdorferi B31
FAAGLAGIGVIETAK

SEQ ID NO: 73756 - protein, 15 aa, Borrelia burgdorferi B31
AAGLAGIGVIETAKN

SEQ ID NO: 73757 - protein, 15 aa, Borrelia burgdorferi B31
AGLAGIGVIETAKNL

SEQ ID NO: 73758 - protein, 15 aa, Borrelia burgdorferi B31
GLAGIGVIETAKNLG

SEQ ID NO: 73759 - protein, 15 aa, Borrelia burgdorferi B31
LAGIGVIETAKNLGD

SEQ ID NO: 73760 - protein, 15 aa, Borrelia burgdorferi B31
AGIGVIETAKNLGDG

SEQ ID NO: 73761 - protein, 15 aa, Borrelia burgdorferi B31
GIGVIETAKNLGDGY

SEQ ID NO: 73762 - protein, 15 aa, Borrelia burgdorferi B31
IGVIETAKNLGDGYY

SEQ ID NO: 73763 - protein, 15 aa, Borrelia burgdorferi B31
GVIETAKNLGDGYYV

SEQ ID NO: 73764 - protein, 15 aa, Borrelia burgdorferi B31
VIETAKNLGDGYYVI

SEQ ID NO: 73765 - protein, 15 aa, Borrelia burgdorferi B31
IETAKNLGDGYYVIG

SEQ ID NO: 73766 - protein, 15 aa, Borrelia burgdorferi B31
ETAKNLGDGYYVIGA

SEQ ID NO: 73767 - protein, 15 aa, Borrelia burgdorferi B31
TAKNLGDGYYVIGAD

SEQ ID NO: 73768 - protein, 15 aa, Borrelia burgdorferi B31
AKNLGDGYYVIGADQ

SEQ ID NO: 73769 - protein, 15 aa, Borrelia burgdorferi B31
KNLGDGYYVIGADQD

SEQ ID NO: 73770 - protein, 15 aa, Borrelia burgdorferi B31
NLGDGYYVIGADQDQ

SEQ ID NO: 73771 - protein, 15 aa, Borrelia burgdorferi B31
LGDGYYVIGADQDQS

SEQ ID NO: 73772 - protein, 15 aa, Borrelia burgdorferi B31
GDGYYVIGADQDQSY

SEQ ID NO: 73773 - protein, 15 aa, Borrelia burgdorferi B31
DGYYVIGADQDQSYL

SEQ ID NO: 73774 - protein, 15 aa, Borrelia burgdorferi B31
GYYVIGADQDQSYLA

SEQ ID NO: 73775 - protein, 15 aa, Borrelia burgdorferi B31
YYVIGADQDQSYLAP

SEQ ID NO: 73776 - protein, 15 aa, Borrelia burgdorferi B31
YVIGADQDQSYLAPK

SEQ ID NO: 73777 - protein, 15 aa, Borrelia burgdorferi B31
VIGADQDQSYLAPKN

SEQ ID NO: 73778 - protein, 15 aa, Borrelia burgdorferi B31
IGADQDQSYLAPKNF

SEQ ID NO: 73779 - protein, 15 aa, Borrelia burgdorferi B31
GADQDQSYLAPKNFI

SEQ ID NO: 73780 - protein, 15 aa, Borrelia burgdorferi B31
ADQDQSYLAPKNFIT

SEQ ID NO: 73781 - protein, 15 aa, Borrelia burgdorferi B31
DQDQSYLAPKNFITS

SEQ ID NO: 73782 - protein, 15 aa, Borrelia burgdorferi B31
QDQSYLAPKNFITSV

SEQ ID NO: 73783 - protein, 15 aa, Borrelia burgdorferi B31
DQSYLAPKNFITSVI

SEQ ID NO: 73784 - protein, 15 aa, Borrelia burgdorferi B31
QSYLAPKNFITSVIK

SEQ ID NO: 73785 - protein, 15 aa, Borrelia burgdorferi B31
SYLAPKNFITSVIKN

SEQ ID NO: 73786 - protein, 15 aa, Borrelia burgdorferi B31
YLAPKNFITSVIKNI

SEQ ID NO: 73787 - protein, 15 aa, Borrelia burgdorferi B31
LAPKNFITSVIKNIG

SEQ ID NO: 73788 - protein, 15 aa, Borrelia burgdorferi B31
APKNFITSVIKNIGD

SEQ ID NO: 73789 - protein, 15 aa, Borrelia burgdorferi B31
PKNFITSVIKNIGDA

SEQ ID NO: 73790 - protein, 15 aa, Borrelia burgdorferi B31
KNFITSVIKNIGDAL

SEQ ID NO: 73791 - protein, 15 aa, Borrelia burgdorferi B31
NFITSVIKNIGDALY

SEQ ID NO: 73792 - protein, 15 aa, Borrelia burgdorferi B31
FITSVIKNIGDALYL

SEQ ID NO: 73793 - protein, 15 aa, Borrelia burgdorferi B31
ITSVIKNIGDALYLI

SEQ ID NO: 73794 - protein, 15 aa, Borrelia burgdorferi B31
TSVIKNIGDALYLIT

SEQ ID NO: 73795 - protein, 15 aa, Borrelia burgdorferi B31
SVIKNIGDALYLITG

SEQ ID NO: 73796 - protein, 15 aa, Borrelia burgdorferi B31
VIKNIGDALYLITGE

SEQ ID NO: 73797 - protein, 15 aa, Borrelia burgdorferi B31
IKNIGDALYLITGEY

SEQ ID NO: 73798 - protein, 15 aa, Borrelia burgdorferi B31
KNIGDALYLITGEYI

SEQ ID NO: 73799 - protein, 15 aa, Borrelia burgdorferi B31
NIGDALYLITGEYIK

SEQ ID NO: 73800 - protein, 15 aa, Borrelia burgdorferi B31
IGDALYLITGEYIKN

SEQ ID NO: 73801 - protein, 15 aa, Borrelia burgdorferi B31
GDALYLITGEYIKNN

SEQ ID NO: 73802 - protein, 15 aa, Borrelia burgdorferi B31
DALYLITGEYIKNNN

SEQ ID NO: 73803 - protein, 15 aa, Borrelia burgdorferi B31
ALYLITGEYIKNNNV

SEQ ID NO: 73804 - protein, 15 aa, Borrelia burgdorferi B31
LYLITGEYIKNNNVW

SEQ ID NO: 73805 - protein, 15 aa, Borrelia burgdorferi B31
YLITGEYIKNNNVWE

SEQ ID NO: 73806 - protein, 15 aa, Borrelia burgdorferi B31
LITGEYIKNNNVWEG

SEQ ID NO: 73807 - protein, 15 aa, Borrelia burgdorferi B31
ITGEYIKNNNVWEGG

SEQ ID NO: 73808 - protein, 15 aa, Borrelia burgdorferi B31
TGEYIKNNNVWEGGK

SEQ ID NO: 73809 - protein, 15 aa, Borrelia burgdorferi B31
GEYIKNNNVWEGGKV

SEQ ID NO: 73810 - protein, 15 aa, Borrelia burgdorferi B31
EYIKNNNVWEGGKVV

SEQ ID NO: 73811 - protein, 15 aa, Borrelia burgdorferi B31
YIKNNNVWEGGKVVQ

SEQ ID NO: 73812 - protein, 15 aa, Borrelia burgdorferi B31
IKNNNVWEGGKVVQM

SEQ ID NO: 73813 - protein, 15 aa, Borrelia burgdorferi B31
KNNNVWEGGKVVQMG

SEQ ID NO: 73814 - protein, 15 aa, Borrelia burgdorferi B31
NNNVWEGGKVVQMGL

SEQ ID NO: 73815 - protein, 15 aa, Borrelia burgdorferi B31
NNVWEGGKVVQMGLR

SEQ ID NO: 73816 - protein, 15 aa, Borrelia burgdorferi B31
NVWEGGKVVQMGLRD

SEQ ID NO: 73817 - protein, 15 aa, Borrelia burgdorferi B31
VWEGGKVVQMGLRDG

SEQ ID NO: 73818 - protein, 15 aa, Borrelia burgdorferi B31
WEGGKVVQMGLRDGV

SEQ ID NO: 73819 - protein, 15 aa, Borrelia burgdorferi B31
EGGKVVQMGLRDGVI

SEQ ID NO: 73820 - protein, 15 aa, Borrelia burgdorferi B31
GGKVVQMGLRDGVIG

SEQ ID NO: 73821 - protein, 15 aa, Borrelia burgdorferi B31
GKVVQMGLRDGVIGL

SEQ ID NO: 73822 - protein, 15 aa, Borrelia burgdorferi B31
KVVQMGLRDGVIGLP

SEQ ID NO: 73823 - protein, 15 aa, Borrelia burgdorferi B31
VVQMGLRDGVIGLPN

SEQ ID NO: 73824 - protein, 15 aa, Borrelia burgdorferi B31
VQMGLRDGVIGLPNA

SEQ ID NO: 73825 - protein, 15 aa, Borrelia burgdorferi B31
QMGLRDGVIGLPNAN

SEQ ID NO: 73826 - protein, 15 aa, Borrelia burgdorferi B31
MGLRDGVIGLPNANE

SEQ ID NO: 73827 - protein, 15 aa, Borrelia burgdorferi B31
GLRDGVIGLPNANEF

SEQ ID NO: 73828 - protein, 15 aa, Borrelia burgdorferi B31
LRDGVIGLPNANEFE

SEQ ID NO: 73829 - protein, 15 aa, Borrelia burgdorferi B31
RDGVIGLPNANEFEY

SEQ ID NO: 73830 - protein, 15 aa, Borrelia burgdorferi B31
DGVIGLPNANEFEYI

SEQ ID NO: 73831 - protein, 15 aa, Borrelia burgdorferi B31
GVIGLPNANEFEYIK

SEQ ID NO: 73832 - protein, 15 aa, Borrelia burgdorferi B31
VIGLPNANEFEYIKV

SEQ ID NO: 73833 - protein, 15 aa, Borrelia burgdorferi B31
IGLPNANEFEYIKVL

SEQ ID NO: 73834 - protein, 15 aa, Borrelia burgdorferi B31
GLPNANEFEYIKVLE

SEQ ID NO: 73835 - protein, 15 aa, Borrelia burgdorferi B31
LPNANEFEYIKVLER

SEQ ID NO: 73836 - protein, 15 aa, Borrelia burgdorferi B31
PNANEFEYIKVLERK

SEQ ID NO: 73837 - protein, 15 aa, Borrelia burgdorferi B31
NANEFEYIKVLERKI

SEQ ID NO: 73838 - protein, 15 aa, Borrelia burgdorferi B31
ANEFEYIKVLERKII

SEQ ID NO: 73839 - protein, 15 aa, Borrelia burgdorferi B31
NEFEYIKVLERKIIN

SEQ ID NO: 73840 - protein, 15 aa, Borrelia burgdorferi B31
EFEYIKVLERKIINK

SEQ ID NO: 73841 - protein, 15 aa, Borrelia burgdorferi B31
FEYIKVLERKIINKE

SEQ ID NO: 73842 - protein, 15 aa, Borrelia burgdorferi B31
EYIKVLERKIINKEI

SEQ ID NO: 73843 - protein, 15 aa, Borrelia burgdorferi B31
YIKVLERKIINKEII

SEQ ID NO: 73844 - protein, 15 aa, Borrelia burgdorferi B31
IKVLERKIINKEIIV

SEQ ID NO: 73845 - protein, 15 aa, Borrelia burgdorferi B31
KVLERKIINKEIIVP

SEQ ID NO: 73846 - protein, 15 aa, Borrelia burgdorferi B31
VLERKIINKEIIVPC

SEQ ID NO: 73847 - protein, 15 aa, Borrelia burgdorferi B31
LERKIINKEIIVPCN

SEQ ID NO: 73848 - protein, 15 aa, Borrelia burgdorferi B31
ERKIINKEIIVPCNQ

SEQ ID NO: 73849 - protein, 15 aa, Borrelia burgdorferi B31
RKIINKEIIVPCNQE

SEQ ID NO: 73850 - protein, 15 aa, Borrelia burgdorferi B31
KIINKEIIVPCNQEE

SEQ ID NO: 73851 - protein, 15 aa, Borrelia burgdorferi B31
IINKEIIVPCNQEEY

SEQ ID NO: 73852 - protein, 15 aa, Borrelia burgdorferi B31
INKEIIVPCNQEEYE

SEQ ID NO: 73853 - protein, 15 aa, Borrelia burgdorferi B31
NKEIIVPCNQEEYEI

SEQ ID NO: 73854 - protein, 15 aa, Borrelia burgdorferi B31
KEIIVPCNQEEYEIF

SEQ ID NO: 73855 - protein, 15 aa, Borrelia burgdorferi B31
EIIVPCNQEEYEIFI

SEQ ID NO: 73856 - protein, 15 aa, Borrelia burgdorferi B31
IIVPCNQEEYEIFIK

SEQ ID NO: 73857 - protein, 15 aa, Borrelia burgdorferi B31
IVPCNQEEYEIFIKQ

SEQ ID NO: 73858 - protein, 15 aa, Borrelia burgdorferi B31
VPCNQEEYEIFIKQI

SEQ ID NO: 73859 - protein, 15 aa, Borrelia burgdorferi B31
PCNQEEYEIFIKQIL

SEQ ID NO: 73860 - protein, 15 aa, Borrelia burgdorferi B31
CNQEEYEIFIKQILK

SEQ ID NO: 73861 - protein, 15 aa, Borrelia burgdorferi B31
NQEEYEIFIKQILKL

SEQ ID NO: 73862 - protein, 16 aa, Borrelia burgdorferi B31
MRIVIFIFGILLTSCF

SEQ ID NO: 73863 - protein, 16 aa, Borrelia burgdorferi B31
RIVIFIFGILLTSCFS

SEQ ID NO: 73864 - protein, 16 aa, Borrelia burgdorferi B31
IVIFIFGILLTSCFSR

SEQ ID NO: 73865 - protein, 16 aa, Borrelia burgdorferi B31
VIFIFGILLTSCFSRN

SEQ ID NO: 73866 - protein, 16 aa, Borrelia burgdorferi B31
IFIFGILLTSCFSRNG

SEQ ID NO: 73867 - protein, 16 aa, Borrelia burgdorferi B31
FIFGILLTSCFSRNGI

SEQ ID NO: 73868 - protein, 16 aa, Borrelia burgdorferi B31
IFGILLTSCFSRNGIE

SEQ ID NO: 73869 - protein, 16 aa, Borrelia burgdorferi B31
FGILLTSCFSRNGIES

SEQ ID NO: 73870 - protein, 16 aa, Borrelia burgdorferi B31
GILLTSCFSRNGIESS

SEQ ID NO: 73871 - protein, 16 aa, Borrelia burgdorferi B31
ILLTSCFSRNGIESSS

SEQ ID NO: 73872 - protein, 16 aa, Borrelia burgdorferi B31
LLTSCFSRNGIESSSK

SEQ ID NO: 73873 - protein, 16 aa, Borrelia burgdorferi B31
LTSCFSRNGIESSSKK

SEQ ID NO: 73874 - protein, 16 aa, Borrelia burgdorferi B31
TSCFSRNGIESSSKKI

SEQ ID NO: 73875 - protein, 16 aa, Borrelia burgdorferi B31
SCFSRNGIESSSKKIK

SEQ ID NO: 73876 - protein, 16 aa, Borrelia burgdorferi B31
CFSRNGIESSSKKIKI

SEQ ID NO: 73877 - protein, 16 aa, Borrelia burgdorferi B31
FSRNGIESSSKKIKIS

SEQ ID NO: 73878 - protein, 16 aa, Borrelia burgdorferi B31
SRNGIESSSKKIKISM

SEQ ID NO: 73879 - protein, 16 aa, Borrelia burgdorferi B31
RNGIESSSKKIKISML

SEQ ID NO: 73880 - protein, 16 aa, Borrelia burgdorferi B31
NGIESSSKKIKISMLV

SEQ ID NO: 73881 - protein, 16 aa, Borrelia burgdorferi B31
GIESSSKKIKISMLVD

SEQ ID NO: 73882 - protein, 16 aa, Borrelia burgdorferi B31
IESSSKKIKISMLVDG

SEQ ID NO: 73883 - protein, 16 aa, Borrelia burgdorferi B31
ESSSKKIKISMLVDGV

SEQ ID NO: 73884 - protein, 16 aa, Borrelia burgdorferi B31
SSSKKIKISMLVDGVL

SEQ ID NO: 73885 - protein, 16 aa, Borrelia burgdorferi B31
SSKKIKISMLVDGVLD

SEQ ID NO: 73886 - protein, 16 aa, Borrelia burgdorferi B31
SKKIKISMLVDGVLDD

SEQ ID NO: 73887 - protein, 16 aa, Borrelia burgdorferi B31
KKIKISMLVDGVLDDK

SEQ ID NO: 73888 - protein, 16 aa, Borrelia burgdorferi B31
KIKISMLVDGVLDDKS

SEQ ID NO: 73889 - protein, 16 aa, Borrelia burgdorferi B31
IKISMLVDGVLDDKSF

SEQ ID NO: 73890 - protein, 16 aa, Borrelia burgdorferi B31
KISMLVDGVLDDKSFN

SEQ ID NO: 73891 - protein, 16 aa, Borrelia burgdorferi B31
ISMLVDGVLDDKSFNS

SEQ ID NO: 73892 - protein, 16 aa, Borrelia burgdorferi B31
SMLVDGVLDDKSFNSS

SEQ ID NO: 73893 - protein, 16 aa, Borrelia burgdorferi B31
MLVDGVLDDKSFNSSA

SEQ ID NO: 73894 - protein, 16 aa, Borrelia burgdorferi B31
LVDGVLDDKSFNSSAN

SEQ ID NO: 73895 - protein, 16 aa, Borrelia burgdorferi B31
VDGVLDDKSFNSSANE

SEQ ID NO: 73896 - protein, 16 aa, Borrelia burgdorferi B31
DGVLDDKSFNSSANEA

SEQ ID NO: 73897 - protein, 16 aa, Borrelia burgdorferi B31
GVLDDKSFNSSANEAL

SEQ ID NO: 73898 - protein, 16 aa, Borrelia burgdorferi B31
VLDDKSFNSSANEALL

SEQ ID NO: 73899 - protein, 16 aa, Borrelia burgdorferi B31
LDDKSFNSSANEALLR

SEQ ID NO: 73900 - protein, 16 aa, Borrelia burgdorferi B31
DDKSFNSSANEALLRL

SEQ ID NO: 73901 - protein, 16 aa, Borrelia burgdorferi B31
DKSFNSSANEALLRLK

SEQ ID NO: 73902 - protein, 16 aa, Borrelia burgdorferi B31
KSFNSSANEALLRLKK

SEQ ID NO: 73903 - protein, 16 aa, Borrelia burgdorferi B31
SFNSSANEALLRLKKD

SEQ ID NO: 73904 - protein, 16 aa, Borrelia burgdorferi B31
FNSSANEALLRLKKDF

SEQ ID NO: 73905 - protein, 16 aa, Borrelia burgdorferi B31
NSSANEALLRLKKDFP

SEQ ID NO: 73906 - protein, 16 aa, Borrelia burgdorferi B31
SSANEALLRLKKDFPE

SEQ ID NO: 73907 - protein, 16 aa, Borrelia burgdorferi B31
SANEALLRLKKDFPEN

SEQ ID NO: 73908 - protein, 16 aa, Borrelia burgdorferi B31
ANEALLRLKKDFPENI

SEQ ID NO: 73909 - protein, 16 aa, Borrelia burgdorferi B31
NEALLRLKKDFPENIE

SEQ ID NO: 73910 - protein, 16 aa, Borrelia burgdorferi B31
EALLRLKKDFPENIEE

SEQ ID NO: 73911 - protein, 16 aa, Borrelia burgdorferi B31
ALLRLKKDFPENIEEV

SEQ ID NO: 73912 - protein, 16 aa, Borrelia burgdorferi B31
LLRLKKDFPENIEEVF

SEQ ID NO: 73913 - protein, 16 aa, Borrelia burgdorferi B31
LRLKKDFPENIEEVFS

SEQ ID NO: 73914 - protein, 16 aa, Borrelia burgdorferi B31
RLKKDFPENIEEVFSC

SEQ ID NO: 73915 - protein, 16 aa, Borrelia burgdorferi B31
LKKDFPENIEEVFSCA

SEQ ID NO: 73916 - protein, 16 aa, Borrelia burgdorferi B31
KKDFPENIEEVFSCAI

SEQ ID NO: 73917 - protein, 16 aa, Borrelia burgdorferi B31
KDFPENIEEVFSCAIS

SEQ ID NO: 73918 - protein, 16 aa, Borrelia burgdorferi B31
DFPENIEEVFSCAISG

SEQ ID NO: 73919 - protein, 16 aa, Borrelia burgdorferi B31
FPENIEEVFSCAISGV

SEQ ID NO: 73920 - protein, 16 aa, Borrelia burgdorferi B31
PENIEEVFSCAISGVY

SEQ ID NO: 73921 - protein, 16 aa, Borrelia burgdorferi B31
ENIEEVFSCAISGVYS

SEQ ID NO: 73922 - protein, 16 aa, Borrelia burgdorferi B31
NIEEVFSCAISGVYSS

SEQ ID NO: 73923 - protein, 16 aa, Borrelia burgdorferi B31
IEEVFSCAISGVYSSY

SEQ ID NO: 73924 - protein, 16 aa, Borrelia burgdorferi B31
EEVFSCAISGVYSSYV

SEQ ID NO: 73925 - protein, 16 aa, Borrelia burgdorferi B31
EVFSCAISGVYSSYVS

SEQ ID NO: 73926 - protein, 16 aa, Borrelia burgdorferi B31
VFSCAISGVYSSYVSD

SEQ ID NO: 73927 - protein, 16 aa, Borrelia burgdorferi B31
FSCAISGVYSSYVSDL

SEQ ID NO: 73928 - protein, 16 aa, Borrelia burgdorferi B31
SCAISGVYSSYVSDLD

SEQ ID NO: 73929 - protein, 16 aa, Borrelia burgdorferi B31
CAISGVYSSYVSDLDN

SEQ ID NO: 73930 - protein, 16 aa, Borrelia burgdorferi B31
AISGVYSSYVSDLDNL

SEQ ID NO: 73931 - protein, 16 aa, Borrelia burgdorferi B31
ISGVYSSYVSDLDNLK

SEQ ID NO: 73932 - protein, 16 aa, Borrelia burgdorferi B31
SGVYSSYVSDLDNLKR

SEQ ID NO: 73933 - protein, 16 aa, Borrelia burgdorferi B31
GVYSSYVSDLDNLKRN

SEQ ID NO: 73934 - protein, 16 aa, Borrelia burgdorferi B31
VYSSYVSDLDNLKRNG

SEQ ID NO: 73935 - protein, 16 aa, Borrelia burgdorferi B31
YSSYVSDLDNLKRNGS

SEQ ID NO: 73936 - protein, 16 aa, Borrelia burgdorferi B31
SSYVSDLDNLKRNGSD

SEQ ID NO: 73937 - protein, 16 aa, Borrelia burgdorferi B31
SYVSDLDNLKRNGSDL

SEQ ID NO: 73938 - protein, 16 aa, Borrelia burgdorferi B31
YVSDLDNLKRNGSDLI

SEQ ID NO: 73939 - protein, 16 aa, Borrelia burgdorferi B31
VSDLDNLKRNGSDLIW

SEQ ID NO: 73940 - protein, 16 aa, Borrelia burgdorferi B31
SDLDNLKRNGSDLIWL

SEQ ID NO: 73941 - protein, 16 aa, Borrelia burgdorferi B31
DLDNLKRNGSDLIWLV

SEQ ID NO: 73942 - protein, 16 aa, Borrelia burgdorferi B31
LDNLKRNGSDLIWLVG

SEQ ID NO: 73943 - protein, 16 aa, Borrelia burgdorferi B31
DNLKRNGSDLIWLVGY

SEQ ID NO: 73944 - protein, 16 aa, Borrelia burgdorferi B31
NLKRNGSDLIWLVGYM

SEQ ID NO: 73945 - protein, 16 aa, Borrelia burgdorferi B31
LKRNGSDLIWLVGYML

SEQ ID NO: 73946 - protein, 16 aa, Borrelia burgdorferi B31
KRNGSDLIWLVGYMLT

SEQ ID NO: 73947 - protein, 16 aa, Borrelia burgdorferi B31
RNGSDLIWLVGYMLTD

SEQ ID NO: 73948 - protein, 16 aa, Borrelia burgdorferi B31
NGSDLIWLVGYMLTDA

SEQ ID NO: 73949 - protein, 16 aa, Borrelia burgdorferi B31
GSDLIWLVGYMLTDAS

SEQ ID NO: 73950 - protein, 16 aa, Borrelia burgdorferi B31
SDLIWLVGYMLTDASL

SEQ ID NO: 73951 - protein, 16 aa, Borrelia burgdorferi B31
DLIWLVGYMLTDASLL

SEQ ID NO: 73952 - protein, 16 aa, Borrelia burgdorferi B31
LIWLVGYMLTDASLLV

SEQ ID NO: 73953 - protein, 16 aa, Borrelia burgdorferi B31
IWLVGYMLTDASLLVS

SEQ ID NO: 73954 - protein, 16 aa, Borrelia burgdorferi B31
WLVGYMLTDASLLVSS

SEQ ID NO: 73955 - protein, 16 aa, Borrelia burgdorferi B31
LVGYMLTDASLLVSSE

SEQ ID NO: 73956 - protein, 16 aa, Borrelia burgdorferi B31
VGYMLTDASLLVSSEN

SEQ ID NO: 73957 - protein, 16 aa, Borrelia burgdorferi B31
GYMLTDASLLVSSENP

SEQ ID NO: 73958 - protein, 16 aa, Borrelia burgdorferi B31
YMLTDASLLVSSENPK

SEQ ID NO: 73959 - protein, 16 aa, Borrelia burgdorferi B31
MLTDASLLVSSENPKI

SEQ ID NO: 73960 - protein, 16 aa, Borrelia burgdorferi B31
LTDASLLVSSENPKIS

SEQ ID NO: 73961 - protein, 16 aa, Borrelia burgdorferi B31
TDASLLVSSENPKISY

SEQ ID NO: 73962 - protein, 16 aa, Borrelia burgdorferi B31
DASLLVSSENPKISYG

SEQ ID NO: 73963 - protein, 16 aa, Borrelia burgdorferi B31
ASLLVSSENPKISYGI

SEQ ID NO: 73964 - protein, 16 aa, Borrelia burgdorferi B31
SLLVSSENPKISYGII

SEQ ID NO: 73965 - protein, 16 aa, Borrelia burgdorferi B31
LLVSSENPKISYGIID

SEQ ID NO: 73966 - protein, 16 aa, Borrelia burgdorferi B31
LVSSENPKISYGIIDP

SEQ ID NO: 73967 - protein, 16 aa, Borrelia burgdorferi B31
VSSENPKISYGIIDPI

SEQ ID NO: 73968 - protein, 16 aa, Borrelia burgdorferi B31
SSENPKISYGIIDPIY

SEQ ID NO: 73969 - protein, 16 aa, Borrelia burgdorferi B31
SENPKISYGIIDPIYG

SEQ ID NO: 73970 - protein, 16 aa, Borrelia burgdorferi B31
ENPKISYGIIDPIYGD

SEQ ID NO: 73971 - protein, 16 aa, Borrelia burgdorferi B31
NPKISYGIIDPIYGDD

SEQ ID NO: 73972 - protein, 16 aa, Borrelia burgdorferi B31
PKISYGIIDPIYGDDV

SEQ ID NO: 73973 - protein, 16 aa, Borrelia burgdorferi B31
KISYGIIDPIYGDDVQ

SEQ ID NO: 73974 - protein, 16 aa, Borrelia burgdorferi B31
ISYGIIDPIYGDDVQI

SEQ ID NO: 73975 - protein, 16 aa, Borrelia burgdorferi B31
SYGIIDPIYGDDVQIP

SEQ ID NO: 73976 - protein, 16 aa, Borrelia burgdorferi B31
YGIIDPIYGDDVQIPE

SEQ ID NO: 73977 - protein, 16 aa, Borrelia burgdorferi B31
GIIDPIYGDDVQIPEN

SEQ ID NO: 73978 - protein, 16 aa, Borrelia burgdorferi B31
IIDPIYGDDVQIPENL

SEQ ID NO: 73979 - protein, 16 aa, Borrelia burgdorferi B31
IDPIYGDDVQIPENLI

SEQ ID NO: 73980 - protein, 16 aa, Borrelia burgdorferi B31
DPIYGDDVQIPENLIA

SEQ ID NO: 73981 - protein, 16 aa, Borrelia burgdorferi B31
PIYGDDVQIPENLIAV

SEQ ID NO: 73982 - protein, 16 aa, Borrelia burgdorferi B31
IYGDDVQIPENLIAVV

SEQ ID NO: 73983 - protein, 16 aa, Borrelia burgdorferi B31
YGDDVQIPENLIAVVF

SEQ ID NO: 73984 - protein, 16 aa, Borrelia burgdorferi B31
GDDVQIPENLIAVVFR

SEQ ID NO: 73985 - protein, 16 aa, Borrelia burgdorferi B31
DDVQIPENLIAVVFRV

SEQ ID NO: 73986 - protein, 16 aa, Borrelia burgdorferi B31
DVQIPENLIAVVFRVE

SEQ ID NO: 73987 - protein, 16 aa, Borrelia burgdorferi B31
VQIPENLIAVVFRVEQ

SEQ ID NO: 73988 - protein, 16 aa, Borrelia burgdorferi B31
QIPENLIAVVFRVEQG

SEQ ID NO: 73989 - protein, 16 aa, Borrelia burgdorferi B31
IPENLIAVVFRVEQGA

SEQ ID NO: 73990 - protein, 16 aa, Borrelia burgdorferi B31
PENLIAVVFRVEQGAF

SEQ ID NO: 73991 - protein, 16 aa, Borrelia burgdorferi B31
ENLIAVVFRVEQGAFL

SEQ ID NO: 73992 - protein, 16 aa, Borrelia burgdorferi B31
NLIAVVFRVEQGAFLA

SEQ ID NO: 73993 - protein, 16 aa, Borrelia burgdorferi B31
LIAVVFRVEQGAFLAG

SEQ ID NO: 73994 - protein, 16 aa, Borrelia burgdorferi B31
IAVVFRVEQGAFLAGY

SEQ ID NO: 73995 - protein, 16 aa, Borrelia burgdorferi B31
AVVFRVEQGAFLAGYI

SEQ ID NO: 73996 - protein, 16 aa, Borrelia burgdorferi B31
VVFRVEQGAFLAGYIA

SEQ ID NO: 73997 - protein, 16 aa, Borrelia burgdorferi B31
VFRVEQGAFLAGYIAA

SEQ ID NO: 73998 - protein, 16 aa, Borrelia burgdorferi B31
FRVEQGAFLAGYIAAK

SEQ ID NO: 73999 - protein, 16 aa, Borrelia burgdorferi B31
RVEQGAFLAGYIAAKK

SEQ ID NO: 74000 - protein, 16 aa, Borrelia burgdorferi B31
VEQGAFLAGYIAAKKS

SEQ ID NO: 74001 - protein, 16 aa, Borrelia burgdorferi B31
EQGAFLAGYIAAKKSF

SEQ ID NO: 74002 - protein, 16 aa, Borrelia burgdorferi B31
QGAFLAGYIAAKKSFS

SEQ ID NO: 74003 - protein, 16 aa, Borrelia burgdorferi B31
GAFLAGYIAAKKSFSG

SEQ ID NO: 74004 - protein, 16 aa, Borrelia burgdorferi B31
AFLAGYIAAKKSFSGK

SEQ ID NO: 74005 - protein, 16 aa, Borrelia burgdorferi B31
FLAGYIAAKKSFSGKI

SEQ ID NO: 74006 - protein, 16 aa, Borrelia burgdorferi B31
LAGYIAAKKSFSGKIG

SEQ ID NO: 74007 - protein, 16 aa, Borrelia burgdorferi B31
AGYIAAKKSFSGKIGF

SEQ ID NO: 74008 - protein, 16 aa, Borrelia burgdorferi B31
GYIAAKKSFSGKIGFI

SEQ ID NO: 74009 - protein, 16 aa, Borrelia burgdorferi B31
YIAAKKSFSGKIGFIG

SEQ ID NO: 74010 - protein, 16 aa, Borrelia burgdorferi B31
IAAKKSFSGKIGFIGG

SEQ ID NO: 74011 - protein, 16 aa, Borrelia burgdorferi B31
AAKKSFSGKIGFIGGM

SEQ ID NO: 74012 - protein, 16 aa, Borrelia burgdorferi B31
AKKSFSGKIGFIGGMK

SEQ ID NO: 74013 - protein, 16 aa, Borrelia burgdorferi B31
KKSFSGKIGFIGGMKG

SEQ ID NO: 74014 - protein, 16 aa, Borrelia burgdorferi B31
KSFSGKIGFIGGMKGN

SEQ ID NO: 74015 - protein, 16 aa, Borrelia burgdorferi B31
SFSGKIGFIGGMKGNI

SEQ ID NO: 74016 - protein, 16 aa, Borrelia burgdorferi B31
FSGKIGFIGGMKGNIV

SEQ ID NO: 74017 - protein, 16 aa, Borrelia burgdorferi B31
SGKIGFIGGMKGNIVD

SEQ ID NO: 74018 - protein, 16 aa, Borrelia burgdorferi B31
GKIGFIGGMKGNIVDA

SEQ ID NO: 74019 - protein, 16 aa, Borrelia burgdorferi B31
KIGFIGGMKGNIVDAF

SEQ ID NO: 74020 - protein, 16 aa, Borrelia burgdorferi B31
IGFIGGMKGNIVDAFR

SEQ ID NO: 74021 - protein, 16 aa, Borrelia burgdorferi B31
GFIGGMKGNIVDAFRY

SEQ ID NO: 74022 - protein, 16 aa, Borrelia burgdorferi B31
FIGGMKGNIVDAFRYG

SEQ ID NO: 74023 - protein, 16 aa, Borrelia burgdorferi B31
IGGMKGNIVDAFRYGY

SEQ ID NO: 74024 - protein, 16 aa, Borrelia burgdorferi B31
GGMKGNIVDAFRYGYE

SEQ ID NO: 74025 - protein, 16 aa, Borrelia burgdorferi B31
GMKGNIVDAFRYGYES

SEQ ID NO: 74026 - protein, 16 aa, Borrelia burgdorferi B31
MKGNIVDAFRYGYESG

SEQ ID NO: 74027 - protein, 16 aa, Borrelia burgdorferi B31
KGNIVDAFRYGYESGA

SEQ ID NO: 74028 - protein, 16 aa, Borrelia burgdorferi B31
GNIVDAFRYGYESGAK

SEQ ID NO: 74029 - protein, 16 aa, Borrelia burgdorferi B31
NIVDAFRYGYESGAKY

SEQ ID NO: 74030 - protein, 16 aa, Borrelia burgdorferi B31
IVDAFRYGYESGAKYA

SEQ ID NO: 74031 - protein, 16 aa, Borrelia burgdorferi B31
VDAFRYGYESGAKYAN

SEQ ID NO: 74032 - protein, 16 aa, Borrelia burgdorferi B31
DAFRYGYESGAKYANK

SEQ ID NO: 74033 - protein, 16 aa, Borrelia burgdorferi B31
AFRYGYESGAKYANKD

SEQ ID NO: 74034 - protein, 16 aa, Borrelia burgdorferi B31
FRYGYESGAKYANKDI

SEQ ID NO: 74035 - protein, 16 aa, Borrelia burgdorferi B31
RYGYESGAKYANKDIE

SEQ ID NO: 74036 - protein, 16 aa, Borrelia burgdorferi B31
YGYESGAKYANKDIEI

SEQ ID NO: 74037 - protein, 16 aa, Borrelia burgdorferi B31
GYESGAKYANKDIEII

SEQ ID NO: 74038 - protein, 16 aa, Borrelia burgdorferi B31
YESGAKYANKDIEIIS

SEQ ID NO: 74039 - protein, 16 aa, Borrelia burgdorferi B31
ESGAKYANKDIEIISE

SEQ ID NO: 74040 - protein, 16 aa, Borrelia burgdorferi B31
SGAKYANKDIEIISEY

SEQ ID NO: 74041 - protein, 16 aa, Borrelia burgdorferi B31
GAKYANKDIEIISEYS

SEQ ID NO: 74042 - protein, 16 aa, Borrelia burgdorferi B31
AKYANKDIEIISEYSN

SEQ ID NO: 74043 - protein, 16 aa, Borrelia burgdorferi B31
KYANKDIEIISEYSNS

SEQ ID NO: 74044 - protein, 16 aa, Borrelia burgdorferi B31
YANKDIEIISEYSNSF

SEQ ID NO: 74045 - protein, 16 aa, Borrelia burgdorferi B31
ANKDIEIISEYSNSFS

SEQ ID NO: 74046 - protein, 16 aa, Borrelia burgdorferi B31
NKDIEIISEYSNSFSD

SEQ ID NO: 74047 - protein, 16 aa, Borrelia burgdorferi B31
KDIEIISEYSNSFSDV

SEQ ID NO: 74048 - protein, 16 aa, Borrelia burgdorferi B31
DIEIISEYSNSFSDVD

SEQ ID NO: 74049 - protein, 16 aa, Borrelia burgdorferi B31
IEIISEYSNSFSDVDI

SEQ ID NO: 74050 - protein, 16 aa, Borrelia burgdorferi B31
EIISEYSNSFSDVDIG

SEQ ID NO: 74051 - protein, 16 aa, Borrelia burgdorferi B31
IISEYSNSFSDVDIGR

SEQ ID NO: 74052 - protein, 16 aa, Borrelia burgdorferi B31
ISEYSNSFSDVDIGRT

SEQ ID NO: 74053 - protein, 16 aa, Borrelia burgdorferi B31
SEYSNSFSDVDIGRTI

SEQ ID NO: 74054 - protein, 16 aa, Borrelia burgdorferi B31
EYSNSFSDVDIGRTIA

SEQ ID NO: 74055 - protein, 16 aa, Borrelia burgdorferi B31
YSNSFSDVDIGRTIAS

SEQ ID NO: 74056 - protein, 16 aa, Borrelia burgdorferi B31
SNSFSDVDIGRTIASK

SEQ ID NO: 74057 - protein, 16 aa, Borrelia burgdorferi B31
NSFSDVDIGRTIASKM

SEQ ID NO: 74058 - protein, 16 aa, Borrelia burgdorferi B31
SFSDVDIGRTIASKMY

SEQ ID NO: 74059 - protein, 16 aa, Borrelia burgdorferi B31
FSDVDIGRTIASKMYS

SEQ ID NO: 74060 - protein, 16 aa, Borrelia burgdorferi B31
SDVDIGRTIASKMYSK

SEQ ID NO: 74061 - protein, 16 aa, Borrelia burgdorferi B31
DVDIGRTIASKMYSKG

SEQ ID NO: 74062 - protein, 16 aa, Borrelia burgdorferi B31
VDIGRTIASKMYSKGI

SEQ ID NO: 74063 - protein, 16 aa, Borrelia burgdorferi B31
DIGRTIASKMYSKGID

SEQ ID NO: 74064 - protein, 16 aa, Borrelia burgdorferi B31
IGRTIASKMYSKGIDV

SEQ ID NO: 74065 - protein, 16 aa, Borrelia burgdorferi B31
GRTIASKMYSKGIDVI

SEQ ID NO: 74066 - protein, 16 aa, Borrelia burgdorferi B31
RTIASKMYSKGIDVIH

SEQ ID NO: 74067 - protein, 16 aa, Borrelia burgdorferi B31
TIASKMYSKGIDVIHF

SEQ ID NO: 74068 - protein, 16 aa, Borrelia burgdorferi B31
IASKMYSKGIDVIHFA

SEQ ID NO: 74069 - protein, 16 aa, Borrelia burgdorferi B31
ASKMYSKGIDVIHFAA

SEQ ID NO: 74070 - protein, 16 aa, Borrelia burgdorferi B31
SKMYSKGIDVIHFAAG

SEQ ID NO: 74071 - protein, 16 aa, Borrelia burgdorferi B31
KMYSKGIDVIHFAAGL

SEQ ID NO: 74072 - protein, 16 aa, Borrelia burgdorferi B31
MYSKGIDVIHFAAGLA

SEQ ID NO: 74073 - protein, 16 aa, Borrelia burgdorferi B31
YSKGIDVIHFAAGLAG

SEQ ID NO: 74074 - protein, 16 aa, Borrelia burgdorferi B31
SKGIDVIHFAAGLAGI

SEQ ID NO: 74075 - protein, 16 aa, Borrelia burgdorferi B31
KGIDVIHFAAGLAGIG

SEQ ID NO: 74076 - protein, 16 aa, Borrelia burgdorferi B31
GIDVIHFAAGLAGIGV

SEQ ID NO: 74077 - protein, 16 aa, Borrelia burgdorferi B31
IDVIHFAAGLAGIGVI

SEQ ID NO: 74078 - protein, 16 aa, Borrelia burgdorferi B31
DVIHFAAGLAGIGVIE

SEQ ID NO: 74079 - protein, 16 aa, Borrelia burgdorferi B31
VIHFAAGLAGIGVIET

SEQ ID NO: 74080 - protein, 16 aa, Borrelia burgdorferi B31
IHFAAGLAGIGVIETA

SEQ ID NO: 74081 - protein, 16 aa, Borrelia burgdorferi B31
HFAAGLAGIGVIETAK

SEQ ID NO: 74082 - protein, 16 aa, Borrelia burgdorferi B31
FAAGLAGIGVIETAKN

SEQ ID NO: 74083 - protein, 16 aa, Borrelia burgdorferi B31
AAGLAGIGVIETAKNL

SEQ ID NO: 74084 - protein, 16 aa, Borrelia burgdorferi B31
AGLAGIGVIETAKNLG

SEQ ID NO: 74085 - protein, 16 aa, Borrelia burgdorferi B31
GLAGIGVIETAKNLGD

SEQ ID NO: 74086 - protein, 16 aa, Borrelia burgdorferi B31
LAGIGVIETAKNLGDG

SEQ ID NO: 74087 - protein, 16 aa, Borrelia burgdorferi B31
AGIGVIETAKNLGDGY

SEQ ID NO: 74088 - protein, 16 aa, Borrelia burgdorferi B31
GIGVIETAKNLGDGYY

SEQ ID NO: 74089 - protein, 16 aa, Borrelia burgdorferi B31
IGVIETAKNLGDGYYV

SEQ ID NO: 74090 - protein, 16 aa, Borrelia burgdorferi B31
GVIETAKNLGDGYYVI

SEQ ID NO: 74091 - protein, 16 aa, Borrelia burgdorferi B31
VIETAKNLGDGYYVIG

SEQ ID NO: 74092 - protein, 16 aa, Borrelia burgdorferi B31
IETAKNLGDGYYVIGA

SEQ ID NO: 74093 - protein, 16 aa, Borrelia burgdorferi B31
ETAKNLGDGYYVIGAD

SEQ ID NO: 74094 - protein, 16 aa, Borrelia burgdorferi B31
TAKNLGDGYYVIGADQ

SEQ ID NO: 74095 - protein, 16 aa, Borrelia burgdorferi B31
AKNLGDGYYVIGADQD

SEQ ID NO: 74096 - protein, 16 aa, Borrelia burgdorferi B31
KNLGDGYYVIGADQDQ

SEQ ID NO: 74097 - protein, 16 aa, Borrelia burgdorferi B31
NLGDGYYVIGADQDQS

SEQ ID NO: 74098 - protein, 16 aa, Borrelia burgdorferi B31
LGDGYYVIGADQDQSY

SEQ ID NO: 74099 - protein, 16 aa, Borrelia burgdorferi B31
GDGYYVIGADQDQSYL

SEQ ID NO: 74100 - protein, 16 aa, Borrelia burgdorferi B31
DGYYVIGADQDQSYLA

SEQ ID NO: 74101 - protein, 16 aa, Borrelia burgdorferi B31
GYYVIGADQDQSYLAP

SEQ ID NO: 74102 - protein, 16 aa, Borrelia burgdorferi B31
YYVIGADQDQSYLAPK

SEQ ID NO: 74103 - protein, 16 aa, Borrelia burgdorferi B31
YVIGADQDQSYLAPKN

SEQ ID NO: 74104 - protein, 16 aa, Borrelia burgdorferi B31
VIGADQDQSYLAPKNF

SEQ ID NO: 74105 - protein, 16 aa, Borrelia burgdorferi B31
IGADQDQSYLAPKNFI

SEQ ID NO: 74106 - protein, 16 aa, Borrelia burgdorferi B31
GADQDQSYLAPKNFIT

SEQ ID NO: 74107 - protein, 16 aa, Borrelia burgdorferi B31
ADQDQSYLAPKNFITS

SEQ ID NO: 74108 - protein, 16 aa, Borrelia burgdorferi B31
DQDQSYLAPKNFITSV

SEQ ID NO: 74109 - protein, 16 aa, Borrelia burgdorferi B31
QDQSYLAPKNFITSVI

SEQ ID NO: 74110 - protein, 16 aa, Borrelia burgdorferi B31
DQSYLAPKNFITSVIK

SEQ ID NO: 74111 - protein, 16 aa, Borrelia burgdorferi B31
QSYLAPKNFITSVIKN

SEQ ID NO: 74112 - protein, 16 aa, Borrelia burgdorferi B31
SYLAPKNFITSVIKNI

SEQ ID NO: 74113 - protein, 16 aa, Borrelia burgdorferi B31
YLAPKNFITSVIKNIG

SEQ ID NO: 74114 - protein, 16 aa, Borrelia burgdorferi B31
LAPKNFITSVIKNIGD

SEQ ID NO: 74115 - protein, 16 aa, Borrelia burgdorferi B31
APKNFITSVIKNIGDA

SEQ ID NO: 74116 - protein, 16 aa, Borrelia burgdorferi B31
PKNFITSVIKNIGDAL

SEQ ID NO: 74117 - protein, 16 aa, Borrelia burgdorferi B31
KNFITSVIKNIGDALY

SEQ ID NO: 74118 - protein, 16 aa, Borrelia burgdorferi B31
NFITSVIKNIGDALYL

SEQ ID NO: 74119 - protein, 16 aa, Borrelia burgdorferi B31
FITSVIKNIGDALYLI

SEQ ID NO: 74120 - protein, 16 aa, Borrelia burgdorferi B31
ITSVIKNIGDALYLIT

SEQ ID NO: 74121 - protein, 16 aa, Borrelia burgdorferi B31
TSVIKNIGDALYLITG

SEQ ID NO: 74122 - protein, 16 aa, Borrelia burgdorferi B31
SVIKNIGDALYLITGE

SEQ ID NO: 74123 - protein, 16 aa, Borrelia burgdorferi B31
VIKNIGDALYLITGEY

SEQ ID NO: 74124 - protein, 16 aa, Borrelia burgdorferi B31
IKNIGDALYLITGEYI

SEQ ID NO: 74125 - protein, 16 aa, Borrelia burgdorferi B31
KNIGDALYLITGEYIK

SEQ ID NO: 74126 - protein, 16 aa, Borrelia burgdorferi B31
NIGDALYLITGEYIKN

SEQ ID NO: 74127 - protein, 16 aa, Borrelia burgdorferi B31
IGDALYLITGEYIKNN

SEQ ID NO: 74128 - protein, 16 aa, Borrelia burgdorferi B31
GDALYLITGEYIKNNN

SEQ ID NO: 74129 - protein, 16 aa, Borrelia burgdorferi B31
DALYLITGEYIKNNNV

SEQ ID NO: 74130 - protein, 16 aa, Borrelia burgdorferi B31
ALYLITGEYIKNNNVW

SEQ ID NO: 74131 - protein, 16 aa, Borrelia burgdorferi B31
LYLITGEYIKNNNVWE

SEQ ID NO: 74132 - protein, 16 aa, Borrelia burgdorferi B31
YLITGEYIKNNNVWEG

SEQ ID NO: 74133 - protein, 16 aa, Borrelia burgdorferi B31
LITGEYIKNNNVWEGG

SEQ ID NO: 74134 - protein, 16 aa, Borrelia burgdorferi B31
ITGEYIKNNNVWEGGK

SEQ ID NO: 74135 - protein, 16 aa, Borrelia burgdorferi B31
TGEYIKNNNVWEGGKV

SEQ ID NO: 74136 - protein, 16 aa, Borrelia burgdorferi B31
GEYIKNNNVWEGGKVV

SEQ ID NO: 74137 - protein, 16 aa, Borrelia burgdorferi B31
EYIKNNNVWEGGKVVQ

SEQ ID NO: 74138 - protein, 16 aa, Borrelia burgdorferi B31
YIKNNNVWEGGKVVQM

SEQ ID NO: 74139 - protein, 16 aa, Borrelia burgdorferi B31
IKNNNVWEGGKVVQMG

SEQ ID NO: 74140 - protein, 16 aa, Borrelia burgdorferi B31
KNNNVWEGGKVVQMGL

SEQ ID NO: 74141 - protein, 16 aa, Borrelia burgdorferi B31
NNNVWEGGKVVQMGLR

SEQ ID NO: 74142 - protein, 16 aa, Borrelia burgdorferi B31
NNVWEGGKVVQMGLRD

SEQ ID NO: 74143 - protein, 16 aa, Borrelia burgdorferi B31
NVWEGGKVVQMGLRDG

SEQ ID NO: 74144 - protein, 16 aa, Borrelia burgdorferi B31
VWEGGKVVQMGLRDGV

SEQ ID NO: 74145 - protein, 16 aa, Borrelia burgdorferi B31
WEGGKVVQMGLRDGVI

SEQ ID NO: 74146 - protein, 16 aa, Borrelia burgdorferi B31
EGGKVVQMGLRDGVIG

SEQ ID NO: 74147 - protein, 16 aa, Borrelia burgdorferi B31
GGKVVQMGLRDGVIGL

SEQ ID NO: 74148 - protein, 16 aa, Borrelia burgdorferi B31
GKVVQMGLRDGVIGLP

SEQ ID NO: 74149 - protein, 16 aa, Borrelia burgdorferi B31
KVVQMGLRDGVIGLPN

SEQ ID NO: 74150 - protein, 16 aa, Borrelia burgdorferi B31
VVQMGLRDGVIGLPNA

SEQ ID NO: 74151 - protein, 16 aa, Borrelia burgdorferi B31
VQMGLRDGVIGLPNAN

SEQ ID NO: 74152 - protein, 16 aa, Borrelia burgdorferi B31
QMGLRDGVIGLPNANE

SEQ ID NO: 74153 - protein, 16 aa, Borrelia burgdorferi B31
MGLRDGVIGLPNANEF

SEQ ID NO: 74154 - protein, 16 aa, Borrelia burgdorferi B31
GLRDGVIGLPNANEFE

SEQ ID NO: 74155 - protein, 16 aa, Borrelia burgdorferi B31
LRDGVIGLPNANEFEY

SEQ ID NO: 74156 - protein, 16 aa, Borrelia burgdorferi B31
RDGVIGLPNANEFEYI

SEQ ID NO: 74157 - protein, 16 aa, Borrelia burgdorferi B31
DGVIGLPNANEFEYIK

SEQ ID NO: 74158 - protein, 16 aa, Borrelia burgdorferi B31
GVIGLPNANEFEYIKV

SEQ ID NO: 74159 - protein, 16 aa, Borrelia burgdorferi B31
VIGLPNANEFEYIKVL

SEQ ID NO: 74160 - protein, 16 aa, Borrelia burgdorferi B31
IGLPNANEFEYIKVLE

SEQ ID NO: 74161 - protein, 16 aa, Borrelia burgdorferi B31
GLPNANEFEYIKVLER

SEQ ID NO: 74162 - protein, 16 aa, Borrelia burgdorferi B31
LPNANEFEYIKVLERK

SEQ ID NO: 74163 - protein, 16 aa, Borrelia burgdorferi B31
PNANEFEYIKVLERKI

SEQ ID NO: 74164 - protein, 16 aa, Borrelia burgdorferi B31
NANEFEYIKVLERKII

SEQ ID NO: 74165 - protein, 16 aa, Borrelia burgdorferi B31
ANEFEYIKVLERKIIN

SEQ ID NO: 74166 - protein, 16 aa, Borrelia burgdorferi B31
NEFEYIKVLERKIINK

SEQ ID NO: 74167 - protein, 16 aa, Borrelia burgdorferi B31
EFEYIKVLERKIINKE

SEQ ID NO: 74168 - protein, 16 aa, Borrelia burgdorferi B31
FEYIKVLERKIINKEI

SEQ ID NO: 74169 - protein, 16 aa, Borrelia burgdorferi B31
EYIKVLERKIINKEII

SEQ ID NO: 74170 - protein, 16 aa, Borrelia burgdorferi B31
YIKVLERKIINKEIIV

SEQ ID NO: 74171 - protein, 16 aa, Borrelia burgdorferi B31
IKVLERKIINKEIIVP

SEQ ID NO: 74172 - protein, 16 aa, Borrelia burgdorferi B31
KVLERKIINKEIIVPC

SEQ ID NO: 74173 - protein, 16 aa, Borrelia burgdorferi B31
VLERKIINKEIIVPCN

SEQ ID NO: 74174 - protein, 16 aa, Borrelia burgdorferi B31
LERKIINKEIIVPCNQ

SEQ ID NO: 74175 - protein, 16 aa, Borrelia burgdorferi B31
ERKIINKEIIVPCNQE

SEQ ID NO: 74176 - protein, 16 aa, Borrelia burgdorferi B31
RKIINKEIIVPCNQEE

SEQ ID NO: 74177 - protein, 16 aa, Borrelia burgdorferi B31
KIINKEIIVPCNQEEY

SEQ ID NO: 74178 - protein, 16 aa, Borrelia burgdorferi B31
IINKEIIVPCNQEEYE

SEQ ID NO: 74179 - protein, 16 aa, Borrelia burgdorferi B31
INKEIIVPCNQEEYEI

SEQ ID NO: 74180 - protein, 16 aa, Borrelia burgdorferi B31
NKEIIVPCNQEEYEIF

SEQ ID NO: 74181 - protein, 16 aa, Borrelia burgdorferi B31
KEIIVPCNQEEYEIFI

SEQ ID NO: 74182 - protein, 16 aa, Borrelia burgdorferi B31
EIIVPCNQEEYEIFIK

SEQ ID NO: 74183 - protein, 16 aa, Borrelia burgdorferi B31
IIVPCNQEEYEIFIKQ

SEQ ID NO: 74184 - protein, 16 aa, Borrelia burgdorferi B31
IVPCNQEEYEIFIKQI

SEQ ID NO: 74185 - protein, 16 aa, Borrelia burgdorferi B31
VPCNQEEYEIFIKQIL

SEQ ID NO: 74186 - protein, 16 aa, Borrelia burgdorferi B31
PCNQEEYEIFIKQILK

SEQ ID NO: 74187 - protein, 16 aa, Borrelia burgdorferi B31
CNQEEYEIFIKQILKL

SEQ ID NO: 74188 - protein, 13 aa, Borrelia burgdorferi B31
MFKRFIFITLSLL

SEQ ID NO: 74189 - protein, 13 aa, Borrelia burgdorferi B31
FKRFIFITLSLLV

SEQ ID NO: 74190 - protein, 13 aa, Borrelia burgdorferi B31
KRFIFITLSLLVF

SEQ ID NO: 74191 - protein, 13 aa, Borrelia burgdorferi B31
RFIFITLSLLVFA

SEQ ID NO: 74192 - protein, 13 aa, Borrelia burgdorferi B31
FIFITLSLLVFAC

SEQ ID NO: 74193 - protein, 13 aa, Borrelia burgdorferi B31
IFITLSLLVFACF

SEQ ID NO: 74194 - protein, 13 aa, Borrelia burgdorferi B31
FITLSLLVFACFK

SEQ ID NO: 74195 - protein, 13 aa, Borrelia burgdorferi B31
ITLSLLVFACFKS

SEQ ID NO: 74196 - protein, 13 aa, Borrelia burgdorferi B31
TLSLLVFACFKSN

SEQ ID NO: 74197 - protein, 13 aa, Borrelia burgdorferi B31
LSLLVFACFKSNK

SEQ ID NO: 74198 - protein, 13 aa, Borrelia burgdorferi B31
SLLVFACFKSNKK

SEQ ID NO: 74199 - protein, 13 aa, Borrelia burgdorferi B31
LLVFACFKSNKKS

SEQ ID NO: 74200 - protein, 13 aa, Borrelia burgdorferi B31
LVFACFKSNKKSI

SEQ ID NO: 74201 - protein, 13 aa, Borrelia burgdorferi B31
VFACFKSNKKSIK

SEQ ID NO: 74202 - protein, 13 aa, Borrelia burgdorferi B31
FACFKSNKKSIKS

SEQ ID NO: 74203 - protein, 13 aa, Borrelia burgdorferi B31
ACFKSNKKSIKSD

SEQ ID NO: 74204 - protein, 13 aa, Borrelia burgdorferi B31
CFKSNKKSIKSDK

SEQ ID NO: 74205 - protein, 13 aa, Borrelia burgdorferi B31
FKSNKKSIKSDKV

SEQ ID NO: 74206 - protein, 13 aa, Borrelia burgdorferi B31
KSNKKSIKSDKVV

SEQ ID NO: 74207 - protein, 13 aa, Borrelia burgdorferi B31
SNKKSIKSDKVVV

SEQ ID NO: 74208 - protein, 13 aa, Borrelia burgdorferi B31
NKKSIKSDKVVVG

SEQ ID NO: 74209 - protein, 13 aa, Borrelia burgdorferi B31
KKSIKSDKVVVGV

SEQ ID NO: 74210 - protein, 13 aa, Borrelia burgdorferi B31
KSIKSDKVVVGVL

SEQ ID NO: 74211 - protein, 13 aa, Borrelia burgdorferi B31
SIKSDKVVVGVLA

SEQ ID NO: 74212 - protein, 13 aa, Borrelia burgdorferi B31
IKSDKVVVGVLAH

SEQ ID NO: 74213 - protein, 13 aa, Borrelia burgdorferi B31
KSDKVVVGVLAHG

SEQ ID NO: 74214 - protein, 13 aa, Borrelia burgdorferi B31
SDKVVVGVLAHGS

SEQ ID NO: 74215 - protein, 13 aa, Borrelia burgdorferi B31
DKVVVGVLAHGSF

SEQ ID NO: 74216 - protein, 13 aa, Borrelia burgdorferi B31
KVVVGVLAHGSFY

SEQ ID NO: 74217 - protein, 13 aa, Borrelia burgdorferi B31
VVVGVLAHGSFYD

SEQ ID NO: 74218 - protein, 13 aa, Borrelia burgdorferi B31
VVGVLAHGSFYDK

SEQ ID NO: 74219 - protein, 13 aa, Borrelia burgdorferi B31
VGVLAHGSFYDKG

SEQ ID NO: 74220 - protein, 13 aa, Borrelia burgdorferi B31
GVLAHGSFYDKGY

SEQ ID NO: 74221 - protein, 13 aa, Borrelia burgdorferi B31
VLAHGSFYDKGYN

SEQ ID NO: 74222 - protein, 13 aa, Borrelia burgdorferi B31
LAHGSFYDKGYNQ

SEQ ID NO: 74223 - protein, 13 aa, Borrelia burgdorferi B31
AHGSFYDKGYNQS

SEQ ID NO: 74224 - protein, 13 aa, Borrelia burgdorferi B31
HGSFYDKGYNQSV

SEQ ID NO: 74225 - protein, 13 aa, Borrelia burgdorferi B31
GSFYDKGYNQSVH

SEQ ID NO: 74226 - protein, 13 aa, Borrelia burgdorferi B31
SFYDKGYNQSVHD

SEQ ID NO: 74227 - protein, 13 aa, Borrelia burgdorferi B31
FYDKGYNQSVHDG

SEQ ID NO: 74228 - protein, 13 aa, Borrelia burgdorferi B31
YDKGYNQSVHDGV

SEQ ID NO: 74229 - protein, 13 aa, Borrelia burgdorferi B31
DKGYNQSVHDGVV

SEQ ID NO: 74230 - protein, 13 aa, Borrelia burgdorferi B31
KGYNQSVHDGVVK

SEQ ID NO: 74231 - protein, 13 aa, Borrelia burgdorferi B31
GYNQSVHDGVVKL

SEQ ID NO: 74232 - protein, 13 aa, Borrelia burgdorferi B31
YNQSVHDGVVKLR

SEQ ID NO: 74233 - protein, 13 aa, Borrelia burgdorferi B31
NQSVHDGVVKLRD

SEQ ID NO: 74234 - protein, 13 aa, Borrelia burgdorferi B31
QSVHDGVVKLRDN

SEQ ID NO: 74235 - protein, 13 aa, Borrelia burgdorferi B31
SVHDGVVKLRDNF

SEQ ID NO: 74236 - protein, 13 aa, Borrelia burgdorferi B31
VHDGVVKLRDNFG

SEQ ID NO: 74237 - protein, 13 aa, Borrelia burgdorferi B31
HDGVVKLRDNFGI

SEQ ID NO: 74238 - protein, 13 aa, Borrelia burgdorferi B31
DGVVKLRDNFGIK

SEQ ID NO: 74239 - protein, 13 aa, Borrelia burgdorferi B31
GVVKLRDNFGIKL

SEQ ID NO: 74240 - protein, 13 aa, Borrelia burgdorferi B31
VVKLRDNFGIKLI

SEQ ID NO: 74241 - protein, 13 aa, Borrelia burgdorferi B31
VKLRDNFGIKLIT

SEQ ID NO: 74242 - protein, 13 aa, Borrelia burgdorferi B31
KLRDNFGIKLITK

SEQ ID NO: 74243 - protein, 13 aa, Borrelia burgdorferi B31
LRDNFGIKLITKS

SEQ ID NO: 74244 - protein, 13 aa, Borrelia burgdorferi B31
RDNFGIKLITKSL

SEQ ID NO: 74245 - protein, 13 aa, Borrelia burgdorferi B31
DNFGIKLITKSLR

SEQ ID NO: 74246 - protein, 13 aa, Borrelia burgdorferi B31
NFGIKLITKSLRP

SEQ ID NO: 74247 - protein, 13 aa, Borrelia burgdorferi B31
FGIKLITKSLRPY

SEQ ID NO: 74248 - protein, 13 aa, Borrelia burgdorferi B31
GIKLITKSLRPYP

SEQ ID NO: 74249 - protein, 13 aa, Borrelia burgdorferi B31
IKLITKSLRPYPI

SEQ ID NO: 74250 - protein, 13 aa, Borrelia burgdorferi B31
KLITKSLRPYPIE

SEQ ID NO: 74251 - protein, 13 aa, Borrelia burgdorferi B31
LITKSLRPYPIEG

SEQ ID NO: 74252 - protein, 13 aa, Borrelia burgdorferi B31
ITKSLRPYPIEGK

SEQ ID NO: 74253 - protein, 13 aa, Borrelia burgdorferi B31
TKSLRPYPIEGKR

SEQ ID NO: 74254 - protein, 13 aa, Borrelia burgdorferi B31
KSLRPYPIEGKRL

SEQ ID NO: 74255 - protein, 13 aa, Borrelia burgdorferi B31
SLRPYPIEGKRLL

SEQ ID NO: 74256 - protein, 13 aa, Borrelia burgdorferi B31
LRPYPIEGKRLLT

SEQ ID NO: 74257 - protein, 13 aa, Borrelia burgdorferi B31
RPYPIEGKRLLTV

SEQ ID NO: 74258 - protein, 13 aa, Borrelia burgdorferi B31
PYPIEGKRLLTVD

SEQ ID NO: 74259 - protein, 13 aa, Borrelia burgdorferi B31
YPIEGKRLLTVDE

SEQ ID NO: 74260 - protein, 13 aa, Borrelia burgdorferi B31
PIEGKRLLTVDEA

SEQ ID NO: 74261 - protein, 13 aa, Borrelia burgdorferi B31
IEGKRLLTVDEAM

SEQ ID NO: 74262 - protein, 13 aa, Borrelia burgdorferi B31
EGKRLLTVDEAMT

SEQ ID NO: 74263 - protein, 13 aa, Borrelia burgdorferi B31
GKRLLTVDEAMTE

SEQ ID NO: 74264 - protein, 13 aa, Borrelia burgdorferi B31
KRLLTVDEAMTED

SEQ ID NO: 74265 - protein, 13 aa, Borrelia burgdorferi B31
RLLTVDEAMTEDA

SEQ ID NO: 74266 - protein, 13 aa, Borrelia burgdorferi B31
LLTVDEAMTEDAY

SEQ ID NO: 74267 - protein, 13 aa, Borrelia burgdorferi B31
LTVDEAMTEDAYE

SEQ ID NO: 74268 - protein, 13 aa, Borrelia burgdorferi B31
TVDEAMTEDAYEV

SEQ ID NO: 74269 - protein, 13 aa, Borrelia burgdorferi B31
VDEAMTEDAYEVQ

SEQ ID NO: 74270 - protein, 13 aa, Borrelia burgdorferi B31
DEAMTEDAYEVQK

SEQ ID NO: 74271 - protein, 13 aa, Borrelia burgdorferi B31
EAMTEDAYEVQKN

SEQ ID NO: 74272 - protein, 13 aa, Borrelia burgdorferi B31
AMTEDAYEVQKNP

SEQ ID NO: 74273 - protein, 13 aa, Borrelia burgdorferi B31
MTEDAYEVQKNPL

SEQ ID NO: 74274 - protein, 13 aa, Borrelia burgdorferi B31
TEDAYEVQKNPLN

SEQ ID NO: 74275 - protein, 13 aa, Borrelia burgdorferi B31
EDAYEVQKNPLNL

SEQ ID NO: 74276 - protein, 13 aa, Borrelia burgdorferi B31
DAYEVQKNPLNLF

SEQ ID NO: 74277 - protein, 13 aa, Borrelia burgdorferi B31
AYEVQKNPLNLFW

SEQ ID NO: 74278 - protein, 13 aa, Borrelia burgdorferi B31
YEVQKNPLNLFWL

SEQ ID NO: 74279 - protein, 13 aa, Borrelia burgdorferi B31
EVQKNPLNLFWLI

SEQ ID NO: 74280 - protein, 13 aa, Borrelia burgdorferi B31
VQKNPLNLFWLIG

SEQ ID NO: 74281 - protein, 13 aa, Borrelia burgdorferi B31
QKNPLNLFWLIGY

SEQ ID NO: 74282 - protein, 13 aa, Borrelia burgdorferi B31
KNPLNLFWLIGYR

SEQ ID NO: 74283 - protein, 13 aa, Borrelia burgdorferi B31
NPLNLFWLIGYRF

SEQ ID NO: 74284 - protein, 13 aa, Borrelia burgdorferi B31
PLNLFWLIGYRFS

SEQ ID NO: 74285 - protein, 13 aa, Borrelia burgdorferi B31
LNLFWLIGYRFSD

SEQ ID NO: 74286 - protein, 13 aa, Borrelia burgdorferi B31
NLFWLIGYRFSDL

SEQ ID NO: 74287 - protein, 13 aa, Borrelia burgdorferi B31
LFWLIGYRFSDLS

SEQ ID NO: 74288 - protein, 13 aa, Borrelia burgdorferi B31
FWLIGYRFSDLSV

SEQ ID NO: 74289 - protein, 13 aa, Borrelia burgdorferi B31
WLIGYRFSDLSVK

SEQ ID NO: 74290 - protein, 13 aa, Borrelia burgdorferi B31
LIGYRFSDLSVKL

SEQ ID NO: 74291 - protein, 13 aa, Borrelia burgdorferi B31
IGYRFSDLSVKLS

SEQ ID NO: 74292 - protein, 13 aa, Borrelia burgdorferi B31
GYRFSDLSVKLSY

SEQ ID NO: 74293 - protein, 13 aa, Borrelia burgdorferi B31
YRFSDLSVKLSYE

SEQ ID NO: 74294 - protein, 13 aa, Borrelia burgdorferi B31
RFSDLSVKLSYER

SEQ ID NO: 74295 - protein, 13 aa, Borrelia burgdorferi B31
FSDLSVKLSYERP

SEQ ID NO: 74296 - protein, 13 aa, Borrelia burgdorferi B31
SDLSVKLSYERPD

SEQ ID NO: 74297 - protein, 13 aa, Borrelia burgdorferi B31
DLSVKLSYERPDI

SEQ ID NO: 74298 - protein, 13 aa, Borrelia burgdorferi B31
LSVKLSYERPDIY

SEQ ID NO: 74299 - protein, 13 aa, Borrelia burgdorferi B31
SVKLSYERPDIYY

SEQ ID NO: 74300 - protein, 13 aa, Borrelia burgdorferi B31
VKLSYERPDIYYG

SEQ ID NO: 74301 - protein, 13 aa, Borrelia burgdorferi B31
KLSYERPDIYYGI

SEQ ID NO: 74302 - protein, 13 aa, Borrelia burgdorferi B31
LSYERPDIYYGII

SEQ ID NO: 74303 - protein, 13 aa, Borrelia burgdorferi B31
SYERPDIYYGIID

SEQ ID NO: 74304 - protein, 13 aa, Borrelia burgdorferi B31
YERPDIYYGIIDA

SEQ ID NO: 74305 - protein, 13 aa, Borrelia burgdorferi B31
ERPDIYYGIIDAF

SEQ ID NO: 74306 - protein, 13 aa, Borrelia burgdorferi B31
RPDIYYGIIDAFD

SEQ ID NO: 74307 - protein, 13 aa, Borrelia burgdorferi B31
PDIYYGIIDAFDY

SEQ ID NO: 74308 - protein, 13 aa, Borrelia burgdorferi B31
DIYYGIIDAFDYG

SEQ ID NO: 74309 - protein, 13 aa, Borrelia burgdorferi B31
IYYGIIDAFDYGD

SEQ ID NO: 74310 - protein, 13 aa, Borrelia burgdorferi B31
YYGIIDAFDYGDI

SEQ ID NO: 74311 - protein, 13 aa, Borrelia burgdorferi B31
YGIIDAFDYGDIQ

SEQ ID NO: 74312 - protein, 13 aa, Borrelia burgdorferi B31
GIIDAFDYGDIQV

SEQ ID NO: 74313 - protein, 13 aa, Borrelia burgdorferi B31
IIDAFDYGDIQVP

SEQ ID NO: 74314 - protein, 13 aa, Borrelia burgdorferi B31
IDAFDYGDIQVPK

SEQ ID NO: 74315 - protein, 13 aa, Borrelia burgdorferi B31
DAFDYGDIQVPKN

SEQ ID NO: 74316 - protein, 13 aa, Borrelia burgdorferi B31
AFDYGDIQVPKNS

SEQ ID NO: 74317 - protein, 13 aa, Borrelia burgdorferi B31
FDYGDIQVPKNSL

SEQ ID NO: 74318 - protein, 13 aa, Borrelia burgdorferi B31
DYGDIQVPKNSLA

SEQ ID NO: 74319 - protein, 13 aa, Borrelia burgdorferi B31
YGDIQVPKNSLAI

SEQ ID NO: 74320 - protein, 13 aa, Borrelia burgdorferi B31
GDIQVPKNSLAIK

SEQ ID NO: 74321 - protein, 13 aa, Borrelia burgdorferi B31
DIQVPKNSLAIKF

SEQ ID NO: 74322 - protein, 13 aa, Borrelia burgdorferi B31
IQVPKNSLAIKFR

SEQ ID NO: 74323 - protein, 13 aa, Borrelia burgdorferi B31
QVPKNSLAIKFRN

SEQ ID NO: 74324 - protein, 13 aa, Borrelia burgdorferi B31
VPKNSLAIKFRNE

SEQ ID NO: 74325 - protein, 13 aa, Borrelia burgdorferi B31
PKNSLAIKFRNEE

SEQ ID NO: 74326 - protein, 13 aa, Borrelia burgdorferi B31
KNSLAIKFRNEEA

SEQ ID NO: 74327 - protein, 13 aa, Borrelia burgdorferi B31
NSLAIKFRNEEAA

SEQ ID NO: 74328 - protein, 13 aa, Borrelia burgdorferi B31
SLAIKFRNEEAAF

SEQ ID NO: 74329 - protein, 13 aa, Borrelia burgdorferi B31
LAIKFRNEEAAFL

SEQ ID NO: 74330 - protein, 13 aa, Borrelia burgdorferi B31
AIKFRNEEAAFLA

SEQ ID NO: 74331 - protein, 13 aa, Borrelia burgdorferi B31
IKFRNEEAAFLAG

SEQ ID NO: 74332 - protein, 13 aa, Borrelia burgdorferi B31
KFRNEEAAFLAGY

SEQ ID NO: 74333 - protein, 13 aa, Borrelia burgdorferi B31
FRNEEAAFLAGYI

SEQ ID NO: 74334 - protein, 13 aa, Borrelia burgdorferi B31
RNEEAAFLAGYIA

SEQ ID NO: 74335 - protein, 13 aa, Borrelia burgdorferi B31
NEEAAFLAGYIAA

SEQ ID NO: 74336 - protein, 13 aa, Borrelia burgdorferi B31
EEAAFLAGYIAAK

SEQ ID NO: 74337 - protein, 13 aa, Borrelia burgdorferi B31
EAAFLAGYIAAKM

SEQ ID NO: 74338 - protein, 13 aa, Borrelia burgdorferi B31
AAFLAGYIAAKMS

SEQ ID NO: 74339 - protein, 13 aa, Borrelia burgdorferi B31
AFLAGYIAAKMSR

SEQ ID NO: 74340 - protein, 13 aa, Borrelia burgdorferi B31
FLAGYIAAKMSRK

SEQ ID NO: 74341 - protein, 13 aa, Borrelia burgdorferi B31
LAGYIAAKMSRKE

SEQ ID NO: 74342 - protein, 13 aa, Borrelia burgdorferi B31
AGYIAAKMSRKEK

SEQ ID NO: 74343 - protein, 13 aa, Borrelia burgdorferi B31
GYIAAKMSRKEKI

SEQ ID NO: 74344 - protein, 13 aa, Borrelia burgdorferi B31
YIAAKMSRKEKIG

SEQ ID NO: 74345 - protein, 13 aa, Borrelia burgdorferi B31
IAAKMSRKEKIGF

SEQ ID NO: 74346 - protein, 13 aa, Borrelia burgdorferi B31
AAKMSRKEKIGFL

SEQ ID NO: 74347 - protein, 13 aa, Borrelia burgdorferi B31
AKMSRKEKIGFLT

SEQ ID NO: 74348 - protein, 13 aa, Borrelia burgdorferi B31
KMSRKEKIGFLTG

SEQ ID NO: 74349 - protein, 13 aa, Borrelia burgdorferi B31
MSRKEKIGFLTGP

SEQ ID NO: 74350 - protein, 13 aa, Borrelia burgdorferi B31
SRKEKIGFLTGPM

SEQ ID NO: 74351 - protein, 13 aa, Borrelia burgdorferi B31
RKEKIGFLTGPMS

SEQ ID NO: 74352 - protein, 13 aa, Borrelia burgdorferi B31
KEKIGFLTGPMSE

SEQ ID NO: 74353 - protein, 13 aa, Borrelia burgdorferi B31
EKIGFLTGPMSEH

SEQ ID NO: 74354 - protein, 13 aa, Borrelia burgdorferi B31
KIGFLTGPMSEHV

SEQ ID NO: 74355 - protein, 13 aa, Borrelia burgdorferi B31
IGFLTGPMSEHVK

SEQ ID NO: 74356 - protein, 13 aa, Borrelia burgdorferi B31
GFLTGPMSEHVKD

SEQ ID NO: 74357 - protein, 13 aa, Borrelia burgdorferi B31
FLTGPMSEHVKDF

SEQ ID NO: 74358 - protein, 13 aa, Borrelia burgdorferi B31
LTGPMSEHVKDFK

SEQ ID NO: 74359 - protein, 13 aa, Borrelia burgdorferi B31
TGPMSEHVKDFKF

SEQ ID NO: 74360 - protein, 13 aa, Borrelia burgdorferi B31
GPMSEHVKDFKFG

SEQ ID NO: 74361 - protein, 13 aa, Borrelia burgdorferi B31
PMSEHVKDFKFGF

SEQ ID NO: 74362 - protein, 13 aa, Borrelia burgdorferi B31
MSEHVKDFKFGFK

SEQ ID NO: 74363 - protein, 13 aa, Borrelia burgdorferi B31
SEHVKDFKFGFKA

SEQ ID NO: 74364 - protein, 13 aa, Borrelia burgdorferi B31
EHVKDFKFGFKAG

SEQ ID NO: 74365 - protein, 13 aa, Borrelia burgdorferi B31
HVKDFKFGFKAGI

SEQ ID NO: 74366 - protein, 13 aa, Borrelia burgdorferi B31
VKDFKFGFKAGIF

SEQ ID NO: 74367 - protein, 13 aa, Borrelia burgdorferi B31
KDFKFGFKAGIFY

SEQ ID NO: 74368 - protein, 13 aa, Borrelia burgdorferi B31
DFKFGFKAGIFYA

SEQ ID NO: 74369 - protein, 13 aa, Borrelia burgdorferi B31
FKFGFKAGIFYAN

SEQ ID NO: 74370 - protein, 13 aa, Borrelia burgdorferi B31
KFGFKAGIFYANP

SEQ ID NO: 74371 - protein, 13 aa, Borrelia burgdorferi B31
FGFKAGIFYANPK

SEQ ID NO: 74372 - protein, 13 aa, Borrelia burgdorferi B31
GFKAGIFYANPKL

SEQ ID NO: 74373 - protein, 13 aa, Borrelia burgdorferi B31
FKAGIFYANPKLR

SEQ ID NO: 74374 - protein, 13 aa, Borrelia burgdorferi B31
KAGIFYANPKLRL

SEQ ID NO: 74375 - protein, 13 aa, Borrelia burgdorferi B31
AGIFYANPKLRLV

SEQ ID NO: 74376 - protein, 13 aa, Borrelia burgdorferi B31
GIFYANPKLRLVS

SEQ ID NO: 74377 - protein, 13 aa, Borrelia burgdorferi B31
IFYANPKLRLVSK

SEQ ID NO: 74378 - protein, 13 aa, Borrelia burgdorferi B31
FYANPKLRLVSKK

SEQ ID NO: 74379 - protein, 13 aa, Borrelia burgdorferi B31
YANPKLRLVSKKA

SEQ ID NO: 74380 - protein, 13 aa, Borrelia burgdorferi B31
ANPKLRLVSKKAP

SEQ ID NO: 74381 - protein, 13 aa, Borrelia burgdorferi B31
NPKLRLVSKKAPS

SEQ ID NO: 74382 - protein, 13 aa, Borrelia burgdorferi B31
PKLRLVSKKAPSL

SEQ ID NO: 74383 - protein, 13 aa, Borrelia burgdorferi B31
KLRLVSKKAPSLF

SEQ ID NO: 74384 - protein, 13 aa, Borrelia burgdorferi B31
LRLVSKKAPSLFD

SEQ ID NO: 74385 - protein, 13 aa, Borrelia burgdorferi B31
RLVSKKAPSLFDK

SEQ ID NO: 74386 - protein, 13 aa, Borrelia burgdorferi B31
LVSKKAPSLFDKE

SEQ ID NO: 74387 - protein, 13 aa, Borrelia burgdorferi B31
VSKKAPSLFDKEK

SEQ ID NO: 74388 - protein, 13 aa, Borrelia burgdorferi B31
SKKAPSLFDKEKG

SEQ ID NO: 74389 - protein, 13 aa, Borrelia burgdorferi B31
KKAPSLFDKEKGK

SEQ ID NO: 74390 - protein, 13 aa, Borrelia burgdorferi B31
KAPSLFDKEKGKA

SEQ ID NO: 74391 - protein, 13 aa, Borrelia burgdorferi B31
APSLFDKEKGKAM

SEQ ID NO: 74392 - protein, 13 aa, Borrelia burgdorferi B31
PSLFDKEKGKAMA

SEQ ID NO: 74393 - protein, 13 aa, Borrelia burgdorferi B31
SLFDKEKGKAMAL

SEQ ID NO: 74394 - protein, 13 aa, Borrelia burgdorferi B31
LFDKEKGKAMALF

SEQ ID NO: 74395 - protein, 13 aa, Borrelia burgdorferi B31
FDKEKGKAMALFM

SEQ ID NO: 74396 - protein, 13 aa, Borrelia burgdorferi B31
DKEKGKAMALFMY

SEQ ID NO: 74397 - protein, 13 aa, Borrelia burgdorferi B31
KEKGKAMALFMYK

SEQ ID NO: 74398 - protein, 13 aa, Borrelia burgdorferi B31
EKGKAMALFMYKE

SEQ ID NO: 74399 - protein, 13 aa, Borrelia burgdorferi B31
KGKAMALFMYKED

SEQ ID NO: 74400 - protein, 13 aa, Borrelia burgdorferi B31
GKAMALFMYKEDK

SEQ ID NO: 74401 - protein, 13 aa, Borrelia burgdorferi B31
KAMALFMYKEDKV

SEQ ID NO: 74402 - protein, 13 aa, Borrelia burgdorferi B31
AMALFMYKEDKVG

SEQ ID NO: 74403 - protein, 13 aa, Borrelia burgdorferi B31
MALFMYKEDKVGV

SEQ ID NO: 74404 - protein, 13 aa, Borrelia burgdorferi B31
ALFMYKEDKVGVI

SEQ ID NO: 74405 - protein, 13 aa, Borrelia burgdorferi B31
LFMYKEDKVGVIF

SEQ ID NO: 74406 - protein, 13 aa, Borrelia burgdorferi B31
FMYKEDKVGVIFP

SEQ ID NO: 74407 - protein, 13 aa, Borrelia burgdorferi B31
MYKEDKVGVIFPI

SEQ ID NO: 74408 - protein, 13 aa, Borrelia burgdorferi B31
YKEDKVGVIFPIA

SEQ ID NO: 74409 - protein, 13 aa, Borrelia burgdorferi B31
KEDKVGVIFPIAG

SEQ ID NO: 74410 - protein, 13 aa, Borrelia burgdorferi B31
EDKVGVIFPIAGI

SEQ ID NO: 74411 - protein, 13 aa, Borrelia burgdorferi B31
DKVGVIFPIAGIT

SEQ ID NO: 74412 - protein, 13 aa, Borrelia burgdorferi B31
KVGVIFPIAGITG

SEQ ID NO: 74413 - protein, 13 aa, Borrelia burgdorferi B31
VGVIFPIAGITGL

SEQ ID NO: 74414 - protein, 13 aa, Borrelia burgdorferi B31
GVIFPIAGITGLG

SEQ ID NO: 74415 - protein, 13 aa, Borrelia burgdorferi B31
VIFPIAGITGLGV

SEQ ID NO: 74416 - protein, 13 aa, Borrelia burgdorferi B31
IFPIAGITGLGVY

SEQ ID NO: 74417 - protein, 13 aa, Borrelia burgdorferi B31
FPIAGITGLGVYD

SEQ ID NO: 74418 - protein, 13 aa, Borrelia burgdorferi B31
PIAGITGLGVYDA

SEQ ID NO: 74419 - protein, 13 aa, Borrelia burgdorferi B31
IAGITGLGVYDAA

SEQ ID NO: 74420 - protein, 13 aa, Borrelia burgdorferi B31
AGITGLGVYDAAK

SEQ ID NO: 74421 - protein, 13 aa, Borrelia burgdorferi B31
GITGLGVYDAAKE

SEQ ID NO: 74422 - protein, 13 aa, Borrelia burgdorferi B31
ITGLGVYDAAKEL

SEQ ID NO: 74423 - protein, 13 aa, Borrelia burgdorferi B31
TGLGVYDAAKELG

SEQ ID NO: 74424 - protein, 13 aa, Borrelia burgdorferi B31
GLGVYDAAKELGP

SEQ ID NO: 74425 - protein, 13 aa, Borrelia burgdorferi B31
LGVYDAAKELGPK

SEQ ID NO: 74426 - protein, 13 aa, Borrelia burgdorferi B31
GVYDAAKELGPKY

SEQ ID NO: 74427 - protein, 13 aa, Borrelia burgdorferi B31
VYDAAKELGPKYY

SEQ ID NO: 74428 - protein, 13 aa, Borrelia burgdorferi B31
YDAAKELGPKYYV

SEQ ID NO: 74429 - protein, 13 aa, Borrelia burgdorferi B31
DAAKELGPKYYVI

SEQ ID NO: 74430 - protein, 13 aa, Borrelia burgdorferi B31
AAKELGPKYYVIG

SEQ ID NO: 74431 - protein, 13 aa, Borrelia burgdorferi B31
AKELGPKYYVIGL

SEQ ID NO: 74432 - protein, 13 aa, Borrelia burgdorferi B31
KELGPKYYVIGLN

SEQ ID NO: 74433 - protein, 13 aa, Borrelia burgdorferi B31
ELGPKYYVIGLNQ

SEQ ID NO: 74434 - protein, 13 aa, Borrelia burgdorferi B31
LGPKYYVIGLNQD

SEQ ID NO: 74435 - protein, 13 aa, Borrelia burgdorferi B31
GPKYYVIGLNQDQ

SEQ ID NO: 74436 - protein, 13 aa, Borrelia burgdorferi B31
PKYYVIGLNQDQS

SEQ ID NO: 74437 - protein, 13 aa, Borrelia burgdorferi B31
KYYVIGLNQDQSY

SEQ ID NO: 74438 - protein, 13 aa, Borrelia burgdorferi B31
YYVIGLNQDQSYI

SEQ ID NO: 74439 - protein, 13 aa, Borrelia burgdorferi B31
YVIGLNQDQSYIA

SEQ ID NO: 74440 - protein, 13 aa, Borrelia burgdorferi B31
VIGLNQDQSYIAP

SEQ ID NO: 74441 - protein, 13 aa, Borrelia burgdorferi B31
IGLNQDQSYIAPQ

SEQ ID NO: 74442 - protein, 13 aa, Borrelia burgdorferi B31
GLNQDQSYIAPQN

SEQ ID NO: 74443 - protein, 13 aa, Borrelia burgdorferi B31
LNQDQSYIAPQNV

SEQ ID NO: 74444 - protein, 13 aa, Borrelia burgdorferi B31
NQDQSYIAPQNVI

SEQ ID NO: 74445 - protein, 13 aa, Borrelia burgdorferi B31
QDQSYIAPQNVIT

SEQ ID NO: 74446 - protein, 13 aa, Borrelia burgdorferi B31
DQSYIAPQNVITS

SEQ ID NO: 74447 - protein, 13 aa, Borrelia burgdorferi B31
QSYIAPQNVITSI

SEQ ID NO: 74448 - protein, 13 aa, Borrelia burgdorferi B31
SYIAPQNVITSII

SEQ ID NO: 74449 - protein, 13 aa, Borrelia burgdorferi B31
YIAPQNVITSIIK

SEQ ID NO: 74450 - protein, 13 aa, Borrelia burgdorferi B31
IAPQNVITSIIKD

SEQ ID NO: 74451 - protein, 13 aa, Borrelia burgdorferi B31
APQNVITSIIKDI

SEQ ID NO: 74452 - protein, 13 aa, Borrelia burgdorferi B31
PQNVITSIIKDIG

SEQ ID NO: 74453 - protein, 13 aa, Borrelia burgdorferi B31
QNVITSIIKDIGK

SEQ ID NO: 74454 - protein, 13 aa, Borrelia burgdorferi B31
NVITSIIKDIGKV

SEQ ID NO: 74455 - protein, 13 aa, Borrelia burgdorferi B31
VITSIIKDIGKVI

SEQ ID NO: 74456 - protein, 13 aa, Borrelia burgdorferi B31
ITSIIKDIGKVIY

SEQ ID NO: 74457 - protein, 13 aa, Borrelia burgdorferi B31
TSIIKDIGKVIYS

SEQ ID NO: 74458 - protein, 13 aa, Borrelia burgdorferi B31
SIIKDIGKVIYSI

SEQ ID NO: 74459 - protein, 13 aa, Borrelia burgdorferi B31
IIKDIGKVIYSIS

SEQ ID NO: 74460 - protein, 13 aa, Borrelia burgdorferi B31
IKDIGKVIYSISS

SEQ ID NO: 74461 - protein, 13 aa, Borrelia burgdorferi B31
KDIGKVIYSISSE

SEQ ID NO: 74462 - protein, 13 aa, Borrelia burgdorferi B31
DIGKVIYSISSEY

SEQ ID NO: 74463 - protein, 13 aa, Borrelia burgdorferi B31
IGKVIYSISSEYI

SEQ ID NO: 74464 - protein, 13 aa, Borrelia burgdorferi B31
GKVIYSISSEYIN

SEQ ID NO: 74465 - protein, 13 aa, Borrelia burgdorferi B31
KVIYSISSEYINN

SEQ ID NO: 74466 - protein, 13 aa, Borrelia burgdorferi B31
VIYSISSEYINNR

SEQ ID NO: 74467 - protein, 13 aa, Borrelia burgdorferi B31
IYSISSEYINNRV

SEQ ID NO: 74468 - protein, 13 aa, Borrelia burgdorferi B31
YSISSEYINNRVF

SEQ ID NO: 74469 - protein, 13 aa, Borrelia burgdorferi B31
SISSEYINNRVFK

SEQ ID NO: 74470 - protein, 13 aa, Borrelia burgdorferi B31
ISSEYINNRVFKG

SEQ ID NO: 74471 - protein, 13 aa, Borrelia burgdorferi B31
SSEYINNRVFKGG

SEQ ID NO: 74472 - protein, 13 aa, Borrelia burgdorferi B31
SEYINNRVFKGGI

SEQ ID NO: 74473 - protein, 13 aa, Borrelia burgdorferi B31
EYINNRVFKGGII

SEQ ID NO: 74474 - protein, 13 aa, Borrelia burgdorferi B31
YINNRVFKGGIII

SEQ ID NO: 74475 - protein, 13 aa, Borrelia burgdorferi B31
INNRVFKGGIIID

SEQ ID NO: 74476 - protein, 13 aa, Borrelia burgdorferi B31
NNRVFKGGIIIDR

SEQ ID NO: 74477 - protein, 13 aa, Borrelia burgdorferi B31
NRVFKGGIIIDRG

SEQ ID NO: 74478 - protein, 13 aa, Borrelia burgdorferi B31
RVFKGGIIIDRGL

SEQ ID NO: 74479 - protein, 13 aa, Borrelia burgdorferi B31
VFKGGIIIDRGLK

SEQ ID NO: 74480 - protein, 13 aa, Borrelia burgdorferi B31
FKGGIIIDRGLKE

SEQ ID NO: 74481 - protein, 13 aa, Borrelia burgdorferi B31
KGGIIIDRGLKEG

SEQ ID NO: 74482 - protein, 13 aa, Borrelia burgdorferi B31
GGIIIDRGLKEGV

SEQ ID NO: 74483 - protein, 13 aa, Borrelia burgdorferi B31
GIIIDRGLKEGVI

SEQ ID NO: 74484 - protein, 13 aa, Borrelia burgdorferi B31
IIIDRGLKEGVIE

SEQ ID NO: 74485 - protein, 13 aa, Borrelia burgdorferi B31
IIDRGLKEGVIEI

SEQ ID NO: 74486 - protein, 13 aa, Borrelia burgdorferi B31
IDRGLKEGVIEIV

SEQ ID NO: 74487 - protein, 13 aa, Borrelia burgdorferi B31
DRGLKEGVIEIVK

SEQ ID NO: 74488 - protein, 13 aa, Borrelia burgdorferi B31
RGLKEGVIEIVKD

SEQ ID NO: 74489 - protein, 13 aa, Borrelia burgdorferi B31
GLKEGVIEIVKDP

SEQ ID NO: 74490 - protein, 13 aa, Borrelia burgdorferi B31
LKEGVIEIVKDPD

SEQ ID NO: 74491 - protein, 13 aa, Borrelia burgdorferi B31
KEGVIEIVKDPDV

SEQ ID NO: 74492 - protein, 13 aa, Borrelia burgdorferi B31
EGVIEIVKDPDVL

SEQ ID NO: 74493 - protein, 13 aa, Borrelia burgdorferi B31
GVIEIVKDPDVLN

SEQ ID NO: 74494 - protein, 13 aa, Borrelia burgdorferi B31
VIEIVKDPDVLNN

SEQ ID NO: 74495 - protein, 13 aa, Borrelia burgdorferi B31
IEIVKDPDVLNNR

SEQ ID NO: 74496 - protein, 13 aa, Borrelia burgdorferi B31
EIVKDPDVLNNRL

SEQ ID NO: 74497 - protein, 13 aa, Borrelia burgdorferi B31
IVKDPDVLNNRLV

SEQ ID NO: 74498 - protein, 13 aa, Borrelia burgdorferi B31
VKDPDVLNNRLVD

SEQ ID NO: 74499 - protein, 13 aa, Borrelia burgdorferi B31
KDPDVLNNRLVDE

SEQ ID NO: 74500 - protein, 13 aa, Borrelia burgdorferi B31
DPDVLNNRLVDEV

SEQ ID NO: 74501 - protein, 13 aa, Borrelia burgdorferi B31
PDVLNNRLVDEVI

SEQ ID NO: 74502 - protein, 13 aa, Borrelia burgdorferi B31
DVLNNRLVDEVID

SEQ ID NO: 74503 - protein, 13 aa, Borrelia burgdorferi B31
VLNNRLVDEVIDL

SEQ ID NO: 74504 - protein, 13 aa, Borrelia burgdorferi B31
LNNRLVDEVIDLE

SEQ ID NO: 74505 - protein, 13 aa, Borrelia burgdorferi B31
NNRLVDEVIDLEN

SEQ ID NO: 74506 - protein, 13 aa, Borrelia burgdorferi B31
NRLVDEVIDLENK

SEQ ID NO: 74507 - protein, 13 aa, Borrelia burgdorferi B31
RLVDEVIDLENKI

SEQ ID NO: 74508 - protein, 13 aa, Borrelia burgdorferi B31
LVDEVIDLENKII

SEQ ID NO: 74509 - protein, 13 aa, Borrelia burgdorferi B31
VDEVIDLENKIIS

SEQ ID NO: 74510 - protein, 13 aa, Borrelia burgdorferi B31
DEVIDLENKIISG

SEQ ID NO: 74511 - protein, 13 aa, Borrelia burgdorferi B31
EVIDLENKIISGE

SEQ ID NO: 74512 - protein, 13 aa, Borrelia burgdorferi B31
VIDLENKIISGEI

SEQ ID NO: 74513 - protein, 13 aa, Borrelia burgdorferi B31
IDLENKIISGEII

SEQ ID NO: 74514 - protein, 13 aa, Borrelia burgdorferi B31
DLENKIISGEIIV

SEQ ID NO: 74515 - protein, 13 aa, Borrelia burgdorferi B31
LENKIISGEIIVP

SEQ ID NO: 74516 - protein, 13 aa, Borrelia burgdorferi B31
ENKIISGEIIVPD

SEQ ID NO: 74517 - protein, 13 aa, Borrelia burgdorferi B31
NKIISGEIIVPDS

SEQ ID NO: 74518 - protein, 13 aa, Borrelia burgdorferi B31
KIISGEIIVPDSE

SEQ ID NO: 74519 - protein, 13 aa, Borrelia burgdorferi B31
IISGEIIVPDSEY

SEQ ID NO: 74520 - protein, 13 aa, Borrelia burgdorferi B31
ISGEIIVPDSEYA

SEQ ID NO: 74521 - protein, 13 aa, Borrelia burgdorferi B31
SGEIIVPDSEYAF

SEQ ID NO: 74522 - protein, 13 aa, Borrelia burgdorferi B31
GEIIVPDSEYAFD

SEQ ID NO: 74523 - protein, 13 aa, Borrelia burgdorferi B31
EIIVPDSEYAFDL

SEQ ID NO: 74524 - protein, 13 aa, Borrelia burgdorferi B31
IIVPDSEYAFDLF

SEQ ID NO: 74525 - protein, 13 aa, Borrelia burgdorferi B31
IVPDSEYAFDLFK

SEQ ID NO: 74526 - protein, 13 aa, Borrelia burgdorferi B31
VPDSEYAFDLFKS

SEQ ID NO: 74527 - protein, 13 aa, Borrelia burgdorferi B31
PDSEYAFDLFKSK

SEQ ID NO: 74528 - protein, 13 aa, Borrelia burgdorferi B31
DSEYAFDLFKSKL

SEQ ID NO: 74529 - protein, 14 aa, Borrelia burgdorferi B31
MFKRFIFITLSLLV

SEQ ID NO: 74530 - protein, 14 aa, Borrelia burgdorferi B31
FKRFIFITLSLLVF

SEQ ID NO: 74531 - protein, 14 aa, Borrelia burgdorferi B31
KRFIFITLSLLVFA

SEQ ID NO: 74532 - protein, 14 aa, Borrelia burgdorferi B31
RFIFITLSLLVFAC

SEQ ID NO: 74533 - protein, 14 aa, Borrelia burgdorferi B31
FIFITLSLLVFACF

SEQ ID NO: 74534 - protein, 14 aa, Borrelia burgdorferi B31
IFITLSLLVFACFK

SEQ ID NO: 74535 - protein, 14 aa, Borrelia burgdorferi B31
FITLSLLVFACFKS

SEQ ID NO: 74536 - protein, 14 aa, Borrelia burgdorferi B31
ITLSLLVFACFKSN

SEQ ID NO: 74537 - protein, 14 aa, Borrelia burgdorferi B31
TLSLLVFACFKSNK

SEQ ID NO: 74538 - protein, 14 aa, Borrelia burgdorferi B31
LSLLVFACFKSNKK

SEQ ID NO: 74539 - protein, 14 aa, Borrelia burgdorferi B31
SLLVFACFKSNKKS

SEQ ID NO: 74540 - protein, 14 aa, Borrelia burgdorferi B31
LLVFACFKSNKKSI

SEQ ID NO: 74541 - protein, 14 aa, Borrelia burgdorferi B31
LVFACFKSNKKSIK

SEQ ID NO: 74542 - protein, 14 aa, Borrelia burgdorferi B31
VFACFKSNKKSIKS

SEQ ID NO: 74543 - protein, 14 aa, Borrelia burgdorferi B31
FACFKSNKKSIKSD

SEQ ID NO: 74544 - protein, 14 aa, Borrelia burgdorferi B31
ACFKSNKKSIKSDK

SEQ ID NO: 74545 - protein, 14 aa, Borrelia burgdorferi B31
CFKSNKKSIKSDKV

SEQ ID NO: 74546 - protein, 14 aa, Borrelia burgdorferi B31
FKSNKKSIKSDKVV

SEQ ID NO: 74547 - protein, 14 aa, Borrelia burgdorferi B31
KSNKKSIKSDKVVV

SEQ ID NO: 74548 - protein, 14 aa, Borrelia burgdorferi B31
SNKKSIKSDKVVVG

SEQ ID NO: 74549 - protein, 14 aa, Borrelia burgdorferi B31
NKKSIKSDKVVVGV

SEQ ID NO: 74550 - protein, 14 aa, Borrelia burgdorferi B31
KKSIKSDKVVVGVL

SEQ ID NO: 74551 - protein, 14 aa, Borrelia burgdorferi B31
KSIKSDKVVVGVLA

SEQ ID NO: 74552 - protein, 14 aa, Borrelia burgdorferi B31
SIKSDKVVVGVLAH

SEQ ID NO: 74553 - protein, 14 aa, Borrelia burgdorferi B31
IKSDKVVVGVLAHG

SEQ ID NO: 74554 - protein, 14 aa, Borrelia burgdorferi B31
KSDKVVVGVLAHGS

SEQ ID NO: 74555 - protein, 14 aa, Borrelia burgdorferi B31
SDKVVVGVLAHGSF

SEQ ID NO: 74556 - protein, 14 aa, Borrelia burgdorferi B31
DKVVVGVLAHGSFY

SEQ ID NO: 74557 - protein, 14 aa, Borrelia burgdorferi B31
KVVVGVLAHGSFYD

SEQ ID NO: 74558 - protein, 14 aa, Borrelia burgdorferi B31
VVVGVLAHGSFYDK

SEQ ID NO: 74559 - protein, 14 aa, Borrelia burgdorferi B31
VVGVLAHGSFYDKG

SEQ ID NO: 74560 - protein, 14 aa, Borrelia burgdorferi B31
VGVLAHGSFYDKGY

SEQ ID NO: 74561 - protein, 14 aa, Borrelia burgdorferi B31
GVLAHGSFYDKGYN

SEQ ID NO: 74562 - protein, 14 aa, Borrelia burgdorferi B31
VLAHGSFYDKGYNQ

SEQ ID NO: 74563 - protein, 14 aa, Borrelia burgdorferi B31
LAHGSFYDKGYNQS

SEQ ID NO: 74564 - protein, 14 aa, Borrelia burgdorferi B31
AHGSFYDKGYNQSV

SEQ ID NO: 74565 - protein, 14 aa, Borrelia burgdorferi B31
HGSFYDKGYNQSVH

SEQ ID NO: 74566 - protein, 14 aa, Borrelia burgdorferi B31
GSFYDKGYNQSVHD

SEQ ID NO: 74567 - protein, 14 aa, Borrelia burgdorferi B31
SFYDKGYNQSVHDG

SEQ ID NO: 74568 - protein, 14 aa, Borrelia burgdorferi B31
FYDKGYNQSVHDGV

SEQ ID NO: 74569 - protein, 14 aa, Borrelia burgdorferi B31
YDKGYNQSVHDGVV

SEQ ID NO: 74570 - protein, 14 aa, Borrelia burgdorferi B31
DKGYNQSVHDGVVK

SEQ ID NO: 74571 - protein, 14 aa, Borrelia burgdorferi B31
KGYNQSVHDGVVKL

SEQ ID NO: 74572 - protein, 14 aa, Borrelia burgdorferi B31
GYNQSVHDGVVKLR

SEQ ID NO: 74573 - protein, 14 aa, Borrelia burgdorferi B31
YNQSVHDGVVKLRD

SEQ ID NO: 74574 - protein, 14 aa, Borrelia burgdorferi B31
NQSVHDGVVKLRDN

SEQ ID NO: 74575 - protein, 14 aa, Borrelia burgdorferi B31
QSVHDGVVKLRDNF

SEQ ID NO: 74576 - protein, 14 aa, Borrelia burgdorferi B31
SVHDGVVKLRDNFG

SEQ ID NO: 74577 - protein, 14 aa, Borrelia burgdorferi B31
VHDGVVKLRDNFGI

SEQ ID NO: 74578 - protein, 14 aa, Borrelia burgdorferi B31
HDGVVKLRDNFGIK

SEQ ID NO: 74579 - protein, 14 aa, Borrelia burgdorferi B31
DGVVKLRDNFGIKL

SEQ ID NO: 74580 - protein, 14 aa, Borrelia burgdorferi B31
GVVKLRDNFGIKLI

SEQ ID NO: 74581 - protein, 14 aa, Borrelia burgdorferi B31
VVKLRDNFGIKLIT

SEQ ID NO: 74582 - protein, 14 aa, Borrelia burgdorferi B31
VKLRDNFGIKLITK

SEQ ID NO: 74583 - protein, 14 aa, Borrelia burgdorferi B31
KLRDNFGIKLITKS

SEQ ID NO: 74584 - protein, 14 aa, Borrelia burgdorferi B31
LRDNFGIKLITKSL

SEQ ID NO: 74585 - protein, 14 aa, Borrelia burgdorferi B31
RDNFGIKLITKSLR

SEQ ID NO: 74586 - protein, 14 aa, Borrelia burgdorferi B31
DNFGIKLITKSLRP

SEQ ID NO: 74587 - protein, 14 aa, Borrelia burgdorferi B31
NFGIKLITKSLRPY

SEQ ID NO: 74588 - protein, 14 aa, Borrelia burgdorferi B31
FGIKLITKSLRPYP

SEQ ID NO: 74589 - protein, 14 aa, Borrelia burgdorferi B31
GIKLITKSLRPYPI

SEQ ID NO: 74590 - protein, 14 aa, Borrelia burgdorferi B31
IKLITKSLRPYPIE

SEQ ID NO: 74591 - protein, 14 aa, Borrelia burgdorferi B31
KLITKSLRPYPIEG

SEQ ID NO: 74592 - protein, 14 aa, Borrelia burgdorferi B31
LITKSLRPYPIEGK

SEQ ID NO: 74593 - protein, 14 aa, Borrelia burgdorferi B31
ITKSLRPYPIEGKR

SEQ ID NO: 74594 - protein, 14 aa, Borrelia burgdorferi B31
TKSLRPYPIEGKRL

SEQ ID NO: 74595 - protein, 14 aa, Borrelia burgdorferi B31
KSLRPYPIEGKRLL

SEQ ID NO: 74596 - protein, 14 aa, Borrelia burgdorferi B31
SLRPYPIEGKRLLT

SEQ ID NO: 74597 - protein, 14 aa, Borrelia burgdorferi B31
LRPYPIEGKRLLTV

SEQ ID NO: 74598 - protein, 14 aa, Borrelia burgdorferi B31
RPYPIEGKRLLTVD

SEQ ID NO: 74599 - protein, 14 aa, Borrelia burgdorferi B31
PYPIEGKRLLTVDE

SEQ ID NO: 74600 - protein, 14 aa, Borrelia burgdorferi B31
YPIEGKRLLTVDEA

SEQ ID NO: 74601 - protein, 14 aa, Borrelia burgdorferi B31
PIEGKRLLTVDEAM

SEQ ID NO: 74602 - protein, 14 aa, Borrelia burgdorferi B31
IEGKRLLTVDEAMT

SEQ ID NO: 74603 - protein, 14 aa, Borrelia burgdorferi B31
EGKRLLTVDEAMTE

SEQ ID NO: 74604 - protein, 14 aa, Borrelia burgdorferi B31
GKRLLTVDEAMTED

SEQ ID NO: 74605 - protein, 14 aa, Borrelia burgdorferi B31
KRLLTVDEAMTEDA

SEQ ID NO: 74606 - protein, 14 aa, Borrelia burgdorferi B31
RLLTVDEAMTEDAY

SEQ ID NO: 74607 - protein, 14 aa, Borrelia burgdorferi B31
LLTVDEAMTEDAYE

SEQ ID NO: 74608 - protein, 14 aa, Borrelia burgdorferi B31
LTVDEAMTEDAYEV

SEQ ID NO: 74609 - protein, 14 aa, Borrelia burgdorferi B31
TVDEAMTEDAYEVQ

SEQ ID NO: 74610 - protein, 14 aa, Borrelia burgdorferi B31
VDEAMTEDAYEVQK

SEQ ID NO: 74611 - protein, 14 aa, Borrelia burgdorferi B31
DEAMTEDAYEVQKN

SEQ ID NO: 74612 - protein, 14 aa, Borrelia burgdorferi B31
EAMTEDAYEVQKNP

SEQ ID NO: 74613 - protein, 14 aa, Borrelia burgdorferi B31
AMTEDAYEVQKNPL

SEQ ID NO: 74614 - protein, 14 aa, Borrelia burgdorferi B31
MTEDAYEVQKNPLN

SEQ ID NO: 74615 - protein, 14 aa, Borrelia burgdorferi B31
TEDAYEVQKNPLNL

SEQ ID NO: 74616 - protein, 14 aa, Borrelia burgdorferi B31
EDAYEVQKNPLNLF

SEQ ID NO: 74617 - protein, 14 aa, Borrelia burgdorferi B31
DAYEVQKNPLNLFW

SEQ ID NO: 74618 - protein, 14 aa, Borrelia burgdorferi B31
AYEVQKNPLNLFWL

SEQ ID NO: 74619 - protein, 14 aa, Borrelia burgdorferi B31
YEVQKNPLNLFWLI

SEQ ID NO: 74620 - protein, 14 aa, Borrelia burgdorferi B31
EVQKNPLNLFWLIG

SEQ ID NO: 74621 - protein, 14 aa, Borrelia burgdorferi B31
VQKNPLNLFWLIGY

SEQ ID NO: 74622 - protein, 14 aa, Borrelia burgdorferi B31
QKNPLNLFWLIGYR

SEQ ID NO: 74623 - protein, 14 aa, Borrelia burgdorferi B31
KNPLNLFWLIGYRF

SEQ ID NO: 74624 - protein, 14 aa, Borrelia burgdorferi B31
NPLNLFWLIGYRFS

SEQ ID NO: 74625 - protein, 14 aa, Borrelia burgdorferi B31
PLNLFWLIGYRFSD

SEQ ID NO: 74626 - protein, 14 aa, Borrelia burgdorferi B31
LNLFWLIGYRFSDL

SEQ ID NO: 74627 - protein, 14 aa, Borrelia burgdorferi B31
NLFWLIGYRFSDLS

SEQ ID NO: 74628 - protein, 14 aa, Borrelia burgdorferi B31
LFWLIGYRFSDLSV

SEQ ID NO: 74629 - protein, 14 aa, Borrelia burgdorferi B31
FWLIGYRFSDLSVK

SEQ ID NO: 74630 - protein, 14 aa, Borrelia burgdorferi B31
WLIGYRFSDLSVKL

SEQ ID NO: 74631 - protein, 14 aa, Borrelia burgdorferi B31
LIGYRFSDLSVKLS

SEQ ID NO: 74632 - protein, 14 aa, Borrelia burgdorferi B31
IGYRFSDLSVKLSY

SEQ ID NO: 74633 - protein, 14 aa, Borrelia burgdorferi B31
GYRFSDLSVKLSYE

SEQ ID NO: 74634 - protein, 14 aa, Borrelia burgdorferi B31
YRFSDLSVKLSYER

SEQ ID NO: 74635 - protein, 14 aa, Borrelia burgdorferi B31
RFSDLSVKLSYERP

SEQ ID NO: 74636 - protein, 14 aa, Borrelia burgdorferi B31
FSDLSVKLSYERPD

SEQ ID NO: 74637 - protein, 14 aa, Borrelia burgdorferi B31
SDLSVKLSYERPDI

SEQ ID NO: 74638 - protein, 14 aa, Borrelia burgdorferi B31
DLSVKLSYERPDIY

SEQ ID NO: 74639 - protein, 14 aa, Borrelia burgdorferi B31
LSVKLSYERPDIYY

SEQ ID NO: 74640 - protein, 14 aa, Borrelia burgdorferi B31
SVKLSYERPDIYYG

SEQ ID NO: 74641 - protein, 14 aa, Borrelia burgdorferi B31
VKLSYERPDIYYGI

SEQ ID NO: 74642 - protein, 14 aa, Borrelia burgdorferi B31
KLSYERPDIYYGII

SEQ ID NO: 74643 - protein, 14 aa, Borrelia burgdorferi B31
LSYERPDIYYGIID

SEQ ID NO: 74644 - protein, 14 aa, Borrelia burgdorferi B31
SYERPDIYYGIIDA

SEQ ID NO: 74645 - protein, 14 aa, Borrelia burgdorferi B31
YERPDIYYGIIDAF

SEQ ID NO: 74646 - protein, 14 aa, Borrelia burgdorferi B31
ERPDIYYGIIDAFD

SEQ ID NO: 74647 - protein, 14 aa, Borrelia burgdorferi B31
RPDIYYGIIDAFDY

SEQ ID NO: 74648 - protein, 14 aa, Borrelia burgdorferi B31
PDIYYGIIDAFDYG

SEQ ID NO: 74649 - protein, 14 aa, Borrelia burgdorferi B31
DIYYGIIDAFDYGD

SEQ ID NO: 74650 - protein, 14 aa, Borrelia burgdorferi B31
IYYGIIDAFDYGDI

SEQ ID NO: 74651 - protein, 14 aa, Borrelia burgdorferi B31
YYGIIDAFDYGDIQ

SEQ ID NO: 74652 - protein, 14 aa, Borrelia burgdorferi B31
YGIIDAFDYGDIQV

SEQ ID NO: 74653 - protein, 14 aa, Borrelia burgdorferi B31
GIIDAFDYGDIQVP

SEQ ID NO: 74654 - protein, 14 aa, Borrelia burgdorferi B31
IIDAFDYGDIQVPK

SEQ ID NO: 74655 - protein, 14 aa, Borrelia burgdorferi B31
IDAFDYGDIQVPKN

SEQ ID NO: 74656 - protein, 14 aa, Borrelia burgdorferi B31
DAFDYGDIQVPKNS

SEQ ID NO: 74657 - protein, 14 aa, Borrelia burgdorferi B31
AFDYGDIQVPKNSL

SEQ ID NO: 74658 - protein, 14 aa, Borrelia burgdorferi B31
FDYGDIQVPKNSLA

SEQ ID NO: 74659 - protein, 14 aa, Borrelia burgdorferi B31
DYGDIQVPKNSLAI

SEQ ID NO: 74660 - protein, 14 aa, Borrelia burgdorferi B31
YGDIQVPKNSLAIK

SEQ ID NO: 74661 - protein, 14 aa, Borrelia burgdorferi B31
GDIQVPKNSLAIKF

SEQ ID NO: 74662 - protein, 14 aa, Borrelia burgdorferi B31
DIQVPKNSLAIKFR

SEQ ID NO: 74663 - protein, 14 aa, Borrelia burgdorferi B31
IQVPKNSLAIKFRN

SEQ ID NO: 74664 - protein, 14 aa, Borrelia burgdorferi B31
QVPKNSLAIKFRNE

SEQ ID NO: 74665 - protein, 14 aa, Borrelia burgdorferi B31
VPKNSLAIKFRNEE

SEQ ID NO: 74666 - protein, 14 aa, Borrelia burgdorferi B31
PKNSLAIKFRNEEA

SEQ ID NO: 74667 - protein, 14 aa, Borrelia burgdorferi B31
KNSLAIKFRNEEAA

SEQ ID NO: 74668 - protein, 14 aa, Borrelia burgdorferi B31
NSLAIKFRNEEAAF

SEQ ID NO: 74669 - protein, 14 aa, Borrelia burgdorferi B31
SLAIKFRNEEAAFL

SEQ ID NO: 74670 - protein, 14 aa, Borrelia burgdorferi B31
LAIKFRNEEAAFLA

SEQ ID NO: 74671 - protein, 14 aa, Borrelia burgdorferi B31
AIKFRNEEAAFLAG

SEQ ID NO: 74672 - protein, 14 aa, Borrelia burgdorferi B31
IKFRNEEAAFLAGY

SEQ ID NO: 74673 - protein, 14 aa, Borrelia burgdorferi B31
KFRNEEAAFLAGYI

SEQ ID NO: 74674 - protein, 14 aa, Borrelia burgdorferi B31
FRNEEAAFLAGYIA

SEQ ID NO: 74675 - protein, 14 aa, Borrelia burgdorferi B31
RNEEAAFLAGYIAA

SEQ ID NO: 74676 - protein, 14 aa, Borrelia burgdorferi B31
NEEAAFLAGYIAAK

SEQ ID NO: 74677 - protein, 14 aa, Borrelia burgdorferi B31
EEAAFLAGYIAAKM

SEQ ID NO: 74678 - protein, 14 aa, Borrelia burgdorferi B31
EAAFLAGYIAAKMS

SEQ ID NO: 74679 - protein, 14 aa, Borrelia burgdorferi B31
AAFLAGYIAAKMSR

SEQ ID NO: 74680 - protein, 14 aa, Borrelia burgdorferi B31
AFLAGYIAAKMSRK

SEQ ID NO: 74681 - protein, 14 aa, Borrelia burgdorferi B31
FLAGYIAAKMSRKE

SEQ ID NO: 74682 - protein, 14 aa, Borrelia burgdorferi B31
LAGYIAAKMSRKEK

SEQ ID NO: 74683 - protein, 14 aa, Borrelia burgdorferi B31
AGYIAAKMSRKEKI

SEQ ID NO: 74684 - protein, 14 aa, Borrelia burgdorferi B31
GYIAAKMSRKEKIG

SEQ ID NO: 74685 - protein, 14 aa, Borrelia burgdorferi B31
YIAAKMSRKEKIGF

SEQ ID NO: 74686 - protein, 14 aa, Borrelia burgdorferi B31
IAAKMSRKEKIGFL

SEQ ID NO: 74687 - protein, 14 aa, Borrelia burgdorferi B31
AAKMSRKEKIGFLT

SEQ ID NO: 74688 - protein, 14 aa, Borrelia burgdorferi B31
AKMSRKEKIGFLTG

SEQ ID NO: 74689 - protein, 14 aa, Borrelia burgdorferi B31
KMSRKEKIGFLTGP

SEQ ID NO: 74690 - protein, 14 aa, Borrelia burgdorferi B31
MSRKEKIGFLTGPM

SEQ ID NO: 74691 - protein, 14 aa, Borrelia burgdorferi B31
SRKEKIGFLTGPMS

SEQ ID NO: 74692 - protein, 14 aa, Borrelia burgdorferi B31
RKEKIGFLTGPMSE

SEQ ID NO: 74693 - protein, 14 aa, Borrelia burgdorferi B31
KEKIGFLTGPMSEH

SEQ ID NO: 74694 - protein, 14 aa, Borrelia burgdorferi B31
EKIGFLTGPMSEHV

SEQ ID NO: 74695 - protein, 14 aa, Borrelia burgdorferi B31
KIGFLTGPMSEHVK

SEQ ID NO: 74696 - protein, 14 aa, Borrelia burgdorferi B31
IGFLTGPMSEHVKD

SEQ ID NO: 74697 - protein, 14 aa, Borrelia burgdorferi B31
GFLTGPMSEHVKDF

SEQ ID NO: 74698 - protein, 14 aa, Borrelia burgdorferi B31
FLTGPMSEHVKDFK

SEQ ID NO: 74699 - protein, 14 aa, Borrelia burgdorferi B31
LTGPMSEHVKDFKF

SEQ ID NO: 74700 - protein, 14 aa, Borrelia burgdorferi B31
TGPMSEHVKDFKFG

SEQ ID NO: 74701 - protein, 14 aa, Borrelia burgdorferi B31
GPMSEHVKDFKFGF

SEQ ID NO: 74702 - protein, 14 aa, Borrelia burgdorferi B31
PMSEHVKDFKFGFK

SEQ ID NO: 74703 - protein, 14 aa, Borrelia burgdorferi B31
MSEHVKDFKFGFKA

SEQ ID NO: 74704 - protein, 14 aa, Borrelia burgdorferi B31
SEHVKDFKFGFKAG

SEQ ID NO: 74705 - protein, 14 aa, Borrelia burgdorferi B31
EHVKDFKFGFKAGI

SEQ ID NO: 74706 - protein, 14 aa, Borrelia burgdorferi B31
HVKDFKFGFKAGIF

SEQ ID NO: 74707 - protein, 14 aa, Borrelia burgdorferi B31
VKDFKFGFKAGIFY

SEQ ID NO: 74708 - protein, 14 aa, Borrelia burgdorferi B31
KDFKFGFKAGIFYA

SEQ ID NO: 74709 - protein, 14 aa, Borrelia burgdorferi B31
DFKFGFKAGIFYAN

SEQ ID NO: 74710 - protein, 14 aa, Borrelia burgdorferi B31
FKFGFKAGIFYANP

SEQ ID NO: 74711 - protein, 14 aa, Borrelia burgdorferi B31
KFGFKAGIFYANPK

SEQ ID NO: 74712 - protein, 14 aa, Borrelia burgdorferi B31
FGFKAGIFYANPKL

SEQ ID NO: 74713 - protein, 14 aa, Borrelia burgdorferi B31
GFKAGIFYANPKLR

SEQ ID NO: 74714 - protein, 14 aa, Borrelia burgdorferi B31
FKAGIFYANPKLRL

SEQ ID NO: 74715 - protein, 14 aa, Borrelia burgdorferi B31
KAGIFYANPKLRLV

SEQ ID NO: 74716 - protein, 14 aa, Borrelia burgdorferi B31
AGIFYANPKLRLVS

SEQ ID NO: 74717 - protein, 14 aa, Borrelia burgdorferi B31
GIFYANPKLRLVSK

SEQ ID NO: 74718 - protein, 14 aa, Borrelia burgdorferi B31
IFYANPKLRLVSKK

SEQ ID NO: 74719 - protein, 14 aa, Borrelia burgdorferi B31
FYANPKLRLVSKKA

SEQ ID NO: 74720 - protein, 14 aa, Borrelia burgdorferi B31
YANPKLRLVSKKAP

SEQ ID NO: 74721 - protein, 14 aa, Borrelia burgdorferi B31
ANPKLRLVSKKAPS

SEQ ID NO: 74722 - protein, 14 aa, Borrelia burgdorferi B31
NPKLRLVSKKAPSL

SEQ ID NO: 74723 - protein, 14 aa, Borrelia burgdorferi B31
PKLRLVSKKAPSLF

SEQ ID NO: 74724 - protein, 14 aa, Borrelia burgdorferi B31
KLRLVSKKAPSLFD

SEQ ID NO: 74725 - protein, 14 aa, Borrelia burgdorferi B31
LRLVSKKAPSLFDK

SEQ ID NO: 74726 - protein, 14 aa, Borrelia burgdorferi B31
RLVSKKAPSLFDKE

SEQ ID NO: 74727 - protein, 14 aa, Borrelia burgdorferi B31
LVSKKAPSLFDKEK

SEQ ID NO: 74728 - protein, 14 aa, Borrelia burgdorferi B31
VSKKAPSLFDKEKG

SEQ ID NO: 74729 - protein, 14 aa, Borrelia burgdorferi B31
SKKAPSLFDKEKGK

SEQ ID NO: 74730 - protein, 14 aa, Borrelia burgdorferi B31
KKAPSLFDKEKGKA

SEQ ID NO: 74731 - protein, 14 aa, Borrelia burgdorferi B31
KAPSLFDKEKGKAM

SEQ ID NO: 74732 - protein, 14 aa, Borrelia burgdorferi B31
APSLFDKEKGKAMA

SEQ ID NO: 74733 - protein, 14 aa, Borrelia burgdorferi B31
PSLFDKEKGKAMAL

SEQ ID NO: 74734 - protein, 14 aa, Borrelia burgdorferi B31
SLFDKEKGKAMALF

SEQ ID NO: 74735 - protein, 14 aa, Borrelia burgdorferi B31
LFDKEKGKAMALFM

SEQ ID NO: 74736 - protein, 14 aa, Borrelia burgdorferi B31
FDKEKGKAMALFMY

SEQ ID NO: 74737 - protein, 14 aa, Borrelia burgdorferi B31
DKEKGKAMALFMYK

SEQ ID NO: 74738 - protein, 14 aa, Borrelia burgdorferi B31
KEKGKAMALFMYKE

SEQ ID NO: 74739 - protein, 14 aa, Borrelia burgdorferi B31
EKGKAMALFMYKED

SEQ ID NO: 74740 - protein, 14 aa, Borrelia burgdorferi B31
KGKAMALFMYKEDK

SEQ ID NO: 74741 - protein, 14 aa, Borrelia burgdorferi B31
GKAMALFMYKEDKV

SEQ ID NO: 74742 - protein, 14 aa, Borrelia burgdorferi B31
KAMALFMYKEDKVG

SEQ ID NO: 74743 - protein, 14 aa, Borrelia burgdorferi B31
AMALFMYKEDKVGV

SEQ ID NO: 74744 - protein, 14 aa, Borrelia burgdorferi B31
MALFMYKEDKVGVI

SEQ ID NO: 74745 - protein, 14 aa, Borrelia burgdorferi B31
ALFMYKEDKVGVIF

SEQ ID NO: 74746 - protein, 14 aa, Borrelia burgdorferi B31
LFMYKEDKVGVIFP

SEQ ID NO: 74747 - protein, 14 aa, Borrelia burgdorferi B31
FMYKEDKVGVIFPI

SEQ ID NO: 74748 - protein, 14 aa, Borrelia burgdorferi B31
MYKEDKVGVIFPIA

SEQ ID NO: 74749 - protein, 14 aa, Borrelia burgdorferi B31
YKEDKVGVIFPIAG

SEQ ID NO: 74750 - protein, 14 aa, Borrelia burgdorferi B31
KEDKVGVIFPIAGI

SEQ ID NO: 74751 - protein, 14 aa, Borrelia burgdorferi B31
EDKVGVIFPIAGIT

SEQ ID NO: 74752 - protein, 14 aa, Borrelia burgdorferi B31
DKVGVIFPIAGITG

SEQ ID NO: 74753 - protein, 14 aa, Borrelia burgdorferi B31
KVGVIFPIAGITGL

SEQ ID NO: 74754 - protein, 14 aa, Borrelia burgdorferi B31
VGVIFPIAGITGLG

SEQ ID NO: 74755 - protein, 14 aa, Borrelia burgdorferi B31
GVIFPIAGITGLGV

SEQ ID NO: 74756 - protein, 14 aa, Borrelia burgdorferi B31
VIFPIAGITGLGVY

SEQ ID NO: 74757 - protein, 14 aa, Borrelia burgdorferi B31
IFPIAGITGLGVYD

SEQ ID NO: 74758 - protein, 14 aa, Borrelia burgdorferi B31
FPIAGITGLGVYDA

SEQ ID NO: 74759 - protein, 14 aa, Borrelia burgdorferi B31
PIAGITGLGVYDAA

SEQ ID NO: 74760 - protein, 14 aa, Borrelia burgdorferi B31
IAGITGLGVYDAAK

SEQ ID NO: 74761 - protein, 14 aa, Borrelia burgdorferi B31
AGITGLGVYDAAKE

SEQ ID NO: 74762 - protein, 14 aa, Borrelia burgdorferi B31
GITGLGVYDAAKEL

SEQ ID NO: 74763 - protein, 14 aa, Borrelia burgdorferi B31
ITGLGVYDAAKELG

SEQ ID NO: 74764 - protein, 14 aa, Borrelia burgdorferi B31
TGLGVYDAAKELGP

SEQ ID NO: 74765 - protein, 14 aa, Borrelia burgdorferi B31
GLGVYDAAKELGPK

SEQ ID NO: 74766 - protein, 14 aa, Borrelia burgdorferi B31
LGVYDAAKELGPKY

SEQ ID NO: 74767 - protein, 14 aa, Borrelia burgdorferi B31
GVYDAAKELGPKYY

SEQ ID NO: 74768 - protein, 14 aa, Borrelia burgdorferi B31
VYDAAKELGPKYYV

SEQ ID NO: 74769 - protein, 14 aa, Borrelia burgdorferi B31
YDAAKELGPKYYVI

SEQ ID NO: 74770 - protein, 14 aa, Borrelia burgdorferi B31
DAAKELGPKYYVIG

SEQ ID NO: 74771 - protein, 14 aa, Borrelia burgdorferi B31
AAKELGPKYYVIGL

SEQ ID NO: 74772 - protein, 14 aa, Borrelia burgdorferi B31
AKELGPKYYVIGLN

SEQ ID NO: 74773 - protein, 14 aa, Borrelia burgdorferi B31
KELGPKYYVIGLNQ

SEQ ID NO: 74774 - protein, 14 aa, Borrelia burgdorferi B31
ELGPKYYVIGLNQD

SEQ ID NO: 74775 - protein, 14 aa, Borrelia burgdorferi B31
LGPKYYVIGLNQDQ

SEQ ID NO: 74776 - protein, 14 aa, Borrelia burgdorferi B31
GPKYYVIGLNQDQS

SEQ ID NO: 74777 - protein, 14 aa, Borrelia burgdorferi B31
PKYYVIGLNQDQSY

SEQ ID NO: 74778 - protein, 14 aa, Borrelia burgdorferi B31
KYYVIGLNQDQSYI

SEQ ID NO: 74779 - protein, 14 aa, Borrelia burgdorferi B31
YYVIGLNQDQSYIA

SEQ ID NO: 74780 - protein, 14 aa, Borrelia burgdorferi B31
YVIGLNQDQSYIAP

SEQ ID NO: 74781 - protein, 14 aa, Borrelia burgdorferi B31
VIGLNQDQSYIAPQ

SEQ ID NO: 74782 - protein, 14 aa, Borrelia burgdorferi B31
IGLNQDQSYIAPQN

SEQ ID NO: 74783 - protein, 14 aa, Borrelia burgdorferi B31
GLNQDQSYIAPQNV

SEQ ID NO: 74784 - protein, 14 aa, Borrelia burgdorferi B31
LNQDQSYIAPQNVI

SEQ ID NO: 74785 - protein, 14 aa, Borrelia burgdorferi B31
NQDQSYIAPQNVIT

SEQ ID NO: 74786 - protein, 14 aa, Borrelia burgdorferi B31
QDQSYIAPQNVITS

SEQ ID NO: 74787 - protein, 14 aa, Borrelia burgdorferi B31
DQSYIAPQNVITSI

SEQ ID NO: 74788 - protein, 14 aa, Borrelia burgdorferi B31
QSYIAPQNVITSII

SEQ ID NO: 74789 - protein, 14 aa, Borrelia burgdorferi B31
SYIAPQNVITSIIK

SEQ ID NO: 74790 - protein, 14 aa, Borrelia burgdorferi B31
YIAPQNVITSIIKD

SEQ ID NO: 74791 - protein, 14 aa, Borrelia burgdorferi B31
IAPQNVITSIIKDI

SEQ ID NO: 74792 - protein, 14 aa, Borrelia burgdorferi B31
APQNVITSIIKDIG

SEQ ID NO: 74793 - protein, 14 aa, Borrelia burgdorferi B31
PQNVITSIIKDIGK

SEQ ID NO: 74794 - protein, 14 aa, Borrelia burgdorferi B31
QNVITSIIKDIGKV

SEQ ID NO: 74795 - protein, 14 aa, Borrelia burgdorferi B31
NVITSIIKDIGKVI

SEQ ID NO: 74796 - protein, 14 aa, Borrelia burgdorferi B31
VITSIIKDIGKVIY

SEQ ID NO: 74797 - protein, 14 aa, Borrelia burgdorferi B31
ITSIIKDIGKVIYS

SEQ ID NO: 74798 - protein, 14 aa, Borrelia burgdorferi B31
TSIIKDIGKVIYSI

SEQ ID NO: 74799 - protein, 14 aa, Borrelia burgdorferi B31
SIIKDIGKVIYSIS

SEQ ID NO: 74800 - protein, 14 aa, Borrelia burgdorferi B31
IIKDIGKVIYSISS

SEQ ID NO: 74801 - protein, 14 aa, Borrelia burgdorferi B31
IKDIGKVIYSISSE

SEQ ID NO: 74802 - protein, 14 aa, Borrelia burgdorferi B31
KDIGKVIYSISSEY

SEQ ID NO: 74803 - protein, 14 aa, Borrelia burgdorferi B31
DIGKVIYSISSEYI

SEQ ID NO: 74804 - protein, 14 aa, Borrelia burgdorferi B31
IGKVIYSISSEYIN

SEQ ID NO: 74805 - protein, 14 aa, Borrelia burgdorferi B31
GKVIYSISSEYINN

SEQ ID NO: 74806 - protein, 14 aa, Borrelia burgdorferi B31
KVIYSISSEYINNR

SEQ ID NO: 74807 - protein, 14 aa, Borrelia burgdorferi B31
VIYSISSEYINNRV

SEQ ID NO: 74808 - protein, 14 aa, Borrelia burgdorferi B31
IYSISSEYINNRVF

SEQ ID NO: 74809 - protein, 14 aa, Borrelia burgdorferi B31
YSISSEYINNRVFK

SEQ ID NO: 74810 - protein, 14 aa, Borrelia burgdorferi B31
SISSEYINNRVFKG

SEQ ID NO: 74811 - protein, 14 aa, Borrelia burgdorferi B31
ISSEYINNRVFKGG

SEQ ID NO: 74812 - protein, 14 aa, Borrelia burgdorferi B31
SSEYINNRVFKGGI

SEQ ID NO: 74813 - protein, 14 aa, Borrelia burgdorferi B31
SEYINNRVFKGGII

SEQ ID NO: 74814 - protein, 14 aa, Borrelia burgdorferi B31
EYINNRVFKGGIII

SEQ ID NO: 74815 - protein, 14 aa, Borrelia burgdorferi B31
YINNRVFKGGIIID

SEQ ID NO: 74816 - protein, 14 aa, Borrelia burgdorferi B31
INNRVFKGGIIIDR

SEQ ID NO: 74817 - protein, 14 aa, Borrelia burgdorferi B31
NNRVFKGGIIIDRG

SEQ ID NO: 74818 - protein, 14 aa, Borrelia burgdorferi B31
NRVFKGGIIIDRGL

SEQ ID NO: 74819 - protein, 14 aa, Borrelia burgdorferi B31
RVFKGGIIIDRGLK

SEQ ID NO: 74820 - protein, 14 aa, Borrelia burgdorferi B31
VFKGGIIIDRGLKE

SEQ ID NO: 74821 - protein, 14 aa, Borrelia burgdorferi B31
FKGGIIIDRGLKEG

SEQ ID NO: 74822 - protein, 14 aa, Borrelia burgdorferi B31
KGGIIIDRGLKEGV

SEQ ID NO: 74823 - protein, 14 aa, Borrelia burgdorferi B31
GGIIIDRGLKEGVI

SEQ ID NO: 74824 - protein, 14 aa, Borrelia burgdorferi B31
GIIIDRGLKEGVIE

SEQ ID NO: 74825 - protein, 14 aa, Borrelia burgdorferi B31
IIIDRGLKEGVIEI

SEQ ID NO: 74826 - protein, 14 aa, Borrelia burgdorferi B31
IIDRGLKEGVIEIV

SEQ ID NO: 74827 - protein, 14 aa, Borrelia burgdorferi B31
IDRGLKEGVIEIVK

SEQ ID NO: 74828 - protein, 14 aa, Borrelia burgdorferi B31
DRGLKEGVIEIVKD

SEQ ID NO: 74829 - protein, 14 aa, Borrelia burgdorferi B31
RGLKEGVIEIVKDP

SEQ ID NO: 74830 - protein, 14 aa, Borrelia burgdorferi B31
GLKEGVIEIVKDPD

SEQ ID NO: 74831 - protein, 14 aa, Borrelia burgdorferi B31
LKEGVIEIVKDPDV

SEQ ID NO: 74832 - protein, 14 aa, Borrelia burgdorferi B31
KEGVIEIVKDPDVL

SEQ ID NO: 74833 - protein, 14 aa, Borrelia burgdorferi B31
EGVIEIVKDPDVLN

SEQ ID NO: 74834 - protein, 14 aa, Borrelia burgdorferi B31
GVIEIVKDPDVLNN

SEQ ID NO: 74835 - protein, 14 aa, Borrelia burgdorferi B31
VIEIVKDPDVLNNR

SEQ ID NO: 74836 - protein, 14 aa, Borrelia burgdorferi B31
IEIVKDPDVLNNRL

SEQ ID NO: 74837 - protein, 14 aa, Borrelia burgdorferi B31
EIVKDPDVLNNRLV

SEQ ID NO: 74838 - protein, 14 aa, Borrelia burgdorferi B31
IVKDPDVLNNRLVD

SEQ ID NO: 74839 - protein, 14 aa, Borrelia burgdorferi B31
VKDPDVLNNRLVDE

SEQ ID NO: 74840 - protein, 14 aa, Borrelia burgdorferi B31
KDPDVLNNRLVDEV

SEQ ID NO: 74841 - protein, 14 aa, Borrelia burgdorferi B31
DPDVLNNRLVDEVI

SEQ ID NO: 74842 - protein, 14 aa, Borrelia burgdorferi B31
PDVLNNRLVDEVID

SEQ ID NO: 74843 - protein, 14 aa, Borrelia burgdorferi B31
DVLNNRLVDEVIDL

SEQ ID NO: 74844 - protein, 14 aa, Borrelia burgdorferi B31
VLNNRLVDEVIDLE

SEQ ID NO: 74845 - protein, 14 aa, Borrelia burgdorferi B31
LNNRLVDEVIDLEN

SEQ ID NO: 74846 - protein, 14 aa, Borrelia burgdorferi B31
NNRLVDEVIDLENK

SEQ ID NO: 74847 - protein, 14 aa, Borrelia burgdorferi B31
NRLVDEVIDLENKI

SEQ ID NO: 74848 - protein, 14 aa, Borrelia burgdorferi B31
RLVDEVIDLENKII

SEQ ID NO: 74849 - protein, 14 aa, Borrelia burgdorferi B31
LVDEVIDLENKIIS

SEQ ID NO: 74850 - protein, 14 aa, Borrelia burgdorferi B31
VDEVIDLENKIISG

SEQ ID NO: 74851 - protein, 14 aa, Borrelia burgdorferi B31
DEVIDLENKIISGE

SEQ ID NO: 74852 - protein, 14 aa, Borrelia burgdorferi B31
EVIDLENKIISGEI

SEQ ID NO: 74853 - protein, 14 aa, Borrelia burgdorferi B31
VIDLENKIISGEII

SEQ ID NO: 74854 - protein, 14 aa, Borrelia burgdorferi B31
IDLENKIISGEIIV

SEQ ID NO: 74855 - protein, 14 aa, Borrelia burgdorferi B31
DLENKIISGEIIVP

SEQ ID NO: 74856 - protein, 14 aa, Borrelia burgdorferi B31
LENKIISGEIIVPD

SEQ ID NO: 74857 - protein, 14 aa, Borrelia burgdorferi B31
ENKIISGEIIVPDS

SEQ ID NO: 74858 - protein, 14 aa, Borrelia burgdorferi B31
NKIISGEIIVPDSE

SEQ ID NO: 74859 - protein, 14 aa, Borrelia burgdorferi B31
KIISGEIIVPDSEY

SEQ ID NO: 74860 - protein, 14 aa, Borrelia burgdorferi B31
IISGEIIVPDSEYA

SEQ ID NO: 74861 - protein, 14 aa, Borrelia burgdorferi B31
ISGEIIVPDSEYAF

SEQ ID NO: 74862 - protein, 14 aa, Borrelia burgdorferi B31
SGEIIVPDSEYAFD

SEQ ID NO: 74863 - protein, 14 aa, Borrelia burgdorferi B31
GEIIVPDSEYAFDL

SEQ ID NO: 74864 - protein, 14 aa, Borrelia burgdorferi B31
EIIVPDSEYAFDLF

SEQ ID NO: 74865 - protein, 14 aa, Borrelia burgdorferi B31
IIVPDSEYAFDLFK

SEQ ID NO: 74866 - protein, 14 aa, Borrelia burgdorferi B31
IVPDSEYAFDLFKS

SEQ ID NO: 74867 - protein, 14 aa, Borrelia burgdorferi B31
VPDSEYAFDLFKSK

SEQ ID NO: 74868 - protein, 14 aa, Borrelia burgdorferi B31
PDSEYAFDLFKSKL

SEQ ID NO: 74869 - protein, 15 aa, Borrelia burgdorferi B31
MFKRFIFITLSLLVF

SEQ ID NO: 74870 - protein, 15 aa, Borrelia burgdorferi B31
FKRFIFITLSLLVFA

SEQ ID NO: 74871 - protein, 15 aa, Borrelia burgdorferi B31
KRFIFITLSLLVFAC

SEQ ID NO: 74872 - protein, 15 aa, Borrelia burgdorferi B31
RFIFITLSLLVFACF

SEQ ID NO: 74873 - protein, 15 aa, Borrelia burgdorferi B31
FIFITLSLLVFACFK

SEQ ID NO: 74874 - protein, 15 aa, Borrelia burgdorferi B31
IFITLSLLVFACFKS

SEQ ID NO: 74875 - protein, 15 aa, Borrelia burgdorferi B31
FITLSLLVFACFKSN

SEQ ID NO: 74876 - protein, 15 aa, Borrelia burgdorferi B31
ITLSLLVFACFKSNK

SEQ ID NO: 74877 - protein, 15 aa, Borrelia burgdorferi B31
TLSLLVFACFKSNKK

SEQ ID NO: 74878 - protein, 15 aa, Borrelia burgdorferi B31
LSLLVFACFKSNKKS

SEQ ID NO: 74879 - protein, 15 aa, Borrelia burgdorferi B31
SLLVFACFKSNKKSI

SEQ ID NO: 74880 - protein, 15 aa, Borrelia burgdorferi B31
LLVFACFKSNKKSIK

SEQ ID NO: 74881 - protein, 15 aa, Borrelia burgdorferi B31
LVFACFKSNKKSIKS

SEQ ID NO: 74882 - protein, 15 aa, Borrelia burgdorferi B31
VFACFKSNKKSIKSD

SEQ ID NO: 74883 - protein, 15 aa, Borrelia burgdorferi B31
FACFKSNKKSIKSDK

SEQ ID NO: 74884 - protein, 15 aa, Borrelia burgdorferi B31
ACFKSNKKSIKSDKV

SEQ ID NO: 74885 - protein, 15 aa, Borrelia burgdorferi B31
CFKSNKKSIKSDKVV

SEQ ID NO: 74886 - protein, 15 aa, Borrelia burgdorferi B31
FKSNKKSIKSDKVVV

SEQ ID NO: 74887 - protein, 15 aa, Borrelia burgdorferi B31
KSNKKSIKSDKVVVG

SEQ ID NO: 74888 - protein, 15 aa, Borrelia burgdorferi B31
SNKKSIKSDKVVVGV

SEQ ID NO: 74889 - protein, 15 aa, Borrelia burgdorferi B31
NKKSIKSDKVVVGVL

SEQ ID NO: 74890 - protein, 15 aa, Borrelia burgdorferi B31
KKSIKSDKVVVGVLA

SEQ ID NO: 74891 - protein, 15 aa, Borrelia burgdorferi B31
KSIKSDKVVVGVLAH

SEQ ID NO: 74892 - protein, 15 aa, Borrelia burgdorferi B31
SIKSDKVVVGVLAHG

SEQ ID NO: 74893 - protein, 15 aa, Borrelia burgdorferi B31
IKSDKVVVGVLAHGS

SEQ ID NO: 74894 - protein, 15 aa, Borrelia burgdorferi B31
KSDKVVVGVLAHGSF

SEQ ID NO: 74895 - protein, 15 aa, Borrelia burgdorferi B31
SDKVVVGVLAHGSFY

SEQ ID NO: 74896 - protein, 15 aa, Borrelia burgdorferi B31
DKVVVGVLAHGSFYD

SEQ ID NO: 74897 - protein, 15 aa, Borrelia burgdorferi B31
KVVVGVLAHGSFYDK

SEQ ID NO: 74898 - protein, 15 aa, Borrelia burgdorferi B31
VVVGVLAHGSFYDKG

SEQ ID NO: 74899 - protein, 15 aa, Borrelia burgdorferi B31
VVGVLAHGSFYDKGY

SEQ ID NO: 74900 - protein, 15 aa, Borrelia burgdorferi B31
VGVLAHGSFYDKGYN

SEQ ID NO: 74901 - protein, 15 aa, Borrelia burgdorferi B31
GVLAHGSFYDKGYNQ

SEQ ID NO: 74902 - protein, 15 aa, Borrelia burgdorferi B31
VLAHGSFYDKGYNQS

SEQ ID NO: 74903 - protein, 15 aa, Borrelia burgdorferi B31
LAHGSFYDKGYNQSV

SEQ ID NO: 74904 - protein, 15 aa, Borrelia burgdorferi B31
AHGSFYDKGYNQSVH

SEQ ID NO: 74905 - protein, 15 aa, Borrelia burgdorferi B31
HGSFYDKGYNQSVHD

SEQ ID NO: 74906 - protein, 15 aa, Borrelia burgdorferi B31
GSFYDKGYNQSVHDG

SEQ ID NO: 74907 - protein, 15 aa, Borrelia burgdorferi B31
SFYDKGYNQSVHDGV

SEQ ID NO: 74908 - protein, 15 aa, Borrelia burgdorferi B31
FYDKGYNQSVHDGVV

SEQ ID NO: 74909 - protein, 15 aa, Borrelia burgdorferi B31
YDKGYNQSVHDGVVK

SEQ ID NO: 74910 - protein, 15 aa, Borrelia burgdorferi B31
DKGYNQSVHDGVVKL

SEQ ID NO: 74911 - protein, 15 aa, Borrelia burgdorferi B31
KGYNQSVHDGVVKLR

SEQ ID NO: 74912 - protein, 15 aa, Borrelia burgdorferi B31
GYNQSVHDGVVKLRD

SEQ ID NO: 74913 - protein, 15 aa, Borrelia burgdorferi B31
YNQSVHDGVVKLRDN

SEQ ID NO: 74914 - protein, 15 aa, Borrelia burgdorferi B31
NQSVHDGVVKLRDNF

SEQ ID NO: 74915 - protein, 15 aa, Borrelia burgdorferi B31
QSVHDGVVKLRDNFG

SEQ ID NO: 74916 - protein, 15 aa, Borrelia burgdorferi B31
SVHDGVVKLRDNFGI

SEQ ID NO: 74917 - protein, 15 aa, Borrelia burgdorferi B31
VHDGVVKLRDNFGIK

SEQ ID NO: 74918 - protein, 15 aa, Borrelia burgdorferi B31
HDGVVKLRDNFGIKL

SEQ ID NO: 74919 - protein, 15 aa, Borrelia burgdorferi B31
DGVVKLRDNFGIKLI

SEQ ID NO: 74920 - protein, 15 aa, Borrelia burgdorferi B31
GVVKLRDNFGIKLIT

SEQ ID NO: 74921 - protein, 15 aa, Borrelia burgdorferi B31
VVKLRDNFGIKLITK

SEQ ID NO: 74922 - protein, 15 aa, Borrelia burgdorferi B31
VKLRDNFGIKLITKS

SEQ ID NO: 74923 - protein, 15 aa, Borrelia burgdorferi B31
KLRDNFGIKLITKSL

SEQ ID NO: 74924 - protein, 15 aa, Borrelia burgdorferi B31
LRDNFGIKLITKSLR

SEQ ID NO: 74925 - protein, 15 aa, Borrelia burgdorferi B31
RDNFGIKLITKSLRP

SEQ ID NO: 74926 - protein, 15 aa, Borrelia burgdorferi B31
DNFGIKLITKSLRPY

SEQ ID NO: 74927 - protein, 15 aa, Borrelia burgdorferi B31
NFGIKLITKSLRPYP

SEQ ID NO: 74928 - protein, 15 aa, Borrelia burgdorferi B31
FGIKLITKSLRPYPI

SEQ ID NO: 74929 - protein, 15 aa, Borrelia burgdorferi B31
GIKLITKSLRPYPIE

SEQ ID NO: 74930 - protein, 15 aa, Borrelia burgdorferi B31
IKLITKSLRPYPIEG

SEQ ID NO: 74931 - protein, 15 aa, Borrelia burgdorferi B31
KLITKSLRPYPIEGK

SEQ ID NO: 74932 - protein, 15 aa, Borrelia burgdorferi B31
LITKSLRPYPIEGKR

SEQ ID NO: 74933 - protein, 15 aa, Borrelia burgdorferi B31
ITKSLRPYPIEGKRL

SEQ ID NO: 74934 - protein, 15 aa, Borrelia burgdorferi B31
TKSLRPYPIEGKRLL

SEQ ID NO: 74935 - protein, 15 aa, Borrelia burgdorferi B31
KSLRPYPIEGKRLLT

SEQ ID NO: 74936 - protein, 15 aa, Borrelia burgdorferi B31
SLRPYPIEGKRLLTV

SEQ ID NO: 74937 - protein, 15 aa, Borrelia burgdorferi B31
LRPYPIEGKRLLTVD

SEQ ID NO: 74938 - protein, 15 aa, Borrelia burgdorferi B31
RPYPIEGKRLLTVDE

SEQ ID NO: 74939 - protein, 15 aa, Borrelia burgdorferi B31
PYPIEGKRLLTVDEA

SEQ ID NO: 74940 - protein, 15 aa, Borrelia burgdorferi B31
YPIEGKRLLTVDEAM

SEQ ID NO: 74941 - protein, 15 aa, Borrelia burgdorferi B31
PIEGKRLLTVDEAMT

SEQ ID NO: 74942 - protein, 15 aa, Borrelia burgdorferi B31
IEGKRLLTVDEAMTE

SEQ ID NO: 74943 - protein, 15 aa, Borrelia burgdorferi B31
EGKRLLTVDEAMTED

SEQ ID NO: 74944 - protein, 15 aa, Borrelia burgdorferi B31
GKRLLTVDEAMTEDA

SEQ ID NO: 74945 - protein, 15 aa, Borrelia burgdorferi B31
KRLLTVDEAMTEDAY

SEQ ID NO: 74946 - protein, 15 aa, Borrelia burgdorferi B31
RLLTVDEAMTEDAYE

SEQ ID NO: 74947 - protein, 15 aa, Borrelia burgdorferi B31
LLTVDEAMTEDAYEV

SEQ ID NO: 74948 - protein, 15 aa, Borrelia burgdorferi B31
LTVDEAMTEDAYEVQ

SEQ ID NO: 74949 - protein, 15 aa, Borrelia burgdorferi B31
TVDEAMTEDAYEVQK

SEQ ID NO: 74950 - protein, 15 aa, Borrelia burgdorferi B31
VDEAMTEDAYEVQKN

SEQ ID NO: 74951 - protein, 15 aa, Borrelia burgdorferi B31
DEAMTEDAYEVQKNP

SEQ ID NO: 74952 - protein, 15 aa, Borrelia burgdorferi B31
EAMTEDAYEVQKNPL

SEQ ID NO: 74953 - protein, 15 aa, Borrelia burgdorferi B31
AMTEDAYEVQKNPLN

SEQ ID NO: 74954 - protein, 15 aa, Borrelia burgdorferi B31
MTEDAYEVQKNPLNL

SEQ ID NO: 74955 - protein, 15 aa, Borrelia burgdorferi B31
TEDAYEVQKNPLNLF

SEQ ID NO: 74956 - protein, 15 aa, Borrelia burgdorferi B31
EDAYEVQKNPLNLFW

SEQ ID NO: 74957 - protein, 15 aa, Borrelia burgdorferi B31
DAYEVQKNPLNLFWL

SEQ ID NO: 74958 - protein, 15 aa, Borrelia burgdorferi B31
AYEVQKNPLNLFWLI

SEQ ID NO: 74959 - protein, 15 aa, Borrelia burgdorferi B31
YEVQKNPLNLFWLIG

SEQ ID NO: 74960 - protein, 15 aa, Borrelia burgdorferi B31
EVQKNPLNLFWLIGY

SEQ ID NO: 74961 - protein, 15 aa, Borrelia burgdorferi B31
VQKNPLNLFWLIGYR

SEQ ID NO: 74962 - protein, 15 aa, Borrelia burgdorferi B31
QKNPLNLFWLIGYRF

SEQ ID NO: 74963 - protein, 15 aa, Borrelia burgdorferi B31
KNPLNLFWLIGYRFS

SEQ ID NO: 74964 - protein, 15 aa, Borrelia burgdorferi B31
NPLNLFWLIGYRFSD

SEQ ID NO: 74965 - protein, 15 aa, Borrelia burgdorferi B31
PLNLFWLIGYRFSDL

SEQ ID NO: 74966 - protein, 15 aa, Borrelia burgdorferi B31
LNLFWLIGYRFSDLS

SEQ ID NO: 74967 - protein, 15 aa, Borrelia burgdorferi B31
NLFWLIGYRFSDLSV

SEQ ID NO: 74968 - protein, 15 aa, Borrelia burgdorferi B31
LFWLIGYRFSDLSVK

SEQ ID NO: 74969 - protein, 15 aa, Borrelia burgdorferi B31
FWLIGYRFSDLSVKL

SEQ ID NO: 74970 - protein, 15 aa, Borrelia burgdorferi B31
WLIGYRFSDLSVKLS

SEQ ID NO: 74971 - protein, 15 aa, Borrelia burgdorferi B31
LIGYRFSDLSVKLSY

SEQ ID NO: 74972 - protein, 15 aa, Borrelia burgdorferi B31
IGYRFSDLSVKLSYE

SEQ ID NO: 74973 - protein, 15 aa, Borrelia burgdorferi B31
GYRFSDLSVKLSYER

SEQ ID NO: 74974 - protein, 15 aa, Borrelia burgdorferi B31
YRFSDLSVKLSYERP

SEQ ID NO: 74975 - protein, 15 aa, Borrelia burgdorferi B31
RFSDLSVKLSYERPD

SEQ ID NO: 74976 - protein, 15 aa, Borrelia burgdorferi B31
FSDLSVKLSYERPDI

SEQ ID NO: 74977 - protein, 15 aa, Borrelia burgdorferi B31
SDLSVKLSYERPDIY

SEQ ID NO: 74978 - protein, 15 aa, Borrelia burgdorferi B31
DLSVKLSYERPDIYY

SEQ ID NO: 74979 - protein, 15 aa, Borrelia burgdorferi B31
LSVKLSYERPDIYYG

SEQ ID NO: 74980 - protein, 15 aa, Borrelia burgdorferi B31
SVKLSYERPDIYYGI

SEQ ID NO: 74981 - protein, 15 aa, Borrelia burgdorferi B31
VKLSYERPDIYYGII

SEQ ID NO: 74982 - protein, 15 aa, Borrelia burgdorferi B31
KLSYERPDIYYGIID

SEQ ID NO: 74983 - protein, 15 aa, Borrelia burgdorferi B31
LSYERPDIYYGIIDA

SEQ ID NO: 74984 - protein, 15 aa, Borrelia burgdorferi B31
SYERPDIYYGIIDAF

SEQ ID NO: 74985 - protein, 15 aa, Borrelia burgdorferi B31
YERPDIYYGIIDAFD

SEQ ID NO: 74986 - protein, 15 aa, Borrelia burgdorferi B31
ERPDIYYGIIDAFDY

SEQ ID NO: 74987 - protein, 15 aa, Borrelia burgdorferi B31
RPDIYYGIIDAFDYG

SEQ ID NO: 74988 - protein, 15 aa, Borrelia burgdorferi B31
PDIYYGIIDAFDYGD

SEQ ID NO: 74989 - protein, 15 aa, Borrelia burgdorferi B31
DIYYGIIDAFDYGDI

SEQ ID NO: 74990 - protein, 15 aa, Borrelia burgdorferi B31
IYYGIIDAFDYGDIQ

SEQ ID NO: 74991 - protein, 15 aa, Borrelia burgdorferi B31
YYGIIDAFDYGDIQV

SEQ ID NO: 74992 - protein, 15 aa, Borrelia burgdorferi B31
YGIIDAFDYGDIQVP

SEQ ID NO: 74993 - protein, 15 aa, Borrelia burgdorferi B31
GIIDAFDYGDIQVPK

SEQ ID NO: 74994 - protein, 15 aa, Borrelia burgdorferi B31
IIDAFDYGDIQVPKN

SEQ ID NO: 74995 - protein, 15 aa, Borrelia burgdorferi B31
IDAFDYGDIQVPKNS

SEQ ID NO: 74996 - protein, 15 aa, Borrelia burgdorferi B31
DAFDYGDIQVPKNSL

SEQ ID NO: 74997 - protein, 15 aa, Borrelia burgdorferi B31
AFDYGDIQVPKNSLA

SEQ ID NO: 74998 - protein, 15 aa, Borrelia burgdorferi B31
FDYGDIQVPKNSLAI

SEQ ID NO: 74999 - protein, 15 aa, Borrelia burgdorferi B31
DYGDIQVPKNSLAIK

SEQ ID NO: 75000 - protein, 15 aa, Borrelia burgdorferi B31
YGDIQVPKNSLAIKF

SEQ ID NO: 75001 - protein, 15 aa, Borrelia burgdorferi B31
GDIQVPKNSLAIKFR

SEQ ID NO: 75002 - protein, 15 aa, Borrelia burgdorferi B31
DIQVPKNSLAIKFRN

SEQ ID NO: 75003 - protein, 15 aa, Borrelia burgdorferi B31
IQVPKNSLAIKFRNE

SEQ ID NO: 75004 - protein, 15 aa, Borrelia burgdorferi B31
QVPKNSLAIKFRNEE

SEQ ID NO: 75005 - protein, 15 aa, Borrelia burgdorferi B31
VPKNSLAIKFRNEEA

SEQ ID NO: 75006 - protein, 15 aa, Borrelia burgdorferi B31
PKNSLAIKFRNEEAA

SEQ ID NO: 75007 - protein, 15 aa, Borrelia burgdorferi B31
KNSLAIKFRNEEAAF

SEQ ID NO: 75008 - protein, 15 aa, Borrelia burgdorferi B31
NSLAIKFRNEEAAFL

SEQ ID NO: 75009 - protein, 15 aa, Borrelia burgdorferi B31
SLAIKFRNEEAAFLA

SEQ ID NO: 75010 - protein, 15 aa, Borrelia burgdorferi B31
LAIKFRNEEAAFLAG

SEQ ID NO: 75011 - protein, 15 aa, Borrelia burgdorferi B31
AIKFRNEEAAFLAGY

SEQ ID NO: 75012 - protein, 15 aa, Borrelia burgdorferi B31
IKFRNEEAAFLAGYI

SEQ ID NO: 75013 - protein, 15 aa, Borrelia burgdorferi B31
KFRNEEAAFLAGYIA

SEQ ID NO: 75014 - protein, 15 aa, Borrelia burgdorferi B31
FRNEEAAFLAGYIAA

SEQ ID NO: 75015 - protein, 15 aa, Borrelia burgdorferi B31
RNEEAAFLAGYIAAK

SEQ ID NO: 75016 - protein, 15 aa, Borrelia burgdorferi B31
NEEAAFLAGYIAAKM

SEQ ID NO: 75017 - protein, 15 aa, Borrelia burgdorferi B31
EEAAFLAGYIAAKMS

SEQ ID NO: 75018 - protein, 15 aa, Borrelia burgdorferi B31
EAAFLAGYIAAKMSR

SEQ ID NO: 75019 - protein, 15 aa, Borrelia burgdorferi B31
AAFLAGYIAAKMSRK

SEQ ID NO: 75020 - protein, 15 aa, Borrelia burgdorferi B31
AFLAGYIAAKMSRKE

SEQ ID NO: 75021 - protein, 15 aa, Borrelia burgdorferi B31
FLAGYIAAKMSRKEK

SEQ ID NO: 75022 - protein, 15 aa, Borrelia burgdorferi B31
LAGYIAAKMSRKEKI

SEQ ID NO: 75023 - protein, 15 aa, Borrelia burgdorferi B31
AGYIAAKMSRKEKIG

SEQ ID NO: 75024 - protein, 15 aa, Borrelia burgdorferi B31
GYIAAKMSRKEKIGF

SEQ ID NO: 75025 - protein, 15 aa, Borrelia burgdorferi B31
YIAAKMSRKEKIGFL

SEQ ID NO: 75026 - protein, 15 aa, Borrelia burgdorferi B31
IAAKMSRKEKIGFLT

SEQ ID NO: 75027 - protein, 15 aa, Borrelia burgdorferi B31
AAKMSRKEKIGFLTG

SEQ ID NO: 75028 - protein, 15 aa, Borrelia burgdorferi B31
AKMSRKEKIGFLTGP

SEQ ID NO: 75029 - protein, 15 aa, Borrelia burgdorferi B31
KMSRKEKIGFLTGPM

SEQ ID NO: 75030 - protein, 15 aa, Borrelia burgdorferi B31
MSRKEKIGFLTGPMS

SEQ ID NO: 75031 - protein, 15 aa, Borrelia burgdorferi B31
SRKEKIGFLTGPMSE

SEQ ID NO: 75032 - protein, 15 aa, Borrelia burgdorferi B31
RKEKIGFLTGPMSEH

SEQ ID NO: 75033 - protein, 15 aa, Borrelia burgdorferi B31
KEKIGFLTGPMSEHV

SEQ ID NO: 75034 - protein, 15 aa, Borrelia burgdorferi B31
EKIGFLTGPMSEHVK

SEQ ID NO: 75035 - protein, 15 aa, Borrelia burgdorferi B31
KIGFLTGPMSEHVKD

SEQ ID NO: 75036 - protein, 15 aa, Borrelia burgdorferi B31
IGFLTGPMSEHVKDF

SEQ ID NO: 75037 - protein, 15 aa, Borrelia burgdorferi B31
GFLTGPMSEHVKDFK

SEQ ID NO: 75038 - protein, 15 aa, Borrelia burgdorferi B31
FLTGPMSEHVKDFKF

SEQ ID NO: 75039 - protein, 15 aa, Borrelia burgdorferi B31
LTGPMSEHVKDFKFG

SEQ ID NO: 75040 - protein, 15 aa, Borrelia burgdorferi B31
TGPMSEHVKDFKFGF

SEQ ID NO: 75041 - protein, 15 aa, Borrelia burgdorferi B31
GPMSEHVKDFKFGFK

SEQ ID NO: 75042 - protein, 15 aa, Borrelia burgdorferi B31
PMSEHVKDFKFGFKA

SEQ ID NO: 75043 - protein, 15 aa, Borrelia burgdorferi B31
MSEHVKDFKFGFKAG

SEQ ID NO: 75044 - protein, 15 aa, Borrelia burgdorferi B31
SEHVKDFKFGFKAGI

SEQ ID NO: 75045 - protein, 15 aa, Borrelia burgdorferi B31
EHVKDFKFGFKAGIF

SEQ ID NO: 75046 - protein, 15 aa, Borrelia burgdorferi B31
HVKDFKFGFKAGIFY

SEQ ID NO: 75047 - protein, 15 aa, Borrelia burgdorferi B31
VKDFKFGFKAGIFYA

SEQ ID NO: 75048 - protein, 15 aa, Borrelia burgdorferi B31
KDFKFGFKAGIFYAN

SEQ ID NO: 75049 - protein, 15 aa, Borrelia burgdorferi B31
DFKFGFKAGIFYANP

SEQ ID NO: 75050 - protein, 15 aa, Borrelia burgdorferi B31
FKFGFKAGIFYANPK

SEQ ID NO: 75051 - protein, 15 aa, Borrelia burgdorferi B31
KFGFKAGIFYANPKL

SEQ ID NO: 75052 - protein, 15 aa, Borrelia burgdorferi B31
FGFKAGIFYANPKLR

SEQ ID NO: 75053 - protein, 15 aa, Borrelia burgdorferi B31
GFKAGIFYANPKLRL

SEQ ID NO: 75054 - protein, 15 aa, Borrelia burgdorferi B31
FKAGIFYANPKLRLV

SEQ ID NO: 75055 - protein, 15 aa, Borrelia burgdorferi B31
KAGIFYANPKLRLVS

SEQ ID NO: 75056 - protein, 15 aa, Borrelia burgdorferi B31
AGIFYANPKLRLVSK

SEQ ID NO: 75057 - protein, 15 aa, Borrelia burgdorferi B31
GIFYANPKLRLVSKK

SEQ ID NO: 75058 - protein, 15 aa, Borrelia burgdorferi B31
IFYANPKLRLVSKKA

SEQ ID NO: 75059 - protein, 15 aa, Borrelia burgdorferi B31
FYANPKLRLVSKKAP

SEQ ID NO: 75060 - protein, 15 aa, Borrelia burgdorferi B31
YANPKLRLVSKKAPS

SEQ ID NO: 75061 - protein, 15 aa, Borrelia burgdorferi B31
ANPKLRLVSKKAPSL

SEQ ID NO: 75062 - protein, 15 aa, Borrelia burgdorferi B31
NPKLRLVSKKAPSLF

SEQ ID NO: 75063 - protein, 15 aa, Borrelia burgdorferi B31
PKLRLVSKKAPSLFD

SEQ ID NO: 75064 - protein, 15 aa, Borrelia burgdorferi B31
KLRLVSKKAPSLFDK

SEQ ID NO: 75065 - protein, 15 aa, Borrelia burgdorferi B31
LRLVSKKAPSLFDKE

SEQ ID NO: 75066 - protein, 15 aa, Borrelia burgdorferi B31
RLVSKKAPSLFDKEK

SEQ ID NO: 75067 - protein, 15 aa, Borrelia burgdorferi B31
LVSKKAPSLFDKEKG

SEQ ID NO: 75068 - protein, 15 aa, Borrelia burgdorferi B31
VSKKAPSLFDKEKGK

SEQ ID NO: 75069 - protein, 15 aa, Borrelia burgdorferi B31
SKKAPSLFDKEKGKA

SEQ ID NO: 75070 - protein, 15 aa, Borrelia burgdorferi B31
KKAPSLFDKEKGKAM

SEQ ID NO: 75071 - protein, 15 aa, Borrelia burgdorferi B31
KAPSLFDKEKGKAMA

SEQ ID NO: 75072 - protein, 15 aa, Borrelia burgdorferi B31
APSLFDKEKGKAMAL

SEQ ID NO: 75073 - protein, 15 aa, Borrelia burgdorferi B31
PSLFDKEKGKAMALF

SEQ ID NO: 75074 - protein, 15 aa, Borrelia burgdorferi B31
SLFDKEKGKAMALFM

SEQ ID NO: 75075 - protein, 15 aa, Borrelia burgdorferi B31
LFDKEKGKAMALFMY

SEQ ID NO: 75076 - protein, 15 aa, Borrelia burgdorferi B31
FDKEKGKAMALFMYK

SEQ ID NO: 75077 - protein, 15 aa, Borrelia burgdorferi B31
DKEKGKAMALFMYKE

SEQ ID NO: 75078 - protein, 15 aa, Borrelia burgdorferi B31
KEKGKAMALFMYKED

SEQ ID NO: 75079 - protein, 15 aa, Borrelia burgdorferi B31
EKGKAMALFMYKEDK

SEQ ID NO: 75080 - protein, 15 aa, Borrelia burgdorferi B31
KGKAMALFMYKEDKV

SEQ ID NO: 75081 - protein, 15 aa, Borrelia burgdorferi B31
GKAMALFMYKEDKVG

SEQ ID NO: 75082 - protein, 15 aa, Borrelia burgdorferi B31
KAMALFMYKEDKVGV

SEQ ID NO: 75083 - protein, 15 aa, Borrelia burgdorferi B31
AMALFMYKEDKVGVI

SEQ ID NO: 75084 - protein, 15 aa, Borrelia burgdorferi B31
MALFMYKEDKVGVIF

SEQ ID NO: 75085 - protein, 15 aa, Borrelia burgdorferi B31
ALFMYKEDKVGVIFP

SEQ ID NO: 75086 - protein, 15 aa, Borrelia burgdorferi B31
LFMYKEDKVGVIFPI

SEQ ID NO: 75087 - protein, 15 aa, Borrelia burgdorferi B31
FMYKEDKVGVIFPIA

SEQ ID NO: 75088 - protein, 15 aa, Borrelia burgdorferi B31
MYKEDKVGVIFPIAG

SEQ ID NO: 75089 - protein, 15 aa, Borrelia burgdorferi B31
YKEDKVGVIFPIAGI

SEQ ID NO: 75090 - protein, 15 aa, Borrelia burgdorferi B31
KEDKVGVIFPIAGIT

SEQ ID NO: 75091 - protein, 15 aa, Borrelia burgdorferi B31
EDKVGVIFPIAGITG

SEQ ID NO: 75092 - protein, 15 aa, Borrelia burgdorferi B31
DKVGVIFPIAGITGL

SEQ ID NO: 75093 - protein, 15 aa, Borrelia burgdorferi B31
KVGVIFPIAGITGLG

SEQ ID NO: 75094 - protein, 15 aa, Borrelia burgdorferi B31
VGVIFPIAGITGLGV

SEQ ID NO: 75095 - protein, 15 aa, Borrelia burgdorferi B31
GVIFPIAGITGLGVY

SEQ ID NO: 75096 - protein, 15 aa, Borrelia burgdorferi B31
VIFPIAGITGLGVYD

SEQ ID NO: 75097 - protein, 15 aa, Borrelia burgdorferi B31
IFPIAGITGLGVYDA

SEQ ID NO: 75098 - protein, 15 aa, Borrelia burgdorferi B31
FPIAGITGLGVYDAA

SEQ ID NO: 75099 - protein, 15 aa, Borrelia burgdorferi B31
PIAGITGLGVYDAAK

SEQ ID NO: 75100 - protein, 15 aa, Borrelia burgdorferi B31
IAGITGLGVYDAAKE

SEQ ID NO: 75101 - protein, 15 aa, Borrelia burgdorferi B31
AGITGLGVYDAAKEL

SEQ ID NO: 75102 - protein, 15 aa, Borrelia burgdorferi B31
GITGLGVYDAAKELG

SEQ ID NO: 75103 - protein, 15 aa, Borrelia burgdorferi B31
ITGLGVYDAAKELGP

SEQ ID NO: 75104 - protein, 15 aa, Borrelia burgdorferi B31
TGLGVYDAAKELGPK

SEQ ID NO: 75105 - protein, 15 aa, Borrelia burgdorferi B31
GLGVYDAAKELGPKY

SEQ ID NO: 75106 - protein, 15 aa, Borrelia burgdorferi B31
LGVYDAAKELGPKYY

SEQ ID NO: 75107 - protein, 15 aa, Borrelia burgdorferi B31
GVYDAAKELGPKYYV

SEQ ID NO: 75108 - protein, 15 aa, Borrelia burgdorferi B31
VYDAAKELGPKYYVI

SEQ ID NO: 75109 - protein, 15 aa, Borrelia burgdorferi B31
YDAAKELGPKYYVIG

SEQ ID NO: 75110 - protein, 15 aa, Borrelia burgdorferi B31
DAAKELGPKYYVIGL

SEQ ID NO: 75111 - protein, 15 aa, Borrelia burgdorferi B31
AAKELGPKYYVIGLN

SEQ ID NO: 75112 - protein, 15 aa, Borrelia burgdorferi B31
AKELGPKYYVIGLNQ

SEQ ID NO: 75113 - protein, 15 aa, Borrelia burgdorferi B31
KELGPKYYVIGLNQD

SEQ ID NO: 75114 - protein, 15 aa, Borrelia burgdorferi B31
ELGPKYYVIGLNQDQ

SEQ ID NO: 75115 - protein, 15 aa, Borrelia burgdorferi B31
LGPKYYVIGLNQDQS

SEQ ID NO: 75116 - protein, 15 aa, Borrelia burgdorferi B31
GPKYYVIGLNQDQSY

SEQ ID NO: 75117 - protein, 15 aa, Borrelia burgdorferi B31
PKYYVIGLNQDQSYI

SEQ ID NO: 75118 - protein, 15 aa, Borrelia burgdorferi B31
KYYVIGLNQDQSYIA

SEQ ID NO: 75119 - protein, 15 aa, Borrelia burgdorferi B31
YYVIGLNQDQSYIAP

SEQ ID NO: 75120 - protein, 15 aa, Borrelia burgdorferi B31
YVIGLNQDQSYIAPQ

SEQ ID NO: 75121 - protein, 15 aa, Borrelia burgdorferi B31
VIGLNQDQSYIAPQN

SEQ ID NO: 75122 - protein, 15 aa, Borrelia burgdorferi B31
IGLNQDQSYIAPQNV

SEQ ID NO: 75123 - protein, 15 aa, Borrelia burgdorferi B31
GLNQDQSYIAPQNVI

SEQ ID NO: 75124 - protein, 15 aa, Borrelia burgdorferi B31
LNQDQSYIAPQNVIT

SEQ ID NO: 75125 - protein, 15 aa, Borrelia burgdorferi B31
NQDQSYIAPQNVITS

SEQ ID NO: 75126 - protein, 15 aa, Borrelia burgdorferi B31
QDQSYIAPQNVITSI

SEQ ID NO: 75127 - protein, 15 aa, Borrelia burgdorferi B31
DQSYIAPQNVITSII

SEQ ID NO: 75128 - protein, 15 aa, Borrelia burgdorferi B31
QSYIAPQNVITSIIK

SEQ ID NO: 75129 - protein, 15 aa, Borrelia burgdorferi B31
SYIAPQNVITSIIKD

SEQ ID NO: 75130 - protein, 15 aa, Borrelia burgdorferi B31
YIAPQNVITSIIKDI

SEQ ID NO: 75131 - protein, 15 aa, Borrelia burgdorferi B31
IAPQNVITSIIKDIG

SEQ ID NO: 75132 - protein, 15 aa, Borrelia burgdorferi B31
APQNVITSIIKDIGK

SEQ ID NO: 75133 - protein, 15 aa, Borrelia burgdorferi B31
PQNVITSIIKDIGKV

SEQ ID NO: 75134 - protein, 15 aa, Borrelia burgdorferi B31
QNVITSIIKDIGKVI

SEQ ID NO: 75135 - protein, 15 aa, Borrelia burgdorferi B31
NVITSIIKDIGKVIY

SEQ ID NO: 75136 - protein, 15 aa, Borrelia burgdorferi B31
VITSIIKDIGKVIYS

SEQ ID NO: 75137 - protein, 15 aa, Borrelia burgdorferi B31
ITSIIKDIGKVIYSI

SEQ ID NO: 75138 - protein, 15 aa, Borrelia burgdorferi B31
TSIIKDIGKVIYSIS

SEQ ID NO: 75139 - protein, 15 aa, Borrelia burgdorferi B31
SIIKDIGKVIYSISS

SEQ ID NO: 75140 - protein, 15 aa, Borrelia burgdorferi B31
IIKDIGKVIYSISSE

SEQ ID NO: 75141 - protein, 15 aa, Borrelia burgdorferi B31
IKDIGKVIYSISSEY

SEQ ID NO: 75142 - protein, 15 aa, Borrelia burgdorferi B31
KDIGKVIYSISSEYI

SEQ ID NO: 75143 - protein, 15 aa, Borrelia burgdorferi B31
DIGKVIYSISSEYIN

SEQ ID NO: 75144 - protein, 15 aa, Borrelia burgdorferi B31
IGKVIYSISSEYINN

SEQ ID NO: 75145 - protein, 15 aa, Borrelia burgdorferi B31
GKVIYSISSEYINNR

SEQ ID NO: 75146 - protein, 15 aa, Borrelia burgdorferi B31
KVIYSISSEYINNRV

SEQ ID NO: 75147 - protein, 15 aa, Borrelia burgdorferi B31
VIYSISSEYINNRVF

SEQ ID NO: 75148 - protein, 15 aa, Borrelia burgdorferi B31
IYSISSEYINNRVFK

SEQ ID NO: 75149 - protein, 15 aa, Borrelia burgdorferi B31
YSISSEYINNRVFKG

SEQ ID NO: 75150 - protein, 15 aa, Borrelia burgdorferi B31
SISSEYINNRVFKGG

SEQ ID NO: 75151 - protein, 15 aa, Borrelia burgdorferi B31
ISSEYINNRVFKGGI

SEQ ID NO: 75152 - protein, 15 aa, Borrelia burgdorferi B31
SSEYINNRVFKGGII

SEQ ID NO: 75153 - protein, 15 aa, Borrelia burgdorferi B31
SEYINNRVFKGGIII

SEQ ID NO: 75154 - protein, 15 aa, Borrelia burgdorferi B31
EYINNRVFKGGIIID

SEQ ID NO: 75155 - protein, 15 aa, Borrelia burgdorferi B31
YINNRVFKGGIIIDR

SEQ ID NO: 75156 - protein, 15 aa, Borrelia burgdorferi B31
INNRVFKGGIIIDRG

SEQ ID NO: 75157 - protein, 15 aa, Borrelia burgdorferi B31
NNRVFKGGIIIDRGL

SEQ ID NO: 75158 - protein, 15 aa, Borrelia burgdorferi B31
NRVFKGGIIIDRGLK

SEQ ID NO: 75159 - protein, 15 aa, Borrelia burgdorferi B31
RVFKGGIIIDRGLKE

SEQ ID NO: 75160 - protein, 15 aa, Borrelia burgdorferi B31
VFKGGIIIDRGLKEG

SEQ ID NO: 75161 - protein, 15 aa, Borrelia burgdorferi B31
FKGGIIIDRGLKEGV

SEQ ID NO: 75162 - protein, 15 aa, Borrelia burgdorferi B31
KGGIIIDRGLKEGVI

SEQ ID NO: 75163 - protein, 15 aa, Borrelia burgdorferi B31
GGIIIDRGLKEGVIE

SEQ ID NO: 75164 - protein, 15 aa, Borrelia burgdorferi B31
GIIIDRGLKEGVIEI

SEQ ID NO: 75165 - protein, 15 aa, Borrelia burgdorferi B31
IIIDRGLKEGVIEIV

SEQ ID NO: 75166 - protein, 15 aa, Borrelia burgdorferi B31
IIDRGLKEGVIEIVK

SEQ ID NO: 75167 - protein, 15 aa, Borrelia burgdorferi B31
IDRGLKEGVIEIVKD

SEQ ID NO: 75168 - protein, 15 aa, Borrelia burgdorferi B31
DRGLKEGVIEIVKDP

SEQ ID NO: 75169 - protein, 15 aa, Borrelia burgdorferi B31
RGLKEGVIEIVKDPD

SEQ ID NO: 75170 - protein, 15 aa, Borrelia burgdorferi B31
GLKEGVIEIVKDPDV

SEQ ID NO: 75171 - protein, 15 aa, Borrelia burgdorferi B31
LKEGVIEIVKDPDVL

SEQ ID NO: 75172 - protein, 15 aa, Borrelia burgdorferi B31
KEGVIEIVKDPDVLN

SEQ ID NO: 75173 - protein, 15 aa, Borrelia burgdorferi B31
EGVIEIVKDPDVLNN

SEQ ID NO: 75174 - protein, 15 aa, Borrelia burgdorferi B31
GVIEIVKDPDVLNNR

SEQ ID NO: 75175 - protein, 15 aa, Borrelia burgdorferi B31
VIEIVKDPDVLNNRL

SEQ ID NO: 75176 - protein, 15 aa, Borrelia burgdorferi B31
IEIVKDPDVLNNRLV

SEQ ID NO: 75177 - protein, 15 aa, Borrelia burgdorferi B31
EIVKDPDVLNNRLVD

SEQ ID NO: 75178 - protein, 15 aa, Borrelia burgdorferi B31
IVKDPDVLNNRLVDE

SEQ ID NO: 75179 - protein, 15 aa, Borrelia burgdorferi B31
VKDPDVLNNRLVDEV

SEQ ID NO: 75180 - protein, 15 aa, Borrelia burgdorferi B31
KDPDVLNNRLVDEVI

SEQ ID NO: 75181 - protein, 15 aa, Borrelia burgdorferi B31
DPDVLNNRLVDEVID

SEQ ID NO: 75182 - protein, 15 aa, Borrelia burgdorferi B31
PDVLNNRLVDEVIDL

SEQ ID NO: 75183 - protein, 15 aa, Borrelia burgdorferi B31
DVLNNRLVDEVIDLE

SEQ ID NO: 75184 - protein, 15 aa, Borrelia burgdorferi B31
VLNNRLVDEVIDLEN

SEQ ID NO: 75185 - protein, 15 aa, Borrelia burgdorferi B31
LNNRLVDEVIDLENK

SEQ ID NO: 75186 - protein, 15 aa, Borrelia burgdorferi B31
NNRLVDEVIDLENKI

SEQ ID NO: 75187 - protein, 15 aa, Borrelia burgdorferi B31
NRLVDEVIDLENKII

SEQ ID NO: 75188 - protein, 15 aa, Borrelia burgdorferi B31
RLVDEVIDLENKIIS

SEQ ID NO: 75189 - protein, 15 aa, Borrelia burgdorferi B31
LVDEVIDLENKIISG

SEQ ID NO: 75190 - protein, 15 aa, Borrelia burgdorferi B31
VDEVIDLENKIISGE

SEQ ID NO: 75191 - protein, 15 aa, Borrelia burgdorferi B31
DEVIDLENKIISGEI

SEQ ID NO: 75192 - protein, 15 aa, Borrelia burgdorferi B31
EVIDLENKIISGEII

SEQ ID NO: 75193 - protein, 15 aa, Borrelia burgdorferi B31
VIDLENKIISGEIIV

SEQ ID NO: 75194 - protein, 15 aa, Borrelia burgdorferi B31
IDLENKIISGEIIVP

SEQ ID NO: 75195 - protein, 15 aa, Borrelia burgdorferi B31
DLENKIISGEIIVPD

SEQ ID NO: 75196 - protein, 15 aa, Borrelia burgdorferi B31
LENKIISGEIIVPDS

SEQ ID NO: 75197 - protein, 15 aa, Borrelia burgdorferi B31
ENKIISGEIIVPDSE

SEQ ID NO: 75198 - protein, 15 aa, Borrelia burgdorferi B31
NKIISGEIIVPDSEY

SEQ ID NO: 75199 - protein, 15 aa, Borrelia burgdorferi B31
KIISGEIIVPDSEYA

SEQ ID NO: 75200 - protein, 15 aa, Borrelia burgdorferi B31
IISGEIIVPDSEYAF

SEQ ID NO: 75201 - protein, 15 aa, Borrelia burgdorferi B31
ISGEIIVPDSEYAFD

SEQ ID NO: 75202 - protein, 15 aa, Borrelia burgdorferi B31
SGEIIVPDSEYAFDL

SEQ ID NO: 75203 - protein, 15 aa, Borrelia burgdorferi B31
GEIIVPDSEYAFDLF

SEQ ID NO: 75204 - protein, 15 aa, Borrelia burgdorferi B31
EIIVPDSEYAFDLFK

SEQ ID NO: 75205 - protein, 15 aa, Borrelia burgdorferi B31
IIVPDSEYAFDLFKS

SEQ ID NO: 75206 - protein, 15 aa, Borrelia burgdorferi B31
IVPDSEYAFDLFKSK

SEQ ID NO: 75207 - protein, 15 aa, Borrelia burgdorferi B31
VPDSEYAFDLFKSKL

SEQ ID NO: 75208 - protein, 16 aa, Borrelia burgdorferi B31
MFKRFIFITLSLLVFA

SEQ ID NO: 75209 - protein, 16 aa, Borrelia burgdorferi B31
FKRFIFITLSLLVFAC

SEQ ID NO: 75210 - protein, 16 aa, Borrelia burgdorferi B31
KRFIFITLSLLVFACF

SEQ ID NO: 75211 - protein, 16 aa, Borrelia burgdorferi B31
RFIFITLSLLVFACFK

SEQ ID NO: 75212 - protein, 16 aa, Borrelia burgdorferi B31
FIFITLSLLVFACFKS

SEQ ID NO: 75213 - protein, 16 aa, Borrelia burgdorferi B31
IFITLSLLVFACFKSN

SEQ ID NO: 75214 - protein, 16 aa, Borrelia burgdorferi B31
FITLSLLVFACFKSNK

SEQ ID NO: 75215 - protein, 16 aa, Borrelia burgdorferi B31
ITLSLLVFACFKSNKK

SEQ ID NO: 75216 - protein, 16 aa, Borrelia burgdorferi B31
TLSLLVFACFKSNKKS

SEQ ID NO: 75217 - protein, 16 aa, Borrelia burgdorferi B31
LSLLVFACFKSNKKSI

SEQ ID NO: 75218 - protein, 16 aa, Borrelia burgdorferi B31
SLLVFACFKSNKKSIK

SEQ ID NO: 75219 - protein, 16 aa, Borrelia burgdorferi B31
LLVFACFKSNKKSIKS

SEQ ID NO: 75220 - protein, 16 aa, Borrelia burgdorferi B31
LVFACFKSNKKSIKSD

SEQ ID NO: 75221 - protein, 16 aa, Borrelia burgdorferi B31
VFACFKSNKKSIKSDK

SEQ ID NO: 75222 - protein, 16 aa, Borrelia burgdorferi B31
FACFKSNKKSIKSDKV

SEQ ID NO: 75223 - protein, 16 aa, Borrelia burgdorferi B31
ACFKSNKKSIKSDKVV

SEQ ID NO: 75224 - protein, 16 aa, Borrelia burgdorferi B31
CFKSNKKSIKSDKVVV

SEQ ID NO: 75225 - protein, 16 aa, Borrelia burgdorferi B31
FKSNKKSIKSDKVVVG

SEQ ID NO: 75226 - protein, 16 aa, Borrelia burgdorferi B31
KSNKKSIKSDKVVVGV

SEQ ID NO: 75227 - protein, 16 aa, Borrelia burgdorferi B31
SNKKSIKSDKVVVGVL

SEQ ID NO: 75228 - protein, 16 aa, Borrelia burgdorferi B31
NKKSIKSDKVVVGVLA

SEQ ID NO: 75229 - protein, 16 aa, Borrelia burgdorferi B31
KKSIKSDKVVVGVLAH

SEQ ID NO: 75230 - protein, 16 aa, Borrelia burgdorferi B31
KSIKSDKVVVGVLAHG

SEQ ID NO: 75231 - protein, 16 aa, Borrelia burgdorferi B31
SIKSDKVVVGVLAHGS

SEQ ID NO: 75232 - protein, 16 aa, Borrelia burgdorferi B31
IKSDKVVVGVLAHGSF

SEQ ID NO: 75233 - protein, 16 aa, Borrelia burgdorferi B31
KSDKVVVGVLAHGSFY

SEQ ID NO: 75234 - protein, 16 aa, Borrelia burgdorferi B31
SDKVVVGVLAHGSFYD

SEQ ID NO: 75235 - protein, 16 aa, Borrelia burgdorferi B31
DKVVVGVLAHGSFYDK

SEQ ID NO: 75236 - protein, 16 aa, Borrelia burgdorferi B31
KVVVGVLAHGSFYDKG

SEQ ID NO: 75237 - protein, 16 aa, Borrelia burgdorferi B31
VVVGVLAHGSFYDKGY

SEQ ID NO: 75238 - protein, 16 aa, Borrelia burgdorferi B31
VVGVLAHGSFYDKGYN

SEQ ID NO: 75239 - protein, 16 aa, Borrelia burgdorferi B31
VGVLAHGSFYDKGYNQ

SEQ ID NO: 75240 - protein, 16 aa, Borrelia burgdorferi B31
GVLAHGSFYDKGYNQS

SEQ ID NO: 75241 - protein, 16 aa, Borrelia burgdorferi B31
VLAHGSFYDKGYNQSV

SEQ ID NO: 75242 - protein, 16 aa, Borrelia burgdorferi B31
LAHGSFYDKGYNQSVH

SEQ ID NO: 75243 - protein, 16 aa, Borrelia burgdorferi B31
AHGSFYDKGYNQSVHD

SEQ ID NO: 75244 - protein, 16 aa, Borrelia burgdorferi B31
HGSFYDKGYNQSVHDG

SEQ ID NO: 75245 - protein, 16 aa, Borrelia burgdorferi B31
GSFYDKGYNQSVHDGV

SEQ ID NO: 75246 - protein, 16 aa, Borrelia burgdorferi B31
SFYDKGYNQSVHDGVV

SEQ ID NO: 75247 - protein, 16 aa, Borrelia burgdorferi B31
FYDKGYNQSVHDGVVK

SEQ ID NO: 75248 - protein, 16 aa, Borrelia burgdorferi B31
YDKGYNQSVHDGVVKL

SEQ ID NO: 75249 - protein, 16 aa, Borrelia burgdorferi B31
DKGYNQSVHDGVVKLR

SEQ ID NO: 75250 - protein, 16 aa, Borrelia burgdorferi B31
KGYNQSVHDGVVKLRD

SEQ ID NO: 75251 - protein, 16 aa, Borrelia burgdorferi B31
GYNQSVHDGVVKLRDN

SEQ ID NO: 75252 - protein, 16 aa, Borrelia burgdorferi B31
YNQSVHDGVVKLRDNF

SEQ ID NO: 75253 - protein, 16 aa, Borrelia burgdorferi B31
NQSVHDGVVKLRDNFG

SEQ ID NO: 75254 - protein, 16 aa, Borrelia burgdorferi B31
QSVHDGVVKLRDNFGI

SEQ ID NO: 75255 - protein, 16 aa, Borrelia burgdorferi B31
SVHDGVVKLRDNFGIK

SEQ ID NO: 75256 - protein, 16 aa, Borrelia burgdorferi B31
VHDGVVKLRDNFGIKL

SEQ ID NO: 75257 - protein, 16 aa, Borrelia burgdorferi B31
HDGVVKLRDNFGIKLI

SEQ ID NO: 75258 - protein, 16 aa, Borrelia burgdorferi B31
DGVVKLRDNFGIKLIT

SEQ ID NO: 75259 - protein, 16 aa, Borrelia burgdorferi B31
GVVKLRDNFGIKLITK

SEQ ID NO: 75260 - protein, 16 aa, Borrelia burgdorferi B31
VVKLRDNFGIKLITKS

SEQ ID NO: 75261 - protein, 16 aa, Borrelia burgdorferi B31
VKLRDNFGIKLITKSL

SEQ ID NO: 75262 - protein, 16 aa, Borrelia burgdorferi B31
KLRDNFGIKLITKSLR

SEQ ID NO: 75263 - protein, 16 aa, Borrelia burgdorferi B31
LRDNFGIKLITKSLRP

SEQ ID NO: 75264 - protein, 16 aa, Borrelia burgdorferi B31
RDNFGIKLITKSLRPY

SEQ ID NO: 75265 - protein, 16 aa, Borrelia burgdorferi B31
DNFGIKLITKSLRPYP

SEQ ID NO: 75266 - protein, 16 aa, Borrelia burgdorferi B31
NFGIKLITKSLRPYPI

SEQ ID NO: 75267 - protein, 16 aa, Borrelia burgdorferi B31
FGIKLITKSLRPYPIE

SEQ ID NO: 75268 - protein, 16 aa, Borrelia burgdorferi B31
GIKLITKSLRPYPIEG

SEQ ID NO: 75269 - protein, 16 aa, Borrelia burgdorferi B31
IKLITKSLRPYPIEGK

SEQ ID NO: 75270 - protein, 16 aa, Borrelia burgdorferi B31
KLITKSLRPYPIEGKR

SEQ ID NO: 75271 - protein, 16 aa, Borrelia burgdorferi B31
LITKSLRPYPIEGKRL

SEQ ID NO: 75272 - protein, 16 aa, Borrelia burgdorferi B31
ITKSLRPYPIEGKRLL

SEQ ID NO: 75273 - protein, 16 aa, Borrelia burgdorferi B31
TKSLRPYPIEGKRLLT

SEQ ID NO: 75274 - protein, 16 aa, Borrelia burgdorferi B31
KSLRPYPIEGKRLLTV

SEQ ID NO: 75275 - protein, 16 aa, Borrelia burgdorferi B31
SLRPYPIEGKRLLTVD

SEQ ID NO: 75276 - protein, 16 aa, Borrelia burgdorferi B31
LRPYPIEGKRLLTVDE

SEQ ID NO: 75277 - protein, 16 aa, Borrelia burgdorferi B31
RPYPIEGKRLLTVDEA

SEQ ID NO: 75278 - protein, 16 aa, Borrelia burgdorferi B31
PYPIEGKRLLTVDEAM

SEQ ID NO: 75279 - protein, 16 aa, Borrelia burgdorferi B31
YPIEGKRLLTVDEAMT

SEQ ID NO: 75280 - protein, 16 aa, Borrelia burgdorferi B31
PIEGKRLLTVDEAMTE

SEQ ID NO: 75281 - protein, 16 aa, Borrelia burgdorferi B31
IEGKRLLTVDEAMTED

SEQ ID NO: 75282 - protein, 16 aa, Borrelia burgdorferi B31
EGKRLLTVDEAMTEDA

SEQ ID NO: 75283 - protein, 16 aa, Borrelia burgdorferi B31
GKRLLTVDEAMTEDAY

SEQ ID NO: 75284 - protein, 16 aa, Borrelia burgdorferi B31
KRLLTVDEAMTEDAYE

SEQ ID NO: 75285 - protein, 16 aa, Borrelia burgdorferi B31
RLLTVDEAMTEDAYEV

SEQ ID NO: 75286 - protein, 16 aa, Borrelia burgdorferi B31
LLTVDEAMTEDAYEVQ

SEQ ID NO: 75287 - protein, 16 aa, Borrelia burgdorferi B31
LTVDEAMTEDAYEVQK

SEQ ID NO: 75288 - protein, 16 aa, Borrelia burgdorferi B31
TVDEAMTEDAYEVQKN

SEQ ID NO: 75289 - protein, 16 aa, Borrelia burgdorferi B31
VDEAMTEDAYEVQKNP

SEQ ID NO: 75290 - protein, 16 aa, Borrelia burgdorferi B31
DEAMTEDAYEVQKNPL

SEQ ID NO: 75291 - protein, 16 aa, Borrelia burgdorferi B31
EAMTEDAYEVQKNPLN

SEQ ID NO: 75292 - protein, 16 aa, Borrelia burgdorferi B31
AMTEDAYEVQKNPLNL

SEQ ID NO: 75293 - protein, 16 aa, Borrelia burgdorferi B31
MTEDAYEVQKNPLNLF

SEQ ID NO: 75294 - protein, 16 aa, Borrelia burgdorferi B31
TEDAYEVQKNPLNLFW

SEQ ID NO: 75295 - protein, 16 aa, Borrelia burgdorferi B31
EDAYEVQKNPLNLFWL

SEQ ID NO: 75296 - protein, 16 aa, Borrelia burgdorferi B31
DAYEVQKNPLNLFWLI

SEQ ID NO: 75297 - protein, 16 aa, Borrelia burgdorferi B31
AYEVQKNPLNLFWLIG

SEQ ID NO: 75298 - protein, 16 aa, Borrelia burgdorferi B31
YEVQKNPLNLFWLIGY

SEQ ID NO: 75299 - protein, 16 aa, Borrelia burgdorferi B31
EVQKNPLNLFWLIGYR

SEQ ID NO: 75300 - protein, 16 aa, Borrelia burgdorferi B31
VQKNPLNLFWLIGYRF

SEQ ID NO: 75301 - protein, 16 aa, Borrelia burgdorferi B31
QKNPLNLFWLIGYRFS

SEQ ID NO: 75302 - protein, 16 aa, Borrelia burgdorferi B31
KNPLNLFWLIGYRFSD

SEQ ID NO: 75303 - protein, 16 aa, Borrelia burgdorferi B31
NPLNLFWLIGYRFSDL

SEQ ID NO: 75304 - protein, 16 aa, Borrelia burgdorferi B31
PLNLFWLIGYRFSDLS

SEQ ID NO: 75305 - protein, 16 aa, Borrelia burgdorferi B31
LNLFWLIGYRFSDLSV

SEQ ID NO: 75306 - protein, 16 aa, Borrelia burgdorferi B31
NLFWLIGYRFSDLSVK

SEQ ID NO: 75307 - protein, 16 aa, Borrelia burgdorferi B31
LFWLIGYRFSDLSVKL

SEQ ID NO: 75308 - protein, 16 aa, Borrelia burgdorferi B31
FWLIGYRFSDLSVKLS

SEQ ID NO: 75309 - protein, 16 aa, Borrelia burgdorferi B31
WLIGYRFSDLSVKLSY

SEQ ID NO: 75310 - protein, 16 aa, Borrelia burgdorferi B31
LIGYRFSDLSVKLSYE

SEQ ID NO: 75311 - protein, 16 aa, Borrelia burgdorferi B31
IGYRFSDLSVKLSYER

SEQ ID NO: 75312 - protein, 16 aa, Borrelia burgdorferi B31
GYRFSDLSVKLSYERP

SEQ ID NO: 75313 - protein, 16 aa, Borrelia burgdorferi B31
YRFSDLSVKLSYERPD

SEQ ID NO: 75314 - protein, 16 aa, Borrelia burgdorferi B31
RFSDLSVKLSYERPDI

SEQ ID NO: 75315 - protein, 16 aa, Borrelia burgdorferi B31
FSDLSVKLSYERPDIY

SEQ ID NO: 75316 - protein, 16 aa, Borrelia burgdorferi B31
SDLSVKLSYERPDIYY

SEQ ID NO: 75317 - protein, 16 aa, Borrelia burgdorferi B31
DLSVKLSYERPDIYYG

SEQ ID NO: 75318 - protein, 16 aa, Borrelia burgdorferi B31
LSVKLSYERPDIYYGI

SEQ ID NO: 75319 - protein, 16 aa, Borrelia burgdorferi B31
SVKLSYERPDIYYGII

SEQ ID NO: 75320 - protein, 16 aa, Borrelia burgdorferi B31
VKLSYERPDIYYGIID

SEQ ID NO: 75321 - protein, 16 aa, Borrelia burgdorferi B31
KLSYERPDIYYGIIDA

SEQ ID NO: 75322 - protein, 16 aa, Borrelia burgdorferi B31
LSYERPDIYYGIIDAF

SEQ ID NO: 75323 - protein, 16 aa, Borrelia burgdorferi B31
SYERPDIYYGIIDAFD

SEQ ID NO: 75324 - protein, 16 aa, Borrelia burgdorferi B31
YERPDIYYGIIDAFDY

SEQ ID NO: 75325 - protein, 16 aa, Borrelia burgdorferi B31
ERPDIYYGIIDAFDYG

SEQ ID NO: 75326 - protein, 16 aa, Borrelia burgdorferi B31
RPDIYYGIIDAFDYGD

SEQ ID NO: 75327 - protein, 16 aa, Borrelia burgdorferi B31
PDIYYGIIDAFDYGDI

SEQ ID NO: 75328 - protein, 16 aa, Borrelia burgdorferi B31
DIYYGIIDAFDYGDIQ

SEQ ID NO: 75329 - protein, 16 aa, Borrelia burgdorferi B31
IYYGIIDAFDYGDIQV

SEQ ID NO: 75330 - protein, 16 aa, Borrelia burgdorferi B31
YYGIIDAFDYGDIQVP

SEQ ID NO: 75331 - protein, 16 aa, Borrelia burgdorferi B31
YGIIDAFDYGDIQVPK

SEQ ID NO: 75332 - protein, 16 aa, Borrelia burgdorferi B31
GIIDAFDYGDIQVPKN

SEQ ID NO: 75333 - protein, 16 aa, Borrelia burgdorferi B31
IIDAFDYGDIQVPKNS

SEQ ID NO: 75334 - protein, 16 aa, Borrelia burgdorferi B31
IDAFDYGDIQVPKNSL

SEQ ID NO: 75335 - protein, 16 aa, Borrelia burgdorferi B31
DAFDYGDIQVPKNSLA

SEQ ID NO: 75336 - protein, 16 aa, Borrelia burgdorferi B31
AFDYGDIQVPKNSLAI

SEQ ID NO: 75337 - protein, 16 aa, Borrelia burgdorferi B31
FDYGDIQVPKNSLAIK

SEQ ID NO: 75338 - protein, 16 aa, Borrelia burgdorferi B31
DYGDIQVPKNSLAIKF

SEQ ID NO: 75339 - protein, 16 aa, Borrelia burgdorferi B31
YGDIQVPKNSLAIKFR

SEQ ID NO: 75340 - protein, 16 aa, Borrelia burgdorferi B31
GDIQVPKNSLAIKFRN

SEQ ID NO: 75341 - protein, 16 aa, Borrelia burgdorferi B31
DIQVPKNSLAIKFRNE

SEQ ID NO: 75342 - protein, 16 aa, Borrelia burgdorferi B31
IQVPKNSLAIKFRNEE

SEQ ID NO: 75343 - protein, 16 aa, Borrelia burgdorferi B31
QVPKNSLAIKFRNEEA

SEQ ID NO: 75344 - protein, 16 aa, Borrelia burgdorferi B31
VPKNSLAIKFRNEEAA

SEQ ID NO: 75345 - protein, 16 aa, Borrelia burgdorferi B31
PKNSLAIKFRNEEAAF

SEQ ID NO: 75346 - protein, 16 aa, Borrelia burgdorferi B31
KNSLAIKFRNEEAAFL

SEQ ID NO: 75347 - protein, 16 aa, Borrelia burgdorferi B31
NSLAIKFRNEEAAFLA

SEQ ID NO: 75348 - protein, 16 aa, Borrelia burgdorferi B31
SLAIKFRNEEAAFLAG

SEQ ID NO: 75349 - protein, 16 aa, Borrelia burgdorferi B31
LAIKFRNEEAAFLAGY

SEQ ID NO: 75350 - protein, 16 aa, Borrelia burgdorferi B31
AIKFRNEEAAFLAGYI

SEQ ID NO: 75351 - protein, 16 aa, Borrelia burgdorferi B31
IKFRNEEAAFLAGYIA

SEQ ID NO: 75352 - protein, 16 aa, Borrelia burgdorferi B31
KFRNEEAAFLAGYIAA

SEQ ID NO: 75353 - protein, 16 aa, Borrelia burgdorferi B31
FRNEEAAFLAGYIAAK

SEQ ID NO: 75354 - protein, 16 aa, Borrelia burgdorferi B31
RNEEAAFLAGYIAAKM

SEQ ID NO: 75355 - protein, 16 aa, Borrelia burgdorferi B31
NEEAAFLAGYIAAKMS

SEQ ID NO: 75356 - protein, 16 aa, Borrelia burgdorferi B31
EEAAFLAGYIAAKMSR

SEQ ID NO: 75357 - protein, 16 aa, Borrelia burgdorferi B31
EAAFLAGYIAAKMSRK

SEQ ID NO: 75358 - protein, 16 aa, Borrelia burgdorferi B31
AAFLAGYIAAKMSRKE

SEQ ID NO: 75359 - protein, 16 aa, Borrelia burgdorferi B31
AFLAGYIAAKMSRKEK

SEQ ID NO: 75360 - protein, 16 aa, Borrelia burgdorferi B31
FLAGYIAAKMSRKEKI

SEQ ID NO: 75361 - protein, 16 aa, Borrelia burgdorferi B31
LAGYIAAKMSRKEKIG

SEQ ID NO: 75362 - protein, 16 aa, Borrelia burgdorferi B31
AGYIAAKMSRKEKIGF

SEQ ID NO: 75363 - protein, 16 aa, Borrelia burgdorferi B31
GYIAAKMSRKEKIGFL

SEQ ID NO: 75364 - protein, 16 aa, Borrelia burgdorferi B31
YIAAKMSRKEKIGFLT

SEQ ID NO: 75365 - protein, 16 aa, Borrelia burgdorferi B31
IAAKMSRKEKIGFLTG

SEQ ID NO: 75366 - protein, 16 aa, Borrelia burgdorferi B31
AAKMSRKEKIGFLTGP

SEQ ID NO: 75367 - protein, 16 aa, Borrelia burgdorferi B31
AKMSRKEKIGFLTGPM

SEQ ID NO: 75368 - protein, 16 aa, Borrelia burgdorferi B31
KMSRKEKIGFLTGPMS

SEQ ID NO: 75369 - protein, 16 aa, Borrelia burgdorferi B31
MSRKEKIGFLTGPMSE

SEQ ID NO: 75370 - protein, 16 aa, Borrelia burgdorferi B31
SRKEKIGFLTGPMSEH

SEQ ID NO: 75371 - protein, 16 aa, Borrelia burgdorferi B31
RKEKIGFLTGPMSEHV

SEQ ID NO: 75372 - protein, 16 aa, Borrelia burgdorferi B31
KEKIGFLTGPMSEHVK

SEQ ID NO: 75373 - protein, 16 aa, Borrelia burgdorferi B31
EKIGFLTGPMSEHVKD

SEQ ID NO: 75374 - protein, 16 aa, Borrelia burgdorferi B31
KIGFLTGPMSEHVKDF

SEQ ID NO: 75375 - protein, 16 aa, Borrelia burgdorferi B31
IGFLTGPMSEHVKDFK

SEQ ID NO: 75376 - protein, 16 aa, Borrelia burgdorferi B31
GFLTGPMSEHVKDFKF

SEQ ID NO: 75377 - protein, 16 aa, Borrelia burgdorferi B31
FLTGPMSEHVKDFKFG

SEQ ID NO: 75378 - protein, 16 aa, Borrelia burgdorferi B31
LTGPMSEHVKDFKFGF

SEQ ID NO: 75379 - protein, 16 aa, Borrelia burgdorferi B31
TGPMSEHVKDFKFGFK

SEQ ID NO: 75380 - protein, 16 aa, Borrelia burgdorferi B31
GPMSEHVKDFKFGFKA

SEQ ID NO: 75381 - protein, 16 aa, Borrelia burgdorferi B31
PMSEHVKDFKFGFKAG

SEQ ID NO: 75382 - protein, 16 aa, Borrelia burgdorferi B31
MSEHVKDFKFGFKAGI

SEQ ID NO: 75383 - protein, 16 aa, Borrelia burgdorferi B31
SEHVKDFKFGFKAGIF

SEQ ID NO: 75384 - protein, 16 aa, Borrelia burgdorferi B31
EHVKDFKFGFKAGIFY

SEQ ID NO: 75385 - protein, 16 aa, Borrelia burgdorferi B31
HVKDFKFGFKAGIFYA

SEQ ID NO: 75386 - protein, 16 aa, Borrelia burgdorferi B31
VKDFKFGFKAGIFYAN

SEQ ID NO: 75387 - protein, 16 aa, Borrelia burgdorferi B31
KDFKFGFKAGIFYANP

SEQ ID NO: 75388 - protein, 16 aa, Borrelia burgdorferi B31
DFKFGFKAGIFYANPK

SEQ ID NO: 75389 - protein, 16 aa, Borrelia burgdorferi B31
FKFGFKAGIFYANPKL

SEQ ID NO: 75390 - protein, 16 aa, Borrelia burgdorferi B31
KFGFKAGIFYANPKLR

SEQ ID NO: 75391 - protein, 16 aa, Borrelia burgdorferi B31
FGFKAGIFYANPKLRL

SEQ ID NO: 75392 - protein, 16 aa, Borrelia burgdorferi B31
GFKAGIFYANPKLRLV

SEQ ID NO: 75393 - protein, 16 aa, Borrelia burgdorferi B31
FKAGIFYANPKLRLVS

SEQ ID NO: 75394 - protein, 16 aa, Borrelia burgdorferi B31
KAGIFYANPKLRLVSK

SEQ ID NO: 75395 - protein, 16 aa, Borrelia burgdorferi B31
AGIFYANPKLRLVSKK

SEQ ID NO: 75396 - protein, 16 aa, Borrelia burgdorferi B31
GIFYANPKLRLVSKKA

SEQ ID NO: 75397 - protein, 16 aa, Borrelia burgdorferi B31
IFYANPKLRLVSKKAP

SEQ ID NO: 75398 - protein, 16 aa, Borrelia burgdorferi B31
FYANPKLRLVSKKAPS

SEQ ID NO: 75399 - protein, 16 aa, Borrelia burgdorferi B31
YANPKLRLVSKKAPSL

SEQ ID NO: 75400 - protein, 16 aa, Borrelia burgdorferi B31
ANPKLRLVSKKAPSLF

SEQ ID NO: 75401 - protein, 16 aa, Borrelia burgdorferi B31
NPKLRLVSKKAPSLFD

SEQ ID NO: 75402 - protein, 16 aa, Borrelia burgdorferi B31
PKLRLVSKKAPSLFDK

SEQ ID NO: 75403 - protein, 16 aa, Borrelia burgdorferi B31
KLRLVSKKAPSLFDKE

SEQ ID NO: 75404 - protein, 16 aa, Borrelia burgdorferi B31
LRLVSKKAPSLFDKEK

SEQ ID NO: 75405 - protein, 16 aa, Borrelia burgdorferi B31
RLVSKKAPSLFDKEKG

SEQ ID NO: 75406 - protein, 16 aa, Borrelia burgdorferi B31
LVSKKAPSLFDKEKGK

SEQ ID NO: 75407 - protein, 16 aa, Borrelia burgdorferi B31
VSKKAPSLFDKEKGKA

SEQ ID NO: 75408 - protein, 16 aa, Borrelia burgdorferi B31
SKKAPSLFDKEKGKAM

SEQ ID NO: 75409 - protein, 16 aa, Borrelia burgdorferi B31
KKAPSLFDKEKGKAMA

SEQ ID NO: 75410 - protein, 16 aa, Borrelia burgdorferi B31
KAPSLFDKEKGKAMAL

SEQ ID NO: 75411 - protein, 16 aa, Borrelia burgdorferi B31
APSLFDKEKGKAMALF

SEQ ID NO: 75412 - protein, 16 aa, Borrelia burgdorferi B31
PSLFDKEKGKAMALFM

SEQ ID NO: 75413 - protein, 16 aa, Borrelia burgdorferi B31
SLFDKEKGKAMALFMY

SEQ ID NO: 75414 - protein, 16 aa, Borrelia burgdorferi B31
LFDKEKGKAMALFMYK

SEQ ID NO: 75415 - protein, 16 aa, Borrelia burgdorferi B31
FDKEKGKAMALFMYKE

SEQ ID NO: 75416 - protein, 16 aa, Borrelia burgdorferi B31
DKEKGKAMALFMYKED

SEQ ID NO: 75417 - protein, 16 aa, Borrelia burgdorferi B31
KEKGKAMALFMYKEDK

SEQ ID NO: 75418 - protein, 16 aa, Borrelia burgdorferi B31
EKGKAMALFMYKEDKV

SEQ ID NO: 75419 - protein, 16 aa, Borrelia burgdorferi B31
KGKAMALFMYKEDKVG

SEQ ID NO: 75420 - protein, 16 aa, Borrelia burgdorferi B31
GKAMALFMYKEDKVGV

SEQ ID NO: 75421 - protein, 16 aa, Borrelia burgdorferi B31
KAMALFMYKEDKVGVI

SEQ ID NO: 75422 - protein, 16 aa, Borrelia burgdorferi B31
AMALFMYKEDKVGVIF

SEQ ID NO: 75423 - protein, 16 aa, Borrelia burgdorferi B31
MALFMYKEDKVGVIFP

SEQ ID NO: 75424 - protein, 16 aa, Borrelia burgdorferi B31
ALFMYKEDKVGVIFPI

SEQ ID NO: 75425 - protein, 16 aa, Borrelia burgdorferi B31
LFMYKEDKVGVIFPIA

SEQ ID NO: 75426 - protein, 16 aa, Borrelia burgdorferi B31
FMYKEDKVGVIFPIAG

SEQ ID NO: 75427 - protein, 16 aa, Borrelia burgdorferi B31
MYKEDKVGVIFPIAGI

SEQ ID NO: 75428 - protein, 16 aa, Borrelia burgdorferi B31
YKEDKVGVIFPIAGIT

SEQ ID NO: 75429 - protein, 16 aa, Borrelia burgdorferi B31
KEDKVGVIFPIAGITG

SEQ ID NO: 75430 - protein, 16 aa, Borrelia burgdorferi B31
EDKVGVIFPIAGITGL

SEQ ID NO: 75431 - protein, 16 aa, Borrelia burgdorferi B31
DKVGVIFPIAGITGLG

SEQ ID NO: 75432 - protein, 16 aa, Borrelia burgdorferi B31
KVGVIFPIAGITGLGV

SEQ ID NO: 75433 - protein, 16 aa, Borrelia burgdorferi B31
VGVIFPIAGITGLGVY

SEQ ID NO: 75434 - protein, 16 aa, Borrelia burgdorferi B31
GVIFPIAGITGLGVYD

SEQ ID NO: 75435 - protein, 16 aa, Borrelia burgdorferi B31
VIFPIAGITGLGVYDA

SEQ ID NO: 75436 - protein, 16 aa, Borrelia burgdorferi B31
IFPIAGITGLGVYDAA

SEQ ID NO: 75437 - protein, 16 aa, Borrelia burgdorferi B31
FPIAGITGLGVYDAAK

SEQ ID NO: 75438 - protein, 16 aa, Borrelia burgdorferi B31
PIAGITGLGVYDAAKE

SEQ ID NO: 75439 - protein, 16 aa, Borrelia burgdorferi B31
IAGITGLGVYDAAKEL

SEQ ID NO: 75440 - protein, 16 aa, Borrelia burgdorferi B31
AGITGLGVYDAAKELG

SEQ ID NO: 75441 - protein, 16 aa, Borrelia burgdorferi B31
GITGLGVYDAAKELGP

SEQ ID NO: 75442 - protein, 16 aa, Borrelia burgdorferi B31
ITGLGVYDAAKELGPK

SEQ ID NO: 75443 - protein, 16 aa, Borrelia burgdorferi B31
TGLGVYDAAKELGPKY

SEQ ID NO: 75444 - protein, 16 aa, Borrelia burgdorferi B31
GLGVYDAAKELGPKYY

SEQ ID NO: 75445 - protein, 16 aa, Borrelia burgdorferi B31
LGVYDAAKELGPKYYV

SEQ ID NO: 75446 - protein, 16 aa, Borrelia burgdorferi B31
GVYDAAKELGPKYYVI

SEQ ID NO: 75447 - protein, 16 aa, Borrelia burgdorferi B31
VYDAAKELGPKYYVIG

SEQ ID NO: 75448 - protein, 16 aa, Borrelia burgdorferi B31
YDAAKELGPKYYVIGL

SEQ ID NO: 75449 - protein, 16 aa, Borrelia burgdorferi B31
DAAKELGPKYYVIGLN

SEQ ID NO: 75450 - protein, 16 aa, Borrelia burgdorferi B31
AAKELGPKYYVIGLNQ

SEQ ID NO: 75451 - protein, 16 aa, Borrelia burgdorferi B31
AKELGPKYYVIGLNQD

SEQ ID NO: 75452 - protein, 16 aa, Borrelia burgdorferi B31
KELGPKYYVIGLNQDQ

SEQ ID NO: 75453 - protein, 16 aa, Borrelia burgdorferi B31
ELGPKYYVIGLNQDQS

SEQ ID NO: 75454 - protein, 16 aa, Borrelia burgdorferi B31
LGPKYYVIGLNQDQSY

SEQ ID NO: 75455 - protein, 16 aa, Borrelia burgdorferi B31
GPKYYVIGLNQDQSYI

SEQ ID NO: 75456 - protein, 16 aa, Borrelia burgdorferi B31
PKYYVIGLNQDQSYIA

SEQ ID NO: 75457 - protein, 16 aa, Borrelia burgdorferi B31
KYYVIGLNQDQSYIAP

SEQ ID NO: 75458 - protein, 16 aa, Borrelia burgdorferi B31
YYVIGLNQDQSYIAPQ

SEQ ID NO: 75459 - protein, 16 aa, Borrelia burgdorferi B31
YVIGLNQDQSYIAPQN

SEQ ID NO: 75460 - protein, 16 aa, Borrelia burgdorferi B31
VIGLNQDQSYIAPQNV

SEQ ID NO: 75461 - protein, 16 aa, Borrelia burgdorferi B31
IGLNQDQSYIAPQNVI

SEQ ID NO: 75462 - protein, 16 aa, Borrelia burgdorferi B31
GLNQDQSYIAPQNVIT

SEQ ID NO: 75463 - protein, 16 aa, Borrelia burgdorferi B31
LNQDQSYIAPQNVITS

SEQ ID NO: 75464 - protein, 16 aa, Borrelia burgdorferi B31
NQDQSYIAPQNVITSI

SEQ ID NO: 75465 - protein, 16 aa, Borrelia burgdorferi B31
QDQSYIAPQNVITSII

SEQ ID NO: 75466 - protein, 16 aa, Borrelia burgdorferi B31
DQSYIAPQNVITSIIK

SEQ ID NO: 75467 - protein, 16 aa, Borrelia burgdorferi B31
QSYIAPQNVITSIIKD

SEQ ID NO: 75468 - protein, 16 aa, Borrelia burgdorferi B31
SYIAPQNVITSIIKDI

SEQ ID NO: 75469 - protein, 16 aa, Borrelia burgdorferi B31
YIAPQNVITSIIKDIG

SEQ ID NO: 75470 - protein, 16 aa, Borrelia burgdorferi B31
IAPQNVITSIIKDIGK

SEQ ID NO: 75471 - protein, 16 aa, Borrelia burgdorferi B31
APQNVITSIIKDIGKV

SEQ ID NO: 75472 - protein, 16 aa, Borrelia burgdorferi B31
PQNVITSIIKDIGKVI

SEQ ID NO: 75473 - protein, 16 aa, Borrelia burgdorferi B31
QNVITSIIKDIGKVIY

SEQ ID NO: 75474 - protein, 16 aa, Borrelia burgdorferi B31
NVITSIIKDIGKVIYS

SEQ ID NO: 75475 - protein, 16 aa, Borrelia burgdorferi B31
VITSIIKDIGKVIYSI

SEQ ID NO: 75476 - protein, 16 aa, Borrelia burgdorferi B31
ITSIIKDIGKVIYSIS

SEQ ID NO: 75477 - protein, 16 aa, Borrelia burgdorferi B31
TSIIKDIGKVIYSISS

SEQ ID NO: 75478 - protein, 16 aa, Borrelia burgdorferi B31
SIIKDIGKVIYSISSE

SEQ ID NO: 75479 - protein, 16 aa, Borrelia burgdorferi B31
IIKDIGKVIYSISSEY

SEQ ID NO: 75480 - protein, 16 aa, Borrelia burgdorferi B31
IKDIGKVIYSISSEYI

SEQ ID NO: 75481 - protein, 16 aa, Borrelia burgdorferi B31
KDIGKVIYSISSEYIN

SEQ ID NO: 75482 - protein, 16 aa, Borrelia burgdorferi B31
DIGKVIYSISSEYINN

SEQ ID NO: 75483 - protein, 16 aa, Borrelia burgdorferi B31
IGKVIYSISSEYINNR

SEQ ID NO: 75484 - protein, 16 aa, Borrelia burgdorferi B31
GKVIYSISSEYINNRV

SEQ ID NO: 75485 - protein, 16 aa, Borrelia burgdorferi B31
KVIYSISSEYINNRVF

SEQ ID NO: 75486 - protein, 16 aa, Borrelia burgdorferi B31
VIYSISSEYINNRVFK

SEQ ID NO: 75487 - protein, 16 aa, Borrelia burgdorferi B31
IYSISSEYINNRVFKG

SEQ ID NO: 75488 - protein, 16 aa, Borrelia burgdorferi B31
YSISSEYINNRVFKGG

SEQ ID NO: 75489 - protein, 16 aa, Borrelia burgdorferi B31
SISSEYINNRVFKGGI

SEQ ID NO: 75490 - protein, 16 aa, Borrelia burgdorferi B31
ISSEYINNRVFKGGII

SEQ ID NO: 75491 - protein, 16 aa, Borrelia burgdorferi B31
SSEYINNRVFKGGIII

SEQ ID NO: 75492 - protein, 16 aa, Borrelia burgdorferi B31
SEYINNRVFKGGIIID

SEQ ID NO: 75493 - protein, 16 aa, Borrelia burgdorferi B31
EYINNRVFKGGIIIDR

SEQ ID NO: 75494 - protein, 16 aa, Borrelia burgdorferi B31
YINNRVFKGGIIIDRG

SEQ ID NO: 75495 - protein, 16 aa, Borrelia burgdorferi B31
INNRVFKGGIIIDRGL

SEQ ID NO: 75496 - protein, 16 aa, Borrelia burgdorferi B31
NNRVFKGGIIIDRGLK

SEQ ID NO: 75497 - protein, 16 aa, Borrelia burgdorferi B31
NRVFKGGIIIDRGLKE

SEQ ID NO: 75498 - protein, 16 aa, Borrelia burgdorferi B31
RVFKGGIIIDRGLKEG

SEQ ID NO: 75499 - protein, 16 aa, Borrelia burgdorferi B31
VFKGGIIIDRGLKEGV

SEQ ID NO: 75500 - protein, 16 aa, Borrelia burgdorferi B31
FKGGIIIDRGLKEGVI

SEQ ID NO: 75501 - protein, 16 aa, Borrelia burgdorferi B31
KGGIIIDRGLKEGVIE

SEQ ID NO: 75502 - protein, 16 aa, Borrelia burgdorferi B31
GGIIIDRGLKEGVIEI

SEQ ID NO: 75503 - protein, 16 aa, Borrelia burgdorferi B31
GIIIDRGLKEGVIEIV

SEQ ID NO: 75504 - protein, 16 aa, Borrelia burgdorferi B31
IIIDRGLKEGVIEIVK

SEQ ID NO: 75505 - protein, 16 aa, Borrelia burgdorferi B31
IIDRGLKEGVIEIVKD

SEQ ID NO: 75506 - protein, 16 aa, Borrelia burgdorferi B31
IDRGLKEGVIEIVKDP

SEQ ID NO: 75507 - protein, 16 aa, Borrelia burgdorferi B31
DRGLKEGVIEIVKDPD

SEQ ID NO: 75508 - protein, 16 aa, Borrelia burgdorferi B31
RGLKEGVIEIVKDPDV

SEQ ID NO: 75509 - protein, 16 aa, Borrelia burgdorferi B31
GLKEGVIEIVKDPDVL

SEQ ID NO: 75510 - protein, 16 aa, Borrelia burgdorferi B31
LKEGVIEIVKDPDVLN

SEQ ID NO: 75511 - protein, 16 aa, Borrelia burgdorferi B31
KEGVIEIVKDPDVLNN

SEQ ID NO: 75512 - protein, 16 aa, Borrelia burgdorferi B31
EGVIEIVKDPDVLNNR

SEQ ID NO: 75513 - protein, 16 aa, Borrelia burgdorferi B31
GVIEIVKDPDVLNNRL

SEQ ID NO: 75514 - protein, 16 aa, Borrelia burgdorferi B31
VIEIVKDPDVLNNRLV

SEQ ID NO: 75515 - protein, 16 aa, Borrelia burgdorferi B31
IEIVKDPDVLNNRLVD

SEQ ID NO: 75516 - protein, 16 aa, Borrelia burgdorferi B31
EIVKDPDVLNNRLVDE

SEQ ID NO: 75517 - protein, 16 aa, Borrelia burgdorferi B31
IVKDPDVLNNRLVDEV

SEQ ID NO: 75518 - protein, 16 aa, Borrelia burgdorferi B31
VKDPDVLNNRLVDEVI

SEQ ID NO: 75519 - protein, 16 aa, Borrelia burgdorferi B31
KDPDVLNNRLVDEVID

SEQ ID NO: 75520 - protein, 16 aa, Borrelia burgdorferi B31
DPDVLNNRLVDEVIDL

SEQ ID NO: 75521 - protein, 16 aa, Borrelia burgdorferi B31
PDVLNNRLVDEVIDLE

SEQ ID NO: 75522 - protein, 16 aa, Borrelia burgdorferi B31
DVLNNRLVDEVIDLEN

SEQ ID NO: 75523 - protein, 16 aa, Borrelia burgdorferi B31
VLNNRLVDEVIDLENK

SEQ ID NO: 75524 - protein, 16 aa, Borrelia burgdorferi B31
LNNRLVDEVIDLENKI

SEQ ID NO: 75525 - protein, 16 aa, Borrelia burgdorferi B31
NNRLVDEVIDLENKII

SEQ ID NO: 75526 - protein, 16 aa, Borrelia burgdorferi B31
NRLVDEVIDLENKIIS

SEQ ID NO: 75527 - protein, 16 aa, Borrelia burgdorferi B31
RLVDEVIDLENKIISG

SEQ ID NO: 75528 - protein, 16 aa, Borrelia burgdorferi B31
LVDEVIDLENKIISGE

SEQ ID NO: 75529 - protein, 16 aa, Borrelia burgdorferi B31
VDEVIDLENKIISGEI

SEQ ID NO: 75530 - protein, 16 aa, Borrelia burgdorferi B31
DEVIDLENKIISGEII

SEQ ID NO: 75531 - protein, 16 aa, Borrelia burgdorferi B31
EVIDLENKIISGEIIV

SEQ ID NO: 75532 - protein, 16 aa, Borrelia burgdorferi B31
VIDLENKIISGEIIVP

SEQ ID NO: 75533 - protein, 16 aa, Borrelia burgdorferi B31
IDLENKIISGEIIVPD

SEQ ID NO: 75534 - protein, 16 aa, Borrelia burgdorferi B31
DLENKIISGEIIVPDS

SEQ ID NO: 75535 - protein, 16 aa, Borrelia burgdorferi B31
LENKIISGEIIVPDSE

SEQ ID NO: 75536 - protein, 16 aa, Borrelia burgdorferi B31
ENKIISGEIIVPDSEY

SEQ ID NO: 75537 - protein, 16 aa, Borrelia burgdorferi B31
NKIISGEIIVPDSEYA

SEQ ID NO: 75538 - protein, 16 aa, Borrelia burgdorferi B31
KIISGEIIVPDSEYAF

SEQ ID NO: 75539 - protein, 16 aa, Borrelia burgdorferi B31
IISGEIIVPDSEYAFD

SEQ ID NO: 75540 - protein, 16 aa, Borrelia burgdorferi B31
ISGEIIVPDSEYAFDL

SEQ ID NO: 75541 - protein, 16 aa, Borrelia burgdorferi B31
SGEIIVPDSEYAFDLF

SEQ ID NO: 75542 - protein, 16 aa, Borrelia burgdorferi B31
GEIIVPDSEYAFDLFK

SEQ ID NO: 75543 - protein, 16 aa, Borrelia burgdorferi B31
EIIVPDSEYAFDLFKS

SEQ ID NO: 75544 - protein, 16 aa, Borrelia burgdorferi B31
IIVPDSEYAFDLFKSK

SEQ ID NO: 75545 - protein, 16 aa, Borrelia burgdorferi B31
IVPDSEYAFDLFKSKL

SEQ ID NO: 75546 - protein, 13 aa, Borrelia burgdorferi B31
MDNYYEIYFLYFF

SEQ ID NO: 75547 - protein, 13 aa, Borrelia burgdorferi B31
DNYYEIYFLYFFI

SEQ ID NO: 75548 - protein, 13 aa, Borrelia burgdorferi B31
NYYEIYFLYFFIK

SEQ ID NO: 75549 - protein, 13 aa, Borrelia burgdorferi B31
YYEIYFLYFFIKS

SEQ ID NO: 75550 - protein, 13 aa, Borrelia burgdorferi B31
YEIYFLYFFIKSK

SEQ ID NO: 75551 - protein, 13 aa, Borrelia burgdorferi B31
EIYFLYFFIKSKE

SEQ ID NO: 75552 - protein, 13 aa, Borrelia burgdorferi B31
IYFLYFFIKSKED

SEQ ID NO: 75553 - protein, 13 aa, Borrelia burgdorferi B31
YFLYFFIKSKEDI

SEQ ID NO: 75554 - protein, 13 aa, Borrelia burgdorferi B31
FLYFFIKSKEDIF

SEQ ID NO: 75555 - protein, 13 aa, Borrelia burgdorferi B31
LYFFIKSKEDIFM

SEQ ID NO: 75556 - protein, 13 aa, Borrelia burgdorferi B31
YFFIKSKEDIFML

SEQ ID NO: 75557 - protein, 13 aa, Borrelia burgdorferi B31
FFIKSKEDIFMLK

SEQ ID NO: 75558 - protein, 13 aa, Borrelia burgdorferi B31
FIKSKEDIFMLKK

SEQ ID NO: 75559 - protein, 13 aa, Borrelia burgdorferi B31
IKSKEDIFMLKKV

SEQ ID NO: 75560 - protein, 13 aa, Borrelia burgdorferi B31
KSKEDIFMLKKVY

SEQ ID NO: 75561 - protein, 13 aa, Borrelia burgdorferi B31
SKEDIFMLKKVYY

SEQ ID NO: 75562 - protein, 13 aa, Borrelia burgdorferi B31
KEDIFMLKKVYYF

SEQ ID NO: 75563 - protein, 13 aa, Borrelia burgdorferi B31
EDIFMLKKVYYFL

SEQ ID NO: 75564 - protein, 13 aa, Borrelia burgdorferi B31
DIFMLKKVYYFLI

SEQ ID NO: 75565 - protein, 13 aa, Borrelia burgdorferi B31
IFMLKKVYYFLIF

SEQ ID NO: 75566 - protein, 13 aa, Borrelia burgdorferi B31
FMLKKVYYFLIFL

SEQ ID NO: 75567 - protein, 13 aa, Borrelia burgdorferi B31
MLKKVYYFLIFLF

SEQ ID NO: 75568 - protein, 13 aa, Borrelia burgdorferi B31
LKKVYYFLIFLFI

SEQ ID NO: 75569 - protein, 13 aa, Borrelia burgdorferi B31
KKVYYFLIFLFIV

SEQ ID NO: 75570 - protein, 13 aa, Borrelia burgdorferi B31
KVYYFLIFLFIVA

SEQ ID NO: 75571 - protein, 13 aa, Borrelia burgdorferi B31
VYYFLIFLFIVAC

SEQ ID NO: 75572 - protein, 13 aa, Borrelia burgdorferi B31
YYFLIFLFIVACS

SEQ ID NO: 75573 - protein, 13 aa, Borrelia burgdorferi B31
YFLIFLFIVACSS

SEQ ID NO: 75574 - protein, 13 aa, Borrelia burgdorferi B31
FLIFLFIVACSSS

SEQ ID NO: 75575 - protein, 13 aa, Borrelia burgdorferi B31
LIFLFIVACSSSD

SEQ ID NO: 75576 - protein, 13 aa, Borrelia burgdorferi B31
IFLFIVACSSSDD

SEQ ID NO: 75577 - protein, 13 aa, Borrelia burgdorferi B31
FLFIVACSSSDDG

SEQ ID NO: 75578 - protein, 13 aa, Borrelia burgdorferi B31
LFIVACSSSDDGK

SEQ ID NO: 75579 - protein, 13 aa, Borrelia burgdorferi B31
FIVACSSSDDGKS

SEQ ID NO: 75580 - protein, 13 aa, Borrelia burgdorferi B31
IVACSSSDDGKSE

SEQ ID NO: 75581 - protein, 13 aa, Borrelia burgdorferi B31
VACSSSDDGKSEA

SEQ ID NO: 75582 - protein, 13 aa, Borrelia burgdorferi B31
ACSSSDDGKSEAK

SEQ ID NO: 75583 - protein, 13 aa, Borrelia burgdorferi B31
CSSSDDGKSEAKT

SEQ ID NO: 75584 - protein, 13 aa, Borrelia burgdorferi B31
SSSDDGKSEAKTV

SEQ ID NO: 75585 - protein, 13 aa, Borrelia burgdorferi B31
SSDDGKSEAKTVS

SEQ ID NO: 75586 - protein, 13 aa, Borrelia burgdorferi B31
SDDGKSEAKTVSL

SEQ ID NO: 75587 - protein, 13 aa, Borrelia burgdorferi B31
DDGKSEAKTVSLI

SEQ ID NO: 75588 - protein, 13 aa, Borrelia burgdorferi B31
DGKSEAKTVSLIV

SEQ ID NO: 75589 - protein, 13 aa, Borrelia burgdorferi B31
GKSEAKTVSLIVD

SEQ ID NO: 75590 - protein, 13 aa, Borrelia burgdorferi B31
KSEAKTVSLIVDG

SEQ ID NO: 75591 - protein, 13 aa, Borrelia burgdorferi B31
SEAKTVSLIVDGA

SEQ ID NO: 75592 - protein, 13 aa, Borrelia burgdorferi B31
EAKTVSLIVDGAF

SEQ ID NO: 75593 - protein, 13 aa, Borrelia burgdorferi B31
AKTVSLIVDGAFD

SEQ ID NO: 75594 - protein, 13 aa, Borrelia burgdorferi B31
KTVSLIVDGAFDD

SEQ ID NO: 75595 - protein, 13 aa, Borrelia burgdorferi B31
TVSLIVDGAFDDK

SEQ ID NO: 75596 - protein, 13 aa, Borrelia burgdorferi B31
VSLIVDGAFDDKG

SEQ ID NO: 75597 - protein, 13 aa, Borrelia burgdorferi B31
SLIVDGAFDDKGF

SEQ ID NO: 75598 - protein, 13 aa, Borrelia burgdorferi B31
LIVDGAFDDKGFN

SEQ ID NO: 75599 - protein, 13 aa, Borrelia burgdorferi B31
IVDGAFDDKGFNE

SEQ ID NO: 75600 - protein, 13 aa, Borrelia burgdorferi B31
VDGAFDDKGFNES

SEQ ID NO: 75601 - protein, 13 aa, Borrelia burgdorferi B31
DGAFDDKGFNESS

SEQ ID NO: 75602 - protein, 13 aa, Borrelia burgdorferi B31
GAFDDKGFNESSS

SEQ ID NO: 75603 - protein, 13 aa, Borrelia burgdorferi B31
AFDDKGFNESSSK

SEQ ID NO: 75604 - protein, 13 aa, Borrelia burgdorferi B31
FDDKGFNESSSKA

SEQ ID NO: 75605 - protein, 13 aa, Borrelia burgdorferi B31
DDKGFNESSSKAI

SEQ ID NO: 75606 - protein, 13 aa, Borrelia burgdorferi B31
DKGFNESSSKAIR

SEQ ID NO: 75607 - protein, 13 aa, Borrelia burgdorferi B31
KGFNESSSKAIRK

SEQ ID NO: 75608 - protein, 13 aa, Borrelia burgdorferi B31
GFNESSSKAIRKL

SEQ ID NO: 75609 - protein, 13 aa, Borrelia burgdorferi B31
FNESSSKAIRKLK

SEQ ID NO: 75610 - protein, 13 aa, Borrelia burgdorferi B31
NESSSKAIRKLKA

SEQ ID NO: 75611 - protein, 13 aa, Borrelia burgdorferi B31
ESSSKAIRKLKAD

SEQ ID NO: 75612 - protein, 13 aa, Borrelia burgdorferi B31
SSSKAIRKLKADL

SEQ ID NO: 75613 - protein, 13 aa, Borrelia burgdorferi B31
SSKAIRKLKADLN

SEQ ID NO: 75614 - protein, 13 aa, Borrelia burgdorferi B31
SKAIRKLKADLNI

SEQ ID NO: 75615 - protein, 13 aa, Borrelia burgdorferi B31
KAIRKLKADLNIN

SEQ ID NO: 75616 - protein, 13 aa, Borrelia burgdorferi B31
AIRKLKADLNINI

SEQ ID NO: 75617 - protein, 13 aa, Borrelia burgdorferi B31
IRKLKADLNINII

SEQ ID NO: 75618 - protein, 13 aa, Borrelia burgdorferi B31
RKLKADLNINIIE

SEQ ID NO: 75619 - protein, 13 aa, Borrelia burgdorferi B31
KLKADLNINIIEK

SEQ ID NO: 75620 - protein, 13 aa, Borrelia burgdorferi B31
LKADLNINIIEKA

SEQ ID NO: 75621 - protein, 13 aa, Borrelia burgdorferi B31
KADLNINIIEKAS

SEQ ID NO: 75622 - protein, 13 aa, Borrelia burgdorferi B31
ADLNINIIEKAST

SEQ ID NO: 75623 - protein, 13 aa, Borrelia burgdorferi B31
DLNINIIEKASTG

SEQ ID NO: 75624 - protein, 13 aa, Borrelia burgdorferi B31
LNINIIEKASTGN

SEQ ID NO: 75625 - protein, 13 aa, Borrelia burgdorferi B31
NINIIEKASTGNS

SEQ ID NO: 75626 - protein, 13 aa, Borrelia burgdorferi B31
INIIEKASTGNSY

SEQ ID NO: 75627 - protein, 13 aa, Borrelia burgdorferi B31
NIIEKASTGNSYL

SEQ ID NO: 75628 - protein, 13 aa, Borrelia burgdorferi B31
IIEKASTGNSYLG

SEQ ID NO: 75629 - protein, 13 aa, Borrelia burgdorferi B31
IEKASTGNSYLGD

SEQ ID NO: 75630 - protein, 13 aa, Borrelia burgdorferi B31
EKASTGNSYLGDI

SEQ ID NO: 75631 - protein, 13 aa, Borrelia burgdorferi B31
KASTGNSYLGDIA

SEQ ID NO: 75632 - protein, 13 aa, Borrelia burgdorferi B31
ASTGNSYLGDIAN

SEQ ID NO: 75633 - protein, 13 aa, Borrelia burgdorferi B31
STGNSYLGDIANL

SEQ ID NO: 75634 - protein, 13 aa, Borrelia burgdorferi B31
TGNSYLGDIANLE

SEQ ID NO: 75635 - protein, 13 aa, Borrelia burgdorferi B31
GNSYLGDIANLED

SEQ ID NO: 75636 - protein, 13 aa, Borrelia burgdorferi B31
NSYLGDIANLEDG

SEQ ID NO: 75637 - protein, 13 aa, Borrelia burgdorferi B31
SYLGDIANLEDGN

SEQ ID NO: 75638 - protein, 13 aa, Borrelia burgdorferi B31
YLGDIANLEDGNS

SEQ ID NO: 75639 - protein, 13 aa, Borrelia burgdorferi B31
LGDIANLEDGNSN

SEQ ID NO: 75640 - protein, 13 aa, Borrelia burgdorferi B31
GDIANLEDGNSNL

SEQ ID NO: 75641 - protein, 13 aa, Borrelia burgdorferi B31
DIANLEDGNSNLI

SEQ ID NO: 75642 - protein, 13 aa, Borrelia burgdorferi B31
IANLEDGNSNLIW

SEQ ID NO: 75643 - protein, 13 aa, Borrelia burgdorferi B31
ANLEDGNSNLIWG

SEQ ID NO: 75644 - protein, 13 aa, Borrelia burgdorferi B31
NLEDGNSNLIWGI

SEQ ID NO: 75645 - protein, 13 aa, Borrelia burgdorferi B31
LEDGNSNLIWGIG

SEQ ID NO: 75646 - protein, 13 aa, Borrelia burgdorferi B31
EDGNSNLIWGIGF

SEQ ID NO: 75647 - protein, 13 aa, Borrelia burgdorferi B31
DGNSNLIWGIGFR

SEQ ID NO: 75648 - protein, 13 aa, Borrelia burgdorferi B31
GNSNLIWGIGFRL

SEQ ID NO: 75649 - protein, 13 aa, Borrelia burgdorferi B31
NSNLIWGIGFRLS

SEQ ID NO: 75650 - protein, 13 aa, Borrelia burgdorferi B31
SNLIWGIGFRLSD

SEQ ID NO: 75651 - protein, 13 aa, Borrelia burgdorferi B31
NLIWGIGFRLSDI

SEQ ID NO: 75652 - protein, 13 aa, Borrelia burgdorferi B31
LIWGIGFRLSDIL

SEQ ID NO: 75653 - protein, 13 aa, Borrelia burgdorferi B31
IWGIGFRLSDILF

SEQ ID NO: 75654 - protein, 13 aa, Borrelia burgdorferi B31
WGIGFRLSDILFQ

SEQ ID NO: 75655 - protein, 13 aa, Borrelia burgdorferi B31
GIGFRLSDILFQR

SEQ ID NO: 75656 - protein, 13 aa, Borrelia burgdorferi B31
IGFRLSDILFQRA

SEQ ID NO: 75657 - protein, 13 aa, Borrelia burgdorferi B31
GFRLSDILFQRAS

SEQ ID NO: 75658 - protein, 13 aa, Borrelia burgdorferi B31
FRLSDILFQRASE

SEQ ID NO: 75659 - protein, 13 aa, Borrelia burgdorferi B31
RLSDILFQRASEN

SEQ ID NO: 75660 - protein, 13 aa, Borrelia burgdorferi B31
LSDILFQRASENV

SEQ ID NO: 75661 - protein, 13 aa, Borrelia burgdorferi B31
SDILFQRASENVS

SEQ ID NO: 75662 - protein, 13 aa, Borrelia burgdorferi B31
DILFQRASENVSV

SEQ ID NO: 75663 - protein, 13 aa, Borrelia burgdorferi B31
ILFQRASENVSVN

SEQ ID NO: 75664 - protein, 13 aa, Borrelia burgdorferi B31
LFQRASENVSVNY

SEQ ID NO: 75665 - protein, 13 aa, Borrelia burgdorferi B31
FQRASENVSVNYA

SEQ ID NO: 75666 - protein, 13 aa, Borrelia burgdorferi B31
QRASENVSVNYAI

SEQ ID NO: 75667 - protein, 13 aa, Borrelia burgdorferi B31
RASENVSVNYAII

SEQ ID NO: 75668 - protein, 13 aa, Borrelia burgdorferi B31
ASENVSVNYAIIE

SEQ ID NO: 75669 - protein, 13 aa, Borrelia burgdorferi B31
SENVSVNYAIIEG

SEQ ID NO: 75670 - protein, 13 aa, Borrelia burgdorferi B31
ENVSVNYAIIEGV

SEQ ID NO: 75671 - protein, 13 aa, Borrelia burgdorferi B31
NVSVNYAIIEGVY

SEQ ID NO: 75672 - protein, 13 aa, Borrelia burgdorferi B31
VSVNYAIIEGVYD

SEQ ID NO: 75673 - protein, 13 aa, Borrelia burgdorferi B31
SVNYAIIEGVYDE

SEQ ID NO: 75674 - protein, 13 aa, Borrelia burgdorferi B31
VNYAIIEGVYDEI

SEQ ID NO: 75675 - protein, 13 aa, Borrelia burgdorferi B31
NYAIIEGVYDEIQ

SEQ ID NO: 75676 - protein, 13 aa, Borrelia burgdorferi B31
YAIIEGVYDEIQI

SEQ ID NO: 75677 - protein, 13 aa, Borrelia burgdorferi B31
AIIEGVYDEIQIP

SEQ ID NO: 75678 - protein, 13 aa, Borrelia burgdorferi B31
IIEGVYDEIQIPK

SEQ ID NO: 75679 - protein, 13 aa, Borrelia burgdorferi B31
IEGVYDEIQIPKN

SEQ ID NO: 75680 - protein, 13 aa, Borrelia burgdorferi B31
EGVYDEIQIPKNL

SEQ ID NO: 75681 - protein, 13 aa, Borrelia burgdorferi B31
GVYDEIQIPKNLL

SEQ ID NO: 75682 - protein, 13 aa, Borrelia burgdorferi B31
VYDEIQIPKNLLN

SEQ ID NO: 75683 - protein, 13 aa, Borrelia burgdorferi B31
YDEIQIPKNLLNI

SEQ ID NO: 75684 - protein, 13 aa, Borrelia burgdorferi B31
DEIQIPKNLLNIS

SEQ ID NO: 75685 - protein, 13 aa, Borrelia burgdorferi B31
EIQIPKNLLNISF

SEQ ID NO: 75686 - protein, 13 aa, Borrelia burgdorferi B31
IQIPKNLLNISFR

SEQ ID NO: 75687 - protein, 13 aa, Borrelia burgdorferi B31
QIPKNLLNISFRS

SEQ ID NO: 75688 - protein, 13 aa, Borrelia burgdorferi B31
IPKNLLNISFRSE

SEQ ID NO: 75689 - protein, 13 aa, Borrelia burgdorferi B31
PKNLLNISFRSEE

SEQ ID NO: 75690 - protein, 13 aa, Borrelia burgdorferi B31
KNLLNISFRSEEV

SEQ ID NO: 75691 - protein, 13 aa, Borrelia burgdorferi B31
NLLNISFRSEEVA

SEQ ID NO: 75692 - protein, 13 aa, Borrelia burgdorferi B31
LLNISFRSEEVAF

SEQ ID NO: 75693 - protein, 13 aa, Borrelia burgdorferi B31
LNISFRSEEVAFL

SEQ ID NO: 75694 - protein, 13 aa, Borrelia burgdorferi B31
NISFRSEEVAFLA

SEQ ID NO: 75695 - protein, 13 aa, Borrelia burgdorferi B31
ISFRSEEVAFLAG

SEQ ID NO: 75696 - protein, 13 aa, Borrelia burgdorferi B31
SFRSEEVAFLAGY

SEQ ID NO: 75697 - protein, 13 aa, Borrelia burgdorferi B31
FRSEEVAFLAGYF

SEQ ID NO: 75698 - protein, 13 aa, Borrelia burgdorferi B31
RSEEVAFLAGYFA

SEQ ID NO: 75699 - protein, 13 aa, Borrelia burgdorferi B31
SEEVAFLAGYFAS

SEQ ID NO: 75700 - protein, 13 aa, Borrelia burgdorferi B31
EEVAFLAGYFASK

SEQ ID NO: 75701 - protein, 13 aa, Borrelia burgdorferi B31
EVAFLAGYFASKA

SEQ ID NO: 75702 - protein, 13 aa, Borrelia burgdorferi B31
VAFLAGYFASKAS

SEQ ID NO: 75703 - protein, 13 aa, Borrelia burgdorferi B31
AFLAGYFASKASK

SEQ ID NO: 75704 - protein, 13 aa, Borrelia burgdorferi B31
FLAGYFASKASKT

SEQ ID NO: 75705 - protein, 13 aa, Borrelia burgdorferi B31
LAGYFASKASKTG

SEQ ID NO: 75706 - protein, 13 aa, Borrelia burgdorferi B31
AGYFASKASKTGK

SEQ ID NO: 75707 - protein, 13 aa, Borrelia burgdorferi B31
GYFASKASKTGKI

SEQ ID NO: 75708 - protein, 13 aa, Borrelia burgdorferi B31
YFASKASKTGKIG

SEQ ID NO: 75709 - protein, 13 aa, Borrelia burgdorferi B31
FASKASKTGKIGF

SEQ ID NO: 75710 - protein, 13 aa, Borrelia burgdorferi B31
ASKASKTGKIGFV

SEQ ID NO: 75711 - protein, 13 aa, Borrelia burgdorferi B31
SKASKTGKIGFVG

SEQ ID NO: 75712 - protein, 13 aa, Borrelia burgdorferi B31
KASKTGKIGFVGG

SEQ ID NO: 75713 - protein, 13 aa, Borrelia burgdorferi B31
ASKTGKIGFVGGV

SEQ ID NO: 75714 - protein, 13 aa, Borrelia burgdorferi B31
SKTGKIGFVGGVR

SEQ ID NO: 75715 - protein, 13 aa, Borrelia burgdorferi B31
KTGKIGFVGGVRG

SEQ ID NO: 75716 - protein, 13 aa, Borrelia burgdorferi B31
TGKIGFVGGVRGK

SEQ ID NO: 75717 - protein, 13 aa, Borrelia burgdorferi B31
GKIGFVGGVRGKV

SEQ ID NO: 75718 - protein, 13 aa, Borrelia burgdorferi B31
KIGFVGGVRGKVL

SEQ ID NO: 75719 - protein, 13 aa, Borrelia burgdorferi B31
IGFVGGVRGKVLE

SEQ ID NO: 75720 - protein, 13 aa, Borrelia burgdorferi B31
GFVGGVRGKVLES

SEQ ID NO: 75721 - protein, 13 aa, Borrelia burgdorferi B31
FVGGVRGKVLESF

SEQ ID NO: 75722 - protein, 13 aa, Borrelia burgdorferi B31
VGGVRGKVLESFM

SEQ ID NO: 75723 - protein, 13 aa, Borrelia burgdorferi B31
GGVRGKVLESFMY

SEQ ID NO: 75724 - protein, 13 aa, Borrelia burgdorferi B31
GVRGKVLESFMYG

SEQ ID NO: 75725 - protein, 13 aa, Borrelia burgdorferi B31
VRGKVLESFMYGY

SEQ ID NO: 75726 - protein, 13 aa, Borrelia burgdorferi B31
RGKVLESFMYGYE

SEQ ID NO: 75727 - protein, 13 aa, Borrelia burgdorferi B31
GKVLESFMYGYEA

SEQ ID NO: 75728 - protein, 13 aa, Borrelia burgdorferi B31
KVLESFMYGYEAG

SEQ ID NO: 75729 - protein, 13 aa, Borrelia burgdorferi B31
VLESFMYGYEAGA

SEQ ID NO: 75730 - protein, 13 aa, Borrelia burgdorferi B31
LESFMYGYEAGAK

SEQ ID NO: 75731 - protein, 13 aa, Borrelia burgdorferi B31
ESFMYGYEAGAKY

SEQ ID NO: 75732 - protein, 13 aa, Borrelia burgdorferi B31
SFMYGYEAGAKYA

SEQ ID NO: 75733 - protein, 13 aa, Borrelia burgdorferi B31
FMYGYEAGAKYAN

SEQ ID NO: 75734 - protein, 13 aa, Borrelia burgdorferi B31
MYGYEAGAKYANS

SEQ ID NO: 75735 - protein, 13 aa, Borrelia burgdorferi B31
YGYEAGAKYANSN

SEQ ID NO: 75736 - protein, 13 aa, Borrelia burgdorferi B31
GYEAGAKYANSNI

SEQ ID NO: 75737 - protein, 13 aa, Borrelia burgdorferi B31
YEAGAKYANSNIK

SEQ ID NO: 75738 - protein, 13 aa, Borrelia burgdorferi B31
EAGAKYANSNIKV

SEQ ID NO: 75739 - protein, 13 aa, Borrelia burgdorferi B31
AGAKYANSNIKVV

SEQ ID NO: 75740 - protein, 13 aa, Borrelia burgdorferi B31
GAKYANSNIKVVS

SEQ ID NO: 75741 - protein, 13 aa, Borrelia burgdorferi B31
AKYANSNIKVVSQ

SEQ ID NO: 75742 - protein, 13 aa, Borrelia burgdorferi B31
KYANSNIKVVSQY

SEQ ID NO: 75743 - protein, 13 aa, Borrelia burgdorferi B31
YANSNIKVVSQYV

SEQ ID NO: 75744 - protein, 13 aa, Borrelia burgdorferi B31
ANSNIKVVSQYVG

SEQ ID NO: 75745 - protein, 13 aa, Borrelia burgdorferi B31
NSNIKVVSQYVGT

SEQ ID NO: 75746 - protein, 13 aa, Borrelia burgdorferi B31
SNIKVVSQYVGTF

SEQ ID NO: 75747 - protein, 13 aa, Borrelia burgdorferi B31
NIKVVSQYVGTFG

SEQ ID NO: 75748 - protein, 13 aa, Borrelia burgdorferi B31
IKVVSQYVGTFGD

SEQ ID NO: 75749 - protein, 13 aa, Borrelia burgdorferi B31
KVVSQYVGTFGDF

SEQ ID NO: 75750 - protein, 13 aa, Borrelia burgdorferi B31
VVSQYVGTFGDFG

SEQ ID NO: 75751 - protein, 13 aa, Borrelia burgdorferi B31
VSQYVGTFGDFGL

SEQ ID NO: 75752 - protein, 13 aa, Borrelia burgdorferi B31
SQYVGTFGDFGLG

SEQ ID NO: 75753 - protein, 13 aa, Borrelia burgdorferi B31
QYVGTFGDFGLGR

SEQ ID NO: 75754 - protein, 13 aa, Borrelia burgdorferi B31
YVGTFGDFGLGRS

SEQ ID NO: 75755 - protein, 13 aa, Borrelia burgdorferi B31
VGTFGDFGLGRST

SEQ ID NO: 75756 - protein, 13 aa, Borrelia burgdorferi B31
GTFGDFGLGRSTA

SEQ ID NO: 75757 - protein, 13 aa, Borrelia burgdorferi B31
TFGDFGLGRSTAS

SEQ ID NO: 75758 - protein, 13 aa, Borrelia burgdorferi B31
FGDFGLGRSTASN

SEQ ID NO: 75759 - protein, 13 aa, Borrelia burgdorferi B31
GDFGLGRSTASNM

SEQ ID NO: 75760 - protein, 13 aa, Borrelia burgdorferi B31
DFGLGRSTASNMY

SEQ ID NO: 75761 - protein, 13 aa, Borrelia burgdorferi B31
FGLGRSTASNMYR

SEQ ID NO: 75762 - protein, 13 aa, Borrelia burgdorferi B31
GLGRSTASNMYRD

SEQ ID NO: 75763 - protein, 13 aa, Borrelia burgdorferi B31
LGRSTASNMYRDG

SEQ ID NO: 75764 - protein, 13 aa, Borrelia burgdorferi B31
GRSTASNMYRDGV

SEQ ID NO: 75765 - protein, 13 aa, Borrelia burgdorferi B31
RSTASNMYRDGVD

SEQ ID NO: 75766 - protein, 13 aa, Borrelia burgdorferi B31
STASNMYRDGVDI

SEQ ID NO: 75767 - protein, 13 aa, Borrelia burgdorferi B31
TASNMYRDGVDII

SEQ ID NO: 75768 - protein, 13 aa, Borrelia burgdorferi B31
ASNMYRDGVDIIF

SEQ ID NO: 75769 - protein, 13 aa, Borrelia burgdorferi B31
SNMYRDGVDIIFA

SEQ ID NO: 75770 - protein, 13 aa, Borrelia burgdorferi B31
NMYRDGVDIIFAA

SEQ ID NO: 75771 - protein, 13 aa, Borrelia burgdorferi B31
MYRDGVDIIFAAA

SEQ ID NO: 75772 - protein, 13 aa, Borrelia burgdorferi B31
YRDGVDIIFAAAG

SEQ ID NO: 75773 - protein, 13 aa, Borrelia burgdorferi B31
RDGVDIIFAAAGL

SEQ ID NO: 75774 - protein, 13 aa, Borrelia burgdorferi B31
DGVDIIFAAAGLS

SEQ ID NO: 75775 - protein, 13 aa, Borrelia burgdorferi B31
GVDIIFAAAGLSG

SEQ ID NO: 75776 - protein, 13 aa, Borrelia burgdorferi B31
VDIIFAAAGLSGI

SEQ ID NO: 75777 - protein, 13 aa, Borrelia burgdorferi B31
DIIFAAAGLSGIG

SEQ ID NO: 75778 - protein, 13 aa, Borrelia burgdorferi B31
IIFAAAGLSGIGV

SEQ ID NO: 75779 - protein, 13 aa, Borrelia burgdorferi B31
IFAAAGLSGIGVI

SEQ ID NO: 75780 - protein, 13 aa, Borrelia burgdorferi B31
FAAAGLSGIGVIE

SEQ ID NO: 75781 - protein, 13 aa, Borrelia burgdorferi B31
AAAGLSGIGVIEA

SEQ ID NO: 75782 - protein, 13 aa, Borrelia burgdorferi B31
AAGLSGIGVIEAA

SEQ ID NO: 75783 - protein, 13 aa, Borrelia burgdorferi B31
AGLSGIGVIEAAK

SEQ ID NO: 75784 - protein, 13 aa, Borrelia burgdorferi B31
GLSGIGVIEAAKE

SEQ ID NO: 75785 - protein, 13 aa, Borrelia burgdorferi B31
LSGIGVIEAAKEL

SEQ ID NO: 75786 - protein, 13 aa, Borrelia burgdorferi B31
SGIGVIEAAKELG

SEQ ID NO: 75787 - protein, 13 aa, Borrelia burgdorferi B31
GIGVIEAAKELGP

SEQ ID NO: 75788 - protein, 13 aa, Borrelia burgdorferi B31
IGVIEAAKELGPD

SEQ ID NO: 75789 - protein, 13 aa, Borrelia burgdorferi B31
GVIEAAKELGPDH

SEQ ID NO: 75790 - protein, 13 aa, Borrelia burgdorferi B31
VIEAAKELGPDHY

SEQ ID NO: 75791 - protein, 13 aa, Borrelia burgdorferi B31
IEAAKELGPDHYI

SEQ ID NO: 75792 - protein, 13 aa, Borrelia burgdorferi B31
EAAKELGPDHYII

SEQ ID NO: 75793 - protein, 13 aa, Borrelia burgdorferi B31
AAKELGPDHYIIG

SEQ ID NO: 75794 - protein, 13 aa, Borrelia burgdorferi B31
AKELGPDHYIIGV

SEQ ID NO: 75795 - protein, 13 aa, Borrelia burgdorferi B31
KELGPDHYIIGVD

SEQ ID NO: 75796 - protein, 13 aa, Borrelia burgdorferi B31
ELGPDHYIIGVDQ

SEQ ID NO: 75797 - protein, 13 aa, Borrelia burgdorferi B31
LGPDHYIIGVDQD

SEQ ID NO: 75798 - protein, 13 aa, Borrelia burgdorferi B31
GPDHYIIGVDQDQ

SEQ ID NO: 75799 - protein, 13 aa, Borrelia burgdorferi B31
PDHYIIGVDQDQS

SEQ ID NO: 75800 - protein, 13 aa, Borrelia burgdorferi B31
DHYIIGVDQDQSY

SEQ ID NO: 75801 - protein, 13 aa, Borrelia burgdorferi B31
HYIIGVDQDQSYL

SEQ ID NO: 75802 - protein, 13 aa, Borrelia burgdorferi B31
YIIGVDQDQSYLA

SEQ ID NO: 75803 - protein, 13 aa, Borrelia burgdorferi B31
IIGVDQDQSYLAP

SEQ ID NO: 75804 - protein, 13 aa, Borrelia burgdorferi B31
IGVDQDQSYLAPN

SEQ ID NO: 75805 - protein, 13 aa, Borrelia burgdorferi B31
GVDQDQSYLAPNN

SEQ ID NO: 75806 - protein, 13 aa, Borrelia burgdorferi B31
VDQDQSYLAPNNV

SEQ ID NO: 75807 - protein, 13 aa, Borrelia burgdorferi B31
DQDQSYLAPNNVI

SEQ ID NO: 75808 - protein, 13 aa, Borrelia burgdorferi B31
QDQSYLAPNNVIV

SEQ ID NO: 75809 - protein, 13 aa, Borrelia burgdorferi B31
DQSYLAPNNVIVS

SEQ ID NO: 75810 - protein, 13 aa, Borrelia burgdorferi B31
QSYLAPNNVIVSA

SEQ ID NO: 75811 - protein, 13 aa, Borrelia burgdorferi B31
SYLAPNNVIVSAV

SEQ ID NO: 75812 - protein, 13 aa, Borrelia burgdorferi B31
YLAPNNVIVSAVK

SEQ ID NO: 75813 - protein, 13 aa, Borrelia burgdorferi B31
LAPNNVIVSAVKK

SEQ ID NO: 75814 - protein, 13 aa, Borrelia burgdorferi B31
APNNVIVSAVKKV

SEQ ID NO: 75815 - protein, 13 aa, Borrelia burgdorferi B31
PNNVIVSAVKKVD

SEQ ID NO: 75816 - protein, 13 aa, Borrelia burgdorferi B31
NNVIVSAVKKVDS

SEQ ID NO: 75817 - protein, 13 aa, Borrelia burgdorferi B31
NVIVSAVKKVDSL

SEQ ID NO: 75818 - protein, 13 aa, Borrelia burgdorferi B31
VIVSAVKKVDSLM

SEQ ID NO: 75819 - protein, 13 aa, Borrelia burgdorferi B31
IVSAVKKVDSLMY

SEQ ID NO: 75820 - protein, 13 aa, Borrelia burgdorferi B31
VSAVKKVDSLMYS

SEQ ID NO: 75821 - protein, 13 aa, Borrelia burgdorferi B31
SAVKKVDSLMYSL

SEQ ID NO: 75822 - protein, 13 aa, Borrelia burgdorferi B31
AVKKVDSLMYSLT

SEQ ID NO: 75823 - protein, 13 aa, Borrelia burgdorferi B31
VKKVDSLMYSLTK

SEQ ID NO: 75824 - protein, 13 aa, Borrelia burgdorferi B31
KKVDSLMYSLTKK

SEQ ID NO: 75825 - protein, 13 aa, Borrelia burgdorferi B31
KVDSLMYSLTKKY

SEQ ID NO: 75826 - protein, 13 aa, Borrelia burgdorferi B31
VDSLMYSLTKKYL

SEQ ID NO: 75827 - protein, 13 aa, Borrelia burgdorferi B31
DSLMYSLTKKYLE

SEQ ID NO: 75828 - protein, 13 aa, Borrelia burgdorferi B31
SLMYSLTKKYLET

SEQ ID NO: 75829 - protein, 13 aa, Borrelia burgdorferi B31
LMYSLTKKYLETG

SEQ ID NO: 75830 - protein, 13 aa, Borrelia burgdorferi B31
MYSLTKKYLETGV

SEQ ID NO: 75831 - protein, 13 aa, Borrelia burgdorferi B31
YSLTKKYLETGVL

SEQ ID NO: 75832 - protein, 13 aa, Borrelia burgdorferi B31
SLTKKYLETGVLD

SEQ ID NO: 75833 - protein, 13 aa, Borrelia burgdorferi B31
LTKKYLETGVLDG

SEQ ID NO: 75834 - protein, 13 aa, Borrelia burgdorferi B31
TKKYLETGVLDGG

SEQ ID NO: 75835 - protein, 13 aa, Borrelia burgdorferi B31
KKYLETGVLDGGK

SEQ ID NO: 75836 - protein, 13 aa, Borrelia burgdorferi B31
KYLETGVLDGGKT

SEQ ID NO: 75837 - protein, 13 aa, Borrelia burgdorferi B31
YLETGVLDGGKTM

SEQ ID NO: 75838 - protein, 13 aa, Borrelia burgdorferi B31
LETGVLDGGKTMF

SEQ ID NO: 75839 - protein, 13 aa, Borrelia burgdorferi B31
ETGVLDGGKTMFL

SEQ ID NO: 75840 - protein, 13 aa, Borrelia burgdorferi B31
TGVLDGGKTMFLG

SEQ ID NO: 75841 - protein, 13 aa, Borrelia burgdorferi B31
GVLDGGKTMFLGL

SEQ ID NO: 75842 - protein, 13 aa, Borrelia burgdorferi B31
VLDGGKTMFLGLK

SEQ ID NO: 75843 - protein, 13 aa, Borrelia burgdorferi B31
LDGGKTMFLGLKE

SEQ ID NO: 75844 - protein, 13 aa, Borrelia burgdorferi B31
DGGKTMFLGLKED

SEQ ID NO: 75845 - protein, 13 aa, Borrelia burgdorferi B31
GGKTMFLGLKEDG

SEQ ID NO: 75846 - protein, 13 aa, Borrelia burgdorferi B31
GKTMFLGLKEDGL

SEQ ID NO: 75847 - protein, 13 aa, Borrelia burgdorferi B31
KTMFLGLKEDGLG

SEQ ID NO: 75848 - protein, 13 aa, Borrelia burgdorferi B31
TMFLGLKEDGLGL

SEQ ID NO: 75849 - protein, 13 aa, Borrelia burgdorferi B31
MFLGLKEDGLGLV

SEQ ID NO: 75850 - protein, 13 aa, Borrelia burgdorferi B31
FLGLKEDGLGLVL

SEQ ID NO: 75851 - protein, 13 aa, Borrelia burgdorferi B31
LGLKEDGLGLVLN

SEQ ID NO: 75852 - protein, 13 aa, Borrelia burgdorferi B31
GLKEDGLGLVLNE

SEQ ID NO: 75853 - protein, 13 aa, Borrelia burgdorferi B31
LKEDGLGLVLNEN

SEQ ID NO: 75854 - protein, 13 aa, Borrelia burgdorferi B31
KEDGLGLVLNENL

SEQ ID NO: 75855 - protein, 13 aa, Borrelia burgdorferi B31
EDGLGLVLNENLK

SEQ ID NO: 75856 - protein, 13 aa, Borrelia burgdorferi B31
DGLGLVLNENLKS

SEQ ID NO: 75857 - protein, 13 aa, Borrelia burgdorferi B31
GLGLVLNENLKSN

SEQ ID NO: 75858 - protein, 13 aa, Borrelia burgdorferi B31
LGLVLNENLKSNY

SEQ ID NO: 75859 - protein, 13 aa, Borrelia burgdorferi B31
GLVLNENLKSNYS

SEQ ID NO: 75860 - protein, 13 aa, Borrelia burgdorferi B31
LVLNENLKSNYSE

SEQ ID NO: 75861 - protein, 13 aa, Borrelia burgdorferi B31
VLNENLKSNYSEI

SEQ ID NO: 75862 - protein, 13 aa, Borrelia burgdorferi B31
LNENLKSNYSEIY

SEQ ID NO: 75863 - protein, 13 aa, Borrelia burgdorferi B31
NENLKSNYSEIYN

SEQ ID NO: 75864 - protein, 13 aa, Borrelia burgdorferi B31
ENLKSNYSEIYNK

SEQ ID NO: 75865 - protein, 13 aa, Borrelia burgdorferi B31
NLKSNYSEIYNKS

SEQ ID NO: 75866 - protein, 13 aa, Borrelia burgdorferi B31
LKSNYSEIYNKSL

SEQ ID NO: 75867 - protein, 13 aa, Borrelia burgdorferi B31
KSNYSEIYNKSLK

SEQ ID NO: 75868 - protein, 13 aa, Borrelia burgdorferi B31
SNYSEIYNKSLKI

SEQ ID NO: 75869 - protein, 13 aa, Borrelia burgdorferi B31
NYSEIYNKSLKIG

SEQ ID NO: 75870 - protein, 13 aa, Borrelia burgdorferi B31
YSEIYNKSLKIGQ

SEQ ID NO: 75871 - protein, 13 aa, Borrelia burgdorferi B31
SEIYNKSLKIGQS

SEQ ID NO: 75872 - protein, 13 aa, Borrelia burgdorferi B31
EIYNKSLKIGQSI

SEQ ID NO: 75873 - protein, 13 aa, Borrelia burgdorferi B31
IYNKSLKIGQSIM

SEQ ID NO: 75874 - protein, 13 aa, Borrelia burgdorferi B31
YNKSLKIGQSIMN

SEQ ID NO: 75875 - protein, 13 aa, Borrelia burgdorferi B31
NKSLKIGQSIMNG

SEQ ID NO: 75876 - protein, 13 aa, Borrelia burgdorferi B31
KSLKIGQSIMNGI

SEQ ID NO: 75877 - protein, 13 aa, Borrelia burgdorferi B31
SLKIGQSIMNGII

SEQ ID NO: 75878 - protein, 13 aa, Borrelia burgdorferi B31
LKIGQSIMNGIIK

SEQ ID NO: 75879 - protein, 13 aa, Borrelia burgdorferi B31
KIGQSIMNGIIKV

SEQ ID NO: 75880 - protein, 13 aa, Borrelia burgdorferi B31
IGQSIMNGIIKVP

SEQ ID NO: 75881 - protein, 13 aa, Borrelia burgdorferi B31
GQSIMNGIIKVPY

SEQ ID NO: 75882 - protein, 13 aa, Borrelia burgdorferi B31
QSIMNGIIKVPYD

SEQ ID NO: 75883 - protein, 13 aa, Borrelia burgdorferi B31
SIMNGIIKVPYDK

SEQ ID NO: 75884 - protein, 13 aa, Borrelia burgdorferi B31
IMNGIIKVPYDKV

SEQ ID NO: 75885 - protein, 13 aa, Borrelia burgdorferi B31
MNGIIKVPYDKVS

SEQ ID NO: 75886 - protein, 13 aa, Borrelia burgdorferi B31
NGIIKVPYDKVSY

SEQ ID NO: 75887 - protein, 13 aa, Borrelia burgdorferi B31
GIIKVPYDKVSYF

SEQ ID NO: 75888 - protein, 13 aa, Borrelia burgdorferi B31
IIKVPYDKVSYFV

SEQ ID NO: 75889 - protein, 13 aa, Borrelia burgdorferi B31
IKVPYDKVSYFVL

SEQ ID NO: 75890 - protein, 13 aa, Borrelia burgdorferi B31
KVPYDKVSYFVLQ

SEQ ID NO: 75891 - protein, 13 aa, Borrelia burgdorferi B31
VPYDKVSYFVLQM

SEQ ID NO: 75892 - protein, 13 aa, Borrelia burgdorferi B31
PYDKVSYFVLQME

SEQ ID NO: 75893 - protein, 13 aa, Borrelia burgdorferi B31
YDKVSYFVLQMEN

SEQ ID NO: 75894 - protein, 14 aa, Borrelia burgdorferi B31
MDNYYEIYFLYFFI

SEQ ID NO: 75895 - protein, 14 aa, Borrelia burgdorferi B31
DNYYEIYFLYFFIK

SEQ ID NO: 75896 - protein, 14 aa, Borrelia burgdorferi B31
NYYEIYFLYFFIKS

SEQ ID NO: 75897 - protein, 14 aa, Borrelia burgdorferi B31
YYEIYFLYFFIKSK

SEQ ID NO: 75898 - protein, 14 aa, Borrelia burgdorferi B31
YEIYFLYFFIKSKE

SEQ ID NO: 75899 - protein, 14 aa, Borrelia burgdorferi B31
EIYFLYFFIKSKED

SEQ ID NO: 75900 - protein, 14 aa, Borrelia burgdorferi B31
IYFLYFFIKSKEDI

SEQ ID NO: 75901 - protein, 14 aa, Borrelia burgdorferi B31
YFLYFFIKSKEDIF

SEQ ID NO: 75902 - protein, 14 aa, Borrelia burgdorferi B31
FLYFFIKSKEDIFM

SEQ ID NO: 75903 - protein, 14 aa, Borrelia burgdorferi B31
LYFFIKSKEDIFML

SEQ ID NO: 75904 - protein, 14 aa, Borrelia burgdorferi B31
YFFIKSKEDIFMLK

SEQ ID NO: 75905 - protein, 14 aa, Borrelia burgdorferi B31
FFIKSKEDIFMLKK

SEQ ID NO: 75906 - protein, 14 aa, Borrelia burgdorferi B31
FIKSKEDIFMLKKV

SEQ ID NO: 75907 - protein, 14 aa, Borrelia burgdorferi B31
IKSKEDIFMLKKVY

SEQ ID NO: 75908 - protein, 14 aa, Borrelia burgdorferi B31
KSKEDIFMLKKVYY

SEQ ID NO: 75909 - protein, 14 aa, Borrelia burgdorferi B31
SKEDIFMLKKVYYF

SEQ ID NO: 75910 - protein, 14 aa, Borrelia burgdorferi B31
KEDIFMLKKVYYFL

SEQ ID NO: 75911 - protein, 14 aa, Borrelia burgdorferi B31
EDIFMLKKVYYFLI

SEQ ID NO: 75912 - protein, 14 aa, Borrelia burgdorferi B31
DIFMLKKVYYFLIF

SEQ ID NO: 75913 - protein, 14 aa, Borrelia burgdorferi B31
IFMLKKVYYFLIFL

SEQ ID NO: 75914 - protein, 14 aa, Borrelia burgdorferi B31
FMLKKVYYFLIFLF

SEQ ID NO: 75915 - protein, 14 aa, Borrelia burgdorferi B31
MLKKVYYFLIFLFI

SEQ ID NO: 75916 - protein, 14 aa, Borrelia burgdorferi B31
LKKVYYFLIFLFIV

SEQ ID NO: 75917 - protein, 14 aa, Borrelia burgdorferi B31
KKVYYFLIFLFIVA

SEQ ID NO: 75918 - protein, 14 aa, Borrelia burgdorferi B31
KVYYFLIFLFIVAC

SEQ ID NO: 75919 - protein, 14 aa, Borrelia burgdorferi B31
VYYFLIFLFIVACS

SEQ ID NO: 75920 - protein, 14 aa, Borrelia burgdorferi B31
YYFLIFLFIVACSS

SEQ ID NO: 75921 - protein, 14 aa, Borrelia burgdorferi B31
YFLIFLFIVACSSS

SEQ ID NO: 75922 - protein, 14 aa, Borrelia burgdorferi B31
FLIFLFIVACSSSD

SEQ ID NO: 75923 - protein, 14 aa, Borrelia burgdorferi B31
LIFLFIVACSSSDD

SEQ ID NO: 75924 - protein, 14 aa, Borrelia burgdorferi B31
IFLFIVACSSSDDG

SEQ ID NO: 75925 - protein, 14 aa, Borrelia burgdorferi B31
FLFIVACSSSDDGK

SEQ ID NO: 75926 - protein, 14 aa, Borrelia burgdorferi B31
LFIVACSSSDDGKS

SEQ ID NO: 75927 - protein, 14 aa, Borrelia burgdorferi B31
FIVACSSSDDGKSE

SEQ ID NO: 75928 - protein, 14 aa, Borrelia burgdorferi B31
IVACSSSDDGKSEA

SEQ ID NO: 75929 - protein, 14 aa, Borrelia burgdorferi B31
VACSSSDDGKSEAK

SEQ ID NO: 75930 - protein, 14 aa, Borrelia burgdorferi B31
ACSSSDDGKSEAKT

SEQ ID NO: 75931 - protein, 14 aa, Borrelia burgdorferi B31
CSSSDDGKSEAKTV

SEQ ID NO: 75932 - protein, 14 aa, Borrelia burgdorferi B31
SSSDDGKSEAKTVS

SEQ ID NO: 75933 - protein, 14 aa, Borrelia burgdorferi B31
SSDDGKSEAKTVSL

SEQ ID NO: 75934 - protein, 14 aa, Borrelia burgdorferi B31
SDDGKSEAKTVSLI

SEQ ID NO: 75935 - protein, 14 aa, Borrelia burgdorferi B31
DDGKSEAKTVSLIV

SEQ ID NO: 75936 - protein, 14 aa, Borrelia burgdorferi B31
DGKSEAKTVSLIVD

SEQ ID NO: 75937 - protein, 14 aa, Borrelia burgdorferi B31
GKSEAKTVSLIVDG

SEQ ID NO: 75938 - protein, 14 aa, Borrelia burgdorferi B31
KSEAKTVSLIVDGA

SEQ ID NO: 75939 - protein, 14 aa, Borrelia burgdorferi B31
SEAKTVSLIVDGAF

SEQ ID NO: 75940 - protein, 14 aa, Borrelia burgdorferi B31
EAKTVSLIVDGAFD

SEQ ID NO: 75941 - protein, 14 aa, Borrelia burgdorferi B31
AKTVSLIVDGAFDD

SEQ ID NO: 75942 - protein, 14 aa, Borrelia burgdorferi B31
KTVSLIVDGAFDDK

SEQ ID NO: 75943 - protein, 14 aa, Borrelia burgdorferi B31
TVSLIVDGAFDDKG

SEQ ID NO: 75944 - protein, 14 aa, Borrelia burgdorferi B31
VSLIVDGAFDDKGF

SEQ ID NO: 75945 - protein, 14 aa, Borrelia burgdorferi B31
SLIVDGAFDDKGFN

SEQ ID NO: 75946 - protein, 14 aa, Borrelia burgdorferi B31
LIVDGAFDDKGFNE

SEQ ID NO: 75947 - protein, 14 aa, Borrelia burgdorferi B31
IVDGAFDDKGFNES

SEQ ID NO: 75948 - protein, 14 aa, Borrelia burgdorferi B31
VDGAFDDKGFNESS

SEQ ID NO: 75949 - protein, 14 aa, Borrelia burgdorferi B31
DGAFDDKGFNESSS

SEQ ID NO: 75950 - protein, 14 aa, Borrelia burgdorferi B31
GAFDDKGFNESSSK

SEQ ID NO: 75951 - protein, 14 aa, Borrelia burgdorferi B31
AFDDKGFNESSSKA

SEQ ID NO: 75952 - protein, 14 aa, Borrelia burgdorferi B31
FDDKGFNESSSKAI

SEQ ID NO: 75953 - protein, 14 aa, Borrelia burgdorferi B31
DDKGFNESSSKAIR

SEQ ID NO: 75954 - protein, 14 aa, Borrelia burgdorferi B31
DKGFNESSSKAIRK

SEQ ID NO: 75955 - protein, 14 aa, Borrelia burgdorferi B31
KGFNESSSKAIRKL

SEQ ID NO: 75956 - protein, 14 aa, Borrelia burgdorferi B31
GFNESSSKAIRKLK

SEQ ID NO: 75957 - protein, 14 aa, Borrelia burgdorferi B31
FNESSSKAIRKLKA

SEQ ID NO: 75958 - protein, 14 aa, Borrelia burgdorferi B31
NESSSKAIRKLKAD

SEQ ID NO: 75959 - protein, 14 aa, Borrelia burgdorferi B31
ESSSKAIRKLKADL

SEQ ID NO: 75960 - protein, 14 aa, Borrelia burgdorferi B31
SSSKAIRKLKADLN

SEQ ID NO: 75961 - protein, 14 aa, Borrelia burgdorferi B31
SSKAIRKLKADLNI

SEQ ID NO: 75962 - protein, 14 aa, Borrelia burgdorferi B31
SKAIRKLKADLNIN

SEQ ID NO: 75963 - protein, 14 aa, Borrelia burgdorferi B31
KAIRKLKADLNINI

SEQ ID NO: 75964 - protein, 14 aa, Borrelia burgdorferi B31
AIRKLKADLNINII

SEQ ID NO: 75965 - protein, 14 aa, Borrelia burgdorferi B31
IRKLKADLNINIIE

SEQ ID NO: 75966 - protein, 14 aa, Borrelia burgdorferi B31
RKLKADLNINIIEK

SEQ ID NO: 75967 - protein, 14 aa, Borrelia burgdorferi B31
KLKADLNINIIEKA

SEQ ID NO: 75968 - protein, 14 aa, Borrelia burgdorferi B31
LKADLNINIIEKAS

SEQ ID NO: 75969 - protein, 14 aa, Borrelia burgdorferi B31
KADLNINIIEKAST

SEQ ID NO: 75970 - protein, 14 aa, Borrelia burgdorferi B31
ADLNINIIEKASTG

SEQ ID NO: 75971 - protein, 14 aa, Borrelia burgdorferi B31
DLNINIIEKASTGN

SEQ ID NO: 75972 - protein, 14 aa, Borrelia burgdorferi B31
LNINIIEKASTGNS

SEQ ID NO: 75973 - protein, 14 aa, Borrelia burgdorferi B31
NINIIEKASTGNSY

SEQ ID NO: 75974 - protein, 14 aa, Borrelia burgdorferi B31
INIIEKASTGNSYL

SEQ ID NO: 75975 - protein, 14 aa, Borrelia burgdorferi B31
NIIEKASTGNSYLG

SEQ ID NO: 75976 - protein, 14 aa, Borrelia burgdorferi B31
IIEKASTGNSYLGD

SEQ ID NO: 75977 - protein, 14 aa, Borrelia burgdorferi B31
IEKASTGNSYLGDI

SEQ ID NO: 75978 - protein, 14 aa, Borrelia burgdorferi B31
EKASTGNSYLGDIA

SEQ ID NO: 75979 - protein, 14 aa, Borrelia burgdorferi B31
KASTGNSYLGDIAN

SEQ ID NO: 75980 - protein, 14 aa, Borrelia burgdorferi B31
ASTGNSYLGDIANL

SEQ ID NO: 75981 - protein, 14 aa, Borrelia burgdorferi B31
STGNSYLGDIANLE

SEQ ID NO: 75982 - protein, 14 aa, Borrelia burgdorferi B31
TGNSYLGDIANLED

SEQ ID NO: 75983 - protein, 14 aa, Borrelia burgdorferi B31
GNSYLGDIANLEDG

SEQ ID NO: 75984 - protein, 14 aa, Borrelia burgdorferi B31
NSYLGDIANLEDGN

SEQ ID NO: 75985 - protein, 14 aa, Borrelia burgdorferi B31
SYLGDIANLEDGNS

SEQ ID NO: 75986 - protein, 14 aa, Borrelia burgdorferi B31
YLGDIANLEDGNSN

SEQ ID NO: 75987 - protein, 14 aa, Borrelia burgdorferi B31
LGDIANLEDGNSNL

SEQ ID NO: 75988 - protein, 14 aa, Borrelia burgdorferi B31
GDIANLEDGNSNLI

SEQ ID NO: 75989 - protein, 14 aa, Borrelia burgdorferi B31
DIANLEDGNSNLIW

SEQ ID NO: 75990 - protein, 14 aa, Borrelia burgdorferi B31
IANLEDGNSNLIWG

SEQ ID NO: 75991 - protein, 14 aa, Borrelia burgdorferi B31
ANLEDGNSNLIWGI

SEQ ID NO: 75992 - protein, 14 aa, Borrelia burgdorferi B31
NLEDGNSNLIWGIG

SEQ ID NO: 75993 - protein, 14 aa, Borrelia burgdorferi B31
LEDGNSNLIWGIGF

SEQ ID NO: 75994 - protein, 14 aa, Borrelia burgdorferi B31
EDGNSNLIWGIGFR

SEQ ID NO: 75995 - protein, 14 aa, Borrelia burgdorferi B31
DGNSNLIWGIGFRL

SEQ ID NO: 75996 - protein, 14 aa, Borrelia burgdorferi B31
GNSNLIWGIGFRLS

SEQ ID NO: 75997 - protein, 14 aa, Borrelia burgdorferi B31
NSNLIWGIGFRLSD

SEQ ID NO: 75998 - protein, 14 aa, Borrelia burgdorferi B31
SNLIWGIGFRLSDI

SEQ ID NO: 75999 - protein, 14 aa, Borrelia burgdorferi B31
NLIWGIGFRLSDIL

SEQ ID NO: 76000 - protein, 14 aa, Borrelia burgdorferi B31
LIWGIGFRLSDILF

SEQ ID NO: 76001 - protein, 14 aa, Borrelia burgdorferi B31
IWGIGFRLSDILFQ

SEQ ID NO: 76002 - protein, 14 aa, Borrelia burgdorferi B31
WGIGFRLSDILFQR

SEQ ID NO: 76003 - protein, 14 aa, Borrelia burgdorferi B31
GIGFRLSDILFQRA

SEQ ID NO: 76004 - protein, 14 aa, Borrelia burgdorferi B31
IGFRLSDILFQRAS

SEQ ID NO: 76005 - protein, 14 aa, Borrelia burgdorferi B31
GFRLSDILFQRASE

SEQ ID NO: 76006 - protein, 14 aa, Borrelia burgdorferi B31
FRLSDILFQRASEN

SEQ ID NO: 76007 - protein, 14 aa, Borrelia burgdorferi B31
RLSDILFQRASENV

SEQ ID NO: 76008 - protein, 14 aa, Borrelia burgdorferi B31
LSDILFQRASENVS

SEQ ID NO: 76009 - protein, 14 aa, Borrelia burgdorferi B31
SDILFQRASENVSV

SEQ ID NO: 76010 - protein, 14 aa, Borrelia burgdorferi B31
DILFQRASENVSVN

SEQ ID NO: 76011 - protein, 14 aa, Borrelia burgdorferi B31
ILFQRASENVSVNY

SEQ ID NO: 76012 - protein, 14 aa, Borrelia burgdorferi B31
LFQRASENVSVNYA

SEQ ID NO: 76013 - protein, 14 aa, Borrelia burgdorferi B31
FQRASENVSVNYAI

SEQ ID NO: 76014 - protein, 14 aa, Borrelia burgdorferi B31
QRASENVSVNYAII

SEQ ID NO: 76015 - protein, 14 aa, Borrelia burgdorferi B31
RASENVSVNYAIIE

SEQ ID NO: 76016 - protein, 14 aa, Borrelia burgdorferi B31
ASENVSVNYAIIEG

SEQ ID NO: 76017 - protein, 14 aa, Borrelia burgdorferi B31
SENVSVNYAIIEGV

SEQ ID NO: 76018 - protein, 14 aa, Borrelia burgdorferi B31
ENVSVNYAIIEGVY

SEQ ID NO: 76019 - protein, 14 aa, Borrelia burgdorferi B31
NVSVNYAIIEGVYD

SEQ ID NO: 76020 - protein, 14 aa, Borrelia burgdorferi B31
VSVNYAIIEGVYDE

SEQ ID NO: 76021 - protein, 14 aa, Borrelia burgdorferi B31
SVNYAIIEGVYDEI

SEQ ID NO: 76022 - protein, 14 aa, Borrelia burgdorferi B31
VNYAIIEGVYDEIQ

SEQ ID NO: 76023 - protein, 14 aa, Borrelia burgdorferi B31
NYAIIEGVYDEIQI

SEQ ID NO: 76024 - protein, 14 aa, Borrelia burgdorferi B31
YAIIEGVYDEIQIP

SEQ ID NO: 76025 - protein, 14 aa, Borrelia burgdorferi B31
AIIEGVYDEIQIPK

SEQ ID NO: 76026 - protein, 14 aa, Borrelia burgdorferi B31
IIEGVYDEIQIPKN

SEQ ID NO: 76027 - protein, 14 aa, Borrelia burgdorferi B31
IEGVYDEIQIPKNL

SEQ ID NO: 76028 - protein, 14 aa, Borrelia burgdorferi B31
EGVYDEIQIPKNLL

SEQ ID NO: 76029 - protein, 14 aa, Borrelia burgdorferi B31
GVYDEIQIPKNLLN

SEQ ID NO: 76030 - protein, 14 aa, Borrelia burgdorferi B31
VYDEIQIPKNLLNI

SEQ ID NO: 76031 - protein, 14 aa, Borrelia burgdorferi B31
YDEIQIPKNLLNIS

SEQ ID NO: 76032 - protein, 14 aa, Borrelia burgdorferi B31
DEIQIPKNLLNISF

SEQ ID NO: 76033 - protein, 14 aa, Borrelia burgdorferi B31
EIQIPKNLLNISFR

SEQ ID NO: 76034 - protein, 14 aa, Borrelia burgdorferi B31
IQIPKNLLNISFRS

SEQ ID NO: 76035 - protein, 14 aa, Borrelia burgdorferi B31
QIPKNLLNISFRSE

SEQ ID NO: 76036 - protein, 14 aa, Borrelia burgdorferi B31
IPKNLLNISFRSEE

SEQ ID NO: 76037 - protein, 14 aa, Borrelia burgdorferi B31
PKNLLNISFRSEEV

SEQ ID NO: 76038 - protein, 14 aa, Borrelia burgdorferi B31
KNLLNISFRSEEVA

SEQ ID NO: 76039 - protein, 14 aa, Borrelia burgdorferi B31
NLLNISFRSEEVAF

SEQ ID NO: 76040 - protein, 14 aa, Borrelia burgdorferi B31
LLNISFRSEEVAFL

SEQ ID NO: 76041 - protein, 14 aa, Borrelia burgdorferi B31
LNISFRSEEVAFLA

SEQ ID NO: 76042 - protein, 14 aa, Borrelia burgdorferi B31
NISFRSEEVAFLAG

SEQ ID NO: 76043 - protein, 14 aa, Borrelia burgdorferi B31
ISFRSEEVAFLAGY

SEQ ID NO: 76044 - protein, 14 aa, Borrelia burgdorferi B31
SFRSEEVAFLAGYF

SEQ ID NO: 76045 - protein, 14 aa, Borrelia burgdorferi B31
FRSEEVAFLAGYFA

SEQ ID NO: 76046 - protein, 14 aa, Borrelia burgdorferi B31
RSEEVAFLAGYFAS

SEQ ID NO: 76047 - protein, 14 aa, Borrelia burgdorferi B31
SEEVAFLAGYFASK

SEQ ID NO: 76048 - protein, 14 aa, Borrelia burgdorferi B31
EEVAFLAGYFASKA

SEQ ID NO: 76049 - protein, 14 aa, Borrelia burgdorferi B31
EVAFLAGYFASKAS

SEQ ID NO: 76050 - protein, 14 aa, Borrelia burgdorferi B31
VAFLAGYFASKASK

SEQ ID NO: 76051 - protein, 14 aa, Borrelia burgdorferi B31
AFLAGYFASKASKT

SEQ ID NO: 76052 - protein, 14 aa, Borrelia burgdorferi B31
FLAGYFASKASKTG

SEQ ID NO: 76053 - protein, 14 aa, Borrelia burgdorferi B31
LAGYFASKASKTGK

SEQ ID NO: 76054 - protein, 14 aa, Borrelia burgdorferi B31
AGYFASKASKTGKI

SEQ ID NO: 76055 - protein, 14 aa, Borrelia burgdorferi B31
GYFASKASKTGKIG

SEQ ID NO: 76056 - protein, 14 aa, Borrelia burgdorferi B31
YFASKASKTGKIGF

SEQ ID NO: 76057 - protein, 14 aa, Borrelia burgdorferi B31
FASKASKTGKIGFV

SEQ ID NO: 76058 - protein, 14 aa, Borrelia burgdorferi B31
ASKASKTGKIGFVG

SEQ ID NO: 76059 - protein, 14 aa, Borrelia burgdorferi B31
SKASKTGKIGFVGG

SEQ ID NO: 76060 - protein, 14 aa, Borrelia burgdorferi B31
KASKTGKIGFVGGV

SEQ ID NO: 76061 - protein, 14 aa, Borrelia burgdorferi B31
ASKTGKIGFVGGVR

SEQ ID NO: 76062 - protein, 14 aa, Borrelia burgdorferi B31
SKTGKIGFVGGVRG

SEQ ID NO: 76063 - protein, 14 aa, Borrelia burgdorferi B31
KTGKIGFVGGVRGK

SEQ ID NO: 76064 - protein, 14 aa, Borrelia burgdorferi B31
TGKIGFVGGVRGKV

SEQ ID NO: 76065 - protein, 14 aa, Borrelia burgdorferi B31
GKIGFVGGVRGKVL

SEQ ID NO: 76066 - protein, 14 aa, Borrelia burgdorferi B31
KIGFVGGVRGKVLE

SEQ ID NO: 76067 - protein, 14 aa, Borrelia burgdorferi B31
IGFVGGVRGKVLES

SEQ ID NO: 76068 - protein, 14 aa, Borrelia burgdorferi B31
GFVGGVRGKVLESF

SEQ ID NO: 76069 - protein, 14 aa, Borrelia burgdorferi B31
FVGGVRGKVLESFM

SEQ ID NO: 76070 - protein, 14 aa, Borrelia burgdorferi B31
VGGVRGKVLESFMY

SEQ ID NO: 76071 - protein, 14 aa, Borrelia burgdorferi B31
GGVRGKVLESFMYG

SEQ ID NO: 76072 - protein, 14 aa, Borrelia burgdorferi B31
GVRGKVLESFMYGY

SEQ ID NO: 76073 - protein, 14 aa, Borrelia burgdorferi B31
VRGKVLESFMYGYE

SEQ ID NO: 76074 - protein, 14 aa, Borrelia burgdorferi B31
RGKVLESFMYGYEA

SEQ ID NO: 76075 - protein, 14 aa, Borrelia burgdorferi B31
GKVLESFMYGYEAG

SEQ ID NO: 76076 - protein, 14 aa, Borrelia burgdorferi B31
KVLESFMYGYEAGA

SEQ ID NO: 76077 - protein, 14 aa, Borrelia burgdorferi B31
VLESFMYGYEAGAK

SEQ ID NO: 76078 - protein, 14 aa, Borrelia burgdorferi B31
LESFMYGYEAGAKY

SEQ ID NO: 76079 - protein, 14 aa, Borrelia burgdorferi B31
ESFMYGYEAGAKYA

SEQ ID NO: 76080 - protein, 14 aa, Borrelia burgdorferi B31
SFMYGYEAGAKYAN

SEQ ID NO: 76081 - protein, 14 aa, Borrelia burgdorferi B31
FMYGYEAGAKYANS

SEQ ID NO: 76082 - protein, 14 aa, Borrelia burgdorferi B31
MYGYEAGAKYANSN

SEQ ID NO: 76083 - protein, 14 aa, Borrelia burgdorferi B31
YGYEAGAKYANSNI

SEQ ID NO: 76084 - protein, 14 aa, Borrelia burgdorferi B31
GYEAGAKYANSNIK

SEQ ID NO: 76085 - protein, 14 aa, Borrelia burgdorferi B31
YEAGAKYANSNIKV

SEQ ID NO: 76086 - protein, 14 aa, Borrelia burgdorferi B31
EAGAKYANSNIKVV

SEQ ID NO: 76087 - protein, 14 aa, Borrelia burgdorferi B31
AGAKYANSNIKVVS

SEQ ID NO: 76088 - protein, 14 aa, Borrelia burgdorferi B31
GAKYANSNIKVVSQ

SEQ ID NO: 76089 - protein, 14 aa, Borrelia burgdorferi B31
AKYANSNIKVVSQY

SEQ ID NO: 76090 - protein, 14 aa, Borrelia burgdorferi B31
KYANSNIKVVSQYV

SEQ ID NO: 76091 - protein, 14 aa, Borrelia burgdorferi B31
YANSNIKVVSQYVG

SEQ ID NO: 76092 - protein, 14 aa, Borrelia burgdorferi B31
ANSNIKVVSQYVGT

SEQ ID NO: 76093 - protein, 14 aa, Borrelia burgdorferi B31
NSNIKVVSQYVGTF

SEQ ID NO: 76094 - protein, 14 aa, Borrelia burgdorferi B31
SNIKVVSQYVGTFG

SEQ ID NO: 76095 - protein, 14 aa, Borrelia burgdorferi B31
NIKVVSQYVGTFGD

SEQ ID NO: 76096 - protein, 14 aa, Borrelia burgdorferi B31
IKVVSQYVGTFGDF

SEQ ID NO: 76097 - protein, 14 aa, Borrelia burgdorferi B31
KVVSQYVGTFGDFG

SEQ ID NO: 76098 - protein, 14 aa, Borrelia burgdorferi B31
VVSQYVGTFGDFGL

SEQ ID NO: 76099 - protein, 14 aa, Borrelia burgdorferi B31
VSQYVGTFGDFGLG

SEQ ID NO: 76100 - protein, 14 aa, Borrelia burgdorferi B31
SQYVGTFGDFGLGR

SEQ ID NO: 76101 - protein, 14 aa, Borrelia burgdorferi B31
QYVGTFGDFGLGRS

SEQ ID NO: 76102 - protein, 14 aa, Borrelia burgdorferi B31
YVGTFGDFGLGRST

SEQ ID NO: 76103 - protein, 14 aa, Borrelia burgdorferi B31
VGTFGDFGLGRSTA

SEQ ID NO: 76104 - protein, 14 aa, Borrelia burgdorferi B31
GTFGDFGLGRSTAS

SEQ ID NO: 76105 - protein, 14 aa, Borrelia burgdorferi B31
TFGDFGLGRSTASN

SEQ ID NO: 76106 - protein, 14 aa, Borrelia burgdorferi B31
FGDFGLGRSTASNM

SEQ ID NO: 76107 - protein, 14 aa, Borrelia burgdorferi B31
GDFGLGRSTASNMY

SEQ ID NO: 76108 - protein, 14 aa, Borrelia burgdorferi B31
DFGLGRSTASNMYR

SEQ ID NO: 76109 - protein, 14 aa, Borrelia burgdorferi B31
FGLGRSTASNMYRD

SEQ ID NO: 76110 - protein, 14 aa, Borrelia burgdorferi B31
GLGRSTASNMYRDG

SEQ ID NO: 76111 - protein, 14 aa, Borrelia burgdorferi B31
LGRSTASNMYRDGV

SEQ ID NO: 76112 - protein, 14 aa, Borrelia burgdorferi B31
GRSTASNMYRDGVD

SEQ ID NO: 76113 - protein, 14 aa, Borrelia burgdorferi B31
RSTASNMYRDGVDI

SEQ ID NO: 76114 - protein, 14 aa, Borrelia burgdorferi B31
STASNMYRDGVDII

SEQ ID NO: 76115 - protein, 14 aa, Borrelia burgdorferi B31
TASNMYRDGVDIIF

SEQ ID NO: 76116 - protein, 14 aa, Borrelia burgdorferi B31
ASNMYRDGVDIIFA

SEQ ID NO: 76117 - protein, 14 aa, Borrelia burgdorferi B31
SNMYRDGVDIIFAA

SEQ ID NO: 76118 - protein, 14 aa, Borrelia burgdorferi B31
NMYRDGVDIIFAAA

SEQ ID NO: 76119 - protein, 14 aa, Borrelia burgdorferi B31
MYRDGVDIIFAAAG

SEQ ID NO: 76120 - protein, 14 aa, Borrelia burgdorferi B31
YRDGVDIIFAAAGL

SEQ ID NO: 76121 - protein, 14 aa, Borrelia burgdorferi B31
RDGVDIIFAAAGLS

SEQ ID NO: 76122 - protein, 14 aa, Borrelia burgdorferi B31
DGVDIIFAAAGLSG

SEQ ID NO: 76123 - protein, 14 aa, Borrelia burgdorferi B31
GVDIIFAAAGLSGI

SEQ ID NO: 76124 - protein, 14 aa, Borrelia burgdorferi B31
VDIIFAAAGLSGIG

SEQ ID NO: 76125 - protein, 14 aa, Borrelia burgdorferi B31
DIIFAAAGLSGIGV

SEQ ID NO: 76126 - protein, 14 aa, Borrelia burgdorferi B31
IIFAAAGLSGIGVI

SEQ ID NO: 76127 - protein, 14 aa, Borrelia burgdorferi B31
IFAAAGLSGIGVIE

SEQ ID NO: 76128 - protein, 14 aa, Borrelia burgdorferi B31
FAAAGLSGIGVIEA

SEQ ID NO: 76129 - protein, 14 aa, Borrelia burgdorferi B31
AAAGLSGIGVIEAA

SEQ ID NO: 76130 - protein, 14 aa, Borrelia burgdorferi B31
AAGLSGIGVIEAAK

SEQ ID NO: 76131 - protein, 14 aa, Borrelia burgdorferi B31
AGLSGIGVIEAAKE

SEQ ID NO: 76132 - protein, 14 aa, Borrelia burgdorferi B31
GLSGIGVIEAAKEL

SEQ ID NO: 76133 - protein, 14 aa, Borrelia burgdorferi B31
LSGIGVIEAAKELG

SEQ ID NO: 76134 - protein, 14 aa, Borrelia burgdorferi B31
SGIGVIEAAKELGP

SEQ ID NO: 76135 - protein, 14 aa, Borrelia burgdorferi B31
GIGVIEAAKELGPD

SEQ ID NO: 76136 - protein, 14 aa, Borrelia burgdorferi B31
IGVIEAAKELGPDH

SEQ ID NO: 76137 - protein, 14 aa, Borrelia burgdorferi B31
GVIEAAKELGPDHY

SEQ ID NO: 76138 - protein, 14 aa, Borrelia burgdorferi B31
VIEAAKELGPDHYI

SEQ ID NO: 76139 - protein, 14 aa, Borrelia burgdorferi B31
IEAAKELGPDHYII

SEQ ID NO: 76140 - protein, 14 aa, Borrelia burgdorferi B31
EAAKELGPDHYIIG

SEQ ID NO: 76141 - protein, 14 aa, Borrelia burgdorferi B31
AAKELGPDHYIIGV

SEQ ID NO: 76142 - protein, 14 aa, Borrelia burgdorferi B31
AKELGPDHYIIGVD

SEQ ID NO: 76143 - protein, 14 aa, Borrelia burgdorferi B31
KELGPDHYIIGVDQ

SEQ ID NO: 76144 - protein, 14 aa, Borrelia burgdorferi B31
ELGPDHYIIGVDQD

SEQ ID NO: 76145 - protein, 14 aa, Borrelia burgdorferi B31
LGPDHYIIGVDQDQ

SEQ ID NO: 76146 - protein, 14 aa, Borrelia burgdorferi B31
GPDHYIIGVDQDQS

SEQ ID NO: 76147 - protein, 14 aa, Borrelia burgdorferi B31
PDHYIIGVDQDQSY

SEQ ID NO: 76148 - protein, 14 aa, Borrelia burgdorferi B31
DHYIIGVDQDQSYL

SEQ ID NO: 76149 - protein, 14 aa, Borrelia burgdorferi B31
HYIIGVDQDQSYLA

SEQ ID NO: 76150 - protein, 14 aa, Borrelia burgdorferi B31
YIIGVDQDQSYLAP

SEQ ID NO: 76151 - protein, 14 aa, Borrelia burgdorferi B31
IIGVDQDQSYLAPN

SEQ ID NO: 76152 - protein, 14 aa, Borrelia burgdorferi B31
IGVDQDQSYLAPNN

SEQ ID NO: 76153 - protein, 14 aa, Borrelia burgdorferi B31
GVDQDQSYLAPNNV

SEQ ID NO: 76154 - protein, 14 aa, Borrelia burgdorferi B31
VDQDQSYLAPNNVI

SEQ ID NO: 76155 - protein, 14 aa, Borrelia burgdorferi B31
DQDQSYLAPNNVIV

SEQ ID NO: 76156 - protein, 14 aa, Borrelia burgdorferi B31
QDQSYLAPNNVIVS

SEQ ID NO: 76157 - protein, 14 aa, Borrelia burgdorferi B31
DQSYLAPNNVIVSA

SEQ ID NO: 76158 - protein, 14 aa, Borrelia burgdorferi B31
QSYLAPNNVIVSAV

SEQ ID NO: 76159 - protein, 14 aa, Borrelia burgdorferi B31
SYLAPNNVIVSAVK

SEQ ID NO: 76160 - protein, 14 aa, Borrelia burgdorferi B31
YLAPNNVIVSAVKK

SEQ ID NO: 76161 - protein, 14 aa, Borrelia burgdorferi B31
LAPNNVIVSAVKKV

SEQ ID NO: 76162 - protein, 14 aa, Borrelia burgdorferi B31
APNNVIVSAVKKVD

SEQ ID NO: 76163 - protein, 14 aa, Borrelia burgdorferi B31
PNNVIVSAVKKVDS

SEQ ID NO: 76164 - protein, 14 aa, Borrelia burgdorferi B31
NNVIVSAVKKVDSL

SEQ ID NO: 76165 - protein, 14 aa, Borrelia burgdorferi B31
NVIVSAVKKVDSLM

SEQ ID NO: 76166 - protein, 14 aa, Borrelia burgdorferi B31
VIVSAVKKVDSLMY

SEQ ID NO: 76167 - protein, 14 aa, Borrelia burgdorferi B31
IVSAVKKVDSLMYS

SEQ ID NO: 76168 - protein, 14 aa, Borrelia burgdorferi B31
VSAVKKVDSLMYSL

SEQ ID NO: 76169 - protein, 14 aa, Borrelia burgdorferi B31
SAVKKVDSLMYSLT

SEQ ID NO: 76170 - protein, 14 aa, Borrelia burgdorferi B31
AVKKVDSLMYSLTK

SEQ ID NO: 76171 - protein, 14 aa, Borrelia burgdorferi B31
VKKVDSLMYSLTKK

SEQ ID NO: 76172 - protein, 14 aa, Borrelia burgdorferi B31
KKVDSLMYSLTKKY

SEQ ID NO: 76173 - protein, 14 aa, Borrelia burgdorferi B31
KVDSLMYSLTKKYL

SEQ ID NO: 76174 - protein, 14 aa, Borrelia burgdorferi B31
VDSLMYSLTKKYLE

SEQ ID NO: 76175 - protein, 14 aa, Borrelia burgdorferi B31
DSLMYSLTKKYLET

SEQ ID NO: 76176 - protein, 14 aa, Borrelia burgdorferi B31
SLMYSLTKKYLETG

SEQ ID NO: 76177 - protein, 14 aa, Borrelia burgdorferi B31
LMYSLTKKYLETGV

SEQ ID NO: 76178 - protein, 14 aa, Borrelia burgdorferi B31
MYSLTKKYLETGVL

SEQ ID NO: 76179 - protein, 14 aa, Borrelia burgdorferi B31
YSLTKKYLETGVLD

SEQ ID NO: 76180 - protein, 14 aa, Borrelia burgdorferi B31
SLTKKYLETGVLDG

SEQ ID NO: 76181 - protein, 14 aa, Borrelia burgdorferi B31
LTKKYLETGVLDGG

SEQ ID NO: 76182 - protein, 14 aa, Borrelia burgdorferi B31
TKKYLETGVLDGGK

SEQ ID NO: 76183 - protein, 14 aa, Borrelia burgdorferi B31
KKYLETGVLDGGKT

SEQ ID NO: 76184 - protein, 14 aa, Borrelia burgdorferi B31
KYLETGVLDGGKTM

SEQ ID NO: 76185 - protein, 14 aa, Borrelia burgdorferi B31
YLETGVLDGGKTMF

SEQ ID NO: 76186 - protein, 14 aa, Borrelia burgdorferi B31
LETGVLDGGKTMFL

SEQ ID NO: 76187 - protein, 14 aa, Borrelia burgdorferi B31
ETGVLDGGKTMFLG

SEQ ID NO: 76188 - protein, 14 aa, Borrelia burgdorferi B31
TGVLDGGKTMFLGL

SEQ ID NO: 76189 - protein, 14 aa, Borrelia burgdorferi B31
GVLDGGKTMFLGLK

SEQ ID NO: 76190 - protein, 14 aa, Borrelia burgdorferi B31
VLDGGKTMFLGLKE

SEQ ID NO: 76191 - protein, 14 aa, Borrelia burgdorferi B31
LDGGKTMFLGLKED

SEQ ID NO: 76192 - protein, 14 aa, Borrelia burgdorferi B31
DGGKTMFLGLKEDG

SEQ ID NO: 76193 - protein, 14 aa, Borrelia burgdorferi B31
GGKTMFLGLKEDGL

SEQ ID NO: 76194 - protein, 14 aa, Borrelia burgdorferi B31
GKTMFLGLKEDGLG

SEQ ID NO: 76195 - protein, 14 aa, Borrelia burgdorferi B31
KTMFLGLKEDGLGL

SEQ ID NO: 76196 - protein, 14 aa, Borrelia burgdorferi B31
TMFLGLKEDGLGLV

SEQ ID NO: 76197 - protein, 14 aa, Borrelia burgdorferi B31
MFLGLKEDGLGLVL

SEQ ID NO: 76198 - protein, 14 aa, Borrelia burgdorferi B31
FLGLKEDGLGLVLN

SEQ ID NO: 76199 - protein, 14 aa, Borrelia burgdorferi B31
LGLKEDGLGLVLNE

SEQ ID NO: 76200 - protein, 14 aa, Borrelia burgdorferi B31
GLKEDGLGLVLNEN

SEQ ID NO: 76201 - protein, 14 aa, Borrelia burgdorferi B31
LKEDGLGLVLNENL

SEQ ID NO: 76202 - protein, 14 aa, Borrelia burgdorferi B31
KEDGLGLVLNENLK

SEQ ID NO: 76203 - protein, 14 aa, Borrelia burgdorferi B31
EDGLGLVLNENLKS

SEQ ID NO: 76204 - protein, 14 aa, Borrelia burgdorferi B31
DGLGLVLNENLKSN

SEQ ID NO: 76205 - protein, 14 aa, Borrelia burgdorferi B31
GLGLVLNENLKSNY

SEQ ID NO: 76206 - protein, 14 aa, Borrelia burgdorferi B31
LGLVLNENLKSNYS

SEQ ID NO: 76207 - protein, 14 aa, Borrelia burgdorferi B31
GLVLNENLKSNYSE

SEQ ID NO: 76208 - protein, 14 aa, Borrelia burgdorferi B31
LVLNENLKSNYSEI

SEQ ID NO: 76209 - protein, 14 aa, Borrelia burgdorferi B31
VLNENLKSNYSEIY

SEQ ID NO: 76210 - protein, 14 aa, Borrelia burgdorferi B31
LNENLKSNYSEIYN

SEQ ID NO: 76211 - protein, 14 aa, Borrelia burgdorferi B31
NENLKSNYSEIYNK

SEQ ID NO: 76212 - protein, 14 aa, Borrelia burgdorferi B31
ENLKSNYSEIYNKS

SEQ ID NO: 76213 - protein, 14 aa, Borrelia burgdorferi B31
NLKSNYSEIYNKSL

SEQ ID NO: 76214 - protein, 14 aa, Borrelia burgdorferi B31
LKSNYSEIYNKSLK

SEQ ID NO: 76215 - protein, 14 aa, Borrelia burgdorferi B31
KSNYSEIYNKSLKI

SEQ ID NO: 76216 - protein, 14 aa, Borrelia burgdorferi B31
SNYSEIYNKSLKIG

SEQ ID NO: 76217 - protein, 14 aa, Borrelia burgdorferi B31
NYSEIYNKSLKIGQ

SEQ ID NO: 76218 - protein, 14 aa, Borrelia burgdorferi B31
YSEIYNKSLKIGQS

SEQ ID NO: 76219 - protein, 14 aa, Borrelia burgdorferi B31
SEIYNKSLKIGQSI

SEQ ID NO: 76220 - protein, 14 aa, Borrelia burgdorferi B31
EIYNKSLKIGQSIM

SEQ ID NO: 76221 - protein, 14 aa, Borrelia burgdorferi B31
IYNKSLKIGQSIMN

SEQ ID NO: 76222 - protein, 14 aa, Borrelia burgdorferi B31
YNKSLKIGQSIMNG

SEQ ID NO: 76223 - protein, 14 aa, Borrelia burgdorferi B31
NKSLKIGQSIMNGI

SEQ ID NO: 76224 - protein, 14 aa, Borrelia burgdorferi B31
KSLKIGQSIMNGII

SEQ ID NO: 76225 - protein, 14 aa, Borrelia burgdorferi B31
SLKIGQSIMNGIIK

SEQ ID NO: 76226 - protein, 14 aa, Borrelia burgdorferi B31
LKIGQSIMNGIIKV

SEQ ID NO: 76227 - protein, 14 aa, Borrelia burgdorferi B31
KIGQSIMNGIIKVP

SEQ ID NO: 76228 - protein, 14 aa, Borrelia burgdorferi B31
IGQSIMNGIIKVPY

SEQ ID NO: 76229 - protein, 14 aa, Borrelia burgdorferi B31
GQSIMNGIIKVPYD

SEQ ID NO: 76230 - protein, 14 aa, Borrelia burgdorferi B31
QSIMNGIIKVPYDK

SEQ ID NO: 76231 - protein, 14 aa, Borrelia burgdorferi B31
SIMNGIIKVPYDKV

SEQ ID NO: 76232 - protein, 14 aa, Borrelia burgdorferi B31
IMNGIIKVPYDKVS

SEQ ID NO: 76233 - protein, 14 aa, Borrelia burgdorferi B31
MNGIIKVPYDKVSY

SEQ ID NO: 76234 - protein, 14 aa, Borrelia burgdorferi B31
NGIIKVPYDKVSYF

SEQ ID NO: 76235 - protein, 14 aa, Borrelia burgdorferi B31
GIIKVPYDKVSYFV

SEQ ID NO: 76236 - protein, 14 aa, Borrelia burgdorferi B31
IIKVPYDKVSYFVL

SEQ ID NO: 76237 - protein, 14 aa, Borrelia burgdorferi B31
IKVPYDKVSYFVLQ

SEQ ID NO: 76238 - protein, 14 aa, Borrelia burgdorferi B31
KVPYDKVSYFVLQM

SEQ ID NO: 76239 - protein, 14 aa, Borrelia burgdorferi B31
VPYDKVSYFVLQME

SEQ ID NO: 76240 - protein, 14 aa, Borrelia burgdorferi B31
PYDKVSYFVLQMEN

SEQ ID NO: 76241 - protein, 15 aa, Borrelia burgdorferi B31
MDNYYEIYFLYFFIK

SEQ ID NO: 76242 - protein, 15 aa, Borrelia burgdorferi B31
DNYYEIYFLYFFIKS

SEQ ID NO: 76243 - protein, 15 aa, Borrelia burgdorferi B31
NYYEIYFLYFFIKSK

SEQ ID NO: 76244 - protein, 15 aa, Borrelia burgdorferi B31
YYEIYFLYFFIKSKE

SEQ ID NO: 76245 - protein, 15 aa, Borrelia burgdorferi B31
YEIYFLYFFIKSKED

SEQ ID NO: 76246 - protein, 15 aa, Borrelia burgdorferi B31
EIYFLYFFIKSKEDI

SEQ ID NO: 76247 - protein, 15 aa, Borrelia burgdorferi B31
IYFLYFFIKSKEDIF

SEQ ID NO: 76248 - protein, 15 aa, Borrelia burgdorferi B31
YFLYFFIKSKEDIFM

SEQ ID NO: 76249 - protein, 15 aa, Borrelia burgdorferi B31
FLYFFIKSKEDIFML

SEQ ID NO: 76250 - protein, 15 aa, Borrelia burgdorferi B31
LYFFIKSKEDIFMLK

SEQ ID NO: 76251 - protein, 15 aa, Borrelia burgdorferi B31
YFFIKSKEDIFMLKK

SEQ ID NO: 76252 - protein, 15 aa, Borrelia burgdorferi B31
FFIKSKEDIFMLKKV

SEQ ID NO: 76253 - protein, 15 aa, Borrelia burgdorferi B31
FIKSKEDIFMLKKVY

SEQ ID NO: 76254 - protein, 15 aa, Borrelia burgdorferi B31
IKSKEDIFMLKKVYY

SEQ ID NO: 76255 - protein, 15 aa, Borrelia burgdorferi B31
KSKEDIFMLKKVYYF

SEQ ID NO: 76256 - protein, 15 aa, Borrelia burgdorferi B31
SKEDIFMLKKVYYFL

SEQ ID NO: 76257 - protein, 15 aa, Borrelia burgdorferi B31
KEDIFMLKKVYYFLI

SEQ ID NO: 76258 - protein, 15 aa, Borrelia burgdorferi B31
EDIFMLKKVYYFLIF

SEQ ID NO: 76259 - protein, 15 aa, Borrelia burgdorferi B31
DIFMLKKVYYFLIFL

SEQ ID NO: 76260 - protein, 15 aa, Borrelia burgdorferi B31
IFMLKKVYYFLIFLF

SEQ ID NO: 76261 - protein, 15 aa, Borrelia burgdorferi B31
FMLKKVYYFLIFLFI

SEQ ID NO: 76262 - protein, 15 aa, Borrelia burgdorferi B31
MLKKVYYFLIFLFIV

SEQ ID NO: 76263 - protein, 15 aa, Borrelia burgdorferi B31
LKKVYYFLIFLFIVA

SEQ ID NO: 76264 - protein, 15 aa, Borrelia burgdorferi B31
KKVYYFLIFLFIVAC

SEQ ID NO: 76265 - protein, 15 aa, Borrelia burgdorferi B31
KVYYFLIFLFIVACS

SEQ ID NO: 76266 - protein, 15 aa, Borrelia burgdorferi B31
VYYFLIFLFIVACSS

SEQ ID NO: 76267 - protein, 15 aa, Borrelia burgdorferi B31
YYFLIFLFIVACSSS

SEQ ID NO: 76268 - protein, 15 aa, Borrelia burgdorferi B31
YFLIFLFIVACSSSD

SEQ ID NO: 76269 - protein, 15 aa, Borrelia burgdorferi B31
FLIFLFIVACSSSDD

SEQ ID NO: 76270 - protein, 15 aa, Borrelia burgdorferi B31
LIFLFIVACSSSDDG

SEQ ID NO: 76271 - protein, 15 aa, Borrelia burgdorferi B31
IFLFIVACSSSDDGK

SEQ ID NO: 76272 - protein, 15 aa, Borrelia burgdorferi B31
FLFIVACSSSDDGKS

SEQ ID NO: 76273 - protein, 15 aa, Borrelia burgdorferi B31
LFIVACSSSDDGKSE

SEQ ID NO: 76274 - protein, 15 aa, Borrelia burgdorferi B31
FIVACSSSDDGKSEA

SEQ ID NO: 76275 - protein, 15 aa, Borrelia burgdorferi B31
IVACSSSDDGKSEAK

SEQ ID NO: 76276 - protein, 15 aa, Borrelia burgdorferi B31
VACSSSDDGKSEAKT

SEQ ID NO: 76277 - protein, 15 aa, Borrelia burgdorferi B31
ACSSSDDGKSEAKTV

SEQ ID NO: 76278 - protein, 15 aa, Borrelia burgdorferi B31
CSSSDDGKSEAKTVS

SEQ ID NO: 76279 - protein, 15 aa, Borrelia burgdorferi B31
SSSDDGKSEAKTVSL

SEQ ID NO: 76280 - protein, 15 aa, Borrelia burgdorferi B31
SSDDGKSEAKTVSLI

SEQ ID NO: 76281 - protein, 15 aa, Borrelia burgdorferi B31
SDDGKSEAKTVSLIV

SEQ ID NO: 76282 - protein, 15 aa, Borrelia burgdorferi B31
DDGKSEAKTVSLIVD

SEQ ID NO: 76283 - protein, 15 aa, Borrelia burgdorferi B31
DGKSEAKTVSLIVDG

SEQ ID NO: 76284 - protein, 15 aa, Borrelia burgdorferi B31
GKSEAKTVSLIVDGA

SEQ ID NO: 76285 - protein, 15 aa, Borrelia burgdorferi B31
KSEAKTVSLIVDGAF

SEQ ID NO: 76286 - protein, 15 aa, Borrelia burgdorferi B31
SEAKTVSLIVDGAFD

SEQ ID NO: 76287 - protein, 15 aa, Borrelia burgdorferi B31
EAKTVSLIVDGAFDD

SEQ ID NO: 76288 - protein, 15 aa, Borrelia burgdorferi B31
AKTVSLIVDGAFDDK

SEQ ID NO: 76289 - protein, 15 aa, Borrelia burgdorferi B31
KTVSLIVDGAFDDKG

SEQ ID NO: 76290 - protein, 15 aa, Borrelia burgdorferi B31
TVSLIVDGAFDDKGF

SEQ ID NO: 76291 - protein, 15 aa, Borrelia burgdorferi B31
VSLIVDGAFDDKGFN

SEQ ID NO: 76292 - protein, 15 aa, Borrelia burgdorferi B31
SLIVDGAFDDKGFNE

SEQ ID NO: 76293 - protein, 15 aa, Borrelia burgdorferi B31
LIVDGAFDDKGFNES

SEQ ID NO: 76294 - protein, 15 aa, Borrelia burgdorferi B31
IVDGAFDDKGFNESS

SEQ ID NO: 76295 - protein, 15 aa, Borrelia burgdorferi B31
VDGAFDDKGFNESSS

SEQ ID NO: 76296 - protein, 15 aa, Borrelia burgdorferi B31
DGAFDDKGFNESSSK

SEQ ID NO: 76297 - protein, 15 aa, Borrelia burgdorferi B31
GAFDDKGFNESSSKA

SEQ ID NO: 76298 - protein, 15 aa, Borrelia burgdorferi B31
AFDDKGFNESSSKAI

SEQ ID NO: 76299 - protein, 15 aa, Borrelia burgdorferi B31
FDDKGFNESSSKAIR

SEQ ID NO: 76300 - protein, 15 aa, Borrelia burgdorferi B31
DDKGFNESSSKAIRK

SEQ ID NO: 76301 - protein, 15 aa, Borrelia burgdorferi B31
DKGFNESSSKAIRKL

SEQ ID NO: 76302 - protein, 15 aa, Borrelia burgdorferi B31
KGFNESSSKAIRKLK

SEQ ID NO: 76303 - protein, 15 aa, Borrelia burgdorferi B31
GFNESSSKAIRKLKA

SEQ ID NO: 76304 - protein, 15 aa, Borrelia burgdorferi B31
FNESSSKAIRKLKAD

SEQ ID NO: 76305 - protein, 15 aa, Borrelia burgdorferi B31
NESSSKAIRKLKADL

SEQ ID NO: 76306 - protein, 15 aa, Borrelia burgdorferi B31
ESSSKAIRKLKADLN

SEQ ID NO: 76307 - protein, 15 aa, Borrelia burgdorferi B31
SSSKAIRKLKADLNI

SEQ ID NO: 76308 - protein, 15 aa, Borrelia burgdorferi B31
SSKAIRKLKADLNIN

SEQ ID NO: 76309 - protein, 15 aa, Borrelia burgdorferi B31
SKAIRKLKADLNINI

SEQ ID NO: 76310 - protein, 15 aa, Borrelia burgdorferi B31
KAIRKLKADLNINII

SEQ ID NO: 76311 - protein, 15 aa, Borrelia burgdorferi B31
AIRKLKADLNINIIE

SEQ ID NO: 76312 - protein, 15 aa, Borrelia burgdorferi B31
IRKLKADLNINIIEK

SEQ ID NO: 76313 - protein, 15 aa, Borrelia burgdorferi B31
RKLKADLNINIIEKA

SEQ ID NO: 76314 - protein, 15 aa, Borrelia burgdorferi B31
KLKADLNINIIEKAS

SEQ ID NO: 76315 - protein, 15 aa, Borrelia burgdorferi B31
LKADLNINIIEKAST

SEQ ID NO: 76316 - protein, 15 aa, Borrelia burgdorferi B31
KADLNINIIEKASTG

SEQ ID NO: 76317 - protein, 15 aa, Borrelia burgdorferi B31
ADLNINIIEKASTGN

SEQ ID NO: 76318 - protein, 15 aa, Borrelia burgdorferi B31
DLNINIIEKASTGNS

SEQ ID NO: 76319 - protein, 15 aa, Borrelia burgdorferi B31
LNINIIEKASTGNSY

SEQ ID NO: 76320 - protein, 15 aa, Borrelia burgdorferi B31
NINIIEKASTGNSYL

SEQ ID NO: 76321 - protein, 15 aa, Borrelia burgdorferi B31
INIIEKASTGNSYLG

SEQ ID NO: 76322 - protein, 15 aa, Borrelia burgdorferi B31
NIIEKASTGNSYLGD

SEQ ID NO: 76323 - protein, 15 aa, Borrelia burgdorferi B31
IIEKASTGNSYLGDI

SEQ ID NO: 76324 - protein, 15 aa, Borrelia burgdorferi B31
IEKASTGNSYLGDIA

SEQ ID NO: 76325 - protein, 15 aa, Borrelia burgdorferi B31
EKASTGNSYLGDIAN

SEQ ID NO: 76326 - protein, 15 aa, Borrelia burgdorferi B31
KASTGNSYLGDIANL

SEQ ID NO: 76327 - protein, 15 aa, Borrelia burgdorferi B31
ASTGNSYLGDIANLE

SEQ ID NO: 76328 - protein, 15 aa, Borrelia burgdorferi B31
STGNSYLGDIANLED

SEQ ID NO: 76329 - protein, 15 aa, Borrelia burgdorferi B31
TGNSYLGDIANLEDG

SEQ ID NO: 76330 - protein, 15 aa, Borrelia burgdorferi B31
GNSYLGDIANLEDGN

SEQ ID NO: 76331 - protein, 15 aa, Borrelia burgdorferi B31
NSYLGDIANLEDGNS

SEQ ID NO: 76332 - protein, 15 aa, Borrelia burgdorferi B31
SYLGDIANLEDGNSN

SEQ ID NO: 76333 - protein, 15 aa, Borrelia burgdorferi B31
YLGDIANLEDGNSNL

SEQ ID NO: 76334 - protein, 15 aa, Borrelia burgdorferi B31
LGDIANLEDGNSNLI

SEQ ID NO: 76335 - protein, 15 aa, Borrelia burgdorferi B31
GDIANLEDGNSNLIW

SEQ ID NO: 76336 - protein, 15 aa, Borrelia burgdorferi B31
DIANLEDGNSNLIWG

SEQ ID NO: 76337 - protein, 15 aa, Borrelia burgdorferi B31
IANLEDGNSNLIWGI

SEQ ID NO: 76338 - protein, 15 aa, Borrelia burgdorferi B31
ANLEDGNSNLIWGIG

SEQ ID NO: 76339 - protein, 15 aa, Borrelia burgdorferi B31
NLEDGNSNLIWGIGF

SEQ ID NO: 76340 - protein, 15 aa, Borrelia burgdorferi B31
LEDGNSNLIWGIGFR

SEQ ID NO: 76341 - protein, 15 aa, Borrelia burgdorferi B31
EDGNSNLIWGIGFRL

SEQ ID NO: 76342 - protein, 15 aa, Borrelia burgdorferi B31
DGNSNLIWGIGFRLS

SEQ ID NO: 76343 - protein, 15 aa, Borrelia burgdorferi B31
GNSNLIWGIGFRLSD

SEQ ID NO: 76344 - protein, 15 aa, Borrelia burgdorferi B31
NSNLIWGIGFRLSDI

SEQ ID NO: 76345 - protein, 15 aa, Borrelia burgdorferi B31
SNLIWGIGFRLSDIL

SEQ ID NO: 76346 - protein, 15 aa, Borrelia burgdorferi B31
NLIWGIGFRLSDILF

SEQ ID NO: 76347 - protein, 15 aa, Borrelia burgdorferi B31
LIWGIGFRLSDILFQ

SEQ ID NO: 76348 - protein, 15 aa, Borrelia burgdorferi B31
IWGIGFRLSDILFQR

SEQ ID NO: 76349 - protein, 15 aa, Borrelia burgdorferi B31
WGIGFRLSDILFQRA

SEQ ID NO: 76350 - protein, 15 aa, Borrelia burgdorferi B31
GIGFRLSDILFQRAS

SEQ ID NO: 76351 - protein, 15 aa, Borrelia burgdorferi B31
IGFRLSDILFQRASE

SEQ ID NO: 76352 - protein, 15 aa, Borrelia burgdorferi B31
GFRLSDILFQRASEN

SEQ ID NO: 76353 - protein, 15 aa, Borrelia burgdorferi B31
FRLSDILFQRASENV

SEQ ID NO: 76354 - protein, 15 aa, Borrelia burgdorferi B31
RLSDILFQRASENVS

SEQ ID NO: 76355 - protein, 15 aa, Borrelia burgdorferi B31
LSDILFQRASENVSV

SEQ ID NO: 76356 - protein, 15 aa, Borrelia burgdorferi B31
SDILFQRASENVSVN

SEQ ID NO: 76357 - protein, 15 aa, Borrelia burgdorferi B31
DILFQRASENVSVNY

SEQ ID NO: 76358 - protein, 15 aa, Borrelia burgdorferi B31
ILFQRASENVSVNYA

SEQ ID NO: 76359 - protein, 15 aa, Borrelia burgdorferi B31
LFQRASENVSVNYAI

SEQ ID NO: 76360 - protein, 15 aa, Borrelia burgdorferi B31
FQRASENVSVNYAII

SEQ ID NO: 76361 - protein, 15 aa, Borrelia burgdorferi B31
QRASENVSVNYAIIE

SEQ ID NO: 76362 - protein, 15 aa, Borrelia burgdorferi B31
RASENVSVNYAIIEG

SEQ ID NO: 76363 - protein, 15 aa, Borrelia burgdorferi B31
ASENVSVNYAIIEGV

SEQ ID NO: 76364 - protein, 15 aa, Borrelia burgdorferi B31
SENVSVNYAIIEGVY

SEQ ID NO: 76365 - protein, 15 aa, Borrelia burgdorferi B31
ENVSVNYAIIEGVYD

SEQ ID NO: 76366 - protein, 15 aa, Borrelia burgdorferi B31
NVSVNYAIIEGVYDE

SEQ ID NO: 76367 - protein, 15 aa, Borrelia burgdorferi B31
VSVNYAIIEGVYDEI

SEQ ID NO: 76368 - protein, 15 aa, Borrelia burgdorferi B31
SVNYAIIEGVYDEIQ

SEQ ID NO: 76369 - protein, 15 aa, Borrelia burgdorferi B31
VNYAIIEGVYDEIQI

SEQ ID NO: 76370 - protein, 15 aa, Borrelia burgdorferi B31
NYAIIEGVYDEIQIP

SEQ ID NO: 76371 - protein, 15 aa, Borrelia burgdorferi B31
YAIIEGVYDEIQIPK

SEQ ID NO: 76372 - protein, 15 aa, Borrelia burgdorferi B31
AIIEGVYDEIQIPKN

SEQ ID NO: 76373 - protein, 15 aa, Borrelia burgdorferi B31
IIEGVYDEIQIPKNL

SEQ ID NO: 76374 - protein, 15 aa, Borrelia burgdorferi B31
IEGVYDEIQIPKNLL

SEQ ID NO: 76375 - protein, 15 aa, Borrelia burgdorferi B31
EGVYDEIQIPKNLLN

SEQ ID NO: 76376 - protein, 15 aa, Borrelia burgdorferi B31
GVYDEIQIPKNLLNI

SEQ ID NO: 76377 - protein, 15 aa, Borrelia burgdorferi B31
VYDEIQIPKNLLNIS

SEQ ID NO: 76378 - protein, 15 aa, Borrelia burgdorferi B31
YDEIQIPKNLLNISF

SEQ ID NO: 76379 - protein, 15 aa, Borrelia burgdorferi B31
DEIQIPKNLLNISFR

SEQ ID NO: 76380 - protein, 15 aa, Borrelia burgdorferi B31
EIQIPKNLLNISFRS

SEQ ID NO: 76381 - protein, 15 aa, Borrelia burgdorferi B31
IQIPKNLLNISFRSE

SEQ ID NO: 76382 - protein, 15 aa, Borrelia burgdorferi B31
QIPKNLLNISFRSEE

SEQ ID NO: 76383 - protein, 15 aa, Borrelia burgdorferi B31
IPKNLLNISFRSEEV

SEQ ID NO: 76384 - protein, 15 aa, Borrelia burgdorferi B31
PKNLLNISFRSEEVA

SEQ ID NO: 76385 - protein, 15 aa, Borrelia burgdorferi B31
KNLLNISFRSEEVAF

SEQ ID NO: 76386 - protein, 15 aa, Borrelia burgdorferi B31
NLLNISFRSEEVAFL

SEQ ID NO: 76387 - protein, 15 aa, Borrelia burgdorferi B31
LLNISFRSEEVAFLA

SEQ ID NO: 76388 - protein, 15 aa, Borrelia burgdorferi B31
LNISFRSEEVAFLAG

SEQ ID NO: 76389 - protein, 15 aa, Borrelia burgdorferi B31
NISFRSEEVAFLAGY

SEQ ID NO: 76390 - protein, 15 aa, Borrelia burgdorferi B31
ISFRSEEVAFLAGYF

SEQ ID NO: 76391 - protein, 15 aa, Borrelia burgdorferi B31
SFRSEEVAFLAGYFA

SEQ ID NO: 76392 - protein, 15 aa, Borrelia burgdorferi B31
FRSEEVAFLAGYFAS

SEQ ID NO: 76393 - protein, 15 aa, Borrelia burgdorferi B31
RSEEVAFLAGYFASK

SEQ ID NO: 76394 - protein, 15 aa, Borrelia burgdorferi B31
SEEVAFLAGYFASKA

SEQ ID NO: 76395 - protein, 15 aa, Borrelia burgdorferi B31
EEVAFLAGYFASKAS

SEQ ID NO: 76396 - protein, 15 aa, Borrelia burgdorferi B31
EVAFLAGYFASKASK

SEQ ID NO: 76397 - protein, 15 aa, Borrelia burgdorferi B31
VAFLAGYFASKASKT

SEQ ID NO: 76398 - protein, 15 aa, Borrelia burgdorferi B31
AFLAGYFASKASKTG

SEQ ID NO: 76399 - protein, 15 aa, Borrelia burgdorferi B31
FLAGYFASKASKTGK

SEQ ID NO: 76400 - protein, 15 aa, Borrelia burgdorferi B31
LAGYFASKASKTGKI

SEQ ID NO: 76401 - protein, 15 aa, Borrelia burgdorferi B31
AGYFASKASKTGKIG

SEQ ID NO: 76402 - protein, 15 aa, Borrelia burgdorferi B31
GYFASKASKTGKIGF

SEQ ID NO: 76403 - protein, 15 aa, Borrelia burgdorferi B31
YFASKASKTGKIGFV

SEQ ID NO: 76404 - protein, 15 aa, Borrelia burgdorferi B31
FASKASKTGKIGFVG

SEQ ID NO: 76405 - protein, 15 aa, Borrelia burgdorferi B31
ASKASKTGKIGFVGG

SEQ ID NO: 76406 - protein, 15 aa, Borrelia burgdorferi B31
SKASKTGKIGFVGGV

SEQ ID NO: 76407 - protein, 15 aa, Borrelia burgdorferi B31
KASKTGKIGFVGGVR

SEQ ID NO: 76408 - protein, 15 aa, Borrelia burgdorferi B31
ASKTGKIGFVGGVRG

SEQ ID NO: 76409 - protein, 15 aa, Borrelia burgdorferi B31
SKTGKIGFVGGVRGK

SEQ ID NO: 76410 - protein, 15 aa, Borrelia burgdorferi B31
KTGKIGFVGGVRGKV

SEQ ID NO: 76411 - protein, 15 aa, Borrelia burgdorferi B31
TGKIGFVGGVRGKVL

SEQ ID NO: 76412 - protein, 15 aa, Borrelia burgdorferi B31
GKIGFVGGVRGKVLE

SEQ ID NO: 76413 - protein, 15 aa, Borrelia burgdorferi B31
KIGFVGGVRGKVLES

SEQ ID NO: 76414 - protein, 15 aa, Borrelia burgdorferi B31
IGFVGGVRGKVLESF

SEQ ID NO: 76415 - protein, 15 aa, Borrelia burgdorferi B31
GFVGGVRGKVLESFM

SEQ ID NO: 76416 - protein, 15 aa, Borrelia burgdorferi B31
FVGGVRGKVLESFMY

SEQ ID NO: 76417 - protein, 15 aa, Borrelia burgdorferi B31
VGGVRGKVLESFMYG

SEQ ID NO: 76418 - protein, 15 aa, Borrelia burgdorferi B31
GGVRGKVLESFMYGY

SEQ ID NO: 76419 - protein, 15 aa, Borrelia burgdorferi B31
GVRGKVLESFMYGYE

SEQ ID NO: 76420 - protein, 15 aa, Borrelia burgdorferi B31
VRGKVLESFMYGYEA

SEQ ID NO: 76421 - protein, 15 aa, Borrelia burgdorferi B31
RGKVLESFMYGYEAG

SEQ ID NO: 76422 - protein, 15 aa, Borrelia burgdorferi B31
GKVLESFMYGYEAGA

SEQ ID NO: 76423 - protein, 15 aa, Borrelia burgdorferi B31
KVLESFMYGYEAGAK

SEQ ID NO: 76424 - protein, 15 aa, Borrelia burgdorferi B31
VLESFMYGYEAGAKY

SEQ ID NO: 76425 - protein, 15 aa, Borrelia burgdorferi B31
LESFMYGYEAGAKYA

SEQ ID NO: 76426 - protein, 15 aa, Borrelia burgdorferi B31
ESFMYGYEAGAKYAN

SEQ ID NO: 76427 - protein, 15 aa, Borrelia burgdorferi B31
SFMYGYEAGAKYANS

SEQ ID NO: 76428 - protein, 15 aa, Borrelia burgdorferi B31
FMYGYEAGAKYANSN

SEQ ID NO: 76429 - protein, 15 aa, Borrelia burgdorferi B31
MYGYEAGAKYANSNI

SEQ ID NO: 76430 - protein, 15 aa, Borrelia burgdorferi B31
YGYEAGAKYANSNIK

SEQ ID NO: 76431 - protein, 15 aa, Borrelia burgdorferi B31
GYEAGAKYANSNIKV

SEQ ID NO: 76432 - protein, 15 aa, Borrelia burgdorferi B31
YEAGAKYANSNIKVV

SEQ ID NO: 76433 - protein, 15 aa, Borrelia burgdorferi B31
EAGAKYANSNIKVVS

SEQ ID NO: 76434 - protein, 15 aa, Borrelia burgdorferi B31
AGAKYANSNIKVVSQ

SEQ ID NO: 76435 - protein, 15 aa, Borrelia burgdorferi B31
GAKYANSNIKVVSQY

SEQ ID NO: 76436 - protein, 15 aa, Borrelia burgdorferi B31
AKYANSNIKVVSQYV

SEQ ID NO: 76437 - protein, 15 aa, Borrelia burgdorferi B31
KYANSNIKVVSQYVG

SEQ ID NO: 76438 - protein, 15 aa, Borrelia burgdorferi B31
YANSNIKVVSQYVGT

SEQ ID NO: 76439 - protein, 15 aa, Borrelia burgdorferi B31
ANSNIKVVSQYVGTF

SEQ ID NO: 76440 - protein, 15 aa, Borrelia burgdorferi B31
NSNIKVVSQYVGTFG

SEQ ID NO: 76441 - protein, 15 aa, Borrelia burgdorferi B31
SNIKVVSQYVGTFGD

SEQ ID NO: 76442 - protein, 15 aa, Borrelia burgdorferi B31
NIKVVSQYVGTFGDF

SEQ ID NO: 76443 - protein, 15 aa, Borrelia burgdorferi B31
IKVVSQYVGTFGDFG

SEQ ID NO: 76444 - protein, 15 aa, Borrelia burgdorferi B31
KVVSQYVGTFGDFGL

SEQ ID NO: 76445 - protein, 15 aa, Borrelia burgdorferi B31
VVSQYVGTFGDFGLG

SEQ ID NO: 76446 - protein, 15 aa, Borrelia burgdorferi B31
VSQYVGTFGDFGLGR

SEQ ID NO: 76447 - protein, 15 aa, Borrelia burgdorferi B31
SQYVGTFGDFGLGRS

SEQ ID NO: 76448 - protein, 15 aa, Borrelia burgdorferi B31
QYVGTFGDFGLGRST

SEQ ID NO: 76449 - protein, 15 aa, Borrelia burgdorferi B31
YVGTFGDFGLGRSTA

SEQ ID NO: 76450 - protein, 15 aa, Borrelia burgdorferi B31
VGTFGDFGLGRSTAS

SEQ ID NO: 76451 - protein, 15 aa, Borrelia burgdorferi B31
GTFGDFGLGRSTASN

SEQ ID NO: 76452 - protein, 15 aa, Borrelia burgdorferi B31
TFGDFGLGRSTASNM

SEQ ID NO: 76453 - protein, 15 aa, Borrelia burgdorferi B31
FGDFGLGRSTASNMY

SEQ ID NO: 76454 - protein, 15 aa, Borrelia burgdorferi B31
GDFGLGRSTASNMYR

SEQ ID NO: 76455 - protein, 15 aa, Borrelia burgdorferi B31
DFGLGRSTASNMYRD

SEQ ID NO: 76456 - protein, 15 aa, Borrelia burgdorferi B31
FGLGRSTASNMYRDG

SEQ ID NO: 76457 - protein, 15 aa, Borrelia burgdorferi B31
GLGRSTASNMYRDGV

SEQ ID NO: 76458 - protein, 15 aa, Borrelia burgdorferi B31
LGRSTASNMYRDGVD

SEQ ID NO: 76459 - protein, 15 aa, Borrelia burgdorferi B31
GRSTASNMYRDGVDI

SEQ ID NO: 76460 - protein, 15 aa, Borrelia burgdorferi B31
RSTASNMYRDGVDII

SEQ ID NO: 76461 - protein, 15 aa, Borrelia burgdorferi B31
STASNMYRDGVDIIF

SEQ ID NO: 76462 - protein, 15 aa, Borrelia burgdorferi B31
TASNMYRDGVDIIFA

SEQ ID NO: 76463 - protein, 15 aa, Borrelia burgdorferi B31
ASNMYRDGVDIIFAA

SEQ ID NO: 76464 - protein, 15 aa, Borrelia burgdorferi B31
SNMYRDGVDIIFAAA

SEQ ID NO: 76465 - protein, 15 aa, Borrelia burgdorferi B31
NMYRDGVDIIFAAAG

SEQ ID NO: 76466 - protein, 15 aa, Borrelia burgdorferi B31
MYRDGVDIIFAAAGL

SEQ ID NO: 76467 - protein, 15 aa, Borrelia burgdorferi B31
YRDGVDIIFAAAGLS

SEQ ID NO: 76468 - protein, 15 aa, Borrelia burgdorferi B31
RDGVDIIFAAAGLSG

SEQ ID NO: 76469 - protein, 15 aa, Borrelia burgdorferi B31
DGVDIIFAAAGLSGI

SEQ ID NO: 76470 - protein, 15 aa, Borrelia burgdorferi B31
GVDIIFAAAGLSGIG

SEQ ID NO: 76471 - protein, 15 aa, Borrelia burgdorferi B31
VDIIFAAAGLSGIGV

SEQ ID NO: 76472 - protein, 15 aa, Borrelia burgdorferi B31
DIIFAAAGLSGIGVI

SEQ ID NO: 76473 - protein, 15 aa, Borrelia burgdorferi B31
IIFAAAGLSGIGVIE

SEQ ID NO: 76474 - protein, 15 aa, Borrelia burgdorferi B31
IFAAAGLSGIGVIEA

SEQ ID NO: 76475 - protein, 15 aa, Borrelia burgdorferi B31
FAAAGLSGIGVIEAA

SEQ ID NO: 76476 - protein, 15 aa, Borrelia burgdorferi B31
AAAGLSGIGVIEAAK

SEQ ID NO: 76477 - protein, 15 aa, Borrelia burgdorferi B31
AAGLSGIGVIEAAKE

SEQ ID NO: 76478 - protein, 15 aa, Borrelia burgdorferi B31
AGLSGIGVIEAAKEL

SEQ ID NO: 76479 - protein, 15 aa, Borrelia burgdorferi B31
GLSGIGVIEAAKELG

SEQ ID NO: 76480 - protein, 15 aa, Borrelia burgdorferi B31
LSGIGVIEAAKELGP

SEQ ID NO: 76481 - protein, 15 aa, Borrelia burgdorferi B31
SGIGVIEAAKELGPD

SEQ ID NO: 76482 - protein, 15 aa, Borrelia burgdorferi B31
GIGVIEAAKELGPDH

SEQ ID NO: 76483 - protein, 15 aa, Borrelia burgdorferi B31
IGVIEAAKELGPDHY

SEQ ID NO: 76484 - protein, 15 aa, Borrelia burgdorferi B31
GVIEAAKELGPDHYI

SEQ ID NO: 76485 - protein, 15 aa, Borrelia burgdorferi B31
VIEAAKELGPDHYII

SEQ ID NO: 76486 - protein, 15 aa, Borrelia burgdorferi B31
IEAAKELGPDHYIIG

SEQ ID NO: 76487 - protein, 15 aa, Borrelia burgdorferi B31
EAAKELGPDHYIIGV

SEQ ID NO: 76488 - protein, 15 aa, Borrelia burgdorferi B31
AAKELGPDHYIIGVD

SEQ ID NO: 76489 - protein, 15 aa, Borrelia burgdorferi B31
AKELGPDHYIIGVDQ

SEQ ID NO: 76490 - protein, 15 aa, Borrelia burgdorferi B31
KELGPDHYIIGVDQD

SEQ ID NO: 76491 - protein, 15 aa, Borrelia burgdorferi B31
ELGPDHYIIGVDQDQ

SEQ ID NO: 76492 - protein, 15 aa, Borrelia burgdorferi B31
LGPDHYIIGVDQDQS

SEQ ID NO: 76493 - protein, 15 aa, Borrelia burgdorferi B31
GPDHYIIGVDQDQSY

SEQ ID NO: 76494 - protein, 15 aa, Borrelia burgdorferi B31
PDHYIIGVDQDQSYL

SEQ ID NO: 76495 - protein, 15 aa, Borrelia burgdorferi B31
DHYIIGVDQDQSYLA

SEQ ID NO: 76496 - protein, 15 aa, Borrelia burgdorferi B31
HYIIGVDQDQSYLAP

SEQ ID NO: 76497 - protein, 15 aa, Borrelia burgdorferi B31
YIIGVDQDQSYLAPN

SEQ ID NO: 76498 - protein, 15 aa, Borrelia burgdorferi B31
IIGVDQDQSYLAPNN

SEQ ID NO: 76499 - protein, 15 aa, Borrelia burgdorferi B31
IGVDQDQSYLAPNNV

SEQ ID NO: 76500 - protein, 15 aa, Borrelia burgdorferi B31
GVDQDQSYLAPNNVI

SEQ ID NO: 76501 - protein, 15 aa, Borrelia burgdorferi B31
VDQDQSYLAPNNVIV

SEQ ID NO: 76502 - protein, 15 aa, Borrelia burgdorferi B31
DQDQSYLAPNNVIVS

SEQ ID NO: 76503 - protein, 15 aa, Borrelia burgdorferi B31
QDQSYLAPNNVIVSA

SEQ ID NO: 76504 - protein, 15 aa, Borrelia burgdorferi B31
DQSYLAPNNVIVSAV

SEQ ID NO: 76505 - protein, 15 aa, Borrelia burgdorferi B31
QSYLAPNNVIVSAVK

SEQ ID NO: 76506 - protein, 15 aa, Borrelia burgdorferi B31
SYLAPNNVIVSAVKK

SEQ ID NO: 76507 - protein, 15 aa, Borrelia burgdorferi B31
YLAPNNVIVSAVKKV

SEQ ID NO: 76508 - protein, 15 aa, Borrelia burgdorferi B31
LAPNNVIVSAVKKVD

SEQ ID NO: 76509 - protein, 15 aa, Borrelia burgdorferi B31
APNNVIVSAVKKVDS

SEQ ID NO: 76510 - protein, 15 aa, Borrelia burgdorferi B31
PNNVIVSAVKKVDSL

SEQ ID NO: 76511 - protein, 15 aa, Borrelia burgdorferi B31
NNVIVSAVKKVDSLM

SEQ ID NO: 76512 - protein, 15 aa, Borrelia burgdorferi B31
NVIVSAVKKVDSLMY

SEQ ID NO: 76513 - protein, 15 aa, Borrelia burgdorferi B31
VIVSAVKKVDSLMYS

SEQ ID NO: 76514 - protein, 15 aa, Borrelia burgdorferi B31
IVSAVKKVDSLMYSL

SEQ ID NO: 76515 - protein, 15 aa, Borrelia burgdorferi B31
VSAVKKVDSLMYSLT

SEQ ID NO: 76516 - protein, 15 aa, Borrelia burgdorferi B31
SAVKKVDSLMYSLTK

SEQ ID NO: 76517 - protein, 15 aa, Borrelia burgdorferi B31
AVKKVDSLMYSLTKK

SEQ ID NO: 76518 - protein, 15 aa, Borrelia burgdorferi B31
VKKVDSLMYSLTKKY

SEQ ID NO: 76519 - protein, 15 aa, Borrelia burgdorferi B31
KKVDSLMYSLTKKYL

SEQ ID NO: 76520 - protein, 15 aa, Borrelia burgdorferi B31
KVDSLMYSLTKKYLE

SEQ ID NO: 76521 - protein, 15 aa, Borrelia burgdorferi B31
VDSLMYSLTKKYLET

SEQ ID NO: 76522 - protein, 15 aa, Borrelia burgdorferi B31
DSLMYSLTKKYLETG

SEQ ID NO: 76523 - protein, 15 aa, Borrelia burgdorferi B31
SLMYSLTKKYLETGV

SEQ ID NO: 76524 - protein, 15 aa, Borrelia burgdorferi B31
LMYSLTKKYLETGVL

SEQ ID NO: 76525 - protein, 15 aa, Borrelia burgdorferi B31
MYSLTKKYLETGVLD

SEQ ID NO: 76526 - protein, 15 aa, Borrelia burgdorferi B31
YSLTKKYLETGVLDG

SEQ ID NO: 76527 - protein, 15 aa, Borrelia burgdorferi B31
SLTKKYLETGVLDGG

SEQ ID NO: 76528 - protein, 15 aa, Borrelia burgdorferi B31
LTKKYLETGVLDGGK

SEQ ID NO: 76529 - protein, 15 aa, Borrelia burgdorferi B31
TKKYLETGVLDGGKT

SEQ ID NO: 76530 - protein, 15 aa, Borrelia burgdorferi B31
KKYLETGVLDGGKTM

SEQ ID NO: 76531 - protein, 15 aa, Borrelia burgdorferi B31
KYLETGVLDGGKTMF

SEQ ID NO: 76532 - protein, 15 aa, Borrelia burgdorferi B31
YLETGVLDGGKTMFL

SEQ ID NO: 76533 - protein, 15 aa, Borrelia burgdorferi B31
LETGVLDGGKTMFLG

SEQ ID NO: 76534 - protein, 15 aa, Borrelia burgdorferi B31
ETGVLDGGKTMFLGL

SEQ ID NO: 76535 - protein, 15 aa, Borrelia burgdorferi B31
TGVLDGGKTMFLGLK

SEQ ID NO: 76536 - protein, 15 aa, Borrelia burgdorferi B31
GVLDGGKTMFLGLKE

SEQ ID NO: 76537 - protein, 15 aa, Borrelia burgdorferi B31
VLDGGKTMFLGLKED

SEQ ID NO: 76538 - protein, 15 aa, Borrelia burgdorferi B31
LDGGKTMFLGLKEDG

SEQ ID NO: 76539 - protein, 15 aa, Borrelia burgdorferi B31
DGGKTMFLGLKEDGL

SEQ ID NO: 76540 - protein, 15 aa, Borrelia burgdorferi B31
GGKTMFLGLKEDGLG

SEQ ID NO: 76541 - protein, 15 aa, Borrelia burgdorferi B31
GKTMFLGLKEDGLGL

SEQ ID NO: 76542 - protein, 15 aa, Borrelia burgdorferi B31
KTMFLGLKEDGLGLV

SEQ ID NO: 76543 - protein, 15 aa, Borrelia burgdorferi B31
TMFLGLKEDGLGLVL

SEQ ID NO: 76544 - protein, 15 aa, Borrelia burgdorferi B31
MFLGLKEDGLGLVLN

SEQ ID NO: 76545 - protein, 15 aa, Borrelia burgdorferi B31
FLGLKEDGLGLVLNE

SEQ ID NO: 76546 - protein, 15 aa, Borrelia burgdorferi B31
LGLKEDGLGLVLNEN

SEQ ID NO: 76547 - protein, 15 aa, Borrelia burgdorferi B31
GLKEDGLGLVLNENL

SEQ ID NO: 76548 - protein, 15 aa, Borrelia burgdorferi B31
LKEDGLGLVLNENLK

SEQ ID NO: 76549 - protein, 15 aa, Borrelia burgdorferi B31
KEDGLGLVLNENLKS

SEQ ID NO: 76550 - protein, 15 aa, Borrelia burgdorferi B31
EDGLGLVLNENLKSN

SEQ ID NO: 76551 - protein, 15 aa, Borrelia burgdorferi B31
DGLGLVLNENLKSNY

SEQ ID NO: 76552 - protein, 15 aa, Borrelia burgdorferi B31
GLGLVLNENLKSNYS

SEQ ID NO: 76553 - protein, 15 aa, Borrelia burgdorferi B31
LGLVLNENLKSNYSE

SEQ ID NO: 76554 - protein, 15 aa, Borrelia burgdorferi B31
GLVLNENLKSNYSEI

SEQ ID NO: 76555 - protein, 15 aa, Borrelia burgdorferi B31
LVLNENLKSNYSEIY

SEQ ID NO: 76556 - protein, 15 aa, Borrelia burgdorferi B31
VLNENLKSNYSEIYN

SEQ ID NO: 76557 - protein, 15 aa, Borrelia burgdorferi B31
LNENLKSNYSEIYNK

SEQ ID NO: 76558 - protein, 15 aa, Borrelia burgdorferi B31
NENLKSNYSEIYNKS

SEQ ID NO: 76559 - protein, 15 aa, Borrelia burgdorferi B31
ENLKSNYSEIYNKSL

SEQ ID NO: 76560 - protein, 15 aa, Borrelia burgdorferi B31
NLKSNYSEIYNKSLK

SEQ ID NO: 76561 - protein, 15 aa, Borrelia burgdorferi B31
LKSNYSEIYNKSLKI

SEQ ID NO: 76562 - protein, 15 aa, Borrelia burgdorferi B31
KSNYSEIYNKSLKIG

SEQ ID NO: 76563 - protein, 15 aa, Borrelia burgdorferi B31
SNYSEIYNKSLKIGQ

SEQ ID NO: 76564 - protein, 15 aa, Borrelia burgdorferi B31
NYSEIYNKSLKIGQS

SEQ ID NO: 76565 - protein, 15 aa, Borrelia burgdorferi B31
YSEIYNKSLKIGQSI

SEQ ID NO: 76566 - protein, 15 aa, Borrelia burgdorferi B31
SEIYNKSLKIGQSIM

SEQ ID NO: 76567 - protein, 15 aa, Borrelia burgdorferi B31
EIYNKSLKIGQSIMN

SEQ ID NO: 76568 - protein, 15 aa, Borrelia burgdorferi B31
IYNKSLKIGQSIMNG

SEQ ID NO: 76569 - protein, 15 aa, Borrelia burgdorferi B31
YNKSLKIGQSIMNGI

SEQ ID NO: 76570 - protein, 15 aa, Borrelia burgdorferi B31
NKSLKIGQSIMNGII

SEQ ID NO: 76571 - protein, 15 aa, Borrelia burgdorferi B31
KSLKIGQSIMNGIIK

SEQ ID NO: 76572 - protein, 15 aa, Borrelia burgdorferi B31
SLKIGQSIMNGIIKV

SEQ ID NO: 76573 - protein, 15 aa, Borrelia burgdorferi B31
LKIGQSIMNGIIKVP

SEQ ID NO: 76574 - protein, 15 aa, Borrelia burgdorferi B31
KIGQSIMNGIIKVPY

SEQ ID NO: 76575 - protein, 15 aa, Borrelia burgdorferi B31
IGQSIMNGIIKVPYD

SEQ ID NO: 76576 - protein, 15 aa, Borrelia burgdorferi B31
GQSIMNGIIKVPYDK

SEQ ID NO: 76577 - protein, 15 aa, Borrelia burgdorferi B31
QSIMNGIIKVPYDKV

SEQ ID NO: 76578 - protein, 15 aa, Borrelia burgdorferi B31
SIMNGIIKVPYDKVS

SEQ ID NO: 76579 - protein, 15 aa, Borrelia burgdorferi B31
IMNGIIKVPYDKVSY

SEQ ID NO: 76580 - protein, 15 aa, Borrelia burgdorferi B31
MNGIIKVPYDKVSYF

SEQ ID NO: 76581 - protein, 15 aa, Borrelia burgdorferi B31
NGIIKVPYDKVSYFV

SEQ ID NO: 76582 - protein, 15 aa, Borrelia burgdorferi B31
GIIKVPYDKVSYFVL

SEQ ID NO: 76583 - protein, 15 aa, Borrelia burgdorferi B31
IIKVPYDKVSYFVLQ

SEQ ID NO: 76584 - protein, 15 aa, Borrelia burgdorferi B31
IKVPYDKVSYFVLQM

SEQ ID NO: 76585 - protein, 15 aa, Borrelia burgdorferi B31
KVPYDKVSYFVLQME

SEQ ID NO: 76586 - protein, 15 aa, Borrelia burgdorferi B31
VPYDKVSYFVLQMEN

SEQ ID NO: 76587 - protein, 16 aa, Borrelia burgdorferi B31
MDNYYEIYFLYFFIKS

SEQ ID NO: 76588 - protein, 16 aa, Borrelia burgdorferi B31
DNYYEIYFLYFFIKSK

SEQ ID NO: 76589 - protein, 16 aa, Borrelia burgdorferi B31
NYYEIYFLYFFIKSKE

SEQ ID NO: 76590 - protein, 16 aa, Borrelia burgdorferi B31
YYEIYFLYFFIKSKED

SEQ ID NO: 76591 - protein, 16 aa, Borrelia burgdorferi B31
YEIYFLYFFIKSKEDI

SEQ ID NO: 76592 - protein, 16 aa, Borrelia burgdorferi B31
EIYFLYFFIKSKEDIF

SEQ ID NO: 76593 - protein, 16 aa, Borrelia burgdorferi B31
IYFLYFFIKSKEDIFM

SEQ ID NO: 76594 - protein, 16 aa, Borrelia burgdorferi B31
YFLYFFIKSKEDIFML

SEQ ID NO: 76595 - protein, 16 aa, Borrelia burgdorferi B31
FLYFFIKSKEDIFMLK

SEQ ID NO: 76596 - protein, 16 aa, Borrelia burgdorferi B31
LYFFIKSKEDIFMLKK

SEQ ID NO: 76597 - protein, 16 aa, Borrelia burgdorferi B31
YFFIKSKEDIFMLKKV

SEQ ID NO: 76598 - protein, 16 aa, Borrelia burgdorferi B31
FFIKSKEDIFMLKKVY

SEQ ID NO: 76599 - protein, 16 aa, Borrelia burgdorferi B31
FIKSKEDIFMLKKVYY

SEQ ID NO: 76600 - protein, 16 aa, Borrelia burgdorferi B31
IKSKEDIFMLKKVYYF

SEQ ID NO: 76601 - protein, 16 aa, Borrelia burgdorferi B31
KSKEDIFMLKKVYYFL

SEQ ID NO: 76602 - protein, 16 aa, Borrelia burgdorferi B31
SKEDIFMLKKVYYFLI

SEQ ID NO: 76603 - protein, 16 aa, Borrelia burgdorferi B31
KEDIFMLKKVYYFLIF

SEQ ID NO: 76604 - protein, 16 aa, Borrelia burgdorferi B31
EDIFMLKKVYYFLIFL

SEQ ID NO: 76605 - protein, 16 aa, Borrelia burgdorferi B31
DIFMLKKVYYFLIFLF

SEQ ID NO: 76606 - protein, 16 aa, Borrelia burgdorferi B31
IFMLKKVYYFLIFLFI

SEQ ID NO: 76607 - protein, 16 aa, Borrelia burgdorferi B31
FMLKKVYYFLIFLFIV

SEQ ID NO: 76608 - protein, 16 aa, Borrelia burgdorferi B31
MLKKVYYFLIFLFIVA

SEQ ID NO: 76609 - protein, 16 aa, Borrelia burgdorferi B31
LKKVYYFLIFLFIVAC

SEQ ID NO: 76610 - protein, 16 aa, Borrelia burgdorferi B31
KKVYYFLIFLFIVACS

SEQ ID NO: 76611 - protein, 16 aa, Borrelia burgdorferi B31
KVYYFLIFLFIVACSS

SEQ ID NO: 76612 - protein, 16 aa, Borrelia burgdorferi B31
VYYFLIFLFIVACSSS

SEQ ID NO: 76613 - protein, 16 aa, Borrelia burgdorferi B31
YYFLIFLFIVACSSSD

SEQ ID NO: 76614 - protein, 16 aa, Borrelia burgdorferi B31
YFLIFLFIVACSSSDD

SEQ ID NO: 76615 - protein, 16 aa, Borrelia burgdorferi B31
FLIFLFIVACSSSDDG

SEQ ID NO: 76616 - protein, 16 aa, Borrelia burgdorferi B31
LIFLFIVACSSSDDGK

SEQ ID NO: 76617 - protein, 16 aa, Borrelia burgdorferi B31
IFLFIVACSSSDDGKS

SEQ ID NO: 76618 - protein, 16 aa, Borrelia burgdorferi B31
FLFIVACSSSDDGKSE

SEQ ID NO: 76619 - protein, 16 aa, Borrelia burgdorferi B31
LFIVACSSSDDGKSEA

SEQ ID NO: 76620 - protein, 16 aa, Borrelia burgdorferi B31
FIVACSSSDDGKSEAK

SEQ ID NO: 76621 - protein, 16 aa, Borrelia burgdorferi B31
IVACSSSDDGKSEAKT

SEQ ID NO: 76622 - protein, 16 aa, Borrelia burgdorferi B31
VACSSSDDGKSEAKTV

SEQ ID NO: 76623 - protein, 16 aa, Borrelia burgdorferi B31
ACSSSDDGKSEAKTVS

SEQ ID NO: 76624 - protein, 16 aa, Borrelia burgdorferi B31
CSSSDDGKSEAKTVSL

SEQ ID NO: 76625 - protein, 16 aa, Borrelia burgdorferi B31
SSSDDGKSEAKTVSLI

SEQ ID NO: 76626 - protein, 16 aa, Borrelia burgdorferi B31
SSDDGKSEAKTVSLIV

SEQ ID NO: 76627 - protein, 16 aa, Borrelia burgdorferi B31
SDDGKSEAKTVSLIVD

SEQ ID NO: 76628 - protein, 16 aa, Borrelia burgdorferi B31
DDGKSEAKTVSLIVDG

SEQ ID NO: 76629 - protein, 16 aa, Borrelia burgdorferi B31
DGKSEAKTVSLIVDGA

SEQ ID NO: 76630 - protein, 16 aa, Borrelia burgdorferi B31
GKSEAKTVSLIVDGAF

SEQ ID NO: 76631 - protein, 16 aa, Borrelia burgdorferi B31
KSEAKTVSLIVDGAFD

SEQ ID NO: 76632 - protein, 16 aa, Borrelia burgdorferi B31
SEAKTVSLIVDGAFDD

SEQ ID NO: 76633 - protein, 16 aa, Borrelia burgdorferi B31
EAKTVSLIVDGAFDDK

SEQ ID NO: 76634 - protein, 16 aa, Borrelia burgdorferi B31
AKTVSLIVDGAFDDKG

SEQ ID NO: 76635 - protein, 16 aa, Borrelia burgdorferi B31
KTVSLIVDGAFDDKGF

SEQ ID NO: 76636 - protein, 16 aa, Borrelia burgdorferi B31
TVSLIVDGAFDDKGFN

SEQ ID NO: 76637 - protein, 16 aa, Borrelia burgdorferi B31
VSLIVDGAFDDKGFNE

SEQ ID NO: 76638 - protein, 16 aa, Borrelia burgdorferi B31
SLIVDGAFDDKGFNES

SEQ ID NO: 76639 - protein, 16 aa, Borrelia burgdorferi B31
LIVDGAFDDKGFNESS

SEQ ID NO: 76640 - protein, 16 aa, Borrelia burgdorferi B31
IVDGAFDDKGFNESSS

SEQ ID NO: 76641 - protein, 16 aa, Borrelia burgdorferi B31
VDGAFDDKGFNESSSK

SEQ ID NO: 76642 - protein, 16 aa, Borrelia burgdorferi B31
DGAFDDKGFNESSSKA

SEQ ID NO: 76643 - protein, 16 aa, Borrelia burgdorferi B31
GAFDDKGFNESSSKAI

SEQ ID NO: 76644 - protein, 16 aa, Borrelia burgdorferi B31
AFDDKGFNESSSKAIR

SEQ ID NO: 76645 - protein, 16 aa, Borrelia burgdorferi B31
FDDKGFNESSSKAIRK

SEQ ID NO: 76646 - protein, 16 aa, Borrelia burgdorferi B31
DDKGFNESSSKAIRKL

SEQ ID NO: 76647 - protein, 16 aa, Borrelia burgdorferi B31
DKGFNESSSKAIRKLK

SEQ ID NO: 76648 - protein, 16 aa, Borrelia burgdorferi B31
KGFNESSSKAIRKLKA

SEQ ID NO: 76649 - protein, 16 aa, Borrelia burgdorferi B31
GFNESSSKAIRKLKAD

SEQ ID NO: 76650 - protein, 16 aa, Borrelia burgdorferi B31
FNESSSKAIRKLKADL

SEQ ID NO: 76651 - protein, 16 aa, Borrelia burgdorferi B31
NESSSKAIRKLKADLN

SEQ ID NO: 76652 - protein, 16 aa, Borrelia burgdorferi B31
ESSSKAIRKLKADLNI

SEQ ID NO: 76653 - protein, 16 aa, Borrelia burgdorferi B31
SSSKAIRKLKADLNIN

SEQ ID NO: 76654 - protein, 16 aa, Borrelia burgdorferi B31
SSKAIRKLKADLNINI

SEQ ID NO: 76655 - protein, 16 aa, Borrelia burgdorferi B31
SKAIRKLKADLNINII

SEQ ID NO: 76656 - protein, 16 aa, Borrelia burgdorferi B31
KAIRKLKADLNINIIE

SEQ ID NO: 76657 - protein, 16 aa, Borrelia burgdorferi B31
AIRKLKADLNINIIEK

SEQ ID NO: 76658 - protein, 16 aa, Borrelia burgdorferi B31
IRKLKADLNINIIEKA

SEQ ID NO: 76659 - protein, 16 aa, Borrelia burgdorferi B31
RKLKADLNINIIEKAS

SEQ ID NO: 76660 - protein, 16 aa, Borrelia burgdorferi B31
KLKADLNINIIEKAST

SEQ ID NO: 76661 - protein, 16 aa, Borrelia burgdorferi B31
LKADLNINIIEKASTG

SEQ ID NO: 76662 - protein, 16 aa, Borrelia burgdorferi B31
KADLNINIIEKASTGN

SEQ ID NO: 76663 - protein, 16 aa, Borrelia burgdorferi B31
ADLNINIIEKASTGNS

SEQ ID NO: 76664 - protein, 16 aa, Borrelia burgdorferi B31
DLNINIIEKASTGNSY

SEQ ID NO: 76665 - protein, 16 aa, Borrelia burgdorferi B31
LNINIIEKASTGNSYL

SEQ ID NO: 76666 - protein, 16 aa, Borrelia burgdorferi B31
NINIIEKASTGNSYLG

SEQ ID NO: 76667 - protein, 16 aa, Borrelia burgdorferi B31
INIIEKASTGNSYLGD

SEQ ID NO: 76668 - protein, 16 aa, Borrelia burgdorferi B31
NIIEKASTGNSYLGDI

SEQ ID NO: 76669 - protein, 16 aa, Borrelia burgdorferi B31
IIEKASTGNSYLGDIA

SEQ ID NO: 76670 - protein, 16 aa, Borrelia burgdorferi B31
IEKASTGNSYLGDIAN

SEQ ID NO: 76671 - protein, 16 aa, Borrelia burgdorferi B31
EKASTGNSYLGDIANL

SEQ ID NO: 76672 - protein, 16 aa, Borrelia burgdorferi B31
KASTGNSYLGDIANLE

SEQ ID NO: 76673 - protein, 16 aa, Borrelia burgdorferi B31
ASTGNSYLGDIANLED

SEQ ID NO: 76674 - protein, 16 aa, Borrelia burgdorferi B31
STGNSYLGDIANLEDG

SEQ ID NO: 76675 - protein, 16 aa, Borrelia burgdorferi B31
TGNSYLGDIANLEDGN

SEQ ID NO: 76676 - protein, 16 aa, Borrelia burgdorferi B31
GNSYLGDIANLEDGNS

SEQ ID NO: 76677 - protein, 16 aa, Borrelia burgdorferi B31
NSYLGDIANLEDGNSN

SEQ ID NO: 76678 - protein, 16 aa, Borrelia burgdorferi B31
SYLGDIANLEDGNSNL

SEQ ID NO: 76679 - protein, 16 aa, Borrelia burgdorferi B31
YLGDIANLEDGNSNLI

SEQ ID NO: 76680 - protein, 16 aa, Borrelia burgdorferi B31
LGDIANLEDGNSNLIW

SEQ ID NO: 76681 - protein, 16 aa, Borrelia burgdorferi B31
GDIANLEDGNSNLIWG

SEQ ID NO: 76682 - protein, 16 aa, Borrelia burgdorferi B31
DIANLEDGNSNLIWGI

SEQ ID NO: 76683 - protein, 16 aa, Borrelia burgdorferi B31
IANLEDGNSNLIWGIG

SEQ ID NO: 76684 - protein, 16 aa, Borrelia burgdorferi B31
ANLEDGNSNLIWGIGF

SEQ ID NO: 76685 - protein, 16 aa, Borrelia burgdorferi B31
NLEDGNSNLIWGIGFR

SEQ ID NO: 76686 - protein, 16 aa, Borrelia burgdorferi B31
LEDGNSNLIWGIGFRL

SEQ ID NO: 76687 - protein, 16 aa, Borrelia burgdorferi B31
EDGNSNLIWGIGFRLS

SEQ ID NO: 76688 - protein, 16 aa, Borrelia burgdorferi B31
DGNSNLIWGIGFRLSD

SEQ ID NO: 76689 - protein, 16 aa, Borrelia burgdorferi B31
GNSNLIWGIGFRLSDI

SEQ ID NO: 76690 - protein, 16 aa, Borrelia burgdorferi B31
NSNLIWGIGFRLSDIL

SEQ ID NO: 76691 - protein, 16 aa, Borrelia burgdorferi B31
SNLIWGIGFRLSDILF

SEQ ID NO: 76692 - protein, 16 aa, Borrelia burgdorferi B31
NLIWGIGFRLSDILFQ

SEQ ID NO: 76693 - protein, 16 aa, Borrelia burgdorferi B31
LIWGIGFRLSDILFQR

SEQ ID NO: 76694 - protein, 16 aa, Borrelia burgdorferi B31
IWGIGFRLSDILFQRA

SEQ ID NO: 76695 - protein, 16 aa, Borrelia burgdorferi B31
WGIGFRLSDILFQRAS

SEQ ID NO: 76696 - protein, 16 aa, Borrelia burgdorferi B31
GIGFRLSDILFQRASE

SEQ ID NO: 76697 - protein, 16 aa, Borrelia burgdorferi B31
IGFRLSDILFQRASEN

SEQ ID NO: 76698 - protein, 16 aa, Borrelia burgdorferi B31
GFRLSDILFQRASENV

SEQ ID NO: 76699 - protein, 16 aa, Borrelia burgdorferi B31
FRLSDILFQRASENVS

SEQ ID NO: 76700 - protein, 16 aa, Borrelia burgdorferi B31
RLSDILFQRASENVSV

SEQ ID NO: 76701 - protein, 16 aa, Borrelia burgdorferi B31
LSDILFQRASENVSVN

SEQ ID NO: 76702 - protein, 16 aa, Borrelia burgdorferi B31
SDILFQRASENVSVNY

SEQ ID NO: 76703 - protein, 16 aa, Borrelia burgdorferi B31
DILFQRASENVSVNYA

SEQ ID NO: 76704 - protein, 16 aa, Borrelia burgdorferi B31
ILFQRASENVSVNYAI

SEQ ID NO: 76705 - protein, 16 aa, Borrelia burgdorferi B31
LFQRASENVSVNYAII

SEQ ID NO: 76706 - protein, 16 aa, Borrelia burgdorferi B31
FQRASENVSVNYAIIE

SEQ ID NO: 76707 - protein, 16 aa, Borrelia burgdorferi B31
QRASENVSVNYAIIEG

SEQ ID NO: 76708 - protein, 16 aa, Borrelia burgdorferi B31
RASENVSVNYAIIEGV

SEQ ID NO: 76709 - protein, 16 aa, Borrelia burgdorferi B31
ASENVSVNYAIIEGVY

SEQ ID NO: 76710 - protein, 16 aa, Borrelia burgdorferi B31
SENVSVNYAIIEGVYD

SEQ ID NO: 76711 - protein, 16 aa, Borrelia burgdorferi B31
ENVSVNYAIIEGVYDE

SEQ ID NO: 76712 - protein, 16 aa, Borrelia burgdorferi B31
NVSVNYAIIEGVYDEI

SEQ ID NO: 76713 - protein, 16 aa, Borrelia burgdorferi B31
VSVNYAIIEGVYDEIQ

SEQ ID NO: 76714 - protein, 16 aa, Borrelia burgdorferi B31
SVNYAIIEGVYDEIQI

SEQ ID NO: 76715 - protein, 16 aa, Borrelia burgdorferi B31
VNYAIIEGVYDEIQIP

SEQ ID NO: 76716 - protein, 16 aa, Borrelia burgdorferi B31
NYAIIEGVYDEIQIPK

SEQ ID NO: 76717 - protein, 16 aa, Borrelia burgdorferi B31
YAIIEGVYDEIQIPKN

SEQ ID NO: 76718 - protein, 16 aa, Borrelia burgdorferi B31
AIIEGVYDEIQIPKNL

SEQ ID NO: 76719 - protein, 16 aa, Borrelia burgdorferi B31
IIEGVYDEIQIPKNLL

SEQ ID NO: 76720 - protein, 16 aa, Borrelia burgdorferi B31
IEGVYDEIQIPKNLLN

SEQ ID NO: 76721 - protein, 16 aa, Borrelia burgdorferi B31
EGVYDEIQIPKNLLNI

SEQ ID NO: 76722 - protein, 16 aa, Borrelia burgdorferi B31
GVYDEIQIPKNLLNIS

SEQ ID NO: 76723 - protein, 16 aa, Borrelia burgdorferi B31
VYDEIQIPKNLLNISF

SEQ ID NO: 76724 - protein, 16 aa, Borrelia burgdorferi B31
YDEIQIPKNLLNISFR

SEQ ID NO: 76725 - protein, 16 aa, Borrelia burgdorferi B31
DEIQIPKNLLNISFRS

SEQ ID NO: 76726 - protein, 16 aa, Borrelia burgdorferi B31
EIQIPKNLLNISFRSE

SEQ ID NO: 76727 - protein, 16 aa, Borrelia burgdorferi B31
IQIPKNLLNISFRSEE

SEQ ID NO: 76728 - protein, 16 aa, Borrelia burgdorferi B31
QIPKNLLNISFRSEEV

SEQ ID NO: 76729 - protein, 16 aa, Borrelia burgdorferi B31
IPKNLLNISFRSEEVA

SEQ ID NO: 76730 - protein, 16 aa, Borrelia burgdorferi B31
PKNLLNISFRSEEVAF

SEQ ID NO: 76731 - protein, 16 aa, Borrelia burgdorferi B31
KNLLNISFRSEEVAFL

SEQ ID NO: 76732 - protein, 16 aa, Borrelia burgdorferi B31
NLLNISFRSEEVAFLA

SEQ ID NO: 76733 - protein, 16 aa, Borrelia burgdorferi B31
LLNISFRSEEVAFLAG

SEQ ID NO: 76734 - protein, 16 aa, Borrelia burgdorferi B31
LNISFRSEEVAFLAGY

SEQ ID NO: 76735 - protein, 16 aa, Borrelia burgdorferi B31
NISFRSEEVAFLAGYF

SEQ ID NO: 76736 - protein, 16 aa, Borrelia burgdorferi B31
ISFRSEEVAFLAGYFA

SEQ ID NO: 76737 - protein, 16 aa, Borrelia burgdorferi B31
SFRSEEVAFLAGYFAS

SEQ ID NO: 76738 - protein, 16 aa, Borrelia burgdorferi B31
FRSEEVAFLAGYFASK

SEQ ID NO: 76739 - protein, 16 aa, Borrelia burgdorferi B31
RSEEVAFLAGYFASKA

SEQ ID NO: 76740 - protein, 16 aa, Borrelia burgdorferi B31
SEEVAFLAGYFASKAS

SEQ ID NO: 76741 - protein, 16 aa, Borrelia burgdorferi B31
EEVAFLAGYFASKASK

SEQ ID NO: 76742 - protein, 16 aa, Borrelia burgdorferi B31
EVAFLAGYFASKASKT

SEQ ID NO: 76743 - protein, 16 aa, Borrelia burgdorferi B31
VAFLAGYFASKASKTG

SEQ ID NO: 76744 - protein, 16 aa, Borrelia burgdorferi B31
AFLAGYFASKASKTGK

SEQ ID NO: 76745 - protein, 16 aa, Borrelia burgdorferi B31
FLAGYFASKASKTGKI

SEQ ID NO: 76746 - protein, 16 aa, Borrelia burgdorferi B31
LAGYFASKASKTGKIG

SEQ ID NO: 76747 - protein, 16 aa, Borrelia burgdorferi B31
AGYFASKASKTGKIGF

SEQ ID NO: 76748 - protein, 16 aa, Borrelia burgdorferi B31
GYFASKASKTGKIGFV

SEQ ID NO: 76749 - protein, 16 aa, Borrelia burgdorferi B31
YFASKASKTGKIGFVG

SEQ ID NO: 76750 - protein, 16 aa, Borrelia burgdorferi B31
FASKASKTGKIGFVGG

SEQ ID NO: 76751 - protein, 16 aa, Borrelia burgdorferi B31
ASKASKTGKIGFVGGV

SEQ ID NO: 76752 - protein, 16 aa, Borrelia burgdorferi B31
SKASKTGKIGFVGGVR

SEQ ID NO: 76753 - protein, 16 aa, Borrelia burgdorferi B31
KASKTGKIGFVGGVRG

SEQ ID NO: 76754 - protein, 16 aa, Borrelia burgdorferi B31
ASKTGKIGFVGGVRGK

SEQ ID NO: 76755 - protein, 16 aa, Borrelia burgdorferi B31
SKTGKIGFVGGVRGKV

SEQ ID NO: 76756 - protein, 16 aa, Borrelia burgdorferi B31
KTGKIGFVGGVRGKVL

SEQ ID NO: 76757 - protein, 16 aa, Borrelia burgdorferi B31
TGKIGFVGGVRGKVLE

SEQ ID NO: 76758 - protein, 16 aa, Borrelia burgdorferi B31
GKIGFVGGVRGKVLES

SEQ ID NO: 76759 - protein, 16 aa, Borrelia burgdorferi B31
KIGFVGGVRGKVLESF

SEQ ID NO: 76760 - protein, 16 aa, Borrelia burgdorferi B31
IGFVGGVRGKVLESFM

SEQ ID NO: 76761 - protein, 16 aa, Borrelia burgdorferi B31
GFVGGVRGKVLESFMY

SEQ ID NO: 76762 - protein, 16 aa, Borrelia burgdorferi B31
FVGGVRGKVLESFMYG

SEQ ID NO: 76763 - protein, 16 aa, Borrelia burgdorferi B31
VGGVRGKVLESFMYGY

SEQ ID NO: 76764 - protein, 16 aa, Borrelia burgdorferi B31
GGVRGKVLESFMYGYE

SEQ ID NO: 76765 - protein, 16 aa, Borrelia burgdorferi B31
GVRGKVLESFMYGYEA

SEQ ID NO: 76766 - protein, 16 aa, Borrelia burgdorferi B31
VRGKVLESFMYGYEAG

SEQ ID NO: 76767 - protein, 16 aa, Borrelia burgdorferi B31
RGKVLESFMYGYEAGA

SEQ ID NO: 76768 - protein, 16 aa, Borrelia burgdorferi B31
GKVLESFMYGYEAGAK

SEQ ID NO: 76769 - protein, 16 aa, Borrelia burgdorferi B31
KVLESFMYGYEAGAKY

SEQ ID NO: 76770 - protein, 16 aa, Borrelia burgdorferi B31
VLESFMYGYEAGAKYA

SEQ ID NO: 76771 - protein, 16 aa, Borrelia burgdorferi B31
LESFMYGYEAGAKYAN

SEQ ID NO: 76772 - protein, 16 aa, Borrelia burgdorferi B31
ESFMYGYEAGAKYANS

SEQ ID NO: 76773 - protein, 16 aa, Borrelia burgdorferi B31
SFMYGYEAGAKYANSN

SEQ ID NO: 76774 - protein, 16 aa, Borrelia burgdorferi B31
FMYGYEAGAKYANSNI

SEQ ID NO: 76775 - protein, 16 aa, Borrelia burgdorferi B31
MYGYEAGAKYANSNIK

SEQ ID NO: 76776 - protein, 16 aa, Borrelia burgdorferi B31
YGYEAGAKYANSNIKV

SEQ ID NO: 76777 - protein, 16 aa, Borrelia burgdorferi B31
GYEAGAKYANSNIKVV

SEQ ID NO: 76778 - protein, 16 aa, Borrelia burgdorferi B31
YEAGAKYANSNIKVVS

SEQ ID NO: 76779 - protein, 16 aa, Borrelia burgdorferi B31
EAGAKYANSNIKVVSQ

SEQ ID NO: 76780 - protein, 16 aa, Borrelia burgdorferi B31
AGAKYANSNIKVVSQY

SEQ ID NO: 76781 - protein, 16 aa, Borrelia burgdorferi B31
GAKYANSNIKVVSQYV

SEQ ID NO: 76782 - protein, 16 aa, Borrelia burgdorferi B31
AKYANSNIKVVSQYVG

SEQ ID NO: 76783 - protein, 16 aa, Borrelia burgdorferi B31
KYANSNIKVVSQYVGT

SEQ ID NO: 76784 - protein, 16 aa, Borrelia burgdorferi B31
YANSNIKVVSQYVGTF

SEQ ID NO: 76785 - protein, 16 aa, Borrelia burgdorferi B31
ANSNIKVVSQYVGTFG

SEQ ID NO: 76786 - protein, 16 aa, Borrelia burgdorferi B31
NSNIKVVSQYVGTFGD

SEQ ID NO: 76787 - protein, 16 aa, Borrelia burgdorferi B31
SNIKVVSQYVGTFGDF

SEQ ID NO: 76788 - protein, 16 aa, Borrelia burgdorferi B31
NIKVVSQYVGTFGDFG

SEQ ID NO: 76789 - protein, 16 aa, Borrelia burgdorferi B31
IKVVSQYVGTFGDFGL

SEQ ID NO: 76790 - protein, 16 aa, Borrelia burgdorferi B31
KVVSQYVGTFGDFGLG

SEQ ID NO: 76791 - protein, 16 aa, Borrelia burgdorferi B31
VVSQYVGTFGDFGLGR

SEQ ID NO: 76792 - protein, 16 aa, Borrelia burgdorferi B31
VSQYVGTFGDFGLGRS

SEQ ID NO: 76793 - protein, 16 aa, Borrelia burgdorferi B31
SQYVGTFGDFGLGRST

SEQ ID NO: 76794 - protein, 16 aa, Borrelia burgdorferi B31
QYVGTFGDFGLGRSTA

SEQ ID NO: 76795 - protein, 16 aa, Borrelia burgdorferi B31
YVGTFGDFGLGRSTAS

SEQ ID NO: 76796 - protein, 16 aa, Borrelia burgdorferi B31
VGTFGDFGLGRSTASN

SEQ ID NO: 76797 - protein, 16 aa, Borrelia burgdorferi B31
GTFGDFGLGRSTASNM

SEQ ID NO: 76798 - protein, 16 aa, Borrelia burgdorferi B31
TFGDFGLGRSTASNMY

SEQ ID NO: 76799 - protein, 16 aa, Borrelia burgdorferi B31
FGDFGLGRSTASNMYR

SEQ ID NO: 76800 - protein, 16 aa, Borrelia burgdorferi B31
GDFGLGRSTASNMYRD

SEQ ID NO: 76801 - protein, 16 aa, Borrelia burgdorferi B31
DFGLGRSTASNMYRDG

SEQ ID NO: 76802 - protein, 16 aa, Borrelia burgdorferi B31
FGLGRSTASNMYRDGV

SEQ ID NO: 76803 - protein, 16 aa, Borrelia burgdorferi B31
GLGRSTASNMYRDGVD

SEQ ID NO: 76804 - protein, 16 aa, Borrelia burgdorferi B31
LGRSTASNMYRDGVDI

SEQ ID NO: 76805 - protein, 16 aa, Borrelia burgdorferi B31
GRSTASNMYRDGVDII

SEQ ID NO: 76806 - protein, 16 aa, Borrelia burgdorferi B31
RSTASNMYRDGVDIIF

SEQ ID NO: 76807 - protein, 16 aa, Borrelia burgdorferi B31
STASNMYRDGVDIIFA

SEQ ID NO: 76808 - protein, 16 aa, Borrelia burgdorferi B31
TASNMYRDGVDIIFAA

SEQ ID NO: 76809 - protein, 16 aa, Borrelia burgdorferi B31
ASNMYRDGVDIIFAAA

SEQ ID NO: 76810 - protein, 16 aa, Borrelia burgdorferi B31
SNMYRDGVDIIFAAAG

SEQ ID NO: 76811 - protein, 16 aa, Borrelia burgdorferi B31
NMYRDGVDIIFAAAGL

SEQ ID NO: 76812 - protein, 16 aa, Borrelia burgdorferi B31
MYRDGVDIIFAAAGLS

SEQ ID NO: 76813 - protein, 16 aa, Borrelia burgdorferi B31
YRDGVDIIFAAAGLSG

SEQ ID NO: 76814 - protein, 16 aa, Borrelia burgdorferi B31
RDGVDIIFAAAGLSGI

SEQ ID NO: 76815 - protein, 16 aa, Borrelia burgdorferi B31
DGVDIIFAAAGLSGIG

SEQ ID NO: 76816 - protein, 16 aa, Borrelia burgdorferi B31
GVDIIFAAAGLSGIGV

SEQ ID NO: 76817 - protein, 16 aa, Borrelia burgdorferi B31
VDIIFAAAGLSGIGVI

SEQ ID NO: 76818 - protein, 16 aa, Borrelia burgdorferi B31
DIIFAAAGLSGIGVIE

SEQ ID NO: 76819 - protein, 16 aa, Borrelia burgdorferi B31
IIFAAAGLSGIGVIEA

SEQ ID NO: 76820 - protein, 16 aa, Borrelia burgdorferi B31
IFAAAGLSGIGVIEAA

SEQ ID NO: 76821 - protein, 16 aa, Borrelia burgdorferi B31
FAAAGLSGIGVIEAAK

SEQ ID NO: 76822 - protein, 16 aa, Borrelia burgdorferi B31
AAAGLSGIGVIEAAKE

SEQ ID NO: 76823 - protein, 16 aa, Borrelia burgdorferi B31
AAGLSGIGVIEAAKEL

SEQ ID NO: 76824 - protein, 16 aa, Borrelia burgdorferi B31
AGLSGIGVIEAAKELG

SEQ ID NO: 76825 - protein, 16 aa, Borrelia burgdorferi B31
GLSGIGVIEAAKELGP

SEQ ID NO: 76826 - protein, 16 aa, Borrelia burgdorferi B31
LSGIGVIEAAKELGPD

SEQ ID NO: 76827 - protein, 16 aa, Borrelia burgdorferi B31
SGIGVIEAAKELGPDH

SEQ ID NO: 76828 - protein, 16 aa, Borrelia burgdorferi B31
GIGVIEAAKELGPDHY

SEQ ID NO: 76829 - protein, 16 aa, Borrelia burgdorferi B31
IGVIEAAKELGPDHYI

SEQ ID NO: 76830 - protein, 16 aa, Borrelia burgdorferi B31
GVIEAAKELGPDHYII

SEQ ID NO: 76831 - protein, 16 aa, Borrelia burgdorferi B31
VIEAAKELGPDHYIIG

SEQ ID NO: 76832 - protein, 16 aa, Borrelia burgdorferi B31
IEAAKELGPDHYIIGV

SEQ ID NO: 76833 - protein, 16 aa, Borrelia burgdorferi B31
EAAKELGPDHYIIGVD

SEQ ID NO: 76834 - protein, 16 aa, Borrelia burgdorferi B31
AAKELGPDHYIIGVDQ

SEQ ID NO: 76835 - protein, 16 aa, Borrelia burgdorferi B31
AKELGPDHYIIGVDQD

SEQ ID NO: 76836 - protein, 16 aa, Borrelia burgdorferi B31
KELGPDHYIIGVDQDQ

SEQ ID NO: 76837 - protein, 16 aa, Borrelia burgdorferi B31
ELGPDHYIIGVDQDQS

SEQ ID NO: 76838 - protein, 16 aa, Borrelia burgdorferi B31
LGPDHYIIGVDQDQSY

SEQ ID NO: 76839 - protein, 16 aa, Borrelia burgdorferi B31
GPDHYIIGVDQDQSYL

SEQ ID NO: 76840 - protein, 16 aa, Borrelia burgdorferi B31
PDHYIIGVDQDQSYLA

SEQ ID NO: 76841 - protein, 16 aa, Borrelia burgdorferi B31
DHYIIGVDQDQSYLAP

SEQ ID NO: 76842 - protein, 16 aa, Borrelia burgdorferi B31
HYIIGVDQDQSYLAPN

SEQ ID NO: 76843 - protein, 16 aa, Borrelia burgdorferi B31
YIIGVDQDQSYLAPNN

SEQ ID NO: 76844 - protein, 16 aa, Borrelia burgdorferi B31
IIGVDQDQSYLAPNNV

SEQ ID NO: 76845 - protein, 16 aa, Borrelia burgdorferi B31
IGVDQDQSYLAPNNVI

SEQ ID NO: 76846 - protein, 16 aa, Borrelia burgdorferi B31
GVDQDQSYLAPNNVIV

SEQ ID NO: 76847 - protein, 16 aa, Borrelia burgdorferi B31
VDQDQSYLAPNNVIVS

SEQ ID NO: 76848 - protein, 16 aa, Borrelia burgdorferi B31
DQDQSYLAPNNVIVSA

SEQ ID NO: 76849 - protein, 16 aa, Borrelia burgdorferi B31
QDQSYLAPNNVIVSAV

SEQ ID NO: 76850 - protein, 16 aa, Borrelia burgdorferi B31
DQSYLAPNNVIVSAVK

SEQ ID NO: 76851 - protein, 16 aa, Borrelia burgdorferi B31
QSYLAPNNVIVSAVKK

SEQ ID NO: 76852 - protein, 16 aa, Borrelia burgdorferi B31
SYLAPNNVIVSAVKKV

SEQ ID NO: 76853 - protein, 16 aa, Borrelia burgdorferi B31
YLAPNNVIVSAVKKVD

SEQ ID NO: 76854 - protein, 16 aa, Borrelia burgdorferi B31
LAPNNVIVSAVKKVDS

SEQ ID NO: 76855 - protein, 16 aa, Borrelia burgdorferi B31
APNNVIVSAVKKVDSL

SEQ ID NO: 76856 - protein, 16 aa, Borrelia burgdorferi B31
PNNVIVSAVKKVDSLM

SEQ ID NO: 76857 - protein, 16 aa, Borrelia burgdorferi B31
NNVIVSAVKKVDSLMY

SEQ ID NO: 76858 - protein, 16 aa, Borrelia burgdorferi B31
NVIVSAVKKVDSLMYS

SEQ ID NO: 76859 - protein, 16 aa, Borrelia burgdorferi B31
VIVSAVKKVDSLMYSL

SEQ ID NO: 76860 - protein, 16 aa, Borrelia burgdorferi B31
IVSAVKKVDSLMYSLT

SEQ ID NO: 76861 - protein, 16 aa, Borrelia burgdorferi B31
VSAVKKVDSLMYSLTK

SEQ ID NO: 76862 - protein, 16 aa, Borrelia burgdorferi B31
SAVKKVDSLMYSLTKK

SEQ ID NO: 76863 - protein, 16 aa, Borrelia burgdorferi B31
AVKKVDSLMYSLTKKY

SEQ ID NO: 76864 - protein, 16 aa, Borrelia burgdorferi B31
VKKVDSLMYSLTKKYL

SEQ ID NO: 76865 - protein, 16 aa, Borrelia burgdorferi B31
KKVDSLMYSLTKKYLE

SEQ ID NO: 76866 - protein, 16 aa, Borrelia burgdorferi B31
KVDSLMYSLTKKYLET

SEQ ID NO: 76867 - protein, 16 aa, Borrelia burgdorferi B31
VDSLMYSLTKKYLETG

SEQ ID NO: 76868 - protein, 16 aa, Borrelia burgdorferi B31
DSLMYSLTKKYLETGV

SEQ ID NO: 76869 - protein, 16 aa, Borrelia burgdorferi B31
SLMYSLTKKYLETGVL

SEQ ID NO: 76870 - protein, 16 aa, Borrelia burgdorferi B31
LMYSLTKKYLETGVLD

SEQ ID NO: 76871 - protein, 16 aa, Borrelia burgdorferi B31
MYSLTKKYLETGVLDG

SEQ ID NO: 76872 - protein, 16 aa, Borrelia burgdorferi B31
YSLTKKYLETGVLDGG

SEQ ID NO: 76873 - protein, 16 aa, Borrelia burgdorferi B31
SLTKKYLETGVLDGGK

SEQ ID NO: 76874 - protein, 16 aa, Borrelia burgdorferi B31
LTKKYLETGVLDGGKT

SEQ ID NO: 76875 - protein, 16 aa, Borrelia burgdorferi B31
TKKYLETGVLDGGKTM

SEQ ID NO: 76876 - protein, 16 aa, Borrelia burgdorferi B31
KKYLETGVLDGGKTMF

SEQ ID NO: 76877 - protein, 16 aa, Borrelia burgdorferi B31
KYLETGVLDGGKTMFL

SEQ ID NO: 76878 - protein, 16 aa, Borrelia burgdorferi B31
YLETGVLDGGKTMFLG

SEQ ID NO: 76879 - protein, 16 aa, Borrelia burgdorferi B31
LETGVLDGGKTMFLGL

SEQ ID NO: 76880 - protein, 16 aa, Borrelia burgdorferi B31
ETGVLDGGKTMFLGLK

SEQ ID NO: 76881 - protein, 16 aa, Borrelia burgdorferi B31
TGVLDGGKTMFLGLKE

SEQ ID NO: 76882 - protein, 16 aa, Borrelia burgdorferi B31
GVLDGGKTMFLGLKED

SEQ ID NO: 76883 - protein, 16 aa, Borrelia burgdorferi B31
VLDGGKTMFLGLKEDG

SEQ ID NO: 76884 - protein, 16 aa, Borrelia burgdorferi B31
LDGGKTMFLGLKEDGL

SEQ ID NO: 76885 - protein, 16 aa, Borrelia burgdorferi B31
DGGKTMFLGLKEDGLG

SEQ ID NO: 76886 - protein, 16 aa, Borrelia burgdorferi B31
GGKTMFLGLKEDGLGL

SEQ ID NO: 76887 - protein, 16 aa, Borrelia burgdorferi B31
GKTMFLGLKEDGLGLV

SEQ ID NO: 76888 - protein, 16 aa, Borrelia burgdorferi B31
KTMFLGLKEDGLGLVL

SEQ ID NO: 76889 - protein, 16 aa, Borrelia burgdorferi B31
TMFLGLKEDGLGLVLN

SEQ ID NO: 76890 - protein, 16 aa, Borrelia burgdorferi B31
MFLGLKEDGLGLVLNE

SEQ ID NO: 76891 - protein, 16 aa, Borrelia burgdorferi B31
FLGLKEDGLGLVLNEN

SEQ ID NO: 76892 - protein, 16 aa, Borrelia burgdorferi B31
LGLKEDGLGLVLNENL

SEQ ID NO: 76893 - protein, 16 aa, Borrelia burgdorferi B31
GLKEDGLGLVLNENLK

SEQ ID NO: 76894 - protein, 16 aa, Borrelia burgdorferi B31
LKEDGLGLVLNENLKS

SEQ ID NO: 76895 - protein, 16 aa, Borrelia burgdorferi B31
KEDGLGLVLNENLKSN

SEQ ID NO: 76896 - protein, 16 aa, Borrelia burgdorferi B31
EDGLGLVLNENLKSNY

SEQ ID NO: 76897 - protein, 16 aa, Borrelia burgdorferi B31
DGLGLVLNENLKSNYS

SEQ ID NO: 76898 - protein, 16 aa, Borrelia burgdorferi B31
GLGLVLNENLKSNYSE

SEQ ID NO: 76899 - protein, 16 aa, Borrelia burgdorferi B31
LGLVLNENLKSNYSEI

SEQ ID NO: 76900 - protein, 16 aa, Borrelia burgdorferi B31
GLVLNENLKSNYSEIY

SEQ ID NO: 76901 - protein, 16 aa, Borrelia burgdorferi B31
LVLNENLKSNYSEIYN

SEQ ID NO: 76902 - protein, 16 aa, Borrelia burgdorferi B31
VLNENLKSNYSEIYNK

SEQ ID NO: 76903 - protein, 16 aa, Borrelia burgdorferi B31
LNENLKSNYSEIYNKS

SEQ ID NO: 76904 - protein, 16 aa, Borrelia burgdorferi B31
NENLKSNYSEIYNKSL

SEQ ID NO: 76905 - protein, 16 aa, Borrelia burgdorferi B31
ENLKSNYSEIYNKSLK

SEQ ID NO: 76906 - protein, 16 aa, Borrelia burgdorferi B31
NLKSNYSEIYNKSLKI

SEQ ID NO: 76907 - protein, 16 aa, Borrelia burgdorferi B31
LKSNYSEIYNKSLKIG

SEQ ID NO: 76908 - protein, 16 aa, Borrelia burgdorferi B31
KSNYSEIYNKSLKIGQ

SEQ ID NO: 76909 - protein, 16 aa, Borrelia burgdorferi B31
SNYSEIYNKSLKIGQS

SEQ ID NO: 76910 - protein, 16 aa, Borrelia burgdorferi B31
NYSEIYNKSLKIGQSI

SEQ ID NO: 76911 - protein, 16 aa, Borrelia burgdorferi B31
YSEIYNKSLKIGQSIM

SEQ ID NO: 76912 - protein, 16 aa, Borrelia burgdorferi B31
SEIYNKSLKIGQSIMN

SEQ ID NO: 76913 - protein, 16 aa, Borrelia burgdorferi B31
EIYNKSLKIGQSIMNG

SEQ ID NO: 76914 - protein, 16 aa, Borrelia burgdorferi B31
IYNKSLKIGQSIMNGI

SEQ ID NO: 76915 - protein, 16 aa, Borrelia burgdorferi B31
YNKSLKIGQSIMNGII

SEQ ID NO: 76916 - protein, 16 aa, Borrelia burgdorferi B31
NKSLKIGQSIMNGIIK

SEQ ID NO: 76917 - protein, 16 aa, Borrelia burgdorferi B31
KSLKIGQSIMNGIIKV

SEQ ID NO: 76918 - protein, 16 aa, Borrelia burgdorferi B31
SLKIGQSIMNGIIKVP

SEQ ID NO: 76919 - protein, 16 aa, Borrelia burgdorferi B31
LKIGQSIMNGIIKVPY

SEQ ID NO: 76920 - protein, 16 aa, Borrelia burgdorferi B31
KIGQSIMNGIIKVPYD

SEQ ID NO: 76921 - protein, 16 aa, Borrelia burgdorferi B31
IGQSIMNGIIKVPYDK

SEQ ID NO: 76922 - protein, 16 aa, Borrelia burgdorferi B31
GQSIMNGIIKVPYDKV

SEQ ID NO: 76923 - protein, 16 aa, Borrelia burgdorferi B31
QSIMNGIIKVPYDKVS

SEQ ID NO: 76924 - protein, 16 aa, Borrelia burgdorferi B31
SIMNGIIKVPYDKVSY

SEQ ID NO: 76925 - protein, 16 aa, Borrelia burgdorferi B31
IMNGIIKVPYDKVSYF

SEQ ID NO: 76926 - protein, 16 aa, Borrelia burgdorferi B31
MNGIIKVPYDKVSYFV

SEQ ID NO: 76927 - protein, 16 aa, Borrelia burgdorferi B31
NGIIKVPYDKVSYFVL

SEQ ID NO: 76928 - protein, 16 aa, Borrelia burgdorferi B31
GIIKVPYDKVSYFVLQ

SEQ ID NO: 76929 - protein, 16 aa, Borrelia burgdorferi B31
IIKVPYDKVSYFVLQM

SEQ ID NO: 76930 - protein, 16 aa, Borrelia burgdorferi B31
IKVPYDKVSYFVLQME

SEQ ID NO: 76931 - protein, 16 aa, Borrelia burgdorferi B31
KVPYDKVSYFVLQMEN

SEQ ID NO: 76932 - protein, 13 aa, Borrelia afzelii
MIKYNKIILTLTL

SEQ ID NO: 76933 - protein, 13 aa, Borrelia afzelii
IKYNKIILTLTLL

SEQ ID NO: 76934 - protein, 13 aa, Borrelia afzelii
KYNKIILTLTLLA

SEQ ID NO: 76935 - protein, 13 aa, Borrelia afzelii
YNKIILTLTLLAS

SEQ ID NO: 76936 - protein, 13 aa, Borrelia afzelii
NKIILTLTLLASL

SEQ ID NO: 76937 - protein, 13 aa, Borrelia afzelii
KIILTLTLLASLL

SEQ ID NO: 76938 - protein, 13 aa, Borrelia afzelii
IILTLTLLASLLA

SEQ ID NO: 76939 - protein, 13 aa, Borrelia afzelii
ILTLTLLASLLAA

SEQ ID NO: 76940 - protein, 13 aa, Borrelia afzelii
LTLTLLASLLAAC

SEQ ID NO: 76941 - protein, 13 aa, Borrelia afzelii
TLTLLASLLAACS

SEQ ID NO: 76942 - protein, 13 aa, Borrelia afzelii
LTLLASLLAACSL

SEQ ID NO: 76943 - protein, 13 aa, Borrelia afzelii
TLLASLLAACSLT

SEQ ID NO: 76944 - protein, 13 aa, Borrelia afzelii
LLASLLAACSLTG

SEQ ID NO: 76945 - protein, 13 aa, Borrelia afzelii
LASLLAACSLTGK

SEQ ID NO: 76946 - protein, 13 aa, Borrelia afzelii
ASLLAACSLTGKA

SEQ ID NO: 76947 - protein, 13 aa, Borrelia afzelii
SLLAACSLTGKAR

SEQ ID NO: 76948 - protein, 13 aa, Borrelia afzelii
LLAACSLTGKARL

SEQ ID NO: 76949 - protein, 13 aa, Borrelia afzelii
LAACSLTGKARLE

SEQ ID NO: 76950 - protein, 13 aa, Borrelia afzelii
AACSLTGKARLES

SEQ ID NO: 76951 - protein, 13 aa, Borrelia afzelii
ACSLTGKARLESS

SEQ ID NO: 76952 - protein, 13 aa, Borrelia afzelii
CSLTGKARLESSV

SEQ ID NO: 76953 - protein, 13 aa, Borrelia afzelii
SLTGKARLESSVK

SEQ ID NO: 76954 - protein, 13 aa, Borrelia afzelii
LTGKARLESSVKD

SEQ ID NO: 76955 - protein, 13 aa, Borrelia afzelii
TGKARLESSVKDI

SEQ ID NO: 76956 - protein, 13 aa, Borrelia afzelii
GKARLESSVKDIT

SEQ ID NO: 76957 - protein, 13 aa, Borrelia afzelii
KARLESSVKDITN

SEQ ID NO: 76958 - protein, 13 aa, Borrelia afzelii
ARLESSVKDITNE

SEQ ID NO: 76959 - protein, 13 aa, Borrelia afzelii
RLESSVKDITNEI

SEQ ID NO: 76960 - protein, 13 aa, Borrelia afzelii
LESSVKDITNEIE

SEQ ID NO: 76961 - protein, 13 aa, Borrelia afzelii
ESSVKDITNEIEK

SEQ ID NO: 76962 - protein, 13 aa, Borrelia afzelii
SSVKDITNEIEKA

SEQ ID NO: 76963 - protein, 13 aa, Borrelia afzelii
SVKDITNEIEKAI

SEQ ID NO: 76964 - protein, 13 aa, Borrelia afzelii
VKDITNEIEKAIK

SEQ ID NO: 76965 - protein, 13 aa, Borrelia afzelii
KDITNEIEKAIKE

SEQ ID NO: 76966 - protein, 13 aa, Borrelia afzelii
DITNEIEKAIKEA

SEQ ID NO: 76967 - protein, 13 aa, Borrelia afzelii
ITNEIEKAIKEAE

SEQ ID NO: 76968 - protein, 13 aa, Borrelia afzelii
TNEIEKAIKEAED

SEQ ID NO: 76969 - protein, 13 aa, Borrelia afzelii
NEIEKAIKEAEDA

SEQ ID NO: 76970 - protein, 13 aa, Borrelia afzelii
EIEKAIKEAEDAG

SEQ ID NO: 76971 - protein, 13 aa, Borrelia afzelii
IEKAIKEAEDAGV

SEQ ID NO: 76972 - protein, 13 aa, Borrelia afzelii
EKAIKEAEDAGVK

SEQ ID NO: 76973 - protein, 13 aa, Borrelia afzelii
KAIKEAEDAGVKT

SEQ ID NO: 76974 - protein, 13 aa, Borrelia afzelii
AIKEAEDAGVKTD

SEQ ID NO: 76975 - protein, 13 aa, Borrelia afzelii
IKEAEDAGVKTDA

SEQ ID NO: 76976 - protein, 13 aa, Borrelia afzelii
KEAEDAGVKTDAF

SEQ ID NO: 76977 - protein, 13 aa, Borrelia afzelii
EAEDAGVKTDAFT

SEQ ID NO: 76978 - protein, 13 aa, Borrelia afzelii
AEDAGVKTDAFTE

SEQ ID NO: 76979 - protein, 13 aa, Borrelia afzelii
EDAGVKTDAFTET

SEQ ID NO: 76980 - protein, 13 aa, Borrelia afzelii
DAGVKTDAFTETQ

SEQ ID NO: 76981 - protein, 13 aa, Borrelia afzelii
AGVKTDAFTETQT

SEQ ID NO: 76982 - protein, 13 aa, Borrelia afzelii
GVKTDAFTETQTG

SEQ ID NO: 76983 - protein, 13 aa, Borrelia afzelii
VKTDAFTETQTGG

SEQ ID NO: 76984 - protein, 13 aa, Borrelia afzelii
KTDAFTETQTGGK

SEQ ID NO: 76985 - protein, 13 aa, Borrelia afzelii
TDAFTETQTGGKV

SEQ ID NO: 76986 - protein, 13 aa, Borrelia afzelii
DAFTETQTGGKVG

SEQ ID NO: 76987 - protein, 13 aa, Borrelia afzelii
AFTETQTGGKVGG

SEQ ID NO: 76988 - protein, 13 aa, Borrelia afzelii
FTETQTGGKVGGS

SEQ ID NO: 76989 - protein, 13 aa, Borrelia afzelii
TETQTGGKVGGSQ

SEQ ID NO: 76990 - protein, 13 aa, Borrelia afzelii
ETQTGGKVGGSQI

SEQ ID NO: 76991 - protein, 13 aa, Borrelia afzelii
TQTGGKVGGSQIR

SEQ ID NO: 76992 - protein, 13 aa, Borrelia afzelii
QTGGKVGGSQIRA

SEQ ID NO: 76993 - protein, 13 aa, Borrelia afzelii
TGGKVGGSQIRAA

SEQ ID NO: 76994 - protein, 13 aa, Borrelia afzelii
GGKVGGSQIRAAK

SEQ ID NO: 76995 - protein, 13 aa, Borrelia afzelii
GKVGGSQIRAAKI

SEQ ID NO: 76996 - protein, 13 aa, Borrelia afzelii
KVGGSQIRAAKIR

SEQ ID NO: 76997 - protein, 13 aa, Borrelia afzelii
VGGSQIRAAKIRV

SEQ ID NO: 76998 - protein, 13 aa, Borrelia afzelii
GGSQIRAAKIRVA

SEQ ID NO: 76999 - protein, 13 aa, Borrelia afzelii
GSQIRAAKIRVAD

SEQ ID NO: 77000 - protein, 13 aa, Borrelia afzelii
SQIRAAKIRVADL

SEQ ID NO: 77001 - protein, 13 aa, Borrelia afzelii
QIRAAKIRVADLT

SEQ ID NO: 77002 - protein, 13 aa, Borrelia afzelii
IRAAKIRVADLTI

SEQ ID NO: 77003 - protein, 13 aa, Borrelia afzelii
RAAKIRVADLTIK

SEQ ID NO: 77004 - protein, 13 aa, Borrelia afzelii
AAKIRVADLTIKF

SEQ ID NO: 77005 - protein, 13 aa, Borrelia afzelii
AKIRVADLTIKFL

SEQ ID NO: 77006 - protein, 13 aa, Borrelia afzelii
KIRVADLTIKFLE

SEQ ID NO: 77007 - protein, 13 aa, Borrelia afzelii
IRVADLTIKFLEA

SEQ ID NO: 77008 - protein, 13 aa, Borrelia afzelii
RVADLTIKFLEAT

SEQ ID NO: 77009 - protein, 13 aa, Borrelia afzelii
VADLTIKFLEATE

SEQ ID NO: 77010 - protein, 13 aa, Borrelia afzelii
ADLTIKFLEATEE

SEQ ID NO: 77011 - protein, 13 aa, Borrelia afzelii
DLTIKFLEATEEE

SEQ ID NO: 77012 - protein, 13 aa, Borrelia afzelii
LTIKFLEATEEET

SEQ ID NO: 77013 - protein, 13 aa, Borrelia afzelii
TIKFLEATEEETI

SEQ ID NO: 77014 - protein, 13 aa, Borrelia afzelii
IKFLEATEEETIT

SEQ ID NO: 77015 - protein, 13 aa, Borrelia afzelii
KFLEATEEETITF

SEQ ID NO: 77016 - protein, 13 aa, Borrelia afzelii
FLEATEEETITFK

SEQ ID NO: 77017 - protein, 13 aa, Borrelia afzelii
LEATEEETITFKE

SEQ ID NO: 77018 - protein, 13 aa, Borrelia afzelii
EATEEETITFKEN

SEQ ID NO: 77019 - protein, 13 aa, Borrelia afzelii
ATEEETITFKENG

SEQ ID NO: 77020 - protein, 13 aa, Borrelia afzelii
TEEETITFKENGA

SEQ ID NO: 77021 - protein, 13 aa, Borrelia afzelii
EEETITFKENGAG

SEQ ID NO: 77022 - protein, 13 aa, Borrelia afzelii
EETITFKENGAGE

SEQ ID NO: 77023 - protein, 13 aa, Borrelia afzelii
ETITFKENGAGEE

SEQ ID NO: 77024 - protein, 13 aa, Borrelia afzelii
TITFKENGAGEED

SEQ ID NO: 77025 - protein, 13 aa, Borrelia afzelii
ITFKENGAGEEDF

SEQ ID NO: 77026 - protein, 13 aa, Borrelia afzelii
TFKENGAGEEDFS

SEQ ID NO: 77027 - protein, 13 aa, Borrelia afzelii
FKENGAGEEDFSG

SEQ ID NO: 77028 - protein, 13 aa, Borrelia afzelii
KENGAGEEDFSGI

SEQ ID NO: 77029 - protein, 13 aa, Borrelia afzelii
ENGAGEEDFSGIY

SEQ ID NO: 77030 - protein, 13 aa, Borrelia afzelii
NGAGEEDFSGIYD

SEQ ID NO: 77031 - protein, 13 aa, Borrelia afzelii
GAGEEDFSGIYDL

SEQ ID NO: 77032 - protein, 13 aa, Borrelia afzelii
AGEEDFSGIYDLI

SEQ ID NO: 77033 - protein, 13 aa, Borrelia afzelii
GEEDFSGIYDLIL

SEQ ID NO: 77034 - protein, 13 aa, Borrelia afzelii
EEDFSGIYDLILN

SEQ ID NO: 77035 - protein, 13 aa, Borrelia afzelii
EDFSGIYDLILNA

SEQ ID NO: 77036 - protein, 13 aa, Borrelia afzelii
DFSGIYDLILNAA

SEQ ID NO: 77037 - protein, 13 aa, Borrelia afzelii
FSGIYDLILNAAK

SEQ ID NO: 77038 - protein, 13 aa, Borrelia afzelii
SGIYDLILNAAKA

SEQ ID NO: 77039 - protein, 13 aa, Borrelia afzelii
GIYDLILNAAKAV

SEQ ID NO: 77040 - protein, 13 aa, Borrelia afzelii
IYDLILNAAKAVE

SEQ ID NO: 77041 - protein, 13 aa, Borrelia afzelii
YDLILNAAKAVEK

SEQ ID NO: 77042 - protein, 13 aa, Borrelia afzelii
DLILNAAKAVEKI

SEQ ID NO: 77043 - protein, 13 aa, Borrelia afzelii
LILNAAKAVEKIG

SEQ ID NO: 77044 - protein, 13 aa, Borrelia afzelii
ILNAAKAVEKIGM

SEQ ID NO: 77045 - protein, 13 aa, Borrelia afzelii
LNAAKAVEKIGMQ

SEQ ID NO: 77046 - protein, 13 aa, Borrelia afzelii
NAAKAVEKIGMQG

SEQ ID NO: 77047 - protein, 13 aa, Borrelia afzelii
AAKAVEKIGMQGM

SEQ ID NO: 77048 - protein, 13 aa, Borrelia afzelii
AKAVEKIGMQGMK

SEQ ID NO: 77049 - protein, 13 aa, Borrelia afzelii
KAVEKIGMQGMKQ

SEQ ID NO: 77050 - protein, 13 aa, Borrelia afzelii
AVEKIGMQGMKQA

SEQ ID NO: 77051 - protein, 13 aa, Borrelia afzelii
VEKIGMQGMKQAV

SEQ ID NO: 77052 - protein, 13 aa, Borrelia afzelii
EKIGMQGMKQAVE

SEQ ID NO: 77053 - protein, 13 aa, Borrelia afzelii
KIGMQGMKQAVEE

SEQ ID NO: 77054 - protein, 13 aa, Borrelia afzelii
IGMQGMKQAVEEA

SEQ ID NO: 77055 - protein, 13 aa, Borrelia afzelii
GMQGMKQAVEEAA

SEQ ID NO: 77056 - protein, 13 aa, Borrelia afzelii
MQGMKQAVEEAAK

SEQ ID NO: 77057 - protein, 13 aa, Borrelia afzelii
QGMKQAVEEAAKE

SEQ ID NO: 77058 - protein, 13 aa, Borrelia afzelii
GMKQAVEEAAKEK

SEQ ID NO: 77059 - protein, 13 aa, Borrelia afzelii
MKQAVEEAAKEKP

SEQ ID NO: 77060 - protein, 13 aa, Borrelia afzelii
KQAVEEAAKEKPK

SEQ ID NO: 77061 - protein, 13 aa, Borrelia afzelii
QAVEEAAKEKPKT

SEQ ID NO: 77062 - protein, 13 aa, Borrelia afzelii
AVEEAAKEKPKTT

SEQ ID NO: 77063 - protein, 13 aa, Borrelia afzelii
VEEAAKEKPKTTA

SEQ ID NO: 77064 - protein, 13 aa, Borrelia afzelii
EEAAKEKPKTTAD

SEQ ID NO: 77065 - protein, 13 aa, Borrelia afzelii
EAAKEKPKTTADG

SEQ ID NO: 77066 - protein, 13 aa, Borrelia afzelii
AAKEKPKTTADGI

SEQ ID NO: 77067 - protein, 13 aa, Borrelia afzelii
AKEKPKTTADGII

SEQ ID NO: 77068 - protein, 13 aa, Borrelia afzelii
KEKPKTTADGIIA

SEQ ID NO: 77069 - protein, 13 aa, Borrelia afzelii
EKPKTTADGIIAI

SEQ ID NO: 77070 - protein, 13 aa, Borrelia afzelii
KPKTTADGIIAIV

SEQ ID NO: 77071 - protein, 13 aa, Borrelia afzelii
PKTTADGIIAIVK

SEQ ID NO: 77072 - protein, 13 aa, Borrelia afzelii
KTTADGIIAIVKV

SEQ ID NO: 77073 - protein, 13 aa, Borrelia afzelii
TTADGIIAIVKVM

SEQ ID NO: 77074 - protein, 13 aa, Borrelia afzelii
TADGIIAIVKVMK

SEQ ID NO: 77075 - protein, 13 aa, Borrelia afzelii
ADGIIAIVKVMKA

SEQ ID NO: 77076 - protein, 13 aa, Borrelia afzelii
DGIIAIVKVMKAK

SEQ ID NO: 77077 - protein, 13 aa, Borrelia afzelii
GIIAIVKVMKAKV

SEQ ID NO: 77078 - protein, 13 aa, Borrelia afzelii
IIAIVKVMKAKVE

SEQ ID NO: 77079 - protein, 13 aa, Borrelia afzelii
IAIVKVMKAKVEN

SEQ ID NO: 77080 - protein, 13 aa, Borrelia afzelii
AIVKVMKAKVENI

SEQ ID NO: 77081 - protein, 13 aa, Borrelia afzelii
IVKVMKAKVENIK

SEQ ID NO: 77082 - protein, 13 aa, Borrelia afzelii
VKVMKAKVENIKE

SEQ ID NO: 77083 - protein, 13 aa, Borrelia afzelii
KVMKAKVENIKEK

SEQ ID NO: 77084 - protein, 13 aa, Borrelia afzelii
VMKAKVENIKEKQ

SEQ ID NO: 77085 - protein, 13 aa, Borrelia afzelii
MKAKVENIKEKQT

SEQ ID NO: 77086 - protein, 13 aa, Borrelia afzelii
KAKVENIKEKQTK

SEQ ID NO: 77087 - protein, 13 aa, Borrelia afzelii
AKVENIKEKQTKN

SEQ ID NO: 77088 - protein, 13 aa, Borrelia afzelii
KVENIKEKQTKNQ

SEQ ID NO: 77089 - protein, 13 aa, Borrelia afzelii
VENIKEKQTKNQK

SEQ ID NO: 77090 - protein, 14 aa, Borrelia afzelii
MIKYNKIILTLTLL

SEQ ID NO: 77091 - protein, 14 aa, Borrelia afzelii
IKYNKIILTLTLLA

SEQ ID NO: 77092 - protein, 14 aa, Borrelia afzelii
KYNKIILTLTLLAS

SEQ ID NO: 77093 - protein, 14 aa, Borrelia afzelii
YNKIILTLTLLASL

SEQ ID NO: 77094 - protein, 14 aa, Borrelia afzelii
NKIILTLTLLASLL

SEQ ID NO: 77095 - protein, 14 aa, Borrelia afzelii
KIILTLTLLASLLA

SEQ ID NO: 77096 - protein, 14 aa, Borrelia afzelii
IILTLTLLASLLAA

SEQ ID NO: 77097 - protein, 14 aa, Borrelia afzelii
ILTLTLLASLLAAC

SEQ ID NO: 77098 - protein, 14 aa, Borrelia afzelii
LTLTLLASLLAACS

SEQ ID NO: 77099 - protein, 14 aa, Borrelia afzelii
TLTLLASLLAACSL

SEQ ID NO: 77100 - protein, 14 aa, Borrelia afzelii
LTLLASLLAACSLT

SEQ ID NO: 77101 - protein, 14 aa, Borrelia afzelii
TLLASLLAACSLTG

SEQ ID NO: 77102 - protein, 14 aa, Borrelia afzelii
LLASLLAACSLTGK

SEQ ID NO: 77103 - protein, 14 aa, Borrelia afzelii
LASLLAACSLTGKA

SEQ ID NO: 77104 - protein, 14 aa, Borrelia afzelii
ASLLAACSLTGKAR

SEQ ID NO: 77105 - protein, 14 aa, Borrelia afzelii
SLLAACSLTGKARL

SEQ ID NO: 77106 - protein, 14 aa, Borrelia afzelii
LLAACSLTGKARLE

SEQ ID NO: 77107 - protein, 14 aa, Borrelia afzelii
LAACSLTGKARLES

SEQ ID NO: 77108 - protein, 14 aa, Borrelia afzelii
AACSLTGKARLESS

SEQ ID NO: 77109 - protein, 14 aa, Borrelia afzelii
ACSLTGKARLESSV

SEQ ID NO: 77110 - protein, 14 aa, Borrelia afzelii
CSLTGKARLESSVK

SEQ ID NO: 77111 - protein, 14 aa, Borrelia afzelii
SLTGKARLESSVKD

SEQ ID NO: 77112 - protein, 14 aa, Borrelia afzelii
LTGKARLESSVKDI

SEQ ID NO: 77113 - protein, 14 aa, Borrelia afzelii
TGKARLESSVKDIT

SEQ ID NO: 77114 - protein, 14 aa, Borrelia afzelii
GKARLESSVKDITN

SEQ ID NO: 77115 - protein, 14 aa, Borrelia afzelii
KARLESSVKDITNE

SEQ ID NO: 77116 - protein, 14 aa, Borrelia afzelii
ARLESSVKDITNEI

SEQ ID NO: 77117 - protein, 14 aa, Borrelia afzelii
RLESSVKDITNEIE

SEQ ID NO: 77118 - protein, 14 aa, Borrelia afzelii
LESSVKDITNEIEK

SEQ ID NO: 77119 - protein, 14 aa, Borrelia afzelii
ESSVKDITNEIEKA

SEQ ID NO: 77120 - protein, 14 aa, Borrelia afzelii
SSVKDITNEIEKAI

SEQ ID NO: 77121 - protein, 14 aa, Borrelia afzelii
SVKDITNEIEKAIK

SEQ ID NO: 77122 - protein, 14 aa, Borrelia afzelii
VKDITNEIEKAIKE

SEQ ID NO: 77123 - protein, 14 aa, Borrelia afzelii
KDITNEIEKAIKEA

SEQ ID NO: 77124 - protein, 14 aa, Borrelia afzelii
DITNEIEKAIKEAE

SEQ ID NO: 77125 - protein, 14 aa, Borrelia afzelii
ITNEIEKAIKEAED

SEQ ID NO: 77126 - protein, 14 aa, Borrelia afzelii
TNEIEKAIKEAEDA

SEQ ID NO: 77127 - protein, 14 aa, Borrelia afzelii
NEIEKAIKEAEDAG

SEQ ID NO: 77128 - protein, 14 aa, Borrelia afzelii
EIEKAIKEAEDAGV

SEQ ID NO: 77129 - protein, 14 aa, Borrelia afzelii
IEKAIKEAEDAGVK

SEQ ID NO: 77130 - protein, 14 aa, Borrelia afzelii
EKAIKEAEDAGVKT

SEQ ID NO: 77131 - protein, 14 aa, Borrelia afzelii
KAIKEAEDAGVKTD

SEQ ID NO: 77132 - protein, 14 aa, Borrelia afzelii
AIKEAEDAGVKTDA

SEQ ID NO: 77133 - protein, 14 aa, Borrelia afzelii
IKEAEDAGVKTDAF

SEQ ID NO: 77134 - protein, 14 aa, Borrelia afzelii
KEAEDAGVKTDAFT

SEQ ID NO: 77135 - protein, 14 aa, Borrelia afzelii
EAEDAGVKTDAFTE

SEQ ID NO: 77136 - protein, 14 aa, Borrelia afzelii
AEDAGVKTDAFTET

SEQ ID NO: 77137 - protein, 14 aa, Borrelia afzelii
EDAGVKTDAFTETQ

SEQ ID NO: 77138 - protein, 14 aa, Borrelia afzelii
DAGVKTDAFTETQT

SEQ ID NO: 77139 - protein, 14 aa, Borrelia afzelii
AGVKTDAFTETQTG

SEQ ID NO: 77140 - protein, 14 aa, Borrelia afzelii
GVKTDAFTETQTGG

SEQ ID NO: 77141 - protein, 14 aa, Borrelia afzelii
VKTDAFTETQTGGK

SEQ ID NO: 77142 - protein, 14 aa, Borrelia afzelii
KTDAFTETQTGGKV

SEQ ID NO: 77143 - protein, 14 aa, Borrelia afzelii
TDAFTETQTGGKVG

SEQ ID NO: 77144 - protein, 14 aa, Borrelia afzelii
DAFTETQTGGKVGG

SEQ ID NO: 77145 - protein, 14 aa, Borrelia afzelii
AFTETQTGGKVGGS

SEQ ID NO: 77146 - protein, 14 aa, Borrelia afzelii
FTETQTGGKVGGSQ

SEQ ID NO: 77147 - protein, 14 aa, Borrelia afzelii
TETQTGGKVGGSQI

SEQ ID NO: 77148 - protein, 14 aa, Borrelia afzelii
ETQTGGKVGGSQIR

SEQ ID NO: 77149 - protein, 14 aa, Borrelia afzelii
TQTGGKVGGSQIRA

SEQ ID NO: 77150 - protein, 14 aa, Borrelia afzelii
QTGGKVGGSQIRAA

SEQ ID NO: 77151 - protein, 14 aa, Borrelia afzelii
TGGKVGGSQIRAAK

SEQ ID NO: 77152 - protein, 14 aa, Borrelia afzelii
GGKVGGSQIRAAKI

SEQ ID NO: 77153 - protein, 14 aa, Borrelia afzelii
GKVGGSQIRAAKIR

SEQ ID NO: 77154 - protein, 14 aa, Borrelia afzelii
KVGGSQIRAAKIRV

SEQ ID NO: 77155 - protein, 14 aa, Borrelia afzelii
VGGSQIRAAKIRVA

SEQ ID NO: 77156 - protein, 14 aa, Borrelia afzelii
GGSQIRAAKIRVAD

SEQ ID NO: 77157 - protein, 14 aa, Borrelia afzelii
GSQIRAAKIRVADL

SEQ ID NO: 77158 - protein, 14 aa, Borrelia afzelii
SQIRAAKIRVADLT

SEQ ID NO: 77159 - protein, 14 aa, Borrelia afzelii
QIRAAKIRVADLTI

SEQ ID NO: 77160 - protein, 14 aa, Borrelia afzelii
IRAAKIRVADLTIK

SEQ ID NO: 77161 - protein, 14 aa, Borrelia afzelii
RAAKIRVADLTIKF

SEQ ID NO: 77162 - protein, 14 aa, Borrelia afzelii
AAKIRVADLTIKFL

SEQ ID NO: 77163 - protein, 14 aa, Borrelia afzelii
AKIRVADLTIKFLE

SEQ ID NO: 77164 - protein, 14 aa, Borrelia afzelii
KIRVADLTIKFLEA

SEQ ID NO: 77165 - protein, 14 aa, Borrelia afzelii
IRVADLTIKFLEAT

SEQ ID NO: 77166 - protein, 14 aa, Borrelia afzelii
RVADLTIKFLEATE

SEQ ID NO: 77167 - protein, 14 aa, Borrelia afzelii
VADLTIKFLEATEE

SEQ ID NO: 77168 - protein, 14 aa, Borrelia afzelii
ADLTIKFLEATEEE

SEQ ID NO: 77169 - protein, 14 aa, Borrelia afzelii
DLTIKFLEATEEET

SEQ ID NO: 77170 - protein, 14 aa, Borrelia afzelii
LTIKFLEATEEETI

SEQ ID NO: 77171 - protein, 14 aa, Borrelia afzelii
TIKFLEATEEETIT

SEQ ID NO: 77172 - protein, 14 aa, Borrelia afzelii
IKFLEATEEETITF

SEQ ID NO: 77173 - protein, 14 aa, Borrelia afzelii
KFLEATEEETITFK

SEQ ID NO: 77174 - protein, 14 aa, Borrelia afzelii
FLEATEEETITFKE

SEQ ID NO: 77175 - protein, 14 aa, Borrelia afzelii
LEATEEETITFKEN

SEQ ID NO: 77176 - protein, 14 aa, Borrelia afzelii
EATEEETITFKENG

SEQ ID NO: 77177 - protein, 14 aa, Borrelia afzelii
ATEEETITFKENGA

SEQ ID NO: 77178 - protein, 14 aa, Borrelia afzelii
TEEETITFKENGAG

SEQ ID NO: 77179 - protein, 14 aa, Borrelia afzelii
EEETITFKENGAGE

SEQ ID NO: 77180 - protein, 14 aa, Borrelia afzelii
EETITFKENGAGEE

SEQ ID NO: 77181 - protein, 14 aa, Borrelia afzelii
ETITFKENGAGEED

SEQ ID NO: 77182 - protein, 14 aa, Borrelia afzelii
TITFKENGAGEEDF

SEQ ID NO: 77183 - protein, 14 aa, Borrelia afzelii
ITFKENGAGEEDFS

SEQ ID NO: 77184 - protein, 14 aa, Borrelia afzelii
TFKENGAGEEDFSG

SEQ ID NO: 77185 - protein, 14 aa, Borrelia afzelii
FKENGAGEEDFSGI

SEQ ID NO: 77186 - protein, 14 aa, Borrelia afzelii
KENGAGEEDFSGIY

SEQ ID NO: 77187 - protein, 14 aa, Borrelia afzelii
ENGAGEEDFSGIYD

SEQ ID NO: 77188 - protein, 14 aa, Borrelia afzelii
NGAGEEDFSGIYDL

SEQ ID NO: 77189 - protein, 14 aa, Borrelia afzelii
GAGEEDFSGIYDLI

SEQ ID NO: 77190 - protein, 14 aa, Borrelia afzelii
AGEEDFSGIYDLIL

SEQ ID NO: 77191 - protein, 14 aa, Borrelia afzelii
GEEDFSGIYDLILN

SEQ ID NO: 77192 - protein, 14 aa, Borrelia afzelii
EEDFSGIYDLILNA

SEQ ID NO: 77193 - protein, 14 aa, Borrelia afzelii
EDFSGIYDLILNAA

SEQ ID NO: 77194 - protein, 14 aa, Borrelia afzelii
DFSGIYDLILNAAK

SEQ ID NO: 77195 - protein, 14 aa, Borrelia afzelii
FSGIYDLILNAAKA

SEQ ID NO: 77196 - protein, 14 aa, Borrelia afzelii
SGIYDLILNAAKAV

SEQ ID NO: 77197 - protein, 14 aa, Borrelia afzelii
GIYDLILNAAKAVE

SEQ ID NO: 77198 - protein, 14 aa, Borrelia afzelii
IYDLILNAAKAVEK

SEQ ID NO: 77199 - protein, 14 aa, Borrelia afzelii
YDLILNAAKAVEKI

SEQ ID NO: 77200 - protein, 14 aa, Borrelia afzelii
DLILNAAKAVEKIG

SEQ ID NO: 77201 - protein, 14 aa, Borrelia afzelii
LILNAAKAVEKIGM

SEQ ID NO: 77202 - protein, 14 aa, Borrelia afzelii
ILNAAKAVEKIGMQ

SEQ ID NO: 77203 - protein, 14 aa, Borrelia afzelii
LNAAKAVEKIGMQG

SEQ ID NO: 77204 - protein, 14 aa, Borrelia afzelii
NAAKAVEKIGMQGM

SEQ ID NO: 77205 - protein, 14 aa, Borrelia afzelii
AAKAVEKIGMQGMK

SEQ ID NO: 77206 - protein, 14 aa, Borrelia afzelii
AKAVEKIGMQGMKQ

SEQ ID NO: 77207 - protein, 14 aa, Borrelia afzelii
KAVEKIGMQGMKQA

SEQ ID NO: 77208 - protein, 14 aa, Borrelia afzelii
AVEKIGMQGMKQAV

SEQ ID NO: 77209 - protein, 14 aa, Borrelia afzelii
VEKIGMQGMKQAVE

SEQ ID NO: 77210 - protein, 14 aa, Borrelia afzelii
EKIGMQGMKQAVEE

SEQ ID NO: 77211 - protein, 14 aa, Borrelia afzelii
KIGMQGMKQAVEEA

SEQ ID NO: 77212 - protein, 14 aa, Borrelia afzelii
IGMQGMKQAVEEAA

SEQ ID NO: 77213 - protein, 14 aa, Borrelia afzelii
GMQGMKQAVEEAAK

SEQ ID NO: 77214 - protein, 14 aa, Borrelia afzelii
MQGMKQAVEEAAKE

SEQ ID NO: 77215 - protein, 14 aa, Borrelia afzelii
QGMKQAVEEAAKEK

SEQ ID NO: 77216 - protein, 14 aa, Borrelia afzelii
GMKQAVEEAAKEKP

SEQ ID NO: 77217 - protein, 14 aa, Borrelia afzelii
MKQAVEEAAKEKPK

SEQ ID NO: 77218 - protein, 14 aa, Borrelia afzelii
KQAVEEAAKEKPKT

SEQ ID NO: 77219 - protein, 14 aa, Borrelia afzelii
QAVEEAAKEKPKTT

SEQ ID NO: 77220 - protein, 14 aa, Borrelia afzelii
AVEEAAKEKPKTTA

SEQ ID NO: 77221 - protein, 14 aa, Borrelia afzelii
VEEAAKEKPKTTAD

SEQ ID NO: 77222 - protein, 14 aa, Borrelia afzelii
EEAAKEKPKTTADG

SEQ ID NO: 77223 - protein, 14 aa, Borrelia afzelii
EAAKEKPKTTADGI

SEQ ID NO: 77224 - protein, 14 aa, Borrelia afzelii
AAKEKPKTTADGII

SEQ ID NO: 77225 - protein, 14 aa, Borrelia afzelii
AKEKPKTTADGIIA

SEQ ID NO: 77226 - protein, 14 aa, Borrelia afzelii
KEKPKTTADGIIAI

SEQ ID NO: 77227 - protein, 14 aa, Borrelia afzelii
EKPKTTADGIIAIV

SEQ ID NO: 77228 - protein, 14 aa, Borrelia afzelii
KPKTTADGIIAIVK

SEQ ID NO: 77229 - protein, 14 aa, Borrelia afzelii
PKTTADGIIAIVKV

SEQ ID NO: 77230 - protein, 14 aa, Borrelia afzelii
KTTADGIIAIVKVM

SEQ ID NO: 77231 - protein, 14 aa, Borrelia afzelii
TTADGIIAIVKVMK

SEQ ID NO: 77232 - protein, 14 aa, Borrelia afzelii
TADGIIAIVKVMKA

SEQ ID NO: 77233 - protein, 14 aa, Borrelia afzelii
ADGIIAIVKVMKAK

SEQ ID NO: 77234 - protein, 14 aa, Borrelia afzelii
DGIIAIVKVMKAKV

SEQ ID NO: 77235 - protein, 14 aa, Borrelia afzelii
GIIAIVKVMKAKVE

SEQ ID NO: 77236 - protein, 14 aa, Borrelia afzelii
IIAIVKVMKAKVEN

SEQ ID NO: 77237 - protein, 14 aa, Borrelia afzelii
IAIVKVMKAKVENI

SEQ ID NO: 77238 - protein, 14 aa, Borrelia afzelii
AIVKVMKAKVENIK

SEQ ID NO: 77239 - protein, 14 aa, Borrelia afzelii
IVKVMKAKVENIKE

SEQ ID NO: 77240 - protein, 14 aa, Borrelia afzelii
VKVMKAKVENIKEK

SEQ ID NO: 77241 - protein, 14 aa, Borrelia afzelii
KVMKAKVENIKEKQ

SEQ ID NO: 77242 - protein, 14 aa, Borrelia afzelii
VMKAKVENIKEKQT

SEQ ID NO: 77243 - protein, 14 aa, Borrelia afzelii
MKAKVENIKEKQTK

SEQ ID NO: 77244 - protein, 14 aa, Borrelia afzelii
KAKVENIKEKQTKN

SEQ ID NO: 77245 - protein, 14 aa, Borrelia afzelii
AKVENIKEKQTKNQ

SEQ ID NO: 77246 - protein, 14 aa, Borrelia afzelii
KVENIKEKQTKNQK

SEQ ID NO: 77247 - protein, 15 aa, Borrelia afzelii
MIKYNKIILTLTLLA

SEQ ID NO: 77248 - protein, 15 aa, Borrelia afzelii
IKYNKIILTLTLLAS

SEQ ID NO: 77249 - protein, 15 aa, Borrelia afzelii
KYNKIILTLTLLASL

SEQ ID NO: 77250 - protein, 15 aa, Borrelia afzelii
YNKIILTLTLLASLL

SEQ ID NO: 77251 - protein, 15 aa, Borrelia afzelii
NKIILTLTLLASLLA

SEQ ID NO: 77252 - protein, 15 aa, Borrelia afzelii
KIILTLTLLASLLAA

SEQ ID NO: 77253 - protein, 15 aa, Borrelia afzelii
IILTLTLLASLLAAC

SEQ ID NO: 77254 - protein, 15 aa, Borrelia afzelii
ILTLTLLASLLAACS

SEQ ID NO: 77255 - protein, 15 aa, Borrelia afzelii
LTLTLLASLLAACSL

SEQ ID NO: 77256 - protein, 15 aa, Borrelia afzelii
TLTLLASLLAACSLT

SEQ ID NO: 77257 - protein, 15 aa, Borrelia afzelii
LTLLASLLAACSLTG

SEQ ID NO: 77258 - protein, 15 aa, Borrelia afzelii
TLLASLLAACSLTGK

SEQ ID NO: 77259 - protein, 15 aa, Borrelia afzelii
LLASLLAACSLTGKA

SEQ ID NO: 77260 - protein, 15 aa, Borrelia afzelii
LASLLAACSLTGKAR

SEQ ID NO: 77261 - protein, 15 aa, Borrelia afzelii
ASLLAACSLTGKARL

SEQ ID NO: 77262 - protein, 15 aa, Borrelia afzelii
SLLAACSLTGKARLE

SEQ ID NO: 77263 - protein, 15 aa, Borrelia afzelii
LLAACSLTGKARLES

SEQ ID NO: 77264 - protein, 15 aa, Borrelia afzelii
LAACSLTGKARLESS

SEQ ID NO: 77265 - protein, 15 aa, Borrelia afzelii
AACSLTGKARLESSV

SEQ ID NO: 77266 - protein, 15 aa, Borrelia afzelii
ACSLTGKARLESSVK

SEQ ID NO: 77267 - protein, 15 aa, Borrelia afzelii
CSLTGKARLESSVKD

SEQ ID NO: 77268 - protein, 15 aa, Borrelia afzelii
SLTGKARLESSVKDI

SEQ ID NO: 77269 - protein, 15 aa, Borrelia afzelii
LTGKARLESSVKDIT

SEQ ID NO: 77270 - protein, 15 aa, Borrelia afzelii
TGKARLESSVKDITN

SEQ ID NO: 77271 - protein, 15 aa, Borrelia afzelii
GKARLESSVKDITNE

SEQ ID NO: 77272 - protein, 15 aa, Borrelia afzelii
KARLESSVKDITNEI

SEQ ID NO: 77273 - protein, 15 aa, Borrelia afzelii
ARLESSVKDITNEIE

SEQ ID NO: 77274 - protein, 15 aa, Borrelia afzelii
RLESSVKDITNEIEK

SEQ ID NO: 77275 - protein, 15 aa, Borrelia afzelii
LESSVKDITNEIEKA

SEQ ID NO: 77276 - protein, 15 aa, Borrelia afzelii
ESSVKDITNEIEKAI

SEQ ID NO: 77277 - protein, 15 aa, Borrelia afzelii
SSVKDITNEIEKAIK

SEQ ID NO: 77278 - protein, 15 aa, Borrelia afzelii
SVKDITNEIEKAIKE

SEQ ID NO: 77279 - protein, 15 aa, Borrelia afzelii
VKDITNEIEKAIKEA

SEQ ID NO: 77280 - protein, 15 aa, Borrelia afzelii
KDITNEIEKAIKEAE

SEQ ID NO: 77281 - protein, 15 aa, Borrelia afzelii
DITNEIEKAIKEAED

SEQ ID NO: 77282 - protein, 15 aa, Borrelia afzelii
ITNEIEKAIKEAEDA

SEQ ID NO: 77283 - protein, 15 aa, Borrelia afzelii
TNEIEKAIKEAEDAG

SEQ ID NO: 77284 - protein, 15 aa, Borrelia afzelii
NEIEKAIKEAEDAGV

SEQ ID NO: 77285 - protein, 15 aa, Borrelia afzelii
EIEKAIKEAEDAGVK

SEQ ID NO: 77286 - protein, 15 aa, Borrelia afzelii
IEKAIKEAEDAGVKT

SEQ ID NO: 77287 - protein, 15 aa, Borrelia afzelii
EKAIKEAEDAGVKTD

SEQ ID NO: 77288 - protein, 15 aa, Borrelia afzelii
KAIKEAEDAGVKTDA

SEQ ID NO: 77289 - protein, 15 aa, Borrelia afzelii
AIKEAEDAGVKTDAF

SEQ ID NO: 77290 - protein, 15 aa, Borrelia afzelii
IKEAEDAGVKTDAFT

SEQ ID NO: 77291 - protein, 15 aa, Borrelia afzelii
KEAEDAGVKTDAFTE

SEQ ID NO: 77292 - protein, 15 aa, Borrelia afzelii
EAEDAGVKTDAFTET

SEQ ID NO: 77293 - protein, 15 aa, Borrelia afzelii
AEDAGVKTDAFTETQ

SEQ ID NO: 77294 - protein, 15 aa, Borrelia afzelii
EDAGVKTDAFTETQT

SEQ ID NO: 77295 - protein, 15 aa, Borrelia afzelii
DAGVKTDAFTETQTG

SEQ ID NO: 77296 - protein, 15 aa, Borrelia afzelii
AGVKTDAFTETQTGG

SEQ ID NO: 77297 - protein, 15 aa, Borrelia afzelii
GVKTDAFTETQTGGK

SEQ ID NO: 77298 - protein, 15 aa, Borrelia afzelii
VKTDAFTETQTGGKV

SEQ ID NO: 77299 - protein, 15 aa, Borrelia afzelii
KTDAFTETQTGGKVG

SEQ ID NO: 77300 - protein, 15 aa, Borrelia afzelii
TDAFTETQTGGKVGG

SEQ ID NO: 77301 - protein, 15 aa, Borrelia afzelii
DAFTETQTGGKVGGS

SEQ ID NO: 77302 - protein, 15 aa, Borrelia afzelii
AFTETQTGGKVGGSQ

SEQ ID NO: 77303 - protein, 15 aa, Borrelia afzelii
FTETQTGGKVGGSQI

SEQ ID NO: 77304 - protein, 15 aa, Borrelia afzelii
TETQTGGKVGGSQIR

SEQ ID NO: 77305 - protein, 15 aa, Borrelia afzelii
ETQTGGKVGGSQIRA

SEQ ID NO: 77306 - protein, 15 aa, Borrelia afzelii
TQTGGKVGGSQIRAA

SEQ ID NO: 77307 - protein, 15 aa, Borrelia afzelii
QTGGKVGGSQIRAAK

SEQ ID NO: 77308 - protein, 15 aa, Borrelia afzelii
TGGKVGGSQIRAAKI

SEQ ID NO: 77309 - protein, 15 aa, Borrelia afzelii
GGKVGGSQIRAAKIR

SEQ ID NO: 77310 - protein, 15 aa, Borrelia afzelii
GKVGGSQIRAAKIRV

SEQ ID NO: 77311 - protein, 15 aa, Borrelia afzelii
KVGGSQIRAAKIRVA

SEQ ID NO: 77312 - protein, 15 aa, Borrelia afzelii
VGGSQIRAAKIRVAD

SEQ ID NO: 77313 - protein, 15 aa, Borrelia afzelii
GGSQIRAAKIRVADL

SEQ ID NO: 77314 - protein, 15 aa, Borrelia afzelii
GSQIRAAKIRVADLT

SEQ ID NO: 77315 - protein, 15 aa, Borrelia afzelii
SQIRAAKIRVADLTI

SEQ ID NO: 77316 - protein, 15 aa, Borrelia afzelii
QIRAAKIRVADLTIK

SEQ ID NO: 77317 - protein, 15 aa, Borrelia afzelii
IRAAKIRVADLTIKF

SEQ ID NO: 77318 - protein, 15 aa, Borrelia afzelii
RAAKIRVADLTIKFL

SEQ ID NO: 77319 - protein, 15 aa, Borrelia afzelii
AAKIRVADLTIKFLE

SEQ ID NO: 77320 - protein, 15 aa, Borrelia afzelii
AKIRVADLTIKFLEA

SEQ ID NO: 77321 - protein, 15 aa, Borrelia afzelii
KIRVADLTIKFLEAT

SEQ ID NO: 77322 - protein, 15 aa, Borrelia afzelii
IRVADLTIKFLEATE

SEQ ID NO: 77323 - protein, 15 aa, Borrelia afzelii
RVADLTIKFLEATEE

SEQ ID NO: 77324 - protein, 15 aa, Borrelia afzelii
VADLTIKFLEATEEE

SEQ ID NO: 77325 - protein, 15 aa, Borrelia afzelii
ADLTIKFLEATEEET

SEQ ID NO: 77326 - protein, 15 aa, Borrelia afzelii
DLTIKFLEATEEETI

SEQ ID NO: 77327 - protein, 15 aa, Borrelia afzelii
LTIKFLEATEEETIT

SEQ ID NO: 77328 - protein, 15 aa, Borrelia afzelii
TIKFLEATEEETITF

SEQ ID NO: 77329 - protein, 15 aa, Borrelia afzelii
IKFLEATEEETITFK

SEQ ID NO: 77330 - protein, 15 aa, Borrelia afzelii
KFLEATEEETITFKE

SEQ ID NO: 77331 - protein, 15 aa, Borrelia afzelii
FLEATEEETITFKEN

SEQ ID NO: 77332 - protein, 15 aa, Borrelia afzelii
LEATEEETITFKENG

SEQ ID NO: 77333 - protein, 15 aa, Borrelia afzelii
EATEEETITFKENGA

SEQ ID NO: 77334 - protein, 15 aa, Borrelia afzelii
ATEEETITFKENGAG

SEQ ID NO: 77335 - protein, 15 aa, Borrelia afzelii
TEEETITFKENGAGE

SEQ ID NO: 77336 - protein, 15 aa, Borrelia afzelii
EEETITFKENGAGEE

SEQ ID NO: 77337 - protein, 15 aa, Borrelia afzelii
EETITFKENGAGEED

SEQ ID NO: 77338 - protein, 15 aa, Borrelia afzelii
ETITFKENGAGEEDF

SEQ ID NO: 77339 - protein, 15 aa, Borrelia afzelii
TITFKENGAGEEDFS

SEQ ID NO: 77340 - protein, 15 aa, Borrelia afzelii
ITFKENGAGEEDFSG

SEQ ID NO: 77341 - protein, 15 aa, Borrelia afzelii
TFKENGAGEEDFSGI

SEQ ID NO: 77342 - protein, 15 aa, Borrelia afzelii
FKENGAGEEDFSGIY

SEQ ID NO: 77343 - protein, 15 aa, Borrelia afzelii
KENGAGEEDFSGIYD

SEQ ID NO: 77344 - protein, 15 aa, Borrelia afzelii
ENGAGEEDFSGIYDL

SEQ ID NO: 77345 - protein, 15 aa, Borrelia afzelii
NGAGEEDFSGIYDLI

SEQ ID NO: 77346 - protein, 15 aa, Borrelia afzelii
GAGEEDFSGIYDLIL

SEQ ID NO: 77347 - protein, 15 aa, Borrelia afzelii
AGEEDFSGIYDLILN

SEQ ID NO: 77348 - protein, 15 aa, Borrelia afzelii
GEEDFSGIYDLILNA

SEQ ID NO: 77349 - protein, 15 aa, Borrelia afzelii
EEDFSGIYDLILNAA

SEQ ID NO: 77350 - protein, 15 aa, Borrelia afzelii
EDFSGIYDLILNAAK

SEQ ID NO: 77351 - protein, 15 aa, Borrelia afzelii
DFSGIYDLILNAAKA

SEQ ID NO: 77352 - protein, 15 aa, Borrelia afzelii
FSGIYDLILNAAKAV

SEQ ID NO: 77353 - protein, 15 aa, Borrelia afzelii
SGIYDLILNAAKAVE

SEQ ID NO: 77354 - protein, 15 aa, Borrelia afzelii
GIYDLILNAAKAVEK

SEQ ID NO: 77355 - protein, 15 aa, Borrelia afzelii
IYDLILNAAKAVEKI

SEQ ID NO: 77356 - protein, 15 aa, Borrelia afzelii
YDLILNAAKAVEKIG

SEQ ID NO: 77357 - protein, 15 aa, Borrelia afzelii
DLILNAAKAVEKIGM

SEQ ID NO: 77358 - protein, 15 aa, Borrelia afzelii
LILNAAKAVEKIGMQ

SEQ ID NO: 77359 - protein, 15 aa, Borrelia afzelii
ILNAAKAVEKIGMQG

SEQ ID NO: 77360 - protein, 15 aa, Borrelia afzelii
LNAAKAVEKIGMQGM

SEQ ID NO: 77361 - protein, 15 aa, Borrelia afzelii
NAAKAVEKIGMQGMK

SEQ ID NO: 77362 - protein, 15 aa, Borrelia afzelii
AAKAVEKIGMQGMKQ

SEQ ID NO: 77363 - protein, 15 aa, Borrelia afzelii
AKAVEKIGMQGMKQA

SEQ ID NO: 77364 - protein, 15 aa, Borrelia afzelii
KAVEKIGMQGMKQAV

SEQ ID NO: 77365 - protein, 15 aa, Borrelia afzelii
AVEKIGMQGMKQAVE

SEQ ID NO: 77366 - protein, 15 aa, Borrelia afzelii
VEKIGMQGMKQAVEE

SEQ ID NO: 77367 - protein, 15 aa, Borrelia afzelii
EKIGMQGMKQAVEEA

SEQ ID NO: 77368 - protein, 15 aa, Borrelia afzelii
KIGMQGMKQAVEEAA

SEQ ID NO: 77369 - protein, 15 aa, Borrelia afzelii
IGMQGMKQAVEEAAK

SEQ ID NO: 77370 - protein, 15 aa, Borrelia afzelii
GMQGMKQAVEEAAKE

SEQ ID NO: 77371 - protein, 15 aa, Borrelia afzelii
MQGMKQAVEEAAKEK

SEQ ID NO: 77372 - protein, 15 aa, Borrelia afzelii
QGMKQAVEEAAKEKP

SEQ ID NO: 77373 - protein, 15 aa, Borrelia afzelii
GMKQAVEEAAKEKPK

SEQ ID NO: 77374 - protein, 15 aa, Borrelia afzelii
MKQAVEEAAKEKPKT

SEQ ID NO: 77375 - protein, 15 aa, Borrelia afzelii
KQAVEEAAKEKPKTT

SEQ ID NO: 77376 - protein, 15 aa, Borrelia afzelii
QAVEEAAKEKPKTTA

SEQ ID NO: 77377 - protein, 15 aa, Borrelia afzelii
AVEEAAKEKPKTTAD

SEQ ID NO: 77378 - protein, 15 aa, Borrelia afzelii
VEEAAKEKPKTTADG

SEQ ID NO: 77379 - protein, 15 aa, Borrelia afzelii
EEAAKEKPKTTADGI

SEQ ID NO: 77380 - protein, 15 aa, Borrelia afzelii
EAAKEKPKTTADGII

SEQ ID NO: 77381 - protein, 15 aa, Borrelia afzelii
AAKEKPKTTADGIIA

SEQ ID NO: 77382 - protein, 15 aa, Borrelia afzelii
AKEKPKTTADGIIAI

SEQ ID NO: 77383 - protein, 15 aa, Borrelia afzelii
KEKPKTTADGIIAIV

SEQ ID NO: 77384 - protein, 15 aa, Borrelia afzelii
EKPKTTADGIIAIVK

SEQ ID NO: 77385 - protein, 15 aa, Borrelia afzelii
KPKTTADGIIAIVKV

SEQ ID NO: 77386 - protein, 15 aa, Borrelia afzelii
PKTTADGIIAIVKVM

SEQ ID NO: 77387 - protein, 15 aa, Borrelia afzelii
KTTADGIIAIVKVMK

SEQ ID NO: 77388 - protein, 15 aa, Borrelia afzelii
TTADGIIAIVKVMKA

SEQ ID NO: 77389 - protein, 15 aa, Borrelia afzelii
TADGIIAIVKVMKAK

SEQ ID NO: 77390 - protein, 15 aa, Borrelia afzelii
ADGIIAIVKVMKAKV

SEQ ID NO: 77391 - protein, 15 aa, Borrelia afzelii
DGIIAIVKVMKAKVE

SEQ ID NO: 77392 - protein, 15 aa, Borrelia afzelii
GIIAIVKVMKAKVEN

SEQ ID NO: 77393 - protein, 15 aa, Borrelia afzelii
IIAIVKVMKAKVENI

SEQ ID NO: 77394 - protein, 15 aa, Borrelia afzelii
IAIVKVMKAKVENIK

SEQ ID NO: 77395 - protein, 15 aa, Borrelia afzelii
AIVKVMKAKVENIKE

SEQ ID NO: 77396 - protein, 15 aa, Borrelia afzelii
IVKVMKAKVENIKEK

SEQ ID NO: 77397 - protein, 15 aa, Borrelia afzelii
VKVMKAKVENIKEKQ

SEQ ID NO: 77398 - protein, 15 aa, Borrelia afzelii
KVMKAKVENIKEKQT

SEQ ID NO: 77399 - protein, 15 aa, Borrelia afzelii
VMKAKVENIKEKQTK

SEQ ID NO: 77400 - protein, 15 aa, Borrelia afzelii
MKAKVENIKEKQTKN

SEQ ID NO: 77401 - protein, 15 aa, Borrelia afzelii
KAKVENIKEKQTKNQ

SEQ ID NO: 77402 - protein, 15 aa, Borrelia afzelii
AKVENIKEKQTKNQK

SEQ ID NO: 77403 - protein, 16 aa, Borrelia afzelii
MIKYNKIILTLTLLAS

SEQ ID NO: 77404 - protein, 16 aa, Borrelia afzelii
IKYNKIILTLTLLASL

SEQ ID NO: 77405 - protein, 16 aa, Borrelia afzelii
KYNKIILTLTLLASLL

SEQ ID NO: 77406 - protein, 16 aa, Borrelia afzelii
YNKIILTLTLLASLLA

SEQ ID NO: 77407 - protein, 16 aa, Borrelia afzelii
NKIILTLTLLASLLAA

SEQ ID NO: 77408 - protein, 16 aa, Borrelia afzelii
KIILTLTLLASLLAAC

SEQ ID NO: 77409 - protein, 16 aa, Borrelia afzelii
IILTLTLLASLLAACS

SEQ ID NO: 77410 - protein, 16 aa, Borrelia afzelii
ILTLTLLASLLAACSL

SEQ ID NO: 77411 - protein, 16 aa, Borrelia afzelii
LTLTLLASLLAACSLT

SEQ ID NO: 77412 - protein, 16 aa, Borrelia afzelii
TLTLLASLLAACSLTG

SEQ ID NO: 77413 - protein, 16 aa, Borrelia afzelii
LTLLASLLAACSLTGK

SEQ ID NO: 77414 - protein, 16 aa, Borrelia afzelii
TLLASLLAACSLTGKA

SEQ ID NO: 77415 - protein, 16 aa, Borrelia afzelii
LLASLLAACSLTGKAR

SEQ ID NO: 77416 - protein, 16 aa, Borrelia afzelii
LASLLAACSLTGKARL

SEQ ID NO: 77417 - protein, 16 aa, Borrelia afzelii
ASLLAACSLTGKARLE

SEQ ID NO: 77418 - protein, 16 aa, Borrelia afzelii
SLLAACSLTGKARLES

SEQ ID NO: 77419 - protein, 16 aa, Borrelia afzelii
LLAACSLTGKARLESS

SEQ ID NO: 77420 - protein, 16 aa, Borrelia afzelii
LAACSLTGKARLESSV

SEQ ID NO: 77421 - protein, 16 aa, Borrelia afzelii
AACSLTGKARLESSVK

SEQ ID NO: 77422 - protein, 16 aa, Borrelia afzelii
ACSLTGKARLESSVKD

SEQ ID NO: 77423 - protein, 16 aa, Borrelia afzelii
CSLTGKARLESSVKDI

SEQ ID NO: 77424 - protein, 16 aa, Borrelia afzelii
SLTGKARLESSVKDIT

SEQ ID NO: 77425 - protein, 16 aa, Borrelia afzelii
LTGKARLESSVKDITN

SEQ ID NO: 77426 - protein, 16 aa, Borrelia afzelii
TGKARLESSVKDITNE

SEQ ID NO: 77427 - protein, 16 aa, Borrelia afzelii
GKARLESSVKDITNEI

SEQ ID NO: 77428 - protein, 16 aa, Borrelia afzelii
KARLESSVKDITNEIE

SEQ ID NO: 77429 - protein, 16 aa, Borrelia afzelii
ARLESSVKDITNEIEK

SEQ ID NO: 77430 - protein, 16 aa, Borrelia afzelii
RLESSVKDITNEIEKA

SEQ ID NO: 77431 - protein, 16 aa, Borrelia afzelii
LESSVKDITNEIEKAI

SEQ ID NO: 77432 - protein, 16 aa, Borrelia afzelii
ESSVKDITNEIEKAIK

SEQ ID NO: 77433 - protein, 16 aa, Borrelia afzelii
SSVKDITNEIEKAIKE

SEQ ID NO: 77434 - protein, 16 aa, Borrelia afzelii
SVKDITNEIEKAIKEA

SEQ ID NO: 77435 - protein, 16 aa, Borrelia afzelii
VKDITNEIEKAIKEAE

SEQ ID NO: 77436 - protein, 16 aa, Borrelia afzelii
KDITNEIEKAIKEAED

SEQ ID NO: 77437 - protein, 16 aa, Borrelia afzelii
DITNEIEKAIKEAEDA

SEQ ID NO: 77438 - protein, 16 aa, Borrelia afzelii
ITNEIEKAIKEAEDAG

SEQ ID NO: 77439 - protein, 16 aa, Borrelia afzelii
TNEIEKAIKEAEDAGV

SEQ ID NO: 77440 - protein, 16 aa, Borrelia afzelii
NEIEKAIKEAEDAGVK

SEQ ID NO: 77441 - protein, 16 aa, Borrelia afzelii
EIEKAIKEAEDAGVKT

SEQ ID NO: 77442 - protein, 16 aa, Borrelia afzelii
IEKAIKEAEDAGVKTD

SEQ ID NO: 77443 - protein, 16 aa, Borrelia afzelii
EKAIKEAEDAGVKTDA

SEQ ID NO: 77444 - protein, 16 aa, Borrelia afzelii
KAIKEAEDAGVKTDAF

SEQ ID NO: 77445 - protein, 16 aa, Borrelia afzelii
AIKEAEDAGVKTDAFT

SEQ ID NO: 77446 - protein, 16 aa, Borrelia afzelii
IKEAEDAGVKTDAFTE

SEQ ID NO: 77447 - protein, 16 aa, Borrelia afzelii
KEAEDAGVKTDAFTET

SEQ ID NO: 77448 - protein, 16 aa, Borrelia afzelii
EAEDAGVKTDAFTETQ

SEQ ID NO: 77449 - protein, 16 aa, Borrelia afzelii
AEDAGVKTDAFTETQT

SEQ ID NO: 77450 - protein, 16 aa, Borrelia afzelii
EDAGVKTDAFTETQTG

SEQ ID NO: 77451 - protein, 16 aa, Borrelia afzelii
DAGVKTDAFTETQTGG

SEQ ID NO: 77452 - protein, 16 aa, Borrelia afzelii
AGVKTDAFTETQTGGK

SEQ ID NO: 77453 - protein, 16 aa, Borrelia afzelii
GVKTDAFTETQTGGKV

SEQ ID NO: 77454 - protein, 16 aa, Borrelia afzelii
VKTDAFTETQTGGKVG

SEQ ID NO: 77455 - protein, 16 aa, Borrelia afzelii
KTDAFTETQTGGKVGG

SEQ ID NO: 77456 - protein, 16 aa, Borrelia afzelii
TDAFTETQTGGKVGGS

SEQ ID NO: 77457 - protein, 16 aa, Borrelia afzelii
DAFTETQTGGKVGGSQ

SEQ ID NO: 77458 - protein, 16 aa, Borrelia afzelii
AFTETQTGGKVGGSQI

SEQ ID NO: 77459 - protein, 16 aa, Borrelia afzelii
FTETQTGGKVGGSQIR

SEQ ID NO: 77460 - protein, 16 aa, Borrelia afzelii
TETQTGGKVGGSQIRA

SEQ ID NO: 77461 - protein, 16 aa, Borrelia afzelii
ETQTGGKVGGSQIRAA

SEQ ID NO: 77462 - protein, 16 aa, Borrelia afzelii
TQTGGKVGGSQIRAAK

SEQ ID NO: 77463 - protein, 16 aa, Borrelia afzelii
QTGGKVGGSQIRAAKI

SEQ ID NO: 77464 - protein, 16 aa, Borrelia afzelii
TGGKVGGSQIRAAKIR

SEQ ID NO: 77465 - protein, 16 aa, Borrelia afzelii
GGKVGGSQIRAAKIRV

SEQ ID NO: 77466 - protein, 16 aa, Borrelia afzelii
GKVGGSQIRAAKIRVA

SEQ ID NO: 77467 - protein, 16 aa, Borrelia afzelii
KVGGSQIRAAKIRVAD

SEQ ID NO: 77468 - protein, 16 aa, Borrelia afzelii
VGGSQIRAAKIRVADL

SEQ ID NO: 77469 - protein, 16 aa, Borrelia afzelii
GGSQIRAAKIRVADLT

SEQ ID NO: 77470 - protein, 16 aa, Borrelia afzelii
GSQIRAAKIRVADLTI

SEQ ID NO: 77471 - protein, 16 aa, Borrelia afzelii
SQIRAAKIRVADLTIK

SEQ ID NO: 77472 - protein, 16 aa, Borrelia afzelii
QIRAAKIRVADLTIKF

SEQ ID NO: 77473 - protein, 16 aa, Borrelia afzelii
IRAAKIRVADLTIKFL

SEQ ID NO: 77474 - protein, 16 aa, Borrelia afzelii
RAAKIRVADLTIKFLE

SEQ ID NO: 77475 - protein, 16 aa, Borrelia afzelii
AAKIRVADLTIKFLEA

SEQ ID NO: 77476 - protein, 16 aa, Borrelia afzelii
AKIRVADLTIKFLEAT

SEQ ID NO: 77477 - protein, 16 aa, Borrelia afzelii
KIRVADLTIKFLEATE

SEQ ID NO: 77478 - protein, 16 aa, Borrelia afzelii
IRVADLTIKFLEATEE

SEQ ID NO: 77479 - protein, 16 aa, Borrelia afzelii
RVADLTIKFLEATEEE

SEQ ID NO: 77480 - protein, 16 aa, Borrelia afzelii
VADLTIKFLEATEEET

SEQ ID NO: 77481 - protein, 16 aa, Borrelia afzelii
ADLTIKFLEATEEETI

SEQ ID NO: 77482 - protein, 16 aa, Borrelia afzelii
DLTIKFLEATEEETIT

SEQ ID NO: 77483 - protein, 16 aa, Borrelia afzelii
LTIKFLEATEEETITF

SEQ ID NO: 77484 - protein, 16 aa, Borrelia afzelii
TIKFLEATEEETITFK

SEQ ID NO: 77485 - protein, 16 aa, Borrelia afzelii
IKFLEATEEETITFKE

SEQ ID NO: 77486 - protein, 16 aa, Borrelia afzelii
KFLEATEEETITFKEN

SEQ ID NO: 77487 - protein, 16 aa, Borrelia afzelii
FLEATEEETITFKENG

SEQ ID NO: 77488 - protein, 16 aa, Borrelia afzelii
LEATEEETITFKENGA

SEQ ID NO: 77489 - protein, 16 aa, Borrelia afzelii
EATEEETITFKENGAG

SEQ ID NO: 77490 - protein, 16 aa, Borrelia afzelii
ATEEETITFKENGAGE

SEQ ID NO: 77491 - protein, 16 aa, Borrelia afzelii
TEEETITFKENGAGEE

SEQ ID NO: 77492 - protein, 16 aa, Borrelia afzelii
EEETITFKENGAGEED

SEQ ID NO: 77493 - protein, 16 aa, Borrelia afzelii
EETITFKENGAGEEDF

SEQ ID NO: 77494 - protein, 16 aa, Borrelia afzelii
ETITFKENGAGEEDFS

SEQ ID NO: 77495 - protein, 16 aa, Borrelia afzelii
TITFKENGAGEEDFSG

SEQ ID NO: 77496 - protein, 16 aa, Borrelia afzelii
ITFKENGAGEEDFSGI

SEQ ID NO: 77497 - protein, 16 aa, Borrelia afzelii
TFKENGAGEEDFSGIY

SEQ ID NO: 77498 - protein, 16 aa, Borrelia afzelii
FKENGAGEEDFSGIYD

SEQ ID NO: 77499 - protein, 16 aa, Borrelia afzelii
KENGAGEEDFSGIYDL

SEQ ID NO: 77500 - protein, 16 aa, Borrelia afzelii
ENGAGEEDFSGIYDLI

SEQ ID NO: 77501 - protein, 16 aa, Borrelia afzelii
NGAGEEDFSGIYDLIL

SEQ ID NO: 77502 - protein, 16 aa, Borrelia afzelii
GAGEEDFSGIYDLILN

SEQ ID NO: 77503 - protein, 16 aa, Borrelia afzelii
AGEEDFSGIYDLILNA

SEQ ID NO: 77504 - protein, 16 aa, Borrelia afzelii
GEEDFSGIYDLILNAA

SEQ ID NO: 77505 - protein, 16 aa, Borrelia afzelii
EEDFSGIYDLILNAAK

SEQ ID NO: 77506 - protein, 16 aa, Borrelia afzelii
EDFSGIYDLILNAAKA

SEQ ID NO: 77507 - protein, 16 aa, Borrelia afzelii
DFSGIYDLILNAAKAV

SEQ ID NO: 77508 - protein, 16 aa, Borrelia afzelii
FSGIYDLILNAAKAVE

SEQ ID NO: 77509 - protein, 16 aa, Borrelia afzelii
SGIYDLILNAAKAVEK

SEQ ID NO: 77510 - protein, 16 aa, Borrelia afzelii
GIYDLILNAAKAVEKI

SEQ ID NO: 77511 - protein, 16 aa, Borrelia afzelii
IYDLILNAAKAVEKIG

SEQ ID NO: 77512 - protein, 16 aa, Borrelia afzelii
YDLILNAAKAVEKIGM

SEQ ID NO: 77513 - protein, 16 aa, Borrelia afzelii
DLILNAAKAVEKIGMQ

SEQ ID NO: 77514 - protein, 16 aa, Borrelia afzelii
LILNAAKAVEKIGMQG

SEQ ID NO: 77515 - protein, 16 aa, Borrelia afzelii
ILNAAKAVEKIGMQGM

SEQ ID NO: 77516 - protein, 16 aa, Borrelia afzelii
LNAAKAVEKIGMQGMK

SEQ ID NO: 77517 - protein, 16 aa, Borrelia afzelii
NAAKAVEKIGMQGMKQ

SEQ ID NO: 77518 - protein, 16 aa, Borrelia afzelii
AAKAVEKIGMQGMKQA

SEQ ID NO: 77519 - protein, 16 aa, Borrelia afzelii
AKAVEKIGMQGMKQAV

SEQ ID NO: 77520 - protein, 16 aa, Borrelia afzelii
KAVEKIGMQGMKQAVE

SEQ ID NO: 77521 - protein, 16 aa, Borrelia afzelii
AVEKIGMQGMKQAVEE

SEQ ID NO: 77522 - protein, 16 aa, Borrelia afzelii
VEKIGMQGMKQAVEEA

SEQ ID NO: 77523 - protein, 16 aa, Borrelia afzelii
EKIGMQGMKQAVEEAA

SEQ ID NO: 77524 - protein, 16 aa, Borrelia afzelii
KIGMQGMKQAVEEAAK

SEQ ID NO: 77525 - protein, 16 aa, Borrelia afzelii
IGMQGMKQAVEEAAKE

SEQ ID NO: 77526 - protein, 16 aa, Borrelia afzelii
GMQGMKQAVEEAAKEK

SEQ ID NO: 77527 - protein, 16 aa, Borrelia afzelii
MQGMKQAVEEAAKEKP

SEQ ID NO: 77528 - protein, 16 aa, Borrelia afzelii
QGMKQAVEEAAKEKPK

SEQ ID NO: 77529 - protein, 16 aa, Borrelia afzelii
GMKQAVEEAAKEKPKT

SEQ ID NO: 77530 - protein, 16 aa, Borrelia afzelii
MKQAVEEAAKEKPKTT

SEQ ID NO: 77531 - protein, 16 aa, Borrelia afzelii
KQAVEEAAKEKPKTTA

SEQ ID NO: 77532 - protein, 16 aa, Borrelia afzelii
QAVEEAAKEKPKTTAD

SEQ ID NO: 77533 - protein, 16 aa, Borrelia afzelii
AVEEAAKEKPKTTADG

SEQ ID NO: 77534 - protein, 16 aa, Borrelia afzelii
VEEAAKEKPKTTADGI

SEQ ID NO: 77535 - protein, 16 aa, Borrelia afzelii
EEAAKEKPKTTADGII

SEQ ID NO: 77536 - protein, 16 aa, Borrelia afzelii
EAAKEKPKTTADGIIA

SEQ ID NO: 77537 - protein, 16 aa, Borrelia afzelii
AAKEKPKTTADGIIAI

SEQ ID NO: 77538 - protein, 16 aa, Borrelia afzelii
AKEKPKTTADGIIAIV

SEQ ID NO: 77539 - protein, 16 aa, Borrelia afzelii
KEKPKTTADGIIAIVK

SEQ ID NO: 77540 - protein, 16 aa, Borrelia afzelii
EKPKTTADGIIAIVKV

SEQ ID NO: 77541 - protein, 16 aa, Borrelia afzelii
KPKTTADGIIAIVKVM

SEQ ID NO: 77542 - protein, 16 aa, Borrelia afzelii
PKTTADGIIAIVKVMK

SEQ ID NO: 77543 - protein, 16 aa, Borrelia afzelii
KTTADGIIAIVKVMKA

SEQ ID NO: 77544 - protein, 16 aa, Borrelia afzelii
TTADGIIAIVKVMKAK

SEQ ID NO: 77545 - protein, 16 aa, Borrelia afzelii
TADGIIAIVKVMKAKV

SEQ ID NO: 77546 - protein, 16 aa, Borrelia afzelii
ADGIIAIVKVMKAKVE

SEQ ID NO: 77547 - protein, 16 aa, Borrelia afzelii
DGIIAIVKVMKAKVEN

SEQ ID NO: 77548 - protein, 16 aa, Borrelia afzelii
GIIAIVKVMKAKVENI

SEQ ID NO: 77549 - protein, 16 aa, Borrelia afzelii
IIAIVKVMKAKVENIK

SEQ ID NO: 77550 - protein, 16 aa, Borrelia afzelii
IAIVKVMKAKVENIKE

SEQ ID NO: 77551 - protein, 16 aa, Borrelia afzelii
AIVKVMKAKVENIKEK

SEQ ID NO: 77552 - protein, 16 aa, Borrelia afzelii
IVKVMKAKVENIKEKQ

SEQ ID NO: 77553 - protein, 16 aa, Borrelia afzelii
VKVMKAKVENIKEKQT

SEQ ID NO: 77554 - protein, 16 aa, Borrelia afzelii
KVMKAKVENIKEKQTK

SEQ ID NO: 77555 - protein, 16 aa, Borrelia afzelii
VMKAKVENIKEKQTKN

SEQ ID NO: 77556 - protein, 16 aa, Borrelia afzelii
MKAKVENIKEKQTKNQ

SEQ ID NO: 77557 - protein, 16 aa, Borrelia afzelii
KAKVENIKEKQTKNQK

SEQ ID NO: 77558 - protein, 13 aa, Borrelia garinii
MIKYNKILLKLSL

SEQ ID NO: 77559 - protein, 13 aa, Borrelia garinii
IKYNKILLKLSLI

SEQ ID NO: 77560 - protein, 13 aa, Borrelia garinii
KYNKILLKLSLIV

SEQ ID NO: 77561 - protein, 13 aa, Borrelia garinii
YNKILLKLSLIVS

SEQ ID NO: 77562 - protein, 13 aa, Borrelia garinii
NKILLKLSLIVSL

SEQ ID NO: 77563 - protein, 13 aa, Borrelia garinii
KILLKLSLIVSLL

SEQ ID NO: 77564 - protein, 13 aa, Borrelia garinii
ILLKLSLIVSLLV

SEQ ID NO: 77565 - protein, 13 aa, Borrelia garinii
LLKLSLIVSLLVA

SEQ ID NO: 77566 - protein, 13 aa, Borrelia garinii
LKLSLIVSLLVAC

SEQ ID NO: 77567 - protein, 13 aa, Borrelia garinii
KLSLIVSLLVACG

SEQ ID NO: 77568 - protein, 13 aa, Borrelia garinii
LSLIVSLLVACGL

SEQ ID NO: 77569 - protein, 13 aa, Borrelia garinii
SLIVSLLVACGLT

SEQ ID NO: 77570 - protein, 13 aa, Borrelia garinii
LIVSLLVACGLTG

SEQ ID NO: 77571 - protein, 13 aa, Borrelia garinii
IVSLLVACGLTGE

SEQ ID NO: 77572 - protein, 13 aa, Borrelia garinii
VSLLVACGLTGET

SEQ ID NO: 77573 - protein, 13 aa, Borrelia garinii
SLLVACGLTGETK

SEQ ID NO: 77574 - protein, 13 aa, Borrelia garinii
LLVACGLTGETKI

SEQ ID NO: 77575 - protein, 13 aa, Borrelia garinii
LVACGLTGETKIR

SEQ ID NO: 77576 - protein, 13 aa, Borrelia garinii
VACGLTGETKIRL

SEQ ID NO: 77577 - protein, 13 aa, Borrelia garinii
ACGLTGETKIRLE

SEQ ID NO: 77578 - protein, 13 aa, Borrelia garinii
CGLTGETKIRLES

SEQ ID NO: 77579 - protein, 13 aa, Borrelia garinii
GLTGETKIRLESS

SEQ ID NO: 77580 - protein, 13 aa, Borrelia garinii
LTGETKIRLESSA

SEQ ID NO: 77581 - protein, 13 aa, Borrelia garinii
TGETKIRLESSAQ

SEQ ID NO: 77582 - protein, 13 aa, Borrelia garinii
GETKIRLESSAQE

SEQ ID NO: 77583 - protein, 13 aa, Borrelia garinii
ETKIRLESSAQEI

SEQ ID NO: 77584 - protein, 13 aa, Borrelia garinii
TKIRLESSAQEIK

SEQ ID NO: 77585 - protein, 13 aa, Borrelia garinii
KIRLESSAQEIKD

SEQ ID NO: 77586 - protein, 13 aa, Borrelia garinii
IRLESSAQEIKDE

SEQ ID NO: 77587 - protein, 13 aa, Borrelia garinii
RLESSAQEIKDEI

SEQ ID NO: 77588 - protein, 13 aa, Borrelia garinii
LESSAQEIKDEIN

SEQ ID NO: 77589 - protein, 13 aa, Borrelia garinii
ESSAQEIKDEINK

SEQ ID NO: 77590 - protein, 13 aa, Borrelia garinii
SSAQEIKDEINKI

SEQ ID NO: 77591 - protein, 13 aa, Borrelia garinii
SAQEIKDEINKIK

SEQ ID NO: 77592 - protein, 13 aa, Borrelia garinii
AQEIKDEINKIKA

SEQ ID NO: 77593 - protein, 13 aa, Borrelia garinii
QEIKDEINKIKAN

SEQ ID NO: 77594 - protein, 13 aa, Borrelia garinii
EIKDEINKIKANA

SEQ ID NO: 77595 - protein, 13 aa, Borrelia garinii
IKDEINKIKANAK

SEQ ID NO: 77596 - protein, 13 aa, Borrelia garinii
KDEINKIKANAKK

SEQ ID NO: 77597 - protein, 13 aa, Borrelia garinii
DEINKIKANAKKE

SEQ ID NO: 77598 - protein, 13 aa, Borrelia garinii
EINKIKANAKKEG

SEQ ID NO: 77599 - protein, 13 aa, Borrelia garinii
INKIKANAKKEGV

SEQ ID NO: 77600 - protein, 13 aa, Borrelia garinii
NKIKANAKKEGVK

SEQ ID NO: 77601 - protein, 13 aa, Borrelia garinii
KIKANAKKEGVKF

SEQ ID NO: 77602 - protein, 13 aa, Borrelia garinii
IKANAKKEGVKFE

SEQ ID NO: 77603 - protein, 13 aa, Borrelia garinii
KANAKKEGVKFEA

SEQ ID NO: 77604 - protein, 13 aa, Borrelia garinii
ANAKKEGVKFEAF

SEQ ID NO: 77605 - protein, 13 aa, Borrelia garinii
NAKKEGVKFEAFT

SEQ ID NO: 77606 - protein, 13 aa, Borrelia garinii
AKKEGVKFEAFTN

SEQ ID NO: 77607 - protein, 13 aa, Borrelia garinii
KKEGVKFEAFTNT

SEQ ID NO: 77608 - protein, 13 aa, Borrelia garinii
KEGVKFEAFTNTQ

SEQ ID NO: 77609 - protein, 13 aa, Borrelia garinii
EGVKFEAFTNTQT

SEQ ID NO: 77610 - protein, 13 aa, Borrelia garinii
GVKFEAFTNTQTG

SEQ ID NO: 77611 - protein, 13 aa, Borrelia garinii
VKFEAFTNTQTGS

SEQ ID NO: 77612 - protein, 13 aa, Borrelia garinii
KFEAFTNTQTGSK

SEQ ID NO: 77613 - protein, 13 aa, Borrelia garinii
FEAFTNTQTGSKI

SEQ ID NO: 77614 - protein, 13 aa, Borrelia garinii
EAFTNTQTGSKIS

SEQ ID NO: 77615 - protein, 13 aa, Borrelia garinii
AFTNTQTGSKISE

SEQ ID NO: 77616 - protein, 13 aa, Borrelia garinii
FTNTQTGSKISEK

SEQ ID NO: 77617 - protein, 13 aa, Borrelia garinii
TNTQTGSKISEKP

SEQ ID NO: 77618 - protein, 13 aa, Borrelia garinii
NTQTGSKISEKPE

SEQ ID NO: 77619 - protein, 13 aa, Borrelia garinii
TQTGSKISEKPEF

SEQ ID NO: 77620 - protein, 13 aa, Borrelia garinii
QTGSKISEKPEFI

SEQ ID NO: 77621 - protein, 13 aa, Borrelia garinii
TGSKISEKPEFIL

SEQ ID NO: 77622 - protein, 13 aa, Borrelia garinii
GSKISEKPEFILK

SEQ ID NO: 77623 - protein, 13 aa, Borrelia garinii
SKISEKPEFILKA

SEQ ID NO: 77624 - protein, 13 aa, Borrelia garinii
KISEKPEFILKAK

SEQ ID NO: 77625 - protein, 13 aa, Borrelia garinii
ISEKPEFILKAKI

SEQ ID NO: 77626 - protein, 13 aa, Borrelia garinii
SEKPEFILKAKIK

SEQ ID NO: 77627 - protein, 13 aa, Borrelia garinii
EKPEFILKAKIKA

SEQ ID NO: 77628 - protein, 13 aa, Borrelia garinii
KPEFILKAKIKAI

SEQ ID NO: 77629 - protein, 13 aa, Borrelia garinii
PEFILKAKIKAIQ

SEQ ID NO: 77630 - protein, 13 aa, Borrelia garinii
EFILKAKIKAIQV

SEQ ID NO: 77631 - protein, 13 aa, Borrelia garinii
FILKAKIKAIQVA

SEQ ID NO: 77632 - protein, 13 aa, Borrelia garinii
ILKAKIKAIQVAE

SEQ ID NO: 77633 - protein, 13 aa, Borrelia garinii
LKAKIKAIQVAER

SEQ ID NO: 77634 - protein, 13 aa, Borrelia garinii
KAKIKAIQVAERF

SEQ ID NO: 77635 - protein, 13 aa, Borrelia garinii
AKIKAIQVAERFV

SEQ ID NO: 77636 - protein, 13 aa, Borrelia garinii
KIKAIQVAERFVK

SEQ ID NO: 77637 - protein, 13 aa, Borrelia garinii
IKAIQVAERFVKA

SEQ ID NO: 77638 - protein, 13 aa, Borrelia garinii
KAIQVAERFVKAI

SEQ ID NO: 77639 - protein, 13 aa, Borrelia garinii
AIQVAERFVKAIK

SEQ ID NO: 77640 - protein, 13 aa, Borrelia garinii
IQVAERFVKAIKE

SEQ ID NO: 77641 - protein, 13 aa, Borrelia garinii
QVAERFVKAIKEE

SEQ ID NO: 77642 - protein, 13 aa, Borrelia garinii
VAERFVKAIKEEA

SEQ ID NO: 77643 - protein, 13 aa, Borrelia garinii
AERFVKAIKEEAE

SEQ ID NO: 77644 - protein, 13 aa, Borrelia garinii
ERFVKAIKEEAEK

SEQ ID NO: 77645 - protein, 13 aa, Borrelia garinii
RFVKAIKEEAEKL

SEQ ID NO: 77646 - protein, 13 aa, Borrelia garinii
FVKAIKEEAEKLK

SEQ ID NO: 77647 - protein, 13 aa, Borrelia garinii
VKAIKEEAEKLKK

SEQ ID NO: 77648 - protein, 13 aa, Borrelia garinii
KAIKEEAEKLKKS

SEQ ID NO: 77649 - protein, 13 aa, Borrelia garinii
AIKEEAEKLKKSG

SEQ ID NO: 77650 - protein, 13 aa, Borrelia garinii
IKEEAEKLKKSGS

SEQ ID NO: 77651 - protein, 13 aa, Borrelia garinii
KEEAEKLKKSGSS

SEQ ID NO: 77652 - protein, 13 aa, Borrelia garinii
EEAEKLKKSGSSG

SEQ ID NO: 77653 - protein, 13 aa, Borrelia garinii
EAEKLKKSGSSGA

SEQ ID NO: 77654 - protein, 13 aa, Borrelia garinii
AEKLKKSGSSGAF

SEQ ID NO: 77655 - protein, 13 aa, Borrelia garinii
EKLKKSGSSGAFS

SEQ ID NO: 77656 - protein, 13 aa, Borrelia garinii
KLKKSGSSGAFSA

SEQ ID NO: 77657 - protein, 13 aa, Borrelia garinii
LKKSGSSGAFSAM

SEQ ID NO: 77658 - protein, 13 aa, Borrelia garinii
KKSGSSGAFSAMY

SEQ ID NO: 77659 - protein, 13 aa, Borrelia garinii
KSGSSGAFSAMYD

SEQ ID NO: 77660 - protein, 13 aa, Borrelia garinii
SGSSGAFSAMYDL

SEQ ID NO: 77661 - protein, 13 aa, Borrelia garinii
GSSGAFSAMYDLM

SEQ ID NO: 77662 - protein, 13 aa, Borrelia garinii
SSGAFSAMYDLMI

SEQ ID NO: 77663 - protein, 13 aa, Borrelia garinii
SGAFSAMYDLMID

SEQ ID NO: 77664 - protein, 13 aa, Borrelia garinii
GAFSAMYDLMIDV

SEQ ID NO: 77665 - protein, 13 aa, Borrelia garinii
AFSAMYDLMIDVS

SEQ ID NO: 77666 - protein, 13 aa, Borrelia garinii
FSAMYDLMIDVSK

SEQ ID NO: 77667 - protein, 13 aa, Borrelia garinii
SAMYDLMIDVSKP

SEQ ID NO: 77668 - protein, 13 aa, Borrelia garinii
AMYDLMIDVSKPL

SEQ ID NO: 77669 - protein, 13 aa, Borrelia garinii
MYDLMIDVSKPLE

SEQ ID NO: 77670 - protein, 13 aa, Borrelia garinii
YDLMIDVSKPLEE

SEQ ID NO: 77671 - protein, 13 aa, Borrelia garinii
DLMIDVSKPLEEI

SEQ ID NO: 77672 - protein, 13 aa, Borrelia garinii
LMIDVSKPLEEIG

SEQ ID NO: 77673 - protein, 13 aa, Borrelia garinii
MIDVSKPLEEIGI

SEQ ID NO: 77674 - protein, 13 aa, Borrelia garinii
IDVSKPLEEIGIQ

SEQ ID NO: 77675 - protein, 13 aa, Borrelia garinii
DVSKPLEEIGIQK

SEQ ID NO: 77676 - protein, 13 aa, Borrelia garinii
VSKPLEEIGIQKM

SEQ ID NO: 77677 - protein, 13 aa, Borrelia garinii
SKPLEEIGIQKMT

SEQ ID NO: 77678 - protein, 13 aa, Borrelia garinii
KPLEEIGIQKMTG

SEQ ID NO: 77679 - protein, 13 aa, Borrelia garinii
PLEEIGIQKMTGT

SEQ ID NO: 77680 - protein, 13 aa, Borrelia garinii
LEEIGIQKMTGTV

SEQ ID NO: 77681 - protein, 13 aa, Borrelia garinii
EEIGIQKMTGTVT

SEQ ID NO: 77682 - protein, 13 aa, Borrelia garinii
EIGIQKMTGTVTK

SEQ ID NO: 77683 - protein, 13 aa, Borrelia garinii
IGIQKMTGTVTKE

SEQ ID NO: 77684 - protein, 13 aa, Borrelia garinii
GIQKMTGTVTKEA

SEQ ID NO: 77685 - protein, 13 aa, Borrelia garinii
IQKMTGTVTKEAE

SEQ ID NO: 77686 - protein, 13 aa, Borrelia garinii
QKMTGTVTKEAEK

SEQ ID NO: 77687 - protein, 13 aa, Borrelia garinii
KMTGTVTKEAEKT

SEQ ID NO: 77688 - protein, 13 aa, Borrelia garinii
MTGTVTKEAEKTP

SEQ ID NO: 77689 - protein, 13 aa, Borrelia garinii
TGTVTKEAEKTPP

SEQ ID NO: 77690 - protein, 13 aa, Borrelia garinii
GTVTKEAEKTPPT

SEQ ID NO: 77691 - protein, 13 aa, Borrelia garinii
TVTKEAEKTPPTT

SEQ ID NO: 77692 - protein, 13 aa, Borrelia garinii
VTKEAEKTPPTTA

SEQ ID NO: 77693 - protein, 13 aa, Borrelia garinii
TKEAEKTPPTTAD

SEQ ID NO: 77694 - protein, 13 aa, Borrelia garinii
KEAEKTPPTTADG

SEQ ID NO: 77695 - protein, 13 aa, Borrelia garinii
EAEKTPPTTADGI

SEQ ID NO: 77696 - protein, 13 aa, Borrelia garinii
AEKTPPTTADGII

SEQ ID NO: 77697 - protein, 13 aa, Borrelia garinii
EKTPPTTADGIIA

SEQ ID NO: 77698 - protein, 13 aa, Borrelia garinii
KTPPTTADGIIAI

SEQ ID NO: 77699 - protein, 13 aa, Borrelia garinii
TPPTTADGIIAIA

SEQ ID NO: 77700 - protein, 13 aa, Borrelia garinii
PPTTADGIIAIAQ

SEQ ID NO: 77701 - protein, 13 aa, Borrelia garinii
PTTADGIIAIAQA

SEQ ID NO: 77702 - protein, 13 aa, Borrelia garinii
TTADGIIAIAQAM

SEQ ID NO: 77703 - protein, 13 aa, Borrelia garinii
TADGIIAIAQAME

SEQ ID NO: 77704 - protein, 13 aa, Borrelia garinii
ADGIIAIAQAMEE

SEQ ID NO: 77705 - protein, 13 aa, Borrelia garinii
DGIIAIAQAMEEK

SEQ ID NO: 77706 - protein, 13 aa, Borrelia garinii
GIIAIAQAMEEKL

SEQ ID NO: 77707 - protein, 13 aa, Borrelia garinii
IIAIAQAMEEKLN

SEQ ID NO: 77708 - protein, 13 aa, Borrelia garinii
IAIAQAMEEKLNN

SEQ ID NO: 77709 - protein, 13 aa, Borrelia garinii
AIAQAMEEKLNNV

SEQ ID NO: 77710 - protein, 13 aa, Borrelia garinii
IAQAMEEKLNNVN

SEQ ID NO: 77711 - protein, 13 aa, Borrelia garinii
AQAMEEKLNNVNK

SEQ ID NO: 77712 - protein, 13 aa, Borrelia garinii
QAMEEKLNNVNKK

SEQ ID NO: 77713 - protein, 13 aa, Borrelia garinii
AMEEKLNNVNKKQ

SEQ ID NO: 77714 - protein, 13 aa, Borrelia garinii
MEEKLNNVNKKQH

SEQ ID NO: 77715 - protein, 13 aa, Borrelia garinii
EEKLNNVNKKQHD

SEQ ID NO: 77716 - protein, 13 aa, Borrelia garinii
EKLNNVNKKQHDA

SEQ ID NO: 77717 - protein, 13 aa, Borrelia garinii
KLNNVNKKQHDAL

SEQ ID NO: 77718 - protein, 13 aa, Borrelia garinii
LNNVNKKQHDALK

SEQ ID NO: 77719 - protein, 13 aa, Borrelia garinii
NNVNKKQHDALKN

SEQ ID NO: 77720 - protein, 13 aa, Borrelia garinii
NVNKKQHDALKNL

SEQ ID NO: 77721 - protein, 13 aa, Borrelia garinii
VNKKQHDALKNLE

SEQ ID NO: 77722 - protein, 13 aa, Borrelia garinii
NKKQHDALKNLEE

SEQ ID NO: 77723 - protein, 13 aa, Borrelia garinii
KKQHDALKNLEEK

SEQ ID NO: 77724 - protein, 13 aa, Borrelia garinii
KQHDALKNLEEKA

SEQ ID NO: 77725 - protein, 13 aa, Borrelia garinii
QHDALKNLEEKAN

SEQ ID NO: 77726 - protein, 13 aa, Borrelia garinii
HDALKNLEEKANT

SEQ ID NO: 77727 - protein, 13 aa, Borrelia garinii
DALKNLEEKANTA

SEQ ID NO: 77728 - protein, 13 aa, Borrelia garinii
ALKNLEEKANTAA

SEQ ID NO: 77729 - protein, 13 aa, Borrelia garinii
LKNLEEKANTAAT

SEQ ID NO: 77730 - protein, 13 aa, Borrelia garinii
KNLEEKANTAATT

SEQ ID NO: 77731 - protein, 13 aa, Borrelia garinii
NLEEKANTAATTT

SEQ ID NO: 77732 - protein, 14 aa, Borrelia garinii
MIKYNKILLKLSLI

SEQ ID NO: 77733 - protein, 14 aa, Borrelia garinii
IKYNKILLKLSLIV

SEQ ID NO: 77734 - protein, 14 aa, Borrelia garinii
KYNKILLKLSLIVS

SEQ ID NO: 77735 - protein, 14 aa, Borrelia garinii
YNKILLKLSLIVSL

SEQ ID NO: 77736 - protein, 14 aa, Borrelia garinii
NKILLKLSLIVSLL

SEQ ID NO: 77737 - protein, 14 aa, Borrelia garinii
KILLKLSLIVSLLV

SEQ ID NO: 77738 - protein, 14 aa, Borrelia garinii
ILLKLSLIVSLLVA

SEQ ID NO: 77739 - protein, 14 aa, Borrelia garinii
LLKLSLIVSLLVAC

SEQ ID NO: 77740 - protein, 14 aa, Borrelia garinii
LKLSLIVSLLVACG

SEQ ID NO: 77741 - protein, 14 aa, Borrelia garinii
KLSLIVSLLVACGL

SEQ ID NO: 77742 - protein, 14 aa, Borrelia garinii
LSLIVSLLVACGLT

SEQ ID NO: 77743 - protein, 14 aa, Borrelia garinii
SLIVSLLVACGLTG

SEQ ID NO: 77744 - protein, 14 aa, Borrelia garinii
LIVSLLVACGLTGE

SEQ ID NO: 77745 - protein, 14 aa, Borrelia garinii
IVSLLVACGLTGET

SEQ ID NO: 77746 - protein, 14 aa, Borrelia garinii
VSLLVACGLTGETK

SEQ ID NO: 77747 - protein, 14 aa, Borrelia garinii
SLLVACGLTGETKI

SEQ ID NO: 77748 - protein, 14 aa, Borrelia garinii
LLVACGLTGETKIR

SEQ ID NO: 77749 - protein, 14 aa, Borrelia garinii
LVACGLTGETKIRL

SEQ ID NO: 77750 - protein, 14 aa, Borrelia garinii
VACGLTGETKIRLE

SEQ ID NO: 77751 - protein, 14 aa, Borrelia garinii
ACGLTGETKIRLES

SEQ ID NO: 77752 - protein, 14 aa, Borrelia garinii
CGLTGETKIRLESS

SEQ ID NO: 77753 - protein, 14 aa, Borrelia garinii
GLTGETKIRLESSA

SEQ ID NO: 77754 - protein, 14 aa, Borrelia garinii
LTGETKIRLESSAQ

SEQ ID NO: 77755 - protein, 14 aa, Borrelia garinii
TGETKIRLESSAQE

SEQ ID NO: 77756 - protein, 14 aa, Borrelia garinii
GETKIRLESSAQEI

SEQ ID NO: 77757 - protein, 14 aa, Borrelia garinii
ETKIRLESSAQEIK

SEQ ID NO: 77758 - protein, 14 aa, Borrelia garinii
TKIRLESSAQEIKD

SEQ ID NO: 77759 - protein, 14 aa, Borrelia garinii
KIRLESSAQEIKDE

SEQ ID NO: 77760 - protein, 14 aa, Borrelia garinii
IRLESSAQEIKDEI

SEQ ID NO: 77761 - protein, 14 aa, Borrelia garinii
RLESSAQEIKDEIN

SEQ ID NO: 77762 - protein, 14 aa, Borrelia garinii
LESSAQEIKDEINK

SEQ ID NO: 77763 - protein, 14 aa, Borrelia garinii
ESSAQEIKDEINKI

SEQ ID NO: 77764 - protein, 14 aa, Borrelia garinii
SSAQEIKDEINKIK

SEQ ID NO: 77765 - protein, 14 aa, Borrelia garinii
SAQEIKDEINKIKA

SEQ ID NO: 77766 - protein, 14 aa, Borrelia garinii
AQEIKDEINKIKAN

SEQ ID NO: 77767 - protein, 14 aa, Borrelia garinii
QEIKDEINKIKANA

SEQ ID NO: 77768 - protein, 14 aa, Borrelia garinii
EIKDEINKIKANAK

SEQ ID NO: 77769 - protein, 14 aa, Borrelia garinii
IKDEINKIKANAKK

SEQ ID NO: 77770 - protein, 14 aa, Borrelia garinii
KDEINKIKANAKKE

SEQ ID NO: 77771 - protein, 14 aa, Borrelia garinii
DEINKIKANAKKEG

SEQ ID NO: 77772 - protein, 14 aa, Borrelia garinii
EINKIKANAKKEGV

SEQ ID NO: 77773 - protein, 14 aa, Borrelia garinii
INKIKANAKKEGVK

SEQ ID NO: 77774 - protein, 14 aa, Borrelia garinii
NKIKANAKKEGVKF

SEQ ID NO: 77775 - protein, 14 aa, Borrelia garinii
KIKANAKKEGVKFE

SEQ ID NO: 77776 - protein, 14 aa, Borrelia garinii
IKANAKKEGVKFEA

SEQ ID NO: 77777 - protein, 14 aa, Borrelia garinii
KANAKKEGVKFEAF

SEQ ID NO: 77778 - protein, 14 aa, Borrelia garinii
ANAKKEGVKFEAFT

SEQ ID NO: 77779 - protein, 14 aa, Borrelia garinii
NAKKEGVKFEAFTN

SEQ ID NO: 77780 - protein, 14 aa, Borrelia garinii
AKKEGVKFEAFTNT

SEQ ID NO: 77781 - protein, 14 aa, Borrelia garinii
KKEGVKFEAFTNTQ

SEQ ID NO: 77782 - protein, 14 aa, Borrelia garinii
KEGVKFEAFTNTQT

SEQ ID NO: 77783 - protein, 14 aa, Borrelia garinii
EGVKFEAFTNTQTG

SEQ ID NO: 77784 - protein, 14 aa, Borrelia garinii
GVKFEAFTNTQTGS

SEQ ID NO: 77785 - protein, 14 aa, Borrelia garinii
VKFEAFTNTQTGSK

SEQ ID NO: 77786 - protein, 14 aa, Borrelia garinii
KFEAFTNTQTGSKI

SEQ ID NO: 77787 - protein, 14 aa, Borrelia garinii
FEAFTNTQTGSKIS

SEQ ID NO: 77788 - protein, 14 aa, Borrelia garinii
EAFTNTQTGSKISE

SEQ ID NO: 77789 - protein, 14 aa, Borrelia garinii
AFTNTQTGSKISEK

SEQ ID NO: 77790 - protein, 14 aa, Borrelia garinii
FTNTQTGSKISEKP

SEQ ID NO: 77791 - protein, 14 aa, Borrelia garinii
TNTQTGSKISEKPE

SEQ ID NO: 77792 - protein, 14 aa, Borrelia garinii
NTQTGSKISEKPEF

SEQ ID NO: 77793 - protein, 14 aa, Borrelia garinii
TQTGSKISEKPEFI

SEQ ID NO: 77794 - protein, 14 aa, Borrelia garinii
QTGSKISEKPEFIL

SEQ ID NO: 77795 - protein, 14 aa, Borrelia garinii
TGSKISEKPEFILK

SEQ ID NO: 77796 - protein, 14 aa, Borrelia garinii
GSKISEKPEFILKA

SEQ ID NO: 77797 - protein, 14 aa, Borrelia garinii
SKISEKPEFILKAK

SEQ ID NO: 77798 - protein, 14 aa, Borrelia garinii
KISEKPEFILKAKI

SEQ ID NO: 77799 - protein, 14 aa, Borrelia garinii
ISEKPEFILKAKIK

SEQ ID NO: 77800 - protein, 14 aa, Borrelia garinii
SEKPEFILKAKIKA

SEQ ID NO: 77801 - protein, 14 aa, Borrelia garinii
EKPEFILKAKIKAI

SEQ ID NO: 77802 - protein, 14 aa, Borrelia garinii
KPEFILKAKIKAIQ

SEQ ID NO: 77803 - protein, 14 aa, Borrelia garinii
PEFILKAKIKAIQV

SEQ ID NO: 77804 - protein, 14 aa, Borrelia garinii
EFILKAKIKAIQVA

SEQ ID NO: 77805 - protein, 14 aa, Borrelia garinii
FILKAKIKAIQVAE

SEQ ID NO: 77806 - protein, 14 aa, Borrelia garinii
ILKAKIKAIQVAER

SEQ ID NO: 77807 - protein, 14 aa, Borrelia garinii
LKAKIKAIQVAERF

SEQ ID NO: 77808 - protein, 14 aa, Borrelia garinii
KAKIKAIQVAERFV

SEQ ID NO: 77809 - protein, 14 aa, Borrelia garinii
AKIKAIQVAERFVK

SEQ ID NO: 77810 - protein, 14 aa, Borrelia garinii
KIKAIQVAERFVKA

SEQ ID NO: 77811 - protein, 14 aa, Borrelia garinii
IKAIQVAERFVKAI

SEQ ID NO: 77812 - protein, 14 aa, Borrelia garinii
KAIQVAERFVKAIK

SEQ ID NO: 77813 - protein, 14 aa, Borrelia garinii
AIQVAERFVKAIKE

SEQ ID NO: 77814 - protein, 14 aa, Borrelia garinii
IQVAERFVKAIKEE

SEQ ID NO: 77815 - protein, 14 aa, Borrelia garinii
QVAERFVKAIKEEA

SEQ ID NO: 77816 - protein, 14 aa, Borrelia garinii
VAERFVKAIKEEAE

SEQ ID NO: 77817 - protein, 14 aa, Borrelia garinii
AERFVKAIKEEAEK

SEQ ID NO: 77818 - protein, 14 aa, Borrelia garinii
ERFVKAIKEEAEKL

SEQ ID NO: 77819 - protein, 14 aa, Borrelia garinii
RFVKAIKEEAEKLK

SEQ ID NO: 77820 - protein, 14 aa, Borrelia garinii
FVKAIKEEAEKLKK

SEQ ID NO: 77821 - protein, 14 aa, Borrelia garinii
VKAIKEEAEKLKKS

SEQ ID NO: 77822 - protein, 14 aa, Borrelia garinii
KAIKEEAEKLKKSG

SEQ ID NO: 77823 - protein, 14 aa, Borrelia garinii
AIKEEAEKLKKSGS

SEQ ID NO: 77824 - protein, 14 aa, Borrelia garinii
IKEEAEKLKKSGSS

SEQ ID NO: 77825 - protein, 14 aa, Borrelia garinii
KEEAEKLKKSGSSG

SEQ ID NO: 77826 - protein, 14 aa, Borrelia garinii
EEAEKLKKSGSSGA

SEQ ID NO: 77827 - protein, 14 aa, Borrelia garinii
EAEKLKKSGSSGAF

SEQ ID NO: 77828 - protein, 14 aa, Borrelia garinii
AEKLKKSGSSGAFS

SEQ ID NO: 77829 - protein, 14 aa, Borrelia garinii
EKLKKSGSSGAFSA

SEQ ID NO: 77830 - protein, 14 aa, Borrelia garinii
KLKKSGSSGAFSAM

SEQ ID NO: 77831 - protein, 14 aa, Borrelia garinii
LKKSGSSGAFSAMY

SEQ ID NO: 77832 - protein, 14 aa, Borrelia garinii
KKSGSSGAFSAMYD

SEQ ID NO: 77833 - protein, 14 aa, Borrelia garinii
KSGSSGAFSAMYDL

SEQ ID NO: 77834 - protein, 14 aa, Borrelia garinii
SGSSGAFSAMYDLM

SEQ ID NO: 77835 - protein, 14 aa, Borrelia garinii
GSSGAFSAMYDLMI

SEQ ID NO: 77836 - protein, 14 aa, Borrelia garinii
SSGAFSAMYDLMID

SEQ ID NO: 77837 - protein, 14 aa, Borrelia garinii
SGAFSAMYDLMIDV

SEQ ID NO: 77838 - protein, 14 aa, Borrelia garinii
GAFSAMYDLMIDVS

SEQ ID NO: 77839 - protein, 14 aa, Borrelia garinii
AFSAMYDLMIDVSK

SEQ ID NO: 77840 - protein, 14 aa, Borrelia garinii
FSAMYDLMIDVSKP

SEQ ID NO: 77841 - protein, 14 aa, Borrelia garinii
SAMYDLMIDVSKPL

SEQ ID NO: 77842 - protein, 14 aa, Borrelia garinii
AMYDLMIDVSKPLE

SEQ ID NO: 77843 - protein, 14 aa, Borrelia garinii
MYDLMIDVSKPLEE

SEQ ID NO: 77844 - protein, 14 aa, Borrelia garinii
YDLMIDVSKPLEEI

SEQ ID NO: 77845 - protein, 14 aa, Borrelia garinii
DLMIDVSKPLEEIG

SEQ ID NO: 77846 - protein, 14 aa, Borrelia garinii
LMIDVSKPLEEIGI

SEQ ID NO: 77847 - protein, 14 aa, Borrelia garinii
MIDVSKPLEEIGIQ

SEQ ID NO: 77848 - protein, 14 aa, Borrelia garinii
IDVSKPLEEIGIQK

SEQ ID NO: 77849 - protein, 14 aa, Borrelia garinii
DVSKPLEEIGIQKM

SEQ ID NO: 77850 - protein, 14 aa, Borrelia garinii
VSKPLEEIGIQKMT

SEQ ID NO: 77851 - protein, 14 aa, Borrelia garinii
SKPLEEIGIQKMTG

SEQ ID NO: 77852 - protein, 14 aa, Borrelia garinii
KPLEEIGIQKMTGT

SEQ ID NO: 77853 - protein, 14 aa, Borrelia garinii
PLEEIGIQKMTGTV

SEQ ID NO: 77854 - protein, 14 aa, Borrelia garinii
LEEIGIQKMTGTVT

SEQ ID NO: 77855 - protein, 14 aa, Borrelia garinii
EEIGIQKMTGTVTK

SEQ ID NO: 77856 - protein, 14 aa, Borrelia garinii
EIGIQKMTGTVTKE

SEQ ID NO: 77857 - protein, 14 aa, Borrelia garinii
IGIQKMTGTVTKEA

SEQ ID NO: 77858 - protein, 14 aa, Borrelia garinii
GIQKMTGTVTKEAE

SEQ ID NO: 77859 - protein, 14 aa, Borrelia garinii
IQKMTGTVTKEAEK

SEQ ID NO: 77860 - protein, 14 aa, Borrelia garinii
QKMTGTVTKEAEKT

SEQ ID NO: 77861 - protein, 14 aa, Borrelia garinii
KMTGTVTKEAEKTP

SEQ ID NO: 77862 - protein, 14 aa, Borrelia garinii
MTGTVTKEAEKTPP

SEQ ID NO: 77863 - protein, 14 aa, Borrelia garinii
TGTVTKEAEKTPPT

SEQ ID NO: 77864 - protein, 14 aa, Borrelia garinii
GTVTKEAEKTPPTT

SEQ ID NO: 77865 - protein, 14 aa, Borrelia garinii
TVTKEAEKTPPTTA

SEQ ID NO: 77866 - protein, 14 aa, Borrelia garinii
VTKEAEKTPPTTAD

SEQ ID NO: 77867 - protein, 14 aa, Borrelia garinii
TKEAEKTPPTTADG

SEQ ID NO: 77868 - protein, 14 aa, Borrelia garinii
KEAEKTPPTTADGI

SEQ ID NO: 77869 - protein, 14 aa, Borrelia garinii
EAEKTPPTTADGII

SEQ ID NO: 77870 - protein, 14 aa, Borrelia garinii
AEKTPPTTADGIIA

SEQ ID NO: 77871 - protein, 14 aa, Borrelia garinii
EKTPPTTADGIIAI

SEQ ID NO: 77872 - protein, 14 aa, Borrelia garinii
KTPPTTADGIIAIA

SEQ ID NO: 77873 - protein, 14 aa, Borrelia garinii
TPPTTADGIIAIAQ

SEQ ID NO: 77874 - protein, 14 aa, Borrelia garinii
PPTTADGIIAIAQA

SEQ ID NO: 77875 - protein, 14 aa, Borrelia garinii
PTTADGIIAIAQAM

SEQ ID NO: 77876 - protein, 14 aa, Borrelia garinii
TTADGIIAIAQAME

SEQ ID NO: 77877 - protein, 14 aa, Borrelia garinii
TADGIIAIAQAMEE

SEQ ID NO: 77878 - protein, 14 aa, Borrelia garinii
ADGIIAIAQAMEEK

SEQ ID NO: 77879 - protein, 14 aa, Borrelia garinii
DGIIAIAQAMEEKL

SEQ ID NO: 77880 - protein, 14 aa, Borrelia garinii
GIIAIAQAMEEKLN

SEQ ID NO: 77881 - protein, 14 aa, Borrelia garinii
IIAIAQAMEEKLNN

SEQ ID NO: 77882 - protein, 14 aa, Borrelia garinii
IAIAQAMEEKLNNV

SEQ ID NO: 77883 - protein, 14 aa, Borrelia garinii
AIAQAMEEKLNNVN

SEQ ID NO: 77884 - protein, 14 aa, Borrelia garinii
IAQAMEEKLNNVNK

SEQ ID NO: 77885 - protein, 14 aa, Borrelia garinii
AQAMEEKLNNVNKK

SEQ ID NO: 77886 - protein, 14 aa, Borrelia garinii
QAMEEKLNNVNKKQ

SEQ ID NO: 77887 - protein, 14 aa, Borrelia garinii
AMEEKLNNVNKKQH

SEQ ID NO: 77888 - protein, 14 aa, Borrelia garinii
MEEKLNNVNKKQHD

SEQ ID NO: 77889 - protein, 14 aa, Borrelia garinii
EEKLNNVNKKQHDA

SEQ ID NO: 77890 - protein, 14 aa, Borrelia garinii
EKLNNVNKKQHDAL

SEQ ID NO: 77891 - protein, 14 aa, Borrelia garinii
KLNNVNKKQHDALK

SEQ ID NO: 77892 - protein, 14 aa, Borrelia garinii
LNNVNKKQHDALKN

SEQ ID NO: 77893 - protein, 14 aa, Borrelia garinii
NNVNKKQHDALKNL

SEQ ID NO: 77894 - protein, 14 aa, Borrelia garinii
NVNKKQHDALKNLE

SEQ ID NO: 77895 - protein, 14 aa, Borrelia garinii
VNKKQHDALKNLEE

SEQ ID NO: 77896 - protein, 14 aa, Borrelia garinii
NKKQHDALKNLEEK

SEQ ID NO: 77897 - protein, 14 aa, Borrelia garinii
KKQHDALKNLEEKA

SEQ ID NO: 77898 - protein, 14 aa, Borrelia garinii
KQHDALKNLEEKAN

SEQ ID NO: 77899 - protein, 14 aa, Borrelia garinii
QHDALKNLEEKANT

SEQ ID NO: 77900 - protein, 14 aa, Borrelia garinii
HDALKNLEEKANTA

SEQ ID NO: 77901 - protein, 14 aa, Borrelia garinii
DALKNLEEKANTAA

SEQ ID NO: 77902 - protein, 14 aa, Borrelia garinii
ALKNLEEKANTAAT

SEQ ID NO: 77903 - protein, 14 aa, Borrelia garinii
LKNLEEKANTAATT

SEQ ID NO: 77904 - protein, 14 aa, Borrelia garinii
KNLEEKANTAATTT

SEQ ID NO: 77905 - protein, 15 aa, Borrelia garinii
MIKYNKILLKLSLIV

SEQ ID NO: 77906 - protein, 15 aa, Borrelia garinii
IKYNKILLKLSLIVS

SEQ ID NO: 77907 - protein, 15 aa, Borrelia garinii
KYNKILLKLSLIVSL

SEQ ID NO: 77908 - protein, 15 aa, Borrelia garinii
YNKILLKLSLIVSLL

SEQ ID NO: 77909 - protein, 15 aa, Borrelia garinii
NKILLKLSLIVSLLV

SEQ ID NO: 77910 - protein, 15 aa, Borrelia garinii
KILLKLSLIVSLLVA

SEQ ID NO: 77911 - protein, 15 aa, Borrelia garinii
ILLKLSLIVSLLVAC

SEQ ID NO: 77912 - protein, 15 aa, Borrelia garinii
LLKLSLIVSLLVACG

SEQ ID NO: 77913 - protein, 15 aa, Borrelia garinii
LKLSLIVSLLVACGL

SEQ ID NO: 77914 - protein, 15 aa, Borrelia garinii
KLSLIVSLLVACGLT

SEQ ID NO: 77915 - protein, 15 aa, Borrelia garinii
LSLIVSLLVACGLTG

SEQ ID NO: 77916 - protein, 15 aa, Borrelia garinii
SLIVSLLVACGLTGE

SEQ ID NO: 77917 - protein, 15 aa, Borrelia garinii
LIVSLLVACGLTGET

SEQ ID NO: 77918 - protein, 15 aa, Borrelia garinii
IVSLLVACGLTGETK

SEQ ID NO: 77919 - protein, 15 aa, Borrelia garinii
VSLLVACGLTGETKI

SEQ ID NO: 77920 - protein, 15 aa, Borrelia garinii
SLLVACGLTGETKIR

SEQ ID NO: 77921 - protein, 15 aa, Borrelia garinii
LLVACGLTGETKIRL

SEQ ID NO: 77922 - protein, 15 aa, Borrelia garinii
LVACGLTGETKIRLE

SEQ ID NO: 77923 - protein, 15 aa, Borrelia garinii
VACGLTGETKIRLES

SEQ ID NO: 77924 - protein, 15 aa, Borrelia garinii
ACGLTGETKIRLESS

SEQ ID NO: 77925 - protein, 15 aa, Borrelia garinii
CGLTGETKIRLESSA

SEQ ID NO: 77926 - protein, 15 aa, Borrelia garinii
GLTGETKIRLESSAQ

SEQ ID NO: 77927 - protein, 15 aa, Borrelia garinii
LTGETKIRLESSAQE

SEQ ID NO: 77928 - protein, 15 aa, Borrelia garinii
TGETKIRLESSAQEI

SEQ ID NO: 77929 - protein, 15 aa, Borrelia garinii
GETKIRLESSAQEIK

SEQ ID NO: 77930 - protein, 15 aa, Borrelia garinii
ETKIRLESSAQEIKD

SEQ ID NO: 77931 - protein, 15 aa, Borrelia garinii
TKIRLESSAQEIKDE

SEQ ID NO: 77932 - protein, 15 aa, Borrelia garinii
KIRLESSAQEIKDEI

SEQ ID NO: 77933 - protein, 15 aa, Borrelia garinii
IRLESSAQEIKDEIN

SEQ ID NO: 77934 - protein, 15 aa, Borrelia garinii
RLESSAQEIKDEINK

SEQ ID NO: 77935 - protein, 15 aa, Borrelia garinii
LESSAQEIKDEINKI

SEQ ID NO: 77936 - protein, 15 aa, Borrelia garinii
ESSAQEIKDEINKIK

SEQ ID NO: 77937 - protein, 15 aa, Borrelia garinii
SSAQEIKDEINKIKA

SEQ ID NO: 77938 - protein, 15 aa, Borrelia garinii
SAQEIKDEINKIKAN

SEQ ID NO: 77939 - protein, 15 aa, Borrelia garinii
AQEIKDEINKIKANA

SEQ ID NO: 77940 - protein, 15 aa, Borrelia garinii
QEIKDEINKIKANAK

SEQ ID NO: 77941 - protein, 15 aa, Borrelia garinii
EIKDEINKIKANAKK

SEQ ID NO: 77942 - protein, 15 aa, Borrelia garinii
IKDEINKIKANAKKE

SEQ ID NO: 77943 - protein, 15 aa, Borrelia garinii
KDEINKIKANAKKEG

SEQ ID NO: 77944 - protein, 15 aa, Borrelia garinii
DEINKIKANAKKEGV

SEQ ID NO: 77945 - protein, 15 aa, Borrelia garinii
EINKIKANAKKEGVK

SEQ ID NO: 77946 - protein, 15 aa, Borrelia garinii
INKIKANAKKEGVKF

SEQ ID NO: 77947 - protein, 15 aa, Borrelia garinii
NKIKANAKKEGVKFE

SEQ ID NO: 77948 - protein, 15 aa, Borrelia garinii
KIKANAKKEGVKFEA

SEQ ID NO: 77949 - protein, 15 aa, Borrelia garinii
IKANAKKEGVKFEAF

SEQ ID NO: 77950 - protein, 15 aa, Borrelia garinii
KANAKKEGVKFEAFT

SEQ ID NO: 77951 - protein, 15 aa, Borrelia garinii
ANAKKEGVKFEAFTN

SEQ ID NO: 77952 - protein, 15 aa, Borrelia garinii
NAKKEGVKFEAFTNT

SEQ ID NO: 77953 - protein, 15 aa, Borrelia garinii
AKKEGVKFEAFTNTQ

SEQ ID NO: 77954 - protein, 15 aa, Borrelia garinii
KKEGVKFEAFTNTQT

SEQ ID NO: 77955 - protein, 15 aa, Borrelia garinii
KEGVKFEAFTNTQTG

SEQ ID NO: 77956 - protein, 15 aa, Borrelia garinii
EGVKFEAFTNTQTGS

SEQ ID NO: 77957 - protein, 15 aa, Borrelia garinii
GVKFEAFTNTQTGSK

SEQ ID NO: 77958 - protein, 15 aa, Borrelia garinii
VKFEAFTNTQTGSKI

SEQ ID NO: 77959 - protein, 15 aa, Borrelia garinii
KFEAFTNTQTGSKIS

SEQ ID NO: 77960 - protein, 15 aa, Borrelia garinii
FEAFTNTQTGSKISE

SEQ ID NO: 77961 - protein, 15 aa, Borrelia garinii
EAFTNTQTGSKISEK

SEQ ID NO: 77962 - protein, 15 aa, Borrelia garinii
AFTNTQTGSKISEKP

SEQ ID NO: 77963 - protein, 15 aa, Borrelia garinii
FTNTQTGSKISEKPE

SEQ ID NO: 77964 - protein, 15 aa, Borrelia garinii
TNTQTGSKISEKPEF

SEQ ID NO: 77965 - protein, 15 aa, Borrelia garinii
NTQTGSKISEKPEFI

SEQ ID NO: 77966 - protein, 15 aa, Borrelia garinii
TQTGSKISEKPEFIL

SEQ ID NO: 77967 - protein, 15 aa, Borrelia garinii
QTGSKISEKPEFILK

SEQ ID NO: 77968 - protein, 15 aa, Borrelia garinii
TGSKISEKPEFILKA

SEQ ID NO: 77969 - protein, 15 aa, Borrelia garinii
GSKISEKPEFILKAK

SEQ ID NO: 77970 - protein, 15 aa, Borrelia garinii
SKISEKPEFILKAKI

SEQ ID NO: 77971 - protein, 15 aa, Borrelia garinii
KISEKPEFILKAKIK

SEQ ID NO: 77972 - protein, 15 aa, Borrelia garinii
ISEKPEFILKAKIKA

SEQ ID NO: 77973 - protein, 15 aa, Borrelia garinii
SEKPEFILKAKIKAI

SEQ ID NO: 77974 - protein, 15 aa, Borrelia garinii
EKPEFILKAKIKAIQ

SEQ ID NO: 77975 - protein, 15 aa, Borrelia garinii
KPEFILKAKIKAIQV

SEQ ID NO: 77976 - protein, 15 aa, Borrelia garinii
PEFILKAKIKAIQVA

SEQ ID NO: 77977 - protein, 15 aa, Borrelia garinii
EFILKAKIKAIQVAE

SEQ ID NO: 77978 - protein, 15 aa, Borrelia garinii
FILKAKIKAIQVAER

SEQ ID NO: 77979 - protein, 15 aa, Borrelia garinii
ILKAKIKAIQVAERF

SEQ ID NO: 77980 - protein, 15 aa, Borrelia garinii
LKAKIKAIQVAERFV

SEQ ID NO: 77981 - protein, 15 aa, Borrelia garinii
KAKIKAIQVAERFVK

SEQ ID NO: 77982 - protein, 15 aa, Borrelia garinii
AKIKAIQVAERFVKA

SEQ ID NO: 77983 - protein, 15 aa, Borrelia garinii
KIKAIQVAERFVKAI

SEQ ID NO: 77984 - protein, 15 aa, Borrelia garinii
IKAIQVAERFVKAIK

SEQ ID NO: 77985 - protein, 15 aa, Borrelia garinii
KAIQVAERFVKAIKE

SEQ ID NO: 77986 - protein, 15 aa, Borrelia garinii
AIQVAERFVKAIKEE

SEQ ID NO: 77987 - protein, 15 aa, Borrelia garinii
IQVAERFVKAIKEEA

SEQ ID NO: 77988 - protein, 15 aa, Borrelia garinii
QVAERFVKAIKEEAE

SEQ ID NO: 77989 - protein, 15 aa, Borrelia garinii
VAERFVKAIKEEAEK

SEQ ID NO: 77990 - protein, 15 aa, Borrelia garinii
AERFVKAIKEEAEKL

SEQ ID NO: 77991 - protein, 15 aa, Borrelia garinii
ERFVKAIKEEAEKLK

SEQ ID NO: 77992 - protein, 15 aa, Borrelia garinii
RFVKAIKEEAEKLKK

SEQ ID NO: 77993 - protein, 15 aa, Borrelia garinii
FVKAIKEEAEKLKKS

SEQ ID NO: 77994 - protein, 15 aa, Borrelia garinii
VKAIKEEAEKLKKSG

SEQ ID NO: 77995 - protein, 15 aa, Borrelia garinii
KAIKEEAEKLKKSGS

SEQ ID NO: 77996 - protein, 15 aa, Borrelia garinii
AIKEEAEKLKKSGSS

SEQ ID NO: 77997 - protein, 15 aa, Borrelia garinii
IKEEAEKLKKSGSSG

SEQ ID NO: 77998 - protein, 15 aa, Borrelia garinii
KEEAEKLKKSGSSGA

SEQ ID NO: 77999 - protein, 15 aa, Borrelia garinii
EEAEKLKKSGSSGAF

SEQ ID NO: 78000 - protein, 15 aa, Borrelia garinii
EAEKLKKSGSSGAFS

SEQ ID NO: 78001 - protein, 15 aa, Borrelia garinii
AEKLKKSGSSGAFSA

SEQ ID NO: 78002 - protein, 15 aa, Borrelia garinii
EKLKKSGSSGAFSAM

SEQ ID NO: 78003 - protein, 15 aa, Borrelia garinii
KLKKSGSSGAFSAMY

SEQ ID NO: 78004 - protein, 15 aa, Borrelia garinii
LKKSGSSGAFSAMYD

SEQ ID NO: 78005 - protein, 15 aa, Borrelia garinii
KKSGSSGAFSAMYDL

SEQ ID NO: 78006 - protein, 15 aa, Borrelia garinii
KSGSSGAFSAMYDLM

SEQ ID NO: 78007 - protein, 15 aa, Borrelia garinii
SGSSGAFSAMYDLMI

SEQ ID NO: 78008 - protein, 15 aa, Borrelia garinii
GSSGAFSAMYDLMID

SEQ ID NO: 78009 - protein, 15 aa, Borrelia garinii
SSGAFSAMYDLMIDV

SEQ ID NO: 78010 - protein, 15 aa, Borrelia garinii
SGAFSAMYDLMIDVS

SEQ ID NO: 78011 - protein, 15 aa, Borrelia garinii
GAFSAMYDLMIDVSK

SEQ ID NO: 78012 - protein, 15 aa, Borrelia garinii
AFSAMYDLMIDVSKP

SEQ ID NO: 78013 - protein, 15 aa, Borrelia garinii
FSAMYDLMIDVSKPL

SEQ ID NO: 78014 - protein, 15 aa, Borrelia garinii
SAMYDLMIDVSKPLE

SEQ ID NO: 78015 - protein, 15 aa, Borrelia garinii
AMYDLMIDVSKPLEE

SEQ ID NO: 78016 - protein, 15 aa, Borrelia garinii
MYDLMIDVSKPLEEI

SEQ ID NO: 78017 - protein, 15 aa, Borrelia garinii
YDLMIDVSKPLEEIG

SEQ ID NO: 78018 - protein, 15 aa, Borrelia garinii
DLMIDVSKPLEEIGI

SEQ ID NO: 78019 - protein, 15 aa, Borrelia garinii
LMIDVSKPLEEIGIQ

SEQ ID NO: 78020 - protein, 15 aa, Borrelia garinii
MIDVSKPLEEIGIQK

SEQ ID NO: 78021 - protein, 15 aa, Borrelia garinii
IDVSKPLEEIGIQKM

SEQ ID NO: 78022 - protein, 15 aa, Borrelia garinii
DVSKPLEEIGIQKMT

SEQ ID NO: 78023 - protein, 15 aa, Borrelia garinii
VSKPLEEIGIQKMTG

SEQ ID NO: 78024 - protein, 15 aa, Borrelia garinii
SKPLEEIGIQKMTGT

SEQ ID NO: 78025 - protein, 15 aa, Borrelia garinii
KPLEEIGIQKMTGTV

SEQ ID NO: 78026 - protein, 15 aa, Borrelia garinii
PLEEIGIQKMTGTVT

SEQ ID NO: 78027 - protein, 15 aa, Borrelia garinii
LEEIGIQKMTGTVTK

SEQ ID NO: 78028 - protein, 15 aa, Borrelia garinii
EEIGIQKMTGTVTKE

SEQ ID NO: 78029 - protein, 15 aa, Borrelia garinii
EIGIQKMTGTVTKEA

SEQ ID NO: 78030 - protein, 15 aa, Borrelia garinii
IGIQKMTGTVTKEAE

SEQ ID NO: 78031 - protein, 15 aa, Borrelia garinii
GIQKMTGTVTKEAEK

SEQ ID NO: 78032 - protein, 15 aa, Borrelia garinii
IQKMTGTVTKEAEKT

SEQ ID NO: 78033 - protein, 15 aa, Borrelia garinii
QKMTGTVTKEAEKTP

SEQ ID NO: 78034 - protein, 15 aa, Borrelia garinii
KMTGTVTKEAEKTPP

SEQ ID NO: 78035 - protein, 15 aa, Borrelia garinii
MTGTVTKEAEKTPPT

SEQ ID NO: 78036 - protein, 15 aa, Borrelia garinii
TGTVTKEAEKTPPTT

SEQ ID NO: 78037 - protein, 15 aa, Borrelia garinii
GTVTKEAEKTPPTTA

SEQ ID NO: 78038 - protein, 15 aa, Borrelia garinii
TVTKEAEKTPPTTAD

SEQ ID NO: 78039 - protein, 15 aa, Borrelia garinii
VTKEAEKTPPTTADG

SEQ ID NO: 78040 - protein, 15 aa, Borrelia garinii
TKEAEKTPPTTADGI

SEQ ID NO: 78041 - protein, 15 aa, Borrelia garinii
KEAEKTPPTTADGII

SEQ ID NO: 78042 - protein, 15 aa, Borrelia garinii
EAEKTPPTTADGIIA

SEQ ID NO: 78043 - protein, 15 aa, Borrelia garinii
AEKTPPTTADGIIAI

SEQ ID NO: 78044 - protein, 15 aa, Borrelia garinii
EKTPPTTADGIIAIA

SEQ ID NO: 78045 - protein, 15 aa, Borrelia garinii
KTPPTTADGIIAIAQ

SEQ ID NO: 78046 - protein, 15 aa, Borrelia garinii
TPPTTADGIIAIAQA

SEQ ID NO: 78047 - protein, 15 aa, Borrelia garinii
PPTTADGIIAIAQAM

SEQ ID NO: 78048 - protein, 15 aa, Borrelia garinii
PTTADGIIAIAQAME

SEQ ID NO: 78049 - protein, 15 aa, Borrelia garinii
TTADGIIAIAQAMEE

SEQ ID NO: 78050 - protein, 15 aa, Borrelia garinii
TADGIIAIAQAMEEK

SEQ ID NO: 78051 - protein, 15 aa, Borrelia garinii
ADGIIAIAQAMEEKL

SEQ ID NO: 78052 - protein, 15 aa, Borrelia garinii
DGIIAIAQAMEEKLN

SEQ ID NO: 78053 - protein, 15 aa, Borrelia garinii
GIIAIAQAMEEKLNN

SEQ ID NO: 78054 - protein, 15 aa, Borrelia garinii
IIAIAQAMEEKLNNV

SEQ ID NO: 78055 - protein, 15 aa, Borrelia garinii
IAIAQAMEEKLNNVN

SEQ ID NO: 78056 - protein, 15 aa, Borrelia garinii
AIAQAMEEKLNNVNK

SEQ ID NO: 78057 - protein, 15 aa, Borrelia garinii
IAQAMEEKLNNVNKK

SEQ ID NO: 78058 - protein, 15 aa, Borrelia garinii
AQAMEEKLNNVNKKQ

SEQ ID NO: 78059 - protein, 15 aa, Borrelia garinii
QAMEEKLNNVNKKQH

SEQ ID NO: 78060 - protein, 15 aa, Borrelia garinii
AMEEKLNNVNKKQHD

SEQ ID NO: 78061 - protein, 15 aa, Borrelia garinii
MEEKLNNVNKKQHDA

SEQ ID NO: 78062 - protein, 15 aa, Borrelia garinii
EEKLNNVNKKQHDAL

SEQ ID NO: 78063 - protein, 15 aa, Borrelia garinii
EKLNNVNKKQHDALK

SEQ ID NO: 78064 - protein, 15 aa, Borrelia garinii
KLNNVNKKQHDALKN

SEQ ID NO: 78065 - protein, 15 aa, Borrelia garinii
LNNVNKKQHDALKNL

SEQ ID NO: 78066 - protein, 15 aa, Borrelia garinii
NNVNKKQHDALKNLE

SEQ ID NO: 78067 - protein, 15 aa, Borrelia garinii
NVNKKQHDALKNLEE

SEQ ID NO: 78068 - protein, 15 aa, Borrelia garinii
VNKKQHDALKNLEEK

SEQ ID NO: 78069 - protein, 15 aa, Borrelia garinii
NKKQHDALKNLEEKA

SEQ ID NO: 78070 - protein, 15 aa, Borrelia garinii
KKQHDALKNLEEKAN

SEQ ID NO: 78071 - protein, 15 aa, Borrelia garinii
KQHDALKNLEEKANT

SEQ ID NO: 78072 - protein, 15 aa, Borrelia garinii
QHDALKNLEEKANTA

SEQ ID NO: 78073 - protein, 15 aa, Borrelia garinii
HDALKNLEEKANTAA

SEQ ID NO: 78074 - protein, 15 aa, Borrelia garinii
DALKNLEEKANTAAT

SEQ ID NO: 78075 - protein, 15 aa, Borrelia garinii
ALKNLEEKANTAATT

SEQ ID NO: 78076 - protein, 15 aa, Borrelia garinii
LKNLEEKANTAATTT

SEQ ID NO: 78077 - protein, 16 aa, Borrelia garinii
MIKYNKILLKLSLIVS

SEQ ID NO: 78078 - protein, 16 aa, Borrelia garinii
IKYNKILLKLSLIVSL

SEQ ID NO: 78079 - protein, 16 aa, Borrelia garinii
KYNKILLKLSLIVSLL

SEQ ID NO: 78080 - protein, 16 aa, Borrelia garinii
YNKILLKLSLIVSLLV

SEQ ID NO: 78081 - protein, 16 aa, Borrelia garinii
NKILLKLSLIVSLLVA

SEQ ID NO: 78082 - protein, 16 aa, Borrelia garinii
KILLKLSLIVSLLVAC

SEQ ID NO: 78083 - protein, 16 aa, Borrelia garinii
ILLKLSLIVSLLVACG

SEQ ID NO: 78084 - protein, 16 aa, Borrelia garinii
LLKLSLIVSLLVACGL

SEQ ID NO: 78085 - protein, 16 aa, Borrelia garinii
LKLSLIVSLLVACGLT

SEQ ID NO: 78086 - protein, 16 aa, Borrelia garinii
KLSLIVSLLVACGLTG

SEQ ID NO: 78087 - protein, 16 aa, Borrelia garinii
LSLIVSLLVACGLTGE

SEQ ID NO: 78088 - protein, 16 aa, Borrelia garinii
SLIVSLLVACGLTGET

SEQ ID NO: 78089 - protein, 16 aa, Borrelia garinii
LIVSLLVACGLTGETK

SEQ ID NO: 78090 - protein, 16 aa, Borrelia garinii
IVSLLVACGLTGETKI

SEQ ID NO: 78091 - protein, 16 aa, Borrelia garinii
VSLLVACGLTGETKIR

SEQ ID NO: 78092 - protein, 16 aa, Borrelia garinii
SLLVACGLTGETKIRL

SEQ ID NO: 78093 - protein, 16 aa, Borrelia garinii
LLVACGLTGETKIRLE

SEQ ID NO: 78094 - protein, 16 aa, Borrelia garinii
LVACGLTGETKIRLES

SEQ ID NO: 78095 - protein, 16 aa, Borrelia garinii
VACGLTGETKIRLESS

SEQ ID NO: 78096 - protein, 16 aa, Borrelia garinii
ACGLTGETKIRLESSA

SEQ ID NO: 78097 - protein, 16 aa, Borrelia garinii
CGLTGETKIRLESSAQ

SEQ ID NO: 78098 - protein, 16 aa, Borrelia garinii
GLTGETKIRLESSAQE

SEQ ID NO: 78099 - protein, 16 aa, Borrelia garinii
LTGETKIRLESSAQEI

SEQ ID NO: 78100 - protein, 16 aa, Borrelia garinii
TGETKIRLESSAQEIK

SEQ ID NO: 78101 - protein, 16 aa, Borrelia garinii
GETKIRLESSAQEIKD

SEQ ID NO: 78102 - protein, 16 aa, Borrelia garinii
ETKIRLESSAQEIKDE

SEQ ID NO: 78103 - protein, 16 aa, Borrelia garinii
TKIRLESSAQEIKDEI

SEQ ID NO: 78104 - protein, 16 aa, Borrelia garinii
KIRLESSAQEIKDEIN

SEQ ID NO: 78105 - protein, 16 aa, Borrelia garinii
IRLESSAQEIKDEINK

SEQ ID NO: 78106 - protein, 16 aa, Borrelia garinii
RLESSAQEIKDEINKI

SEQ ID NO: 78107 - protein, 16 aa, Borrelia garinii
LESSAQEIKDEINKIK

SEQ ID NO: 78108 - protein, 16 aa, Borrelia garinii
ESSAQEIKDEINKIKA

SEQ ID NO: 78109 - protein, 16 aa, Borrelia garinii
SSAQEIKDEINKIKAN

SEQ ID NO: 78110 - protein, 16 aa, Borrelia garinii
SAQEIKDEINKIKANA

SEQ ID NO: 78111 - protein, 16 aa, Borrelia garinii
AQEIKDEINKIKANAK

SEQ ID NO: 78112 - protein, 16 aa, Borrelia garinii
QEIKDEINKIKANAKK

SEQ ID NO: 78113 - protein, 16 aa, Borrelia garinii
EIKDEINKIKANAKKE

SEQ ID NO: 78114 - protein, 16 aa, Borrelia garinii
IKDEINKIKANAKKEG

SEQ ID NO: 78115 - protein, 16 aa, Borrelia garinii
KDEINKIKANAKKEGV

SEQ ID NO: 78116 - protein, 16 aa, Borrelia garinii
DEINKIKANAKKEGVK

SEQ ID NO: 78117 - protein, 16 aa, Borrelia garinii
EINKIKANAKKEGVKF

SEQ ID NO: 78118 - protein, 16 aa, Borrelia garinii
INKIKANAKKEGVKFE

SEQ ID NO: 78119 - protein, 16 aa, Borrelia garinii
NKIKANAKKEGVKFEA

SEQ ID NO: 78120 - protein, 16 aa, Borrelia garinii
KIKANAKKEGVKFEAF

SEQ ID NO: 78121 - protein, 16 aa, Borrelia garinii
IKANAKKEGVKFEAFT

SEQ ID NO: 78122 - protein, 16 aa, Borrelia garinii
KANAKKEGVKFEAFTN

SEQ ID NO: 78123 - protein, 16 aa, Borrelia garinii
ANAKKEGVKFEAFTNT

SEQ ID NO: 78124 - protein, 16 aa, Borrelia garinii
NAKKEGVKFEAFTNTQ

SEQ ID NO: 78125 - protein, 16 aa, Borrelia garinii
AKKEGVKFEAFTNTQT

SEQ ID NO: 78126 - protein, 16 aa, Borrelia garinii
KKEGVKFEAFTNTQTG

SEQ ID NO: 78127 - protein, 16 aa, Borrelia garinii
KEGVKFEAFTNTQTGS

SEQ ID NO: 78128 - protein, 16 aa, Borrelia garinii
EGVKFEAFTNTQTGSK

SEQ ID NO: 78129 - protein, 16 aa, Borrelia garinii
GVKFEAFTNTQTGSKI

SEQ ID NO: 78130 - protein, 16 aa, Borrelia garinii
VKFEAFTNTQTGSKIS

SEQ ID NO: 78131 - protein, 16 aa, Borrelia garinii
KFEAFTNTQTGSKISE

SEQ ID NO: 78132 - protein, 16 aa, Borrelia garinii
FEAFTNTQTGSKISEK

SEQ ID NO: 78133 - protein, 16 aa, Borrelia garinii
EAFTNTQTGSKISEKP

SEQ ID NO: 78134 - protein, 16 aa, Borrelia garinii
AFTNTQTGSKISEKPE

SEQ ID NO: 78135 - protein, 16 aa, Borrelia garinii
FTNTQTGSKISEKPEF

SEQ ID NO: 78136 - protein, 16 aa, Borrelia garinii
TNTQTGSKISEKPEFI

SEQ ID NO: 78137 - protein, 16 aa, Borrelia garinii
NTQTGSKISEKPEFIL

SEQ ID NO: 78138 - protein, 16 aa, Borrelia garinii
TQTGSKISEKPEFILK

SEQ ID NO: 78139 - protein, 16 aa, Borrelia garinii
QTGSKISEKPEFILKA

SEQ ID NO: 78140 - protein, 16 aa, Borrelia garinii
TGSKISEKPEFILKAK

SEQ ID NO: 78141 - protein, 16 aa, Borrelia garinii
GSKISEKPEFILKAKI

SEQ ID NO: 78142 - protein, 16 aa, Borrelia garinii
SKISEKPEFILKAKIK

SEQ ID NO: 78143 - protein, 16 aa, Borrelia garinii
KISEKPEFILKAKIKA

SEQ ID NO: 78144 - protein, 16 aa, Borrelia garinii
ISEKPEFILKAKIKAI

SEQ ID NO: 78145 - protein, 16 aa, Borrelia garinii
SEKPEFILKAKIKAIQ

SEQ ID NO: 78146 - protein, 16 aa, Borrelia garinii
EKPEFILKAKIKAIQV

SEQ ID NO: 78147 - protein, 16 aa, Borrelia garinii
KPEFILKAKIKAIQVA

SEQ ID NO: 78148 - protein, 16 aa, Borrelia garinii
PEFILKAKIKAIQVAE

SEQ ID NO: 78149 - protein, 16 aa, Borrelia garinii
EFILKAKIKAIQVAER

SEQ ID NO: 78150 - protein, 16 aa, Borrelia garinii
FILKAKIKAIQVAERF

SEQ ID NO: 78151 - protein, 16 aa, Borrelia garinii
ILKAKIKAIQVAERFV

SEQ ID NO: 78152 - protein, 16 aa, Borrelia garinii
LKAKIKAIQVAERFVK

SEQ ID NO: 78153 - protein, 16 aa, Borrelia garinii
KAKIKAIQVAERFVKA

SEQ ID NO: 78154 - protein, 16 aa, Borrelia garinii
AKIKAIQVAERFVKAI

SEQ ID NO: 78155 - protein, 16 aa, Borrelia garinii
KIKAIQVAERFVKAIK

SEQ ID NO: 78156 - protein, 16 aa, Borrelia garinii
IKAIQVAERFVKAIKE

SEQ ID NO: 78157 - protein, 16 aa, Borrelia garinii
KAIQVAERFVKAIKEE

SEQ ID NO: 78158 - protein, 16 aa, Borrelia garinii
AIQVAERFVKAIKEEA

SEQ ID NO: 78159 - protein, 16 aa, Borrelia garinii
IQVAERFVKAIKEEAE

SEQ ID NO: 78160 - protein, 16 aa, Borrelia garinii
QVAERFVKAIKEEAEK

SEQ ID NO: 78161 - protein, 16 aa, Borrelia garinii
VAERFVKAIKEEAEKL

SEQ ID NO: 78162 - protein, 16 aa, Borrelia garinii
AERFVKAIKEEAEKLK

SEQ ID NO: 78163 - protein, 16 aa, Borrelia garinii
ERFVKAIKEEAEKLKK

SEQ ID NO: 78164 - protein, 16 aa, Borrelia garinii
RFVKAIKEEAEKLKKS

SEQ ID NO: 78165 - protein, 16 aa, Borrelia garinii
FVKAIKEEAEKLKKSG

SEQ ID NO: 78166 - protein, 16 aa, Borrelia garinii
VKAIKEEAEKLKKSGS

SEQ ID NO: 78167 - protein, 16 aa, Borrelia garinii
KAIKEEAEKLKKSGSS

SEQ ID NO: 78168 - protein, 16 aa, Borrelia garinii
AIKEEAEKLKKSGSSG

SEQ ID NO: 78169 - protein, 16 aa, Borrelia garinii
IKEEAEKLKKSGSSGA

SEQ ID NO: 78170 - protein, 16 aa, Borrelia garinii
KEEAEKLKKSGSSGAF

SEQ ID NO: 78171 - protein, 16 aa, Borrelia garinii
EEAEKLKKSGSSGAFS

SEQ ID NO: 78172 - protein, 16 aa, Borrelia garinii
EAEKLKKSGSSGAFSA

SEQ ID NO: 78173 - protein, 16 aa, Borrelia garinii
AEKLKKSGSSGAFSAM

SEQ ID NO: 78174 - protein, 16 aa, Borrelia garinii
EKLKKSGSSGAFSAMY

SEQ ID NO: 78175 - protein, 16 aa, Borrelia garinii
KLKKSGSSGAFSAMYD

SEQ ID NO: 78176 - protein, 16 aa, Borrelia garinii
LKKSGSSGAFSAMYDL

SEQ ID NO: 78177 - protein, 16 aa, Borrelia garinii
KKSGSSGAFSAMYDLM

SEQ ID NO: 78178 - protein, 16 aa, Borrelia garinii
KSGSSGAFSAMYDLMI

SEQ ID NO: 78179 - protein, 16 aa, Borrelia garinii
SGSSGAFSAMYDLMID

SEQ ID NO: 78180 - protein, 16 aa, Borrelia garinii
GSSGAFSAMYDLMIDV

SEQ ID NO: 78181 - protein, 16 aa, Borrelia garinii
SSGAFSAMYDLMIDVS

SEQ ID NO: 78182 - protein, 16 aa, Borrelia garinii
SGAFSAMYDLMIDVSK

SEQ ID NO: 78183 - protein, 16 aa, Borrelia garinii
GAFSAMYDLMIDVSKP

SEQ ID NO: 78184 - protein, 16 aa, Borrelia garinii
AFSAMYDLMIDVSKPL

SEQ ID NO: 78185 - protein, 16 aa, Borrelia garinii
FSAMYDLMIDVSKPLE

SEQ ID NO: 78186 - protein, 16 aa, Borrelia garinii
SAMYDLMIDVSKPLEE

SEQ ID NO: 78187 - protein, 16 aa, Borrelia garinii
AMYDLMIDVSKPLEEI

SEQ ID NO: 78188 - protein, 16 aa, Borrelia garinii
MYDLMIDVSKPLEEIG

SEQ ID NO: 78189 - protein, 16 aa, Borrelia garinii
YDLMIDVSKPLEEIGI

SEQ ID NO: 78190 - protein, 16 aa, Borrelia garinii
DLMIDVSKPLEEIGIQ

SEQ ID NO: 78191 - protein, 16 aa, Borrelia garinii
LMIDVSKPLEEIGIQK

SEQ ID NO: 78192 - protein, 16 aa, Borrelia garinii
MIDVSKPLEEIGIQKM

SEQ ID NO: 78193 - protein, 16 aa, Borrelia garinii
IDVSKPLEEIGIQKMT

SEQ ID NO: 78194 - protein, 16 aa, Borrelia garinii
DVSKPLEEIGIQKMTG

SEQ ID NO: 78195 - protein, 16 aa, Borrelia garinii
VSKPLEEIGIQKMTGT

SEQ ID NO: 78196 - protein, 16 aa, Borrelia garinii
SKPLEEIGIQKMTGTV

SEQ ID NO: 78197 - protein, 16 aa, Borrelia garinii
KPLEEIGIQKMTGTVT

SEQ ID NO: 78198 - protein, 16 aa, Borrelia garinii
PLEEIGIQKMTGTVTK

SEQ ID NO: 78199 - protein, 16 aa, Borrelia garinii
LEEIGIQKMTGTVTKE

SEQ ID NO: 78200 - protein, 16 aa, Borrelia garinii
EEIGIQKMTGTVTKEA

SEQ ID NO: 78201 - protein, 16 aa, Borrelia garinii
EIGIQKMTGTVTKEAE

SEQ ID NO: 78202 - protein, 16 aa, Borrelia garinii
IGIQKMTGTVTKEAEK

SEQ ID NO: 78203 - protein, 16 aa, Borrelia garinii
GIQKMTGTVTKEAEKT

SEQ ID NO: 78204 - protein, 16 aa, Borrelia garinii
IQKMTGTVTKEAEKTP

SEQ ID NO: 78205 - protein, 16 aa, Borrelia garinii
QKMTGTVTKEAEKTPP

SEQ ID NO: 78206 - protein, 16 aa, Borrelia garinii
KMTGTVTKEAEKTPPT

SEQ ID NO: 78207 - protein, 16 aa, Borrelia garinii
MTGTVTKEAEKTPPTT

SEQ ID NO: 78208 - protein, 16 aa, Borrelia garinii
TGTVTKEAEKTPPTTA

SEQ ID NO: 78209 - protein, 16 aa, Borrelia garinii
GTVTKEAEKTPPTTAD

SEQ ID NO: 78210 - protein, 16 aa, Borrelia garinii
TVTKEAEKTPPTTADG

SEQ ID NO: 78211 - protein, 16 aa, Borrelia garinii
VTKEAEKTPPTTADGI

SEQ ID NO: 78212 - protein, 16 aa, Borrelia garinii
TKEAEKTPPTTADGII

SEQ ID NO: 78213 - protein, 16 aa, Borrelia garinii
KEAEKTPPTTADGIIA

SEQ ID NO: 78214 - protein, 16 aa, Borrelia garinii
EAEKTPPTTADGIIAI

SEQ ID NO: 78215 - protein, 16 aa, Borrelia garinii
AEKTPPTTADGIIAIA

SEQ ID NO: 78216 - protein, 16 aa, Borrelia garinii
EKTPPTTADGIIAIAQ

SEQ ID NO: 78217 - protein, 16 aa, Borrelia garinii
KTPPTTADGIIAIAQA

SEQ ID NO: 78218 - protein, 16 aa, Borrelia garinii
TPPTTADGIIAIAQAM

SEQ ID NO: 78219 - protein, 16 aa, Borrelia garinii
PPTTADGIIAIAQAME

SEQ ID NO: 78220 - protein, 16 aa, Borrelia garinii
PTTADGIIAIAQAMEE

SEQ ID NO: 78221 - protein, 16 aa, Borrelia garinii
TTADGIIAIAQAMEEK

SEQ ID NO: 78222 - protein, 16 aa, Borrelia garinii
TADGIIAIAQAMEEKL

SEQ ID NO: 78223 - protein, 16 aa, Borrelia garinii
ADGIIAIAQAMEEKLN

SEQ ID NO: 78224 - protein, 16 aa, Borrelia garinii
DGIIAIAQAMEEKLNN

SEQ ID NO: 78225 - protein, 16 aa, Borrelia garinii
GIIAIAQAMEEKLNNV

SEQ ID NO: 78226 - protein, 16 aa, Borrelia garinii
IIAIAQAMEEKLNNVN

SEQ ID NO: 78227 - protein, 16 aa, Borrelia garinii
IAIAQAMEEKLNNVNK

SEQ ID NO: 78228 - protein, 16 aa, Borrelia garinii
AIAQAMEEKLNNVNKK

SEQ ID NO: 78229 - protein, 16 aa, Borrelia garinii
IAQAMEEKLNNVNKKQ

SEQ ID NO: 78230 - protein, 16 aa, Borrelia garinii
AQAMEEKLNNVNKKQH

SEQ ID NO: 78231 - protein, 16 aa, Borrelia garinii
QAMEEKLNNVNKKQHD

SEQ ID NO: 78232 - protein, 16 aa, Borrelia garinii
AMEEKLNNVNKKQHDA

SEQ ID NO: 78233 - protein, 16 aa, Borrelia garinii
MEEKLNNVNKKQHDAL

SEQ ID NO: 78234 - protein, 16 aa, Borrelia garinii
EEKLNNVNKKQHDALK

SEQ ID NO: 78235 - protein, 16 aa, Borrelia garinii
EKLNNVNKKQHDALKN

SEQ ID NO: 78236 - protein, 16 aa, Borrelia garinii
KLNNVNKKQHDALKNL

SEQ ID NO: 78237 - protein, 16 aa, Borrelia garinii
LNNVNKKQHDALKNLE

SEQ ID NO: 78238 - protein, 16 aa, Borrelia garinii
NNVNKKQHDALKNLEE

SEQ ID NO: 78239 - protein, 16 aa, Borrelia garinii
NVNKKQHDALKNLEEK

SEQ ID NO: 78240 - protein, 16 aa, Borrelia garinii
VNKKQHDALKNLEEKA

SEQ ID NO: 78241 - protein, 16 aa, Borrelia garinii
NKKQHDALKNLEEKAN

SEQ ID NO: 78242 - protein, 16 aa, Borrelia garinii
KKQHDALKNLEEKANT

SEQ ID NO: 78243 - protein, 16 aa, Borrelia garinii
KQHDALKNLEEKANTA

SEQ ID NO: 78244 - protein, 16 aa, Borrelia garinii
QHDALKNLEEKANTAA

SEQ ID NO: 78245 - protein, 16 aa, Borrelia garinii
HDALKNLEEKANTAAT

SEQ ID NO: 78246 - protein, 16 aa, Borrelia garinii
DALKNLEEKANTAATT

SEQ ID NO: 78247 - protein, 16 aa, Borrelia garinii
ALKNLEEKANTAATTT

SEQ ID NO: 78248 - protein, 13 aa, Borrelia burgdorferi
SIVIALFFKLLVA

SEQ ID NO: 78249 - protein, 13 aa, Borrelia burgdorferi
IVIALFFKLLVAC

SEQ ID NO: 78250 - protein, 13 aa, Borrelia burgdorferi
VIALFFKLLVACS

SEQ ID NO: 78251 - protein, 13 aa, Borrelia burgdorferi
IALFFKLLVACSI

SEQ ID NO: 78252 - protein, 13 aa, Borrelia burgdorferi
ALFFKLLVACSIG

SEQ ID NO: 78253 - protein, 13 aa, Borrelia burgdorferi
LFFKLLVACSIGL

SEQ ID NO: 78254 - protein, 13 aa, Borrelia burgdorferi
FFKLLVACSIGLV

SEQ ID NO: 78255 - protein, 13 aa, Borrelia burgdorferi
FKLLVACSIGLVE

SEQ ID NO: 78256 - protein, 13 aa, Borrelia burgdorferi
KLLVACSIGLVER

SEQ ID NO: 78257 - protein, 13 aa, Borrelia burgdorferi
LLVACSIGLVERT

SEQ ID NO: 78258 - protein, 13 aa, Borrelia burgdorferi
LVACSIGLVERTN

SEQ ID NO: 78259 - protein, 13 aa, Borrelia burgdorferi
VACSIGLVERTNA

SEQ ID NO: 78260 - protein, 13 aa, Borrelia burgdorferi
ACSIGLVERTNAA

SEQ ID NO: 78261 - protein, 13 aa, Borrelia burgdorferi
CSIGLVERTNAAL

SEQ ID NO: 78262 - protein, 13 aa, Borrelia burgdorferi
SIGLVERTNAALE

SEQ ID NO: 78263 - protein, 13 aa, Borrelia burgdorferi
IGLVERTNAALES

SEQ ID NO: 78264 - protein, 13 aa, Borrelia burgdorferi
GLVERTNAALESS

SEQ ID NO: 78265 - protein, 13 aa, Borrelia burgdorferi
LVERTNAALESSS

SEQ ID NO: 78266 - protein, 13 aa, Borrelia burgdorferi
VERTNAALESSSK

SEQ ID NO: 78267 - protein, 13 aa, Borrelia burgdorferi
ERTNAALESSSKD

SEQ ID NO: 78268 - protein, 13 aa, Borrelia burgdorferi
RTNAALESSSKDL

SEQ ID NO: 78269 - protein, 13 aa, Borrelia burgdorferi
TNAALESSSKDLK

SEQ ID NO: 78270 - protein, 13 aa, Borrelia burgdorferi
NAALESSSKDLKN

SEQ ID NO: 78271 - protein, 13 aa, Borrelia burgdorferi
AALESSSKDLKNK

SEQ ID NO: 78272 - protein, 13 aa, Borrelia burgdorferi
ALESSSKDLKNKI

SEQ ID NO: 78273 - protein, 13 aa, Borrelia burgdorferi
LESSSKDLKNKIL

SEQ ID NO: 78274 - protein, 13 aa, Borrelia burgdorferi
ESSSKDLKNKILK

SEQ ID NO: 78275 - protein, 13 aa, Borrelia burgdorferi
SSSKDLKNKILKI

SEQ ID NO: 78276 - protein, 13 aa, Borrelia burgdorferi
SSKDLKNKILKIK

SEQ ID NO: 78277 - protein, 13 aa, Borrelia burgdorferi
SKDLKNKILKIKK

SEQ ID NO: 78278 - protein, 13 aa, Borrelia burgdorferi
KDLKNKILKIKKE

SEQ ID NO: 78279 - protein, 13 aa, Borrelia burgdorferi
DLKNKILKIKKEA

SEQ ID NO: 78280 - protein, 13 aa, Borrelia burgdorferi
LKNKILKIKKEAT

SEQ ID NO: 78281 - protein, 13 aa, Borrelia burgdorferi
KNKILKIKKEATG

SEQ ID NO: 78282 - protein, 13 aa, Borrelia burgdorferi
NKILKIKKEATGK

SEQ ID NO: 78283 - protein, 13 aa, Borrelia burgdorferi
KILKIKKEATGKG

SEQ ID NO: 78284 - protein, 13 aa, Borrelia burgdorferi
ILKIKKEATGKGV

SEQ ID NO: 78285 - protein, 13 aa, Borrelia burgdorferi
LKIKKEATGKGVL

SEQ ID NO: 78286 - protein, 13 aa, Borrelia burgdorferi
KIKKEATGKGVLF

SEQ ID NO: 78287 - protein, 13 aa, Borrelia burgdorferi
IKKEATGKGVLFE

SEQ ID NO: 78288 - protein, 13 aa, Borrelia burgdorferi
KKEATGKGVLFEA

SEQ ID NO: 78289 - protein, 13 aa, Borrelia burgdorferi
KEATGKGVLFEAF

SEQ ID NO: 78290 - protein, 13 aa, Borrelia burgdorferi
EATGKGVLFEAFT

SEQ ID NO: 78291 - protein, 13 aa, Borrelia burgdorferi
ATGKGVLFEAFTG

SEQ ID NO: 78292 - protein, 13 aa, Borrelia burgdorferi
TGKGVLFEAFTGL

SEQ ID NO: 78293 - protein, 13 aa, Borrelia burgdorferi
GKGVLFEAFTGLK

SEQ ID NO: 78294 - protein, 13 aa, Borrelia burgdorferi
KGVLFEAFTGLKT

SEQ ID NO: 78295 - protein, 13 aa, Borrelia burgdorferi
GVLFEAFTGLKTG

SEQ ID NO: 78296 - protein, 13 aa, Borrelia burgdorferi
VLFEAFTGLKTGS

SEQ ID NO: 78297 - protein, 13 aa, Borrelia burgdorferi
LFEAFTGLKTGSK

SEQ ID NO: 78298 - protein, 13 aa, Borrelia burgdorferi
FEAFTGLKTGSKV

SEQ ID NO: 78299 - protein, 13 aa, Borrelia burgdorferi
EAFTGLKTGSKVT

SEQ ID NO: 78300 - protein, 13 aa, Borrelia burgdorferi
AFTGLKTGSKVTS

SEQ ID NO: 78301 - protein, 13 aa, Borrelia burgdorferi
FTGLKTGSKVTSG

SEQ ID NO: 78302 - protein, 13 aa, Borrelia burgdorferi
TGLKTGSKVTSGG

SEQ ID NO: 78303 - protein, 13 aa, Borrelia burgdorferi
GLKTGSKVTSGGL

SEQ ID NO: 78304 - protein, 13 aa, Borrelia burgdorferi
LKTGSKVTSGGLA

SEQ ID NO: 78305 - protein, 13 aa, Borrelia burgdorferi
KTGSKVTSGGLAL

SEQ ID NO: 78306 - protein, 13 aa, Borrelia burgdorferi
TGSKVTSGGLALR

SEQ ID NO: 78307 - protein, 13 aa, Borrelia burgdorferi
GSKVTSGGLALRE

SEQ ID NO: 78308 - protein, 13 aa, Borrelia burgdorferi
SKVTSGGLALREA

SEQ ID NO: 78309 - protein, 13 aa, Borrelia burgdorferi
KVTSGGLALREAK

SEQ ID NO: 78310 - protein, 13 aa, Borrelia burgdorferi
VTSGGLALREAKV

SEQ ID NO: 78311 - protein, 13 aa, Borrelia burgdorferi
TSGGLALREAKVQ

SEQ ID NO: 78312 - protein, 13 aa, Borrelia burgdorferi
SGGLALREAKVQA

SEQ ID NO: 78313 - protein, 13 aa, Borrelia burgdorferi
GGLALREAKVQAI

SEQ ID NO: 78314 - protein, 13 aa, Borrelia burgdorferi
GLALREAKVQAIV

SEQ ID NO: 78315 - protein, 13 aa, Borrelia burgdorferi
LALREAKVQAIVE

SEQ ID NO: 78316 - protein, 13 aa, Borrelia burgdorferi
ALREAKVQAIVET

SEQ ID NO: 78317 - protein, 13 aa, Borrelia burgdorferi
LREAKVQAIVETG

SEQ ID NO: 78318 - protein, 13 aa, Borrelia burgdorferi
REAKVQAIVETGK

SEQ ID NO: 78319 - protein, 13 aa, Borrelia burgdorferi
EAKVQAIVETGKF

SEQ ID NO: 78320 - protein, 13 aa, Borrelia burgdorferi
AKVQAIVETGKFL

SEQ ID NO: 78321 - protein, 13 aa, Borrelia burgdorferi
KVQAIVETGKFLK

SEQ ID NO: 78322 - protein, 13 aa, Borrelia burgdorferi
VQAIVETGKFLKI

SEQ ID NO: 78323 - protein, 13 aa, Borrelia burgdorferi
QAIVETGKFLKII

SEQ ID NO: 78324 - protein, 13 aa, Borrelia burgdorferi
AIVETGKFLKIIE

SEQ ID NO: 78325 - protein, 13 aa, Borrelia burgdorferi
IVETGKFLKIIEE

SEQ ID NO: 78326 - protein, 13 aa, Borrelia burgdorferi
VETGKFLKIIEEE

SEQ ID NO: 78327 - protein, 13 aa, Borrelia burgdorferi
ETGKFLKIIEEEA

SEQ ID NO: 78328 - protein, 13 aa, Borrelia burgdorferi
TGKFLKIIEEEAL

SEQ ID NO: 78329 - protein, 13 aa, Borrelia burgdorferi
GKFLKIIEEEALK

SEQ ID NO: 78330 - protein, 13 aa, Borrelia burgdorferi
KFLKIIEEEALKL

SEQ ID NO: 78331 - protein, 13 aa, Borrelia burgdorferi
FLKIIEEEALKLK

SEQ ID NO: 78332 - protein, 13 aa, Borrelia burgdorferi
LKIIEEEALKLKE

SEQ ID NO: 78333 - protein, 13 aa, Borrelia burgdorferi
KIIEEEALKLKET

SEQ ID NO: 78334 - protein, 13 aa, Borrelia burgdorferi
IIEEEALKLKETG

SEQ ID NO: 78335 - protein, 13 aa, Borrelia burgdorferi
IEEEALKLKETGN

SEQ ID NO: 78336 - protein, 13 aa, Borrelia burgdorferi
EEEALKLKETGNS

SEQ ID NO: 78337 - protein, 13 aa, Borrelia burgdorferi
EEALKLKETGNSG

SEQ ID NO: 78338 - protein, 13 aa, Borrelia burgdorferi
EALKLKETGNSGQ

SEQ ID NO: 78339 - protein, 13 aa, Borrelia burgdorferi
ALKLKETGNSGQF

SEQ ID NO: 78340 - protein, 13 aa, Borrelia burgdorferi
LKLKETGNSGQFL

SEQ ID NO: 78341 - protein, 13 aa, Borrelia burgdorferi
KLKETGNSGQFLA

SEQ ID NO: 78342 - protein, 13 aa, Borrelia burgdorferi
LKETGNSGQFLAM

SEQ ID NO: 78343 - protein, 13 aa, Borrelia burgdorferi
KETGNSGQFLAMF

SEQ ID NO: 78344 - protein, 13 aa, Borrelia burgdorferi
ETGNSGQFLAMFD

SEQ ID NO: 78345 - protein, 13 aa, Borrelia burgdorferi
TGNSGQFLAMFDL

SEQ ID NO: 78346 - protein, 13 aa, Borrelia burgdorferi
GNSGQFLAMFDLM

SEQ ID NO: 78347 - protein, 13 aa, Borrelia burgdorferi
NSGQFLAMFDLML

SEQ ID NO: 78348 - protein, 13 aa, Borrelia burgdorferi
SGQFLAMFDLMLE

SEQ ID NO: 78349 - protein, 13 aa, Borrelia burgdorferi
GQFLAMFDLMLEV

SEQ ID NO: 78350 - protein, 13 aa, Borrelia burgdorferi
QFLAMFDLMLEVV

SEQ ID NO: 78351 - protein, 13 aa, Borrelia burgdorferi
FLAMFDLMLEVVE

SEQ ID NO: 78352 - protein, 13 aa, Borrelia burgdorferi
LAMFDLMLEVVES

SEQ ID NO: 78353 - protein, 13 aa, Borrelia burgdorferi
AMFDLMLEVVESL

SEQ ID NO: 78354 - protein, 13 aa, Borrelia burgdorferi
MFDLMLEVVESLE

SEQ ID NO: 78355 - protein, 13 aa, Borrelia burgdorferi
FDLMLEVVESLED

SEQ ID NO: 78356 - protein, 13 aa, Borrelia burgdorferi
DLMLEVVESLEDV

SEQ ID NO: 78357 - protein, 13 aa, Borrelia burgdorferi
LMLEVVESLEDVG

SEQ ID NO: 78358 - protein, 13 aa, Borrelia burgdorferi
MLEVVESLEDVGI

SEQ ID NO: 78359 - protein, 13 aa, Borrelia burgdorferi
LEVVESLEDVGII

SEQ ID NO: 78360 - protein, 13 aa, Borrelia burgdorferi
EVVESLEDVGIIG

SEQ ID NO: 78361 - protein, 13 aa, Borrelia burgdorferi
VVESLEDVGIIGL

SEQ ID NO: 78362 - protein, 13 aa, Borrelia burgdorferi
VESLEDVGIIGLK

SEQ ID NO: 78363 - protein, 13 aa, Borrelia burgdorferi
ESLEDVGIIGLKA

SEQ ID NO: 78364 - protein, 13 aa, Borrelia burgdorferi
SLEDVGIIGLKAR

SEQ ID NO: 78365 - protein, 13 aa, Borrelia burgdorferi
LEDVGIIGLKARV

SEQ ID NO: 78366 - protein, 13 aa, Borrelia burgdorferi
EDVGIIGLKARVL

SEQ ID NO: 78367 - protein, 13 aa, Borrelia burgdorferi
DVGIIGLKARVLE

SEQ ID NO: 78368 - protein, 13 aa, Borrelia burgdorferi
VGIIGLKARVLEE

SEQ ID NO: 78369 - protein, 13 aa, Borrelia burgdorferi
GIIGLKARVLEES

SEQ ID NO: 78370 - protein, 13 aa, Borrelia burgdorferi
IIGLKARVLEESK

SEQ ID NO: 78371 - protein, 13 aa, Borrelia burgdorferi
IGLKARVLEESKN

SEQ ID NO: 78372 - protein, 13 aa, Borrelia burgdorferi
GLKARVLEESKNN

SEQ ID NO: 78373 - protein, 13 aa, Borrelia burgdorferi
LKARVLEESKNNP

SEQ ID NO: 78374 - protein, 13 aa, Borrelia burgdorferi
KARVLEESKNNPI

SEQ ID NO: 78375 - protein, 13 aa, Borrelia burgdorferi
ARVLEESKNNPIN

SEQ ID NO: 78376 - protein, 13 aa, Borrelia burgdorferi
RVLEESKNNPINT

SEQ ID NO: 78377 - protein, 13 aa, Borrelia burgdorferi
VLEESKNNPINTA

SEQ ID NO: 78378 - protein, 13 aa, Borrelia burgdorferi
LEESKNNPINTAE

SEQ ID NO: 78379 - protein, 13 aa, Borrelia burgdorferi
EESKNNPINTAER

SEQ ID NO: 78380 - protein, 13 aa, Borrelia burgdorferi
ESKNNPINTAERL

SEQ ID NO: 78381 - protein, 13 aa, Borrelia burgdorferi
SKNNPINTAERLL

SEQ ID NO: 78382 - protein, 13 aa, Borrelia burgdorferi
KNNPINTAERLLA

SEQ ID NO: 78383 - protein, 13 aa, Borrelia burgdorferi
NNPINTAERLLAA

SEQ ID NO: 78384 - protein, 13 aa, Borrelia burgdorferi
NPINTAERLLAAK

SEQ ID NO: 78385 - protein, 13 aa, Borrelia burgdorferi
PINTAERLLAAKA

SEQ ID NO: 78386 - protein, 13 aa, Borrelia burgdorferi
INTAERLLAAKAQ

SEQ ID NO: 78387 - protein, 13 aa, Borrelia burgdorferi
NTAERLLAAKAQI

SEQ ID NO: 78388 - protein, 13 aa, Borrelia burgdorferi
TAERLLAAKAQIE

SEQ ID NO: 78389 - protein, 13 aa, Borrelia burgdorferi
AERLLAAKAQIEN

SEQ ID NO: 78390 - protein, 13 aa, Borrelia burgdorferi
ERLLAAKAQIENQ

SEQ ID NO: 78391 - protein, 13 aa, Borrelia burgdorferi
RLLAAKAQIENQL

SEQ ID NO: 78392 - protein, 13 aa, Borrelia burgdorferi
LLAAKAQIENQLK

SEQ ID NO: 78393 - protein, 13 aa, Borrelia burgdorferi
LAAKAQIENQLKV

SEQ ID NO: 78394 - protein, 13 aa, Borrelia burgdorferi
AAKAQIENQLKVV

SEQ ID NO: 78395 - protein, 13 aa, Borrelia burgdorferi
AKAQIENQLKVVK

SEQ ID NO: 78396 - protein, 13 aa, Borrelia burgdorferi
KAQIENQLKVVKE

SEQ ID NO: 78397 - protein, 13 aa, Borrelia burgdorferi
AQIENQLKVVKEK

SEQ ID NO: 78398 - protein, 13 aa, Borrelia burgdorferi
QIENQLKVVKEKQ

SEQ ID NO: 78399 - protein, 13 aa, Borrelia burgdorferi
IENQLKVVKEKQN

SEQ ID NO: 78400 - protein, 13 aa, Borrelia burgdorferi
ENQLKVVKEKQNI

SEQ ID NO: 78401 - protein, 13 aa, Borrelia burgdorferi
NQLKVVKEKQNIE

SEQ ID NO: 78402 - protein, 13 aa, Borrelia burgdorferi
QLKVVKEKQNIEN

SEQ ID NO: 78403 - protein, 13 aa, Borrelia burgdorferi
LKVVKEKQNIENG

SEQ ID NO: 78404 - protein, 13 aa, Borrelia burgdorferi
KVVKEKQNIENGG

SEQ ID NO: 78405 - protein, 13 aa, Borrelia burgdorferi
VVKEKQNIENGGE

SEQ ID NO: 78406 - protein, 13 aa, Borrelia burgdorferi
VKEKQNIENGGEK

SEQ ID NO: 78407 - protein, 13 aa, Borrelia burgdorferi
KEKQNIENGGEKK

SEQ ID NO: 78408 - protein, 13 aa, Borrelia burgdorferi
EKQNIENGGEKKN

SEQ ID NO: 78409 - protein, 13 aa, Borrelia burgdorferi
KQNIENGGEKKNN

SEQ ID NO: 78410 - protein, 13 aa, Borrelia burgdorferi
QNIENGGEKKNNK

SEQ ID NO: 78411 - protein, 13 aa, Borrelia burgdorferi
NIENGGEKKNNKS

SEQ ID NO: 78412 - protein, 13 aa, Borrelia burgdorferi
IENGGEKKNNKSK

SEQ ID NO: 78413 - protein, 13 aa, Borrelia burgdorferi
ENGGEKKNNKSKK

SEQ ID NO: 78414 - protein, 13 aa, Borrelia burgdorferi
NGGEKKNNKSKKK

SEQ ID NO: 78415 - protein, 13 aa, Borrelia burgdorferi
GGEKKNNKSKKKK

SEQ ID NO: 78416 - protein, 14 aa, Borrelia burgdorferi
SIVIALFFKLLVAC

SEQ ID NO: 78417 - protein, 14 aa, Borrelia burgdorferi
IVIALFFKLLVACS

SEQ ID NO: 78418 - protein, 14 aa, Borrelia burgdorferi
VIALFFKLLVACSI

SEQ ID NO: 78419 - protein, 14 aa, Borrelia burgdorferi
IALFFKLLVACSIG

SEQ ID NO: 78420 - protein, 14 aa, Borrelia burgdorferi
ALFFKLLVACSIGL

SEQ ID NO: 78421 - protein, 14 aa, Borrelia burgdorferi
LFFKLLVACSIGLV

SEQ ID NO: 78422 - protein, 14 aa, Borrelia burgdorferi
FFKLLVACSIGLVE

SEQ ID NO: 78423 - protein, 14 aa, Borrelia burgdorferi
FKLLVACSIGLVER

SEQ ID NO: 78424 - protein, 14 aa, Borrelia burgdorferi
KLLVACSIGLVERT

SEQ ID NO: 78425 - protein, 14 aa, Borrelia burgdorferi
LLVACSIGLVERTN

SEQ ID NO: 78426 - protein, 14 aa, Borrelia burgdorferi
LVACSIGLVERTNA

SEQ ID NO: 78427 - protein, 14 aa, Borrelia burgdorferi
VACSIGLVERTNAA

SEQ ID NO: 78428 - protein, 14 aa, Borrelia burgdorferi
ACSIGLVERTNAAL

SEQ ID NO: 78429 - protein, 14 aa, Borrelia burgdorferi
CSIGLVERTNAALE

SEQ ID NO: 78430 - protein, 14 aa, Borrelia burgdorferi
SIGLVERTNAALES

SEQ ID NO: 78431 - protein, 14 aa, Borrelia burgdorferi
IGLVERTNAALESS

SEQ ID NO: 78432 - protein, 14 aa, Borrelia burgdorferi
GLVERTNAALESSS

SEQ ID NO: 78433 - protein, 14 aa, Borrelia burgdorferi
LVERTNAALESSSK

SEQ ID NO: 78434 - protein, 14 aa, Borrelia burgdorferi
VERTNAALESSSKD

SEQ ID NO: 78435 - protein, 14 aa, Borrelia burgdorferi
ERTNAALESSSKDL

SEQ ID NO: 78436 - protein, 14 aa, Borrelia burgdorferi
RTNAALESSSKDLK

SEQ ID NO: 78437 - protein, 14 aa, Borrelia burgdorferi
TNAALESSSKDLKN

SEQ ID NO: 78438 - protein, 14 aa, Borrelia burgdorferi
NAALESSSKDLKNK

SEQ ID NO: 78439 - protein, 14 aa, Borrelia burgdorferi
AALESSSKDLKNKI

SEQ ID NO: 78440 - protein, 14 aa, Borrelia burgdorferi
ALESSSKDLKNKIL

SEQ ID NO: 78441 - protein, 14 aa, Borrelia burgdorferi
LESSSKDLKNKILK

SEQ ID NO: 78442 - protein, 14 aa, Borrelia burgdorferi
ESSSKDLKNKILKI

SEQ ID NO: 78443 - protein, 14 aa, Borrelia burgdorferi
SSSKDLKNKILKIK

SEQ ID NO: 78444 - protein, 14 aa, Borrelia burgdorferi
SSKDLKNKILKIKK

SEQ ID NO: 78445 - protein, 14 aa, Borrelia burgdorferi
SKDLKNKILKIKKE

SEQ ID NO: 78446 - protein, 14 aa, Borrelia burgdorferi
KDLKNKILKIKKEA

SEQ ID NO: 78447 - protein, 14 aa, Borrelia burgdorferi
DLKNKILKIKKEAT

SEQ ID NO: 78448 - protein, 14 aa, Borrelia burgdorferi
LKNKILKIKKEATG

SEQ ID NO: 78449 - protein, 14 aa, Borrelia burgdorferi
KNKILKIKKEATGK

SEQ ID NO: 78450 - protein, 14 aa, Borrelia burgdorferi
NKILKIKKEATGKG

SEQ ID NO: 78451 - protein, 14 aa, Borrelia burgdorferi
KILKIKKEATGKGV

SEQ ID NO: 78452 - protein, 14 aa, Borrelia burgdorferi
ILKIKKEATGKGVL

SEQ ID NO: 78453 - protein, 14 aa, Borrelia burgdorferi
LKIKKEATGKGVLF

SEQ ID NO: 78454 - protein, 14 aa, Borrelia burgdorferi
KIKKEATGKGVLFE

SEQ ID NO: 78455 - protein, 14 aa, Borrelia burgdorferi
IKKEATGKGVLFEA

SEQ ID NO: 78456 - protein, 14 aa, Borrelia burgdorferi
KKEATGKGVLFEAF

SEQ ID NO: 78457 - protein, 14 aa, Borrelia burgdorferi
KEATGKGVLFEAFT

SEQ ID NO: 78458 - protein, 14 aa, Borrelia burgdorferi
EATGKGVLFEAFTG

SEQ ID NO: 78459 - protein, 14 aa, Borrelia burgdorferi
ATGKGVLFEAFTGL

SEQ ID NO: 78460 - protein, 14 aa, Borrelia burgdorferi
TGKGVLFEAFTGLK

SEQ ID NO: 78461 - protein, 14 aa, Borrelia burgdorferi
GKGVLFEAFTGLKT

SEQ ID NO: 78462 - protein, 14 aa, Borrelia burgdorferi
KGVLFEAFTGLKTG

SEQ ID NO: 78463 - protein, 14 aa, Borrelia burgdorferi
GVLFEAFTGLKTGS

SEQ ID NO: 78464 - protein, 14 aa, Borrelia burgdorferi
VLFEAFTGLKTGSK

SEQ ID NO: 78465 - protein, 14 aa, Borrelia burgdorferi
LFEAFTGLKTGSKV

SEQ ID NO: 78466 - protein, 14 aa, Borrelia burgdorferi
FEAFTGLKTGSKVT

SEQ ID NO: 78467 - protein, 14 aa, Borrelia burgdorferi
EAFTGLKTGSKVTS

SEQ ID NO: 78468 - protein, 14 aa, Borrelia burgdorferi
AFTGLKTGSKVTSG

SEQ ID NO: 78469 - protein, 14 aa, Borrelia burgdorferi
FTGLKTGSKVTSGG

SEQ ID NO: 78470 - protein, 14 aa, Borrelia burgdorferi
TGLKTGSKVTSGGL

SEQ ID NO: 78471 - protein, 14 aa, Borrelia burgdorferi
GLKTGSKVTSGGLA

SEQ ID NO: 78472 - protein, 14 aa, Borrelia burgdorferi
LKTGSKVTSGGLAL

SEQ ID NO: 78473 - protein, 14 aa, Borrelia burgdorferi
KTGSKVTSGGLALR

SEQ ID NO: 78474 - protein, 14 aa, Borrelia burgdorferi
TGSKVTSGGLALRE

SEQ ID NO: 78475 - protein, 14 aa, Borrelia burgdorferi
GSKVTSGGLALREA

SEQ ID NO: 78476 - protein, 14 aa, Borrelia burgdorferi
SKVTSGGLALREAK

SEQ ID NO: 78477 - protein, 14 aa, Borrelia burgdorferi
KVTSGGLALREAKV

SEQ ID NO: 78478 - protein, 14 aa, Borrelia burgdorferi
VTSGGLALREAKVQ

SEQ ID NO: 78479 - protein, 14 aa, Borrelia burgdorferi
TSGGLALREAKVQA

SEQ ID NO: 78480 - protein, 14 aa, Borrelia burgdorferi
SGGLALREAKVQAI

SEQ ID NO: 78481 - protein, 14 aa, Borrelia burgdorferi
GGLALREAKVQAIV

SEQ ID NO: 78482 - protein, 14 aa, Borrelia burgdorferi
GLALREAKVQAIVE

SEQ ID NO: 78483 - protein, 14 aa, Borrelia burgdorferi
LALREAKVQAIVET

SEQ ID NO: 78484 - protein, 14 aa, Borrelia burgdorferi
ALREAKVQAIVETG

SEQ ID NO: 78485 - protein, 14 aa, Borrelia burgdorferi
LREAKVQAIVETGK

SEQ ID NO: 78486 - protein, 14 aa, Borrelia burgdorferi
REAKVQAIVETGKF

SEQ ID NO: 78487 - protein, 14 aa, Borrelia burgdorferi
EAKVQAIVETGKFL

SEQ ID NO: 78488 - protein, 14 aa, Borrelia burgdorferi
AKVQAIVETGKFLK

SEQ ID NO: 78489 - protein, 14 aa, Borrelia burgdorferi
KVQAIVETGKFLKI

SEQ ID NO: 78490 - protein, 14 aa, Borrelia burgdorferi
VQAIVETGKFLKII

SEQ ID NO: 78491 - protein, 14 aa, Borrelia burgdorferi
QAIVETGKFLKIIE

SEQ ID NO: 78492 - protein, 14 aa, Borrelia burgdorferi
AIVETGKFLKIIEE

SEQ ID NO: 78493 - protein, 14 aa, Borrelia burgdorferi
IVETGKFLKIIEEE

SEQ ID NO: 78494 - protein, 14 aa, Borrelia burgdorferi
VETGKFLKIIEEEA

SEQ ID NO: 78495 - protein, 14 aa, Borrelia burgdorferi
ETGKFLKIIEEEAL

SEQ ID NO: 78496 - protein, 14 aa, Borrelia burgdorferi
TGKFLKIIEEEALK

SEQ ID NO: 78497 - protein, 14 aa, Borrelia burgdorferi
GKFLKIIEEEALKL

SEQ ID NO: 78498 - protein, 14 aa, Borrelia burgdorferi
KFLKIIEEEALKLK

SEQ ID NO: 78499 - protein, 14 aa, Borrelia burgdorferi
FLKIIEEEALKLKE

SEQ ID NO: 78500 - protein, 14 aa, Borrelia burgdorferi
LKIIEEEALKLKET

SEQ ID NO: 78501 - protein, 14 aa, Borrelia burgdorferi
KIIEEEALKLKETG

SEQ ID NO: 78502 - protein, 14 aa, Borrelia burgdorferi
IIEEEALKLKETGN

SEQ ID NO: 78503 - protein, 14 aa, Borrelia burgdorferi
IEEEALKLKETGNS

SEQ ID NO: 78504 - protein, 14 aa, Borrelia burgdorferi
EEEALKLKETGNSG

SEQ ID NO: 78505 - protein, 14 aa, Borrelia burgdorferi
EEALKLKETGNSGQ

SEQ ID NO: 78506 - protein, 14 aa, Borrelia burgdorferi
EALKLKETGNSGQF

SEQ ID NO: 78507 - protein, 14 aa, Borrelia burgdorferi
ALKLKETGNSGQFL

SEQ ID NO: 78508 - protein, 14 aa, Borrelia burgdorferi
LKLKETGNSGQFLA

SEQ ID NO: 78509 - protein, 14 aa, Borrelia burgdorferi
KLKETGNSGQFLAM

SEQ ID NO: 78510 - protein, 14 aa, Borrelia burgdorferi
LKETGNSGQFLAMF

SEQ ID NO: 78511 - protein, 14 aa, Borrelia burgdorferi
KETGNSGQFLAMFD

SEQ ID NO: 78512 - protein, 14 aa, Borrelia burgdorferi
ETGNSGQFLAMFDL

SEQ ID NO: 78513 - protein, 14 aa, Borrelia burgdorferi
TGNSGQFLAMFDLM

SEQ ID NO: 78514 - protein, 14 aa, Borrelia burgdorferi
GNSGQFLAMFDLML

SEQ ID NO: 78515 - protein, 14 aa, Borrelia burgdorferi
NSGQFLAMFDLMLE

SEQ ID NO: 78516 - protein, 14 aa, Borrelia burgdorferi
SGQFLAMFDLMLEV

SEQ ID NO: 78517 - protein, 14 aa, Borrelia burgdorferi
GQFLAMFDLMLEVV

SEQ ID NO: 78518 - protein, 14 aa, Borrelia burgdorferi
QFLAMFDLMLEVVE

SEQ ID NO: 78519 - protein, 14 aa, Borrelia burgdorferi
FLAMFDLMLEVVES

SEQ ID NO: 78520 - protein, 14 aa, Borrelia burgdorferi
LAMFDLMLEVVESL

SEQ ID NO: 78521 - protein, 14 aa, Borrelia burgdorferi
AMFDLMLEVVESLE

SEQ ID NO: 78522 - protein, 14 aa, Borrelia burgdorferi
MFDLMLEVVESLED

SEQ ID NO: 78523 - protein, 14 aa, Borrelia burgdorferi
FDLMLEVVESLEDV

SEQ ID NO: 78524 - protein, 14 aa, Borrelia burgdorferi
DLMLEVVESLEDVG

SEQ ID NO: 78525 - protein, 14 aa, Borrelia burgdorferi
LMLEVVESLEDVGI

SEQ ID NO: 78526 - protein, 14 aa, Borrelia burgdorferi
MLEVVESLEDVGII

SEQ ID NO: 78527 - protein, 14 aa, Borrelia burgdorferi
LEVVESLEDVGIIG

SEQ ID NO: 78528 - protein, 14 aa, Borrelia burgdorferi
EVVESLEDVGIIGL

SEQ ID NO: 78529 - protein, 14 aa, Borrelia burgdorferi
VVESLEDVGIIGLK

SEQ ID NO: 78530 - protein, 14 aa, Borrelia burgdorferi
VESLEDVGIIGLKA

SEQ ID NO: 78531 - protein, 14 aa, Borrelia burgdorferi
ESLEDVGIIGLKAR

SEQ ID NO: 78532 - protein, 14 aa, Borrelia burgdorferi
SLEDVGIIGLKARV

SEQ ID NO: 78533 - protein, 14 aa, Borrelia burgdorferi
LEDVGIIGLKARVL

SEQ ID NO: 78534 - protein, 14 aa, Borrelia burgdorferi
EDVGIIGLKARVLE

SEQ ID NO: 78535 - protein, 14 aa, Borrelia burgdorferi
DVGIIGLKARVLEE

SEQ ID NO: 78536 - protein, 14 aa, Borrelia burgdorferi
VGIIGLKARVLEES

SEQ ID NO: 78537 - protein, 14 aa, Borrelia burgdorferi
GIIGLKARVLEESK

SEQ ID NO: 78538 - protein, 14 aa, Borrelia burgdorferi
IIGLKARVLEESKN

SEQ ID NO: 78539 - protein, 14 aa, Borrelia burgdorferi
IGLKARVLEESKNN

SEQ ID NO: 78540 - protein, 14 aa, Borrelia burgdorferi
GLKARVLEESKNNP

SEQ ID NO: 78541 - protein, 14 aa, Borrelia burgdorferi
LKARVLEESKNNPI

SEQ ID NO: 78542 - protein, 14 aa, Borrelia burgdorferi
KARVLEESKNNPIN

SEQ ID NO: 78543 - protein, 14 aa, Borrelia burgdorferi
ARVLEESKNNPINT

SEQ ID NO: 78544 - protein, 14 aa, Borrelia burgdorferi
RVLEESKNNPINTA

SEQ ID NO: 78545 - protein, 14 aa, Borrelia burgdorferi
VLEESKNNPINTAE

SEQ ID NO: 78546 - protein, 14 aa, Borrelia burgdorferi
LEESKNNPINTAER

SEQ ID NO: 78547 - protein, 14 aa, Borrelia burgdorferi
EESKNNPINTAERL

SEQ ID NO: 78548 - protein, 14 aa, Borrelia burgdorferi
ESKNNPINTAERLL

SEQ ID NO: 78549 - protein, 14 aa, Borrelia burgdorferi
SKNNPINTAERLLA

SEQ ID NO: 78550 - protein, 14 aa, Borrelia burgdorferi
KNNPINTAERLLAA

SEQ ID NO: 78551 - protein, 14 aa, Borrelia burgdorferi
NNPINTAERLLAAK

SEQ ID NO: 78552 - protein, 14 aa, Borrelia burgdorferi
NPINTAERLLAAKA

SEQ ID NO: 78553 - protein, 14 aa, Borrelia burgdorferi
PINTAERLLAAKAQ

SEQ ID NO: 78554 - protein, 14 aa, Borrelia burgdorferi
INTAERLLAAKAQI

SEQ ID NO: 78555 - protein, 14 aa, Borrelia burgdorferi
NTAERLLAAKAQIE

SEQ ID NO: 78556 - protein, 14 aa, Borrelia burgdorferi
TAERLLAAKAQIEN

SEQ ID NO: 78557 - protein, 14 aa, Borrelia burgdorferi
AERLLAAKAQIENQ

SEQ ID NO: 78558 - protein, 14 aa, Borrelia burgdorferi
ERLLAAKAQIENQL

SEQ ID NO: 78559 - protein, 14 aa, Borrelia burgdorferi
RLLAAKAQIENQLK

SEQ ID NO: 78560 - protein, 14 aa, Borrelia burgdorferi
LLAAKAQIENQLKV

SEQ ID NO: 78561 - protein, 14 aa, Borrelia burgdorferi
LAAKAQIENQLKVV

SEQ ID NO: 78562 - protein, 14 aa, Borrelia burgdorferi
AAKAQIENQLKVVK

SEQ ID NO: 78563 - protein, 14 aa, Borrelia burgdorferi
AKAQIENQLKVVKE

SEQ ID NO: 78564 - protein, 14 aa, Borrelia burgdorferi
KAQIENQLKVVKEK

SEQ ID NO: 78565 - protein, 14 aa, Borrelia burgdorferi
AQIENQLKVVKEKQ

SEQ ID NO: 78566 - protein, 14 aa, Borrelia burgdorferi
QIENQLKVVKEKQN

SEQ ID NO: 78567 - protein, 14 aa, Borrelia burgdorferi
IENQLKVVKEKQNI

SEQ ID NO: 78568 - protein, 14 aa, Borrelia burgdorferi
ENQLKVVKEKQNIE

SEQ ID NO: 78569 - protein, 14 aa, Borrelia burgdorferi
NQLKVVKEKQNIEN

SEQ ID NO: 78570 - protein, 14 aa, Borrelia burgdorferi
QLKVVKEKQNIENG

SEQ ID NO: 78571 - protein, 14 aa, Borrelia burgdorferi
LKVVKEKQNIENGG

SEQ ID NO: 78572 - protein, 14 aa, Borrelia burgdorferi
KVVKEKQNIENGGE

SEQ ID NO: 78573 - protein, 14 aa, Borrelia burgdorferi
VVKEKQNIENGGEK

SEQ ID NO: 78574 - protein, 14 aa, Borrelia burgdorferi
VKEKQNIENGGEKK

SEQ ID NO: 78575 - protein, 14 aa, Borrelia burgdorferi
KEKQNIENGGEKKN

SEQ ID NO: 78576 - protein, 14 aa, Borrelia burgdorferi
EKQNIENGGEKKNN

SEQ ID NO: 78577 - protein, 14 aa, Borrelia burgdorferi
KQNIENGGEKKNNK

SEQ ID NO: 78578 - protein, 14 aa, Borrelia burgdorferi
QNIENGGEKKNNKS

SEQ ID NO: 78579 - protein, 14 aa, Borrelia burgdorferi
NIENGGEKKNNKSK

SEQ ID NO: 78580 - protein, 14 aa, Borrelia burgdorferi
IENGGEKKNNKSKK

SEQ ID NO: 78581 - protein, 14 aa, Borrelia burgdorferi
ENGGEKKNNKSKKK

SEQ ID NO: 78582 - protein, 14 aa, Borrelia burgdorferi
NGGEKKNNKSKKKK

SEQ ID NO: 78583 - protein, 15 aa, Borrelia burgdorferi
SIVIALFFKLLVACS

SEQ ID NO: 78584 - protein, 15 aa, Borrelia burgdorferi
IVIALFFKLLVACSI

SEQ ID NO: 78585 - protein, 15 aa, Borrelia burgdorferi
VIALFFKLLVACSIG

SEQ ID NO: 78586 - protein, 15 aa, Borrelia burgdorferi
IALFFKLLVACSIGL

SEQ ID NO: 78587 - protein, 15 aa, Borrelia burgdorferi
ALFFKLLVACSIGLV

SEQ ID NO: 78588 - protein, 15 aa, Borrelia burgdorferi
LFFKLLVACSIGLVE

SEQ ID NO: 78589 - protein, 15 aa, Borrelia burgdorferi
FFKLLVACSIGLVER

SEQ ID NO: 78590 - protein, 15 aa, Borrelia burgdorferi
FKLLVACSIGLVERT

SEQ ID NO: 78591 - protein, 15 aa, Borrelia burgdorferi
KLLVACSIGLVERTN

SEQ ID NO: 78592 - protein, 15 aa, Borrelia burgdorferi
LLVACSIGLVERTNA

SEQ ID NO: 78593 - protein, 15 aa, Borrelia burgdorferi
LVACSIGLVERTNAA

SEQ ID NO: 78594 - protein, 15 aa, Borrelia burgdorferi
VACSIGLVERTNAAL

SEQ ID NO: 78595 - protein, 15 aa, Borrelia burgdorferi
ACSIGLVERTNAALE

SEQ ID NO: 78596 - protein, 15 aa, Borrelia burgdorferi
CSIGLVERTNAALES

SEQ ID NO: 78597 - protein, 15 aa, Borrelia burgdorferi
SIGLVERTNAALESS

SEQ ID NO: 78598 - protein, 15 aa, Borrelia burgdorferi
IGLVERTNAALESSS

SEQ ID NO: 78599 - protein, 15 aa, Borrelia burgdorferi
GLVERTNAALESSSK

SEQ ID NO: 78600 - protein, 15 aa, Borrelia burgdorferi
LVERTNAALESSSKD

SEQ ID NO: 78601 - protein, 15 aa, Borrelia burgdorferi
VERTNAALESSSKDL

SEQ ID NO: 78602 - protein, 15 aa, Borrelia burgdorferi
ERTNAALESSSKDLK

SEQ ID NO: 78603 - protein, 15 aa, Borrelia burgdorferi
RTNAALESSSKDLKN

SEQ ID NO: 78604 - protein, 15 aa, Borrelia burgdorferi
TNAALESSSKDLKNK

SEQ ID NO: 78605 - protein, 15 aa, Borrelia burgdorferi
NAALESSSKDLKNKI

SEQ ID NO: 78606 - protein, 15 aa, Borrelia burgdorferi
AALESSSKDLKNKIL

SEQ ID NO: 78607 - protein, 15 aa, Borrelia burgdorferi
ALESSSKDLKNKILK

SEQ ID NO: 78608 - protein, 15 aa, Borrelia burgdorferi
LESSSKDLKNKILKI

SEQ ID NO: 78609 - protein, 15 aa, Borrelia burgdorferi
ESSSKDLKNKILKIK

SEQ ID NO: 78610 - protein, 15 aa, Borrelia burgdorferi
SSSKDLKNKILKIKK

SEQ ID NO: 78611 - protein, 15 aa, Borrelia burgdorferi
SSKDLKNKILKIKKE

SEQ ID NO: 78612 - protein, 15 aa, Borrelia burgdorferi
SKDLKNKILKIKKEA

SEQ ID NO: 78613 - protein, 15 aa, Borrelia burgdorferi
KDLKNKILKIKKEAT

SEQ ID NO: 78614 - protein, 15 aa, Borrelia burgdorferi
DLKNKILKIKKEATG

SEQ ID NO: 78615 - protein, 15 aa, Borrelia burgdorferi
LKNKILKIKKEATGK

SEQ ID NO: 78616 - protein, 15 aa, Borrelia burgdorferi
KNKILKIKKEATGKG

SEQ ID NO: 78617 - protein, 15 aa, Borrelia burgdorferi
NKILKIKKEATGKGV

SEQ ID NO: 78618 - protein, 15 aa, Borrelia burgdorferi
KILKIKKEATGKGVL

SEQ ID NO: 78619 - protein, 15 aa, Borrelia burgdorferi
ILKIKKEATGKGVLF

SEQ ID NO: 78620 - protein, 15 aa, Borrelia burgdorferi
LKIKKEATGKGVLFE

SEQ ID NO: 78621 - protein, 15 aa, Borrelia burgdorferi
KIKKEATGKGVLFEA

SEQ ID NO: 78622 - protein, 15 aa, Borrelia burgdorferi
IKKEATGKGVLFEAF

SEQ ID NO: 78623 - protein, 15 aa, Borrelia burgdorferi
KKEATGKGVLFEAFT

SEQ ID NO: 78624 - protein, 15 aa, Borrelia burgdorferi
KEATGKGVLFEAFTG

SEQ ID NO: 78625 - protein, 15 aa, Borrelia burgdorferi
EATGKGVLFEAFTGL

SEQ ID NO: 78626 - protein, 15 aa, Borrelia burgdorferi
ATGKGVLFEAFTGLK

SEQ ID NO: 78627 - protein, 15 aa, Borrelia burgdorferi
TGKGVLFEAFTGLKT

SEQ ID NO: 78628 - protein, 15 aa, Borrelia burgdorferi
GKGVLFEAFTGLKTG

SEQ ID NO: 78629 - protein, 15 aa, Borrelia burgdorferi
KGVLFEAFTGLKTGS

SEQ ID NO: 78630 - protein, 15 aa, Borrelia burgdorferi
GVLFEAFTGLKTGSK

SEQ ID NO: 78631 - protein, 15 aa, Borrelia burgdorferi
VLFEAFTGLKTGSKV

SEQ ID NO: 78632 - protein, 15 aa, Borrelia burgdorferi
LFEAFTGLKTGSKVT

SEQ ID NO: 78633 - protein, 15 aa, Borrelia burgdorferi
FEAFTGLKTGSKVTS

SEQ ID NO: 78634 - protein, 15 aa, Borrelia burgdorferi
EAFTGLKTGSKVTSG

SEQ ID NO: 78635 - protein, 15 aa, Borrelia burgdorferi
AFTGLKTGSKVTSGG

SEQ ID NO: 78636 - protein, 15 aa, Borrelia burgdorferi
FTGLKTGSKVTSGGL

SEQ ID NO: 78637 - protein, 15 aa, Borrelia burgdorferi
TGLKTGSKVTSGGLA

SEQ ID NO: 78638 - protein, 15 aa, Borrelia burgdorferi
GLKTGSKVTSGGLAL

SEQ ID NO: 78639 - protein, 15 aa, Borrelia burgdorferi
LKTGSKVTSGGLALR

SEQ ID NO: 78640 - protein, 15 aa, Borrelia burgdorferi
KTGSKVTSGGLALRE

SEQ ID NO: 78641 - protein, 15 aa, Borrelia burgdorferi
TGSKVTSGGLALREA

SEQ ID NO: 78642 - protein, 15 aa, Borrelia burgdorferi
GSKVTSGGLALREAK

SEQ ID NO: 78643 - protein, 15 aa, Borrelia burgdorferi
SKVTSGGLALREAKV

SEQ ID NO: 78644 - protein, 15 aa, Borrelia burgdorferi
KVTSGGLALREAKVQ

SEQ ID NO: 78645 - protein, 15 aa, Borrelia burgdorferi
VTSGGLALREAKVQA

SEQ ID NO: 78646 - protein, 15 aa, Borrelia burgdorferi
TSGGLALREAKVQAI

SEQ ID NO: 78647 - protein, 15 aa, Borrelia burgdorferi
SGGLALREAKVQAIV

SEQ ID NO: 78648 - protein, 15 aa, Borrelia burgdorferi
GGLALREAKVQAIVE

SEQ ID NO: 78649 - protein, 15 aa, Borrelia burgdorferi
GLALREAKVQAIVET

SEQ ID NO: 78650 - protein, 15 aa, Borrelia burgdorferi
LALREAKVQAIVETG

SEQ ID NO: 78651 - protein, 15 aa, Borrelia burgdorferi
ALREAKVQAIVETGK

SEQ ID NO: 78652 - protein, 15 aa, Borrelia burgdorferi
LREAKVQAIVETGKF

SEQ ID NO: 78653 - protein, 15 aa, Borrelia burgdorferi
REAKVQAIVETGKFL

SEQ ID NO: 78654 - protein, 15 aa, Borrelia burgdorferi
EAKVQAIVETGKFLK

SEQ ID NO: 78655 - protein, 15 aa, Borrelia burgdorferi
AKVQAIVETGKFLKI

SEQ ID NO: 78656 - protein, 15 aa, Borrelia burgdorferi
KVQAIVETGKFLKII

SEQ ID NO: 78657 - protein, 15 aa, Borrelia burgdorferi
VQAIVETGKFLKIIE

SEQ ID NO: 78658 - protein, 15 aa, Borrelia burgdorferi
QAIVETGKFLKIIEE

SEQ ID NO: 78659 - protein, 15 aa, Borrelia burgdorferi
AIVETGKFLKIIEEE

SEQ ID NO: 78660 - protein, 15 aa, Borrelia burgdorferi
IVETGKFLKIIEEEA

SEQ ID NO: 78661 - protein, 15 aa, Borrelia burgdorferi
VETGKFLKIIEEEAL

SEQ ID NO: 78662 - protein, 15 aa, Borrelia burgdorferi
ETGKFLKIIEEEALK

SEQ ID NO: 78663 - protein, 15 aa, Borrelia burgdorferi
TGKFLKIIEEEALKL

SEQ ID NO: 78664 - protein, 15 aa, Borrelia burgdorferi
GKFLKIIEEEALKLK

SEQ ID NO: 78665 - protein, 15 aa, Borrelia burgdorferi
KFLKIIEEEALKLKE

SEQ ID NO: 78666 - protein, 15 aa, Borrelia burgdorferi
FLKIIEEEALKLKET

SEQ ID NO: 78667 - protein, 15 aa, Borrelia burgdorferi
LKIIEEEALKLKETG

SEQ ID NO: 78668 - protein, 15 aa, Borrelia burgdorferi
KIIEEEALKLKETGN

SEQ ID NO: 78669 - protein, 15 aa, Borrelia burgdorferi
IIEEEALKLKETGNS

SEQ ID NO: 78670 - protein, 15 aa, Borrelia burgdorferi
IEEEALKLKETGNSG

SEQ ID NO: 78671 - protein, 15 aa, Borrelia burgdorferi
EEEALKLKETGNSGQ

SEQ ID NO: 78672 - protein, 15 aa, Borrelia burgdorferi
EEALKLKETGNSGQF

SEQ ID NO: 78673 - protein, 15 aa, Borrelia burgdorferi
EALKLKETGNSGQFL

SEQ ID NO: 78674 - protein, 15 aa, Borrelia burgdorferi
ALKLKETGNSGQFLA

SEQ ID NO: 78675 - protein, 15 aa, Borrelia burgdorferi
LKLKETGNSGQFLAM

SEQ ID NO: 78676 - protein, 15 aa, Borrelia burgdorferi
KLKETGNSGQFLAMF

SEQ ID NO: 78677 - protein, 15 aa, Borrelia burgdorferi
LKETGNSGQFLAMFD

SEQ ID NO: 78678 - protein, 15 aa, Borrelia burgdorferi
KETGNSGQFLAMFDL

SEQ ID NO: 78679 - protein, 15 aa, Borrelia burgdorferi
ETGNSGQFLAMFDLM

SEQ ID NO: 78680 - protein, 15 aa, Borrelia burgdorferi
TGNSGQFLAMFDLML

SEQ ID NO: 78681 - protein, 15 aa, Borrelia burgdorferi
GNSGQFLAMFDLMLE

SEQ ID NO: 78682 - protein, 15 aa, Borrelia burgdorferi
NSGQFLAMFDLMLEV

SEQ ID NO: 78683 - protein, 15 aa, Borrelia burgdorferi
SGQFLAMFDLMLEVV

SEQ ID NO: 78684 - protein, 15 aa, Borrelia burgdorferi
GQFLAMFDLMLEVVE

SEQ ID NO: 78685 - protein, 15 aa, Borrelia burgdorferi
QFLAMFDLMLEVVES

SEQ ID NO: 78686 - protein, 15 aa, Borrelia burgdorferi
FLAMFDLMLEVVESL

SEQ ID NO: 78687 - protein, 15 aa, Borrelia burgdorferi
LAMFDLMLEVVESLE

SEQ ID NO: 78688 - protein, 15 aa, Borrelia burgdorferi
AMFDLMLEVVESLED

SEQ ID NO: 78689 - protein, 15 aa, Borrelia burgdorferi
MFDLMLEVVESLEDV

SEQ ID NO: 78690 - protein, 15 aa, Borrelia burgdorferi
FDLMLEVVESLEDVG

SEQ ID NO: 78691 - protein, 15 aa, Borrelia burgdorferi
DLMLEVVESLEDVGI

SEQ ID NO: 78692 - protein, 15 aa, Borrelia burgdorferi
LMLEVVESLEDVGII

SEQ ID NO: 78693 - protein, 15 aa, Borrelia burgdorferi
MLEVVESLEDVGIIG

SEQ ID NO: 78694 - protein, 15 aa, Borrelia burgdorferi
LEVVESLEDVGIIGL

SEQ ID NO: 78695 - protein, 15 aa, Borrelia burgdorferi
EVVESLEDVGIIGLK

SEQ ID NO: 78696 - protein, 15 aa, Borrelia burgdorferi
VVESLEDVGIIGLKA

SEQ ID NO: 78697 - protein, 15 aa, Borrelia burgdorferi
VESLEDVGIIGLKAR

SEQ ID NO: 78698 - protein, 15 aa, Borrelia burgdorferi
ESLEDVGIIGLKARV

SEQ ID NO: 78699 - protein, 15 aa, Borrelia burgdorferi
SLEDVGIIGLKARVL

SEQ ID NO: 78700 - protein, 15 aa, Borrelia burgdorferi
LEDVGIIGLKARVLE

SEQ ID NO: 78701 - protein, 15 aa, Borrelia burgdorferi
EDVGIIGLKARVLEE

SEQ ID NO: 78702 - protein, 15 aa, Borrelia burgdorferi
DVGIIGLKARVLEES

SEQ ID NO: 78703 - protein, 15 aa, Borrelia burgdorferi
VGIIGLKARVLEESK

SEQ ID NO: 78704 - protein, 15 aa, Borrelia burgdorferi
GIIGLKARVLEESKN

SEQ ID NO: 78705 - protein, 15 aa, Borrelia burgdorferi
IIGLKARVLEESKNN

SEQ ID NO: 78706 - protein, 15 aa, Borrelia burgdorferi
IGLKARVLEESKNNP

SEQ ID NO: 78707 - protein, 15 aa, Borrelia burgdorferi
GLKARVLEESKNNPI

SEQ ID NO: 78708 - protein, 15 aa, Borrelia burgdorferi
LKARVLEESKNNPIN

SEQ ID NO: 78709 - protein, 15 aa, Borrelia burgdorferi
KARVLEESKNNPINT

SEQ ID NO: 78710 - protein, 15 aa, Borrelia burgdorferi
ARVLEESKNNPINTA

SEQ ID NO: 78711 - protein, 15 aa, Borrelia burgdorferi
RVLEESKNNPINTAE

SEQ ID NO: 78712 - protein, 15 aa, Borrelia burgdorferi
VLEESKNNPINTAER

SEQ ID NO: 78713 - protein, 15 aa, Borrelia burgdorferi
LEESKNNPINTAERL

SEQ ID NO: 78714 - protein, 15 aa, Borrelia burgdorferi
EESKNNPINTAERLL

SEQ ID NO: 78715 - protein, 15 aa, Borrelia burgdorferi
ESKNNPINTAERLLA

SEQ ID NO: 78716 - protein, 15 aa, Borrelia burgdorferi
SKNNPINTAERLLAA

SEQ ID NO: 78717 - protein, 15 aa, Borrelia burgdorferi
KNNPINTAERLLAAK

SEQ ID NO: 78718 - protein, 15 aa, Borrelia burgdorferi
NNPINTAERLLAAKA

SEQ ID NO: 78719 - protein, 15 aa, Borrelia burgdorferi
NPINTAERLLAAKAQ

SEQ ID NO: 78720 - protein, 15 aa, Borrelia burgdorferi
PINTAERLLAAKAQI

SEQ ID NO: 78721 - protein, 15 aa, Borrelia burgdorferi
INTAERLLAAKAQIE

SEQ ID NO: 78722 - protein, 15 aa, Borrelia burgdorferi
NTAERLLAAKAQIEN

SEQ ID NO: 78723 - protein, 15 aa, Borrelia burgdorferi
TAERLLAAKAQIENQ

SEQ ID NO: 78724 - protein, 15 aa, Borrelia burgdorferi
AERLLAAKAQIENQL

SEQ ID NO: 78725 - protein, 15 aa, Borrelia burgdorferi
ERLLAAKAQIENQLK

SEQ ID NO: 78726 - protein, 15 aa, Borrelia burgdorferi
RLLAAKAQIENQLKV

SEQ ID NO: 78727 - protein, 15 aa, Borrelia burgdorferi
LLAAKAQIENQLKVV

SEQ ID NO: 78728 - protein, 15 aa, Borrelia burgdorferi
LAAKAQIENQLKVVK

SEQ ID NO: 78729 - protein, 15 aa, Borrelia burgdorferi
AAKAQIENQLKVVKE

SEQ ID NO: 78730 - protein, 15 aa, Borrelia burgdorferi
AKAQIENQLKVVKEK

SEQ ID NO: 78731 - protein, 15 aa, Borrelia burgdorferi
KAQIENQLKVVKEKQ

SEQ ID NO: 78732 - protein, 15 aa, Borrelia burgdorferi
AQIENQLKVVKEKQN

SEQ ID NO: 78733 - protein, 15 aa, Borrelia burgdorferi
QIENQLKVVKEKQNI

SEQ ID NO: 78734 - protein, 15 aa, Borrelia burgdorferi
IENQLKVVKEKQNIE

SEQ ID NO: 78735 - protein, 15 aa, Borrelia burgdorferi
ENQLKVVKEKQNIEN

SEQ ID NO: 78736 - protein, 15 aa, Borrelia burgdorferi
NQLKVVKEKQNIENG

SEQ ID NO: 78737 - protein, 15 aa, Borrelia burgdorferi
QLKVVKEKQNIENGG

SEQ ID NO: 78738 - protein, 15 aa, Borrelia burgdorferi
LKVVKEKQNIENGGE

SEQ ID NO: 78739 - protein, 15 aa, Borrelia burgdorferi
KVVKEKQNIENGGEK

SEQ ID NO: 78740 - protein, 15 aa, Borrelia burgdorferi
VVKEKQNIENGGEKK

SEQ ID NO: 78741 - protein, 15 aa, Borrelia burgdorferi
VKEKQNIENGGEKKN

SEQ ID NO: 78742 - protein, 15 aa, Borrelia burgdorferi
KEKQNIENGGEKKNN

SEQ ID NO: 78743 - protein, 15 aa, Borrelia burgdorferi
EKQNIENGGEKKNNK

SEQ ID NO: 78744 - protein, 15 aa, Borrelia burgdorferi
KQNIENGGEKKNNKS

SEQ ID NO: 78745 - protein, 15 aa, Borrelia burgdorferi
QNIENGGEKKNNKSK

SEQ ID NO: 78746 - protein, 15 aa, Borrelia burgdorferi
NIENGGEKKNNKSKK

SEQ ID NO: 78747 - protein, 15 aa, Borrelia burgdorferi
IENGGEKKNNKSKKK

SEQ ID NO: 78748 - protein, 15 aa, Borrelia burgdorferi
ENGGEKKNNKSKKKK

SEQ ID NO: 78749 - protein, 16 aa, Borrelia burgdorferi
SIVIALFFKLLVACSI

SEQ ID NO: 78750 - protein, 16 aa, Borrelia burgdorferi
IVIALFFKLLVACSIG

SEQ ID NO: 78751 - protein, 16 aa, Borrelia burgdorferi
VIALFFKLLVACSIGL

SEQ ID NO: 78752 - protein, 16 aa, Borrelia burgdorferi
IALFFKLLVACSIGLV

SEQ ID NO: 78753 - protein, 16 aa, Borrelia burgdorferi
ALFFKLLVACSIGLVE

SEQ ID NO: 78754 - protein, 16 aa, Borrelia burgdorferi
LFFKLLVACSIGLVER

SEQ ID NO: 78755 - protein, 16 aa, Borrelia burgdorferi
FFKLLVACSIGLVERT

SEQ ID NO: 78756 - protein, 16 aa, Borrelia burgdorferi
FKLLVACSIGLVERTN

SEQ ID NO: 78757 - protein, 16 aa, Borrelia burgdorferi
KLLVACSIGLVERTNA

SEQ ID NO: 78758 - protein, 16 aa, Borrelia burgdorferi
LLVACSIGLVERTNAA

SEQ ID NO: 78759 - protein, 16 aa, Borrelia burgdorferi
LVACSIGLVERTNAAL

SEQ ID NO: 78760 - protein, 16 aa, Borrelia burgdorferi
VACSIGLVERTNAALE

SEQ ID NO: 78761 - protein, 16 aa, Borrelia burgdorferi
ACSIGLVERTNAALES

SEQ ID NO: 78762 - protein, 16 aa, Borrelia burgdorferi
CSIGLVERTNAALESS

SEQ ID NO: 78763 - protein, 16 aa, Borrelia burgdorferi
SIGLVERTNAALESSS

SEQ ID NO: 78764 - protein, 16 aa, Borrelia burgdorferi
IGLVERTNAALESSSK

SEQ ID NO: 78765 - protein, 16 aa, Borrelia burgdorferi
GLVERTNAALESSSKD

SEQ ID NO: 78766 - protein, 16 aa, Borrelia burgdorferi
LVERTNAALESSSKDL

SEQ ID NO: 78767 - protein, 16 aa, Borrelia burgdorferi
VERTNAALESSSKDLK

SEQ ID NO: 78768 - protein, 16 aa, Borrelia burgdorferi
ERTNAALESSSKDLKN

SEQ ID NO: 78769 - protein, 16 aa, Borrelia burgdorferi
RTNAALESSSKDLKNK

SEQ ID NO: 78770 - protein, 16 aa, Borrelia burgdorferi
TNAALESSSKDLKNKI

SEQ ID NO: 78771 - protein, 16 aa, Borrelia burgdorferi
NAALESSSKDLKNKIL

SEQ ID NO: 78772 - protein, 16 aa, Borrelia burgdorferi
AALESSSKDLKNKILK

SEQ ID NO: 78773 - protein, 16 aa, Borrelia burgdorferi
ALESSSKDLKNKILKI

SEQ ID NO: 78774 - protein, 16 aa, Borrelia burgdorferi
LESSSKDLKNKILKIK

SEQ ID NO: 78775 - protein, 16 aa, Borrelia burgdorferi
ESSSKDLKNKILKIKK

SEQ ID NO: 78776 - protein, 16 aa, Borrelia burgdorferi
SSSKDLKNKILKIKKE

SEQ ID NO: 78777 - protein, 16 aa, Borrelia burgdorferi
SSKDLKNKILKIKKEA

SEQ ID NO: 78778 - protein, 16 aa, Borrelia burgdorferi
SKDLKNKILKIKKEAT

SEQ ID NO: 78779 - protein, 16 aa, Borrelia burgdorferi
KDLKNKILKIKKEATG

SEQ ID NO: 78780 - protein, 16 aa, Borrelia burgdorferi
DLKNKILKIKKEATGK

SEQ ID NO: 78781 - protein, 16 aa, Borrelia burgdorferi
LKNKILKIKKEATGKG

SEQ ID NO: 78782 - protein, 16 aa, Borrelia burgdorferi
KNKILKIKKEATGKGV

SEQ ID NO: 78783 - protein, 16 aa, Borrelia burgdorferi
NKILKIKKEATGKGVL

SEQ ID NO: 78784 - protein, 16 aa, Borrelia burgdorferi
KILKIKKEATGKGVLF

SEQ ID NO: 78785 - protein, 16 aa, Borrelia burgdorferi
ILKIKKEATGKGVLFE

SEQ ID NO: 78786 - protein, 16 aa, Borrelia burgdorferi
LKIKKEATGKGVLFEA

SEQ ID NO: 78787 - protein, 16 aa, Borrelia burgdorferi
KIKKEATGKGVLFEAF

SEQ ID NO: 78788 - protein, 16 aa, Borrelia burgdorferi
IKKEATGKGVLFEAFT

SEQ ID NO: 78789 - protein, 16 aa, Borrelia burgdorferi
KKEATGKGVLFEAFTG

SEQ ID NO: 78790 - protein, 16 aa, Borrelia burgdorferi
KEATGKGVLFEAFTGL

SEQ ID NO: 78791 - protein, 16 aa, Borrelia burgdorferi
EATGKGVLFEAFTGLK

SEQ ID NO: 78792 - protein, 16 aa, Borrelia burgdorferi
ATGKGVLFEAFTGLKT

SEQ ID NO: 78793 - protein, 16 aa, Borrelia burgdorferi
TGKGVLFEAFTGLKTG

SEQ ID NO: 78794 - protein, 16 aa, Borrelia burgdorferi
GKGVLFEAFTGLKTGS

SEQ ID NO: 78795 - protein, 16 aa, Borrelia burgdorferi
KGVLFEAFTGLKTGSK

SEQ ID NO: 78796 - protein, 16 aa, Borrelia burgdorferi
GVLFEAFTGLKTGSKV

SEQ ID NO: 78797 - protein, 16 aa, Borrelia burgdorferi
VLFEAFTGLKTGSKVT

SEQ ID NO: 78798 - protein, 16 aa, Borrelia burgdorferi
LFEAFTGLKTGSKVTS

SEQ ID NO: 78799 - protein, 16 aa, Borrelia burgdorferi
FEAFTGLKTGSKVTSG

SEQ ID NO: 78800 - protein, 16 aa, Borrelia burgdorferi
EAFTGLKTGSKVTSGG

SEQ ID NO: 78801 - protein, 16 aa, Borrelia burgdorferi
AFTGLKTGSKVTSGGL

SEQ ID NO: 78802 - protein, 16 aa, Borrelia burgdorferi
FTGLKTGSKVTSGGLA

SEQ ID NO: 78803 - protein, 16 aa, Borrelia burgdorferi
TGLKTGSKVTSGGLAL

SEQ ID NO: 78804 - protein, 16 aa, Borrelia burgdorferi
GLKTGSKVTSGGLALR

SEQ ID NO: 78805 - protein, 16 aa, Borrelia burgdorferi
LKTGSKVTSGGLALRE

SEQ ID NO: 78806 - protein, 16 aa, Borrelia burgdorferi
KTGSKVTSGGLALREA

SEQ ID NO: 78807 - protein, 16 aa, Borrelia burgdorferi
TGSKVTSGGLALREAK

SEQ ID NO: 78808 - protein, 16 aa, Borrelia burgdorferi
GSKVTSGGLALREAKV

SEQ ID NO: 78809 - protein, 16 aa, Borrelia burgdorferi
SKVTSGGLALREAKVQ

SEQ ID NO: 78810 - protein, 16 aa, Borrelia burgdorferi
KVTSGGLALREAKVQA

SEQ ID NO: 78811 - protein, 16 aa, Borrelia burgdorferi
VTSGGLALREAKVQAI

SEQ ID NO: 78812 - protein, 16 aa, Borrelia burgdorferi
TSGGLALREAKVQAIV

SEQ ID NO: 78813 - protein, 16 aa, Borrelia burgdorferi
SGGLALREAKVQAIVE

SEQ ID NO: 78814 - protein, 16 aa, Borrelia burgdorferi
GGLALREAKVQAIVET

SEQ ID NO: 78815 - protein, 16 aa, Borrelia burgdorferi
GLALREAKVQAIVETG

SEQ ID NO: 78816 - protein, 16 aa, Borrelia burgdorferi
LALREAKVQAIVETGK

SEQ ID NO: 78817 - protein, 16 aa, Borrelia burgdorferi
ALREAKVQAIVETGKF

SEQ ID NO: 78818 - protein, 16 aa, Borrelia burgdorferi
LREAKVQAIVETGKFL

SEQ ID NO: 78819 - protein, 16 aa, Borrelia burgdorferi
REAKVQAIVETGKFLK

SEQ ID NO: 78820 - protein, 16 aa, Borrelia burgdorferi
EAKVQAIVETGKFLKI

SEQ ID NO: 78821 - protein, 16 aa, Borrelia burgdorferi
AKVQAIVETGKFLKII

SEQ ID NO: 78822 - protein, 16 aa, Borrelia burgdorferi
KVQAIVETGKFLKIIE

SEQ ID NO: 78823 - protein, 16 aa, Borrelia burgdorferi
VQAIVETGKFLKIIEE

SEQ ID NO: 78824 - protein, 16 aa, Borrelia burgdorferi
QAIVETGKFLKIIEEE

SEQ ID NO: 78825 - protein, 16 aa, Borrelia burgdorferi
AIVETGKFLKIIEEEA

SEQ ID NO: 78826 - protein, 16 aa, Borrelia burgdorferi
IVETGKFLKIIEEEAL

SEQ ID NO: 78827 - protein, 16 aa, Borrelia burgdorferi
VETGKFLKIIEEEALK

SEQ ID NO: 78828 - protein, 16 aa, Borrelia burgdorferi
ETGKFLKIIEEEALKL

SEQ ID NO: 78829 - protein, 16 aa, Borrelia burgdorferi
TGKFLKIIEEEALKLK

SEQ ID NO: 78830 - protein, 16 aa, Borrelia burgdorferi
GKFLKIIEEEALKLKE

SEQ ID NO: 78831 - protein, 16 aa, Borrelia burgdorferi
KFLKIIEEEALKLKET

SEQ ID NO: 78832 - protein, 16 aa, Borrelia burgdorferi
FLKIIEEEALKLKETG

SEQ ID NO: 78833 - protein, 16 aa, Borrelia burgdorferi
LKIIEEEALKLKETGN

SEQ ID NO: 78834 - protein, 16 aa, Borrelia burgdorferi
KIIEEEALKLKETGNS

SEQ ID NO: 78835 - protein, 16 aa, Borrelia burgdorferi
IIEEEALKLKETGNSG

SEQ ID NO: 78836 - protein, 16 aa, Borrelia burgdorferi
IEEEALKLKETGNSGQ

SEQ ID NO: 78837 - protein, 16 aa, Borrelia burgdorferi
EEEALKLKETGNSGQF

SEQ ID NO: 78838 - protein, 16 aa, Borrelia burgdorferi
EEALKLKETGNSGQFL

SEQ ID NO: 78839 - protein, 16 aa, Borrelia burgdorferi
EALKLKETGNSGQFLA

SEQ ID NO: 78840 - protein, 16 aa, Borrelia burgdorferi
ALKLKETGNSGQFLAM

SEQ ID NO: 78841 - protein, 16 aa, Borrelia burgdorferi
LKLKETGNSGQFLAMF

SEQ ID NO: 78842 - protein, 16 aa, Borrelia burgdorferi
KLKETGNSGQFLAMFD

SEQ ID NO: 78843 - protein, 16 aa, Borrelia burgdorferi
LKETGNSGQFLAMFDL

SEQ ID NO: 78844 - protein, 16 aa, Borrelia burgdorferi
KETGNSGQFLAMFDLM

SEQ ID NO: 78845 - protein, 16 aa, Borrelia burgdorferi
ETGNSGQFLAMFDLML

SEQ ID NO: 78846 - protein, 16 aa, Borrelia burgdorferi
TGNSGQFLAMFDLMLE

SEQ ID NO: 78847 - protein, 16 aa, Borrelia burgdorferi
GNSGQFLAMFDLMLEV

SEQ ID NO: 78848 - protein, 16 aa, Borrelia burgdorferi
NSGQFLAMFDLMLEVV

SEQ ID NO: 78849 - protein, 16 aa, Borrelia burgdorferi
SGQFLAMFDLMLEVVE

SEQ ID NO: 78850 - protein, 16 aa, Borrelia burgdorferi
GQFLAMFDLMLEVVES

SEQ ID NO: 78851 - protein, 16 aa, Borrelia burgdorferi
QFLAMFDLMLEVVESL

SEQ ID NO: 78852 - protein, 16 aa, Borrelia burgdorferi
FLAMFDLMLEVVESLE

SEQ ID NO: 78853 - protein, 16 aa, Borrelia burgdorferi
LAMFDLMLEVVESLED

SEQ ID NO: 78854 - protein, 16 aa, Borrelia burgdorferi
AMFDLMLEVVESLEDV

SEQ ID NO: 78855 - protein, 16 aa, Borrelia burgdorferi
MFDLMLEVVESLEDVG

SEQ ID NO: 78856 - protein, 16 aa, Borrelia burgdorferi
FDLMLEVVESLEDVGI

SEQ ID NO: 78857 - protein, 16 aa, Borrelia burgdorferi
DLMLEVVESLEDVGII

SEQ ID NO: 78858 - protein, 16 aa, Borrelia burgdorferi
LMLEVVESLEDVGIIG

SEQ ID NO: 78859 - protein, 16 aa, Borrelia burgdorferi
MLEVVESLEDVGIIGL

SEQ ID NO: 78860 - protein, 16 aa, Borrelia burgdorferi
LEVVESLEDVGIIGLK

SEQ ID NO: 78861 - protein, 16 aa, Borrelia burgdorferi
EVVESLEDVGIIGLKA

SEQ ID NO: 78862 - protein, 16 aa, Borrelia burgdorferi
VVESLEDVGIIGLKAR

SEQ ID NO: 78863 - protein, 16 aa, Borrelia burgdorferi
VESLEDVGIIGLKARV

SEQ ID NO: 78864 - protein, 16 aa, Borrelia burgdorferi
ESLEDVGIIGLKARVL

SEQ ID NO: 78865 - protein, 16 aa, Borrelia burgdorferi
SLEDVGIIGLKARVLE

SEQ ID NO: 78866 - protein, 16 aa, Borrelia burgdorferi
LEDVGIIGLKARVLEE

SEQ ID NO: 78867 - protein, 16 aa, Borrelia burgdorferi
EDVGIIGLKARVLEES

SEQ ID NO: 78868 - protein, 16 aa, Borrelia burgdorferi
DVGIIGLKARVLEESK

SEQ ID NO: 78869 - protein, 16 aa, Borrelia burgdorferi
VGIIGLKARVLEESKN

SEQ ID NO: 78870 - protein, 16 aa, Borrelia burgdorferi
GIIGLKARVLEESKNN

SEQ ID NO: 78871 - protein, 16 aa, Borrelia burgdorferi
IIGLKARVLEESKNNP

SEQ ID NO: 78872 - protein, 16 aa, Borrelia burgdorferi
IGLKARVLEESKNNPI

SEQ ID NO: 78873 - protein, 16 aa, Borrelia burgdorferi
GLKARVLEESKNNPIN

SEQ ID NO: 78874 - protein, 16 aa, Borrelia burgdorferi
LKARVLEESKNNPINT

SEQ ID NO: 78875 - protein, 16 aa, Borrelia burgdorferi
KARVLEESKNNPINTA

SEQ ID NO: 78876 - protein, 16 aa, Borrelia burgdorferi
ARVLEESKNNPINTAE

SEQ ID NO: 78877 - protein, 16 aa, Borrelia burgdorferi
RVLEESKNNPINTAER

SEQ ID NO: 78878 - protein, 16 aa, Borrelia burgdorferi
VLEESKNNPINTAERL

SEQ ID NO: 78879 - protein, 16 aa, Borrelia burgdorferi
LEESKNNPINTAERLL

SEQ ID NO: 78880 - protein, 16 aa, Borrelia burgdorferi
EESKNNPINTAERLLA

SEQ ID NO: 78881 - protein, 16 aa, Borrelia burgdorferi
ESKNNPINTAERLLAA

SEQ ID NO: 78882 - protein, 16 aa, Borrelia burgdorferi
SKNNPINTAERLLAAK

SEQ ID NO: 78883 - protein, 16 aa, Borrelia burgdorferi
KNNPINTAERLLAAKA

SEQ ID NO: 78884 - protein, 16 aa, Borrelia burgdorferi
NNPINTAERLLAAKAQ

SEQ ID NO: 78885 - protein, 16 aa, Borrelia burgdorferi
NPINTAERLLAAKAQI

SEQ ID NO: 78886 - protein, 16 aa, Borrelia burgdorferi
PINTAERLLAAKAQIE

SEQ ID NO: 78887 - protein, 16 aa, Borrelia burgdorferi
INTAERLLAAKAQIEN

SEQ ID NO: 78888 - protein, 16 aa, Borrelia burgdorferi
NTAERLLAAKAQIENQ

SEQ ID NO: 78889 - protein, 16 aa, Borrelia burgdorferi
TAERLLAAKAQIENQL

SEQ ID NO: 78890 - protein, 16 aa, Borrelia burgdorferi
AERLLAAKAQIENQLK

SEQ ID NO: 78891 - protein, 16 aa, Borrelia burgdorferi
ERLLAAKAQIENQLKV

SEQ ID NO: 78892 - protein, 16 aa, Borrelia burgdorferi
RLLAAKAQIENQLKVV

SEQ ID NO: 78893 - protein, 16 aa, Borrelia burgdorferi
LLAAKAQIENQLKVVK

SEQ ID NO: 78894 - protein, 16 aa, Borrelia burgdorferi
LAAKAQIENQLKVVKE

SEQ ID NO: 78895 - protein, 16 aa, Borrelia burgdorferi
AAKAQIENQLKVVKEK

SEQ ID NO: 78896 - protein, 16 aa, Borrelia burgdorferi
AKAQIENQLKVVKEKQ

SEQ ID NO: 78897 - protein, 16 aa, Borrelia burgdorferi
KAQIENQLKVVKEKQN

SEQ ID NO: 78898 - protein, 16 aa, Borrelia burgdorferi
AQIENQLKVVKEKQNI

SEQ ID NO: 78899 - protein, 16 aa, Borrelia burgdorferi
QIENQLKVVKEKQNIE

SEQ ID NO: 78900 - protein, 16 aa, Borrelia burgdorferi
IENQLKVVKEKQNIEN

SEQ ID NO: 78901 - protein, 16 aa, Borrelia burgdorferi
ENQLKVVKEKQNIENG

SEQ ID NO: 78902 - protein, 16 aa, Borrelia burgdorferi
NQLKVVKEKQNIENGG

SEQ ID NO: 78903 - protein, 16 aa, Borrelia burgdorferi
QLKVVKEKQNIENGGE

SEQ ID NO: 78904 - protein, 16 aa, Borrelia burgdorferi
LKVVKEKQNIENGGEK

SEQ ID NO: 78905 - protein, 16 aa, Borrelia burgdorferi
KVVKEKQNIENGGEKK

SEQ ID NO: 78906 - protein, 16 aa, Borrelia burgdorferi
VVKEKQNIENGGEKKN

SEQ ID NO: 78907 - protein, 16 aa, Borrelia burgdorferi
VKEKQNIENGGEKKNN

SEQ ID NO: 78908 - protein, 16 aa, Borrelia burgdorferi
KEKQNIENGGEKKNNK

SEQ ID NO: 78909 - protein, 16 aa, Borrelia burgdorferi
EKQNIENGGEKKNNKS

SEQ ID NO: 78910 - protein, 16 aa, Borrelia burgdorferi
KQNIENGGEKKNNKSK

SEQ ID NO: 78911 - protein, 16 aa, Borrelia burgdorferi
QNIENGGEKKNNKSKK

SEQ ID NO: 78912 - protein, 16 aa, Borrelia burgdorferi
NIENGGEKKNNKSKKK

SEQ ID NO: 78913 - protein, 16 aa, Borrelia burgdorferi
IENGGEKKNNKSKKKK

SEQ ID NO: 78914 - protein, 13 aa, Borrelia burgdorferi B31
MILIFYFKQIALF

SEQ ID NO: 78915 - protein, 13 aa, Borrelia burgdorferi B31
ILIFYFKQIALFI

SEQ ID NO: 78916 - protein, 13 aa, Borrelia burgdorferi B31
LIFYFKQIALFII

SEQ ID NO: 78917 - protein, 13 aa, Borrelia burgdorferi B31
IFYFKQIALFIIF

SEQ ID NO: 78918 - protein, 13 aa, Borrelia burgdorferi B31
FYFKQIALFIIFR

SEQ ID NO: 78919 - protein, 13 aa, Borrelia burgdorferi B31
YFKQIALFIIFRL

SEQ ID NO: 78920 - protein, 13 aa, Borrelia burgdorferi B31
FKQIALFIIFRLC

SEQ ID NO: 78921 - protein, 13 aa, Borrelia burgdorferi B31
KQIALFIIFRLCY

SEQ ID NO: 78922 - protein, 13 aa, Borrelia burgdorferi B31
QIALFIIFRLCYI

SEQ ID NO: 78923 - protein, 13 aa, Borrelia burgdorferi B31
IALFIIFRLCYII

SEQ ID NO: 78924 - protein, 13 aa, Borrelia burgdorferi B31
ALFIIFRLCYIIK

SEQ ID NO: 78925 - protein, 13 aa, Borrelia burgdorferi B31
LFIIFRLCYIIKK

SEQ ID NO: 78926 - protein, 13 aa, Borrelia burgdorferi B31
FIIFRLCYIIKKV

SEQ ID NO: 78927 - protein, 13 aa, Borrelia burgdorferi B31
IIFRLCYIIKKVK

SEQ ID NO: 78928 - protein, 13 aa, Borrelia burgdorferi B31
IFRLCYIIKKVKI

SEQ ID NO: 78929 - protein, 13 aa, Borrelia burgdorferi B31
FRLCYIIKKVKIK

SEQ ID NO: 78930 - protein, 13 aa, Borrelia burgdorferi B31
RLCYIIKKVKIKL

SEQ ID NO: 78931 - protein, 13 aa, Borrelia burgdorferi B31
LCYIIKKVKIKLK

SEQ ID NO: 78932 - protein, 13 aa, Borrelia burgdorferi B31
CYIIKKVKIKLKR

SEQ ID NO: 78933 - protein, 13 aa, Borrelia burgdorferi B31
YIIKKVKIKLKRK

SEQ ID NO: 78934 - protein, 13 aa, Borrelia burgdorferi B31
IIKKVKIKLKRKS

SEQ ID NO: 78935 - protein, 13 aa, Borrelia burgdorferi B31
IKKVKIKLKRKSC

SEQ ID NO: 78936 - protein, 13 aa, Borrelia burgdorferi B31
KKVKIKLKRKSCM

SEQ ID NO: 78937 - protein, 13 aa, Borrelia burgdorferi B31
KVKIKLKRKSCMK

SEQ ID NO: 78938 - protein, 13 aa, Borrelia burgdorferi B31
VKIKLKRKSCMKK

SEQ ID NO: 78939 - protein, 13 aa, Borrelia burgdorferi B31
KIKLKRKSCMKKQ

SEQ ID NO: 78940 - protein, 13 aa, Borrelia burgdorferi B31
IKLKRKSCMKKQF

SEQ ID NO: 78941 - protein, 13 aa, Borrelia burgdorferi B31
KLKRKSCMKKQFD

SEQ ID NO: 78942 - protein, 13 aa, Borrelia burgdorferi B31
LKRKSCMKKQFDT

SEQ ID NO: 78943 - protein, 13 aa, Borrelia burgdorferi B31
KRKSCMKKQFDTE

SEQ ID NO: 78944 - protein, 13 aa, Borrelia burgdorferi B31
RKSCMKKQFDTEV

SEQ ID NO: 78945 - protein, 13 aa, Borrelia burgdorferi B31
KSCMKKQFDTEVN

SEQ ID NO: 78946 - protein, 13 aa, Borrelia burgdorferi B31
SCMKKQFDTEVND

SEQ ID NO: 78947 - protein, 13 aa, Borrelia burgdorferi B31
CMKKQFDTEVNDL

SEQ ID NO: 78948 - protein, 13 aa, Borrelia burgdorferi B31
MKKQFDTEVNDLL

SEQ ID NO: 78949 - protein, 13 aa, Borrelia burgdorferi B31
KKQFDTEVNDLLY

SEQ ID NO: 78950 - protein, 13 aa, Borrelia burgdorferi B31
KQFDTEVNDLLYL

SEQ ID NO: 78951 - protein, 13 aa, Borrelia burgdorferi B31
QFDTEVNDLLYLI

SEQ ID NO: 78952 - protein, 13 aa, Borrelia burgdorferi B31
FDTEVNDLLYLII

SEQ ID NO: 78953 - protein, 13 aa, Borrelia burgdorferi B31
DTEVNDLLYLIIH

SEQ ID NO: 78954 - protein, 13 aa, Borrelia burgdorferi B31
TEVNDLLYLIIHS

SEQ ID NO: 78955 - protein, 13 aa, Borrelia burgdorferi B31
EVNDLLYLIIHSL

SEQ ID NO: 78956 - protein, 13 aa, Borrelia burgdorferi B31
VNDLLYLIIHSLY

SEQ ID NO: 78957 - protein, 13 aa, Borrelia burgdorferi B31
NDLLYLIIHSLYS

SEQ ID NO: 78958 - protein, 13 aa, Borrelia burgdorferi B31
DLLYLIIHSLYSH

SEQ ID NO: 78959 - protein, 13 aa, Borrelia burgdorferi B31
LLYLIIHSLYSHK

SEQ ID NO: 78960 - protein, 13 aa, Borrelia burgdorferi B31
LYLIIHSLYSHKE

SEQ ID NO: 78961 - protein, 13 aa, Borrelia burgdorferi B31
YLIIHSLYSHKEI

SEQ ID NO: 78962 - protein, 13 aa, Borrelia burgdorferi B31
LIIHSLYSHKEIF

SEQ ID NO: 78963 - protein, 13 aa, Borrelia burgdorferi B31
IIHSLYSHKEIFL

SEQ ID NO: 78964 - protein, 13 aa, Borrelia burgdorferi B31
IHSLYSHKEIFLR

SEQ ID NO: 78965 - protein, 13 aa, Borrelia burgdorferi B31
HSLYSHKEIFLRE

SEQ ID NO: 78966 - protein, 13 aa, Borrelia burgdorferi B31
SLYSHKEIFLREL

SEQ ID NO: 78967 - protein, 13 aa, Borrelia burgdorferi B31
LYSHKEIFLRELI

SEQ ID NO: 78968 - protein, 13 aa, Borrelia burgdorferi B31
YSHKEIFLRELIS

SEQ ID NO: 78969 - protein, 13 aa, Borrelia burgdorferi B31
SHKEIFLRELISN

SEQ ID NO: 78970 - protein, 13 aa, Borrelia burgdorferi B31
HKEIFLRELISNA

SEQ ID NO: 78971 - protein, 13 aa, Borrelia burgdorferi B31
KEIFLRELISNAS

SEQ ID NO: 78972 - protein, 13 aa, Borrelia burgdorferi B31
EIFLRELISNASD

SEQ ID NO: 78973 - protein, 13 aa, Borrelia burgdorferi B31
IFLRELISNASDA

SEQ ID NO: 78974 - protein, 13 aa, Borrelia burgdorferi B31
FLRELISNASDAI

SEQ ID NO: 78975 - protein, 13 aa, Borrelia burgdorferi B31
LRELISNASDAID

SEQ ID NO: 78976 - protein, 13 aa, Borrelia burgdorferi B31
RELISNASDAIDK

SEQ ID NO: 78977 - protein, 13 aa, Borrelia burgdorferi B31
ELISNASDAIDKL

SEQ ID NO: 78978 - protein, 13 aa, Borrelia burgdorferi B31
LISNASDAIDKLK

SEQ ID NO: 78979 - protein, 13 aa, Borrelia burgdorferi B31
ISNASDAIDKLKF

SEQ ID NO: 78980 - protein, 13 aa, Borrelia burgdorferi B31
SNASDAIDKLKFL

SEQ ID NO: 78981 - protein, 13 aa, Borrelia burgdorferi B31
NASDAIDKLKFLS

SEQ ID NO: 78982 - protein, 13 aa, Borrelia burgdorferi B31
ASDAIDKLKFLSL

SEQ ID NO: 78983 - protein, 13 aa, Borrelia burgdorferi B31
SDAIDKLKFLSLT

SEQ ID NO: 78984 - protein, 13 aa, Borrelia burgdorferi B31
DAIDKLKFLSLTN

SEQ ID NO: 78985 - protein, 13 aa, Borrelia burgdorferi B31
AIDKLKFLSLTNE

SEQ ID NO: 78986 - protein, 13 aa, Borrelia burgdorferi B31
IDKLKFLSLTNEK

SEQ ID NO: 78987 - protein, 13 aa, Borrelia burgdorferi B31
DKLKFLSLTNEKF

SEQ ID NO: 78988 - protein, 13 aa, Borrelia burgdorferi B31
KLKFLSLTNEKFK

SEQ ID NO: 78989 - protein, 13 aa, Borrelia burgdorferi B31
LKFLSLTNEKFKN

SEQ ID NO: 78990 - protein, 13 aa, Borrelia burgdorferi B31
KFLSLTNEKFKNI

SEQ ID NO: 78991 - protein, 13 aa, Borrelia burgdorferi B31
FLSLTNEKFKNIA

SEQ ID NO: 78992 - protein, 13 aa, Borrelia burgdorferi B31
LSLTNEKFKNIAL

SEQ ID NO: 78993 - protein, 13 aa, Borrelia burgdorferi B31
SLTNEKFKNIALE

SEQ ID NO: 78994 - protein, 13 aa, Borrelia burgdorferi B31
LTNEKFKNIALEP

SEQ ID NO: 78995 - protein, 13 aa, Borrelia burgdorferi B31
TNEKFKNIALEPK

SEQ ID NO: 78996 - protein, 13 aa, Borrelia burgdorferi B31
NEKFKNIALEPKI

SEQ ID NO: 78997 - protein, 13 aa, Borrelia burgdorferi B31
EKFKNIALEPKIE

SEQ ID NO: 78998 - protein, 13 aa, Borrelia burgdorferi B31
KFKNIALEPKIEI

SEQ ID NO: 78999 - protein, 13 aa, Borrelia burgdorferi B31
FKNIALEPKIEIS

SEQ ID NO: 79000 - protein, 13 aa, Borrelia burgdorferi B31
KNIALEPKIEISF

SEQ ID NO: 79001 - protein, 13 aa, Borrelia burgdorferi B31
NIALEPKIEISFD

SEQ ID NO: 79002 - protein, 13 aa, Borrelia burgdorferi B31
IALEPKIEISFDD

SEQ ID NO: 79003 - protein, 13 aa, Borrelia burgdorferi B31
ALEPKIEISFDDK

SEQ ID NO: 79004 - protein, 13 aa, Borrelia burgdorferi B31
LEPKIEISFDDKS

SEQ ID NO: 79005 - protein, 13 aa, Borrelia burgdorferi B31
EPKIEISFDDKSI

SEQ ID NO: 79006 - protein, 13 aa, Borrelia burgdorferi B31
PKIEISFDDKSIL

SEQ ID NO: 79007 - protein, 13 aa, Borrelia burgdorferi B31
KIEISFDDKSILI

SEQ ID NO: 79008 - protein, 13 aa, Borrelia burgdorferi B31
IEISFDDKSILIK

SEQ ID NO: 79009 - protein, 13 aa, Borrelia burgdorferi B31
EISFDDKSILIKD

SEQ ID NO: 79010 - protein, 13 aa, Borrelia burgdorferi B31
ISFDDKSILIKDN

SEQ ID NO: 79011 - protein, 13 aa, Borrelia burgdorferi B31
SFDDKSILIKDNG

SEQ ID NO: 79012 - protein, 13 aa, Borrelia burgdorferi B31
FDDKSILIKDNGI

SEQ ID NO: 79013 - protein, 13 aa, Borrelia burgdorferi B31
DDKSILIKDNGIG

SEQ ID NO: 79014 - protein, 13 aa, Borrelia burgdorferi B31
DKSILIKDNGIGM

SEQ ID NO: 79015 - protein, 13 aa, Borrelia burgdorferi B31
KSILIKDNGIGMD

SEQ ID NO: 79016 - protein, 13 aa, Borrelia burgdorferi B31
SILIKDNGIGMDE

SEQ ID NO: 79017 - protein, 13 aa, Borrelia burgdorferi B31
ILIKDNGIGMDEQ

SEQ ID NO: 79018 - protein, 13 aa, Borrelia burgdorferi B31
LIKDNGIGMDEQD

SEQ ID NO: 79019 - protein, 13 aa, Borrelia burgdorferi B31
IKDNGIGMDEQDL

SEQ ID NO: 79020 - protein, 13 aa, Borrelia burgdorferi B31
KDNGIGMDEQDLT

SEQ ID NO: 79021 - protein, 13 aa, Borrelia burgdorferi B31
DNGIGMDEQDLTN

SEQ ID NO: 79022 - protein, 13 aa, Borrelia burgdorferi B31
NGIGMDEQDLTNH

SEQ ID NO: 79023 - protein, 13 aa, Borrelia burgdorferi B31
GIGMDEQDLTNHL

SEQ ID NO: 79024 - protein, 13 aa, Borrelia burgdorferi B31
IGMDEQDLTNHLG

SEQ ID NO: 79025 - protein, 13 aa, Borrelia burgdorferi B31
GMDEQDLTNHLGV

SEQ ID NO: 79026 - protein, 13 aa, Borrelia burgdorferi B31
MDEQDLTNHLGVI

SEQ ID NO: 79027 - protein, 13 aa, Borrelia burgdorferi B31
DEQDLTNHLGVIA

SEQ ID NO: 79028 - protein, 13 aa, Borrelia burgdorferi B31
EQDLTNHLGVIAK

SEQ ID NO: 79029 - protein, 13 aa, Borrelia burgdorferi B31
QDLTNHLGVIAKS

SEQ ID NO: 79030 - protein, 13 aa, Borrelia burgdorferi B31
DLTNHLGVIAKSG

SEQ ID NO: 79031 - protein, 13 aa, Borrelia burgdorferi B31
LTNHLGVIAKSGT

SEQ ID NO: 79032 - protein, 13 aa, Borrelia burgdorferi B31
TNHLGVIAKSGTK

SEQ ID NO: 79033 - protein, 13 aa, Borrelia burgdorferi B31
NHLGVIAKSGTKE

SEQ ID NO: 79034 - protein, 13 aa, Borrelia burgdorferi B31
HLGVIAKSGTKEF

SEQ ID NO: 79035 - protein, 13 aa, Borrelia burgdorferi B31
LGVIAKSGTKEFI

SEQ ID NO: 79036 - protein, 13 aa, Borrelia burgdorferi B31
GVIAKSGTKEFIN

SEQ ID NO: 79037 - protein, 13 aa, Borrelia burgdorferi B31
VIAKSGTKEFINN

SEQ ID NO: 79038 - protein, 13 aa, Borrelia burgdorferi B31
IAKSGTKEFINNL

SEQ ID NO: 79039 - protein, 13 aa, Borrelia burgdorferi B31
AKSGTKEFINNLK

SEQ ID NO: 79040 - protein, 13 aa, Borrelia burgdorferi B31
KSGTKEFINNLKQ

SEQ ID NO: 79041 - protein, 13 aa, Borrelia burgdorferi B31
SGTKEFINNLKQD

SEQ ID NO: 79042 - protein, 13 aa, Borrelia burgdorferi B31
GTKEFINNLKQDE

SEQ ID NO: 79043 - protein, 13 aa, Borrelia burgdorferi B31
TKEFINNLKQDEK

SEQ ID NO: 79044 - protein, 13 aa, Borrelia burgdorferi B31
KEFINNLKQDEKK

SEQ ID NO: 79045 - protein, 13 aa, Borrelia burgdorferi B31
EFINNLKQDEKKS

SEQ ID NO: 79046 - protein, 13 aa, Borrelia burgdorferi B31
FINNLKQDEKKSA

SEQ ID NO: 79047 - protein, 13 aa, Borrelia burgdorferi B31
INNLKQDEKKSAS

SEQ ID NO: 79048 - protein, 13 aa, Borrelia burgdorferi B31
NNLKQDEKKSASL

SEQ ID NO: 79049 - protein, 13 aa, Borrelia burgdorferi B31
NLKQDEKKSASLI

SEQ ID NO: 79050 - protein, 13 aa, Borrelia burgdorferi B31
LKQDEKKSASLIG

SEQ ID NO: 79051 - protein, 13 aa, Borrelia burgdorferi B31
KQDEKKSASLIGQ

SEQ ID NO: 79052 - protein, 13 aa, Borrelia burgdorferi B31
QDEKKSASLIGQF

SEQ ID NO: 79053 - protein, 13 aa, Borrelia burgdorferi B31
DEKKSASLIGQFG

SEQ ID NO: 79054 - protein, 13 aa, Borrelia burgdorferi B31
EKKSASLIGQFGV

SEQ ID NO: 79055 - protein, 13 aa, Borrelia burgdorferi B31
KKSASLIGQFGVG

SEQ ID NO: 79056 - protein, 13 aa, Borrelia burgdorferi B31
KSASLIGQFGVGF

SEQ ID NO: 79057 - protein, 13 aa, Borrelia burgdorferi B31
SASLIGQFGVGFY

SEQ ID NO: 79058 - protein, 13 aa, Borrelia burgdorferi B31
ASLIGQFGVGFYS

SEQ ID NO: 79059 - protein, 13 aa, Borrelia burgdorferi B31
SLIGQFGVGFYSA

SEQ ID NO: 79060 - protein, 13 aa, Borrelia burgdorferi B31
LIGQFGVGFYSAF

SEQ ID NO: 79061 - protein, 13 aa, Borrelia burgdorferi B31
IGQFGVGFYSAFI

SEQ ID NO: 79062 - protein, 13 aa, Borrelia burgdorferi B31
GQFGVGFYSAFIV

SEQ ID NO: 79063 - protein, 13 aa, Borrelia burgdorferi B31
QFGVGFYSAFIVS

SEQ ID NO: 79064 - protein, 13 aa, Borrelia burgdorferi B31
FGVGFYSAFIVSE

SEQ ID NO: 79065 - protein, 13 aa, Borrelia burgdorferi B31
GVGFYSAFIVSEK

SEQ ID NO: 79066 - protein, 13 aa, Borrelia burgdorferi B31
VGFYSAFIVSEKV

SEQ ID NO: 79067 - protein, 13 aa, Borrelia burgdorferi B31
GFYSAFIVSEKVE

SEQ ID NO: 79068 - protein, 13 aa, Borrelia burgdorferi B31
FYSAFIVSEKVEV

SEQ ID NO: 79069 - protein, 13 aa, Borrelia burgdorferi B31
YSAFIVSEKVEVT

SEQ ID NO: 79070 - protein, 13 aa, Borrelia burgdorferi B31
SAFIVSEKVEVTS

SEQ ID NO: 79071 - protein, 13 aa, Borrelia burgdorferi B31
AFIVSEKVEVTSK

SEQ ID NO: 79072 - protein, 13 aa, Borrelia burgdorferi B31
FIVSEKVEVTSKK

SEQ ID NO: 79073 - protein, 13 aa, Borrelia burgdorferi B31
IVSEKVEVTSKKA

SEQ ID NO: 79074 - protein, 13 aa, Borrelia burgdorferi B31
VSEKVEVTSKKAL

SEQ ID NO: 79075 - protein, 13 aa, Borrelia burgdorferi B31
SEKVEVTSKKALE

SEQ ID NO: 79076 - protein, 13 aa, Borrelia burgdorferi B31
EKVEVTSKKALES

SEQ ID NO: 79077 - protein, 13 aa, Borrelia burgdorferi B31
KVEVTSKKALESD

SEQ ID NO: 79078 - protein, 13 aa, Borrelia burgdorferi B31
VEVTSKKALESDA

SEQ ID NO: 79079 - protein, 13 aa, Borrelia burgdorferi B31
EVTSKKALESDAY

SEQ ID NO: 79080 - protein, 13 aa, Borrelia burgdorferi B31
VTSKKALESDAYI

SEQ ID NO: 79081 - protein, 13 aa, Borrelia burgdorferi B31
TSKKALESDAYIW

SEQ ID NO: 79082 - protein, 13 aa, Borrelia burgdorferi B31
SKKALESDAYIWS

SEQ ID NO: 79083 - protein, 13 aa, Borrelia burgdorferi B31
KKALESDAYIWSS

SEQ ID NO: 79084 - protein, 13 aa, Borrelia burgdorferi B31
KALESDAYIWSSD

SEQ ID NO: 79085 - protein, 13 aa, Borrelia burgdorferi B31
ALESDAYIWSSDG

SEQ ID NO: 79086 - protein, 13 aa, Borrelia burgdorferi B31
LESDAYIWSSDGK

SEQ ID NO: 79087 - protein, 13 aa, Borrelia burgdorferi B31
ESDAYIWSSDGKT

SEQ ID NO: 79088 - protein, 13 aa, Borrelia burgdorferi B31
SDAYIWSSDGKTG

SEQ ID NO: 79089 - protein, 13 aa, Borrelia burgdorferi B31
DAYIWSSDGKTGY

SEQ ID NO: 79090 - protein, 13 aa, Borrelia burgdorferi B31
AYIWSSDGKTGYE

SEQ ID NO: 79091 - protein, 13 aa, Borrelia burgdorferi B31
YIWSSDGKTGYEI

SEQ ID NO: 79092 - protein, 13 aa, Borrelia burgdorferi B31
IWSSDGKTGYEIE

SEQ ID NO: 79093 - protein, 13 aa, Borrelia burgdorferi B31
WSSDGKTGYEIEK

SEQ ID NO: 79094 - protein, 13 aa, Borrelia burgdorferi B31
SSDGKTGYEIEKA

SEQ ID NO: 79095 - protein, 13 aa, Borrelia burgdorferi B31
SDGKTGYEIEKAK

SEQ ID NO: 79096 - protein, 13 aa, Borrelia burgdorferi B31
DGKTGYEIEKAKK

SEQ ID NO: 79097 - protein, 13 aa, Borrelia burgdorferi B31
GKTGYEIEKAKKE

SEQ ID NO: 79098 - protein, 13 aa, Borrelia burgdorferi B31
KTGYEIEKAKKEE

SEQ ID NO: 79099 - protein, 13 aa, Borrelia burgdorferi B31
TGYEIEKAKKEES

SEQ ID NO: 79100 - protein, 13 aa, Borrelia burgdorferi B31
GYEIEKAKKEESG

SEQ ID NO: 79101 - protein, 13 aa, Borrelia burgdorferi B31
YEIEKAKKEESGT

SEQ ID NO: 79102 - protein, 13 aa, Borrelia burgdorferi B31
EIEKAKKEESGTE

SEQ ID NO: 79103 - protein, 13 aa, Borrelia burgdorferi B31
IEKAKKEESGTEI

SEQ ID NO: 79104 - protein, 13 aa, Borrelia burgdorferi B31
EKAKKEESGTEIK

SEQ ID NO: 79105 - protein, 13 aa, Borrelia burgdorferi B31
KAKKEESGTEIKL

SEQ ID NO: 79106 - protein, 13 aa, Borrelia burgdorferi B31
AKKEESGTEIKLY

SEQ ID NO: 79107 - protein, 13 aa, Borrelia burgdorferi B31
KKEESGTEIKLYL

SEQ ID NO: 79108 - protein, 13 aa, Borrelia burgdorferi B31
KEESGTEIKLYLN

SEQ ID NO: 79109 - protein, 13 aa, Borrelia burgdorferi B31
EESGTEIKLYLNK

SEQ ID NO: 79110 - protein, 13 aa, Borrelia burgdorferi B31
ESGTEIKLYLNKE

SEQ ID NO: 79111 - protein, 13 aa, Borrelia burgdorferi B31
SGTEIKLYLNKEG

SEQ ID NO: 79112 - protein, 13 aa, Borrelia burgdorferi B31
GTEIKLYLNKEGL

SEQ ID NO: 79113 - protein, 13 aa, Borrelia burgdorferi B31
TEIKLYLNKEGLE

SEQ ID NO: 79114 - protein, 13 aa, Borrelia burgdorferi B31
EIKLYLNKEGLEY

SEQ ID NO: 79115 - protein, 13 aa, Borrelia burgdorferi B31
IKLYLNKEGLEYA

SEQ ID NO: 79116 - protein, 13 aa, Borrelia burgdorferi B31
KLYLNKEGLEYAN

SEQ ID NO: 79117 - protein, 13 aa, Borrelia burgdorferi B31
LYLNKEGLEYANK

SEQ ID NO: 79118 - protein, 13 aa, Borrelia burgdorferi B31
YLNKEGLEYANKW

SEQ ID NO: 79119 - protein, 13 aa, Borrelia burgdorferi B31
LNKEGLEYANKWK

SEQ ID NO: 79120 - protein, 13 aa, Borrelia burgdorferi B31
NKEGLEYANKWKI

SEQ ID NO: 79121 - protein, 13 aa, Borrelia burgdorferi B31
KEGLEYANKWKIQ

SEQ ID NO: 79122 - protein, 13 aa, Borrelia burgdorferi B31
EGLEYANKWKIQE

SEQ ID NO: 79123 - protein, 13 aa, Borrelia burgdorferi B31
GLEYANKWKIQEI

SEQ ID NO: 79124 - protein, 13 aa, Borrelia burgdorferi B31
LEYANKWKIQEII

SEQ ID NO: 79125 - protein, 13 aa, Borrelia burgdorferi B31
EYANKWKIQEIIK

SEQ ID NO: 79126 - protein, 13 aa, Borrelia burgdorferi B31
YANKWKIQEIIKK

SEQ ID NO: 79127 - protein, 13 aa, Borrelia burgdorferi B31
ANKWKIQEIIKKY

SEQ ID NO: 79128 - protein, 13 aa, Borrelia burgdorferi B31
NKWKIQEIIKKYS

SEQ ID NO: 79129 - protein, 13 aa, Borrelia burgdorferi B31
KWKIQEIIKKYSN

SEQ ID NO: 79130 - protein, 13 aa, Borrelia burgdorferi B31
WKIQEIIKKYSNH

SEQ ID NO: 79131 - protein, 13 aa, Borrelia burgdorferi B31
KIQEIIKKYSNHI

SEQ ID NO: 79132 - protein, 13 aa, Borrelia burgdorferi B31
IQEIIKKYSNHIN

SEQ ID NO: 79133 - protein, 13 aa, Borrelia burgdorferi B31
QEIIKKYSNHINY

SEQ ID NO: 79134 - protein, 13 aa, Borrelia burgdorferi B31
EIIKKYSNHINYP

SEQ ID NO: 79135 - protein, 13 aa, Borrelia burgdorferi B31
IIKKYSNHINYPI

SEQ ID NO: 79136 - protein, 13 aa, Borrelia burgdorferi B31
IKKYSNHINYPIY

SEQ ID NO: 79137 - protein, 13 aa, Borrelia burgdorferi B31
KKYSNHINYPIYI

SEQ ID NO: 79138 - protein, 13 aa, Borrelia burgdorferi B31
KYSNHINYPIYIK

SEQ ID NO: 79139 - protein, 13 aa, Borrelia burgdorferi B31
YSNHINYPIYIKY

SEQ ID NO: 79140 - protein, 13 aa, Borrelia burgdorferi B31
SNHINYPIYIKYS

SEQ ID NO: 79141 - protein, 13 aa, Borrelia burgdorferi B31
NHINYPIYIKYSE

SEQ ID NO: 79142 - protein, 13 aa, Borrelia burgdorferi B31
HINYPIYIKYSEP

SEQ ID NO: 79143 - protein, 13 aa, Borrelia burgdorferi B31
INYPIYIKYSEPI

SEQ ID NO: 79144 - protein, 13 aa, Borrelia burgdorferi B31
NYPIYIKYSEPIM

SEQ ID NO: 79145 - protein, 13 aa, Borrelia burgdorferi B31
YPIYIKYSEPIMK

SEQ ID NO: 79146 - protein, 13 aa, Borrelia burgdorferi B31
PIYIKYSEPIMKD

SEQ ID NO: 79147 - protein, 13 aa, Borrelia burgdorferi B31
IYIKYSEPIMKDG

SEQ ID NO: 79148 - protein, 13 aa, Borrelia burgdorferi B31
YIKYSEPIMKDGK

SEQ ID NO: 79149 - protein, 13 aa, Borrelia burgdorferi B31
IKYSEPIMKDGKQ

SEQ ID NO: 79150 - protein, 13 aa, Borrelia burgdorferi B31
KYSEPIMKDGKQE

SEQ ID NO: 79151 - protein, 13 aa, Borrelia burgdorferi B31
YSEPIMKDGKQEG

SEQ ID NO: 79152 - protein, 13 aa, Borrelia burgdorferi B31
SEPIMKDGKQEGI

SEQ ID NO: 79153 - protein, 13 aa, Borrelia burgdorferi B31
EPIMKDGKQEGIE

SEQ ID NO: 79154 - protein, 13 aa, Borrelia burgdorferi B31
PIMKDGKQEGIEE

SEQ ID NO: 79155 - protein, 13 aa, Borrelia burgdorferi B31
IMKDGKQEGIEEK

SEQ ID NO: 79156 - protein, 13 aa, Borrelia burgdorferi B31
MKDGKQEGIEEKE

SEQ ID NO: 79157 - protein, 13 aa, Borrelia burgdorferi B31
KDGKQEGIEEKEE

SEQ ID NO: 79158 - protein, 13 aa, Borrelia burgdorferi B31
DGKQEGIEEKEEK

SEQ ID NO: 79159 - protein, 13 aa, Borrelia burgdorferi B31
GKQEGIEEKEEKL

SEQ ID NO: 79160 - protein, 13 aa, Borrelia burgdorferi B31
KQEGIEEKEEKLN

SEQ ID NO: 79161 - protein, 13 aa, Borrelia burgdorferi B31
QEGIEEKEEKLNE

SEQ ID NO: 79162 - protein, 13 aa, Borrelia burgdorferi B31
EGIEEKEEKLNET

SEQ ID NO: 79163 - protein, 13 aa, Borrelia burgdorferi B31
GIEEKEEKLNETT

SEQ ID NO: 79164 - protein, 13 aa, Borrelia burgdorferi B31
IEEKEEKLNETTA

SEQ ID NO: 79165 - protein, 13 aa, Borrelia burgdorferi B31
EEKEEKLNETTAL

SEQ ID NO: 79166 - protein, 13 aa, Borrelia burgdorferi B31
EKEEKLNETTALW

SEQ ID NO: 79167 - protein, 13 aa, Borrelia burgdorferi B31
KEEKLNETTALWT

SEQ ID NO: 79168 - protein, 13 aa, Borrelia burgdorferi B31
EEKLNETTALWTK

SEQ ID NO: 79169 - protein, 13 aa, Borrelia burgdorferi B31
EKLNETTALWTKN

SEQ ID NO: 79170 - protein, 13 aa, Borrelia burgdorferi B31
KLNETTALWTKNK

SEQ ID NO: 79171 - protein, 13 aa, Borrelia burgdorferi B31
LNETTALWTKNKS

SEQ ID NO: 79172 - protein, 13 aa, Borrelia burgdorferi B31
NETTALWTKNKSE

SEQ ID NO: 79173 - protein, 13 aa, Borrelia burgdorferi B31
ETTALWTKNKSEI

SEQ ID NO: 79174 - protein, 13 aa, Borrelia burgdorferi B31
TTALWTKNKSEIK

SEQ ID NO: 79175 - protein, 13 aa, Borrelia burgdorferi B31
TALWTKNKSEIKA

SEQ ID NO: 79176 - protein, 13 aa, Borrelia burgdorferi B31
ALWTKNKSEIKAE

SEQ ID NO: 79177 - protein, 13 aa, Borrelia burgdorferi B31
LWTKNKSEIKAEE

SEQ ID NO: 79178 - protein, 13 aa, Borrelia burgdorferi B31
WTKNKSEIKAEEY

SEQ ID NO: 79179 - protein, 13 aa, Borrelia burgdorferi B31
TKNKSEIKAEEYN

SEQ ID NO: 79180 - protein, 13 aa, Borrelia burgdorferi B31
KNKSEIKAEEYNE

SEQ ID NO: 79181 - protein, 13 aa, Borrelia burgdorferi B31
NKSEIKAEEYNEF

SEQ ID NO: 79182 - protein, 13 aa, Borrelia burgdorferi B31
KSEIKAEEYNEFY

SEQ ID NO: 79183 - protein, 13 aa, Borrelia burgdorferi B31
SEIKAEEYNEFYK

SEQ ID NO: 79184 - protein, 13 aa, Borrelia burgdorferi B31
EIKAEEYNEFYKN

SEQ ID NO: 79185 - protein, 13 aa, Borrelia burgdorferi B31
IKAEEYNEFYKNT

SEQ ID NO: 79186 - protein, 13 aa, Borrelia burgdorferi B31
KAEEYNEFYKNTT

SEQ ID NO: 79187 - protein, 13 aa, Borrelia burgdorferi B31
AEEYNEFYKNTTF

SEQ ID NO: 79188 - protein, 13 aa, Borrelia burgdorferi B31
EEYNEFYKNTTFD

SEQ ID NO: 79189 - protein, 13 aa, Borrelia burgdorferi B31
EYNEFYKNTTFDY

SEQ ID NO: 79190 - protein, 13 aa, Borrelia burgdorferi B31
YNEFYKNTTFDYE

SEQ ID NO: 79191 - protein, 13 aa, Borrelia burgdorferi B31
NEFYKNTTFDYEN

SEQ ID NO: 79192 - protein, 13 aa, Borrelia burgdorferi B31
EFYKNTTFDYENP

SEQ ID NO: 79193 - protein, 13 aa, Borrelia burgdorferi B31
FYKNTTFDYENPL

SEQ ID NO: 79194 - protein, 13 aa, Borrelia burgdorferi B31
YKNTTFDYENPLM

SEQ ID NO: 79195 - protein, 13 aa, Borrelia burgdorferi B31
KNTTFDYENPLMH

SEQ ID NO: 79196 - protein, 13 aa, Borrelia burgdorferi B31
NTTFDYENPLMHI

SEQ ID NO: 79197 - protein, 13 aa, Borrelia burgdorferi B31
TTFDYENPLMHIH

SEQ ID NO: 79198 - protein, 13 aa, Borrelia burgdorferi B31
TFDYENPLMHIHT

SEQ ID NO: 79199 - protein, 13 aa, Borrelia burgdorferi B31
FDYENPLMHIHTK

SEQ ID NO: 79200 - protein, 13 aa, Borrelia burgdorferi B31
DYENPLMHIHTKA

SEQ ID NO: 79201 - protein, 13 aa, Borrelia burgdorferi B31
YENPLMHIHTKAE

SEQ ID NO: 79202 - protein, 13 aa, Borrelia burgdorferi B31
ENPLMHIHTKAEG

SEQ ID NO: 79203 - protein, 13 aa, Borrelia burgdorferi B31
NPLMHIHTKAEGN

SEQ ID NO: 79204 - protein, 13 aa, Borrelia burgdorferi B31
PLMHIHTKAEGNL

SEQ ID NO: 79205 - protein, 13 aa, Borrelia burgdorferi B31
LMHIHTKAEGNLE

SEQ ID NO: 79206 - protein, 13 aa, Borrelia burgdorferi B31
MHIHTKAEGNLEY

SEQ ID NO: 79207 - protein, 13 aa, Borrelia burgdorferi B31
HIHTKAEGNLEYT

SEQ ID NO: 79208 - protein, 13 aa, Borrelia burgdorferi B31
IHTKAEGNLEYTN

SEQ ID NO: 79209 - protein, 13 aa, Borrelia burgdorferi B31
HTKAEGNLEYTNL

SEQ ID NO: 79210 - protein, 13 aa, Borrelia burgdorferi B31
TKAEGNLEYTNLF

SEQ ID NO: 79211 - protein, 13 aa, Borrelia burgdorferi B31
KAEGNLEYTNLFY

SEQ ID NO: 79212 - protein, 13 aa, Borrelia burgdorferi B31
AEGNLEYTNLFYV

SEQ ID NO: 79213 - protein, 13 aa, Borrelia burgdorferi B31
EGNLEYTNLFYVP

SEQ ID NO: 79214 - protein, 13 aa, Borrelia burgdorferi B31
GNLEYTNLFYVPS

SEQ ID NO: 79215 - protein, 13 aa, Borrelia burgdorferi B31
NLEYTNLFYVPSK

SEQ ID NO: 79216 - protein, 13 aa, Borrelia burgdorferi B31
LEYTNLFYVPSKA

SEQ ID NO: 79217 - protein, 13 aa, Borrelia burgdorferi B31
EYTNLFYVPSKAP

SEQ ID NO: 79218 - protein, 13 aa, Borrelia burgdorferi B31
YTNLFYVPSKAPY

SEQ ID NO: 79219 - protein, 13 aa, Borrelia burgdorferi B31
TNLFYVPSKAPYD

SEQ ID NO: 79220 - protein, 13 aa, Borrelia burgdorferi B31
NLFYVPSKAPYDL

SEQ ID NO: 79221 - protein, 13 aa, Borrelia burgdorferi B31
LFYVPSKAPYDLY

SEQ ID NO: 79222 - protein, 13 aa, Borrelia burgdorferi B31
FYVPSKAPYDLYY

SEQ ID NO: 79223 - protein, 13 aa, Borrelia burgdorferi B31
YVPSKAPYDLYYP

SEQ ID NO: 79224 - protein, 13 aa, Borrelia burgdorferi B31
VPSKAPYDLYYPN

SEQ ID NO: 79225 - protein, 13 aa, Borrelia burgdorferi B31
PSKAPYDLYYPNT

SEQ ID NO: 79226 - protein, 13 aa, Borrelia burgdorferi B31
SKAPYDLYYPNTK

SEQ ID NO: 79227 - protein, 13 aa, Borrelia burgdorferi B31
KAPYDLYYPNTKP

SEQ ID NO: 79228 - protein, 13 aa, Borrelia burgdorferi B31
APYDLYYPNTKPG

SEQ ID NO: 79229 - protein, 13 aa, Borrelia burgdorferi B31
PYDLYYPNTKPGV

SEQ ID NO: 79230 - protein, 13 aa, Borrelia burgdorferi B31
YDLYYPNTKPGVK

SEQ ID NO: 79231 - protein, 13 aa, Borrelia burgdorferi B31
DLYYPNTKPGVKL

SEQ ID NO: 79232 - protein, 13 aa, Borrelia burgdorferi B31
LYYPNTKPGVKLF

SEQ ID NO: 79233 - protein, 13 aa, Borrelia burgdorferi B31
YYPNTKPGVKLFI

SEQ ID NO: 79234 - protein, 13 aa, Borrelia burgdorferi B31
YPNTKPGVKLFIN

SEQ ID NO: 79235 - protein, 13 aa, Borrelia burgdorferi B31
PNTKPGVKLFINR

SEQ ID NO: 79236 - protein, 13 aa, Borrelia burgdorferi B31
NTKPGVKLFINRI

SEQ ID NO: 79237 - protein, 13 aa, Borrelia burgdorferi B31
TKPGVKLFINRIF

SEQ ID NO: 79238 - protein, 13 aa, Borrelia burgdorferi B31
KPGVKLFINRIFI

SEQ ID NO: 79239 - protein, 13 aa, Borrelia burgdorferi B31
PGVKLFINRIFIT

SEQ ID NO: 79240 - protein, 13 aa, Borrelia burgdorferi B31
GVKLFINRIFITD

SEQ ID NO: 79241 - protein, 13 aa, Borrelia burgdorferi B31
VKLFINRIFITDS

SEQ ID NO: 79242 - protein, 13 aa, Borrelia burgdorferi B31
KLFINRIFITDSE

SEQ ID NO: 79243 - protein, 13 aa, Borrelia burgdorferi B31
LFINRIFITDSEG

SEQ ID NO: 79244 - protein, 13 aa, Borrelia burgdorferi B31
FINRIFITDSEGS

SEQ ID NO: 79245 - protein, 13 aa, Borrelia burgdorferi B31
INRIFITDSEGSL

SEQ ID NO: 79246 - protein, 13 aa, Borrelia burgdorferi B31
NRIFITDSEGSLL

SEQ ID NO: 79247 - protein, 13 aa, Borrelia burgdorferi B31
RIFITDSEGSLLP

SEQ ID NO: 79248 - protein, 13 aa, Borrelia burgdorferi B31
IFITDSEGSLLPN

SEQ ID NO: 79249 - protein, 13 aa, Borrelia burgdorferi B31
FITDSEGSLLPNY

SEQ ID NO: 79250 - protein, 13 aa, Borrelia burgdorferi B31
ITDSEGSLLPNYL

SEQ ID NO: 79251 - protein, 13 aa, Borrelia burgdorferi B31
TDSEGSLLPNYLR

SEQ ID NO: 79252 - protein, 13 aa, Borrelia burgdorferi B31
DSEGSLLPNYLRF

SEQ ID NO: 79253 - protein, 13 aa, Borrelia burgdorferi B31
SEGSLLPNYLRFI

SEQ ID NO: 79254 - protein, 13 aa, Borrelia burgdorferi B31
EGSLLPNYLRFIK

SEQ ID NO: 79255 - protein, 13 aa, Borrelia burgdorferi B31
GSLLPNYLRFIKG

SEQ ID NO: 79256 - protein, 13 aa, Borrelia burgdorferi B31
SLLPNYLRFIKGI

SEQ ID NO: 79257 - protein, 13 aa, Borrelia burgdorferi B31
LLPNYLRFIKGII

SEQ ID NO: 79258 - protein, 13 aa, Borrelia burgdorferi B31
LPNYLRFIKGIID

SEQ ID NO: 79259 - protein, 13 aa, Borrelia burgdorferi B31
PNYLRFIKGIIDC

SEQ ID NO: 79260 - protein, 13 aa, Borrelia burgdorferi B31
NYLRFIKGIIDCQ

SEQ ID NO: 79261 - protein, 13 aa, Borrelia burgdorferi B31
YLRFIKGIIDCQD

SEQ ID NO: 79262 - protein, 13 aa, Borrelia burgdorferi B31
LRFIKGIIDCQDL

SEQ ID NO: 79263 - protein, 13 aa, Borrelia burgdorferi B31
RFIKGIIDCQDLP

SEQ ID NO: 79264 - protein, 13 aa, Borrelia burgdorferi B31
FIKGIIDCQDLPL

SEQ ID NO: 79265 - protein, 13 aa, Borrelia burgdorferi B31
IKGIIDCQDLPLN

SEQ ID NO: 79266 - protein, 13 aa, Borrelia burgdorferi B31
KGIIDCQDLPLNV

SEQ ID NO: 79267 - protein, 13 aa, Borrelia burgdorferi B31
GIIDCQDLPLNVS

SEQ ID NO: 79268 - protein, 13 aa, Borrelia burgdorferi B31
IIDCQDLPLNVSR

SEQ ID NO: 79269 - protein, 13 aa, Borrelia burgdorferi B31
IDCQDLPLNVSRE

SEQ ID NO: 79270 - protein, 13 aa, Borrelia burgdorferi B31
DCQDLPLNVSREI

SEQ ID NO: 79271 - protein, 13 aa, Borrelia burgdorferi B31
CQDLPLNVSREIL

SEQ ID NO: 79272 - protein, 13 aa, Borrelia burgdorferi B31
QDLPLNVSREILQ

SEQ ID NO: 79273 - protein, 13 aa, Borrelia burgdorferi B31
DLPLNVSREILQQ

SEQ ID NO: 79274 - protein, 13 aa, Borrelia burgdorferi B31
LPLNVSREILQQN

SEQ ID NO: 79275 - protein, 13 aa, Borrelia burgdorferi B31
PLNVSREILQQNK

SEQ ID NO: 79276 - protein, 13 aa, Borrelia burgdorferi B31
LNVSREILQQNKI

SEQ ID NO: 79277 - protein, 13 aa, Borrelia burgdorferi B31
NVSREILQQNKIL

SEQ ID NO: 79278 - protein, 13 aa, Borrelia burgdorferi B31
VSREILQQNKILS

SEQ ID NO: 79279 - protein, 13 aa, Borrelia burgdorferi B31
SREILQQNKILSK

SEQ ID NO: 79280 - protein, 13 aa, Borrelia burgdorferi B31
REILQQNKILSKI

SEQ ID NO: 79281 - protein, 13 aa, Borrelia burgdorferi B31
EILQQNKILSKIK

SEQ ID NO: 79282 - protein, 13 aa, Borrelia burgdorferi B31
ILQQNKILSKIKS

SEQ ID NO: 79283 - protein, 13 aa, Borrelia burgdorferi B31
LQQNKILSKIKSS

SEQ ID NO: 79284 - protein, 13 aa, Borrelia burgdorferi B31
QQNKILSKIKSSS

SEQ ID NO: 79285 - protein, 13 aa, Borrelia burgdorferi B31
QNKILSKIKSSSV

SEQ ID NO: 79286 - protein, 13 aa, Borrelia burgdorferi B31
NKILSKIKSSSVK

SEQ ID NO: 79287 - protein, 13 aa, Borrelia burgdorferi B31
KILSKIKSSSVKK

SEQ ID NO: 79288 - protein, 13 aa, Borrelia burgdorferi B31
ILSKIKSSSVKKI

SEQ ID NO: 79289 - protein, 13 aa, Borrelia burgdorferi B31
LSKIKSSSVKKIL

SEQ ID NO: 79290 - protein, 13 aa, Borrelia burgdorferi B31
SKIKSSSVKKILS

SEQ ID NO: 79291 - protein, 13 aa, Borrelia burgdorferi B31
KIKSSSVKKILSE

SEQ ID NO: 79292 - protein, 13 aa, Borrelia burgdorferi B31
IKSSSVKKILSEL

SEQ ID NO: 79293 - protein, 13 aa, Borrelia burgdorferi B31
KSSSVKKILSELE

SEQ ID NO: 79294 - protein, 13 aa, Borrelia burgdorferi B31
SSSVKKILSELEK

SEQ ID NO: 79295 - protein, 13 aa, Borrelia burgdorferi B31
SSVKKILSELEKL

SEQ ID NO: 79296 - protein, 13 aa, Borrelia burgdorferi B31
SVKKILSELEKLS

SEQ ID NO: 79297 - protein, 13 aa, Borrelia burgdorferi B31
VKKILSELEKLSK

SEQ ID NO: 79298 - protein, 13 aa, Borrelia burgdorferi B31
KKILSELEKLSKK

SEQ ID NO: 79299 - protein, 13 aa, Borrelia burgdorferi B31
KILSELEKLSKKN

SEQ ID NO: 79300 - protein, 13 aa, Borrelia burgdorferi B31
ILSELEKLSKKNP

SEQ ID NO: 79301 - protein, 13 aa, Borrelia burgdorferi B31
LSELEKLSKKNPE

SEQ ID NO: 79302 - protein, 13 aa, Borrelia burgdorferi B31
SELEKLSKKNPEK

SEQ ID NO: 79303 - protein, 13 aa, Borrelia burgdorferi B31
ELEKLSKKNPEKF

SEQ ID NO: 79304 - protein, 13 aa, Borrelia burgdorferi B31
LEKLSKKNPEKFS

SEQ ID NO: 79305 - protein, 13 aa, Borrelia burgdorferi B31
EKLSKKNPEKFSE

SEQ ID NO: 79306 - protein, 13 aa, Borrelia burgdorferi B31
KLSKKNPEKFSEF

SEQ ID NO: 79307 - protein, 13 aa, Borrelia burgdorferi B31
LSKKNPEKFSEFS

SEQ ID NO: 79308 - protein, 13 aa, Borrelia burgdorferi B31
SKKNPEKFSEFSK

SEQ ID NO: 79309 - protein, 13 aa, Borrelia burgdorferi B31
KKNPEKFSEFSKE

SEQ ID NO: 79310 - protein, 13 aa, Borrelia burgdorferi B31
KNPEKFSEFSKEF

SEQ ID NO: 79311 - protein, 13 aa, Borrelia burgdorferi B31
NPEKFSEFSKEFG

SEQ ID NO: 79312 - protein, 13 aa, Borrelia burgdorferi B31
PEKFSEFSKEFGR

SEQ ID NO: 79313 - protein, 13 aa, Borrelia burgdorferi B31
EKFSEFSKEFGRC

SEQ ID NO: 79314 - protein, 13 aa, Borrelia burgdorferi B31
KFSEFSKEFGRCI

SEQ ID NO: 79315 - protein, 13 aa, Borrelia burgdorferi B31
FSEFSKEFGRCIK

SEQ ID NO: 79316 - protein, 13 aa, Borrelia burgdorferi B31
SEFSKEFGRCIKE

SEQ ID NO: 79317 - protein, 13 aa, Borrelia burgdorferi B31
EFSKEFGRCIKEG

SEQ ID NO: 79318 - protein, 13 aa, Borrelia burgdorferi B31
FSKEFGRCIKEGV

SEQ ID NO: 79319 - protein, 13 aa, Borrelia burgdorferi B31
SKEFGRCIKEGVY

SEQ ID NO: 79320 - protein, 13 aa, Borrelia burgdorferi B31
KEFGRCIKEGVYS

SEQ ID NO: 79321 - protein, 13 aa, Borrelia burgdorferi B31
EFGRCIKEGVYSD

SEQ ID NO: 79322 - protein, 13 aa, Borrelia burgdorferi B31
FGRCIKEGVYSDF

SEQ ID NO: 79323 - protein, 13 aa, Borrelia burgdorferi B31
GRCIKEGVYSDFE

SEQ ID NO: 79324 - protein, 13 aa, Borrelia burgdorferi B31
RCIKEGVYSDFEN

SEQ ID NO: 79325 - protein, 13 aa, Borrelia burgdorferi B31
CIKEGVYSDFENR

SEQ ID NO: 79326 - protein, 13 aa, Borrelia burgdorferi B31
IKEGVYSDFENRE

SEQ ID NO: 79327 - protein, 13 aa, Borrelia burgdorferi B31
KEGVYSDFENREK

SEQ ID NO: 79328 - protein, 13 aa, Borrelia burgdorferi B31
EGVYSDFENREKL

SEQ ID NO: 79329 - protein, 13 aa, Borrelia burgdorferi B31
GVYSDFENREKLI

SEQ ID NO: 79330 - protein, 13 aa, Borrelia burgdorferi B31
VYSDFENREKLIS

SEQ ID NO: 79331 - protein, 13 aa, Borrelia burgdorferi B31
YSDFENREKLISL

SEQ ID NO: 79332 - protein, 13 aa, Borrelia burgdorferi B31
SDFENREKLISLI

SEQ ID NO: 79333 - protein, 13 aa, Borrelia burgdorferi B31
DFENREKLISLIR

SEQ ID NO: 79334 - protein, 13 aa, Borrelia burgdorferi B31
FENREKLISLIRF

SEQ ID NO: 79335 - protein, 13 aa, Borrelia burgdorferi B31
ENREKLISLIRFK

SEQ ID NO: 79336 - protein, 13 aa, Borrelia burgdorferi B31
NREKLISLIRFKS

SEQ ID NO: 79337 - protein, 13 aa, Borrelia burgdorferi B31
REKLISLIRFKSS

SEQ ID NO: 79338 - protein, 13 aa, Borrelia burgdorferi B31
EKLISLIRFKSSS

SEQ ID NO: 79339 - protein, 13 aa, Borrelia burgdorferi B31
KLISLIRFKSSSV

SEQ ID NO: 79340 - protein, 13 aa, Borrelia burgdorferi B31
LISLIRFKSSSVD

SEQ ID NO: 79341 - protein, 13 aa, Borrelia burgdorferi B31
ISLIRFKSSSVDG

SEQ ID NO: 79342 - protein, 13 aa, Borrelia burgdorferi B31
SLIRFKSSSVDGF

SEQ ID NO: 79343 - protein, 13 aa, Borrelia burgdorferi B31
LIRFKSSSVDGFV

SEQ ID NO: 79344 - protein, 13 aa, Borrelia burgdorferi B31
IRFKSSSVDGFVS

SEQ ID NO: 79345 - protein, 13 aa, Borrelia burgdorferi B31
RFKSSSVDGFVSF

SEQ ID NO: 79346 - protein, 13 aa, Borrelia burgdorferi B31
FKSSSVDGFVSFK

SEQ ID NO: 79347 - protein, 13 aa, Borrelia burgdorferi B31
KSSSVDGFVSFKE

SEQ ID NO: 79348 - protein, 13 aa, Borrelia burgdorferi B31
SSSVDGFVSFKEY

SEQ ID NO: 79349 - protein, 13 aa, Borrelia burgdorferi B31
SSVDGFVSFKEYK

SEQ ID NO: 79350 - protein, 13 aa, Borrelia burgdorferi B31
SVDGFVSFKEYKE

SEQ ID NO: 79351 - protein, 13 aa, Borrelia burgdorferi B31
VDGFVSFKEYKER

SEQ ID NO: 79352 - protein, 13 aa, Borrelia burgdorferi B31
DGFVSFKEYKERM

SEQ ID NO: 79353 - protein, 13 aa, Borrelia burgdorferi B31
GFVSFKEYKERMN

SEQ ID NO: 79354 - protein, 13 aa, Borrelia burgdorferi B31
FVSFKEYKERMNE

SEQ ID NO: 79355 - protein, 13 aa, Borrelia burgdorferi B31
VSFKEYKERMNES

SEQ ID NO: 79356 - protein, 13 aa, Borrelia burgdorferi B31
SFKEYKERMNESQ

SEQ ID NO: 79357 - protein, 13 aa, Borrelia burgdorferi B31
FKEYKERMNESQK

SEQ ID NO: 79358 - protein, 13 aa, Borrelia burgdorferi B31
KEYKERMNESQKS

SEQ ID NO: 79359 - protein, 13 aa, Borrelia burgdorferi B31
EYKERMNESQKSI

SEQ ID NO: 79360 - protein, 13 aa, Borrelia burgdorferi B31
YKERMNESQKSIY

SEQ ID NO: 79361 - protein, 13 aa, Borrelia burgdorferi B31
KERMNESQKSIYY

SEQ ID NO: 79362 - protein, 13 aa, Borrelia burgdorferi B31
ERMNESQKSIYYI

SEQ ID NO: 79363 - protein, 13 aa, Borrelia burgdorferi B31
RMNESQKSIYYIT

SEQ ID NO: 79364 - protein, 13 aa, Borrelia burgdorferi B31
MNESQKSIYYITG

SEQ ID NO: 79365 - protein, 13 aa, Borrelia burgdorferi B31
NESQKSIYYITGG

SEQ ID NO: 79366 - protein, 13 aa, Borrelia burgdorferi B31
ESQKSIYYITGGK

SEQ ID NO: 79367 - protein, 13 aa, Borrelia burgdorferi B31
SQKSIYYITGGKE

SEQ ID NO: 79368 - protein, 13 aa, Borrelia burgdorferi B31
QKSIYYITGGKEN

SEQ ID NO: 79369 - protein, 13 aa, Borrelia burgdorferi B31
KSIYYITGGKENI

SEQ ID NO: 79370 - protein, 13 aa, Borrelia burgdorferi B31
SIYYITGGKENIL

SEQ ID NO: 79371 - protein, 13 aa, Borrelia burgdorferi B31
IYYITGGKENILK

SEQ ID NO: 79372 - protein, 13 aa, Borrelia burgdorferi B31
YYITGGKENILKE

SEQ ID NO: 79373 - protein, 13 aa, Borrelia burgdorferi B31
YITGGKENILKEN

SEQ ID NO: 79374 - protein, 13 aa, Borrelia burgdorferi B31
ITGGKENILKENP

SEQ ID NO: 79375 - protein, 13 aa, Borrelia burgdorferi B31
TGGKENILKENPI

SEQ ID NO: 79376 - protein, 13 aa, Borrelia burgdorferi B31
GGKENILKENPIV

SEQ ID NO: 79377 - protein, 13 aa, Borrelia burgdorferi B31
GKENILKENPIVA

SEQ ID NO: 79378 - protein, 13 aa, Borrelia burgdorferi B31
KENILKENPIVAA

SEQ ID NO: 79379 - protein, 13 aa, Borrelia burgdorferi B31
ENILKENPIVAAY

SEQ ID NO: 79380 - protein, 13 aa, Borrelia burgdorferi B31
NILKENPIVAAYK

SEQ ID NO: 79381 - protein, 13 aa, Borrelia burgdorferi B31
ILKENPIVAAYKE

SEQ ID NO: 79382 - protein, 13 aa, Borrelia burgdorferi B31
LKENPIVAAYKEK

SEQ ID NO: 79383 - protein, 13 aa, Borrelia burgdorferi B31
KENPIVAAYKEKG

SEQ ID NO: 79384 - protein, 13 aa, Borrelia burgdorferi B31
ENPIVAAYKEKGF

SEQ ID NO: 79385 - protein, 13 aa, Borrelia burgdorferi B31
NPIVAAYKEKGFE

SEQ ID NO: 79386 - protein, 13 aa, Borrelia burgdorferi B31
PIVAAYKEKGFEI

SEQ ID NO: 79387 - protein, 13 aa, Borrelia burgdorferi B31
IVAAYKEKGFEIL

SEQ ID NO: 79388 - protein, 13 aa, Borrelia burgdorferi B31
VAAYKEKGFEILI

SEQ ID NO: 79389 - protein, 13 aa, Borrelia burgdorferi B31
AAYKEKGFEILIM

SEQ ID NO: 79390 - protein, 13 aa, Borrelia burgdorferi B31
AYKEKGFEILIMD

SEQ ID NO: 79391 - protein, 13 aa, Borrelia burgdorferi B31
YKEKGFEILIMDD

SEQ ID NO: 79392 - protein, 13 aa, Borrelia burgdorferi B31
KEKGFEILIMDDE

SEQ ID NO: 79393 - protein, 13 aa, Borrelia burgdorferi B31
EKGFEILIMDDEL

SEQ ID NO: 79394 - protein, 13 aa, Borrelia burgdorferi B31
KGFEILIMDDELD

SEQ ID NO: 79395 - protein, 13 aa, Borrelia burgdorferi B31
GFEILIMDDELDE

SEQ ID NO: 79396 - protein, 13 aa, Borrelia burgdorferi B31
FEILIMDDELDEA

SEQ ID NO: 79397 - protein, 13 aa, Borrelia burgdorferi B31
EILIMDDELDEAI

SEQ ID NO: 79398 - protein, 13 aa, Borrelia burgdorferi B31
ILIMDDELDEAIL

SEQ ID NO: 79399 - protein, 13 aa, Borrelia burgdorferi B31
LIMDDELDEAILN

SEQ ID NO: 79400 - protein, 13 aa, Borrelia burgdorferi B31
IMDDELDEAILNL

SEQ ID NO: 79401 - protein, 13 aa, Borrelia burgdorferi B31
MDDELDEAILNLI

SEQ ID NO: 79402 - protein, 13 aa, Borrelia burgdorferi B31
DDELDEAILNLIP

SEQ ID NO: 79403 - protein, 13 aa, Borrelia burgdorferi B31
DELDEAILNLIPE

SEQ ID NO: 79404 - protein, 13 aa, Borrelia burgdorferi B31
ELDEAILNLIPEY

SEQ ID NO: 79405 - protein, 13 aa, Borrelia burgdorferi B31
LDEAILNLIPEYE

SEQ ID NO: 79406 - protein, 13 aa, Borrelia burgdorferi B31
DEAILNLIPEYEG

SEQ ID NO: 79407 - protein, 13 aa, Borrelia burgdorferi B31
EAILNLIPEYEGL

SEQ ID NO: 79408 - protein, 13 aa, Borrelia burgdorferi B31
AILNLIPEYEGLK

SEQ ID NO: 79409 - protein, 13 aa, Borrelia burgdorferi B31
ILNLIPEYEGLKL

SEQ ID NO: 79410 - protein, 13 aa, Borrelia burgdorferi B31
LNLIPEYEGLKLK

SEQ ID NO: 79411 - protein, 13 aa, Borrelia burgdorferi B31
NLIPEYEGLKLKA

SEQ ID NO: 79412 - protein, 13 aa, Borrelia burgdorferi B31
LIPEYEGLKLKAI

SEQ ID NO: 79413 - protein, 13 aa, Borrelia burgdorferi B31
IPEYEGLKLKAIN

SEQ ID NO: 79414 - protein, 13 aa, Borrelia burgdorferi B31
PEYEGLKLKAINK

SEQ ID NO: 79415 - protein, 13 aa, Borrelia burgdorferi B31
EYEGLKLKAINKN

SEQ ID NO: 79416 - protein, 13 aa, Borrelia burgdorferi B31
YEGLKLKAINKNE

SEQ ID NO: 79417 - protein, 13 aa, Borrelia burgdorferi B31
EGLKLKAINKNET

SEQ ID NO: 79418 - protein, 13 aa, Borrelia burgdorferi B31
GLKLKAINKNETS

SEQ ID NO: 79419 - protein, 13 aa, Borrelia burgdorferi B31
LKLKAINKNETSN

SEQ ID NO: 79420 - protein, 13 aa, Borrelia burgdorferi B31
KLKAINKNETSNE

SEQ ID NO: 79421 - protein, 13 aa, Borrelia burgdorferi B31
LKAINKNETSNEL

SEQ ID NO: 79422 - protein, 13 aa, Borrelia burgdorferi B31
KAINKNETSNELK

SEQ ID NO: 79423 - protein, 13 aa, Borrelia burgdorferi B31
AINKNETSNELKD

SEQ ID NO: 79424 - protein, 13 aa, Borrelia burgdorferi B31
INKNETSNELKDE

SEQ ID NO: 79425 - protein, 13 aa, Borrelia burgdorferi B31
NKNETSNELKDEN

SEQ ID NO: 79426 - protein, 13 aa, Borrelia burgdorferi B31
KNETSNELKDENF

SEQ ID NO: 79427 - protein, 13 aa, Borrelia burgdorferi B31
NETSNELKDENFK

SEQ ID NO: 79428 - protein, 13 aa, Borrelia burgdorferi B31
ETSNELKDENFKK

SEQ ID NO: 79429 - protein, 13 aa, Borrelia burgdorferi B31
TSNELKDENFKKI

SEQ ID NO: 79430 - protein, 13 aa, Borrelia burgdorferi B31
SNELKDENFKKIE

SEQ ID NO: 79431 - protein, 13 aa, Borrelia burgdorferi B31
NELKDENFKKIEE

SEQ ID NO: 79432 - protein, 13 aa, Borrelia burgdorferi B31
ELKDENFKKIEEE

SEQ ID NO: 79433 - protein, 13 aa, Borrelia burgdorferi B31
LKDENFKKIEEEF

SEQ ID NO: 79434 - protein, 13 aa, Borrelia burgdorferi B31
KDENFKKIEEEFK

SEQ ID NO: 79435 - protein, 13 aa, Borrelia burgdorferi B31
DENFKKIEEEFKD

SEQ ID NO: 79436 - protein, 13 aa, Borrelia burgdorferi B31
ENFKKIEEEFKDT

SEQ ID NO: 79437 - protein, 13 aa, Borrelia burgdorferi B31
NFKKIEEEFKDTL

SEQ ID NO: 79438 - protein, 13 aa, Borrelia burgdorferi B31
FKKIEEEFKDTLT

SEQ ID NO: 79439 - protein, 13 aa, Borrelia burgdorferi B31
KKIEEEFKDTLTK

SEQ ID NO: 79440 - protein, 13 aa, Borrelia burgdorferi B31
KIEEEFKDTLTKV

SEQ ID NO: 79441 - protein, 13 aa, Borrelia burgdorferi B31
IEEEFKDTLTKVK

SEQ ID NO: 79442 - protein, 13 aa, Borrelia burgdorferi B31
EEEFKDTLTKVKE

SEQ ID NO: 79443 - protein, 13 aa, Borrelia burgdorferi B31
EEFKDTLTKVKEI

SEQ ID NO: 79444 - protein, 13 aa, Borrelia burgdorferi B31
EFKDTLTKVKEIL

SEQ ID NO: 79445 - protein, 13 aa, Borrelia burgdorferi B31
FKDTLTKVKEILK

SEQ ID NO: 79446 - protein, 13 aa, Borrelia burgdorferi B31
KDTLTKVKEILKD

SEQ ID NO: 79447 - protein, 13 aa, Borrelia burgdorferi B31
DTLTKVKEILKDH

SEQ ID NO: 79448 - protein, 13 aa, Borrelia burgdorferi B31
TLTKVKEILKDHI

SEQ ID NO: 79449 - protein, 13 aa, Borrelia burgdorferi B31
LTKVKEILKDHIK

SEQ ID NO: 79450 - protein, 13 aa, Borrelia burgdorferi B31
TKVKEILKDHIKE

SEQ ID NO: 79451 - protein, 13 aa, Borrelia burgdorferi B31
KVKEILKDHIKEV

SEQ ID NO: 79452 - protein, 13 aa, Borrelia burgdorferi B31
VKEILKDHIKEVN

SEQ ID NO: 79453 - protein, 13 aa, Borrelia burgdorferi B31
KEILKDHIKEVNL

SEQ ID NO: 79454 - protein, 13 aa, Borrelia burgdorferi B31
EILKDHIKEVNLS

SEQ ID NO: 79455 - protein, 13 aa, Borrelia burgdorferi B31
ILKDHIKEVNLSA

SEQ ID NO: 79456 - protein, 13 aa, Borrelia burgdorferi B31
LKDHIKEVNLSAT

SEQ ID NO: 79457 - protein, 13 aa, Borrelia burgdorferi B31
KDHIKEVNLSATL

SEQ ID NO: 79458 - protein, 13 aa, Borrelia burgdorferi B31
DHIKEVNLSATLI

SEQ ID NO: 79459 - protein, 13 aa, Borrelia burgdorferi B31
HIKEVNLSATLIK

SEQ ID NO: 79460 - protein, 13 aa, Borrelia burgdorferi B31
IKEVNLSATLIKE

SEQ ID NO: 79461 - protein, 13 aa, Borrelia burgdorferi B31
KEVNLSATLIKEP

SEQ ID NO: 79462 - protein, 13 aa, Borrelia burgdorferi B31
EVNLSATLIKEPS

SEQ ID NO: 79463 - protein, 13 aa, Borrelia burgdorferi B31
VNLSATLIKEPSA

SEQ ID NO: 79464 - protein, 13 aa, Borrelia burgdorferi B31
NLSATLIKEPSAI

SEQ ID NO: 79465 - protein, 13 aa, Borrelia burgdorferi B31
LSATLIKEPSAII

SEQ ID NO: 79466 - protein, 13 aa, Borrelia burgdorferi B31
SATLIKEPSAIII

SEQ ID NO: 79467 - protein, 13 aa, Borrelia burgdorferi B31
ATLIKEPSAIIID

SEQ ID NO: 79468 - protein, 13 aa, Borrelia burgdorferi B31
TLIKEPSAIIIDS

SEQ ID NO: 79469 - protein, 13 aa, Borrelia burgdorferi B31
LIKEPSAIIIDSN

SEQ ID NO: 79470 - protein, 13 aa, Borrelia burgdorferi B31
IKEPSAIIIDSND

SEQ ID NO: 79471 - protein, 13 aa, Borrelia burgdorferi B31
KEPSAIIIDSNDP

SEQ ID NO: 79472 - protein, 13 aa, Borrelia burgdorferi B31
EPSAIIIDSNDPT

SEQ ID NO: 79473 - protein, 13 aa, Borrelia burgdorferi B31
PSAIIIDSNDPTY

SEQ ID NO: 79474 - protein, 13 aa, Borrelia burgdorferi B31
SAIIIDSNDPTYQ

SEQ ID NO: 79475 - protein, 13 aa, Borrelia burgdorferi B31
AIIIDSNDPTYQM

SEQ ID NO: 79476 - protein, 13 aa, Borrelia burgdorferi B31
IIIDSNDPTYQMQ

SEQ ID NO: 79477 - protein, 13 aa, Borrelia burgdorferi B31
IIDSNDPTYQMQK

SEQ ID NO: 79478 - protein, 13 aa, Borrelia burgdorferi B31
IDSNDPTYQMQKI

SEQ ID NO: 79479 - protein, 13 aa, Borrelia burgdorferi B31
DSNDPTYQMQKIM

SEQ ID NO: 79480 - protein, 13 aa, Borrelia burgdorferi B31
SNDPTYQMQKIML

SEQ ID NO: 79481 - protein, 13 aa, Borrelia burgdorferi B31
NDPTYQMQKIMLS

SEQ ID NO: 79482 - protein, 13 aa, Borrelia burgdorferi B31
DPTYQMQKIMLSM

SEQ ID NO: 79483 - protein, 13 aa, Borrelia burgdorferi B31
PTYQMQKIMLSMG

SEQ ID NO: 79484 - protein, 13 aa, Borrelia burgdorferi B31
TYQMQKIMLSMGQ

SEQ ID NO: 79485 - protein, 13 aa, Borrelia burgdorferi B31
YQMQKIMLSMGQE

SEQ ID NO: 79486 - protein, 13 aa, Borrelia burgdorferi B31
QMQKIMLSMGQEV

SEQ ID NO: 79487 - protein, 13 aa, Borrelia burgdorferi B31
MQKIMLSMGQEVK

SEQ ID NO: 79488 - protein, 13 aa, Borrelia burgdorferi B31
QKIMLSMGQEVKE

SEQ ID NO: 79489 - protein, 13 aa, Borrelia burgdorferi B31
KIMLSMGQEVKEI

SEQ ID NO: 79490 - protein, 13 aa, Borrelia burgdorferi B31
IMLSMGQEVKEIK

SEQ ID NO: 79491 - protein, 13 aa, Borrelia burgdorferi B31
MLSMGQEVKEIKP

SEQ ID NO: 79492 - protein, 13 aa, Borrelia burgdorferi B31
LSMGQEVKEIKPI

SEQ ID NO: 79493 - protein, 13 aa, Borrelia burgdorferi B31
SMGQEVKEIKPIL

SEQ ID NO: 79494 - protein, 13 aa, Borrelia burgdorferi B31
MGQEVKEIKPILE

SEQ ID NO: 79495 - protein, 13 aa, Borrelia burgdorferi B31
GQEVKEIKPILEL

SEQ ID NO: 79496 - protein, 13 aa, Borrelia burgdorferi B31
QEVKEIKPILELN

SEQ ID NO: 79497 - protein, 13 aa, Borrelia burgdorferi B31
EVKEIKPILELNP

SEQ ID NO: 79498 - protein, 13 aa, Borrelia burgdorferi B31
VKEIKPILELNPN

SEQ ID NO: 79499 - protein, 13 aa, Borrelia burgdorferi B31
KEIKPILELNPNN

SEQ ID NO: 79500 - protein, 13 aa, Borrelia burgdorferi B31
EIKPILELNPNNK

SEQ ID NO: 79501 - protein, 13 aa, Borrelia burgdorferi B31
IKPILELNPNNKI

SEQ ID NO: 79502 - protein, 13 aa, Borrelia burgdorferi B31
KPILELNPNNKIV

SEQ ID NO: 79503 - protein, 13 aa, Borrelia burgdorferi B31
PILELNPNNKIVQ

SEQ ID NO: 79504 - protein, 13 aa, Borrelia burgdorferi B31
ILELNPNNKIVQN

SEQ ID NO: 79505 - protein, 13 aa, Borrelia burgdorferi B31
LELNPNNKIVQNL

SEQ ID NO: 79506 - protein, 13 aa, Borrelia burgdorferi B31
ELNPNNKIVQNLK

SEQ ID NO: 79507 - protein, 13 aa, Borrelia burgdorferi B31
LNPNNKIVQNLKN

SEQ ID NO: 79508 - protein, 13 aa, Borrelia burgdorferi B31
NPNNKIVQNLKNL

SEQ ID NO: 79509 - protein, 13 aa, Borrelia burgdorferi B31
PNNKIVQNLKNLE

SEQ ID NO: 79510 - protein, 13 aa, Borrelia burgdorferi B31
NNKIVQNLKNLEP

SEQ ID NO: 79511 - protein, 13 aa, Borrelia burgdorferi B31
NKIVQNLKNLEPE

SEQ ID NO: 79512 - protein, 13 aa, Borrelia burgdorferi B31
KIVQNLKNLEPEK

SEQ ID NO: 79513 - protein, 13 aa, Borrelia burgdorferi B31
IVQNLKNLEPEKL

SEQ ID NO: 79514 - protein, 13 aa, Borrelia burgdorferi B31
VQNLKNLEPEKLE

SEQ ID NO: 79515 - protein, 13 aa, Borrelia burgdorferi B31
QNLKNLEPEKLEK

SEQ ID NO: 79516 - protein, 13 aa, Borrelia burgdorferi B31
NLKNLEPEKLEKI

SEQ ID NO: 79517 - protein, 13 aa, Borrelia burgdorferi B31
LKNLEPEKLEKIS

SEQ ID NO: 79518 - protein, 13 aa, Borrelia burgdorferi B31
KNLEPEKLEKISI

SEQ ID NO: 79519 - protein, 13 aa, Borrelia burgdorferi B31
NLEPEKLEKISIL

SEQ ID NO: 79520 - protein, 13 aa, Borrelia burgdorferi B31
LEPEKLEKISILL

SEQ ID NO: 79521 - protein, 13 aa, Borrelia burgdorferi B31
EPEKLEKISILLF

SEQ ID NO: 79522 - protein, 13 aa, Borrelia burgdorferi B31
PEKLEKISILLFE

SEQ ID NO: 79523 - protein, 13 aa, Borrelia burgdorferi B31
EKLEKISILLFEE

SEQ ID NO: 79524 - protein, 13 aa, Borrelia burgdorferi B31
KLEKISILLFEEA

SEQ ID NO: 79525 - protein, 13 aa, Borrelia burgdorferi B31
LEKISILLFEEAM

SEQ ID NO: 79526 - protein, 13 aa, Borrelia burgdorferi B31
EKISILLFEEAML

SEQ ID NO: 79527 - protein, 13 aa, Borrelia burgdorferi B31
KISILLFEEAMLT

SEQ ID NO: 79528 - protein, 13 aa, Borrelia burgdorferi B31
ISILLFEEAMLTS

SEQ ID NO: 79529 - protein, 13 aa, Borrelia burgdorferi B31
SILLFEEAMLTSG

SEQ ID NO: 79530 - protein, 13 aa, Borrelia burgdorferi B31
ILLFEEAMLTSGM

SEQ ID NO: 79531 - protein, 13 aa, Borrelia burgdorferi B31
LLFEEAMLTSGMP

SEQ ID NO: 79532 - protein, 13 aa, Borrelia burgdorferi B31
LFEEAMLTSGMPS

SEQ ID NO: 79533 - protein, 13 aa, Borrelia burgdorferi B31
FEEAMLTSGMPSK

SEQ ID NO: 79534 - protein, 13 aa, Borrelia burgdorferi B31
EEAMLTSGMPSKN

SEQ ID NO: 79535 - protein, 13 aa, Borrelia burgdorferi B31
EAMLTSGMPSKNP

SEQ ID NO: 79536 - protein, 13 aa, Borrelia burgdorferi B31
AMLTSGMPSKNPG

SEQ ID NO: 79537 - protein, 13 aa, Borrelia burgdorferi B31
MLTSGMPSKNPGK

SEQ ID NO: 79538 - protein, 13 aa, Borrelia burgdorferi B31
LTSGMPSKNPGKF

SEQ ID NO: 79539 - protein, 13 aa, Borrelia burgdorferi B31
TSGMPSKNPGKFI

SEQ ID NO: 79540 - protein, 13 aa, Borrelia burgdorferi B31
SGMPSKNPGKFIN

SEQ ID NO: 79541 - protein, 13 aa, Borrelia burgdorferi B31
GMPSKNPGKFINI

SEQ ID NO: 79542 - protein, 13 aa, Borrelia burgdorferi B31
MPSKNPGKFINII

SEQ ID NO: 79543 - protein, 13 aa, Borrelia burgdorferi B31
PSKNPGKFINIIN

SEQ ID NO: 79544 - protein, 13 aa, Borrelia burgdorferi B31
SKNPGKFINIINE

SEQ ID NO: 79545 - protein, 13 aa, Borrelia burgdorferi B31
KNPGKFINIINEF

SEQ ID NO: 79546 - protein, 13 aa, Borrelia burgdorferi B31
NPGKFINIINEFI

SEQ ID NO: 79547 - protein, 13 aa, Borrelia burgdorferi B31
PGKFINIINEFIE

SEQ ID NO: 79548 - protein, 13 aa, Borrelia burgdorferi B31
GKFINIINEFIEK

SEQ ID NO: 79549 - protein, 13 aa, Borrelia burgdorferi B31
KFINIINEFIEKD

SEQ ID NO: 79550 - protein, 13 aa, Borrelia burgdorferi B31
FINIINEFIEKDF

SEQ ID NO: 79551 - protein, 13 aa, Borrelia burgdorferi B31
INIINEFIEKDFL

SEQ ID NO: 79552 - protein, 14 aa, Borrelia burgdorferi B31
MILIFYFKQIALFI

SEQ ID NO: 79553 - protein, 14 aa, Borrelia burgdorferi B31
ILIFYFKQIALFII

SEQ ID NO: 79554 - protein, 14 aa, Borrelia burgdorferi B31
LIFYFKQIALFIIF

SEQ ID NO: 79555 - protein, 14 aa, Borrelia burgdorferi B31
IFYFKQIALFIIFR

SEQ ID NO: 79556 - protein, 14 aa, Borrelia burgdorferi B31
FYFKQIALFIIFRL

SEQ ID NO: 79557 - protein, 14 aa, Borrelia burgdorferi B31
YFKQIALFIIFRLC

SEQ ID NO: 79558 - protein, 14 aa, Borrelia burgdorferi B31
FKQIALFIIFRLCY

SEQ ID NO: 79559 - protein, 14 aa, Borrelia burgdorferi B31
KQIALFIIFRLCYI

SEQ ID NO: 79560 - protein, 14 aa, Borrelia burgdorferi B31
QIALFIIFRLCYII

SEQ ID NO: 79561 - protein, 14 aa, Borrelia burgdorferi B31
IALFIIFRLCYIIK

SEQ ID NO: 79562 - protein, 14 aa, Borrelia burgdorferi B31
ALFIIFRLCYIIKK

SEQ ID NO: 79563 - protein, 14 aa, Borrelia burgdorferi B31
LFIIFRLCYIIKKV

SEQ ID NO: 79564 - protein, 14 aa, Borrelia burgdorferi B31
FIIFRLCYIIKKVK

SEQ ID NO: 79565 - protein, 14 aa, Borrelia burgdorferi B31
IIFRLCYIIKKVKI

SEQ ID NO: 79566 - protein, 14 aa, Borrelia burgdorferi B31
IFRLCYIIKKVKIK

SEQ ID NO: 79567 - protein, 14 aa, Borrelia burgdorferi B31
FRLCYIIKKVKIKL

SEQ ID NO: 79568 - protein, 14 aa, Borrelia burgdorferi B31
RLCYIIKKVKIKLK

SEQ ID NO: 79569 - protein, 14 aa, Borrelia burgdorferi B31
LCYIIKKVKIKLKR

SEQ ID NO: 79570 - protein, 14 aa, Borrelia burgdorferi B31
CYIIKKVKIKLKRK

SEQ ID NO: 79571 - protein, 14 aa, Borrelia burgdorferi B31
YIIKKVKIKLKRKS

SEQ ID NO: 79572 - protein, 14 aa, Borrelia burgdorferi B31
IIKKVKIKLKRKSC

SEQ ID NO: 79573 - protein, 14 aa, Borrelia burgdorferi B31
IKKVKIKLKRKSCM

SEQ ID NO: 79574 - protein, 14 aa, Borrelia burgdorferi B31
KKVKIKLKRKSCMK

SEQ ID NO: 79575 - protein, 14 aa, Borrelia burgdorferi B31
KVKIKLKRKSCMKK

SEQ ID NO: 79576 - protein, 14 aa, Borrelia burgdorferi B31
VKIKLKRKSCMKKQ

SEQ ID NO: 79577 - protein, 14 aa, Borrelia burgdorferi B31
KIKLKRKSCMKKQF

SEQ ID NO: 79578 - protein, 14 aa, Borrelia burgdorferi B31
IKLKRKSCMKKQFD

SEQ ID NO: 79579 - protein, 14 aa, Borrelia burgdorferi B31
KLKRKSCMKKQFDT

SEQ ID NO: 79580 - protein, 14 aa, Borrelia burgdorferi B31
LKRKSCMKKQFDTE

SEQ ID NO: 79581 - protein, 14 aa, Borrelia burgdorferi B31
KRKSCMKKQFDTEV

SEQ ID NO: 79582 - protein, 14 aa, Borrelia burgdorferi B31
RKSCMKKQFDTEVN

SEQ ID NO: 79583 - protein, 14 aa, Borrelia burgdorferi B31
KSCMKKQFDTEVND

SEQ ID NO: 79584 - protein, 14 aa, Borrelia burgdorferi B31
SCMKKQFDTEVNDL

SEQ ID NO: 79585 - protein, 14 aa, Borrelia burgdorferi B31
CMKKQFDTEVNDLL

SEQ ID NO: 79586 - protein, 14 aa, Borrelia burgdorferi B31
MKKQFDTEVNDLLY

SEQ ID NO: 79587 - protein, 14 aa, Borrelia burgdorferi B31
KKQFDTEVNDLLYL

SEQ ID NO: 79588 - protein, 14 aa, Borrelia burgdorferi B31
KQFDTEVNDLLYLI

SEQ ID NO: 79589 - protein, 14 aa, Borrelia burgdorferi B31
QFDTEVNDLLYLII

SEQ ID NO: 79590 - protein, 14 aa, Borrelia burgdorferi B31
FDTEVNDLLYLIIH

SEQ ID NO: 79591 - protein, 14 aa, Borrelia burgdorferi B31
DTEVNDLLYLIIHS

SEQ ID NO: 79592 - protein, 14 aa, Borrelia burgdorferi B31
TEVNDLLYLIIHSL

SEQ ID NO: 79593 - protein, 14 aa, Borrelia burgdorferi B31
EVNDLLYLIIHSLY

SEQ ID NO: 79594 - protein, 14 aa, Borrelia burgdorferi B31
VNDLLYLIIHSLYS

SEQ ID NO: 79595 - protein, 14 aa, Borrelia burgdorferi B31
NDLLYLIIHSLYSH

SEQ ID NO: 79596 - protein, 14 aa, Borrelia burgdorferi B31
DLLYLIIHSLYSHK

SEQ ID NO: 79597 - protein, 14 aa, Borrelia burgdorferi B31
LLYLIIHSLYSHKE

SEQ ID NO: 79598 - protein, 14 aa, Borrelia burgdorferi B31
LYLIIHSLYSHKEI

SEQ ID NO: 79599 - protein, 14 aa, Borrelia burgdorferi B31
YLIIHSLYSHKEIF

SEQ ID NO: 79600 - protein, 14 aa, Borrelia burgdorferi B31
LIIHSLYSHKEIFL

SEQ ID NO: 79601 - protein, 14 aa, Borrelia burgdorferi B31
IIHSLYSHKEIFLR

SEQ ID NO: 79602 - protein, 14 aa, Borrelia burgdorferi B31
IHSLYSHKEIFLRE

SEQ ID NO: 79603 - protein, 14 aa, Borrelia burgdorferi B31
HSLYSHKEIFLREL

SEQ ID NO: 79604 - protein, 14 aa, Borrelia burgdorferi B31
SLYSHKEIFLRELI

SEQ ID NO: 79605 - protein, 14 aa, Borrelia burgdorferi B31
LYSHKEIFLRELIS

SEQ ID NO: 79606 - protein, 14 aa, Borrelia burgdorferi B31
YSHKEIFLRELISN

SEQ ID NO: 79607 - protein, 14 aa, Borrelia burgdorferi B31
SHKEIFLRELISNA

SEQ ID NO: 79608 - protein, 14 aa, Borrelia burgdorferi B31
HKEIFLRELISNAS

SEQ ID NO: 79609 - protein, 14 aa, Borrelia burgdorferi B31
KEIFLRELISNASD

SEQ ID NO: 79610 - protein, 14 aa, Borrelia burgdorferi B31
EIFLRELISNASDA

SEQ ID NO: 79611 - protein, 14 aa, Borrelia burgdorferi B31
IFLRELISNASDAI

SEQ ID NO: 79612 - protein, 14 aa, Borrelia burgdorferi B31
FLRELISNASDAID

SEQ ID NO: 79613 - protein, 14 aa, Borrelia burgdorferi B31
LRELISNASDAIDK

SEQ ID NO: 79614 - protein, 14 aa, Borrelia burgdorferi B31
RELISNASDAIDKL

SEQ ID NO: 79615 - protein, 14 aa, Borrelia burgdorferi B31
ELISNASDAIDKLK

SEQ ID NO: 79616 - protein, 14 aa, Borrelia burgdorferi B31
LISNASDAIDKLKF

SEQ ID NO: 79617 - protein, 14 aa, Borrelia burgdorferi B31
ISNASDAIDKLKFL

SEQ ID NO: 79618 - protein, 14 aa, Borrelia burgdorferi B31
SNASDAIDKLKFLS

SEQ ID NO: 79619 - protein, 14 aa, Borrelia burgdorferi B31
NASDAIDKLKFLSL

SEQ ID NO: 79620 - protein, 14 aa, Borrelia burgdorferi B31
ASDAIDKLKFLSLT

SEQ ID NO: 79621 - protein, 14 aa, Borrelia burgdorferi B31
SDAIDKLKFLSLTN

SEQ ID NO: 79622 - protein, 14 aa, Borrelia burgdorferi B31
DAIDKLKFLSLTNE

SEQ ID NO: 79623 - protein, 14 aa, Borrelia burgdorferi B31
AIDKLKFLSLTNEK

SEQ ID NO: 79624 - protein, 14 aa, Borrelia burgdorferi B31
IDKLKFLSLTNEKF

SEQ ID NO: 79625 - protein, 14 aa, Borrelia burgdorferi B31
DKLKFLSLTNEKFK

SEQ ID NO: 79626 - protein, 14 aa, Borrelia burgdorferi B31
KLKFLSLTNEKFKN

SEQ ID NO: 79627 - protein, 14 aa, Borrelia burgdorferi B31
LKFLSLTNEKFKNI

SEQ ID NO: 79628 - protein, 14 aa, Borrelia burgdorferi B31
KFLSLTNEKFKNIA

SEQ ID NO: 79629 - protein, 14 aa, Borrelia burgdorferi B31
FLSLTNEKFKNIAL

SEQ ID NO: 79630 - protein, 14 aa, Borrelia burgdorferi B31
LSLTNEKFKNIALE

SEQ ID NO: 79631 - protein, 14 aa, Borrelia burgdorferi B31
SLTNEKFKNIALEP

SEQ ID NO: 79632 - protein, 14 aa, Borrelia burgdorferi B31
LTNEKFKNIALEPK

SEQ ID NO: 79633 - protein, 14 aa, Borrelia burgdorferi B31
TNEKFKNIALEPKI

SEQ ID NO: 79634 - protein, 14 aa, Borrelia burgdorferi B31
NEKFKNIALEPKIE

SEQ ID NO: 79635 - protein, 14 aa, Borrelia burgdorferi B31
EKFKNIALEPKIEI

SEQ ID NO: 79636 - protein, 14 aa, Borrelia burgdorferi B31
KFKNIALEPKIEIS

SEQ ID NO: 79637 - protein, 14 aa, Borrelia burgdorferi B31
FKNIALEPKIEISF

SEQ ID NO: 79638 - protein, 14 aa, Borrelia burgdorferi B31
KNIALEPKIEISFD

SEQ ID NO: 79639 - protein, 14 aa, Borrelia burgdorferi B31
NIALEPKIEISFDD

SEQ ID NO: 79640 - protein, 14 aa, Borrelia burgdorferi B31
IALEPKIEISFDDK

SEQ ID NO: 79641 - protein, 14 aa, Borrelia burgdorferi B31
ALEPKIEISFDDKS

SEQ ID NO: 79642 - protein, 14 aa, Borrelia burgdorferi B31
LEPKIEISFDDKSI

SEQ ID NO: 79643 - protein, 14 aa, Borrelia burgdorferi B31
EPKIEISFDDKSIL

SEQ ID NO: 79644 - protein, 14 aa, Borrelia burgdorferi B31
PKIEISFDDKSILI

SEQ ID NO: 79645 - protein, 14 aa, Borrelia burgdorferi B31
KIEISFDDKSILIK

SEQ ID NO: 79646 - protein, 14 aa, Borrelia burgdorferi B31
IEISFDDKSILIKD

SEQ ID NO: 79647 - protein, 14 aa, Borrelia burgdorferi B31
EISFDDKSILIKDN

SEQ ID NO: 79648 - protein, 14 aa, Borrelia burgdorferi B31
ISFDDKSILIKDNG

SEQ ID NO: 79649 - protein, 14 aa, Borrelia burgdorferi B31
SFDDKSILIKDNGI

SEQ ID NO: 79650 - protein, 14 aa, Borrelia burgdorferi B31
FDDKSILIKDNGIG

SEQ ID NO: 79651 - protein, 14 aa, Borrelia burgdorferi B31
DDKSILIKDNGIGM

SEQ ID NO: 79652 - protein, 14 aa, Borrelia burgdorferi B31
DKSILIKDNGIGMD

SEQ ID NO: 79653 - protein, 14 aa, Borrelia burgdorferi B31
KSILIKDNGIGMDE

SEQ ID NO: 79654 - protein, 14 aa, Borrelia burgdorferi B31
SILIKDNGIGMDEQ

SEQ ID NO: 79655 - protein, 14 aa, Borrelia burgdorferi B31
ILIKDNGIGMDEQD

SEQ ID NO: 79656 - protein, 14 aa, Borrelia burgdorferi B31
LIKDNGIGMDEQDL

SEQ ID NO: 79657 - protein, 14 aa, Borrelia burgdorferi B31
IKDNGIGMDEQDLT

SEQ ID NO: 79658 - protein, 14 aa, Borrelia burgdorferi B31
KDNGIGMDEQDLTN

SEQ ID NO: 79659 - protein, 14 aa, Borrelia burgdorferi B31
DNGIGMDEQDLTNH

SEQ ID NO: 79660 - protein, 14 aa, Borrelia burgdorferi B31
NGIGMDEQDLTNHL

SEQ ID NO: 79661 - protein, 14 aa, Borrelia burgdorferi B31
GIGMDEQDLTNHLG

SEQ ID NO: 79662 - protein, 14 aa, Borrelia burgdorferi B31
IGMDEQDLTNHLGV

SEQ ID NO: 79663 - protein, 14 aa, Borrelia burgdorferi B31
GMDEQDLTNHLGVI

SEQ ID NO: 79664 - protein, 14 aa, Borrelia burgdorferi B31
MDEQDLTNHLGVIA

SEQ ID NO: 79665 - protein, 14 aa, Borrelia burgdorferi B31
DEQDLTNHLGVIAK

SEQ ID NO: 79666 - protein, 14 aa, Borrelia burgdorferi B31
EQDLTNHLGVIAKS

SEQ ID NO: 79667 - protein, 14 aa, Borrelia burgdorferi B31
QDLTNHLGVIAKSG

SEQ ID NO: 79668 - protein, 14 aa, Borrelia burgdorferi B31
DLTNHLGVIAKSGT

SEQ ID NO: 79669 - protein, 14 aa, Borrelia burgdorferi B31
LTNHLGVIAKSGTK

SEQ ID NO: 79670 - protein, 14 aa, Borrelia burgdorferi B31
TNHLGVIAKSGTKE

SEQ ID NO: 79671 - protein, 14 aa, Borrelia burgdorferi B31
NHLGVIAKSGTKEF

SEQ ID NO: 79672 - protein, 14 aa, Borrelia burgdorferi B31
HLGVIAKSGTKEFI

SEQ ID NO: 79673 - protein, 14 aa, Borrelia burgdorferi B31
LGVIAKSGTKEFIN

SEQ ID NO: 79674 - protein, 14 aa, Borrelia burgdorferi B31
GVIAKSGTKEFINN

SEQ ID NO: 79675 - protein, 14 aa, Borrelia burgdorferi B31
VIAKSGTKEFINNL

SEQ ID NO: 79676 - protein, 14 aa, Borrelia burgdorferi B31
IAKSGTKEFINNLK

SEQ ID NO: 79677 - protein, 14 aa, Borrelia burgdorferi B31
AKSGTKEFINNLKQ

SEQ ID NO: 79678 - protein, 14 aa, Borrelia burgdorferi B31
KSGTKEFINNLKQD

SEQ ID NO: 79679 - protein, 14 aa, Borrelia burgdorferi B31
SGTKEFINNLKQDE

SEQ ID NO: 79680 - protein, 14 aa, Borrelia burgdorferi B31
GTKEFINNLKQDEK

SEQ ID NO: 79681 - protein, 14 aa, Borrelia burgdorferi B31
TKEFINNLKQDEKK

SEQ ID NO: 79682 - protein, 14 aa, Borrelia burgdorferi B31
KEFINNLKQDEKKS

SEQ ID NO: 79683 - protein, 14 aa, Borrelia burgdorferi B31
EFINNLKQDEKKSA

SEQ ID NO: 79684 - protein, 14 aa, Borrelia burgdorferi B31
FINNLKQDEKKSAS

SEQ ID NO: 79685 - protein, 14 aa, Borrelia burgdorferi B31
INNLKQDEKKSASL

SEQ ID NO: 79686 - protein, 14 aa, Borrelia burgdorferi B31
NNLKQDEKKSASLI

SEQ ID NO: 79687 - protein, 14 aa, Borrelia burgdorferi B31
NLKQDEKKSASLIG

SEQ ID NO: 79688 - protein, 14 aa, Borrelia burgdorferi B31
LKQDEKKSASLIGQ

SEQ ID NO: 79689 - protein, 14 aa, Borrelia burgdorferi B31
KQDEKKSASLIGQF

SEQ ID NO: 79690 - protein, 14 aa, Borrelia burgdorferi B31
QDEKKSASLIGQFG

SEQ ID NO: 79691 - protein, 14 aa, Borrelia burgdorferi B31
DEKKSASLIGQFGV

SEQ ID NO: 79692 - protein, 14 aa, Borrelia burgdorferi B31
EKKSASLIGQFGVG

SEQ ID NO: 79693 - protein, 14 aa, Borrelia burgdorferi B31
KKSASLIGQFGVGF

SEQ ID NO: 79694 - protein, 14 aa, Borrelia burgdorferi B31
KSASLIGQFGVGFY

SEQ ID NO: 79695 - protein, 14 aa, Borrelia burgdorferi B31
SASLIGQFGVGFYS

SEQ ID NO: 79696 - protein, 14 aa, Borrelia burgdorferi B31
ASLIGQFGVGFYSA

SEQ ID NO: 79697 - protein, 14 aa, Borrelia burgdorferi B31
SLIGQFGVGFYSAF

SEQ ID NO: 79698 - protein, 14 aa, Borrelia burgdorferi B31
LIGQFGVGFYSAFI

SEQ ID NO: 79699 - protein, 14 aa, Borrelia burgdorferi B31
IGQFGVGFYSAFIV

SEQ ID NO: 79700 - protein, 14 aa, Borrelia burgdorferi B31
GQFGVGFYSAFIVS

SEQ ID NO: 79701 - protein, 14 aa, Borrelia burgdorferi B31
QFGVGFYSAFIVSE

SEQ ID NO: 79702 - protein, 14 aa, Borrelia burgdorferi B31
FGVGFYSAFIVSEK

SEQ ID NO: 79703 - protein, 14 aa, Borrelia burgdorferi B31
GVGFYSAFIVSEKV

SEQ ID NO: 79704 - protein, 14 aa, Borrelia burgdorferi B31
VGFYSAFIVSEKVE

SEQ ID NO: 79705 - protein, 14 aa, Borrelia burgdorferi B31
GFYSAFIVSEKVEV

SEQ ID NO: 79706 - protein, 14 aa, Borrelia burgdorferi B31
FYSAFIVSEKVEVT

SEQ ID NO: 79707 - protein, 14 aa, Borrelia burgdorferi B31
YSAFIVSEKVEVTS

SEQ ID NO: 79708 - protein, 14 aa, Borrelia burgdorferi B31
SAFIVSEKVEVTSK

SEQ ID NO: 79709 - protein, 14 aa, Borrelia burgdorferi B31
AFIVSEKVEVTSKK

SEQ ID NO: 79710 - protein, 14 aa, Borrelia burgdorferi B31
FIVSEKVEVTSKKA

SEQ ID NO: 79711 - protein, 14 aa, Borrelia burgdorferi B31
IVSEKVEVTSKKAL

SEQ ID NO: 79712 - protein, 14 aa, Borrelia burgdorferi B31
VSEKVEVTSKKALE

SEQ ID NO: 79713 - protein, 14 aa, Borrelia burgdorferi B31
SEKVEVTSKKALES

SEQ ID NO: 79714 - protein, 14 aa, Borrelia burgdorferi B31
EKVEVTSKKALESD

SEQ ID NO: 79715 - protein, 14 aa, Borrelia burgdorferi B31
KVEVTSKKALESDA

SEQ ID NO: 79716 - protein, 14 aa, Borrelia burgdorferi B31
VEVTSKKALESDAY

SEQ ID NO: 79717 - protein, 14 aa, Borrelia burgdorferi B31
EVTSKKALESDAYI

SEQ ID NO: 79718 - protein, 14 aa, Borrelia burgdorferi B31
VTSKKALESDAYIW

SEQ ID NO: 79719 - protein, 14 aa, Borrelia burgdorferi B31
TSKKALESDAYIWS

SEQ ID NO: 79720 - protein, 14 aa, Borrelia burgdorferi B31
SKKALESDAYIWSS

SEQ ID NO: 79721 - protein, 14 aa, Borrelia burgdorferi B31
KKALESDAYIWSSD

SEQ ID NO: 79722 - protein, 14 aa, Borrelia burgdorferi B31
KALESDAYIWSSDG

SEQ ID NO: 79723 - protein, 14 aa, Borrelia burgdorferi B31
ALESDAYIWSSDGK

SEQ ID NO: 79724 - protein, 14 aa, Borrelia burgdorferi B31
LESDAYIWSSDGKT

SEQ ID NO: 79725 - protein, 14 aa, Borrelia burgdorferi B31
ESDAYIWSSDGKTG

SEQ ID NO: 79726 - protein, 14 aa, Borrelia burgdorferi B31
SDAYIWSSDGKTGY

SEQ ID NO: 79727 - protein, 14 aa, Borrelia burgdorferi B31
DAYIWSSDGKTGYE

SEQ ID NO: 79728 - protein, 14 aa, Borrelia burgdorferi B31
AYIWSSDGKTGYEI

SEQ ID NO: 79729 - protein, 14 aa, Borrelia burgdorferi B31
YIWSSDGKTGYEIE

SEQ ID NO: 79730 - protein, 14 aa, Borrelia burgdorferi B31
IWSSDGKTGYEIEK

SEQ ID NO: 79731 - protein, 14 aa, Borrelia burgdorferi B31
WSSDGKTGYEIEKA

SEQ ID NO: 79732 - protein, 14 aa, Borrelia burgdorferi B31
SSDGKTGYEIEKAK

SEQ ID NO: 79733 - protein, 14 aa, Borrelia burgdorferi B31
SDGKTGYEIEKAKK

SEQ ID NO: 79734 - protein, 14 aa, Borrelia burgdorferi B31
DGKTGYEIEKAKKE

SEQ ID NO: 79735 - protein, 14 aa, Borrelia burgdorferi B31
GKTGYEIEKAKKEE

SEQ ID NO: 79736 - protein, 14 aa, Borrelia burgdorferi B31
KTGYEIEKAKKEES

SEQ ID NO: 79737 - protein, 14 aa, Borrelia burgdorferi B31
TGYEIEKAKKEESG

SEQ ID NO: 79738 - protein, 14 aa, Borrelia burgdorferi B31
GYEIEKAKKEESGT

SEQ ID NO: 79739 - protein, 14 aa, Borrelia burgdorferi B31
YEIEKAKKEESGTE

SEQ ID NO: 79740 - protein, 14 aa, Borrelia burgdorferi B31
EIEKAKKEESGTEI

SEQ ID NO: 79741 - protein, 14 aa, Borrelia burgdorferi B31
IEKAKKEESGTEIK

SEQ ID NO: 79742 - protein, 14 aa, Borrelia burgdorferi B31
EKAKKEESGTEIKL

SEQ ID NO: 79743 - protein, 14 aa, Borrelia burgdorferi B31
KAKKEESGTEIKLY

SEQ ID NO: 79744 - protein, 14 aa, Borrelia burgdorferi B31
AKKEESGTEIKLYL

SEQ ID NO: 79745 - protein, 14 aa, Borrelia burgdorferi B31
KKEESGTEIKLYLN

SEQ ID NO: 79746 - protein, 14 aa, Borrelia burgdorferi B31
KEESGTEIKLYLNK

SEQ ID NO: 79747 - protein, 14 aa, Borrelia burgdorferi B31
EESGTEIKLYLNKE

SEQ ID NO: 79748 - protein, 14 aa, Borrelia burgdorferi B31
ESGTEIKLYLNKEG

SEQ ID NO: 79749 - protein, 14 aa, Borrelia burgdorferi B31
SGTEIKLYLNKEGL

SEQ ID NO: 79750 - protein, 14 aa, Borrelia burgdorferi B31
GTEIKLYLNKEGLE

SEQ ID NO: 79751 - protein, 14 aa, Borrelia burgdorferi B31
TEIKLYLNKEGLEY

SEQ ID NO: 79752 - protein, 14 aa, Borrelia burgdorferi B31
EIKLYLNKEGLEYA

SEQ ID NO: 79753 - protein, 14 aa, Borrelia burgdorferi B31
IKLYLNKEGLEYAN

SEQ ID NO: 79754 - protein, 14 aa, Borrelia burgdorferi B31
KLYLNKEGLEYANK

SEQ ID NO: 79755 - protein, 14 aa, Borrelia burgdorferi B31
LYLNKEGLEYANKW

SEQ ID NO: 79756 - protein, 14 aa, Borrelia burgdorferi B31
YLNKEGLEYANKWK

SEQ ID NO: 79757 - protein, 14 aa, Borrelia burgdorferi B31
LNKEGLEYANKWKI

SEQ ID NO: 79758 - protein, 14 aa, Borrelia burgdorferi B31
NKEGLEYANKWKIQ

SEQ ID NO: 79759 - protein, 14 aa, Borrelia burgdorferi B31
KEGLEYANKWKIQE

SEQ ID NO: 79760 - protein, 14 aa, Borrelia burgdorferi B31
EGLEYANKWKIQEI

SEQ ID NO: 79761 - protein, 14 aa, Borrelia burgdorferi B31
GLEYANKWKIQEII

SEQ ID NO: 79762 - protein, 14 aa, Borrelia burgdorferi B31
LEYANKWKIQEIIK

SEQ ID NO: 79763 - protein, 14 aa, Borrelia burgdorferi B31
EYANKWKIQEIIKK

SEQ ID NO: 79764 - protein, 14 aa, Borrelia burgdorferi B31
YANKWKIQEIIKKY

SEQ ID NO: 79765 - protein, 14 aa, Borrelia burgdorferi B31
ANKWKIQEIIKKYS

SEQ ID NO: 79766 - protein, 14 aa, Borrelia burgdorferi B31
NKWKIQEIIKKYSN

SEQ ID NO: 79767 - protein, 14 aa, Borrelia burgdorferi B31
KWKIQEIIKKYSNH

SEQ ID NO: 79768 - protein, 14 aa, Borrelia burgdorferi B31
WKIQEIIKKYSNHI

SEQ ID NO: 79769 - protein, 14 aa, Borrelia burgdorferi B31
KIQEIIKKYSNHIN

SEQ ID NO: 79770 - protein, 14 aa, Borrelia burgdorferi B31
IQEIIKKYSNHINY

SEQ ID NO: 79771 - protein, 14 aa, Borrelia burgdorferi B31
QEIIKKYSNHINYP

SEQ ID NO: 79772 - protein, 14 aa, Borrelia burgdorferi B31
EIIKKYSNHINYPI

SEQ ID NO: 79773 - protein, 14 aa, Borrelia burgdorferi B31
IIKKYSNHINYPIY

SEQ ID NO: 79774 - protein, 14 aa, Borrelia burgdorferi B31
IKKYSNHINYPIYI

SEQ ID NO: 79775 - protein, 14 aa, Borrelia burgdorferi B31
KKYSNHINYPIYIK

SEQ ID NO: 79776 - protein, 14 aa, Borrelia burgdorferi B31
KYSNHINYPIYIKY

SEQ ID NO: 79777 - protein, 14 aa, Borrelia burgdorferi B31
YSNHINYPIYIKYS

SEQ ID NO: 79778 - protein, 14 aa, Borrelia burgdorferi B31
SNHINYPIYIKYSE

SEQ ID NO: 79779 - protein, 14 aa, Borrelia burgdorferi B31
NHINYPIYIKYSEP

SEQ ID NO: 79780 - protein, 14 aa, Borrelia burgdorferi B31
HINYPIYIKYSEPI

SEQ ID NO: 79781 - protein, 14 aa, Borrelia burgdorferi B31
INYPIYIKYSEPIM

SEQ ID NO: 79782 - protein, 14 aa, Borrelia burgdorferi B31
NYPIYIKYSEPIMK

SEQ ID NO: 79783 - protein, 14 aa, Borrelia burgdorferi B31
YPIYIKYSEPIMKD

SEQ ID NO: 79784 - protein, 14 aa, Borrelia burgdorferi B31
PIYIKYSEPIMKDG

SEQ ID NO: 79785 - protein, 14 aa, Borrelia burgdorferi B31
IYIKYSEPIMKDGK

SEQ ID NO: 79786 - protein, 14 aa, Borrelia burgdorferi B31
YIKYSEPIMKDGKQ

SEQ ID NO: 79787 - protein, 14 aa, Borrelia burgdorferi B31
IKYSEPIMKDGKQE

SEQ ID NO: 79788 - protein, 14 aa, Borrelia burgdorferi B31
KYSEPIMKDGKQEG

SEQ ID NO: 79789 - protein, 14 aa, Borrelia burgdorferi B31
YSEPIMKDGKQEGI

SEQ ID NO: 79790 - protein, 14 aa, Borrelia burgdorferi B31
SEPIMKDGKQEGIE

SEQ ID NO: 79791 - protein, 14 aa, Borrelia burgdorferi B31
EPIMKDGKQEGIEE

SEQ ID NO: 79792 - protein, 14 aa, Borrelia burgdorferi B31
PIMKDGKQEGIEEK

SEQ ID NO: 79793 - protein, 14 aa, Borrelia burgdorferi B31
IMKDGKQEGIEEKE

SEQ ID NO: 79794 - protein, 14 aa, Borrelia burgdorferi B31
MKDGKQEGIEEKEE

SEQ ID NO: 79795 - protein, 14 aa, Borrelia burgdorferi B31
KDGKQEGIEEKEEK

SEQ ID NO: 79796 - protein, 14 aa, Borrelia burgdorferi B31
DGKQEGIEEKEEKL

SEQ ID NO: 79797 - protein, 14 aa, Borrelia burgdorferi B31
GKQEGIEEKEEKLN

SEQ ID NO: 79798 - protein, 14 aa, Borrelia burgdorferi B31
KQEGIEEKEEKLNE

SEQ ID NO: 79799 - protein, 14 aa, Borrelia burgdorferi B31
QEGIEEKEEKLNET

SEQ ID NO: 79800 - protein, 14 aa, Borrelia burgdorferi B31
EGIEEKEEKLNETT

SEQ ID NO: 79801 - protein, 14 aa, Borrelia burgdorferi B31
GIEEKEEKLNETTA

SEQ ID NO: 79802 - protein, 14 aa, Borrelia burgdorferi B31
IEEKEEKLNETTAL

SEQ ID NO: 79803 - protein, 14 aa, Borrelia burgdorferi B31
EEKEEKLNETTALW

SEQ ID NO: 79804 - protein, 14 aa, Borrelia burgdorferi B31
EKEEKLNETTALWT

SEQ ID NO: 79805 - protein, 14 aa, Borrelia burgdorferi B31
KEEKLNETTALWTK

SEQ ID NO: 79806 - protein, 14 aa, Borrelia burgdorferi B31
EEKLNETTALWTKN

SEQ ID NO: 79807 - protein, 14 aa, Borrelia burgdorferi B31
EKLNETTALWTKNK

SEQ ID NO: 79808 - protein, 14 aa, Borrelia burgdorferi B31
KLNETTALWTKNKS

SEQ ID NO: 79809 - protein, 14 aa, Borrelia burgdorferi B31
LNETTALWTKNKSE

SEQ ID NO: 79810 - protein, 14 aa, Borrelia burgdorferi B31
NETTALWTKNKSEI

SEQ ID NO: 79811 - protein, 14 aa, Borrelia burgdorferi B31
ETTALWTKNKSEIK

SEQ ID NO: 79812 - protein, 14 aa, Borrelia burgdorferi B31
TTALWTKNKSEIKA

SEQ ID NO: 79813 - protein, 14 aa, Borrelia burgdorferi B31
TALWTKNKSEIKAE

SEQ ID NO: 79814 - protein, 14 aa, Borrelia burgdorferi B31
ALWTKNKSEIKAEE

SEQ ID NO: 79815 - protein, 14 aa, Borrelia burgdorferi B31
LWTKNKSEIKAEEY

SEQ ID NO: 79816 - protein, 14 aa, Borrelia burgdorferi B31
WTKNKSEIKAEEYN

SEQ ID NO: 79817 - protein, 14 aa, Borrelia burgdorferi B31
TKNKSEIKAEEYNE

SEQ ID NO: 79818 - protein, 14 aa, Borrelia burgdorferi B31
KNKSEIKAEEYNEF

SEQ ID NO: 79819 - protein, 14 aa, Borrelia burgdorferi B31
NKSEIKAEEYNEFY

SEQ ID NO: 79820 - protein, 14 aa, Borrelia burgdorferi B31
KSEIKAEEYNEFYK

SEQ ID NO: 79821 - protein, 14 aa, Borrelia burgdorferi B31
SEIKAEEYNEFYKN

SEQ ID NO: 79822 - protein, 14 aa, Borrelia burgdorferi B31
EIKAEEYNEFYKNT

SEQ ID NO: 79823 - protein, 14 aa, Borrelia burgdorferi B31
IKAEEYNEFYKNTT

SEQ ID NO: 79824 - protein, 14 aa, Borrelia burgdorferi B31
KAEEYNEFYKNTTF

SEQ ID NO: 79825 - protein, 14 aa, Borrelia burgdorferi B31
AEEYNEFYKNTTFD

SEQ ID NO: 79826 - protein, 14 aa, Borrelia burgdorferi B31
EEYNEFYKNTTFDY

SEQ ID NO: 79827 - protein, 14 aa, Borrelia burgdorferi B31
EYNEFYKNTTFDYE

SEQ ID NO: 79828 - protein, 14 aa, Borrelia burgdorferi B31
YNEFYKNTTFDYEN

SEQ ID NO: 79829 - protein, 14 aa, Borrelia burgdorferi B31
NEFYKNTTFDYENP

SEQ ID NO: 79830 - protein, 14 aa, Borrelia burgdorferi B31
EFYKNTTFDYENPL

SEQ ID NO: 79831 - protein, 14 aa, Borrelia burgdorferi B31
FYKNTTFDYENPLM

SEQ ID NO: 79832 - protein, 14 aa, Borrelia burgdorferi B31
YKNTTFDYENPLMH

SEQ ID NO: 79833 - protein, 14 aa, Borrelia burgdorferi B31
KNTTFDYENPLMHI

SEQ ID NO: 79834 - protein, 14 aa, Borrelia burgdorferi B31
NTTFDYENPLMHIH

SEQ ID NO: 79835 - protein, 14 aa, Borrelia burgdorferi B31
TTFDYENPLMHIHT

SEQ ID NO: 79836 - protein, 14 aa, Borrelia burgdorferi B31
TFDYENPLMHIHTK

SEQ ID NO: 79837 - protein, 14 aa, Borrelia burgdorferi B31
FDYENPLMHIHTKA

SEQ ID NO: 79838 - protein, 14 aa, Borrelia burgdorferi B31
DYENPLMHIHTKAE

SEQ ID NO: 79839 - protein, 14 aa, Borrelia burgdorferi B31
YENPLMHIHTKAEG

SEQ ID NO: 79840 - protein, 14 aa, Borrelia burgdorferi B31
ENPLMHIHTKAEGN

SEQ ID NO: 79841 - protein, 14 aa, Borrelia burgdorferi B31
NPLMHIHTKAEGNL

SEQ ID NO: 79842 - protein, 14 aa, Borrelia burgdorferi B31
PLMHIHTKAEGNLE

SEQ ID NO: 79843 - protein, 14 aa, Borrelia burgdorferi B31
LMHIHTKAEGNLEY

SEQ ID NO: 79844 - protein, 14 aa, Borrelia burgdorferi B31
MHIHTKAEGNLEYT

SEQ ID NO: 79845 - protein, 14 aa, Borrelia burgdorferi B31
HIHTKAEGNLEYTN

SEQ ID NO: 79846 - protein, 14 aa, Borrelia burgdorferi B31
IHTKAEGNLEYTNL

SEQ ID NO: 79847 - protein, 14 aa, Borrelia burgdorferi B31
HTKAEGNLEYTNLF

SEQ ID NO: 79848 - protein, 14 aa, Borrelia burgdorferi B31
TKAEGNLEYTNLFY

SEQ ID NO: 79849 - protein, 14 aa, Borrelia burgdorferi B31
KAEGNLEYTNLFYV

SEQ ID NO: 79850 - protein, 14 aa, Borrelia burgdorferi B31
AEGNLEYTNLFYVP

SEQ ID NO: 79851 - protein, 14 aa, Borrelia burgdorferi B31
EGNLEYTNLFYVPS

SEQ ID NO: 79852 - protein, 14 aa, Borrelia burgdorferi B31
GNLEYTNLFYVPSK

SEQ ID NO: 79853 - protein, 14 aa, Borrelia burgdorferi B31
NLEYTNLFYVPSKA

SEQ ID NO: 79854 - protein, 14 aa, Borrelia burgdorferi B31
LEYTNLFYVPSKAP

SEQ ID NO: 79855 - protein, 14 aa, Borrelia burgdorferi B31
EYTNLFYVPSKAPY

SEQ ID NO: 79856 - protein, 14 aa, Borrelia burgdorferi B31
YTNLFYVPSKAPYD

SEQ ID NO: 79857 - protein, 14 aa, Borrelia burgdorferi B31
TNLFYVPSKAPYDL

SEQ ID NO: 79858 - protein, 14 aa, Borrelia burgdorferi B31
NLFYVPSKAPYDLY

SEQ ID NO: 79859 - protein, 14 aa, Borrelia burgdorferi B31
LFYVPSKAPYDLYY

SEQ ID NO: 79860 - protein, 14 aa, Borrelia burgdorferi B31
FYVPSKAPYDLYYP

SEQ ID NO: 79861 - protein, 14 aa, Borrelia burgdorferi B31
YVPSKAPYDLYYPN

SEQ ID NO: 79862 - protein, 14 aa, Borrelia burgdorferi B31
VPSKAPYDLYYPNT

SEQ ID NO: 79863 - protein, 14 aa, Borrelia burgdorferi B31
PSKAPYDLYYPNTK

SEQ ID NO: 79864 - protein, 14 aa, Borrelia burgdorferi B31
SKAPYDLYYPNTKP

SEQ ID NO: 79865 - protein, 14 aa, Borrelia burgdorferi B31
KAPYDLYYPNTKPG

SEQ ID NO: 79866 - protein, 14 aa, Borrelia burgdorferi B31
APYDLYYPNTKPGV

SEQ ID NO: 79867 - protein, 14 aa, Borrelia burgdorferi B31
PYDLYYPNTKPGVK

SEQ ID NO: 79868 - protein, 14 aa, Borrelia burgdorferi B31
YDLYYPNTKPGVKL

SEQ ID NO: 79869 - protein, 14 aa, Borrelia burgdorferi B31
DLYYPNTKPGVKLF

SEQ ID NO: 79870 - protein, 14 aa, Borrelia burgdorferi B31
LYYPNTKPGVKLFI

SEQ ID NO: 79871 - protein, 14 aa, Borrelia burgdorferi B31
YYPNTKPGVKLFIN

SEQ ID NO: 79872 - protein, 14 aa, Borrelia burgdorferi B31
YPNTKPGVKLFINR

SEQ ID NO: 79873 - protein, 14 aa, Borrelia burgdorferi B31
PNTKPGVKLFINRI

SEQ ID NO: 79874 - protein, 14 aa, Borrelia burgdorferi B31
NTKPGVKLFINRIF

SEQ ID NO: 79875 - protein, 14 aa, Borrelia burgdorferi B31
TKPGVKLFINRIFI

SEQ ID NO: 79876 - protein, 14 aa, Borrelia burgdorferi B31
KPGVKLFINRIFIT

SEQ ID NO: 79877 - protein, 14 aa, Borrelia burgdorferi B31
PGVKLFINRIFITD

SEQ ID NO: 79878 - protein, 14 aa, Borrelia burgdorferi B31
GVKLFINRIFITDS

SEQ ID NO: 79879 - protein, 14 aa, Borrelia burgdorferi B31
VKLFINRIFITDSE

SEQ ID NO: 79880 - protein, 14 aa, Borrelia burgdorferi B31
KLFINRIFITDSEG

SEQ ID NO: 79881 - protein, 14 aa, Borrelia burgdorferi B31
LFINRIFITDSEGS

SEQ ID NO: 79882 - protein, 14 aa, Borrelia burgdorferi B31
FINRIFITDSEGSL

SEQ ID NO: 79883 - protein, 14 aa, Borrelia burgdorferi B31
INRIFITDSEGSLL

SEQ ID NO: 79884 - protein, 14 aa, Borrelia burgdorferi B31
NRIFITDSEGSLLP

SEQ ID NO: 79885 - protein, 14 aa, Borrelia burgdorferi B31
RIFITDSEGSLLPN

SEQ ID NO: 79886 - protein, 14 aa, Borrelia burgdorferi B31
IFITDSEGSLLPNY

SEQ ID NO: 79887 - protein, 14 aa, Borrelia burgdorferi B31
FITDSEGSLLPNYL

SEQ ID NO: 79888 - protein, 14 aa, Borrelia burgdorferi B31
ITDSEGSLLPNYLR

SEQ ID NO: 79889 - protein, 14 aa, Borrelia burgdorferi B31
TDSEGSLLPNYLRF

SEQ ID NO: 79890 - protein, 14 aa, Borrelia burgdorferi B31
DSEGSLLPNYLRFI

SEQ ID NO: 79891 - protein, 14 aa, Borrelia burgdorferi B31
SEGSLLPNYLRFIK

SEQ ID NO: 79892 - protein, 14 aa, Borrelia burgdorferi B31
EGSLLPNYLRFIKG

SEQ ID NO: 79893 - protein, 14 aa, Borrelia burgdorferi B31
GSLLPNYLRFIKGI

SEQ ID NO: 79894 - protein, 14 aa, Borrelia burgdorferi B31
SLLPNYLRFIKGII

SEQ ID NO: 79895 - protein, 14 aa, Borrelia burgdorferi B31
LLPNYLRFIKGIID

SEQ ID NO: 79896 - protein, 14 aa, Borrelia burgdorferi B31
LPNYLRFIKGIIDC

SEQ ID NO: 79897 - protein, 14 aa, Borrelia burgdorferi B31
PNYLRFIKGIIDCQ

SEQ ID NO: 79898 - protein, 14 aa, Borrelia burgdorferi B31
NYLRFIKGIIDCQD

SEQ ID NO: 79899 - protein, 14 aa, Borrelia burgdorferi B31
YLRFIKGIIDCQDL

SEQ ID NO: 79900 - protein, 14 aa, Borrelia burgdorferi B31
LRFIKGIIDCQDLP

SEQ ID NO: 79901 - protein, 14 aa, Borrelia burgdorferi B31
RFIKGIIDCQDLPL

SEQ ID NO: 79902 - protein, 14 aa, Borrelia burgdorferi B31
FIKGIIDCQDLPLN

SEQ ID NO: 79903 - protein, 14 aa, Borrelia burgdorferi B31
IKGIIDCQDLPLNV

SEQ ID NO: 79904 - protein, 14 aa, Borrelia burgdorferi B31
KGIIDCQDLPLNVS

SEQ ID NO: 79905 - protein, 14 aa, Borrelia burgdorferi B31
GIIDCQDLPLNVSR

SEQ ID NO: 79906 - protein, 14 aa, Borrelia burgdorferi B31
IIDCQDLPLNVSRE

SEQ ID NO: 79907 - protein, 14 aa, Borrelia burgdorferi B31
IDCQDLPLNVSREI

SEQ ID NO: 79908 - protein, 14 aa, Borrelia burgdorferi B31
DCQDLPLNVSREIL

SEQ ID NO: 79909 - protein, 14 aa, Borrelia burgdorferi B31
CQDLPLNVSREILQ

SEQ ID NO: 79910 - protein, 14 aa, Borrelia burgdorferi B31
QDLPLNVSREILQQ

SEQ ID NO: 79911 - protein, 14 aa, Borrelia burgdorferi B31
DLPLNVSREILQQN

SEQ ID NO: 79912 - protein, 14 aa, Borrelia burgdorferi B31
LPLNVSREILQQNK

SEQ ID NO: 79913 - protein, 14 aa, Borrelia burgdorferi B31
PLNVSREILQQNKI

SEQ ID NO: 79914 - protein, 14 aa, Borrelia burgdorferi B31
LNVSREILQQNKIL

SEQ ID NO: 79915 - protein, 14 aa, Borrelia burgdorferi B31
NVSREILQQNKILS

SEQ ID NO: 79916 - protein, 14 aa, Borrelia burgdorferi B31
VSREILQQNKILSK

SEQ ID NO: 79917 - protein, 14 aa, Borrelia burgdorferi B31
SREILQQNKILSKI

SEQ ID NO: 79918 - protein, 14 aa, Borrelia burgdorferi B31
REILQQNKILSKIK

SEQ ID NO: 79919 - protein, 14 aa, Borrelia burgdorferi B31
EILQQNKILSKIKS

SEQ ID NO: 79920 - protein, 14 aa, Borrelia burgdorferi B31
ILQQNKILSKIKSS

SEQ ID NO: 79921 - protein, 14 aa, Borrelia burgdorferi B31
LQQNKILSKIKSSS

SEQ ID NO: 79922 - protein, 14 aa, Borrelia burgdorferi B31
QQNKILSKIKSSSV

SEQ ID NO: 79923 - protein, 14 aa, Borrelia burgdorferi B31
QNKILSKIKSSSVK

SEQ ID NO: 79924 - protein, 14 aa, Borrelia burgdorferi B31
NKILSKIKSSSVKK

SEQ ID NO: 79925 - protein, 14 aa, Borrelia burgdorferi B31
KILSKIKSSSVKKI

SEQ ID NO: 79926 - protein, 14 aa, Borrelia burgdorferi B31
ILSKIKSSSVKKIL

SEQ ID NO: 79927 - protein, 14 aa, Borrelia burgdorferi B31
LSKIKSSSVKKILS

SEQ ID NO: 79928 - protein, 14 aa, Borrelia burgdorferi B31
SKIKSSSVKKILSE

SEQ ID NO: 79929 - protein, 14 aa, Borrelia burgdorferi B31
KIKSSSVKKILSEL

SEQ ID NO: 79930 - protein, 14 aa, Borrelia burgdorferi B31
IKSSSVKKILSELE

SEQ ID NO: 79931 - protein, 14 aa, Borrelia burgdorferi B31
KSSSVKKILSELEK

SEQ ID NO: 79932 - protein, 14 aa, Borrelia burgdorferi B31
SSSVKKILSELEKL

SEQ ID NO: 79933 - protein, 14 aa, Borrelia burgdorferi B31
SSVKKILSELEKLS

SEQ ID NO: 79934 - protein, 14 aa, Borrelia burgdorferi B31
SVKKILSELEKLSK

SEQ ID NO: 79935 - protein, 14 aa, Borrelia burgdorferi B31
VKKILSELEKLSKK

SEQ ID NO: 79936 - protein, 14 aa, Borrelia burgdorferi B31
KKILSELEKLSKKN

SEQ ID NO: 79937 - protein, 14 aa, Borrelia burgdorferi B31
KILSELEKLSKKNP

SEQ ID NO: 79938 - protein, 14 aa, Borrelia burgdorferi B31
ILSELEKLSKKNPE

SEQ ID NO: 79939 - protein, 14 aa, Borrelia burgdorferi B31
LSELEKLSKKNPEK

SEQ ID NO: 79940 - protein, 14 aa, Borrelia burgdorferi B31
SELEKLSKKNPEKF

SEQ ID NO: 79941 - protein, 14 aa, Borrelia burgdorferi B31
ELEKLSKKNPEKFS

SEQ ID NO: 79942 - protein, 14 aa, Borrelia burgdorferi B31
LEKLSKKNPEKFSE

SEQ ID NO: 79943 - protein, 14 aa, Borrelia burgdorferi B31
EKLSKKNPEKFSEF

SEQ ID NO: 79944 - protein, 14 aa, Borrelia burgdorferi B31
KLSKKNPEKFSEFS

SEQ ID NO: 79945 - protein, 14 aa, Borrelia burgdorferi B31
LSKKNPEKFSEFSK

SEQ ID NO: 79946 - protein, 14 aa, Borrelia burgdorferi B31
SKKNPEKFSEFSKE

SEQ ID NO: 79947 - protein, 14 aa, Borrelia burgdorferi B31
KKNPEKFSEFSKEF

SEQ ID NO: 79948 - protein, 14 aa, Borrelia burgdorferi B31
KNPEKFSEFSKEFG

SEQ ID NO: 79949 - protein, 14 aa, Borrelia burgdorferi B31
NPEKFSEFSKEFGR

SEQ ID NO: 79950 - protein, 14 aa, Borrelia burgdorferi B31
PEKFSEFSKEFGRC

SEQ ID NO: 79951 - protein, 14 aa, Borrelia burgdorferi B31
EKFSEFSKEFGRCI

SEQ ID NO: 79952 - protein, 14 aa, Borrelia burgdorferi B31
KFSEFSKEFGRCIK

SEQ ID NO: 79953 - protein, 14 aa, Borrelia burgdorferi B31
FSEFSKEFGRCIKE

SEQ ID NO: 79954 - protein, 14 aa, Borrelia burgdorferi B31
SEFSKEFGRCIKEG

SEQ ID NO: 79955 - protein, 14 aa, Borrelia burgdorferi B31
EFSKEFGRCIKEGV

SEQ ID NO: 79956 - protein, 14 aa, Borrelia burgdorferi B31
FSKEFGRCIKEGVY

SEQ ID NO: 79957 - protein, 14 aa, Borrelia burgdorferi B31
SKEFGRCIKEGVYS

SEQ ID NO: 79958 - protein, 14 aa, Borrelia burgdorferi B31
KEFGRCIKEGVYSD

SEQ ID NO: 79959 - protein, 14 aa, Borrelia burgdorferi B31
EFGRCIKEGVYSDF

SEQ ID NO: 79960 - protein, 14 aa, Borrelia burgdorferi B31
FGRCIKEGVYSDFE

SEQ ID NO: 79961 - protein, 14 aa, Borrelia burgdorferi B31
GRCIKEGVYSDFEN

SEQ ID NO: 79962 - protein, 14 aa, Borrelia burgdorferi B31
RCIKEGVYSDFENR

SEQ ID NO: 79963 - protein, 14 aa, Borrelia burgdorferi B31
CIKEGVYSDFENRE

SEQ ID NO: 79964 - protein, 14 aa, Borrelia burgdorferi B31
IKEGVYSDFENREK

SEQ ID NO: 79965 - protein, 14 aa, Borrelia burgdorferi B31
KEGVYSDFENREKL

SEQ ID NO: 79966 - protein, 14 aa, Borrelia burgdorferi B31
EGVYSDFENREKLI

SEQ ID NO: 79967 - protein, 14 aa, Borrelia burgdorferi B31
GVYSDFENREKLIS

SEQ ID NO: 79968 - protein, 14 aa, Borrelia burgdorferi B31
VYSDFENREKLISL

SEQ ID NO: 79969 - protein, 14 aa, Borrelia burgdorferi B31
YSDFENREKLISLI

SEQ ID NO: 79970 - protein, 14 aa, Borrelia burgdorferi B31
SDFENREKLISLIR

SEQ ID NO: 79971 - protein, 14 aa, Borrelia burgdorferi B31
DFENREKLISLIRF

SEQ ID NO: 79972 - protein, 14 aa, Borrelia burgdorferi B31
FENREKLISLIRFK

SEQ ID NO: 79973 - protein, 14 aa, Borrelia burgdorferi B31
ENREKLISLIRFKS

SEQ ID NO: 79974 - protein, 14 aa, Borrelia burgdorferi B31
NREKLISLIRFKSS

SEQ ID NO: 79975 - protein, 14 aa, Borrelia burgdorferi B31
REKLISLIRFKSSS

SEQ ID NO: 79976 - protein, 14 aa, Borrelia burgdorferi B31
EKLISLIRFKSSSV

SEQ ID NO: 79977 - protein, 14 aa, Borrelia burgdorferi B31
KLISLIRFKSSSVD

SEQ ID NO: 79978 - protein, 14 aa, Borrelia burgdorferi B31
LISLIRFKSSSVDG

SEQ ID NO: 79979 - protein, 14 aa, Borrelia burgdorferi B31
ISLIRFKSSSVDGF

SEQ ID NO: 79980 - protein, 14 aa, Borrelia burgdorferi B31
SLIRFKSSSVDGFV

SEQ ID NO: 79981 - protein, 14 aa, Borrelia burgdorferi B31
LIRFKSSSVDGFVS

SEQ ID NO: 79982 - protein, 14 aa, Borrelia burgdorferi B31
IRFKSSSVDGFVSF

SEQ ID NO: 79983 - protein, 14 aa, Borrelia burgdorferi B31
RFKSSSVDGFVSFK

SEQ ID NO: 79984 - protein, 14 aa, Borrelia burgdorferi B31
FKSSSVDGFVSFKE

SEQ ID NO: 79985 - protein, 14 aa, Borrelia burgdorferi B31
KSSSVDGFVSFKEY

SEQ ID NO: 79986 - protein, 14 aa, Borrelia burgdorferi B31
SSSVDGFVSFKEYK

SEQ ID NO: 79987 - protein, 14 aa, Borrelia burgdorferi B31
SSVDGFVSFKEYKE

SEQ ID NO: 79988 - protein, 14 aa, Borrelia burgdorferi B31
SVDGFVSFKEYKER

SEQ ID NO: 79989 - protein, 14 aa, Borrelia burgdorferi B31
VDGFVSFKEYKERM

SEQ ID NO: 79990 - protein, 14 aa, Borrelia burgdorferi B31
DGFVSFKEYKERMN

SEQ ID NO: 79991 - protein, 14 aa, Borrelia burgdorferi B31
GFVSFKEYKERMNE

SEQ ID NO: 79992 - protein, 14 aa, Borrelia burgdorferi B31
FVSFKEYKERMNES

SEQ ID NO: 79993 - protein, 14 aa, Borrelia burgdorferi B31
VSFKEYKERMNESQ

SEQ ID NO: 79994 - protein, 14 aa, Borrelia burgdorferi B31
SFKEYKERMNESQK

SEQ ID NO: 79995 - protein, 14 aa, Borrelia burgdorferi B31
FKEYKERMNESQKS

SEQ ID NO: 79996 - protein, 14 aa, Borrelia burgdorferi B31
KEYKERMNESQKSI

SEQ ID NO: 79997 - protein, 14 aa, Borrelia burgdorferi B31
EYKERMNESQKSIY

SEQ ID NO: 79998 - protein, 14 aa, Borrelia burgdorferi B31
YKERMNESQKSIYY

SEQ ID NO: 79999 - protein, 14 aa, Borrelia burgdorferi B31
KERMNESQKSIYYI

SEQ ID NO: 80000 - protein, 14 aa, Borrelia burgdorferi B31
ERMNESQKSIYYIT

SEQ ID NO: 80001 - protein, 14 aa, Borrelia burgdorferi B31
RMNESQKSIYYITG

SEQ ID NO: 80002 - protein, 14 aa, Borrelia burgdorferi B31
MNESQKSIYYITGG

SEQ ID NO: 80003 - protein, 14 aa, Borrelia burgdorferi B31
NESQKSIYYITGGK

SEQ ID NO: 80004 - protein, 14 aa, Borrelia burgdorferi B31
ESQKSIYYITGGKE

SEQ ID NO: 80005 - protein, 14 aa, Borrelia burgdorferi B31
SQKSIYYITGGKEN

SEQ ID NO: 80006 - protein, 14 aa, Borrelia burgdorferi B31
QKSIYYITGGKENI

SEQ ID NO: 80007 - protein, 14 aa, Borrelia burgdorferi B31
KSIYYITGGKENIL

SEQ ID NO: 80008 - protein, 14 aa, Borrelia burgdorferi B31
SIYYITGGKENILK

SEQ ID NO: 80009 - protein, 14 aa, Borrelia burgdorferi B31
IYYITGGKENILKE

SEQ ID NO: 80010 - protein, 14 aa, Borrelia burgdorferi B31
YYITGGKENILKEN

SEQ ID NO: 80011 - protein, 14 aa, Borrelia burgdorferi B31
YITGGKENILKENP

SEQ ID NO: 80012 - protein, 14 aa, Borrelia burgdorferi B31
ITGGKENILKENPI

SEQ ID NO: 80013 - protein, 14 aa, Borrelia burgdorferi B31
TGGKENILKENPIV

SEQ ID NO: 80014 - protein, 14 aa, Borrelia burgdorferi B31
GGKENILKENPIVA

SEQ ID NO: 80015 - protein, 14 aa, Borrelia burgdorferi B31
GKENILKENPIVAA

SEQ ID NO: 80016 - protein, 14 aa, Borrelia burgdorferi B31
KENILKENPIVAAY

SEQ ID NO: 80017 - protein, 14 aa, Borrelia burgdorferi B31
ENILKENPIVAAYK

SEQ ID NO: 80018 - protein, 14 aa, Borrelia burgdorferi B31
NILKENPIVAAYKE

SEQ ID NO: 80019 - protein, 14 aa, Borrelia burgdorferi B31
ILKENPIVAAYKEK

SEQ ID NO: 80020 - protein, 14 aa, Borrelia burgdorferi B31
LKENPIVAAYKEKG

SEQ ID NO: 80021 - protein, 14 aa, Borrelia burgdorferi B31
KENPIVAAYKEKGF

SEQ ID NO: 80022 - protein, 14 aa, Borrelia burgdorferi B31
ENPIVAAYKEKGFE

SEQ ID NO: 80023 - protein, 14 aa, Borrelia burgdorferi B31
NPIVAAYKEKGFEI

SEQ ID NO: 80024 - protein, 14 aa, Borrelia burgdorferi B31
PIVAAYKEKGFEIL

SEQ ID NO: 80025 - protein, 14 aa, Borrelia burgdorferi B31
IVAAYKEKGFEILI

SEQ ID NO: 80026 - protein, 14 aa, Borrelia burgdorferi B31
VAAYKEKGFEILIM

SEQ ID NO: 80027 - protein, 14 aa, Borrelia burgdorferi B31
AAYKEKGFEILIMD

SEQ ID NO: 80028 - protein, 14 aa, Borrelia burgdorferi B31
AYKEKGFEILIMDD

SEQ ID NO: 80029 - protein, 14 aa, Borrelia burgdorferi B31
YKEKGFEILIMDDE

SEQ ID NO: 80030 - protein, 14 aa, Borrelia burgdorferi B31
KEKGFEILIMDDEL

SEQ ID NO: 80031 - protein, 14 aa, Borrelia burgdorferi B31
EKGFEILIMDDELD

SEQ ID NO: 80032 - protein, 14 aa, Borrelia burgdorferi B31
KGFEILIMDDELDE

SEQ ID NO: 80033 - protein, 14 aa, Borrelia burgdorferi B31
GFEILIMDDELDEA

SEQ ID NO: 80034 - protein, 14 aa, Borrelia burgdorferi B31
FEILIMDDELDEAI

SEQ ID NO: 80035 - protein, 14 aa, Borrelia burgdorferi B31
EILIMDDELDEAIL

SEQ ID NO: 80036 - protein, 14 aa, Borrelia burgdorferi B31
ILIMDDELDEAILN

SEQ ID NO: 80037 - protein, 14 aa, Borrelia burgdorferi B31
LIMDDELDEAILNL

SEQ ID NO: 80038 - protein, 14 aa, Borrelia burgdorferi B31
IMDDELDEAILNLI

SEQ ID NO: 80039 - protein, 14 aa, Borrelia burgdorferi B31
MDDELDEAILNLIP

SEQ ID NO: 80040 - protein, 14 aa, Borrelia burgdorferi B31
DDELDEAILNLIPE

SEQ ID NO: 80041 - protein, 14 aa, Borrelia burgdorferi B31
DELDEAILNLIPEY

SEQ ID NO: 80042 - protein, 14 aa, Borrelia burgdorferi B31
ELDEAILNLIPEYE

SEQ ID NO: 80043 - protein, 14 aa, Borrelia burgdorferi B31
LDEAILNLIPEYEG

SEQ ID NO: 80044 - protein, 14 aa, Borrelia burgdorferi B31
DEAILNLIPEYEGL

SEQ ID NO: 80045 - protein, 14 aa, Borrelia burgdorferi B31
EAILNLIPEYEGLK

SEQ ID NO: 80046 - protein, 14 aa, Borrelia burgdorferi B31
AILNLIPEYEGLKL

SEQ ID NO: 80047 - protein, 14 aa, Borrelia burgdorferi B31
ILNLIPEYEGLKLK

SEQ ID NO: 80048 - protein, 14 aa, Borrelia burgdorferi B31
LNLIPEYEGLKLKA

SEQ ID NO: 80049 - protein, 14 aa, Borrelia burgdorferi B31
NLIPEYEGLKLKAI

SEQ ID NO: 80050 - protein, 14 aa, Borrelia burgdorferi B31
LIPEYEGLKLKAIN

SEQ ID NO: 80051 - protein, 14 aa, Borrelia burgdorferi B31
IPEYEGLKLKAINK

SEQ ID NO: 80052 - protein, 14 aa, Borrelia burgdorferi B31
PEYEGLKLKAINKN

SEQ ID NO: 80053 - protein, 14 aa, Borrelia burgdorferi B31
EYEGLKLKAINKNE

SEQ ID NO: 80054 - protein, 14 aa, Borrelia burgdorferi B31
YEGLKLKAINKNET

SEQ ID NO: 80055 - protein, 14 aa, Borrelia burgdorferi B31
EGLKLKAINKNETS

SEQ ID NO: 80056 - protein, 14 aa, Borrelia burgdorferi B31
GLKLKAINKNETSN

SEQ ID NO: 80057 - protein, 14 aa, Borrelia burgdorferi B31
LKLKAINKNETSNE

SEQ ID NO: 80058 - protein, 14 aa, Borrelia burgdorferi B31
KLKAINKNETSNEL

SEQ ID NO: 80059 - protein, 14 aa, Borrelia burgdorferi B31
LKAINKNETSNELK

SEQ ID NO: 80060 - protein, 14 aa, Borrelia burgdorferi B31
KAINKNETSNELKD

SEQ ID NO: 80061 - protein, 14 aa, Borrelia burgdorferi B31
AINKNETSNELKDE

SEQ ID NO: 80062 - protein, 14 aa, Borrelia burgdorferi B31
INKNETSNELKDEN

SEQ ID NO: 80063 - protein, 14 aa, Borrelia burgdorferi B31
NKNETSNELKDENF

SEQ ID NO: 80064 - protein, 14 aa, Borrelia burgdorferi B31
KNETSNELKDENFK

SEQ ID NO: 80065 - protein, 14 aa, Borrelia burgdorferi B31
NETSNELKDENFKK

SEQ ID NO: 80066 - protein, 14 aa, Borrelia burgdorferi B31
ETSNELKDENFKKI

SEQ ID NO: 80067 - protein, 14 aa, Borrelia burgdorferi B31
TSNELKDENFKKIE

SEQ ID NO: 80068 - protein, 14 aa, Borrelia burgdorferi B31
SNELKDENFKKIEE

SEQ ID NO: 80069 - protein, 14 aa, Borrelia burgdorferi B31
NELKDENFKKIEEE

SEQ ID NO: 80070 - protein, 14 aa, Borrelia burgdorferi B31
ELKDENFKKIEEEF

SEQ ID NO: 80071 - protein, 14 aa, Borrelia burgdorferi B31
LKDENFKKIEEEFK

SEQ ID NO: 80072 - protein, 14 aa, Borrelia burgdorferi B31
KDENFKKIEEEFKD

SEQ ID NO: 80073 - protein, 14 aa, Borrelia burgdorferi B31
DENFKKIEEEFKDT

SEQ ID NO: 80074 - protein, 14 aa, Borrelia burgdorferi B31
ENFKKIEEEFKDTL

SEQ ID NO: 80075 - protein, 14 aa, Borrelia burgdorferi B31
NFKKIEEEFKDTLT

SEQ ID NO: 80076 - protein, 14 aa, Borrelia burgdorferi B31
FKKIEEEFKDTLTK

SEQ ID NO: 80077 - protein, 14 aa, Borrelia burgdorferi B31
KKIEEEFKDTLTKV

SEQ ID NO: 80078 - protein, 14 aa, Borrelia burgdorferi B31
KIEEEFKDTLTKVK

SEQ ID NO: 80079 - protein, 14 aa, Borrelia burgdorferi B31
IEEEFKDTLTKVKE

SEQ ID NO: 80080 - protein, 14 aa, Borrelia burgdorferi B31
EEEFKDTLTKVKEI

SEQ ID NO: 80081 - protein, 14 aa, Borrelia burgdorferi B31
EEFKDTLTKVKEIL

SEQ ID NO: 80082 - protein, 14 aa, Borrelia burgdorferi B31
EFKDTLTKVKEILK

SEQ ID NO: 80083 - protein, 14 aa, Borrelia burgdorferi B31
FKDTLTKVKEILKD

SEQ ID NO: 80084 - protein, 14 aa, Borrelia burgdorferi B31
KDTLTKVKEILKDH

SEQ ID NO: 80085 - protein, 14 aa, Borrelia burgdorferi B31
DTLTKVKEILKDHI

SEQ ID NO: 80086 - protein, 14 aa, Borrelia burgdorferi B31
TLTKVKEILKDHIK

SEQ ID NO: 80087 - protein, 14 aa, Borrelia burgdorferi B31
LTKVKEILKDHIKE

SEQ ID NO: 80088 - protein, 14 aa, Borrelia burgdorferi B31
TKVKEILKDHIKEV

SEQ ID NO: 80089 - protein, 14 aa, Borrelia burgdorferi B31
KVKEILKDHIKEVN

SEQ ID NO: 80090 - protein, 14 aa, Borrelia burgdorferi B31
VKEILKDHIKEVNL

SEQ ID NO: 80091 - protein, 14 aa, Borrelia burgdorferi B31
KEILKDHIKEVNLS

SEQ ID NO: 80092 - protein, 14 aa, Borrelia burgdorferi B31
EILKDHIKEVNLSA

SEQ ID NO: 80093 - protein, 14 aa, Borrelia burgdorferi B31
ILKDHIKEVNLSAT

SEQ ID NO: 80094 - protein, 14 aa, Borrelia burgdorferi B31
LKDHIKEVNLSATL

SEQ ID NO: 80095 - protein, 14 aa, Borrelia burgdorferi B31
KDHIKEVNLSATLI

SEQ ID NO: 80096 - protein, 14 aa, Borrelia burgdorferi B31
DHIKEVNLSATLIK

SEQ ID NO: 80097 - protein, 14 aa, Borrelia burgdorferi B31
HIKEVNLSATLIKE

SEQ ID NO: 80098 - protein, 14 aa, Borrelia burgdorferi B31
IKEVNLSATLIKEP

SEQ ID NO: 80099 - protein, 14 aa, Borrelia burgdorferi B31
KEVNLSATLIKEPS

SEQ ID NO: 80100 - protein, 14 aa, Borrelia burgdorferi B31
EVNLSATLIKEPSA

SEQ ID NO: 80101 - protein, 14 aa, Borrelia burgdorferi B31
VNLSATLIKEPSAI

SEQ ID NO: 80102 - protein, 14 aa, Borrelia burgdorferi B31
NLSATLIKEPSAII

SEQ ID NO: 80103 - protein, 14 aa, Borrelia burgdorferi B31
LSATLIKEPSAIII

SEQ ID NO: 80104 - protein, 14 aa, Borrelia burgdorferi B31
SATLIKEPSAIIID

SEQ ID NO: 80105 - protein, 14 aa, Borrelia burgdorferi B31
ATLIKEPSAIIIDS

SEQ ID NO: 80106 - protein, 14 aa, Borrelia burgdorferi B31
TLIKEPSAIIIDSN

SEQ ID NO: 80107 - protein, 14 aa, Borrelia burgdorferi B31
LIKEPSAIIIDSND

SEQ ID NO: 80108 - protein, 14 aa, Borrelia burgdorferi B31
IKEPSAIIIDSNDP

SEQ ID NO: 80109 - protein, 14 aa, Borrelia burgdorferi B31
KEPSAIIIDSNDPT

SEQ ID NO: 80110 - protein, 14 aa, Borrelia burgdorferi B31
EPSAIIIDSNDPTY

SEQ ID NO: 80111 - protein, 14 aa, Borrelia burgdorferi B31
PSAIIIDSNDPTYQ

SEQ ID NO: 80112 - protein, 14 aa, Borrelia burgdorferi B31
SAIIIDSNDPTYQM

SEQ ID NO: 80113 - protein, 14 aa, Borrelia burgdorferi B31
AIIIDSNDPTYQMQ

SEQ ID NO: 80114 - protein, 14 aa, Borrelia burgdorferi B31
IIIDSNDPTYQMQK

SEQ ID NO: 80115 - protein, 14 aa, Borrelia burgdorferi B31
IIDSNDPTYQMQKI

SEQ ID NO: 80116 - protein, 14 aa, Borrelia burgdorferi B31
IDSNDPTYQMQKIM

SEQ ID NO: 80117 - protein, 14 aa, Borrelia burgdorferi B31
DSNDPTYQMQKIML

SEQ ID NO: 80118 - protein, 14 aa, Borrelia burgdorferi B31
SNDPTYQMQKIMLS

SEQ ID NO: 80119 - protein, 14 aa, Borrelia burgdorferi B31
NDPTYQMQKIMLSM

SEQ ID NO: 80120 - protein, 14 aa, Borrelia burgdorferi B31
DPTYQMQKIMLSMG

SEQ ID NO: 80121 - protein, 14 aa, Borrelia burgdorferi B31
PTYQMQKIMLSMGQ

SEQ ID NO: 80122 - protein, 14 aa, Borrelia burgdorferi B31
TYQMQKIMLSMGQE

SEQ ID NO: 80123 - protein, 14 aa, Borrelia burgdorferi B31
YQMQKIMLSMGQEV

SEQ ID NO: 80124 - protein, 14 aa, Borrelia burgdorferi B31
QMQKIMLSMGQEVK

SEQ ID NO: 80125 - protein, 14 aa, Borrelia burgdorferi B31
MQKIMLSMGQEVKE

SEQ ID NO: 80126 - protein, 14 aa, Borrelia burgdorferi B31
QKIMLSMGQEVKEI

SEQ ID NO: 80127 - protein, 14 aa, Borrelia burgdorferi B31
KIMLSMGQEVKEIK

SEQ ID NO: 80128 - protein, 14 aa, Borrelia burgdorferi B31
IMLSMGQEVKEIKP

SEQ ID NO: 80129 - protein, 14 aa, Borrelia burgdorferi B31
MLSMGQEVKEIKPI

SEQ ID NO: 80130 - protein, 14 aa, Borrelia burgdorferi B31
LSMGQEVKEIKPIL

SEQ ID NO: 80131 - protein, 14 aa, Borrelia burgdorferi B31
SMGQEVKEIKPILE

SEQ ID NO: 80132 - protein, 14 aa, Borrelia burgdorferi B31
MGQEVKEIKPILEL

SEQ ID NO: 80133 - protein, 14 aa, Borrelia burgdorferi B31
GQEVKEIKPILELN

SEQ ID NO: 80134 - protein, 14 aa, Borrelia burgdorferi B31
QEVKEIKPILELNP

SEQ ID NO: 80135 - protein, 14 aa, Borrelia burgdorferi B31
EVKEIKPILELNPN

SEQ ID NO: 80136 - protein, 14 aa, Borrelia burgdorferi B31
VKEIKPILELNPNN

SEQ ID NO: 80137 - protein, 14 aa, Borrelia burgdorferi B31
KEIKPILELNPNNK

SEQ ID NO: 80138 - protein, 14 aa, Borrelia burgdorferi B31
EIKPILELNPNNKI

SEQ ID NO: 80139 - protein, 14 aa, Borrelia burgdorferi B31
IKPILELNPNNKIV

SEQ ID NO: 80140 - protein, 14 aa, Borrelia burgdorferi B31
KPILELNPNNKIVQ

SEQ ID NO: 80141 - protein, 14 aa, Borrelia burgdorferi B31
PILELNPNNKIVQN

SEQ ID NO: 80142 - protein, 14 aa, Borrelia burgdorferi B31
ILELNPNNKIVQNL

SEQ ID NO: 80143 - protein, 14 aa, Borrelia burgdorferi B31
LELNPNNKIVQNLK

SEQ ID NO: 80144 - protein, 14 aa, Borrelia burgdorferi B31
ELNPNNKIVQNLKN

SEQ ID NO: 80145 - protein, 14 aa, Borrelia burgdorferi B31
LNPNNKIVQNLKNL

SEQ ID NO: 80146 - protein, 14 aa, Borrelia burgdorferi B31
NPNNKIVQNLKNLE

SEQ ID NO: 80147 - protein, 14 aa, Borrelia burgdorferi B31
PNNKIVQNLKNLEP

SEQ ID NO: 80148 - protein, 14 aa, Borrelia burgdorferi B31
NNKIVQNLKNLEPE

SEQ ID NO: 80149 - protein, 14 aa, Borrelia burgdorferi B31
NKIVQNLKNLEPEK

SEQ ID NO: 80150 - protein, 14 aa, Borrelia burgdorferi B31
KIVQNLKNLEPEKL

SEQ ID NO: 80151 - protein, 14 aa, Borrelia burgdorferi B31
IVQNLKNLEPEKLE

SEQ ID NO: 80152 - protein, 14 aa, Borrelia burgdorferi B31
VQNLKNLEPEKLEK

SEQ ID NO: 80153 - protein, 14 aa, Borrelia burgdorferi B31
QNLKNLEPEKLEKI

SEQ ID NO: 80154 - protein, 14 aa, Borrelia burgdorferi B31
NLKNLEPEKLEKIS

SEQ ID NO: 80155 - protein, 14 aa, Borrelia burgdorferi B31
LKNLEPEKLEKISI

SEQ ID NO: 80156 - protein, 14 aa, Borrelia burgdorferi B31
KNLEPEKLEKISIL

SEQ ID NO: 80157 - protein, 14 aa, Borrelia burgdorferi B31
NLEPEKLEKISILL

SEQ ID NO: 80158 - protein, 14 aa, Borrelia burgdorferi B31
LEPEKLEKISILLF

SEQ ID NO: 80159 - protein, 14 aa, Borrelia burgdorferi B31
EPEKLEKISILLFE

SEQ ID NO: 80160 - protein, 14 aa, Borrelia burgdorferi B31
PEKLEKISILLFEE

SEQ ID NO: 80161 - protein, 14 aa, Borrelia burgdorferi B31
EKLEKISILLFEEA

SEQ ID NO: 80162 - protein, 14 aa, Borrelia burgdorferi B31
KLEKISILLFEEAM

SEQ ID NO: 80163 - protein, 14 aa, Borrelia burgdorferi B31
LEKISILLFEEAML

SEQ ID NO: 80164 - protein, 14 aa, Borrelia burgdorferi B31
EKISILLFEEAMLT

SEQ ID NO: 80165 - protein, 14 aa, Borrelia burgdorferi B31
KISILLFEEAMLTS

SEQ ID NO: 80166 - protein, 14 aa, Borrelia burgdorferi B31
ISILLFEEAMLTSG

SEQ ID NO: 80167 - protein, 14 aa, Borrelia burgdorferi B31
SILLFEEAMLTSGM

SEQ ID NO: 80168 - protein, 14 aa, Borrelia burgdorferi B31
ILLFEEAMLTSGMP

SEQ ID NO: 80169 - protein, 14 aa, Borrelia burgdorferi B31
LLFEEAMLTSGMPS

SEQ ID NO: 80170 - protein, 14 aa, Borrelia burgdorferi B31
LFEEAMLTSGMPSK

SEQ ID NO: 80171 - protein, 14 aa, Borrelia burgdorferi B31
FEEAMLTSGMPSKN

SEQ ID NO: 80172 - protein, 14 aa, Borrelia burgdorferi B31
EEAMLTSGMPSKNP

SEQ ID NO: 80173 - protein, 14 aa, Borrelia burgdorferi B31
EAMLTSGMPSKNPG

SEQ ID NO: 80174 - protein, 14 aa, Borrelia burgdorferi B31
AMLTSGMPSKNPGK

SEQ ID NO: 80175 - protein, 14 aa, Borrelia burgdorferi B31
MLTSGMPSKNPGKF

SEQ ID NO: 80176 - protein, 14 aa, Borrelia burgdorferi B31
LTSGMPSKNPGKFI

SEQ ID NO: 80177 - protein, 14 aa, Borrelia burgdorferi B31
TSGMPSKNPGKFIN

SEQ ID NO: 80178 - protein, 14 aa, Borrelia burgdorferi B31
SGMPSKNPGKFINI

SEQ ID NO: 80179 - protein, 14 aa, Borrelia burgdorferi B31
GMPSKNPGKFINII

SEQ ID NO: 80180 - protein, 14 aa, Borrelia burgdorferi B31
MPSKNPGKFINIIN

SEQ ID NO: 80181 - protein, 14 aa, Borrelia burgdorferi B31
PSKNPGKFINIINE

SEQ ID NO: 80182 - protein, 14 aa, Borrelia burgdorferi B31
SKNPGKFINIINEF

SEQ ID NO: 80183 - protein, 14 aa, Borrelia burgdorferi B31
KNPGKFINIINEFI

SEQ ID NO: 80184 - protein, 14 aa, Borrelia burgdorferi B31
NPGKFINIINEFIE

SEQ ID NO: 80185 - protein, 14 aa, Borrelia burgdorferi B31
PGKFINIINEFIEK

SEQ ID NO: 80186 - protein, 14 aa, Borrelia burgdorferi B31
GKFINIINEFIEKD

SEQ ID NO: 80187 - protein, 14 aa, Borrelia burgdorferi B31
KFINIINEFIEKDF

SEQ ID NO: 80188 - protein, 14 aa, Borrelia burgdorferi B31
FINIINEFIEKDFL

SEQ ID NO: 80189 - protein, 15 aa, Borrelia burgdorferi B31
MILIFYFKQIALFII

SEQ ID NO: 80190 - protein, 15 aa, Borrelia burgdorferi B31
ILIFYFKQIALFIIF

SEQ ID NO: 80191 - protein, 15 aa, Borrelia burgdorferi B31
LIFYFKQIALFIIFR

SEQ ID NO: 80192 - protein, 15 aa, Borrelia burgdorferi B31
IFYFKQIALFIIFRL

SEQ ID NO: 80193 - protein, 15 aa, Borrelia burgdorferi B31
FYFKQIALFIIFRLC

SEQ ID NO: 80194 - protein, 15 aa, Borrelia burgdorferi B31
YFKQIALFIIFRLCY

SEQ ID NO: 80195 - protein, 15 aa, Borrelia burgdorferi B31
FKQIALFIIFRLCYI

SEQ ID NO: 80196 - protein, 15 aa, Borrelia burgdorferi B31
KQIALFIIFRLCYII

SEQ ID NO: 80197 - protein, 15 aa, Borrelia burgdorferi B31
QIALFIIFRLCYIIK

SEQ ID NO: 80198 - protein, 15 aa, Borrelia burgdorferi B31
IALFIIFRLCYIIKK

SEQ ID NO: 80199 - protein, 15 aa, Borrelia burgdorferi B31
ALFIIFRLCYIIKKV

SEQ ID NO: 80200 - protein, 15 aa, Borrelia burgdorferi B31
LFIIFRLCYIIKKVK

SEQ ID NO: 80201 - protein, 15 aa, Borrelia burgdorferi B31
FIIFRLCYIIKKVKI

SEQ ID NO: 80202 - protein, 15 aa, Borrelia burgdorferi B31
IIFRLCYIIKKVKIK

SEQ ID NO: 80203 - protein, 15 aa, Borrelia burgdorferi B31
IFRLCYIIKKVKIKL

SEQ ID NO: 80204 - protein, 15 aa, Borrelia burgdorferi B31
FRLCYIIKKVKIKLK

SEQ ID NO: 80205 - protein, 15 aa, Borrelia burgdorferi B31
RLCYIIKKVKIKLKR

SEQ ID NO: 80206 - protein, 15 aa, Borrelia burgdorferi B31
LCYIIKKVKIKLKRK

SEQ ID NO: 80207 - protein, 15 aa, Borrelia burgdorferi B31
CYIIKKVKIKLKRKS

SEQ ID NO: 80208 - protein, 15 aa, Borrelia burgdorferi B31
YIIKKVKIKLKRKSC

SEQ ID NO: 80209 - protein, 15 aa, Borrelia burgdorferi B31
IIKKVKIKLKRKSCM

SEQ ID NO: 80210 - protein, 15 aa, Borrelia burgdorferi B31
IKKVKIKLKRKSCMK

SEQ ID NO: 80211 - protein, 15 aa, Borrelia burgdorferi B31
KKVKIKLKRKSCMKK

SEQ ID NO: 80212 - protein, 15 aa, Borrelia burgdorferi B31
KVKIKLKRKSCMKKQ

SEQ ID NO: 80213 - protein, 15 aa, Borrelia burgdorferi B31
VKIKLKRKSCMKKQF

SEQ ID NO: 80214 - protein, 15 aa, Borrelia burgdorferi B31
KIKLKRKSCMKKQFD

SEQ ID NO: 80215 - protein, 15 aa, Borrelia burgdorferi B31
IKLKRKSCMKKQFDT

SEQ ID NO: 80216 - protein, 15 aa, Borrelia burgdorferi B31
KLKRKSCMKKQFDTE

SEQ ID NO: 80217 - protein, 15 aa, Borrelia burgdorferi B31
LKRKSCMKKQFDTEV

SEQ ID NO: 80218 - protein, 15 aa, Borrelia burgdorferi B31
KRKSCMKKQFDTEVN

SEQ ID NO: 80219 - protein, 15 aa, Borrelia burgdorferi B31
RKSCMKKQFDTEVND

SEQ ID NO: 80220 - protein, 15 aa, Borrelia burgdorferi B31
KSCMKKQFDTEVNDL

SEQ ID NO: 80221 - protein, 15 aa, Borrelia burgdorferi B31
SCMKKQFDTEVNDLL

SEQ ID NO: 80222 - protein, 15 aa, Borrelia burgdorferi B31
CMKKQFDTEVNDLLY

SEQ ID NO: 80223 - protein, 15 aa, Borrelia burgdorferi B31
MKKQFDTEVNDLLYL

SEQ ID NO: 80224 - protein, 15 aa, Borrelia burgdorferi B31
KKQFDTEVNDLLYLI

SEQ ID NO: 80225 - protein, 15 aa, Borrelia burgdorferi B31
KQFDTEVNDLLYLII

SEQ ID NO: 80226 - protein, 15 aa, Borrelia burgdorferi B31
QFDTEVNDLLYLIIH

SEQ ID NO: 80227 - protein, 15 aa, Borrelia burgdorferi B31
FDTEVNDLLYLIIHS

SEQ ID NO: 80228 - protein, 15 aa, Borrelia burgdorferi B31
DTEVNDLLYLIIHSL

SEQ ID NO: 80229 - protein, 15 aa, Borrelia burgdorferi B31
TEVNDLLYLIIHSLY

SEQ ID NO: 80230 - protein, 15 aa, Borrelia burgdorferi B31
EVNDLLYLIIHSLYS

SEQ ID NO: 80231 - protein, 15 aa, Borrelia burgdorferi B31
VNDLLYLIIHSLYSH

SEQ ID NO: 80232 - protein, 15 aa, Borrelia burgdorferi B31
NDLLYLIIHSLYSHK

SEQ ID NO: 80233 - protein, 15 aa, Borrelia burgdorferi B31
DLLYLIIHSLYSHKE

SEQ ID NO: 80234 - protein, 15 aa, Borrelia burgdorferi B31
LLYLIIHSLYSHKEI

SEQ ID NO: 80235 - protein, 15 aa, Borrelia burgdorferi B31
LYLIIHSLYSHKEIF

SEQ ID NO: 80236 - protein, 15 aa, Borrelia burgdorferi B31
YLIIHSLYSHKEIFL

SEQ ID NO: 80237 - protein, 15 aa, Borrelia burgdorferi B31
LIIHSLYSHKEIFLR

SEQ ID NO: 80238 - protein, 15 aa, Borrelia burgdorferi B31
IIHSLYSHKEIFLRE

SEQ ID NO: 80239 - protein, 15 aa, Borrelia burgdorferi B31
IHSLYSHKEIFLREL

SEQ ID NO: 80240 - protein, 15 aa, Borrelia burgdorferi B31
HSLYSHKEIFLRELI

SEQ ID NO: 80241 - protein, 15 aa, Borrelia burgdorferi B31
SLYSHKEIFLRELIS

SEQ ID NO: 80242 - protein, 15 aa, Borrelia burgdorferi B31
LYSHKEIFLRELISN

SEQ ID NO: 80243 - protein, 15 aa, Borrelia burgdorferi B31
YSHKEIFLRELISNA

SEQ ID NO: 80244 - protein, 15 aa, Borrelia burgdorferi B31
SHKEIFLRELISNAS

SEQ ID NO: 80245 - protein, 15 aa, Borrelia burgdorferi B31
HKEIFLRELISNASD

SEQ ID NO: 80246 - protein, 15 aa, Borrelia burgdorferi B31
KEIFLRELISNASDA

SEQ ID NO: 80247 - protein, 15 aa, Borrelia burgdorferi B31
EIFLRELISNASDAI

SEQ ID NO: 80248 - protein, 15 aa, Borrelia burgdorferi B31
IFLRELISNASDAID

SEQ ID NO: 80249 - protein, 15 aa, Borrelia burgdorferi B31
FLRELISNASDAIDK

SEQ ID NO: 80250 - protein, 15 aa, Borrelia burgdorferi B31
LRELISNASDAIDKL

SEQ ID NO: 80251 - protein, 15 aa, Borrelia burgdorferi B31
RELISNASDAIDKLK

SEQ ID NO: 80252 - protein, 15 aa, Borrelia burgdorferi B31
ELISNASDAIDKLKF

SEQ ID NO: 80253 - protein, 15 aa, Borrelia burgdorferi B31
LISNASDAIDKLKFL

SEQ ID NO: 80254 - protein, 15 aa, Borrelia burgdorferi B31
ISNASDAIDKLKFLS

SEQ ID NO: 80255 - protein, 15 aa, Borrelia burgdorferi B31
SNASDAIDKLKFLSL

SEQ ID NO: 80256 - protein, 15 aa, Borrelia burgdorferi B31
NASDAIDKLKFLSLT

SEQ ID NO: 80257 - protein, 15 aa, Borrelia burgdorferi B31
ASDAIDKLKFLSLTN

SEQ ID NO: 80258 - protein, 15 aa, Borrelia burgdorferi B31
SDAIDKLKFLSLTNE

SEQ ID NO: 80259 - protein, 15 aa, Borrelia burgdorferi B31
DAIDKLKFLSLTNEK

SEQ ID NO: 80260 - protein, 15 aa, Borrelia burgdorferi B31
AIDKLKFLSLTNEKF

SEQ ID NO: 80261 - protein, 15 aa, Borrelia burgdorferi B31
IDKLKFLSLTNEKFK

SEQ ID NO: 80262 - protein, 15 aa, Borrelia burgdorferi B31
DKLKFLSLTNEKFKN

SEQ ID NO: 80263 - protein, 15 aa, Borrelia burgdorferi B31
KLKFLSLTNEKFKNI

SEQ ID NO: 80264 - protein, 15 aa, Borrelia burgdorferi B31
LKFLSLTNEKFKNIA

SEQ ID NO: 80265 - protein, 15 aa, Borrelia burgdorferi B31
KFLSLTNEKFKNIAL

SEQ ID NO: 80266 - protein, 15 aa, Borrelia burgdorferi B31
FLSLTNEKFKNIALE

SEQ ID NO: 80267 - protein, 15 aa, Borrelia burgdorferi B31
LSLTNEKFKNIALEP

SEQ ID NO: 80268 - protein, 15 aa, Borrelia burgdorferi B31
SLTNEKFKNIALEPK

SEQ ID NO: 80269 - protein, 15 aa, Borrelia burgdorferi B31
LTNEKFKNIALEPKI

SEQ ID NO: 80270 - protein, 15 aa, Borrelia burgdorferi B31
TNEKFKNIALEPKIE

SEQ ID NO: 80271 - protein, 15 aa, Borrelia burgdorferi B31
NEKFKNIALEPKIEI

SEQ ID NO: 80272 - protein, 15 aa, Borrelia burgdorferi B31
EKFKNIALEPKIEIS

SEQ ID NO: 80273 - protein, 15 aa, Borrelia burgdorferi B31
KFKNIALEPKIEISF

SEQ ID NO: 80274 - protein, 15 aa, Borrelia burgdorferi B31
FKNIALEPKIEISFD

SEQ ID NO: 80275 - protein, 15 aa, Borrelia burgdorferi B31
KNIALEPKIEISFDD

SEQ ID NO: 80276 - protein, 15 aa, Borrelia burgdorferi B31
NIALEPKIEISFDDK

SEQ ID NO: 80277 - protein, 15 aa, Borrelia burgdorferi B31
IALEPKIEISFDDKS

SEQ ID NO: 80278 - protein, 15 aa, Borrelia burgdorferi B31
ALEPKIEISFDDKSI

SEQ ID NO: 80279 - protein, 15 aa, Borrelia burgdorferi B31
LEPKIEISFDDKSIL

SEQ ID NO: 80280 - protein, 15 aa, Borrelia burgdorferi B31
EPKIEISFDDKSILI

SEQ ID NO: 80281 - protein, 15 aa, Borrelia burgdorferi B31
PKIEISFDDKSILIK

SEQ ID NO: 80282 - protein, 15 aa, Borrelia burgdorferi B31
KIEISFDDKSILIKD

SEQ ID NO: 80283 - protein, 15 aa, Borrelia burgdorferi B31
IEISFDDKSILIKDN

SEQ ID NO: 80284 - protein, 15 aa, Borrelia burgdorferi B31
EISFDDKSILIKDNG

SEQ ID NO: 80285 - protein, 15 aa, Borrelia burgdorferi B31
ISFDDKSILIKDNGI

SEQ ID NO: 80286 - protein, 15 aa, Borrelia burgdorferi B31
SFDDKSILIKDNGIG

SEQ ID NO: 80287 - protein, 15 aa, Borrelia burgdorferi B31
FDDKSILIKDNGIGM

SEQ ID NO: 80288 - protein, 15 aa, Borrelia burgdorferi B31
DDKSILIKDNGIGMD

SEQ ID NO: 80289 - protein, 15 aa, Borrelia burgdorferi B31
DKSILIKDNGIGMDE

SEQ ID NO: 80290 - protein, 15 aa, Borrelia burgdorferi B31
KSILIKDNGIGMDEQ

SEQ ID NO: 80291 - protein, 15 aa, Borrelia burgdorferi B31
SILIKDNGIGMDEQD

SEQ ID NO: 80292 - protein, 15 aa, Borrelia burgdorferi B31
ILIKDNGIGMDEQDL

SEQ ID NO: 80293 - protein, 15 aa, Borrelia burgdorferi B31
LIKDNGIGMDEQDLT

SEQ ID NO: 80294 - protein, 15 aa, Borrelia burgdorferi B31
IKDNGIGMDEQDLTN

SEQ ID NO: 80295 - protein, 15 aa, Borrelia burgdorferi B31
KDNGIGMDEQDLTNH

SEQ ID NO: 80296 - protein, 15 aa, Borrelia burgdorferi B31
DNGIGMDEQDLTNHL

SEQ ID NO: 80297 - protein, 15 aa, Borrelia burgdorferi B31
NGIGMDEQDLTNHLG

SEQ ID NO: 80298 - protein, 15 aa, Borrelia burgdorferi B31
GIGMDEQDLTNHLGV

SEQ ID NO: 80299 - protein, 15 aa, Borrelia burgdorferi B31
IGMDEQDLTNHLGVI

SEQ ID NO: 80300 - protein, 15 aa, Borrelia burgdorferi B31
GMDEQDLTNHLGVIA

SEQ ID NO: 80301 - protein, 15 aa, Borrelia burgdorferi B31
MDEQDLTNHLGVIAK

SEQ ID NO: 80302 - protein, 15 aa, Borrelia burgdorferi B31
DEQDLTNHLGVIAKS

SEQ ID NO: 80303 - protein, 15 aa, Borrelia burgdorferi B31
EQDLTNHLGVIAKSG

SEQ ID NO: 80304 - protein, 15 aa, Borrelia burgdorferi B31
QDLTNHLGVIAKSGT

SEQ ID NO: 80305 - protein, 15 aa, Borrelia burgdorferi B31
DLTNHLGVIAKSGTK

SEQ ID NO: 80306 - protein, 15 aa, Borrelia burgdorferi B31
LTNHLGVIAKSGTKE

SEQ ID NO: 80307 - protein, 15 aa, Borrelia burgdorferi B31
TNHLGVIAKSGTKEF

SEQ ID NO: 80308 - protein, 15 aa, Borrelia burgdorferi B31
NHLGVIAKSGTKEFI

SEQ ID NO: 80309 - protein, 15 aa, Borrelia burgdorferi B31
HLGVIAKSGTKEFIN

SEQ ID NO: 80310 - protein, 15 aa, Borrelia burgdorferi B31
LGVIAKSGTKEFINN

SEQ ID NO: 80311 - protein, 15 aa, Borrelia burgdorferi B31
GVIAKSGTKEFINNL

SEQ ID NO: 80312 - protein, 15 aa, Borrelia burgdorferi B31
VIAKSGTKEFINNLK

SEQ ID NO: 80313 - protein, 15 aa, Borrelia burgdorferi B31
IAKSGTKEFINNLKQ

SEQ ID NO: 80314 - protein, 15 aa, Borrelia burgdorferi B31
AKSGTKEFINNLKQD

SEQ ID NO: 80315 - protein, 15 aa, Borrelia burgdorferi B31
KSGTKEFINNLKQDE

SEQ ID NO: 80316 - protein, 15 aa, Borrelia burgdorferi B31
SGTKEFINNLKQDEK

SEQ ID NO: 80317 - protein, 15 aa, Borrelia burgdorferi B31
GTKEFINNLKQDEKK

SEQ ID NO: 80318 - protein, 15 aa, Borrelia burgdorferi B31
TKEFINNLKQDEKKS

SEQ ID NO: 80319 - protein, 15 aa, Borrelia burgdorferi B31
KEFINNLKQDEKKSA

SEQ ID NO: 80320 - protein, 15 aa, Borrelia burgdorferi B31
EFINNLKQDEKKSAS

SEQ ID NO: 80321 - protein, 15 aa, Borrelia burgdorferi B31
FINNLKQDEKKSASL

SEQ ID NO: 80322 - protein, 15 aa, Borrelia burgdorferi B31
INNLKQDEKKSASLI

SEQ ID NO: 80323 - protein, 15 aa, Borrelia burgdorferi B31
NNLKQDEKKSASLIG

SEQ ID NO: 80324 - protein, 15 aa, Borrelia burgdorferi B31
NLKQDEKKSASLIGQ

SEQ ID NO: 80325 - protein, 15 aa, Borrelia burgdorferi B31
LKQDEKKSASLIGQF

SEQ ID NO: 80326 - protein, 15 aa, Borrelia burgdorferi B31
KQDEKKSASLIGQFG

SEQ ID NO: 80327 - protein, 15 aa, Borrelia burgdorferi B31
QDEKKSASLIGQFGV

SEQ ID NO: 80328 - protein, 15 aa, Borrelia burgdorferi B31
DEKKSASLIGQFGVG

SEQ ID NO: 80329 - protein, 15 aa, Borrelia burgdorferi B31
EKKSASLIGQFGVGF

SEQ ID NO: 80330 - protein, 15 aa, Borrelia burgdorferi B31
KKSASLIGQFGVGFY

SEQ ID NO: 80331 - protein, 15 aa, Borrelia burgdorferi B31
KSASLIGQFGVGFYS

SEQ ID NO: 80332 - protein, 15 aa, Borrelia burgdorferi B31
SASLIGQFGVGFYSA

SEQ ID NO: 80333 - protein, 15 aa, Borrelia burgdorferi B31
ASLIGQFGVGFYSAF

SEQ ID NO: 80334 - protein, 15 aa, Borrelia burgdorferi B31
SLIGQFGVGFYSAFI

SEQ ID NO: 80335 - protein, 15 aa, Borrelia burgdorferi B31
LIGQFGVGFYSAFIV

SEQ ID NO: 80336 - protein, 15 aa, Borrelia burgdorferi B31
IGQFGVGFYSAFIVS

SEQ ID NO: 80337 - protein, 15 aa, Borrelia burgdorferi B31
GQFGVGFYSAFIVSE

SEQ ID NO: 80338 - protein, 15 aa, Borrelia burgdorferi B31
QFGVGFYSAFIVSEK

SEQ ID NO: 80339 - protein, 15 aa, Borrelia burgdorferi B31
FGVGFYSAFIVSEKV

SEQ ID NO: 80340 - protein, 15 aa, Borrelia burgdorferi B31
GVGFYSAFIVSEKVE

SEQ ID NO: 80341 - protein, 15 aa, Borrelia burgdorferi B31
VGFYSAFIVSEKVEV

SEQ ID NO: 80342 - protein, 15 aa, Borrelia burgdorferi B31
GFYSAFIVSEKVEVT

SEQ ID NO: 80343 - protein, 15 aa, Borrelia burgdorferi B31
FYSAFIVSEKVEVTS

SEQ ID NO: 80344 - protein, 15 aa, Borrelia burgdorferi B31
YSAFIVSEKVEVTSK

SEQ ID NO: 80345 - protein, 15 aa, Borrelia burgdorferi B31
SAFIVSEKVEVTSKK

SEQ ID NO: 80346 - protein, 15 aa, Borrelia burgdorferi B31
AFIVSEKVEVTSKKA

SEQ ID NO: 80347 - protein, 15 aa, Borrelia burgdorferi B31
FIVSEKVEVTSKKAL

SEQ ID NO: 80348 - protein, 15 aa, Borrelia burgdorferi B31
IVSEKVEVTSKKALE

SEQ ID NO: 80349 - protein, 15 aa, Borrelia burgdorferi B31
VSEKVEVTSKKALES

SEQ ID NO: 80350 - protein, 15 aa, Borrelia burgdorferi B31
SEKVEVTSKKALESD

SEQ ID NO: 80351 - protein, 15 aa, Borrelia burgdorferi B31
EKVEVTSKKALESDA

SEQ ID NO: 80352 - protein, 15 aa, Borrelia burgdorferi B31
KVEVTSKKALESDAY

SEQ ID NO: 80353 - protein, 15 aa, Borrelia burgdorferi B31
VEVTSKKALESDAYI

SEQ ID NO: 80354 - protein, 15 aa, Borrelia burgdorferi B31
EVTSKKALESDAYIW

SEQ ID NO: 80355 - protein, 15 aa, Borrelia burgdorferi B31
VTSKKALESDAYIWS

SEQ ID NO: 80356 - protein, 15 aa, Borrelia burgdorferi B31
TSKKALESDAYIWSS

SEQ ID NO: 80357 - protein, 15 aa, Borrelia burgdorferi B31
SKKALESDAYIWSSD

SEQ ID NO: 80358 - protein, 15 aa, Borrelia burgdorferi B31
KKALESDAYIWSSDG

SEQ ID NO: 80359 - protein, 15 aa, Borrelia burgdorferi B31
KALESDAYIWSSDGK

SEQ ID NO: 80360 - protein, 15 aa, Borrelia burgdorferi B31
ALESDAYIWSSDGKT

SEQ ID NO: 80361 - protein, 15 aa, Borrelia burgdorferi B31
LESDAYIWSSDGKTG

SEQ ID NO: 80362 - protein, 15 aa, Borrelia burgdorferi B31
ESDAYIWSSDGKTGY

SEQ ID NO: 80363 - protein, 15 aa, Borrelia burgdorferi B31
SDAYIWSSDGKTGYE

SEQ ID NO: 80364 - protein, 15 aa, Borrelia burgdorferi B31
DAYIWSSDGKTGYEI

SEQ ID NO: 80365 - protein, 15 aa, Borrelia burgdorferi B31
AYIWSSDGKTGYEIE

SEQ ID NO: 80366 - protein, 15 aa, Borrelia burgdorferi B31
YIWSSDGKTGYEIEK

SEQ ID NO: 80367 - protein, 15 aa, Borrelia burgdorferi B31
IWSSDGKTGYEIEKA

SEQ ID NO: 80368 - protein, 15 aa, Borrelia burgdorferi B31
WSSDGKTGYEIEKAK

SEQ ID NO: 80369 - protein, 15 aa, Borrelia burgdorferi B31
SSDGKTGYEIEKAKK

SEQ ID NO: 80370 - protein, 15 aa, Borrelia burgdorferi B31
SDGKTGYEIEKAKKE

SEQ ID NO: 80371 - protein, 15 aa, Borrelia burgdorferi B31
DGKTGYEIEKAKKEE

SEQ ID NO: 80372 - protein, 15 aa, Borrelia burgdorferi B31
GKTGYEIEKAKKEES

SEQ ID NO: 80373 - protein, 15 aa, Borrelia burgdorferi B31
KTGYEIEKAKKEESG

SEQ ID NO: 80374 - protein, 15 aa, Borrelia burgdorferi B31
TGYEIEKAKKEESGT

SEQ ID NO: 80375 - protein, 15 aa, Borrelia burgdorferi B31
GYEIEKAKKEESGTE

SEQ ID NO: 80376 - protein, 15 aa, Borrelia burgdorferi B31
YEIEKAKKEESGTEI

SEQ ID NO: 80377 - protein, 15 aa, Borrelia burgdorferi B31
EIEKAKKEESGTEIK

SEQ ID NO: 80378 - protein, 15 aa, Borrelia burgdorferi B31
IEKAKKEESGTEIKL

SEQ ID NO: 80379 - protein, 15 aa, Borrelia burgdorferi B31
EKAKKEESGTEIKLY

SEQ ID NO: 80380 - protein, 15 aa, Borrelia burgdorferi B31
KAKKEESGTEIKLYL

SEQ ID NO: 80381 - protein, 15 aa, Borrelia burgdorferi B31
AKKEESGTEIKLYLN

SEQ ID NO: 80382 - protein, 15 aa, Borrelia burgdorferi B31
KKEESGTEIKLYLNK

SEQ ID NO: 80383 - protein, 15 aa, Borrelia burgdorferi B31
KEESGTEIKLYLNKE

SEQ ID NO: 80384 - protein, 15 aa, Borrelia burgdorferi B31
EESGTEIKLYLNKEG

SEQ ID NO: 80385 - protein, 15 aa, Borrelia burgdorferi B31
ESGTEIKLYLNKEGL

SEQ ID NO: 80386 - protein, 15 aa, Borrelia burgdorferi B31
SGTEIKLYLNKEGLE

SEQ ID NO: 80387 - protein, 15 aa, Borrelia burgdorferi B31
GTEIKLYLNKEGLEY

SEQ ID NO: 80388 - protein, 15 aa, Borrelia burgdorferi B31
TEIKLYLNKEGLEYA

SEQ ID NO: 80389 - protein, 15 aa, Borrelia burgdorferi B31
EIKLYLNKEGLEYAN

SEQ ID NO: 80390 - protein, 15 aa, Borrelia burgdorferi B31
IKLYLNKEGLEYANK

SEQ ID NO: 80391 - protein, 15 aa, Borrelia burgdorferi B31
KLYLNKEGLEYANKW

SEQ ID NO: 80392 - protein, 15 aa, Borrelia burgdorferi B31
LYLNKEGLEYANKWK

SEQ ID NO: 80393 - protein, 15 aa, Borrelia burgdorferi B31
YLNKEGLEYANKWKI

SEQ ID NO: 80394 - protein, 15 aa, Borrelia burgdorferi B31
LNKEGLEYANKWKIQ

SEQ ID NO: 80395 - protein, 15 aa, Borrelia burgdorferi B31
NKEGLEYANKWKIQE

SEQ ID NO: 80396 - protein, 15 aa, Borrelia burgdorferi B31
KEGLEYANKWKIQEI

SEQ ID NO: 80397 - protein, 15 aa, Borrelia burgdorferi B31
EGLEYANKWKIQEII

SEQ ID NO: 80398 - protein, 15 aa, Borrelia burgdorferi B31
GLEYANKWKIQEIIK

SEQ ID NO: 80399 - protein, 15 aa, Borrelia burgdorferi B31
LEYANKWKIQEIIKK

SEQ ID NO: 80400 - protein, 15 aa, Borrelia burgdorferi B31
EYANKWKIQEIIKKY

SEQ ID NO: 80401 - protein, 15 aa, Borrelia burgdorferi B31
YANKWKIQEIIKKYS

SEQ ID NO: 80402 - protein, 15 aa, Borrelia burgdorferi B31
ANKWKIQEIIKKYSN

SEQ ID NO: 80403 - protein, 15 aa, Borrelia burgdorferi B31
NKWKIQEIIKKYSNH

SEQ ID NO: 80404 - protein, 15 aa, Borrelia burgdorferi B31
KWKIQEIIKKYSNHI

SEQ ID NO: 80405 - protein, 15 aa, Borrelia burgdorferi B31
WKIQEIIKKYSNHIN

SEQ ID NO: 80406 - protein, 15 aa, Borrelia burgdorferi B31
KIQEIIKKYSNHINY

SEQ ID NO: 80407 - protein, 15 aa, Borrelia burgdorferi B31
IQEIIKKYSNHINYP

SEQ ID NO: 80408 - protein, 15 aa, Borrelia burgdorferi B31
QEIIKKYSNHINYPI

SEQ ID NO: 80409 - protein, 15 aa, Borrelia burgdorferi B31
EIIKKYSNHINYPIY

SEQ ID NO: 80410 - protein, 15 aa, Borrelia burgdorferi B31
IIKKYSNHINYPIYI

SEQ ID NO: 80411 - protein, 15 aa, Borrelia burgdorferi B31
IKKYSNHINYPIYIK

SEQ ID NO: 80412 - protein, 15 aa, Borrelia burgdorferi B31
KKYSNHINYPIYIKY

SEQ ID NO: 80413 - protein, 15 aa, Borrelia burgdorferi B31
KYSNHINYPIYIKYS

SEQ ID NO: 80414 - protein, 15 aa, Borrelia burgdorferi B31
YSNHINYPIYIKYSE

SEQ ID NO: 80415 - protein, 15 aa, Borrelia burgdorferi B31
SNHINYPIYIKYSEP

SEQ ID NO: 80416 - protein, 15 aa, Borrelia burgdorferi B31
NHINYPIYIKYSEPI

SEQ ID NO: 80417 - protein, 15 aa, Borrelia burgdorferi B31
HINYPIYIKYSEPIM

SEQ ID NO: 80418 - protein, 15 aa, Borrelia burgdorferi B31
INYPIYIKYSEPIMK

SEQ ID NO: 80419 - protein, 15 aa, Borrelia burgdorferi B31
NYPIYIKYSEPIMKD

SEQ ID NO: 80420 - protein, 15 aa, Borrelia burgdorferi B31
YPIYIKYSEPIMKDG

SEQ ID NO: 80421 - protein, 15 aa, Borrelia burgdorferi B31
PIYIKYSEPIMKDGK

SEQ ID NO: 80422 - protein, 15 aa, Borrelia burgdorferi B31
IYIKYSEPIMKDGKQ

SEQ ID NO: 80423 - protein, 15 aa, Borrelia burgdorferi B31
YIKYSEPIMKDGKQE

SEQ ID NO: 80424 - protein, 15 aa, Borrelia burgdorferi B31
IKYSEPIMKDGKQEG

SEQ ID NO: 80425 - protein, 15 aa, Borrelia burgdorferi B31
KYSEPIMKDGKQEGI

SEQ ID NO: 80426 - protein, 15 aa, Borrelia burgdorferi B31
YSEPIMKDGKQEGIE

SEQ ID NO: 80427 - protein, 15 aa, Borrelia burgdorferi B31
SEPIMKDGKQEGIEE

SEQ ID NO: 80428 - protein, 15 aa, Borrelia burgdorferi B31
EPIMKDGKQEGIEEK

SEQ ID NO: 80429 - protein, 15 aa, Borrelia burgdorferi B31
PIMKDGKQEGIEEKE

SEQ ID NO: 80430 - protein, 15 aa, Borrelia burgdorferi B31
IMKDGKQEGIEEKEE

SEQ ID NO: 80431 - protein, 15 aa, Borrelia burgdorferi B31
MKDGKQEGIEEKEEK

SEQ ID NO: 80432 - protein, 15 aa, Borrelia burgdorferi B31
KDGKQEGIEEKEEKL

SEQ ID NO: 80433 - protein, 15 aa, Borrelia burgdorferi B31
DGKQEGIEEKEEKLN

SEQ ID NO: 80434 - protein, 15 aa, Borrelia burgdorferi B31
GKQEGIEEKEEKLNE

SEQ ID NO: 80435 - protein, 15 aa, Borrelia burgdorferi B31
KQEGIEEKEEKLNET

SEQ ID NO: 80436 - protein, 15 aa, Borrelia burgdorferi B31
QEGIEEKEEKLNETT

SEQ ID NO: 80437 - protein, 15 aa, Borrelia burgdorferi B31
EGIEEKEEKLNETTA

SEQ ID NO: 80438 - protein, 15 aa, Borrelia burgdorferi B31
GIEEKEEKLNETTAL

SEQ ID NO: 80439 - protein, 15 aa, Borrelia burgdorferi B31
IEEKEEKLNETTALW

SEQ ID NO: 80440 - protein, 15 aa, Borrelia burgdorferi B31
EEKEEKLNETTALWT

SEQ ID NO: 80441 - protein, 15 aa, Borrelia burgdorferi B31
EKEEKLNETTALWTK

SEQ ID NO: 80442 - protein, 15 aa, Borrelia burgdorferi B31
KEEKLNETTALWTKN

SEQ ID NO: 80443 - protein, 15 aa, Borrelia burgdorferi B31
EEKLNETTALWTKNK

SEQ ID NO: 80444 - protein, 15 aa, Borrelia burgdorferi B31
EKLNETTALWTKNKS

SEQ ID NO: 80445 - protein, 15 aa, Borrelia burgdorferi B31
KLNETTALWTKNKSE

SEQ ID NO: 80446 - protein, 15 aa, Borrelia burgdorferi B31
LNETTALWTKNKSEI

SEQ ID NO: 80447 - protein, 15 aa, Borrelia burgdorferi B31
NETTALWTKNKSEIK

SEQ ID NO: 80448 - protein, 15 aa, Borrelia burgdorferi B31
ETTALWTKNKSEIKA

SEQ ID NO: 80449 - protein, 15 aa, Borrelia burgdorferi B31
TTALWTKNKSEIKAE

SEQ ID NO: 80450 - protein, 15 aa, Borrelia burgdorferi B31
TALWTKNKSEIKAEE

SEQ ID NO: 80451 - protein, 15 aa, Borrelia burgdorferi B31
ALWTKNKSEIKAEEY

SEQ ID NO: 80452 - protein, 15 aa, Borrelia burgdorferi B31
LWTKNKSEIKAEEYN

SEQ ID NO: 80453 - protein, 15 aa, Borrelia burgdorferi B31
WTKNKSEIKAEEYNE

SEQ ID NO: 80454 - protein, 15 aa, Borrelia burgdorferi B31
TKNKSEIKAEEYNEF

SEQ ID NO: 80455 - protein, 15 aa, Borrelia burgdorferi B31
KNKSEIKAEEYNEFY

SEQ ID NO: 80456 - protein, 15 aa, Borrelia burgdorferi B31
NKSEIKAEEYNEFYK

SEQ ID NO: 80457 - protein, 15 aa, Borrelia burgdorferi B31
KSEIKAEEYNEFYKN

SEQ ID NO: 80458 - protein, 15 aa, Borrelia burgdorferi B31
SEIKAEEYNEFYKNT

SEQ ID NO: 80459 - protein, 15 aa, Borrelia burgdorferi B31
EIKAEEYNEFYKNTT

SEQ ID NO: 80460 - protein, 15 aa, Borrelia burgdorferi B31
IKAEEYNEFYKNTTF

SEQ ID NO: 80461 - protein, 15 aa, Borrelia burgdorferi B31
KAEEYNEFYKNTTFD

SEQ ID NO: 80462 - protein, 15 aa, Borrelia burgdorferi B31
AEEYNEFYKNTTFDY

SEQ ID NO: 80463 - protein, 15 aa, Borrelia burgdorferi B31
EEYNEFYKNTTFDYE

SEQ ID NO: 80464 - protein, 15 aa, Borrelia burgdorferi B31
EYNEFYKNTTFDYEN

SEQ ID NO: 80465 - protein, 15 aa, Borrelia burgdorferi B31
YNEFYKNTTFDYENP

SEQ ID NO: 80466 - protein, 15 aa, Borrelia burgdorferi B31
NEFYKNTTFDYENPL

SEQ ID NO: 80467 - protein, 15 aa, Borrelia burgdorferi B31
EFYKNTTFDYENPLM

SEQ ID NO: 80468 - protein, 15 aa, Borrelia burgdorferi B31
FYKNTTFDYENPLMH

SEQ ID NO: 80469 - protein, 15 aa, Borrelia burgdorferi B31
YKNTTFDYENPLMHI

SEQ ID NO: 80470 - protein, 15 aa, Borrelia burgdorferi B31
KNTTFDYENPLMHIH

SEQ ID NO: 80471 - protein, 15 aa, Borrelia burgdorferi B31
NTTFDYENPLMHIHT

SEQ ID NO: 80472 - protein, 15 aa, Borrelia burgdorferi B31
TTFDYENPLMHIHTK

SEQ ID NO: 80473 - protein, 15 aa, Borrelia burgdorferi B31
TFDYENPLMHIHTKA

SEQ ID NO: 80474 - protein, 15 aa, Borrelia burgdorferi B31
FDYENPLMHIHTKAE

SEQ ID NO: 80475 - protein, 15 aa, Borrelia burgdorferi B31
DYENPLMHIHTKAEG

SEQ ID NO: 80476 - protein, 15 aa, Borrelia burgdorferi B31
YENPLMHIHTKAEGN

SEQ ID NO: 80477 - protein, 15 aa, Borrelia burgdorferi B31
ENPLMHIHTKAEGNL

SEQ ID NO: 80478 - protein, 15 aa, Borrelia burgdorferi B31
NPLMHIHTKAEGNLE

SEQ ID NO: 80479 - protein, 15 aa, Borrelia burgdorferi B31
PLMHIHTKAEGNLEY

SEQ ID NO: 80480 - protein, 15 aa, Borrelia burgdorferi B31
LMHIHTKAEGNLEYT

SEQ ID NO: 80481 - protein, 15 aa, Borrelia burgdorferi B31
MHIHTKAEGNLEYTN

SEQ ID NO: 80482 - protein, 15 aa, Borrelia burgdorferi B31
HIHTKAEGNLEYTNL

SEQ ID NO: 80483 - protein, 15 aa, Borrelia burgdorferi B31
IHTKAEGNLEYTNLF

SEQ ID NO: 80484 - protein, 15 aa, Borrelia burgdorferi B31
HTKAEGNLEYTNLFY

SEQ ID NO: 80485 - protein, 15 aa, Borrelia burgdorferi B31
TKAEGNLEYTNLFYV

SEQ ID NO: 80486 - protein, 15 aa, Borrelia burgdorferi B31
KAEGNLEYTNLFYVP

SEQ ID NO: 80487 - protein, 15 aa, Borrelia burgdorferi B31
AEGNLEYTNLFYVPS

SEQ ID NO: 80488 - protein, 15 aa, Borrelia burgdorferi B31
EGNLEYTNLFYVPSK

SEQ ID NO: 80489 - protein, 15 aa, Borrelia burgdorferi B31
GNLEYTNLFYVPSKA

SEQ ID NO: 80490 - protein, 15 aa, Borrelia burgdorferi B31
NLEYTNLFYVPSKAP

SEQ ID NO: 80491 - protein, 15 aa, Borrelia burgdorferi B31
LEYTNLFYVPSKAPY

SEQ ID NO: 80492 - protein, 15 aa, Borrelia burgdorferi B31
EYTNLFYVPSKAPYD

SEQ ID NO: 80493 - protein, 15 aa, Borrelia burgdorferi B31
YTNLFYVPSKAPYDL

SEQ ID NO: 80494 - protein, 15 aa, Borrelia burgdorferi B31
TNLFYVPSKAPYDLY

SEQ ID NO: 80495 - protein, 15 aa, Borrelia burgdorferi B31
NLFYVPSKAPYDLYY

SEQ ID NO: 80496 - protein, 15 aa, Borrelia burgdorferi B31
LFYVPSKAPYDLYYP

SEQ ID NO: 80497 - protein, 15 aa, Borrelia burgdorferi B31
FYVPSKAPYDLYYPN

SEQ ID NO: 80498 - protein, 15 aa, Borrelia burgdorferi B31
YVPSKAPYDLYYPNT

SEQ ID NO: 80499 - protein, 15 aa, Borrelia burgdorferi B31
VPSKAPYDLYYPNTK

SEQ ID NO: 80500 - protein, 15 aa, Borrelia burgdorferi B31
PSKAPYDLYYPNTKP

SEQ ID NO: 80501 - protein, 15 aa, Borrelia burgdorferi B31
SKAPYDLYYPNTKPG

SEQ ID NO: 80502 - protein, 15 aa, Borrelia burgdorferi B31
KAPYDLYYPNTKPGV

SEQ ID NO: 80503 - protein, 15 aa, Borrelia burgdorferi B31
APYDLYYPNTKPGVK

SEQ ID NO: 80504 - protein, 15 aa, Borrelia burgdorferi B31
PYDLYYPNTKPGVKL

SEQ ID NO: 80505 - protein, 15 aa, Borrelia burgdorferi B31
YDLYYPNTKPGVKLF

SEQ ID NO: 80506 - protein, 15 aa, Borrelia burgdorferi B31
DLYYPNTKPGVKLFI

SEQ ID NO: 80507 - protein, 15 aa, Borrelia burgdorferi B31
LYYPNTKPGVKLFIN

SEQ ID NO: 80508 - protein, 15 aa, Borrelia burgdorferi B31
YYPNTKPGVKLFINR

SEQ ID NO: 80509 - protein, 15 aa, Borrelia burgdorferi B31
YPNTKPGVKLFINRI

SEQ ID NO: 80510 - protein, 15 aa, Borrelia burgdorferi B31
PNTKPGVKLFINRIF

SEQ ID NO: 80511 - protein, 15 aa, Borrelia burgdorferi B31
NTKPGVKLFINRIFI

SEQ ID NO: 80512 - protein, 15 aa, Borrelia burgdorferi B31
TKPGVKLFINRIFIT

SEQ ID NO: 80513 - protein, 15 aa, Borrelia burgdorferi B31
KPGVKLFINRIFITD

SEQ ID NO: 80514 - protein, 15 aa, Borrelia burgdorferi B31
PGVKLFINRIFITDS

SEQ ID NO: 80515 - protein, 15 aa, Borrelia burgdorferi B31
GVKLFINRIFITDSE

SEQ ID NO: 80516 - protein, 15 aa, Borrelia burgdorferi B31
VKLFINRIFITDSEG

SEQ ID NO: 80517 - protein, 15 aa, Borrelia burgdorferi B31
KLFINRIFITDSEGS

SEQ ID NO: 80518 - protein, 15 aa, Borrelia burgdorferi B31
LFINRIFITDSEGSL

SEQ ID NO: 80519 - protein, 15 aa, Borrelia burgdorferi B31
FINRIFITDSEGSLL

SEQ ID NO: 80520 - protein, 15 aa, Borrelia burgdorferi B31
INRIFITDSEGSLLP

SEQ ID NO: 80521 - protein, 15 aa, Borrelia burgdorferi B31
NRIFITDSEGSLLPN

SEQ ID NO: 80522 - protein, 15 aa, Borrelia burgdorferi B31
RIFITDSEGSLLPNY

SEQ ID NO: 80523 - protein, 15 aa, Borrelia burgdorferi B31
IFITDSEGSLLPNYL

SEQ ID NO: 80524 - protein, 15 aa, Borrelia burgdorferi B31
FITDSEGSLLPNYLR

SEQ ID NO: 80525 - protein, 15 aa, Borrelia burgdorferi B31
ITDSEGSLLPNYLRF

SEQ ID NO: 80526 - protein, 15 aa, Borrelia burgdorferi B31
TDSEGSLLPNYLRFI

SEQ ID NO: 80527 - protein, 15 aa, Borrelia burgdorferi B31
DSEGSLLPNYLRFIK

SEQ ID NO: 80528 - protein, 15 aa, Borrelia burgdorferi B31
SEGSLLPNYLRFIKG

SEQ ID NO: 80529 - protein, 15 aa, Borrelia burgdorferi B31
EGSLLPNYLRFIKGI

SEQ ID NO: 80530 - protein, 15 aa, Borrelia burgdorferi B31
GSLLPNYLRFIKGII

SEQ ID NO: 80531 - protein, 15 aa, Borrelia burgdorferi B31
SLLPNYLRFIKGIID

SEQ ID NO: 80532 - protein, 15 aa, Borrelia burgdorferi B31
LLPNYLRFIKGIIDC

SEQ ID NO: 80533 - protein, 15 aa, Borrelia burgdorferi B31
LPNYLRFIKGIIDCQ

SEQ ID NO: 80534 - protein, 15 aa, Borrelia burgdorferi B31
PNYLRFIKGIIDCQD

SEQ ID NO: 80535 - protein, 15 aa, Borrelia burgdorferi B31
NYLRFIKGIIDCQDL

SEQ ID NO: 80536 - protein, 15 aa, Borrelia burgdorferi B31
YLRFIKGIIDCQDLP

SEQ ID NO: 80537 - protein, 15 aa, Borrelia burgdorferi B31
LRFIKGIIDCQDLPL

SEQ ID NO: 80538 - protein, 15 aa, Borrelia burgdorferi B31
RFIKGIIDCQDLPLN

SEQ ID NO: 80539 - protein, 15 aa, Borrelia burgdorferi B31
FIKGIIDCQDLPLNV

SEQ ID NO: 80540 - protein, 15 aa, Borrelia burgdorferi B31
IKGIIDCQDLPLNVS

SEQ ID NO: 80541 - protein, 15 aa, Borrelia burgdorferi B31
KGIIDCQDLPLNVSR

SEQ ID NO: 80542 - protein, 15 aa, Borrelia burgdorferi B31
GIIDCQDLPLNVSRE

SEQ ID NO: 80543 - protein, 15 aa, Borrelia burgdorferi B31
IIDCQDLPLNVSREI

SEQ ID NO: 80544 - protein, 15 aa, Borrelia burgdorferi B31
IDCQDLPLNVSREIL

SEQ ID NO: 80545 - protein, 15 aa, Borrelia burgdorferi B31
DCQDLPLNVSREILQ

SEQ ID NO: 80546 - protein, 15 aa, Borrelia burgdorferi B31
CQDLPLNVSREILQQ

SEQ ID NO: 80547 - protein, 15 aa, Borrelia burgdorferi B31
QDLPLNVSREILQQN

SEQ ID NO: 80548 - protein, 15 aa, Borrelia burgdorferi B31
DLPLNVSREILQQNK

SEQ ID NO: 80549 - protein, 15 aa, Borrelia burgdorferi B31
LPLNVSREILQQNKI

SEQ ID NO: 80550 - protein, 15 aa, Borrelia burgdorferi B31
PLNVSREILQQNKIL

SEQ ID NO: 80551 - protein, 15 aa, Borrelia burgdorferi B31
LNVSREILQQNKILS

SEQ ID NO: 80552 - protein, 15 aa, Borrelia burgdorferi B31
NVSREILQQNKILSK

SEQ ID NO: 80553 - protein, 15 aa, Borrelia burgdorferi B31
VSREILQQNKILSKI

SEQ ID NO: 80554 - protein, 15 aa, Borrelia burgdorferi B31
SREILQQNKILSKIK

SEQ ID NO: 80555 - protein, 15 aa, Borrelia burgdorferi B31
REILQQNKILSKIKS

SEQ ID NO: 80556 - protein, 15 aa, Borrelia burgdorferi B31
EILQQNKILSKIKSS

SEQ ID NO: 80557 - protein, 15 aa, Borrelia burgdorferi B31
ILQQNKILSKIKSSS

SEQ ID NO: 80558 - protein, 15 aa, Borrelia burgdorferi B31
LQQNKILSKIKSSSV

SEQ ID NO: 80559 - protein, 15 aa, Borrelia burgdorferi B31
QQNKILSKIKSSSVK

SEQ ID NO: 80560 - protein, 15 aa, Borrelia burgdorferi B31
QNKILSKIKSSSVKK

SEQ ID NO: 80561 - protein, 15 aa, Borrelia burgdorferi B31
NKILSKIKSSSVKKI

SEQ ID NO: 80562 - protein, 15 aa, Borrelia burgdorferi B31
KILSKIKSSSVKKIL

SEQ ID NO: 80563 - protein, 15 aa, Borrelia burgdorferi B31
ILSKIKSSSVKKILS

SEQ ID NO: 80564 - protein, 15 aa, Borrelia burgdorferi B31
LSKIKSSSVKKILSE

SEQ ID NO: 80565 - protein, 15 aa, Borrelia burgdorferi B31
SKIKSSSVKKILSEL

SEQ ID NO: 80566 - protein, 15 aa, Borrelia burgdorferi B31
KIKSSSVKKILSELE

SEQ ID NO: 80567 - protein, 15 aa, Borrelia burgdorferi B31
IKSSSVKKILSELEK

SEQ ID NO: 80568 - protein, 15 aa, Borrelia burgdorferi B31
KSSSVKKILSELEKL

SEQ ID NO: 80569 - protein, 15 aa, Borrelia burgdorferi B31
SSSVKKILSELEKLS

SEQ ID NO: 80570 - protein, 15 aa, Borrelia burgdorferi B31
SSVKKILSELEKLSK

SEQ ID NO: 80571 - protein, 15 aa, Borrelia burgdorferi B31
SVKKILSELEKLSKK

SEQ ID NO: 80572 - protein, 15 aa, Borrelia burgdorferi B31
VKKILSELEKLSKKN

SEQ ID NO: 80573 - protein, 15 aa, Borrelia burgdorferi B31
KKILSELEKLSKKNP

SEQ ID NO: 80574 - protein, 15 aa, Borrelia burgdorferi B31
KILSELEKLSKKNPE

SEQ ID NO: 80575 - protein, 15 aa, Borrelia burgdorferi B31
ILSELEKLSKKNPEK

SEQ ID NO: 80576 - protein, 15 aa, Borrelia burgdorferi B31
LSELEKLSKKNPEKF

SEQ ID NO: 80577 - protein, 15 aa, Borrelia burgdorferi B31
SELEKLSKKNPEKFS

SEQ ID NO: 80578 - protein, 15 aa, Borrelia burgdorferi B31
ELEKLSKKNPEKFSE

SEQ ID NO: 80579 - protein, 15 aa, Borrelia burgdorferi B31
LEKLSKKNPEKFSEF

SEQ ID NO: 80580 - protein, 15 aa, Borrelia burgdorferi B31
EKLSKKNPEKFSEFS

SEQ ID NO: 80581 - protein, 15 aa, Borrelia burgdorferi B31
KLSKKNPEKFSEFSK

SEQ ID NO: 80582 - protein, 15 aa, Borrelia burgdorferi B31
LSKKNPEKFSEFSKE

SEQ ID NO: 80583 - protein, 15 aa, Borrelia burgdorferi B31
SKKNPEKFSEFSKEF

SEQ ID NO: 80584 - protein, 15 aa, Borrelia burgdorferi B31
KKNPEKFSEFSKEFG

SEQ ID NO: 80585 - protein, 15 aa, Borrelia burgdorferi B31
KNPEKFSEFSKEFGR

SEQ ID NO: 80586 - protein, 15 aa, Borrelia burgdorferi B31
NPEKFSEFSKEFGRC

SEQ ID NO: 80587 - protein, 15 aa, Borrelia burgdorferi B31
PEKFSEFSKEFGRCI

SEQ ID NO: 80588 - protein, 15 aa, Borrelia burgdorferi B31
EKFSEFSKEFGRCIK

SEQ ID NO: 80589 - protein, 15 aa, Borrelia burgdorferi B31
KFSEFSKEFGRCIKE

SEQ ID NO: 80590 - protein, 15 aa, Borrelia burgdorferi B31
FSEFSKEFGRCIKEG

SEQ ID NO: 80591 - protein, 15 aa, Borrelia burgdorferi B31
SEFSKEFGRCIKEGV

SEQ ID NO: 80592 - protein, 15 aa, Borrelia burgdorferi B31
EFSKEFGRCIKEGVY

SEQ ID NO: 80593 - protein, 15 aa, Borrelia burgdorferi B31
FSKEFGRCIKEGVYS

SEQ ID NO: 80594 - protein, 15 aa, Borrelia burgdorferi B31
SKEFGRCIKEGVYSD

SEQ ID NO: 80595 - protein, 15 aa, Borrelia burgdorferi B31
KEFGRCIKEGVYSDF

SEQ ID NO: 80596 - protein, 15 aa, Borrelia burgdorferi B31
EFGRCIKEGVYSDFE

SEQ ID NO: 80597 - protein, 15 aa, Borrelia burgdorferi B31
FGRCIKEGVYSDFEN

SEQ ID NO: 80598 - protein, 15 aa, Borrelia burgdorferi B31
GRCIKEGVYSDFENR

SEQ ID NO: 80599 - protein, 15 aa, Borrelia burgdorferi B31
RCIKEGVYSDFENRE

SEQ ID NO: 80600 - protein, 15 aa, Borrelia burgdorferi B31
CIKEGVYSDFENREK

SEQ ID NO: 80601 - protein, 15 aa, Borrelia burgdorferi B31
IKEGVYSDFENREKL

SEQ ID NO: 80602 - protein, 15 aa, Borrelia burgdorferi B31
KEGVYSDFENREKLI

SEQ ID NO: 80603 - protein, 15 aa, Borrelia burgdorferi B31
EGVYSDFENREKLIS

SEQ ID NO: 80604 - protein, 15 aa, Borrelia burgdorferi B31
GVYSDFENREKLISL

SEQ ID NO: 80605 - protein, 15 aa, Borrelia burgdorferi B31
VYSDFENREKLISLI

SEQ ID NO: 80606 - protein, 15 aa, Borrelia burgdorferi B31
YSDFENREKLISLIR

SEQ ID NO: 80607 - protein, 15 aa, Borrelia burgdorferi B31
SDFENREKLISLIRF

SEQ ID NO: 80608 - protein, 15 aa, Borrelia burgdorferi B31
DFENREKLISLIRFK

SEQ ID NO: 80609 - protein, 15 aa, Borrelia burgdorferi B31
FENREKLISLIRFKS

SEQ ID NO: 80610 - protein, 15 aa, Borrelia burgdorferi B31
ENREKLISLIRFKSS

SEQ ID NO: 80611 - protein, 15 aa, Borrelia burgdorferi B31
NREKLISLIRFKSSS

SEQ ID NO: 80612 - protein, 15 aa, Borrelia burgdorferi B31
REKLISLIRFKSSSV

SEQ ID NO: 80613 - protein, 15 aa, Borrelia burgdorferi B31
EKLISLIRFKSSSVD

SEQ ID NO: 80614 - protein, 15 aa, Borrelia burgdorferi B31
KLISLIRFKSSSVDG

SEQ ID NO: 80615 - protein, 15 aa, Borrelia burgdorferi B31
LISLIRFKSSSVDGF

SEQ ID NO: 80616 - protein, 15 aa, Borrelia burgdorferi B31
ISLIRFKSSSVDGFV

SEQ ID NO: 80617 - protein, 15 aa, Borrelia burgdorferi B31
SLIRFKSSSVDGFVS

SEQ ID NO: 80618 - protein, 15 aa, Borrelia burgdorferi B31
LIRFKSSSVDGFVSF

SEQ ID NO: 80619 - protein, 15 aa, Borrelia burgdorferi B31
IRFKSSSVDGFVSFK

SEQ ID NO: 80620 - protein, 15 aa, Borrelia burgdorferi B31
RFKSSSVDGFVSFKE

SEQ ID NO: 80621 - protein, 15 aa, Borrelia burgdorferi B31
FKSSSVDGFVSFKEY

SEQ ID NO: 80622 - protein, 15 aa, Borrelia burgdorferi B31
KSSSVDGFVSFKEYK

SEQ ID NO: 80623 - protein, 15 aa, Borrelia burgdorferi B31
SSSVDGFVSFKEYKE

SEQ ID NO: 80624 - protein, 15 aa, Borrelia burgdorferi B31
SSVDGFVSFKEYKER

SEQ ID NO: 80625 - protein, 15 aa, Borrelia burgdorferi B31
SVDGFVSFKEYKERM

SEQ ID NO: 80626 - protein, 15 aa, Borrelia burgdorferi B31
VDGFVSFKEYKERMN

SEQ ID NO: 80627 - protein, 15 aa, Borrelia burgdorferi B31
DGFVSFKEYKERMNE

SEQ ID NO: 80628 - protein, 15 aa, Borrelia burgdorferi B31
GFVSFKEYKERMNES

SEQ ID NO: 80629 - protein, 15 aa, Borrelia burgdorferi B31
FVSFKEYKERMNESQ

SEQ ID NO: 80630 - protein, 15 aa, Borrelia burgdorferi B31
VSFKEYKERMNESQK

SEQ ID NO: 80631 - protein, 15 aa, Borrelia burgdorferi B31
SFKEYKERMNESQKS

SEQ ID NO: 80632 - protein, 15 aa, Borrelia burgdorferi B31
FKEYKERMNESQKSI

SEQ ID NO: 80633 - protein, 15 aa, Borrelia burgdorferi B31
KEYKERMNESQKSIY

SEQ ID NO: 80634 - protein, 15 aa, Borrelia burgdorferi B31
EYKERMNESQKSIYY

SEQ ID NO: 80635 - protein, 15 aa, Borrelia burgdorferi B31
YKERMNESQKSIYYI

SEQ ID NO: 80636 - protein, 15 aa, Borrelia burgdorferi B31
KERMNESQKSIYYIT

SEQ ID NO: 80637 - protein, 15 aa, Borrelia burgdorferi B31
ERMNESQKSIYYITG

SEQ ID NO: 80638 - protein, 15 aa, Borrelia burgdorferi B31
RMNESQKSIYYITGG

SEQ ID NO: 80639 - protein, 15 aa, Borrelia burgdorferi B31
MNESQKSIYYITGGK

SEQ ID NO: 80640 - protein, 15 aa, Borrelia burgdorferi B31
NESQKSIYYITGGKE

SEQ ID NO: 80641 - protein, 15 aa, Borrelia burgdorferi B31
ESQKSIYYITGGKEN

SEQ ID NO: 80642 - protein, 15 aa, Borrelia burgdorferi B31
SQKSIYYITGGKENI

SEQ ID NO: 80643 - protein, 15 aa, Borrelia burgdorferi B31
QKSIYYITGGKENIL

SEQ ID NO: 80644 - protein, 15 aa, Borrelia burgdorferi B31
KSIYYITGGKENILK

SEQ ID NO: 80645 - protein, 15 aa, Borrelia burgdorferi B31
SIYYITGGKENILKE

SEQ ID NO: 80646 - protein, 15 aa, Borrelia burgdorferi B31
IYYITGGKENILKEN

SEQ ID NO: 80647 - protein, 15 aa, Borrelia burgdorferi B31
YYITGGKENILKENP

SEQ ID NO: 80648 - protein, 15 aa, Borrelia burgdorferi B31
YITGGKENILKENPI

SEQ ID NO: 80649 - protein, 15 aa, Borrelia burgdorferi B31
ITGGKENILKENPIV

SEQ ID NO: 80650 - protein, 15 aa, Borrelia burgdorferi B31
TGGKENILKENPIVA

SEQ ID NO: 80651 - protein, 15 aa, Borrelia burgdorferi B31
GGKENILKENPIVAA

SEQ ID NO: 80652 - protein, 15 aa, Borrelia burgdorferi B31
GKENILKENPIVAAY

SEQ ID NO: 80653 - protein, 15 aa, Borrelia burgdorferi B31
KENILKENPIVAAYK

SEQ ID NO: 80654 - protein, 15 aa, Borrelia burgdorferi B31
ENILKENPIVAAYKE

SEQ ID NO: 80655 - protein, 15 aa, Borrelia burgdorferi B31
NILKENPIVAAYKEK

SEQ ID NO: 80656 - protein, 15 aa, Borrelia burgdorferi B31
ILKENPIVAAYKEKG

SEQ ID NO: 80657 - protein, 15 aa, Borrelia burgdorferi B31
LKENPIVAAYKEKGF

SEQ ID NO: 80658 - protein, 15 aa, Borrelia burgdorferi B31
KENPIVAAYKEKGFE

SEQ ID NO: 80659 - protein, 15 aa, Borrelia burgdorferi B31
ENPIVAAYKEKGFEI

SEQ ID NO: 80660 - protein, 15 aa, Borrelia burgdorferi B31
NPIVAAYKEKGFEIL

SEQ ID NO: 80661 - protein, 15 aa, Borrelia burgdorferi B31
PIVAAYKEKGFEILI

SEQ ID NO: 80662 - protein, 15 aa, Borrelia burgdorferi B31
IVAAYKEKGFEILIM

SEQ ID NO: 80663 - protein, 15 aa, Borrelia burgdorferi B31
VAAYKEKGFEILIMD

SEQ ID NO: 80664 - protein, 15 aa, Borrelia burgdorferi B31
AAYKEKGFEILIMDD

SEQ ID NO: 80665 - protein, 15 aa, Borrelia burgdorferi B31
AYKEKGFEILIMDDE

SEQ ID NO: 80666 - protein, 15 aa, Borrelia burgdorferi B31
YKEKGFEILIMDDEL

SEQ ID NO: 80667 - protein, 15 aa, Borrelia burgdorferi B31
KEKGFEILIMDDELD

SEQ ID NO: 80668 - protein, 15 aa, Borrelia burgdorferi B31
EKGFEILIMDDELDE

SEQ ID NO: 80669 - protein, 15 aa, Borrelia burgdorferi B31
KGFEILIMDDELDEA

SEQ ID NO: 80670 - protein, 15 aa, Borrelia burgdorferi B31
GFEILIMDDELDEAI

SEQ ID NO: 80671 - protein, 15 aa, Borrelia burgdorferi B31
FEILIMDDELDEAIL

SEQ ID NO: 80672 - protein, 15 aa, Borrelia burgdorferi B31
EILIMDDELDEAILN

SEQ ID NO: 80673 - protein, 15 aa, Borrelia burgdorferi B31
ILIMDDELDEAILNL

SEQ ID NO: 80674 - protein, 15 aa, Borrelia burgdorferi B31
LIMDDELDEAILNLI

SEQ ID NO: 80675 - protein, 15 aa, Borrelia burgdorferi B31
IMDDELDEAILNLIP

SEQ ID NO: 80676 - protein, 15 aa, Borrelia burgdorferi B31
MDDELDEAILNLIPE

SEQ ID NO: 80677 - protein, 15 aa, Borrelia burgdorferi B31
DDELDEAILNLIPEY

SEQ ID NO: 80678 - protein, 15 aa, Borrelia burgdorferi B31
DELDEAILNLIPEYE

SEQ ID NO: 80679 - protein, 15 aa, Borrelia burgdorferi B31
ELDEAILNLIPEYEG

SEQ ID NO: 80680 - protein, 15 aa, Borrelia burgdorferi B31
LDEAILNLIPEYEGL

SEQ ID NO: 80681 - protein, 15 aa, Borrelia burgdorferi B31
DEAILNLIPEYEGLK

SEQ ID NO: 80682 - protein, 15 aa, Borrelia burgdorferi B31
EAILNLIPEYEGLKL

SEQ ID NO: 80683 - protein, 15 aa, Borrelia burgdorferi B31
AILNLIPEYEGLKLK

SEQ ID NO: 80684 - protein, 15 aa, Borrelia burgdorferi B31
ILNLIPEYEGLKLKA

SEQ ID NO: 80685 - protein, 15 aa, Borrelia burgdorferi B31
LNLIPEYEGLKLKAI

SEQ ID NO: 80686 - protein, 15 aa, Borrelia burgdorferi B31
NLIPEYEGLKLKAIN

SEQ ID NO: 80687 - protein, 15 aa, Borrelia burgdorferi B31
LIPEYEGLKLKAINK

SEQ ID NO: 80688 - protein, 15 aa, Borrelia burgdorferi B31
IPEYEGLKLKAINKN

SEQ ID NO: 80689 - protein, 15 aa, Borrelia burgdorferi B31
PEYEGLKLKAINKNE

SEQ ID NO: 80690 - protein, 15 aa, Borrelia burgdorferi B31
EYEGLKLKAINKNET

SEQ ID NO: 80691 - protein, 15 aa, Borrelia burgdorferi B31
YEGLKLKAINKNETS

SEQ ID NO: 80692 - protein, 15 aa, Borrelia burgdorferi B31
EGLKLKAINKNETSN

SEQ ID NO: 80693 - protein, 15 aa, Borrelia burgdorferi B31
GLKLKAINKNETSNE

SEQ ID NO: 80694 - protein, 15 aa, Borrelia burgdorferi B31
LKLKAINKNETSNEL

SEQ ID NO: 80695 - protein, 15 aa, Borrelia burgdorferi B31
KLKAINKNETSNELK

SEQ ID NO: 80696 - protein, 15 aa, Borrelia burgdorferi B31
LKAINKNETSNELKD

SEQ ID NO: 80697 - protein, 15 aa, Borrelia burgdorferi B31
KAINKNETSNELKDE

SEQ ID NO: 80698 - protein, 15 aa, Borrelia burgdorferi B31
AINKNETSNELKDEN

SEQ ID NO: 80699 - protein, 15 aa, Borrelia burgdorferi B31
INKNETSNELKDENF

SEQ ID NO: 80700 - protein, 15 aa, Borrelia burgdorferi B31
NKNETSNELKDENFK

SEQ ID NO: 80701 - protein, 15 aa, Borrelia burgdorferi B31
KNETSNELKDENFKK

SEQ ID NO: 80702 - protein, 15 aa, Borrelia burgdorferi B31
NETSNELKDENFKKI

SEQ ID NO: 80703 - protein, 15 aa, Borrelia burgdorferi B31
ETSNELKDENFKKIE

SEQ ID NO: 80704 - protein, 15 aa, Borrelia burgdorferi B31
TSNELKDENFKKIEE

SEQ ID NO: 80705 - protein, 15 aa, Borrelia burgdorferi B31
SNELKDENFKKIEEE

SEQ ID NO: 80706 - protein, 15 aa, Borrelia burgdorferi B31
NELKDENFKKIEEEF

SEQ ID NO: 80707 - protein, 15 aa, Borrelia burgdorferi B31
ELKDENFKKIEEEFK

SEQ ID NO: 80708 - protein, 15 aa, Borrelia burgdorferi B31
LKDENFKKIEEEFKD

SEQ ID NO: 80709 - protein, 15 aa, Borrelia burgdorferi B31
KDENFKKIEEEFKDT

SEQ ID NO: 80710 - protein, 15 aa, Borrelia burgdorferi B31
DENFKKIEEEFKDTL

SEQ ID NO: 80711 - protein, 15 aa, Borrelia burgdorferi B31
ENFKKIEEEFKDTLT

SEQ ID NO: 80712 - protein, 15 aa, Borrelia burgdorferi B31
NFKKIEEEFKDTLTK

SEQ ID NO: 80713 - protein, 15 aa, Borrelia burgdorferi B31
FKKIEEEFKDTLTKV

SEQ ID NO: 80714 - protein, 15 aa, Borrelia burgdorferi B31
KKIEEEFKDTLTKVK

SEQ ID NO: 80715 - protein, 15 aa, Borrelia burgdorferi B31
KIEEEFKDTLTKVKE

SEQ ID NO: 80716 - protein, 15 aa, Borrelia burgdorferi B31
IEEEFKDTLTKVKEI

SEQ ID NO: 80717 - protein, 15 aa, Borrelia burgdorferi B31
EEEFKDTLTKVKEIL

SEQ ID NO: 80718 - protein, 15 aa, Borrelia burgdorferi B31
EEFKDTLTKVKEILK

SEQ ID NO: 80719 - protein, 15 aa, Borrelia burgdorferi B31
EFKDTLTKVKEILKD

SEQ ID NO: 80720 - protein, 15 aa, Borrelia burgdorferi B31
FKDTLTKVKEILKDH

SEQ ID NO: 80721 - protein, 15 aa, Borrelia burgdorferi B31
KDTLTKVKEILKDHI

SEQ ID NO: 80722 - protein, 15 aa, Borrelia burgdorferi B31
DTLTKVKEILKDHIK

SEQ ID NO: 80723 - protein, 15 aa, Borrelia burgdorferi B31
TLTKVKEILKDHIKE

SEQ ID NO: 80724 - protein, 15 aa, Borrelia burgdorferi B31
LTKVKEILKDHIKEV

SEQ ID NO: 80725 - protein, 15 aa, Borrelia burgdorferi B31
TKVKEILKDHIKEVN

SEQ ID NO: 80726 - protein, 15 aa, Borrelia burgdorferi B31
KVKEILKDHIKEVNL

SEQ ID NO: 80727 - protein, 15 aa, Borrelia burgdorferi B31
VKEILKDHIKEVNLS

SEQ ID NO: 80728 - protein, 15 aa, Borrelia burgdorferi B31
KEILKDHIKEVNLSA

SEQ ID NO: 80729 - protein, 15 aa, Borrelia burgdorferi B31
EILKDHIKEVNLSAT

SEQ ID NO: 80730 - protein, 15 aa, Borrelia burgdorferi B31
ILKDHIKEVNLSATL

SEQ ID NO: 80731 - protein, 15 aa, Borrelia burgdorferi B31
LKDHIKEVNLSATLI

SEQ ID NO: 80732 - protein, 15 aa, Borrelia burgdorferi B31
KDHIKEVNLSATLIK

SEQ ID NO: 80733 - protein, 15 aa, Borrelia burgdorferi B31
DHIKEVNLSATLIKE

SEQ ID NO: 80734 - protein, 15 aa, Borrelia burgdorferi B31
HIKEVNLSATLIKEP

SEQ ID NO: 80735 - protein, 15 aa, Borrelia burgdorferi B31
IKEVNLSATLIKEPS

SEQ ID NO: 80736 - protein, 15 aa, Borrelia burgdorferi B31
KEVNLSATLIKEPSA

SEQ ID NO: 80737 - protein, 15 aa, Borrelia burgdorferi B31
EVNLSATLIKEPSAI

SEQ ID NO: 80738 - protein, 15 aa, Borrelia burgdorferi B31
VNLSATLIKEPSAII

SEQ ID NO: 80739 - protein, 15 aa, Borrelia burgdorferi B31
NLSATLIKEPSAIII

SEQ ID NO: 80740 - protein, 15 aa, Borrelia burgdorferi B31
LSATLIKEPSAIIID

SEQ ID NO: 80741 - protein, 15 aa, Borrelia burgdorferi B31
SATLIKEPSAIIIDS

SEQ ID NO: 80742 - protein, 15 aa, Borrelia burgdorferi B31
ATLIKEPSAIIIDSN

SEQ ID NO: 80743 - protein, 15 aa, Borrelia burgdorferi B31
TLIKEPSAIIIDSND

SEQ ID NO: 80744 - protein, 15 aa, Borrelia burgdorferi B31
LIKEPSAIIIDSNDP

SEQ ID NO: 80745 - protein, 15 aa, Borrelia burgdorferi B31
IKEPSAIIIDSNDPT

SEQ ID NO: 80746 - protein, 15 aa, Borrelia burgdorferi B31
KEPSAIIIDSNDPTY

SEQ ID NO: 80747 - protein, 15 aa, Borrelia burgdorferi B31
EPSAIIIDSNDPTYQ

SEQ ID NO: 80748 - protein, 15 aa, Borrelia burgdorferi B31
PSAIIIDSNDPTYQM

SEQ ID NO: 80749 - protein, 15 aa, Borrelia burgdorferi B31
SAIIIDSNDPTYQMQ

SEQ ID NO: 80750 - protein, 15 aa, Borrelia burgdorferi B31
AIIIDSNDPTYQMQK

SEQ ID NO: 80751 - protein, 15 aa, Borrelia burgdorferi B31
IIIDSNDPTYQMQKI

SEQ ID NO: 80752 - protein, 15 aa, Borrelia burgdorferi B31
IIDSNDPTYQMQKIM

SEQ ID NO: 80753 - protein, 15 aa, Borrelia burgdorferi B31
IDSNDPTYQMQKIML

SEQ ID NO: 80754 - protein, 15 aa, Borrelia burgdorferi B31
DSNDPTYQMQKIMLS

SEQ ID NO: 80755 - protein, 15 aa, Borrelia burgdorferi B31
SNDPTYQMQKIMLSM

SEQ ID NO: 80756 - protein, 15 aa, Borrelia burgdorferi B31
NDPTYQMQKIMLSMG

SEQ ID NO: 80757 - protein, 15 aa, Borrelia burgdorferi B31
DPTYQMQKIMLSMGQ

SEQ ID NO: 80758 - protein, 15 aa, Borrelia burgdorferi B31
PTYQMQKIMLSMGQE

SEQ ID NO: 80759 - protein, 15 aa, Borrelia burgdorferi B31
TYQMQKIMLSMGQEV

SEQ ID NO: 80760 - protein, 15 aa, Borrelia burgdorferi B31
YQMQKIMLSMGQEVK

SEQ ID NO: 80761 - protein, 15 aa, Borrelia burgdorferi B31
QMQKIMLSMGQEVKE

SEQ ID NO: 80762 - protein, 15 aa, Borrelia burgdorferi B31
MQKIMLSMGQEVKEI

SEQ ID NO: 80763 - protein, 15 aa, Borrelia burgdorferi B31
QKIMLSMGQEVKEIK

SEQ ID NO: 80764 - protein, 15 aa, Borrelia burgdorferi B31
KIMLSMGQEVKEIKP

SEQ ID NO: 80765 - protein, 15 aa, Borrelia burgdorferi B31
IMLSMGQEVKEIKPI

SEQ ID NO: 80766 - protein, 15 aa, Borrelia burgdorferi B31
MLSMGQEVKEIKPIL

SEQ ID NO: 80767 - protein, 15 aa, Borrelia burgdorferi B31
LSMGQEVKEIKPILE

SEQ ID NO: 80768 - protein, 15 aa, Borrelia burgdorferi B31
SMGQEVKEIKPILEL

SEQ ID NO: 80769 - protein, 15 aa, Borrelia burgdorferi B31
MGQEVKEIKPILELN

SEQ ID NO: 80770 - protein, 15 aa, Borrelia burgdorferi B31
GQEVKEIKPILELNP

SEQ ID NO: 80771 - protein, 15 aa, Borrelia burgdorferi B31
QEVKEIKPILELNPN

SEQ ID NO: 80772 - protein, 15 aa, Borrelia burgdorferi B31
EVKEIKPILELNPNN

SEQ ID NO: 80773 - protein, 15 aa, Borrelia burgdorferi B31
VKEIKPILELNPNNK

SEQ ID NO: 80774 - protein, 15 aa, Borrelia burgdorferi B31
KEIKPILELNPNNKI

SEQ ID NO: 80775 - protein, 15 aa, Borrelia burgdorferi B31
EIKPILELNPNNKIV

SEQ ID NO: 80776 - protein, 15 aa, Borrelia burgdorferi B31
IKPILELNPNNKIVQ

SEQ ID NO: 80777 - protein, 15 aa, Borrelia burgdorferi B31
KPILELNPNNKIVQN

SEQ ID NO: 80778 - protein, 15 aa, Borrelia burgdorferi B31
PILELNPNNKIVQNL

SEQ ID NO: 80779 - protein, 15 aa, Borrelia burgdorferi B31
ILELNPNNKIVQNLK

SEQ ID NO: 80780 - protein, 15 aa, Borrelia burgdorferi B31
LELNPNNKIVQNLKN

SEQ ID NO: 80781 - protein, 15 aa, Borrelia burgdorferi B31
ELNPNNKIVQNLKNL

SEQ ID NO: 80782 - protein, 15 aa, Borrelia burgdorferi B31
LNPNNKIVQNLKNLE

SEQ ID NO: 80783 - protein, 15 aa, Borrelia burgdorferi B31
NPNNKIVQNLKNLEP

SEQ ID NO: 80784 - protein, 15 aa, Borrelia burgdorferi B31
PNNKIVQNLKNLEPE

SEQ ID NO: 80785 - protein, 15 aa, Borrelia burgdorferi B31
NNKIVQNLKNLEPEK

SEQ ID NO: 80786 - protein, 15 aa, Borrelia burgdorferi B31
NKIVQNLKNLEPEKL

SEQ ID NO: 80787 - protein, 15 aa, Borrelia burgdorferi B31
KIVQNLKNLEPEKLE

SEQ ID NO: 80788 - protein, 15 aa, Borrelia burgdorferi B31
IVQNLKNLEPEKLEK

SEQ ID NO: 80789 - protein, 15 aa, Borrelia burgdorferi B31
VQNLKNLEPEKLEKI

SEQ ID NO: 80790 - protein, 15 aa, Borrelia burgdorferi B31
QNLKNLEPEKLEKIS

SEQ ID NO: 80791 - protein, 15 aa, Borrelia burgdorferi B31
NLKNLEPEKLEKISI

SEQ ID NO: 80792 - protein, 15 aa, Borrelia burgdorferi B31
LKNLEPEKLEKISIL

SEQ ID NO: 80793 - protein, 15 aa, Borrelia burgdorferi B31
KNLEPEKLEKISILL

SEQ ID NO: 80794 - protein, 15 aa, Borrelia burgdorferi B31
NLEPEKLEKISILLF

SEQ ID NO: 80795 - protein, 15 aa, Borrelia burgdorferi B31
LEPEKLEKISILLFE

SEQ ID NO: 80796 - protein, 15 aa, Borrelia burgdorferi B31
EPEKLEKISILLFEE

SEQ ID NO: 80797 - protein, 15 aa, Borrelia burgdorferi B31
PEKLEKISILLFEEA

SEQ ID NO: 80798 - protein, 15 aa, Borrelia burgdorferi B31
EKLEKISILLFEEAM

SEQ ID NO: 80799 - protein, 15 aa, Borrelia burgdorferi B31
KLEKISILLFEEAML

SEQ ID NO: 80800 - protein, 15 aa, Borrelia burgdorferi B31
LEKISILLFEEAMLT

SEQ ID NO: 80801 - protein, 15 aa, Borrelia burgdorferi B31
EKISILLFEEAMLTS

SEQ ID NO: 80802 - protein, 15 aa, Borrelia burgdorferi B31
KISILLFEEAMLTSG

SEQ ID NO: 80803 - protein, 15 aa, Borrelia burgdorferi B31
ISILLFEEAMLTSGM

SEQ ID NO: 80804 - protein, 15 aa, Borrelia burgdorferi B31
SILLFEEAMLTSGMP

SEQ ID NO: 80805 - protein, 15 aa, Borrelia burgdorferi B31
ILLFEEAMLTSGMPS

SEQ ID NO: 80806 - protein, 15 aa, Borrelia burgdorferi B31
LLFEEAMLTSGMPSK

SEQ ID NO: 80807 - protein, 15 aa, Borrelia burgdorferi B31
LFEEAMLTSGMPSKN

SEQ ID NO: 80808 - protein, 15 aa, Borrelia burgdorferi B31
FEEAMLTSGMPSKNP

SEQ ID NO: 80809 - protein, 15 aa, Borrelia burgdorferi B31
EEAMLTSGMPSKNPG

SEQ ID NO: 80810 - protein, 15 aa, Borrelia burgdorferi B31
EAMLTSGMPSKNPGK

SEQ ID NO: 80811 - protein, 15 aa, Borrelia burgdorferi B31
AMLTSGMPSKNPGKF

SEQ ID NO: 80812 - protein, 15 aa, Borrelia burgdorferi B31
MLTSGMPSKNPGKFI

SEQ ID NO: 80813 - protein, 15 aa, Borrelia burgdorferi B31
LTSGMPSKNPGKFIN

SEQ ID NO: 80814 - protein, 15 aa, Borrelia burgdorferi B31
TSGMPSKNPGKFINI

SEQ ID NO: 80815 - protein, 15 aa, Borrelia burgdorferi B31
SGMPSKNPGKFINII

SEQ ID NO: 80816 - protein, 15 aa, Borrelia burgdorferi B31
GMPSKNPGKFINIIN

SEQ ID NO: 80817 - protein, 15 aa, Borrelia burgdorferi B31
MPSKNPGKFINIINE

SEQ ID NO: 80818 - protein, 15 aa, Borrelia burgdorferi B31
PSKNPGKFINIINEF

SEQ ID NO: 80819 - protein, 15 aa, Borrelia burgdorferi B31
SKNPGKFINIINEFI

SEQ ID NO: 80820 - protein, 15 aa, Borrelia burgdorferi B31
KNPGKFINIINEFIE

SEQ ID NO: 80821 - protein, 15 aa, Borrelia burgdorferi B31
NPGKFINIINEFIEK

SEQ ID NO: 80822 - protein, 15 aa, Borrelia burgdorferi B31
PGKFINIINEFIEKD

SEQ ID NO: 80823 - protein, 15 aa, Borrelia burgdorferi B31
GKFINIINEFIEKDF

SEQ ID NO: 80824 - protein, 15 aa, Borrelia burgdorferi B31
KFINIINEFIEKDFL

SEQ ID NO: 80825 - protein, 16 aa, Borrelia burgdorferi B31
MILIFYFKQIALFIIF

SEQ ID NO: 80826 - protein, 16 aa, Borrelia burgdorferi B31
ILIFYFKQIALFIIFR

SEQ ID NO: 80827 - protein, 16 aa, Borrelia burgdorferi B31
LIFYFKQIALFIIFRL

SEQ ID NO: 80828 - protein, 16 aa, Borrelia burgdorferi B31
IFYFKQIALFIIFRLC

SEQ ID NO: 80829 - protein, 16 aa, Borrelia burgdorferi B31
FYFKQIALFIIFRLCY

SEQ ID NO: 80830 - protein, 16 aa, Borrelia burgdorferi B31
YFKQIALFIIFRLCYI

SEQ ID NO: 80831 - protein, 16 aa, Borrelia burgdorferi B31
FKQIALFIIFRLCYII

SEQ ID NO: 80832 - protein, 16 aa, Borrelia burgdorferi B31
KQIALFIIFRLCYIIK

SEQ ID NO: 80833 - protein, 16 aa, Borrelia burgdorferi B31
QIALFIIFRLCYIIKK

SEQ ID NO: 80834 - protein, 16 aa, Borrelia burgdorferi B31
IALFIIFRLCYIIKKV

SEQ ID NO: 80835 - protein, 16 aa, Borrelia burgdorferi B31
ALFIIFRLCYIIKKVK

SEQ ID NO: 80836 - protein, 16 aa, Borrelia burgdorferi B31
LFIIFRLCYIIKKVKI

SEQ ID NO: 80837 - protein, 16 aa, Borrelia burgdorferi B31
FIIFRLCYIIKKVKIK

SEQ ID NO: 80838 - protein, 16 aa, Borrelia burgdorferi B31
IIFRLCYIIKKVKIKL

SEQ ID NO: 80839 - protein, 16 aa, Borrelia burgdorferi B31
IFRLCYIIKKVKIKLK

SEQ ID NO: 80840 - protein, 16 aa, Borrelia burgdorferi B31
FRLCYIIKKVKIKLKR

SEQ ID NO: 80841 - protein, 16 aa, Borrelia burgdorferi B31
RLCYIIKKVKIKLKRK

SEQ ID NO: 80842 - protein, 16 aa, Borrelia burgdorferi B31
LCYIIKKVKIKLKRKS

SEQ ID NO: 80843 - protein, 16 aa, Borrelia burgdorferi B31
CYIIKKVKIKLKRKSC

SEQ ID NO: 80844 - protein, 16 aa, Borrelia burgdorferi B31
YIIKKVKIKLKRKSCM

SEQ ID NO: 80845 - protein, 16 aa, Borrelia burgdorferi B31
IIKKVKIKLKRKSCMK

SEQ ID NO: 80846 - protein, 16 aa, Borrelia burgdorferi B31
IKKVKIKLKRKSCMKK

SEQ ID NO: 80847 - protein, 16 aa, Borrelia burgdorferi B31
KKVKIKLKRKSCMKKQ

SEQ ID NO: 80848 - protein, 16 aa, Borrelia burgdorferi B31
KVKIKLKRKSCMKKQF

SEQ ID NO: 80849 - protein, 16 aa, Borrelia burgdorferi B31
VKIKLKRKSCMKKQFD

SEQ ID NO: 80850 - protein, 16 aa, Borrelia burgdorferi B31
KIKLKRKSCMKKQFDT

SEQ ID NO: 80851 - protein, 16 aa, Borrelia burgdorferi B31
IKLKRKSCMKKQFDTE

SEQ ID NO: 80852 - protein, 16 aa, Borrelia burgdorferi B31
KLKRKSCMKKQFDTEV

SEQ ID NO: 80853 - protein, 16 aa, Borrelia burgdorferi B31
LKRKSCMKKQFDTEVN

SEQ ID NO: 80854 - protein, 16 aa, Borrelia burgdorferi B31
KRKSCMKKQFDTEVND

SEQ ID NO: 80855 - protein, 16 aa, Borrelia burgdorferi B31
RKSCMKKQFDTEVNDL

SEQ ID NO: 80856 - protein, 16 aa, Borrelia burgdorferi B31
KSCMKKQFDTEVNDLL

SEQ ID NO: 80857 - protein, 16 aa, Borrelia burgdorferi B31
SCMKKQFDTEVNDLLY

SEQ ID NO: 80858 - protein, 16 aa, Borrelia burgdorferi B31
CMKKQFDTEVNDLLYL

SEQ ID NO: 80859 - protein, 16 aa, Borrelia burgdorferi B31
MKKQFDTEVNDLLYLI

SEQ ID NO: 80860 - protein, 16 aa, Borrelia burgdorferi B31
KKQFDTEVNDLLYLII

SEQ ID NO: 80861 - protein, 16 aa, Borrelia burgdorferi B31
KQFDTEVNDLLYLIIH

SEQ ID NO: 80862 - protein, 16 aa, Borrelia burgdorferi B31
QFDTEVNDLLYLIIHS

SEQ ID NO: 80863 - protein, 16 aa, Borrelia burgdorferi B31
FDTEVNDLLYLIIHSL

SEQ ID NO: 80864 - protein, 16 aa, Borrelia burgdorferi B31
DTEVNDLLYLIIHSLY

SEQ ID NO: 80865 - protein, 16 aa, Borrelia burgdorferi B31
TEVNDLLYLIIHSLYS

SEQ ID NO: 80866 - protein, 16 aa, Borrelia burgdorferi B31
EVNDLLYLIIHSLYSH

SEQ ID NO: 80867 - protein, 16 aa, Borrelia burgdorferi B31
VNDLLYLIIHSLYSHK

SEQ ID NO: 80868 - protein, 16 aa, Borrelia burgdorferi B31
NDLLYLIIHSLYSHKE

SEQ ID NO: 80869 - protein, 16 aa, Borrelia burgdorferi B31
DLLYLIIHSLYSHKEI

SEQ ID NO: 80870 - protein, 16 aa, Borrelia burgdorferi B31
LLYLIIHSLYSHKEIF

SEQ ID NO: 80871 - protein, 16 aa, Borrelia burgdorferi B31
LYLIIHSLYSHKEIFL

SEQ ID NO: 80872 - protein, 16 aa, Borrelia burgdorferi B31
YLIIHSLYSHKEIFLR

SEQ ID NO: 80873 - protein, 16 aa, Borrelia burgdorferi B31
LIIHSLYSHKEIFLRE

SEQ ID NO: 80874 - protein, 16 aa, Borrelia burgdorferi B31
IIHSLYSHKEIFLREL

SEQ ID NO: 80875 - protein, 16 aa, Borrelia burgdorferi B31
IHSLYSHKEIFLRELI

SEQ ID NO: 80876 - protein, 16 aa, Borrelia burgdorferi B31
HSLYSHKEIFLRELIS

SEQ ID NO: 80877 - protein, 16 aa, Borrelia burgdorferi B31
SLYSHKEIFLRELISN

SEQ ID NO: 80878 - protein, 16 aa, Borrelia burgdorferi B31
LYSHKEIFLRELISNA

SEQ ID NO: 80879 - protein, 16 aa, Borrelia burgdorferi B31
YSHKEIFLRELISNAS

SEQ ID NO: 80880 - protein, 16 aa, Borrelia burgdorferi B31
SHKEIFLRELISNASD

SEQ ID NO: 80881 - protein, 16 aa, Borrelia burgdorferi B31
HKEIFLRELISNASDA

SEQ ID NO: 80882 - protein, 16 aa, Borrelia burgdorferi B31
KEIFLRELISNASDAI

SEQ ID NO: 80883 - protein, 16 aa, Borrelia burgdorferi B31
EIFLRELISNASDAID

SEQ ID NO: 80884 - protein, 16 aa, Borrelia burgdorferi B31
IFLRELISNASDAIDK

SEQ ID NO: 80885 - protein, 16 aa, Borrelia burgdorferi B31
FLRELISNASDAIDKL

SEQ ID NO: 80886 - protein, 16 aa, Borrelia burgdorferi B31
LRELISNASDAIDKLK

SEQ ID NO: 80887 - protein, 16 aa, Borrelia burgdorferi B31
RELISNASDAIDKLKF

SEQ ID NO: 80888 - protein, 16 aa, Borrelia burgdorferi B31
ELISNASDAIDKLKFL

SEQ ID NO: 80889 - protein, 16 aa, Borrelia burgdorferi B31
LISNASDAIDKLKFLS

SEQ ID NO: 80890 - protein, 16 aa, Borrelia burgdorferi B31
ISNASDAIDKLKFLSL

SEQ ID NO: 80891 - protein, 16 aa, Borrelia burgdorferi B31
SNASDAIDKLKFLSLT

SEQ ID NO: 80892 - protein, 16 aa, Borrelia burgdorferi B31
NASDAIDKLKFLSLTN

SEQ ID NO: 80893 - protein, 16 aa, Borrelia burgdorferi B31
ASDAIDKLKFLSLTNE

SEQ ID NO: 80894 - protein, 16 aa, Borrelia burgdorferi B31
SDAIDKLKFLSLTNEK

SEQ ID NO: 80895 - protein, 16 aa, Borrelia burgdorferi B31
DAIDKLKFLSLTNEKF

SEQ ID NO: 80896 - protein, 16 aa, Borrelia burgdorferi B31
AIDKLKFLSLTNEKFK

SEQ ID NO: 80897 - protein, 16 aa, Borrelia burgdorferi B31
IDKLKFLSLTNEKFKN

SEQ ID NO: 80898 - protein, 16 aa, Borrelia burgdorferi B31
DKLKFLSLTNEKFKNI

SEQ ID NO: 80899 - protein, 16 aa, Borrelia burgdorferi B31
KLKFLSLTNEKFKNIA

SEQ ID NO: 80900 - protein, 16 aa, Borrelia burgdorferi B31
LKFLSLTNEKFKNIAL

SEQ ID NO: 80901 - protein, 16 aa, Borrelia burgdorferi B31
KFLSLTNEKFKNIALE

SEQ ID NO: 80902 - protein, 16 aa, Borrelia burgdorferi B31
FLSLTNEKFKNIALEP

SEQ ID NO: 80903 - protein, 16 aa, Borrelia burgdorferi B31
LSLTNEKFKNIALEPK

SEQ ID NO: 80904 - protein, 16 aa, Borrelia burgdorferi B31
SLTNEKFKNIALEPKI

SEQ ID NO: 80905 - protein, 16 aa, Borrelia burgdorferi B31
LTNEKFKNIALEPKIE

SEQ ID NO: 80906 - protein, 16 aa, Borrelia burgdorferi B31
TNEKFKNIALEPKIEI

SEQ ID NO: 80907 - protein, 16 aa, Borrelia burgdorferi B31
NEKFKNIALEPKIEIS

SEQ ID NO: 80908 - protein, 16 aa, Borrelia burgdorferi B31
EKFKNIALEPKIEISF

SEQ ID NO: 80909 - protein, 16 aa, Borrelia burgdorferi B31
KFKNIALEPKIEISFD

SEQ ID NO: 80910 - protein, 16 aa, Borrelia burgdorferi B31
FKNIALEPKIEISFDD

SEQ ID NO: 80911 - protein, 16 aa, Borrelia burgdorferi B31
KNIALEPKIEISFDDK

SEQ ID NO: 80912 - protein, 16 aa, Borrelia burgdorferi B31
NIALEPKIEISFDDKS

SEQ ID NO: 80913 - protein, 16 aa, Borrelia burgdorferi B31
IALEPKIEISFDDKSI

SEQ ID NO: 80914 - protein, 16 aa, Borrelia burgdorferi B31
ALEPKIEISFDDKSIL

SEQ ID NO: 80915 - protein, 16 aa, Borrelia burgdorferi B31
LEPKIEISFDDKSILI

SEQ ID NO: 80916 - protein, 16 aa, Borrelia burgdorferi B31
EPKIEISFDDKSILIK

SEQ ID NO: 80917 - protein, 16 aa, Borrelia burgdorferi B31
PKIEISFDDKSILIKD

SEQ ID NO: 80918 - protein, 16 aa, Borrelia burgdorferi B31
KIEISFDDKSILIKDN

SEQ ID NO: 80919 - protein, 16 aa, Borrelia burgdorferi B31
IEISFDDKSILIKDNG

SEQ ID NO: 80920 - protein, 16 aa, Borrelia burgdorferi B31
EISFDDKSILIKDNGI

SEQ ID NO: 80921 - protein, 16 aa, Borrelia burgdorferi B31
ISFDDKSILIKDNGIG

SEQ ID NO: 80922 - protein, 16 aa, Borrelia burgdorferi B31
SFDDKSILIKDNGIGM

SEQ ID NO: 80923 - protein, 16 aa, Borrelia burgdorferi B31
FDDKSILIKDNGIGMD

SEQ ID NO: 80924 - protein, 16 aa, Borrelia burgdorferi B31
DDKSILIKDNGIGMDE

SEQ ID NO: 80925 - protein, 16 aa, Borrelia burgdorferi B31
DKSILIKDNGIGMDEQ

SEQ ID NO: 80926 - protein, 16 aa, Borrelia burgdorferi B31
KSILIKDNGIGMDEQD

SEQ ID NO: 80927 - protein, 16 aa, Borrelia burgdorferi B31
SILIKDNGIGMDEQDL

SEQ ID NO: 80928 - protein, 16 aa, Borrelia burgdorferi B31
ILIKDNGIGMDEQDLT

SEQ ID NO: 80929 - protein, 16 aa, Borrelia burgdorferi B31
LIKDNGIGMDEQDLTN

SEQ ID NO: 80930 - protein, 16 aa, Borrelia burgdorferi B31
IKDNGIGMDEQDLTNH

SEQ ID NO: 80931 - protein, 16 aa, Borrelia burgdorferi B31
KDNGIGMDEQDLTNHL

SEQ ID NO: 80932 - protein, 16 aa, Borrelia burgdorferi B31
DNGIGMDEQDLTNHLG

SEQ ID NO: 80933 - protein, 16 aa, Borrelia burgdorferi B31
NGIGMDEQDLTNHLGV

SEQ ID NO: 80934 - protein, 16 aa, Borrelia burgdorferi B31
GIGMDEQDLTNHLGVI

SEQ ID NO: 80935 - protein, 16 aa, Borrelia burgdorferi B31
IGMDEQDLTNHLGVIA

SEQ ID NO: 80936 - protein, 16 aa, Borrelia burgdorferi B31
GMDEQDLTNHLGVIAK

SEQ ID NO: 80937 - protein, 16 aa, Borrelia burgdorferi B31
MDEQDLTNHLGVIAKS

SEQ ID NO: 80938 - protein, 16 aa, Borrelia burgdorferi B31
DEQDLTNHLGVIAKSG

SEQ ID NO: 80939 - protein, 16 aa, Borrelia burgdorferi B31
EQDLTNHLGVIAKSGT

SEQ ID NO: 80940 - protein, 16 aa, Borrelia burgdorferi B31
QDLTNHLGVIAKSGTK

SEQ ID NO: 80941 - protein, 16 aa, Borrelia burgdorferi B31
DLTNHLGVIAKSGTKE

SEQ ID NO: 80942 - protein, 16 aa, Borrelia burgdorferi B31
LTNHLGVIAKSGTKEF

SEQ ID NO: 80943 - protein, 16 aa, Borrelia burgdorferi B31
TNHLGVIAKSGTKEFI

SEQ ID NO: 80944 - protein, 16 aa, Borrelia burgdorferi B31
NHLGVIAKSGTKEFIN

SEQ ID NO: 80945 - protein, 16 aa, Borrelia burgdorferi B31
HLGVIAKSGTKEFINN

SEQ ID NO: 80946 - protein, 16 aa, Borrelia burgdorferi B31
LGVIAKSGTKEFINNL

SEQ ID NO: 80947 - protein, 16 aa, Borrelia burgdorferi B31
GVIAKSGTKEFINNLK

SEQ ID NO: 80948 - protein, 16 aa, Borrelia burgdorferi B31
VIAKSGTKEFINNLKQ

SEQ ID NO: 80949 - protein, 16 aa, Borrelia burgdorferi B31
IAKSGTKEFINNLKQD

SEQ ID NO: 80950 - protein, 16 aa, Borrelia burgdorferi B31
AKSGTKEFINNLKQDE

SEQ ID NO: 80951 - protein, 16 aa, Borrelia burgdorferi B31
KSGTKEFINNLKQDEK

SEQ ID NO: 80952 - protein, 16 aa, Borrelia burgdorferi B31
SGTKEFINNLKQDEKK

SEQ ID NO: 80953 - protein, 16 aa, Borrelia burgdorferi B31
GTKEFINNLKQDEKKS

SEQ ID NO: 80954 - protein, 16 aa, Borrelia burgdorferi B31
TKEFINNLKQDEKKSA

SEQ ID NO: 80955 - protein, 16 aa, Borrelia burgdorferi B31
KEFINNLKQDEKKSAS

SEQ ID NO: 80956 - protein, 16 aa, Borrelia burgdorferi B31
EFINNLKQDEKKSASL

SEQ ID NO: 80957 - protein, 16 aa, Borrelia burgdorferi B31
FINNLKQDEKKSASLI

SEQ ID NO: 80958 - protein, 16 aa, Borrelia burgdorferi B31
INNLKQDEKKSASLIG

SEQ ID NO: 80959 - protein, 16 aa, Borrelia burgdorferi B31
NNLKQDEKKSASLIGQ

SEQ ID NO: 80960 - protein, 16 aa, Borrelia burgdorferi B31
NLKQDEKKSASLIGQF

SEQ ID NO: 80961 - protein, 16 aa, Borrelia burgdorferi B31
LKQDEKKSASLIGQFG

SEQ ID NO: 80962 - protein, 16 aa, Borrelia burgdorferi B31
KQDEKKSASLIGQFGV

SEQ ID NO: 80963 - protein, 16 aa, Borrelia burgdorferi B31
QDEKKSASLIGQFGVG

SEQ ID NO: 80964 - protein, 16 aa, Borrelia burgdorferi B31
DEKKSASLIGQFGVGF

SEQ ID NO: 80965 - protein, 16 aa, Borrelia burgdorferi B31
EKKSASLIGQFGVGFY

SEQ ID NO: 80966 - protein, 16 aa, Borrelia burgdorferi B31
KKSASLIGQFGVGFYS

SEQ ID NO: 80967 - protein, 16 aa, Borrelia burgdorferi B31
KSASLIGQFGVGFYSA

SEQ ID NO: 80968 - protein, 16 aa, Borrelia burgdorferi B31
SASLIGQFGVGFYSAF

SEQ ID NO: 80969 - protein, 16 aa, Borrelia burgdorferi B31
ASLIGQFGVGFYSAFI

SEQ ID NO: 80970 - protein, 16 aa, Borrelia burgdorferi B31
SLIGQFGVGFYSAFIV

SEQ ID NO: 80971 - protein, 16 aa, Borrelia burgdorferi B31
LIGQFGVGFYSAFIVS

SEQ ID NO: 80972 - protein, 16 aa, Borrelia burgdorferi B31
IGQFGVGFYSAFIVSE

SEQ ID NO: 80973 - protein, 16 aa, Borrelia burgdorferi B31
GQFGVGFYSAFIVSEK

SEQ ID NO: 80974 - protein, 16 aa, Borrelia burgdorferi B31
QFGVGFYSAFIVSEKV

SEQ ID NO: 80975 - protein, 16 aa, Borrelia burgdorferi B31
FGVGFYSAFIVSEKVE

SEQ ID NO: 80976 - protein, 16 aa, Borrelia burgdorferi B31
GVGFYSAFIVSEKVEV

SEQ ID NO: 80977 - protein, 16 aa, Borrelia burgdorferi B31
VGFYSAFIVSEKVEVT

SEQ ID NO: 80978 - protein, 16 aa, Borrelia burgdorferi B31
GFYSAFIVSEKVEVTS

SEQ ID NO: 80979 - protein, 16 aa, Borrelia burgdorferi B31
FYSAFIVSEKVEVTSK

SEQ ID NO: 80980 - protein, 16 aa, Borrelia burgdorferi B31
YSAFIVSEKVEVTSKK

SEQ ID NO: 80981 - protein, 16 aa, Borrelia burgdorferi B31
SAFIVSEKVEVTSKKA

SEQ ID NO: 80982 - protein, 16 aa, Borrelia burgdorferi B31
AFIVSEKVEVTSKKAL

SEQ ID NO: 80983 - protein, 16 aa, Borrelia burgdorferi B31
FIVSEKVEVTSKKALE

SEQ ID NO: 80984 - protein, 16 aa, Borrelia burgdorferi B31
IVSEKVEVTSKKALES

SEQ ID NO: 80985 - protein, 16 aa, Borrelia burgdorferi B31
VSEKVEVTSKKALESD

SEQ ID NO: 80986 - protein, 16 aa, Borrelia burgdorferi B31
SEKVEVTSKKALESDA

SEQ ID NO: 80987 - protein, 16 aa, Borrelia burgdorferi B31
EKVEVTSKKALESDAY

SEQ ID NO: 80988 - protein, 16 aa, Borrelia burgdorferi B31
KVEVTSKKALESDAYI

SEQ ID NO: 80989 - protein, 16 aa, Borrelia burgdorferi B31
VEVTSKKALESDAYIW

SEQ ID NO: 80990 - protein, 16 aa, Borrelia burgdorferi B31
EVTSKKALESDAYIWS

SEQ ID NO: 80991 - protein, 16 aa, Borrelia burgdorferi B31
VTSKKALESDAYIWSS

SEQ ID NO: 80992 - protein, 16 aa, Borrelia burgdorferi B31
TSKKALESDAYIWSSD

SEQ ID NO: 80993 - protein, 16 aa, Borrelia burgdorferi B31
SKKALESDAYIWSSDG

SEQ ID NO: 80994 - protein, 16 aa, Borrelia burgdorferi B31
KKALESDAYIWSSDGK

SEQ ID NO: 80995 - protein, 16 aa, Borrelia burgdorferi B31
KALESDAYIWSSDGKT

SEQ ID NO: 80996 - protein, 16 aa, Borrelia burgdorferi B31
ALESDAYIWSSDGKTG

SEQ ID NO: 80997 - protein, 16 aa, Borrelia burgdorferi B31
LESDAYIWSSDGKTGY

SEQ ID NO: 80998 - protein, 16 aa, Borrelia burgdorferi B31
ESDAYIWSSDGKTGYE

SEQ ID NO: 80999 - protein, 16 aa, Borrelia burgdorferi B31
SDAYIWSSDGKTGYEI

SEQ ID NO: 81000 - protein, 16 aa, Borrelia burgdorferi B31
DAYIWSSDGKTGYEIE

SEQ ID NO: 81001 - protein, 16 aa, Borrelia burgdorferi B31
AYIWSSDGKTGYEIEK

SEQ ID NO: 81002 - protein, 16 aa, Borrelia burgdorferi B31
YIWSSDGKTGYEIEKA

SEQ ID NO: 81003 - protein, 16 aa, Borrelia burgdorferi B31
IWSSDGKTGYEIEKAK

SEQ ID NO: 81004 - protein, 16 aa, Borrelia burgdorferi B31
WSSDGKTGYEIEKAKK

SEQ ID NO: 81005 - protein, 16 aa, Borrelia burgdorferi B31
SSDGKTGYEIEKAKKE

SEQ ID NO: 81006 - protein, 16 aa, Borrelia burgdorferi B31
SDGKTGYEIEKAKKEE

SEQ ID NO: 81007 - protein, 16 aa, Borrelia burgdorferi B31
DGKTGYEIEKAKKEES

SEQ ID NO: 81008 - protein, 16 aa, Borrelia burgdorferi B31
GKTGYEIEKAKKEESG

SEQ ID NO: 81009 - protein, 16 aa, Borrelia burgdorferi B31
KTGYEIEKAKKEESGT

SEQ ID NO: 81010 - protein, 16 aa, Borrelia burgdorferi B31
TGYEIEKAKKEESGTE

SEQ ID NO: 81011 - protein, 16 aa, Borrelia burgdorferi B31
GYEIEKAKKEESGTEI

SEQ ID NO: 81012 - protein, 16 aa, Borrelia burgdorferi B31
YEIEKAKKEESGTEIK

SEQ ID NO: 81013 - protein, 16 aa, Borrelia burgdorferi B31
EIEKAKKEESGTEIKL

SEQ ID NO: 81014 - protein, 16 aa, Borrelia burgdorferi B31
IEKAKKEESGTEIKLY

SEQ ID NO: 81015 - protein, 16 aa, Borrelia burgdorferi B31
EKAKKEESGTEIKLYL

SEQ ID NO: 81016 - protein, 16 aa, Borrelia burgdorferi B31
KAKKEESGTEIKLYLN

SEQ ID NO: 81017 - protein, 16 aa, Borrelia burgdorferi B31
AKKEESGTEIKLYLNK

SEQ ID NO: 81018 - protein, 16 aa, Borrelia burgdorferi B31
KKEESGTEIKLYLNKE

SEQ ID NO: 81019 - protein, 16 aa, Borrelia burgdorferi B31
KEESGTEIKLYLNKEG

SEQ ID NO: 81020 - protein, 16 aa, Borrelia burgdorferi B31
EESGTEIKLYLNKEGL

SEQ ID NO: 81021 - protein, 16 aa, Borrelia burgdorferi B31
ESGTEIKLYLNKEGLE

SEQ ID NO: 81022 - protein, 16 aa, Borrelia burgdorferi B31
SGTEIKLYLNKEGLEY

SEQ ID NO: 81023 - protein, 16 aa, Borrelia burgdorferi B31
GTEIKLYLNKEGLEYA

SEQ ID NO: 81024 - protein, 16 aa, Borrelia burgdorferi B31
TEIKLYLNKEGLEYAN

SEQ ID NO: 81025 - protein, 16 aa, Borrelia burgdorferi B31
EIKLYLNKEGLEYANK

SEQ ID NO: 81026 - protein, 16 aa, Borrelia burgdorferi B31
IKLYLNKEGLEYANKW

SEQ ID NO: 81027 - protein, 16 aa, Borrelia burgdorferi B31
KLYLNKEGLEYANKWK

SEQ ID NO: 81028 - protein, 16 aa, Borrelia burgdorferi B31
LYLNKEGLEYANKWKI

SEQ ID NO: 81029 - protein, 16 aa, Borrelia burgdorferi B31
YLNKEGLEYANKWKIQ

SEQ ID NO: 81030 - protein, 16 aa, Borrelia burgdorferi B31
LNKEGLEYANKWKIQE

SEQ ID NO: 81031 - protein, 16 aa, Borrelia burgdorferi B31
NKEGLEYANKWKIQEI

SEQ ID NO: 81032 - protein, 16 aa, Borrelia burgdorferi B31
KEGLEYANKWKIQEII

SEQ ID NO: 81033 - protein, 16 aa, Borrelia burgdorferi B31
EGLEYANKWKIQEIIK

SEQ ID NO: 81034 - protein, 16 aa, Borrelia burgdorferi B31
GLEYANKWKIQEIIKK

SEQ ID NO: 81035 - protein, 16 aa, Borrelia burgdorferi B31
LEYANKWKIQEIIKKY

SEQ ID NO: 81036 - protein, 16 aa, Borrelia burgdorferi B31
EYANKWKIQEIIKKYS

SEQ ID NO: 81037 - protein, 16 aa, Borrelia burgdorferi B31
YANKWKIQEIIKKYSN

SEQ ID NO: 81038 - protein, 16 aa, Borrelia burgdorferi B31
ANKWKIQEIIKKYSNH

SEQ ID NO: 81039 - protein, 16 aa, Borrelia burgdorferi B31
NKWKIQEIIKKYSNHI

SEQ ID NO: 81040 - protein, 16 aa, Borrelia burgdorferi B31
KWKIQEIIKKYSNHIN

SEQ ID NO: 81041 - protein, 16 aa, Borrelia burgdorferi B31
WKIQEIIKKYSNHINY

SEQ ID NO: 81042 - protein, 16 aa, Borrelia burgdorferi B31
KIQEIIKKYSNHINYP

SEQ ID NO: 81043 - protein, 16 aa, Borrelia burgdorferi B31
IQEIIKKYSNHINYPI

SEQ ID NO: 81044 - protein, 16 aa, Borrelia burgdorferi B31
QEIIKKYSNHINYPIY

SEQ ID NO: 81045 - protein, 16 aa, Borrelia burgdorferi B31
EIIKKYSNHINYPIYI

SEQ ID NO: 81046 - protein, 16 aa, Borrelia burgdorferi B31
IIKKYSNHINYPIYIK

SEQ ID NO: 81047 - protein, 16 aa, Borrelia burgdorferi B31
IKKYSNHINYPIYIKY

SEQ ID NO: 81048 - protein, 16 aa, Borrelia burgdorferi B31
KKYSNHINYPIYIKYS

SEQ ID NO: 81049 - protein, 16 aa, Borrelia burgdorferi B31
KYSNHINYPIYIKYSE

SEQ ID NO: 81050 - protein, 16 aa, Borrelia burgdorferi B31
YSNHINYPIYIKYSEP

SEQ ID NO: 81051 - protein, 16 aa, Borrelia burgdorferi B31
SNHINYPIYIKYSEPI

SEQ ID NO: 81052 - protein, 16 aa, Borrelia burgdorferi B31
NHINYPIYIKYSEPIM

SEQ ID NO: 81053 - protein, 16 aa, Borrelia burgdorferi B31
HINYPIYIKYSEPIMK

SEQ ID NO: 81054 - protein, 16 aa, Borrelia burgdorferi B31
INYPIYIKYSEPIMKD

SEQ ID NO: 81055 - protein, 16 aa, Borrelia burgdorferi B31
NYPIYIKYSEPIMKDG

SEQ ID NO: 81056 - protein, 16 aa, Borrelia burgdorferi B31
YPIYIKYSEPIMKDGK

SEQ ID NO: 81057 - protein, 16 aa, Borrelia burgdorferi B31
PIYIKYSEPIMKDGKQ

SEQ ID NO: 81058 - protein, 16 aa, Borrelia burgdorferi B31
IYIKYSEPIMKDGKQE

SEQ ID NO: 81059 - protein, 16 aa, Borrelia burgdorferi B31
YIKYSEPIMKDGKQEG

SEQ ID NO: 81060 - protein, 16 aa, Borrelia burgdorferi B31
IKYSEPIMKDGKQEGI

SEQ ID NO: 81061 - protein, 16 aa, Borrelia burgdorferi B31
KYSEPIMKDGKQEGIE

SEQ ID NO: 81062 - protein, 16 aa, Borrelia burgdorferi B31
YSEPIMKDGKQEGIEE

SEQ ID NO: 81063 - protein, 16 aa, Borrelia burgdorferi B31
SEPIMKDGKQEGIEEK

SEQ ID NO: 81064 - protein, 16 aa, Borrelia burgdorferi B31
EPIMKDGKQEGIEEKE

SEQ ID NO: 81065 - protein, 16 aa, Borrelia burgdorferi B31
PIMKDGKQEGIEEKEE

SEQ ID NO: 81066 - protein, 16 aa, Borrelia burgdorferi B31
IMKDGKQEGIEEKEEK

SEQ ID NO: 81067 - protein, 16 aa, Borrelia burgdorferi B31
MKDGKQEGIEEKEEKL

SEQ ID NO: 81068 - protein, 16 aa, Borrelia burgdorferi B31
KDGKQEGIEEKEEKLN

SEQ ID NO: 81069 - protein, 16 aa, Borrelia burgdorferi B31
DGKQEGIEEKEEKLNE

SEQ ID NO: 81070 - protein, 16 aa, Borrelia burgdorferi B31
GKQEGIEEKEEKLNET

SEQ ID NO: 81071 - protein, 16 aa, Borrelia burgdorferi B31
KQEGIEEKEEKLNETT

SEQ ID NO: 81072 - protein, 16 aa, Borrelia burgdorferi B31
QEGIEEKEEKLNETTA

SEQ ID NO: 81073 - protein, 16 aa, Borrelia burgdorferi B31
EGIEEKEEKLNETTAL

SEQ ID NO: 81074 - protein, 16 aa, Borrelia burgdorferi B31
GIEEKEEKLNETTALW

SEQ ID NO: 81075 - protein, 16 aa, Borrelia burgdorferi B31
IEEKEEKLNETTALWT

SEQ ID NO: 81076 - protein, 16 aa, Borrelia burgdorferi B31
EEKEEKLNETTALWTK

SEQ ID NO: 81077 - protein, 16 aa, Borrelia burgdorferi B31
EKEEKLNETTALWTKN

SEQ ID NO: 81078 - protein, 16 aa, Borrelia burgdorferi B31
KEEKLNETTALWTKNK

SEQ ID NO: 81079 - protein, 16 aa, Borrelia burgdorferi B31
EEKLNETTALWTKNKS

SEQ ID NO: 81080 - protein, 16 aa, Borrelia burgdorferi B31
EKLNETTALWTKNKSE

SEQ ID NO: 81081 - protein, 16 aa, Borrelia burgdorferi B31
KLNETTALWTKNKSEI

SEQ ID NO: 81082 - protein, 16 aa, Borrelia burgdorferi B31
LNETTALWTKNKSEIK

SEQ ID NO: 81083 - protein, 16 aa, Borrelia burgdorferi B31
NETTALWTKNKSEIKA

SEQ ID NO: 81084 - protein, 16 aa, Borrelia burgdorferi B31
ETTALWTKNKSEIKAE

SEQ ID NO: 81085 - protein, 16 aa, Borrelia burgdorferi B31
TTALWTKNKSEIKAEE

SEQ ID NO: 81086 - protein, 16 aa, Borrelia burgdorferi B31
TALWTKNKSEIKAEEY

SEQ ID NO: 81087 - protein, 16 aa, Borrelia burgdorferi B31
ALWTKNKSEIKAEEYN

SEQ ID NO: 81088 - protein, 16 aa, Borrelia burgdorferi B31
LWTKNKSEIKAEEYNE

SEQ ID NO: 81089 - protein, 16 aa, Borrelia burgdorferi B31
WTKNKSEIKAEEYNEF

SEQ ID NO: 81090 - protein, 16 aa, Borrelia burgdorferi B31
TKNKSEIKAEEYNEFY

SEQ ID NO: 81091 - protein, 16 aa, Borrelia burgdorferi B31
KNKSEIKAEEYNEFYK

SEQ ID NO: 81092 - protein, 16 aa, Borrelia burgdorferi B31
NKSEIKAEEYNEFYKN

SEQ ID NO: 81093 - protein, 16 aa, Borrelia burgdorferi B31
KSEIKAEEYNEFYKNT

SEQ ID NO: 81094 - protein, 16 aa, Borrelia burgdorferi B31
SEIKAEEYNEFYKNTT

SEQ ID NO: 81095 - protein, 16 aa, Borrelia burgdorferi B31
EIKAEEYNEFYKNTTF

SEQ ID NO: 81096 - protein, 16 aa, Borrelia burgdorferi B31
IKAEEYNEFYKNTTFD

SEQ ID NO: 81097 - protein, 16 aa, Borrelia burgdorferi B31
KAEEYNEFYKNTTFDY

SEQ ID NO: 81098 - protein, 16 aa, Borrelia burgdorferi B31
AEEYNEFYKNTTFDYE

SEQ ID NO: 81099 - protein, 16 aa, Borrelia burgdorferi B31
EEYNEFYKNTTFDYEN

SEQ ID NO: 81100 - protein, 16 aa, Borrelia burgdorferi B31
EYNEFYKNTTFDYENP

SEQ ID NO: 81101 - protein, 16 aa, Borrelia burgdorferi B31
YNEFYKNTTFDYENPL

SEQ ID NO: 81102 - protein, 16 aa, Borrelia burgdorferi B31
NEFYKNTTFDYENPLM

SEQ ID NO: 81103 - protein, 16 aa, Borrelia burgdorferi B31
EFYKNTTFDYENPLMH

SEQ ID NO: 81104 - protein, 16 aa, Borrelia burgdorferi B31
FYKNTTFDYENPLMHI

SEQ ID NO: 81105 - protein, 16 aa, Borrelia burgdorferi B31
YKNTTFDYENPLMHIH

SEQ ID NO: 81106 - protein, 16 aa, Borrelia burgdorferi B31
KNTTFDYENPLMHIHT

SEQ ID NO: 81107 - protein, 16 aa, Borrelia burgdorferi B31
NTTFDYENPLMHIHTK

SEQ ID NO: 81108 - protein, 16 aa, Borrelia burgdorferi B31
TTFDYENPLMHIHTKA

SEQ ID NO: 81109 - protein, 16 aa, Borrelia burgdorferi B31
TFDYENPLMHIHTKAE

SEQ ID NO: 81110 - protein, 16 aa, Borrelia burgdorferi B31
FDYENPLMHIHTKAEG

SEQ ID NO: 81111 - protein, 16 aa, Borrelia burgdorferi B31
DYENPLMHIHTKAEGN

SEQ ID NO: 81112 - protein, 16 aa, Borrelia burgdorferi B31
YENPLMHIHTKAEGNL

SEQ ID NO: 81113 - protein, 16 aa, Borrelia burgdorferi B31
ENPLMHIHTKAEGNLE

SEQ ID NO: 81114 - protein, 16 aa, Borrelia burgdorferi B31
NPLMHIHTKAEGNLEY

SEQ ID NO: 81115 - protein, 16 aa, Borrelia burgdorferi B31
PLMHIHTKAEGNLEYT

SEQ ID NO: 81116 - protein, 16 aa, Borrelia burgdorferi B31
LMHIHTKAEGNLEYTN

SEQ ID NO: 81117 - protein, 16 aa, Borrelia burgdorferi B31
MHIHTKAEGNLEYTNL

SEQ ID NO: 81118 - protein, 16 aa, Borrelia burgdorferi B31
HIHTKAEGNLEYTNLF

SEQ ID NO: 81119 - protein, 16 aa, Borrelia burgdorferi B31
IHTKAEGNLEYTNLFY

SEQ ID NO: 81120 - protein, 16 aa, Borrelia burgdorferi B31
HTKAEGNLEYTNLFYV

SEQ ID NO: 81121 - protein, 16 aa, Borrelia burgdorferi B31
TKAEGNLEYTNLFYVP

SEQ ID NO: 81122 - protein, 16 aa, Borrelia burgdorferi B31
KAEGNLEYTNLFYVPS

SEQ ID NO: 81123 - protein, 16 aa, Borrelia burgdorferi B31
AEGNLEYTNLFYVPSK

SEQ ID NO: 81124 - protein, 16 aa, Borrelia burgdorferi B31
EGNLEYTNLFYVPSKA

SEQ ID NO: 81125 - protein, 16 aa, Borrelia burgdorferi B31
GNLEYTNLFYVPSKAP

SEQ ID NO: 81126 - protein, 16 aa, Borrelia burgdorferi B31
NLEYTNLFYVPSKAPY

SEQ ID NO: 81127 - protein, 16 aa, Borrelia burgdorferi B31
LEYTNLFYVPSKAPYD

SEQ ID NO: 81128 - protein, 16 aa, Borrelia burgdorferi B31
EYTNLFYVPSKAPYDL

SEQ ID NO: 81129 - protein, 16 aa, Borrelia burgdorferi B31
YTNLFYVPSKAPYDLY

SEQ ID NO: 81130 - protein, 16 aa, Borrelia burgdorferi B31
TNLFYVPSKAPYDLYY

SEQ ID NO: 81131 - protein, 16 aa, Borrelia burgdorferi B31
NLFYVPSKAPYDLYYP

SEQ ID NO: 81132 - protein, 16 aa, Borrelia burgdorferi B31
LFYVPSKAPYDLYYPN

SEQ ID NO: 81133 - protein, 16 aa, Borrelia burgdorferi B31
FYVPSKAPYDLYYPNT

SEQ ID NO: 81134 - protein, 16 aa, Borrelia burgdorferi B31
YVPSKAPYDLYYPNTK

SEQ ID NO: 81135 - protein, 16 aa, Borrelia burgdorferi B31
VPSKAPYDLYYPNTKP

SEQ ID NO: 81136 - protein, 16 aa, Borrelia burgdorferi B31
PSKAPYDLYYPNTKPG

SEQ ID NO: 81137 - protein, 16 aa, Borrelia burgdorferi B31
SKAPYDLYYPNTKPGV

SEQ ID NO: 81138 - protein, 16 aa, Borrelia burgdorferi B31
KAPYDLYYPNTKPGVK

SEQ ID NO: 81139 - protein, 16 aa, Borrelia burgdorferi B31
APYDLYYPNTKPGVKL

SEQ ID NO: 81140 - protein, 16 aa, Borrelia burgdorferi B31
PYDLYYPNTKPGVKLF

SEQ ID NO: 81141 - protein, 16 aa, Borrelia burgdorferi B31
YDLYYPNTKPGVKLFI

SEQ ID NO: 81142 - protein, 16 aa, Borrelia burgdorferi B31
DLYYPNTKPGVKLFIN

SEQ ID NO: 81143 - protein, 16 aa, Borrelia burgdorferi B31
LYYPNTKPGVKLFINR

SEQ ID NO: 81144 - protein, 16 aa, Borrelia burgdorferi B31
YYPNTKPGVKLFINRI

SEQ ID NO: 81145 - protein, 16 aa, Borrelia burgdorferi B31
YPNTKPGVKLFINRIF

SEQ ID NO: 81146 - protein, 16 aa, Borrelia burgdorferi B31
PNTKPGVKLFINRIFI

SEQ ID NO: 81147 - protein, 16 aa, Borrelia burgdorferi B31
NTKPGVKLFINRIFIT

SEQ ID NO: 81148 - protein, 16 aa, Borrelia burgdorferi B31
TKPGVKLFINRIFITD

SEQ ID NO: 81149 - protein, 16 aa, Borrelia burgdorferi B31
KPGVKLFINRIFITDS

SEQ ID NO: 81150 - protein, 16 aa, Borrelia burgdorferi B31
PGVKLFINRIFITDSE

SEQ ID NO: 81151 - protein, 16 aa, Borrelia burgdorferi B31
GVKLFINRIFITDSEG

SEQ ID NO: 81152 - protein, 16 aa, Borrelia burgdorferi B31
VKLFINRIFITDSEGS

SEQ ID NO: 81153 - protein, 16 aa, Borrelia burgdorferi B31
KLFINRIFITDSEGSL

SEQ ID NO: 81154 - protein, 16 aa, Borrelia burgdorferi B31
LFINRIFITDSEGSLL

SEQ ID NO: 81155 - protein, 16 aa, Borrelia burgdorferi B31
FINRIFITDSEGSLLP

SEQ ID NO: 81156 - protein, 16 aa, Borrelia burgdorferi B31
INRIFITDSEGSLLPN

SEQ ID NO: 81157 - protein, 16 aa, Borrelia burgdorferi B31
NRIFITDSEGSLLPNY

SEQ ID NO: 81158 - protein, 16 aa, Borrelia burgdorferi B31
RIFITDSEGSLLPNYL

SEQ ID NO: 81159 - protein, 16 aa, Borrelia burgdorferi B31
IFITDSEGSLLPNYLR

SEQ ID NO: 81160 - protein, 16 aa, Borrelia burgdorferi B31
FITDSEGSLLPNYLRF

SEQ ID NO: 81161 - protein, 16 aa, Borrelia burgdorferi B31
ITDSEGSLLPNYLRFI

SEQ ID NO: 81162 - protein, 16 aa, Borrelia burgdorferi B31
TDSEGSLLPNYLRFIK

SEQ ID NO: 81163 - protein, 16 aa, Borrelia burgdorferi B31
DSEGSLLPNYLRFIKG

SEQ ID NO: 81164 - protein, 16 aa, Borrelia burgdorferi B31
SEGSLLPNYLRFIKGI

SEQ ID NO: 81165 - protein, 16 aa, Borrelia burgdorferi B31
EGSLLPNYLRFIKGII

SEQ ID NO: 81166 - protein, 16 aa, Borrelia burgdorferi B31
GSLLPNYLRFIKGIID

SEQ ID NO: 81167 - protein, 16 aa, Borrelia burgdorferi B31
SLLPNYLRFIKGIIDC

SEQ ID NO: 81168 - protein, 16 aa, Borrelia burgdorferi B31
LLPNYLRFIKGIIDCQ

SEQ ID NO: 81169 - protein, 16 aa, Borrelia burgdorferi B31
LPNYLRFIKGIIDCQD

SEQ ID NO: 81170 - protein, 16 aa, Borrelia burgdorferi B31
PNYLRFIKGIIDCQDL

SEQ ID NO: 81171 - protein, 16 aa, Borrelia burgdorferi B31
NYLRFIKGIIDCQDLP

SEQ ID NO: 81172 - protein, 16 aa, Borrelia burgdorferi B31
YLRFIKGIIDCQDLPL

SEQ ID NO: 81173 - protein, 16 aa, Borrelia burgdorferi B31
LRFIKGIIDCQDLPLN

SEQ ID NO: 81174 - protein, 16 aa, Borrelia burgdorferi B31
RFIKGIIDCQDLPLNV

SEQ ID NO: 81175 - protein, 16 aa, Borrelia burgdorferi B31
FIKGIIDCQDLPLNVS

SEQ ID NO: 81176 - protein, 16 aa, Borrelia burgdorferi B31
IKGIIDCQDLPLNVSR

SEQ ID NO: 81177 - protein, 16 aa, Borrelia burgdorferi B31
KGIIDCQDLPLNVSRE

SEQ ID NO: 81178 - protein, 16 aa, Borrelia burgdorferi B31
GIIDCQDLPLNVSREI

SEQ ID NO: 81179 - protein, 16 aa, Borrelia burgdorferi B31
IIDCQDLPLNVSREIL

SEQ ID NO: 81180 - protein, 16 aa, Borrelia burgdorferi B31
IDCQDLPLNVSREILQ

SEQ ID NO: 81181 - protein, 16 aa, Borrelia burgdorferi B31
DCQDLPLNVSREILQQ

SEQ ID NO: 81182 - protein, 16 aa, Borrelia burgdorferi B31
CQDLPLNVSREILQQN

SEQ ID NO: 81183 - protein, 16 aa, Borrelia burgdorferi B31
QDLPLNVSREILQQNK

SEQ ID NO: 81184 - protein, 16 aa, Borrelia burgdorferi B31
DLPLNVSREILQQNKI

SEQ ID NO: 81185 - protein, 16 aa, Borrelia burgdorferi B31
LPLNVSREILQQNKIL

SEQ ID NO: 81186 - protein, 16 aa, Borrelia burgdorferi B31
PLNVSREILQQNKILS

SEQ ID NO: 81187 - protein, 16 aa, Borrelia burgdorferi B31
LNVSREILQQNKILSK

SEQ ID NO: 81188 - protein, 16 aa, Borrelia burgdorferi B31
NVSREILQQNKILSKI

SEQ ID NO: 81189 - protein, 16 aa, Borrelia burgdorferi B31
VSREILQQNKILSKIK

SEQ ID NO: 81190 - protein, 16 aa, Borrelia burgdorferi B31
SREILQQNKILSKIKS

SEQ ID NO: 81191 - protein, 16 aa, Borrelia burgdorferi B31
REILQQNKILSKIKSS

SEQ ID NO: 81192 - protein, 16 aa, Borrelia burgdorferi B31
EILQQNKILSKIKSSS

SEQ ID NO: 81193 - protein, 16 aa, Borrelia burgdorferi B31
ILQQNKILSKIKSSSV

SEQ ID NO: 81194 - protein, 16 aa, Borrelia burgdorferi B31
LQQNKILSKIKSSSVK

SEQ ID NO: 81195 - protein, 16 aa, Borrelia burgdorferi B31
QQNKILSKIKSSSVKK

SEQ ID NO: 81196 - protein, 16 aa, Borrelia burgdorferi B31
QNKILSKIKSSSVKKI

SEQ ID NO: 81197 - protein, 16 aa, Borrelia burgdorferi B31
NKILSKIKSSSVKKIL

SEQ ID NO: 81198 - protein, 16 aa, Borrelia burgdorferi B31
KILSKIKSSSVKKILS

SEQ ID NO: 81199 - protein, 16 aa, Borrelia burgdorferi B31
ILSKIKSSSVKKILSE

SEQ ID NO: 81200 - protein, 16 aa, Borrelia burgdorferi B31
LSKIKSSSVKKILSEL

SEQ ID NO: 81201 - protein, 16 aa, Borrelia burgdorferi B31
SKIKSSSVKKILSELE

SEQ ID NO: 81202 - protein, 16 aa, Borrelia burgdorferi B31
KIKSSSVKKILSELEK

SEQ ID NO: 81203 - protein, 16 aa, Borrelia burgdorferi B31
IKSSSVKKILSELEKL

SEQ ID NO: 81204 - protein, 16 aa, Borrelia burgdorferi B31
KSSSVKKILSELEKLS

SEQ ID NO: 81205 - protein, 16 aa, Borrelia burgdorferi B31
SSSVKKILSELEKLSK

SEQ ID NO: 81206 - protein, 16 aa, Borrelia burgdorferi B31
SSVKKILSELEKLSKK

SEQ ID NO: 81207 - protein, 16 aa, Borrelia burgdorferi B31
SVKKILSELEKLSKKN

SEQ ID NO: 81208 - protein, 16 aa, Borrelia burgdorferi B31
VKKILSELEKLSKKNP

SEQ ID NO: 81209 - protein, 16 aa, Borrelia burgdorferi B31
KKILSELEKLSKKNPE

SEQ ID NO: 81210 - protein, 16 aa, Borrelia burgdorferi B31
KILSELEKLSKKNPEK

SEQ ID NO: 81211 - protein, 16 aa, Borrelia burgdorferi B31
ILSELEKLSKKNPEKF

SEQ ID NO: 81212 - protein, 16 aa, Borrelia burgdorferi B31
LSELEKLSKKNPEKFS

SEQ ID NO: 81213 - protein, 16 aa, Borrelia burgdorferi B31
SELEKLSKKNPEKFSE

SEQ ID NO: 81214 - protein, 16 aa, Borrelia burgdorferi B31
ELEKLSKKNPEKFSEF

SEQ ID NO: 81215 - protein, 16 aa, Borrelia burgdorferi B31
LEKLSKKNPEKFSEFS

SEQ ID NO: 81216 - protein, 16 aa, Borrelia burgdorferi B31
EKLSKKNPEKFSEFSK

SEQ ID NO: 81217 - protein, 16 aa, Borrelia burgdorferi B31
KLSKKNPEKFSEFSKE

SEQ ID NO: 81218 - protein, 16 aa, Borrelia burgdorferi B31
LSKKNPEKFSEFSKEF

SEQ ID NO: 81219 - protein, 16 aa, Borrelia burgdorferi B31
SKKNPEKFSEFSKEFG

SEQ ID NO: 81220 - protein, 16 aa, Borrelia burgdorferi B31
KKNPEKFSEFSKEFGR

SEQ ID NO: 81221 - protein, 16 aa, Borrelia burgdorferi B31
KNPEKFSEFSKEFGRC

SEQ ID NO: 81222 - protein, 16 aa, Borrelia burgdorferi B31
NPEKFSEFSKEFGRCI

SEQ ID NO: 81223 - protein, 16 aa, Borrelia burgdorferi B31
PEKFSEFSKEFGRCIK

SEQ ID NO: 81224 - protein, 16 aa, Borrelia burgdorferi B31
EKFSEFSKEFGRCIKE

SEQ ID NO: 81225 - protein, 16 aa, Borrelia burgdorferi B31
KFSEFSKEFGRCIKEG

SEQ ID NO: 81226 - protein, 16 aa, Borrelia burgdorferi B31
FSEFSKEFGRCIKEGV

SEQ ID NO: 81227 - protein, 16 aa, Borrelia burgdorferi B31
SEFSKEFGRCIKEGVY

SEQ ID NO: 81228 - protein, 16 aa, Borrelia burgdorferi B31
EFSKEFGRCIKEGVYS

SEQ ID NO: 81229 - protein, 16 aa, Borrelia burgdorferi B31
FSKEFGRCIKEGVYSD

SEQ ID NO: 81230 - protein, 16 aa, Borrelia burgdorferi B31
SKEFGRCIKEGVYSDF

SEQ ID NO: 81231 - protein, 16 aa, Borrelia burgdorferi B31
KEFGRCIKEGVYSDFE

SEQ ID NO: 81232 - protein, 16 aa, Borrelia burgdorferi B31
EFGRCIKEGVYSDFEN

SEQ ID NO: 81233 - protein, 16 aa, Borrelia burgdorferi B31
FGRCIKEGVYSDFENR

SEQ ID NO: 81234 - protein, 16 aa, Borrelia burgdorferi B31
GRCIKEGVYSDFENRE

SEQ ID NO: 81235 - protein, 16 aa, Borrelia burgdorferi B31
RCIKEGVYSDFENREK

SEQ ID NO: 81236 - protein, 16 aa, Borrelia burgdorferi B31
CIKEGVYSDFENREKL

SEQ ID NO: 81237 - protein, 16 aa, Borrelia burgdorferi B31
IKEGVYSDFENREKLI

SEQ ID NO: 81238 - protein, 16 aa, Borrelia burgdorferi B31
KEGVYSDFENREKLIS

SEQ ID NO: 81239 - protein, 16 aa, Borrelia burgdorferi B31
EGVYSDFENREKLISL

SEQ ID NO: 81240 - protein, 16 aa, Borrelia burgdorferi B31
GVYSDFENREKLISLI

SEQ ID NO: 81241 - protein, 16 aa, Borrelia burgdorferi B31
VYSDFENREKLISLIR

SEQ ID NO: 81242 - protein, 16 aa, Borrelia burgdorferi B31
YSDFENREKLISLIRF

SEQ ID NO: 81243 - protein, 16 aa, Borrelia burgdorferi B31
SDFENREKLISLIRFK

SEQ ID NO: 81244 - protein, 16 aa, Borrelia burgdorferi B31
DFENREKLISLIRFKS

SEQ ID NO: 81245 - protein, 16 aa, Borrelia burgdorferi B31
FENREKLISLIRFKSS

SEQ ID NO: 81246 - protein, 16 aa, Borrelia burgdorferi B31
ENREKLISLIRFKSSS

SEQ ID NO: 81247 - protein, 16 aa, Borrelia burgdorferi B31
NREKLISLIRFKSSSV

SEQ ID NO: 81248 - protein, 16 aa, Borrelia burgdorferi B31
REKLISLIRFKSSSVD

SEQ ID NO: 81249 - protein, 16 aa, Borrelia burgdorferi B31
EKLISLIRFKSSSVDG

SEQ ID NO: 81250 - protein, 16 aa, Borrelia burgdorferi B31
KLISLIRFKSSSVDGF

SEQ ID NO: 81251 - protein, 16 aa, Borrelia burgdorferi B31
LISLIRFKSSSVDGFV

SEQ ID NO: 81252 - protein, 16 aa, Borrelia burgdorferi B31
ISLIRFKSSSVDGFVS

SEQ ID NO: 81253 - protein, 16 aa, Borrelia burgdorferi B31
SLIRFKSSSVDGFVSF

SEQ ID NO: 81254 - protein, 16 aa, Borrelia burgdorferi B31
LIRFKSSSVDGFVSFK

SEQ ID NO: 81255 - protein, 16 aa, Borrelia burgdorferi B31
IRFKSSSVDGFVSFKE

SEQ ID NO: 81256 - protein, 16 aa, Borrelia burgdorferi B31
RFKSSSVDGFVSFKEY

SEQ ID NO: 81257 - protein, 16 aa, Borrelia burgdorferi B31
FKSSSVDGFVSFKEYK

SEQ ID NO: 81258 - protein, 16 aa, Borrelia burgdorferi B31
KSSSVDGFVSFKEYKE

SEQ ID NO: 81259 - protein, 16 aa, Borrelia burgdorferi B31
SSSVDGFVSFKEYKER

SEQ ID NO: 81260 - protein, 16 aa, Borrelia burgdorferi B31
SSVDGFVSFKEYKERM

SEQ ID NO: 81261 - protein, 16 aa, Borrelia burgdorferi B31
SVDGFVSFKEYKERMN

SEQ ID NO: 81262 - protein, 16 aa, Borrelia burgdorferi B31
VDGFVSFKEYKERMNE

SEQ ID NO: 81263 - protein, 16 aa, Borrelia burgdorferi B31
DGFVSFKEYKERMNES

SEQ ID NO: 81264 - protein, 16 aa, Borrelia burgdorferi B31
GFVSFKEYKERMNESQ

SEQ ID NO: 81265 - protein, 16 aa, Borrelia burgdorferi B31
FVSFKEYKERMNESQK

SEQ ID NO: 81266 - protein, 16 aa, Borrelia burgdorferi B31
VSFKEYKERMNESQKS

SEQ ID NO: 81267 - protein, 16 aa, Borrelia burgdorferi B31
SFKEYKERMNESQKSI

SEQ ID NO: 81268 - protein, 16 aa, Borrelia burgdorferi B31
FKEYKERMNESQKSIY

SEQ ID NO: 81269 - protein, 16 aa, Borrelia burgdorferi B31
KEYKERMNESQKSIYY

SEQ ID NO: 81270 - protein, 16 aa, Borrelia burgdorferi B31
EYKERMNESQKSIYYI

SEQ ID NO: 81271 - protein, 16 aa, Borrelia burgdorferi B31
YKERMNESQKSIYYIT

SEQ ID NO: 81272 - protein, 16 aa, Borrelia burgdorferi B31
KERMNESQKSIYYITG

SEQ ID NO: 81273 - protein, 16 aa, Borrelia burgdorferi B31
ERMNESQKSIYYITGG

SEQ ID NO: 81274 - protein, 16 aa, Borrelia burgdorferi B31
RMNESQKSIYYITGGK

SEQ ID NO: 81275 - protein, 16 aa, Borrelia burgdorferi B31
MNESQKSIYYITGGKE

SEQ ID NO: 81276 - protein, 16 aa, Borrelia burgdorferi B31
NESQKSIYYITGGKEN

SEQ ID NO: 81277 - protein, 16 aa, Borrelia burgdorferi B31
ESQKSIYYITGGKENI

SEQ ID NO: 81278 - protein, 16 aa, Borrelia burgdorferi B31
SQKSIYYITGGKENIL

SEQ ID NO: 81279 - protein, 16 aa, Borrelia burgdorferi B31
QKSIYYITGGKENILK

SEQ ID NO: 81280 - protein, 16 aa, Borrelia burgdorferi B31
KSIYYITGGKENILKE

SEQ ID NO: 81281 - protein, 16 aa, Borrelia burgdorferi B31
SIYYITGGKENILKEN

SEQ ID NO: 81282 - protein, 16 aa, Borrelia burgdorferi B31
IYYITGGKENILKENP

SEQ ID NO: 81283 - protein, 16 aa, Borrelia burgdorferi B31
YYITGGKENILKENPI

SEQ ID NO: 81284 - protein, 16 aa, Borrelia burgdorferi B31
YITGGKENILKENPIV

SEQ ID NO: 81285 - protein, 16 aa, Borrelia burgdorferi B31
ITGGKENILKENPIVA

SEQ ID NO: 81286 - protein, 16 aa, Borrelia burgdorferi B31
TGGKENILKENPIVAA

SEQ ID NO: 81287 - protein, 16 aa, Borrelia burgdorferi B31
GGKENILKENPIVAAY

SEQ ID NO: 81288 - protein, 16 aa, Borrelia burgdorferi B31
GKENILKENPIVAAYK

SEQ ID NO: 81289 - protein, 16 aa, Borrelia burgdorferi B31
KENILKENPIVAAYKE

SEQ ID NO: 81290 - protein, 16 aa, Borrelia burgdorferi B31
ENILKENPIVAAYKEK

SEQ ID NO: 81291 - protein, 16 aa, Borrelia burgdorferi B31
NILKENPIVAAYKEKG

SEQ ID NO: 81292 - protein, 16 aa, Borrelia burgdorferi B31
ILKENPIVAAYKEKGF

SEQ ID NO: 81293 - protein, 16 aa, Borrelia burgdorferi B31
LKENPIVAAYKEKGFE

SEQ ID NO: 81294 - protein, 16 aa, Borrelia burgdorferi B31
KENPIVAAYKEKGFEI

SEQ ID NO: 81295 - protein, 16 aa, Borrelia burgdorferi B31
ENPIVAAYKEKGFEIL

SEQ ID NO: 81296 - protein, 16 aa, Borrelia burgdorferi B31
NPIVAAYKEKGFEILI

SEQ ID NO: 81297 - protein, 16 aa, Borrelia burgdorferi B31
PIVAAYKEKGFEILIM

SEQ ID NO: 81298 - protein, 16 aa, Borrelia burgdorferi B31
IVAAYKEKGFEILIMD

SEQ ID NO: 81299 - protein, 16 aa, Borrelia burgdorferi B31
VAAYKEKGFEILIMDD

SEQ ID NO: 81300 - protein, 16 aa, Borrelia burgdorferi B31
AAYKEKGFEILIMDDE

SEQ ID NO: 81301 - protein, 16 aa, Borrelia burgdorferi B31
AYKEKGFEILIMDDEL

SEQ ID NO: 81302 - protein, 16 aa, Borrelia burgdorferi B31
YKEKGFEILIMDDELD

SEQ ID NO: 81303 - protein, 16 aa, Borrelia burgdorferi B31
KEKGFEILIMDDELDE

SEQ ID NO: 81304 - protein, 16 aa, Borrelia burgdorferi B31
EKGFEILIMDDELDEA

SEQ ID NO: 81305 - protein, 16 aa, Borrelia burgdorferi B31
KGFEILIMDDELDEAI

SEQ ID NO: 81306 - protein, 16 aa, Borrelia burgdorferi B31
GFEILIMDDELDEAIL

SEQ ID NO: 81307 - protein, 16 aa, Borrelia burgdorferi B31
FEILIMDDELDEAILN

SEQ ID NO: 81308 - protein, 16 aa, Borrelia burgdorferi B31
EILIMDDELDEAILNL

SEQ ID NO: 81309 - protein, 16 aa, Borrelia burgdorferi B31
ILIMDDELDEAILNLI

SEQ ID NO: 81310 - protein, 16 aa, Borrelia burgdorferi B31
LIMDDELDEAILNLIP

SEQ ID NO: 81311 - protein, 16 aa, Borrelia burgdorferi B31
IMDDELDEAILNLIPE

SEQ ID NO: 81312 - protein, 16 aa, Borrelia burgdorferi B31
MDDELDEAILNLIPEY

SEQ ID NO: 81313 - protein, 16 aa, Borrelia burgdorferi B31
DDELDEAILNLIPEYE

SEQ ID NO: 81314 - protein, 16 aa, Borrelia burgdorferi B31
DELDEAILNLIPEYEG

SEQ ID NO: 81315 - protein, 16 aa, Borrelia burgdorferi B31
ELDEAILNLIPEYEGL

SEQ ID NO: 81316 - protein, 16 aa, Borrelia burgdorferi B31
LDEAILNLIPEYEGLK

SEQ ID NO: 81317 - protein, 16 aa, Borrelia burgdorferi B31
DEAILNLIPEYEGLKL

SEQ ID NO: 81318 - protein, 16 aa, Borrelia burgdorferi B31
EAILNLIPEYEGLKLK

SEQ ID NO: 81319 - protein, 16 aa, Borrelia burgdorferi B31
AILNLIPEYEGLKLKA

SEQ ID NO: 81320 - protein, 16 aa, Borrelia burgdorferi B31
ILNLIPEYEGLKLKAI

SEQ ID NO: 81321 - protein, 16 aa, Borrelia burgdorferi B31
LNLIPEYEGLKLKAIN

SEQ ID NO: 81322 - protein, 16 aa, Borrelia burgdorferi B31
NLIPEYEGLKLKAINK

SEQ ID NO: 81323 - protein, 16 aa, Borrelia burgdorferi B31
LIPEYEGLKLKAINKN

SEQ ID NO: 81324 - protein, 16 aa, Borrelia burgdorferi B31
IPEYEGLKLKAINKNE

SEQ ID NO: 81325 - protein, 16 aa, Borrelia burgdorferi B31
PEYEGLKLKAINKNET

SEQ ID NO: 81326 - protein, 16 aa, Borrelia burgdorferi B31
EYEGLKLKAINKNETS

SEQ ID NO: 81327 - protein, 16 aa, Borrelia burgdorferi B31
YEGLKLKAINKNETSN

SEQ ID NO: 81328 - protein, 16 aa, Borrelia burgdorferi B31
EGLKLKAINKNETSNE

SEQ ID NO: 81329 - protein, 16 aa, Borrelia burgdorferi B31
GLKLKAINKNETSNEL

SEQ ID NO: 81330 - protein, 16 aa, Borrelia burgdorferi B31
LKLKAINKNETSNELK

SEQ ID NO: 81331 - protein, 16 aa, Borrelia burgdorferi B31
KLKAINKNETSNELKD

SEQ ID NO: 81332 - protein, 16 aa, Borrelia burgdorferi B31
LKAINKNETSNELKDE

SEQ ID NO: 81333 - protein, 16 aa, Borrelia burgdorferi B31
KAINKNETSNELKDEN

SEQ ID NO: 81334 - protein, 16 aa, Borrelia burgdorferi B31
AINKNETSNELKDENF

SEQ ID NO: 81335 - protein, 16 aa, Borrelia burgdorferi B31
INKNETSNELKDENFK

SEQ ID NO: 81336 - protein, 16 aa, Borrelia burgdorferi B31
NKNETSNELKDENFKK

SEQ ID NO: 81337 - protein, 16 aa, Borrelia burgdorferi B31
KNETSNELKDENFKKI

SEQ ID NO: 81338 - protein, 16 aa, Borrelia burgdorferi B31
NETSNELKDENFKKIE

SEQ ID NO: 81339 - protein, 16 aa, Borrelia burgdorferi B31
ETSNELKDENFKKIEE

SEQ ID NO: 81340 - protein, 16 aa, Borrelia burgdorferi B31
TSNELKDENFKKIEEE

SEQ ID NO: 81341 - protein, 16 aa, Borrelia burgdorferi B31
SNELKDENFKKIEEEF

SEQ ID NO: 81342 - protein, 16 aa, Borrelia burgdorferi B31
NELKDENFKKIEEEFK

SEQ ID NO: 81343 - protein, 16 aa, Borrelia burgdorferi B31
ELKDENFKKIEEEFKD

SEQ ID NO: 81344 - protein, 16 aa, Borrelia burgdorferi B31
LKDENFKKIEEEFKDT

SEQ ID NO: 81345 - protein, 16 aa, Borrelia burgdorferi B31
KDENFKKIEEEFKDTL

SEQ ID NO: 81346 - protein, 16 aa, Borrelia burgdorferi B31
DENFKKIEEEFKDTLT

SEQ ID NO: 81347 - protein, 16 aa, Borrelia burgdorferi B31
ENFKKIEEEFKDTLTK

SEQ ID NO: 81348 - protein, 16 aa, Borrelia burgdorferi B31
NFKKIEEEFKDTLTKV

SEQ ID NO: 81349 - protein, 16 aa, Borrelia burgdorferi B31
FKKIEEEFKDTLTKVK

SEQ ID NO: 81350 - protein, 16 aa, Borrelia burgdorferi B31
KKIEEEFKDTLTKVKE

SEQ ID NO: 81351 - protein, 16 aa, Borrelia burgdorferi B31
KIEEEFKDTLTKVKEI

SEQ ID NO: 81352 - protein, 16 aa, Borrelia burgdorferi B31
IEEEFKDTLTKVKEIL

SEQ ID NO: 81353 - protein, 16 aa, Borrelia burgdorferi B31
EEEFKDTLTKVKEILK

SEQ ID NO: 81354 - protein, 16 aa, Borrelia burgdorferi B31
EEFKDTLTKVKEILKD

SEQ ID NO: 81355 - protein, 16 aa, Borrelia burgdorferi B31
EFKDTLTKVKEILKDH

SEQ ID NO: 81356 - protein, 16 aa, Borrelia burgdorferi B31
FKDTLTKVKEILKDHI

SEQ ID NO: 81357 - protein, 16 aa, Borrelia burgdorferi B31
KDTLTKVKEILKDHIK

SEQ ID NO: 81358 - protein, 16 aa, Borrelia burgdorferi B31
DTLTKVKEILKDHIKE

SEQ ID NO: 81359 - protein, 16 aa, Borrelia burgdorferi B31
TLTKVKEILKDHIKEV

SEQ ID NO: 81360 - protein, 16 aa, Borrelia burgdorferi B31
LTKVKEILKDHIKEVN

SEQ ID NO: 81361 - protein, 16 aa, Borrelia burgdorferi B31
TKVKEILKDHIKEVNL

SEQ ID NO: 81362 - protein, 16 aa, Borrelia burgdorferi B31
KVKEILKDHIKEVNLS

SEQ ID NO: 81363 - protein, 16 aa, Borrelia burgdorferi B31
VKEILKDHIKEVNLSA

SEQ ID NO: 81364 - protein, 16 aa, Borrelia burgdorferi B31
KEILKDHIKEVNLSAT

SEQ ID NO: 81365 - protein, 16 aa, Borrelia burgdorferi B31
EILKDHIKEVNLSATL

SEQ ID NO: 81366 - protein, 16 aa, Borrelia burgdorferi B31
ILKDHIKEVNLSATLI

SEQ ID NO: 81367 - protein, 16 aa, Borrelia burgdorferi B31
LKDHIKEVNLSATLIK

SEQ ID NO: 81368 - protein, 16 aa, Borrelia burgdorferi B31
KDHIKEVNLSATLIKE

SEQ ID NO: 81369 - protein, 16 aa, Borrelia burgdorferi B31
DHIKEVNLSATLIKEP

SEQ ID NO: 81370 - protein, 16 aa, Borrelia burgdorferi B31
HIKEVNLSATLIKEPS

SEQ ID NO: 81371 - protein, 16 aa, Borrelia burgdorferi B31
IKEVNLSATLIKEPSA

SEQ ID NO: 81372 - protein, 16 aa, Borrelia burgdorferi B31
KEVNLSATLIKEPSAI

SEQ ID NO: 81373 - protein, 16 aa, Borrelia burgdorferi B31
EVNLSATLIKEPSAII

SEQ ID NO: 81374 - protein, 16 aa, Borrelia burgdorferi B31
VNLSATLIKEPSAIII

SEQ ID NO: 81375 - protein, 16 aa, Borrelia burgdorferi B31
NLSATLIKEPSAIIID

SEQ ID NO: 81376 - protein, 16 aa, Borrelia burgdorferi B31
LSATLIKEPSAIIIDS

SEQ ID NO: 81377 - protein, 16 aa, Borrelia burgdorferi B31
SATLIKEPSAIIIDSN

SEQ ID NO: 81378 - protein, 16 aa, Borrelia burgdorferi B31
ATLIKEPSAIIIDSND

SEQ ID NO: 81379 - protein, 16 aa, Borrelia burgdorferi B31
TLIKEPSAIIIDSNDP

SEQ ID NO: 81380 - protein, 16 aa, Borrelia burgdorferi B31
LIKEPSAIIIDSNDPT

SEQ ID NO: 81381 - protein, 16 aa, Borrelia burgdorferi B31
IKEPSAIIIDSNDPTY

SEQ ID NO: 81382 - protein, 16 aa, Borrelia burgdorferi B31
KEPSAIIIDSNDPTYQ

SEQ ID NO: 81383 - protein, 16 aa, Borrelia burgdorferi B31
EPSAIIIDSNDPTYQM

SEQ ID NO: 81384 - protein, 16 aa, Borrelia burgdorferi B31
PSAIIIDSNDPTYQMQ

SEQ ID NO: 81385 - protein, 16 aa, Borrelia burgdorferi B31
SAIIIDSNDPTYQMQK

SEQ ID NO: 81386 - protein, 16 aa, Borrelia burgdorferi B31
AIIIDSNDPTYQMQKI

SEQ ID NO: 81387 - protein, 16 aa, Borrelia burgdorferi B31
IIIDSNDPTYQMQKIM

SEQ ID NO: 81388 - protein, 16 aa, Borrelia burgdorferi B31
IIDSNDPTYQMQKIML

SEQ ID NO: 81389 - protein, 16 aa, Borrelia burgdorferi B31
IDSNDPTYQMQKIMLS

SEQ ID NO: 81390 - protein, 16 aa, Borrelia burgdorferi B31
DSNDPTYQMQKIMLSM

SEQ ID NO: 81391 - protein, 16 aa, Borrelia burgdorferi B31
SNDPTYQMQKIMLSMG

SEQ ID NO: 81392 - protein, 16 aa, Borrelia burgdorferi B31
NDPTYQMQKIMLSMGQ

SEQ ID NO: 81393 - protein, 16 aa, Borrelia burgdorferi B31
DPTYQMQKIMLSMGQE

SEQ ID NO: 81394 - protein, 16 aa, Borrelia burgdorferi B31
PTYQMQKIMLSMGQEV

SEQ ID NO: 81395 - protein, 16 aa, Borrelia burgdorferi B31
TYQMQKIMLSMGQEVK

SEQ ID NO: 81396 - protein, 16 aa, Borrelia burgdorferi B31
YQMQKIMLSMGQEVKE

SEQ ID NO: 81397 - protein, 16 aa, Borrelia burgdorferi B31
QMQKIMLSMGQEVKEI

SEQ ID NO: 81398 - protein, 16 aa, Borrelia burgdorferi B31
MQKIMLSMGQEVKEIK

SEQ ID NO: 81399 - protein, 16 aa, Borrelia burgdorferi B31
QKIMLSMGQEVKEIKP

SEQ ID NO: 81400 - protein, 16 aa, Borrelia burgdorferi B31
KIMLSMGQEVKEIKPI

SEQ ID NO: 81401 - protein, 16 aa, Borrelia burgdorferi B31
IMLSMGQEVKEIKPIL

SEQ ID NO: 81402 - protein, 16 aa, Borrelia burgdorferi B31
MLSMGQEVKEIKPILE

SEQ ID NO: 81403 - protein, 16 aa, Borrelia burgdorferi B31
LSMGQEVKEIKPILEL

SEQ ID NO: 81404 - protein, 16 aa, Borrelia burgdorferi B31
SMGQEVKEIKPILELN

SEQ ID NO: 81405 - protein, 16 aa, Borrelia burgdorferi B31
MGQEVKEIKPILELNP

SEQ ID NO: 81406 - protein, 16 aa, Borrelia burgdorferi B31
GQEVKEIKPILELNPN

SEQ ID NO: 81407 - protein, 16 aa, Borrelia burgdorferi B31
QEVKEIKPILELNPNN

SEQ ID NO: 81408 - protein, 16 aa, Borrelia burgdorferi B31
EVKEIKPILELNPNNK

SEQ ID NO: 81409 - protein, 16 aa, Borrelia burgdorferi B31
VKEIKPILELNPNNKI

SEQ ID NO: 81410 - protein, 16 aa, Borrelia burgdorferi B31
KEIKPILELNPNNKIV

SEQ ID NO: 81411 - protein, 16 aa, Borrelia burgdorferi B31
EIKPILELNPNNKIVQ

SEQ ID NO: 81412 - protein, 16 aa, Borrelia burgdorferi B31
IKPILELNPNNKIVQN

SEQ ID NO: 81413 - protein, 16 aa, Borrelia burgdorferi B31
KPILELNPNNKIVQNL

SEQ ID NO: 81414 - protein, 16 aa, Borrelia burgdorferi B31
PILELNPNNKIVQNLK

SEQ ID NO: 81415 - protein, 16 aa, Borrelia burgdorferi B31
ILELNPNNKIVQNLKN

SEQ ID NO: 81416 - protein, 16 aa, Borrelia burgdorferi B31
LELNPNNKIVQNLKNL

SEQ ID NO: 81417 - protein, 16 aa, Borrelia burgdorferi B31
ELNPNNKIVQNLKNLE

SEQ ID NO: 81418 - protein, 16 aa, Borrelia burgdorferi B31
LNPNNKIVQNLKNLEP

SEQ ID NO: 81419 - protein, 16 aa, Borrelia burgdorferi B31
NPNNKIVQNLKNLEPE

SEQ ID NO: 81420 - protein, 16 aa, Borrelia burgdorferi B31
PNNKIVQNLKNLEPEK

SEQ ID NO: 81421 - protein, 16 aa, Borrelia burgdorferi B31
NNKIVQNLKNLEPEKL

SEQ ID NO: 81422 - protein, 16 aa, Borrelia burgdorferi B31
NKIVQNLKNLEPEKLE

SEQ ID NO: 81423 - protein, 16 aa, Borrelia burgdorferi B31
KIVQNLKNLEPEKLEK

SEQ ID NO: 81424 - protein, 16 aa, Borrelia burgdorferi B31
IVQNLKNLEPEKLEKI

SEQ ID NO: 81425 - protein, 16 aa, Borrelia burgdorferi B31
VQNLKNLEPEKLEKIS

SEQ ID NO: 81426 - protein, 16 aa, Borrelia burgdorferi B31
QNLKNLEPEKLEKISI

SEQ ID NO: 81427 - protein, 16 aa, Borrelia burgdorferi B31
NLKNLEPEKLEKISIL

SEQ ID NO: 81428 - protein, 16 aa, Borrelia burgdorferi B31
LKNLEPEKLEKISILL

SEQ ID NO: 81429 - protein, 16 aa, Borrelia burgdorferi B31
KNLEPEKLEKISILLF

SEQ ID NO: 81430 - protein, 16 aa, Borrelia burgdorferi B31
NLEPEKLEKISILLFE

SEQ ID NO: 81431 - protein, 16 aa, Borrelia burgdorferi B31
LEPEKLEKISILLFEE

SEQ ID NO: 81432 - protein, 16 aa, Borrelia burgdorferi B31
EPEKLEKISILLFEEA

SEQ ID NO: 81433 - protein, 16 aa, Borrelia burgdorferi B31
PEKLEKISILLFEEAM

SEQ ID NO: 81434 - protein, 16 aa, Borrelia burgdorferi B31
EKLEKISILLFEEAML

SEQ ID NO: 81435 - protein, 16 aa, Borrelia burgdorferi B31
KLEKISILLFEEAMLT

SEQ ID NO: 81436 - protein, 16 aa, Borrelia burgdorferi B31
LEKISILLFEEAMLTS

SEQ ID NO: 81437 - protein, 16 aa, Borrelia burgdorferi B31
EKISILLFEEAMLTSG

SEQ ID NO: 81438 - protein, 16 aa, Borrelia burgdorferi B31
KISILLFEEAMLTSGM

SEQ ID NO: 81439 - protein, 16 aa, Borrelia burgdorferi B31
ISILLFEEAMLTSGMP

SEQ ID NO: 81440 - protein, 16 aa, Borrelia burgdorferi B31
SILLFEEAMLTSGMPS

SEQ ID NO: 81441 - protein, 16 aa, Borrelia burgdorferi B31
ILLFEEAMLTSGMPSK

SEQ ID NO: 81442 - protein, 16 aa, Borrelia burgdorferi B31
LLFEEAMLTSGMPSKN

SEQ ID NO: 81443 - protein, 16 aa, Borrelia burgdorferi B31
LFEEAMLTSGMPSKNP

SEQ ID NO: 81444 - protein, 16 aa, Borrelia burgdorferi B31
FEEAMLTSGMPSKNPG

SEQ ID NO: 81445 - protein, 16 aa, Borrelia burgdorferi B31
EEAMLTSGMPSKNPGK

SEQ ID NO: 81446 - protein, 16 aa, Borrelia burgdorferi B31
EAMLTSGMPSKNPGKF

SEQ ID NO: 81447 - protein, 16 aa, Borrelia burgdorferi B31
AMLTSGMPSKNPGKFI

SEQ ID NO: 81448 - protein, 16 aa, Borrelia burgdorferi B31
MLTSGMPSKNPGKFIN

SEQ ID NO: 81449 - protein, 16 aa, Borrelia burgdorferi B31
LTSGMPSKNPGKFINI

SEQ ID NO: 81450 - protein, 16 aa, Borrelia burgdorferi B31
TSGMPSKNPGKFINII

SEQ ID NO: 81451 - protein, 16 aa, Borrelia burgdorferi B31
SGMPSKNPGKFINIIN

SEQ ID NO: 81452 - protein, 16 aa, Borrelia burgdorferi B31
GMPSKNPGKFINIINE

SEQ ID NO: 81453 - protein, 16 aa, Borrelia burgdorferi B31
MPSKNPGKFINIINEF

SEQ ID NO: 81454 - protein, 16 aa, Borrelia burgdorferi B31
PSKNPGKFINIINEFI

SEQ ID NO: 81455 - protein, 16 aa, Borrelia burgdorferi B31
SKNPGKFINIINEFIE

SEQ ID NO: 81456 - protein, 16 aa, Borrelia burgdorferi B31
KNPGKFINIINEFIEK

SEQ ID NO: 81457 - protein, 16 aa, Borrelia burgdorferi B31
NPGKFINIINEFIEKD

SEQ ID NO: 81458 - protein, 16 aa, Borrelia burgdorferi B31
PGKFINIINEFIEKDF

SEQ ID NO: 81459 - protein, 16 aa, Borrelia burgdorferi B31
GKFINIINEFIEKDFL

SEQ ID NO: 81460 - protein, 13 aa, Borrelia burgdorferi
MKKYLLGIGLILA

SEQ ID NO: 81461 - protein, 13 aa, Borrelia burgdorferi
KKYLLGIGLILAL

SEQ ID NO: 81462 - protein, 13 aa, Borrelia burgdorferi
KYLLGIGLILALI

SEQ ID NO: 81463 - protein, 13 aa, Borrelia burgdorferi
YLLGIGLILALIA

SEQ ID NO: 81464 - protein, 13 aa, Borrelia burgdorferi
LLGIGLILALIAC

SEQ ID NO: 81465 - protein, 13 aa, Borrelia burgdorferi
LGIGLILALIACK

SEQ ID NO: 81466 - protein, 13 aa, Borrelia burgdorferi
GIGLILALIACKQ

SEQ ID NO: 81467 - protein, 13 aa, Borrelia burgdorferi
IGLILALIACKQN

SEQ ID NO: 81468 - protein, 13 aa, Borrelia burgdorferi
GLILALIACKQNV

SEQ ID NO: 81469 - protein, 13 aa, Borrelia burgdorferi
LILALIACKQNVS

SEQ ID NO: 81470 - protein, 13 aa, Borrelia burgdorferi
ILALIACKQNVST

SEQ ID NO: 81471 - protein, 13 aa, Borrelia burgdorferi
LALIACKQNVSTL

SEQ ID NO: 81472 - protein, 13 aa, Borrelia burgdorferi
ALIACKQNVSTLD

SEQ ID NO: 81473 - protein, 13 aa, Borrelia burgdorferi
LIACKQNVSTLDE

SEQ ID NO: 81474 - protein, 13 aa, Borrelia burgdorferi
IACKQNVSTLDEK

SEQ ID NO: 81475 - protein, 13 aa, Borrelia burgdorferi
ACKQNVSTLDEKN

SEQ ID NO: 81476 - protein, 13 aa, Borrelia burgdorferi
CKQNVSTLDEKNS

SEQ ID NO: 81477 - protein, 13 aa, Borrelia burgdorferi
KQNVSTLDEKNSV

SEQ ID NO: 81478 - protein, 13 aa, Borrelia burgdorferi
QNVSTLDEKNSVS

SEQ ID NO: 81479 - protein, 13 aa, Borrelia burgdorferi
NVSTLDEKNSVSV

SEQ ID NO: 81480 - protein, 13 aa, Borrelia burgdorferi
VSTLDEKNSVSVD

SEQ ID NO: 81481 - protein, 13 aa, Borrelia burgdorferi
STLDEKNSVSVDL

SEQ ID NO: 81482 - protein, 13 aa, Borrelia burgdorferi
TLDEKNSVSVDLP

SEQ ID NO: 81483 - protein, 13 aa, Borrelia burgdorferi
LDEKNSVSVDLPG

SEQ ID NO: 81484 - protein, 13 aa, Borrelia burgdorferi
DEKNSVSVDLPGG

SEQ ID NO: 81485 - protein, 13 aa, Borrelia burgdorferi
EKNSVSVDLPGGM

SEQ ID NO: 81486 - protein, 13 aa, Borrelia burgdorferi
KNSVSVDLPGGMT

SEQ ID NO: 81487 - protein, 13 aa, Borrelia burgdorferi
NSVSVDLPGGMTE

SEQ ID NO: 81488 - protein, 13 aa, Borrelia burgdorferi
SVSVDLPGGMTEL

SEQ ID NO: 81489 - protein, 13 aa, Borrelia burgdorferi
VSVDLPGGMTELV

SEQ ID NO: 81490 - protein, 13 aa, Borrelia burgdorferi
SVDLPGGMTELVS

SEQ ID NO: 81491 - protein, 13 aa, Borrelia burgdorferi
VDLPGGMTELVSK

SEQ ID NO: 81492 - protein, 13 aa, Borrelia burgdorferi
DLPGGMTELVSKE

SEQ ID NO: 81493 - protein, 13 aa, Borrelia burgdorferi
LPGGMTELVSKEK

SEQ ID NO: 81494 - protein, 13 aa, Borrelia burgdorferi
PGGMTELVSKEKD

SEQ ID NO: 81495 - protein, 13 aa, Borrelia burgdorferi
GGMTELVSKEKDK

SEQ ID NO: 81496 - protein, 13 aa, Borrelia burgdorferi
GMTELVSKEKDKD

SEQ ID NO: 81497 - protein, 13 aa, Borrelia burgdorferi
MTELVSKEKDKDG

SEQ ID NO: 81498 - protein, 13 aa, Borrelia burgdorferi
TELVSKEKDKDGK

SEQ ID NO: 81499 - protein, 13 aa, Borrelia burgdorferi
ELVSKEKDKDGKY

SEQ ID NO: 81500 - protein, 13 aa, Borrelia burgdorferi
LVSKEKDKDGKYS

SEQ ID NO: 81501 - protein, 13 aa, Borrelia burgdorferi
VSKEKDKDGKYSL

SEQ ID NO: 81502 - protein, 13 aa, Borrelia burgdorferi
SKEKDKDGKYSLE

SEQ ID NO: 81503 - protein, 13 aa, Borrelia burgdorferi
KEKDKDGKYSLEA

SEQ ID NO: 81504 - protein, 13 aa, Borrelia burgdorferi
EKDKDGKYSLEAT

SEQ ID NO: 81505 - protein, 13 aa, Borrelia burgdorferi
KDKDGKYSLEATV

SEQ ID NO: 81506 - protein, 13 aa, Borrelia burgdorferi
DKDGKYSLEATVD

SEQ ID NO: 81507 - protein, 13 aa, Borrelia burgdorferi
KDGKYSLEATVDK

SEQ ID NO: 81508 - protein, 13 aa, Borrelia burgdorferi
DGKYSLEATVDKL

SEQ ID NO: 81509 - protein, 13 aa, Borrelia burgdorferi
GKYSLEATVDKLE

SEQ ID NO: 81510 - protein, 13 aa, Borrelia burgdorferi
KYSLEATVDKLEL

SEQ ID NO: 81511 - protein, 13 aa, Borrelia burgdorferi
YSLEATVDKLELK

SEQ ID NO: 81512 - protein, 13 aa, Borrelia burgdorferi
SLEATVDKLELKG

SEQ ID NO: 81513 - protein, 13 aa, Borrelia burgdorferi
LEATVDKLELKGT

SEQ ID NO: 81514 - protein, 13 aa, Borrelia burgdorferi
EATVDKLELKGTS

SEQ ID NO: 81515 - protein, 13 aa, Borrelia burgdorferi
ATVDKLELKGTSD

SEQ ID NO: 81516 - protein, 13 aa, Borrelia burgdorferi
TVDKLELKGTSDK

SEQ ID NO: 81517 - protein, 13 aa, Borrelia burgdorferi
VDKLELKGTSDKN

SEQ ID NO: 81518 - protein, 13 aa, Borrelia burgdorferi
DKLELKGTSDKNN

SEQ ID NO: 81519 - protein, 13 aa, Borrelia burgdorferi
KLELKGTSDKNNG

SEQ ID NO: 81520 - protein, 13 aa, Borrelia burgdorferi
LELKGTSDKNNGS

SEQ ID NO: 81521 - protein, 13 aa, Borrelia burgdorferi
ELKGTSDKNNGSG

SEQ ID NO: 81522 - protein, 13 aa, Borrelia burgdorferi
LKGTSDKNNGSGT

SEQ ID NO: 81523 - protein, 13 aa, Borrelia burgdorferi
KGTSDKNNGSGTL

SEQ ID NO: 81524 - protein, 13 aa, Borrelia burgdorferi
GTSDKNNGSGTLE

SEQ ID NO: 81525 - protein, 13 aa, Borrelia burgdorferi
TSDKNNGSGTLEG

SEQ ID NO: 81526 - protein, 13 aa, Borrelia burgdorferi
SDKNNGSGTLEGE

SEQ ID NO: 81527 - protein, 13 aa, Borrelia burgdorferi
DKNNGSGTLEGEK

SEQ ID NO: 81528 - protein, 13 aa, Borrelia burgdorferi
KNNGSGTLEGEKT

SEQ ID NO: 81529 - protein, 13 aa, Borrelia burgdorferi
NNGSGTLEGEKTD

SEQ ID NO: 81530 - protein, 13 aa, Borrelia burgdorferi
NGSGTLEGEKTDK

SEQ ID NO: 81531 - protein, 13 aa, Borrelia burgdorferi
GSGTLEGEKTDKS

SEQ ID NO: 81532 - protein, 13 aa, Borrelia burgdorferi
SGTLEGEKTDKSK

SEQ ID NO: 81533 - protein, 13 aa, Borrelia burgdorferi
GTLEGEKTDKSKV

SEQ ID NO: 81534 - protein, 13 aa, Borrelia burgdorferi
TLEGEKTDKSKVK

SEQ ID NO: 81535 - protein, 13 aa, Borrelia burgdorferi
LEGEKTDKSKVKL

SEQ ID NO: 81536 - protein, 13 aa, Borrelia burgdorferi
EGEKTDKSKVKLT

SEQ ID NO: 81537 - protein, 13 aa, Borrelia burgdorferi
GEKTDKSKVKLTI

SEQ ID NO: 81538 - protein, 13 aa, Borrelia burgdorferi
EKTDKSKVKLTIA

SEQ ID NO: 81539 - protein, 13 aa, Borrelia burgdorferi
KTDKSKVKLTIAD

SEQ ID NO: 81540 - protein, 13 aa, Borrelia burgdorferi
TDKSKVKLTIADD

SEQ ID NO: 81541 - protein, 13 aa, Borrelia burgdorferi
DKSKVKLTIADDL

SEQ ID NO: 81542 - protein, 13 aa, Borrelia burgdorferi
KSKVKLTIADDLS

SEQ ID NO: 81543 - protein, 13 aa, Borrelia burgdorferi
SKVKLTIADDLSQ

SEQ ID NO: 81544 - protein, 13 aa, Borrelia burgdorferi
KVKLTIADDLSQT

SEQ ID NO: 81545 - protein, 13 aa, Borrelia burgdorferi
VKLTIADDLSQTK

SEQ ID NO: 81546 - protein, 13 aa, Borrelia burgdorferi
KLTIADDLSQTKF

SEQ ID NO: 81547 - protein, 13 aa, Borrelia burgdorferi
LTIADDLSQTKFE

SEQ ID NO: 81548 - protein, 13 aa, Borrelia burgdorferi
TIADDLSQTKFEI

SEQ ID NO: 81549 - protein, 13 aa, Borrelia burgdorferi
IADDLSQTKFEIF

SEQ ID NO: 81550 - protein, 13 aa, Borrelia burgdorferi
ADDLSQTKFEIFK

SEQ ID NO: 81551 - protein, 13 aa, Borrelia burgdorferi
DDLSQTKFEIFKE

SEQ ID NO: 81552 - protein, 13 aa, Borrelia burgdorferi
DLSQTKFEIFKED

SEQ ID NO: 81553 - protein, 13 aa, Borrelia burgdorferi
LSQTKFEIFKEDA

SEQ ID NO: 81554 - protein, 13 aa, Borrelia burgdorferi
SQTKFEIFKEDAK

SEQ ID NO: 81555 - protein, 13 aa, Borrelia burgdorferi
QTKFEIFKEDAKT

SEQ ID NO: 81556 - protein, 13 aa, Borrelia burgdorferi
TKFEIFKEDAKTL

SEQ ID NO: 81557 - protein, 13 aa, Borrelia burgdorferi
KFEIFKEDAKTLV

SEQ ID NO: 81558 - protein, 13 aa, Borrelia burgdorferi
FEIFKEDAKTLVS

SEQ ID NO: 81559 - protein, 13 aa, Borrelia burgdorferi
EIFKEDAKTLVSK

SEQ ID NO: 81560 - protein, 13 aa, Borrelia burgdorferi
IFKEDAKTLVSKK

SEQ ID NO: 81561 - protein, 13 aa, Borrelia burgdorferi
FKEDAKTLVSKKV

SEQ ID NO: 81562 - protein, 13 aa, Borrelia burgdorferi
KEDAKTLVSKKVT

SEQ ID NO: 81563 - protein, 13 aa, Borrelia burgdorferi
EDAKTLVSKKVTL

SEQ ID NO: 81564 - protein, 13 aa, Borrelia burgdorferi
DAKTLVSKKVTLK

SEQ ID NO: 81565 - protein, 13 aa, Borrelia burgdorferi
AKTLVSKKVTLKD

SEQ ID NO: 81566 - protein, 13 aa, Borrelia burgdorferi
KTLVSKKVTLKDK

SEQ ID NO: 81567 - protein, 13 aa, Borrelia burgdorferi
TLVSKKVTLKDKS

SEQ ID NO: 81568 - protein, 13 aa, Borrelia burgdorferi
LVSKKVTLKDKSS

SEQ ID NO: 81569 - protein, 13 aa, Borrelia burgdorferi
VSKKVTLKDKSST

SEQ ID NO: 81570 - protein, 13 aa, Borrelia burgdorferi
SKKVTLKDKSSTE

SEQ ID NO: 81571 - protein, 13 aa, Borrelia burgdorferi
KKVTLKDKSSTEE

SEQ ID NO: 81572 - protein, 13 aa, Borrelia burgdorferi
KVTLKDKSSTEEK

SEQ ID NO: 81573 - protein, 13 aa, Borrelia burgdorferi
VTLKDKSSTEEKF

SEQ ID NO: 81574 - protein, 13 aa, Borrelia burgdorferi
TLKDKSSTEEKFN

SEQ ID NO: 81575 - protein, 13 aa, Borrelia burgdorferi
LKDKSSTEEKFNE

SEQ ID NO: 81576 - protein, 13 aa, Borrelia burgdorferi
KDKSSTEEKFNEK

SEQ ID NO: 81577 - protein, 13 aa, Borrelia burgdorferi
DKSSTEEKFNEKG

SEQ ID NO: 81578 - protein, 13 aa, Borrelia burgdorferi
KSSTEEKFNEKGE

SEQ ID NO: 81579 - protein, 13 aa, Borrelia burgdorferi
SSTEEKFNEKGET

SEQ ID NO: 81580 - protein, 13 aa, Borrelia burgdorferi
STEEKFNEKGETS

SEQ ID NO: 81581 - protein, 13 aa, Borrelia burgdorferi
TEEKFNEKGETSE

SEQ ID NO: 81582 - protein, 13 aa, Borrelia burgdorferi
EEKFNEKGETSEK

SEQ ID NO: 81583 - protein, 13 aa, Borrelia burgdorferi
EKFNEKGETSEKT

SEQ ID NO: 81584 - protein, 13 aa, Borrelia burgdorferi
KFNEKGETSEKTI

SEQ ID NO: 81585 - protein, 13 aa, Borrelia burgdorferi
FNEKGETSEKTIV

SEQ ID NO: 81586 - protein, 13 aa, Borrelia burgdorferi
NEKGETSEKTIVR

SEQ ID NO: 81587 - protein, 13 aa, Borrelia burgdorferi
EKGETSEKTIVRA

SEQ ID NO: 81588 - protein, 13 aa, Borrelia burgdorferi
KGETSEKTIVRAN

SEQ ID NO: 81589 - protein, 13 aa, Borrelia burgdorferi
GETSEKTIVRANG

SEQ ID NO: 81590 - protein, 13 aa, Borrelia burgdorferi
ETSEKTIVRANGT

SEQ ID NO: 81591 - protein, 13 aa, Borrelia burgdorferi
TSEKTIVRANGTR

SEQ ID NO: 81592 - protein, 13 aa, Borrelia burgdorferi
SEKTIVRANGTRL

SEQ ID NO: 81593 - protein, 13 aa, Borrelia burgdorferi
EKTIVRANGTRLE

SEQ ID NO: 81594 - protein, 13 aa, Borrelia burgdorferi
KTIVRANGTRLEY

SEQ ID NO: 81595 - protein, 13 aa, Borrelia burgdorferi
TIVRANGTRLEYT

SEQ ID NO: 81596 - protein, 13 aa, Borrelia burgdorferi
IVRANGTRLEYTD

SEQ ID NO: 81597 - protein, 13 aa, Borrelia burgdorferi
VRANGTRLEYTDI

SEQ ID NO: 81598 - protein, 13 aa, Borrelia burgdorferi
RANGTRLEYTDIK

SEQ ID NO: 81599 - protein, 13 aa, Borrelia burgdorferi
ANGTRLEYTDIKS

SEQ ID NO: 81600 - protein, 13 aa, Borrelia burgdorferi
NGTRLEYTDIKSD

SEQ ID NO: 81601 - protein, 13 aa, Borrelia burgdorferi
GTRLEYTDIKSDG

SEQ ID NO: 81602 - protein, 13 aa, Borrelia burgdorferi
TRLEYTDIKSDGS

SEQ ID NO: 81603 - protein, 13 aa, Borrelia burgdorferi
RLEYTDIKSDGSG

SEQ ID NO: 81604 - protein, 13 aa, Borrelia burgdorferi
LEYTDIKSDGSGK

SEQ ID NO: 81605 - protein, 13 aa, Borrelia burgdorferi
EYTDIKSDGSGKA

SEQ ID NO: 81606 - protein, 13 aa, Borrelia burgdorferi
YTDIKSDGSGKAK

SEQ ID NO: 81607 - protein, 13 aa, Borrelia burgdorferi
TDIKSDGSGKAKE

SEQ ID NO: 81608 - protein, 13 aa, Borrelia burgdorferi
DIKSDGSGKAKEV

SEQ ID NO: 81609 - protein, 13 aa, Borrelia burgdorferi
IKSDGSGKAKEVL

SEQ ID NO: 81610 - protein, 13 aa, Borrelia burgdorferi
KSDGSGKAKEVLK

SEQ ID NO: 81611 - protein, 13 aa, Borrelia burgdorferi
SDGSGKAKEVLKD

SEQ ID NO: 81612 - protein, 13 aa, Borrelia burgdorferi
DGSGKAKEVLKDF

SEQ ID NO: 81613 - protein, 13 aa, Borrelia burgdorferi
GSGKAKEVLKDFT

SEQ ID NO: 81614 - protein, 13 aa, Borrelia burgdorferi
SGKAKEVLKDFTL

SEQ ID NO: 81615 - protein, 13 aa, Borrelia burgdorferi
GKAKEVLKDFTLE

SEQ ID NO: 81616 - protein, 13 aa, Borrelia burgdorferi
KAKEVLKDFTLEG

SEQ ID NO: 81617 - protein, 13 aa, Borrelia burgdorferi
AKEVLKDFTLEGT

SEQ ID NO: 81618 - protein, 13 aa, Borrelia burgdorferi
KEVLKDFTLEGTL

SEQ ID NO: 81619 - protein, 13 aa, Borrelia burgdorferi
EVLKDFTLEGTLA

SEQ ID NO: 81620 - protein, 13 aa, Borrelia burgdorferi
VLKDFTLEGTLAA

SEQ ID NO: 81621 - protein, 13 aa, Borrelia burgdorferi
LKDFTLEGTLAAD

SEQ ID NO: 81622 - protein, 13 aa, Borrelia burgdorferi
KDFTLEGTLAADG

SEQ ID NO: 81623 - protein, 13 aa, Borrelia burgdorferi
DFTLEGTLAADGK

SEQ ID NO: 81624 - protein, 13 aa, Borrelia burgdorferi
FTLEGTLAADGKT

SEQ ID NO: 81625 - protein, 13 aa, Borrelia burgdorferi
TLEGTLAADGKTT

SEQ ID NO: 81626 - protein, 13 aa, Borrelia burgdorferi
LEGTLAADGKTTL

SEQ ID NO: 81627 - protein, 13 aa, Borrelia burgdorferi
EGTLAADGKTTLK

SEQ ID NO: 81628 - protein, 13 aa, Borrelia burgdorferi
GTLAADGKTTLKV

SEQ ID NO: 81629 - protein, 13 aa, Borrelia burgdorferi
TLAADGKTTLKVT

SEQ ID NO: 81630 - protein, 13 aa, Borrelia burgdorferi
LAADGKTTLKVTE

SEQ ID NO: 81631 - protein, 13 aa, Borrelia burgdorferi
AADGKTTLKVTEG

SEQ ID NO: 81632 - protein, 13 aa, Borrelia burgdorferi
ADGKTTLKVTEGT

SEQ ID NO: 81633 - protein, 13 aa, Borrelia burgdorferi
DGKTTLKVTEGTV

SEQ ID NO: 81634 - protein, 13 aa, Borrelia burgdorferi
GKTTLKVTEGTVV

SEQ ID NO: 81635 - protein, 13 aa, Borrelia burgdorferi
KTTLKVTEGTVVL

SEQ ID NO: 81636 - protein, 13 aa, Borrelia burgdorferi
TTLKVTEGTVVLS

SEQ ID NO: 81637 - protein, 13 aa, Borrelia burgdorferi
TLKVTEGTVVLSK

SEQ ID NO: 81638 - protein, 13 aa, Borrelia burgdorferi
LKVTEGTVVLSKN

SEQ ID NO: 81639 - protein, 13 aa, Borrelia burgdorferi
KVTEGTVVLSKNI

SEQ ID NO: 81640 - protein, 13 aa, Borrelia burgdorferi
VTEGTVVLSKNIL

SEQ ID NO: 81641 - protein, 13 aa, Borrelia burgdorferi
TEGTVVLSKNILK

SEQ ID NO: 81642 - protein, 13 aa, Borrelia burgdorferi
EGTVVLSKNILKS

SEQ ID NO: 81643 - protein, 13 aa, Borrelia burgdorferi
GTVVLSKNILKSG

SEQ ID NO: 81644 - protein, 13 aa, Borrelia burgdorferi
TVVLSKNILKSGE

SEQ ID NO: 81645 - protein, 13 aa, Borrelia burgdorferi
VVLSKNILKSGEI

SEQ ID NO: 81646 - protein, 13 aa, Borrelia burgdorferi
VLSKNILKSGEIT

SEQ ID NO: 81647 - protein, 13 aa, Borrelia burgdorferi
LSKNILKSGEITV

SEQ ID NO: 81648 - protein, 13 aa, Borrelia burgdorferi
SKNILKSGEITVA

SEQ ID NO: 81649 - protein, 13 aa, Borrelia burgdorferi
KNILKSGEITVAL

SEQ ID NO: 81650 - protein, 13 aa, Borrelia burgdorferi
NILKSGEITVALD

SEQ ID NO: 81651 - protein, 13 aa, Borrelia burgdorferi
ILKSGEITVALDD

SEQ ID NO: 81652 - protein, 13 aa, Borrelia burgdorferi
LKSGEITVALDDS

SEQ ID NO: 81653 - protein, 13 aa, Borrelia burgdorferi
KSGEITVALDDSD

SEQ ID NO: 81654 - protein, 13 aa, Borrelia burgdorferi
SGEITVALDDSDT

SEQ ID NO: 81655 - protein, 13 aa, Borrelia burgdorferi
GEITVALDDSDTT

SEQ ID NO: 81656 - protein, 13 aa, Borrelia burgdorferi
EITVALDDSDTTQ

SEQ ID NO: 81657 - protein, 13 aa, Borrelia burgdorferi
ITVALDDSDTTQA

SEQ ID NO: 81658 - protein, 13 aa, Borrelia burgdorferi
TVALDDSDTTQAT

SEQ ID NO: 81659 - protein, 13 aa, Borrelia burgdorferi
VALDDSDTTQATK

SEQ ID NO: 81660 - protein, 13 aa, Borrelia burgdorferi
ALDDSDTTQATKK

SEQ ID NO: 81661 - protein, 13 aa, Borrelia burgdorferi
LDDSDTTQATKKT

SEQ ID NO: 81662 - protein, 13 aa, Borrelia burgdorferi
DDSDTTQATKKTG

SEQ ID NO: 81663 - protein, 13 aa, Borrelia burgdorferi
DSDTTQATKKTGK

SEQ ID NO: 81664 - protein, 13 aa, Borrelia burgdorferi
SDTTQATKKTGKW

SEQ ID NO: 81665 - protein, 13 aa, Borrelia burgdorferi
DTTQATKKTGKWD

SEQ ID NO: 81666 - protein, 13 aa, Borrelia burgdorferi
TTQATKKTGKWDS

SEQ ID NO: 81667 - protein, 13 aa, Borrelia burgdorferi
TQATKKTGKWDSK

SEQ ID NO: 81668 - protein, 13 aa, Borrelia burgdorferi
QATKKTGKWDSKT

SEQ ID NO: 81669 - protein, 13 aa, Borrelia burgdorferi
ATKKTGKWDSKTS

SEQ ID NO: 81670 - protein, 13 aa, Borrelia burgdorferi
TKKTGKWDSKTST

SEQ ID NO: 81671 - protein, 13 aa, Borrelia burgdorferi
KKTGKWDSKTSTL

SEQ ID NO: 81672 - protein, 13 aa, Borrelia burgdorferi
KTGKWDSKTSTLT

SEQ ID NO: 81673 - protein, 13 aa, Borrelia burgdorferi
TGKWDSKTSTLTI

SEQ ID NO: 81674 - protein, 13 aa, Borrelia burgdorferi
GKWDSKTSTLTIS

SEQ ID NO: 81675 - protein, 13 aa, Borrelia burgdorferi
KWDSKTSTLTISV

SEQ ID NO: 81676 - protein, 13 aa, Borrelia burgdorferi
WDSKTSTLTISVN

SEQ ID NO: 81677 - protein, 13 aa, Borrelia burgdorferi
DSKTSTLTISVNS

SEQ ID NO: 81678 - protein, 13 aa, Borrelia burgdorferi
SKTSTLTISVNSQ

SEQ ID NO: 81679 - protein, 13 aa, Borrelia burgdorferi
KTSTLTISVNSQK

SEQ ID NO: 81680 - protein, 13 aa, Borrelia burgdorferi
TSTLTISVNSQKT

SEQ ID NO: 81681 - protein, 13 aa, Borrelia burgdorferi
STLTISVNSQKTK

SEQ ID NO: 81682 - protein, 13 aa, Borrelia burgdorferi
TLTISVNSQKTKN

SEQ ID NO: 81683 - protein, 13 aa, Borrelia burgdorferi
LTISVNSQKTKNL

SEQ ID NO: 81684 - protein, 13 aa, Borrelia burgdorferi
TISVNSQKTKNLV

SEQ ID NO: 81685 - protein, 13 aa, Borrelia burgdorferi
ISVNSQKTKNLVF

SEQ ID NO: 81686 - protein, 13 aa, Borrelia burgdorferi
SVNSQKTKNLVFT

SEQ ID NO: 81687 - protein, 13 aa, Borrelia burgdorferi
VNSQKTKNLVFTK

SEQ ID NO: 81688 - protein, 13 aa, Borrelia burgdorferi
NSQKTKNLVFTKE

SEQ ID NO: 81689 - protein, 13 aa, Borrelia burgdorferi
SQKTKNLVFTKED

SEQ ID NO: 81690 - protein, 13 aa, Borrelia burgdorferi
QKTKNLVFTKEDT

SEQ ID NO: 81691 - protein, 13 aa, Borrelia burgdorferi
KTKNLVFTKEDTI

SEQ ID NO: 81692 - protein, 13 aa, Borrelia burgdorferi
TKNLVFTKEDTIT

SEQ ID NO: 81693 - protein, 13 aa, Borrelia burgdorferi
KNLVFTKEDTITV

SEQ ID NO: 81694 - protein, 13 aa, Borrelia burgdorferi
NLVFTKEDTITVQ

SEQ ID NO: 81695 - protein, 13 aa, Borrelia burgdorferi
LVFTKEDTITVQK

SEQ ID NO: 81696 - protein, 13 aa, Borrelia burgdorferi
VFTKEDTITVQKY

SEQ ID NO: 81697 - protein, 13 aa, Borrelia burgdorferi
FTKEDTITVQKYD

SEQ ID NO: 81698 - protein, 13 aa, Borrelia burgdorferi
TKEDTITVQKYDS

SEQ ID NO: 81699 - protein, 13 aa, Borrelia burgdorferi
KEDTITVQKYDSA

SEQ ID NO: 81700 - protein, 13 aa, Borrelia burgdorferi
EDTITVQKYDSAG

SEQ ID NO: 81701 - protein, 13 aa, Borrelia burgdorferi
DTITVQKYDSAGT

SEQ ID NO: 81702 - protein, 13 aa, Borrelia burgdorferi
TITVQKYDSAGTN

SEQ ID NO: 81703 - protein, 13 aa, Borrelia burgdorferi
ITVQKYDSAGTNL

SEQ ID NO: 81704 - protein, 13 aa, Borrelia burgdorferi
TVQKYDSAGTNLE

SEQ ID NO: 81705 - protein, 13 aa, Borrelia burgdorferi
VQKYDSAGTNLEG

SEQ ID NO: 81706 - protein, 13 aa, Borrelia burgdorferi
QKYDSAGTNLEGK

SEQ ID NO: 81707 - protein, 13 aa, Borrelia burgdorferi
KYDSAGTNLEGKA

SEQ ID NO: 81708 - protein, 13 aa, Borrelia burgdorferi
YDSAGTNLEGKAV

SEQ ID NO: 81709 - protein, 13 aa, Borrelia burgdorferi
DSAGTNLEGKAVE

SEQ ID NO: 81710 - protein, 13 aa, Borrelia burgdorferi
SAGTNLEGKAVEI

SEQ ID NO: 81711 - protein, 13 aa, Borrelia burgdorferi
AGTNLEGKAVEIT

SEQ ID NO: 81712 - protein, 13 aa, Borrelia burgdorferi
GTNLEGKAVEITT

SEQ ID NO: 81713 - protein, 13 aa, Borrelia burgdorferi
TNLEGKAVEITTL

SEQ ID NO: 81714 - protein, 13 aa, Borrelia burgdorferi
NLEGKAVEITTLK

SEQ ID NO: 81715 - protein, 13 aa, Borrelia burgdorferi
LEGKAVEITTLKE

SEQ ID NO: 81716 - protein, 13 aa, Borrelia burgdorferi
EGKAVEITTLKEL

SEQ ID NO: 81717 - protein, 13 aa, Borrelia burgdorferi
GKAVEITTLKELK

SEQ ID NO: 81718 - protein, 13 aa, Borrelia burgdorferi
KAVEITTLKELKN

SEQ ID NO: 81719 - protein, 13 aa, Borrelia burgdorferi
AVEITTLKELKNA

SEQ ID NO: 81720 - protein, 13 aa, Borrelia burgdorferi
VEITTLKELKNAL

SEQ ID NO: 81721 - protein, 13 aa, Borrelia burgdorferi
EITTLKELKNALK

SEQ ID NO: 81722 - protein, 14 aa, Borrelia burgdorferi
MKKYLLGIGLILAL

SEQ ID NO: 81723 - protein, 14 aa, Borrelia burgdorferi
KKYLLGIGLILALI

SEQ ID NO: 81724 - protein, 14 aa, Borrelia burgdorferi
KYLLGIGLILALIA

SEQ ID NO: 81725 - protein, 14 aa, Borrelia burgdorferi
YLLGIGLILALIAC

SEQ ID NO: 81726 - protein, 14 aa, Borrelia burgdorferi
LLGIGLILALIACK

SEQ ID NO: 81727 - protein, 14 aa, Borrelia burgdorferi
LGIGLILALIACKQ

SEQ ID NO: 81728 - protein, 14 aa, Borrelia burgdorferi
GIGLILALIACKQN

SEQ ID NO: 81729 - protein, 14 aa, Borrelia burgdorferi
IGLILALIACKQNV

SEQ ID NO: 81730 - protein, 14 aa, Borrelia burgdorferi
GLILALIACKQNVS

SEQ ID NO: 81731 - protein, 14 aa, Borrelia burgdorferi
LILALIACKQNVST

SEQ ID NO: 81732 - protein, 14 aa, Borrelia burgdorferi
ILALIACKQNVSTL

SEQ ID NO: 81733 - protein, 14 aa, Borrelia burgdorferi
LALIACKQNVSTLD

SEQ ID NO: 81734 - protein, 14 aa, Borrelia burgdorferi
ALIACKQNVSTLDE

SEQ ID NO: 81735 - protein, 14 aa, Borrelia burgdorferi
LIACKQNVSTLDEK

SEQ ID NO: 81736 - protein, 14 aa, Borrelia burgdorferi
IACKQNVSTLDEKN

SEQ ID NO: 81737 - protein, 14 aa, Borrelia burgdorferi
ACKQNVSTLDEKNS

SEQ ID NO: 81738 - protein, 14 aa, Borrelia burgdorferi
CKQNVSTLDEKNSV

SEQ ID NO: 81739 - protein, 14 aa, Borrelia burgdorferi
KQNVSTLDEKNSVS

SEQ ID NO: 81740 - protein, 14 aa, Borrelia burgdorferi
QNVSTLDEKNSVSV

SEQ ID NO: 81741 - protein, 14 aa, Borrelia burgdorferi
NVSTLDEKNSVSVD

SEQ ID NO: 81742 - protein, 14 aa, Borrelia burgdorferi
VSTLDEKNSVSVDL

SEQ ID NO: 81743 - protein, 14 aa, Borrelia burgdorferi
STLDEKNSVSVDLP

SEQ ID NO: 81744 - protein, 14 aa, Borrelia burgdorferi
TLDEKNSVSVDLPG

SEQ ID NO: 81745 - protein, 14 aa, Borrelia burgdorferi
LDEKNSVSVDLPGG

SEQ ID NO: 81746 - protein, 14 aa, Borrelia burgdorferi
DEKNSVSVDLPGGM

SEQ ID NO: 81747 - protein, 14 aa, Borrelia burgdorferi
EKNSVSVDLPGGMT

SEQ ID NO: 81748 - protein, 14 aa, Borrelia burgdorferi
KNSVSVDLPGGMTE

SEQ ID NO: 81749 - protein, 14 aa, Borrelia burgdorferi
NSVSVDLPGGMTEL

SEQ ID NO: 81750 - protein, 14 aa, Borrelia burgdorferi
SVSVDLPGGMTELV

SEQ ID NO: 81751 - protein, 14 aa, Borrelia burgdorferi
VSVDLPGGMTELVS

SEQ ID NO: 81752 - protein, 14 aa, Borrelia burgdorferi
SVDLPGGMTELVSK

SEQ ID NO: 81753 - protein, 14 aa, Borrelia burgdorferi
VDLPGGMTELVSKE

SEQ ID NO: 81754 - protein, 14 aa, Borrelia burgdorferi
DLPGGMTELVSKEK

SEQ ID NO: 81755 - protein, 14 aa, Borrelia burgdorferi
LPGGMTELVSKEKD

SEQ ID NO: 81756 - protein, 14 aa, Borrelia burgdorferi
PGGMTELVSKEKDK

SEQ ID NO: 81757 - protein, 14 aa, Borrelia burgdorferi
GGMTELVSKEKDKD

SEQ ID NO: 81758 - protein, 14 aa, Borrelia burgdorferi
GMTELVSKEKDKDG

SEQ ID NO: 81759 - protein, 14 aa, Borrelia burgdorferi
MTELVSKEKDKDGK

SEQ ID NO: 81760 - protein, 14 aa, Borrelia burgdorferi
TELVSKEKDKDGKY

SEQ ID NO: 81761 - protein, 14 aa, Borrelia burgdorferi
ELVSKEKDKDGKYS

SEQ ID NO: 81762 - protein, 14 aa, Borrelia burgdorferi
LVSKEKDKDGKYSL

SEQ ID NO: 81763 - protein, 14 aa, Borrelia burgdorferi
VSKEKDKDGKYSLE

SEQ ID NO: 81764 - protein, 14 aa, Borrelia burgdorferi
SKEKDKDGKYSLEA

SEQ ID NO: 81765 - protein, 14 aa, Borrelia burgdorferi
KEKDKDGKYSLEAT

SEQ ID NO: 81766 - protein, 14 aa, Borrelia burgdorferi
EKDKDGKYSLEATV

SEQ ID NO: 81767 - protein, 14 aa, Borrelia burgdorferi
KDKDGKYSLEATVD

SEQ ID NO: 81768 - protein, 14 aa, Borrelia burgdorferi
DKDGKYSLEATVDK

SEQ ID NO: 81769 - protein, 14 aa, Borrelia burgdorferi
KDGKYSLEATVDKL

SEQ ID NO: 81770 - protein, 14 aa, Borrelia burgdorferi
DGKYSLEATVDKLE

SEQ ID NO: 81771 - protein, 14 aa, Borrelia burgdorferi
GKYSLEATVDKLEL

SEQ ID NO: 81772 - protein, 14 aa, Borrelia burgdorferi
KYSLEATVDKLELK

SEQ ID NO: 81773 - protein, 14 aa, Borrelia burgdorferi
YSLEATVDKLELKG

SEQ ID NO: 81774 - protein, 14 aa, Borrelia burgdorferi
SLEATVDKLELKGT

SEQ ID NO: 81775 - protein, 14 aa, Borrelia burgdorferi
LEATVDKLELKGTS

SEQ ID NO: 81776 - protein, 14 aa, Borrelia burgdorferi
EATVDKLELKGTSD

SEQ ID NO: 81777 - protein, 14 aa, Borrelia burgdorferi
ATVDKLELKGTSDK

SEQ ID NO: 81778 - protein, 14 aa, Borrelia burgdorferi
TVDKLELKGTSDKN

SEQ ID NO: 81779 - protein, 14 aa, Borrelia burgdorferi
VDKLELKGTSDKNN

SEQ ID NO: 81780 - protein, 14 aa, Borrelia burgdorferi
DKLELKGTSDKNNG

SEQ ID NO: 81781 - protein, 14 aa, Borrelia burgdorferi
KLELKGTSDKNNGS

SEQ ID NO: 81782 - protein, 14 aa, Borrelia burgdorferi
LELKGTSDKNNGSG

SEQ ID NO: 81783 - protein, 14 aa, Borrelia burgdorferi
ELKGTSDKNNGSGT

SEQ ID NO: 81784 - protein, 14 aa, Borrelia burgdorferi
LKGTSDKNNGSGTL

SEQ ID NO: 81785 - protein, 14 aa, Borrelia burgdorferi
KGTSDKNNGSGTLE

SEQ ID NO: 81786 - protein, 14 aa, Borrelia burgdorferi
GTSDKNNGSGTLEG

SEQ ID NO: 81787 - protein, 14 aa, Borrelia burgdorferi
TSDKNNGSGTLEGE

SEQ ID NO: 81788 - protein, 14 aa, Borrelia burgdorferi
SDKNNGSGTLEGEK

SEQ ID NO: 81789 - protein, 14 aa, Borrelia burgdorferi
DKNNGSGTLEGEKT

SEQ ID NO: 81790 - protein, 14 aa, Borrelia burgdorferi
KNNGSGTLEGEKTD

SEQ ID NO: 81791 - protein, 14 aa, Borrelia burgdorferi
NNGSGTLEGEKTDK

SEQ ID NO: 81792 - protein, 14 aa, Borrelia burgdorferi
NGSGTLEGEKTDKS

SEQ ID NO: 81793 - protein, 14 aa, Borrelia burgdorferi
GSGTLEGEKTDKSK

SEQ ID NO: 81794 - protein, 14 aa, Borrelia burgdorferi
SGTLEGEKTDKSKV

SEQ ID NO: 81795 - protein, 14 aa, Borrelia burgdorferi
GTLEGEKTDKSKVK

SEQ ID NO: 81796 - protein, 14 aa, Borrelia burgdorferi
TLEGEKTDKSKVKL

SEQ ID NO: 81797 - protein, 14 aa, Borrelia burgdorferi
LEGEKTDKSKVKLT

SEQ ID NO: 81798 - protein, 14 aa, Borrelia burgdorferi
EGEKTDKSKVKLTI

SEQ ID NO: 81799 - protein, 14 aa, Borrelia burgdorferi
GEKTDKSKVKLTIA

SEQ ID NO: 81800 - protein, 14 aa, Borrelia burgdorferi
EKTDKSKVKLTIAD

SEQ ID NO: 81801 - protein, 14 aa, Borrelia burgdorferi
KTDKSKVKLTIADD

SEQ ID NO: 81802 - protein, 14 aa, Borrelia burgdorferi
TDKSKVKLTIADDL

SEQ ID NO: 81803 - protein, 14 aa, Borrelia burgdorferi
DKSKVKLTIADDLS

SEQ ID NO: 81804 - protein, 14 aa, Borrelia burgdorferi
KSKVKLTIADDLSQ

SEQ ID NO: 81805 - protein, 14 aa, Borrelia burgdorferi
SKVKLTIADDLSQT

SEQ ID NO: 81806 - protein, 14 aa, Borrelia burgdorferi
KVKLTIADDLSQTK

SEQ ID NO: 81807 - protein, 14 aa, Borrelia burgdorferi
VKLTIADDLSQTKF

SEQ ID NO: 81808 - protein, 14 aa, Borrelia burgdorferi
KLTIADDLSQTKFE

SEQ ID NO: 81809 - protein, 14 aa, Borrelia burgdorferi
LTIADDLSQTKFEI

SEQ ID NO: 81810 - protein, 14 aa, Borrelia burgdorferi
TIADDLSQTKFEIF

SEQ ID NO: 81811 - protein, 14 aa, Borrelia burgdorferi
IADDLSQTKFEIFK

SEQ ID NO: 81812 - protein, 14 aa, Borrelia burgdorferi
ADDLSQTKFEIFKE

SEQ ID NO: 81813 - protein, 14 aa, Borrelia burgdorferi
DDLSQTKFEIFKED

SEQ ID NO: 81814 - protein, 14 aa, Borrelia burgdorferi
DLSQTKFEIFKEDA

SEQ ID NO: 81815 - protein, 14 aa, Borrelia burgdorferi
LSQTKFEIFKEDAK

SEQ ID NO: 81816 - protein, 14 aa, Borrelia burgdorferi
SQTKFEIFKEDAKT

SEQ ID NO: 81817 - protein, 14 aa, Borrelia burgdorferi
QTKFEIFKEDAKTL

SEQ ID NO: 81818 - protein, 14 aa, Borrelia burgdorferi
TKFEIFKEDAKTLV

SEQ ID NO: 81819 - protein, 14 aa, Borrelia burgdorferi
KFEIFKEDAKTLVS

SEQ ID NO: 81820 - protein, 14 aa, Borrelia burgdorferi
FEIFKEDAKTLVSK

SEQ ID NO: 81821 - protein, 14 aa, Borrelia burgdorferi
EIFKEDAKTLVSKK

SEQ ID NO: 81822 - protein, 14 aa, Borrelia burgdorferi
IFKEDAKTLVSKKV

SEQ ID NO: 81823 - protein, 14 aa, Borrelia burgdorferi
FKEDAKTLVSKKVT

SEQ ID NO: 81824 - protein, 14 aa, Borrelia burgdorferi
KEDAKTLVSKKVTL

SEQ ID NO: 81825 - protein, 14 aa, Borrelia burgdorferi
EDAKTLVSKKVTLK

SEQ ID NO: 81826 - protein, 14 aa, Borrelia burgdorferi
DAKTLVSKKVTLKD

SEQ ID NO: 81827 - protein, 14 aa, Borrelia burgdorferi
AKTLVSKKVTLKDK

SEQ ID NO: 81828 - protein, 14 aa, Borrelia burgdorferi
KTLVSKKVTLKDKS

SEQ ID NO: 81829 - protein, 14 aa, Borrelia burgdorferi
TLVSKKVTLKDKSS

SEQ ID NO: 81830 - protein, 14 aa, Borrelia burgdorferi
LVSKKVTLKDKSST

SEQ ID NO: 81831 - protein, 14 aa, Borrelia burgdorferi
VSKKVTLKDKSSTE

SEQ ID NO: 81832 - protein, 14 aa, Borrelia burgdorferi
SKKVTLKDKSSTEE

SEQ ID NO: 81833 - protein, 14 aa, Borrelia burgdorferi
KKVTLKDKSSTEEK

SEQ ID NO: 81834 - protein, 14 aa, Borrelia burgdorferi
KVTLKDKSSTEEKF

SEQ ID NO: 81835 - protein, 14 aa, Borrelia burgdorferi
VTLKDKSSTEEKFN

SEQ ID NO: 81836 - protein, 14 aa, Borrelia burgdorferi
TLKDKSSTEEKFNE

SEQ ID NO: 81837 - protein, 14 aa, Borrelia burgdorferi
LKDKSSTEEKFNEK

SEQ ID NO: 81838 - protein, 14 aa, Borrelia burgdorferi
KDKSSTEEKFNEKG

SEQ ID NO: 81839 - protein, 14 aa, Borrelia burgdorferi
DKSSTEEKFNEKGE

SEQ ID NO: 81840 - protein, 14 aa, Borrelia burgdorferi
KSSTEEKFNEKGET

SEQ ID NO: 81841 - protein, 14 aa, Borrelia burgdorferi
SSTEEKFNEKGETS

SEQ ID NO: 81842 - protein, 14 aa, Borrelia burgdorferi
STEEKFNEKGETSE

SEQ ID NO: 81843 - protein, 14 aa, Borrelia burgdorferi
TEEKFNEKGETSEK

SEQ ID NO: 81844 - protein, 14 aa, Borrelia burgdorferi
EEKFNEKGETSEKT

SEQ ID NO: 81845 - protein, 14 aa, Borrelia burgdorferi
EKFNEKGETSEKTI

SEQ ID NO: 81846 - protein, 14 aa, Borrelia burgdorferi
KFNEKGETSEKTIV

SEQ ID NO: 81847 - protein, 14 aa, Borrelia burgdorferi
FNEKGETSEKTIVR

SEQ ID NO: 81848 - protein, 14 aa, Borrelia burgdorferi
NEKGETSEKTIVRA

SEQ ID NO: 81849 - protein, 14 aa, Borrelia burgdorferi
EKGETSEKTIVRAN

SEQ ID NO: 81850 - protein, 14 aa, Borrelia burgdorferi
KGETSEKTIVRANG

SEQ ID NO: 81851 - protein, 14 aa, Borrelia burgdorferi
GETSEKTIVRANGT

SEQ ID NO: 81852 - protein, 14 aa, Borrelia burgdorferi
ETSEKTIVRANGTR

SEQ ID NO: 81853 - protein, 14 aa, Borrelia burgdorferi
TSEKTIVRANGTRL

SEQ ID NO: 81854 - protein, 14 aa, Borrelia burgdorferi
SEKTIVRANGTRLE

SEQ ID NO: 81855 - protein, 14 aa, Borrelia burgdorferi
EKTIVRANGTRLEY

SEQ ID NO: 81856 - protein, 14 aa, Borrelia burgdorferi
KTIVRANGTRLEYT

SEQ ID NO: 81857 - protein, 14 aa, Borrelia burgdorferi
TIVRANGTRLEYTD

SEQ ID NO: 81858 - protein, 14 aa, Borrelia burgdorferi
IVRANGTRLEYTDI

SEQ ID NO: 81859 - protein, 14 aa, Borrelia burgdorferi
VRANGTRLEYTDIK

SEQ ID NO: 81860 - protein, 14 aa, Borrelia burgdorferi
RANGTRLEYTDIKS

SEQ ID NO: 81861 - protein, 14 aa, Borrelia burgdorferi
ANGTRLEYTDIKSD

SEQ ID NO: 81862 - protein, 14 aa, Borrelia burgdorferi
NGTRLEYTDIKSDG

SEQ ID NO: 81863 - protein, 14 aa, Borrelia burgdorferi
GTRLEYTDIKSDGS

SEQ ID NO: 81864 - protein, 14 aa, Borrelia burgdorferi
TRLEYTDIKSDGSG

SEQ ID NO: 81865 - protein, 14 aa, Borrelia burgdorferi
RLEYTDIKSDGSGK

SEQ ID NO: 81866 - protein, 14 aa, Borrelia burgdorferi
LEYTDIKSDGSGKA

SEQ ID NO: 81867 - protein, 14 aa, Borrelia burgdorferi
EYTDIKSDGSGKAK

SEQ ID NO: 81868 - protein, 14 aa, Borrelia burgdorferi
YTDIKSDGSGKAKE

SEQ ID NO: 81869 - protein, 14 aa, Borrelia burgdorferi
TDIKSDGSGKAKEV

SEQ ID NO: 81870 - protein, 14 aa, Borrelia burgdorferi
DIKSDGSGKAKEVL

SEQ ID NO: 81871 - protein, 14 aa, Borrelia burgdorferi
IKSDGSGKAKEVLK

SEQ ID NO: 81872 - protein, 14 aa, Borrelia burgdorferi
KSDGSGKAKEVLKD

SEQ ID NO: 81873 - protein, 14 aa, Borrelia burgdorferi
SDGSGKAKEVLKDF

SEQ ID NO: 81874 - protein, 14 aa, Borrelia burgdorferi
DGSGKAKEVLKDFT

SEQ ID NO: 81875 - protein, 14 aa, Borrelia burgdorferi
GSGKAKEVLKDFTL

SEQ ID NO: 81876 - protein, 14 aa, Borrelia burgdorferi
SGKAKEVLKDFTLE

SEQ ID NO: 81877 - protein, 14 aa, Borrelia burgdorferi
GKAKEVLKDFTLEG

SEQ ID NO: 81878 - protein, 14 aa, Borrelia burgdorferi
KAKEVLKDFTLEGT

SEQ ID NO: 81879 - protein, 14 aa, Borrelia burgdorferi
AKEVLKDFTLEGTL

SEQ ID NO: 81880 - protein, 14 aa, Borrelia burgdorferi
KEVLKDFTLEGTLA

SEQ ID NO: 81881 - protein, 14 aa, Borrelia burgdorferi
EVLKDFTLEGTLAA

SEQ ID NO: 81882 - protein, 14 aa, Borrelia burgdorferi
VLKDFTLEGTLAAD

SEQ ID NO: 81883 - protein, 14 aa, Borrelia burgdorferi
LKDFTLEGTLAADG

SEQ ID NO: 81884 - protein, 14 aa, Borrelia burgdorferi
KDFTLEGTLAADGK

SEQ ID NO: 81885 - protein, 14 aa, Borrelia burgdorferi
DFTLEGTLAADGKT

SEQ ID NO: 81886 - protein, 14 aa, Borrelia burgdorferi
FTLEGTLAADGKTT

SEQ ID NO: 81887 - protein, 14 aa, Borrelia burgdorferi
TLEGTLAADGKTTL

SEQ ID NO: 81888 - protein, 14 aa, Borrelia burgdorferi
LEGTLAADGKTTLK

SEQ ID NO: 81889 - protein, 14 aa, Borrelia burgdorferi
EGTLAADGKTTLKV

SEQ ID NO: 81890 - protein, 14 aa, Borrelia burgdorferi
GTLAADGKTTLKVT

SEQ ID NO: 81891 - protein, 14 aa, Borrelia burgdorferi
TLAADGKTTLKVTE

SEQ ID NO: 81892 - protein, 14 aa, Borrelia burgdorferi
LAADGKTTLKVTEG

SEQ ID NO: 81893 - protein, 14 aa, Borrelia burgdorferi
AADGKTTLKVTEGT

SEQ ID NO: 81894 - protein, 14 aa, Borrelia burgdorferi
ADGKTTLKVTEGTV

SEQ ID NO: 81895 - protein, 14 aa, Borrelia burgdorferi
DGKTTLKVTEGTVV

SEQ ID NO: 81896 - protein, 14 aa, Borrelia burgdorferi
GKTTLKVTEGTVVL

SEQ ID NO: 81897 - protein, 14 aa, Borrelia burgdorferi
KTTLKVTEGTVVLS

SEQ ID NO: 81898 - protein, 14 aa, Borrelia burgdorferi
TTLKVTEGTVVLSK

SEQ ID NO: 81899 - protein, 14 aa, Borrelia burgdorferi
TLKVTEGTVVLSKN

SEQ ID NO: 81900 - protein, 14 aa, Borrelia burgdorferi
LKVTEGTVVLSKNI

SEQ ID NO: 81901 - protein, 14 aa, Borrelia burgdorferi
KVTEGTVVLSKNIL

SEQ ID NO: 81902 - protein, 14 aa, Borrelia burgdorferi
VTEGTVVLSKNILK

SEQ ID NO: 81903 - protein, 14 aa, Borrelia burgdorferi
TEGTVVLSKNILKS

SEQ ID NO: 81904 - protein, 14 aa, Borrelia burgdorferi
EGTVVLSKNILKSG

SEQ ID NO: 81905 - protein, 14 aa, Borrelia burgdorferi
GTVVLSKNILKSGE

SEQ ID NO: 81906 - protein, 14 aa, Borrelia burgdorferi
TVVLSKNILKSGEI

SEQ ID NO: 81907 - protein, 14 aa, Borrelia burgdorferi
VVLSKNILKSGEIT

SEQ ID NO: 81908 - protein, 14 aa, Borrelia burgdorferi
VLSKNILKSGEITV

SEQ ID NO: 81909 - protein, 14 aa, Borrelia burgdorferi
LSKNILKSGEITVA

SEQ ID NO: 81910 - protein, 14 aa, Borrelia burgdorferi
SKNILKSGEITVAL

SEQ ID NO: 81911 - protein, 14 aa, Borrelia burgdorferi
KNILKSGEITVALD

SEQ ID NO: 81912 - protein, 14 aa, Borrelia burgdorferi
NILKSGEITVALDD

SEQ ID NO: 81913 - protein, 14 aa, Borrelia burgdorferi
ILKSGEITVALDDS

SEQ ID NO: 81914 - protein, 14 aa, Borrelia burgdorferi
LKSGEITVALDDSD

SEQ ID NO: 81915 - protein, 14 aa, Borrelia burgdorferi
KSGEITVALDDSDT

SEQ ID NO: 81916 - protein, 14 aa, Borrelia burgdorferi
SGEITVALDDSDTT

SEQ ID NO: 81917 - protein, 14 aa, Borrelia burgdorferi
GEITVALDDSDTTQ

SEQ ID NO: 81918 - protein, 14 aa, Borrelia burgdorferi
EITVALDDSDTTQA

SEQ ID NO: 81919 - protein, 14 aa, Borrelia burgdorferi
ITVALDDSDTTQAT

SEQ ID NO: 81920 - protein, 14 aa, Borrelia burgdorferi
TVALDDSDTTQATK

SEQ ID NO: 81921 - protein, 14 aa, Borrelia burgdorferi
VALDDSDTTQATKK

SEQ ID NO: 81922 - protein, 14 aa, Borrelia burgdorferi
ALDDSDTTQATKKT

SEQ ID NO: 81923 - protein, 14 aa, Borrelia burgdorferi
LDDSDTTQATKKTG

SEQ ID NO: 81924 - protein, 14 aa, Borrelia burgdorferi
DDSDTTQATKKTGK

SEQ ID NO: 81925 - protein, 14 aa, Borrelia burgdorferi
DSDTTQATKKTGKW

SEQ ID NO: 81926 - protein, 14 aa, Borrelia burgdorferi
SDTTQATKKTGKWD

SEQ ID NO: 81927 - protein, 14 aa, Borrelia burgdorferi
DTTQATKKTGKWDS

SEQ ID NO: 81928 - protein, 14 aa, Borrelia burgdorferi
TTQATKKTGKWDSK

SEQ ID NO: 81929 - protein, 14 aa, Borrelia burgdorferi
TQATKKTGKWDSKT

SEQ ID NO: 81930 - protein, 14 aa, Borrelia burgdorferi
QATKKTGKWDSKTS

SEQ ID NO: 81931 - protein, 14 aa, Borrelia burgdorferi
ATKKTGKWDSKTST

SEQ ID NO: 81932 - protein, 14 aa, Borrelia burgdorferi
TKKTGKWDSKTSTL

SEQ ID NO: 81933 - protein, 14 aa, Borrelia burgdorferi
KKTGKWDSKTSTLT

SEQ ID NO: 81934 - protein, 14 aa, Borrelia burgdorferi
KTGKWDSKTSTLTI

SEQ ID NO: 81935 - protein, 14 aa, Borrelia burgdorferi
TGKWDSKTSTLTIS

SEQ ID NO: 81936 - protein, 14 aa, Borrelia burgdorferi
GKWDSKTSTLTISV

SEQ ID NO: 81937 - protein, 14 aa, Borrelia burgdorferi
KWDSKTSTLTISVN

SEQ ID NO: 81938 - protein, 14 aa, Borrelia burgdorferi
WDSKTSTLTISVNS

SEQ ID NO: 81939 - protein, 14 aa, Borrelia burgdorferi
DSKTSTLTISVNSQ

SEQ ID NO: 81940 - protein, 14 aa, Borrelia burgdorferi
SKTSTLTISVNSQK

SEQ ID NO: 81941 - protein, 14 aa, Borrelia burgdorferi
KTSTLTISVNSQKT

SEQ ID NO: 81942 - protein, 14 aa, Borrelia burgdorferi
TSTLTISVNSQKTK

SEQ ID NO: 81943 - protein, 14 aa, Borrelia burgdorferi
STLTISVNSQKTKN

SEQ ID NO: 81944 - protein, 14 aa, Borrelia burgdorferi
TLTISVNSQKTKNL

SEQ ID NO: 81945 - protein, 14 aa, Borrelia burgdorferi
LTISVNSQKTKNLV

SEQ ID NO: 81946 - protein, 14 aa, Borrelia burgdorferi
TISVNSQKTKNLVF

SEQ ID NO: 81947 - protein, 14 aa, Borrelia burgdorferi
ISVNSQKTKNLVFT

SEQ ID NO: 81948 - protein, 14 aa, Borrelia burgdorferi
SVNSQKTKNLVFTK

SEQ ID NO: 81949 - protein, 14 aa, Borrelia burgdorferi
VNSQKTKNLVFTKE

SEQ ID NO: 81950 - protein, 14 aa, Borrelia burgdorferi
NSQKTKNLVFTKED

SEQ ID NO: 81951 - protein, 14 aa, Borrelia burgdorferi
SQKTKNLVFTKEDT

SEQ ID NO: 81952 - protein, 14 aa, Borrelia burgdorferi
QKTKNLVFTKEDTI

SEQ ID NO: 81953 - protein, 14 aa, Borrelia burgdorferi
KTKNLVFTKEDTIT

SEQ ID NO: 81954 - protein, 14 aa, Borrelia burgdorferi
TKNLVFTKEDTITV

SEQ ID NO: 81955 - protein, 14 aa, Borrelia burgdorferi
KNLVFTKEDTITVQ

SEQ ID NO: 81956 - protein, 14 aa, Borrelia burgdorferi
NLVFTKEDTITVQK

SEQ ID NO: 81957 - protein, 14 aa, Borrelia burgdorferi
LVFTKEDTITVQKY

SEQ ID NO: 81958 - protein, 14 aa, Borrelia burgdorferi
VFTKEDTITVQKYD

SEQ ID NO: 81959 - protein, 14 aa, Borrelia burgdorferi
FTKEDTITVQKYDS

SEQ ID NO: 81960 - protein, 14 aa, Borrelia burgdorferi
TKEDTITVQKYDSA

SEQ ID NO: 81961 - protein, 14 aa, Borrelia burgdorferi
KEDTITVQKYDSAG

SEQ ID NO: 81962 - protein, 14 aa, Borrelia burgdorferi
EDTITVQKYDSAGT

SEQ ID NO: 81963 - protein, 14 aa, Borrelia burgdorferi
DTITVQKYDSAGTN

SEQ ID NO: 81964 - protein, 14 aa, Borrelia burgdorferi
TITVQKYDSAGTNL

SEQ ID NO: 81965 - protein, 14 aa, Borrelia burgdorferi
ITVQKYDSAGTNLE

SEQ ID NO: 81966 - protein, 14 aa, Borrelia burgdorferi
TVQKYDSAGTNLEG

SEQ ID NO: 81967 - protein, 14 aa, Borrelia burgdorferi
VQKYDSAGTNLEGK

SEQ ID NO: 81968 - protein, 14 aa, Borrelia burgdorferi
QKYDSAGTNLEGKA

SEQ ID NO: 81969 - protein, 14 aa, Borrelia burgdorferi
KYDSAGTNLEGKAV

SEQ ID NO: 81970 - protein, 14 aa, Borrelia burgdorferi
YDSAGTNLEGKAVE

SEQ ID NO: 81971 - protein, 14 aa, Borrelia burgdorferi
DSAGTNLEGKAVEI

SEQ ID NO: 81972 - protein, 14 aa, Borrelia burgdorferi
SAGTNLEGKAVEIT

SEQ ID NO: 81973 - protein, 14 aa, Borrelia burgdorferi
AGTNLEGKAVEITT

SEQ ID NO: 81974 - protein, 14 aa, Borrelia burgdorferi
GTNLEGKAVEITTL

SEQ ID NO: 81975 - protein, 14 aa, Borrelia burgdorferi
TNLEGKAVEITTLK

SEQ ID NO: 81976 - protein, 14 aa, Borrelia burgdorferi
NLEGKAVEITTLKE

SEQ ID NO: 81977 - protein, 14 aa, Borrelia burgdorferi
LEGKAVEITTLKEL

SEQ ID NO: 81978 - protein, 14 aa, Borrelia burgdorferi
EGKAVEITTLKELK

SEQ ID NO: 81979 - protein, 14 aa, Borrelia burgdorferi
GKAVEITTLKELKN

SEQ ID NO: 81980 - protein, 14 aa, Borrelia burgdorferi
KAVEITTLKELKNA

SEQ ID NO: 81981 - protein, 14 aa, Borrelia burgdorferi
AVEITTLKELKNAL

SEQ ID NO: 81982 - protein, 14 aa, Borrelia burgdorferi
VEITTLKELKNALK

SEQ ID NO: 81983 - protein, 15 aa, Borrelia burgdorferi
MKKYLLGIGLILALI

SEQ ID NO: 81984 - protein, 15 aa, Borrelia burgdorferi
KKYLLGIGLILALIA

SEQ ID NO: 81985 - protein, 15 aa, Borrelia burgdorferi
KYLLGIGLILALIAC

SEQ ID NO: 81986 - protein, 15 aa, Borrelia burgdorferi
YLLGIGLILALIACK

SEQ ID NO: 81987 - protein, 15 aa, Borrelia burgdorferi
LLGIGLILALIACKQ

SEQ ID NO: 81988 - protein, 15 aa, Borrelia burgdorferi
LGIGLILALIACKQN

SEQ ID NO: 81989 - protein, 15 aa, Borrelia burgdorferi
GIGLILALIACKQNV

SEQ ID NO: 81990 - protein, 15 aa, Borrelia burgdorferi
IGLILALIACKQNVS

SEQ ID NO: 81991 - protein, 15 aa, Borrelia burgdorferi
GLILALIACKQNVST

SEQ ID NO: 81992 - protein, 15 aa, Borrelia burgdorferi
LILALIACKQNVSTL

SEQ ID NO: 81993 - protein, 15 aa, Borrelia burgdorferi
ILALIACKQNVSTLD

SEQ ID NO: 81994 - protein, 15 aa, Borrelia burgdorferi
LALIACKQNVSTLDE

SEQ ID NO: 81995 - protein, 15 aa, Borrelia burgdorferi
ALIACKQNVSTLDEK

SEQ ID NO: 81996 - protein, 15 aa, Borrelia burgdorferi
LIACKQNVSTLDEKN

SEQ ID NO: 81997 - protein, 15 aa, Borrelia burgdorferi
IACKQNVSTLDEKNS

SEQ ID NO: 81998 - protein, 15 aa, Borrelia burgdorferi
ACKQNVSTLDEKNSV

SEQ ID NO: 81999 - protein, 15 aa, Borrelia burgdorferi
CKQNVSTLDEKNSVS

SEQ ID NO: 82000 - protein, 15 aa, Borrelia burgdorferi
KQNVSTLDEKNSVSV

SEQ ID NO: 82001 - protein, 15 aa, Borrelia burgdorferi
QNVSTLDEKNSVSVD

SEQ ID NO: 82002 - protein, 15 aa, Borrelia burgdorferi
NVSTLDEKNSVSVDL

SEQ ID NO: 82003 - protein, 15 aa, Borrelia burgdorferi
VSTLDEKNSVSVDLP

SEQ ID NO: 82004 - protein, 15 aa, Borrelia burgdorferi
STLDEKNSVSVDLPG

SEQ ID NO: 82005 - protein, 15 aa, Borrelia burgdorferi
TLDEKNSVSVDLPGG

SEQ ID NO: 82006 - protein, 15 aa, Borrelia burgdorferi
LDEKNSVSVDLPGGM

SEQ ID NO: 82007 - protein, 15 aa, Borrelia burgdorferi
DEKNSVSVDLPGGMT

SEQ ID NO: 82008 - protein, 15 aa, Borrelia burgdorferi
EKNSVSVDLPGGMTE

SEQ ID NO: 82009 - protein, 15 aa, Borrelia burgdorferi
KNSVSVDLPGGMTEL

SEQ ID NO: 82010 - protein, 15 aa, Borrelia burgdorferi
NSVSVDLPGGMTELV

SEQ ID NO: 82011 - protein, 15 aa, Borrelia burgdorferi
SVSVDLPGGMTELVS

SEQ ID NO: 82012 - protein, 15 aa, Borrelia burgdorferi
VSVDLPGGMTELVSK

SEQ ID NO: 82013 - protein, 15 aa, Borrelia burgdorferi
SVDLPGGMTELVSKE

SEQ ID NO: 82014 - protein, 15 aa, Borrelia burgdorferi
VDLPGGMTELVSKEK

SEQ ID NO: 82015 - protein, 15 aa, Borrelia burgdorferi
DLPGGMTELVSKEKD

SEQ ID NO: 82016 - protein, 15 aa, Borrelia burgdorferi
LPGGMTELVSKEKDK

SEQ ID NO: 82017 - protein, 15 aa, Borrelia burgdorferi
PGGMTELVSKEKDKD

SEQ ID NO: 82018 - protein, 15 aa, Borrelia burgdorferi
GGMTELVSKEKDKDG

SEQ ID NO: 82019 - protein, 15 aa, Borrelia burgdorferi
GMTELVSKEKDKDGK

SEQ ID NO: 82020 - protein, 15 aa, Borrelia burgdorferi
MTELVSKEKDKDGKY

SEQ ID NO: 82021 - protein, 15 aa, Borrelia burgdorferi
TELVSKEKDKDGKYS

SEQ ID NO: 82022 - protein, 15 aa, Borrelia burgdorferi
ELVSKEKDKDGKYSL

SEQ ID NO: 82023 - protein, 15 aa, Borrelia burgdorferi
LVSKEKDKDGKYSLE

SEQ ID NO: 82024 - protein, 15 aa, Borrelia burgdorferi
VSKEKDKDGKYSLEA

SEQ ID NO: 82025 - protein, 15 aa, Borrelia burgdorferi
SKEKDKDGKYSLEAT

SEQ ID NO: 82026 - protein, 15 aa, Borrelia burgdorferi
KEKDKDGKYSLEATV

SEQ ID NO: 82027 - protein, 15 aa, Borrelia burgdorferi
EKDKDGKYSLEATVD

SEQ ID NO: 82028 - protein, 15 aa, Borrelia burgdorferi
KDKDGKYSLEATVDK

SEQ ID NO: 82029 - protein, 15 aa, Borrelia burgdorferi
DKDGKYSLEATVDKL

SEQ ID NO: 82030 - protein, 15 aa, Borrelia burgdorferi
KDGKYSLEATVDKLE

SEQ ID NO: 82031 - protein, 15 aa, Borrelia burgdorferi
DGKYSLEATVDKLEL

SEQ ID NO: 82032 - protein, 15 aa, Borrelia burgdorferi
GKYSLEATVDKLELK

SEQ ID NO: 82033 - protein, 15 aa, Borrelia burgdorferi
KYSLEATVDKLELKG

SEQ ID NO: 82034 - protein, 15 aa, Borrelia burgdorferi
YSLEATVDKLELKGT

SEQ ID NO: 82035 - protein, 15 aa, Borrelia burgdorferi
SLEATVDKLELKGTS

SEQ ID NO: 82036 - protein, 15 aa, Borrelia burgdorferi
LEATVDKLELKGTSD

SEQ ID NO: 82037 - protein, 15 aa, Borrelia burgdorferi
EATVDKLELKGTSDK

SEQ ID NO: 82038 - protein, 15 aa, Borrelia burgdorferi
ATVDKLELKGTSDKN

SEQ ID NO: 82039 - protein, 15 aa, Borrelia burgdorferi
TVDKLELKGTSDKNN

SEQ ID NO: 82040 - protein, 15 aa, Borrelia burgdorferi
VDKLELKGTSDKNNG

SEQ ID NO: 82041 - protein, 15 aa, Borrelia burgdorferi
DKLELKGTSDKNNGS

SEQ ID NO: 82042 - protein, 15 aa, Borrelia burgdorferi
KLELKGTSDKNNGSG

SEQ ID NO: 82043 - protein, 15 aa, Borrelia burgdorferi
LELKGTSDKNNGSGT

SEQ ID NO: 82044 - protein, 15 aa, Borrelia burgdorferi
ELKGTSDKNNGSGTL

SEQ ID NO: 82045 - protein, 15 aa, Borrelia burgdorferi
LKGTSDKNNGSGTLE

SEQ ID NO: 82046 - protein, 15 aa, Borrelia burgdorferi
KGTSDKNNGSGTLEG

SEQ ID NO: 82047 - protein, 15 aa, Borrelia burgdorferi
GTSDKNNGSGTLEGE

SEQ ID NO: 82048 - protein, 15 aa, Borrelia burgdorferi
TSDKNNGSGTLEGEK

SEQ ID NO: 82049 - protein, 15 aa, Borrelia burgdorferi
SDKNNGSGTLEGEKT

SEQ ID NO: 82050 - protein, 15 aa, Borrelia burgdorferi
DKNNGSGTLEGEKTD

SEQ ID NO: 82051 - protein, 15 aa, Borrelia burgdorferi
KNNGSGTLEGEKTDK

SEQ ID NO: 82052 - protein, 15 aa, Borrelia burgdorferi
NNGSGTLEGEKTDKS

SEQ ID NO: 82053 - protein, 15 aa, Borrelia burgdorferi
NGSGTLEGEKTDKSK

SEQ ID NO: 82054 - protein, 15 aa, Borrelia burgdorferi
GSGTLEGEKTDKSKV

SEQ ID NO: 82055 - protein, 15 aa, Borrelia burgdorferi
SGTLEGEKTDKSKVK

SEQ ID NO: 82056 - protein, 15 aa, Borrelia burgdorferi
GTLEGEKTDKSKVKL

SEQ ID NO: 82057 - protein, 15 aa, Borrelia burgdorferi
TLEGEKTDKSKVKLT

SEQ ID NO: 82058 - protein, 15 aa, Borrelia burgdorferi
LEGEKTDKSKVKLTI

SEQ ID NO: 82059 - protein, 15 aa, Borrelia burgdorferi
EGEKTDKSKVKLTIA

SEQ ID NO: 82060 - protein, 15 aa, Borrelia burgdorferi
GEKTDKSKVKLTIAD

SEQ ID NO: 82061 - protein, 15 aa, Borrelia burgdorferi
EKTDKSKVKLTIADD

SEQ ID NO: 82062 - protein, 15 aa, Borrelia burgdorferi
KTDKSKVKLTIADDL

SEQ ID NO: 82063 - protein, 15 aa, Borrelia burgdorferi
TDKSKVKLTIADDLS

SEQ ID NO: 82064 - protein, 15 aa, Borrelia burgdorferi
DKSKVKLTIADDLSQ

SEQ ID NO: 82065 - protein, 15 aa, Borrelia burgdorferi
KSKVKLTIADDLSQT

SEQ ID NO: 82066 - protein, 15 aa, Borrelia burgdorferi
SKVKLTIADDLSQTK

SEQ ID NO: 82067 - protein, 15 aa, Borrelia burgdorferi
KVKLTIADDLSQTKF

SEQ ID NO: 82068 - protein, 15 aa, Borrelia burgdorferi
VKLTIADDLSQTKFE

SEQ ID NO: 82069 - protein, 15 aa, Borrelia burgdorferi
KLTIADDLSQTKFEI

SEQ ID NO: 82070 - protein, 15 aa, Borrelia burgdorferi
LTIADDLSQTKFEIF

SEQ ID NO: 82071 - protein, 15 aa, Borrelia burgdorferi
TIADDLSQTKFEIFK

SEQ ID NO: 82072 - protein, 15 aa, Borrelia burgdorferi
IADDLSQTKFEIFKE

SEQ ID NO: 82073 - protein, 15 aa, Borrelia burgdorferi
ADDLSQTKFEIFKED

SEQ ID NO: 82074 - protein, 15 aa, Borrelia burgdorferi
DDLSQTKFEIFKEDA

SEQ ID NO: 82075 - protein, 15 aa, Borrelia burgdorferi
DLSQTKFEIFKEDAK

SEQ ID NO: 82076 - protein, 15 aa, Borrelia burgdorferi
LSQTKFEIFKEDAKT

SEQ ID NO: 82077 - protein, 15 aa, Borrelia burgdorferi
SQTKFEIFKEDAKTL

SEQ ID NO: 82078 - protein, 15 aa, Borrelia burgdorferi
QTKFEIFKEDAKTLV

SEQ ID NO: 82079 - protein, 15 aa, Borrelia burgdorferi
TKFEIFKEDAKTLVS

SEQ ID NO: 82080 - protein, 15 aa, Borrelia burgdorferi
KFEIFKEDAKTLVSK

SEQ ID NO: 82081 - protein, 15 aa, Borrelia burgdorferi
FEIFKEDAKTLVSKK

SEQ ID NO: 82082 - protein, 15 aa, Borrelia burgdorferi
EIFKEDAKTLVSKKV

SEQ ID NO: 82083 - protein, 15 aa, Borrelia burgdorferi
IFKEDAKTLVSKKVT

SEQ ID NO: 82084 - protein, 15 aa, Borrelia burgdorferi
FKEDAKTLVSKKVTL

SEQ ID NO: 82085 - protein, 15 aa, Borrelia burgdorferi
KEDAKTLVSKKVTLK

SEQ ID NO: 82086 - protein, 15 aa, Borrelia burgdorferi
EDAKTLVSKKVTLKD

SEQ ID NO: 82087 - protein, 15 aa, Borrelia burgdorferi
DAKTLVSKKVTLKDK

SEQ ID NO: 82088 - protein, 15 aa, Borrelia burgdorferi
AKTLVSKKVTLKDKS

SEQ ID NO: 82089 - protein, 15 aa, Borrelia burgdorferi
KTLVSKKVTLKDKSS

SEQ ID NO: 82090 - protein, 15 aa, Borrelia burgdorferi
TLVSKKVTLKDKSST

SEQ ID NO: 82091 - protein, 15 aa, Borrelia burgdorferi
LVSKKVTLKDKSSTE

SEQ ID NO: 82092 - protein, 15 aa, Borrelia burgdorferi
VSKKVTLKDKSSTEE

SEQ ID NO: 82093 - protein, 15 aa, Borrelia burgdorferi
SKKVTLKDKSSTEEK

SEQ ID NO: 82094 - protein, 15 aa, Borrelia burgdorferi
KKVTLKDKSSTEEKF

SEQ ID NO: 82095 - protein, 15 aa, Borrelia burgdorferi
KVTLKDKSSTEEKFN

SEQ ID NO: 82096 - protein, 15 aa, Borrelia burgdorferi
VTLKDKSSTEEKFNE

SEQ ID NO: 82097 - protein, 15 aa, Borrelia burgdorferi
TLKDKSSTEEKFNEK

SEQ ID NO: 82098 - protein, 15 aa, Borrelia burgdorferi
LKDKSSTEEKFNEKG

SEQ ID NO: 82099 - protein, 15 aa, Borrelia burgdorferi
KDKSSTEEKFNEKGE

SEQ ID NO: 82100 - protein, 15 aa, Borrelia burgdorferi
DKSSTEEKFNEKGET

SEQ ID NO: 82101 - protein, 15 aa, Borrelia burgdorferi
KSSTEEKFNEKGETS

SEQ ID NO: 82102 - protein, 15 aa, Borrelia burgdorferi
SSTEEKFNEKGETSE

SEQ ID NO: 82103 - protein, 15 aa, Borrelia burgdorferi
STEEKFNEKGETSEK

SEQ ID NO: 82104 - protein, 15 aa, Borrelia burgdorferi
TEEKFNEKGETSEKT

SEQ ID NO: 82105 - protein, 15 aa, Borrelia burgdorferi
EEKFNEKGETSEKTI

SEQ ID NO: 82106 - protein, 15 aa, Borrelia burgdorferi
EKFNEKGETSEKTIV

SEQ ID NO: 82107 - protein, 15 aa, Borrelia burgdorferi
KFNEKGETSEKTIVR

SEQ ID NO: 82108 - protein, 15 aa, Borrelia burgdorferi
FNEKGETSEKTIVRA

SEQ ID NO: 82109 - protein, 15 aa, Borrelia burgdorferi
NEKGETSEKTIVRAN

SEQ ID NO: 82110 - protein, 15 aa, Borrelia burgdorferi
EKGETSEKTIVRANG

SEQ ID NO: 82111 - protein, 15 aa, Borrelia burgdorferi
KGETSEKTIVRANGT

SEQ ID NO: 82112 - protein, 15 aa, Borrelia burgdorferi
GETSEKTIVRANGTR

SEQ ID NO: 82113 - protein, 15 aa, Borrelia burgdorferi
ETSEKTIVRANGTRL

SEQ ID NO: 82114 - protein, 15 aa, Borrelia burgdorferi
TSEKTIVRANGTRLE

SEQ ID NO: 82115 - protein, 15 aa, Borrelia burgdorferi
SEKTIVRANGTRLEY

SEQ ID NO: 82116 - protein, 15 aa, Borrelia burgdorferi
EKTIVRANGTRLEYT

SEQ ID NO: 82117 - protein, 15 aa, Borrelia burgdorferi
KTIVRANGTRLEYTD

SEQ ID NO: 82118 - protein, 15 aa, Borrelia burgdorferi
TIVRANGTRLEYTDI

SEQ ID NO: 82119 - protein, 15 aa, Borrelia burgdorferi
IVRANGTRLEYTDIK

SEQ ID NO: 82120 - protein, 15 aa, Borrelia burgdorferi
VRANGTRLEYTDIKS

SEQ ID NO: 82121 - protein, 15 aa, Borrelia burgdorferi
RANGTRLEYTDIKSD

SEQ ID NO: 82122 - protein, 15 aa, Borrelia burgdorferi
ANGTRLEYTDIKSDG

SEQ ID NO: 82123 - protein, 15 aa, Borrelia burgdorferi
NGTRLEYTDIKSDGS

SEQ ID NO: 82124 - protein, 15 aa, Borrelia burgdorferi
GTRLEYTDIKSDGSG

SEQ ID NO: 82125 - protein, 15 aa, Borrelia burgdorferi
TRLEYTDIKSDGSGK

SEQ ID NO: 82126 - protein, 15 aa, Borrelia burgdorferi
RLEYTDIKSDGSGKA

SEQ ID NO: 82127 - protein, 15 aa, Borrelia burgdorferi
LEYTDIKSDGSGKAK

SEQ ID NO: 82128 - protein, 15 aa, Borrelia burgdorferi
EYTDIKSDGSGKAKE

SEQ ID NO: 82129 - protein, 15 aa, Borrelia burgdorferi
YTDIKSDGSGKAKEV

SEQ ID NO: 82130 - protein, 15 aa, Borrelia burgdorferi
TDIKSDGSGKAKEVL

SEQ ID NO: 82131 - protein, 15 aa, Borrelia burgdorferi
DIKSDGSGKAKEVLK

SEQ ID NO: 82132 - protein, 15 aa, Borrelia burgdorferi
IKSDGSGKAKEVLKD

SEQ ID NO: 82133 - protein, 15 aa, Borrelia burgdorferi
KSDGSGKAKEVLKDF

SEQ ID NO: 82134 - protein, 15 aa, Borrelia burgdorferi
SDGSGKAKEVLKDFT

SEQ ID NO: 82135 - protein, 15 aa, Borrelia burgdorferi
DGSGKAKEVLKDFTL

SEQ ID NO: 82136 - protein, 15 aa, Borrelia burgdorferi
GSGKAKEVLKDFTLE

SEQ ID NO: 82137 - protein, 15 aa, Borrelia burgdorferi
SGKAKEVLKDFTLEG

SEQ ID NO: 82138 - protein, 15 aa, Borrelia burgdorferi
GKAKEVLKDFTLEGT

SEQ ID NO: 82139 - protein, 15 aa, Borrelia burgdorferi
KAKEVLKDFTLEGTL

SEQ ID NO: 82140 - protein, 15 aa, Borrelia burgdorferi
AKEVLKDFTLEGTLA

SEQ ID NO: 82141 - protein, 15 aa, Borrelia burgdorferi
KEVLKDFTLEGTLAA

SEQ ID NO: 82142 - protein, 15 aa, Borrelia burgdorferi
EVLKDFTLEGTLAAD

SEQ ID NO: 82143 - protein, 15 aa, Borrelia burgdorferi
VLKDFTLEGTLAADG

SEQ ID NO: 82144 - protein, 15 aa, Borrelia burgdorferi
LKDFTLEGTLAADGK

SEQ ID NO: 82145 - protein, 15 aa, Borrelia burgdorferi
KDFTLEGTLAADGKT

SEQ ID NO: 82146 - protein, 15 aa, Borrelia burgdorferi
DFTLEGTLAADGKTT

SEQ ID NO: 82147 - protein, 15 aa, Borrelia burgdorferi
FTLEGTLAADGKTTL

SEQ ID NO: 82148 - protein, 15 aa, Borrelia burgdorferi
TLEGTLAADGKTTLK

SEQ ID NO: 82149 - protein, 15 aa, Borrelia burgdorferi
LEGTLAADGKTTLKV

SEQ ID NO: 82150 - protein, 15 aa, Borrelia burgdorferi
EGTLAADGKTTLKVT

SEQ ID NO: 82151 - protein, 15 aa, Borrelia burgdorferi
GTLAADGKTTLKVTE

SEQ ID NO: 82152 - protein, 15 aa, Borrelia burgdorferi
TLAADGKTTLKVTEG

SEQ ID NO: 82153 - protein, 15 aa, Borrelia burgdorferi
LAADGKTTLKVTEGT

SEQ ID NO: 82154 - protein, 15 aa, Borrelia burgdorferi
AADGKTTLKVTEGTV

SEQ ID NO: 82155 - protein, 15 aa, Borrelia burgdorferi
ADGKTTLKVTEGTVV

SEQ ID NO: 82156 - protein, 15 aa, Borrelia burgdorferi
DGKTTLKVTEGTVVL

SEQ ID NO: 82157 - protein, 15 aa, Borrelia burgdorferi
GKTTLKVTEGTVVLS

SEQ ID NO: 82158 - protein, 15 aa, Borrelia burgdorferi
KTTLKVTEGTVVLSK

SEQ ID NO: 82159 - protein, 15 aa, Borrelia burgdorferi
TTLKVTEGTVVLSKN

SEQ ID NO: 82160 - protein, 15 aa, Borrelia burgdorferi
TLKVTEGTVVLSKNI

SEQ ID NO: 82161 - protein, 15 aa, Borrelia burgdorferi
LKVTEGTVVLSKNIL

SEQ ID NO: 82162 - protein, 15 aa, Borrelia burgdorferi
KVTEGTVVLSKNILK

SEQ ID NO: 82163 - protein, 15 aa, Borrelia burgdorferi
VTEGTVVLSKNILKS

SEQ ID NO: 82164 - protein, 15 aa, Borrelia burgdorferi
TEGTVVLSKNILKSG

SEQ ID NO: 82165 - protein, 15 aa, Borrelia burgdorferi
EGTVVLSKNILKSGE

SEQ ID NO: 82166 - protein, 15 aa, Borrelia burgdorferi
GTVVLSKNILKSGEI

SEQ ID NO: 82167 - protein, 15 aa, Borrelia burgdorferi
TVVLSKNILKSGEIT

SEQ ID NO: 82168 - protein, 15 aa, Borrelia burgdorferi
VVLSKNILKSGEITV

SEQ ID NO: 82169 - protein, 15 aa, Borrelia burgdorferi
VLSKNILKSGEITVA

SEQ ID NO: 82170 - protein, 15 aa, Borrelia burgdorferi
LSKNILKSGEITVAL

SEQ ID NO: 82171 - protein, 15 aa, Borrelia burgdorferi
SKNILKSGEITVALD

SEQ ID NO: 82172 - protein, 15 aa, Borrelia burgdorferi
KNILKSGEITVALDD

SEQ ID NO: 82173 - protein, 15 aa, Borrelia burgdorferi
NILKSGEITVALDDS

SEQ ID NO: 82174 - protein, 15 aa, Borrelia burgdorferi
ILKSGEITVALDDSD

SEQ ID NO: 82175 - protein, 15 aa, Borrelia burgdorferi
LKSGEITVALDDSDT

SEQ ID NO: 82176 - protein, 15 aa, Borrelia burgdorferi
KSGEITVALDDSDTT

SEQ ID NO: 82177 - protein, 15 aa, Borrelia burgdorferi
SGEITVALDDSDTTQ

SEQ ID NO: 82178 - protein, 15 aa, Borrelia burgdorferi
GEITVALDDSDTTQA

SEQ ID NO: 82179 - protein, 15 aa, Borrelia burgdorferi
EITVALDDSDTTQAT

SEQ ID NO: 82180 - protein, 15 aa, Borrelia burgdorferi
ITVALDDSDTTQATK

SEQ ID NO: 82181 - protein, 15 aa, Borrelia burgdorferi
TVALDDSDTTQATKK

SEQ ID NO: 82182 - protein, 15 aa, Borrelia burgdorferi
VALDDSDTTQATKKT

SEQ ID NO: 82183 - protein, 15 aa, Borrelia burgdorferi
ALDDSDTTQATKKTG

SEQ ID NO: 82184 - protein, 15 aa, Borrelia burgdorferi
LDDSDTTQATKKTGK

SEQ ID NO: 82185 - protein, 15 aa, Borrelia burgdorferi
DDSDTTQATKKTGKW

SEQ ID NO: 82186 - protein, 15 aa, Borrelia burgdorferi
DSDTTQATKKTGKWD

SEQ ID NO: 82187 - protein, 15 aa, Borrelia burgdorferi
SDTTQATKKTGKWDS

SEQ ID NO: 82188 - protein, 15 aa, Borrelia burgdorferi
DTTQATKKTGKWDSK

SEQ ID NO: 82189 - protein, 15 aa, Borrelia burgdorferi
TTQATKKTGKWDSKT

SEQ ID NO: 82190 - protein, 15 aa, Borrelia burgdorferi
TQATKKTGKWDSKTS

SEQ ID NO: 82191 - protein, 15 aa, Borrelia burgdorferi
QATKKTGKWDSKTST

SEQ ID NO: 82192 - protein, 15 aa, Borrelia burgdorferi
ATKKTGKWDSKTSTL

SEQ ID NO: 82193 - protein, 15 aa, Borrelia burgdorferi
TKKTGKWDSKTSTLT

SEQ ID NO: 82194 - protein, 15 aa, Borrelia burgdorferi
KKTGKWDSKTSTLTI

SEQ ID NO: 82195 - protein, 15 aa, Borrelia burgdorferi
KTGKWDSKTSTLTIS

SEQ ID NO: 82196 - protein, 15 aa, Borrelia burgdorferi
TGKWDSKTSTLTISV

SEQ ID NO: 82197 - protein, 15 aa, Borrelia burgdorferi
GKWDSKTSTLTISVN

SEQ ID NO: 82198 - protein, 15 aa, Borrelia burgdorferi
KWDSKTSTLTISVNS

SEQ ID NO: 82199 - protein, 15 aa, Borrelia burgdorferi
WDSKTSTLTISVNSQ

SEQ ID NO: 82200 - protein, 15 aa, Borrelia burgdorferi
DSKTSTLTISVNSQK

SEQ ID NO: 82201 - protein, 15 aa, Borrelia burgdorferi
SKTSTLTISVNSQKT

SEQ ID NO: 82202 - protein, 15 aa, Borrelia burgdorferi
KTSTLTISVNSQKTK

SEQ ID NO: 82203 - protein, 15 aa, Borrelia burgdorferi
TSTLTISVNSQKTKN

SEQ ID NO: 82204 - protein, 15 aa, Borrelia burgdorferi
STLTISVNSQKTKNL

SEQ ID NO: 82205 - protein, 15 aa, Borrelia burgdorferi
TLTISVNSQKTKNLV

SEQ ID NO: 82206 - protein, 15 aa, Borrelia burgdorferi
LTISVNSQKTKNLVF

SEQ ID NO: 82207 - protein, 15 aa, Borrelia burgdorferi
TISVNSQKTKNLVFT

SEQ ID NO: 82208 - protein, 15 aa, Borrelia burgdorferi
ISVNSQKTKNLVFTK

SEQ ID NO: 82209 - protein, 15 aa, Borrelia burgdorferi
SVNSQKTKNLVFTKE

SEQ ID NO: 82210 - protein, 15 aa, Borrelia burgdorferi
VNSQKTKNLVFTKED

SEQ ID NO: 82211 - protein, 15 aa, Borrelia burgdorferi
NSQKTKNLVFTKEDT

SEQ ID NO: 82212 - protein, 15 aa, Borrelia burgdorferi
SQKTKNLVFTKEDTI

SEQ ID NO: 82213 - protein, 15 aa, Borrelia burgdorferi
QKTKNLVFTKEDTIT

SEQ ID NO: 82214 - protein, 15 aa, Borrelia burgdorferi
KTKNLVFTKEDTITV

SEQ ID NO: 82215 - protein, 15 aa, Borrelia burgdorferi
TKNLVFTKEDTITVQ

SEQ ID NO: 82216 - protein, 15 aa, Borrelia burgdorferi
KNLVFTKEDTITVQK

SEQ ID NO: 82217 - protein, 15 aa, Borrelia burgdorferi
NLVFTKEDTITVQKY

SEQ ID NO: 82218 - protein, 15 aa, Borrelia burgdorferi
LVFTKEDTITVQKYD

SEQ ID NO: 82219 - protein, 15 aa, Borrelia burgdorferi
VFTKEDTITVQKYDS

SEQ ID NO: 82220 - protein, 15 aa, Borrelia burgdorferi
FTKEDTITVQKYDSA

SEQ ID NO: 82221 - protein, 15 aa, Borrelia burgdorferi
TKEDTITVQKYDSAG

SEQ ID NO: 82222 - protein, 15 aa, Borrelia burgdorferi
KEDTITVQKYDSAGT

SEQ ID NO: 82223 - protein, 15 aa, Borrelia burgdorferi
EDTITVQKYDSAGTN

SEQ ID NO: 82224 - protein, 15 aa, Borrelia burgdorferi
DTITVQKYDSAGTNL

SEQ ID NO: 82225 - protein, 15 aa, Borrelia burgdorferi
TITVQKYDSAGTNLE

SEQ ID NO: 82226 - protein, 15 aa, Borrelia burgdorferi
ITVQKYDSAGTNLEG

SEQ ID NO: 82227 - protein, 15 aa, Borrelia burgdorferi
TVQKYDSAGTNLEGK

SEQ ID NO: 82228 - protein, 15 aa, Borrelia burgdorferi
VQKYDSAGTNLEGKA

SEQ ID NO: 82229 - protein, 15 aa, Borrelia burgdorferi
QKYDSAGTNLEGKAV

SEQ ID NO: 82230 - protein, 15 aa, Borrelia burgdorferi
KYDSAGTNLEGKAVE

SEQ ID NO: 82231 - protein, 15 aa, Borrelia burgdorferi
YDSAGTNLEGKAVEI

SEQ ID NO: 82232 - protein, 15 aa, Borrelia burgdorferi
DSAGTNLEGKAVEIT

SEQ ID NO: 82233 - protein, 15 aa, Borrelia burgdorferi
SAGTNLEGKAVEITT

SEQ ID NO: 82234 - protein, 15 aa, Borrelia burgdorferi
AGTNLEGKAVEITTL

SEQ ID NO: 82235 - protein, 15 aa, Borrelia burgdorferi
GTNLEGKAVEITTLK

SEQ ID NO: 82236 - protein, 15 aa, Borrelia burgdorferi
TNLEGKAVEITTLKE

SEQ ID NO: 82237 - protein, 15 aa, Borrelia burgdorferi
NLEGKAVEITTLKEL

SEQ ID NO: 82238 - protein, 15 aa, Borrelia burgdorferi
LEGKAVEITTLKELK

SEQ ID NO: 82239 - protein, 15 aa, Borrelia burgdorferi
EGKAVEITTLKELKN

SEQ ID NO: 82240 - protein, 15 aa, Borrelia burgdorferi
GKAVEITTLKELKNA

SEQ ID NO: 82241 - protein, 15 aa, Borrelia burgdorferi
KAVEITTLKELKNAL

SEQ ID NO: 82242 - protein, 15 aa, Borrelia burgdorferi
AVEITTLKELKNALK

SEQ ID NO: 82243 - protein, 16 aa, Borrelia burgdorferi
MKKYLLGIGLILALIA

SEQ ID NO: 82244 - protein, 16 aa, Borrelia burgdorferi
KKYLLGIGLILALIAC

SEQ ID NO: 82245 - protein, 16 aa, Borrelia burgdorferi
KYLLGIGLILALIACK

SEQ ID NO: 82246 - protein, 16 aa, Borrelia burgdorferi
YLLGIGLILALIACKQ

SEQ ID NO: 82247 - protein, 16 aa, Borrelia burgdorferi
LLGIGLILALIACKQN

SEQ ID NO: 82248 - protein, 16 aa, Borrelia burgdorferi
LGIGLILALIACKQNV

SEQ ID NO: 82249 - protein, 16 aa, Borrelia burgdorferi
GIGLILALIACKQNVS

SEQ ID NO: 82250 - protein, 16 aa, Borrelia burgdorferi
IGLILALIACKQNVST

SEQ ID NO: 82251 - protein, 16 aa, Borrelia burgdorferi
GLILALIACKQNVSTL

SEQ ID NO: 82252 - protein, 16 aa, Borrelia burgdorferi
LILALIACKQNVSTLD

SEQ ID NO: 82253 - protein, 16 aa, Borrelia burgdorferi
ILALIACKQNVSTLDE

SEQ ID NO: 82254 - protein, 16 aa, Borrelia burgdorferi
LALIACKQNVSTLDEK

SEQ ID NO: 82255 - protein, 16 aa, Borrelia burgdorferi
ALIACKQNVSTLDEKN

SEQ ID NO: 82256 - protein, 16 aa, Borrelia burgdorferi
LIACKQNVSTLDEKNS

SEQ ID NO: 82257 - protein, 16 aa, Borrelia burgdorferi
IACKQNVSTLDEKNSV

SEQ ID NO: 82258 - protein, 16 aa, Borrelia burgdorferi
ACKQNVSTLDEKNSVS

SEQ ID NO: 82259 - protein, 16 aa, Borrelia burgdorferi
CKQNVSTLDEKNSVSV

SEQ ID NO: 82260 - protein, 16 aa, Borrelia burgdorferi
KQNVSTLDEKNSVSVD

SEQ ID NO: 82261 - protein, 16 aa, Borrelia burgdorferi
QNVSTLDEKNSVSVDL

SEQ ID NO: 82262 - protein, 16 aa, Borrelia burgdorferi
NVSTLDEKNSVSVDLP

SEQ ID NO: 82263 - protein, 16 aa, Borrelia burgdorferi
VSTLDEKNSVSVDLPG

SEQ ID NO: 82264 - protein, 16 aa, Borrelia burgdorferi
STLDEKNSVSVDLPGG

SEQ ID NO: 82265 - protein, 16 aa, Borrelia burgdorferi
TLDEKNSVSVDLPGGM

SEQ ID NO: 82266 - protein, 16 aa, Borrelia burgdorferi
LDEKNSVSVDLPGGMT

SEQ ID NO: 82267 - protein, 16 aa, Borrelia burgdorferi
DEKNSVSVDLPGGMTE

SEQ ID NO: 82268 - protein, 16 aa, Borrelia burgdorferi
EKNSVSVDLPGGMTEL

SEQ ID NO: 82269 - protein, 16 aa, Borrelia burgdorferi
KNSVSVDLPGGMTELV

SEQ ID NO: 82270 - protein, 16 aa, Borrelia burgdorferi
NSVSVDLPGGMTELVS

SEQ ID NO: 82271 - protein, 16 aa, Borrelia burgdorferi
SVSVDLPGGMTELVSK

SEQ ID NO: 82272 - protein, 16 aa, Borrelia burgdorferi
VSVDLPGGMTELVSKE

SEQ ID NO: 82273 - protein, 16 aa, Borrelia burgdorferi
SVDLPGGMTELVSKEK

SEQ ID NO: 82274 - protein, 16 aa, Borrelia burgdorferi
VDLPGGMTELVSKEKD

SEQ ID NO: 82275 - protein, 16 aa, Borrelia burgdorferi
DLPGGMTELVSKEKDK

SEQ ID NO: 82276 - protein, 16 aa, Borrelia burgdorferi
LPGGMTELVSKEKDKD

SEQ ID NO: 82277 - protein, 16 aa, Borrelia burgdorferi
PGGMTELVSKEKDKDG

SEQ ID NO: 82278 - protein, 16 aa, Borrelia burgdorferi
GGMTELVSKEKDKDGK

SEQ ID NO: 82279 - protein, 16 aa, Borrelia burgdorferi
GMTELVSKEKDKDGKY

SEQ ID NO: 82280 - protein, 16 aa, Borrelia burgdorferi
MTELVSKEKDKDGKYS

SEQ ID NO: 82281 - protein, 16 aa, Borrelia burgdorferi
TELVSKEKDKDGKYSL

SEQ ID NO: 82282 - protein, 16 aa, Borrelia burgdorferi
ELVSKEKDKDGKYSLE

SEQ ID NO: 82283 - protein, 16 aa, Borrelia burgdorferi
LVSKEKDKDGKYSLEA

SEQ ID NO: 82284 - protein, 16 aa, Borrelia burgdorferi
VSKEKDKDGKYSLEAT

SEQ ID NO: 82285 - protein, 16 aa, Borrelia burgdorferi
SKEKDKDGKYSLEATV

SEQ ID NO: 82286 - protein, 16 aa, Borrelia burgdorferi
KEKDKDGKYSLEATVD

SEQ ID NO: 82287 - protein, 16 aa, Borrelia burgdorferi
EKDKDGKYSLEATVDK

SEQ ID NO: 82288 - protein, 16 aa, Borrelia burgdorferi
KDKDGKYSLEATVDKL

SEQ ID NO: 82289 - protein, 16 aa, Borrelia burgdorferi
DKDGKYSLEATVDKLE

SEQ ID NO: 82290 - protein, 16 aa, Borrelia burgdorferi
KDGKYSLEATVDKLEL

SEQ ID NO: 82291 - protein, 16 aa, Borrelia burgdorferi
DGKYSLEATVDKLELK

SEQ ID NO: 82292 - protein, 16 aa, Borrelia burgdorferi
GKYSLEATVDKLELKG

SEQ ID NO: 82293 - protein, 16 aa, Borrelia burgdorferi
KYSLEATVDKLELKGT

SEQ ID NO: 82294 - protein, 16 aa, Borrelia burgdorferi
YSLEATVDKLELKGTS

SEQ ID NO: 82295 - protein, 16 aa, Borrelia burgdorferi
SLEATVDKLELKGTSD

SEQ ID NO: 82296 - protein, 16 aa, Borrelia burgdorferi
LEATVDKLELKGTSDK

SEQ ID NO: 82297 - protein, 16 aa, Borrelia burgdorferi
EATVDKLELKGTSDKN

SEQ ID NO: 82298 - protein, 16 aa, Borrelia burgdorferi
ATVDKLELKGTSDKNN

SEQ ID NO: 82299 - protein, 16 aa, Borrelia burgdorferi
TVDKLELKGTSDKNNG

SEQ ID NO: 82300 - protein, 16 aa, Borrelia burgdorferi
VDKLELKGTSDKNNGS

SEQ ID NO: 82301 - protein, 16 aa, Borrelia burgdorferi
DKLELKGTSDKNNGSG

SEQ ID NO: 82302 - protein, 16 aa, Borrelia burgdorferi
KLELKGTSDKNNGSGT

SEQ ID NO: 82303 - protein, 16 aa, Borrelia burgdorferi
LELKGTSDKNNGSGTL

SEQ ID NO: 82304 - protein, 16 aa, Borrelia burgdorferi
ELKGTSDKNNGSGTLE

SEQ ID NO: 82305 - protein, 16 aa, Borrelia burgdorferi
LKGTSDKNNGSGTLEG

SEQ ID NO: 82306 - protein, 16 aa, Borrelia burgdorferi
KGTSDKNNGSGTLEGE

SEQ ID NO: 82307 - protein, 16 aa, Borrelia burgdorferi
GTSDKNNGSGTLEGEK

SEQ ID NO: 82308 - protein, 16 aa, Borrelia burgdorferi
TSDKNNGSGTLEGEKT

SEQ ID NO: 82309 - protein, 16 aa, Borrelia burgdorferi
SDKNNGSGTLEGEKTD

SEQ ID NO: 82310 - protein, 16 aa, Borrelia burgdorferi
DKNNGSGTLEGEKTDK

SEQ ID NO: 82311 - protein, 16 aa, Borrelia burgdorferi
KNNGSGTLEGEKTDKS

SEQ ID NO: 82312 - protein, 16 aa, Borrelia burgdorferi
NNGSGTLEGEKTDKSK

SEQ ID NO: 82313 - protein, 16 aa, Borrelia burgdorferi
NGSGTLEGEKTDKSKV

SEQ ID NO: 82314 - protein, 16 aa, Borrelia burgdorferi
GSGTLEGEKTDKSKVK

SEQ ID NO: 82315 - protein, 16 aa, Borrelia burgdorferi
SGTLEGEKTDKSKVKL

SEQ ID NO: 82316 - protein, 16 aa, Borrelia burgdorferi
GTLEGEKTDKSKVKLT

SEQ ID NO: 82317 - protein, 16 aa, Borrelia burgdorferi
TLEGEKTDKSKVKLTI

SEQ ID NO: 82318 - protein, 16 aa, Borrelia burgdorferi
LEGEKTDKSKVKLTIA

SEQ ID NO: 82319 - protein, 16 aa, Borrelia burgdorferi
EGEKTDKSKVKLTIAD

SEQ ID NO: 82320 - protein, 16 aa, Borrelia burgdorferi
GEKTDKSKVKLTIADD

SEQ ID NO: 82321 - protein, 16 aa, Borrelia burgdorferi
EKTDKSKVKLTIADDL

SEQ ID NO: 82322 - protein, 16 aa, Borrelia burgdorferi
KTDKSKVKLTIADDLS

SEQ ID NO: 82323 - protein, 16 aa, Borrelia burgdorferi
TDKSKVKLTIADDLSQ

SEQ ID NO: 82324 - protein, 16 aa, Borrelia burgdorferi
DKSKVKLTIADDLSQT

SEQ ID NO: 82325 - protein, 16 aa, Borrelia burgdorferi
KSKVKLTIADDLSQTK

SEQ ID NO: 82326 - protein, 16 aa, Borrelia burgdorferi
SKVKLTIADDLSQTKF

SEQ ID NO: 82327 - protein, 16 aa, Borrelia burgdorferi
KVKLTIADDLSQTKFE

SEQ ID NO: 82328 - protein, 16 aa, Borrelia burgdorferi
VKLTIADDLSQTKFEI

SEQ ID NO: 82329 - protein, 16 aa, Borrelia burgdorferi
KLTIADDLSQTKFEIF

SEQ ID NO: 82330 - protein, 16 aa, Borrelia burgdorferi
LTIADDLSQTKFEIFK

SEQ ID NO: 82331 - protein, 16 aa, Borrelia burgdorferi
TIADDLSQTKFEIFKE

SEQ ID NO: 82332 - protein, 16 aa, Borrelia burgdorferi
IADDLSQTKFEIFKED

SEQ ID NO: 82333 - protein, 16 aa, Borrelia burgdorferi
ADDLSQTKFEIFKEDA

SEQ ID NO: 82334 - protein, 16 aa, Borrelia burgdorferi
DDLSQTKFEIFKEDAK

SEQ ID NO: 82335 - protein, 16 aa, Borrelia burgdorferi
DLSQTKFEIFKEDAKT

SEQ ID NO: 82336 - protein, 16 aa, Borrelia burgdorferi
LSQTKFEIFKEDAKTL

SEQ ID NO: 82337 - protein, 16 aa, Borrelia burgdorferi
SQTKFEIFKEDAKTLV

SEQ ID NO: 82338 - protein, 16 aa, Borrelia burgdorferi
QTKFEIFKEDAKTLVS

SEQ ID NO: 82339 - protein, 16 aa, Borrelia burgdorferi
TKFEIFKEDAKTLVSK

SEQ ID NO: 82340 - protein, 16 aa, Borrelia burgdorferi
KFEIFKEDAKTLVSKK

SEQ ID NO: 82341 - protein, 16 aa, Borrelia burgdorferi
FEIFKEDAKTLVSKKV

SEQ ID NO: 82342 - protein, 16 aa, Borrelia burgdorferi
EIFKEDAKTLVSKKVT

SEQ ID NO: 82343 - protein, 16 aa, Borrelia burgdorferi
IFKEDAKTLVSKKVTL

SEQ ID NO: 82344 - protein, 16 aa, Borrelia burgdorferi
FKEDAKTLVSKKVTLK

SEQ ID NO: 82345 - protein, 16 aa, Borrelia burgdorferi
KEDAKTLVSKKVTLKD

SEQ ID NO: 82346 - protein, 16 aa, Borrelia burgdorferi
EDAKTLVSKKVTLKDK

SEQ ID NO: 82347 - protein, 16 aa, Borrelia burgdorferi
DAKTLVSKKVTLKDKS

SEQ ID NO: 82348 - protein, 16 aa, Borrelia burgdorferi
AKTLVSKKVTLKDKSS

SEQ ID NO: 82349 - protein, 16 aa, Borrelia burgdorferi
KTLVSKKVTLKDKSST

SEQ ID NO: 82350 - protein, 16 aa, Borrelia burgdorferi
TLVSKKVTLKDKSSTE

SEQ ID NO: 82351 - protein, 16 aa, Borrelia burgdorferi
LVSKKVTLKDKSSTEE

SEQ ID NO: 82352 - protein, 16 aa, Borrelia burgdorferi
VSKKVTLKDKSSTEEK

SEQ ID NO: 82353 - protein, 16 aa, Borrelia burgdorferi
SKKVTLKDKSSTEEKF

SEQ ID NO: 82354 - protein, 16 aa, Borrelia burgdorferi
KKVTLKDKSSTEEKFN

SEQ ID NO: 82355 - protein, 16 aa, Borrelia burgdorferi
KVTLKDKSSTEEKFNE

SEQ ID NO: 82356 - protein, 16 aa, Borrelia burgdorferi
VTLKDKSSTEEKFNEK

SEQ ID NO: 82357 - protein, 16 aa, Borrelia burgdorferi
TLKDKSSTEEKFNEKG

SEQ ID NO: 82358 - protein, 16 aa, Borrelia burgdorferi
LKDKSSTEEKFNEKGE

SEQ ID NO: 82359 - protein, 16 aa, Borrelia burgdorferi
KDKSSTEEKFNEKGET

SEQ ID NO: 82360 - protein, 16 aa, Borrelia burgdorferi
DKSSTEEKFNEKGETS

SEQ ID NO: 82361 - protein, 16 aa, Borrelia burgdorferi
KSSTEEKFNEKGETSE

SEQ ID NO: 82362 - protein, 16 aa, Borrelia burgdorferi
SSTEEKFNEKGETSEK

SEQ ID NO: 82363 - protein, 16 aa, Borrelia burgdorferi
STEEKFNEKGETSEKT

SEQ ID NO: 82364 - protein, 16 aa, Borrelia burgdorferi
TEEKFNEKGETSEKTI

SEQ ID NO: 82365 - protein, 16 aa, Borrelia burgdorferi
EEKFNEKGETSEKTIV

SEQ ID NO: 82366 - protein, 16 aa, Borrelia burgdorferi
EKFNEKGETSEKTIVR

SEQ ID NO: 82367 - protein, 16 aa, Borrelia burgdorferi
KFNEKGETSEKTIVRA

SEQ ID NO: 82368 - protein, 16 aa, Borrelia burgdorferi
FNEKGETSEKTIVRAN

SEQ ID NO: 82369 - protein, 16 aa, Borrelia burgdorferi
NEKGETSEKTIVRANG

SEQ ID NO: 82370 - protein, 16 aa, Borrelia burgdorferi
EKGETSEKTIVRANGT

SEQ ID NO: 82371 - protein, 16 aa, Borrelia burgdorferi
KGETSEKTIVRANGTR

SEQ ID NO: 82372 - protein, 16 aa, Borrelia burgdorferi
GETSEKTIVRANGTRL

SEQ ID NO: 82373 - protein, 16 aa, Borrelia burgdorferi
ETSEKTIVRANGTRLE

SEQ ID NO: 82374 - protein, 16 aa, Borrelia burgdorferi
TSEKTIVRANGTRLEY

SEQ ID NO: 82375 - protein, 16 aa, Borrelia burgdorferi
SEKTIVRANGTRLEYT

SEQ ID NO: 82376 - protein, 16 aa, Borrelia burgdorferi
EKTIVRANGTRLEYTD

SEQ ID NO: 82377 - protein, 16 aa, Borrelia burgdorferi
KTIVRANGTRLEYTDI

SEQ ID NO: 82378 - protein, 16 aa, Borrelia burgdorferi
TIVRANGTRLEYTDIK

SEQ ID NO: 82379 - protein, 16 aa, Borrelia burgdorferi
IVRANGTRLEYTDIKS

SEQ ID NO: 82380 - protein, 16 aa, Borrelia burgdorferi
VRANGTRLEYTDIKSD

SEQ ID NO: 82381 - protein, 16 aa, Borrelia burgdorferi
RANGTRLEYTDIKSDG

SEQ ID NO: 82382 - protein, 16 aa, Borrelia burgdorferi
ANGTRLEYTDIKSDGS

SEQ ID NO: 82383 - protein, 16 aa, Borrelia burgdorferi
NGTRLEYTDIKSDGSG

SEQ ID NO: 82384 - protein, 16 aa, Borrelia burgdorferi
GTRLEYTDIKSDGSGK

SEQ ID NO: 82385 - protein, 16 aa, Borrelia burgdorferi
TRLEYTDIKSDGSGKA

SEQ ID NO: 82386 - protein, 16 aa, Borrelia burgdorferi
RLEYTDIKSDGSGKAK

SEQ ID NO: 82387 - protein, 16 aa, Borrelia burgdorferi
LEYTDIKSDGSGKAKE

SEQ ID NO: 82388 - protein, 16 aa, Borrelia burgdorferi
EYTDIKSDGSGKAKEV

SEQ ID NO: 82389 - protein, 16 aa, Borrelia burgdorferi
YTDIKSDGSGKAKEVL

SEQ ID NO: 82390 - protein, 16 aa, Borrelia burgdorferi
TDIKSDGSGKAKEVLK

SEQ ID NO: 82391 - protein, 16 aa, Borrelia burgdorferi
DIKSDGSGKAKEVLKD

SEQ ID NO: 82392 - protein, 16 aa, Borrelia burgdorferi
IKSDGSGKAKEVLKDF

SEQ ID NO: 82393 - protein, 16 aa, Borrelia burgdorferi
KSDGSGKAKEVLKDFT

SEQ ID NO: 82394 - protein, 16 aa, Borrelia burgdorferi
SDGSGKAKEVLKDFTL

SEQ ID NO: 82395 - protein, 16 aa, Borrelia burgdorferi
DGSGKAKEVLKDFTLE

SEQ ID NO: 82396 - protein, 16 aa, Borrelia burgdorferi
GSGKAKEVLKDFTLEG

SEQ ID NO: 82397 - protein, 16 aa, Borrelia burgdorferi
SGKAKEVLKDFTLEGT

SEQ ID NO: 82398 - protein, 16 aa, Borrelia burgdorferi
GKAKEVLKDFTLEGTL

SEQ ID NO: 82399 - protein, 16 aa, Borrelia burgdorferi
KAKEVLKDFTLEGTLA

SEQ ID NO: 82400 - protein, 16 aa, Borrelia burgdorferi
AKEVLKDFTLEGTLAA

SEQ ID NO: 82401 - protein, 16 aa, Borrelia burgdorferi
KEVLKDFTLEGTLAAD

SEQ ID NO: 82402 - protein, 16 aa, Borrelia burgdorferi
EVLKDFTLEGTLAADG

SEQ ID NO: 82403 - protein, 16 aa, Borrelia burgdorferi
VLKDFTLEGTLAADGK

SEQ ID NO: 82404 - protein, 16 aa, Borrelia burgdorferi
LKDFTLEGTLAADGKT

SEQ ID NO: 82405 - protein, 16 aa, Borrelia burgdorferi
KDFTLEGTLAADGKTT

SEQ ID NO: 82406 - protein, 16 aa, Borrelia burgdorferi
DFTLEGTLAADGKTTL

SEQ ID NO: 82407 - protein, 16 aa, Borrelia burgdorferi
FTLEGTLAADGKTTLK

SEQ ID NO: 82408 - protein, 16 aa, Borrelia burgdorferi
TLEGTLAADGKTTLKV

SEQ ID NO: 82409 - protein, 16 aa, Borrelia burgdorferi
LEGTLAADGKTTLKVT

SEQ ID NO: 82410 - protein, 16 aa, Borrelia burgdorferi
EGTLAADGKTTLKVTE

SEQ ID NO: 82411 - protein, 16 aa, Borrelia burgdorferi
GTLAADGKTTLKVTEG

SEQ ID NO: 82412 - protein, 16 aa, Borrelia burgdorferi
TLAADGKTTLKVTEGT

SEQ ID NO: 82413 - protein, 16 aa, Borrelia burgdorferi
LAADGKTTLKVTEGTV

SEQ ID NO: 82414 - protein, 16 aa, Borrelia burgdorferi
AADGKTTLKVTEGTVV

SEQ ID NO: 82415 - protein, 16 aa, Borrelia burgdorferi
ADGKTTLKVTEGTVVL

SEQ ID NO: 82416 - protein, 16 aa, Borrelia burgdorferi
DGKTTLKVTEGTVVLS

SEQ ID NO: 82417 - protein, 16 aa, Borrelia burgdorferi
GKTTLKVTEGTVVLSK

SEQ ID NO: 82418 - protein, 16 aa, Borrelia burgdorferi
KTTLKVTEGTVVLSKN

SEQ ID NO: 82419 - protein, 16 aa, Borrelia burgdorferi
TTLKVTEGTVVLSKNI

SEQ ID NO: 82420 - protein, 16 aa, Borrelia burgdorferi
TLKVTEGTVVLSKNIL

SEQ ID NO: 82421 - protein, 16 aa, Borrelia burgdorferi
LKVTEGTVVLSKNILK

SEQ ID NO: 82422 - protein, 16 aa, Borrelia burgdorferi
KVTEGTVVLSKNILKS

SEQ ID NO: 82423 - protein, 16 aa, Borrelia burgdorferi
VTEGTVVLSKNILKSG

SEQ ID NO: 82424 - protein, 16 aa, Borrelia burgdorferi
TEGTVVLSKNILKSGE

SEQ ID NO: 82425 - protein, 16 aa, Borrelia burgdorferi
EGTVVLSKNILKSGEI

SEQ ID NO: 82426 - protein, 16 aa, Borrelia burgdorferi
GTVVLSKNILKSGEIT

SEQ ID NO: 82427 - protein, 16 aa, Borrelia burgdorferi
TVVLSKNILKSGEITV

SEQ ID NO: 82428 - protein, 16 aa, Borrelia burgdorferi
VVLSKNILKSGEITVA

SEQ ID NO: 82429 - protein, 16 aa, Borrelia burgdorferi
VLSKNILKSGEITVAL

SEQ ID NO: 82430 - protein, 16 aa, Borrelia burgdorferi
LSKNILKSGEITVALD

SEQ ID NO: 82431 - protein, 16 aa, Borrelia burgdorferi
SKNILKSGEITVALDD

SEQ ID NO: 82432 - protein, 16 aa, Borrelia burgdorferi
KNILKSGEITVALDDS

SEQ ID NO: 82433 - protein, 16 aa, Borrelia burgdorferi
NILKSGEITVALDDSD

SEQ ID NO: 82434 - protein, 16 aa, Borrelia burgdorferi
ILKSGEITVALDDSDT

SEQ ID NO: 82435 - protein, 16 aa, Borrelia burgdorferi
LKSGEITVALDDSDTT

SEQ ID NO: 82436 - protein, 16 aa, Borrelia burgdorferi
KSGEITVALDDSDTTQ

SEQ ID NO: 82437 - protein, 16 aa, Borrelia burgdorferi
SGEITVALDDSDTTQA

SEQ ID NO: 82438 - protein, 16 aa, Borrelia burgdorferi
GEITVALDDSDTTQAT

SEQ ID NO: 82439 - protein, 16 aa, Borrelia burgdorferi
EITVALDDSDTTQATK

SEQ ID NO: 82440 - protein, 16 aa, Borrelia burgdorferi
ITVALDDSDTTQATKK

SEQ ID NO: 82441 - protein, 16 aa, Borrelia burgdorferi
TVALDDSDTTQATKKT

SEQ ID NO: 82442 - protein, 16 aa, Borrelia burgdorferi
VALDDSDTTQATKKTG

SEQ ID NO: 82443 - protein, 16 aa, Borrelia burgdorferi
ALDDSDTTQATKKTGK

SEQ ID NO: 82444 - protein, 16 aa, Borrelia burgdorferi
LDDSDTTQATKKTGKW

SEQ ID NO: 82445 - protein, 16 aa, Borrelia burgdorferi
DDSDTTQATKKTGKWD

SEQ ID NO: 82446 - protein, 16 aa, Borrelia burgdorferi
DSDTTQATKKTGKWDS

SEQ ID NO: 82447 - protein, 16 aa, Borrelia burgdorferi
SDTTQATKKTGKWDSK

SEQ ID NO: 82448 - protein, 16 aa, Borrelia burgdorferi
DTTQATKKTGKWDSKT

SEQ ID NO: 82449 - protein, 16 aa, Borrelia burgdorferi
TTQATKKTGKWDSKTS

SEQ ID NO: 82450 - protein, 16 aa, Borrelia burgdorferi
TQATKKTGKWDSKTST

SEQ ID NO: 82451 - protein, 16 aa, Borrelia burgdorferi
QATKKTGKWDSKTSTL

SEQ ID NO: 82452 - protein, 16 aa, Borrelia burgdorferi
ATKKTGKWDSKTSTLT

SEQ ID NO: 82453 - protein, 16 aa, Borrelia burgdorferi
TKKTGKWDSKTSTLTI

SEQ ID NO: 82454 - protein, 16 aa, Borrelia burgdorferi
KKTGKWDSKTSTLTIS

SEQ ID NO: 82455 - protein, 16 aa, Borrelia burgdorferi
KTGKWDSKTSTLTISV

SEQ ID NO: 82456 - protein, 16 aa, Borrelia burgdorferi
TGKWDSKTSTLTISVN

SEQ ID NO: 82457 - protein, 16 aa, Borrelia burgdorferi
GKWDSKTSTLTISVNS

SEQ ID NO: 82458 - protein, 16 aa, Borrelia burgdorferi
KWDSKTSTLTISVNSQ

SEQ ID NO: 82459 - protein, 16 aa, Borrelia burgdorferi
WDSKTSTLTISVNSQK

SEQ ID NO: 82460 - protein, 16 aa, Borrelia burgdorferi
DSKTSTLTISVNSQKT

SEQ ID NO: 82461 - protein, 16 aa, Borrelia burgdorferi
SKTSTLTISVNSQKTK

SEQ ID NO: 82462 - protein, 16 aa, Borrelia burgdorferi
KTSTLTISVNSQKTKN

SEQ ID NO: 82463 - protein, 16 aa, Borrelia burgdorferi
TSTLTISVNSQKTKNL

SEQ ID NO: 82464 - protein, 16 aa, Borrelia burgdorferi
STLTISVNSQKTKNLV

SEQ ID NO: 82465 - protein, 16 aa, Borrelia burgdorferi
TLTISVNSQKTKNLVF

SEQ ID NO: 82466 - protein, 16 aa, Borrelia burgdorferi
LTISVNSQKTKNLVFT

SEQ ID NO: 82467 - protein, 16 aa, Borrelia burgdorferi
TISVNSQKTKNLVFTK

SEQ ID NO: 82468 - protein, 16 aa, Borrelia burgdorferi
ISVNSQKTKNLVFTKE

SEQ ID NO: 82469 - protein, 16 aa, Borrelia burgdorferi
SVNSQKTKNLVFTKED

SEQ ID NO: 82470 - protein, 16 aa, Borrelia burgdorferi
VNSQKTKNLVFTKEDT

SEQ ID NO: 82471 - protein, 16 aa, Borrelia burgdorferi
NSQKTKNLVFTKEDTI

SEQ ID NO: 82472 - protein, 16 aa, Borrelia burgdorferi
SQKTKNLVFTKEDTIT

SEQ ID NO: 82473 - protein, 16 aa, Borrelia burgdorferi
QKTKNLVFTKEDTITV

SEQ ID NO: 82474 - protein, 16 aa, Borrelia burgdorferi
KTKNLVFTKEDTITVQ

SEQ ID NO: 82475 - protein, 16 aa, Borrelia burgdorferi
TKNLVFTKEDTITVQK

SEQ ID NO: 82476 - protein, 16 aa, Borrelia burgdorferi
KNLVFTKEDTITVQKY

SEQ ID NO: 82477 - protein, 16 aa, Borrelia burgdorferi
NLVFTKEDTITVQKYD

SEQ ID NO: 82478 - protein, 16 aa, Borrelia burgdorferi
LVFTKEDTITVQKYDS

SEQ ID NO: 82479 - protein, 16 aa, Borrelia burgdorferi
VFTKEDTITVQKYDSA

SEQ ID NO: 82480 - protein, 16 aa, Borrelia burgdorferi
FTKEDTITVQKYDSAG

SEQ ID NO: 82481 - protein, 16 aa, Borrelia burgdorferi
TKEDTITVQKYDSAGT

SEQ ID NO: 82482 - protein, 16 aa, Borrelia burgdorferi
KEDTITVQKYDSAGTN

SEQ ID NO: 82483 - protein, 16 aa, Borrelia burgdorferi
EDTITVQKYDSAGTNL

SEQ ID NO: 82484 - protein, 16 aa, Borrelia burgdorferi
DTITVQKYDSAGTNLE

SEQ ID NO: 82485 - protein, 16 aa, Borrelia burgdorferi
TITVQKYDSAGTNLEG

SEQ ID NO: 82486 - protein, 16 aa, Borrelia burgdorferi
ITVQKYDSAGTNLEGK

SEQ ID NO: 82487 - protein, 16 aa, Borrelia burgdorferi
TVQKYDSAGTNLEGKA

SEQ ID NO: 82488 - protein, 16 aa, Borrelia burgdorferi
VQKYDSAGTNLEGKAV

SEQ ID NO: 82489 - protein, 16 aa, Borrelia burgdorferi
QKYDSAGTNLEGKAVE

SEQ ID NO: 82490 - protein, 16 aa, Borrelia burgdorferi
KYDSAGTNLEGKAVEI

SEQ ID NO: 82491 - protein, 16 aa, Borrelia burgdorferi
YDSAGTNLEGKAVEIT

SEQ ID NO: 82492 - protein, 16 aa, Borrelia burgdorferi
DSAGTNLEGKAVEITT

SEQ ID NO: 82493 - protein, 16 aa, Borrelia burgdorferi
SAGTNLEGKAVEITTL

SEQ ID NO: 82494 - protein, 16 aa, Borrelia burgdorferi
AGTNLEGKAVEITTLK

SEQ ID NO: 82495 - protein, 16 aa, Borrelia burgdorferi
GTNLEGKAVEITTLKE

SEQ ID NO: 82496 - protein, 16 aa, Borrelia burgdorferi
TNLEGKAVEITTLKEL

SEQ ID NO: 82497 - protein, 16 aa, Borrelia burgdorferi
NLEGKAVEITTLKELK

SEQ ID NO: 82498 - protein, 16 aa, Borrelia burgdorferi
LEGKAVEITTLKELKN

SEQ ID NO: 82499 - protein, 16 aa, Borrelia burgdorferi
EGKAVEITTLKELKNA

SEQ ID NO: 82500 - protein, 16 aa, Borrelia burgdorferi
GKAVEITTLKELKNAL

SEQ ID NO: 82501 - protein, 16 aa, Borrelia burgdorferi
KAVEITTLKELKNALK

SEQ ID NO: 82502 - protein, 15 aa, Borrelia burgdorferi
AVEITTLKELKNALK

SEQ ID NO: 82503 - protein, 13 aa, Borrelia garinii
MKKYLLGFALVLA

SEQ ID NO: 82504 - protein, 13 aa, Borrelia garinii
KKYLLGFALVLAL

SEQ ID NO: 82505 - protein, 13 aa, Borrelia garinii
KYLLGFALVLALI

SEQ ID NO: 82506 - protein, 13 aa, Borrelia garinii
YLLGFALVLALIA

SEQ ID NO: 82507 - protein, 13 aa, Borrelia garinii
LLGFALVLALIAC

SEQ ID NO: 82508 - protein, 13 aa, Borrelia garinii
LGFALVLALIACG

SEQ ID NO: 82509 - protein, 13 aa, Borrelia garinii
GFALVLALIACGQ

SEQ ID NO: 82510 - protein, 13 aa, Borrelia garinii
FALVLALIACGQK

SEQ ID NO: 82511 - protein, 13 aa, Borrelia garinii
ALVLALIACGQKG

SEQ ID NO: 82512 - protein, 13 aa, Borrelia garinii
LVLALIACGQKGA

SEQ ID NO: 82513 - protein, 13 aa, Borrelia garinii
VLALIACGQKGAE

SEQ ID NO: 82514 - protein, 13 aa, Borrelia garinii
LALIACGQKGAEP

SEQ ID NO: 82515 - protein, 13 aa, Borrelia garinii
ALIACGQKGAEPK

SEQ ID NO: 82516 - protein, 13 aa, Borrelia garinii
LIACGQKGAEPKH

SEQ ID NO: 82517 - protein, 13 aa, Borrelia garinii
IACGQKGAEPKHN

SEQ ID NO: 82518 - protein, 13 aa, Borrelia garinii
ACGQKGAEPKHND

SEQ ID NO: 82519 - protein, 13 aa, Borrelia garinii
CGQKGAEPKHNDQ

SEQ ID NO: 82520 - protein, 13 aa, Borrelia garinii
GQKGAEPKHNDQE

SEQ ID NO: 82521 - protein, 13 aa, Borrelia garinii
QKGAEPKHNDQEV

SEQ ID NO: 82522 - protein, 13 aa, Borrelia garinii
KGAEPKHNDQEVE

SEQ ID NO: 82523 - protein, 13 aa, Borrelia garinii
GAEPKHNDQEVED

SEQ ID NO: 82524 - protein, 13 aa, Borrelia garinii
AEPKHNDQEVEDS

SEQ ID NO: 82525 - protein, 13 aa, Borrelia garinii
EPKHNDQEVEDSK

SEQ ID NO: 82526 - protein, 13 aa, Borrelia garinii
PKHNDQEVEDSKK

SEQ ID NO: 82527 - protein, 13 aa, Borrelia garinii
KHNDQEVEDSKKD

SEQ ID NO: 82528 - protein, 13 aa, Borrelia garinii
HNDQEVEDSKKDQ

SEQ ID NO: 82529 - protein, 13 aa, Borrelia garinii
NDQEVEDSKKDQK

SEQ ID NO: 82530 - protein, 13 aa, Borrelia garinii
DQEVEDSKKDQKD

SEQ ID NO: 82531 - protein, 13 aa, Borrelia garinii
QEVEDSKKDQKDA

SEQ ID NO: 82532 - protein, 13 aa, Borrelia garinii
EVEDSKKDQKDAS

SEQ ID NO: 82533 - protein, 13 aa, Borrelia garinii
VEDSKKDQKDASK

SEQ ID NO: 82534 - protein, 13 aa, Borrelia garinii
EDSKKDQKDASKK

SEQ ID NO: 82535 - protein, 13 aa, Borrelia garinii
DSKKDQKDASKKD

SEQ ID NO: 82536 - protein, 13 aa, Borrelia garinii
SKKDQKDASKKDL

SEQ ID NO: 82537 - protein, 13 aa, Borrelia garinii
KKDQKDASKKDLP

SEQ ID NO: 82538 - protein, 13 aa, Borrelia garinii
KDQKDASKKDLPL

SEQ ID NO: 82539 - protein, 13 aa, Borrelia garinii
DQKDASKKDLPLV

SEQ ID NO: 82540 - protein, 13 aa, Borrelia garinii
QKDASKKDLPLVT

SEQ ID NO: 82541 - protein, 13 aa, Borrelia garinii
KDASKKDLPLVTE

SEQ ID NO: 82542 - protein, 13 aa, Borrelia garinii
DASKKDLPLVTED

SEQ ID NO: 82543 - protein, 13 aa, Borrelia garinii
ASKKDLPLVTEDT

SEQ ID NO: 82544 - protein, 13 aa, Borrelia garinii
SKKDLPLVTEDTV

SEQ ID NO: 82545 - protein, 13 aa, Borrelia garinii
KKDLPLVTEDTVK

SEQ ID NO: 82546 - protein, 13 aa, Borrelia garinii
KDLPLVTEDTVKL

SEQ ID NO: 82547 - protein, 13 aa, Borrelia garinii
DLPLVTEDTVKLF

SEQ ID NO: 82548 - protein, 13 aa, Borrelia garinii
LPLVTEDTVKLFN

SEQ ID NO: 82549 - protein, 13 aa, Borrelia garinii
PLVTEDTVKLFND

SEQ ID NO: 82550 - protein, 13 aa, Borrelia garinii
LVTEDTVKLFNDT

SEQ ID NO: 82551 - protein, 13 aa, Borrelia garinii
VTEDTVKLFNDTK

SEQ ID NO: 82552 - protein, 13 aa, Borrelia garinii
TEDTVKLFNDTKI

SEQ ID NO: 82553 - protein, 13 aa, Borrelia garinii
EDTVKLFNDTKIF

SEQ ID NO: 82554 - protein, 13 aa, Borrelia garinii
DTVKLFNDTKIFI

SEQ ID NO: 82555 - protein, 13 aa, Borrelia garinii
TVKLFNDTKIFIS

SEQ ID NO: 82556 - protein, 13 aa, Borrelia garinii
VKLFNDTKIFISK

SEQ ID NO: 82557 - protein, 13 aa, Borrelia garinii
KLFNDTKIFISKE

SEQ ID NO: 82558 - protein, 13 aa, Borrelia garinii
LFNDTKIFISKEK

SEQ ID NO: 82559 - protein, 13 aa, Borrelia garinii
FNDTKIFISKEKN

SEQ ID NO: 82560 - protein, 13 aa, Borrelia garinii
NDTKIFISKEKNK

SEQ ID NO: 82561 - protein, 13 aa, Borrelia garinii
DTKIFISKEKNKD

SEQ ID NO: 82562 - protein, 13 aa, Borrelia garinii
TKIFISKEKNKDG

SEQ ID NO: 82563 - protein, 13 aa, Borrelia garinii
KIFISKEKNKDGK

SEQ ID NO: 82564 - protein, 13 aa, Borrelia garinii
IFISKEKNKDGKY

SEQ ID NO: 82565 - protein, 13 aa, Borrelia garinii
FISKEKNKDGKYE

SEQ ID NO: 82566 - protein, 13 aa, Borrelia garinii
ISKEKNKDGKYEL

SEQ ID NO: 82567 - protein, 13 aa, Borrelia garinii
SKEKNKDGKYELR

SEQ ID NO: 82568 - protein, 13 aa, Borrelia garinii
KEKNKDGKYELRA

SEQ ID NO: 82569 - protein, 13 aa, Borrelia garinii
EKNKDGKYELRAT

SEQ ID NO: 82570 - protein, 13 aa, Borrelia garinii
KNKDGKYELRATV

SEQ ID NO: 82571 - protein, 13 aa, Borrelia garinii
NKDGKYELRATVD

SEQ ID NO: 82572 - protein, 13 aa, Borrelia garinii
KDGKYELRATVDT

SEQ ID NO: 82573 - protein, 13 aa, Borrelia garinii
DGKYELRATVDTV

SEQ ID NO: 82574 - protein, 13 aa, Borrelia garinii
GKYELRATVDTVE

SEQ ID NO: 82575 - protein, 13 aa, Borrelia garinii
KYELRATVDTVEL

SEQ ID NO: 82576 - protein, 13 aa, Borrelia garinii
YELRATVDTVELK

SEQ ID NO: 82577 - protein, 13 aa, Borrelia garinii
ELRATVDTVELKG

SEQ ID NO: 82578 - protein, 13 aa, Borrelia garinii
LRATVDTVELKGV

SEQ ID NO: 82579 - protein, 13 aa, Borrelia garinii
RATVDTVELKGVA

SEQ ID NO: 82580 - protein, 13 aa, Borrelia garinii
ATVDTVELKGVAD

SEQ ID NO: 82581 - protein, 13 aa, Borrelia garinii
TVDTVELKGVADK

SEQ ID NO: 82582 - protein, 13 aa, Borrelia garinii
VDTVELKGVADKN

SEQ ID NO: 82583 - protein, 13 aa, Borrelia garinii
DTVELKGVADKND

SEQ ID NO: 82584 - protein, 13 aa, Borrelia garinii
TVELKGVADKNDG

SEQ ID NO: 82585 - protein, 13 aa, Borrelia garinii
VELKGVADKNDGS

SEQ ID NO: 82586 - protein, 13 aa, Borrelia garinii
ELKGVADKNDGSG

SEQ ID NO: 82587 - protein, 13 aa, Borrelia garinii
LKGVADKNDGSGG

SEQ ID NO: 82588 - protein, 13 aa, Borrelia garinii
KGVADKNDGSGGK

SEQ ID NO: 82589 - protein, 13 aa, Borrelia garinii
GVADKNDGSGGKL

SEQ ID NO: 82590 - protein, 13 aa, Borrelia garinii
VADKNDGSGGKLE

SEQ ID NO: 82591 - protein, 13 aa, Borrelia garinii
ADKNDGSGGKLEG

SEQ ID NO: 82592 - protein, 13 aa, Borrelia garinii
DKNDGSGGKLEGV

SEQ ID NO: 82593 - protein, 13 aa, Borrelia garinii
KNDGSGGKLEGVK

SEQ ID NO: 82594 - protein, 13 aa, Borrelia garinii
NDGSGGKLEGVKS

SEQ ID NO: 82595 - protein, 13 aa, Borrelia garinii
DGSGGKLEGVKSD

SEQ ID NO: 82596 - protein, 13 aa, Borrelia garinii
GSGGKLEGVKSDQ

SEQ ID NO: 82597 - protein, 13 aa, Borrelia garinii
SGGKLEGVKSDQS

SEQ ID NO: 82598 - protein, 13 aa, Borrelia garinii
GGKLEGVKSDQSK

SEQ ID NO: 82599 - protein, 13 aa, Borrelia garinii
GKLEGVKSDQSKV

SEQ ID NO: 82600 - protein, 13 aa, Borrelia garinii
KLEGVKSDQSKVT

SEQ ID NO: 82601 - protein, 13 aa, Borrelia garinii
LEGVKSDQSKVTM

SEQ ID NO: 82602 - protein, 13 aa, Borrelia garinii
EGVKSDQSKVTMS

SEQ ID NO: 82603 - protein, 13 aa, Borrelia garinii
GVKSDQSKVTMSI

SEQ ID NO: 82604 - protein, 13 aa, Borrelia garinii
VKSDQSKVTMSIT

SEQ ID NO: 82605 - protein, 13 aa, Borrelia garinii
KSDQSKVTMSITD

SEQ ID NO: 82606 - protein, 13 aa, Borrelia garinii
SDQSKVTMSITDD

SEQ ID NO: 82607 - protein, 13 aa, Borrelia garinii
DQSKVTMSITDDL

SEQ ID NO: 82608 - protein, 13 aa, Borrelia garinii
QSKVTMSITDDLN

SEQ ID NO: 82609 - protein, 13 aa, Borrelia garinii
SKVTMSITDDLNT

SEQ ID NO: 82610 - protein, 13 aa, Borrelia garinii
KVTMSITDDLNTI

SEQ ID NO: 82611 - protein, 13 aa, Borrelia garinii
VTMSITDDLNTIT

SEQ ID NO: 82612 - protein, 13 aa, Borrelia garinii
TMSITDDLNTITV

SEQ ID NO: 82613 - protein, 13 aa, Borrelia garinii
MSITDDLNTITVE

SEQ ID NO: 82614 - protein, 13 aa, Borrelia garinii
SITDDLNTITVET

SEQ ID NO: 82615 - protein, 13 aa, Borrelia garinii
ITDDLNTITVETY

SEQ ID NO: 82616 - protein, 13 aa, Borrelia garinii
TDDLNTITVETYD

SEQ ID NO: 82617 - protein, 13 aa, Borrelia garinii
DDLNTITVETYDS

SEQ ID NO: 82618 - protein, 13 aa, Borrelia garinii
DLNTITVETYDSS

SEQ ID NO: 82619 - protein, 13 aa, Borrelia garinii
LNTITVETYDSSN

SEQ ID NO: 82620 - protein, 13 aa, Borrelia garinii
NTITVETYDSSNT

SEQ ID NO: 82621 - protein, 13 aa, Borrelia garinii
TITVETYDSSNTK

SEQ ID NO: 82622 - protein, 13 aa, Borrelia garinii
ITVETYDSSNTKV

SEQ ID NO: 82623 - protein, 13 aa, Borrelia garinii
TVETYDSSNTKVA

SEQ ID NO: 82624 - protein, 13 aa, Borrelia garinii
VETYDSSNTKVAS

SEQ ID NO: 82625 - protein, 13 aa, Borrelia garinii
ETYDSSNTKVASK

SEQ ID NO: 82626 - protein, 13 aa, Borrelia garinii
TYDSSNTKVASKV

SEQ ID NO: 82627 - protein, 13 aa, Borrelia garinii
YDSSNTKVASKVF

SEQ ID NO: 82628 - protein, 13 aa, Borrelia garinii
DSSNTKVASKVFK

SEQ ID NO: 82629 - protein, 13 aa, Borrelia garinii
SSNTKVASKVFKK

SEQ ID NO: 82630 - protein, 13 aa, Borrelia garinii
SNTKVASKVFKKQ

SEQ ID NO: 82631 - protein, 13 aa, Borrelia garinii
NTKVASKVFKKQG

SEQ ID NO: 82632 - protein, 13 aa, Borrelia garinii
TKVASKVFKKQGS

SEQ ID NO: 82633 - protein, 13 aa, Borrelia garinii
KVASKVFKKQGSL

SEQ ID NO: 82634 - protein, 13 aa, Borrelia garinii
VASKVFKKQGSLT

SEQ ID NO: 82635 - protein, 13 aa, Borrelia garinii
ASKVFKKQGSLTE

SEQ ID NO: 82636 - protein, 13 aa, Borrelia garinii
SKVFKKQGSLTEE

SEQ ID NO: 82637 - protein, 13 aa, Borrelia garinii
KVFKKQGSLTEET

SEQ ID NO: 82638 - protein, 13 aa, Borrelia garinii
VFKKQGSLTEETE

SEQ ID NO: 82639 - protein, 13 aa, Borrelia garinii
FKKQGSLTEETEE

SEQ ID NO: 82640 - protein, 13 aa, Borrelia garinii
KKQGSLTEETEET

SEQ ID NO: 82641 - protein, 13 aa, Borrelia garinii
KQGSLTEETEETY

SEQ ID NO: 82642 - protein, 13 aa, Borrelia garinii
QGSLTEETEETYK

SEQ ID NO: 82643 - protein, 13 aa, Borrelia garinii
GSLTEETEETYKT

SEQ ID NO: 82644 - protein, 13 aa, Borrelia garinii
SLTEETEETYKTG

SEQ ID NO: 82645 - protein, 13 aa, Borrelia garinii
LTEETEETYKTGK

SEQ ID NO: 82646 - protein, 13 aa, Borrelia garinii
TEETEETYKTGKL

SEQ ID NO: 82647 - protein, 13 aa, Borrelia garinii
EETEETYKTGKLS

SEQ ID NO: 82648 - protein, 13 aa, Borrelia garinii
ETEETYKTGKLST

SEQ ID NO: 82649 - protein, 13 aa, Borrelia garinii
TEETYKTGKLSTK

SEQ ID NO: 82650 - protein, 13 aa, Borrelia garinii
EETYKTGKLSTKK

SEQ ID NO: 82651 - protein, 13 aa, Borrelia garinii
ETYKTGKLSTKKI

SEQ ID NO: 82652 - protein, 13 aa, Borrelia garinii
TYKTGKLSTKKIT

SEQ ID NO: 82653 - protein, 13 aa, Borrelia garinii
YKTGKLSTKKITR

SEQ ID NO: 82654 - protein, 13 aa, Borrelia garinii
KTGKLSTKKITRT

SEQ ID NO: 82655 - protein, 13 aa, Borrelia garinii
TGKLSTKKITRTN

SEQ ID NO: 82656 - protein, 13 aa, Borrelia garinii
GKLSTKKITRTNG

SEQ ID NO: 82657 - protein, 13 aa, Borrelia garinii
KLSTKKITRTNGT

SEQ ID NO: 82658 - protein, 13 aa, Borrelia garinii
LSTKKITRTNGTT

SEQ ID NO: 82659 - protein, 13 aa, Borrelia garinii
STKKITRTNGTTL

SEQ ID NO: 82660 - protein, 13 aa, Borrelia garinii
TKKITRTNGTTLE

SEQ ID NO: 82661 - protein, 13 aa, Borrelia garinii
KKITRTNGTTLEY

SEQ ID NO: 82662 - protein, 13 aa, Borrelia garinii
KITRTNGTTLEYS

SEQ ID NO: 82663 - protein, 13 aa, Borrelia garinii
ITRTNGTTLEYSD

SEQ ID NO: 82664 - protein, 13 aa, Borrelia garinii
TRTNGTTLEYSDM

SEQ ID NO: 82665 - protein, 13 aa, Borrelia garinii
RTNGTTLEYSDMT

SEQ ID NO: 82666 - protein, 13 aa, Borrelia garinii
TNGTTLEYSDMTN

SEQ ID NO: 82667 - protein, 13 aa, Borrelia garinii
NGTTLEYSDMTND

SEQ ID NO: 82668 - protein, 13 aa, Borrelia garinii
GTTLEYSDMTNDE

SEQ ID NO: 82669 - protein, 13 aa, Borrelia garinii
TTLEYSDMTNDEN

SEQ ID NO: 82670 - protein, 13 aa, Borrelia garinii
TLEYSDMTNDENA

SEQ ID NO: 82671 - protein, 13 aa, Borrelia garinii
LEYSDMTNDENAT

SEQ ID NO: 82672 - protein, 13 aa, Borrelia garinii
EYSDMTNDENATK

SEQ ID NO: 82673 - protein, 13 aa, Borrelia garinii
YSDMTNDENATKA

SEQ ID NO: 82674 - protein, 13 aa, Borrelia garinii
SDMTNDENATKAV

SEQ ID NO: 82675 - protein, 13 aa, Borrelia garinii
DMTNDENATKAVE

SEQ ID NO: 82676 - protein, 13 aa, Borrelia garinii
MTNDENATKAVET

SEQ ID NO: 82677 - protein, 13 aa, Borrelia garinii
TNDENATKAVETL

SEQ ID NO: 82678 - protein, 13 aa, Borrelia garinii
NDENATKAVETLK

SEQ ID NO: 82679 - protein, 13 aa, Borrelia garinii
DENATKAVETLKN

SEQ ID NO: 82680 - protein, 13 aa, Borrelia garinii
ENATKAVETLKNG

SEQ ID NO: 82681 - protein, 13 aa, Borrelia garinii
NATKAVETLKNGI

SEQ ID NO: 82682 - protein, 13 aa, Borrelia garinii
ATKAVETLKNGIM

SEQ ID NO: 82683 - protein, 13 aa, Borrelia garinii
TKAVETLKNGIML

SEQ ID NO: 82684 - protein, 13 aa, Borrelia garinii
KAVETLKNGIMLE

SEQ ID NO: 82685 - protein, 13 aa, Borrelia garinii
AVETLKNGIMLEG

SEQ ID NO: 82686 - protein, 13 aa, Borrelia garinii
VETLKNGIMLEGN

SEQ ID NO: 82687 - protein, 13 aa, Borrelia garinii
ETLKNGIMLEGNL

SEQ ID NO: 82688 - protein, 13 aa, Borrelia garinii
TLKNGIMLEGNLV

SEQ ID NO: 82689 - protein, 13 aa, Borrelia garinii
LKNGIMLEGNLVG

SEQ ID NO: 82690 - protein, 13 aa, Borrelia garinii
KNGIMLEGNLVGG

SEQ ID NO: 82691 - protein, 13 aa, Borrelia garinii
NGIMLEGNLVGGK

SEQ ID NO: 82692 - protein, 13 aa, Borrelia garinii
GIMLEGNLVGGKT

SEQ ID NO: 82693 - protein, 13 aa, Borrelia garinii
IMLEGNLVGGKTS

SEQ ID NO: 82694 - protein, 13 aa, Borrelia garinii
MLEGNLVGGKTSV

SEQ ID NO: 82695 - protein, 13 aa, Borrelia garinii
LEGNLVGGKTSVE

SEQ ID NO: 82696 - protein, 13 aa, Borrelia garinii
EGNLVGGKTSVEI

SEQ ID NO: 82697 - protein, 13 aa, Borrelia garinii
GNLVGGKTSVEIK

SEQ ID NO: 82698 - protein, 13 aa, Borrelia garinii
NLVGGKTSVEIKE

SEQ ID NO: 82699 - protein, 13 aa, Borrelia garinii
LVGGKTSVEIKEG

SEQ ID NO: 82700 - protein, 13 aa, Borrelia garinii
VGGKTSVEIKEGT

SEQ ID NO: 82701 - protein, 13 aa, Borrelia garinii
GGKTSVEIKEGTV

SEQ ID NO: 82702 - protein, 13 aa, Borrelia garinii
GKTSVEIKEGTVT

SEQ ID NO: 82703 - protein, 13 aa, Borrelia garinii
KTSVEIKEGTVTL

SEQ ID NO: 82704 - protein, 13 aa, Borrelia garinii
TSVEIKEGTVTLK

SEQ ID NO: 82705 - protein, 13 aa, Borrelia garinii
SVEIKEGTVTLKK

SEQ ID NO: 82706 - protein, 13 aa, Borrelia garinii
VEIKEGTVTLKKE

SEQ ID NO: 82707 - protein, 13 aa, Borrelia garinii
EIKEGTVTLKKEI

SEQ ID NO: 82708 - protein, 13 aa, Borrelia garinii
IKEGTVTLKKEIE

SEQ ID NO: 82709 - protein, 13 aa, Borrelia garinii
KEGTVTLKKEIEK

SEQ ID NO: 82710 - protein, 13 aa, Borrelia garinii
EGTVTLKKEIEKA

SEQ ID NO: 82711 - protein, 13 aa, Borrelia garinii
GTVTLKKEIEKAG

SEQ ID NO: 82712 - protein, 13 aa, Borrelia garinii
TVTLKKEIEKAGT

SEQ ID NO: 82713 - protein, 13 aa, Borrelia garinii
VTLKKEIEKAGTV

SEQ ID NO: 82714 - protein, 13 aa, Borrelia garinii
TLKKEIEKAGTVK

SEQ ID NO: 82715 - protein, 13 aa, Borrelia garinii
LKKEIEKAGTVKL

SEQ ID NO: 82716 - protein, 13 aa, Borrelia garinii
KKEIEKAGTVKLF

SEQ ID NO: 82717 - protein, 13 aa, Borrelia garinii
KEIEKAGTVKLFL

SEQ ID NO: 82718 - protein, 13 aa, Borrelia garinii
EIEKAGTVKLFLD

SEQ ID NO: 82719 - protein, 13 aa, Borrelia garinii
IEKAGTVKLFLDD

SEQ ID NO: 82720 - protein, 13 aa, Borrelia garinii
EKAGTVKLFLDDT

SEQ ID NO: 82721 - protein, 13 aa, Borrelia garinii
KAGTVKLFLDDTS

SEQ ID NO: 82722 - protein, 13 aa, Borrelia garinii
AGTVKLFLDDTSS

SEQ ID NO: 82723 - protein, 13 aa, Borrelia garinii
GTVKLFLDDTSSG

SEQ ID NO: 82724 - protein, 13 aa, Borrelia garinii
TVKLFLDDTSSGS

SEQ ID NO: 82725 - protein, 13 aa, Borrelia garinii
VKLFLDDTSSGST

SEQ ID NO: 82726 - protein, 13 aa, Borrelia garinii
KLFLDDTSSGSTK

SEQ ID NO: 82727 - protein, 13 aa, Borrelia garinii
LFLDDTSSGSTKK

SEQ ID NO: 82728 - protein, 13 aa, Borrelia garinii
FLDDTSSGSTKKT

SEQ ID NO: 82729 - protein, 13 aa, Borrelia garinii
LDDTSSGSTKKTA

SEQ ID NO: 82730 - protein, 13 aa, Borrelia garinii
DDTSSGSTKKTAV

SEQ ID NO: 82731 - protein, 13 aa, Borrelia garinii
DTSSGSTKKTAVW

SEQ ID NO: 82732 - protein, 13 aa, Borrelia garinii
TSSGSTKKTAVWS

SEQ ID NO: 82733 - protein, 13 aa, Borrelia garinii
SSGSTKKTAVWSD

SEQ ID NO: 82734 - protein, 13 aa, Borrelia garinii
SGSTKKTAVWSDT

SEQ ID NO: 82735 - protein, 13 aa, Borrelia garinii
GSTKKTAVWSDTS

SEQ ID NO: 82736 - protein, 13 aa, Borrelia garinii
STKKTAVWSDTSN

SEQ ID NO: 82737 - protein, 13 aa, Borrelia garinii
TKKTAVWSDTSNT

SEQ ID NO: 82738 - protein, 13 aa, Borrelia garinii
KKTAVWSDTSNTL

SEQ ID NO: 82739 - protein, 13 aa, Borrelia garinii
KTAVWSDTSNTLT

SEQ ID NO: 82740 - protein, 13 aa, Borrelia garinii
TAVWSDTSNTLTV

SEQ ID NO: 82741 - protein, 13 aa, Borrelia garinii
AVWSDTSNTLTVS

SEQ ID NO: 82742 - protein, 13 aa, Borrelia garinii
VWSDTSNTLTVSA

SEQ ID NO: 82743 - protein, 13 aa, Borrelia garinii
WSDTSNTLTVSAD

SEQ ID NO: 82744 - protein, 13 aa, Borrelia garinii
SDTSNTLTVSADS

SEQ ID NO: 82745 - protein, 13 aa, Borrelia garinii
DTSNTLTVSADSK

SEQ ID NO: 82746 - protein, 13 aa, Borrelia garinii
TSNTLTVSADSKK

SEQ ID NO: 82747 - protein, 13 aa, Borrelia garinii
SNTLTVSADSKKI

SEQ ID NO: 82748 - protein, 13 aa, Borrelia garinii
NTLTVSADSKKIK

SEQ ID NO: 82749 - protein, 13 aa, Borrelia garinii
TLTVSADSKKIKD

SEQ ID NO: 82750 - protein, 13 aa, Borrelia garinii
LTVSADSKKIKDF

SEQ ID NO: 82751 - protein, 13 aa, Borrelia garinii
TVSADSKKIKDFV

SEQ ID NO: 82752 - protein, 13 aa, Borrelia garinii
VSADSKKIKDFVF

SEQ ID NO: 82753 - protein, 13 aa, Borrelia garinii
SADSKKIKDFVFL

SEQ ID NO: 82754 - protein, 13 aa, Borrelia garinii
ADSKKIKDFVFLT

SEQ ID NO: 82755 - protein, 13 aa, Borrelia garinii
DSKKIKDFVFLTD

SEQ ID NO: 82756 - protein, 13 aa, Borrelia garinii
SKKIKDFVFLTDG

SEQ ID NO: 82757 - protein, 13 aa, Borrelia garinii
KKIKDFVFLTDGT

SEQ ID NO: 82758 - protein, 13 aa, Borrelia garinii
KIKDFVFLTDGTI

SEQ ID NO: 82759 - protein, 13 aa, Borrelia garinii
IKDFVFLTDGTIT

SEQ ID NO: 82760 - protein, 13 aa, Borrelia garinii
KDFVFLTDGTITV

SEQ ID NO: 82761 - protein, 13 aa, Borrelia garinii
DFVFLTDGTITVQ

SEQ ID NO: 82762 - protein, 13 aa, Borrelia garinii
FVFLTDGTITVQN

SEQ ID NO: 82763 - protein, 13 aa, Borrelia garinii
VFLTDGTITVQNY

SEQ ID NO: 82764 - protein, 13 aa, Borrelia garinii
FLTDGTITVQNYD

SEQ ID NO: 82765 - protein, 13 aa, Borrelia garinii
LTDGTITVQNYDT

SEQ ID NO: 82766 - protein, 13 aa, Borrelia garinii
TDGTITVQNYDTA

SEQ ID NO: 82767 - protein, 13 aa, Borrelia garinii
DGTITVQNYDTAG

SEQ ID NO: 82768 - protein, 13 aa, Borrelia garinii
GTITVQNYDTAGT

SEQ ID NO: 82769 - protein, 13 aa, Borrelia garinii
TITVQNYDTAGTK

SEQ ID NO: 82770 - protein, 13 aa, Borrelia garinii
ITVQNYDTAGTKL

SEQ ID NO: 82771 - protein, 13 aa, Borrelia garinii
TVQNYDTAGTKLA

SEQ ID NO: 82772 - protein, 13 aa, Borrelia garinii
VQNYDTAGTKLAG

SEQ ID NO: 82773 - protein, 13 aa, Borrelia garinii
QNYDTAGTKLAGT

SEQ ID NO: 82774 - protein, 13 aa, Borrelia garinii
NYDTAGTKLAGTA

SEQ ID NO: 82775 - protein, 13 aa, Borrelia garinii
YDTAGTKLAGTAT

SEQ ID NO: 82776 - protein, 13 aa, Borrelia garinii
DTAGTKLAGTATE

SEQ ID NO: 82777 - protein, 13 aa, Borrelia garinii
TAGTKLAGTATEI

SEQ ID NO: 82778 - protein, 13 aa, Borrelia garinii
AGTKLAGTATEIK

SEQ ID NO: 82779 - protein, 13 aa, Borrelia garinii
GTKLAGTATEIKD

SEQ ID NO: 82780 - protein, 13 aa, Borrelia garinii
TKLAGTATEIKDL

SEQ ID NO: 82781 - protein, 13 aa, Borrelia garinii
KLAGTATEIKDLE

SEQ ID NO: 82782 - protein, 13 aa, Borrelia garinii
LAGTATEIKDLEA

SEQ ID NO: 82783 - protein, 13 aa, Borrelia garinii
AGTATEIKDLEAL

SEQ ID NO: 82784 - protein, 13 aa, Borrelia garinii
GTATEIKDLEALK

SEQ ID NO: 82785 - protein, 13 aa, Borrelia garinii
TATEIKDLEALKA

SEQ ID NO: 82786 - protein, 13 aa, Borrelia garinii
ATEIKDLEALKAA

SEQ ID NO: 82787 - protein, 13 aa, Borrelia garinii
TEIKDLEALKAAL

SEQ ID NO: 82788 - protein, 13 aa, Borrelia garinii
EIKDLEALKAALK

SEQ ID NO: 82789 - protein, 14 aa, Borrelia garinii
MKKYLLGFALVLAL

SEQ ID NO: 82790 - protein, 14 aa, Borrelia garinii
KKYLLGFALVLALI

SEQ ID NO: 82791 - protein, 14 aa, Borrelia garinii
KYLLGFALVLALIA

SEQ ID NO: 82792 - protein, 14 aa, Borrelia garinii
YLLGFALVLALIAC

SEQ ID NO: 82793 - protein, 14 aa, Borrelia garinii
LLGFALVLALIACG

SEQ ID NO: 82794 - protein, 14 aa, Borrelia garinii
LGFALVLALIACGQ

SEQ ID NO: 82795 - protein, 14 aa, Borrelia garinii
GFALVLALIACGQK

SEQ ID NO: 82796 - protein, 14 aa, Borrelia garinii
FALVLALIACGQKG

SEQ ID NO: 82797 - protein, 14 aa, Borrelia garinii
ALVLALIACGQKGA

SEQ ID NO: 82798 - protein, 14 aa, Borrelia garinii
LVLALIACGQKGAE

SEQ ID NO: 82799 - protein, 14 aa, Borrelia garinii
VLALIACGQKGAEP

SEQ ID NO: 82800 - protein, 14 aa, Borrelia garinii
LALIACGQKGAEPK

SEQ ID NO: 82801 - protein, 14 aa, Borrelia garinii
ALIACGQKGAEPKH

SEQ ID NO: 82802 - protein, 14 aa, Borrelia garinii
LIACGQKGAEPKHN

SEQ ID NO: 82803 - protein, 14 aa, Borrelia garinii
IACGQKGAEPKHND

SEQ ID NO: 82804 - protein, 14 aa, Borrelia garinii
ACGQKGAEPKHNDQ

SEQ ID NO: 82805 - protein, 14 aa, Borrelia garinii
CGQKGAEPKHNDQE

SEQ ID NO: 82806 - protein, 14 aa, Borrelia garinii
GQKGAEPKHNDQEV

SEQ ID NO: 82807 - protein, 14 aa, Borrelia garinii
QKGAEPKHNDQEVE

SEQ ID NO: 82808 - protein, 14 aa, Borrelia garinii
KGAEPKHNDQEVED

SEQ ID NO: 82809 - protein, 14 aa, Borrelia garinii
GAEPKHNDQEVEDS

SEQ ID NO: 82810 - protein, 14 aa, Borrelia garinii
AEPKHNDQEVEDSK

SEQ ID NO: 82811 - protein, 14 aa, Borrelia garinii
EPKHNDQEVEDSKK

SEQ ID NO: 82812 - protein, 14 aa, Borrelia garinii
PKHNDQEVEDSKKD

SEQ ID NO: 82813 - protein, 14 aa, Borrelia garinii
KHNDQEVEDSKKDQ

SEQ ID NO: 82814 - protein, 14 aa, Borrelia garinii
HNDQEVEDSKKDQK

SEQ ID NO: 82815 - protein, 14 aa, Borrelia garinii
NDQEVEDSKKDQKD

SEQ ID NO: 82816 - protein, 14 aa, Borrelia garinii
DQEVEDSKKDQKDA

SEQ ID NO: 82817 - protein, 14 aa, Borrelia garinii
QEVEDSKKDQKDAS

SEQ ID NO: 82818 - protein, 14 aa, Borrelia garinii
EVEDSKKDQKDASK

SEQ ID NO: 82819 - protein, 14 aa, Borrelia garinii
VEDSKKDQKDASKK

SEQ ID NO: 82820 - protein, 14 aa, Borrelia garinii
EDSKKDQKDASKKD

SEQ ID NO: 82821 - protein, 14 aa, Borrelia garinii
DSKKDQKDASKKDL

SEQ ID NO: 82822 - protein, 14 aa, Borrelia garinii
SKKDQKDASKKDLP

SEQ ID NO: 82823 - protein, 14 aa, Borrelia garinii
KKDQKDASKKDLPL

SEQ ID NO: 82824 - protein, 14 aa, Borrelia garinii
KDQKDASKKDLPLV

SEQ ID NO: 82825 - protein, 14 aa, Borrelia garinii
DQKDASKKDLPLVT

SEQ ID NO: 82826 - protein, 14 aa, Borrelia garinii
QKDASKKDLPLVTE

SEQ ID NO: 82827 - protein, 14 aa, Borrelia garinii
KDASKKDLPLVTED

SEQ ID NO: 82828 - protein, 14 aa, Borrelia garinii
DASKKDLPLVTEDT

SEQ ID NO: 82829 - protein, 14 aa, Borrelia garinii
ASKKDLPLVTEDTV

SEQ ID NO: 82830 - protein, 14 aa, Borrelia garinii
SKKDLPLVTEDTVK

SEQ ID NO: 82831 - protein, 14 aa, Borrelia garinii
KKDLPLVTEDTVKL

SEQ ID NO: 82832 - protein, 14 aa, Borrelia garinii
KDLPLVTEDTVKLF

SEQ ID NO: 82833 - protein, 14 aa, Borrelia garinii
DLPLVTEDTVKLFN

SEQ ID NO: 82834 - protein, 14 aa, Borrelia garinii
LPLVTEDTVKLFND

SEQ ID NO: 82835 - protein, 14 aa, Borrelia garinii
PLVTEDTVKLFNDT

SEQ ID NO: 82836 - protein, 14 aa, Borrelia garinii
LVTEDTVKLFNDTK

SEQ ID NO: 82837 - protein, 14 aa, Borrelia garinii
VTEDTVKLFNDTKI

SEQ ID NO: 82838 - protein, 14 aa, Borrelia garinii
TEDTVKLFNDTKIF

SEQ ID NO: 82839 - protein, 14 aa, Borrelia garinii
EDTVKLFNDTKIFI

SEQ ID NO: 82840 - protein, 14 aa, Borrelia garinii
DTVKLFNDTKIFIS

SEQ ID NO: 82841 - protein, 14 aa, Borrelia garinii
TVKLFNDTKIFISK

SEQ ID NO: 82842 - protein, 14 aa, Borrelia garinii
VKLFNDTKIFISKE

SEQ ID NO: 82843 - protein, 14 aa, Borrelia garinii
KLFNDTKIFISKEK

SEQ ID NO: 82844 - protein, 14 aa, Borrelia garinii
LFNDTKIFISKEKN

SEQ ID NO: 82845 - protein, 14 aa, Borrelia garinii
FNDTKIFISKEKNK

SEQ ID NO: 82846 - protein, 14 aa, Borrelia garinii
NDTKIFISKEKNKD

SEQ ID NO: 82847 - protein, 14 aa, Borrelia garinii
DTKIFISKEKNKDG

SEQ ID NO: 82848 - protein, 14 aa, Borrelia garinii
TKIFISKEKNKDGK

SEQ ID NO: 82849 - protein, 14 aa, Borrelia garinii
KIFISKEKNKDGKY

SEQ ID NO: 82850 - protein, 14 aa, Borrelia garinii
IFISKEKNKDGKYE

SEQ ID NO: 82851 - protein, 14 aa, Borrelia garinii
FISKEKNKDGKYEL

SEQ ID NO: 82852 - protein, 14 aa, Borrelia garinii
ISKEKNKDGKYELR

SEQ ID NO: 82853 - protein, 14 aa, Borrelia garinii
SKEKNKDGKYELRA

SEQ ID NO: 82854 - protein, 14 aa, Borrelia garinii
KEKNKDGKYELRAT

SEQ ID NO: 82855 - protein, 14 aa, Borrelia garinii
EKNKDGKYELRATV

SEQ ID NO: 82856 - protein, 14 aa, Borrelia garinii
KNKDGKYELRATVD

SEQ ID NO: 82857 - protein, 14 aa, Borrelia garinii
NKDGKYELRATVDT

SEQ ID NO: 82858 - protein, 14 aa, Borrelia garinii
KDGKYELRATVDTV

SEQ ID NO: 82859 - protein, 14 aa, Borrelia garinii
DGKYELRATVDTVE

SEQ ID NO: 82860 - protein, 14 aa, Borrelia garinii
GKYELRATVDTVEL

SEQ ID NO: 82861 - protein, 14 aa, Borrelia garinii
KYELRATVDTVELK

SEQ ID NO: 82862 - protein, 14 aa, Borrelia garinii
YELRATVDTVELKG

SEQ ID NO: 82863 - protein, 14 aa, Borrelia garinii
ELRATVDTVELKGV

SEQ ID NO: 82864 - protein, 14 aa, Borrelia garinii
LRATVDTVELKGVA

SEQ ID NO: 82865 - protein, 14 aa, Borrelia garinii
RATVDTVELKGVAD

SEQ ID NO: 82866 - protein, 14 aa, Borrelia garinii
ATVDTVELKGVADK

SEQ ID NO: 82867 - protein, 14 aa, Borrelia garinii
TVDTVELKGVADKN

SEQ ID NO: 82868 - protein, 14 aa, Borrelia garinii
VDTVELKGVADKND

SEQ ID NO: 82869 - protein, 14 aa, Borrelia garinii
DTVELKGVADKNDG

SEQ ID NO: 82870 - protein, 14 aa, Borrelia garinii
TVELKGVADKNDGS

SEQ ID NO: 82871 - protein, 14 aa, Borrelia garinii
VELKGVADKNDGSG

SEQ ID NO: 82872 - protein, 14 aa, Borrelia garinii
ELKGVADKNDGSGG

SEQ ID NO: 82873 - protein, 14 aa, Borrelia garinii
LKGVADKNDGSGGK

SEQ ID NO: 82874 - protein, 14 aa, Borrelia garinii
KGVADKNDGSGGKL

SEQ ID NO: 82875 - protein, 14 aa, Borrelia garinii
GVADKNDGSGGKLE

SEQ ID NO: 82876 - protein, 14 aa, Borrelia garinii
VADKNDGSGGKLEG

SEQ ID NO: 82877 - protein, 14 aa, Borrelia garinii
ADKNDGSGGKLEGV

SEQ ID NO: 82878 - protein, 14 aa, Borrelia garinii
DKNDGSGGKLEGVK

SEQ ID NO: 82879 - protein, 14 aa, Borrelia garinii
KNDGSGGKLEGVKS

SEQ ID NO: 82880 - protein, 14 aa, Borrelia garinii
NDGSGGKLEGVKSD

SEQ ID NO: 82881 - protein, 14 aa, Borrelia garinii
DGSGGKLEGVKSDQ

SEQ ID NO: 82882 - protein, 14 aa, Borrelia garinii
GSGGKLEGVKSDQS

SEQ ID NO: 82883 - protein, 14 aa, Borrelia garinii
SGGKLEGVKSDQSK

SEQ ID NO: 82884 - protein, 14 aa, Borrelia garinii
GGKLEGVKSDQSKV

SEQ ID NO: 82885 - protein, 14 aa, Borrelia garinii
GKLEGVKSDQSKVT

SEQ ID NO: 82886 - protein, 14 aa, Borrelia garinii
KLEGVKSDQSKVTM

SEQ ID NO: 82887 - protein, 14 aa, Borrelia garinii
LEGVKSDQSKVTMS

SEQ ID NO: 82888 - protein, 14 aa, Borrelia garinii
EGVKSDQSKVTMSI

SEQ ID NO: 82889 - protein, 14 aa, Borrelia garinii
GVKSDQSKVTMSIT

SEQ ID NO: 82890 - protein, 14 aa, Borrelia garinii
VKSDQSKVTMSITD

SEQ ID NO: 82891 - protein, 14 aa, Borrelia garinii
KSDQSKVTMSITDD

SEQ ID NO: 82892 - protein, 14 aa, Borrelia garinii
SDQSKVTMSITDDL

SEQ ID NO: 82893 - protein, 14 aa, Borrelia garinii
DQSKVTMSITDDLN

SEQ ID NO: 82894 - protein, 14 aa, Borrelia garinii
QSKVTMSITDDLNT

SEQ ID NO: 82895 - protein, 14 aa, Borrelia garinii
SKVTMSITDDLNTI

SEQ ID NO: 82896 - protein, 14 aa, Borrelia garinii
KVTMSITDDLNTIT

SEQ ID NO: 82897 - protein, 14 aa, Borrelia garinii
VTMSITDDLNTITV

SEQ ID NO: 82898 - protein, 14 aa, Borrelia garinii
TMSITDDLNTITVE

SEQ ID NO: 82899 - protein, 14 aa, Borrelia garinii
MSITDDLNTITVET

SEQ ID NO: 82900 - protein, 14 aa, Borrelia garinii
SITDDLNTITVETY

SEQ ID NO: 82901 - protein, 14 aa, Borrelia garinii
ITDDLNTITVETYD

SEQ ID NO: 82902 - protein, 14 aa, Borrelia garinii
TDDLNTITVETYDS

SEQ ID NO: 82903 - protein, 14 aa, Borrelia garinii
DDLNTITVETYDSS

SEQ ID NO: 82904 - protein, 14 aa, Borrelia garinii
DLNTITVETYDSSN

SEQ ID NO: 82905 - protein, 14 aa, Borrelia garinii
LNTITVETYDSSNT

SEQ ID NO: 82906 - protein, 14 aa, Borrelia garinii
NTITVETYDSSNTK

SEQ ID NO: 82907 - protein, 14 aa, Borrelia garinii
TITVETYDSSNTKV

SEQ ID NO: 82908 - protein, 14 aa, Borrelia garinii
ITVETYDSSNTKVA

SEQ ID NO: 82909 - protein, 14 aa, Borrelia garinii
TVETYDSSNTKVAS

SEQ ID NO: 82910 - protein, 14 aa, Borrelia garinii
VETYDSSNTKVASK

SEQ ID NO: 82911 - protein, 14 aa, Borrelia garinii
ETYDSSNTKVASKV

SEQ ID NO: 82912 - protein, 14 aa, Borrelia garinii
TYDSSNTKVASKVF

SEQ ID NO: 82913 - protein, 14 aa, Borrelia garinii
YDSSNTKVASKVFK

SEQ ID NO: 82914 - protein, 14 aa, Borrelia garinii
DSSNTKVASKVFKK

SEQ ID NO: 82915 - protein, 14 aa, Borrelia garinii
SSNTKVASKVFKKQ

SEQ ID NO: 82916 - protein, 14 aa, Borrelia garinii
SNTKVASKVFKKQG

SEQ ID NO: 82917 - protein, 14 aa, Borrelia garinii
NTKVASKVFKKQGS

SEQ ID NO: 82918 - protein, 14 aa, Borrelia garinii
TKVASKVFKKQGSL

SEQ ID NO: 82919 - protein, 14 aa, Borrelia garinii
KVASKVFKKQGSLT

SEQ ID NO: 82920 - protein, 14 aa, Borrelia garinii
VASKVFKKQGSLTE

SEQ ID NO: 82921 - protein, 14 aa, Borrelia garinii
ASKVFKKQGSLTEE

SEQ ID NO: 82922 - protein, 14 aa, Borrelia garinii
SKVFKKQGSLTEET

SEQ ID NO: 82923 - protein, 14 aa, Borrelia garinii
KVFKKQGSLTEETE

SEQ ID NO: 82924 - protein, 14 aa, Borrelia garinii
VFKKQGSLTEETEE

SEQ ID NO: 82925 - protein, 14 aa, Borrelia garinii
FKKQGSLTEETEET

SEQ ID NO: 82926 - protein, 14 aa, Borrelia garinii
KKQGSLTEETEETY

SEQ ID NO: 82927 - protein, 14 aa, Borrelia garinii
KQGSLTEETEETYK

SEQ ID NO: 82928 - protein, 14 aa, Borrelia garinii
QGSLTEETEETYKT

SEQ ID NO: 82929 - protein, 14 aa, Borrelia garinii
GSLTEETEETYKTG

SEQ ID NO: 82930 - protein, 14 aa, Borrelia garinii
SLTEETEETYKTGK

SEQ ID NO: 82931 - protein, 14 aa, Borrelia garinii
LTEETEETYKTGKL

SEQ ID NO: 82932 - protein, 14 aa, Borrelia garinii
TEETEETYKTGKLS

SEQ ID NO: 82933 - protein, 14 aa, Borrelia garinii
EETEETYKTGKLST

SEQ ID NO: 82934 - protein, 14 aa, Borrelia garinii
ETEETYKTGKLSTK

SEQ ID NO: 82935 - protein, 14 aa, Borrelia garinii
TEETYKTGKLSTKK

SEQ ID NO: 82936 - protein, 14 aa, Borrelia garinii
EETYKTGKLSTKKI

SEQ ID NO: 82937 - protein, 14 aa, Borrelia garinii
ETYKTGKLSTKKIT

SEQ ID NO: 82938 - protein, 14 aa, Borrelia garinii
TYKTGKLSTKKITR

SEQ ID NO: 82939 - protein, 14 aa, Borrelia garinii
YKTGKLSTKKITRT

SEQ ID NO: 82940 - protein, 14 aa, Borrelia garinii
KTGKLSTKKITRTN

SEQ ID NO: 82941 - protein, 14 aa, Borrelia garinii
TGKLSTKKITRTNG

SEQ ID NO: 82942 - protein, 14 aa, Borrelia garinii
GKLSTKKITRTNGT

SEQ ID NO: 82943 - protein, 14 aa, Borrelia garinii
KLSTKKITRTNGTT

SEQ ID NO: 82944 - protein, 14 aa, Borrelia garinii
LSTKKITRTNGTTL

SEQ ID NO: 82945 - protein, 14 aa, Borrelia garinii
STKKITRTNGTTLE

SEQ ID NO: 82946 - protein, 14 aa, Borrelia garinii
TKKITRTNGTTLEY

SEQ ID NO: 82947 - protein, 14 aa, Borrelia garinii
KKITRTNGTTLEYS

SEQ ID NO: 82948 - protein, 14 aa, Borrelia garinii
KITRTNGTTLEYSD

SEQ ID NO: 82949 - protein, 14 aa, Borrelia garinii
ITRTNGTTLEYSDM

SEQ ID NO: 82950 - protein, 14 aa, Borrelia garinii
TRTNGTTLEYSDMT

SEQ ID NO: 82951 - protein, 14 aa, Borrelia garinii
RTNGTTLEYSDMTN

SEQ ID NO: 82952 - protein, 14 aa, Borrelia garinii
TNGTTLEYSDMTND

SEQ ID NO: 82953 - protein, 14 aa, Borrelia garinii
NGTTLEYSDMTNDE

SEQ ID NO: 82954 - protein, 14 aa, Borrelia garinii
GTTLEYSDMTNDEN

SEQ ID NO: 82955 - protein, 14 aa, Borrelia garinii
TTLEYSDMTNDENA

SEQ ID NO: 82956 - protein, 14 aa, Borrelia garinii
TLEYSDMTNDENAT

SEQ ID NO: 82957 - protein, 14 aa, Borrelia garinii
LEYSDMTNDENATK

SEQ ID NO: 82958 - protein, 14 aa, Borrelia garinii
EYSDMTNDENATKA

SEQ ID NO: 82959 - protein, 14 aa, Borrelia garinii
YSDMTNDENATKAV

SEQ ID NO: 82960 - protein, 14 aa, Borrelia garinii
SDMTNDENATKAVE

SEQ ID NO: 82961 - protein, 14 aa, Borrelia garinii
DMTNDENATKAVET

SEQ ID NO: 82962 - protein, 14 aa, Borrelia garinii
MTNDENATKAVETL

SEQ ID NO: 82963 - protein, 14 aa, Borrelia garinii
TNDENATKAVETLK

SEQ ID NO: 82964 - protein, 14 aa, Borrelia garinii
NDENATKAVETLKN

SEQ ID NO: 82965 - protein, 14 aa, Borrelia garinii
DENATKAVETLKNG

SEQ ID NO: 82966 - protein, 14 aa, Borrelia garinii
ENATKAVETLKNGI

SEQ ID NO: 82967 - protein, 14 aa, Borrelia garinii
NATKAVETLKNGIM

SEQ ID NO: 82968 - protein, 14 aa, Borrelia garinii
ATKAVETLKNGIML

SEQ ID NO: 82969 - protein, 14 aa, Borrelia garinii
TKAVETLKNGIMLE

SEQ ID NO: 82970 - protein, 14 aa, Borrelia garinii
KAVETLKNGIMLEG

SEQ ID NO: 82971 - protein, 14 aa, Borrelia garinii
AVETLKNGIMLEGN

SEQ ID NO: 82972 - protein, 14 aa, Borrelia garinii
VETLKNGIMLEGNL

SEQ ID NO: 82973 - protein, 14 aa, Borrelia garinii
ETLKNGIMLEGNLV

SEQ ID NO: 82974 - protein, 14 aa, Borrelia garinii
TLKNGIMLEGNLVG

SEQ ID NO: 82975 - protein, 14 aa, Borrelia garinii
LKNGIMLEGNLVGG

SEQ ID NO: 82976 - protein, 14 aa, Borrelia garinii
KNGIMLEGNLVGGK

SEQ ID NO: 82977 - protein, 14 aa, Borrelia garinii
NGIMLEGNLVGGKT

SEQ ID NO: 82978 - protein, 14 aa, Borrelia garinii
GIMLEGNLVGGKTS

SEQ ID NO: 82979 - protein, 14 aa, Borrelia garinii
IMLEGNLVGGKTSV

SEQ ID NO: 82980 - protein, 14 aa, Borrelia garinii
MLEGNLVGGKTSVE

SEQ ID NO: 82981 - protein, 14 aa, Borrelia garinii
LEGNLVGGKTSVEI

SEQ ID NO: 82982 - protein, 14 aa, Borrelia garinii
EGNLVGGKTSVEIK

SEQ ID NO: 82983 - protein, 14 aa, Borrelia garinii
GNLVGGKTSVEIKE

SEQ ID NO: 82984 - protein, 14 aa, Borrelia garinii
NLVGGKTSVEIKEG

SEQ ID NO: 82985 - protein, 14 aa, Borrelia garinii
LVGGKTSVEIKEGT

SEQ ID NO: 82986 - protein, 14 aa, Borrelia garinii
VGGKTSVEIKEGTV

SEQ ID NO: 82987 - protein, 14 aa, Borrelia garinii
GGKTSVEIKEGTVT

SEQ ID NO: 82988 - protein, 14 aa, Borrelia garinii
GKTSVEIKEGTVTL

SEQ ID NO: 82989 - protein, 14 aa, Borrelia garinii
KTSVEIKEGTVTLK

SEQ ID NO: 82990 - protein, 14 aa, Borrelia garinii
TSVEIKEGTVTLKK

SEQ ID NO: 82991 - protein, 14 aa, Borrelia garinii
SVEIKEGTVTLKKE

SEQ ID NO: 82992 - protein, 14 aa, Borrelia garinii
VEIKEGTVTLKKEI

SEQ ID NO: 82993 - protein, 14 aa, Borrelia garinii
EIKEGTVTLKKEIE

SEQ ID NO: 82994 - protein, 14 aa, Borrelia garinii
IKEGTVTLKKEIEK

SEQ ID NO: 82995 - protein, 14 aa, Borrelia garinii
KEGTVTLKKEIEKA

SEQ ID NO: 82996 - protein, 14 aa, Borrelia garinii
EGTVTLKKEIEKAG

SEQ ID NO: 82997 - protein, 14 aa, Borrelia garinii
GTVTLKKEIEKAGT

SEQ ID NO: 82998 - protein, 14 aa, Borrelia garinii
TVTLKKEIEKAGTV

SEQ ID NO: 82999 - protein, 14 aa, Borrelia garinii
VTLKKEIEKAGTVK

SEQ ID NO: 83000 - protein, 14 aa, Borrelia garinii
TLKKEIEKAGTVKL

SEQ ID NO: 83001 - protein, 14 aa, Borrelia garinii
LKKEIEKAGTVKLF

SEQ ID NO: 83002 - protein, 14 aa, Borrelia garinii
KKEIEKAGTVKLFL

SEQ ID NO: 83003 - protein, 14 aa, Borrelia garinii
KEIEKAGTVKLFLD

SEQ ID NO: 83004 - protein, 14 aa, Borrelia garinii
EIEKAGTVKLFLDD

SEQ ID NO: 83005 - protein, 14 aa, Borrelia garinii
IEKAGTVKLFLDDT

SEQ ID NO: 83006 - protein, 14 aa, Borrelia garinii
EKAGTVKLFLDDTS

SEQ ID NO: 83007 - protein, 14 aa, Borrelia garinii
KAGTVKLFLDDTSS

SEQ ID NO: 83008 - protein, 14 aa, Borrelia garinii
AGTVKLFLDDTSSG

SEQ ID NO: 83009 - protein, 14 aa, Borrelia garinii
GTVKLFLDDTSSGS

SEQ ID NO: 83010 - protein, 14 aa, Borrelia garinii
TVKLFLDDTSSGST

SEQ ID NO: 83011 - protein, 14 aa, Borrelia garinii
VKLFLDDTSSGSTK

SEQ ID NO: 83012 - protein, 14 aa, Borrelia garinii
KLFLDDTSSGSTKK

SEQ ID NO: 83013 - protein, 14 aa, Borrelia garinii
LFLDDTSSGSTKKT

SEQ ID NO: 83014 - protein, 14 aa, Borrelia garinii
FLDDTSSGSTKKTA

SEQ ID NO: 83015 - protein, 14 aa, Borrelia garinii
LDDTSSGSTKKTAV

SEQ ID NO: 83016 - protein, 14 aa, Borrelia garinii
DDTSSGSTKKTAVW

SEQ ID NO: 83017 - protein, 14 aa, Borrelia garinii
DTSSGSTKKTAVWS

SEQ ID NO: 83018 - protein, 14 aa, Borrelia garinii
TSSGSTKKTAVWSD

SEQ ID NO: 83019 - protein, 14 aa, Borrelia garinii
SSGSTKKTAVWSDT

SEQ ID NO: 83020 - protein, 14 aa, Borrelia garinii
SGSTKKTAVWSDTS

SEQ ID NO: 83021 - protein, 14 aa, Borrelia garinii
GSTKKTAVWSDTSN

SEQ ID NO: 83022 - protein, 14 aa, Borrelia garinii
STKKTAVWSDTSNT

SEQ ID NO: 83023 - protein, 14 aa, Borrelia garinii
TKKTAVWSDTSNTL

SEQ ID NO: 83024 - protein, 14 aa, Borrelia garinii
KKTAVWSDTSNTLT

SEQ ID NO: 83025 - protein, 14 aa, Borrelia garinii
KTAVWSDTSNTLTV

SEQ ID NO: 83026 - protein, 14 aa, Borrelia garinii
TAVWSDTSNTLTVS

SEQ ID NO: 83027 - protein, 14 aa, Borrelia garinii
AVWSDTSNTLTVSA

SEQ ID NO: 83028 - protein, 14 aa, Borrelia garinii
VWSDTSNTLTVSAD

SEQ ID NO: 83029 - protein, 14 aa, Borrelia garinii
WSDTSNTLTVSADS

SEQ ID NO: 83030 - protein, 14 aa, Borrelia garinii
SDTSNTLTVSADSK

SEQ ID NO: 83031 - protein, 14 aa, Borrelia garinii
DTSNTLTVSADSKK

SEQ ID NO: 83032 - protein, 14 aa, Borrelia garinii
TSNTLTVSADSKKI

SEQ ID NO: 83033 - protein, 14 aa, Borrelia garinii
SNTLTVSADSKKIK

SEQ ID NO: 83034 - protein, 14 aa, Borrelia garinii
NTLTVSADSKKIKD

SEQ ID NO: 83035 - protein, 14 aa, Borrelia garinii
TLTVSADSKKIKDF

SEQ ID NO: 83036 - protein, 14 aa, Borrelia garinii
LTVSADSKKIKDFV

SEQ ID NO: 83037 - protein, 14 aa, Borrelia garinii
TVSADSKKIKDFVF

SEQ ID NO: 83038 - protein, 14 aa, Borrelia garinii
VSADSKKIKDFVFL

SEQ ID NO: 83039 - protein, 14 aa, Borrelia garinii
SADSKKIKDFVFLT

SEQ ID NO: 83040 - protein, 14 aa, Borrelia garinii
ADSKKIKDFVFLTD

SEQ ID NO: 83041 - protein, 14 aa, Borrelia garinii
DSKKIKDFVFLTDG

SEQ ID NO: 83042 - protein, 14 aa, Borrelia garinii
SKKIKDFVFLTDGT

SEQ ID NO: 83043 - protein, 14 aa, Borrelia garinii
KKIKDFVFLTDGTI

SEQ ID NO: 83044 - protein, 14 aa, Borrelia garinii
KIKDFVFLTDGTIT

SEQ ID NO: 83045 - protein, 14 aa, Borrelia garinii
IKDFVFLTDGTITV

SEQ ID NO: 83046 - protein, 14 aa, Borrelia garinii
KDFVFLTDGTITVQ

SEQ ID NO: 83047 - protein, 14 aa, Borrelia garinii
DFVFLTDGTITVQN

SEQ ID NO: 83048 - protein, 14 aa, Borrelia garinii
FVFLTDGTITVQNY

SEQ ID NO: 83049 - protein, 14 aa, Borrelia garinii
VFLTDGTITVQNYD

SEQ ID NO: 83050 - protein, 14 aa, Borrelia garinii
FLTDGTITVQNYDT

SEQ ID NO: 83051 - protein, 14 aa, Borrelia garinii
LTDGTITVQNYDTA

SEQ ID NO: 83052 - protein, 14 aa, Borrelia garinii
TDGTITVQNYDTAG

SEQ ID NO: 83053 - protein, 14 aa, Borrelia garinii
DGTITVQNYDTAGT

SEQ ID NO: 83054 - protein, 14 aa, Borrelia garinii
GTITVQNYDTAGTK

SEQ ID NO: 83055 - protein, 14 aa, Borrelia garinii
TITVQNYDTAGTKL

SEQ ID NO: 83056 - protein, 14 aa, Borrelia garinii
ITVQNYDTAGTKLA

SEQ ID NO: 83057 - protein, 14 aa, Borrelia garinii
TVQNYDTAGTKLAG

SEQ ID NO: 83058 - protein, 14 aa, Borrelia garinii
VQNYDTAGTKLAGT

SEQ ID NO: 83059 - protein, 14 aa, Borrelia garinii
QNYDTAGTKLAGTA

SEQ ID NO: 83060 - protein, 14 aa, Borrelia garinii
NYDTAGTKLAGTAT

SEQ ID NO: 83061 - protein, 14 aa, Borrelia garinii
YDTAGTKLAGTATE

SEQ ID NO: 83062 - protein, 14 aa, Borrelia garinii
DTAGTKLAGTATEI

SEQ ID NO: 83063 - protein, 14 aa, Borrelia garinii
TAGTKLAGTATEIK

SEQ ID NO: 83064 - protein, 14 aa, Borrelia garinii
AGTKLAGTATEIKD

SEQ ID NO: 83065 - protein, 14 aa, Borrelia garinii
GTKLAGTATEIKDL

SEQ ID NO: 83066 - protein, 14 aa, Borrelia garinii
TKLAGTATEIKDLE

SEQ ID NO: 83067 - protein, 14 aa, Borrelia garinii
KLAGTATEIKDLEA

SEQ ID NO: 83068 - protein, 14 aa, Borrelia garinii
LAGTATEIKDLEAL

SEQ ID NO: 83069 - protein, 14 aa, Borrelia garinii
AGTATEIKDLEALK

SEQ ID NO: 83070 - protein, 14 aa, Borrelia garinii
GTATEIKDLEALKA

SEQ ID NO: 83071 - protein, 14 aa, Borrelia garinii
TATEIKDLEALKAA

SEQ ID NO: 83072 - protein, 14 aa, Borrelia garinii
ATEIKDLEALKAAL

SEQ ID NO: 83073 - protein, 14 aa, Borrelia garinii
TEIKDLEALKAALK

SEQ ID NO: 83074 - protein, 15 aa, Borrelia garinii
MKKYLLGFALVLALI

SEQ ID NO: 83075 - protein, 15 aa, Borrelia garinii
KKYLLGFALVLALIA

SEQ ID NO: 83076 - protein, 15 aa, Borrelia garinii
KYLLGFALVLALIAC

SEQ ID NO: 83077 - protein, 15 aa, Borrelia garinii
YLLGFALVLALIACG

SEQ ID NO: 83078 - protein, 15 aa, Borrelia garinii
LLGFALVLALIACGQ

SEQ ID NO: 83079 - protein, 15 aa, Borrelia garinii
LGFALVLALIACGQK

SEQ ID NO: 83080 - protein, 15 aa, Borrelia garinii
GFALVLALIACGQKG

SEQ ID NO: 83081 - protein, 15 aa, Borrelia garinii
FALVLALIACGQKGA

SEQ ID NO: 83082 - protein, 15 aa, Borrelia garinii
ALVLALIACGQKGAE

SEQ ID NO: 83083 - protein, 15 aa, Borrelia garinii
LVLALIACGQKGAEP

SEQ ID NO: 83084 - protein, 15 aa, Borrelia garinii
VLALIACGQKGAEPK

SEQ ID NO: 83085 - protein, 15 aa, Borrelia garinii
LALIACGQKGAEPKH

SEQ ID NO: 83086 - protein, 15 aa, Borrelia garinii
ALIACGQKGAEPKHN

SEQ ID NO: 83087 - protein, 15 aa, Borrelia garinii
LIACGQKGAEPKHND

SEQ ID NO: 83088 - protein, 15 aa, Borrelia garinii
IACGQKGAEPKHNDQ

SEQ ID NO: 83089 - protein, 15 aa, Borrelia garinii
ACGQKGAEPKHNDQE

SEQ ID NO: 83090 - protein, 15 aa, Borrelia garinii
CGQKGAEPKHNDQEV

SEQ ID NO: 83091 - protein, 15 aa, Borrelia garinii
GQKGAEPKHNDQEVE

SEQ ID NO: 83092 - protein, 15 aa, Borrelia garinii
QKGAEPKHNDQEVED

SEQ ID NO: 83093 - protein, 15 aa, Borrelia garinii
KGAEPKHNDQEVEDS

SEQ ID NO: 83094 - protein, 15 aa, Borrelia garinii
GAEPKHNDQEVEDSK

SEQ ID NO: 83095 - protein, 15 aa, Borrelia garinii
AEPKHNDQEVEDSKK

SEQ ID NO: 83096 - protein, 15 aa, Borrelia garinii
EPKHNDQEVEDSKKD

SEQ ID NO: 83097 - protein, 15 aa, Borrelia garinii
PKHNDQEVEDSKKDQ

SEQ ID NO: 83098 - protein, 15 aa, Borrelia garinii
KHNDQEVEDSKKDQK

SEQ ID NO: 83099 - protein, 15 aa, Borrelia garinii
HNDQEVEDSKKDQKD

SEQ ID NO: 83100 - protein, 15 aa, Borrelia garinii
NDQEVEDSKKDQKDA

SEQ ID NO: 83101 - protein, 15 aa, Borrelia garinii
DQEVEDSKKDQKDAS

SEQ ID NO: 83102 - protein, 15 aa, Borrelia garinii
QEVEDSKKDQKDASK

SEQ ID NO: 83103 - protein, 15 aa, Borrelia garinii
EVEDSKKDQKDASKK

SEQ ID NO: 83104 - protein, 15 aa, Borrelia garinii
VEDSKKDQKDASKKD

SEQ ID NO: 83105 - protein, 15 aa, Borrelia garinii
EDSKKDQKDASKKDL

SEQ ID NO: 83106 - protein, 15 aa, Borrelia garinii
DSKKDQKDASKKDLP

SEQ ID NO: 83107 - protein, 15 aa, Borrelia garinii
SKKDQKDASKKDLPL

SEQ ID NO: 83108 - protein, 15 aa, Borrelia garinii
KKDQKDASKKDLPLV

SEQ ID NO: 83109 - protein, 15 aa, Borrelia garinii
KDQKDASKKDLPLVT

SEQ ID NO: 83110 - protein, 15 aa, Borrelia garinii
DQKDASKKDLPLVTE

SEQ ID NO: 83111 - protein, 15 aa, Borrelia garinii
QKDASKKDLPLVTED

SEQ ID NO: 83112 - protein, 15 aa, Borrelia garinii
KDASKKDLPLVTEDT

SEQ ID NO: 83113 - protein, 15 aa, Borrelia garinii
DASKKDLPLVTEDTV

SEQ ID NO: 83114 - protein, 15 aa, Borrelia garinii
ASKKDLPLVTEDTVK

SEQ ID NO: 83115 - protein, 15 aa, Borrelia garinii
SKKDLPLVTEDTVKL

SEQ ID NO: 83116 - protein, 15 aa, Borrelia garinii
KKDLPLVTEDTVKLF

SEQ ID NO: 83117 - protein, 15 aa, Borrelia garinii
KDLPLVTEDTVKLFN

SEQ ID NO: 83118 - protein, 15 aa, Borrelia garinii
DLPLVTEDTVKLFND

SEQ ID NO: 83119 - protein, 15 aa, Borrelia garinii
LPLVTEDTVKLFNDT

SEQ ID NO: 83120 - protein, 15 aa, Borrelia garinii
PLVTEDTVKLFNDTK

SEQ ID NO: 83121 - protein, 15 aa, Borrelia garinii
LVTEDTVKLFNDTKI

SEQ ID NO: 83122 - protein, 15 aa, Borrelia garinii
VTEDTVKLFNDTKIF

SEQ ID NO: 83123 - protein, 15 aa, Borrelia garinii
TEDTVKLFNDTKIFI

SEQ ID NO: 83124 - protein, 15 aa, Borrelia garinii
EDTVKLFNDTKIFIS

SEQ ID NO: 83125 - protein, 15 aa, Borrelia garinii
DTVKLFNDTKIFISK

SEQ ID NO: 83126 - protein, 15 aa, Borrelia garinii
TVKLFNDTKIFISKE

SEQ ID NO: 83127 - protein, 15 aa, Borrelia garinii
VKLFNDTKIFISKEK

SEQ ID NO: 83128 - protein, 15 aa, Borrelia garinii
KLFNDTKIFISKEKN

SEQ ID NO: 83129 - protein, 15 aa, Borrelia garinii
LFNDTKIFISKEKNK

SEQ ID NO: 83130 - protein, 15 aa, Borrelia garinii
FNDTKIFISKEKNKD

SEQ ID NO: 83131 - protein, 15 aa, Borrelia garinii
NDTKIFISKEKNKDG

SEQ ID NO: 83132 - protein, 15 aa, Borrelia garinii
DTKIFISKEKNKDGK

SEQ ID NO: 83133 - protein, 15 aa, Borrelia garinii
TKIFISKEKNKDGKY

SEQ ID NO: 83134 - protein, 15 aa, Borrelia garinii
KIFISKEKNKDGKYE

SEQ ID NO: 83135 - protein, 15 aa, Borrelia garinii
IFISKEKNKDGKYEL

SEQ ID NO: 83136 - protein, 15 aa, Borrelia garinii
FISKEKNKDGKYELR

SEQ ID NO: 83137 - protein, 15 aa, Borrelia garinii
ISKEKNKDGKYELRA

SEQ ID NO: 83138 - protein, 15 aa, Borrelia garinii
SKEKNKDGKYELRAT

SEQ ID NO: 83139 - protein, 15 aa, Borrelia garinii
KEKNKDGKYELRATV

SEQ ID NO: 83140 - protein, 15 aa, Borrelia garinii
EKNKDGKYELRATVD

SEQ ID NO: 83141 - protein, 15 aa, Borrelia garinii
KNKDGKYELRATVDT

SEQ ID NO: 83142 - protein, 15 aa, Borrelia garinii
NKDGKYELRATVDTV

SEQ ID NO: 83143 - protein, 15 aa, Borrelia garinii
KDGKYELRATVDTVE

SEQ ID NO: 83144 - protein, 15 aa, Borrelia garinii
DGKYELRATVDTVEL

SEQ ID NO: 83145 - protein, 15 aa, Borrelia garinii
GKYELRATVDTVELK

SEQ ID NO: 83146 - protein, 15 aa, Borrelia garinii
KYELRATVDTVELKG

SEQ ID NO: 83147 - protein, 15 aa, Borrelia garinii
YELRATVDTVELKGV

SEQ ID NO: 83148 - protein, 15 aa, Borrelia garinii
ELRATVDTVELKGVA

SEQ ID NO: 83149 - protein, 15 aa, Borrelia garinii
LRATVDTVELKGVAD

SEQ ID NO: 83150 - protein, 15 aa, Borrelia garinii
RATVDTVELKGVADK

SEQ ID NO: 83151 - protein, 15 aa, Borrelia garinii
ATVDTVELKGVADKN

SEQ ID NO: 83152 - protein, 15 aa, Borrelia garinii
TVDTVELKGVADKND

SEQ ID NO: 83153 - protein, 15 aa, Borrelia garinii
VDTVELKGVADKNDG

SEQ ID NO: 83154 - protein, 15 aa, Borrelia garinii
DTVELKGVADKNDGS

SEQ ID NO: 83155 - protein, 15 aa, Borrelia garinii
TVELKGVADKNDGSG

SEQ ID NO: 83156 - protein, 15 aa, Borrelia garinii
VELKGVADKNDGSGG

SEQ ID NO: 83157 - protein, 15 aa, Borrelia garinii
ELKGVADKNDGSGGK

SEQ ID NO: 83158 - protein, 15 aa, Borrelia garinii
LKGVADKNDGSGGKL

SEQ ID NO: 83159 - protein, 15 aa, Borrelia garinii
KGVADKNDGSGGKLE

SEQ ID NO: 83160 - protein, 15 aa, Borrelia garinii
GVADKNDGSGGKLEG

SEQ ID NO: 83161 - protein, 15 aa, Borrelia garinii
VADKNDGSGGKLEGV

SEQ ID NO: 83162 - protein, 15 aa, Borrelia garinii
ADKNDGSGGKLEGVK

SEQ ID NO: 83163 - protein, 15 aa, Borrelia garinii
DKNDGSGGKLEGVKS

SEQ ID NO: 83164 - protein, 15 aa, Borrelia garinii
KNDGSGGKLEGVKSD

SEQ ID NO: 83165 - protein, 15 aa, Borrelia garinii
NDGSGGKLEGVKSDQ

SEQ ID NO: 83166 - protein, 15 aa, Borrelia garinii
DGSGGKLEGVKSDQS

SEQ ID NO: 83167 - protein, 15 aa, Borrelia garinii
GSGGKLEGVKSDQSK

SEQ ID NO: 83168 - protein, 15 aa, Borrelia garinii
SGGKLEGVKSDQSKV

SEQ ID NO: 83169 - protein, 15 aa, Borrelia garinii
GGKLEGVKSDQSKVT

SEQ ID NO: 83170 - protein, 15 aa, Borrelia garinii
GKLEGVKSDQSKVTM

SEQ ID NO: 83171 - protein, 15 aa, Borrelia garinii
KLEGVKSDQSKVTMS

SEQ ID NO: 83172 - protein, 15 aa, Borrelia garinii
LEGVKSDQSKVTMSI

SEQ ID NO: 83173 - protein, 15 aa, Borrelia garinii
EGVKSDQSKVTMSIT

SEQ ID NO: 83174 - protein, 15 aa, Borrelia garinii
GVKSDQSKVTMSITD

SEQ ID NO: 83175 - protein, 15 aa, Borrelia garinii
VKSDQSKVTMSITDD

SEQ ID NO: 83176 - protein, 15 aa, Borrelia garinii
KSDQSKVTMSITDDL

SEQ ID NO: 83177 - protein, 15 aa, Borrelia garinii
SDQSKVTMSITDDLN

SEQ ID NO: 83178 - protein, 15 aa, Borrelia garinii
DQSKVTMSITDDLNT

SEQ ID NO: 83179 - protein, 15 aa, Borrelia garinii
QSKVTMSITDDLNTI

SEQ ID NO: 83180 - protein, 15 aa, Borrelia garinii
SKVTMSITDDLNTIT

SEQ ID NO: 83181 - protein, 15 aa, Borrelia garinii
KVTMSITDDLNTITV

SEQ ID NO: 83182 - protein, 15 aa, Borrelia garinii
VTMSITDDLNTITVE

SEQ ID NO: 83183 - protein, 15 aa, Borrelia garinii
TMSITDDLNTITVET

SEQ ID NO: 83184 - protein, 15 aa, Borrelia garinii
MSITDDLNTITVETY

SEQ ID NO: 83185 - protein, 15 aa, Borrelia garinii
SITDDLNTITVETYD

SEQ ID NO: 83186 - protein, 15 aa, Borrelia garinii
ITDDLNTITVETYDS

SEQ ID NO: 83187 - protein, 15 aa, Borrelia garinii
TDDLNTITVETYDSS

SEQ ID NO: 83188 - protein, 15 aa, Borrelia garinii
DDLNTITVETYDSSN

SEQ ID NO: 83189 - protein, 15 aa, Borrelia garinii
DLNTITVETYDSSNT

SEQ ID NO: 83190 - protein, 15 aa, Borrelia garinii
LNTITVETYDSSNTK

SEQ ID NO: 83191 - protein, 15 aa, Borrelia garinii
NTITVETYDSSNTKV

SEQ ID NO: 83192 - protein, 15 aa, Borrelia garinii
TITVETYDSSNTKVA

SEQ ID NO: 83193 - protein, 15 aa, Borrelia garinii
ITVETYDSSNTKVAS

SEQ ID NO: 83194 - protein, 15 aa, Borrelia garinii
TVETYDSSNTKVASK

SEQ ID NO: 83195 - protein, 15 aa, Borrelia garinii
VETYDSSNTKVASKV

SEQ ID NO: 83196 - protein, 15 aa, Borrelia garinii
ETYDSSNTKVASKVF

SEQ ID NO: 83197 - protein, 15 aa, Borrelia garinii
TYDSSNTKVASKVFK

SEQ ID NO: 83198 - protein, 15 aa, Borrelia garinii
YDSSNTKVASKVFKK

SEQ ID NO: 83199 - protein, 15 aa, Borrelia garinii
DSSNTKVASKVFKKQ

SEQ ID NO: 83200 - protein, 15 aa, Borrelia garinii
SSNTKVASKVFKKQG

SEQ ID NO: 83201 - protein, 15 aa, Borrelia garinii
SNTKVASKVFKKQGS

SEQ ID NO: 83202 - protein, 15 aa, Borrelia garinii
NTKVASKVFKKQGSL

SEQ ID NO: 83203 - protein, 15 aa, Borrelia garinii
TKVASKVFKKQGSLT

SEQ ID NO: 83204 - protein, 15 aa, Borrelia garinii
KVASKVFKKQGSLTE

SEQ ID NO: 83205 - protein, 15 aa, Borrelia garinii
VASKVFKKQGSLTEE

SEQ ID NO: 83206 - protein, 15 aa, Borrelia garinii
ASKVFKKQGSLTEET

SEQ ID NO: 83207 - protein, 15 aa, Borrelia garinii
SKVFKKQGSLTEETE

SEQ ID NO: 83208 - protein, 15 aa, Borrelia garinii
KVFKKQGSLTEETEE

SEQ ID NO: 83209 - protein, 15 aa, Borrelia garinii
VFKKQGSLTEETEET

SEQ ID NO: 83210 - protein, 15 aa, Borrelia garinii
FKKQGSLTEETEETY

SEQ ID NO: 83211 - protein, 15 aa, Borrelia garinii
KKQGSLTEETEETYK

SEQ ID NO: 83212 - protein, 15 aa, Borrelia garinii
KQGSLTEETEETYKT

SEQ ID NO: 83213 - protein, 15 aa, Borrelia garinii
QGSLTEETEETYKTG

SEQ ID NO: 83214 - protein, 15 aa, Borrelia garinii
GSLTEETEETYKTGK

SEQ ID NO: 83215 - protein, 15 aa, Borrelia garinii
SLTEETEETYKTGKL

SEQ ID NO: 83216 - protein, 15 aa, Borrelia garinii
LTEETEETYKTGKLS

SEQ ID NO: 83217 - protein, 15 aa, Borrelia garinii
TEETEETYKTGKLST

SEQ ID NO: 83218 - protein, 15 aa, Borrelia garinii
EETEETYKTGKLSTK

SEQ ID NO: 83219 - protein, 15 aa, Borrelia garinii
ETEETYKTGKLSTKK

SEQ ID NO: 83220 - protein, 15 aa, Borrelia garinii
TEETYKTGKLSTKKI

SEQ ID NO: 83221 - protein, 15 aa, Borrelia garinii
EETYKTGKLSTKKIT

SEQ ID NO: 83222 - protein, 15 aa, Borrelia garinii
ETYKTGKLSTKKITR

SEQ ID NO: 83223 - protein, 15 aa, Borrelia garinii
TYKTGKLSTKKITRT

SEQ ID NO: 83224 - protein, 15 aa, Borrelia garinii
YKTGKLSTKKITRTN

SEQ ID NO: 83225 - protein, 15 aa, Borrelia garinii
KTGKLSTKKITRTNG

SEQ ID NO: 83226 - protein, 15 aa, Borrelia garinii
TGKLSTKKITRTNGT

SEQ ID NO: 83227 - protein, 15 aa, Borrelia garinii
GKLSTKKITRTNGTT

SEQ ID NO: 83228 - protein, 15 aa, Borrelia garinii
KLSTKKITRTNGTTL

SEQ ID NO: 83229 - protein, 15 aa, Borrelia garinii
LSTKKITRTNGTTLE

SEQ ID NO: 83230 - protein, 15 aa, Borrelia garinii
STKKITRTNGTTLEY

SEQ ID NO: 83231 - protein, 15 aa, Borrelia garinii
TKKITRTNGTTLEYS

SEQ ID NO: 83232 - protein, 15 aa, Borrelia garinii
KKITRTNGTTLEYSD

SEQ ID NO: 83233 - protein, 15 aa, Borrelia garinii
KITRTNGTTLEYSDM

SEQ ID NO: 83234 - protein, 15 aa, Borrelia garinii
ITRTNGTTLEYSDMT

SEQ ID NO: 83235 - protein, 15 aa, Borrelia garinii
TRTNGTTLEYSDMTN

SEQ ID NO: 83236 - protein, 15 aa, Borrelia garinii
RTNGTTLEYSDMTND

SEQ ID NO: 83237 - protein, 15 aa, Borrelia garinii
TNGTTLEYSDMTNDE

SEQ ID NO: 83238 - protein, 15 aa, Borrelia garinii
NGTTLEYSDMTNDEN

SEQ ID NO: 83239 - protein, 15 aa, Borrelia garinii
GTTLEYSDMTNDENA

SEQ ID NO: 83240 - protein, 15 aa, Borrelia garinii
TTLEYSDMTNDENAT

SEQ ID NO: 83241 - protein, 15 aa, Borrelia garinii
TLEYSDMTNDENATK

SEQ ID NO: 83242 - protein, 15 aa, Borrelia garinii
LEYSDMTNDENATKA

SEQ ID NO: 83243 - protein, 15 aa, Borrelia garinii
EYSDMTNDENATKAV

SEQ ID NO: 83244 - protein, 15 aa, Borrelia garinii
YSDMTNDENATKAVE

SEQ ID NO: 83245 - protein, 15 aa, Borrelia garinii
SDMTNDENATKAVET

SEQ ID NO: 83246 - protein, 15 aa, Borrelia garinii
DMTNDENATKAVETL

SEQ ID NO: 83247 - protein, 15 aa, Borrelia garinii
MTNDENATKAVETLK

SEQ ID NO: 83248 - protein, 15 aa, Borrelia garinii
TNDENATKAVETLKN

SEQ ID NO: 83249 - protein, 15 aa, Borrelia garinii
NDENATKAVETLKNG

SEQ ID NO: 83250 - protein, 15 aa, Borrelia garinii
DENATKAVETLKNGI

SEQ ID NO: 83251 - protein, 15 aa, Borrelia garinii
ENATKAVETLKNGIM

SEQ ID NO: 83252 - protein, 15 aa, Borrelia garinii
NATKAVETLKNGIML

SEQ ID NO: 83253 - protein, 15 aa, Borrelia garinii
ATKAVETLKNGIMLE

SEQ ID NO: 83254 - protein, 15 aa, Borrelia garinii
TKAVETLKNGIMLEG

SEQ ID NO: 83255 - protein, 15 aa, Borrelia garinii
KAVETLKNGIMLEGN

SEQ ID NO: 83256 - protein, 15 aa, Borrelia garinii
AVETLKNGIMLEGNL

SEQ ID NO: 83257 - protein, 15 aa, Borrelia garinii
VETLKNGIMLEGNLV

SEQ ID NO: 83258 - protein, 15 aa, Borrelia garinii
ETLKNGIMLEGNLVG

SEQ ID NO: 83259 - protein, 15 aa, Borrelia garinii
TLKNGIMLEGNLVGG

SEQ ID NO: 83260 - protein, 15 aa, Borrelia garinii
LKNGIMLEGNLVGGK

SEQ ID NO: 83261 - protein, 15 aa, Borrelia garinii
KNGIMLEGNLVGGKT

SEQ ID NO: 83262 - protein, 15 aa, Borrelia garinii
NGIMLEGNLVGGKTS

SEQ ID NO: 83263 - protein, 15 aa, Borrelia garinii
GIMLEGNLVGGKTSV

SEQ ID NO: 83264 - protein, 15 aa, Borrelia garinii
IMLEGNLVGGKTSVE

SEQ ID NO: 83265 - protein, 15 aa, Borrelia garinii
MLEGNLVGGKTSVEI

SEQ ID NO: 83266 - protein, 15 aa, Borrelia garinii
LEGNLVGGKTSVEIK

SEQ ID NO: 83267 - protein, 15 aa, Borrelia garinii
EGNLVGGKTSVEIKE

SEQ ID NO: 83268 - protein, 15 aa, Borrelia garinii
GNLVGGKTSVEIKEG

SEQ ID NO: 83269 - protein, 15 aa, Borrelia garinii
NLVGGKTSVEIKEGT

SEQ ID NO: 83270 - protein, 15 aa, Borrelia garinii
LVGGKTSVEIKEGTV

SEQ ID NO: 83271 - protein, 15 aa, Borrelia garinii
VGGKTSVEIKEGTVT

SEQ ID NO: 83272 - protein, 15 aa, Borrelia garinii
GGKTSVEIKEGTVTL

SEQ ID NO: 83273 - protein, 15 aa, Borrelia garinii
GKTSVEIKEGTVTLK

SEQ ID NO: 83274 - protein, 15 aa, Borrelia garinii
KTSVEIKEGTVTLKK

SEQ ID NO: 83275 - protein, 15 aa, Borrelia garinii
TSVEIKEGTVTLKKE

SEQ ID NO: 83276 - protein, 15 aa, Borrelia garinii
SVEIKEGTVTLKKEI

SEQ ID NO: 83277 - protein, 15 aa, Borrelia garinii
VEIKEGTVTLKKEIE

SEQ ID NO: 83278 - protein, 15 aa, Borrelia garinii
EIKEGTVTLKKEIEK

SEQ ID NO: 83279 - protein, 15 aa, Borrelia garinii
IKEGTVTLKKEIEKA

SEQ ID NO: 83280 - protein, 15 aa, Borrelia garinii
KEGTVTLKKEIEKAG

SEQ ID NO: 83281 - protein, 15 aa, Borrelia garinii
EGTVTLKKEIEKAGT

SEQ ID NO: 83282 - protein, 15 aa, Borrelia garinii
GTVTLKKEIEKAGTV

SEQ ID NO: 83283 - protein, 15 aa, Borrelia garinii
TVTLKKEIEKAGTVK

SEQ ID NO: 83284 - protein, 15 aa, Borrelia garinii
VTLKKEIEKAGTVKL

SEQ ID NO: 83285 - protein, 15 aa, Borrelia garinii
TLKKEIEKAGTVKLF

SEQ ID NO: 83286 - protein, 15 aa, Borrelia garinii
LKKEIEKAGTVKLFL

SEQ ID NO: 83287 - protein, 15 aa, Borrelia garinii
KKEIEKAGTVKLFLD

SEQ ID NO: 83288 - protein, 15 aa, Borrelia garinii
KEIEKAGTVKLFLDD

SEQ ID NO: 83289 - protein, 15 aa, Borrelia garinii
EIEKAGTVKLFLDDT

SEQ ID NO: 83290 - protein, 15 aa, Borrelia garinii
IEKAGTVKLFLDDTS

SEQ ID NO: 83291 - protein, 15 aa, Borrelia garinii
EKAGTVKLFLDDTSS

SEQ ID NO: 83292 - protein, 15 aa, Borrelia garinii
KAGTVKLFLDDTSSG

SEQ ID NO: 83293 - protein, 15 aa, Borrelia garinii
AGTVKLFLDDTSSGS

SEQ ID NO: 83294 - protein, 15 aa, Borrelia garinii
GTVKLFLDDTSSGST

SEQ ID NO: 83295 - protein, 15 aa, Borrelia garinii
TVKLFLDDTSSGSTK

SEQ ID NO: 83296 - protein, 15 aa, Borrelia garinii
VKLFLDDTSSGSTKK

SEQ ID NO: 83297 - protein, 15 aa, Borrelia garinii
KLFLDDTSSGSTKKT

SEQ ID NO: 83298 - protein, 15 aa, Borrelia garinii
LFLDDTSSGSTKKTA

SEQ ID NO: 83299 - protein, 15 aa, Borrelia garinii
FLDDTSSGSTKKTAV

SEQ ID NO: 83300 - protein, 15 aa, Borrelia garinii
LDDTSSGSTKKTAVW

SEQ ID NO: 83301 - protein, 15 aa, Borrelia garinii
DDTSSGSTKKTAVWS

SEQ ID NO: 83302 - protein, 15 aa, Borrelia garinii
DTSSGSTKKTAVWSD

SEQ ID NO: 83303 - protein, 15 aa, Borrelia garinii
TSSGSTKKTAVWSDT

SEQ ID NO: 83304 - protein, 15 aa, Borrelia garinii
SSGSTKKTAVWSDTS

SEQ ID NO: 83305 - protein, 15 aa, Borrelia garinii
SGSTKKTAVWSDTSN

SEQ ID NO: 83306 - protein, 15 aa, Borrelia garinii
GSTKKTAVWSDTSNT

SEQ ID NO: 83307 - protein, 15 aa, Borrelia garinii
STKKTAVWSDTSNTL

SEQ ID NO: 83308 - protein, 15 aa, Borrelia garinii
TKKTAVWSDTSNTLT

SEQ ID NO: 83309 - protein, 15 aa, Borrelia garinii
KKTAVWSDTSNTLTV

SEQ ID NO: 83310 - protein, 15 aa, Borrelia garinii
KTAVWSDTSNTLTVS

SEQ ID NO: 83311 - protein, 15 aa, Borrelia garinii
TAVWSDTSNTLTVSA

SEQ ID NO: 83312 - protein, 15 aa, Borrelia garinii
AVWSDTSNTLTVSAD

SEQ ID NO: 83313 - protein, 15 aa, Borrelia garinii
VWSDTSNTLTVSADS

SEQ ID NO: 83314 - protein, 15 aa, Borrelia garinii
WSDTSNTLTVSADSK

SEQ ID NO: 83315 - protein, 15 aa, Borrelia garinii
SDTSNTLTVSADSKK

SEQ ID NO: 83316 - protein, 15 aa, Borrelia garinii
DTSNTLTVSADSKKI

SEQ ID NO: 83317 - protein, 15 aa, Borrelia garinii
TSNTLTVSADSKKIK

SEQ ID NO: 83318 - protein, 15 aa, Borrelia garinii
SNTLTVSADSKKIKD

SEQ ID NO: 83319 - protein, 15 aa, Borrelia garinii
NTLTVSADSKKIKDF

SEQ ID NO: 83320 - protein, 15 aa, Borrelia garinii
TLTVSADSKKIKDFV

SEQ ID NO: 83321 - protein, 15 aa, Borrelia garinii
LTVSADSKKIKDFVF

SEQ ID NO: 83322 - protein, 15 aa, Borrelia garinii
TVSADSKKIKDFVFL

SEQ ID NO: 83323 - protein, 15 aa, Borrelia garinii
VSADSKKIKDFVFLT

SEQ ID NO: 83324 - protein, 15 aa, Borrelia garinii
SADSKKIKDFVFLTD

SEQ ID NO: 83325 - protein, 15 aa, Borrelia garinii
ADSKKIKDFVFLTDG

SEQ ID NO: 83326 - protein, 15 aa, Borrelia garinii
DSKKIKDFVFLTDGT

SEQ ID NO: 83327 - protein, 15 aa, Borrelia garinii
SKKIKDFVFLTDGTI

SEQ ID NO: 83328 - protein, 15 aa, Borrelia garinii
KKIKDFVFLTDGTIT

SEQ ID NO: 83329 - protein, 15 aa, Borrelia garinii
KIKDFVFLTDGTITV

SEQ ID NO: 83330 - protein, 15 aa, Borrelia garinii
IKDFVFLTDGTITVQ

SEQ ID NO: 83331 - protein, 15 aa, Borrelia garinii
KDFVFLTDGTITVQN

SEQ ID NO: 83332 - protein, 15 aa, Borrelia garinii
DFVFLTDGTITVQNY

SEQ ID NO: 83333 - protein, 15 aa, Borrelia garinii
FVFLTDGTITVQNYD

SEQ ID NO: 83334 - protein, 15 aa, Borrelia garinii
VFLTDGTITVQNYDT

SEQ ID NO: 83335 - protein, 15 aa, Borrelia garinii
FLTDGTITVQNYDTA

SEQ ID NO: 83336 - protein, 15 aa, Borrelia garinii
LTDGTITVQNYDTAG

SEQ ID NO: 83337 - protein, 15 aa, Borrelia garinii
TDGTITVQNYDTAGT

SEQ ID NO: 83338 - protein, 15 aa, Borrelia garinii
DGTITVQNYDTAGTK

SEQ ID NO: 83339 - protein, 15 aa, Borrelia garinii
GTITVQNYDTAGTKL

SEQ ID NO: 83340 - protein, 15 aa, Borrelia garinii
TITVQNYDTAGTKLA

SEQ ID NO: 83341 - protein, 15 aa, Borrelia garinii
ITVQNYDTAGTKLAG

SEQ ID NO: 83342 - protein, 15 aa, Borrelia garinii
TVQNYDTAGTKLAGT

SEQ ID NO: 83343 - protein, 15 aa, Borrelia garinii
VQNYDTAGTKLAGTA

SEQ ID NO: 83344 - protein, 15 aa, Borrelia garinii
QNYDTAGTKLAGTAT

SEQ ID NO: 83345 - protein, 15 aa, Borrelia garinii
NYDTAGTKLAGTATE

SEQ ID NO: 83346 - protein, 15 aa, Borrelia garinii
YDTAGTKLAGTATEI

SEQ ID NO: 83347 - protein, 15 aa, Borrelia garinii
DTAGTKLAGTATEIK

SEQ ID NO: 83348 - protein, 15 aa, Borrelia garinii
TAGTKLAGTATEIKD

SEQ ID NO: 83349 - protein, 15 aa, Borrelia garinii
AGTKLAGTATEIKDL

SEQ ID NO: 83350 - protein, 15 aa, Borrelia garinii
GTKLAGTATEIKDLE

SEQ ID NO: 83351 - protein, 15 aa, Borrelia garinii
TKLAGTATEIKDLEA

SEQ ID NO: 83352 - protein, 15 aa, Borrelia garinii
KLAGTATEIKDLEAL

SEQ ID NO: 83353 - protein, 15 aa, Borrelia garinii
LAGTATEIKDLEALK

SEQ ID NO: 83354 - protein, 15 aa, Borrelia garinii
AGTATEIKDLEALKA

SEQ ID NO: 83355 - protein, 15 aa, Borrelia garinii
GTATEIKDLEALKAA

SEQ ID NO: 83356 - protein, 15 aa, Borrelia garinii
TATEIKDLEALKAAL

SEQ ID NO: 83357 - protein, 15 aa, Borrelia garinii
ATEIKDLEALKAALK

SEQ ID NO: 83358 - protein, 16 aa, Borrelia garinii
MKKYLLGFALVLALIA

SEQ ID NO: 83359 - protein, 16 aa, Borrelia garinii
KKYLLGFALVLALIAC

SEQ ID NO: 83360 - protein, 16 aa, Borrelia garinii
KYLLGFALVLALIACG

SEQ ID NO: 83361 - protein, 16 aa, Borrelia garinii
YLLGFALVLALIACGQ

SEQ ID NO: 83362 - protein, 16 aa, Borrelia garinii
LLGFALVLALIACGQK

SEQ ID NO: 83363 - protein, 16 aa, Borrelia garinii
LGFALVLALIACGQKG

SEQ ID NO: 83364 - protein, 16 aa, Borrelia garinii
GFALVLALIACGQKGA

SEQ ID NO: 83365 - protein, 16 aa, Borrelia garinii
FALVLALIACGQKGAE

SEQ ID NO: 83366 - protein, 16 aa, Borrelia garinii
ALVLALIACGQKGAEP

SEQ ID NO: 83367 - protein, 16 aa, Borrelia garinii
LVLALIACGQKGAEPK

SEQ ID NO: 83368 - protein, 16 aa, Borrelia garinii
VLALIACGQKGAEPKH

SEQ ID NO: 83369 - protein, 16 aa, Borrelia garinii
LALIACGQKGAEPKHN

SEQ ID NO: 83370 - protein, 16 aa, Borrelia garinii
ALIACGQKGAEPKHND

SEQ ID NO: 83371 - protein, 16 aa, Borrelia garinii
LIACGQKGAEPKHNDQ

SEQ ID NO: 83372 - protein, 16 aa, Borrelia garinii
IACGQKGAEPKHNDQE

SEQ ID NO: 83373 - protein, 16 aa, Borrelia garinii
ACGQKGAEPKHNDQEV

SEQ ID NO: 83374 - protein, 16 aa, Borrelia garinii
CGQKGAEPKHNDQEVE

SEQ ID NO: 83375 - protein, 16 aa, Borrelia garinii
GQKGAEPKHNDQEVED

SEQ ID NO: 83376 - protein, 16 aa, Borrelia garinii
QKGAEPKHNDQEVEDS

SEQ ID NO: 83377 - protein, 16 aa, Borrelia garinii
KGAEPKHNDQEVEDSK

SEQ ID NO: 83378 - protein, 16 aa, Borrelia garinii
GAEPKHNDQEVEDSKK

SEQ ID NO: 83379 - protein, 16 aa, Borrelia garinii
AEPKHNDQEVEDSKKD

SEQ ID NO: 83380 - protein, 16 aa, Borrelia garinii
EPKHNDQEVEDSKKDQ

SEQ ID NO: 83381 - protein, 16 aa, Borrelia garinii
PKHNDQEVEDSKKDQK

SEQ ID NO: 83382 - protein, 16 aa, Borrelia garinii
KHNDQEVEDSKKDQKD

SEQ ID NO: 83383 - protein, 16 aa, Borrelia garinii
HNDQEVEDSKKDQKDA

SEQ ID NO: 83384 - protein, 16 aa, Borrelia garinii
NDQEVEDSKKDQKDAS

SEQ ID NO: 83385 - protein, 16 aa, Borrelia garinii
DQEVEDSKKDQKDASK

SEQ ID NO: 83386 - protein, 16 aa, Borrelia garinii
QEVEDSKKDQKDASKK

SEQ ID NO: 83387 - protein, 16 aa, Borrelia garinii
EVEDSKKDQKDASKKD

SEQ ID NO: 83388 - protein, 16 aa, Borrelia garinii
VEDSKKDQKDASKKDL

SEQ ID NO: 83389 - protein, 16 aa, Borrelia garinii
EDSKKDQKDASKKDLP

SEQ ID NO: 83390 - protein, 16 aa, Borrelia garinii
DSKKDQKDASKKDLPL

SEQ ID NO: 83391 - protein, 16 aa, Borrelia garinii
SKKDQKDASKKDLPLV

SEQ ID NO: 83392 - protein, 16 aa, Borrelia garinii
KKDQKDASKKDLPLVT

SEQ ID NO: 83393 - protein, 16 aa, Borrelia garinii
KDQKDASKKDLPLVTE

SEQ ID NO: 83394 - protein, 16 aa, Borrelia garinii
DQKDASKKDLPLVTED

SEQ ID NO: 83395 - protein, 16 aa, Borrelia garinii
QKDASKKDLPLVTEDT

SEQ ID NO: 83396 - protein, 16 aa, Borrelia garinii
KDASKKDLPLVTEDTV

SEQ ID NO: 83397 - protein, 16 aa, Borrelia garinii
DASKKDLPLVTEDTVK

SEQ ID NO: 83398 - protein, 16 aa, Borrelia garinii
ASKKDLPLVTEDTVKL

SEQ ID NO: 83399 - protein, 16 aa, Borrelia garinii
SKKDLPLVTEDTVKLF

SEQ ID NO: 83400 - protein, 16 aa, Borrelia garinii
KKDLPLVTEDTVKLFN

SEQ ID NO: 83401 - protein, 16 aa, Borrelia garinii
KDLPLVTEDTVKLFND

SEQ ID NO: 83402 - protein, 16 aa, Borrelia garinii
DLPLVTEDTVKLFNDT

SEQ ID NO: 83403 - protein, 16 aa, Borrelia garinii
LPLVTEDTVKLFNDTK

SEQ ID NO: 83404 - protein, 16 aa, Borrelia garinii
PLVTEDTVKLFNDTKI

SEQ ID NO: 83405 - protein, 16 aa, Borrelia garinii
LVTEDTVKLFNDTKIF

SEQ ID NO: 83406 - protein, 16 aa, Borrelia garinii
VTEDTVKLFNDTKIFI

SEQ ID NO: 83407 - protein, 16 aa, Borrelia garinii
TEDTVKLFNDTKIFIS

SEQ ID NO: 83408 - protein, 16 aa, Borrelia garinii
EDTVKLFNDTKIFISK

SEQ ID NO: 83409 - protein, 16 aa, Borrelia garinii
DTVKLFNDTKIFISKE

SEQ ID NO: 83410 - protein, 16 aa, Borrelia garinii
TVKLFNDTKIFISKEK

SEQ ID NO: 83411 - protein, 16 aa, Borrelia garinii
VKLFNDTKIFISKEKN

SEQ ID NO: 83412 - protein, 16 aa, Borrelia garinii
KLFNDTKIFISKEKNK

SEQ ID NO: 83413 - protein, 16 aa, Borrelia garinii
LFNDTKIFISKEKNKD

SEQ ID NO: 83414 - protein, 16 aa, Borrelia garinii
FNDTKIFISKEKNKDG

SEQ ID NO: 83415 - protein, 16 aa, Borrelia garinii
NDTKIFISKEKNKDGK

SEQ ID NO: 83416 - protein, 16 aa, Borrelia garinii
DTKIFISKEKNKDGKY

SEQ ID NO: 83417 - protein, 16 aa, Borrelia garinii
TKIFISKEKNKDGKYE

SEQ ID NO: 83418 - protein, 16 aa, Borrelia garinii
KIFISKEKNKDGKYEL

SEQ ID NO: 83419 - protein, 16 aa, Borrelia garinii
IFISKEKNKDGKYELR

SEQ ID NO: 83420 - protein, 16 aa, Borrelia garinii
FISKEKNKDGKYELRA

SEQ ID NO: 83421 - protein, 16 aa, Borrelia garinii
ISKEKNKDGKYELRAT

SEQ ID NO: 83422 - protein, 16 aa, Borrelia garinii
SKEKNKDGKYELRATV

SEQ ID NO: 83423 - protein, 16 aa, Borrelia garinii
KEKNKDGKYELRATVD

SEQ ID NO: 83424 - protein, 16 aa, Borrelia garinii
EKNKDGKYELRATVDT

SEQ ID NO: 83425 - protein, 16 aa, Borrelia garinii
KNKDGKYELRATVDTV

SEQ ID NO: 83426 - protein, 16 aa, Borrelia garinii
NKDGKYELRATVDTVE

SEQ ID NO: 83427 - protein, 16 aa, Borrelia garinii
KDGKYELRATVDTVEL

SEQ ID NO: 83428 - protein, 16 aa, Borrelia garinii
DGKYELRATVDTVELK

SEQ ID NO: 83429 - protein, 16 aa, Borrelia garinii
GKYELRATVDTVELKG

SEQ ID NO: 83430 - protein, 16 aa, Borrelia garinii
KYELRATVDTVELKGV

SEQ ID NO: 83431 - protein, 16 aa, Borrelia garinii
YELRATVDTVELKGVA

SEQ ID NO: 83432 - protein, 16 aa, Borrelia garinii
ELRATVDTVELKGVAD

SEQ ID NO: 83433 - protein, 16 aa, Borrelia garinii
LRATVDTVELKGVADK

SEQ ID NO: 83434 - protein, 16 aa, Borrelia garinii
RATVDTVELKGVADKN

SEQ ID NO: 83435 - protein, 16 aa, Borrelia garinii
ATVDTVELKGVADKND

SEQ ID NO: 83436 - protein, 16 aa, Borrelia garinii
TVDTVELKGVADKNDG

SEQ ID NO: 83437 - protein, 16 aa, Borrelia garinii
VDTVELKGVADKNDGS

SEQ ID NO: 83438 - protein, 16 aa, Borrelia garinii
DTVELKGVADKNDGSG

SEQ ID NO: 83439 - protein, 16 aa, Borrelia garinii
TVELKGVADKNDGSGG

SEQ ID NO: 83440 - protein, 16 aa, Borrelia garinii
VELKGVADKNDGSGGK

SEQ ID NO: 83441 - protein, 16 aa, Borrelia garinii
ELKGVADKNDGSGGKL

SEQ ID NO: 83442 - protein, 16 aa, Borrelia garinii
LKGVADKNDGSGGKLE

SEQ ID NO: 83443 - protein, 16 aa, Borrelia garinii
KGVADKNDGSGGKLEG

SEQ ID NO: 83444 - protein, 16 aa, Borrelia garinii
GVADKNDGSGGKLEGV

SEQ ID NO: 83445 - protein, 16 aa, Borrelia garinii
VADKNDGSGGKLEGVK

SEQ ID NO: 83446 - protein, 16 aa, Borrelia garinii
ADKNDGSGGKLEGVKS

SEQ ID NO: 83447 - protein, 16 aa, Borrelia garinii
DKNDGSGGKLEGVKSD

SEQ ID NO: 83448 - protein, 16 aa, Borrelia garinii
KNDGSGGKLEGVKSDQ

SEQ ID NO: 83449 - protein, 16 aa, Borrelia garinii
NDGSGGKLEGVKSDQS

SEQ ID NO: 83450 - protein, 16 aa, Borrelia garinii
DGSGGKLEGVKSDQSK

SEQ ID NO: 83451 - protein, 16 aa, Borrelia garinii
GSGGKLEGVKSDQSKV

SEQ ID NO: 83452 - protein, 16 aa, Borrelia garinii
SGGKLEGVKSDQSKVT

SEQ ID NO: 83453 - protein, 16 aa, Borrelia garinii
GGKLEGVKSDQSKVTM

SEQ ID NO: 83454 - protein, 16 aa, Borrelia garinii
GKLEGVKSDQSKVTMS

SEQ ID NO: 83455 - protein, 16 aa, Borrelia garinii
KLEGVKSDQSKVTMSI

SEQ ID NO: 83456 - protein, 16 aa, Borrelia garinii
LEGVKSDQSKVTMSIT

SEQ ID NO: 83457 - protein, 16 aa, Borrelia garinii
EGVKSDQSKVTMSITD

SEQ ID NO: 83458 - protein, 16 aa, Borrelia garinii
GVKSDQSKVTMSITDD

SEQ ID NO: 83459 - protein, 16 aa, Borrelia garinii
VKSDQSKVTMSITDDL

SEQ ID NO: 83460 - protein, 16 aa, Borrelia garinii
KSDQSKVTMSITDDLN

SEQ ID NO: 83461 - protein, 16 aa, Borrelia garinii
SDQSKVTMSITDDLNT

SEQ ID NO: 83462 - protein, 16 aa, Borrelia garinii
DQSKVTMSITDDLNTI

SEQ ID NO: 83463 - protein, 16 aa, Borrelia garinii
QSKVTMSITDDLNTIT

SEQ ID NO: 83464 - protein, 16 aa, Borrelia garinii
SKVTMSITDDLNTITV

SEQ ID NO: 83465 - protein, 16 aa, Borrelia garinii
KVTMSITDDLNTITVE

SEQ ID NO: 83466 - protein, 16 aa, Borrelia garinii
VTMSITDDLNTITVET

SEQ ID NO: 83467 - protein, 16 aa, Borrelia garinii
TMSITDDLNTITVETY

SEQ ID NO: 83468 - protein, 16 aa, Borrelia garinii
MSITDDLNTITVETYD

SEQ ID NO: 83469 - protein, 16 aa, Borrelia garinii
SITDDLNTITVETYDS

SEQ ID NO: 83470 - protein, 16 aa, Borrelia garinii
ITDDLNTITVETYDSS

SEQ ID NO: 83471 - protein, 16 aa, Borrelia garinii
TDDLNTITVETYDSSN

SEQ ID NO: 83472 - protein, 16 aa, Borrelia garinii
DDLNTITVETYDSSNT

SEQ ID NO: 83473 - protein, 16 aa, Borrelia garinii
DLNTITVETYDSSNTK

SEQ ID NO: 83474 - protein, 16 aa, Borrelia garinii
LNTITVETYDSSNTKV

SEQ ID NO: 83475 - protein, 16 aa, Borrelia garinii
NTITVETYDSSNTKVA

SEQ ID NO: 83476 - protein, 16 aa, Borrelia garinii
TITVETYDSSNTKVAS

SEQ ID NO: 83477 - protein, 16 aa, Borrelia garinii
ITVETYDSSNTKVASK

SEQ ID NO: 83478 - protein, 16 aa, Borrelia garinii
TVETYDSSNTKVASKV

SEQ ID NO: 83479 - protein, 16 aa, Borrelia garinii
VETYDSSNTKVASKVF

SEQ ID NO: 83480 - protein, 16 aa, Borrelia garinii
ETYDSSNTKVASKVFK

SEQ ID NO: 83481 - protein, 16 aa, Borrelia garinii
TYDSSNTKVASKVFKK

SEQ ID NO: 83482 - protein, 16 aa, Borrelia garinii
YDSSNTKVASKVFKKQ

SEQ ID NO: 83483 - protein, 16 aa, Borrelia garinii
DSSNTKVASKVFKKQG

SEQ ID NO: 83484 - protein, 16 aa, Borrelia garinii
SSNTKVASKVFKKQGS

SEQ ID NO: 83485 - protein, 16 aa, Borrelia garinii
SNTKVASKVFKKQGSL

SEQ ID NO: 83486 - protein, 16 aa, Borrelia garinii
NTKVASKVFKKQGSLT

SEQ ID NO: 83487 - protein, 16 aa, Borrelia garinii
TKVASKVFKKQGSLTE

SEQ ID NO: 83488 - protein, 16 aa, Borrelia garinii
KVASKVFKKQGSLTEE

SEQ ID NO: 83489 - protein, 16 aa, Borrelia garinii
VASKVFKKQGSLTEET

SEQ ID NO: 83490 - protein, 16 aa, Borrelia garinii
ASKVFKKQGSLTEETE

SEQ ID NO: 83491 - protein, 16 aa, Borrelia garinii
SKVFKKQGSLTEETEE

SEQ ID NO: 83492 - protein, 16 aa, Borrelia garinii
KVFKKQGSLTEETEET

SEQ ID NO: 83493 - protein, 16 aa, Borrelia garinii
VFKKQGSLTEETEETY

SEQ ID NO: 83494 - protein, 16 aa, Borrelia garinii
FKKQGSLTEETEETYK

SEQ ID NO: 83495 - protein, 16 aa, Borrelia garinii
KKQGSLTEETEETYKT

SEQ ID NO: 83496 - protein, 16 aa, Borrelia garinii
KQGSLTEETEETYKTG

SEQ ID NO: 83497 - protein, 16 aa, Borrelia garinii
QGSLTEETEETYKTGK

SEQ ID NO: 83498 - protein, 16 aa, Borrelia garinii
GSLTEETEETYKTGKL

SEQ ID NO: 83499 - protein, 16 aa, Borrelia garinii
SLTEETEETYKTGKLS

SEQ ID NO: 83500 - protein, 16 aa, Borrelia garinii
LTEETEETYKTGKLST

SEQ ID NO: 83501 - protein, 16 aa, Borrelia garinii
TEETEETYKTGKLSTK

SEQ ID NO: 83502 - protein, 16 aa, Borrelia garinii
EETEETYKTGKLSTKK

SEQ ID NO: 83503 - protein, 16 aa, Borrelia garinii
ETEETYKTGKLSTKKI

SEQ ID NO: 83504 - protein, 16 aa, Borrelia garinii
TEETYKTGKLSTKKIT

SEQ ID NO: 83505 - protein, 16 aa, Borrelia garinii
EETYKTGKLSTKKITR

SEQ ID NO: 83506 - protein, 16 aa, Borrelia garinii
ETYKTGKLSTKKITRT

SEQ ID NO: 83507 - protein, 16 aa, Borrelia garinii
TYKTGKLSTKKITRTN

SEQ ID NO: 83508 - protein, 16 aa, Borrelia garinii
YKTGKLSTKKITRTNG

SEQ ID NO: 83509 - protein, 16 aa, Borrelia garinii
KTGKLSTKKITRTNGT

SEQ ID NO: 83510 - protein, 16 aa, Borrelia garinii
TGKLSTKKITRTNGTT

SEQ ID NO: 83511 - protein, 16 aa, Borrelia garinii
GKLSTKKITRTNGTTL

SEQ ID NO: 83512 - protein, 16 aa, Borrelia garinii
KLSTKKITRTNGTTLE

SEQ ID NO: 83513 - protein, 16 aa, Borrelia garinii
LSTKKITRTNGTTLEY

SEQ ID NO: 83514 - protein, 16 aa, Borrelia garinii
STKKITRTNGTTLEYS

SEQ ID NO: 83515 - protein, 16 aa, Borrelia garinii
TKKITRTNGTTLEYSD

SEQ ID NO: 83516 - protein, 16 aa, Borrelia garinii
KKITRTNGTTLEYSDM

SEQ ID NO: 83517 - protein, 16 aa, Borrelia garinii
KITRTNGTTLEYSDMT

SEQ ID NO: 83518 - protein, 16 aa, Borrelia garinii
ITRTNGTTLEYSDMTN

SEQ ID NO: 83519 - protein, 16 aa, Borrelia garinii
TRTNGTTLEYSDMTND

SEQ ID NO: 83520 - protein, 16 aa, Borrelia garinii
RTNGTTLEYSDMTNDE

SEQ ID NO: 83521 - protein, 16 aa, Borrelia garinii
TNGTTLEYSDMTNDEN

SEQ ID NO: 83522 - protein, 16 aa, Borrelia garinii
NGTTLEYSDMTNDENA

SEQ ID NO: 83523 - protein, 16 aa, Borrelia garinii
GTTLEYSDMTNDENAT

SEQ ID NO: 83524 - protein, 16 aa, Borrelia garinii
TTLEYSDMTNDENATK

SEQ ID NO: 83525 - protein, 16 aa, Borrelia garinii
TLEYSDMTNDENATKA

SEQ ID NO: 83526 - protein, 16 aa, Borrelia garinii
LEYSDMTNDENATKAV

SEQ ID NO: 83527 - protein, 16 aa, Borrelia garinii
EYSDMTNDENATKAVE

SEQ ID NO: 83528 - protein, 16 aa, Borrelia garinii
YSDMTNDENATKAVET

SEQ ID NO: 83529 - protein, 16 aa, Borrelia garinii
SDMTNDENATKAVETL

SEQ ID NO: 83530 - protein, 16 aa, Borrelia garinii
DMTNDENATKAVETLK

SEQ ID NO: 83531 - protein, 16 aa, Borrelia garinii
MTNDENATKAVETLKN

SEQ ID NO: 83532 - protein, 16 aa, Borrelia garinii
TNDENATKAVETLKNG

SEQ ID NO: 83533 - protein, 16 aa, Borrelia garinii
NDENATKAVETLKNGI

SEQ ID NO: 83534 - protein, 16 aa, Borrelia garinii
DENATKAVETLKNGIM

SEQ ID NO: 83535 - protein, 16 aa, Borrelia garinii
ENATKAVETLKNGIML

SEQ ID NO: 83536 - protein, 16 aa, Borrelia garinii
NATKAVETLKNGIMLE

SEQ ID NO: 83537 - protein, 16 aa, Borrelia garinii
ATKAVETLKNGIMLEG

SEQ ID NO: 83538 - protein, 16 aa, Borrelia garinii
TKAVETLKNGIMLEGN

SEQ ID NO: 83539 - protein, 16 aa, Borrelia garinii
KAVETLKNGIMLEGNL

SEQ ID NO: 83540 - protein, 16 aa, Borrelia garinii
AVETLKNGIMLEGNLV

SEQ ID NO: 83541 - protein, 16 aa, Borrelia garinii
VETLKNGIMLEGNLVG

SEQ ID NO: 83542 - protein, 16 aa, Borrelia garinii
ETLKNGIMLEGNLVGG

SEQ ID NO: 83543 - protein, 16 aa, Borrelia garinii
TLKNGIMLEGNLVGGK

SEQ ID NO: 83544 - protein, 16 aa, Borrelia garinii
LKNGIMLEGNLVGGKT

SEQ ID NO: 83545 - protein, 16 aa, Borrelia garinii
KNGIMLEGNLVGGKTS

SEQ ID NO: 83546 - protein, 16 aa, Borrelia garinii
NGIMLEGNLVGGKTSV

SEQ ID NO: 83547 - protein, 16 aa, Borrelia garinii
GIMLEGNLVGGKTSVE

SEQ ID NO: 83548 - protein, 16 aa, Borrelia garinii
IMLEGNLVGGKTSVEI

SEQ ID NO: 83549 - protein, 16 aa, Borrelia garinii
MLEGNLVGGKTSVEIK

SEQ ID NO: 83550 - protein, 16 aa, Borrelia garinii
LEGNLVGGKTSVEIKE

SEQ ID NO: 83551 - protein, 16 aa, Borrelia garinii
EGNLVGGKTSVEIKEG

SEQ ID NO: 83552 - protein, 16 aa, Borrelia garinii
GNLVGGKTSVEIKEGT

SEQ ID NO: 83553 - protein, 16 aa, Borrelia garinii
NLVGGKTSVEIKEGTV

SEQ ID NO: 83554 - protein, 16 aa, Borrelia garinii
LVGGKTSVEIKEGTVT

SEQ ID NO: 83555 - protein, 16 aa, Borrelia garinii
VGGKTSVEIKEGTVTL

SEQ ID NO: 83556 - protein, 16 aa, Borrelia garinii
GGKTSVEIKEGTVTLK

SEQ ID NO: 83557 - protein, 16 aa, Borrelia garinii
GKTSVEIKEGTVTLKK

SEQ ID NO: 83558 - protein, 16 aa, Borrelia garinii
KTSVEIKEGTVTLKKE

SEQ ID NO: 83559 - protein, 16 aa, Borrelia garinii
TSVEIKEGTVTLKKEI

SEQ ID NO: 83560 - protein, 16 aa, Borrelia garinii
SVEIKEGTVTLKKEIE

SEQ ID NO: 83561 - protein, 16 aa, Borrelia garinii
VEIKEGTVTLKKEIEK

SEQ ID NO: 83562 - protein, 16 aa, Borrelia garinii
EIKEGTVTLKKEIEKA

SEQ ID NO: 83563 - protein, 16 aa, Borrelia garinii
IKEGTVTLKKEIEKAG

SEQ ID NO: 83564 - protein, 16 aa, Borrelia garinii
KEGTVTLKKEIEKAGT

SEQ ID NO: 83565 - protein, 16 aa, Borrelia garinii
EGTVTLKKEIEKAGTV

SEQ ID NO: 83566 - protein, 16 aa, Borrelia garinii
GTVTLKKEIEKAGTVK

SEQ ID NO: 83567 - protein, 16 aa, Borrelia garinii
TVTLKKEIEKAGTVKL

SEQ ID NO: 83568 - protein, 16 aa, Borrelia garinii
VTLKKEIEKAGTVKLF

SEQ ID NO: 83569 - protein, 16 aa, Borrelia garinii
TLKKEIEKAGTVKLFL

SEQ ID NO: 83570 - protein, 16 aa, Borrelia garinii
LKKEIEKAGTVKLFLD

SEQ ID NO: 83571 - protein, 16 aa, Borrelia garinii
KKEIEKAGTVKLFLDD

SEQ ID NO: 83572 - protein, 16 aa, Borrelia garinii
KEIEKAGTVKLFLDDT

SEQ ID NO: 83573 - protein, 16 aa, Borrelia garinii
EIEKAGTVKLFLDDTS

SEQ ID NO: 83574 - protein, 16 aa, Borrelia garinii
IEKAGTVKLFLDDTSS

SEQ ID NO: 83575 - protein, 16 aa, Borrelia garinii
EKAGTVKLFLDDTSSG

SEQ ID NO: 83576 - protein, 16 aa, Borrelia garinii
KAGTVKLFLDDTSSGS

SEQ ID NO: 83577 - protein, 16 aa, Borrelia garinii
AGTVKLFLDDTSSGST

SEQ ID NO: 83578 - protein, 16 aa, Borrelia garinii
GTVKLFLDDTSSGSTK

SEQ ID NO: 83579 - protein, 16 aa, Borrelia garinii
TVKLFLDDTSSGSTKK

SEQ ID NO: 83580 - protein, 16 aa, Borrelia garinii
VKLFLDDTSSGSTKKT

SEQ ID NO: 83581 - protein, 16 aa, Borrelia garinii
KLFLDDTSSGSTKKTA

SEQ ID NO: 83582 - protein, 16 aa, Borrelia garinii
LFLDDTSSGSTKKTAV

SEQ ID NO: 83583 - protein, 16 aa, Borrelia garinii
FLDDTSSGSTKKTAVW

SEQ ID NO: 83584 - protein, 16 aa, Borrelia garinii
LDDTSSGSTKKTAVWS

SEQ ID NO: 83585 - protein, 16 aa, Borrelia garinii
DDTSSGSTKKTAVWSD

SEQ ID NO: 83586 - protein, 16 aa, Borrelia garinii
DTSSGSTKKTAVWSDT

SEQ ID NO: 83587 - protein, 16 aa, Borrelia garinii
TSSGSTKKTAVWSDTS

SEQ ID NO: 83588 - protein, 16 aa, Borrelia garinii
SSGSTKKTAVWSDTSN

SEQ ID NO: 83589 - protein, 16 aa, Borrelia garinii
SGSTKKTAVWSDTSNT

SEQ ID NO: 83590 - protein, 16 aa, Borrelia garinii
GSTKKTAVWSDTSNTL

SEQ ID NO: 83591 - protein, 16 aa, Borrelia garinii
STKKTAVWSDTSNTLT

SEQ ID NO: 83592 - protein, 16 aa, Borrelia garinii
TKKTAVWSDTSNTLTV

SEQ ID NO: 83593 - protein, 16 aa, Borrelia garinii
KKTAVWSDTSNTLTVS

SEQ ID NO: 83594 - protein, 16 aa, Borrelia garinii
KTAVWSDTSNTLTVSA

SEQ ID NO: 83595 - protein, 16 aa, Borrelia garinii
TAVWSDTSNTLTVSAD

SEQ ID NO: 83596 - protein, 16 aa, Borrelia garinii
AVWSDTSNTLTVSADS

SEQ ID NO: 83597 - protein, 16 aa, Borrelia garinii
VWSDTSNTLTVSADSK

SEQ ID NO: 83598 - protein, 16 aa, Borrelia garinii
WSDTSNTLTVSADSKK

SEQ ID NO: 83599 - protein, 16 aa, Borrelia garinii
SDTSNTLTVSADSKKI

SEQ ID NO: 83600 - protein, 16 aa, Borrelia garinii
DTSNTLTVSADSKKIK

SEQ ID NO: 83601 - protein, 16 aa, Borrelia garinii
TSNTLTVSADSKKIKD

SEQ ID NO: 83602 - protein, 16 aa, Borrelia garinii
SNTLTVSADSKKIKDF

SEQ ID NO: 83603 - protein, 16 aa, Borrelia garinii
NTLTVSADSKKIKDFV

SEQ ID NO: 83604 - protein, 16 aa, Borrelia garinii
TLTVSADSKKIKDFVF

SEQ ID NO: 83605 - protein, 16 aa, Borrelia garinii
LTVSADSKKIKDFVFL

SEQ ID NO: 83606 - protein, 16 aa, Borrelia garinii
TVSADSKKIKDFVFLT

SEQ ID NO: 83607 - protein, 16 aa, Borrelia garinii
VSADSKKIKDFVFLTD

SEQ ID NO: 83608 - protein, 16 aa, Borrelia garinii
SADSKKIKDFVFLTDG

SEQ ID NO: 83609 - protein, 16 aa, Borrelia garinii
ADSKKIKDFVFLTDGT

SEQ ID NO: 83610 - protein, 16 aa, Borrelia garinii
DSKKIKDFVFLTDGTI

SEQ ID NO: 83611 - protein, 16 aa, Borrelia garinii
SKKIKDFVFLTDGTIT

SEQ ID NO: 83612 - protein, 16 aa, Borrelia garinii
KKIKDFVFLTDGTITV

SEQ ID NO: 83613 - protein, 16 aa, Borrelia garinii
KIKDFVFLTDGTITVQ

SEQ ID NO: 83614 - protein, 16 aa, Borrelia garinii
IKDFVFLTDGTITVQN

SEQ ID NO: 83615 - protein, 16 aa, Borrelia garinii
KDFVFLTDGTITVQNY

SEQ ID NO: 83616 - protein, 16 aa, Borrelia garinii
DFVFLTDGTITVQNYD

SEQ ID NO: 83617 - protein, 16 aa, Borrelia garinii
FVFLTDGTITVQNYDT

SEQ ID NO: 83618 - protein, 16 aa, Borrelia garinii
VFLTDGTITVQNYDTA

SEQ ID NO: 83619 - protein, 16 aa, Borrelia garinii
FLTDGTITVQNYDTAG

SEQ ID NO: 83620 - protein, 16 aa, Borrelia garinii
LTDGTITVQNYDTAGT

SEQ ID NO: 83621 - protein, 16 aa, Borrelia garinii
TDGTITVQNYDTAGTK

SEQ ID NO: 83622 - protein, 16 aa, Borrelia garinii
DGTITVQNYDTAGTKL

SEQ ID NO: 83623 - protein, 16 aa, Borrelia garinii
GTITVQNYDTAGTKLA

SEQ ID NO: 83624 - protein, 16 aa, Borrelia garinii
TITVQNYDTAGTKLAG

SEQ ID NO: 83625 - protein, 16 aa, Borrelia garinii
ITVQNYDTAGTKLAGT

SEQ ID NO: 83626 - protein, 16 aa, Borrelia garinii
TVQNYDTAGTKLAGTA

SEQ ID NO: 83627 - protein, 16 aa, Borrelia garinii
VQNYDTAGTKLAGTAT

SEQ ID NO: 83628 - protein, 16 aa, Borrelia garinii
QNYDTAGTKLAGTATE

SEQ ID NO: 83629 - protein, 16 aa, Borrelia garinii
NYDTAGTKLAGTATEI

SEQ ID NO: 83630 - protein, 16 aa, Borrelia garinii
YDTAGTKLAGTATEIK

SEQ ID NO: 83631 - protein, 16 aa, Borrelia garinii
DTAGTKLAGTATEIKD

SEQ ID NO: 83632 - protein, 16 aa, Borrelia garinii
TAGTKLAGTATEIKDL

SEQ ID NO: 83633 - protein, 16 aa, Borrelia garinii
AGTKLAGTATEIKDLE

SEQ ID NO: 83634 - protein, 16 aa, Borrelia garinii
GTKLAGTATEIKDLEA

SEQ ID NO: 83635 - protein, 16 aa, Borrelia garinii
TKLAGTATEIKDLEAL

SEQ ID NO: 83636 - protein, 16 aa, Borrelia garinii
KLAGTATEIKDLEALK

SEQ ID NO: 83637 - protein, 16 aa, Borrelia garinii
LAGTATEIKDLEALKA

SEQ ID NO: 83638 - protein, 16 aa, Borrelia garinii
AGTATEIKDLEALKAA

SEQ ID NO: 83639 - protein, 16 aa, Borrelia garinii
GTATEIKDLEALKAAL

SEQ ID NO: 83640 - protein, 16 aa, Borrelia garinii
TATEIKDLEALKAALK

SEQ ID NO: 83641 - protein, 13 aa, Borrelia afzelii
MKKNTLSAILMTL

SEQ ID NO: 83642 - protein, 13 aa, Borrelia afzelii
KKNTLSAILMTLF

SEQ ID NO: 83643 - protein, 13 aa, Borrelia afzelii
KNTLSAILMTLFL

SEQ ID NO: 83644 - protein, 13 aa, Borrelia afzelii
NTLSAILMTLFLF

SEQ ID NO: 83645 - protein, 13 aa, Borrelia afzelii
TLSAILMTLFLFI

SEQ ID NO: 83646 - protein, 13 aa, Borrelia afzelii
LSAILMTLFLFIS

SEQ ID NO: 83647 - protein, 13 aa, Borrelia afzelii
SAILMTLFLFISC

SEQ ID NO: 83648 - protein, 13 aa, Borrelia afzelii
AILMTLFLFISCN

SEQ ID NO: 83649 - protein, 13 aa, Borrelia afzelii
ILMTLFLFISCNN

SEQ ID NO: 83650 - protein, 13 aa, Borrelia afzelii
LMTLFLFISCNNS

SEQ ID NO: 83651 - protein, 13 aa, Borrelia afzelii
MTLFLFISCNNSG

SEQ ID NO: 83652 - protein, 13 aa, Borrelia afzelii
TLFLFISCNNSGK

SEQ ID NO: 83653 - protein, 13 aa, Borrelia afzelii
LFLFISCNNSGKG

SEQ ID NO: 83654 - protein, 13 aa, Borrelia afzelii
FLFISCNNSGKGG

SEQ ID NO: 83655 - protein, 13 aa, Borrelia afzelii
LFISCNNSGKGGD

SEQ ID NO: 83656 - protein, 13 aa, Borrelia afzelii
FISCNNSGKGGDS

SEQ ID NO: 83657 - protein, 13 aa, Borrelia afzelii
ISCNNSGKGGDSA

SEQ ID NO: 83658 - protein, 13 aa, Borrelia afzelii
SCNNSGKGGDSAS

SEQ ID NO: 83659 - protein, 13 aa, Borrelia afzelii
CNNSGKGGDSAST

SEQ ID NO: 83660 - protein, 13 aa, Borrelia afzelii
NNSGKGGDSASTN

SEQ ID NO: 83661 - protein, 13 aa, Borrelia afzelii
NSGKGGDSASTNP

SEQ ID NO: 83662 - protein, 13 aa, Borrelia afzelii
SGKGGDSASTNPA

SEQ ID NO: 83663 - protein, 13 aa, Borrelia afzelii
GKGGDSASTNPAD

SEQ ID NO: 83664 - protein, 13 aa, Borrelia afzelii
KGGDSASTNPADE

SEQ ID NO: 83665 - protein, 13 aa, Borrelia afzelii
GGDSASTNPADES

SEQ ID NO: 83666 - protein, 13 aa, Borrelia afzelii
GDSASTNPADESA

SEQ ID NO: 83667 - protein, 13 aa, Borrelia afzelii
DSASTNPADESAK

SEQ ID NO: 83668 - protein, 13 aa, Borrelia afzelii
SASTNPADESAKG

SEQ ID NO: 83669 - protein, 13 aa, Borrelia afzelii
ASTNPADESAKGP

SEQ ID NO: 83670 - protein, 13 aa, Borrelia afzelii
STNPADESAKGPN

SEQ ID NO: 83671 - protein, 13 aa, Borrelia afzelii
TNPADESAKGPNL

SEQ ID NO: 83672 - protein, 13 aa, Borrelia afzelii
NPADESAKGPNLT

SEQ ID NO: 83673 - protein, 13 aa, Borrelia afzelii
PADESAKGPNLTE

SEQ ID NO: 83674 - protein, 13 aa, Borrelia afzelii
ADESAKGPNLTEI

SEQ ID NO: 83675 - protein, 13 aa, Borrelia afzelii
DESAKGPNLTEIS

SEQ ID NO: 83676 - protein, 13 aa, Borrelia afzelii
ESAKGPNLTEISK

SEQ ID NO: 83677 - protein, 13 aa, Borrelia afzelii
SAKGPNLTEISKK

SEQ ID NO: 83678 - protein, 13 aa, Borrelia afzelii
AKGPNLTEISKKI

SEQ ID NO: 83679 - protein, 13 aa, Borrelia afzelii
KGPNLTEISKKIT

SEQ ID NO: 83680 - protein, 13 aa, Borrelia afzelii
GPNLTEISKKITD

SEQ ID NO: 83681 - protein, 13 aa, Borrelia afzelii
PNLTEISKKITDS

SEQ ID NO: 83682 - protein, 13 aa, Borrelia afzelii
NLTEISKKITDSN

SEQ ID NO: 83683 - protein, 13 aa, Borrelia afzelii
LTEISKKITDSNA

SEQ ID NO: 83684 - protein, 13 aa, Borrelia afzelii
TEISKKITDSNAF

SEQ ID NO: 83685 - protein, 13 aa, Borrelia afzelii
EISKKITDSNAFV

SEQ ID NO: 83686 - protein, 13 aa, Borrelia afzelii
ISKKITDSNAFVL

SEQ ID NO: 83687 - protein, 13 aa, Borrelia afzelii
SKKITDSNAFVLA

SEQ ID NO: 83688 - protein, 13 aa, Borrelia afzelii
KKITDSNAFVLAV

SEQ ID NO: 83689 - protein, 13 aa, Borrelia afzelii
KITDSNAFVLAVK

SEQ ID NO: 83690 - protein, 13 aa, Borrelia afzelii
ITDSNAFVLAVKE

SEQ ID NO: 83691 - protein, 13 aa, Borrelia afzelii
TDSNAFVLAVKEV

SEQ ID NO: 83692 - protein, 13 aa, Borrelia afzelii
DSNAFVLAVKEVE

SEQ ID NO: 83693 - protein, 13 aa, Borrelia afzelii
SNAFVLAVKEVET

SEQ ID NO: 83694 - protein, 13 aa, Borrelia afzelii
NAFVLAVKEVETL

SEQ ID NO: 83695 - protein, 13 aa, Borrelia afzelii
AFVLAVKEVETLV

SEQ ID NO: 83696 - protein, 13 aa, Borrelia afzelii
FVLAVKEVETLVS

SEQ ID NO: 83697 - protein, 13 aa, Borrelia afzelii
VLAVKEVETLVSS

SEQ ID NO: 83698 - protein, 13 aa, Borrelia afzelii
LAVKEVETLVSSI

SEQ ID NO: 83699 - protein, 13 aa, Borrelia afzelii
AVKEVETLVSSID

SEQ ID NO: 83700 - protein, 13 aa, Borrelia afzelii
VKEVETLVSSIDE

SEQ ID NO: 83701 - protein, 13 aa, Borrelia afzelii
KEVETLVSSIDEL

SEQ ID NO: 83702 - protein, 13 aa, Borrelia afzelii
EVETLVSSIDELA

SEQ ID NO: 83703 - protein, 13 aa, Borrelia afzelii
VETLVSSIDELAN

SEQ ID NO: 83704 - protein, 13 aa, Borrelia afzelii
ETLVSSIDELANK

SEQ ID NO: 83705 - protein, 13 aa, Borrelia afzelii
TLVSSIDELANKA

SEQ ID NO: 83706 - protein, 13 aa, Borrelia afzelii
LVSSIDELANKAI

SEQ ID NO: 83707 - protein, 13 aa, Borrelia afzelii
VSSIDELANKAIG

SEQ ID NO: 83708 - protein, 13 aa, Borrelia afzelii
SSIDELANKAIGK

SEQ ID NO: 83709 - protein, 13 aa, Borrelia afzelii
SIDELANKAIGKK

SEQ ID NO: 83710 - protein, 13 aa, Borrelia afzelii
IDELANKAIGKKI

SEQ ID NO: 83711 - protein, 13 aa, Borrelia afzelii
DELANKAIGKKIQ

SEQ ID NO: 83712 - protein, 13 aa, Borrelia afzelii
ELANKAIGKKIQQ

SEQ ID NO: 83713 - protein, 13 aa, Borrelia afzelii
LANKAIGKKIQQN

SEQ ID NO: 83714 - protein, 13 aa, Borrelia afzelii
ANKAIGKKIQQNG

SEQ ID NO: 83715 - protein, 13 aa, Borrelia afzelii
NKAIGKKIQQNGL

SEQ ID NO: 83716 - protein, 13 aa, Borrelia afzelii
KAIGKKIQQNGLG

SEQ ID NO: 83717 - protein, 13 aa, Borrelia afzelii
AIGKKIQQNGLGA

SEQ ID NO: 83718 - protein, 13 aa, Borrelia afzelii
IGKKIQQNGLGAE

SEQ ID NO: 83719 - protein, 13 aa, Borrelia afzelii
GKKIQQNGLGAEA

SEQ ID NO: 83720 - protein, 13 aa, Borrelia afzelii
KKIQQNGLGAEAN

SEQ ID NO: 83721 - protein, 13 aa, Borrelia afzelii
KIQQNGLGAEANR

SEQ ID NO: 83722 - protein, 13 aa, Borrelia afzelii
IQQNGLGAEANRN

SEQ ID NO: 83723 - protein, 13 aa, Borrelia afzelii
QQNGLGAEANRNE

SEQ ID NO: 83724 - protein, 13 aa, Borrelia afzelii
QNGLGAEANRNES

SEQ ID NO: 83725 - protein, 13 aa, Borrelia afzelii
NGLGAEANRNESL

SEQ ID NO: 83726 - protein, 13 aa, Borrelia afzelii
GLGAEANRNESLL

SEQ ID NO: 83727 - protein, 13 aa, Borrelia afzelii
LGAEANRNESLLA

SEQ ID NO: 83728 - protein, 13 aa, Borrelia afzelii
GAEANRNESLLAG

SEQ ID NO: 83729 - protein, 13 aa, Borrelia afzelii
AEANRNESLLAGV

SEQ ID NO: 83730 - protein, 13 aa, Borrelia afzelii
EANRNESLLAGVH

SEQ ID NO: 83731 - protein, 13 aa, Borrelia afzelii
ANRNESLLAGVHE

SEQ ID NO: 83732 - protein, 13 aa, Borrelia afzelii
NRNESLLAGVHEI

SEQ ID NO: 83733 - protein, 13 aa, Borrelia afzelii
RNESLLAGVHEIS

SEQ ID NO: 83734 - protein, 13 aa, Borrelia afzelii
NESLLAGVHEIST

SEQ ID NO: 83735 - protein, 13 aa, Borrelia afzelii
ESLLAGVHEISTL

SEQ ID NO: 83736 - protein, 13 aa, Borrelia afzelii
SLLAGVHEISTLI

SEQ ID NO: 83737 - protein, 13 aa, Borrelia afzelii
LLAGVHEISTLIT

SEQ ID NO: 83738 - protein, 13 aa, Borrelia afzelii
LAGVHEISTLITE

SEQ ID NO: 83739 - protein, 13 aa, Borrelia afzelii
AGVHEISTLITEK

SEQ ID NO: 83740 - protein, 13 aa, Borrelia afzelii
GVHEISTLITEKL

SEQ ID NO: 83741 - protein, 13 aa, Borrelia afzelii
VHEISTLITEKLS

SEQ ID NO: 83742 - protein, 13 aa, Borrelia afzelii
HEISTLITEKLSK

SEQ ID NO: 83743 - protein, 13 aa, Borrelia afzelii
EISTLITEKLSKL

SEQ ID NO: 83744 - protein, 13 aa, Borrelia afzelii
ISTLITEKLSKLK

SEQ ID NO: 83745 - protein, 13 aa, Borrelia afzelii
STLITEKLSKLKN

SEQ ID NO: 83746 - protein, 13 aa, Borrelia afzelii
TLITEKLSKLKNS

SEQ ID NO: 83747 - protein, 13 aa, Borrelia afzelii
LITEKLSKLKNSG

SEQ ID NO: 83748 - protein, 13 aa, Borrelia afzelii
ITEKLSKLKNSGE

SEQ ID NO: 83749 - protein, 13 aa, Borrelia afzelii
TEKLSKLKNSGEL

SEQ ID NO: 83750 - protein, 13 aa, Borrelia afzelii
EKLSKLKNSGELK

SEQ ID NO: 83751 - protein, 13 aa, Borrelia afzelii
KLSKLKNSGELKA

SEQ ID NO: 83752 - protein, 13 aa, Borrelia afzelii
LSKLKNSGELKAK

SEQ ID NO: 83753 - protein, 13 aa, Borrelia afzelii
SKLKNSGELKAKI

SEQ ID NO: 83754 - protein, 13 aa, Borrelia afzelii
KLKNSGELKAKIE

SEQ ID NO: 83755 - protein, 13 aa, Borrelia afzelii
LKNSGELKAKIED

SEQ ID NO: 83756 - protein, 13 aa, Borrelia afzelii
KNSGELKAKIEDA

SEQ ID NO: 83757 - protein, 13 aa, Borrelia afzelii
NSGELKAKIEDAK

SEQ ID NO: 83758 - protein, 13 aa, Borrelia afzelii
SGELKAKIEDAKK

SEQ ID NO: 83759 - protein, 13 aa, Borrelia afzelii
GELKAKIEDAKKC

SEQ ID NO: 83760 - protein, 13 aa, Borrelia afzelii
ELKAKIEDAKKCS

SEQ ID NO: 83761 - protein, 13 aa, Borrelia afzelii
LKAKIEDAKKCSE

SEQ ID NO: 83762 - protein, 13 aa, Borrelia afzelii
KAKIEDAKKCSEE

SEQ ID NO: 83763 - protein, 13 aa, Borrelia afzelii
AKIEDAKKCSEEF

SEQ ID NO: 83764 - protein, 13 aa, Borrelia afzelii
KIEDAKKCSEEFT

SEQ ID NO: 83765 - protein, 13 aa, Borrelia afzelii
IEDAKKCSEEFTN

SEQ ID NO: 83766 - protein, 13 aa, Borrelia afzelii
EDAKKCSEEFTNK

SEQ ID NO: 83767 - protein, 13 aa, Borrelia afzelii
DAKKCSEEFTNKL

SEQ ID NO: 83768 - protein, 13 aa, Borrelia afzelii
AKKCSEEFTNKLR

SEQ ID NO: 83769 - protein, 13 aa, Borrelia afzelii
KKCSEEFTNKLRV

SEQ ID NO: 83770 - protein, 13 aa, Borrelia afzelii
KCSEEFTNKLRVS

SEQ ID NO: 83771 - protein, 13 aa, Borrelia afzelii
CSEEFTNKLRVSH

SEQ ID NO: 83772 - protein, 13 aa, Borrelia afzelii
SEEFTNKLRVSHA

SEQ ID NO: 83773 - protein, 13 aa, Borrelia afzelii
EEFTNKLRVSHAD

SEQ ID NO: 83774 - protein, 13 aa, Borrelia afzelii
EFTNKLRVSHADL

SEQ ID NO: 83775 - protein, 13 aa, Borrelia afzelii
FTNKLRVSHADLG

SEQ ID NO: 83776 - protein, 13 aa, Borrelia afzelii
TNKLRVSHADLGK

SEQ ID NO: 83777 - protein, 13 aa, Borrelia afzelii
NKLRVSHADLGKQ

SEQ ID NO: 83778 - protein, 13 aa, Borrelia afzelii
KLRVSHADLGKQG

SEQ ID NO: 83779 - protein, 13 aa, Borrelia afzelii
LRVSHADLGKQGV

SEQ ID NO: 83780 - protein, 13 aa, Borrelia afzelii
RVSHADLGKQGVN

SEQ ID NO: 83781 - protein, 13 aa, Borrelia afzelii
VSHADLGKQGVND

SEQ ID NO: 83782 - protein, 13 aa, Borrelia afzelii
SHADLGKQGVNDD

SEQ ID NO: 83783 - protein, 13 aa, Borrelia afzelii
HADLGKQGVNDDD

SEQ ID NO: 83784 - protein, 13 aa, Borrelia afzelii
ADLGKQGVNDDDA

SEQ ID NO: 83785 - protein, 13 aa, Borrelia afzelii
DLGKQGVNDDDAK

SEQ ID NO: 83786 - protein, 13 aa, Borrelia afzelii
LGKQGVNDDDAKK

SEQ ID NO: 83787 - protein, 13 aa, Borrelia afzelii
GKQGVNDDDAKKA

SEQ ID NO: 83788 - protein, 13 aa, Borrelia afzelii
KQGVNDDDAKKAI

SEQ ID NO: 83789 - protein, 13 aa, Borrelia afzelii
QGVNDDDAKKAIL

SEQ ID NO: 83790 - protein, 13 aa, Borrelia afzelii
GVNDDDAKKAILK

SEQ ID NO: 83791 - protein, 13 aa, Borrelia afzelii
VNDDDAKKAILKT

SEQ ID NO: 83792 - protein, 13 aa, Borrelia afzelii
NDDDAKKAILKTN

SEQ ID NO: 83793 - protein, 13 aa, Borrelia afzelii
DDDAKKAILKTNA

SEQ ID NO: 83794 - protein, 13 aa, Borrelia afzelii
DDAKKAILKTNAD

SEQ ID NO: 83795 - protein, 13 aa, Borrelia afzelii
DAKKAILKTNADK

SEQ ID NO: 83796 - protein, 13 aa, Borrelia afzelii
AKKAILKTNADKT

SEQ ID NO: 83797 - protein, 13 aa, Borrelia afzelii
KKAILKTNADKTK

SEQ ID NO: 83798 - protein, 13 aa, Borrelia afzelii
KAILKTNADKTKG

SEQ ID NO: 83799 - protein, 13 aa, Borrelia afzelii
AILKTNADKTKGA

SEQ ID NO: 83800 - protein, 13 aa, Borrelia afzelii
ILKTNADKTKGAE

SEQ ID NO: 83801 - protein, 13 aa, Borrelia afzelii
LKTNADKTKGAEE

SEQ ID NO: 83802 - protein, 13 aa, Borrelia afzelii
KTNADKTKGAEEL

SEQ ID NO: 83803 - protein, 13 aa, Borrelia afzelii
TNADKTKGAEELG

SEQ ID NO: 83804 - protein, 13 aa, Borrelia afzelii
NADKTKGAEELGK

SEQ ID NO: 83805 - protein, 13 aa, Borrelia afzelii
ADKTKGAEELGKL

SEQ ID NO: 83806 - protein, 13 aa, Borrelia afzelii
DKTKGAEELGKLF

SEQ ID NO: 83807 - protein, 13 aa, Borrelia afzelii
KTKGAEELGKLFK

SEQ ID NO: 83808 - protein, 13 aa, Borrelia afzelii
TKGAEELGKLFKS

SEQ ID NO: 83809 - protein, 13 aa, Borrelia afzelii
KGAEELGKLFKSV

SEQ ID NO: 83810 - protein, 13 aa, Borrelia afzelii
GAEELGKLFKSVE

SEQ ID NO: 83811 - protein, 13 aa, Borrelia afzelii
AEELGKLFKSVEG

SEQ ID NO: 83812 - protein, 13 aa, Borrelia afzelii
EELGKLFKSVEGL

SEQ ID NO: 83813 - protein, 13 aa, Borrelia afzelii
ELGKLFKSVEGLV

SEQ ID NO: 83814 - protein, 13 aa, Borrelia afzelii
LGKLFKSVEGLVK

SEQ ID NO: 83815 - protein, 13 aa, Borrelia afzelii
GKLFKSVEGLVKA

SEQ ID NO: 83816 - protein, 13 aa, Borrelia afzelii
KLFKSVEGLVKAA

SEQ ID NO: 83817 - protein, 13 aa, Borrelia afzelii
LFKSVEGLVKAAQ

SEQ ID NO: 83818 - protein, 13 aa, Borrelia afzelii
FKSVEGLVKAAQE

SEQ ID NO: 83819 - protein, 13 aa, Borrelia afzelii
KSVEGLVKAAQEA

SEQ ID NO: 83820 - protein, 13 aa, Borrelia afzelii
SVEGLVKAAQEAL

SEQ ID NO: 83821 - protein, 13 aa, Borrelia afzelii
VEGLVKAAQEALT

SEQ ID NO: 83822 - protein, 13 aa, Borrelia afzelii
EGLVKAAQEALTN

SEQ ID NO: 83823 - protein, 13 aa, Borrelia afzelii
GLVKAAQEALTNS

SEQ ID NO: 83824 - protein, 13 aa, Borrelia afzelii
LVKAAQEALTNSV

SEQ ID NO: 83825 - protein, 13 aa, Borrelia afzelii
VKAAQEALTNSVK

SEQ ID NO: 83826 - protein, 13 aa, Borrelia afzelii
KAAQEALTNSVKE

SEQ ID NO: 83827 - protein, 13 aa, Borrelia afzelii
AAQEALTNSVKEL

SEQ ID NO: 83828 - protein, 13 aa, Borrelia afzelii
AQEALTNSVKELT

SEQ ID NO: 83829 - protein, 13 aa, Borrelia afzelii
QEALTNSVKELTS

SEQ ID NO: 83830 - protein, 13 aa, Borrelia afzelii
EALTNSVKELTSP

SEQ ID NO: 83831 - protein, 13 aa, Borrelia afzelii
ALTNSVKELTSPV

SEQ ID NO: 83832 - protein, 13 aa, Borrelia afzelii
LTNSVKELTSPVV

SEQ ID NO: 83833 - protein, 13 aa, Borrelia afzelii
TNSVKELTSPVVA

SEQ ID NO: 83834 - protein, 13 aa, Borrelia afzelii
NSVKELTSPVVAE

SEQ ID NO: 83835 - protein, 13 aa, Borrelia afzelii
SVKELTSPVVAES

SEQ ID NO: 83836 - protein, 13 aa, Borrelia afzelii
VKELTSPVVAESP

SEQ ID NO: 83837 - protein, 13 aa, Borrelia afzelii
KELTSPVVAESPK

SEQ ID NO: 83838 - protein, 13 aa, Borrelia afzelii
ELTSPVVAESPKK

SEQ ID NO: 83839 - protein, 13 aa, Borrelia afzelii
LTSPVVAESPKKP

SEQ ID NO: 83840 - protein, 14 aa, Borrelia afzelii
MKKNTLSAILMTLF

SEQ ID NO: 83841 - protein, 14 aa, Borrelia afzelii
KKNTLSAILMTLFL

SEQ ID NO: 83842 - protein, 14 aa, Borrelia afzelii
KNTLSAILMTLFLF

SEQ ID NO: 83843 - protein, 14 aa, Borrelia afzelii
NTLSAILMTLFLFI

SEQ ID NO: 83844 - protein, 14 aa, Borrelia afzelii
TLSAILMTLFLFIS

SEQ ID NO: 83845 - protein, 14 aa, Borrelia afzelii
LSAILMTLFLFISC

SEQ ID NO: 83846 - protein, 14 aa, Borrelia afzelii
SAILMTLFLFISCN

SEQ ID NO: 83847 - protein, 14 aa, Borrelia afzelii
AILMTLFLFISCNN

SEQ ID NO: 83848 - protein, 14 aa, Borrelia afzelii
ILMTLFLFISCNNS

SEQ ID NO: 83849 - protein, 14 aa, Borrelia afzelii
LMTLFLFISCNNSG

SEQ ID NO: 83850 - protein, 14 aa, Borrelia afzelii
MTLFLFISCNNSGK

SEQ ID NO: 83851 - protein, 14 aa, Borrelia afzelii
TLFLFISCNNSGKG

SEQ ID NO: 83852 - protein, 14 aa, Borrelia afzelii
LFLFISCNNSGKGG

SEQ ID NO: 83853 - protein, 14 aa, Borrelia afzelii
FLFISCNNSGKGGD

SEQ ID NO: 83854 - protein, 14 aa, Borrelia afzelii
LFISCNNSGKGGDS

SEQ ID NO: 83855 - protein, 14 aa, Borrelia afzelii
FISCNNSGKGGDSA

SEQ ID NO: 83856 - protein, 14 aa, Borrelia afzelii
ISCNNSGKGGDSAS

SEQ ID NO: 83857 - protein, 14 aa, Borrelia afzelii
SCNNSGKGGDSAST

SEQ ID NO: 83858 - protein, 14 aa, Borrelia afzelii
CNNSGKGGDSASTN

SEQ ID NO: 83859 - protein, 14 aa, Borrelia afzelii
NNSGKGGDSASTNP

SEQ ID NO: 83860 - protein, 14 aa, Borrelia afzelii
NSGKGGDSASTNPA

SEQ ID NO: 83861 - protein, 14 aa, Borrelia afzelii
SGKGGDSASTNPAD

SEQ ID NO: 83862 - protein, 14 aa, Borrelia afzelii
GKGGDSASTNPADE

SEQ ID NO: 83863 - protein, 14 aa, Borrelia afzelii
KGGDSASTNPADES

SEQ ID NO: 83864 - protein, 14 aa, Borrelia afzelii
GGDSASTNPADESA

SEQ ID NO: 83865 - protein, 14 aa, Borrelia afzelii
GDSASTNPADESAK

SEQ ID NO: 83866 - protein, 14 aa, Borrelia afzelii
DSASTNPADESAKG

SEQ ID NO: 83867 - protein, 14 aa, Borrelia afzelii
SASTNPADESAKGP

SEQ ID NO: 83868 - protein, 14 aa, Borrelia afzelii
ASTNPADESAKGPN

SEQ ID NO: 83869 - protein, 14 aa, Borrelia afzelii
STNPADESAKGPNL

SEQ ID NO: 83870 - protein, 14 aa, Borrelia afzelii
TNPADESAKGPNLT

SEQ ID NO: 83871 - protein, 14 aa, Borrelia afzelii
NPADESAKGPNLTE

SEQ ID NO: 83872 - protein, 14 aa, Borrelia afzelii
PADESAKGPNLTEI

SEQ ID NO: 83873 - protein, 14 aa, Borrelia afzelii
ADESAKGPNLTEIS

SEQ ID NO: 83874 - protein, 14 aa, Borrelia afzelii
DESAKGPNLTEISK

SEQ ID NO: 83875 - protein, 14 aa, Borrelia afzelii
ESAKGPNLTEISKK

SEQ ID NO: 83876 - protein, 14 aa, Borrelia afzelii
SAKGPNLTEISKKI

SEQ ID NO: 83877 - protein, 14 aa, Borrelia afzelii
AKGPNLTEISKKIT

SEQ ID NO: 83878 - protein, 14 aa, Borrelia afzelii
KGPNLTEISKKITD

SEQ ID NO: 83879 - protein, 14 aa, Borrelia afzelii
GPNLTEISKKITDS

SEQ ID NO: 83880 - protein, 14 aa, Borrelia afzelii
PNLTEISKKITDSN

SEQ ID NO: 83881 - protein, 14 aa, Borrelia afzelii
NLTEISKKITDSNA

SEQ ID NO: 83882 - protein, 14 aa, Borrelia afzelii
LTEISKKITDSNAF

SEQ ID NO: 83883 - protein, 14 aa, Borrelia afzelii
TEISKKITDSNAFV

SEQ ID NO: 83884 - protein, 14 aa, Borrelia afzelii
EISKKITDSNAFVL

SEQ ID NO: 83885 - protein, 14 aa, Borrelia afzelii
ISKKITDSNAFVLA

SEQ ID NO: 83886 - protein, 14 aa, Borrelia afzelii
SKKITDSNAFVLAV

SEQ ID NO: 83887 - protein, 14 aa, Borrelia afzelii
KKITDSNAFVLAVK

SEQ ID NO: 83888 - protein, 14 aa, Borrelia afzelii
KITDSNAFVLAVKE

SEQ ID NO: 83889 - protein, 14 aa, Borrelia afzelii
ITDSNAFVLAVKEV

SEQ ID NO: 83890 - protein, 14 aa, Borrelia afzelii
TDSNAFVLAVKEVE

SEQ ID NO: 83891 - protein, 14 aa, Borrelia afzelii
DSNAFVLAVKEVET

SEQ ID NO: 83892 - protein, 14 aa, Borrelia afzelii
SNAFVLAVKEVETL

SEQ ID NO: 83893 - protein, 14 aa, Borrelia afzelii
NAFVLAVKEVETLV

SEQ ID NO: 83894 - protein, 14 aa, Borrelia afzelii
AFVLAVKEVETLVS

SEQ ID NO: 83895 - protein, 14 aa, Borrelia afzelii
FVLAVKEVETLVSS

SEQ ID NO: 83896 - protein, 14 aa, Borrelia afzelii
VLAVKEVETLVSSI

SEQ ID NO: 83897 - protein, 14 aa, Borrelia afzelii
LAVKEVETLVSSID

SEQ ID NO: 83898 - protein, 14 aa, Borrelia afzelii
AVKEVETLVSSIDE

SEQ ID NO: 83899 - protein, 14 aa, Borrelia afzelii
VKEVETLVSSIDEL

SEQ ID NO: 83900 - protein, 14 aa, Borrelia afzelii
KEVETLVSSIDELA

SEQ ID NO: 83901 - protein, 14 aa, Borrelia afzelii
EVETLVSSIDELAN

SEQ ID NO: 83902 - protein, 14 aa, Borrelia afzelii
VETLVSSIDELANK

SEQ ID NO: 83903 - protein, 14 aa, Borrelia afzelii
ETLVSSIDELANKA

SEQ ID NO: 83904 - protein, 14 aa, Borrelia afzelii
TLVSSIDELANKAI

SEQ ID NO: 83905 - protein, 14 aa, Borrelia afzelii
LVSSIDELANKAIG

SEQ ID NO: 83906 - protein, 14 aa, Borrelia afzelii
VSSIDELANKAIGK

SEQ ID NO: 83907 - protein, 14 aa, Borrelia afzelii
SSIDELANKAIGKK

SEQ ID NO: 83908 - protein, 14 aa, Borrelia afzelii
SIDELANKAIGKKI

SEQ ID NO: 83909 - protein, 14 aa, Borrelia afzelii
IDELANKAIGKKIQ

SEQ ID NO: 83910 - protein, 14 aa, Borrelia afzelii
DELANKAIGKKIQQ

SEQ ID NO: 83911 - protein, 14 aa, Borrelia afzelii
ELANKAIGKKIQQN

SEQ ID NO: 83912 - protein, 14 aa, Borrelia afzelii
LANKAIGKKIQQNG

SEQ ID NO: 83913 - protein, 14 aa, Borrelia afzelii
ANKAIGKKIQQNGL

SEQ ID NO: 83914 - protein, 14 aa, Borrelia afzelii
NKAIGKKIQQNGLG

SEQ ID NO: 83915 - protein, 14 aa, Borrelia afzelii
KAIGKKIQQNGLGA

SEQ ID NO: 83916 - protein, 14 aa, Borrelia afzelii
AIGKKIQQNGLGAE

SEQ ID NO: 83917 - protein, 14 aa, Borrelia afzelii
IGKKIQQNGLGAEA

SEQ ID NO: 83918 - protein, 14 aa, Borrelia afzelii
GKKIQQNGLGAEAN

SEQ ID NO: 83919 - protein, 14 aa, Borrelia afzelii
KKIQQNGLGAEANR

SEQ ID NO: 83920 - protein, 14 aa, Borrelia afzelii
KIQQNGLGAEANRN

SEQ ID NO: 83921 - protein, 14 aa, Borrelia afzelii
IQQNGLGAEANRNE

SEQ ID NO: 83922 - protein, 14 aa, Borrelia afzelii
QQNGLGAEANRNES

SEQ ID NO: 83923 - protein, 14 aa, Borrelia afzelii
QNGLGAEANRNESL

SEQ ID NO: 83924 - protein, 14 aa, Borrelia afzelii
NGLGAEANRNESLL

SEQ ID NO: 83925 - protein, 14 aa, Borrelia afzelii
GLGAEANRNESLLA

SEQ ID NO: 83926 - protein, 14 aa, Borrelia afzelii
LGAEANRNESLLAG

SEQ ID NO: 83927 - protein, 14 aa, Borrelia afzelii
GAEANRNESLLAGV

SEQ ID NO: 83928 - protein, 14 aa, Borrelia afzelii
AEANRNESLLAGVH

SEQ ID NO: 83929 - protein, 14 aa, Borrelia afzelii
EANRNESLLAGVHE

SEQ ID NO: 83930 - protein, 14 aa, Borrelia afzelii
ANRNESLLAGVHEI

SEQ ID NO: 83931 - protein, 14 aa, Borrelia afzelii
NRNESLLAGVHEIS

SEQ ID NO: 83932 - protein, 14 aa, Borrelia afzelii
RNESLLAGVHEIST

SEQ ID NO: 83933 - protein, 14 aa, Borrelia afzelii
NESLLAGVHEISTL

SEQ ID NO: 83934 - protein, 14 aa, Borrelia afzelii
ESLLAGVHEISTLI

SEQ ID NO: 83935 - protein, 14 aa, Borrelia afzelii
SLLAGVHEISTLIT

SEQ ID NO: 83936 - protein, 14 aa, Borrelia afzelii
LLAGVHEISTLITE

SEQ ID NO: 83937 - protein, 14 aa, Borrelia afzelii
LAGVHEISTLITEK

SEQ ID NO: 83938 - protein, 14 aa, Borrelia afzelii
AGVHEISTLITEKL

SEQ ID NO: 83939 - protein, 14 aa, Borrelia afzelii
GVHEISTLITEKLS

SEQ ID NO: 83940 - protein, 14 aa, Borrelia afzelii
VHEISTLITEKLSK

SEQ ID NO: 83941 - protein, 14 aa, Borrelia afzelii
HEISTLITEKLSKL

SEQ ID NO: 83942 - protein, 14 aa, Borrelia afzelii
EISTLITEKLSKLK

SEQ ID NO: 83943 - protein, 14 aa, Borrelia afzelii
ISTLITEKLSKLKN

SEQ ID NO: 83944 - protein, 14 aa, Borrelia afzelii
STLITEKLSKLKNS

SEQ ID NO: 83945 - protein, 14 aa, Borrelia afzelii
TLITEKLSKLKNSG

SEQ ID NO: 83946 - protein, 14 aa, Borrelia afzelii
LITEKLSKLKNSGE

SEQ ID NO: 83947 - protein, 14 aa, Borrelia afzelii
ITEKLSKLKNSGEL

SEQ ID NO: 83948 - protein, 14 aa, Borrelia afzelii
TEKLSKLKNSGELK

SEQ ID NO: 83949 - protein, 14 aa, Borrelia afzelii
EKLSKLKNSGELKA

SEQ ID NO: 83950 - protein, 14 aa, Borrelia afzelii
KLSKLKNSGELKAK

SEQ ID NO: 83951 - protein, 14 aa, Borrelia afzelii
LSKLKNSGELKAKI

SEQ ID NO: 83952 - protein, 14 aa, Borrelia afzelii
SKLKNSGELKAKIE

SEQ ID NO: 83953 - protein, 14 aa, Borrelia afzelii
KLKNSGELKAKIED

SEQ ID NO: 83954 - protein, 14 aa, Borrelia afzelii
LKNSGELKAKIEDA

SEQ ID NO: 83955 - protein, 14 aa, Borrelia afzelii
KNSGELKAKIEDAK

SEQ ID NO: 83956 - protein, 14 aa, Borrelia afzelii
NSGELKAKIEDAKK

SEQ ID NO: 83957 - protein, 14 aa, Borrelia afzelii
SGELKAKIEDAKKC

SEQ ID NO: 83958 - protein, 14 aa, Borrelia afzelii
GELKAKIEDAKKCS

SEQ ID NO: 83959 - protein, 14 aa, Borrelia afzelii
ELKAKIEDAKKCSE

SEQ ID NO: 83960 - protein, 14 aa, Borrelia afzelii
LKAKIEDAKKCSEE

SEQ ID NO: 83961 - protein, 14 aa, Borrelia afzelii
KAKIEDAKKCSEEF

SEQ ID NO: 83962 - protein, 14 aa, Borrelia afzelii
AKIEDAKKCSEEFT

SEQ ID NO: 83963 - protein, 14 aa, Borrelia afzelii
KIEDAKKCSEEFTN

SEQ ID NO: 83964 - protein, 14 aa, Borrelia afzelii
IEDAKKCSEEFTNK

SEQ ID NO: 83965 - protein, 14 aa, Borrelia afzelii
EDAKKCSEEFTNKL

SEQ ID NO: 83966 - protein, 14 aa, Borrelia afzelii
DAKKCSEEFTNKLR

SEQ ID NO: 83967 - protein, 14 aa, Borrelia afzelii
AKKCSEEFTNKLRV

SEQ ID NO: 83968 - protein, 14 aa, Borrelia afzelii
KKCSEEFTNKLRVS

SEQ ID NO: 83969 - protein, 14 aa, Borrelia afzelii
KCSEEFTNKLRVSH

SEQ ID NO: 83970 - protein, 14 aa, Borrelia afzelii
CSEEFTNKLRVSHA

SEQ ID NO: 83971 - protein, 14 aa, Borrelia afzelii
SEEFTNKLRVSHAD

SEQ ID NO: 83972 - protein, 14 aa, Borrelia afzelii
EEFTNKLRVSHADL

SEQ ID NO: 83973 - protein, 14 aa, Borrelia afzelii
EFTNKLRVSHADLG

SEQ ID NO: 83974 - protein, 14 aa, Borrelia afzelii
FTNKLRVSHADLGK

SEQ ID NO: 83975 - protein, 14 aa, Borrelia afzelii
TNKLRVSHADLGKQ

SEQ ID NO: 83976 - protein, 14 aa, Borrelia afzelii
NKLRVSHADLGKQG

SEQ ID NO: 83977 - protein, 14 aa, Borrelia afzelii
KLRVSHADLGKQGV

SEQ ID NO: 83978 - protein, 14 aa, Borrelia afzelii
LRVSHADLGKQGVN

SEQ ID NO: 83979 - protein, 14 aa, Borrelia afzelii
RVSHADLGKQGVND

SEQ ID NO: 83980 - protein, 14 aa, Borrelia afzelii
VSHADLGKQGVNDD

SEQ ID NO: 83981 - protein, 14 aa, Borrelia afzelii
SHADLGKQGVNDDD

SEQ ID NO: 83982 - protein, 14 aa, Borrelia afzelii
HADLGKQGVNDDDA

SEQ ID NO: 83983 - protein, 14 aa, Borrelia afzelii
ADLGKQGVNDDDAK

SEQ ID NO: 83984 - protein, 14 aa, Borrelia afzelii
DLGKQGVNDDDAKK

SEQ ID NO: 83985 - protein, 14 aa, Borrelia afzelii
LGKQGVNDDDAKKA

SEQ ID NO: 83986 - protein, 14 aa, Borrelia afzelii
GKQGVNDDDAKKAI

SEQ ID NO: 83987 - protein, 14 aa, Borrelia afzelii
KQGVNDDDAKKAIL

SEQ ID NO: 83988 - protein, 14 aa, Borrelia afzelii
QGVNDDDAKKAILK

SEQ ID NO: 83989 - protein, 14 aa, Borrelia afzelii
GVNDDDAKKAILKT

SEQ ID NO: 83990 - protein, 14 aa, Borrelia afzelii
VNDDDAKKAILKTN

SEQ ID NO: 83991 - protein, 14 aa, Borrelia afzelii
NDDDAKKAILKTNA

SEQ ID NO: 83992 - protein, 14 aa, Borrelia afzelii
DDDAKKAILKTNAD

SEQ ID NO: 83993 - protein, 14 aa, Borrelia afzelii
DDAKKAILKTNADK

SEQ ID NO: 83994 - protein, 14 aa, Borrelia afzelii
DAKKAILKTNADKT

SEQ ID NO: 83995 - protein, 14 aa, Borrelia afzelii
AKKAILKTNADKTK

SEQ ID NO: 83996 - protein, 14 aa, Borrelia afzelii
KKAILKTNADKTKG

SEQ ID NO: 83997 - protein, 14 aa, Borrelia afzelii
KAILKTNADKTKGA

SEQ ID NO: 83998 - protein, 14 aa, Borrelia afzelii
AILKTNADKTKGAE

SEQ ID NO: 83999 - protein, 14 aa, Borrelia afzelii
ILKTNADKTKGAEE

SEQ ID NO: 84000 - protein, 14 aa, Borrelia afzelii
LKTNADKTKGAEEL

SEQ ID NO: 84001 - protein, 14 aa, Borrelia afzelii
KTNADKTKGAEELG

SEQ ID NO: 84002 - protein, 14 aa, Borrelia afzelii
TNADKTKGAEELGK

SEQ ID NO: 84003 - protein, 14 aa, Borrelia afzelii
NADKTKGAEELGKL

SEQ ID NO: 84004 - protein, 14 aa, Borrelia afzelii
ADKTKGAEELGKLF

SEQ ID NO: 84005 - protein, 14 aa, Borrelia afzelii
DKTKGAEELGKLFK

SEQ ID NO: 84006 - protein, 14 aa, Borrelia afzelii
KTKGAEELGKLFKS

SEQ ID NO: 84007 - protein, 14 aa, Borrelia afzelii
TKGAEELGKLFKSV

SEQ ID NO: 84008 - protein, 14 aa, Borrelia afzelii
KGAEELGKLFKSVE

SEQ ID NO: 84009 - protein, 14 aa, Borrelia afzelii
GAEELGKLFKSVEG

SEQ ID NO: 84010 - protein, 14 aa, Borrelia afzelii
AEELGKLFKSVEGL

SEQ ID NO: 84011 - protein, 14 aa, Borrelia afzelii
EELGKLFKSVEGLV

SEQ ID NO: 84012 - protein, 14 aa, Borrelia afzelii
ELGKLFKSVEGLVK

SEQ ID NO: 84013 - protein, 14 aa, Borrelia afzelii
LGKLFKSVEGLVKA

SEQ ID NO: 84014 - protein, 14 aa, Borrelia afzelii
GKLFKSVEGLVKAA

SEQ ID NO: 84015 - protein, 14 aa, Borrelia afzelii
KLFKSVEGLVKAAQ

SEQ ID NO: 84016 - protein, 14 aa, Borrelia afzelii
LFKSVEGLVKAAQE

SEQ ID NO: 84017 - protein, 14 aa, Borrelia afzelii
FKSVEGLVKAAQEA

SEQ ID NO: 84018 - protein, 14 aa, Borrelia afzelii
KSVEGLVKAAQEAL

SEQ ID NO: 84019 - protein, 14 aa, Borrelia afzelii
SVEGLVKAAQEALT

SEQ ID NO: 84020 - protein, 14 aa, Borrelia afzelii
VEGLVKAAQEALTN

SEQ ID NO: 84021 - protein, 14 aa, Borrelia afzelii
EGLVKAAQEALTNS

SEQ ID NO: 84022 - protein, 14 aa, Borrelia afzelii
GLVKAAQEALTNSV

SEQ ID NO: 84023 - protein, 14 aa, Borrelia afzelii
LVKAAQEALTNSVK

SEQ ID NO: 84024 - protein, 14 aa, Borrelia afzelii
VKAAQEALTNSVKE

SEQ ID NO: 84025 - protein, 14 aa, Borrelia afzelii
KAAQEALTNSVKEL

SEQ ID NO: 84026 - protein, 14 aa, Borrelia afzelii
AAQEALTNSVKELT

SEQ ID NO: 84027 - protein, 14 aa, Borrelia afzelii
AQEALTNSVKELTS

SEQ ID NO: 84028 - protein, 14 aa, Borrelia afzelii
QEALTNSVKELTSP

SEQ ID NO: 84029 - protein, 14 aa, Borrelia afzelii
EALTNSVKELTSPV

SEQ ID NO: 84030 - protein, 14 aa, Borrelia afzelii
ALTNSVKELTSPVV

SEQ ID NO: 84031 - protein, 14 aa, Borrelia afzelii
LTNSVKELTSPVVA

SEQ ID NO: 84032 - protein, 14 aa, Borrelia afzelii
TNSVKELTSPVVAE

SEQ ID NO: 84033 - protein, 14 aa, Borrelia afzelii
NSVKELTSPVVAES

SEQ ID NO: 84034 - protein, 14 aa, Borrelia afzelii
SVKELTSPVVAESP

SEQ ID NO: 84035 - protein, 14 aa, Borrelia afzelii
VKELTSPVVAESPK

SEQ ID NO: 84036 - protein, 14 aa, Borrelia afzelii
KELTSPVVAESPKK

SEQ ID NO: 84037 - protein, 14 aa, Borrelia afzelii
ELTSPVVAESPKKP

SEQ ID NO: 84038 - protein, 15 aa, Borrelia afzelii
MKKNTLSAILMTLFL

SEQ ID NO: 84039 - protein, 15 aa, Borrelia afzelii
KKNTLSAILMTLFLF

SEQ ID NO: 84040 - protein, 15 aa, Borrelia afzelii
KNTLSAILMTLFLFI

SEQ ID NO: 84041 - protein, 15 aa, Borrelia afzelii
NTLSAILMTLFLFIS

SEQ ID NO: 84042 - protein, 15 aa, Borrelia afzelii
TLSAILMTLFLFISC

SEQ ID NO: 84043 - protein, 15 aa, Borrelia afzelii
LSAILMTLFLFISCN

SEQ ID NO: 84044 - protein, 15 aa, Borrelia afzelii
SAILMTLFLFISCNN

SEQ ID NO: 84045 - protein, 15 aa, Borrelia afzelii
AILMTLFLFISCNNS

SEQ ID NO: 84046 - protein, 15 aa, Borrelia afzelii
ILMTLFLFISCNNSG

SEQ ID NO: 84047 - protein, 15 aa, Borrelia afzelii
LMTLFLFISCNNSGK

SEQ ID NO: 84048 - protein, 15 aa, Borrelia afzelii
MTLFLFISCNNSGKG

SEQ ID NO: 84049 - protein, 15 aa, Borrelia afzelii
TLFLFISCNNSGKGG

SEQ ID NO: 84050 - protein, 15 aa, Borrelia afzelii
LFLFISCNNSGKGGD

SEQ ID NO: 84051 - protein, 15 aa, Borrelia afzelii
FLFISCNNSGKGGDS

SEQ ID NO: 84052 - protein, 15 aa, Borrelia afzelii
LFISCNNSGKGGDSA

SEQ ID NO: 84053 - protein, 15 aa, Borrelia afzelii
FISCNNSGKGGDSAS

SEQ ID NO: 84054 - protein, 15 aa, Borrelia afzelii
ISCNNSGKGGDSAST

SEQ ID NO: 84055 - protein, 15 aa, Borrelia afzelii
SCNNSGKGGDSASTN

SEQ ID NO: 84056 - protein, 15 aa, Borrelia afzelii
CNNSGKGGDSASTNP

SEQ ID NO: 84057 - protein, 15 aa, Borrelia afzelii
NNSGKGGDSASTNPA

SEQ ID NO: 84058 - protein, 15 aa, Borrelia afzelii
NSGKGGDSASTNPAD

SEQ ID NO: 84059 - protein, 15 aa, Borrelia afzelii
SGKGGDSASTNPADE

SEQ ID NO: 84060 - protein, 15 aa, Borrelia afzelii
GKGGDSASTNPADES

SEQ ID NO: 84061 - protein, 15 aa, Borrelia afzelii
KGGDSASTNPADESA

SEQ ID NO: 84062 - protein, 15 aa, Borrelia afzelii
GGDSASTNPADESAK

SEQ ID NO: 84063 - protein, 15 aa, Borrelia afzelii
GDSASTNPADESAKG

SEQ ID NO: 84064 - protein, 15 aa, Borrelia afzelii
DSASTNPADESAKGP

SEQ ID NO: 84065 - protein, 15 aa, Borrelia afzelii
SASTNPADESAKGPN

SEQ ID NO: 84066 - protein, 15 aa, Borrelia afzelii
ASTNPADESAKGPNL

SEQ ID NO: 84067 - protein, 15 aa, Borrelia afzelii
STNPADESAKGPNLT

SEQ ID NO: 84068 - protein, 15 aa, Borrelia afzelii
TNPADESAKGPNLTE

SEQ ID NO: 84069 - protein, 15 aa, Borrelia afzelii
NPADESAKGPNLTEI

SEQ ID NO: 84070 - protein, 15 aa, Borrelia afzelii
PADESAKGPNLTEIS

SEQ ID NO: 84071 - protein, 15 aa, Borrelia afzelii
ADESAKGPNLTEISK

SEQ ID NO: 84072 - protein, 15 aa, Borrelia afzelii
DESAKGPNLTEISKK

SEQ ID NO: 84073 - protein, 15 aa, Borrelia afzelii
ESAKGPNLTEISKKI

SEQ ID NO: 84074 - protein, 15 aa, Borrelia afzelii
SAKGPNLTEISKKIT

SEQ ID NO: 84075 - protein, 15 aa, Borrelia afzelii
AKGPNLTEISKKITD

SEQ ID NO: 84076 - protein, 15 aa, Borrelia afzelii
KGPNLTEISKKITDS

SEQ ID NO: 84077 - protein, 15 aa, Borrelia afzelii
GPNLTEISKKITDSN

SEQ ID NO: 84078 - protein, 15 aa, Borrelia afzelii
PNLTEISKKITDSNA

SEQ ID NO: 84079 - protein, 15 aa, Borrelia afzelii
NLTEISKKITDSNAF

SEQ ID NO: 84080 - protein, 15 aa, Borrelia afzelii
LTEISKKITDSNAFV

SEQ ID NO: 84081 - protein, 15 aa, Borrelia afzelii
TEISKKITDSNAFVL

SEQ ID NO: 84082 - protein, 15 aa, Borrelia afzelii
EISKKITDSNAFVLA

SEQ ID NO: 84083 - protein, 15 aa, Borrelia afzelii
ISKKITDSNAFVLAV

SEQ ID NO: 84084 - protein, 15 aa, Borrelia afzelii
SKKITDSNAFVLAVK

SEQ ID NO: 84085 - protein, 15 aa, Borrelia afzelii
KKITDSNAFVLAVKE

SEQ ID NO: 84086 - protein, 15 aa, Borrelia afzelii
KITDSNAFVLAVKEV

SEQ ID NO: 84087 - protein, 15 aa, Borrelia afzelii
ITDSNAFVLAVKEVE

SEQ ID NO: 84088 - protein, 15 aa, Borrelia afzelii
TDSNAFVLAVKEVET

SEQ ID NO: 84089 - protein, 15 aa, Borrelia afzelii
DSNAFVLAVKEVETL

SEQ ID NO: 84090 - protein, 15 aa, Borrelia afzelii
SNAFVLAVKEVETLV

SEQ ID NO: 84091 - protein, 15 aa, Borrelia afzelii
NAFVLAVKEVETLVS

SEQ ID NO: 84092 - protein, 15 aa, Borrelia afzelii
AFVLAVKEVETLVSS

SEQ ID NO: 84093 - protein, 15 aa, Borrelia afzelii
FVLAVKEVETLVSSI

SEQ ID NO: 84094 - protein, 15 aa, Borrelia afzelii
VLAVKEVETLVSSID

SEQ ID NO: 84095 - protein, 15 aa, Borrelia afzelii
LAVKEVETLVSSIDE

SEQ ID NO: 84096 - protein, 15 aa, Borrelia afzelii
AVKEVETLVSSIDEL

SEQ ID NO: 84097 - protein, 15 aa, Borrelia afzelii
VKEVETLVSSIDELA

SEQ ID NO: 84098 - protein, 15 aa, Borrelia afzelii
KEVETLVSSIDELAN

SEQ ID NO: 84099 - protein, 15 aa, Borrelia afzelii
EVETLVSSIDELANK

SEQ ID NO: 84100 - protein, 15 aa, Borrelia afzelii
VETLVSSIDELANKA

SEQ ID NO: 84101 - protein, 15 aa, Borrelia afzelii
ETLVSSIDELANKAI

SEQ ID NO: 84102 - protein, 15 aa, Borrelia afzelii
TLVSSIDELANKAIG

SEQ ID NO: 84103 - protein, 15 aa, Borrelia afzelii
LVSSIDELANKAIGK

SEQ ID NO: 84104 - protein, 15 aa, Borrelia afzelii
VSSIDELANKAIGKK

SEQ ID NO: 84105 - protein, 15 aa, Borrelia afzelii
SSIDELANKAIGKKI

SEQ ID NO: 84106 - protein, 15 aa, Borrelia afzelii
SIDELANKAIGKKIQ

SEQ ID NO: 84107 - protein, 15 aa, Borrelia afzelii
IDELANKAIGKKIQQ

SEQ ID NO: 84108 - protein, 15 aa, Borrelia afzelii
DELANKAIGKKIQQN

SEQ ID NO: 84109 - protein, 15 aa, Borrelia afzelii
ELANKAIGKKIQQNG

SEQ ID NO: 84110 - protein, 15 aa, Borrelia afzelii
LANKAIGKKIQQNGL

SEQ ID NO: 84111 - protein, 15 aa, Borrelia afzelii
ANKAIGKKIQQNGLG

SEQ ID NO: 84112 - protein, 15 aa, Borrelia afzelii
NKAIGKKIQQNGLGA

SEQ ID NO: 84113 - protein, 15 aa, Borrelia afzelii
KAIGKKIQQNGLGAE

SEQ ID NO: 84114 - protein, 15 aa, Borrelia afzelii
AIGKKIQQNGLGAEA

SEQ ID NO: 84115 - protein, 15 aa, Borrelia afzelii
IGKKIQQNGLGAEAN

SEQ ID NO: 84116 - protein, 15 aa, Borrelia afzelii
GKKIQQNGLGAEANR

SEQ ID NO: 84117 - protein, 15 aa, Borrelia afzelii
KKIQQNGLGAEANRN

SEQ ID NO: 84118 - protein, 15 aa, Borrelia afzelii
KIQQNGLGAEANRNE

SEQ ID NO: 84119 - protein, 15 aa, Borrelia afzelii
IQQNGLGAEANRNES

SEQ ID NO: 84120 - protein, 15 aa, Borrelia afzelii
QQNGLGAEANRNESL

SEQ ID NO: 84121 - protein, 15 aa, Borrelia afzelii
QNGLGAEANRNESLL

SEQ ID NO: 84122 - protein, 15 aa, Borrelia afzelii
NGLGAEANRNESLLA

SEQ ID NO: 84123 - protein, 15 aa, Borrelia afzelii
GLGAEANRNESLLAG

SEQ ID NO: 84124 - protein, 15 aa, Borrelia afzelii
LGAEANRNESLLAGV

SEQ ID NO: 84125 - protein, 15 aa, Borrelia afzelii
GAEANRNESLLAGVH

SEQ ID NO: 84126 - protein, 15 aa, Borrelia afzelii
AEANRNESLLAGVHE

SEQ ID NO: 84127 - protein, 15 aa, Borrelia afzelii
EANRNESLLAGVHEI

SEQ ID NO: 84128 - protein, 15 aa, Borrelia afzelii
ANRNESLLAGVHEIS

SEQ ID NO: 84129 - protein, 15 aa, Borrelia afzelii
NRNESLLAGVHEIST

SEQ ID NO: 84130 - protein, 15 aa, Borrelia afzelii
RNESLLAGVHEISTL

SEQ ID NO: 84131 - protein, 15 aa, Borrelia afzelii
NESLLAGVHEISTLI

SEQ ID NO: 84132 - protein, 15 aa, Borrelia afzelii
ESLLAGVHEISTLIT

SEQ ID NO: 84133 - protein, 15 aa, Borrelia afzelii
SLLAGVHEISTLITE

SEQ ID NO: 84134 - protein, 15 aa, Borrelia afzelii
LLAGVHEISTLITEK

SEQ ID NO: 84135 - protein, 15 aa, Borrelia afzelii
LAGVHEISTLITEKL

SEQ ID NO: 84136 - protein, 15 aa, Borrelia afzelii
AGVHEISTLITEKLS

SEQ ID NO: 84137 - protein, 15 aa, Borrelia afzelii
GVHEISTLITEKLSK

SEQ ID NO: 84138 - protein, 15 aa, Borrelia afzelii
VHEISTLITEKLSKL

SEQ ID NO: 84139 - protein, 15 aa, Borrelia afzelii
HEISTLITEKLSKLK

SEQ ID NO: 84140 - protein, 15 aa, Borrelia afzelii
EISTLITEKLSKLKN

SEQ ID NO: 84141 - protein, 15 aa, Borrelia afzelii
ISTLITEKLSKLKNS

SEQ ID NO: 84142 - protein, 15 aa, Borrelia afzelii
STLITEKLSKLKNSG

SEQ ID NO: 84143 - protein, 15 aa, Borrelia afzelii
TLITEKLSKLKNSGE

SEQ ID NO: 84144 - protein, 15 aa, Borrelia afzelii
LITEKLSKLKNSGEL

SEQ ID NO: 84145 - protein, 15 aa, Borrelia afzelii
ITEKLSKLKNSGELK

SEQ ID NO: 84146 - protein, 15 aa, Borrelia afzelii
TEKLSKLKNSGELKA

SEQ ID NO: 84147 - protein, 15 aa, Borrelia afzelii
EKLSKLKNSGELKAK

SEQ ID NO: 84148 - protein, 15 aa, Borrelia afzelii
KLSKLKNSGELKAKI

SEQ ID NO: 84149 - protein, 15 aa, Borrelia afzelii
LSKLKNSGELKAKIE

SEQ ID NO: 84150 - protein, 15 aa, Borrelia afzelii
SKLKNSGELKAKIED

SEQ ID NO: 84151 - protein, 15 aa, Borrelia afzelii
KLKNSGELKAKIEDA

SEQ ID NO: 84152 - protein, 15 aa, Borrelia afzelii
LKNSGELKAKIEDAK

SEQ ID NO: 84153 - protein, 15 aa, Borrelia afzelii
KNSGELKAKIEDAKK

SEQ ID NO: 84154 - protein, 15 aa, Borrelia afzelii
NSGELKAKIEDAKKC

SEQ ID NO: 84155 - protein, 15 aa, Borrelia afzelii
SGELKAKIEDAKKCS

SEQ ID NO: 84156 - protein, 15 aa, Borrelia afzelii
GELKAKIEDAKKCSE

SEQ ID NO: 84157 - protein, 15 aa, Borrelia afzelii
ELKAKIEDAKKCSEE

SEQ ID NO: 84158 - protein, 15 aa, Borrelia afzelii
LKAKIEDAKKCSEEF

SEQ ID NO: 84159 - protein, 15 aa, Borrelia afzelii
KAKIEDAKKCSEEFT

SEQ ID NO: 84160 - protein, 15 aa, Borrelia afzelii
AKIEDAKKCSEEFTN

SEQ ID NO: 84161 - protein, 15 aa, Borrelia afzelii
KIEDAKKCSEEFTNK

SEQ ID NO: 84162 - protein, 15 aa, Borrelia afzelii
IEDAKKCSEEFTNKL

SEQ ID NO: 84163 - protein, 15 aa, Borrelia afzelii
EDAKKCSEEFTNKLR

SEQ ID NO: 84164 - protein, 15 aa, Borrelia afzelii
DAKKCSEEFTNKLRV

SEQ ID NO: 84165 - protein, 15 aa, Borrelia afzelii
AKKCSEEFTNKLRVS

SEQ ID NO: 84166 - protein, 15 aa, Borrelia afzelii
KKCSEEFTNKLRVSH

SEQ ID NO: 84167 - protein, 15 aa, Borrelia afzelii
KCSEEFTNKLRVSHA

SEQ ID NO: 84168 - protein, 15 aa, Borrelia afzelii
CSEEFTNKLRVSHAD

SEQ ID NO: 84169 - protein, 15 aa, Borrelia afzelii
SEEFTNKLRVSHADL

SEQ ID NO: 84170 - protein, 15 aa, Borrelia afzelii
EEFTNKLRVSHADLG

SEQ ID NO: 84171 - protein, 15 aa, Borrelia afzelii
EFTNKLRVSHADLGK

SEQ ID NO: 84172 - protein, 15 aa, Borrelia afzelii
FTNKLRVSHADLGKQ

SEQ ID NO: 84173 - protein, 15 aa, Borrelia afzelii
TNKLRVSHADLGKQG

SEQ ID NO: 84174 - protein, 15 aa, Borrelia afzelii
NKLRVSHADLGKQGV

SEQ ID NO: 84175 - protein, 15 aa, Borrelia afzelii
KLRVSHADLGKQGVN

SEQ ID NO: 84176 - protein, 15 aa, Borrelia afzelii
LRVSHADLGKQGVND

SEQ ID NO: 84177 - protein, 15 aa, Borrelia afzelii
RVSHADLGKQGVNDD

SEQ ID NO: 84178 - protein, 15 aa, Borrelia afzelii
VSHADLGKQGVNDDD

SEQ ID NO: 84179 - protein, 15 aa, Borrelia afzelii
SHADLGKQGVNDDDA

SEQ ID NO: 84180 - protein, 15 aa, Borrelia afzelii
HADLGKQGVNDDDAK

SEQ ID NO: 84181 - protein, 15 aa, Borrelia afzelii
ADLGKQGVNDDDAKK

SEQ ID NO: 84182 - protein, 15 aa, Borrelia afzelii
DLGKQGVNDDDAKKA

SEQ ID NO: 84183 - protein, 15 aa, Borrelia afzelii
LGKQGVNDDDAKKAI

SEQ ID NO: 84184 - protein, 15 aa, Borrelia afzelii
GKQGVNDDDAKKAIL

SEQ ID NO: 84185 - protein, 15 aa, Borrelia afzelii
KQGVNDDDAKKAILK

SEQ ID NO: 84186 - protein, 15 aa, Borrelia afzelii
QGVNDDDAKKAILKT

SEQ ID NO: 84187 - protein, 15 aa, Borrelia afzelii
GVNDDDAKKAILKTN

SEQ ID NO: 84188 - protein, 15 aa, Borrelia afzelii
VNDDDAKKAILKTNA

SEQ ID NO: 84189 - protein, 15 aa, Borrelia afzelii
NDDDAKKAILKTNAD

SEQ ID NO: 84190 - protein, 15 aa, Borrelia afzelii
DDDAKKAILKTNADK

SEQ ID NO: 84191 - protein, 15 aa, Borrelia afzelii
DDAKKAILKTNADKT

SEQ ID NO: 84192 - protein, 15 aa, Borrelia afzelii
DAKKAILKTNADKTK

SEQ ID NO: 84193 - protein, 15 aa, Borrelia afzelii
AKKAILKTNADKTKG

SEQ ID NO: 84194 - protein, 15 aa, Borrelia afzelii
KKAILKTNADKTKGA

SEQ ID NO: 84195 - protein, 15 aa, Borrelia afzelii
KAILKTNADKTKGAE

SEQ ID NO: 84196 - protein, 15 aa, Borrelia afzelii
AILKTNADKTKGAEE

SEQ ID NO: 84197 - protein, 15 aa, Borrelia afzelii
ILKTNADKTKGAEEL

SEQ ID NO: 84198 - protein, 15 aa, Borrelia afzelii
LKTNADKTKGAEELG

SEQ ID NO: 84199 - protein, 15 aa, Borrelia afzelii
KTNADKTKGAEELGK

SEQ ID NO: 84200 - protein, 15 aa, Borrelia afzelii
TNADKTKGAEELGKL

SEQ ID NO: 84201 - protein, 15 aa, Borrelia afzelii
NADKTKGAEELGKLF

SEQ ID NO: 84202 - protein, 15 aa, Borrelia afzelii
ADKTKGAEELGKLFK

SEQ ID NO: 84203 - protein, 15 aa, Borrelia afzelii
DKTKGAEELGKLFKS

SEQ ID NO: 84204 - protein, 15 aa, Borrelia afzelii
KTKGAEELGKLFKSV

SEQ ID NO: 84205 - protein, 15 aa, Borrelia afzelii
TKGAEELGKLFKSVE

SEQ ID NO: 84206 - protein, 15 aa, Borrelia afzelii
KGAEELGKLFKSVEG

SEQ ID NO: 84207 - protein, 15 aa, Borrelia afzelii
GAEELGKLFKSVEGL

SEQ ID NO: 84208 - protein, 15 aa, Borrelia afzelii
AEELGKLFKSVEGLV

SEQ ID NO: 84209 - protein, 15 aa, Borrelia afzelii
EELGKLFKSVEGLVK

SEQ ID NO: 84210 - protein, 15 aa, Borrelia afzelii
ELGKLFKSVEGLVKA

SEQ ID NO: 84211 - protein, 15 aa, Borrelia afzelii
LGKLFKSVEGLVKAA

SEQ ID NO: 84212 - protein, 15 aa, Borrelia afzelii
GKLFKSVEGLVKAAQ

SEQ ID NO: 84213 - protein, 15 aa, Borrelia afzelii
KLFKSVEGLVKAAQE

SEQ ID NO: 84214 - protein, 15 aa, Borrelia afzelii
LFKSVEGLVKAAQEA

SEQ ID NO: 84215 - protein, 15 aa, Borrelia afzelii
FKSVEGLVKAAQEAL

SEQ ID NO: 84216 - protein, 15 aa, Borrelia afzelii
KSVEGLVKAAQEALT

SEQ ID NO: 84217 - protein, 15 aa, Borrelia afzelii
SVEGLVKAAQEALTN

SEQ ID NO: 84218 - protein, 15 aa, Borrelia afzelii
VEGLVKAAQEALTNS

SEQ ID NO: 84219 - protein, 15 aa, Borrelia afzelii
EGLVKAAQEALTNSV

SEQ ID NO: 84220 - protein, 15 aa, Borrelia afzelii
GLVKAAQEALTNSVK

SEQ ID NO: 84221 - protein, 15 aa, Borrelia afzelii
LVKAAQEALTNSVKE

SEQ ID NO: 84222 - protein, 15 aa, Borrelia afzelii
VKAAQEALTNSVKEL

SEQ ID NO: 84223 - protein, 15 aa, Borrelia afzelii
KAAQEALTNSVKELT

SEQ ID NO: 84224 - protein, 15 aa, Borrelia afzelii
AAQEALTNSVKELTS

SEQ ID NO: 84225 - protein, 15 aa, Borrelia afzelii
AQEALTNSVKELTSP

SEQ ID NO: 84226 - protein, 15 aa, Borrelia afzelii
QEALTNSVKELTSPV

SEQ ID NO: 84227 - protein, 15 aa, Borrelia afzelii
EALTNSVKELTSPVV

SEQ ID NO: 84228 - protein, 15 aa, Borrelia afzelii
ALTNSVKELTSPVVA

SEQ ID NO: 84229 - protein, 15 aa, Borrelia afzelii
LTNSVKELTSPVVAE

SEQ ID NO: 84230 - protein, 15 aa, Borrelia afzelii
TNSVKELTSPVVAES

SEQ ID NO: 84231 - protein, 15 aa, Borrelia afzelii
NSVKELTSPVVAESP

SEQ ID NO: 84232 - protein, 15 aa, Borrelia afzelii
SVKELTSPVVAESPK

SEQ ID NO: 84233 - protein, 15 aa, Borrelia afzelii
VKELTSPVVAESPKK

SEQ ID NO: 84234 - protein, 15 aa, Borrelia afzelii
KELTSPVVAESPKKP

SEQ ID NO: 84235 - protein, 16 aa, Borrelia afzelii
MKKNTLSAILMTLFLF

SEQ ID NO: 84236 - protein, 16 aa, Borrelia afzelii
KKNTLSAILMTLFLFI

SEQ ID NO: 84237 - protein, 16 aa, Borrelia afzelii
KNTLSAILMTLFLFIS

SEQ ID NO: 84238 - protein, 16 aa, Borrelia afzelii
NTLSAILMTLFLFISC

SEQ ID NO: 84239 - protein, 16 aa, Borrelia afzelii
TLSAILMTLFLFISCN

SEQ ID NO: 84240 - protein, 16 aa, Borrelia afzelii
LSAILMTLFLFISCNN

SEQ ID NO: 84241 - protein, 16 aa, Borrelia afzelii
SAILMTLFLFISCNNS

SEQ ID NO: 84242 - protein, 16 aa, Borrelia afzelii
AILMTLFLFISCNNSG

SEQ ID NO: 84243 - protein, 16 aa, Borrelia afzelii
ILMTLFLFISCNNSGK

SEQ ID NO: 84244 - protein, 16 aa, Borrelia afzelii
LMTLFLFISCNNSGKG

SEQ ID NO: 84245 - protein, 16 aa, Borrelia afzelii
MTLFLFISCNNSGKGG

SEQ ID NO: 84246 - protein, 16 aa, Borrelia afzelii
TLFLFISCNNSGKGGD

SEQ ID NO: 84247 - protein, 16 aa, Borrelia afzelii
LFLFISCNNSGKGGDS

SEQ ID NO: 84248 - protein, 16 aa, Borrelia afzelii
FLFISCNNSGKGGDSA

SEQ ID NO: 84249 - protein, 16 aa, Borrelia afzelii
LFISCNNSGKGGDSAS

SEQ ID NO: 84250 - protein, 16 aa, Borrelia afzelii
FISCNNSGKGGDSAST

SEQ ID NO: 84251 - protein, 16 aa, Borrelia afzelii
ISCNNSGKGGDSASTN

SEQ ID NO: 84252 - protein, 16 aa, Borrelia afzelii
SCNNSGKGGDSASTNP

SEQ ID NO: 84253 - protein, 16 aa, Borrelia afzelii
CNNSGKGGDSASTNPA

SEQ ID NO: 84254 - protein, 16 aa, Borrelia afzelii
NNSGKGGDSASTNPAD

SEQ ID NO: 84255 - protein, 16 aa, Borrelia afzelii
NSGKGGDSASTNPADE

SEQ ID NO: 84256 - protein, 16 aa, Borrelia afzelii
SGKGGDSASTNPADES

SEQ ID NO: 84257 - protein, 16 aa, Borrelia afzelii
GKGGDSASTNPADESA

SEQ ID NO: 84258 - protein, 16 aa, Borrelia afzelii
KGGDSASTNPADESAK

SEQ ID NO: 84259 - protein, 16 aa, Borrelia afzelii
GGDSASTNPADESAKG

SEQ ID NO: 84260 - protein, 16 aa, Borrelia afzelii
GDSASTNPADESAKGP

SEQ ID NO: 84261 - protein, 16 aa, Borrelia afzelii
DSASTNPADESAKGPN

SEQ ID NO: 84262 - protein, 16 aa, Borrelia afzelii
SASTNPADESAKGPNL

SEQ ID NO: 84263 - protein, 16 aa, Borrelia afzelii
ASTNPADESAKGPNLT

SEQ ID NO: 84264 - protein, 16 aa, Borrelia afzelii
STNPADESAKGPNLTE

SEQ ID NO: 84265 - protein, 16 aa, Borrelia afzelii
TNPADESAKGPNLTEI

SEQ ID NO: 84266 - protein, 16 aa, Borrelia afzelii
NPADESAKGPNLTEIS

SEQ ID NO: 84267 - protein, 16 aa, Borrelia afzelii
PADESAKGPNLTEISK

SEQ ID NO: 84268 - protein, 16 aa, Borrelia afzelii
ADESAKGPNLTEISKK

SEQ ID NO: 84269 - protein, 16 aa, Borrelia afzelii
DESAKGPNLTEISKKI

SEQ ID NO: 84270 - protein, 16 aa, Borrelia afzelii
ESAKGPNLTEISKKIT

SEQ ID NO: 84271 - protein, 16 aa, Borrelia afzelii
SAKGPNLTEISKKITD

SEQ ID NO: 84272 - protein, 16 aa, Borrelia afzelii
AKGPNLTEISKKITDS

SEQ ID NO: 84273 - protein, 16 aa, Borrelia afzelii
KGPNLTEISKKITDSN

SEQ ID NO: 84274 - protein, 16 aa, Borrelia afzelii
GPNLTEISKKITDSNA

SEQ ID NO: 84275 - protein, 16 aa, Borrelia afzelii
PNLTEISKKITDSNAF

SEQ ID NO: 84276 - protein, 16 aa, Borrelia afzelii
NLTEISKKITDSNAFV

SEQ ID NO: 84277 - protein, 16 aa, Borrelia afzelii
LTEISKKITDSNAFVL

SEQ ID NO: 84278 - protein, 16 aa, Borrelia afzelii
TEISKKITDSNAFVLA

SEQ ID NO: 84279 - protein, 16 aa, Borrelia afzelii
EISKKITDSNAFVLAV

SEQ ID NO: 84280 - protein, 16 aa, Borrelia afzelii
ISKKITDSNAFVLAVK

SEQ ID NO: 84281 - protein, 16 aa, Borrelia afzelii
SKKITDSNAFVLAVKE

SEQ ID NO: 84282 - protein, 16 aa, Borrelia afzelii
KKITDSNAFVLAVKEV

SEQ ID NO: 84283 - protein, 16 aa, Borrelia afzelii
KITDSNAFVLAVKEVE

SEQ ID NO: 84284 - protein, 16 aa, Borrelia afzelii
ITDSNAFVLAVKEVET

SEQ ID NO: 84285 - protein, 16 aa, Borrelia afzelii
TDSNAFVLAVKEVETL

SEQ ID NO: 84286 - protein, 16 aa, Borrelia afzelii
DSNAFVLAVKEVETLV

SEQ ID NO: 84287 - protein, 16 aa, Borrelia afzelii
SNAFVLAVKEVETLVS

SEQ ID NO: 84288 - protein, 16 aa, Borrelia afzelii
NAFVLAVKEVETLVSS

SEQ ID NO: 84289 - protein, 16 aa, Borrelia afzelii
AFVLAVKEVETLVSSI

SEQ ID NO: 84290 - protein, 16 aa, Borrelia afzelii
FVLAVKEVETLVSSID

SEQ ID NO: 84291 - protein, 16 aa, Borrelia afzelii
VLAVKEVETLVSSIDE

SEQ ID NO: 84292 - protein, 16 aa, Borrelia afzelii
LAVKEVETLVSSIDEL

SEQ ID NO: 84293 - protein, 16 aa, Borrelia afzelii
AVKEVETLVSSIDELA

SEQ ID NO: 84294 - protein, 16 aa, Borrelia afzelii
VKEVETLVSSIDELAN

SEQ ID NO: 84295 - protein, 16 aa, Borrelia afzelii
KEVETLVSSIDELANK

SEQ ID NO: 84296 - protein, 16 aa, Borrelia afzelii
EVETLVSSIDELANKA

SEQ ID NO: 84297 - protein, 16 aa, Borrelia afzelii
VETLVSSIDELANKAI

SEQ ID NO: 84298 - protein, 16 aa, Borrelia afzelii
ETLVSSIDELANKAIG

SEQ ID NO: 84299 - protein, 16 aa, Borrelia afzelii
TLVSSIDELANKAIGK

SEQ ID NO: 84300 - protein, 16 aa, Borrelia afzelii
LVSSIDELANKAIGKK

SEQ ID NO: 84301 - protein, 16 aa, Borrelia afzelii
VSSIDELANKAIGKKI

SEQ ID NO: 84302 - protein, 16 aa, Borrelia afzelii
SSIDELANKAIGKKIQ

SEQ ID NO: 84303 - protein, 16 aa, Borrelia afzelii
SIDELANKAIGKKIQQ

SEQ ID NO: 84304 - protein, 16 aa, Borrelia afzelii
IDELANKAIGKKIQQN

SEQ ID NO: 84305 - protein, 16 aa, Borrelia afzelii
DELANKAIGKKIQQNG

SEQ ID NO: 84306 - protein, 16 aa, Borrelia afzelii
ELANKAIGKKIQQNGL

SEQ ID NO: 84307 - protein, 16 aa, Borrelia afzelii
LANKAIGKKIQQNGLG

SEQ ID NO: 84308 - protein, 16 aa, Borrelia afzelii
ANKAIGKKIQQNGLGA

SEQ ID NO: 84309 - protein, 16 aa, Borrelia afzelii
NKAIGKKIQQNGLGAE

SEQ ID NO: 84310 - protein, 16 aa, Borrelia afzelii
KAIGKKIQQNGLGAEA

SEQ ID NO: 84311 - protein, 16 aa, Borrelia afzelii
AIGKKIQQNGLGAEAN

SEQ ID NO: 84312 - protein, 16 aa, Borrelia afzelii
IGKKIQQNGLGAEANR

SEQ ID NO: 84313 - protein, 16 aa, Borrelia afzelii
GKKIQQNGLGAEANRN

SEQ ID NO: 84314 - protein, 16 aa, Borrelia afzelii
KKIQQNGLGAEANRNE

SEQ ID NO: 84315 - protein, 16 aa, Borrelia afzelii
KIQQNGLGAEANRNES

SEQ ID NO: 84316 - protein, 16 aa, Borrelia afzelii
IQQNGLGAEANRNESL

SEQ ID NO: 84317 - protein, 16 aa, Borrelia afzelii
QQNGLGAEANRNESLL

SEQ ID NO: 84318 - protein, 16 aa, Borrelia afzelii
QNGLGAEANRNESLLA

SEQ ID NO: 84319 - protein, 16 aa, Borrelia afzelii
NGLGAEANRNESLLAG

SEQ ID NO: 84320 - protein, 16 aa, Borrelia afzelii
GLGAEANRNESLLAGV

SEQ ID NO: 84321 - protein, 16 aa, Borrelia afzelii
LGAEANRNESLLAGVH

SEQ ID NO: 84322 - protein, 16 aa, Borrelia afzelii
GAEANRNESLLAGVHE

SEQ ID NO: 84323 - protein, 16 aa, Borrelia afzelii
AEANRNESLLAGVHEI

SEQ ID NO: 84324 - protein, 16 aa, Borrelia afzelii
EANRNESLLAGVHEIS

SEQ ID NO: 84325 - protein, 16 aa, Borrelia afzelii
ANRNESLLAGVHEIST

SEQ ID NO: 84326 - protein, 16 aa, Borrelia afzelii
NRNESLLAGVHEISTL

SEQ ID NO: 84327 - protein, 16 aa, Borrelia afzelii
RNESLLAGVHEISTLI

SEQ ID NO: 84328 - protein, 16 aa, Borrelia afzelii
NESLLAGVHEISTLIT

SEQ ID NO: 84329 - protein, 16 aa, Borrelia afzelii
ESLLAGVHEISTLITE

SEQ ID NO: 84330 - protein, 16 aa, Borrelia afzelii
SLLAGVHEISTLITEK

SEQ ID NO: 84331 - protein, 16 aa, Borrelia afzelii
LLAGVHEISTLITEKL

SEQ ID NO: 84332 - protein, 16 aa, Borrelia afzelii
LAGVHEISTLITEKLS

SEQ ID NO: 84333 - protein, 16 aa, Borrelia afzelii
AGVHEISTLITEKLSK

SEQ ID NO: 84334 - protein, 16 aa, Borrelia afzelii
GVHEISTLITEKLSKL

SEQ ID NO: 84335 - protein, 16 aa, Borrelia afzelii
VHEISTLITEKLSKLK

SEQ ID NO: 84336 - protein, 16 aa, Borrelia afzelii
HEISTLITEKLSKLKN

SEQ ID NO: 84337 - protein, 16 aa, Borrelia afzelii
EISTLITEKLSKLKNS

SEQ ID NO: 84338 - protein, 16 aa, Borrelia afzelii
ISTLITEKLSKLKNSG

SEQ ID NO: 84339 - protein, 16 aa, Borrelia afzelii
STLITEKLSKLKNSGE

SEQ ID NO: 84340 - protein, 16 aa, Borrelia afzelii
TLITEKLSKLKNSGEL

SEQ ID NO: 84341 - protein, 16 aa, Borrelia afzelii
LITEKLSKLKNSGELK

SEQ ID NO: 84342 - protein, 16 aa, Borrelia afzelii
ITEKLSKLKNSGELKA

SEQ ID NO: 84343 - protein, 16 aa, Borrelia afzelii
TEKLSKLKNSGELKAK

SEQ ID NO: 84344 - protein, 16 aa, Borrelia afzelii
EKLSKLKNSGELKAKI

SEQ ID NO: 84345 - protein, 16 aa, Borrelia afzelii
KLSKLKNSGELKAKIE

SEQ ID NO: 84346 - protein, 16 aa, Borrelia afzelii
LSKLKNSGELKAKIED

SEQ ID NO: 84347 - protein, 16 aa, Borrelia afzelii
SKLKNSGELKAKIEDA

SEQ ID NO: 84348 - protein, 16 aa, Borrelia afzelii
KLKNSGELKAKIEDAK

SEQ ID NO: 84349 - protein, 16 aa, Borrelia afzelii
LKNSGELKAKIEDAKK

SEQ ID NO: 84350 - protein, 16 aa, Borrelia afzelii
KNSGELKAKIEDAKKC

SEQ ID NO: 84351 - protein, 16 aa, Borrelia afzelii
NSGELKAKIEDAKKCS

SEQ ID NO: 84352 - protein, 16 aa, Borrelia afzelii
SGELKAKIEDAKKCSE

SEQ ID NO: 84353 - protein, 16 aa, Borrelia afzelii
GELKAKIEDAKKCSEE

SEQ ID NO: 84354 - protein, 16 aa, Borrelia afzelii
ELKAKIEDAKKCSEEF

SEQ ID NO: 84355 - protein, 16 aa, Borrelia afzelii
LKAKIEDAKKCSEEFT

SEQ ID NO: 84356 - protein, 16 aa, Borrelia afzelii
KAKIEDAKKCSEEFTN

SEQ ID NO: 84357 - protein, 16 aa, Borrelia afzelii
AKIEDAKKCSEEFTNK

SEQ ID NO: 84358 - protein, 16 aa, Borrelia afzelii
KIEDAKKCSEEFTNKL

SEQ ID NO: 84359 - protein, 16 aa, Borrelia afzelii
IEDAKKCSEEFTNKLR

SEQ ID NO: 84360 - protein, 16 aa, Borrelia afzelii
EDAKKCSEEFTNKLRV

SEQ ID NO: 84361 - protein, 16 aa, Borrelia afzelii
DAKKCSEEFTNKLRVS

SEQ ID NO: 84362 - protein, 16 aa, Borrelia afzelii
AKKCSEEFTNKLRVSH

SEQ ID NO: 84363 - protein, 16 aa, Borrelia afzelii
KKCSEEFTNKLRVSHA

SEQ ID NO: 84364 - protein, 16 aa, Borrelia afzelii
KCSEEFTNKLRVSHAD

SEQ ID NO: 84365 - protein, 16 aa, Borrelia afzelii
CSEEFTNKLRVSHADL

SEQ ID NO: 84366 - protein, 16 aa, Borrelia afzelii
SEEFTNKLRVSHADLG

SEQ ID NO: 84367 - protein, 16 aa, Borrelia afzelii
EEFTNKLRVSHADLGK

SEQ ID NO: 84368 - protein, 16 aa, Borrelia afzelii
EFTNKLRVSHADLGKQ

SEQ ID NO: 84369 - protein, 16 aa, Borrelia afzelii
FTNKLRVSHADLGKQG

SEQ ID NO: 84370 - protein, 16 aa, Borrelia afzelii
TNKLRVSHADLGKQGV

SEQ ID NO: 84371 - protein, 16 aa, Borrelia afzelii
NKLRVSHADLGKQGVN

SEQ ID NO: 84372 - protein, 16 aa, Borrelia afzelii
KLRVSHADLGKQGVND

SEQ ID NO: 84373 - protein, 16 aa, Borrelia afzelii
LRVSHADLGKQGVNDD

SEQ ID NO: 84374 - protein, 16 aa, Borrelia afzelii
RVSHADLGKQGVNDDD

SEQ ID NO: 84375 - protein, 16 aa, Borrelia afzelii
VSHADLGKQGVNDDDA

SEQ ID NO: 84376 - protein, 16 aa, Borrelia afzelii
SHADLGKQGVNDDDAK

SEQ ID NO: 84377 - protein, 16 aa, Borrelia afzelii
HADLGKQGVNDDDAKK

SEQ ID NO: 84378 - protein, 16 aa, Borrelia afzelii
ADLGKQGVNDDDAKKA

SEQ ID NO: 84379 - protein, 16 aa, Borrelia afzelii
DLGKQGVNDDDAKKAI

SEQ ID NO: 84380 - protein, 16 aa, Borrelia afzelii
LGKQGVNDDDAKKAIL

SEQ ID NO: 84381 - protein, 16 aa, Borrelia afzelii
GKQGVNDDDAKKAILK

SEQ ID NO: 84382 - protein, 16 aa, Borrelia afzelii
KQGVNDDDAKKAILKT

SEQ ID NO: 84383 - protein, 16 aa, Borrelia afzelii
QGVNDDDAKKAILKTN

SEQ ID NO: 84384 - protein, 16 aa, Borrelia afzelii
GVNDDDAKKAILKTNA

SEQ ID NO: 84385 - protein, 16 aa, Borrelia afzelii
VNDDDAKKAILKTNAD

SEQ ID NO: 84386 - protein, 16 aa, Borrelia afzelii
NDDDAKKAILKTNADK

SEQ ID NO: 84387 - protein, 16 aa, Borrelia afzelii
DDDAKKAILKTNADKT

SEQ ID NO: 84388 - protein, 16 aa, Borrelia afzelii
DDAKKAILKTNADKTK

SEQ ID NO: 84389 - protein, 16 aa, Borrelia afzelii
DAKKAILKTNADKTKG

SEQ ID NO: 84390 - protein, 16 aa, Borrelia afzelii
AKKAILKTNADKTKGA

SEQ ID NO: 84391 - protein, 16 aa, Borrelia afzelii
KKAILKTNADKTKGAE

SEQ ID NO: 84392 - protein, 16 aa, Borrelia afzelii
KAILKTNADKTKGAEE

SEQ ID NO: 84393 - protein, 16 aa, Borrelia afzelii
AILKTNADKTKGAEEL

SEQ ID NO: 84394 - protein, 16 aa, Borrelia afzelii
ILKTNADKTKGAEELG

SEQ ID NO: 84395 - protein, 16 aa, Borrelia afzelii
LKTNADKTKGAEELGK

SEQ ID NO: 84396 - protein, 16 aa, Borrelia afzelii
KTNADKTKGAEELGKL

SEQ ID NO: 84397 - protein, 16 aa, Borrelia afzelii
TNADKTKGAEELGKLF

SEQ ID NO: 84398 - protein, 16 aa, Borrelia afzelii
NADKTKGAEELGKLFK

SEQ ID NO: 84399 - protein, 16 aa, Borrelia afzelii
ADKTKGAEELGKLFKS

SEQ ID NO: 84400 - protein, 16 aa, Borrelia afzelii
DKTKGAEELGKLFKSV

SEQ ID NO: 84401 - protein, 16 aa, Borrelia afzelii
KTKGAEELGKLFKSVE

SEQ ID NO: 84402 - protein, 16 aa, Borrelia afzelii
TKGAEELGKLFKSVEG

SEQ ID NO: 84403 - protein, 16 aa, Borrelia afzelii
KGAEELGKLFKSVEGL

SEQ ID NO: 84404 - protein, 16 aa, Borrelia afzelii
GAEELGKLFKSVEGLV

SEQ ID NO: 84405 - protein, 16 aa, Borrelia afzelii
AEELGKLFKSVEGLVK

SEQ ID NO: 84406 - protein, 16 aa, Borrelia afzelii
EELGKLFKSVEGLVKA

SEQ ID NO: 84407 - protein, 16 aa, Borrelia afzelii
ELGKLFKSVEGLVKAA

SEQ ID NO: 84408 - protein, 16 aa, Borrelia afzelii
LGKLFKSVEGLVKAAQ

SEQ ID NO: 84409 - protein, 16 aa, Borrelia afzelii
GKLFKSVEGLVKAAQE

SEQ ID NO: 84410 - protein, 16 aa, Borrelia afzelii
KLFKSVEGLVKAAQEA

SEQ ID NO: 84411 - protein, 16 aa, Borrelia afzelii
LFKSVEGLVKAAQEAL

SEQ ID NO: 84412 - protein, 16 aa, Borrelia afzelii
FKSVEGLVKAAQEALT

SEQ ID NO: 84413 - protein, 16 aa, Borrelia afzelii
KSVEGLVKAAQEALTN

SEQ ID NO: 84414 - protein, 16 aa, Borrelia afzelii
SVEGLVKAAQEALTNS

SEQ ID NO: 84415 - protein, 16 aa, Borrelia afzelii
VEGLVKAAQEALTNSV

SEQ ID NO: 84416 - protein, 16 aa, Borrelia afzelii
EGLVKAAQEALTNSVK

SEQ ID NO: 84417 - protein, 16 aa, Borrelia afzelii
GLVKAAQEALTNSVKE

SEQ ID NO: 84418 - protein, 16 aa, Borrelia afzelii
LVKAAQEALTNSVKEL

SEQ ID NO: 84419 - protein, 16 aa, Borrelia afzelii
VKAAQEALTNSVKELT

SEQ ID NO: 84420 - protein, 16 aa, Borrelia afzelii
KAAQEALTNSVKELTS

SEQ ID NO: 84421 - protein, 16 aa, Borrelia afzelii
AAQEALTNSVKELTSP

SEQ ID NO: 84422 - protein, 16 aa, Borrelia afzelii
AQEALTNSVKELTSPV

SEQ ID NO: 84423 - protein, 16 aa, Borrelia afzelii
QEALTNSVKELTSPVV

SEQ ID NO: 84424 - protein, 16 aa, Borrelia afzelii
EALTNSVKELTSPVVA

SEQ ID NO: 84425 - protein, 16 aa, Borrelia afzelii
ALTNSVKELTSPVVAE

SEQ ID NO: 84426 - protein, 16 aa, Borrelia afzelii
LTNSVKELTSPVVAES

SEQ ID NO: 84427 - protein, 16 aa, Borrelia afzelii
TNSVKELTSPVVAESP

SEQ ID NO: 84428 - protein, 16 aa, Borrelia afzelii
NSVKELTSPVVAESPK

SEQ ID NO: 84429 - protein, 16 aa, Borrelia afzelii
SVKELTSPVVAESPKK

SEQ ID NO: 84430 - protein, 16 aa, Borrelia afzelii
VKELTSPVVAESPKKP

SEQ ID NO: 84431 - protein, 13 aa, Borrelia garinii
MNKKMKMFIICAV

SEQ ID NO: 84432 - protein, 13 aa, Borrelia garinii
NKKMKMFIICAVF

SEQ ID NO: 84433 - protein, 13 aa, Borrelia garinii
KKMKMFIICAVFV

SEQ ID NO: 84434 - protein, 13 aa, Borrelia garinii
KMKMFIICAVFVL

SEQ ID NO: 84435 - protein, 13 aa, Borrelia garinii
MKMFIICAVFVLI

SEQ ID NO: 84436 - protein, 13 aa, Borrelia garinii
KMFIICAVFVLIS

SEQ ID NO: 84437 - protein, 13 aa, Borrelia garinii
MFIICAVFVLISS

SEQ ID NO: 84438 - protein, 13 aa, Borrelia garinii
FIICAVFVLISSC

SEQ ID NO: 84439 - protein, 13 aa, Borrelia garinii
IICAVFVLISSCG

SEQ ID NO: 84440 - protein, 13 aa, Borrelia garinii
ICAVFVLISSCGN

SEQ ID NO: 84441 - protein, 13 aa, Borrelia garinii
CAVFVLISSCGNF

SEQ ID NO: 84442 - protein, 13 aa, Borrelia garinii
AVFVLISSCGNFR

SEQ ID NO: 84443 - protein, 13 aa, Borrelia garinii
VFVLISSCGNFRS

SEQ ID NO: 84444 - protein, 13 aa, Borrelia garinii
FVLISSCGNFRSS

SEQ ID NO: 84445 - protein, 13 aa, Borrelia garinii
VLISSCGNFRSSL

SEQ ID NO: 84446 - protein, 13 aa, Borrelia garinii
LISSCGNFRSSLS

SEQ ID NO: 84447 - protein, 13 aa, Borrelia garinii
ISSCGNFRSSLSD

SEQ ID NO: 84448 - protein, 13 aa, Borrelia garinii
SSCGNFRSSLSDQ

SEQ ID NO: 84449 - protein, 13 aa, Borrelia garinii
SCGNFRSSLSDQG

SEQ ID NO: 84450 - protein, 13 aa, Borrelia garinii
CGNFRSSLSDQGS

SEQ ID NO: 84451 - protein, 13 aa, Borrelia garinii
GNFRSSLSDQGSL

SEQ ID NO: 84452 - protein, 13 aa, Borrelia garinii
NFRSSLSDQGSLS

SEQ ID NO: 84453 - protein, 13 aa, Borrelia garinii
FRSSLSDQGSLSD

SEQ ID NO: 84454 - protein, 13 aa, Borrelia garinii
RSSLSDQGSLSDQ

SEQ ID NO: 84455 - protein, 13 aa, Borrelia garinii
SSLSDQGSLSDQG

SEQ ID NO: 84456 - protein, 13 aa, Borrelia garinii
SLSDQGSLSDQGS

SEQ ID NO: 84457 - protein, 13 aa, Borrelia garinii
LSDQGSLSDQGSL

SEQ ID NO: 84458 - protein, 13 aa, Borrelia garinii
SDQGSLSDQGSLS

SEQ ID NO: 84459 - protein, 13 aa, Borrelia garinii
DQGSLSDQGSLSD

SEQ ID NO: 84460 - protein, 13 aa, Borrelia garinii
QGSLSDQGSLSDQ

SEQ ID NO: 84461 - protein, 13 aa, Borrelia garinii
GSLSDQGSLSDQG

SEQ ID NO: 84462 - protein, 13 aa, Borrelia garinii
SLSDQGSLSDQGS

SEQ ID NO: 84463 - protein, 13 aa, Borrelia garinii
LSDQGSLSDQGSL

SEQ ID NO: 84464 - protein, 13 aa, Borrelia garinii
SDQGSLSDQGSLS

SEQ ID NO: 84465 - protein, 13 aa, Borrelia garinii
DQGSLSDQGSLSD

SEQ ID NO: 84466 - protein, 13 aa, Borrelia garinii
QGSLSDQGSLSDQ

SEQ ID NO: 84467 - protein, 13 aa, Borrelia garinii
GSLSDQGSLSDQG

SEQ ID NO: 84468 - protein, 13 aa, Borrelia garinii
SLSDQGSLSDQGG

SEQ ID NO: 84469 - protein, 13 aa, Borrelia garinii
LSDQGSLSDQGGL

SEQ ID NO: 84470 - protein, 13 aa, Borrelia garinii
SDQGSLSDQGGLS

SEQ ID NO: 84471 - protein, 13 aa, Borrelia garinii
DQGSLSDQGGLSG

SEQ ID NO: 84472 - protein, 13 aa, Borrelia garinii
QGSLSDQGGLSGQ

SEQ ID NO: 84473 - protein, 13 aa, Borrelia garinii
GSLSDQGGLSGQA

SEQ ID NO: 84474 - protein, 13 aa, Borrelia garinii
SLSDQGGLSGQAS

SEQ ID NO: 84475 - protein, 13 aa, Borrelia garinii
LSDQGGLSGQASS

SEQ ID NO: 84476 - protein, 13 aa, Borrelia garinii
SDQGGLSGQASSD

SEQ ID NO: 84477 - protein, 13 aa, Borrelia garinii
DQGGLSGQASSDT

SEQ ID NO: 84478 - protein, 13 aa, Borrelia garinii
QGGLSGQASSDTI

SEQ ID NO: 84479 - protein, 13 aa, Borrelia garinii
GGLSGQASSDTIK

SEQ ID NO: 84480 - protein, 13 aa, Borrelia garinii
GLSGQASSDTIKF

SEQ ID NO: 84481 - protein, 13 aa, Borrelia garinii
LSGQASSDTIKFS

SEQ ID NO: 84482 - protein, 13 aa, Borrelia garinii
SGQASSDTIKFSE

SEQ ID NO: 84483 - protein, 13 aa, Borrelia garinii
GQASSDTIKFSEF

SEQ ID NO: 84484 - protein, 13 aa, Borrelia garinii
QASSDTIKFSEFT

SEQ ID NO: 84485 - protein, 13 aa, Borrelia garinii
ASSDTIKFSEFTV

SEQ ID NO: 84486 - protein, 13 aa, Borrelia garinii
SSDTIKFSEFTVN

SEQ ID NO: 84487 - protein, 13 aa, Borrelia garinii
SDTIKFSEFTVNI

SEQ ID NO: 84488 - protein, 13 aa, Borrelia garinii
DTIKFSEFTVNIK

SEQ ID NO: 84489 - protein, 13 aa, Borrelia garinii
TIKFSEFTVNIKN

SEQ ID NO: 84490 - protein, 13 aa, Borrelia garinii
IKFSEFTVNIKNK

SEQ ID NO: 84491 - protein, 13 aa, Borrelia garinii
KFSEFTVNIKNKK

SEQ ID NO: 84492 - protein, 13 aa, Borrelia garinii
FSEFTVNIKNKKD

SEQ ID NO: 84493 - protein, 13 aa, Borrelia garinii
SEFTVNIKNKKDN

SEQ ID NO: 84494 - protein, 13 aa, Borrelia garinii
EFTVNIKNKKDNN

SEQ ID NO: 84495 - protein, 13 aa, Borrelia garinii
FTVNIKNKKDNNG

SEQ ID NO: 84496 - protein, 13 aa, Borrelia garinii
TVNIKNKKDNNGD

SEQ ID NO: 84497 - protein, 13 aa, Borrelia garinii
VNIKNKKDNNGDW

SEQ ID NO: 84498 - protein, 13 aa, Borrelia garinii
NIKNKKDNNGDWS

SEQ ID NO: 84499 - protein, 13 aa, Borrelia garinii
IKNKKDNNGDWSN

SEQ ID NO: 84500 - protein, 13 aa, Borrelia garinii
KNKKDNNGDWSNL

SEQ ID NO: 84501 - protein, 13 aa, Borrelia garinii
NKKDNNGDWSNLG

SEQ ID NO: 84502 - protein, 13 aa, Borrelia garinii
KKDNNGDWSNLGT

SEQ ID NO: 84503 - protein, 13 aa, Borrelia garinii
KDNNGDWSNLGTL

SEQ ID NO: 84504 - protein, 13 aa, Borrelia garinii
DNNGDWSNLGTLV

SEQ ID NO: 84505 - protein, 13 aa, Borrelia garinii
NNGDWSNLGTLVI

SEQ ID NO: 84506 - protein, 13 aa, Borrelia garinii
NGDWSNLGTLVIR

SEQ ID NO: 84507 - protein, 13 aa, Borrelia garinii
GDWSNLGTLVIRK

SEQ ID NO: 84508 - protein, 13 aa, Borrelia garinii
DWSNLGTLVIRKE

SEQ ID NO: 84509 - protein, 13 aa, Borrelia garinii
WSNLGTLVIRKEQ

SEQ ID NO: 84510 - protein, 13 aa, Borrelia garinii
SNLGTLVIRKEQD

SEQ ID NO: 84511 - protein, 13 aa, Borrelia garinii
NLGTLVIRKEQDG

SEQ ID NO: 84512 - protein, 13 aa, Borrelia garinii
LGTLVIRKEQDGV

SEQ ID NO: 84513 - protein, 13 aa, Borrelia garinii
GTLVIRKEQDGVE

SEQ ID NO: 84514 - protein, 13 aa, Borrelia garinii
TLVIRKEQDGVET

SEQ ID NO: 84515 - protein, 13 aa, Borrelia garinii
LVIRKEQDGVETG

SEQ ID NO: 84516 - protein, 13 aa, Borrelia garinii
VIRKEQDGVETGL

SEQ ID NO: 84517 - protein, 13 aa, Borrelia garinii
IRKEQDGVETGLN

SEQ ID NO: 84518 - protein, 13 aa, Borrelia garinii
RKEQDGVETGLNV

SEQ ID NO: 84519 - protein, 13 aa, Borrelia garinii
KEQDGVETGLNVI

SEQ ID NO: 84520 - protein, 13 aa, Borrelia garinii
EQDGVETGLNVIG

SEQ ID NO: 84521 - protein, 13 aa, Borrelia garinii
QDGVETGLNVIGT

SEQ ID NO: 84522 - protein, 13 aa, Borrelia garinii
DGVETGLNVIGTI

SEQ ID NO: 84523 - protein, 13 aa, Borrelia garinii
GVETGLNVIGTIN

SEQ ID NO: 84524 - protein, 13 aa, Borrelia garinii
VETGLNVIGTING

SEQ ID NO: 84525 - protein, 13 aa, Borrelia garinii
ETGLNVIGTINGQ

SEQ ID NO: 84526 - protein, 13 aa, Borrelia garinii
TGLNVIGTINGQL

SEQ ID NO: 84527 - protein, 13 aa, Borrelia garinii
GLNVIGTINGQLR

SEQ ID NO: 84528 - protein, 13 aa, Borrelia garinii
LNVIGTINGQLRG

SEQ ID NO: 84529 - protein, 13 aa, Borrelia garinii
NVIGTINGQLRGH

SEQ ID NO: 84530 - protein, 13 aa, Borrelia garinii
VIGTINGQLRGHS

SEQ ID NO: 84531 - protein, 13 aa, Borrelia garinii
IGTINGQLRGHSA

SEQ ID NO: 84532 - protein, 13 aa, Borrelia garinii
GTINGQLRGHSAT

SEQ ID NO: 84533 - protein, 13 aa, Borrelia garinii
TINGQLRGHSATF

SEQ ID NO: 84534 - protein, 13 aa, Borrelia garinii
INGQLRGHSATFF

SEQ ID NO: 84535 - protein, 13 aa, Borrelia garinii
NGQLRGHSATFFC

SEQ ID NO: 84536 - protein, 13 aa, Borrelia garinii
GQLRGHSATFFCI

SEQ ID NO: 84537 - protein, 13 aa, Borrelia garinii
QLRGHSATFFCIE

SEQ ID NO: 84538 - protein, 13 aa, Borrelia garinii
LRGHSATFFCIEE

SEQ ID NO: 84539 - protein, 13 aa, Borrelia garinii
RGHSATFFCIEEA

SEQ ID NO: 84540 - protein, 13 aa, Borrelia garinii
GHSATFFCIEEAE

SEQ ID NO: 84541 - protein, 13 aa, Borrelia garinii
HSATFFCIEEAEV

SEQ ID NO: 84542 - protein, 13 aa, Borrelia garinii
SATFFCIEEAEVN

SEQ ID NO: 84543 - protein, 13 aa, Borrelia garinii
ATFFCIEEAEVNN

SEQ ID NO: 84544 - protein, 13 aa, Borrelia garinii
TFFCIEEAEVNNF

SEQ ID NO: 84545 - protein, 13 aa, Borrelia garinii
FFCIEEAEVNNFV

SEQ ID NO: 84546 - protein, 13 aa, Borrelia garinii
FCIEEAEVNNFVK

SEQ ID NO: 84547 - protein, 13 aa, Borrelia garinii
CIEEAEVNNFVKA

SEQ ID NO: 84548 - protein, 13 aa, Borrelia garinii
IEEAEVNNFVKAM

SEQ ID NO: 84549 - protein, 13 aa, Borrelia garinii
EEAEVNNFVKAMT

SEQ ID NO: 84550 - protein, 13 aa, Borrelia garinii
EAEVNNFVKAMTN

SEQ ID NO: 84551 - protein, 13 aa, Borrelia garinii
AEVNNFVKAMTNV

SEQ ID NO: 84552 - protein, 13 aa, Borrelia garinii
EVNNFVKAMTNVG

SEQ ID NO: 84553 - protein, 13 aa, Borrelia garinii
VNNFVKAMTNVGS

SEQ ID NO: 84554 - protein, 13 aa, Borrelia garinii
NNFVKAMTNVGSF

SEQ ID NO: 84555 - protein, 13 aa, Borrelia garinii
NFVKAMTNVGSFK

SEQ ID NO: 84556 - protein, 13 aa, Borrelia garinii
FVKAMTNVGSFKT

SEQ ID NO: 84557 - protein, 13 aa, Borrelia garinii
VKAMTNVGSFKTS

SEQ ID NO: 84558 - protein, 13 aa, Borrelia garinii
KAMTNVGSFKTSL

SEQ ID NO: 84559 - protein, 13 aa, Borrelia garinii
AMTNVGSFKTSLY

SEQ ID NO: 84560 - protein, 13 aa, Borrelia garinii
MTNVGSFKTSLYY

SEQ ID NO: 84561 - protein, 13 aa, Borrelia garinii
TNVGSFKTSLYYG

SEQ ID NO: 84562 - protein, 13 aa, Borrelia garinii
NVGSFKTSLYYGY

SEQ ID NO: 84563 - protein, 13 aa, Borrelia garinii
VGSFKTSLYYGYK

SEQ ID NO: 84564 - protein, 13 aa, Borrelia garinii
GSFKTSLYYGYKE

SEQ ID NO: 84565 - protein, 13 aa, Borrelia garinii
SFKTSLYYGYKEE

SEQ ID NO: 84566 - protein, 13 aa, Borrelia garinii
FKTSLYYGYKEEQ

SEQ ID NO: 84567 - protein, 13 aa, Borrelia garinii
KTSLYYGYKEEQS

SEQ ID NO: 84568 - protein, 13 aa, Borrelia garinii
TSLYYGYKEEQSS

SEQ ID NO: 84569 - protein, 13 aa, Borrelia garinii
SLYYGYKEEQSST

SEQ ID NO: 84570 - protein, 13 aa, Borrelia garinii
LYYGYKEEQSSTN

SEQ ID NO: 84571 - protein, 13 aa, Borrelia garinii
YYGYKEEQSSTNG

SEQ ID NO: 84572 - protein, 13 aa, Borrelia garinii
YGYKEEQSSTNGI

SEQ ID NO: 84573 - protein, 13 aa, Borrelia garinii
GYKEEQSSTNGIK

SEQ ID NO: 84574 - protein, 13 aa, Borrelia garinii
YKEEQSSTNGIKG

SEQ ID NO: 84575 - protein, 13 aa, Borrelia garinii
KEEQSSTNGIKGK

SEQ ID NO: 84576 - protein, 13 aa, Borrelia garinii
EEQSSTNGIKGKE

SEQ ID NO: 84577 - protein, 13 aa, Borrelia garinii
EQSSTNGIKGKEI

SEQ ID NO: 84578 - protein, 13 aa, Borrelia garinii
QSSTNGIKGKEIT

SEQ ID NO: 84579 - protein, 13 aa, Borrelia garinii
SSTNGIKGKEITT

SEQ ID NO: 84580 - protein, 13 aa, Borrelia garinii
STNGIKGKEITTK

SEQ ID NO: 84581 - protein, 13 aa, Borrelia garinii
TNGIKGKEITTKI

SEQ ID NO: 84582 - protein, 13 aa, Borrelia garinii
NGIKGKEITTKIE

SEQ ID NO: 84583 - protein, 13 aa, Borrelia garinii
GIKGKEITTKIET

SEQ ID NO: 84584 - protein, 13 aa, Borrelia garinii
IKGKEITTKIETI

SEQ ID NO: 84585 - protein, 13 aa, Borrelia garinii
KGKEITTKIETIN

SEQ ID NO: 84586 - protein, 13 aa, Borrelia garinii
GKEITTKIETINN

SEQ ID NO: 84587 - protein, 13 aa, Borrelia garinii
KEITTKIETINNS

SEQ ID NO: 84588 - protein, 13 aa, Borrelia garinii
EITTKIETINNSE

SEQ ID NO: 84589 - protein, 13 aa, Borrelia garinii
ITTKIETINNSEH

SEQ ID NO: 84590 - protein, 13 aa, Borrelia garinii
TTKIETINNSEHI

SEQ ID NO: 84591 - protein, 13 aa, Borrelia garinii
TKIETINNSEHIT

SEQ ID NO: 84592 - protein, 13 aa, Borrelia garinii
KIETINNSEHITF

SEQ ID NO: 84593 - protein, 13 aa, Borrelia garinii
IETINNSEHITFS

SEQ ID NO: 84594 - protein, 13 aa, Borrelia garinii
ETINNSEHITFSG

SEQ ID NO: 84595 - protein, 13 aa, Borrelia garinii
TINNSEHITFSGD

SEQ ID NO: 84596 - protein, 13 aa, Borrelia garinii
INNSEHITFSGDK

SEQ ID NO: 84597 - protein, 13 aa, Borrelia garinii
NNSEHITFSGDKI

SEQ ID NO: 84598 - protein, 14 aa, Borrelia garinii
MNKKMKMFIICAVF

SEQ ID NO: 84599 - protein, 14 aa, Borrelia garinii
NKKMKMFIICAVFV

SEQ ID NO: 84600 - protein, 14 aa, Borrelia garinii
KKMKMFIICAVFVL

SEQ ID NO: 84601 - protein, 14 aa, Borrelia garinii
KMKMFIICAVFVLI

SEQ ID NO: 84602 - protein, 14 aa, Borrelia garinii
MKMFIICAVFVLIS

SEQ ID NO: 84603 - protein, 14 aa, Borrelia garinii
KMFIICAVFVLISS

SEQ ID NO: 84604 - protein, 14 aa, Borrelia garinii
MFIICAVFVLISSC

SEQ ID NO: 84605 - protein, 14 aa, Borrelia garinii
FIICAVFVLISSCG

SEQ ID NO: 84606 - protein, 14 aa, Borrelia garinii
IICAVFVLISSCGN

SEQ ID NO: 84607 - protein, 14 aa, Borrelia garinii
ICAVFVLISSCGNF

SEQ ID NO: 84608 - protein, 14 aa, Borrelia garinii
CAVFVLISSCGNFR

SEQ ID NO: 84609 - protein, 14 aa, Borrelia garinii
AVFVLISSCGNFRS

SEQ ID NO: 84610 - protein, 14 aa, Borrelia garinii
VFVLISSCGNFRSS

SEQ ID NO: 84611 - protein, 14 aa, Borrelia garinii
FVLISSCGNFRSSL

SEQ ID NO: 84612 - protein, 14 aa, Borrelia garinii
VLISSCGNFRSSLS

SEQ ID NO: 84613 - protein, 14 aa, Borrelia garinii
LISSCGNFRSSLSD

SEQ ID NO: 84614 - protein, 14 aa, Borrelia garinii
ISSCGNFRSSLSDQ

SEQ ID NO: 84615 - protein, 14 aa, Borrelia garinii
SSCGNFRSSLSDQG

SEQ ID NO: 84616 - protein, 14 aa, Borrelia garinii
SCGNFRSSLSDQGS

SEQ ID NO: 84617 - protein, 14 aa, Borrelia garinii
CGNFRSSLSDQGSL

SEQ ID NO: 84618 - protein, 14 aa, Borrelia garinii
GNFRSSLSDQGSLS

SEQ ID NO: 84619 - protein, 14 aa, Borrelia garinii
NFRSSLSDQGSLSD

SEQ ID NO: 84620 - protein, 14 aa, Borrelia garinii
FRSSLSDQGSLSDQ

SEQ ID NO: 84621 - protein, 14 aa, Borrelia garinii
RSSLSDQGSLSDQG

SEQ ID NO: 84622 - protein, 14 aa, Borrelia garinii
SSLSDQGSLSDQGS

SEQ ID NO: 84623 - protein, 14 aa, Borrelia garinii
SLSDQGSLSDQGSL

SEQ ID NO: 84624 - protein, 14 aa, Borrelia garinii
LSDQGSLSDQGSLS

SEQ ID NO: 84625 - protein, 14 aa, Borrelia garinii
SDQGSLSDQGSLSD

SEQ ID NO: 84626 - protein, 14 aa, Borrelia garinii
DQGSLSDQGSLSDQ

SEQ ID NO: 84627 - protein, 14 aa, Borrelia garinii
QGSLSDQGSLSDQG

SEQ ID NO: 84628 - protein, 14 aa, Borrelia garinii
GSLSDQGSLSDQGS

SEQ ID NO: 84629 - protein, 14 aa, Borrelia garinii
SLSDQGSLSDQGSL

SEQ ID NO: 84630 - protein, 14 aa, Borrelia garinii
LSDQGSLSDQGSLS

SEQ ID NO: 84631 - protein, 14 aa, Borrelia garinii
SDQGSLSDQGSLSD

SEQ ID NO: 84632 - protein, 14 aa, Borrelia garinii
DQGSLSDQGSLSDQ

SEQ ID NO: 84633 - protein, 14 aa, Borrelia garinii
QGSLSDQGSLSDQG

SEQ ID NO: 84634 - protein, 14 aa, Borrelia garinii
GSLSDQGSLSDQGG

SEQ ID NO: 84635 - protein, 14 aa, Borrelia garinii
SLSDQGSLSDQGGL

SEQ ID NO: 84636 - protein, 14 aa, Borrelia garinii
LSDQGSLSDQGGLS

SEQ ID NO: 84637 - protein, 14 aa, Borrelia garinii
SDQGSLSDQGGLSG

SEQ ID NO: 84638 - protein, 14 aa, Borrelia garinii
DQGSLSDQGGLSGQ

SEQ ID NO: 84639 - protein, 14 aa, Borrelia garinii
QGSLSDQGGLSGQA

SEQ ID NO: 84640 - protein, 14 aa, Borrelia garinii
GSLSDQGGLSGQAS

SEQ ID NO: 84641 - protein, 14 aa, Borrelia garinii
SLSDQGGLSGQASS

SEQ ID NO: 84642 - protein, 14 aa, Borrelia garinii
LSDQGGLSGQASSD

SEQ ID NO: 84643 - protein, 14 aa, Borrelia garinii
SDQGGLSGQASSDT

SEQ ID NO: 84644 - protein, 14 aa, Borrelia garinii
DQGGLSGQASSDTI

SEQ ID NO: 84645 - protein, 14 aa, Borrelia garinii
QGGLSGQASSDTIK

SEQ ID NO: 84646 - protein, 14 aa, Borrelia garinii
GGLSGQASSDTIKF

SEQ ID NO: 84647 - protein, 14 aa, Borrelia garinii
GLSGQASSDTIKFS

SEQ ID NO: 84648 - protein, 14 aa, Borrelia garinii
LSGQASSDTIKFSE

SEQ ID NO: 84649 - protein, 14 aa, Borrelia garinii
SGQASSDTIKFSEF

SEQ ID NO: 84650 - protein, 14 aa, Borrelia garinii
GQASSDTIKFSEFT

SEQ ID NO: 84651 - protein, 14 aa, Borrelia garinii
QASSDTIKFSEFTV

SEQ ID NO: 84652 - protein, 14 aa, Borrelia garinii
ASSDTIKFSEFTVN

SEQ ID NO: 84653 - protein, 14 aa, Borrelia garinii
SSDTIKFSEFTVNI

SEQ ID NO: 84654 - protein, 14 aa, Borrelia garinii
SDTIKFSEFTVNIK

SEQ ID NO: 84655 - protein, 14 aa, Borrelia garinii
DTIKFSEFTVNIKN

SEQ ID NO: 84656 - protein, 14 aa, Borrelia garinii
TIKFSEFTVNIKNK

SEQ ID NO: 84657 - protein, 14 aa, Borrelia garinii
IKFSEFTVNIKNKK

SEQ ID NO: 84658 - protein, 14 aa, Borrelia garinii
KFSEFTVNIKNKKD

SEQ ID NO: 84659 - protein, 14 aa, Borrelia garinii
FSEFTVNIKNKKDN

SEQ ID NO: 84660 - protein, 14 aa, Borrelia garinii
SEFTVNIKNKKDNN

SEQ ID NO: 84661 - protein, 14 aa, Borrelia garinii
EFTVNIKNKKDNNG

SEQ ID NO: 84662 - protein, 14 aa, Borrelia garinii
FTVNIKNKKDNNGD

SEQ ID NO: 84663 - protein, 14 aa, Borrelia garinii
TVNIKNKKDNNGDW

SEQ ID NO: 84664 - protein, 14 aa, Borrelia garinii
VNIKNKKDNNGDWS

SEQ ID NO: 84665 - protein, 14 aa, Borrelia garinii
NIKNKKDNNGDWSN

SEQ ID NO: 84666 - protein, 14 aa, Borrelia garinii
IKNKKDNNGDWSNL

SEQ ID NO: 84667 - protein, 14 aa, Borrelia garinii
KNKKDNNGDWSNLG

SEQ ID NO: 84668 - protein, 14 aa, Borrelia garinii
NKKDNNGDWSNLGT

SEQ ID NO: 84669 - protein, 14 aa, Borrelia garinii
KKDNNGDWSNLGTL

SEQ ID NO: 84670 - protein, 14 aa, Borrelia garinii
KDNNGDWSNLGTLV

SEQ ID NO: 84671 - protein, 14 aa, Borrelia garinii
DNNGDWSNLGTLVI

SEQ ID NO: 84672 - protein, 14 aa, Borrelia garinii
NNGDWSNLGTLVIR

SEQ ID NO: 84673 - protein, 14 aa, Borrelia garinii
NGDWSNLGTLVIRK

SEQ ID NO: 84674 - protein, 14 aa, Borrelia garinii
GDWSNLGTLVIRKE

SEQ ID NO: 84675 - protein, 14 aa, Borrelia garinii
DWSNLGTLVIRKEQ

SEQ ID NO: 84676 - protein, 14 aa, Borrelia garinii
WSNLGTLVIRKEQD

SEQ ID NO: 84677 - protein, 14 aa, Borrelia garinii
SNLGTLVIRKEQDG

SEQ ID NO: 84678 - protein, 14 aa, Borrelia garinii
NLGTLVIRKEQDGV

SEQ ID NO: 84679 - protein, 14 aa, Borrelia garinii
LGTLVIRKEQDGVE

SEQ ID NO: 84680 - protein, 14 aa, Borrelia garinii
GTLVIRKEQDGVET

SEQ ID NO: 84681 - protein, 14 aa, Borrelia garinii
TLVIRKEQDGVETG

SEQ ID NO: 84682 - protein, 14 aa, Borrelia garinii
LVIRKEQDGVETGL

SEQ ID NO: 84683 - protein, 14 aa, Borrelia garinii
VIRKEQDGVETGLN

SEQ ID NO: 84684 - protein, 14 aa, Borrelia garinii
IRKEQDGVETGLNV

SEQ ID NO: 84685 - protein, 14 aa, Borrelia garinii
RKEQDGVETGLNVI

SEQ ID NO: 84686 - protein, 14 aa, Borrelia garinii
KEQDGVETGLNVIG

SEQ ID NO: 84687 - protein, 14 aa, Borrelia garinii
EQDGVETGLNVIGT

SEQ ID NO: 84688 - protein, 14 aa, Borrelia garinii
QDGVETGLNVIGTI

SEQ ID NO: 84689 - protein, 14 aa, Borrelia garinii
DGVETGLNVIGTIN

SEQ ID NO: 84690 - protein, 14 aa, Borrelia garinii
GVETGLNVIGTING

SEQ ID NO: 84691 - protein, 14 aa, Borrelia garinii
VETGLNVIGTINGQ

SEQ ID NO: 84692 - protein, 14 aa, Borrelia garinii
ETGLNVIGTINGQL

SEQ ID NO: 84693 - protein, 14 aa, Borrelia garinii
TGLNVIGTINGQLR

SEQ ID NO: 84694 - protein, 14 aa, Borrelia garinii
GLNVIGTINGQLRG

SEQ ID NO: 84695 - protein, 14 aa, Borrelia garinii
LNVIGTINGQLRGH

SEQ ID NO: 84696 - protein, 14 aa, Borrelia garinii
NVIGTINGQLRGHS

SEQ ID NO: 84697 - protein, 14 aa, Borrelia garinii
VIGTINGQLRGHSA

SEQ ID NO: 84698 - protein, 14 aa, Borrelia garinii
IGTINGQLRGHSAT

SEQ ID NO: 84699 - protein, 14 aa, Borrelia garinii
GTINGQLRGHSATF

SEQ ID NO: 84700 - protein, 14 aa, Borrelia garinii
TINGQLRGHSATFF

SEQ ID NO: 84701 - protein, 14 aa, Borrelia garinii
INGQLRGHSATFFC

SEQ ID NO: 84702 - protein, 14 aa, Borrelia garinii
NGQLRGHSATFFCI

SEQ ID NO: 84703 - protein, 14 aa, Borrelia garinii
GQLRGHSATFFCIE

SEQ ID NO: 84704 - protein, 14 aa, Borrelia garinii
QLRGHSATFFCIEE

SEQ ID NO: 84705 - protein, 14 aa, Borrelia garinii
LRGHSATFFCIEEA

SEQ ID NO: 84706 - protein, 14 aa, Borrelia garinii
RGHSATFFCIEEAE

SEQ ID NO: 84707 - protein, 14 aa, Borrelia garinii
GHSATFFCIEEAEV

SEQ ID NO: 84708 - protein, 14 aa, Borrelia garinii
HSATFFCIEEAEVN

SEQ ID NO: 84709 - protein, 14 aa, Borrelia garinii
SATFFCIEEAEVNN

SEQ ID NO: 84710 - protein, 14 aa, Borrelia garinii
ATFFCIEEAEVNNF

SEQ ID NO: 84711 - protein, 14 aa, Borrelia garinii
TFFCIEEAEVNNFV

SEQ ID NO: 84712 - protein, 14 aa, Borrelia garinii
FFCIEEAEVNNFVK

SEQ ID NO: 84713 - protein, 14 aa, Borrelia garinii
FCIEEAEVNNFVKA

SEQ ID NO: 84714 - protein, 14 aa, Borrelia garinii
CIEEAEVNNFVKAM

SEQ ID NO: 84715 - protein, 14 aa, Borrelia garinii
IEEAEVNNFVKAMT

SEQ ID NO: 84716 - protein, 14 aa, Borrelia garinii
EEAEVNNFVKAMTN

SEQ ID NO: 84717 - protein, 14 aa, Borrelia garinii
EAEVNNFVKAMTNV

SEQ ID NO: 84718 - protein, 14 aa, Borrelia garinii
AEVNNFVKAMTNVG

SEQ ID NO: 84719 - protein, 14 aa, Borrelia garinii
EVNNFVKAMTNVGS

SEQ ID NO: 84720 - protein, 14 aa, Borrelia garinii
VNNFVKAMTNVGSF

SEQ ID NO: 84721 - protein, 14 aa, Borrelia garinii
NNFVKAMTNVGSFK

SEQ ID NO: 84722 - protein, 14 aa, Borrelia garinii
NFVKAMTNVGSFKT

SEQ ID NO: 84723 - protein, 14 aa, Borrelia garinii
FVKAMTNVGSFKTS

SEQ ID NO: 84724 - protein, 14 aa, Borrelia garinii
VKAMTNVGSFKTSL

SEQ ID NO: 84725 - protein, 14 aa, Borrelia garinii
KAMTNVGSFKTSLY

SEQ ID NO: 84726 - protein, 14 aa, Borrelia garinii
AMTNVGSFKTSLYY

SEQ ID NO: 84727 - protein, 14 aa, Borrelia garinii
MTNVGSFKTSLYYG

SEQ ID NO: 84728 - protein, 14 aa, Borrelia garinii
TNVGSFKTSLYYGY

SEQ ID NO: 84729 - protein, 14 aa, Borrelia garinii
NVGSFKTSLYYGYK

SEQ ID NO: 84730 - protein, 14 aa, Borrelia garinii
VGSFKTSLYYGYKE

SEQ ID NO: 84731 - protein, 14 aa, Borrelia garinii
GSFKTSLYYGYKEE

SEQ ID NO: 84732 - protein, 14 aa, Borrelia garinii
SFKTSLYYGYKEEQ

SEQ ID NO: 84733 - protein, 14 aa, Borrelia garinii
FKTSLYYGYKEEQS

SEQ ID NO: 84734 - protein, 14 aa, Borrelia garinii
KTSLYYGYKEEQSS

SEQ ID NO: 84735 - protein, 14 aa, Borrelia garinii
TSLYYGYKEEQSST

SEQ ID NO: 84736 - protein, 14 aa, Borrelia garinii
SLYYGYKEEQSSTN

SEQ ID NO: 84737 - protein, 14 aa, Borrelia garinii
LYYGYKEEQSSTNG

SEQ ID NO: 84738 - protein, 14 aa, Borrelia garinii
YYGYKEEQSSTNGI

SEQ ID NO: 84739 - protein, 14 aa, Borrelia garinii
YGYKEEQSSTNGIK

SEQ ID NO: 84740 - protein, 14 aa, Borrelia garinii
GYKEEQSSTNGIKG

SEQ ID NO: 84741 - protein, 14 aa, Borrelia garinii
YKEEQSSTNGIKGK

SEQ ID NO: 84742 - protein, 14 aa, Borrelia garinii
KEEQSSTNGIKGKE

SEQ ID NO: 84743 - protein, 14 aa, Borrelia garinii
EEQSSTNGIKGKEI

SEQ ID NO: 84744 - protein, 14 aa, Borrelia garinii
EQSSTNGIKGKEIT

SEQ ID NO: 84745 - protein, 14 aa, Borrelia garinii
QSSTNGIKGKEITT

SEQ ID NO: 84746 - protein, 14 aa, Borrelia garinii
SSTNGIKGKEITTK

SEQ ID NO: 84747 - protein, 14 aa, Borrelia garinii
STNGIKGKEITTKI

SEQ ID NO: 84748 - protein, 14 aa, Borrelia garinii
TNGIKGKEITTKIE

SEQ ID NO: 84749 - protein, 14 aa, Borrelia garinii
NGIKGKEITTKIET

SEQ ID NO: 84750 - protein, 14 aa, Borrelia garinii
GIKGKEITTKIETI

SEQ ID NO: 84751 - protein, 14 aa, Borrelia garinii
IKGKEITTKIETIN

SEQ ID NO: 84752 - protein, 14 aa, Borrelia garinii
KGKEITTKIETINN

SEQ ID NO: 84753 - protein, 14 aa, Borrelia garinii
GKEITTKIETINNS

SEQ ID NO: 84754 - protein, 14 aa, Borrelia garinii
KEITTKIETINNSE

SEQ ID NO: 84755 - protein, 14 aa, Borrelia garinii
EITTKIETINNSEH

SEQ ID NO: 84756 - protein, 14 aa, Borrelia garinii
ITTKIETINNSEHI

SEQ ID NO: 84757 - protein, 14 aa, Borrelia garinii
TTKIETINNSEHIT

SEQ ID NO: 84758 - protein, 14 aa, Borrelia garinii
TKIETINNSEHITF

SEQ ID NO: 84759 - protein, 14 aa, Borrelia garinii
KIETINNSEHITFS

SEQ ID NO: 84760 - protein, 14 aa, Borrelia garinii
IETINNSEHITFSG

SEQ ID NO: 84761 - protein, 14 aa, Borrelia garinii
ETINNSEHITFSGD

SEQ ID NO: 84762 - protein, 14 aa, Borrelia garinii
TINNSEHITFSGDK

SEQ ID NO: 84763 - protein, 14 aa, Borrelia garinii
INNSEHITFSGDKI

SEQ ID NO: 84764 - protein, 15 aa, Borrelia garinii
MNKKMKMFIICAVFV

SEQ ID NO: 84765 - protein, 15 aa, Borrelia garinii
NKKMKMFIICAVFVL

SEQ ID NO: 84766 - protein, 15 aa, Borrelia garinii
KKMKMFIICAVFVLI

SEQ ID NO: 84767 - protein, 15 aa, Borrelia garinii
KMKMFIICAVFVLIS

SEQ ID NO: 84768 - protein, 15 aa, Borrelia garinii
MKMFIICAVFVLISS

SEQ ID NO: 84769 - protein, 15 aa, Borrelia garinii
KMFIICAVFVLISSC

SEQ ID NO: 84770 - protein, 15 aa, Borrelia garinii
MFIICAVFVLISSCG

SEQ ID NO: 84771 - protein, 15 aa, Borrelia garinii
FIICAVFVLISSCGN

SEQ ID NO: 84772 - protein, 15 aa, Borrelia garinii
IICAVFVLISSCGNF

SEQ ID NO: 84773 - protein, 15 aa, Borrelia garinii
ICAVFVLISSCGNFR

SEQ ID NO: 84774 - protein, 15 aa, Borrelia garinii
CAVFVLISSCGNFRS

SEQ ID NO: 84775 - protein, 15 aa, Borrelia garinii
AVFVLISSCGNFRSS

SEQ ID NO: 84776 - protein, 15 aa, Borrelia garinii
VFVLISSCGNFRSSL

SEQ ID NO: 84777 - protein, 15 aa, Borrelia garinii
FVLISSCGNFRSSLS

SEQ ID NO: 84778 - protein, 15 aa, Borrelia garinii
VLISSCGNFRSSLSD

SEQ ID NO: 84779 - protein, 15 aa, Borrelia garinii
LISSCGNFRSSLSDQ

SEQ ID NO: 84780 - protein, 15 aa, Borrelia garinii
ISSCGNFRSSLSDQG

SEQ ID NO: 84781 - protein, 15 aa, Borrelia garinii
SSCGNFRSSLSDQGS

SEQ ID NO: 84782 - protein, 15 aa, Borrelia garinii
SCGNFRSSLSDQGSL

SEQ ID NO: 84783 - protein, 15 aa, Borrelia garinii
CGNFRSSLSDQGSLS

SEQ ID NO: 84784 - protein, 15 aa, Borrelia garinii
GNFRSSLSDQGSLSD

SEQ ID NO: 84785 - protein, 15 aa, Borrelia garinii
NFRSSLSDQGSLSDQ

SEQ ID NO: 84786 - protein, 15 aa, Borrelia garinii
FRSSLSDQGSLSDQG

SEQ ID NO: 84787 - protein, 15 aa, Borrelia garinii
RSSLSDQGSLSDQGS

SEQ ID NO: 84788 - protein, 15 aa, Borrelia garinii
SSLSDQGSLSDQGSL

SEQ ID NO: 84789 - protein, 15 aa, Borrelia garinii
SLSDQGSLSDQGSLS

SEQ ID NO: 84790 - protein, 15 aa, Borrelia garinii
LSDQGSLSDQGSLSD

SEQ ID NO: 84791 - protein, 15 aa, Borrelia garinii
SDQGSLSDQGSLSDQ

SEQ ID NO: 84792 - protein, 15 aa, Borrelia garinii
DQGSLSDQGSLSDQG

SEQ ID NO: 84793 - protein, 15 aa, Borrelia garinii
QGSLSDQGSLSDQGS

SEQ ID NO: 84794 - protein, 15 aa, Borrelia garinii
GSLSDQGSLSDQGSL

SEQ ID NO: 84795 - protein, 15 aa, Borrelia garinii
SLSDQGSLSDQGSLS

SEQ ID NO: 84796 - protein, 15 aa, Borrelia garinii
LSDQGSLSDQGSLSD

SEQ ID NO: 84797 - protein, 15 aa, Borrelia garinii
SDQGSLSDQGSLSDQ

SEQ ID NO: 84798 - protein, 15 aa, Borrelia garinii
DQGSLSDQGSLSDQG

SEQ ID NO: 84799 - protein, 15 aa, Borrelia garinii
QGSLSDQGSLSDQGG

SEQ ID NO: 84800 - protein, 15 aa, Borrelia garinii
GSLSDQGSLSDQGGL

SEQ ID NO: 84801 - protein, 15 aa, Borrelia garinii
SLSDQGSLSDQGGLS

SEQ ID NO: 84802 - protein, 15 aa, Borrelia garinii
LSDQGSLSDQGGLSG

SEQ ID NO: 84803 - protein, 15 aa, Borrelia garinii
SDQGSLSDQGGLSGQ

SEQ ID NO: 84804 - protein, 15 aa, Borrelia garinii
DQGSLSDQGGLSGQA

SEQ ID NO: 84805 - protein, 15 aa, Borrelia garinii
QGSLSDQGGLSGQAS

SEQ ID NO: 84806 - protein, 15 aa, Borrelia garinii
GSLSDQGGLSGQASS

SEQ ID NO: 84807 - protein, 15 aa, Borrelia garinii
SLSDQGGLSGQASSD

SEQ ID NO: 84808 - protein, 15 aa, Borrelia garinii
LSDQGGLSGQASSDT

SEQ ID NO: 84809 - protein, 15 aa, Borrelia garinii
SDQGGLSGQASSDTI

SEQ ID NO: 84810 - protein, 15 aa, Borrelia garinii
DQGGLSGQASSDTIK

SEQ ID NO: 84811 - protein, 15 aa, Borrelia garinii
QGGLSGQASSDTIKF

SEQ ID NO: 84812 - protein, 15 aa, Borrelia garinii
GGLSGQASSDTIKFS

SEQ ID NO: 84813 - protein, 15 aa, Borrelia garinii
GLSGQASSDTIKFSE

SEQ ID NO: 84814 - protein, 15 aa, Borrelia garinii
LSGQASSDTIKFSEF

SEQ ID NO: 84815 - protein, 15 aa, Borrelia garinii
SGQASSDTIKFSEFT

SEQ ID NO: 84816 - protein, 15 aa, Borrelia garinii
GQASSDTIKFSEFTV

SEQ ID NO: 84817 - protein, 15 aa, Borrelia garinii
QASSDTIKFSEFTVN

SEQ ID NO: 84818 - protein, 15 aa, Borrelia garinii
ASSDTIKFSEFTVNI

SEQ ID NO: 84819 - protein, 15 aa, Borrelia garinii
SSDTIKFSEFTVNIK

SEQ ID NO: 84820 - protein, 15 aa, Borrelia garinii
SDTIKFSEFTVNIKN

SEQ ID NO: 84821 - protein, 15 aa, Borrelia garinii
DTIKFSEFTVNIKNK

SEQ ID NO: 84822 - protein, 15 aa, Borrelia garinii
TIKFSEFTVNIKNKK

SEQ ID NO: 84823 - protein, 15 aa, Borrelia garinii
IKFSEFTVNIKNKKD

SEQ ID NO: 84824 - protein, 15 aa, Borrelia garinii
KFSEFTVNIKNKKDN

SEQ ID NO: 84825 - protein, 15 aa, Borrelia garinii
FSEFTVNIKNKKDNN

SEQ ID NO: 84826 - protein, 15 aa, Borrelia garinii
SEFTVNIKNKKDNNG

SEQ ID NO: 84827 - protein, 15 aa, Borrelia garinii
EFTVNIKNKKDNNGD

SEQ ID NO: 84828 - protein, 15 aa, Borrelia garinii
FTVNIKNKKDNNGDW

SEQ ID NO: 84829 - protein, 15 aa, Borrelia garinii
TVNIKNKKDNNGDWS

SEQ ID NO: 84830 - protein, 15 aa, Borrelia garinii
VNIKNKKDNNGDWSN

SEQ ID NO: 84831 - protein, 15 aa, Borrelia garinii
NIKNKKDNNGDWSNL

SEQ ID NO: 84832 - protein, 15 aa, Borrelia garinii
IKNKKDNNGDWSNLG

SEQ ID NO: 84833 - protein, 15 aa, Borrelia garinii
KNKKDNNGDWSNLGT

SEQ ID NO: 84834 - protein, 15 aa, Borrelia garinii
NKKDNNGDWSNLGTL

SEQ ID NO: 84835 - protein, 15 aa, Borrelia garinii
KKDNNGDWSNLGTLV

SEQ ID NO: 84836 - protein, 15 aa, Borrelia garinii
KDNNGDWSNLGTLVI

SEQ ID NO: 84837 - protein, 15 aa, Borrelia garinii
DNNGDWSNLGTLVIR

SEQ ID NO: 84838 - protein, 15 aa, Borrelia garinii
NNGDWSNLGTLVIRK

SEQ ID NO: 84839 - protein, 15 aa, Borrelia garinii
NGDWSNLGTLVIRKE

SEQ ID NO: 84840 - protein, 15 aa, Borrelia garinii
GDWSNLGTLVIRKEQ

SEQ ID NO: 84841 - protein, 15 aa, Borrelia garinii
DWSNLGTLVIRKEQD

SEQ ID NO: 84842 - protein, 15 aa, Borrelia garinii
WSNLGTLVIRKEQDG

SEQ ID NO: 84843 - protein, 15 aa, Borrelia garinii
SNLGTLVIRKEQDGV

SEQ ID NO: 84844 - protein, 15 aa, Borrelia garinii
NLGTLVIRKEQDGVE

SEQ ID NO: 84845 - protein, 15 aa, Borrelia garinii
LGTLVIRKEQDGVET

SEQ ID NO: 84846 - protein, 15 aa, Borrelia garinii
GTLVIRKEQDGVETG

SEQ ID NO: 84847 - protein, 15 aa, Borrelia garinii
TLVIRKEQDGVETGL

SEQ ID NO: 84848 - protein, 15 aa, Borrelia garinii
LVIRKEQDGVETGLN

SEQ ID NO: 84849 - protein, 15 aa, Borrelia garinii
VIRKEQDGVETGLNV

SEQ ID NO: 84850 - protein, 15 aa, Borrelia garinii
IRKEQDGVETGLNVI

SEQ ID NO: 84851 - protein, 15 aa, Borrelia garinii
RKEQDGVETGLNVIG

SEQ ID NO: 84852 - protein, 15 aa, Borrelia garinii
KEQDGVETGLNVIGT

SEQ ID NO: 84853 - protein, 15 aa, Borrelia garinii
EQDGVETGLNVIGTI

SEQ ID NO: 84854 - protein, 15 aa, Borrelia garinii
QDGVETGLNVIGTIN

SEQ ID NO: 84855 - protein, 15 aa, Borrelia garinii
DGVETGLNVIGTING

SEQ ID NO: 84856 - protein, 15 aa, Borrelia garinii
GVETGLNVIGTINGQ

SEQ ID NO: 84857 - protein, 15 aa, Borrelia garinii
VETGLNVIGTINGQL

SEQ ID NO: 84858 - protein, 15 aa, Borrelia garinii
ETGLNVIGTINGQLR

SEQ ID NO: 84859 - protein, 15 aa, Borrelia garinii
TGLNVIGTINGQLRG

SEQ ID NO: 84860 - protein, 15 aa, Borrelia garinii
GLNVIGTINGQLRGH

SEQ ID NO: 84861 - protein, 15 aa, Borrelia garinii
LNVIGTINGQLRGHS

SEQ ID NO: 84862 - protein, 15 aa, Borrelia garinii
NVIGTINGQLRGHSA

SEQ ID NO: 84863 - protein, 15 aa, Borrelia garinii
VIGTINGQLRGHSAT

SEQ ID NO: 84864 - protein, 15 aa, Borrelia garinii
IGTINGQLRGHSATF

SEQ ID NO: 84865 - protein, 15 aa, Borrelia garinii
GTINGQLRGHSATFF

SEQ ID NO: 84866 - protein, 15 aa, Borrelia garinii
TINGQLRGHSATFFC

SEQ ID NO: 84867 - protein, 15 aa, Borrelia garinii
INGQLRGHSATFFCI

SEQ ID NO: 84868 - protein, 15 aa, Borrelia garinii
NGQLRGHSATFFCIE

SEQ ID NO: 84869 - protein, 15 aa, Borrelia garinii
GQLRGHSATFFCIEE

SEQ ID NO: 84870 - protein, 15 aa, Borrelia garinii
QLRGHSATFFCIEEA

SEQ ID NO: 84871 - protein, 15 aa, Borrelia garinii
LRGHSATFFCIEEAE

SEQ ID NO: 84872 - protein, 15 aa, Borrelia garinii
RGHSATFFCIEEAEV

SEQ ID NO: 84873 - protein, 15 aa, Borrelia garinii
GHSATFFCIEEAEVN

SEQ ID NO: 84874 - protein, 15 aa, Borrelia garinii
HSATFFCIEEAEVNN

SEQ ID NO: 84875 - protein, 15 aa, Borrelia garinii
SATFFCIEEAEVNNF

SEQ ID NO: 84876 - protein, 15 aa, Borrelia garinii
ATFFCIEEAEVNNFV

SEQ ID NO: 84877 - protein, 15 aa, Borrelia garinii
TFFCIEEAEVNNFVK

SEQ ID NO: 84878 - protein, 15 aa, Borrelia garinii
FFCIEEAEVNNFVKA

SEQ ID NO: 84879 - protein, 15 aa, Borrelia garinii
FCIEEAEVNNFVKAM

SEQ ID NO: 84880 - protein, 15 aa, Borrelia garinii
CIEEAEVNNFVKAMT

SEQ ID NO: 84881 - protein, 15 aa, Borrelia garinii
IEEAEVNNFVKAMTN

SEQ ID NO: 84882 - protein, 15 aa, Borrelia garinii
EEAEVNNFVKAMTNV

SEQ ID NO: 84883 - protein, 15 aa, Borrelia garinii
EAEVNNFVKAMTNVG

SEQ ID NO: 84884 - protein, 15 aa, Borrelia garinii
AEVNNFVKAMTNVGS

SEQ ID NO: 84885 - protein, 15 aa, Borrelia garinii
EVNNFVKAMTNVGSF

SEQ ID NO: 84886 - protein, 15 aa, Borrelia garinii
VNNFVKAMTNVGSFK

SEQ ID NO: 84887 - protein, 15 aa, Borrelia garinii
NNFVKAMTNVGSFKT

SEQ ID NO: 84888 - protein, 15 aa, Borrelia garinii
NFVKAMTNVGSFKTS

SEQ ID NO: 84889 - protein, 15 aa, Borrelia garinii
FVKAMTNVGSFKTSL

SEQ ID NO: 84890 - protein, 15 aa, Borrelia garinii
VKAMTNVGSFKTSLY

SEQ ID NO: 84891 - protein, 15 aa, Borrelia garinii
KAMTNVGSFKTSLYY

SEQ ID NO: 84892 - protein, 15 aa, Borrelia garinii
AMTNVGSFKTSLYYG

SEQ ID NO: 84893 - protein, 15 aa, Borrelia garinii
MTNVGSFKTSLYYGY

SEQ ID NO: 84894 - protein, 15 aa, Borrelia garinii
TNVGSFKTSLYYGYK

SEQ ID NO: 84895 - protein, 15 aa, Borrelia garinii
NVGSFKTSLYYGYKE

SEQ ID NO: 84896 - protein, 15 aa, Borrelia garinii
VGSFKTSLYYGYKEE

SEQ ID NO: 84897 - protein, 15 aa, Borrelia garinii
GSFKTSLYYGYKEEQ

SEQ ID NO: 84898 - protein, 15 aa, Borrelia garinii
SFKTSLYYGYKEEQS

SEQ ID NO: 84899 - protein, 15 aa, Borrelia garinii
FKTSLYYGYKEEQSS

SEQ ID NO: 84900 - protein, 15 aa, Borrelia garinii
KTSLYYGYKEEQSST

SEQ ID NO: 84901 - protein, 15 aa, Borrelia garinii
TSLYYGYKEEQSSTN

SEQ ID NO: 84902 - protein, 15 aa, Borrelia garinii
SLYYGYKEEQSSTNG

SEQ ID NO: 84903 - protein, 15 aa, Borrelia garinii
LYYGYKEEQSSTNGI

SEQ ID NO: 84904 - protein, 15 aa, Borrelia garinii
YYGYKEEQSSTNGIK

SEQ ID NO: 84905 - protein, 15 aa, Borrelia garinii
YGYKEEQSSTNGIKG

SEQ ID NO: 84906 - protein, 15 aa, Borrelia garinii
GYKEEQSSTNGIKGK

SEQ ID NO: 84907 - protein, 15 aa, Borrelia garinii
YKEEQSSTNGIKGKE

SEQ ID NO: 84908 - protein, 15 aa, Borrelia garinii
KEEQSSTNGIKGKEI

SEQ ID NO: 84909 - protein, 15 aa, Borrelia garinii
EEQSSTNGIKGKEIT

SEQ ID NO: 84910 - protein, 15 aa, Borrelia garinii
EQSSTNGIKGKEITT

SEQ ID NO: 84911 - protein, 15 aa, Borrelia garinii
QSSTNGIKGKEITTK

SEQ ID NO: 84912 - protein, 15 aa, Borrelia garinii
SSTNGIKGKEITTKI

SEQ ID NO: 84913 - protein, 15 aa, Borrelia garinii
STNGIKGKEITTKIE

SEQ ID NO: 84914 - protein, 15 aa, Borrelia garinii
TNGIKGKEITTKIET

SEQ ID NO: 84915 - protein, 15 aa, Borrelia garinii
NGIKGKEITTKIETI

SEQ ID NO: 84916 - protein, 15 aa, Borrelia garinii
GIKGKEITTKIETIN

SEQ ID NO: 84917 - protein, 15 aa, Borrelia garinii
IKGKEITTKIETINN

SEQ ID NO: 84918 - protein, 15 aa, Borrelia garinii
KGKEITTKIETINNS

SEQ ID NO: 84919 - protein, 15 aa, Borrelia garinii
GKEITTKIETINNSE

SEQ ID NO: 84920 - protein, 15 aa, Borrelia garinii
KEITTKIETINNSEH

SEQ ID NO: 84921 - protein, 15 aa, Borrelia garinii
EITTKIETINNSEHI

SEQ ID NO: 84922 - protein, 15 aa, Borrelia garinii
ITTKIETINNSEHIT

SEQ ID NO: 84923 - protein, 15 aa, Borrelia garinii
TTKIETINNSEHITF

SEQ ID NO: 84924 - protein, 15 aa, Borrelia garinii
TKIETINNSEHITFS

SEQ ID NO: 84925 - protein, 15 aa, Borrelia garinii
KIETINNSEHITFSG

SEQ ID NO: 84926 - protein, 15 aa, Borrelia garinii
IETINNSEHITFSGD

SEQ ID NO: 84927 - protein, 15 aa, Borrelia garinii
ETINNSEHITFSGDK

SEQ ID NO: 84928 - protein, 15 aa, Borrelia garinii
TINNSEHITFSGDKI

SEQ ID NO: 84929 - protein, 16 aa, Borrelia garinii
MNKKMKMFIICAVFVL

SEQ ID NO: 84930 - protein, 16 aa, Borrelia garinii
NKKMKMFIICAVFVLI

SEQ ID NO: 84931 - protein, 16 aa, Borrelia garinii
KKMKMFIICAVFVLIS

SEQ ID NO: 84932 - protein, 16 aa, Borrelia garinii
KMKMFIICAVFVLISS

SEQ ID NO: 84933 - protein, 16 aa, Borrelia garinii
MKMFIICAVFVLISSC

SEQ ID NO: 84934 - protein, 16 aa, Borrelia garinii
KMFIICAVFVLISSCG

SEQ ID NO: 84935 - protein, 16 aa, Borrelia garinii
MFIICAVFVLISSCGN

SEQ ID NO: 84936 - protein, 16 aa, Borrelia garinii
FIICAVFVLISSCGNF

SEQ ID NO: 84937 - protein, 16 aa, Borrelia garinii
IICAVFVLISSCGNFR

SEQ ID NO: 84938 - protein, 16 aa, Borrelia garinii
ICAVFVLISSCGNFRS

SEQ ID NO: 84939 - protein, 16 aa, Borrelia garinii
CAVFVLISSCGNFRSS

SEQ ID NO: 84940 - protein, 16 aa, Borrelia garinii
AVFVLISSCGNFRSSL

SEQ ID NO: 84941 - protein, 16 aa, Borrelia garinii
VFVLISSCGNFRSSLS

SEQ ID NO: 84942 - protein, 16 aa, Borrelia garinii
FVLISSCGNFRSSLSD

SEQ ID NO: 84943 - protein, 16 aa, Borrelia garinii
VLISSCGNFRSSLSDQ

SEQ ID NO: 84944 - protein, 16 aa, Borrelia garinii
LISSCGNFRSSLSDQG

SEQ ID NO: 84945 - protein, 16 aa, Borrelia garinii
ISSCGNFRSSLSDQGS

SEQ ID NO: 84946 - protein, 16 aa, Borrelia garinii
SSCGNFRSSLSDQGSL

SEQ ID NO: 84947 - protein, 16 aa, Borrelia garinii
SCGNFRSSLSDQGSLS

SEQ ID NO: 84948 - protein, 16 aa, Borrelia garinii
CGNFRSSLSDQGSLSD

SEQ ID NO: 84949 - protein, 16 aa, Borrelia garinii
GNFRSSLSDQGSLSDQ

SEQ ID NO: 84950 - protein, 16 aa, Borrelia garinii
NFRSSLSDQGSLSDQG

SEQ ID NO: 84951 - protein, 16 aa, Borrelia garinii
FRSSLSDQGSLSDQGS

SEQ ID NO: 84952 - protein, 16 aa, Borrelia garinii
RSSLSDQGSLSDQGSL

SEQ ID NO: 84953 - protein, 16 aa, Borrelia garinii
SSLSDQGSLSDQGSLS

SEQ ID NO: 84954 - protein, 16 aa, Borrelia garinii
SLSDQGSLSDQGSLSD

SEQ ID NO: 84955 - protein, 16 aa, Borrelia garinii
LSDQGSLSDQGSLSDQ

SEQ ID NO: 84956 - protein, 16 aa, Borrelia garinii
SDQGSLSDQGSLSDQG

SEQ ID NO: 84957 - protein, 16 aa, Borrelia garinii
DQGSLSDQGSLSDQGS

SEQ ID NO: 84958 - protein, 16 aa, Borrelia garinii
QGSLSDQGSLSDQGSL

SEQ ID NO: 84959 - protein, 16 aa, Borrelia garinii
GSLSDQGSLSDQGSLS

SEQ ID NO: 84960 - protein, 16 aa, Borrelia garinii
SLSDQGSLSDQGSLSD

SEQ ID NO: 84961 - protein, 16 aa, Borrelia garinii
LSDQGSLSDQGSLSDQ

SEQ ID NO: 84962 - protein, 16 aa, Borrelia garinii
SDQGSLSDQGSLSDQG

SEQ ID NO: 84963 - protein, 16 aa, Borrelia garinii
DQGSLSDQGSLSDQGG

SEQ ID NO: 84964 - protein, 16 aa, Borrelia garinii
QGSLSDQGSLSDQGGL

SEQ ID NO: 84965 - protein, 16 aa, Borrelia garinii
GSLSDQGSLSDQGGLS

SEQ ID NO: 84966 - protein, 16 aa, Borrelia garinii
SLSDQGSLSDQGGLSG

SEQ ID NO: 84967 - protein, 16 aa, Borrelia garinii
LSDQGSLSDQGGLSGQ

SEQ ID NO: 84968 - protein, 16 aa, Borrelia garinii
SDQGSLSDQGGLSGQA

SEQ ID NO: 84969 - protein, 16 aa, Borrelia garinii
DQGSLSDQGGLSGQAS

SEQ ID NO: 84970 - protein, 16 aa, Borrelia garinii
QGSLSDQGGLSGQASS

SEQ ID NO: 84971 - protein, 16 aa, Borrelia garinii
GSLSDQGGLSGQASSD

SEQ ID NO: 84972 - protein, 16 aa, Borrelia garinii
SLSDQGGLSGQASSDT

SEQ ID NO: 84973 - protein, 16 aa, Borrelia garinii
LSDQGGLSGQASSDTI

SEQ ID NO: 84974 - protein, 16 aa, Borrelia garinii
SDQGGLSGQASSDTIK

SEQ ID NO: 84975 - protein, 16 aa, Borrelia garinii
DQGGLSGQASSDTIKF

SEQ ID NO: 84976 - protein, 16 aa, Borrelia garinii
QGGLSGQASSDTIKFS

SEQ ID NO: 84977 - protein, 16 aa, Borrelia garinii
GGLSGQASSDTIKFSE

SEQ ID NO: 84978 - protein, 16 aa, Borrelia garinii
GLSGQASSDTIKFSEF

SEQ ID NO: 84979 - protein, 16 aa, Borrelia garinii
LSGQASSDTIKFSEFT

SEQ ID NO: 84980 - protein, 16 aa, Borrelia garinii
SGQASSDTIKFSEFTV

SEQ ID NO: 84981 - protein, 16 aa, Borrelia garinii
GQASSDTIKFSEFTVN

SEQ ID NO: 84982 - protein, 16 aa, Borrelia garinii
QASSDTIKFSEFTVNI

SEQ ID NO: 84983 - protein, 16 aa, Borrelia garinii
ASSDTIKFSEFTVNIK

SEQ ID NO: 84984 - protein, 16 aa, Borrelia garinii
SSDTIKFSEFTVNIKN

SEQ ID NO: 84985 - protein, 16 aa, Borrelia garinii
SDTIKFSEFTVNIKNK

SEQ ID NO: 84986 - protein, 16 aa, Borrelia garinii
DTIKFSEFTVNIKNKK

SEQ ID NO: 84987 - protein, 16 aa, Borrelia garinii
TIKFSEFTVNIKNKKD

SEQ ID NO: 84988 - protein, 16 aa, Borrelia garinii
IKFSEFTVNIKNKKDN

SEQ ID NO: 84989 - protein, 16 aa, Borrelia garinii
KFSEFTVNIKNKKDNN

SEQ ID NO: 84990 - protein, 16 aa, Borrelia garinii
FSEFTVNIKNKKDNNG

SEQ ID NO: 84991 - protein, 16 aa, Borrelia garinii
SEFTVNIKNKKDNNGD

SEQ ID NO: 84992 - protein, 16 aa, Borrelia garinii
EFTVNIKNKKDNNGDW

SEQ ID NO: 84993 - protein, 16 aa, Borrelia garinii
FTVNIKNKKDNNGDWS

SEQ ID NO: 84994 - protein, 16 aa, Borrelia garinii
TVNIKNKKDNNGDWSN

SEQ ID NO: 84995 - protein, 16 aa, Borrelia garinii
VNIKNKKDNNGDWSNL

SEQ ID NO: 84996 - protein, 16 aa, Borrelia garinii
NIKNKKDNNGDWSNLG

SEQ ID NO: 84997 - protein, 16 aa, Borrelia garinii
IKNKKDNNGDWSNLGT

SEQ ID NO: 84998 - protein, 16 aa, Borrelia garinii
KNKKDNNGDWSNLGTL

SEQ ID NO: 84999 - protein, 16 aa, Borrelia garinii
NKKDNNGDWSNLGTLV

SEQ ID NO: 85000 - protein, 16 aa, Borrelia garinii
KKDNNGDWSNLGTLVI

SEQ ID NO: 85001 - protein, 16 aa, Borrelia garinii
KDNNGDWSNLGTLVIR

SEQ ID NO: 85002 - protein, 16 aa, Borrelia garinii
DNNGDWSNLGTLVIRK

SEQ ID NO: 85003 - protein, 16 aa, Borrelia garinii
NNGDWSNLGTLVIRKE

SEQ ID NO: 85004 - protein, 16 aa, Borrelia garinii
NGDWSNLGTLVIRKEQ

SEQ ID NO: 85005 - protein, 16 aa, Borrelia garinii
GDWSNLGTLVIRKEQD

SEQ ID NO: 85006 - protein, 16 aa, Borrelia garinii
DWSNLGTLVIRKEQDG

SEQ ID NO: 85007 - protein, 16 aa, Borrelia garinii
WSNLGTLVIRKEQDGV

SEQ ID NO: 85008 - protein, 16 aa, Borrelia garinii
SNLGTLVIRKEQDGVE

SEQ ID NO: 85009 - protein, 16 aa, Borrelia garinii
NLGTLVIRKEQDGVET

SEQ ID NO: 85010 - protein, 16 aa, Borrelia garinii
LGTLVIRKEQDGVETG

SEQ ID NO: 85011 - protein, 16 aa, Borrelia garinii
GTLVIRKEQDGVETGL

SEQ ID NO: 85012 - protein, 16 aa, Borrelia garinii
TLVIRKEQDGVETGLN

SEQ ID NO: 85013 - protein, 16 aa, Borrelia garinii
LVIRKEQDGVETGLNV

SEQ ID NO: 85014 - protein, 16 aa, Borrelia garinii
VIRKEQDGVETGLNVI

SEQ ID NO: 85015 - protein, 16 aa, Borrelia garinii
IRKEQDGVETGLNVIG

SEQ ID NO: 85016 - protein, 16 aa, Borrelia garinii
RKEQDGVETGLNVIGT

SEQ ID NO: 85017 - protein, 16 aa, Borrelia garinii
KEQDGVETGLNVIGTI

SEQ ID NO: 85018 - protein, 16 aa, Borrelia garinii
EQDGVETGLNVIGTIN

SEQ ID NO: 85019 - protein, 16 aa, Borrelia garinii
QDGVETGLNVIGTING

SEQ ID NO: 85020 - protein, 16 aa, Borrelia garinii
DGVETGLNVIGTINGQ

SEQ ID NO: 85021 - protein, 16 aa, Borrelia garinii
GVETGLNVIGTINGQL

SEQ ID NO: 85022 - protein, 16 aa, Borrelia garinii
VETGLNVIGTINGQLR

SEQ ID NO: 85023 - protein, 16 aa, Borrelia garinii
ETGLNVIGTINGQLRG

SEQ ID NO: 85024 - protein, 16 aa, Borrelia garinii
TGLNVIGTINGQLRGH

SEQ ID NO: 85025 - protein, 16 aa, Borrelia garinii
GLNVIGTINGQLRGHS

SEQ ID NO: 85026 - protein, 16 aa, Borrelia garinii
LNVIGTINGQLRGHSA

SEQ ID NO: 85027 - protein, 16 aa, Borrelia garinii
NVIGTINGQLRGHSAT

SEQ ID NO: 85028 - protein, 16 aa, Borrelia garinii
VIGTINGQLRGHSATF

SEQ ID NO: 85029 - protein, 16 aa, Borrelia garinii
IGTINGQLRGHSATFF

SEQ ID NO: 85030 - protein, 16 aa, Borrelia garinii
GTINGQLRGHSATFFC

SEQ ID NO: 85031 - protein, 16 aa, Borrelia garinii
TINGQLRGHSATFFCI

SEQ ID NO: 85032 - protein, 16 aa, Borrelia garinii
INGQLRGHSATFFCIE

SEQ ID NO: 85033 - protein, 16 aa, Borrelia garinii
NGQLRGHSATFFCIEE

SEQ ID NO: 85034 - protein, 16 aa, Borrelia garinii
GQLRGHSATFFCIEEA

SEQ ID NO: 85035 - protein, 16 aa, Borrelia garinii
QLRGHSATFFCIEEAE

SEQ ID NO: 85036 - protein, 16 aa, Borrelia garinii
LRGHSATFFCIEEAEV

SEQ ID NO: 85037 - protein, 16 aa, Borrelia garinii
RGHSATFFCIEEAEVN

SEQ ID NO: 85038 - protein, 16 aa, Borrelia garinii
GHSATFFCIEEAEVNN

SEQ ID NO: 85039 - protein, 16 aa, Borrelia garinii
HSATFFCIEEAEVNNF

SEQ ID NO: 85040 - protein, 16 aa, Borrelia garinii
SATFFCIEEAEVNNFV

SEQ ID NO: 85041 - protein, 16 aa, Borrelia garinii
ATFFCIEEAEVNNFVK

SEQ ID NO: 85042 - protein, 16 aa, Borrelia garinii
TFFCIEEAEVNNFVKA

SEQ ID NO: 85043 - protein, 16 aa, Borrelia garinii
FFCIEEAEVNNFVKAM

SEQ ID NO: 85044 - protein, 16 aa, Borrelia garinii
FCIEEAEVNNFVKAMT

SEQ ID NO: 85045 - protein, 16 aa, Borrelia garinii
CIEEAEVNNFVKAMTN

SEQ ID NO: 85046 - protein, 16 aa, Borrelia garinii
IEEAEVNNFVKAMTNV

SEQ ID NO: 85047 - protein, 16 aa, Borrelia garinii
EEAEVNNFVKAMTNVG

SEQ ID NO: 85048 - protein, 16 aa, Borrelia garinii
EAEVNNFVKAMTNVGS

SEQ ID NO: 85049 - protein, 16 aa, Borrelia garinii
AEVNNFVKAMTNVGSF

SEQ ID NO: 85050 - protein, 16 aa, Borrelia garinii
EVNNFVKAMTNVGSFK

SEQ ID NO: 85051 - protein, 16 aa, Borrelia garinii
VNNFVKAMTNVGSFKT

SEQ ID NO: 85052 - protein, 16 aa, Borrelia garinii
NNFVKAMTNVGSFKTS

SEQ ID NO: 85053 - protein, 16 aa, Borrelia garinii
NFVKAMTNVGSFKTSL

SEQ ID NO: 85054 - protein, 16 aa, Borrelia garinii
FVKAMTNVGSFKTSLY

SEQ ID NO: 85055 - protein, 16 aa, Borrelia garinii
VKAMTNVGSFKTSLYY

SEQ ID NO: 85056 - protein, 16 aa, Borrelia garinii
KAMTNVGSFKTSLYYG

SEQ ID NO: 85057 - protein, 16 aa, Borrelia garinii
AMTNVGSFKTSLYYGY

SEQ ID NO: 85058 - protein, 16 aa, Borrelia garinii
MTNVGSFKTSLYYGYK

SEQ ID NO: 85059 - protein, 16 aa, Borrelia garinii
TNVGSFKTSLYYGYKE

SEQ ID NO: 85060 - protein, 16 aa, Borrelia garinii
NVGSFKTSLYYGYKEE

SEQ ID NO: 85061 - protein, 16 aa, Borrelia garinii
VGSFKTSLYYGYKEEQ

SEQ ID NO: 85062 - protein, 16 aa, Borrelia garinii
GSFKTSLYYGYKEEQS

SEQ ID NO: 85063 - protein, 16 aa, Borrelia garinii
SFKTSLYYGYKEEQSS

SEQ ID NO: 85064 - protein, 16 aa, Borrelia garinii
FKTSLYYGYKEEQSST

SEQ ID NO: 85065 - protein, 16 aa, Borrelia garinii
KTSLYYGYKEEQSSTN

SEQ ID NO: 85066 - protein, 16 aa, Borrelia garinii
TSLYYGYKEEQSSTNG

SEQ ID NO: 85067 - protein, 16 aa, Borrelia garinii
SLYYGYKEEQSSTNGI

SEQ ID NO: 85068 - protein, 16 aa, Borrelia garinii
LYYGYKEEQSSTNGIK

SEQ ID NO: 85069 - protein, 16 aa, Borrelia garinii
YYGYKEEQSSTNGIKG

SEQ ID NO: 85070 - protein, 16 aa, Borrelia garinii
YGYKEEQSSTNGIKGK

SEQ ID NO: 85071 - protein, 16 aa, Borrelia garinii
GYKEEQSSTNGIKGKE

SEQ ID NO: 85072 - protein, 16 aa, Borrelia garinii
YKEEQSSTNGIKGKEI

SEQ ID NO: 85073 - protein, 16 aa, Borrelia garinii
KEEQSSTNGIKGKEIT

SEQ ID NO: 85074 - protein, 16 aa, Borrelia garinii
EEQSSTNGIKGKEITT

SEQ ID NO: 85075 - protein, 16 aa, Borrelia garinii
EQSSTNGIKGKEITTK

SEQ ID NO: 85076 - protein, 16 aa, Borrelia garinii
QSSTNGIKGKEITTKI

SEQ ID NO: 85077 - protein, 16 aa, Borrelia garinii
SSTNGIKGKEITTKIE

SEQ ID NO: 85078 - protein, 16 aa, Borrelia garinii
STNGIKGKEITTKIET

SEQ ID NO: 85079 - protein, 16 aa, Borrelia garinii
TNGIKGKEITTKIETI

SEQ ID NO: 85080 - protein, 16 aa, Borrelia garinii
NGIKGKEITTKIETIN

SEQ ID NO: 85081 - protein, 16 aa, Borrelia garinii
GIKGKEITTKIETINN

SEQ ID NO: 85082 - protein, 16 aa, Borrelia garinii
IKGKEITTKIETINNS

SEQ ID NO: 85083 - protein, 16 aa, Borrelia garinii
KGKEITTKIETINNSE

SEQ ID NO: 85084 - protein, 16 aa, Borrelia garinii
GKEITTKIETINNSEH

SEQ ID NO: 85085 - protein, 16 aa, Borrelia garinii
KEITTKIETINNSEHI

SEQ ID NO: 85086 - protein, 16 aa, Borrelia garinii
EITTKIETINNSEHIT

SEQ ID NO: 85087 - protein, 16 aa, Borrelia garinii
ITTKIETINNSEHITF

SEQ ID NO: 85088 - protein, 16 aa, Borrelia garinii
TTKIETINNSEHITFS

SEQ ID NO: 85089 - protein, 16 aa, Borrelia garinii
TKIETINNSEHITFSG

SEQ ID NO: 85090 - protein, 16 aa, Borrelia garinii
KIETINNSEHITFSGD

SEQ ID NO: 85091 - protein, 16 aa, Borrelia garinii
IETINNSEHITFSGDK

SEQ ID NO: 85092 - protein, 16 aa, Borrelia garinii
ETINNSEHITFSGDKI

SEQ ID NO: 85093 - protein, 13 aa, Borrelia burgdorferi
MNKKMKNLIICAV

SEQ ID NO: 85094 - protein, 13 aa, Borrelia burgdorferi
NKKMKNLIICAVF

SEQ ID NO: 85095 - protein, 13 aa, Borrelia burgdorferi
KKMKNLIICAVFV

SEQ ID NO: 85096 - protein, 13 aa, Borrelia burgdorferi
KMKNLIICAVFVL

SEQ ID NO: 85097 - protein, 13 aa, Borrelia burgdorferi
MKNLIICAVFVLI

SEQ ID NO: 85098 - protein, 13 aa, Borrelia burgdorferi
KNLIICAVFVLII

SEQ ID NO: 85099 - protein, 13 aa, Borrelia burgdorferi
NLIICAVFVLIIS

SEQ ID NO: 85100 - protein, 13 aa, Borrelia burgdorferi
LIICAVFVLIISC

SEQ ID NO: 85101 - protein, 13 aa, Borrelia burgdorferi
IICAVFVLIISCK

SEQ ID NO: 85102 - protein, 13 aa, Borrelia burgdorferi
ICAVFVLIISCKI

SEQ ID NO: 85103 - protein, 13 aa, Borrelia burgdorferi
CAVFVLIISCKID

SEQ ID NO: 85104 - protein, 13 aa, Borrelia burgdorferi
AVFVLIISCKIDA

SEQ ID NO: 85105 - protein, 13 aa, Borrelia burgdorferi
VFVLIISCKIDAS

SEQ ID NO: 85106 - protein, 13 aa, Borrelia burgdorferi
FVLIISCKIDASS

SEQ ID NO: 85107 - protein, 13 aa, Borrelia burgdorferi
VLIISCKIDASSE

SEQ ID NO: 85108 - protein, 13 aa, Borrelia burgdorferi
LIISCKIDASSED

SEQ ID NO: 85109 - protein, 13 aa, Borrelia burgdorferi
IISCKIDASSEDL

SEQ ID NO: 85110 - protein, 13 aa, Borrelia burgdorferi
ISCKIDASSEDLK

SEQ ID NO: 85111 - protein, 13 aa, Borrelia burgdorferi
SCKIDASSEDLKQ

SEQ ID NO: 85112 - protein, 13 aa, Borrelia burgdorferi
CKIDASSEDLKQN

SEQ ID NO: 85113 - protein, 13 aa, Borrelia burgdorferi
KIDASSEDLKQNV

SEQ ID NO: 85114 - protein, 13 aa, Borrelia burgdorferi
IDASSEDLKQNVK

SEQ ID NO: 85115 - protein, 13 aa, Borrelia burgdorferi
DASSEDLKQNVKE

SEQ ID NO: 85116 - protein, 13 aa, Borrelia burgdorferi
ASSEDLKQNVKEK

SEQ ID NO: 85117 - protein, 13 aa, Borrelia burgdorferi
SSEDLKQNVKEKV

SEQ ID NO: 85118 - protein, 13 aa, Borrelia burgdorferi
SEDLKQNVKEKVE

SEQ ID NO: 85119 - protein, 13 aa, Borrelia burgdorferi
EDLKQNVKEKVEG

SEQ ID NO: 85120 - protein, 13 aa, Borrelia burgdorferi
DLKQNVKEKVEGF

SEQ ID NO: 85121 - protein, 13 aa, Borrelia burgdorferi
LKQNVKEKVEGFL

SEQ ID NO: 85122 - protein, 13 aa, Borrelia burgdorferi
KQNVKEKVEGFLD

SEQ ID NO: 85123 - protein, 13 aa, Borrelia burgdorferi
QNVKEKVEGFLDK

SEQ ID NO: 85124 - protein, 13 aa, Borrelia burgdorferi
NVKEKVEGFLDKE

SEQ ID NO: 85125 - protein, 13 aa, Borrelia burgdorferi
VKEKVEGFLDKEL

SEQ ID NO: 85126 - protein, 13 aa, Borrelia burgdorferi
KEKVEGFLDKELM

SEQ ID NO: 85127 - protein, 13 aa, Borrelia burgdorferi
EKVEGFLDKELMQ

SEQ ID NO: 85128 - protein, 13 aa, Borrelia burgdorferi
KVEGFLDKELMQG

SEQ ID NO: 85129 - protein, 13 aa, Borrelia burgdorferi
VEGFLDKELMQGD

SEQ ID NO: 85130 - protein, 13 aa, Borrelia burgdorferi
EGFLDKELMQGDD

SEQ ID NO: 85131 - protein, 13 aa, Borrelia burgdorferi
GFLDKELMQGDDP

SEQ ID NO: 85132 - protein, 13 aa, Borrelia burgdorferi
FLDKELMQGDDPN

SEQ ID NO: 85133 - protein, 13 aa, Borrelia burgdorferi
LDKELMQGDDPNN

SEQ ID NO: 85134 - protein, 13 aa, Borrelia burgdorferi
DKELMQGDDPNNS

SEQ ID NO: 85135 - protein, 13 aa, Borrelia burgdorferi
KELMQGDDPNNSL

SEQ ID NO: 85136 - protein, 13 aa, Borrelia burgdorferi
ELMQGDDPNNSLF

SEQ ID NO: 85137 - protein, 13 aa, Borrelia burgdorferi
LMQGDDPNNSLFN

SEQ ID NO: 85138 - protein, 13 aa, Borrelia burgdorferi
MQGDDPNNSLFNP

SEQ ID NO: 85139 - protein, 13 aa, Borrelia burgdorferi
QGDDPNNSLFNPP

SEQ ID NO: 85140 - protein, 13 aa, Borrelia burgdorferi
GDDPNNSLFNPPP

SEQ ID NO: 85141 - protein, 13 aa, Borrelia burgdorferi
DDPNNSLFNPPPV

SEQ ID NO: 85142 - protein, 13 aa, Borrelia burgdorferi
DPNNSLFNPPPVL

SEQ ID NO: 85143 - protein, 13 aa, Borrelia burgdorferi
PNNSLFNPPPVLP

SEQ ID NO: 85144 - protein, 13 aa, Borrelia burgdorferi
NNSLFNPPPVLPA

SEQ ID NO: 85145 - protein, 13 aa, Borrelia burgdorferi
NSLFNPPPVLPAS

SEQ ID NO: 85146 - protein, 13 aa, Borrelia burgdorferi
SLFNPPPVLPASS

SEQ ID NO: 85147 - protein, 13 aa, Borrelia burgdorferi
LFNPPPVLPASSH

SEQ ID NO: 85148 - protein, 13 aa, Borrelia burgdorferi
FNPPPVLPASSHD

SEQ ID NO: 85149 - protein, 13 aa, Borrelia burgdorferi
NPPPVLPASSHDN

SEQ ID NO: 85150 - protein, 13 aa, Borrelia burgdorferi
PPPVLPASSHDNT

SEQ ID NO: 85151 - protein, 13 aa, Borrelia burgdorferi
PPVLPASSHDNTP

SEQ ID NO: 85152 - protein, 13 aa, Borrelia burgdorferi
PVLPASSHDNTPV

SEQ ID NO: 85153 - protein, 13 aa, Borrelia burgdorferi
VLPASSHDNTPVL

SEQ ID NO: 85154 - protein, 13 aa, Borrelia burgdorferi
LPASSHDNTPVLK

SEQ ID NO: 85155 - protein, 13 aa, Borrelia burgdorferi
PASSHDNTPVLKA

SEQ ID NO: 85156 - protein, 13 aa, Borrelia burgdorferi
ASSHDNTPVLKAV

SEQ ID NO: 85157 - protein, 13 aa, Borrelia burgdorferi
SSHDNTPVLKAVQ

SEQ ID NO: 85158 - protein, 13 aa, Borrelia burgdorferi
SHDNTPVLKAVQA

SEQ ID NO: 85159 - protein, 13 aa, Borrelia burgdorferi
HDNTPVLKAVQAK

SEQ ID NO: 85160 - protein, 13 aa, Borrelia burgdorferi
DNTPVLKAVQAKD

SEQ ID NO: 85161 - protein, 13 aa, Borrelia burgdorferi
NTPVLKAVQAKDG

SEQ ID NO: 85162 - protein, 13 aa, Borrelia burgdorferi
TPVLKAVQAKDGG

SEQ ID NO: 85163 - protein, 13 aa, Borrelia burgdorferi
PVLKAVQAKDGGQ

SEQ ID NO: 85164 - protein, 13 aa, Borrelia burgdorferi
VLKAVQAKDGGQQ

SEQ ID NO: 85165 - protein, 13 aa, Borrelia burgdorferi
LKAVQAKDGGQQE

SEQ ID NO: 85166 - protein, 13 aa, Borrelia burgdorferi
KAVQAKDGGQQEG

SEQ ID NO: 85167 - protein, 13 aa, Borrelia burgdorferi
AVQAKDGGQQEGK

SEQ ID NO: 85168 - protein, 13 aa, Borrelia burgdorferi
VQAKDGGQQEGKE

SEQ ID NO: 85169 - protein, 13 aa, Borrelia burgdorferi
QAKDGGQQEGKEE

SEQ ID NO: 85170 - protein, 13 aa, Borrelia burgdorferi
AKDGGQQEGKEEK

SEQ ID NO: 85171 - protein, 13 aa, Borrelia burgdorferi
KDGGQQEGKEEKE

SEQ ID NO: 85172 - protein, 13 aa, Borrelia burgdorferi
DGGQQEGKEEKEK

SEQ ID NO: 85173 - protein, 13 aa, Borrelia burgdorferi
GGQQEGKEEKEKE

SEQ ID NO: 85174 - protein, 13 aa, Borrelia burgdorferi
GQQEGKEEKEKEI

SEQ ID NO: 85175 - protein, 13 aa, Borrelia burgdorferi
QQEGKEEKEKEIQ

SEQ ID NO: 85176 - protein, 13 aa, Borrelia burgdorferi
QEGKEEKEKEIQE

SEQ ID NO: 85177 - protein, 13 aa, Borrelia burgdorferi
EGKEEKEKEIQEL

SEQ ID NO: 85178 - protein, 13 aa, Borrelia burgdorferi
GKEEKEKEIQELK

SEQ ID NO: 85179 - protein, 13 aa, Borrelia burgdorferi
KEEKEKEIQELKD

SEQ ID NO: 85180 - protein, 13 aa, Borrelia burgdorferi
EEKEKEIQELKDK

SEQ ID NO: 85181 - protein, 13 aa, Borrelia burgdorferi
EKEKEIQELKDKI

SEQ ID NO: 85182 - protein, 13 aa, Borrelia burgdorferi
KEKEIQELKDKID

SEQ ID NO: 85183 - protein, 13 aa, Borrelia burgdorferi
EKEIQELKDKIDK

SEQ ID NO: 85184 - protein, 13 aa, Borrelia burgdorferi
KEIQELKDKIDKR

SEQ ID NO: 85185 - protein, 13 aa, Borrelia burgdorferi
EIQELKDKIDKRK

SEQ ID NO: 85186 - protein, 13 aa, Borrelia burgdorferi
IQELKDKIDKRKK

SEQ ID NO: 85187 - protein, 13 aa, Borrelia burgdorferi
QELKDKIDKRKKE

SEQ ID NO: 85188 - protein, 13 aa, Borrelia burgdorferi
ELKDKIDKRKKEL

SEQ ID NO: 85189 - protein, 13 aa, Borrelia burgdorferi
LKDKIDKRKKELE

SEQ ID NO: 85190 - protein, 13 aa, Borrelia burgdorferi
KDKIDKRKKELEE

SEQ ID NO: 85191 - protein, 13 aa, Borrelia burgdorferi
DKIDKRKKELEEA

SEQ ID NO: 85192 - protein, 13 aa, Borrelia burgdorferi
KIDKRKKELEEAR

SEQ ID NO: 85193 - protein, 13 aa, Borrelia burgdorferi
IDKRKKELEEARK

SEQ ID NO: 85194 - protein, 13 aa, Borrelia burgdorferi
DKRKKELEEARKK

SEQ ID NO: 85195 - protein, 13 aa, Borrelia burgdorferi
KRKKELEEARKKF

SEQ ID NO: 85196 - protein, 13 aa, Borrelia burgdorferi
RKKELEEARKKFQ

SEQ ID NO: 85197 - protein, 13 aa, Borrelia burgdorferi
KKELEEARKKFQE

SEQ ID NO: 85198 - protein, 13 aa, Borrelia burgdorferi
KELEEARKKFQEF

SEQ ID NO: 85199 - protein, 13 aa, Borrelia burgdorferi
ELEEARKKFQEFK

SEQ ID NO: 85200 - protein, 13 aa, Borrelia burgdorferi
LEEARKKFQEFKE

SEQ ID NO: 85201 - protein, 13 aa, Borrelia burgdorferi
EEARKKFQEFKEQ

SEQ ID NO: 85202 - protein, 13 aa, Borrelia burgdorferi
EARKKFQEFKEQV

SEQ ID NO: 85203 - protein, 13 aa, Borrelia burgdorferi
ARKKFQEFKEQVE

SEQ ID NO: 85204 - protein, 13 aa, Borrelia burgdorferi
RKKFQEFKEQVES

SEQ ID NO: 85205 - protein, 13 aa, Borrelia burgdorferi
KKFQEFKEQVESA

SEQ ID NO: 85206 - protein, 13 aa, Borrelia burgdorferi
KFQEFKEQVESAT

SEQ ID NO: 85207 - protein, 13 aa, Borrelia burgdorferi
FQEFKEQVESATG

SEQ ID NO: 85208 - protein, 13 aa, Borrelia burgdorferi
QEFKEQVESATGE

SEQ ID NO: 85209 - protein, 13 aa, Borrelia burgdorferi
EFKEQVESATGES

SEQ ID NO: 85210 - protein, 13 aa, Borrelia burgdorferi
FKEQVESATGEST

SEQ ID NO: 85211 - protein, 13 aa, Borrelia burgdorferi
KEQVESATGESTE

SEQ ID NO: 85212 - protein, 13 aa, Borrelia burgdorferi
EQVESATGESTEK

SEQ ID NO: 85213 - protein, 13 aa, Borrelia burgdorferi
QVESATGESTEKV

SEQ ID NO: 85214 - protein, 13 aa, Borrelia burgdorferi
VESATGESTEKVK

SEQ ID NO: 85215 - protein, 13 aa, Borrelia burgdorferi
ESATGESTEKVKK

SEQ ID NO: 85216 - protein, 13 aa, Borrelia burgdorferi
SATGESTEKVKKQ

SEQ ID NO: 85217 - protein, 13 aa, Borrelia burgdorferi
ATGESTEKVKKQG

SEQ ID NO: 85218 - protein, 13 aa, Borrelia burgdorferi
TGESTEKVKKQGN

SEQ ID NO: 85219 - protein, 13 aa, Borrelia burgdorferi
GESTEKVKKQGNI

SEQ ID NO: 85220 - protein, 13 aa, Borrelia burgdorferi
ESTEKVKKQGNIG

SEQ ID NO: 85221 - protein, 13 aa, Borrelia burgdorferi
STEKVKKQGNIGQ

SEQ ID NO: 85222 - protein, 13 aa, Borrelia burgdorferi
TEKVKKQGNIGQK

SEQ ID NO: 85223 - protein, 13 aa, Borrelia burgdorferi
EKVKKQGNIGQKA

SEQ ID NO: 85224 - protein, 13 aa, Borrelia burgdorferi
KVKKQGNIGQKAL

SEQ ID NO: 85225 - protein, 13 aa, Borrelia burgdorferi
VKKQGNIGQKALK

SEQ ID NO: 85226 - protein, 13 aa, Borrelia burgdorferi
KKQGNIGQKALKY

SEQ ID NO: 85227 - protein, 13 aa, Borrelia burgdorferi
KQGNIGQKALKYA

SEQ ID NO: 85228 - protein, 13 aa, Borrelia burgdorferi
QGNIGQKALKYAK

SEQ ID NO: 85229 - protein, 13 aa, Borrelia burgdorferi
GNIGQKALKYAKE

SEQ ID NO: 85230 - protein, 13 aa, Borrelia burgdorferi
NIGQKALKYAKEL

SEQ ID NO: 85231 - protein, 13 aa, Borrelia burgdorferi
IGQKALKYAKELG

SEQ ID NO: 85232 - protein, 13 aa, Borrelia burgdorferi
GQKALKYAKELGV

SEQ ID NO: 85233 - protein, 13 aa, Borrelia burgdorferi
QKALKYAKELGVN

SEQ ID NO: 85234 - protein, 13 aa, Borrelia burgdorferi
KALKYAKELGVNG

SEQ ID NO: 85235 - protein, 13 aa, Borrelia burgdorferi
ALKYAKELGVNGS

SEQ ID NO: 85236 - protein, 13 aa, Borrelia burgdorferi
LKYAKELGVNGSY

SEQ ID NO: 85237 - protein, 13 aa, Borrelia burgdorferi
KYAKELGVNGSYS

SEQ ID NO: 85238 - protein, 13 aa, Borrelia burgdorferi
YAKELGVNGSYSV

SEQ ID NO: 85239 - protein, 13 aa, Borrelia burgdorferi
AKELGVNGSYSVN

SEQ ID NO: 85240 - protein, 13 aa, Borrelia burgdorferi
KELGVNGSYSVND

SEQ ID NO: 85241 - protein, 13 aa, Borrelia burgdorferi
ELGVNGSYSVNDG

SEQ ID NO: 85242 - protein, 13 aa, Borrelia burgdorferi
LGVNGSYSVNDGT

SEQ ID NO: 85243 - protein, 13 aa, Borrelia burgdorferi
GVNGSYSVNDGTN

SEQ ID NO: 85244 - protein, 13 aa, Borrelia burgdorferi
VNGSYSVNDGTNT

SEQ ID NO: 85245 - protein, 13 aa, Borrelia burgdorferi
NGSYSVNDGTNTN

SEQ ID NO: 85246 - protein, 13 aa, Borrelia burgdorferi
GSYSVNDGTNTND

SEQ ID NO: 85247 - protein, 13 aa, Borrelia burgdorferi
SYSVNDGTNTNDF

SEQ ID NO: 85248 - protein, 13 aa, Borrelia burgdorferi
YSVNDGTNTNDFV

SEQ ID NO: 85249 - protein, 13 aa, Borrelia burgdorferi
SVNDGTNTNDFVK

SEQ ID NO: 85250 - protein, 13 aa, Borrelia burgdorferi
VNDGTNTNDFVKK

SEQ ID NO: 85251 - protein, 13 aa, Borrelia burgdorferi
NDGTNTNDFVKKV

SEQ ID NO: 85252 - protein, 13 aa, Borrelia burgdorferi
DGTNTNDFVKKVI

SEQ ID NO: 85253 - protein, 13 aa, Borrelia burgdorferi
GTNTNDFVKKVID

SEQ ID NO: 85254 - protein, 13 aa, Borrelia burgdorferi
TNTNDFVKKVIDD

SEQ ID NO: 85255 - protein, 13 aa, Borrelia burgdorferi
NTNDFVKKVIDDA

SEQ ID NO: 85256 - protein, 13 aa, Borrelia burgdorferi
TNDFVKKVIDDAL

SEQ ID NO: 85257 - protein, 13 aa, Borrelia burgdorferi
NDFVKKVIDDALK

SEQ ID NO: 85258 - protein, 13 aa, Borrelia burgdorferi
DFVKKVIDDALKN

SEQ ID NO: 85259 - protein, 13 aa, Borrelia burgdorferi
FVKKVIDDALKNI

SEQ ID NO: 85260 - protein, 13 aa, Borrelia burgdorferi
VKKVIDDALKNIE

SEQ ID NO: 85261 - protein, 13 aa, Borrelia burgdorferi
KKVIDDALKNIEE

SEQ ID NO: 85262 - protein, 13 aa, Borrelia burgdorferi
KVIDDALKNIEEE

SEQ ID NO: 85263 - protein, 13 aa, Borrelia burgdorferi
VIDDALKNIEEEL

SEQ ID NO: 85264 - protein, 13 aa, Borrelia burgdorferi
IDDALKNIEEELE

SEQ ID NO: 85265 - protein, 13 aa, Borrelia burgdorferi
DDALKNIEEELEK

SEQ ID NO: 85266 - protein, 13 aa, Borrelia burgdorferi
DALKNIEEELEKL

SEQ ID NO: 85267 - protein, 13 aa, Borrelia burgdorferi
ALKNIEEELEKLA

SEQ ID NO: 85268 - protein, 13 aa, Borrelia burgdorferi
LKNIEEELEKLAE

SEQ ID NO: 85269 - protein, 13 aa, Borrelia burgdorferi
KNIEEELEKLAEP

SEQ ID NO: 85270 - protein, 13 aa, Borrelia burgdorferi
NIEEELEKLAEPQ

SEQ ID NO: 85271 - protein, 13 aa, Borrelia burgdorferi
IEEELEKLAEPQN

SEQ ID NO: 85272 - protein, 13 aa, Borrelia burgdorferi
EEELEKLAEPQNI

SEQ ID NO: 85273 - protein, 13 aa, Borrelia burgdorferi
EELEKLAEPQNIE

SEQ ID NO: 85274 - protein, 13 aa, Borrelia burgdorferi
ELEKLAEPQNIED

SEQ ID NO: 85275 - protein, 13 aa, Borrelia burgdorferi
LEKLAEPQNIEDK

SEQ ID NO: 85276 - protein, 13 aa, Borrelia burgdorferi
EKLAEPQNIEDKK

SEQ ID NO: 85277 - protein, 14 aa, Borrelia burgdorferi
MNKKMKNLIICAVF

SEQ ID NO: 85278 - protein, 14 aa, Borrelia burgdorferi
NKKMKNLIICAVFV

SEQ ID NO: 85279 - protein, 14 aa, Borrelia burgdorferi
KKMKNLIICAVFVL

SEQ ID NO: 85280 - protein, 14 aa, Borrelia burgdorferi
KMKNLIICAVFVLI

SEQ ID NO: 85281 - protein, 14 aa, Borrelia burgdorferi
MKNLIICAVFVLII

SEQ ID NO: 85282 - protein, 14 aa, Borrelia burgdorferi
KNLIICAVFVLIIS

SEQ ID NO: 85283 - protein, 14 aa, Borrelia burgdorferi
NLIICAVFVLIISC

SEQ ID NO: 85284 - protein, 14 aa, Borrelia burgdorferi
LIICAVFVLIISCK

SEQ ID NO: 85285 - protein, 14 aa, Borrelia burgdorferi
IICAVFVLIISCKI

SEQ ID NO: 85286 - protein, 14 aa, Borrelia burgdorferi
ICAVFVLIISCKID

SEQ ID NO: 85287 - protein, 14 aa, Borrelia burgdorferi
CAVFVLIISCKIDA

SEQ ID NO: 85288 - protein, 14 aa, Borrelia burgdorferi
AVFVLIISCKIDAS

SEQ ID NO: 85289 - protein, 14 aa, Borrelia burgdorferi
VFVLIISCKIDASS

SEQ ID NO: 85290 - protein, 14 aa, Borrelia burgdorferi
FVLIISCKIDASSE

SEQ ID NO: 85291 - protein, 14 aa, Borrelia burgdorferi
VLIISCKIDASSED

SEQ ID NO: 85292 - protein, 14 aa, Borrelia burgdorferi
LIISCKIDASSEDL

SEQ ID NO: 85293 - protein, 14 aa, Borrelia burgdorferi
IISCKIDASSEDLK

SEQ ID NO: 85294 - protein, 14 aa, Borrelia burgdorferi
ISCKIDASSEDLKQ

SEQ ID NO: 85295 - protein, 14 aa, Borrelia burgdorferi
SCKIDASSEDLKQN

SEQ ID NO: 85296 - protein, 14 aa, Borrelia burgdorferi
CKIDASSEDLKQNV

SEQ ID NO: 85297 - protein, 14 aa, Borrelia burgdorferi
KIDASSEDLKQNVK

SEQ ID NO: 85298 - protein, 14 aa, Borrelia burgdorferi
IDASSEDLKQNVKE

SEQ ID NO: 85299 - protein, 14 aa, Borrelia burgdorferi
DASSEDLKQNVKEK

SEQ ID NO: 85300 - protein, 14 aa, Borrelia burgdorferi
ASSEDLKQNVKEKV

SEQ ID NO: 85301 - protein, 14 aa, Borrelia burgdorferi
SSEDLKQNVKEKVE

SEQ ID NO: 85302 - protein, 14 aa, Borrelia burgdorferi
SEDLKQNVKEKVEG

SEQ ID NO: 85303 - protein, 14 aa, Borrelia burgdorferi
EDLKQNVKEKVEGF

SEQ ID NO: 85304 - protein, 14 aa, Borrelia burgdorferi
DLKQNVKEKVEGFL

SEQ ID NO: 85305 - protein, 14 aa, Borrelia burgdorferi
LKQNVKEKVEGFLD

SEQ ID NO: 85306 - protein, 14 aa, Borrelia burgdorferi
KQNVKEKVEGFLDK

SEQ ID NO: 85307 - protein, 14 aa, Borrelia burgdorferi
QNVKEKVEGFLDKE

SEQ ID NO: 85308 - protein, 14 aa, Borrelia burgdorferi
NVKEKVEGFLDKEL

SEQ ID NO: 85309 - protein, 14 aa, Borrelia burgdorferi
VKEKVEGFLDKELM

SEQ ID NO: 85310 - protein, 14 aa, Borrelia burgdorferi
KEKVEGFLDKELMQ

SEQ ID NO: 85311 - protein, 14 aa, Borrelia burgdorferi
EKVEGFLDKELMQG

SEQ ID NO: 85312 - protein, 14 aa, Borrelia burgdorferi
KVEGFLDKELMQGD

SEQ ID NO: 85313 - protein, 14 aa, Borrelia burgdorferi
VEGFLDKELMQGDD

SEQ ID NO: 85314 - protein, 14 aa, Borrelia burgdorferi
EGFLDKELMQGDDP

SEQ ID NO: 85315 - protein, 14 aa, Borrelia burgdorferi
GFLDKELMQGDDPN

SEQ ID NO: 85316 - protein, 14 aa, Borrelia burgdorferi
FLDKELMQGDDPNN

SEQ ID NO: 85317 - protein, 14 aa, Borrelia burgdorferi
LDKELMQGDDPNNS

SEQ ID NO: 85318 - protein, 14 aa, Borrelia burgdorferi
DKELMQGDDPNNSL

SEQ ID NO: 85319 - protein, 14 aa, Borrelia burgdorferi
KELMQGDDPNNSLF

SEQ ID NO: 85320 - protein, 14 aa, Borrelia burgdorferi
ELMQGDDPNNSLFN

SEQ ID NO: 85321 - protein, 14 aa, Borrelia burgdorferi
LMQGDDPNNSLFNP

SEQ ID NO: 85322 - protein, 14 aa, Borrelia burgdorferi
MQGDDPNNSLFNPP

SEQ ID NO: 85323 - protein, 14 aa, Borrelia burgdorferi
QGDDPNNSLFNPPP

SEQ ID NO: 85324 - protein, 14 aa, Borrelia burgdorferi
GDDPNNSLFNPPPV

SEQ ID NO: 85325 - protein, 14 aa, Borrelia burgdorferi
DDPNNSLFNPPPVL

SEQ ID NO: 85326 - protein, 14 aa, Borrelia burgdorferi
DPNNSLFNPPPVLP

SEQ ID NO: 85327 - protein, 14 aa, Borrelia burgdorferi
PNNSLFNPPPVLPA

SEQ ID NO: 85328 - protein, 14 aa, Borrelia burgdorferi
NNSLFNPPPVLPAS

SEQ ID NO: 85329 - protein, 14 aa, Borrelia burgdorferi
NSLFNPPPVLPASS

SEQ ID NO: 85330 - protein, 14 aa, Borrelia burgdorferi
SLFNPPPVLPASSH

SEQ ID NO: 85331 - protein, 14 aa, Borrelia burgdorferi
LFNPPPVLPASSHD

SEQ ID NO: 85332 - protein, 14 aa, Borrelia burgdorferi
FNPPPVLPASSHDN

SEQ ID NO: 85333 - protein, 14 aa, Borrelia burgdorferi
NPPPVLPASSHDNT

SEQ ID NO: 85334 - protein, 14 aa, Borrelia burgdorferi
PPPVLPASSHDNTP

SEQ ID NO: 85335 - protein, 14 aa, Borrelia burgdorferi
PPVLPASSHDNTPV

SEQ ID NO: 85336 - protein, 14 aa, Borrelia burgdorferi
PVLPASSHDNTPVL

SEQ ID NO: 85337 - protein, 14 aa, Borrelia burgdorferi
VLPASSHDNTPVLK

SEQ ID NO: 85338 - protein, 14 aa, Borrelia burgdorferi
LPASSHDNTPVLKA

SEQ ID NO: 85339 - protein, 14 aa, Borrelia burgdorferi
PASSHDNTPVLKAV

SEQ ID NO: 85340 - protein, 14 aa, Borrelia burgdorferi
ASSHDNTPVLKAVQ

SEQ ID NO: 85341 - protein, 14 aa, Borrelia burgdorferi
SSHDNTPVLKAVQA

SEQ ID NO: 85342 - protein, 14 aa, Borrelia burgdorferi
SHDNTPVLKAVQAK

SEQ ID NO: 85343 - protein, 14 aa, Borrelia burgdorferi
HDNTPVLKAVQAKD

SEQ ID NO: 85344 - protein, 14 aa, Borrelia burgdorferi
DNTPVLKAVQAKDG

SEQ ID NO: 85345 - protein, 14 aa, Borrelia burgdorferi
NTPVLKAVQAKDGG

SEQ ID NO: 85346 - protein, 14 aa, Borrelia burgdorferi
TPVLKAVQAKDGGQ

SEQ ID NO: 85347 - protein, 14 aa, Borrelia burgdorferi
PVLKAVQAKDGGQQ

SEQ ID NO: 85348 - protein, 14 aa, Borrelia burgdorferi
VLKAVQAKDGGQQE

SEQ ID NO: 85349 - protein, 14 aa, Borrelia burgdorferi
LKAVQAKDGGQQEG

SEQ ID NO: 85350 - protein, 14 aa, Borrelia burgdorferi
KAVQAKDGGQQEGK

SEQ ID NO: 85351 - protein, 14 aa, Borrelia burgdorferi
AVQAKDGGQQEGKE

SEQ ID NO: 85352 - protein, 14 aa, Borrelia burgdorferi
VQAKDGGQQEGKEE

SEQ ID NO: 85353 - protein, 14 aa, Borrelia burgdorferi
QAKDGGQQEGKEEK

SEQ ID NO: 85354 - protein, 14 aa, Borrelia burgdorferi
AKDGGQQEGKEEKE

SEQ ID NO: 85355 - protein, 14 aa, Borrelia burgdorferi
KDGGQQEGKEEKEK

SEQ ID NO: 85356 - protein, 14 aa, Borrelia burgdorferi
DGGQQEGKEEKEKE

SEQ ID NO: 85357 - protein, 14 aa, Borrelia burgdorferi
GGQQEGKEEKEKEI

SEQ ID NO: 85358 - protein, 14 aa, Borrelia burgdorferi
GQQEGKEEKEKEIQ

SEQ ID NO: 85359 - protein, 14 aa, Borrelia burgdorferi
QQEGKEEKEKEIQE

SEQ ID NO: 85360 - protein, 14 aa, Borrelia burgdorferi
QEGKEEKEKEIQEL

SEQ ID NO: 85361 - protein, 14 aa, Borrelia burgdorferi
EGKEEKEKEIQELK

SEQ ID NO: 85362 - protein, 14 aa, Borrelia burgdorferi
GKEEKEKEIQELKD

SEQ ID NO: 85363 - protein, 14 aa, Borrelia burgdorferi
KEEKEKEIQELKDK

SEQ ID NO: 85364 - protein, 14 aa, Borrelia burgdorferi
EEKEKEIQELKDKI

SEQ ID NO: 85365 - protein, 14 aa, Borrelia burgdorferi
EKEKEIQELKDKID

SEQ ID NO: 85366 - protein, 14 aa, Borrelia burgdorferi
KEKEIQELKDKIDK

SEQ ID NO: 85367 - protein, 14 aa, Borrelia burgdorferi
EKEIQELKDKIDKR

SEQ ID NO: 85368 - protein, 14 aa, Borrelia burgdorferi
KEIQELKDKIDKRK

SEQ ID NO: 85369 - protein, 14 aa, Borrelia burgdorferi
EIQELKDKIDKRKK

SEQ ID NO: 85370 - protein, 14 aa, Borrelia burgdorferi
IQELKDKIDKRKKE

SEQ ID NO: 85371 - protein, 14 aa, Borrelia burgdorferi
QELKDKIDKRKKEL

SEQ ID NO: 85372 - protein, 14 aa, Borrelia burgdorferi
ELKDKIDKRKKELE

SEQ ID NO: 85373 - protein, 14 aa, Borrelia burgdorferi
LKDKIDKRKKELEE

SEQ ID NO: 85374 - protein, 14 aa, Borrelia burgdorferi
KDKIDKRKKELEEA

SEQ ID NO: 85375 - protein, 14 aa, Borrelia burgdorferi
DKIDKRKKELEEAR

SEQ ID NO: 85376 - protein, 14 aa, Borrelia burgdorferi
KIDKRKKELEEARK

SEQ ID NO: 85377 - protein, 14 aa, Borrelia burgdorferi
IDKRKKELEEARKK

SEQ ID NO: 85378 - protein, 14 aa, Borrelia burgdorferi
DKRKKELEEARKKF

SEQ ID NO: 85379 - protein, 14 aa, Borrelia burgdorferi
KRKKELEEARKKFQ

SEQ ID NO: 85380 - protein, 14 aa, Borrelia burgdorferi
RKKELEEARKKFQE

SEQ ID NO: 85381 - protein, 14 aa, Borrelia burgdorferi
KKELEEARKKFQEF

SEQ ID NO: 85382 - protein, 14 aa, Borrelia burgdorferi
KELEEARKKFQEFK

SEQ ID NO: 85383 - protein, 14 aa, Borrelia burgdorferi
ELEEARKKFQEFKE

SEQ ID NO: 85384 - protein, 14 aa, Borrelia burgdorferi
LEEARKKFQEFKEQ

SEQ ID NO: 85385 - protein, 14 aa, Borrelia burgdorferi
EEARKKFQEFKEQV

SEQ ID NO: 85386 - protein, 14 aa, Borrelia burgdorferi
EARKKFQEFKEQVE

SEQ ID NO: 85387 - protein, 14 aa, Borrelia burgdorferi
ARKKFQEFKEQVES

SEQ ID NO: 85388 - protein, 14 aa, Borrelia burgdorferi
RKKFQEFKEQVESA

SEQ ID NO: 85389 - protein, 14 aa, Borrelia burgdorferi
KKFQEFKEQVESAT

SEQ ID NO: 85390 - protein, 14 aa, Borrelia burgdorferi
KFQEFKEQVESATG

SEQ ID NO: 85391 - protein, 14 aa, Borrelia burgdorferi
FQEFKEQVESATGE

SEQ ID NO: 85392 - protein, 14 aa, Borrelia burgdorferi
QEFKEQVESATGES

SEQ ID NO: 85393 - protein, 14 aa, Borrelia burgdorferi
EFKEQVESATGEST

SEQ ID NO: 85394 - protein, 14 aa, Borrelia burgdorferi
FKEQVESATGESTE

SEQ ID NO: 85395 - protein, 14 aa, Borrelia burgdorferi
KEQVESATGESTEK

SEQ ID NO: 85396 - protein, 14 aa, Borrelia burgdorferi
EQVESATGESTEKV

SEQ ID NO: 85397 - protein, 14 aa, Borrelia burgdorferi
QVESATGESTEKVK

SEQ ID NO: 85398 - protein, 14 aa, Borrelia burgdorferi
VESATGESTEKVKK

SEQ ID NO: 85399 - protein, 14 aa, Borrelia burgdorferi
ESATGESTEKVKKQ

SEQ ID NO: 85400 - protein, 14 aa, Borrelia burgdorferi
SATGESTEKVKKQG

SEQ ID NO: 85401 - protein, 14 aa, Borrelia burgdorferi
ATGESTEKVKKQGN

SEQ ID NO: 85402 - protein, 14 aa, Borrelia burgdorferi
TGESTEKVKKQGNI

SEQ ID NO: 85403 - protein, 14 aa, Borrelia burgdorferi
GESTEKVKKQGNIG

SEQ ID NO: 85404 - protein, 14 aa, Borrelia burgdorferi
ESTEKVKKQGNIGQ

SEQ ID NO: 85405 - protein, 14 aa, Borrelia burgdorferi
STEKVKKQGNIGQK

SEQ ID NO: 85406 - protein, 14 aa, Borrelia burgdorferi
TEKVKKQGNIGQKA

SEQ ID NO: 85407 - protein, 14 aa, Borrelia burgdorferi
EKVKKQGNIGQKAL

SEQ ID NO: 85408 - protein, 14 aa, Borrelia burgdorferi
KVKKQGNIGQKALK

SEQ ID NO: 85409 - protein, 14 aa, Borrelia burgdorferi
VKKQGNIGQKALKY

SEQ ID NO: 85410 - protein, 14 aa, Borrelia burgdorferi
KKQGNIGQKALKYA

SEQ ID NO: 85411 - protein, 14 aa, Borrelia burgdorferi
KQGNIGQKALKYAK

SEQ ID NO: 85412 - protein, 14 aa, Borrelia burgdorferi
QGNIGQKALKYAKE

SEQ ID NO: 85413 - protein, 14 aa, Borrelia burgdorferi
GNIGQKALKYAKEL

SEQ ID NO: 85414 - protein, 14 aa, Borrelia burgdorferi
NIGQKALKYAKELG

SEQ ID NO: 85415 - protein, 14 aa, Borrelia burgdorferi
IGQKALKYAKELGV

SEQ ID NO: 85416 - protein, 14 aa, Borrelia burgdorferi
GQKALKYAKELGVN

SEQ ID NO: 85417 - protein, 14 aa, Borrelia burgdorferi
QKALKYAKELGVNG

SEQ ID NO: 85418 - protein, 14 aa, Borrelia burgdorferi
KALKYAKELGVNGS

SEQ ID NO: 85419 - protein, 14 aa, Borrelia burgdorferi
ALKYAKELGVNGSY

SEQ ID NO: 85420 - protein, 14 aa, Borrelia burgdorferi
LKYAKELGVNGSYS

SEQ ID NO: 85421 - protein, 14 aa, Borrelia burgdorferi
KYAKELGVNGSYSV

SEQ ID NO: 85422 - protein, 14 aa, Borrelia burgdorferi
YAKELGVNGSYSVN

SEQ ID NO: 85423 - protein, 14 aa, Borrelia burgdorferi
AKELGVNGSYSVND

SEQ ID NO: 85424 - protein, 14 aa, Borrelia burgdorferi
KELGVNGSYSVNDG

SEQ ID NO: 85425 - protein, 14 aa, Borrelia burgdorferi
ELGVNGSYSVNDGT

SEQ ID NO: 85426 - protein, 14 aa, Borrelia burgdorferi
LGVNGSYSVNDGTN

SEQ ID NO: 85427 - protein, 14 aa, Borrelia burgdorferi
GVNGSYSVNDGTNT

SEQ ID NO: 85428 - protein, 14 aa, Borrelia burgdorferi
VNGSYSVNDGTNTN

SEQ ID NO: 85429 - protein, 14 aa, Borrelia burgdorferi
NGSYSVNDGTNTND

SEQ ID NO: 85430 - protein, 14 aa, Borrelia burgdorferi
GSYSVNDGTNTNDF

SEQ ID NO: 85431 - protein, 14 aa, Borrelia burgdorferi
SYSVNDGTNTNDFV

SEQ ID NO: 85432 - protein, 14 aa, Borrelia burgdorferi
YSVNDGTNTNDFVK

SEQ ID NO: 85433 - protein, 14 aa, Borrelia burgdorferi
SVNDGTNTNDFVKK

SEQ ID NO: 85434 - protein, 14 aa, Borrelia burgdorferi
VNDGTNTNDFVKKV

SEQ ID NO: 85435 - protein, 14 aa, Borrelia burgdorferi
NDGTNTNDFVKKVI

SEQ ID NO: 85436 - protein, 14 aa, Borrelia burgdorferi
DGTNTNDFVKKVID

SEQ ID NO: 85437 - protein, 14 aa, Borrelia burgdorferi
GTNTNDFVKKVIDD

SEQ ID NO: 85438 - protein, 14 aa, Borrelia burgdorferi
TNTNDFVKKVIDDA

SEQ ID NO: 85439 - protein, 14 aa, Borrelia burgdorferi
NTNDFVKKVIDDAL

SEQ ID NO: 85440 - protein, 14 aa, Borrelia burgdorferi
TNDFVKKVIDDALK

SEQ ID NO: 85441 - protein, 14 aa, Borrelia burgdorferi
NDFVKKVIDDALKN

SEQ ID NO: 85442 - protein, 14 aa, Borrelia burgdorferi
DFVKKVIDDALKNI

SEQ ID NO: 85443 - protein, 14 aa, Borrelia burgdorferi
FVKKVIDDALKNIE

SEQ ID NO: 85444 - protein, 14 aa, Borrelia burgdorferi
VKKVIDDALKNIEE

SEQ ID NO: 85445 - protein, 14 aa, Borrelia burgdorferi
KKVIDDALKNIEEE

SEQ ID NO: 85446 - protein, 14 aa, Borrelia burgdorferi
KVIDDALKNIEEEL

SEQ ID NO: 85447 - protein, 14 aa, Borrelia burgdorferi
VIDDALKNIEEELE

SEQ ID NO: 85448 - protein, 14 aa, Borrelia burgdorferi
IDDALKNIEEELEK

SEQ ID NO: 85449 - protein, 14 aa, Borrelia burgdorferi
DDALKNIEEELEKL

SEQ ID NO: 85450 - protein, 14 aa, Borrelia burgdorferi
DALKNIEEELEKLA

SEQ ID NO: 85451 - protein, 14 aa, Borrelia burgdorferi
ALKNIEEELEKLAE

SEQ ID NO: 85452 - protein, 14 aa, Borrelia burgdorferi
LKNIEEELEKLAEP

SEQ ID NO: 85453 - protein, 14 aa, Borrelia burgdorferi
KNIEEELEKLAEPQ

SEQ ID NO: 85454 - protein, 14 aa, Borrelia burgdorferi
NIEEELEKLAEPQN

SEQ ID NO: 85455 - protein, 14 aa, Borrelia burgdorferi
IEEELEKLAEPQNI

SEQ ID NO: 85456 - protein, 14 aa, Borrelia burgdorferi
EEELEKLAEPQNIE

SEQ ID NO: 85457 - protein, 14 aa, Borrelia burgdorferi
EELEKLAEPQNIED

SEQ ID NO: 85458 - protein, 14 aa, Borrelia burgdorferi
ELEKLAEPQNIEDK

SEQ ID NO: 85459 - protein, 14 aa, Borrelia burgdorferi
LEKLAEPQNIEDKK

SEQ ID NO: 85460 - protein, 15 aa, Borrelia burgdorferi
MNKKMKNLIICAVFV

SEQ ID NO: 85461 - protein, 15 aa, Borrelia burgdorferi
NKKMKNLIICAVFVL

SEQ ID NO: 85462 - protein, 15 aa, Borrelia burgdorferi
KKMKNLIICAVFVLI

SEQ ID NO: 85463 - protein, 15 aa, Borrelia burgdorferi
KMKNLIICAVFVLII

SEQ ID NO: 85464 - protein, 15 aa, Borrelia burgdorferi
MKNLIICAVFVLIIS

SEQ ID NO: 85465 - protein, 15 aa, Borrelia burgdorferi
KNLIICAVFVLIISC

SEQ ID NO: 85466 - protein, 15 aa, Borrelia burgdorferi
NLIICAVFVLIISCK

SEQ ID NO: 85467 - protein, 15 aa, Borrelia burgdorferi
LIICAVFVLIISCKI

SEQ ID NO: 85468 - protein, 15 aa, Borrelia burgdorferi
IICAVFVLIISCKID

SEQ ID NO: 85469 - protein, 15 aa, Borrelia burgdorferi
ICAVFVLIISCKIDA

SEQ ID NO: 85470 - protein, 15 aa, Borrelia burgdorferi
CAVFVLIISCKIDAS

SEQ ID NO: 85471 - protein, 15 aa, Borrelia burgdorferi
AVFVLIISCKIDASS

SEQ ID NO: 85472 - protein, 15 aa, Borrelia burgdorferi
VFVLIISCKIDASSE

SEQ ID NO: 85473 - protein, 15 aa, Borrelia burgdorferi
FVLIISCKIDASSED

SEQ ID NO: 85474 - protein, 15 aa, Borrelia burgdorferi
VLIISCKIDASSEDL

SEQ ID NO: 85475 - protein, 15 aa, Borrelia burgdorferi
LIISCKIDASSEDLK

SEQ ID NO: 85476 - protein, 15 aa, Borrelia burgdorferi
IISCKIDASSEDLKQ

SEQ ID NO: 85477 - protein, 15 aa, Borrelia burgdorferi
ISCKIDASSEDLKQN

SEQ ID NO: 85478 - protein, 15 aa, Borrelia burgdorferi
SCKIDASSEDLKQNV

SEQ ID NO: 85479 - protein, 15 aa, Borrelia burgdorferi
CKIDASSEDLKQNVK

SEQ ID NO: 85480 - protein, 15 aa, Borrelia burgdorferi
KIDASSEDLKQNVKE

SEQ ID NO: 85481 - protein, 15 aa, Borrelia burgdorferi
IDASSEDLKQNVKEK

SEQ ID NO: 85482 - protein, 15 aa, Borrelia burgdorferi
DASSEDLKQNVKEKV

SEQ ID NO: 85483 - protein, 15 aa, Borrelia burgdorferi
ASSEDLKQNVKEKVE

SEQ ID NO: 85484 - protein, 15 aa, Borrelia burgdorferi
SSEDLKQNVKEKVEG

SEQ ID NO: 85485 - protein, 15 aa, Borrelia burgdorferi
SEDLKQNVKEKVEGF

SEQ ID NO: 85486 - protein, 15 aa, Borrelia burgdorferi
EDLKQNVKEKVEGFL

SEQ ID NO: 85487 - protein, 15 aa, Borrelia burgdorferi
DLKQNVKEKVEGFLD

SEQ ID NO: 85488 - protein, 15 aa, Borrelia burgdorferi
LKQNVKEKVEGFLDK

SEQ ID NO: 85489 - protein, 15 aa, Borrelia burgdorferi
KQNVKEKVEGFLDKE

SEQ ID NO: 85490 - protein, 15 aa, Borrelia burgdorferi
QNVKEKVEGFLDKEL

SEQ ID NO: 85491 - protein, 15 aa, Borrelia burgdorferi
NVKEKVEGFLDKELM

SEQ ID NO: 85492 - protein, 15 aa, Borrelia burgdorferi
VKEKVEGFLDKELMQ

SEQ ID NO: 85493 - protein, 15 aa, Borrelia burgdorferi
KEKVEGFLDKELMQG

SEQ ID NO: 85494 - protein, 15 aa, Borrelia burgdorferi
EKVEGFLDKELMQGD

SEQ ID NO: 85495 - protein, 15 aa, Borrelia burgdorferi
KVEGFLDKELMQGDD

SEQ ID NO: 85496 - protein, 15 aa, Borrelia burgdorferi
VEGFLDKELMQGDDP

SEQ ID NO: 85497 - protein, 15 aa, Borrelia burgdorferi
EGFLDKELMQGDDPN

SEQ ID NO: 85498 - protein, 15 aa, Borrelia burgdorferi
GFLDKELMQGDDPNN

SEQ ID NO: 85499 - protein, 15 aa, Borrelia burgdorferi
FLDKELMQGDDPNNS

SEQ ID NO: 85500 - protein, 15 aa, Borrelia burgdorferi
LDKELMQGDDPNNSL

SEQ ID NO: 85501 - protein, 15 aa, Borrelia burgdorferi
DKELMQGDDPNNSLF

SEQ ID NO: 85502 - protein, 15 aa, Borrelia burgdorferi
KELMQGDDPNNSLFN

SEQ ID NO: 85503 - protein, 15 aa, Borrelia burgdorferi
ELMQGDDPNNSLFNP

SEQ ID NO: 85504 - protein, 15 aa, Borrelia burgdorferi
LMQGDDPNNSLFNPP

SEQ ID NO: 85505 - protein, 15 aa, Borrelia burgdorferi
MQGDDPNNSLFNPPP

SEQ ID NO: 85506 - protein, 15 aa, Borrelia burgdorferi
QGDDPNNSLFNPPPV

SEQ ID NO: 85507 - protein, 15 aa, Borrelia burgdorferi
GDDPNNSLFNPPPVL

SEQ ID NO: 85508 - protein, 15 aa, Borrelia burgdorferi
DDPNNSLFNPPPVLP

SEQ ID NO: 85509 - protein, 15 aa, Borrelia burgdorferi
DPNNSLFNPPPVLPA

SEQ ID NO: 85510 - protein, 15 aa, Borrelia burgdorferi
PNNSLFNPPPVLPAS

SEQ ID NO: 85511 - protein, 15 aa, Borrelia burgdorferi
NNSLFNPPPVLPASS

SEQ ID NO: 85512 - protein, 15 aa, Borrelia burgdorferi
NSLFNPPPVLPASSH

SEQ ID NO: 85513 - protein, 15 aa, Borrelia burgdorferi
SLFNPPPVLPASSHD

SEQ ID NO: 85514 - protein, 15 aa, Borrelia burgdorferi
LFNPPPVLPASSHDN

SEQ ID NO: 85515 - protein, 15 aa, Borrelia burgdorferi
FNPPPVLPASSHDNT

SEQ ID NO: 85516 - protein, 15 aa, Borrelia burgdorferi
NPPPVLPASSHDNTP

SEQ ID NO: 85517 - protein, 15 aa, Borrelia burgdorferi
PPPVLPASSHDNTPV

SEQ ID NO: 85518 - protein, 15 aa, Borrelia burgdorferi
PPVLPASSHDNTPVL

SEQ ID NO: 85519 - protein, 15 aa, Borrelia burgdorferi
PVLPASSHDNTPVLK

SEQ ID NO: 85520 - protein, 15 aa, Borrelia burgdorferi
VLPASSHDNTPVLKA

SEQ ID NO: 85521 - protein, 15 aa, Borrelia burgdorferi
LPASSHDNTPVLKAV

SEQ ID NO: 85522 - protein, 15 aa, Borrelia burgdorferi
PASSHDNTPVLKAVQ

SEQ ID NO: 85523 - protein, 15 aa, Borrelia burgdorferi
ASSHDNTPVLKAVQA

SEQ ID NO: 85524 - protein, 15 aa, Borrelia burgdorferi
SSHDNTPVLKAVQAK

SEQ ID NO: 85525 - protein, 15 aa, Borrelia burgdorferi
SHDNTPVLKAVQAKD

SEQ ID NO: 85526 - protein, 15 aa, Borrelia burgdorferi
HDNTPVLKAVQAKDG

SEQ ID NO: 85527 - protein, 15 aa, Borrelia burgdorferi
DNTPVLKAVQAKDGG

SEQ ID NO: 85528 - protein, 15 aa, Borrelia burgdorferi
NTPVLKAVQAKDGGQ

SEQ ID NO: 85529 - protein, 15 aa, Borrelia burgdorferi
TPVLKAVQAKDGGQQ

SEQ ID NO: 85530 - protein, 15 aa, Borrelia burgdorferi
PVLKAVQAKDGGQQE

SEQ ID NO: 85531 - protein, 15 aa, Borrelia burgdorferi
VLKAVQAKDGGQQEG

SEQ ID NO: 85532 - protein, 15 aa, Borrelia burgdorferi
LKAVQAKDGGQQEGK

SEQ ID NO: 85533 - protein, 15 aa, Borrelia burgdorferi
KAVQAKDGGQQEGKE

SEQ ID NO: 85534 - protein, 15 aa, Borrelia burgdorferi
AVQAKDGGQQEGKEE

SEQ ID NO: 85535 - protein, 15 aa, Borrelia burgdorferi
VQAKDGGQQEGKEEK

SEQ ID NO: 85536 - protein, 15 aa, Borrelia burgdorferi
QAKDGGQQEGKEEKE

SEQ ID NO: 85537 - protein, 15 aa, Borrelia burgdorferi
AKDGGQQEGKEEKEK

SEQ ID NO: 85538 - protein, 15 aa, Borrelia burgdorferi
KDGGQQEGKEEKEKE

SEQ ID NO: 85539 - protein, 15 aa, Borrelia burgdorferi
DGGQQEGKEEKEKEI

SEQ ID NO: 85540 - protein, 15 aa, Borrelia burgdorferi
GGQQEGKEEKEKEIQ

SEQ ID NO: 85541 - protein, 15 aa, Borrelia burgdorferi
GQQEGKEEKEKEIQE

SEQ ID NO: 85542 - protein, 15 aa, Borrelia burgdorferi
QQEGKEEKEKEIQEL

SEQ ID NO: 85543 - protein, 15 aa, Borrelia burgdorferi
QEGKEEKEKEIQELK

SEQ ID NO: 85544 - protein, 15 aa, Borrelia burgdorferi
EGKEEKEKEIQELKD

SEQ ID NO: 85545 - protein, 15 aa, Borrelia burgdorferi
GKEEKEKEIQELKDK

SEQ ID NO: 85546 - protein, 15 aa, Borrelia burgdorferi
KEEKEKEIQELKDKI

SEQ ID NO: 85547 - protein, 15 aa, Borrelia burgdorferi
EEKEKEIQELKDKID

SEQ ID NO: 85548 - protein, 15 aa, Borrelia burgdorferi
EKEKEIQELKDKIDK

SEQ ID NO: 85549 - protein, 15 aa, Borrelia burgdorferi
KEKEIQELKDKIDKR

SEQ ID NO: 85550 - protein, 15 aa, Borrelia burgdorferi
EKEIQELKDKIDKRK

SEQ ID NO: 85551 - protein, 15 aa, Borrelia burgdorferi
KEIQELKDKIDKRKK

SEQ ID NO: 85552 - protein, 15 aa, Borrelia burgdorferi
EIQELKDKIDKRKKE

SEQ ID NO: 85553 - protein, 15 aa, Borrelia burgdorferi
IQELKDKIDKRKKEL

SEQ ID NO: 85554 - protein, 15 aa, Borrelia burgdorferi
QELKDKIDKRKKELE

SEQ ID NO: 85555 - protein, 15 aa, Borrelia burgdorferi
ELKDKIDKRKKELEE

SEQ ID NO: 85556 - protein, 15 aa, Borrelia burgdorferi
LKDKIDKRKKELEEA

SEQ ID NO: 85557 - protein, 15 aa, Borrelia burgdorferi
KDKIDKRKKELEEAR

SEQ ID NO: 85558 - protein, 15 aa, Borrelia burgdorferi
DKIDKRKKELEEARK

SEQ ID NO: 85559 - protein, 15 aa, Borrelia burgdorferi
KIDKRKKELEEARKK

SEQ ID NO: 85560 - protein, 15 aa, Borrelia burgdorferi
IDKRKKELEEARKKF

SEQ ID NO: 85561 - protein, 15 aa, Borrelia burgdorferi
DKRKKELEEARKKFQ

SEQ ID NO: 85562 - protein, 15 aa, Borrelia burgdorferi
KRKKELEEARKKFQE

SEQ ID NO: 85563 - protein, 15 aa, Borrelia burgdorferi
RKKELEEARKKFQEF

SEQ ID NO: 85564 - protein, 15 aa, Borrelia burgdorferi
KKELEEARKKFQEFK

SEQ ID NO: 85565 - protein, 15 aa, Borrelia burgdorferi
KELEEARKKFQEFKE

SEQ ID NO: 85566 - protein, 15 aa, Borrelia burgdorferi
ELEEARKKFQEFKEQ

SEQ ID NO: 85567 - protein, 15 aa, Borrelia burgdorferi
LEEARKKFQEFKEQV

SEQ ID NO: 85568 - protein, 15 aa, Borrelia burgdorferi
EEARKKFQEFKEQVE

SEQ ID NO: 85569 - protein, 15 aa, Borrelia burgdorferi
EARKKFQEFKEQVES

SEQ ID NO: 85570 - protein, 15 aa, Borrelia burgdorferi
ARKKFQEFKEQVESA

SEQ ID NO: 85571 - protein, 15 aa, Borrelia burgdorferi
RKKFQEFKEQVESAT

SEQ ID NO: 85572 - protein, 15 aa, Borrelia burgdorferi
KKFQEFKEQVESATG

SEQ ID NO: 85573 - protein, 15 aa, Borrelia burgdorferi
KFQEFKEQVESATGE

SEQ ID NO: 85574 - protein, 15 aa, Borrelia burgdorferi
FQEFKEQVESATGES

SEQ ID NO: 85575 - protein, 15 aa, Borrelia burgdorferi
QEFKEQVESATGEST

SEQ ID NO: 85576 - protein, 15 aa, Borrelia burgdorferi
EFKEQVESATGESTE

SEQ ID NO: 85577 - protein, 15 aa, Borrelia burgdorferi
FKEQVESATGESTEK

SEQ ID NO: 85578 - protein, 15 aa, Borrelia burgdorferi
KEQVESATGESTEKV

SEQ ID NO: 85579 - protein, 15 aa, Borrelia burgdorferi
EQVESATGESTEKVK

SEQ ID NO: 85580 - protein, 15 aa, Borrelia burgdorferi
QVESATGESTEKVKK

SEQ ID NO: 85581 - protein, 15 aa, Borrelia burgdorferi
VESATGESTEKVKKQ

SEQ ID NO: 85582 - protein, 15 aa, Borrelia burgdorferi
ESATGESTEKVKKQG

SEQ ID NO: 85583 - protein, 15 aa, Borrelia burgdorferi
SATGESTEKVKKQGN

SEQ ID NO: 85584 - protein, 15 aa, Borrelia burgdorferi
ATGESTEKVKKQGNI

SEQ ID NO: 85585 - protein, 15 aa, Borrelia burgdorferi
TGESTEKVKKQGNIG

SEQ ID NO: 85586 - protein, 15 aa, Borrelia burgdorferi
GESTEKVKKQGNIGQ

SEQ ID NO: 85587 - protein, 15 aa, Borrelia burgdorferi
ESTEKVKKQGNIGQK

SEQ ID NO: 85588 - protein, 15 aa, Borrelia burgdorferi
STEKVKKQGNIGQKA

SEQ ID NO: 85589 - protein, 15 aa, Borrelia burgdorferi
TEKVKKQGNIGQKAL

SEQ ID NO: 85590 - protein, 15 aa, Borrelia burgdorferi
EKVKKQGNIGQKALK

SEQ ID NO: 85591 - protein, 15 aa, Borrelia burgdorferi
KVKKQGNIGQKALKY

SEQ ID NO: 85592 - protein, 15 aa, Borrelia burgdorferi
VKKQGNIGQKALKYA

SEQ ID NO: 85593 - protein, 15 aa, Borrelia burgdorferi
KKQGNIGQKALKYAK

SEQ ID NO: 85594 - protein, 15 aa, Borrelia burgdorferi
KQGNIGQKALKYAKE

SEQ ID NO: 85595 - protein, 15 aa, Borrelia burgdorferi
QGNIGQKALKYAKEL

SEQ ID NO: 85596 - protein, 15 aa, Borrelia burgdorferi
GNIGQKALKYAKELG

SEQ ID NO: 85597 - protein, 15 aa, Borrelia burgdorferi
NIGQKALKYAKELGV

SEQ ID NO: 85598 - protein, 15 aa, Borrelia burgdorferi
IGQKALKYAKELGVN

SEQ ID NO: 85599 - protein, 15 aa, Borrelia burgdorferi
GQKALKYAKELGVNG

SEQ ID NO: 85600 - protein, 15 aa, Borrelia burgdorferi
QKALKYAKELGVNGS

SEQ ID NO: 85601 - protein, 15 aa, Borrelia burgdorferi
KALKYAKELGVNGSY

SEQ ID NO: 85602 - protein, 15 aa, Borrelia burgdorferi
ALKYAKELGVNGSYS

SEQ ID NO: 85603 - protein, 15 aa, Borrelia burgdorferi
LKYAKELGVNGSYSV

SEQ ID NO: 85604 - protein, 15 aa, Borrelia burgdorferi
KYAKELGVNGSYSVN

SEQ ID NO: 85605 - protein, 15 aa, Borrelia burgdorferi
YAKELGVNGSYSVND

SEQ ID NO: 85606 - protein, 15 aa, Borrelia burgdorferi
AKELGVNGSYSVNDG

SEQ ID NO: 85607 - protein, 15 aa, Borrelia burgdorferi
KELGVNGSYSVNDGT

SEQ ID NO: 85608 - protein, 15 aa, Borrelia burgdorferi
ELGVNGSYSVNDGTN

SEQ ID NO: 85609 - protein, 15 aa, Borrelia burgdorferi
LGVNGSYSVNDGTNT

SEQ ID NO: 85610 - protein, 15 aa, Borrelia burgdorferi
GVNGSYSVNDGTNTN

SEQ ID NO: 85611 - protein, 15 aa, Borrelia burgdorferi
VNGSYSVNDGTNTND

SEQ ID NO: 85612 - protein, 15 aa, Borrelia burgdorferi
NGSYSVNDGTNTNDF

SEQ ID NO: 85613 - protein, 15 aa, Borrelia burgdorferi
GSYSVNDGTNTNDFV

SEQ ID NO: 85614 - protein, 15 aa, Borrelia burgdorferi
SYSVNDGTNTNDFVK

SEQ ID NO: 85615 - protein, 15 aa, Borrelia burgdorferi
YSVNDGTNTNDFVKK

SEQ ID NO: 85616 - protein, 15 aa, Borrelia burgdorferi
SVNDGTNTNDFVKKV

SEQ ID NO: 85617 - protein, 15 aa, Borrelia burgdorferi
VNDGTNTNDFVKKVI

SEQ ID NO: 85618 - protein, 15 aa, Borrelia burgdorferi
NDGTNTNDFVKKVID

SEQ ID NO: 85619 - protein, 15 aa, Borrelia burgdorferi
DGTNTNDFVKKVIDD

SEQ ID NO: 85620 - protein, 15 aa, Borrelia burgdorferi
GTNTNDFVKKVIDDA

SEQ ID NO: 85621 - protein, 15 aa, Borrelia burgdorferi
TNTNDFVKKVIDDAL

SEQ ID NO: 85622 - protein, 15 aa, Borrelia burgdorferi
NTNDFVKKVIDDALK

SEQ ID NO: 85623 - protein, 15 aa, Borrelia burgdorferi
TNDFVKKVIDDALKN

SEQ ID NO: 85624 - protein, 15 aa, Borrelia burgdorferi
NDFVKKVIDDALKNI

SEQ ID NO: 85625 - protein, 15 aa, Borrelia burgdorferi
DFVKKVIDDALKNIE

SEQ ID NO: 85626 - protein, 15 aa, Borrelia burgdorferi
FVKKVIDDALKNIEE

SEQ ID NO: 85627 - protein, 15 aa, Borrelia burgdorferi
VKKVIDDALKNIEEE

SEQ ID NO: 85628 - protein, 15 aa, Borrelia burgdorferi
KKVIDDALKNIEEEL

SEQ ID NO: 85629 - protein, 15 aa, Borrelia burgdorferi
KVIDDALKNIEEELE

SEQ ID NO: 85630 - protein, 15 aa, Borrelia burgdorferi
VIDDALKNIEEELEK

SEQ ID NO: 85631 - protein, 15 aa, Borrelia burgdorferi
IDDALKNIEEELEKL

SEQ ID NO: 85632 - protein, 15 aa, Borrelia burgdorferi
DDALKNIEEELEKLA

SEQ ID NO: 85633 - protein, 15 aa, Borrelia burgdorferi
DALKNIEEELEKLAE

SEQ ID NO: 85634 - protein, 15 aa, Borrelia burgdorferi
ALKNIEEELEKLAEP

SEQ ID NO: 85635 - protein, 15 aa, Borrelia burgdorferi
LKNIEEELEKLAEPQ

SEQ ID NO: 85636 - protein, 15 aa, Borrelia burgdorferi
KNIEEELEKLAEPQN

SEQ ID NO: 85637 - protein, 15 aa, Borrelia burgdorferi
NIEEELEKLAEPQNI

SEQ ID NO: 85638 - protein, 15 aa, Borrelia burgdorferi
IEEELEKLAEPQNIE

SEQ ID NO: 85639 - protein, 15 aa, Borrelia burgdorferi
EEELEKLAEPQNIED

SEQ ID NO: 85640 - protein, 15 aa, Borrelia burgdorferi
EELEKLAEPQNIEDK

SEQ ID NO: 85641 - protein, 15 aa, Borrelia burgdorferi
ELEKLAEPQNIEDKK

SEQ ID NO: 85642 - protein, 16 aa, Borrelia burgdorferi
MNKKMKNLIICAVFVL

SEQ ID NO: 85643 - protein, 16 aa, Borrelia burgdorferi
NKKMKNLIICAVFVLI

SEQ ID NO: 85644 - protein, 16 aa, Borrelia burgdorferi
KKMKNLIICAVFVLII

SEQ ID NO: 85645 - protein, 16 aa, Borrelia burgdorferi
KMKNLIICAVFVLIIS

SEQ ID NO: 85646 - protein, 16 aa, Borrelia burgdorferi
MKNLIICAVFVLIISC

SEQ ID NO: 85647 - protein, 16 aa, Borrelia burgdorferi
KNLIICAVFVLIISCK

SEQ ID NO: 85648 - protein, 16 aa, Borrelia burgdorferi
NLIICAVFVLIISCKI

SEQ ID NO: 85649 - protein, 16 aa, Borrelia burgdorferi
LIICAVFVLIISCKID

SEQ ID NO: 85650 - protein, 16 aa, Borrelia burgdorferi
IICAVFVLIISCKIDA

SEQ ID NO: 85651 - protein, 16 aa, Borrelia burgdorferi
ICAVFVLIISCKIDAS

SEQ ID NO: 85652 - protein, 16 aa, Borrelia burgdorferi
CAVFVLIISCKIDASS

SEQ ID NO: 85653 - protein, 16 aa, Borrelia burgdorferi
AVFVLIISCKIDASSE

SEQ ID NO: 85654 - protein, 16 aa, Borrelia burgdorferi
VFVLIISCKIDASSED

SEQ ID NO: 85655 - protein, 16 aa, Borrelia burgdorferi
FVLIISCKIDASSEDL

SEQ ID NO: 85656 - protein, 16 aa, Borrelia burgdorferi
VLIISCKIDASSEDLK

SEQ ID NO: 85657 - protein, 16 aa, Borrelia burgdorferi
LIISCKIDASSEDLKQ

SEQ ID NO: 85658 - protein, 16 aa, Borrelia burgdorferi
IISCKIDASSEDLKQN

SEQ ID NO: 85659 - protein, 16 aa, Borrelia burgdorferi
ISCKIDASSEDLKQNV

SEQ ID NO: 85660 - protein, 16 aa, Borrelia burgdorferi
SCKIDASSEDLKQNVK

SEQ ID NO: 85661 - protein, 16 aa, Borrelia burgdorferi
CKIDASSEDLKQNVKE

SEQ ID NO: 85662 - protein, 16 aa, Borrelia burgdorferi
KIDASSEDLKQNVKEK

SEQ ID NO: 85663 - protein, 16 aa, Borrelia burgdorferi
IDASSEDLKQNVKEKV

SEQ ID NO: 85664 - protein, 16 aa, Borrelia burgdorferi
DASSEDLKQNVKEKVE

SEQ ID NO: 85665 - protein, 16 aa, Borrelia burgdorferi
ASSEDLKQNVKEKVEG

SEQ ID NO: 85666 - protein, 16 aa, Borrelia burgdorferi
SSEDLKQNVKEKVEGF

SEQ ID NO: 85667 - protein, 16 aa, Borrelia burgdorferi
SEDLKQNVKEKVEGFL

SEQ ID NO: 85668 - protein, 16 aa, Borrelia burgdorferi
EDLKQNVKEKVEGFLD

SEQ ID NO: 85669 - protein, 16 aa, Borrelia burgdorferi
DLKQNVKEKVEGFLDK

SEQ ID NO: 85670 - protein, 16 aa, Borrelia burgdorferi
LKQNVKEKVEGFLDKE

SEQ ID NO: 85671 - protein, 16 aa, Borrelia burgdorferi
KQNVKEKVEGFLDKEL

SEQ ID NO: 85672 - protein, 16 aa, Borrelia burgdorferi
QNVKEKVEGFLDKELM

SEQ ID NO: 85673 - protein, 16 aa, Borrelia burgdorferi
NVKEKVEGFLDKELMQ

SEQ ID NO: 85674 - protein, 16 aa, Borrelia burgdorferi
VKEKVEGFLDKELMQG

SEQ ID NO: 85675 - protein, 16 aa, Borrelia burgdorferi
KEKVEGFLDKELMQGD

SEQ ID NO: 85676 - protein, 16 aa, Borrelia burgdorferi
EKVEGFLDKELMQGDD

SEQ ID NO: 85677 - protein, 16 aa, Borrelia burgdorferi
KVEGFLDKELMQGDDP

SEQ ID NO: 85678 - protein, 16 aa, Borrelia burgdorferi
VEGFLDKELMQGDDPN

SEQ ID NO: 85679 - protein, 16 aa, Borrelia burgdorferi
EGFLDKELMQGDDPNN

SEQ ID NO: 85680 - protein, 16 aa, Borrelia burgdorferi
GFLDKELMQGDDPNNS

SEQ ID NO: 85681 - protein, 16 aa, Borrelia burgdorferi
FLDKELMQGDDPNNSL

SEQ ID NO: 85682 - protein, 16 aa, Borrelia burgdorferi
LDKELMQGDDPNNSLF

SEQ ID NO: 85683 - protein, 16 aa, Borrelia burgdorferi
DKELMQGDDPNNSLFN

SEQ ID NO: 85684 - protein, 16 aa, Borrelia burgdorferi
KELMQGDDPNNSLFNP

SEQ ID NO: 85685 - protein, 16 aa, Borrelia burgdorferi
ELMQGDDPNNSLFNPP

SEQ ID NO: 85686 - protein, 16 aa, Borrelia burgdorferi
LMQGDDPNNSLFNPPP

SEQ ID NO: 85687 - protein, 16 aa, Borrelia burgdorferi
MQGDDPNNSLFNPPPV

SEQ ID NO: 85688 - protein, 16 aa, Borrelia burgdorferi
QGDDPNNSLFNPPPVL

SEQ ID NO: 85689 - protein, 16 aa, Borrelia burgdorferi
GDDPNNSLFNPPPVLP

SEQ ID NO: 85690 - protein, 16 aa, Borrelia burgdorferi
DDPNNSLFNPPPVLPA

SEQ ID NO: 85691 - protein, 16 aa, Borrelia burgdorferi
DPNNSLFNPPPVLPAS

SEQ ID NO: 85692 - protein, 16 aa, Borrelia burgdorferi
PNNSLFNPPPVLPASS

SEQ ID NO: 85693 - protein, 16 aa, Borrelia burgdorferi
NNSLFNPPPVLPASSH

SEQ ID NO: 85694 - protein, 16 aa, Borrelia burgdorferi
NSLFNPPPVLPASSHD

SEQ ID NO: 85695 - protein, 16 aa, Borrelia burgdorferi
SLFNPPPVLPASSHDN

SEQ ID NO: 85696 - protein, 16 aa, Borrelia burgdorferi
LFNPPPVLPASSHDNT

SEQ ID NO: 85697 - protein, 16 aa, Borrelia burgdorferi
FNPPPVLPASSHDNTP

SEQ ID NO: 85698 - protein, 16 aa, Borrelia burgdorferi
NPPPVLPASSHDNTPV

SEQ ID NO: 85699 - protein, 16 aa, Borrelia burgdorferi
PPPVLPASSHDNTPVL

SEQ ID NO: 85700 - protein, 16 aa, Borrelia burgdorferi
PPVLPASSHDNTPVLK

SEQ ID NO: 85701 - protein, 16 aa, Borrelia burgdorferi
PVLPASSHDNTPVLKA

SEQ ID NO: 85702 - protein, 16 aa, Borrelia burgdorferi
VLPASSHDNTPVLKAV

SEQ ID NO: 85703 - protein, 16 aa, Borrelia burgdorferi
LPASSHDNTPVLKAVQ

SEQ ID NO: 85704 - protein, 16 aa, Borrelia burgdorferi
PASSHDNTPVLKAVQA

SEQ ID NO: 85705 - protein, 16 aa, Borrelia burgdorferi
ASSHDNTPVLKAVQAK

SEQ ID NO: 85706 - protein, 16 aa, Borrelia burgdorferi
SSHDNTPVLKAVQAKD

SEQ ID NO: 85707 - protein, 16 aa, Borrelia burgdorferi
SHDNTPVLKAVQAKDG

SEQ ID NO: 85708 - protein, 16 aa, Borrelia burgdorferi
HDNTPVLKAVQAKDGG

SEQ ID NO: 85709 - protein, 16 aa, Borrelia burgdorferi
DNTPVLKAVQAKDGGQ

SEQ ID NO: 85710 - protein, 16 aa, Borrelia burgdorferi
NTPVLKAVQAKDGGQQ

SEQ ID NO: 85711 - protein, 16 aa, Borrelia burgdorferi
TPVLKAVQAKDGGQQE

SEQ ID NO: 85712 - protein, 16 aa, Borrelia burgdorferi
PVLKAVQAKDGGQQEG

SEQ ID NO: 85713 - protein, 16 aa, Borrelia burgdorferi
VLKAVQAKDGGQQEGK

SEQ ID NO: 85714 - protein, 16 aa, Borrelia burgdorferi
LKAVQAKDGGQQEGKE

SEQ ID NO: 85715 - protein, 16 aa, Borrelia burgdorferi
KAVQAKDGGQQEGKEE

SEQ ID NO: 85716 - protein, 16 aa, Borrelia burgdorferi
AVQAKDGGQQEGKEEK

SEQ ID NO: 85717 - protein, 16 aa, Borrelia burgdorferi
VQAKDGGQQEGKEEKE

SEQ ID NO: 85718 - protein, 16 aa, Borrelia burgdorferi
QAKDGGQQEGKEEKEK

SEQ ID NO: 85719 - protein, 16 aa, Borrelia burgdorferi
AKDGGQQEGKEEKEKE

SEQ ID NO: 85720 - protein, 16 aa, Borrelia burgdorferi
KDGGQQEGKEEKEKEI

SEQ ID NO: 85721 - protein, 16 aa, Borrelia burgdorferi
DGGQQEGKEEKEKEIQ

SEQ ID NO: 85722 - protein, 16 aa, Borrelia burgdorferi
GGQQEGKEEKEKEIQE

SEQ ID NO: 85723 - protein, 16 aa, Borrelia burgdorferi
GQQEGKEEKEKEIQEL

SEQ ID NO: 85724 - protein, 16 aa, Borrelia burgdorferi
QQEGKEEKEKEIQELK

SEQ ID NO: 85725 - protein, 16 aa, Borrelia burgdorferi
QEGKEEKEKEIQELKD

SEQ ID NO: 85726 - protein, 16 aa, Borrelia burgdorferi
EGKEEKEKEIQELKDK

SEQ ID NO: 85727 - protein, 16 aa, Borrelia burgdorferi
GKEEKEKEIQELKDKI

SEQ ID NO: 85728 - protein, 16 aa, Borrelia burgdorferi
KEEKEKEIQELKDKID

SEQ ID NO: 85729 - protein, 16 aa, Borrelia burgdorferi
EEKEKEIQELKDKIDK

SEQ ID NO: 85730 - protein, 16 aa, Borrelia burgdorferi
EKEKEIQELKDKIDKR

SEQ ID NO: 85731 - protein, 16 aa, Borrelia burgdorferi
KEKEIQELKDKIDKRK

SEQ ID NO: 85732 - protein, 16 aa, Borrelia burgdorferi
EKEIQELKDKIDKRKK

SEQ ID NO: 85733 - protein, 16 aa, Borrelia burgdorferi
KEIQELKDKIDKRKKE

SEQ ID NO: 85734 - protein, 16 aa, Borrelia burgdorferi
EIQELKDKIDKRKKEL

SEQ ID NO: 85735 - protein, 16 aa, Borrelia burgdorferi
IQELKDKIDKRKKELE

SEQ ID NO: 85736 - protein, 16 aa, Borrelia burgdorferi
QELKDKIDKRKKELEE

SEQ ID NO: 85737 - protein, 16 aa, Borrelia burgdorferi
ELKDKIDKRKKELEEA

SEQ ID NO: 85738 - protein, 16 aa, Borrelia burgdorferi
LKDKIDKRKKELEEAR

SEQ ID NO: 85739 - protein, 16 aa, Borrelia burgdorferi
KDKIDKRKKELEEARK

SEQ ID NO: 85740 - protein, 16 aa, Borrelia burgdorferi
DKIDKRKKELEEARKK

SEQ ID NO: 85741 - protein, 16 aa, Borrelia burgdorferi
KIDKRKKELEEARKKF

SEQ ID NO: 85742 - protein, 16 aa, Borrelia burgdorferi
IDKRKKELEEARKKFQ

SEQ ID NO: 85743 - protein, 16 aa, Borrelia burgdorferi
DKRKKELEEARKKFQE

SEQ ID NO: 85744 - protein, 16 aa, Borrelia burgdorferi
KRKKELEEARKKFQEF

SEQ ID NO: 85745 - protein, 16 aa, Borrelia burgdorferi
RKKELEEARKKFQEFK

SEQ ID NO: 85746 - protein, 16 aa, Borrelia burgdorferi
KKELEEARKKFQEFKE

SEQ ID NO: 85747 - protein, 16 aa, Borrelia burgdorferi
KELEEARKKFQEFKEQ

SEQ ID NO: 85748 - protein, 16 aa, Borrelia burgdorferi
ELEEARKKFQEFKEQV

SEQ ID NO: 85749 - protein, 16 aa, Borrelia burgdorferi
LEEARKKFQEFKEQVE

SEQ ID NO: 85750 - protein, 16 aa, Borrelia burgdorferi
EEARKKFQEFKEQVES

SEQ ID NO: 85751 - protein, 16 aa, Borrelia burgdorferi
EARKKFQEFKEQVESA

SEQ ID NO: 85752 - protein, 16 aa, Borrelia burgdorferi
ARKKFQEFKEQVESAT

SEQ ID NO: 85753 - protein, 16 aa, Borrelia burgdorferi
RKKFQEFKEQVESATG

SEQ ID NO: 85754 - protein, 16 aa, Borrelia burgdorferi
KKFQEFKEQVESATGE

SEQ ID NO: 85755 - protein, 16 aa, Borrelia burgdorferi
KFQEFKEQVESATGES

SEQ ID NO: 85756 - protein, 16 aa, Borrelia burgdorferi
FQEFKEQVESATGEST

SEQ ID NO: 85757 - protein, 16 aa, Borrelia burgdorferi
QEFKEQVESATGESTE

SEQ ID NO: 85758 - protein, 16 aa, Borrelia burgdorferi
EFKEQVESATGESTEK

SEQ ID NO: 85759 - protein, 16 aa, Borrelia burgdorferi
FKEQVESATGESTEKV

SEQ ID NO: 85760 - protein, 16 aa, Borrelia burgdorferi
KEQVESATGESTEKVK

SEQ ID NO: 85761 - protein, 16 aa, Borrelia burgdorferi
EQVESATGESTEKVKK

SEQ ID NO: 85762 - protein, 16 aa, Borrelia burgdorferi
QVESATGESTEKVKKQ

SEQ ID NO: 85763 - protein, 16 aa, Borrelia burgdorferi
VESATGESTEKVKKQG

SEQ ID NO: 85764 - protein, 16 aa, Borrelia burgdorferi
ESATGESTEKVKKQGN

SEQ ID NO: 85765 - protein, 16 aa, Borrelia burgdorferi
SATGESTEKVKKQGNI

SEQ ID NO: 85766 - protein, 16 aa, Borrelia burgdorferi
ATGESTEKVKKQGNIG

SEQ ID NO: 85767 - protein, 16 aa, Borrelia burgdorferi
TGESTEKVKKQGNIGQ

SEQ ID NO: 85768 - protein, 16 aa, Borrelia burgdorferi
GESTEKVKKQGNIGQK

SEQ ID NO: 85769 - protein, 16 aa, Borrelia burgdorferi
ESTEKVKKQGNIGQKA

SEQ ID NO: 85770 - protein, 16 aa, Borrelia burgdorferi
STEKVKKQGNIGQKAL

SEQ ID NO: 85771 - protein, 16 aa, Borrelia burgdorferi
TEKVKKQGNIGQKALK

SEQ ID NO: 85772 - protein, 16 aa, Borrelia burgdorferi
EKVKKQGNIGQKALKY

SEQ ID NO: 85773 - protein, 16 aa, Borrelia burgdorferi
KVKKQGNIGQKALKYA

SEQ ID NO: 85774 - protein, 16 aa, Borrelia burgdorferi
VKKQGNIGQKALKYAK

SEQ ID NO: 85775 - protein, 16 aa, Borrelia burgdorferi
KKQGNIGQKALKYAKE

SEQ ID NO: 85776 - protein, 16 aa, Borrelia burgdorferi
KQGNIGQKALKYAKEL

SEQ ID NO: 85777 - protein, 16 aa, Borrelia burgdorferi
QGNIGQKALKYAKELG

SEQ ID NO: 85778 - protein, 16 aa, Borrelia burgdorferi
GNIGQKALKYAKELGV

SEQ ID NO: 85779 - protein, 16 aa, Borrelia burgdorferi
NIGQKALKYAKELGVN

SEQ ID NO: 85780 - protein, 16 aa, Borrelia burgdorferi
IGQKALKYAKELGVNG

SEQ ID NO: 85781 - protein, 16 aa, Borrelia burgdorferi
GQKALKYAKELGVNGS

SEQ ID NO: 85782 - protein, 16 aa, Borrelia burgdorferi
QKALKYAKELGVNGSY

SEQ ID NO: 85783 - protein, 16 aa, Borrelia burgdorferi
KALKYAKELGVNGSYS

SEQ ID NO: 85784 - protein, 16 aa, Borrelia burgdorferi
ALKYAKELGVNGSYSV

SEQ ID NO: 85785 - protein, 16 aa, Borrelia burgdorferi
LKYAKELGVNGSYSVN

SEQ ID NO: 85786 - protein, 16 aa, Borrelia burgdorferi
KYAKELGVNGSYSVND

SEQ ID NO: 85787 - protein, 16 aa, Borrelia burgdorferi
YAKELGVNGSYSVNDG

SEQ ID NO: 85788 - protein, 16 aa, Borrelia burgdorferi
AKELGVNGSYSVNDGT

SEQ ID NO: 85789 - protein, 16 aa, Borrelia burgdorferi
KELGVNGSYSVNDGTN

SEQ ID NO: 85790 - protein, 16 aa, Borrelia burgdorferi
ELGVNGSYSVNDGTNT

SEQ ID NO: 85791 - protein, 16 aa, Borrelia burgdorferi
LGVNGSYSVNDGTNTN

SEQ ID NO: 85792 - protein, 16 aa, Borrelia burgdorferi
GVNGSYSVNDGTNTND

SEQ ID NO: 85793 - protein, 16 aa, Borrelia burgdorferi
VNGSYSVNDGTNTNDF

SEQ ID NO: 85794 - protein, 16 aa, Borrelia burgdorferi
NGSYSVNDGTNTNDFV

SEQ ID NO: 85795 - protein, 16 aa, Borrelia burgdorferi
GSYSVNDGTNTNDFVK

SEQ ID NO: 85796 - protein, 16 aa, Borrelia burgdorferi
SYSVNDGTNTNDFVKK

SEQ ID NO: 85797 - protein, 16 aa, Borrelia burgdorferi
YSVNDGTNTNDFVKKV

SEQ ID NO: 85798 - protein, 16 aa, Borrelia burgdorferi
SVNDGTNTNDFVKKVI

SEQ ID NO: 85799 - protein, 16 aa, Borrelia burgdorferi
VNDGTNTNDFVKKVID

SEQ ID NO: 85800 - protein, 16 aa, Borrelia burgdorferi
NDGTNTNDFVKKVIDD

SEQ ID NO: 85801 - protein, 16 aa, Borrelia burgdorferi
DGTNTNDFVKKVIDDA

SEQ ID NO: 85802 - protein, 16 aa, Borrelia burgdorferi
GTNTNDFVKKVIDDAL

SEQ ID NO: 85803 - protein, 16 aa, Borrelia burgdorferi
TNTNDFVKKVIDDALK

SEQ ID NO: 85804 - protein, 16 aa, Borrelia burgdorferi
NTNDFVKKVIDDALKN

SEQ ID NO: 85805 - protein, 16 aa, Borrelia burgdorferi
TNDFVKKVIDDALKNI

SEQ ID NO: 85806 - protein, 16 aa, Borrelia burgdorferi
NDFVKKVIDDALKNIE

SEQ ID NO: 85807 - protein, 16 aa, Borrelia burgdorferi
DFVKKVIDDALKNIEE

SEQ ID NO: 85808 - protein, 16 aa, Borrelia burgdorferi
FVKKVIDDALKNIEEE

SEQ ID NO: 85809 - protein, 16 aa, Borrelia burgdorferi
VKKVIDDALKNIEEEL

SEQ ID NO: 85810 - protein, 16 aa, Borrelia burgdorferi
KKVIDDALKNIEEELE

SEQ ID NO: 85811 - protein, 16 aa, Borrelia burgdorferi
KVIDDALKNIEEELEK

SEQ ID NO: 85812 - protein, 16 aa, Borrelia burgdorferi
VIDDALKNIEEELEKL

SEQ ID NO: 85813 - protein, 16 aa, Borrelia burgdorferi
IDDALKNIEEELEKLA

SEQ ID NO: 85814 - protein, 16 aa, Borrelia burgdorferi
DDALKNIEEELEKLAE

SEQ ID NO: 85815 - protein, 16 aa, Borrelia burgdorferi
DALKNIEEELEKLAEP

SEQ ID NO: 85816 - protein, 16 aa, Borrelia burgdorferi
ALKNIEEELEKLAEPQ

SEQ ID NO: 85817 - protein, 16 aa, Borrelia burgdorferi
LKNIEEELEKLAEPQN

SEQ ID NO: 85818 - protein, 16 aa, Borrelia burgdorferi
KNIEEELEKLAEPQNI

SEQ ID NO: 85819 - protein, 16 aa, Borrelia burgdorferi
NIEEELEKLAEPQNIE

SEQ ID NO: 85820 - protein, 16 aa, Borrelia burgdorferi
IEEELEKLAEPQNIED

SEQ ID NO: 85821 - protein, 16 aa, Borrelia burgdorferi
EEELEKLAEPQNIEDK

SEQ ID NO: 85822 - protein, 16 aa, Borrelia burgdorferi
EELEKLAEPQNIEDKK

SEQ ID NO: 85823 - protein, 13 aa, Borrelia burgdorferi
MKRKAKSILFFLL

SEQ ID NO: 85824 - protein, 13 aa, Borrelia burgdorferi
KRKAKSILFFLLS

SEQ ID NO: 85825 - protein, 13 aa, Borrelia burgdorferi
RKAKSILFFLLST

SEQ ID NO: 85826 - protein, 13 aa, Borrelia burgdorferi
KAKSILFFLLSTV

SEQ ID NO: 85827 - protein, 13 aa, Borrelia burgdorferi
AKSILFFLLSTVL

SEQ ID NO: 85828 - protein, 13 aa, Borrelia burgdorferi
KSILFFLLSTVLF

SEQ ID NO: 85829 - protein, 13 aa, Borrelia burgdorferi
SILFFLLSTVLFA

SEQ ID NO: 85830 - protein, 13 aa, Borrelia burgdorferi
ILFFLLSTVLFAQ

SEQ ID NO: 85831 - protein, 13 aa, Borrelia burgdorferi
LFFLLSTVLFAQE

SEQ ID NO: 85832 - protein, 13 aa, Borrelia burgdorferi
FFLLSTVLFAQET

SEQ ID NO: 85833 - protein, 13 aa, Borrelia burgdorferi
FLLSTVLFAQETD

SEQ ID NO: 85834 - protein, 13 aa, Borrelia burgdorferi
LLSTVLFAQETDG

SEQ ID NO: 85835 - protein, 13 aa, Borrelia burgdorferi
LSTVLFAQETDGL

SEQ ID NO: 85836 - protein, 13 aa, Borrelia burgdorferi
STVLFAQETDGLA

SEQ ID NO: 85837 - protein, 13 aa, Borrelia burgdorferi
TVLFAQETDGLAE

SEQ ID NO: 85838 - protein, 13 aa, Borrelia burgdorferi
VLFAQETDGLAEG

SEQ ID NO: 85839 - protein, 13 aa, Borrelia burgdorferi
LFAQETDGLAEGS

SEQ ID NO: 85840 - protein, 13 aa, Borrelia burgdorferi
FAQETDGLAEGSK

SEQ ID NO: 85841 - protein, 13 aa, Borrelia burgdorferi
AQETDGLAEGSKR

SEQ ID NO: 85842 - protein, 13 aa, Borrelia burgdorferi
QETDGLAEGSKRA

SEQ ID NO: 85843 - protein, 13 aa, Borrelia burgdorferi
ETDGLAEGSKRAE

SEQ ID NO: 85844 - protein, 13 aa, Borrelia burgdorferi
TDGLAEGSKRAEP

SEQ ID NO: 85845 - protein, 13 aa, Borrelia burgdorferi
DGLAEGSKRAEPG

SEQ ID NO: 85846 - protein, 13 aa, Borrelia burgdorferi
GLAEGSKRAEPGE

SEQ ID NO: 85847 - protein, 13 aa, Borrelia burgdorferi
LAEGSKRAEPGEL

SEQ ID NO: 85848 - protein, 13 aa, Borrelia burgdorferi
AEGSKRAEPGELV

SEQ ID NO: 85849 - protein, 13 aa, Borrelia burgdorferi
EGSKRAEPGELVL

SEQ ID NO: 85850 - protein, 13 aa, Borrelia burgdorferi
GSKRAEPGELVLD

SEQ ID NO: 85851 - protein, 13 aa, Borrelia burgdorferi
SKRAEPGELVLDF

SEQ ID NO: 85852 - protein, 13 aa, Borrelia burgdorferi
KRAEPGELVLDFA

SEQ ID NO: 85853 - protein, 13 aa, Borrelia burgdorferi
RAEPGELVLDFAE

SEQ ID NO: 85854 - protein, 13 aa, Borrelia burgdorferi
AEPGELVLDFAEL

SEQ ID NO: 85855 - protein, 13 aa, Borrelia burgdorferi
EPGELVLDFAELA

SEQ ID NO: 85856 - protein, 13 aa, Borrelia burgdorferi
PGELVLDFAELAR

SEQ ID NO: 85857 - protein, 13 aa, Borrelia burgdorferi
GELVLDFAELARD

SEQ ID NO: 85858 - protein, 13 aa, Borrelia burgdorferi
ELVLDFAELARDP

SEQ ID NO: 85859 - protein, 13 aa, Borrelia burgdorferi
LVLDFAELARDPS

SEQ ID NO: 85860 - protein, 13 aa, Borrelia burgdorferi
VLDFAELARDPSS

SEQ ID NO: 85861 - protein, 13 aa, Borrelia burgdorferi
LDFAELARDPSST

SEQ ID NO: 85862 - protein, 13 aa, Borrelia burgdorferi
DFAELARDPSSTR

SEQ ID NO: 85863 - protein, 13 aa, Borrelia burgdorferi
FAELARDPSSTRL

SEQ ID NO: 85864 - protein, 13 aa, Borrelia burgdorferi
AELARDPSSTRLD

SEQ ID NO: 85865 - protein, 13 aa, Borrelia burgdorferi
ELARDPSSTRLDL

SEQ ID NO: 85866 - protein, 13 aa, Borrelia burgdorferi
LARDPSSTRLDLT

SEQ ID NO: 85867 - protein, 13 aa, Borrelia burgdorferi
ARDPSSTRLDLTN

SEQ ID NO: 85868 - protein, 13 aa, Borrelia burgdorferi
RDPSSTRLDLTNY

SEQ ID NO: 85869 - protein, 13 aa, Borrelia burgdorferi
DPSSTRLDLTNYV

SEQ ID NO: 85870 - protein, 13 aa, Borrelia burgdorferi
PSSTRLDLTNYVD

SEQ ID NO: 85871 - protein, 13 aa, Borrelia burgdorferi
SSTRLDLTNYVDY

SEQ ID NO: 85872 - protein, 13 aa, Borrelia burgdorferi
STRLDLTNYVDYV

SEQ ID NO: 85873 - protein, 13 aa, Borrelia burgdorferi
TRLDLTNYVDYVY

SEQ ID NO: 85874 - protein, 13 aa, Borrelia burgdorferi
RLDLTNYVDYVYS

SEQ ID NO: 85875 - protein, 13 aa, Borrelia burgdorferi
LDLTNYVDYVYSG

SEQ ID NO: 85876 - protein, 13 aa, Borrelia burgdorferi
DLTNYVDYVYSGA

SEQ ID NO: 85877 - protein, 13 aa, Borrelia burgdorferi
LTNYVDYVYSGAS

SEQ ID NO: 85878 - protein, 13 aa, Borrelia burgdorferi
TNYVDYVYSGASG

SEQ ID NO: 85879 - protein, 13 aa, Borrelia burgdorferi
NYVDYVYSGASGI

SEQ ID NO: 85880 - protein, 13 aa, Borrelia burgdorferi
YVDYVYSGASGIV

SEQ ID NO: 85881 - protein, 13 aa, Borrelia burgdorferi
VDYVYSGASGIVK

SEQ ID NO: 85882 - protein, 13 aa, Borrelia burgdorferi
DYVYSGASGIVKP

SEQ ID NO: 85883 - protein, 13 aa, Borrelia burgdorferi
YVYSGASGIVKPE

SEQ ID NO: 85884 - protein, 13 aa, Borrelia burgdorferi
VYSGASGIVKPED

SEQ ID NO: 85885 - protein, 13 aa, Borrelia burgdorferi
YSGASGIVKPEDM

SEQ ID NO: 85886 - protein, 13 aa, Borrelia burgdorferi
SGASGIVKPEDMV

SEQ ID NO: 85887 - protein, 13 aa, Borrelia burgdorferi
GASGIVKPEDMVV

SEQ ID NO: 85888 - protein, 13 aa, Borrelia burgdorferi
ASGIVKPEDMVVD

SEQ ID NO: 85889 - protein, 13 aa, Borrelia burgdorferi
SGIVKPEDMVVDL

SEQ ID NO: 85890 - protein, 13 aa, Borrelia burgdorferi
GIVKPEDMVVDLG

SEQ ID NO: 85891 - protein, 13 aa, Borrelia burgdorferi
IVKPEDMVVDLGI

SEQ ID NO: 85892 - protein, 13 aa, Borrelia burgdorferi
VKPEDMVVDLGIN

SEQ ID NO: 85893 - protein, 13 aa, Borrelia burgdorferi
KPEDMVVDLGINN

SEQ ID NO: 85894 - protein, 13 aa, Borrelia burgdorferi
PEDMVVDLGINNW

SEQ ID NO: 85895 - protein, 13 aa, Borrelia burgdorferi
EDMVVDLGINNWS

SEQ ID NO: 85896 - protein, 13 aa, Borrelia burgdorferi
DMVVDLGINNWSV

SEQ ID NO: 85897 - protein, 13 aa, Borrelia burgdorferi
MVVDLGINNWSVL

SEQ ID NO: 85898 - protein, 13 aa, Borrelia burgdorferi
VVDLGINNWSVLL

SEQ ID NO: 85899 - protein, 13 aa, Borrelia burgdorferi
VDLGINNWSVLLT

SEQ ID NO: 85900 - protein, 13 aa, Borrelia burgdorferi
DLGINNWSVLLTP

SEQ ID NO: 85901 - protein, 13 aa, Borrelia burgdorferi
LGINNWSVLLTPS

SEQ ID NO: 85902 - protein, 13 aa, Borrelia burgdorferi
GINNWSVLLTPSA

SEQ ID NO: 85903 - protein, 13 aa, Borrelia burgdorferi
INNWSVLLTPSAR

SEQ ID NO: 85904 - protein, 13 aa, Borrelia burgdorferi
NNWSVLLTPSARL

SEQ ID NO: 85905 - protein, 13 aa, Borrelia burgdorferi
NWSVLLTPSARLQ

SEQ ID NO: 85906 - protein, 13 aa, Borrelia burgdorferi
WSVLLTPSARLQA

SEQ ID NO: 85907 - protein, 13 aa, Borrelia burgdorferi
SVLLTPSARLQAY

SEQ ID NO: 85908 - protein, 13 aa, Borrelia burgdorferi
VLLTPSARLQAYV

SEQ ID NO: 85909 - protein, 13 aa, Borrelia burgdorferi
LLTPSARLQAYVK

SEQ ID NO: 85910 - protein, 13 aa, Borrelia burgdorferi
LTPSARLQAYVKN

SEQ ID NO: 85911 - protein, 13 aa, Borrelia burgdorferi
TPSARLQAYVKNS

SEQ ID NO: 85912 - protein, 13 aa, Borrelia burgdorferi
PSARLQAYVKNSV

SEQ ID NO: 85913 - protein, 13 aa, Borrelia burgdorferi
SARLQAYVKNSVV

SEQ ID NO: 85914 - protein, 13 aa, Borrelia burgdorferi
ARLQAYVKNSVVA

SEQ ID NO: 85915 - protein, 13 aa, Borrelia burgdorferi
RLQAYVKNSVVAP

SEQ ID NO: 85916 - protein, 13 aa, Borrelia burgdorferi
LQAYVKNSVVAPA

SEQ ID NO: 85917 - protein, 13 aa, Borrelia burgdorferi
QAYVKNSVVAPAV

SEQ ID NO: 85918 - protein, 13 aa, Borrelia burgdorferi
AYVKNSVVAPAVV

SEQ ID NO: 85919 - protein, 13 aa, Borrelia burgdorferi
YVKNSVVAPAVVK

SEQ ID NO: 85920 - protein, 13 aa, Borrelia burgdorferi
VKNSVVAPAVVKS

SEQ ID NO: 85921 - protein, 13 aa, Borrelia burgdorferi
KNSVVAPAVVKSE

SEQ ID NO: 85922 - protein, 13 aa, Borrelia burgdorferi
NSVVAPAVVKSES

SEQ ID NO: 85923 - protein, 13 aa, Borrelia burgdorferi
SVVAPAVVKSESK

SEQ ID NO: 85924 - protein, 13 aa, Borrelia burgdorferi
VVAPAVVKSESKR

SEQ ID NO: 85925 - protein, 13 aa, Borrelia burgdorferi
VAPAVVKSESKRY

SEQ ID NO: 85926 - protein, 13 aa, Borrelia burgdorferi
APAVVKSESKRYA

SEQ ID NO: 85927 - protein, 13 aa, Borrelia burgdorferi
PAVVKSESKRYAG

SEQ ID NO: 85928 - protein, 13 aa, Borrelia burgdorferi
AVVKSESKRYAGD

SEQ ID NO: 85929 - protein, 13 aa, Borrelia burgdorferi
VVKSESKRYAGDT

SEQ ID NO: 85930 - protein, 13 aa, Borrelia burgdorferi
VKSESKRYAGDTI

SEQ ID NO: 85931 - protein, 13 aa, Borrelia burgdorferi
KSESKRYAGDTIL

SEQ ID NO: 85932 - protein, 13 aa, Borrelia burgdorferi
SESKRYAGDTILG

SEQ ID NO: 85933 - protein, 13 aa, Borrelia burgdorferi
ESKRYAGDTILGV

SEQ ID NO: 85934 - protein, 13 aa, Borrelia burgdorferi
SKRYAGDTILGVR

SEQ ID NO: 85935 - protein, 13 aa, Borrelia burgdorferi
KRYAGDTILGVRV

SEQ ID NO: 85936 - protein, 13 aa, Borrelia burgdorferi
RYAGDTILGVRVL

SEQ ID NO: 85937 - protein, 13 aa, Borrelia burgdorferi
YAGDTILGVRVLF

SEQ ID NO: 85938 - protein, 13 aa, Borrelia burgdorferi
AGDTILGVRVLFP

SEQ ID NO: 85939 - protein, 13 aa, Borrelia burgdorferi
GDTILGVRVLFPS

SEQ ID NO: 85940 - protein, 13 aa, Borrelia burgdorferi
DTILGVRVLFPSY

SEQ ID NO: 85941 - protein, 13 aa, Borrelia burgdorferi
TILGVRVLFPSYS

SEQ ID NO: 85942 - protein, 13 aa, Borrelia burgdorferi
ILGVRVLFPSYSQ

SEQ ID NO: 85943 - protein, 13 aa, Borrelia burgdorferi
LGVRVLFPSYSQS

SEQ ID NO: 85944 - protein, 13 aa, Borrelia burgdorferi
GVRVLFPSYSQSS

SEQ ID NO: 85945 - protein, 13 aa, Borrelia burgdorferi
VRVLFPSYSQSSA

SEQ ID NO: 85946 - protein, 13 aa, Borrelia burgdorferi
RVLFPSYSQSSAM

SEQ ID NO: 85947 - protein, 13 aa, Borrelia burgdorferi
VLFPSYSQSSAMI

SEQ ID NO: 85948 - protein, 13 aa, Borrelia burgdorferi
LFPSYSQSSAMIM

SEQ ID NO: 85949 - protein, 13 aa, Borrelia burgdorferi
FPSYSQSSAMIMP

SEQ ID NO: 85950 - protein, 13 aa, Borrelia burgdorferi
PSYSQSSAMIMPP

SEQ ID NO: 85951 - protein, 13 aa, Borrelia burgdorferi
SYSQSSAMIMPPF

SEQ ID NO: 85952 - protein, 13 aa, Borrelia burgdorferi
YSQSSAMIMPPFK

SEQ ID NO: 85953 - protein, 13 aa, Borrelia burgdorferi
SQSSAMIMPPFKI

SEQ ID NO: 85954 - protein, 13 aa, Borrelia burgdorferi
QSSAMIMPPFKIP

SEQ ID NO: 85955 - protein, 13 aa, Borrelia burgdorferi
SSAMIMPPFKIPF

SEQ ID NO: 85956 - protein, 13 aa, Borrelia burgdorferi
SAMIMPPFKIPFY

SEQ ID NO: 85957 - protein, 13 aa, Borrelia burgdorferi
AMIMPPFKIPFYS

SEQ ID NO: 85958 - protein, 13 aa, Borrelia burgdorferi
MIMPPFKIPFYSG

SEQ ID NO: 85959 - protein, 13 aa, Borrelia burgdorferi
IMPPFKIPFYSGE

SEQ ID NO: 85960 - protein, 13 aa, Borrelia burgdorferi
MPPFKIPFYSGES

SEQ ID NO: 85961 - protein, 13 aa, Borrelia burgdorferi
PPFKIPFYSGESG

SEQ ID NO: 85962 - protein, 13 aa, Borrelia burgdorferi
PFKIPFYSGESGN

SEQ ID NO: 85963 - protein, 13 aa, Borrelia burgdorferi
FKIPFYSGESGNQ

SEQ ID NO: 85964 - protein, 13 aa, Borrelia burgdorferi
KIPFYSGESGNQF

SEQ ID NO: 85965 - protein, 13 aa, Borrelia burgdorferi
IPFYSGESGNQFL

SEQ ID NO: 85966 - protein, 13 aa, Borrelia burgdorferi
PFYSGESGNQFLG

SEQ ID NO: 85967 - protein, 13 aa, Borrelia burgdorferi
FYSGESGNQFLGK

SEQ ID NO: 85968 - protein, 13 aa, Borrelia burgdorferi
YSGESGNQFLGKG

SEQ ID NO: 85969 - protein, 13 aa, Borrelia burgdorferi
SGESGNQFLGKGL

SEQ ID NO: 85970 - protein, 13 aa, Borrelia burgdorferi
GESGNQFLGKGLI

SEQ ID NO: 85971 - protein, 13 aa, Borrelia burgdorferi
ESGNQFLGKGLID

SEQ ID NO: 85972 - protein, 13 aa, Borrelia burgdorferi
SGNQFLGKGLIDN

SEQ ID NO: 85973 - protein, 13 aa, Borrelia burgdorferi
GNQFLGKGLIDNI

SEQ ID NO: 85974 - protein, 13 aa, Borrelia burgdorferi
NQFLGKGLIDNIK

SEQ ID NO: 85975 - protein, 13 aa, Borrelia burgdorferi
QFLGKGLIDNIKT

SEQ ID NO: 85976 - protein, 13 aa, Borrelia burgdorferi
FLGKGLIDNIKTM

SEQ ID NO: 85977 - protein, 13 aa, Borrelia burgdorferi
LGKGLIDNIKTMK

SEQ ID NO: 85978 - protein, 13 aa, Borrelia burgdorferi
GKGLIDNIKTMKE

SEQ ID NO: 85979 - protein, 13 aa, Borrelia burgdorferi
KGLIDNIKTMKEI

SEQ ID NO: 85980 - protein, 13 aa, Borrelia burgdorferi
GLIDNIKTMKEIK

SEQ ID NO: 85981 - protein, 13 aa, Borrelia burgdorferi
LIDNIKTMKEIKV

SEQ ID NO: 85982 - protein, 13 aa, Borrelia burgdorferi
IDNIKTMKEIKVS

SEQ ID NO: 85983 - protein, 13 aa, Borrelia burgdorferi
DNIKTMKEIKVSV

SEQ ID NO: 85984 - protein, 13 aa, Borrelia burgdorferi
NIKTMKEIKVSVY

SEQ ID NO: 85985 - protein, 13 aa, Borrelia burgdorferi
IKTMKEIKVSVYS

SEQ ID NO: 85986 - protein, 13 aa, Borrelia burgdorferi
KTMKEIKVSVYSL

SEQ ID NO: 85987 - protein, 13 aa, Borrelia burgdorferi
TMKEIKVSVYSLG

SEQ ID NO: 85988 - protein, 13 aa, Borrelia burgdorferi
MKEIKVSVYSLGY

SEQ ID NO: 85989 - protein, 13 aa, Borrelia burgdorferi
KEIKVSVYSLGYE

SEQ ID NO: 85990 - protein, 13 aa, Borrelia burgdorferi
EIKVSVYSLGYEI

SEQ ID NO: 85991 - protein, 13 aa, Borrelia burgdorferi
IKVSVYSLGYEID

SEQ ID NO: 85992 - protein, 13 aa, Borrelia burgdorferi
KVSVYSLGYEIDL

SEQ ID NO: 85993 - protein, 13 aa, Borrelia burgdorferi
VSVYSLGYEIDLE

SEQ ID NO: 85994 - protein, 13 aa, Borrelia burgdorferi
SVYSLGYEIDLEV

SEQ ID NO: 85995 - protein, 13 aa, Borrelia burgdorferi
VYSLGYEIDLEVL

SEQ ID NO: 85996 - protein, 13 aa, Borrelia burgdorferi
YSLGYEIDLEVLF

SEQ ID NO: 85997 - protein, 13 aa, Borrelia burgdorferi
SLGYEIDLEVLFE

SEQ ID NO: 85998 - protein, 13 aa, Borrelia burgdorferi
LGYEIDLEVLFED

SEQ ID NO: 85999 - protein, 13 aa, Borrelia burgdorferi
GYEIDLEVLFEDM

SEQ ID NO: 86000 - protein, 13 aa, Borrelia burgdorferi
YEIDLEVLFEDMN

SEQ ID NO: 86001 - protein, 13 aa, Borrelia burgdorferi
EIDLEVLFEDMNG

SEQ ID NO: 86002 - protein, 13 aa, Borrelia burgdorferi
IDLEVLFEDMNGM

SEQ ID NO: 86003 - protein, 13 aa, Borrelia burgdorferi
DLEVLFEDMNGME

SEQ ID NO: 86004 - protein, 13 aa, Borrelia burgdorferi
LEVLFEDMNGMEY

SEQ ID NO: 86005 - protein, 13 aa, Borrelia burgdorferi
EVLFEDMNGMEYA

SEQ ID NO: 86006 - protein, 13 aa, Borrelia burgdorferi
VLFEDMNGMEYAY

SEQ ID NO: 86007 - protein, 13 aa, Borrelia burgdorferi
LFEDMNGMEYAYS

SEQ ID NO: 86008 - protein, 13 aa, Borrelia burgdorferi
FEDMNGMEYAYSM

SEQ ID NO: 86009 - protein, 13 aa, Borrelia burgdorferi
EDMNGMEYAYSMG

SEQ ID NO: 86010 - protein, 13 aa, Borrelia burgdorferi
DMNGMEYAYSMGT

SEQ ID NO: 86011 - protein, 13 aa, Borrelia burgdorferi
MNGMEYAYSMGTL

SEQ ID NO: 86012 - protein, 13 aa, Borrelia burgdorferi
NGMEYAYSMGTLK

SEQ ID NO: 86013 - protein, 13 aa, Borrelia burgdorferi
GMEYAYSMGTLKF

SEQ ID NO: 86014 - protein, 13 aa, Borrelia burgdorferi
MEYAYSMGTLKFK

SEQ ID NO: 86015 - protein, 13 aa, Borrelia burgdorferi
EYAYSMGTLKFKG

SEQ ID NO: 86016 - protein, 13 aa, Borrelia burgdorferi
YAYSMGTLKFKGW

SEQ ID NO: 86017 - protein, 13 aa, Borrelia burgdorferi
AYSMGTLKFKGWA

SEQ ID NO: 86018 - protein, 13 aa, Borrelia burgdorferi
YSMGTLKFKGWAD

SEQ ID NO: 86019 - protein, 13 aa, Borrelia burgdorferi
SMGTLKFKGWADL

SEQ ID NO: 86020 - protein, 13 aa, Borrelia burgdorferi
MGTLKFKGWADLI

SEQ ID NO: 86021 - protein, 13 aa, Borrelia burgdorferi
GTLKFKGWADLIW

SEQ ID NO: 86022 - protein, 13 aa, Borrelia burgdorferi
TLKFKGWADLIWS

SEQ ID NO: 86023 - protein, 13 aa, Borrelia burgdorferi
LKFKGWADLIWSN

SEQ ID NO: 86024 - protein, 13 aa, Borrelia burgdorferi
KFKGWADLIWSNP

SEQ ID NO: 86025 - protein, 13 aa, Borrelia burgdorferi
FKGWADLIWSNPN

SEQ ID NO: 86026 - protein, 13 aa, Borrelia burgdorferi
KGWADLIWSNPNY

SEQ ID NO: 86027 - protein, 13 aa, Borrelia burgdorferi
GWADLIWSNPNYI

SEQ ID NO: 86028 - protein, 13 aa, Borrelia burgdorferi
WADLIWSNPNYIP

SEQ ID NO: 86029 - protein, 13 aa, Borrelia burgdorferi
ADLIWSNPNYIPN

SEQ ID NO: 86030 - protein, 13 aa, Borrelia burgdorferi
DLIWSNPNYIPNI

SEQ ID NO: 86031 - protein, 13 aa, Borrelia burgdorferi
LIWSNPNYIPNIS

SEQ ID NO: 86032 - protein, 13 aa, Borrelia burgdorferi
IWSNPNYIPNISS

SEQ ID NO: 86033 - protein, 13 aa, Borrelia burgdorferi
WSNPNYIPNISSR

SEQ ID NO: 86034 - protein, 13 aa, Borrelia burgdorferi
SNPNYIPNISSRI

SEQ ID NO: 86035 - protein, 13 aa, Borrelia burgdorferi
NPNYIPNISSRII

SEQ ID NO: 86036 - protein, 13 aa, Borrelia burgdorferi
PNYIPNISSRIIK

SEQ ID NO: 86037 - protein, 13 aa, Borrelia burgdorferi
NYIPNISSRIIKD

SEQ ID NO: 86038 - protein, 13 aa, Borrelia burgdorferi
YIPNISSRIIKDD

SEQ ID NO: 86039 - protein, 13 aa, Borrelia burgdorferi
IPNISSRIIKDDV

SEQ ID NO: 86040 - protein, 13 aa, Borrelia burgdorferi
PNISSRIIKDDVP

SEQ ID NO: 86041 - protein, 13 aa, Borrelia burgdorferi
NISSRIIKDDVPN

SEQ ID NO: 86042 - protein, 13 aa, Borrelia burgdorferi
ISSRIIKDDVPNY

SEQ ID NO: 86043 - protein, 13 aa, Borrelia burgdorferi
SSRIIKDDVPNYP

SEQ ID NO: 86044 - protein, 13 aa, Borrelia burgdorferi
SRIIKDDVPNYPL

SEQ ID NO: 86045 - protein, 13 aa, Borrelia burgdorferi
RIIKDDVPNYPLA

SEQ ID NO: 86046 - protein, 13 aa, Borrelia burgdorferi
IIKDDVPNYPLAS

SEQ ID NO: 86047 - protein, 13 aa, Borrelia burgdorferi
IKDDVPNYPLASS

SEQ ID NO: 86048 - protein, 13 aa, Borrelia burgdorferi
KDDVPNYPLASSK

SEQ ID NO: 86049 - protein, 13 aa, Borrelia burgdorferi
DDVPNYPLASSKM

SEQ ID NO: 86050 - protein, 13 aa, Borrelia burgdorferi
DVPNYPLASSKMR

SEQ ID NO: 86051 - protein, 13 aa, Borrelia burgdorferi
VPNYPLASSKMRF

SEQ ID NO: 86052 - protein, 13 aa, Borrelia burgdorferi
PNYPLASSKMRFK

SEQ ID NO: 86053 - protein, 13 aa, Borrelia burgdorferi
NYPLASSKMRFKA

SEQ ID NO: 86054 - protein, 13 aa, Borrelia burgdorferi
YPLASSKMRFKAF

SEQ ID NO: 86055 - protein, 13 aa, Borrelia burgdorferi
PLASSKMRFKAFR

SEQ ID NO: 86056 - protein, 13 aa, Borrelia burgdorferi
LASSKMRFKAFRV

SEQ ID NO: 86057 - protein, 13 aa, Borrelia burgdorferi
ASSKMRFKAFRVS

SEQ ID NO: 86058 - protein, 13 aa, Borrelia burgdorferi
SSKMRFKAFRVSK

SEQ ID NO: 86059 - protein, 13 aa, Borrelia burgdorferi
SKMRFKAFRVSKS

SEQ ID NO: 86060 - protein, 13 aa, Borrelia burgdorferi
KMRFKAFRVSKSH

SEQ ID NO: 86061 - protein, 13 aa, Borrelia burgdorferi
MRFKAFRVSKSHS

SEQ ID NO: 86062 - protein, 13 aa, Borrelia burgdorferi
RFKAFRVSKSHSS

SEQ ID NO: 86063 - protein, 13 aa, Borrelia burgdorferi
FKAFRVSKSHSSK

SEQ ID NO: 86064 - protein, 13 aa, Borrelia burgdorferi
KAFRVSKSHSSKV

SEQ ID NO: 86065 - protein, 13 aa, Borrelia burgdorferi
AFRVSKSHSSKVK

SEQ ID NO: 86066 - protein, 13 aa, Borrelia burgdorferi
FRVSKSHSSKVKN

SEQ ID NO: 86067 - protein, 13 aa, Borrelia burgdorferi
RVSKSHSSKVKNF

SEQ ID NO: 86068 - protein, 13 aa, Borrelia burgdorferi
VSKSHSSKVKNFI

SEQ ID NO: 86069 - protein, 13 aa, Borrelia burgdorferi
SKSHSSKVKNFIF

SEQ ID NO: 86070 - protein, 13 aa, Borrelia burgdorferi
KSHSSKVKNFIFY

SEQ ID NO: 86071 - protein, 13 aa, Borrelia burgdorferi
SHSSKVKNFIFYV

SEQ ID NO: 86072 - protein, 13 aa, Borrelia burgdorferi
HSSKVKNFIFYVK

SEQ ID NO: 86073 - protein, 13 aa, Borrelia burgdorferi
SSKVKNFIFYVKD

SEQ ID NO: 86074 - protein, 13 aa, Borrelia burgdorferi
SKVKNFIFYVKDL

SEQ ID NO: 86075 - protein, 13 aa, Borrelia burgdorferi
KVKNFIFYVKDLR

SEQ ID NO: 86076 - protein, 13 aa, Borrelia burgdorferi
VKNFIFYVKDLRV

SEQ ID NO: 86077 - protein, 13 aa, Borrelia burgdorferi
KNFIFYVKDLRVL

SEQ ID NO: 86078 - protein, 13 aa, Borrelia burgdorferi
NFIFYVKDLRVLY

SEQ ID NO: 86079 - protein, 13 aa, Borrelia burgdorferi
FIFYVKDLRVLYD

SEQ ID NO: 86080 - protein, 13 aa, Borrelia burgdorferi
IFYVKDLRVLYDK

SEQ ID NO: 86081 - protein, 13 aa, Borrelia burgdorferi
FYVKDLRVLYDKL

SEQ ID NO: 86082 - protein, 13 aa, Borrelia burgdorferi
YVKDLRVLYDKLS

SEQ ID NO: 86083 - protein, 13 aa, Borrelia burgdorferi
VKDLRVLYDKLSV

SEQ ID NO: 86084 - protein, 13 aa, Borrelia burgdorferi
KDLRVLYDKLSVS

SEQ ID NO: 86085 - protein, 13 aa, Borrelia burgdorferi
DLRVLYDKLSVSI

SEQ ID NO: 86086 - protein, 13 aa, Borrelia burgdorferi
LRVLYDKLSVSID

SEQ ID NO: 86087 - protein, 13 aa, Borrelia burgdorferi
RVLYDKLSVSIDS

SEQ ID NO: 86088 - protein, 13 aa, Borrelia burgdorferi
VLYDKLSVSIDSD

SEQ ID NO: 86089 - protein, 13 aa, Borrelia burgdorferi
LYDKLSVSIDSDI

SEQ ID NO: 86090 - protein, 13 aa, Borrelia burgdorferi
YDKLSVSIDSDID

SEQ ID NO: 86091 - protein, 13 aa, Borrelia burgdorferi
DKLSVSIDSDIDS

SEQ ID NO: 86092 - protein, 13 aa, Borrelia burgdorferi
KLSVSIDSDIDSE

SEQ ID NO: 86093 - protein, 13 aa, Borrelia burgdorferi
LSVSIDSDIDSES

SEQ ID NO: 86094 - protein, 13 aa, Borrelia burgdorferi
SVSIDSDIDSESV

SEQ ID NO: 86095 - protein, 13 aa, Borrelia burgdorferi
VSIDSDIDSESVF

SEQ ID NO: 86096 - protein, 13 aa, Borrelia burgdorferi
SIDSDIDSESVFK

SEQ ID NO: 86097 - protein, 13 aa, Borrelia burgdorferi
IDSDIDSESVFKV

SEQ ID NO: 86098 - protein, 13 aa, Borrelia burgdorferi
DSDIDSESVFKVY

SEQ ID NO: 86099 - protein, 13 aa, Borrelia burgdorferi
SDIDSESVFKVYE

SEQ ID NO: 86100 - protein, 13 aa, Borrelia burgdorferi
DIDSESVFKVYET

SEQ ID NO: 86101 - protein, 13 aa, Borrelia burgdorferi
IDSESVFKVYETS

SEQ ID NO: 86102 - protein, 13 aa, Borrelia burgdorferi
DSESVFKVYETSG

SEQ ID NO: 86103 - protein, 13 aa, Borrelia burgdorferi
SESVFKVYETSGT

SEQ ID NO: 86104 - protein, 13 aa, Borrelia burgdorferi
ESVFKVYETSGTE

SEQ ID NO: 86105 - protein, 13 aa, Borrelia burgdorferi
SVFKVYETSGTES

SEQ ID NO: 86106 - protein, 13 aa, Borrelia burgdorferi
VFKVYETSGTESL

SEQ ID NO: 86107 - protein, 13 aa, Borrelia burgdorferi
FKVYETSGTESLR

SEQ ID NO: 86108 - protein, 13 aa, Borrelia burgdorferi
KVYETSGTESLRK

SEQ ID NO: 86109 - protein, 13 aa, Borrelia burgdorferi
VYETSGTESLRKL

SEQ ID NO: 86110 - protein, 13 aa, Borrelia burgdorferi
YETSGTESLRKLK

SEQ ID NO: 86111 - protein, 13 aa, Borrelia burgdorferi
ETSGTESLRKLKA

SEQ ID NO: 86112 - protein, 13 aa, Borrelia burgdorferi
TSGTESLRKLKAH

SEQ ID NO: 86113 - protein, 13 aa, Borrelia burgdorferi
SGTESLRKLKAHE

SEQ ID NO: 86114 - protein, 13 aa, Borrelia burgdorferi
GTESLRKLKAHET

SEQ ID NO: 86115 - protein, 13 aa, Borrelia burgdorferi
TESLRKLKAHETF

SEQ ID NO: 86116 - protein, 13 aa, Borrelia burgdorferi
ESLRKLKAHETFK

SEQ ID NO: 86117 - protein, 13 aa, Borrelia burgdorferi
SLRKLKAHETFKR

SEQ ID NO: 86118 - protein, 13 aa, Borrelia burgdorferi
LRKLKAHETFKRV

SEQ ID NO: 86119 - protein, 13 aa, Borrelia burgdorferi
RKLKAHETFKRVL

SEQ ID NO: 86120 - protein, 13 aa, Borrelia burgdorferi
KLKAHETFKRVLK

SEQ ID NO: 86121 - protein, 13 aa, Borrelia burgdorferi
LKAHETFKRVLKL

SEQ ID NO: 86122 - protein, 13 aa, Borrelia burgdorferi
KAHETFKRVLKLR

SEQ ID NO: 86123 - protein, 13 aa, Borrelia burgdorferi
AHETFKRVLKLRE

SEQ ID NO: 86124 - protein, 13 aa, Borrelia burgdorferi
HETFKRVLKLREK

SEQ ID NO: 86125 - protein, 13 aa, Borrelia burgdorferi
ETFKRVLKLREKI

SEQ ID NO: 86126 - protein, 13 aa, Borrelia burgdorferi
TFKRVLKLREKIS

SEQ ID NO: 86127 - protein, 13 aa, Borrelia burgdorferi
FKRVLKLREKISI

SEQ ID NO: 86128 - protein, 13 aa, Borrelia burgdorferi
KRVLKLREKISIA

SEQ ID NO: 86129 - protein, 13 aa, Borrelia burgdorferi
RVLKLREKISIAE

SEQ ID NO: 86130 - protein, 13 aa, Borrelia burgdorferi
VLKLREKISIAEG

SEQ ID NO: 86131 - protein, 13 aa, Borrelia burgdorferi
LKLREKISIAEGS

SEQ ID NO: 86132 - protein, 13 aa, Borrelia burgdorferi
KLREKISIAEGSF

SEQ ID NO: 86133 - protein, 13 aa, Borrelia burgdorferi
LREKISIAEGSFQ

SEQ ID NO: 86134 - protein, 13 aa, Borrelia burgdorferi
REKISIAEGSFQN

SEQ ID NO: 86135 - protein, 13 aa, Borrelia burgdorferi
EKISIAEGSFQNF

SEQ ID NO: 86136 - protein, 13 aa, Borrelia burgdorferi
KISIAEGSFQNFV

SEQ ID NO: 86137 - protein, 13 aa, Borrelia burgdorferi
ISIAEGSFQNFVE

SEQ ID NO: 86138 - protein, 13 aa, Borrelia burgdorferi
SIAEGSFQNFVEK

SEQ ID NO: 86139 - protein, 13 aa, Borrelia burgdorferi
IAEGSFQNFVEKI

SEQ ID NO: 86140 - protein, 13 aa, Borrelia burgdorferi
AEGSFQNFVEKIE

SEQ ID NO: 86141 - protein, 13 aa, Borrelia burgdorferi
EGSFQNFVEKIES

SEQ ID NO: 86142 - protein, 13 aa, Borrelia burgdorferi
GSFQNFVEKIESE

SEQ ID NO: 86143 - protein, 13 aa, Borrelia burgdorferi
SFQNFVEKIESEK

SEQ ID NO: 86144 - protein, 13 aa, Borrelia burgdorferi
FQNFVEKIESEKP

SEQ ID NO: 86145 - protein, 13 aa, Borrelia burgdorferi
QNFVEKIESEKPE

SEQ ID NO: 86146 - protein, 13 aa, Borrelia burgdorferi
NFVEKIESEKPEE

SEQ ID NO: 86147 - protein, 13 aa, Borrelia burgdorferi
FVEKIESEKPEES

SEQ ID NO: 86148 - protein, 13 aa, Borrelia burgdorferi
VEKIESEKPEESS

SEQ ID NO: 86149 - protein, 13 aa, Borrelia burgdorferi
EKIESEKPEESSP

SEQ ID NO: 86150 - protein, 13 aa, Borrelia burgdorferi
KIESEKPEESSPK

SEQ ID NO: 86151 - protein, 13 aa, Borrelia burgdorferi
IESEKPEESSPKN

SEQ ID NO: 86152 - protein, 14 aa, Borrelia burgdorferi
MKRKAKSILFFLLS

SEQ ID NO: 86153 - protein, 14 aa, Borrelia burgdorferi
KRKAKSILFFLLST

SEQ ID NO: 86154 - protein, 14 aa, Borrelia burgdorferi
RKAKSILFFLLSTV

SEQ ID NO: 86155 - protein, 14 aa, Borrelia burgdorferi
KAKSILFFLLSTVL

SEQ ID NO: 86156 - protein, 14 aa, Borrelia burgdorferi
AKSILFFLLSTVLF

SEQ ID NO: 86157 - protein, 14 aa, Borrelia burgdorferi
KSILFFLLSTVLFA

SEQ ID NO: 86158 - protein, 14 aa, Borrelia burgdorferi
SILFFLLSTVLFAQ

SEQ ID NO: 86159 - protein, 14 aa, Borrelia burgdorferi
ILFFLLSTVLFAQE

SEQ ID NO: 86160 - protein, 14 aa, Borrelia burgdorferi
LFFLLSTVLFAQET

SEQ ID NO: 86161 - protein, 14 aa, Borrelia burgdorferi
FFLLSTVLFAQETD

SEQ ID NO: 86162 - protein, 14 aa, Borrelia burgdorferi
FLLSTVLFAQETDG

SEQ ID NO: 86163 - protein, 14 aa, Borrelia burgdorferi
LLSTVLFAQETDGL

SEQ ID NO: 86164 - protein, 14 aa, Borrelia burgdorferi
LSTVLFAQETDGLA

SEQ ID NO: 86165 - protein, 14 aa, Borrelia burgdorferi
STVLFAQETDGLAE

SEQ ID NO: 86166 - protein, 14 aa, Borrelia burgdorferi
TVLFAQETDGLAEG

SEQ ID NO: 86167 - protein, 14 aa, Borrelia burgdorferi
VLFAQETDGLAEGS

SEQ ID NO: 86168 - protein, 14 aa, Borrelia burgdorferi
LFAQETDGLAEGSK

SEQ ID NO: 86169 - protein, 14 aa, Borrelia burgdorferi
FAQETDGLAEGSKR

SEQ ID NO: 86170 - protein, 14 aa, Borrelia burgdorferi
AQETDGLAEGSKRA

SEQ ID NO: 86171 - protein, 14 aa, Borrelia burgdorferi
QETDGLAEGSKRAE

SEQ ID NO: 86172 - protein, 14 aa, Borrelia burgdorferi
ETDGLAEGSKRAEP

SEQ ID NO: 86173 - protein, 14 aa, Borrelia burgdorferi
TDGLAEGSKRAEPG

SEQ ID NO: 86174 - protein, 14 aa, Borrelia burgdorferi
DGLAEGSKRAEPGE

SEQ ID NO: 86175 - protein, 14 aa, Borrelia burgdorferi
GLAEGSKRAEPGEL

SEQ ID NO: 86176 - protein, 14 aa, Borrelia burgdorferi
LAEGSKRAEPGELV

SEQ ID NO: 86177 - protein, 14 aa, Borrelia burgdorferi
AEGSKRAEPGELVL

SEQ ID NO: 86178 - protein, 14 aa, Borrelia burgdorferi
EGSKRAEPGELVLD

SEQ ID NO: 86179 - protein, 14 aa, Borrelia burgdorferi
GSKRAEPGELVLDF

SEQ ID NO: 86180 - protein, 14 aa, Borrelia burgdorferi
SKRAEPGELVLDFA

SEQ ID NO: 86181 - protein, 14 aa, Borrelia burgdorferi
KRAEPGELVLDFAE

SEQ ID NO: 86182 - protein, 14 aa, Borrelia burgdorferi
RAEPGELVLDFAEL

SEQ ID NO: 86183 - protein, 14 aa, Borrelia burgdorferi
AEPGELVLDFAELA

SEQ ID NO: 86184 - protein, 14 aa, Borrelia burgdorferi
EPGELVLDFAELAR

SEQ ID NO: 86185 - protein, 14 aa, Borrelia burgdorferi
PGELVLDFAELARD

SEQ ID NO: 86186 - protein, 14 aa, Borrelia burgdorferi
GELVLDFAELARDP

SEQ ID NO: 86187 - protein, 14 aa, Borrelia burgdorferi
ELVLDFAELARDPS

SEQ ID NO: 86188 - protein, 14 aa, Borrelia burgdorferi
LVLDFAELARDPSS

SEQ ID NO: 86189 - protein, 14 aa, Borrelia burgdorferi
VLDFAELARDPSST

SEQ ID NO: 86190 - protein, 14 aa, Borrelia burgdorferi
LDFAELARDPSSTR

SEQ ID NO: 86191 - protein, 14 aa, Borrelia burgdorferi
DFAELARDPSSTRL

SEQ ID NO: 86192 - protein, 14 aa, Borrelia burgdorferi
FAELARDPSSTRLD

SEQ ID NO: 86193 - protein, 14 aa, Borrelia burgdorferi
AELARDPSSTRLDL

SEQ ID NO: 86194 - protein, 14 aa, Borrelia burgdorferi
ELARDPSSTRLDLT

SEQ ID NO: 86195 - protein, 14 aa, Borrelia burgdorferi
LARDPSSTRLDLTN

SEQ ID NO: 86196 - protein, 14 aa, Borrelia burgdorferi
ARDPSSTRLDLTNY

SEQ ID NO: 86197 - protein, 14 aa, Borrelia burgdorferi
RDPSSTRLDLTNYV

SEQ ID NO: 86198 - protein, 14 aa, Borrelia burgdorferi
DPSSTRLDLTNYVD

SEQ ID NO: 86199 - protein, 14 aa, Borrelia burgdorferi
PSSTRLDLTNYVDY

SEQ ID NO: 86200 - protein, 14 aa, Borrelia burgdorferi
SSTRLDLTNYVDYV

SEQ ID NO: 86201 - protein, 14 aa, Borrelia burgdorferi
STRLDLTNYVDYVY

SEQ ID NO: 86202 - protein, 14 aa, Borrelia burgdorferi
TRLDLTNYVDYVYS

SEQ ID NO: 86203 - protein, 14 aa, Borrelia burgdorferi
RLDLTNYVDYVYSG

SEQ ID NO: 86204 - protein, 14 aa, Borrelia burgdorferi
LDLTNYVDYVYSGA

SEQ ID NO: 86205 - protein, 14 aa, Borrelia burgdorferi
DLTNYVDYVYSGAS

SEQ ID NO: 86206 - protein, 14 aa, Borrelia burgdorferi
LTNYVDYVYSGASG

SEQ ID NO: 86207 - protein, 14 aa, Borrelia burgdorferi
TNYVDYVYSGASGI

SEQ ID NO: 86208 - protein, 14 aa, Borrelia burgdorferi
NYVDYVYSGASGIV

SEQ ID NO: 86209 - protein, 14 aa, Borrelia burgdorferi
YVDYVYSGASGIVK

SEQ ID NO: 86210 - protein, 14 aa, Borrelia burgdorferi
VDYVYSGASGIVKP

SEQ ID NO: 86211 - protein, 14 aa, Borrelia burgdorferi
DYVYSGASGIVKPE

SEQ ID NO: 86212 - protein, 14 aa, Borrelia burgdorferi
YVYSGASGIVKPED

SEQ ID NO: 86213 - protein, 14 aa, Borrelia burgdorferi
VYSGASGIVKPEDM

SEQ ID NO: 86214 - protein, 14 aa, Borrelia burgdorferi
YSGASGIVKPEDMV

SEQ ID NO: 86215 - protein, 14 aa, Borrelia burgdorferi
SGASGIVKPEDMVV

SEQ ID NO: 86216 - protein, 14 aa, Borrelia burgdorferi
GASGIVKPEDMVVD

SEQ ID NO: 86217 - protein, 14 aa, Borrelia burgdorferi
ASGIVKPEDMVVDL

SEQ ID NO: 86218 - protein, 14 aa, Borrelia burgdorferi
SGIVKPEDMVVDLG

SEQ ID NO: 86219 - protein, 14 aa, Borrelia burgdorferi
GIVKPEDMVVDLGI

SEQ ID NO: 86220 - protein, 14 aa, Borrelia burgdorferi
IVKPEDMVVDLGIN

SEQ ID NO: 86221 - protein, 14 aa, Borrelia burgdorferi
VKPEDMVVDLGINN

SEQ ID NO: 86222 - protein, 14 aa, Borrelia burgdorferi
KPEDMVVDLGINNW

SEQ ID NO: 86223 - protein, 14 aa, Borrelia burgdorferi
PEDMVVDLGINNWS

SEQ ID NO: 86224 - protein, 14 aa, Borrelia burgdorferi
EDMVVDLGINNWSV

SEQ ID NO: 86225 - protein, 14 aa, Borrelia burgdorferi
DMVVDLGINNWSVL

SEQ ID NO: 86226 - protein, 14 aa, Borrelia burgdorferi
MVVDLGINNWSVLL

SEQ ID NO: 86227 - protein, 14 aa, Borrelia burgdorferi
VVDLGINNWSVLLT

SEQ ID NO: 86228 - protein, 14 aa, Borrelia burgdorferi
VDLGINNWSVLLTP

SEQ ID NO: 86229 - protein, 14 aa, Borrelia burgdorferi
DLGINNWSVLLTPS

SEQ ID NO: 86230 - protein, 14 aa, Borrelia burgdorferi
LGINNWSVLLTPSA

SEQ ID NO: 86231 - protein, 14 aa, Borrelia burgdorferi
GINNWSVLLTPSAR

SEQ ID NO: 86232 - protein, 14 aa, Borrelia burgdorferi
INNWSVLLTPSARL

SEQ ID NO: 86233 - protein, 14 aa, Borrelia burgdorferi
NNWSVLLTPSARLQ

SEQ ID NO: 86234 - protein, 14 aa, Borrelia burgdorferi
NWSVLLTPSARLQA

SEQ ID NO: 86235 - protein, 14 aa, Borrelia burgdorferi
WSVLLTPSARLQAY

SEQ ID NO: 86236 - protein, 14 aa, Borrelia burgdorferi
SVLLTPSARLQAYV

SEQ ID NO: 86237 - protein, 14 aa, Borrelia burgdorferi
VLLTPSARLQAYVK

SEQ ID NO: 86238 - protein, 14 aa, Borrelia burgdorferi
LLTPSARLQAYVKN

SEQ ID NO: 86239 - protein, 14 aa, Borrelia burgdorferi
LTPSARLQAYVKNS

SEQ ID NO: 86240 - protein, 14 aa, Borrelia burgdorferi
TPSARLQAYVKNSV

SEQ ID NO: 86241 - protein, 14 aa, Borrelia burgdorferi
PSARLQAYVKNSVV

SEQ ID NO: 86242 - protein, 14 aa, Borrelia burgdorferi
SARLQAYVKNSVVA

SEQ ID NO: 86243 - protein, 14 aa, Borrelia burgdorferi
ARLQAYVKNSVVAP

SEQ ID NO: 86244 - protein, 14 aa, Borrelia burgdorferi
RLQAYVKNSVVAPA

SEQ ID NO: 86245 - protein, 14 aa, Borrelia burgdorferi
LQAYVKNSVVAPAV

SEQ ID NO: 86246 - protein, 14 aa, Borrelia burgdorferi
QAYVKNSVVAPAVV

SEQ ID NO: 86247 - protein, 14 aa, Borrelia burgdorferi
AYVKNSVVAPAVVK

SEQ ID NO: 86248 - protein, 14 aa, Borrelia burgdorferi
YVKNSVVAPAVVKS

SEQ ID NO: 86249 - protein, 14 aa, Borrelia burgdorferi
VKNSVVAPAVVKSE

SEQ ID NO: 86250 - protein, 14 aa, Borrelia burgdorferi
KNSVVAPAVVKSES

SEQ ID NO: 86251 - protein, 14 aa, Borrelia burgdorferi
NSVVAPAVVKSESK

SEQ ID NO: 86252 - protein, 14 aa, Borrelia burgdorferi
SVVAPAVVKSESKR

SEQ ID NO: 86253 - protein, 14 aa, Borrelia burgdorferi
VVAPAVVKSESKRY

SEQ ID NO: 86254 - protein, 14 aa, Borrelia burgdorferi
VAPAVVKSESKRYA

SEQ ID NO: 86255 - protein, 14 aa, Borrelia burgdorferi
APAVVKSESKRYAG

SEQ ID NO: 86256 - protein, 14 aa, Borrelia burgdorferi
PAVVKSESKRYAGD

SEQ ID NO: 86257 - protein, 14 aa, Borrelia burgdorferi
AVVKSESKRYAGDT

SEQ ID NO: 86258 - protein, 14 aa, Borrelia burgdorferi
VVKSESKRYAGDTI

SEQ ID NO: 86259 - protein, 14 aa, Borrelia burgdorferi
VKSESKRYAGDTIL

SEQ ID NO: 86260 - protein, 14 aa, Borrelia burgdorferi
KSESKRYAGDTILG

SEQ ID NO: 86261 - protein, 14 aa, Borrelia burgdorferi
SESKRYAGDTILGV

SEQ ID NO: 86262 - protein, 14 aa, Borrelia burgdorferi
ESKRYAGDTILGVR

SEQ ID NO: 86263 - protein, 14 aa, Borrelia burgdorferi
SKRYAGDTILGVRV

SEQ ID NO: 86264 - protein, 14 aa, Borrelia burgdorferi
KRYAGDTILGVRVL

SEQ ID NO: 86265 - protein, 14 aa, Borrelia burgdorferi
RYAGDTILGVRVLF

SEQ ID NO: 86266 - protein, 14 aa, Borrelia burgdorferi
YAGDTILGVRVLFP

SEQ ID NO: 86267 - protein, 14 aa, Borrelia burgdorferi
AGDTILGVRVLFPS

SEQ ID NO: 86268 - protein, 14 aa, Borrelia burgdorferi
GDTILGVRVLFPSY

SEQ ID NO: 86269 - protein, 14 aa, Borrelia burgdorferi
DTILGVRVLFPSYS

SEQ ID NO: 86270 - protein, 14 aa, Borrelia burgdorferi
TILGVRVLFPSYSQ

SEQ ID NO: 86271 - protein, 14 aa, Borrelia burgdorferi
ILGVRVLFPSYSQS

SEQ ID NO: 86272 - protein, 14 aa, Borrelia burgdorferi
LGVRVLFPSYSQSS

SEQ ID NO: 86273 - protein, 14 aa, Borrelia burgdorferi
GVRVLFPSYSQSSA

SEQ ID NO: 86274 - protein, 14 aa, Borrelia burgdorferi
VRVLFPSYSQSSAM

SEQ ID NO: 86275 - protein, 14 aa, Borrelia burgdorferi
RVLFPSYSQSSAMI

SEQ ID NO: 86276 - protein, 14 aa, Borrelia burgdorferi
VLFPSYSQSSAMIM

SEQ ID NO: 86277 - protein, 14 aa, Borrelia burgdorferi
LFPSYSQSSAMIMP

SEQ ID NO: 86278 - protein, 14 aa, Borrelia burgdorferi
FPSYSQSSAMIMPP

SEQ ID NO: 86279 - protein, 14 aa, Borrelia burgdorferi
PSYSQSSAMIMPPF

SEQ ID NO: 86280 - protein, 14 aa, Borrelia burgdorferi
SYSQSSAMIMPPFK

SEQ ID NO: 86281 - protein, 14 aa, Borrelia burgdorferi
YSQSSAMIMPPFKI

SEQ ID NO: 86282 - protein, 14 aa, Borrelia burgdorferi
SQSSAMIMPPFKIP

SEQ ID NO: 86283 - protein, 14 aa, Borrelia burgdorferi
QSSAMIMPPFKIPF

SEQ ID NO: 86284 - protein, 14 aa, Borrelia burgdorferi
SSAMIMPPFKIPFY

SEQ ID NO: 86285 - protein, 14 aa, Borrelia burgdorferi
SAMIMPPFKIPFYS

SEQ ID NO: 86286 - protein, 14 aa, Borrelia burgdorferi
AMIMPPFKIPFYSG

SEQ ID NO: 86287 - protein, 14 aa, Borrelia burgdorferi
MIMPPFKIPFYSGE

SEQ ID NO: 86288 - protein, 14 aa, Borrelia burgdorferi
IMPPFKIPFYSGES

SEQ ID NO: 86289 - protein, 14 aa, Borrelia burgdorferi
MPPFKIPFYSGESG

SEQ ID NO: 86290 - protein, 14 aa, Borrelia burgdorferi
PPFKIPFYSGESGN

SEQ ID NO: 86291 - protein, 14 aa, Borrelia burgdorferi
PFKIPFYSGESGNQ

SEQ ID NO: 86292 - protein, 14 aa, Borrelia burgdorferi
FKIPFYSGESGNQF

SEQ ID NO: 86293 - protein, 14 aa, Borrelia burgdorferi
KIPFYSGESGNQFL

SEQ ID NO: 86294 - protein, 14 aa, Borrelia burgdorferi
IPFYSGESGNQFLG

SEQ ID NO: 86295 - protein, 14 aa, Borrelia burgdorferi
PFYSGESGNQFLGK

SEQ ID NO: 86296 - protein, 14 aa, Borrelia burgdorferi
FYSGESGNQFLGKG

SEQ ID NO: 86297 - protein, 14 aa, Borrelia burgdorferi
YSGESGNQFLGKGL

SEQ ID NO: 86298 - protein, 14 aa, Borrelia burgdorferi
SGESGNQFLGKGLI

SEQ ID NO: 86299 - protein, 14 aa, Borrelia burgdorferi
GESGNQFLGKGLID

SEQ ID NO: 86300 - protein, 14 aa, Borrelia burgdorferi
ESGNQFLGKGLIDN

SEQ ID NO: 86301 - protein, 14 aa, Borrelia burgdorferi
SGNQFLGKGLIDNI

SEQ ID NO: 86302 - protein, 14 aa, Borrelia burgdorferi
GNQFLGKGLIDNIK

SEQ ID NO: 86303 - protein, 14 aa, Borrelia burgdorferi
NQFLGKGLIDNIKT

SEQ ID NO: 86304 - protein, 14 aa, Borrelia burgdorferi
QFLGKGLIDNIKTM

SEQ ID NO: 86305 - protein, 14 aa, Borrelia burgdorferi
FLGKGLIDNIKTMK

SEQ ID NO: 86306 - protein, 14 aa, Borrelia burgdorferi
LGKGLIDNIKTMKE

SEQ ID NO: 86307 - protein, 14 aa, Borrelia burgdorferi
GKGLIDNIKTMKEI

SEQ ID NO: 86308 - protein, 14 aa, Borrelia burgdorferi
KGLIDNIKTMKEIK

SEQ ID NO: 86309 - protein, 14 aa, Borrelia burgdorferi
GLIDNIKTMKEIKV

SEQ ID NO: 86310 - protein, 14 aa, Borrelia burgdorferi
LIDNIKTMKEIKVS

SEQ ID NO: 86311 - protein, 14 aa, Borrelia burgdorferi
IDNIKTMKEIKVSV

SEQ ID NO: 86312 - protein, 14 aa, Borrelia burgdorferi
DNIKTMKEIKVSVY

SEQ ID NO: 86313 - protein, 14 aa, Borrelia burgdorferi
NIKTMKEIKVSVYS

SEQ ID NO: 86314 - protein, 14 aa, Borrelia burgdorferi
IKTMKEIKVSVYSL

SEQ ID NO: 86315 - protein, 14 aa, Borrelia burgdorferi
KTMKEIKVSVYSLG

SEQ ID NO: 86316 - protein, 14 aa, Borrelia burgdorferi
TMKEIKVSVYSLGY

SEQ ID NO: 86317 - protein, 14 aa, Borrelia burgdorferi
MKEIKVSVYSLGYE

SEQ ID NO: 86318 - protein, 14 aa, Borrelia burgdorferi
KEIKVSVYSLGYEI

SEQ ID NO: 86319 - protein, 14 aa, Borrelia burgdorferi
EIKVSVYSLGYEID

SEQ ID NO: 86320 - protein, 14 aa, Borrelia burgdorferi
IKVSVYSLGYEIDL

SEQ ID NO: 86321 - protein, 14 aa, Borrelia burgdorferi
KVSVYSLGYEIDLE

SEQ ID NO: 86322 - protein, 14 aa, Borrelia burgdorferi
VSVYSLGYEIDLEV

SEQ ID NO: 86323 - protein, 14 aa, Borrelia burgdorferi
SVYSLGYEIDLEVL

SEQ ID NO: 86324 - protein, 14 aa, Borrelia burgdorferi
VYSLGYEIDLEVLF

SEQ ID NO: 86325 - protein, 14 aa, Borrelia burgdorferi
YSLGYEIDLEVLFE

SEQ ID NO: 86326 - protein, 14 aa, Borrelia burgdorferi
SLGYEIDLEVLFED

SEQ ID NO: 86327 - protein, 14 aa, Borrelia burgdorferi
LGYEIDLEVLFEDM

SEQ ID NO: 86328 - protein, 14 aa, Borrelia burgdorferi
GYEIDLEVLFEDMN

SEQ ID NO: 86329 - protein, 14 aa, Borrelia burgdorferi
YEIDLEVLFEDMNG

SEQ ID NO: 86330 - protein, 14 aa, Borrelia burgdorferi
EIDLEVLFEDMNGM

SEQ ID NO: 86331 - protein, 14 aa, Borrelia burgdorferi
IDLEVLFEDMNGME

SEQ ID NO: 86332 - protein, 14 aa, Borrelia burgdorferi
DLEVLFEDMNGMEY

SEQ ID NO: 86333 - protein, 14 aa, Borrelia burgdorferi
LEVLFEDMNGMEYA

SEQ ID NO: 86334 - protein, 14 aa, Borrelia burgdorferi
EVLFEDMNGMEYAY

SEQ ID NO: 86335 - protein, 14 aa, Borrelia burgdorferi
VLFEDMNGMEYAYS

SEQ ID NO: 86336 - protein, 14 aa, Borrelia burgdorferi
LFEDMNGMEYAYSM

SEQ ID NO: 86337 - protein, 14 aa, Borrelia burgdorferi
FEDMNGMEYAYSMG

SEQ ID NO: 86338 - protein, 14 aa, Borrelia burgdorferi
EDMNGMEYAYSMGT

SEQ ID NO: 86339 - protein, 14 aa, Borrelia burgdorferi
DMNGMEYAYSMGTL

SEQ ID NO: 86340 - protein, 14 aa, Borrelia burgdorferi
MNGMEYAYSMGTLK

SEQ ID NO: 86341 - protein, 14 aa, Borrelia burgdorferi
NGMEYAYSMGTLKF

SEQ ID NO: 86342 - protein, 14 aa, Borrelia burgdorferi
GMEYAYSMGTLKFK

SEQ ID NO: 86343 - protein, 14 aa, Borrelia burgdorferi
MEYAYSMGTLKFKG

SEQ ID NO: 86344 - protein, 14 aa, Borrelia burgdorferi
EYAYSMGTLKFKGW

SEQ ID NO: 86345 - protein, 14 aa, Borrelia burgdorferi
YAYSMGTLKFKGWA

SEQ ID NO: 86346 - protein, 14 aa, Borrelia burgdorferi
AYSMGTLKFKGWAD

SEQ ID NO: 86347 - protein, 14 aa, Borrelia burgdorferi
YSMGTLKFKGWADL

SEQ ID NO: 86348 - protein, 14 aa, Borrelia burgdorferi
SMGTLKFKGWADLI

SEQ ID NO: 86349 - protein, 14 aa, Borrelia burgdorferi
MGTLKFKGWADLIW

SEQ ID NO: 86350 - protein, 14 aa, Borrelia burgdorferi
GTLKFKGWADLIWS

SEQ ID NO: 86351 - protein, 14 aa, Borrelia burgdorferi
TLKFKGWADLIWSN

SEQ ID NO: 86352 - protein, 14 aa, Borrelia burgdorferi
LKFKGWADLIWSNP

SEQ ID NO: 86353 - protein, 14 aa, Borrelia burgdorferi
KFKGWADLIWSNPN

SEQ ID NO: 86354 - protein, 14 aa, Borrelia burgdorferi
FKGWADLIWSNPNY

SEQ ID NO: 86355 - protein, 14 aa, Borrelia burgdorferi
KGWADLIWSNPNYI

SEQ ID NO: 86356 - protein, 14 aa, Borrelia burgdorferi
GWADLIWSNPNYIP

SEQ ID NO: 86357 - protein, 14 aa, Borrelia burgdorferi
WADLIWSNPNYIPN

SEQ ID NO: 86358 - protein, 14 aa, Borrelia burgdorferi
ADLIWSNPNYIPNI

SEQ ID NO: 86359 - protein, 14 aa, Borrelia burgdorferi
DLIWSNPNYIPNIS

SEQ ID NO: 86360 - protein, 14 aa, Borrelia burgdorferi
LIWSNPNYIPNISS

SEQ ID NO: 86361 - protein, 14 aa, Borrelia burgdorferi
IWSNPNYIPNISSR

SEQ ID NO: 86362 - protein, 14 aa, Borrelia burgdorferi
WSNPNYIPNISSRI

SEQ ID NO: 86363 - protein, 14 aa, Borrelia burgdorferi
SNPNYIPNISSRII

SEQ ID NO: 86364 - protein, 14 aa, Borrelia burgdorferi
NPNYIPNISSRIIK

SEQ ID NO: 86365 - protein, 14 aa, Borrelia burgdorferi
PNYIPNISSRIIKD

SEQ ID NO: 86366 - protein, 14 aa, Borrelia burgdorferi
NYIPNISSRIIKDD

SEQ ID NO: 86367 - protein, 14 aa, Borrelia burgdorferi
YIPNISSRIIKDDV

SEQ ID NO: 86368 - protein, 14 aa, Borrelia burgdorferi
IPNISSRIIKDDVP

SEQ ID NO: 86369 - protein, 14 aa, Borrelia burgdorferi
PNISSRIIKDDVPN

SEQ ID NO: 86370 - protein, 14 aa, Borrelia burgdorferi
NISSRIIKDDVPNY

SEQ ID NO: 86371 - protein, 14 aa, Borrelia burgdorferi
ISSRIIKDDVPNYP

SEQ ID NO: 86372 - protein, 14 aa, Borrelia burgdorferi
SSRIIKDDVPNYPL

SEQ ID NO: 86373 - protein, 14 aa, Borrelia burgdorferi
SRIIKDDVPNYPLA

SEQ ID NO: 86374 - protein, 14 aa, Borrelia burgdorferi
RIIKDDVPNYPLAS

SEQ ID NO: 86375 - protein, 14 aa, Borrelia burgdorferi
IIKDDVPNYPLASS

SEQ ID NO: 86376 - protein, 14 aa, Borrelia burgdorferi
IKDDVPNYPLASSK

SEQ ID NO: 86377 - protein, 14 aa, Borrelia burgdorferi
KDDVPNYPLASSKM

SEQ ID NO: 86378 - protein, 14 aa, Borrelia burgdorferi
DDVPNYPLASSKMR

SEQ ID NO: 86379 - protein, 14 aa, Borrelia burgdorferi
DVPNYPLASSKMRF

SEQ ID NO: 86380 - protein, 14 aa, Borrelia burgdorferi
VPNYPLASSKMRFK

SEQ ID NO: 86381 - protein, 14 aa, Borrelia burgdorferi
PNYPLASSKMRFKA

SEQ ID NO: 86382 - protein, 14 aa, Borrelia burgdorferi
NYPLASSKMRFKAF

SEQ ID NO: 86383 - protein, 14 aa, Borrelia burgdorferi
YPLASSKMRFKAFR

SEQ ID NO: 86384 - protein, 14 aa, Borrelia burgdorferi
PLASSKMRFKAFRV

SEQ ID NO: 86385 - protein, 14 aa, Borrelia burgdorferi
LASSKMRFKAFRVS

SEQ ID NO: 86386 - protein, 14 aa, Borrelia burgdorferi
ASSKMRFKAFRVSK

SEQ ID NO: 86387 - protein, 14 aa, Borrelia burgdorferi
SSKMRFKAFRVSKS

SEQ ID NO: 86388 - protein, 14 aa, Borrelia burgdorferi
SKMRFKAFRVSKSH

SEQ ID NO: 86389 - protein, 14 aa, Borrelia burgdorferi
KMRFKAFRVSKSHS

SEQ ID NO: 86390 - protein, 14 aa, Borrelia burgdorferi
MRFKAFRVSKSHSS

SEQ ID NO: 86391 - protein, 14 aa, Borrelia burgdorferi
RFKAFRVSKSHSSK

SEQ ID NO: 86392 - protein, 14 aa, Borrelia burgdorferi
FKAFRVSKSHSSKV

SEQ ID NO: 86393 - protein, 14 aa, Borrelia burgdorferi
KAFRVSKSHSSKVK

SEQ ID NO: 86394 - protein, 14 aa, Borrelia burgdorferi
AFRVSKSHSSKVKN

SEQ ID NO: 86395 - protein, 14 aa, Borrelia burgdorferi
FRVSKSHSSKVKNF

SEQ ID NO: 86396 - protein, 14 aa, Borrelia burgdorferi
RVSKSHSSKVKNFI

SEQ ID NO: 86397 - protein, 14 aa, Borrelia burgdorferi
VSKSHSSKVKNFIF

SEQ ID NO: 86398 - protein, 14 aa, Borrelia burgdorferi
SKSHSSKVKNFIFY

SEQ ID NO: 86399 - protein, 14 aa, Borrelia burgdorferi
KSHSSKVKNFIFYV

SEQ ID NO: 86400 - protein, 14 aa, Borrelia burgdorferi
SHSSKVKNFIFYVK

SEQ ID NO: 86401 - protein, 14 aa, Borrelia burgdorferi
HSSKVKNFIFYVKD

SEQ ID NO: 86402 - protein, 14 aa, Borrelia burgdorferi
SSKVKNFIFYVKDL

SEQ ID NO: 86403 - protein, 14 aa, Borrelia burgdorferi
SKVKNFIFYVKDLR

SEQ ID NO: 86404 - protein, 14 aa, Borrelia burgdorferi
KVKNFIFYVKDLRV

SEQ ID NO: 86405 - protein, 14 aa, Borrelia burgdorferi
VKNFIFYVKDLRVL

SEQ ID NO: 86406 - protein, 14 aa, Borrelia burgdorferi
KNFIFYVKDLRVLY

SEQ ID NO: 86407 - protein, 14 aa, Borrelia burgdorferi
NFIFYVKDLRVLYD

SEQ ID NO: 86408 - protein, 14 aa, Borrelia burgdorferi
FIFYVKDLRVLYDK

SEQ ID NO: 86409 - protein, 14 aa, Borrelia burgdorferi
IFYVKDLRVLYDKL

SEQ ID NO: 86410 - protein, 14 aa, Borrelia burgdorferi
FYVKDLRVLYDKLS

SEQ ID NO: 86411 - protein, 14 aa, Borrelia burgdorferi
YVKDLRVLYDKLSV

SEQ ID NO: 86412 - protein, 14 aa, Borrelia burgdorferi
VKDLRVLYDKLSVS

SEQ ID NO: 86413 - protein, 14 aa, Borrelia burgdorferi
KDLRVLYDKLSVSI

SEQ ID NO: 86414 - protein, 14 aa, Borrelia burgdorferi
DLRVLYDKLSVSID

SEQ ID NO: 86415 - protein, 14 aa, Borrelia burgdorferi
LRVLYDKLSVSIDS

SEQ ID NO: 86416 - protein, 14 aa, Borrelia burgdorferi
RVLYDKLSVSIDSD

SEQ ID NO: 86417 - protein, 14 aa, Borrelia burgdorferi
VLYDKLSVSIDSDI

SEQ ID NO: 86418 - protein, 14 aa, Borrelia burgdorferi
LYDKLSVSIDSDID

SEQ ID NO: 86419 - protein, 14 aa, Borrelia burgdorferi
YDKLSVSIDSDIDS

SEQ ID NO: 86420 - protein, 14 aa, Borrelia burgdorferi
DKLSVSIDSDIDSE

SEQ ID NO: 86421 - protein, 14 aa, Borrelia burgdorferi
KLSVSIDSDIDSES

SEQ ID NO: 86422 - protein, 14 aa, Borrelia burgdorferi
LSVSIDSDIDSESV

SEQ ID NO: 86423 - protein, 14 aa, Borrelia burgdorferi
SVSIDSDIDSESVF

SEQ ID NO: 86424 - protein, 14 aa, Borrelia burgdorferi
VSIDSDIDSESVFK

SEQ ID NO: 86425 - protein, 14 aa, Borrelia burgdorferi
SIDSDIDSESVFKV

SEQ ID NO: 86426 - protein, 14 aa, Borrelia burgdorferi
IDSDIDSESVFKVY

SEQ ID NO: 86427 - protein, 14 aa, Borrelia burgdorferi
DSDIDSESVFKVYE

SEQ ID NO: 86428 - protein, 14 aa, Borrelia burgdorferi
SDIDSESVFKVYET

SEQ ID NO: 86429 - protein, 14 aa, Borrelia burgdorferi
DIDSESVFKVYETS

SEQ ID NO: 86430 - protein, 14 aa, Borrelia burgdorferi
IDSESVFKVYETSG

SEQ ID NO: 86431 - protein, 14 aa, Borrelia burgdorferi
DSESVFKVYETSGT

SEQ ID NO: 86432 - protein, 14 aa, Borrelia burgdorferi
SESVFKVYETSGTE

SEQ ID NO: 86433 - protein, 14 aa, Borrelia burgdorferi
ESVFKVYETSGTES

SEQ ID NO: 86434 - protein, 14 aa, Borrelia burgdorferi
SVFKVYETSGTESL

SEQ ID NO: 86435 - protein, 14 aa, Borrelia burgdorferi
VFKVYETSGTESLR

SEQ ID NO: 86436 - protein, 14 aa, Borrelia burgdorferi
FKVYETSGTESLRK

SEQ ID NO: 86437 - protein, 14 aa, Borrelia burgdorferi
KVYETSGTESLRKL

SEQ ID NO: 86438 - protein, 14 aa, Borrelia burgdorferi
VYETSGTESLRKLK

SEQ ID NO: 86439 - protein, 14 aa, Borrelia burgdorferi
YETSGTESLRKLKA

SEQ ID NO: 86440 - protein, 14 aa, Borrelia burgdorferi
ETSGTESLRKLKAH

SEQ ID NO: 86441 - protein, 14 aa, Borrelia burgdorferi
TSGTESLRKLKAHE

SEQ ID NO: 86442 - protein, 14 aa, Borrelia burgdorferi
SGTESLRKLKAHET

SEQ ID NO: 86443 - protein, 14 aa, Borrelia burgdorferi
GTESLRKLKAHETF

SEQ ID NO: 86444 - protein, 14 aa, Borrelia burgdorferi
TESLRKLKAHETFK

SEQ ID NO: 86445 - protein, 14 aa, Borrelia burgdorferi
ESLRKLKAHETFKR

SEQ ID NO: 86446 - protein, 14 aa, Borrelia burgdorferi
SLRKLKAHETFKRV

SEQ ID NO: 86447 - protein, 14 aa, Borrelia burgdorferi
LRKLKAHETFKRVL

SEQ ID NO: 86448 - protein, 14 aa, Borrelia burgdorferi
RKLKAHETFKRVLK

SEQ ID NO: 86449 - protein, 14 aa, Borrelia burgdorferi
KLKAHETFKRVLKL

SEQ ID NO: 86450 - protein, 14 aa, Borrelia burgdorferi
LKAHETFKRVLKLR

SEQ ID NO: 86451 - protein, 14 aa, Borrelia burgdorferi
KAHETFKRVLKLRE

SEQ ID NO: 86452 - protein, 14 aa, Borrelia burgdorferi
AHETFKRVLKLREK

SEQ ID NO: 86453 - protein, 14 aa, Borrelia burgdorferi
HETFKRVLKLREKI

SEQ ID NO: 86454 - protein, 14 aa, Borrelia burgdorferi
ETFKRVLKLREKIS

SEQ ID NO: 86455 - protein, 14 aa, Borrelia burgdorferi
TFKRVLKLREKISI

SEQ ID NO: 86456 - protein, 14 aa, Borrelia burgdorferi
FKRVLKLREKISIA

SEQ ID NO: 86457 - protein, 14 aa, Borrelia burgdorferi
KRVLKLREKISIAE

SEQ ID NO: 86458 - protein, 14 aa, Borrelia burgdorferi
RVLKLREKISIAEG

SEQ ID NO: 86459 - protein, 14 aa, Borrelia burgdorferi
VLKLREKISIAEGS

SEQ ID NO: 86460 - protein, 14 aa, Borrelia burgdorferi
LKLREKISIAEGSF

SEQ ID NO: 86461 - protein, 14 aa, Borrelia burgdorferi
KLREKISIAEGSFQ

SEQ ID NO: 86462 - protein, 14 aa, Borrelia burgdorferi
LREKISIAEGSFQN

SEQ ID NO: 86463 - protein, 14 aa, Borrelia burgdorferi
REKISIAEGSFQNF

SEQ ID NO: 86464 - protein, 14 aa, Borrelia burgdorferi
EKISIAEGSFQNFV

SEQ ID NO: 86465 - protein, 14 aa, Borrelia burgdorferi
KISIAEGSFQNFVE

SEQ ID NO: 86466 - protein, 14 aa, Borrelia burgdorferi
ISIAEGSFQNFVEK

SEQ ID NO: 86467 - protein, 14 aa, Borrelia burgdorferi
SIAEGSFQNFVEKI

SEQ ID NO: 86468 - protein, 14 aa, Borrelia burgdorferi
IAEGSFQNFVEKIE

SEQ ID NO: 86469 - protein, 14 aa, Borrelia burgdorferi
AEGSFQNFVEKIES

SEQ ID NO: 86470 - protein, 14 aa, Borrelia burgdorferi
EGSFQNFVEKIESE

SEQ ID NO: 86471 - protein, 14 aa, Borrelia burgdorferi
GSFQNFVEKIESEK

SEQ ID NO: 86472 - protein, 14 aa, Borrelia burgdorferi
SFQNFVEKIESEKP

SEQ ID NO: 86473 - protein, 14 aa, Borrelia burgdorferi
FQNFVEKIESEKPE

SEQ ID NO: 86474 - protein, 14 aa, Borrelia burgdorferi
QNFVEKIESEKPEE

SEQ ID NO: 86475 - protein, 14 aa, Borrelia burgdorferi
NFVEKIESEKPEES

SEQ ID NO: 86476 - protein, 14 aa, Borrelia burgdorferi
FVEKIESEKPEESS

SEQ ID NO: 86477 - protein, 14 aa, Borrelia burgdorferi
VEKIESEKPEESSP

SEQ ID NO: 86478 - protein, 14 aa, Borrelia burgdorferi
EKIESEKPEESSPK

SEQ ID NO: 86479 - protein, 14 aa, Borrelia burgdorferi
KIESEKPEESSPKN

SEQ ID NO: 86480 - protein, 15 aa, Borrelia burgdorferi
MKRKAKSILFFLLST

SEQ ID NO: 86481 - protein, 15 aa, Borrelia burgdorferi
KRKAKSILFFLLSTV

SEQ ID NO: 86482 - protein, 15 aa, Borrelia burgdorferi
RKAKSILFFLLSTVL

SEQ ID NO: 86483 - protein, 15 aa, Borrelia burgdorferi
KAKSILFFLLSTVLF

SEQ ID NO: 86484 - protein, 15 aa, Borrelia burgdorferi
AKSILFFLLSTVLFA

SEQ ID NO: 86485 - protein, 15 aa, Borrelia burgdorferi
KSILFFLLSTVLFAQ

SEQ ID NO: 86486 - protein, 15 aa, Borrelia burgdorferi
SILFFLLSTVLFAQE

SEQ ID NO: 86487 - protein, 15 aa, Borrelia burgdorferi
ILFFLLSTVLFAQET

SEQ ID NO: 86488 - protein, 15 aa, Borrelia burgdorferi
LFFLLSTVLFAQETD

SEQ ID NO: 86489 - protein, 15 aa, Borrelia burgdorferi
FFLLSTVLFAQETDG

SEQ ID NO: 86490 - protein, 15 aa, Borrelia burgdorferi
FLLSTVLFAQETDGL

SEQ ID NO: 86491 - protein, 15 aa, Borrelia burgdorferi
LLSTVLFAQETDGLA

SEQ ID NO: 86492 - protein, 15 aa, Borrelia burgdorferi
LSTVLFAQETDGLAE

SEQ ID NO: 86493 - protein, 15 aa, Borrelia burgdorferi
STVLFAQETDGLAEG

SEQ ID NO: 86494 - protein, 15 aa, Borrelia burgdorferi
TVLFAQETDGLAEGS

SEQ ID NO: 86495 - protein, 15 aa, Borrelia burgdorferi
VLFAQETDGLAEGSK

SEQ ID NO: 86496 - protein, 15 aa, Borrelia burgdorferi
LFAQETDGLAEGSKR

SEQ ID NO: 86497 - protein, 15 aa, Borrelia burgdorferi
FAQETDGLAEGSKRA

SEQ ID NO: 86498 - protein, 15 aa, Borrelia burgdorferi
AQETDGLAEGSKRAE

SEQ ID NO: 86499 - protein, 15 aa, Borrelia burgdorferi
QETDGLAEGSKRAEP

SEQ ID NO: 86500 - protein, 15 aa, Borrelia burgdorferi
ETDGLAEGSKRAEPG

SEQ ID NO: 86501 - protein, 15 aa, Borrelia burgdorferi
TDGLAEGSKRAEPGE

SEQ ID NO: 86502 - protein, 15 aa, Borrelia burgdorferi
DGLAEGSKRAEPGEL

SEQ ID NO: 86503 - protein, 15 aa, Borrelia burgdorferi
GLAEGSKRAEPGELV

SEQ ID NO: 86504 - protein, 15 aa, Borrelia burgdorferi
LAEGSKRAEPGELVL

SEQ ID NO: 86505 - protein, 15 aa, Borrelia burgdorferi
AEGSKRAEPGELVLD

SEQ ID NO: 86506 - protein, 15 aa, Borrelia burgdorferi
EGSKRAEPGELVLDF

SEQ ID NO: 86507 - protein, 15 aa, Borrelia burgdorferi
GSKRAEPGELVLDFA

SEQ ID NO: 86508 - protein, 15 aa, Borrelia burgdorferi
SKRAEPGELVLDFAE

SEQ ID NO: 86509 - protein, 15 aa, Borrelia burgdorferi
KRAEPGELVLDFAEL

SEQ ID NO: 86510 - protein, 15 aa, Borrelia burgdorferi
RAEPGELVLDFAELA

SEQ ID NO: 86511 - protein, 15 aa, Borrelia burgdorferi
AEPGELVLDFAELAR

SEQ ID NO: 86512 - protein, 15 aa, Borrelia burgdorferi
EPGELVLDFAELARD

SEQ ID NO: 86513 - protein, 15 aa, Borrelia burgdorferi
PGELVLDFAELARDP

SEQ ID NO: 86514 - protein, 15 aa, Borrelia burgdorferi
GELVLDFAELARDPS

SEQ ID NO: 86515 - protein, 15 aa, Borrelia burgdorferi
ELVLDFAELARDPSS

SEQ ID NO: 86516 - protein, 15 aa, Borrelia burgdorferi
LVLDFAELARDPSST

SEQ ID NO: 86517 - protein, 15 aa, Borrelia burgdorferi
VLDFAELARDPSSTR

SEQ ID NO: 86518 - protein, 15 aa, Borrelia burgdorferi
LDFAELARDPSSTRL

SEQ ID NO: 86519 - protein, 15 aa, Borrelia burgdorferi
DFAELARDPSSTRLD

SEQ ID NO: 86520 - protein, 15 aa, Borrelia burgdorferi
FAELARDPSSTRLDL

SEQ ID NO: 86521 - protein, 15 aa, Borrelia burgdorferi
AELARDPSSTRLDLT

SEQ ID NO: 86522 - protein, 15 aa, Borrelia burgdorferi
ELARDPSSTRLDLTN

SEQ ID NO: 86523 - protein, 15 aa, Borrelia burgdorferi
LARDPSSTRLDLTNY

SEQ ID NO: 86524 - protein, 15 aa, Borrelia burgdorferi
ARDPSSTRLDLTNYV

SEQ ID NO: 86525 - protein, 15 aa, Borrelia burgdorferi
RDPSSTRLDLTNYVD

SEQ ID NO: 86526 - protein, 15 aa, Borrelia burgdorferi
DPSSTRLDLTNYVDY

SEQ ID NO: 86527 - protein, 15 aa, Borrelia burgdorferi
PSSTRLDLTNYVDYV

SEQ ID NO: 86528 - protein, 15 aa, Borrelia burgdorferi
SSTRLDLTNYVDYVY

SEQ ID NO: 86529 - protein, 15 aa, Borrelia burgdorferi
STRLDLTNYVDYVYS

SEQ ID NO: 86530 - protein, 15 aa, Borrelia burgdorferi
TRLDLTNYVDYVYSG

SEQ ID NO: 86531 - protein, 15 aa, Borrelia burgdorferi
RLDLTNYVDYVYSGA

SEQ ID NO: 86532 - protein, 15 aa, Borrelia burgdorferi
LDLTNYVDYVYSGAS

SEQ ID NO: 86533 - protein, 15 aa, Borrelia burgdorferi
DLTNYVDYVYSGASG

SEQ ID NO: 86534 - protein, 15 aa, Borrelia burgdorferi
LTNYVDYVYSGASGI

SEQ ID NO: 86535 - protein, 15 aa, Borrelia burgdorferi
TNYVDYVYSGASGIV

SEQ ID NO: 86536 - protein, 15 aa, Borrelia burgdorferi
NYVDYVYSGASGIVK

SEQ ID NO: 86537 - protein, 15 aa, Borrelia burgdorferi
YVDYVYSGASGIVKP

SEQ ID NO: 86538 - protein, 15 aa, Borrelia burgdorferi
VDYVYSGASGIVKPE

SEQ ID NO: 86539 - protein, 15 aa, Borrelia burgdorferi
DYVYSGASGIVKPED

SEQ ID NO: 86540 - protein, 15 aa, Borrelia burgdorferi
YVYSGASGIVKPEDM

SEQ ID NO: 86541 - protein, 15 aa, Borrelia burgdorferi
VYSGASGIVKPEDMV

SEQ ID NO: 86542 - protein, 15 aa, Borrelia burgdorferi
YSGASGIVKPEDMVV

SEQ ID NO: 86543 - protein, 15 aa, Borrelia burgdorferi
SGASGIVKPEDMVVD

SEQ ID NO: 86544 - protein, 15 aa, Borrelia burgdorferi
GASGIVKPEDMVVDL

SEQ ID NO: 86545 - protein, 15 aa, Borrelia burgdorferi
ASGIVKPEDMVVDLG

SEQ ID NO: 86546 - protein, 15 aa, Borrelia burgdorferi
SGIVKPEDMVVDLGI

SEQ ID NO: 86547 - protein, 15 aa, Borrelia burgdorferi
GIVKPEDMVVDLGIN

SEQ ID NO: 86548 - protein, 15 aa, Borrelia burgdorferi
IVKPEDMVVDLGINN

SEQ ID NO: 86549 - protein, 15 aa, Borrelia burgdorferi
VKPEDMVVDLGINNW

SEQ ID NO: 86550 - protein, 15 aa, Borrelia burgdorferi
KPEDMVVDLGINNWS

SEQ ID NO: 86551 - protein, 15 aa, Borrelia burgdorferi
PEDMVVDLGINNWSV

SEQ ID NO: 86552 - protein, 15 aa, Borrelia burgdorferi
EDMVVDLGINNWSVL

SEQ ID NO: 86553 - protein, 15 aa, Borrelia burgdorferi
DMVVDLGINNWSVLL

SEQ ID NO: 86554 - protein, 15 aa, Borrelia burgdorferi
MVVDLGINNWSVLLT

SEQ ID NO: 86555 - protein, 15 aa, Borrelia burgdorferi
VVDLGINNWSVLLTP

SEQ ID NO: 86556 - protein, 15 aa, Borrelia burgdorferi
VDLGINNWSVLLTPS

SEQ ID NO: 86557 - protein, 15 aa, Borrelia burgdorferi
DLGINNWSVLLTPSA

SEQ ID NO: 86558 - protein, 15 aa, Borrelia burgdorferi
LGINNWSVLLTPSAR

SEQ ID NO: 86559 - protein, 15 aa, Borrelia burgdorferi
GINNWSVLLTPSARL

SEQ ID NO: 86560 - protein, 15 aa, Borrelia burgdorferi
INNWSVLLTPSARLQ

SEQ ID NO: 86561 - protein, 15 aa, Borrelia burgdorferi
NNWSVLLTPSARLQA

SEQ ID NO: 86562 - protein, 15 aa, Borrelia burgdorferi
NWSVLLTPSARLQAY

SEQ ID NO: 86563 - protein, 15 aa, Borrelia burgdorferi
WSVLLTPSARLQAYV

SEQ ID NO: 86564 - protein, 15 aa, Borrelia burgdorferi
SVLLTPSARLQAYVK

SEQ ID NO: 86565 - protein, 15 aa, Borrelia burgdorferi
VLLTPSARLQAYVKN

SEQ ID NO: 86566 - protein, 15 aa, Borrelia burgdorferi
LLTPSARLQAYVKNS

SEQ ID NO: 86567 - protein, 15 aa, Borrelia burgdorferi
LTPSARLQAYVKNSV

SEQ ID NO: 86568 - protein, 15 aa, Borrelia burgdorferi
TPSARLQAYVKNSVV

SEQ ID NO: 86569 - protein, 15 aa, Borrelia burgdorferi
PSARLQAYVKNSVVA

SEQ ID NO: 86570 - protein, 15 aa, Borrelia burgdorferi
SARLQAYVKNSVVAP

SEQ ID NO: 86571 - protein, 15 aa, Borrelia burgdorferi
ARLQAYVKNSVVAPA

SEQ ID NO: 86572 - protein, 15 aa, Borrelia burgdorferi
RLQAYVKNSVVAPAV

SEQ ID NO: 86573 - protein, 15 aa, Borrelia burgdorferi
LQAYVKNSVVAPAVV

SEQ ID NO: 86574 - protein, 15 aa, Borrelia burgdorferi
QAYVKNSVVAPAVVK

SEQ ID NO: 86575 - protein, 15 aa, Borrelia burgdorferi
AYVKNSVVAPAVVKS

SEQ ID NO: 86576 - protein, 15 aa, Borrelia burgdorferi
YVKNSVVAPAVVKSE

SEQ ID NO: 86577 - protein, 15 aa, Borrelia burgdorferi
VKNSVVAPAVVKSES

SEQ ID NO: 86578 - protein, 15 aa, Borrelia burgdorferi
KNSVVAPAVVKSESK

SEQ ID NO: 86579 - protein, 15 aa, Borrelia burgdorferi
NSVVAPAVVKSESKR

SEQ ID NO: 86580 - protein, 15 aa, Borrelia burgdorferi
SVVAPAVVKSESKRY

SEQ ID NO: 86581 - protein, 15 aa, Borrelia burgdorferi
VVAPAVVKSESKRYA

SEQ ID NO: 86582 - protein, 15 aa, Borrelia burgdorferi
VAPAVVKSESKRYAG

SEQ ID NO: 86583 - protein, 15 aa, Borrelia burgdorferi
APAVVKSESKRYAGD

SEQ ID NO: 86584 - protein, 15 aa, Borrelia burgdorferi
PAVVKSESKRYAGDT

SEQ ID NO: 86585 - protein, 15 aa, Borrelia burgdorferi
AVVKSESKRYAGDTI

SEQ ID NO: 86586 - protein, 15 aa, Borrelia burgdorferi
VVKSESKRYAGDTIL

SEQ ID NO: 86587 - protein, 15 aa, Borrelia burgdorferi
VKSESKRYAGDTILG

SEQ ID NO: 86588 - protein, 15 aa, Borrelia burgdorferi
KSESKRYAGDTILGV

SEQ ID NO: 86589 - protein, 15 aa, Borrelia burgdorferi
SESKRYAGDTILGVR

SEQ ID NO: 86590 - protein, 15 aa, Borrelia burgdorferi
ESKRYAGDTILGVRV

SEQ ID NO: 86591 - protein, 15 aa, Borrelia burgdorferi
SKRYAGDTILGVRVL

SEQ ID NO: 86592 - protein, 15 aa, Borrelia burgdorferi
KRYAGDTILGVRVLF

SEQ ID NO: 86593 - protein, 15 aa, Borrelia burgdorferi
RYAGDTILGVRVLFP

SEQ ID NO: 86594 - protein, 15 aa, Borrelia burgdorferi
YAGDTILGVRVLFPS

SEQ ID NO: 86595 - protein, 15 aa, Borrelia burgdorferi
AGDTILGVRVLFPSY

SEQ ID NO: 86596 - protein, 15 aa, Borrelia burgdorferi
GDTILGVRVLFPSYS

SEQ ID NO: 86597 - protein, 15 aa, Borrelia burgdorferi
DTILGVRVLFPSYSQ

SEQ ID NO: 86598 - protein, 15 aa, Borrelia burgdorferi
TILGVRVLFPSYSQS

SEQ ID NO: 86599 - protein, 15 aa, Borrelia burgdorferi
ILGVRVLFPSYSQSS

SEQ ID NO: 86600 - protein, 15 aa, Borrelia burgdorferi
LGVRVLFPSYSQSSA

SEQ ID NO: 86601 - protein, 15 aa, Borrelia burgdorferi
GVRVLFPSYSQSSAM

SEQ ID NO: 86602 - protein, 15 aa, Borrelia burgdorferi
VRVLFPSYSQSSAMI

SEQ ID NO: 86603 - protein, 15 aa, Borrelia burgdorferi
RVLFPSYSQSSAMIM

SEQ ID NO: 86604 - protein, 15 aa, Borrelia burgdorferi
VLFPSYSQSSAMIMP

SEQ ID NO: 86605 - protein, 15 aa, Borrelia burgdorferi
LFPSYSQSSAMIMPP

SEQ ID NO: 86606 - protein, 15 aa, Borrelia burgdorferi
FPSYSQSSAMIMPPF

SEQ ID NO: 86607 - protein, 15 aa, Borrelia burgdorferi
PSYSQSSAMIMPPFK

SEQ ID NO: 86608 - protein, 15 aa, Borrelia burgdorferi
SYSQSSAMIMPPFKI

SEQ ID NO: 86609 - protein, 15 aa, Borrelia burgdorferi
YSQSSAMIMPPFKIP

SEQ ID NO: 86610 - protein, 15 aa, Borrelia burgdorferi
SQSSAMIMPPFKIPF

SEQ ID NO: 86611 - protein, 15 aa, Borrelia burgdorferi
QSSAMIMPPFKIPFY

SEQ ID NO: 86612 - protein, 15 aa, Borrelia burgdorferi
SSAMIMPPFKIPFYS

SEQ ID NO: 86613 - protein, 15 aa, Borrelia burgdorferi
SAMIMPPFKIPFYSG

SEQ ID NO: 86614 - protein, 15 aa, Borrelia burgdorferi
AMIMPPFKIPFYSGE

SEQ ID NO: 86615 - protein, 15 aa, Borrelia burgdorferi
MIMPPFKIPFYSGES

SEQ ID NO: 86616 - protein, 15 aa, Borrelia burgdorferi
IMPPFKIPFYSGESG

SEQ ID NO: 86617 - protein, 15 aa, Borrelia burgdorferi
MPPFKIPFYSGESGN

SEQ ID NO: 86618 - protein, 15 aa, Borrelia burgdorferi
PPFKIPFYSGESGNQ

SEQ ID NO: 86619 - protein, 15 aa, Borrelia burgdorferi
PFKIPFYSGESGNQF

SEQ ID NO: 86620 - protein, 15 aa, Borrelia burgdorferi
FKIPFYSGESGNQFL

SEQ ID NO: 86621 - protein, 15 aa, Borrelia burgdorferi
KIPFYSGESGNQFLG

SEQ ID NO: 86622 - protein, 15 aa, Borrelia burgdorferi
IPFYSGESGNQFLGK

SEQ ID NO: 86623 - protein, 15 aa, Borrelia burgdorferi
PFYSGESGNQFLGKG

SEQ ID NO: 86624 - protein, 15 aa, Borrelia burgdorferi
FYSGESGNQFLGKGL

SEQ ID NO: 86625 - protein, 15 aa, Borrelia burgdorferi
YSGESGNQFLGKGLI

SEQ ID NO: 86626 - protein, 15 aa, Borrelia burgdorferi
SGESGNQFLGKGLID

SEQ ID NO: 86627 - protein, 15 aa, Borrelia burgdorferi
GESGNQFLGKGLIDN

SEQ ID NO: 86628 - protein, 15 aa, Borrelia burgdorferi
ESGNQFLGKGLIDNI

SEQ ID NO: 86629 - protein, 15 aa, Borrelia burgdorferi
SGNQFLGKGLIDNIK

SEQ ID NO: 86630 - protein, 15 aa, Borrelia burgdorferi
GNQFLGKGLIDNIKT

SEQ ID NO: 86631 - protein, 15 aa, Borrelia burgdorferi
NQFLGKGLIDNIKTM

SEQ ID NO: 86632 - protein, 15 aa, Borrelia burgdorferi
QFLGKGLIDNIKTMK

SEQ ID NO: 86633 - protein, 15 aa, Borrelia burgdorferi
FLGKGLIDNIKTMKE

SEQ ID NO: 86634 - protein, 15 aa, Borrelia burgdorferi
LGKGLIDNIKTMKEI

SEQ ID NO: 86635 - protein, 15 aa, Borrelia burgdorferi
GKGLIDNIKTMKEIK

SEQ ID NO: 86636 - protein, 15 aa, Borrelia burgdorferi
KGLIDNIKTMKEIKV

SEQ ID NO: 86637 - protein, 15 aa, Borrelia burgdorferi
GLIDNIKTMKEIKVS

SEQ ID NO: 86638 - protein, 15 aa, Borrelia burgdorferi
LIDNIKTMKEIKVSV

SEQ ID NO: 86639 - protein, 15 aa, Borrelia burgdorferi
IDNIKTMKEIKVSVY

SEQ ID NO: 86640 - protein, 15 aa, Borrelia burgdorferi
DNIKTMKEIKVSVYS

SEQ ID NO: 86641 - protein, 15 aa, Borrelia burgdorferi
NIKTMKEIKVSVYSL

SEQ ID NO: 86642 - protein, 15 aa, Borrelia burgdorferi
IKTMKEIKVSVYSLG

SEQ ID NO: 86643 - protein, 15 aa, Borrelia burgdorferi
KTMKEIKVSVYSLGY

SEQ ID NO: 86644 - protein, 15 aa, Borrelia burgdorferi
TMKEIKVSVYSLGYE

SEQ ID NO: 86645 - protein, 15 aa, Borrelia burgdorferi
MKEIKVSVYSLGYEI

SEQ ID NO: 86646 - protein, 15 aa, Borrelia burgdorferi
KEIKVSVYSLGYEID

SEQ ID NO: 86647 - protein, 15 aa, Borrelia burgdorferi
EIKVSVYSLGYEIDL

SEQ ID NO: 86648 - protein, 15 aa, Borrelia burgdorferi
IKVSVYSLGYEIDLE

SEQ ID NO: 86649 - protein, 15 aa, Borrelia burgdorferi
KVSVYSLGYEIDLEV

SEQ ID NO: 86650 - protein, 15 aa, Borrelia burgdorferi
VSVYSLGYEIDLEVL

SEQ ID NO: 86651 - protein, 15 aa, Borrelia burgdorferi
SVYSLGYEIDLEVLF

SEQ ID NO: 86652 - protein, 15 aa, Borrelia burgdorferi
VYSLGYEIDLEVLFE

SEQ ID NO: 86653 - protein, 15 aa, Borrelia burgdorferi
YSLGYEIDLEVLFED

SEQ ID NO: 86654 - protein, 15 aa, Borrelia burgdorferi
SLGYEIDLEVLFEDM

SEQ ID NO: 86655 - protein, 15 aa, Borrelia burgdorferi
LGYEIDLEVLFEDMN

SEQ ID NO: 86656 - protein, 15 aa, Borrelia burgdorferi
GYEIDLEVLFEDMNG

SEQ ID NO: 86657 - protein, 15 aa, Borrelia burgdorferi
YEIDLEVLFEDMNGM

SEQ ID NO: 86658 - protein, 15 aa, Borrelia burgdorferi
EIDLEVLFEDMNGME

SEQ ID NO: 86659 - protein, 15 aa, Borrelia burgdorferi
IDLEVLFEDMNGMEY

SEQ ID NO: 86660 - protein, 15 aa, Borrelia burgdorferi
DLEVLFEDMNGMEYA

SEQ ID NO: 86661 - protein, 15 aa, Borrelia burgdorferi
LEVLFEDMNGMEYAY

SEQ ID NO: 86662 - protein, 15 aa, Borrelia burgdorferi
EVLFEDMNGMEYAYS

SEQ ID NO: 86663 - protein, 15 aa, Borrelia burgdorferi
VLFEDMNGMEYAYSM

SEQ ID NO: 86664 - protein, 15 aa, Borrelia burgdorferi
LFEDMNGMEYAYSMG

SEQ ID NO: 86665 - protein, 15 aa, Borrelia burgdorferi
FEDMNGMEYAYSMGT

SEQ ID NO: 86666 - protein, 15 aa, Borrelia burgdorferi
EDMNGMEYAYSMGTL

SEQ ID NO: 86667 - protein, 15 aa, Borrelia burgdorferi
DMNGMEYAYSMGTLK

SEQ ID NO: 86668 - protein, 15 aa, Borrelia burgdorferi
MNGMEYAYSMGTLKF

SEQ ID NO: 86669 - protein, 15 aa, Borrelia burgdorferi
NGMEYAYSMGTLKFK

SEQ ID NO: 86670 - protein, 15 aa, Borrelia burgdorferi
GMEYAYSMGTLKFKG

SEQ ID NO: 86671 - protein, 15 aa, Borrelia burgdorferi
MEYAYSMGTLKFKGW

SEQ ID NO: 86672 - protein, 15 aa, Borrelia burgdorferi
EYAYSMGTLKFKGWA

SEQ ID NO: 86673 - protein, 15 aa, Borrelia burgdorferi
YAYSMGTLKFKGWAD

SEQ ID NO: 86674 - protein, 15 aa, Borrelia burgdorferi
AYSMGTLKFKGWADL

SEQ ID NO: 86675 - protein, 15 aa, Borrelia burgdorferi
YSMGTLKFKGWADLI

SEQ ID NO: 86676 - protein, 15 aa, Borrelia burgdorferi
SMGTLKFKGWADLIW

SEQ ID NO: 86677 - protein, 15 aa, Borrelia burgdorferi
MGTLKFKGWADLIWS

SEQ ID NO: 86678 - protein, 15 aa, Borrelia burgdorferi
GTLKFKGWADLIWSN

SEQ ID NO: 86679 - protein, 15 aa, Borrelia burgdorferi
TLKFKGWADLIWSNP

SEQ ID NO: 86680 - protein, 15 aa, Borrelia burgdorferi
LKFKGWADLIWSNPN

SEQ ID NO: 86681 - protein, 15 aa, Borrelia burgdorferi
KFKGWADLIWSNPNY

SEQ ID NO: 86682 - protein, 15 aa, Borrelia burgdorferi
FKGWADLIWSNPNYI

SEQ ID NO: 86683 - protein, 15 aa, Borrelia burgdorferi
KGWADLIWSNPNYIP

SEQ ID NO: 86684 - protein, 15 aa, Borrelia burgdorferi
GWADLIWSNPNYIPN

SEQ ID NO: 86685 - protein, 15 aa, Borrelia burgdorferi
WADLIWSNPNYIPNI

SEQ ID NO: 86686 - protein, 15 aa, Borrelia burgdorferi
ADLIWSNPNYIPNIS

SEQ ID NO: 86687 - protein, 15 aa, Borrelia burgdorferi
DLIWSNPNYIPNISS

SEQ ID NO: 86688 - protein, 15 aa, Borrelia burgdorferi
LIWSNPNYIPNISSR

SEQ ID NO: 86689 - protein, 15 aa, Borrelia burgdorferi
IWSNPNYIPNISSRI

SEQ ID NO: 86690 - protein, 15 aa, Borrelia burgdorferi
WSNPNYIPNISSRII

SEQ ID NO: 86691 - protein, 15 aa, Borrelia burgdorferi
SNPNYIPNISSRIIK

SEQ ID NO: 86692 - protein, 15 aa, Borrelia burgdorferi
NPNYIPNISSRIIKD

SEQ ID NO: 86693 - protein, 15 aa, Borrelia burgdorferi
PNYIPNISSRIIKDD

SEQ ID NO: 86694 - protein, 15 aa, Borrelia burgdorferi
NYIPNISSRIIKDDV

SEQ ID NO: 86695 - protein, 15 aa, Borrelia burgdorferi
YIPNISSRIIKDDVP

SEQ ID NO: 86696 - protein, 15 aa, Borrelia burgdorferi
IPNISSRIIKDDVPN

SEQ ID NO: 86697 - protein, 15 aa, Borrelia burgdorferi
PNISSRIIKDDVPNY

SEQ ID NO: 86698 - protein, 15 aa, Borrelia burgdorferi
NISSRIIKDDVPNYP

SEQ ID NO: 86699 - protein, 15 aa, Borrelia burgdorferi
ISSRIIKDDVPNYPL

SEQ ID NO: 86700 - protein, 15 aa, Borrelia burgdorferi
SSRIIKDDVPNYPLA

SEQ ID NO: 86701 - protein, 15 aa, Borrelia burgdorferi
SRIIKDDVPNYPLAS

SEQ ID NO: 86702 - protein, 15 aa, Borrelia burgdorferi
RIIKDDVPNYPLASS

SEQ ID NO: 86703 - protein, 15 aa, Borrelia burgdorferi
IIKDDVPNYPLASSK

SEQ ID NO: 86704 - protein, 15 aa, Borrelia burgdorferi
IKDDVPNYPLASSKM

SEQ ID NO: 86705 - protein, 15 aa, Borrelia burgdorferi
KDDVPNYPLASSKMR

SEQ ID NO: 86706 - protein, 15 aa, Borrelia burgdorferi
DDVPNYPLASSKMRF

SEQ ID NO: 86707 - protein, 15 aa, Borrelia burgdorferi
DVPNYPLASSKMRFK

SEQ ID NO: 86708 - protein, 15 aa, Borrelia burgdorferi
VPNYPLASSKMRFKA

SEQ ID NO: 86709 - protein, 15 aa, Borrelia burgdorferi
PNYPLASSKMRFKAF

SEQ ID NO: 86710 - protein, 15 aa, Borrelia burgdorferi
NYPLASSKMRFKAFR

SEQ ID NO: 86711 - protein, 15 aa, Borrelia burgdorferi
YPLASSKMRFKAFRV

SEQ ID NO: 86712 - protein, 15 aa, Borrelia burgdorferi
PLASSKMRFKAFRVS

SEQ ID NO: 86713 - protein, 15 aa, Borrelia burgdorferi
LASSKMRFKAFRVSK

SEQ ID NO: 86714 - protein, 15 aa, Borrelia burgdorferi
ASSKMRFKAFRVSKS

SEQ ID NO: 86715 - protein, 15 aa, Borrelia burgdorferi
SSKMRFKAFRVSKSH

SEQ ID NO: 86716 - protein, 15 aa, Borrelia burgdorferi
SKMRFKAFRVSKSHS

SEQ ID NO: 86717 - protein, 15 aa, Borrelia burgdorferi
KMRFKAFRVSKSHSS

SEQ ID NO: 86718 - protein, 15 aa, Borrelia burgdorferi
MRFKAFRVSKSHSSK

SEQ ID NO: 86719 - protein, 15 aa, Borrelia burgdorferi
RFKAFRVSKSHSSKV

SEQ ID NO: 86720 - protein, 15 aa, Borrelia burgdorferi
FKAFRVSKSHSSKVK

SEQ ID NO: 86721 - protein, 15 aa, Borrelia burgdorferi
KAFRVSKSHSSKVKN

SEQ ID NO: 86722 - protein, 15 aa, Borrelia burgdorferi
AFRVSKSHSSKVKNF

SEQ ID NO: 86723 - protein, 15 aa, Borrelia burgdorferi
FRVSKSHSSKVKNFI

SEQ ID NO: 86724 - protein, 15 aa, Borrelia burgdorferi
RVSKSHSSKVKNFIF

SEQ ID NO: 86725 - protein, 15 aa, Borrelia burgdorferi
VSKSHSSKVKNFIFY

SEQ ID NO: 86726 - protein, 15 aa, Borrelia burgdorferi
SKSHSSKVKNFIFYV

SEQ ID NO: 86727 - protein, 15 aa, Borrelia burgdorferi
KSHSSKVKNFIFYVK

SEQ ID NO: 86728 - protein, 15 aa, Borrelia burgdorferi
SHSSKVKNFIFYVKD

SEQ ID NO: 86729 - protein, 15 aa, Borrelia burgdorferi
HSSKVKNFIFYVKDL

SEQ ID NO: 86730 - protein, 15 aa, Borrelia burgdorferi
SSKVKNFIFYVKDLR

SEQ ID NO: 86731 - protein, 15 aa, Borrelia burgdorferi
SKVKNFIFYVKDLRV

SEQ ID NO: 86732 - protein, 15 aa, Borrelia burgdorferi
KVKNFIFYVKDLRVL

SEQ ID NO: 86733 - protein, 15 aa, Borrelia burgdorferi
VKNFIFYVKDLRVLY

SEQ ID NO: 86734 - protein, 15 aa, Borrelia burgdorferi
KNFIFYVKDLRVLYD

SEQ ID NO: 86735 - protein, 15 aa, Borrelia burgdorferi
NFIFYVKDLRVLYDK

SEQ ID NO: 86736 - protein, 15 aa, Borrelia burgdorferi
FIFYVKDLRVLYDKL

SEQ ID NO: 86737 - protein, 15 aa, Borrelia burgdorferi
IFYVKDLRVLYDKLS

SEQ ID NO: 86738 - protein, 15 aa, Borrelia burgdorferi
FYVKDLRVLYDKLSV

SEQ ID NO: 86739 - protein, 15 aa, Borrelia burgdorferi
YVKDLRVLYDKLSVS

SEQ ID NO: 86740 - protein, 15 aa, Borrelia burgdorferi
VKDLRVLYDKLSVSI

SEQ ID NO: 86741 - protein, 15 aa, Borrelia burgdorferi
KDLRVLYDKLSVSID

SEQ ID NO: 86742 - protein, 15 aa, Borrelia burgdorferi
DLRVLYDKLSVSIDS

SEQ ID NO: 86743 - protein, 15 aa, Borrelia burgdorferi
LRVLYDKLSVSIDSD

SEQ ID NO: 86744 - protein, 15 aa, Borrelia burgdorferi
RVLYDKLSVSIDSDI

SEQ ID NO: 86745 - protein, 15 aa, Borrelia burgdorferi
VLYDKLSVSIDSDID

SEQ ID NO: 86746 - protein, 15 aa, Borrelia burgdorferi
LYDKLSVSIDSDIDS

SEQ ID NO: 86747 - protein, 15 aa, Borrelia burgdorferi
YDKLSVSIDSDIDSE

SEQ ID NO: 86748 - protein, 15 aa, Borrelia burgdorferi
DKLSVSIDSDIDSES

SEQ ID NO: 86749 - protein, 15 aa, Borrelia burgdorferi
KLSVSIDSDIDSESV

SEQ ID NO: 86750 - protein, 15 aa, Borrelia burgdorferi
LSVSIDSDIDSESVF

SEQ ID NO: 86751 - protein, 15 aa, Borrelia burgdorferi
SVSIDSDIDSESVFK

SEQ ID NO: 86752 - protein, 15 aa, Borrelia burgdorferi
VSIDSDIDSESVFKV

SEQ ID NO: 86753 - protein, 15 aa, Borrelia burgdorferi
SIDSDIDSESVFKVY

SEQ ID NO: 86754 - protein, 15 aa, Borrelia burgdorferi
IDSDIDSESVFKVYE

SEQ ID NO: 86755 - protein, 15 aa, Borrelia burgdorferi
DSDIDSESVFKVYET

SEQ ID NO: 86756 - protein, 15 aa, Borrelia burgdorferi
SDIDSESVFKVYETS

SEQ ID NO: 86757 - protein, 15 aa, Borrelia burgdorferi
DIDSESVFKVYETSG

SEQ ID NO: 86758 - protein, 15 aa, Borrelia burgdorferi
IDSESVFKVYETSGT

SEQ ID NO: 86759 - protein, 15 aa, Borrelia burgdorferi
DSESVFKVYETSGTE

SEQ ID NO: 86760 - protein, 15 aa, Borrelia burgdorferi
SESVFKVYETSGTES

SEQ ID NO: 86761 - protein, 15 aa, Borrelia burgdorferi
ESVFKVYETSGTESL

SEQ ID NO: 86762 - protein, 15 aa, Borrelia burgdorferi
SVFKVYETSGTESLR

SEQ ID NO: 86763 - protein, 15 aa, Borrelia burgdorferi
VFKVYETSGTESLRK

SEQ ID NO: 86764 - protein, 15 aa, Borrelia burgdorferi
FKVYETSGTESLRKL

SEQ ID NO: 86765 - protein, 15 aa, Borrelia burgdorferi
KVYETSGTESLRKLK

SEQ ID NO: 86766 - protein, 15 aa, Borrelia burgdorferi
VYETSGTESLRKLKA

SEQ ID NO: 86767 - protein, 15 aa, Borrelia burgdorferi
YETSGTESLRKLKAH

SEQ ID NO: 86768 - protein, 15 aa, Borrelia burgdorferi
ETSGTESLRKLKAHE

SEQ ID NO: 86769 - protein, 15 aa, Borrelia burgdorferi
TSGTESLRKLKAHET

SEQ ID NO: 86770 - protein, 15 aa, Borrelia burgdorferi
SGTESLRKLKAHETF

SEQ ID NO: 86771 - protein, 15 aa, Borrelia burgdorferi
GTESLRKLKAHETFK

SEQ ID NO: 86772 - protein, 15 aa, Borrelia burgdorferi
TESLRKLKAHETFKR

SEQ ID NO: 86773 - protein, 15 aa, Borrelia burgdorferi
ESLRKLKAHETFKRV

SEQ ID NO: 86774 - protein, 15 aa, Borrelia burgdorferi
SLRKLKAHETFKRVL

SEQ ID NO: 86775 - protein, 15 aa, Borrelia burgdorferi
LRKLKAHETFKRVLK

SEQ ID NO: 86776 - protein, 15 aa, Borrelia burgdorferi
RKLKAHETFKRVLKL

SEQ ID NO: 86777 - protein, 15 aa, Borrelia burgdorferi
KLKAHETFKRVLKLR

SEQ ID NO: 86778 - protein, 15 aa, Borrelia burgdorferi
LKAHETFKRVLKLRE

SEQ ID NO: 86779 - protein, 15 aa, Borrelia burgdorferi
KAHETFKRVLKLREK

SEQ ID NO: 86780 - protein, 15 aa, Borrelia burgdorferi
AHETFKRVLKLREKI

SEQ ID NO: 86781 - protein, 15 aa, Borrelia burgdorferi
HETFKRVLKLREKIS

SEQ ID NO: 86782 - protein, 15 aa, Borrelia burgdorferi
ETFKRVLKLREKISI

SEQ ID NO: 86783 - protein, 15 aa, Borrelia burgdorferi
TFKRVLKLREKISIA

SEQ ID NO: 86784 - protein, 15 aa, Borrelia burgdorferi
FKRVLKLREKISIAE

SEQ ID NO: 86785 - protein, 15 aa, Borrelia burgdorferi
KRVLKLREKISIAEG

SEQ ID NO: 86786 - protein, 15 aa, Borrelia burgdorferi
RVLKLREKISIAEGS

SEQ ID NO: 86787 - protein, 15 aa, Borrelia burgdorferi
VLKLREKISIAEGSF

SEQ ID NO: 86788 - protein, 15 aa, Borrelia burgdorferi
LKLREKISIAEGSFQ

SEQ ID NO: 86789 - protein, 15 aa, Borrelia burgdorferi
KLREKISIAEGSFQN

SEQ ID NO: 86790 - protein, 15 aa, Borrelia burgdorferi
LREKISIAEGSFQNF

SEQ ID NO: 86791 - protein, 15 aa, Borrelia burgdorferi
REKISIAEGSFQNFV

SEQ ID NO: 86792 - protein, 15 aa, Borrelia burgdorferi
EKISIAEGSFQNFVE

SEQ ID NO: 86793 - protein, 15 aa, Borrelia burgdorferi
KISIAEGSFQNFVEK

SEQ ID NO: 86794 - protein, 15 aa, Borrelia burgdorferi
ISIAEGSFQNFVEKI

SEQ ID NO: 86795 - protein, 15 aa, Borrelia burgdorferi
SIAEGSFQNFVEKIE

SEQ ID NO: 86796 - protein, 15 aa, Borrelia burgdorferi
IAEGSFQNFVEKIES

SEQ ID NO: 86797 - protein, 15 aa, Borrelia burgdorferi
AEGSFQNFVEKIESE

SEQ ID NO: 86798 - protein, 15 aa, Borrelia burgdorferi
EGSFQNFVEKIESEK

SEQ ID NO: 86799 - protein, 15 aa, Borrelia burgdorferi
GSFQNFVEKIESEKP

SEQ ID NO: 86800 - protein, 15 aa, Borrelia burgdorferi
SFQNFVEKIESEKPE

SEQ ID NO: 86801 - protein, 15 aa, Borrelia burgdorferi
FQNFVEKIESEKPEE

SEQ ID NO: 86802 - protein, 15 aa, Borrelia burgdorferi
QNFVEKIESEKPEES

SEQ ID NO: 86803 - protein, 15 aa, Borrelia burgdorferi
NFVEKIESEKPEESS

SEQ ID NO: 86804 - protein, 15 aa, Borrelia burgdorferi
FVEKIESEKPEESSP

SEQ ID NO: 86805 - protein, 15 aa, Borrelia burgdorferi
VEKIESEKPEESSPK

SEQ ID NO: 86806 - protein, 15 aa, Borrelia burgdorferi
EKIESEKPEESSPKN

SEQ ID NO: 86807 - protein, 16 aa, Borrelia burgdorferi
MKRKAKSILFFLLSTV

SEQ ID NO: 86808 - protein, 16 aa, Borrelia burgdorferi
KRKAKSILFFLLSTVL

SEQ ID NO: 86809 - protein, 16 aa, Borrelia burgdorferi
RKAKSILFFLLSTVLF

SEQ ID NO: 86810 - protein, 16 aa, Borrelia burgdorferi
KAKSILFFLLSTVLFA

SEQ ID NO: 86811 - protein, 16 aa, Borrelia burgdorferi
AKSILFFLLSTVLFAQ

SEQ ID NO: 86812 - protein, 16 aa, Borrelia burgdorferi
KSILFFLLSTVLFAQE

SEQ ID NO: 86813 - protein, 16 aa, Borrelia burgdorferi
SILFFLLSTVLFAQET

SEQ ID NO: 86814 - protein, 16 aa, Borrelia burgdorferi
ILFFLLSTVLFAQETD

SEQ ID NO: 86815 - protein, 16 aa, Borrelia burgdorferi
LFFLLSTVLFAQETDG

SEQ ID NO: 86816 - protein, 16 aa, Borrelia burgdorferi
FFLLSTVLFAQETDGL

SEQ ID NO: 86817 - protein, 16 aa, Borrelia burgdorferi
FLLSTVLFAQETDGLA

SEQ ID NO: 86818 - protein, 16 aa, Borrelia burgdorferi
LLSTVLFAQETDGLAE

SEQ ID NO: 86819 - protein, 16 aa, Borrelia burgdorferi
LSTVLFAQETDGLAEG

SEQ ID NO: 86820 - protein, 16 aa, Borrelia burgdorferi
STVLFAQETDGLAEGS

SEQ ID NO: 86821 - protein, 16 aa, Borrelia burgdorferi
TVLFAQETDGLAEGSK

SEQ ID NO: 86822 - protein, 16 aa, Borrelia burgdorferi
VLFAQETDGLAEGSKR

SEQ ID NO: 86823 - protein, 16 aa, Borrelia burgdorferi
LFAQETDGLAEGSKRA

SEQ ID NO: 86824 - protein, 16 aa, Borrelia burgdorferi
FAQETDGLAEGSKRAE

SEQ ID NO: 86825 - protein, 16 aa, Borrelia burgdorferi
AQETDGLAEGSKRAEP

SEQ ID NO: 86826 - protein, 16 aa, Borrelia burgdorferi
QETDGLAEGSKRAEPG

SEQ ID NO: 86827 - protein, 16 aa, Borrelia burgdorferi
ETDGLAEGSKRAEPGE

SEQ ID NO: 86828 - protein, 16 aa, Borrelia burgdorferi
TDGLAEGSKRAEPGEL

SEQ ID NO: 86829 - protein, 16 aa, Borrelia burgdorferi
DGLAEGSKRAEPGELV

SEQ ID NO: 86830 - protein, 16 aa, Borrelia burgdorferi
GLAEGSKRAEPGELVL

SEQ ID NO: 86831 - protein, 16 aa, Borrelia burgdorferi
LAEGSKRAEPGELVLD

SEQ ID NO: 86832 - protein, 16 aa, Borrelia burgdorferi
AEGSKRAEPGELVLDF

SEQ ID NO: 86833 - protein, 16 aa, Borrelia burgdorferi
EGSKRAEPGELVLDFA

SEQ ID NO: 86834 - protein, 16 aa, Borrelia burgdorferi
GSKRAEPGELVLDFAE

SEQ ID NO: 86835 - protein, 16 aa, Borrelia burgdorferi
SKRAEPGELVLDFAEL

SEQ ID NO: 86836 - protein, 16 aa, Borrelia burgdorferi
KRAEPGELVLDFAELA

SEQ ID NO: 86837 - protein, 16 aa, Borrelia burgdorferi
RAEPGELVLDFAELAR

SEQ ID NO: 86838 - protein, 16 aa, Borrelia burgdorferi
AEPGELVLDFAELARD

SEQ ID NO: 86839 - protein, 16 aa, Borrelia burgdorferi
EPGELVLDFAELARDP

SEQ ID NO: 86840 - protein, 16 aa, Borrelia burgdorferi
PGELVLDFAELARDPS

SEQ ID NO: 86841 - protein, 16 aa, Borrelia burgdorferi
GELVLDFAELARDPSS

SEQ ID NO: 86842 - protein, 16 aa, Borrelia burgdorferi
ELVLDFAELARDPSST

SEQ ID NO: 86843 - protein, 16 aa, Borrelia burgdorferi
LVLDFAELARDPSSTR

SEQ ID NO: 86844 - protein, 16 aa, Borrelia burgdorferi
VLDFAELARDPSSTRL

SEQ ID NO: 86845 - protein, 16 aa, Borrelia burgdorferi
LDFAELARDPSSTRLD

SEQ ID NO: 86846 - protein, 16 aa, Borrelia burgdorferi
DFAELARDPSSTRLDL

SEQ ID NO: 86847 - protein, 16 aa, Borrelia burgdorferi
FAELARDPSSTRLDLT

SEQ ID NO: 86848 - protein, 16 aa, Borrelia burgdorferi
AELARDPSSTRLDLTN

SEQ ID NO: 86849 - protein, 16 aa, Borrelia burgdorferi
ELARDPSSTRLDLTNY

SEQ ID NO: 86850 - protein, 16 aa, Borrelia burgdorferi
LARDPSSTRLDLTNYV

SEQ ID NO: 86851 - protein, 16 aa, Borrelia burgdorferi
ARDPSSTRLDLTNYVD

SEQ ID NO: 86852 - protein, 16 aa, Borrelia burgdorferi
RDPSSTRLDLTNYVDY

SEQ ID NO: 86853 - protein, 16 aa, Borrelia burgdorferi
DPSSTRLDLTNYVDYV

SEQ ID NO: 86854 - protein, 16 aa, Borrelia burgdorferi
PSSTRLDLTNYVDYVY

SEQ ID NO: 86855 - protein, 16 aa, Borrelia burgdorferi
SSTRLDLTNYVDYVYS

SEQ ID NO: 86856 - protein, 16 aa, Borrelia burgdorferi
STRLDLTNYVDYVYSG

SEQ ID NO: 86857 - protein, 16 aa, Borrelia burgdorferi
TRLDLTNYVDYVYSGA

SEQ ID NO: 86858 - protein, 16 aa, Borrelia burgdorferi
RLDLTNYVDYVYSGAS

SEQ ID NO: 86859 - protein, 16 aa, Borrelia burgdorferi
LDLTNYVDYVYSGASG

SEQ ID NO: 86860 - protein, 16 aa, Borrelia burgdorferi
DLTNYVDYVYSGASGI

SEQ ID NO: 86861 - protein, 16 aa, Borrelia burgdorferi
LTNYVDYVYSGASGIV

SEQ ID NO: 86862 - protein, 16 aa, Borrelia burgdorferi
TNYVDYVYSGASGIVK

SEQ ID NO: 86863 - protein, 16 aa, Borrelia burgdorferi
NYVDYVYSGASGIVKP

SEQ ID NO: 86864 - protein, 16 aa, Borrelia burgdorferi
YVDYVYSGASGIVKPE

SEQ ID NO: 86865 - protein, 16 aa, Borrelia burgdorferi
VDYVYSGASGIVKPED

SEQ ID NO: 86866 - protein, 16 aa, Borrelia burgdorferi
DYVYSGASGIVKPEDM

SEQ ID NO: 86867 - protein, 16 aa, Borrelia burgdorferi
YVYSGASGIVKPEDMV

SEQ ID NO: 86868 - protein, 16 aa, Borrelia burgdorferi
VYSGASGIVKPEDMVV

SEQ ID NO: 86869 - protein, 16 aa, Borrelia burgdorferi
YSGASGIVKPEDMVVD

SEQ ID NO: 86870 - protein, 16 aa, Borrelia burgdorferi
SGASGIVKPEDMVVDL

SEQ ID NO: 86871 - protein, 16 aa, Borrelia burgdorferi
GASGIVKPEDMVVDLG

SEQ ID NO: 86872 - protein, 16 aa, Borrelia burgdorferi
ASGIVKPEDMVVDLGI

SEQ ID NO: 86873 - protein, 16 aa, Borrelia burgdorferi
SGIVKPEDMVVDLGIN

SEQ ID NO: 86874 - protein, 16 aa, Borrelia burgdorferi
GIVKPEDMVVDLGINN

SEQ ID NO: 86875 - protein, 16 aa, Borrelia burgdorferi
IVKPEDMVVDLGINNW

SEQ ID NO: 86876 - protein, 16 aa, Borrelia burgdorferi
VKPEDMVVDLGINNWS

SEQ ID NO: 86877 - protein, 16 aa, Borrelia burgdorferi
KPEDMVVDLGINNWSV

SEQ ID NO: 86878 - protein, 16 aa, Borrelia burgdorferi
PEDMVVDLGINNWSVL

SEQ ID NO: 86879 - protein, 16 aa, Borrelia burgdorferi
EDMVVDLGINNWSVLL

SEQ ID NO: 86880 - protein, 16 aa, Borrelia burgdorferi
DMVVDLGINNWSVLLT

SEQ ID NO: 86881 - protein, 16 aa, Borrelia burgdorferi
MVVDLGINNWSVLLTP

SEQ ID NO: 86882 - protein, 16 aa, Borrelia burgdorferi
VVDLGINNWSVLLTPS

SEQ ID NO: 86883 - protein, 16 aa, Borrelia burgdorferi
VDLGINNWSVLLTPSA

SEQ ID NO: 86884 - protein, 16 aa, Borrelia burgdorferi
DLGINNWSVLLTPSAR

SEQ ID NO: 86885 - protein, 16 aa, Borrelia burgdorferi
LGINNWSVLLTPSARL

SEQ ID NO: 86886 - protein, 16 aa, Borrelia burgdorferi
GINNWSVLLTPSARLQ

SEQ ID NO: 86887 - protein, 16 aa, Borrelia burgdorferi
INNWSVLLTPSARLQA

SEQ ID NO: 86888 - protein, 16 aa, Borrelia burgdorferi
NNWSVLLTPSARLQAY

SEQ ID NO: 86889 - protein, 16 aa, Borrelia burgdorferi
NWSVLLTPSARLQAYV

SEQ ID NO: 86890 - protein, 16 aa, Borrelia burgdorferi
WSVLLTPSARLQAYVK

SEQ ID NO: 86891 - protein, 16 aa, Borrelia burgdorferi
SVLLTPSARLQAYVKN

SEQ ID NO: 86892 - protein, 16 aa, Borrelia burgdorferi
VLLTPSARLQAYVKNS

SEQ ID NO: 86893 - protein, 16 aa, Borrelia burgdorferi
LLTPSARLQAYVKNSV

SEQ ID NO: 86894 - protein, 16 aa, Borrelia burgdorferi
LTPSARLQAYVKNSVV

SEQ ID NO: 86895 - protein, 16 aa, Borrelia burgdorferi
TPSARLQAYVKNSVVA

SEQ ID NO: 86896 - protein, 16 aa, Borrelia burgdorferi
PSARLQAYVKNSVVAP

SEQ ID NO: 86897 - protein, 16 aa, Borrelia burgdorferi
SARLQAYVKNSVVAPA

SEQ ID NO: 86898 - protein, 16 aa, Borrelia burgdorferi
ARLQAYVKNSVVAPAV

SEQ ID NO: 86899 - protein, 16 aa, Borrelia burgdorferi
RLQAYVKNSVVAPAVV

SEQ ID NO: 86900 - protein, 16 aa, Borrelia burgdorferi
LQAYVKNSVVAPAVVK

SEQ ID NO: 86901 - protein, 16 aa, Borrelia burgdorferi
QAYVKNSVVAPAVVKS

SEQ ID NO: 86902 - protein, 16 aa, Borrelia burgdorferi
AYVKNSVVAPAVVKSE

SEQ ID NO: 86903 - protein, 16 aa, Borrelia burgdorferi
YVKNSVVAPAVVKSES

SEQ ID NO: 86904 - protein, 16 aa, Borrelia burgdorferi
VKNSVVAPAVVKSESK

SEQ ID NO: 86905 - protein, 16 aa, Borrelia burgdorferi
KNSVVAPAVVKSESKR

SEQ ID NO: 86906 - protein, 16 aa, Borrelia burgdorferi
NSVVAPAVVKSESKRY

SEQ ID NO: 86907 - protein, 16 aa, Borrelia burgdorferi
SVVAPAVVKSESKRYA

SEQ ID NO: 86908 - protein, 16 aa, Borrelia burgdorferi
VVAPAVVKSESKRYAG

SEQ ID NO: 86909 - protein, 16 aa, Borrelia burgdorferi
VAPAVVKSESKRYAGD

SEQ ID NO: 86910 - protein, 16 aa, Borrelia burgdorferi
APAVVKSESKRYAGDT

SEQ ID NO: 86911 - protein, 16 aa, Borrelia burgdorferi
PAVVKSESKRYAGDTI

SEQ ID NO: 86912 - protein, 16 aa, Borrelia burgdorferi
AVVKSESKRYAGDTIL

SEQ ID NO: 86913 - protein, 16 aa, Borrelia burgdorferi
VVKSESKRYAGDTILG

SEQ ID NO: 86914 - protein, 16 aa, Borrelia burgdorferi
VKSESKRYAGDTILGV

SEQ ID NO: 86915 - protein, 16 aa, Borrelia burgdorferi
KSESKRYAGDTILGVR

SEQ ID NO: 86916 - protein, 16 aa, Borrelia burgdorferi
SESKRYAGDTILGVRV

SEQ ID NO: 86917 - protein, 16 aa, Borrelia burgdorferi
ESKRYAGDTILGVRVL

SEQ ID NO: 86918 - protein, 16 aa, Borrelia burgdorferi
SKRYAGDTILGVRVLF

SEQ ID NO: 86919 - protein, 16 aa, Borrelia burgdorferi
KRYAGDTILGVRVLFP

SEQ ID NO: 86920 - protein, 16 aa, Borrelia burgdorferi
RYAGDTILGVRVLFPS

SEQ ID NO: 86921 - protein, 16 aa, Borrelia burgdorferi
YAGDTILGVRVLFPSY

SEQ ID NO: 86922 - protein, 16 aa, Borrelia burgdorferi
AGDTILGVRVLFPSYS

SEQ ID NO: 86923 - protein, 16 aa, Borrelia burgdorferi
GDTILGVRVLFPSYSQ

SEQ ID NO: 86924 - protein, 16 aa, Borrelia burgdorferi
DTILGVRVLFPSYSQS

SEQ ID NO: 86925 - protein, 16 aa, Borrelia burgdorferi
TILGVRVLFPSYSQSS

SEQ ID NO: 86926 - protein, 16 aa, Borrelia burgdorferi
ILGVRVLFPSYSQSSA

SEQ ID NO: 86927 - protein, 16 aa, Borrelia burgdorferi
LGVRVLFPSYSQSSAM

SEQ ID NO: 86928 - protein, 16 aa, Borrelia burgdorferi
GVRVLFPSYSQSSAMI

SEQ ID NO: 86929 - protein, 16 aa, Borrelia burgdorferi
VRVLFPSYSQSSAMIM

SEQ ID NO: 86930 - protein, 16 aa, Borrelia burgdorferi
RVLFPSYSQSSAMIMP

SEQ ID NO: 86931 - protein, 16 aa, Borrelia burgdorferi
VLFPSYSQSSAMIMPP

SEQ ID NO: 86932 - protein, 16 aa, Borrelia burgdorferi
LFPSYSQSSAMIMPPF

SEQ ID NO: 86933 - protein, 16 aa, Borrelia burgdorferi
FPSYSQSSAMIMPPFK

SEQ ID NO: 86934 - protein, 16 aa, Borrelia burgdorferi
PSYSQSSAMIMPPFKI

SEQ ID NO: 86935 - protein, 16 aa, Borrelia burgdorferi
SYSQSSAMIMPPFKIP

SEQ ID NO: 86936 - protein, 16 aa, Borrelia burgdorferi
YSQSSAMIMPPFKIPF

SEQ ID NO: 86937 - protein, 16 aa, Borrelia burgdorferi
SQSSAMIMPPFKIPFY

SEQ ID NO: 86938 - protein, 16 aa, Borrelia burgdorferi
QSSAMIMPPFKIPFYS

SEQ ID NO: 86939 - protein, 16 aa, Borrelia burgdorferi
SSAMIMPPFKIPFYSG

SEQ ID NO: 86940 - protein, 16 aa, Borrelia burgdorferi
SAMIMPPFKIPFYSGE

SEQ ID NO: 86941 - protein, 16 aa, Borrelia burgdorferi
AMIMPPFKIPFYSGES

SEQ ID NO: 86942 - protein, 16 aa, Borrelia burgdorferi
MIMPPFKIPFYSGESG

SEQ ID NO: 86943 - protein, 16 aa, Borrelia burgdorferi
IMPPFKIPFYSGESGN

SEQ ID NO: 86944 - protein, 16 aa, Borrelia burgdorferi
MPPFKIPFYSGESGNQ

SEQ ID NO: 86945 - protein, 16 aa, Borrelia burgdorferi
PPFKIPFYSGESGNQF

SEQ ID NO: 86946 - protein, 16 aa, Borrelia burgdorferi
PFKIPFYSGESGNQFL

SEQ ID NO: 86947 - protein, 16 aa, Borrelia burgdorferi
FKIPFYSGESGNQFLG

SEQ ID NO: 86948 - protein, 16 aa, Borrelia burgdorferi
KIPFYSGESGNQFLGK

SEQ ID NO: 86949 - protein, 16 aa, Borrelia burgdorferi
IPFYSGESGNQFLGKG

SEQ ID NO: 86950 - protein, 16 aa, Borrelia burgdorferi
PFYSGESGNQFLGKGL

SEQ ID NO: 86951 - protein, 16 aa, Borrelia burgdorferi
FYSGESGNQFLGKGLI

SEQ ID NO: 86952 - protein, 16 aa, Borrelia burgdorferi
YSGESGNQFLGKGLID

SEQ ID NO: 86953 - protein, 16 aa, Borrelia burgdorferi
SGESGNQFLGKGLIDN

SEQ ID NO: 86954 - protein, 16 aa, Borrelia burgdorferi
GESGNQFLGKGLIDNI

SEQ ID NO: 86955 - protein, 16 aa, Borrelia burgdorferi
ESGNQFLGKGLIDNIK

SEQ ID NO: 86956 - protein, 16 aa, Borrelia burgdorferi
SGNQFLGKGLIDNIKT

SEQ ID NO: 86957 - protein, 16 aa, Borrelia burgdorferi
GNQFLGKGLIDNIKTM

SEQ ID NO: 86958 - protein, 16 aa, Borrelia burgdorferi
NQFLGKGLIDNIKTMK

SEQ ID NO: 86959 - protein, 16 aa, Borrelia burgdorferi
QFLGKGLIDNIKTMKE

SEQ ID NO: 86960 - protein, 16 aa, Borrelia burgdorferi
FLGKGLIDNIKTMKEI

SEQ ID NO: 86961 - protein, 16 aa, Borrelia burgdorferi
LGKGLIDNIKTMKEIK

SEQ ID NO: 86962 - protein, 16 aa, Borrelia burgdorferi
GKGLIDNIKTMKEIKV

SEQ ID NO: 86963 - protein, 16 aa, Borrelia burgdorferi
KGLIDNIKTMKEIKVS

SEQ ID NO: 86964 - protein, 16 aa, Borrelia burgdorferi
GLIDNIKTMKEIKVSV

SEQ ID NO: 86965 - protein, 16 aa, Borrelia burgdorferi
LIDNIKTMKEIKVSVY

SEQ ID NO: 86966 - protein, 16 aa, Borrelia burgdorferi
IDNIKTMKEIKVSVYS

SEQ ID NO: 86967 - protein, 16 aa, Borrelia burgdorferi
DNIKTMKEIKVSVYSL

SEQ ID NO: 86968 - protein, 16 aa, Borrelia burgdorferi
NIKTMKEIKVSVYSLG

SEQ ID NO: 86969 - protein, 16 aa, Borrelia burgdorferi
IKTMKEIKVSVYSLGY

SEQ ID NO: 86970 - protein, 16 aa, Borrelia burgdorferi
KTMKEIKVSVYSLGYE

SEQ ID NO: 86971 - protein, 16 aa, Borrelia burgdorferi
TMKEIKVSVYSLGYEI

SEQ ID NO: 86972 - protein, 16 aa, Borrelia burgdorferi
MKEIKVSVYSLGYEID

SEQ ID NO: 86973 - protein, 16 aa, Borrelia burgdorferi
KEIKVSVYSLGYEIDL

SEQ ID NO: 86974 - protein, 16 aa, Borrelia burgdorferi
EIKVSVYSLGYEIDLE

SEQ ID NO: 86975 - protein, 16 aa, Borrelia burgdorferi
IKVSVYSLGYEIDLEV

SEQ ID NO: 86976 - protein, 16 aa, Borrelia burgdorferi
KVSVYSLGYEIDLEVL

SEQ ID NO: 86977 - protein, 16 aa, Borrelia burgdorferi
VSVYSLGYEIDLEVLF

SEQ ID NO: 86978 - protein, 16 aa, Borrelia burgdorferi
SVYSLGYEIDLEVLFE

SEQ ID NO: 86979 - protein, 16 aa, Borrelia burgdorferi
VYSLGYEIDLEVLFED

SEQ ID NO: 86980 - protein, 16 aa, Borrelia burgdorferi
YSLGYEIDLEVLFEDM

SEQ ID NO: 86981 - protein, 16 aa, Borrelia burgdorferi
SLGYEIDLEVLFEDMN

SEQ ID NO: 86982 - protein, 16 aa, Borrelia burgdorferi
LGYEIDLEVLFEDMNG

SEQ ID NO: 86983 - protein, 16 aa, Borrelia burgdorferi
GYEIDLEVLFEDMNGM

SEQ ID NO: 86984 - protein, 16 aa, Borrelia burgdorferi
YEIDLEVLFEDMNGME

SEQ ID NO: 86985 - protein, 16 aa, Borrelia burgdorferi
EIDLEVLFEDMNGMEY

SEQ ID NO: 86986 - protein, 16 aa, Borrelia burgdorferi
IDLEVLFEDMNGMEYA

SEQ ID NO: 86987 - protein, 16 aa, Borrelia burgdorferi
DLEVLFEDMNGMEYAY

SEQ ID NO: 86988 - protein, 16 aa, Borrelia burgdorferi
LEVLFEDMNGMEYAYS

SEQ ID NO: 86989 - protein, 16 aa, Borrelia burgdorferi
EVLFEDMNGMEYAYSM

SEQ ID NO: 86990 - protein, 16 aa, Borrelia burgdorferi
VLFEDMNGMEYAYSMG

SEQ ID NO: 86991 - protein, 16 aa, Borrelia burgdorferi
LFEDMNGMEYAYSMGT

SEQ ID NO: 86992 - protein, 16 aa, Borrelia burgdorferi
FEDMNGMEYAYSMGTL

SEQ ID NO: 86993 - protein, 16 aa, Borrelia burgdorferi
EDMNGMEYAYSMGTLK

SEQ ID NO: 86994 - protein, 16 aa, Borrelia burgdorferi
DMNGMEYAYSMGTLKF

SEQ ID NO: 86995 - protein, 16 aa, Borrelia burgdorferi
MNGMEYAYSMGTLKFK

SEQ ID NO: 86996 - protein, 16 aa, Borrelia burgdorferi
NGMEYAYSMGTLKFKG

SEQ ID NO: 86997 - protein, 16 aa, Borrelia burgdorferi
GMEYAYSMGTLKFKGW

SEQ ID NO: 86998 - protein, 16 aa, Borrelia burgdorferi
MEYAYSMGTLKFKGWA

SEQ ID NO: 86999 - protein, 16 aa, Borrelia burgdorferi
EYAYSMGTLKFKGWAD

SEQ ID NO: 87000 - protein, 16 aa, Borrelia burgdorferi
YAYSMGTLKFKGWADL

SEQ ID NO: 87001 - protein, 16 aa, Borrelia burgdorferi
AYSMGTLKFKGWADLI

SEQ ID NO: 87002 - protein, 16 aa, Borrelia burgdorferi
YSMGTLKFKGWADLIW

SEQ ID NO: 87003 - protein, 16 aa, Borrelia burgdorferi
SMGTLKFKGWADLIWS

SEQ ID NO: 87004 - protein, 16 aa, Borrelia burgdorferi
MGTLKFKGWADLIWSN

SEQ ID NO: 87005 - protein, 16 aa, Borrelia burgdorferi
GTLKFKGWADLIWSNP

SEQ ID NO: 87006 - protein, 16 aa, Borrelia burgdorferi
TLKFKGWADLIWSNPN

SEQ ID NO: 87007 - protein, 16 aa, Borrelia burgdorferi
LKFKGWADLIWSNPNY

SEQ ID NO: 87008 - protein, 16 aa, Borrelia burgdorferi
KFKGWADLIWSNPNYI

SEQ ID NO: 87009 - protein, 16 aa, Borrelia burgdorferi
FKGWADLIWSNPNYIP

SEQ ID NO: 87010 - protein, 16 aa, Borrelia burgdorferi
KGWADLIWSNPNYIPN

SEQ ID NO: 87011 - protein, 16 aa, Borrelia burgdorferi
GWADLIWSNPNYIPNI

SEQ ID NO: 87012 - protein, 16 aa, Borrelia burgdorferi
WADLIWSNPNYIPNIS

SEQ ID NO: 87013 - protein, 16 aa, Borrelia burgdorferi
ADLIWSNPNYIPNISS

SEQ ID NO: 87014 - protein, 16 aa, Borrelia burgdorferi
DLIWSNPNYIPNISSR

SEQ ID NO: 87015 - protein, 16 aa, Borrelia burgdorferi
LIWSNPNYIPNISSRI

SEQ ID NO: 87016 - protein, 16 aa, Borrelia burgdorferi
IWSNPNYIPNISSRII

SEQ ID NO: 87017 - protein, 16 aa, Borrelia burgdorferi
WSNPNYIPNISSRIIK

SEQ ID NO: 87018 - protein, 16 aa, Borrelia burgdorferi
SNPNYIPNISSRIIKD

SEQ ID NO: 87019 - protein, 16 aa, Borrelia burgdorferi
NPNYIPNISSRIIKDD

SEQ ID NO: 87020 - protein, 16 aa, Borrelia burgdorferi
PNYIPNISSRIIKDDV

SEQ ID NO: 87021 - protein, 16 aa, Borrelia burgdorferi
NYIPNISSRIIKDDVP

SEQ ID NO: 87022 - protein, 16 aa, Borrelia burgdorferi
YIPNISSRIIKDDVPN

SEQ ID NO: 87023 - protein, 16 aa, Borrelia burgdorferi
IPNISSRIIKDDVPNY

SEQ ID NO: 87024 - protein, 16 aa, Borrelia burgdorferi
PNISSRIIKDDVPNYP

SEQ ID NO: 87025 - protein, 16 aa, Borrelia burgdorferi
NISSRIIKDDVPNYPL

SEQ ID NO: 87026 - protein, 16 aa, Borrelia burgdorferi
ISSRIIKDDVPNYPLA

SEQ ID NO: 87027 - protein, 16 aa, Borrelia burgdorferi
SSRIIKDDVPNYPLAS

SEQ ID NO: 87028 - protein, 16 aa, Borrelia burgdorferi
SRIIKDDVPNYPLASS

SEQ ID NO: 87029 - protein, 16 aa, Borrelia burgdorferi
RIIKDDVPNYPLASSK

SEQ ID NO: 87030 - protein, 16 aa, Borrelia burgdorferi
IIKDDVPNYPLASSKM

SEQ ID NO: 87031 - protein, 16 aa, Borrelia burgdorferi
IKDDVPNYPLASSKMR

SEQ ID NO: 87032 - protein, 16 aa, Borrelia burgdorferi
KDDVPNYPLASSKMRF

SEQ ID NO: 87033 - protein, 16 aa, Borrelia burgdorferi
DDVPNYPLASSKMRFK

SEQ ID NO: 87034 - protein, 16 aa, Borrelia burgdorferi
DVPNYPLASSKMRFKA

SEQ ID NO: 87035 - protein, 16 aa, Borrelia burgdorferi
VPNYPLASSKMRFKAF

SEQ ID NO: 87036 - protein, 16 aa, Borrelia burgdorferi
PNYPLASSKMRFKAFR

SEQ ID NO: 87037 - protein, 16 aa, Borrelia burgdorferi
NYPLASSKMRFKAFRV

SEQ ID NO: 87038 - protein, 16 aa, Borrelia burgdorferi
YPLASSKMRFKAFRVS

SEQ ID NO: 87039 - protein, 16 aa, Borrelia burgdorferi
PLASSKMRFKAFRVSK

SEQ ID NO: 87040 - protein, 16 aa, Borrelia burgdorferi
LASSKMRFKAFRVSKS

SEQ ID NO: 87041 - protein, 16 aa, Borrelia burgdorferi
ASSKMRFKAFRVSKSH

SEQ ID NO: 87042 - protein, 16 aa, Borrelia burgdorferi
SSKMRFKAFRVSKSHS

SEQ ID NO: 87043 - protein, 16 aa, Borrelia burgdorferi
SKMRFKAFRVSKSHSS

SEQ ID NO: 87044 - protein, 16 aa, Borrelia burgdorferi
KMRFKAFRVSKSHSSK

SEQ ID NO: 87045 - protein, 16 aa, Borrelia burgdorferi
MRFKAFRVSKSHSSKV

SEQ ID NO: 87046 - protein, 16 aa, Borrelia burgdorferi
RFKAFRVSKSHSSKVK

SEQ ID NO: 87047 - protein, 16 aa, Borrelia burgdorferi
FKAFRVSKSHSSKVKN

SEQ ID NO: 87048 - protein, 16 aa, Borrelia burgdorferi
KAFRVSKSHSSKVKNF

SEQ ID NO: 87049 - protein, 16 aa, Borrelia burgdorferi
AFRVSKSHSSKVKNFI

SEQ ID NO: 87050 - protein, 16 aa, Borrelia burgdorferi
FRVSKSHSSKVKNFIF

SEQ ID NO: 87051 - protein, 16 aa, Borrelia burgdorferi
RVSKSHSSKVKNFIFY

SEQ ID NO: 87052 - protein, 16 aa, Borrelia burgdorferi
VSKSHSSKVKNFIFYV

SEQ ID NO: 87053 - protein, 16 aa, Borrelia burgdorferi
SKSHSSKVKNFIFYVK

SEQ ID NO: 87054 - protein, 16 aa, Borrelia burgdorferi
KSHSSKVKNFIFYVKD

SEQ ID NO: 87055 - protein, 16 aa, Borrelia burgdorferi
SHSSKVKNFIFYVKDL

SEQ ID NO: 87056 - protein, 16 aa, Borrelia burgdorferi
HSSKVKNFIFYVKDLR

SEQ ID NO: 87057 - protein, 16 aa, Borrelia burgdorferi
SSKVKNFIFYVKDLRV

SEQ ID NO: 87058 - protein, 16 aa, Borrelia burgdorferi
SKVKNFIFYVKDLRVL

SEQ ID NO: 87059 - protein, 16 aa, Borrelia burgdorferi
KVKNFIFYVKDLRVLY

SEQ ID NO: 87060 - protein, 16 aa, Borrelia burgdorferi
VKNFIFYVKDLRVLYD

SEQ ID NO: 87061 - protein, 16 aa, Borrelia burgdorferi
KNFIFYVKDLRVLYDK

SEQ ID NO: 87062 - protein, 16 aa, Borrelia burgdorferi
NFIFYVKDLRVLYDKL

SEQ ID NO: 87063 - protein, 16 aa, Borrelia burgdorferi
FIFYVKDLRVLYDKLS

SEQ ID NO: 87064 - protein, 16 aa, Borrelia burgdorferi
IFYVKDLRVLYDKLSV

SEQ ID NO: 87065 - protein, 16 aa, Borrelia burgdorferi
FYVKDLRVLYDKLSVS

SEQ ID NO: 87066 - protein, 16 aa, Borrelia burgdorferi
YVKDLRVLYDKLSVSI

SEQ ID NO: 87067 - protein, 16 aa, Borrelia burgdorferi
VKDLRVLYDKLSVSID

SEQ ID NO: 87068 - protein, 16 aa, Borrelia burgdorferi
KDLRVLYDKLSVSIDS

SEQ ID NO: 87069 - protein, 16 aa, Borrelia burgdorferi
DLRVLYDKLSVSIDSD

SEQ ID NO: 87070 - protein, 16 aa, Borrelia burgdorferi
LRVLYDKLSVSIDSDI

SEQ ID NO: 87071 - protein, 16 aa, Borrelia burgdorferi
RVLYDKLSVSIDSDID

SEQ ID NO: 87072 - protein, 16 aa, Borrelia burgdorferi
VLYDKLSVSIDSDIDS

SEQ ID NO: 87073 - protein, 16 aa, Borrelia burgdorferi
LYDKLSVSIDSDIDSE

SEQ ID NO: 87074 - protein, 16 aa, Borrelia burgdorferi
YDKLSVSIDSDIDSES

SEQ ID NO: 87075 - protein, 16 aa, Borrelia burgdorferi
DKLSVSIDSDIDSESV

SEQ ID NO: 87076 - protein, 16 aa, Borrelia burgdorferi
KLSVSIDSDIDSESVF

SEQ ID NO: 87077 - protein, 16 aa, Borrelia burgdorferi
LSVSIDSDIDSESVFK

SEQ ID NO: 87078 - protein, 16 aa, Borrelia burgdorferi
SVSIDSDIDSESVFKV

SEQ ID NO: 87079 - protein, 16 aa, Borrelia burgdorferi
VSIDSDIDSESVFKVY

SEQ ID NO: 87080 - protein, 16 aa, Borrelia burgdorferi
SIDSDIDSESVFKVYE

SEQ ID NO: 87081 - protein, 16 aa, Borrelia burgdorferi
IDSDIDSESVFKVYET

SEQ ID NO: 87082 - protein, 16 aa, Borrelia burgdorferi
DSDIDSESVFKVYETS

SEQ ID NO: 87083 - protein, 16 aa, Borrelia burgdorferi
SDIDSESVFKVYETSG

SEQ ID NO: 87084 - protein, 16 aa, Borrelia burgdorferi
DIDSESVFKVYETSGT

SEQ ID NO: 87085 - protein, 16 aa, Borrelia burgdorferi
IDSESVFKVYETSGTE

SEQ ID NO: 87086 - protein, 16 aa, Borrelia burgdorferi
DSESVFKVYETSGTES

SEQ ID NO: 87087 - protein, 16 aa, Borrelia burgdorferi
SESVFKVYETSGTESL

SEQ ID NO: 87088 - protein, 16 aa, Borrelia burgdorferi
ESVFKVYETSGTESLR

SEQ ID NO: 87089 - protein, 16 aa, Borrelia burgdorferi
SVFKVYETSGTESLRK

SEQ ID NO: 87090 - protein, 16 aa, Borrelia burgdorferi
VFKVYETSGTESLRKL

SEQ ID NO: 87091 - protein, 16 aa, Borrelia burgdorferi
FKVYETSGTESLRKLK

SEQ ID NO: 87092 - protein, 16 aa, Borrelia burgdorferi
KVYETSGTESLRKLKA

SEQ ID NO: 87093 - protein, 16 aa, Borrelia burgdorferi
VYETSGTESLRKLKAH

SEQ ID NO: 87094 - protein, 16 aa, Borrelia burgdorferi
YETSGTESLRKLKAHE

SEQ ID NO: 87095 - protein, 16 aa, Borrelia burgdorferi
ETSGTESLRKLKAHET

SEQ ID NO: 87096 - protein, 16 aa, Borrelia burgdorferi
TSGTESLRKLKAHETF

SEQ ID NO: 87097 - protein, 16 aa, Borrelia burgdorferi
SGTESLRKLKAHETFK

SEQ ID NO: 87098 - protein, 16 aa, Borrelia burgdorferi
GTESLRKLKAHETFKR

SEQ ID NO: 87099 - protein, 16 aa, Borrelia burgdorferi
TESLRKLKAHETFKRV

SEQ ID NO: 87100 - protein, 16 aa, Borrelia burgdorferi
ESLRKLKAHETFKRVL

SEQ ID NO: 87101 - protein, 16 aa, Borrelia burgdorferi
SLRKLKAHETFKRVLK

SEQ ID NO: 87102 - protein, 16 aa, Borrelia burgdorferi
LRKLKAHETFKRVLKL

SEQ ID NO: 87103 - protein, 16 aa, Borrelia burgdorferi
RKLKAHETFKRVLKLR

SEQ ID NO: 87104 - protein, 16 aa, Borrelia burgdorferi
KLKAHETFKRVLKLRE

SEQ ID NO: 87105 - protein, 16 aa, Borrelia burgdorferi
LKAHETFKRVLKLREK

SEQ ID NO: 87106 - protein, 16 aa, Borrelia burgdorferi
KAHETFKRVLKLREKI

SEQ ID NO: 87107 - protein, 16 aa, Borrelia burgdorferi
AHETFKRVLKLREKIS

SEQ ID NO: 87108 - protein, 16 aa, Borrelia burgdorferi
HETFKRVLKLREKISI

SEQ ID NO: 87109 - protein, 16 aa, Borrelia burgdorferi
ETFKRVLKLREKISIA

SEQ ID NO: 87110 - protein, 16 aa, Borrelia burgdorferi
TFKRVLKLREKISIAE

SEQ ID NO: 87111 - protein, 16 aa, Borrelia burgdorferi
FKRVLKLREKISIAEG

SEQ ID NO: 87112 - protein, 16 aa, Borrelia burgdorferi
KRVLKLREKISIAEGS

SEQ ID NO: 87113 - protein, 16 aa, Borrelia burgdorferi
RVLKLREKISIAEGSF

SEQ ID NO: 87114 - protein, 16 aa, Borrelia burgdorferi
VLKLREKISIAEGSFQ

SEQ ID NO: 87115 - protein, 16 aa, Borrelia burgdorferi
LKLREKISIAEGSFQN

SEQ ID NO: 87116 - protein, 16 aa, Borrelia burgdorferi
KLREKISIAEGSFQNF

SEQ ID NO: 87117 - protein, 16 aa, Borrelia burgdorferi
LREKISIAEGSFQNFV

SEQ ID NO: 87118 - protein, 16 aa, Borrelia burgdorferi
REKISIAEGSFQNFVE

SEQ ID NO: 87119 - protein, 16 aa, Borrelia burgdorferi
EKISIAEGSFQNFVEK

SEQ ID NO: 87120 - protein, 16 aa, Borrelia burgdorferi
KISIAEGSFQNFVEKI

SEQ ID NO: 87121 - protein, 16 aa, Borrelia burgdorferi
ISIAEGSFQNFVEKIE

SEQ ID NO: 87122 - protein, 16 aa, Borrelia burgdorferi
SIAEGSFQNFVEKIES

SEQ ID NO: 87123 - protein, 16 aa, Borrelia burgdorferi
IAEGSFQNFVEKIESE

SEQ ID NO: 87124 - protein, 16 aa, Borrelia burgdorferi
AEGSFQNFVEKIESEK

SEQ ID NO: 87125 - protein, 16 aa, Borrelia burgdorferi
EGSFQNFVEKIESEKP

SEQ ID NO: 87126 - protein, 16 aa, Borrelia burgdorferi
GSFQNFVEKIESEKPE

SEQ ID NO: 87127 - protein, 16 aa, Borrelia burgdorferi
SFQNFVEKIESEKPEE

SEQ ID NO: 87128 - protein, 16 aa, Borrelia burgdorferi
FQNFVEKIESEKPEES

SEQ ID NO: 87129 - protein, 16 aa, Borrelia burgdorferi
QNFVEKIESEKPEESS

SEQ ID NO: 87130 - protein, 16 aa, Borrelia burgdorferi
NFVEKIESEKPEESSP

SEQ ID NO: 87131 - protein, 16 aa, Borrelia burgdorferi
FVEKIESEKPEESSPK

SEQ ID NO: 87132 - protein, 16 aa, Borrelia burgdorferi
VEKIESEKPEESSPKN

SEQ ID NO: 87133 - protein, 13 aa, Borrelia garinii PBi
MIINHNTSAINAS

SEQ ID NO: 87134 - protein, 13 aa, Borrelia garinii PBi
IINHNTSAINASR

SEQ ID NO: 87135 - protein, 13 aa, Borrelia garinii PBi
INHNTSAINASRN

SEQ ID NO: 87136 - protein, 13 aa, Borrelia garinii PBi
NHNTSAINASRNN

SEQ ID NO: 87137 - protein, 13 aa, Borrelia garinii PBi
HNTSAINASRNNS

SEQ ID NO: 87138 - protein, 13 aa, Borrelia garinii PBi
NTSAINASRNNSI

SEQ ID NO: 87139 - protein, 13 aa, Borrelia garinii PBi
TSAINASRNNSIN

SEQ ID NO: 87140 - protein, 13 aa, Borrelia garinii PBi
SAINASRNNSINA

SEQ ID NO: 87141 - protein, 13 aa, Borrelia garinii PBi
AINASRNNSINAA

SEQ ID NO: 87142 - protein, 13 aa, Borrelia garinii PBi
INASRNNSINAAN

SEQ ID NO: 87143 - protein, 13 aa, Borrelia garinii PBi
NASRNNSINAANL

SEQ ID NO: 87144 - protein, 13 aa, Borrelia garinii PBi
ASRNNSINAANLS

SEQ ID NO: 87145 - protein, 13 aa, Borrelia garinii PBi
SRNNSINAANLSK

SEQ ID NO: 87146 - protein, 13 aa, Borrelia garinii PBi
RNNSINAANLSKT

SEQ ID NO: 87147 - protein, 13 aa, Borrelia garinii PBi
NNSINAANLSKTQ

SEQ ID NO: 87148 - protein, 13 aa, Borrelia garinii PBi
NSINAANLSKTQE

SEQ ID NO: 87149 - protein, 13 aa, Borrelia garinii PBi
SINAANLSKTQEK

SEQ ID NO: 87150 - protein, 13 aa, Borrelia garinii PBi
INAANLSKTQEKL

SEQ ID NO: 87151 - protein, 13 aa, Borrelia garinii PBi
NAANLSKTQEKLS

SEQ ID NO: 87152 - protein, 13 aa, Borrelia garinii PBi
AANLSKTQEKLSS

SEQ ID NO: 87153 - protein, 13 aa, Borrelia garinii PBi
ANLSKTQEKLSSG

SEQ ID NO: 87154 - protein, 13 aa, Borrelia garinii PBi
NLSKTQEKLSSGY

SEQ ID NO: 87155 - protein, 13 aa, Borrelia garinii PBi
LSKTQEKLSSGYR

SEQ ID NO: 87156 - protein, 13 aa, Borrelia garinii PBi
SKTQEKLSSGYRI

SEQ ID NO: 87157 - protein, 13 aa, Borrelia garinii PBi
KTQEKLSSGYRIN

SEQ ID NO: 87158 - protein, 13 aa, Borrelia garinii PBi
TQEKLSSGYRINR

SEQ ID NO: 87159 - protein, 13 aa, Borrelia garinii PBi
QEKLSSGYRINRA

SEQ ID NO: 87160 - protein, 13 aa, Borrelia garinii PBi
EKLSSGYRINRAS

SEQ ID NO: 87161 - protein, 13 aa, Borrelia garinii PBi
KLSSGYRINRASD

SEQ ID NO: 87162 - protein, 13 aa, Borrelia garinii PBi
LSSGYRINRASDD

SEQ ID NO: 87163 - protein, 13 aa, Borrelia garinii PBi
SSGYRINRASDDA

SEQ ID NO: 87164 - protein, 13 aa, Borrelia garinii PBi
SGYRINRASDDAA

SEQ ID NO: 87165 - protein, 13 aa, Borrelia garinii PBi
GYRINRASDDAAG

SEQ ID NO: 87166 - protein, 13 aa, Borrelia garinii PBi
YRINRASDDAAGM

SEQ ID NO: 87167 - protein, 13 aa, Borrelia garinii PBi
RINRASDDAAGMG

SEQ ID NO: 87168 - protein, 13 aa, Borrelia garinii PBi
INRASDDAAGMGV

SEQ ID NO: 87169 - protein, 13 aa, Borrelia garinii PBi
NRASDDAAGMGVS

SEQ ID NO: 87170 - protein, 13 aa, Borrelia garinii PBi
RASDDAAGMGVSG

SEQ ID NO: 87171 - protein, 13 aa, Borrelia garinii PBi
ASDDAAGMGVSGK

SEQ ID NO: 87172 - protein, 13 aa, Borrelia garinii PBi
SDDAAGMGVSGKI

SEQ ID NO: 87173 - protein, 13 aa, Borrelia garinii PBi
DDAAGMGVSGKIN

SEQ ID NO: 87174 - protein, 13 aa, Borrelia garinii PBi
DAAGMGVSGKINA

SEQ ID NO: 87175 - protein, 13 aa, Borrelia garinii PBi
AAGMGVSGKINAQ

SEQ ID NO: 87176 - protein, 13 aa, Borrelia garinii PBi
AGMGVSGKINAQI

SEQ ID NO: 87177 - protein, 13 aa, Borrelia garinii PBi
GMGVSGKINAQIR

SEQ ID NO: 87178 - protein, 13 aa, Borrelia garinii PBi
MGVSGKINAQIRG

SEQ ID NO: 87179 - protein, 13 aa, Borrelia garinii PBi
GVSGKINAQIRGL

SEQ ID NO: 87180 - protein, 13 aa, Borrelia garinii PBi
VSGKINAQIRGLS

SEQ ID NO: 87181 - protein, 13 aa, Borrelia garinii PBi
SGKINAQIRGLSQ

SEQ ID NO: 87182 - protein, 13 aa, Borrelia garinii PBi
GKINAQIRGLSQA

SEQ ID NO: 87183 - protein, 13 aa, Borrelia garinii PBi
KINAQIRGLSQAS

SEQ ID NO: 87184 - protein, 13 aa, Borrelia garinii PBi
INAQIRGLSQASR

SEQ ID NO: 87185 - protein, 13 aa, Borrelia garinii PBi
NAQIRGLSQASRN

SEQ ID NO: 87186 - protein, 13 aa, Borrelia garinii PBi
AQIRGLSQASRNT

SEQ ID NO: 87187 - protein, 13 aa, Borrelia garinii PBi
QIRGLSQASRNTS

SEQ ID NO: 87188 - protein, 13 aa, Borrelia garinii PBi
IRGLSQASRNTSK

SEQ ID NO: 87189 - protein, 13 aa, Borrelia garinii PBi
RGLSQASRNTSKA

SEQ ID NO: 87190 - protein, 13 aa, Borrelia garinii PBi
GLSQASRNTSKAI

SEQ ID NO: 87191 - protein, 13 aa, Borrelia garinii PBi
LSQASRNTSKAIN

SEQ ID NO: 87192 - protein, 13 aa, Borrelia garinii PBi
SQASRNTSKAINF

SEQ ID NO: 87193 - protein, 13 aa, Borrelia garinii PBi
QASRNTSKAINFI

SEQ ID NO: 87194 - protein, 13 aa, Borrelia garinii PBi
ASRNTSKAINFIQ

SEQ ID NO: 87195 - protein, 13 aa, Borrelia garinii PBi
SRNTSKAINFIQT

SEQ ID NO: 87196 - protein, 13 aa, Borrelia garinii PBi
RNTSKAINFIQTT

SEQ ID NO: 87197 - protein, 13 aa, Borrelia garinii PBi
NTSKAINFIQTTE

SEQ ID NO: 87198 - protein, 13 aa, Borrelia garinii PBi
TSKAINFIQTTEG

SEQ ID NO: 87199 - protein, 13 aa, Borrelia garinii PBi
SKAINFIQTTEGN

SEQ ID NO: 87200 - protein, 13 aa, Borrelia garinii PBi
KAINFIQTTEGNL

SEQ ID NO: 87201 - protein, 13 aa, Borrelia garinii PBi
AINFIQTTEGNLN

SEQ ID NO: 87202 - protein, 13 aa, Borrelia garinii PBi
INFIQTTEGNLNE

SEQ ID NO: 87203 - protein, 13 aa, Borrelia garinii PBi
NFIQTTEGNLNEV

SEQ ID NO: 87204 - protein, 13 aa, Borrelia garinii PBi
FIQTTEGNLNEVE

SEQ ID NO: 87205 - protein, 13 aa, Borrelia garinii PBi
IQTTEGNLNEVEK

SEQ ID NO: 87206 - protein, 13 aa, Borrelia garinii PBi
QTTEGNLNEVEKV

SEQ ID NO: 87207 - protein, 13 aa, Borrelia garinii PBi
TTEGNLNEVEKVL

SEQ ID NO: 87208 - protein, 13 aa, Borrelia garinii PBi
TEGNLNEVEKVLV

SEQ ID NO: 87209 - protein, 13 aa, Borrelia garinii PBi
EGNLNEVEKVLVR

SEQ ID NO: 87210 - protein, 13 aa, Borrelia garinii PBi
GNLNEVEKVLVRM

SEQ ID NO: 87211 - protein, 13 aa, Borrelia garinii PBi
NLNEVEKVLVRMK

SEQ ID NO: 87212 - protein, 13 aa, Borrelia garinii PBi
LNEVEKVLVRMKE

SEQ ID NO: 87213 - protein, 13 aa, Borrelia garinii PBi
NEVEKVLVRMKEL

SEQ ID NO: 87214 - protein, 13 aa, Borrelia garinii PBi
EVEKVLVRMKELA

SEQ ID NO: 87215 - protein, 13 aa, Borrelia garinii PBi
VEKVLVRMKELAV

SEQ ID NO: 87216 - protein, 13 aa, Borrelia garinii PBi
EKVLVRMKELAVQ

SEQ ID NO: 87217 - protein, 13 aa, Borrelia garinii PBi
KVLVRMKELAVQS

SEQ ID NO: 87218 - protein, 13 aa, Borrelia garinii PBi
VLVRMKELAVQSG

SEQ ID NO: 87219 - protein, 13 aa, Borrelia garinii PBi
LVRMKELAVQSGN

SEQ ID NO: 87220 - protein, 13 aa, Borrelia garinii PBi
VRMKELAVQSGNG

SEQ ID NO: 87221 - protein, 13 aa, Borrelia garinii PBi
RMKELAVQSGNGT

SEQ ID NO: 87222 - protein, 13 aa, Borrelia garinii PBi
MKELAVQSGNGTY

SEQ ID NO: 87223 - protein, 13 aa, Borrelia garinii PBi
KELAVQSGNGTYS

SEQ ID NO: 87224 - protein, 13 aa, Borrelia garinii PBi
ELAVQSGNGTYSD

SEQ ID NO: 87225 - protein, 13 aa, Borrelia garinii PBi
LAVQSGNGTYSDA

SEQ ID NO: 87226 - protein, 13 aa, Borrelia garinii PBi
AVQSGNGTYSDAD

SEQ ID NO: 87227 - protein, 13 aa, Borrelia garinii PBi
VQSGNGTYSDADR

SEQ ID NO: 87228 - protein, 13 aa, Borrelia garinii PBi
QSGNGTYSDADRG

SEQ ID NO: 87229 - protein, 13 aa, Borrelia garinii PBi
SGNGTYSDADRGS

SEQ ID NO: 87230 - protein, 13 aa, Borrelia garinii PBi
GNGTYSDADRGSI

SEQ ID NO: 87231 - protein, 13 aa, Borrelia garinii PBi
NGTYSDADRGSIQ

SEQ ID NO: 87232 - protein, 13 aa, Borrelia garinii PBi
GTYSDADRGSIQI

SEQ ID NO: 87233 - protein, 13 aa, Borrelia garinii PBi
TYSDADRGSIQIE

SEQ ID NO: 87234 - protein, 13 aa, Borrelia garinii PBi
YSDADRGSIQIEI

SEQ ID NO: 87235 - protein, 13 aa, Borrelia garinii PBi
SDADRGSIQIEIE

SEQ ID NO: 87236 - protein, 13 aa, Borrelia garinii PBi
DADRGSIQIEIEQ

SEQ ID NO: 87237 - protein, 13 aa, Borrelia garinii PBi
ADRGSIQIEIEQL

SEQ ID NO: 87238 - protein, 13 aa, Borrelia garinii PBi
DRGSIQIEIEQLT

SEQ ID NO: 87239 - protein, 13 aa, Borrelia garinii PBi
RGSIQIEIEQLTD

SEQ ID NO: 87240 - protein, 13 aa, Borrelia garinii PBi
GSIQIEIEQLTDE

SEQ ID NO: 87241 - protein, 13 aa, Borrelia garinii PBi
SIQIEIEQLTDEI

SEQ ID NO: 87242 - protein, 13 aa, Borrelia garinii PBi
IQIEIEQLTDEIN

SEQ ID NO: 87243 - protein, 13 aa, Borrelia garinii PBi
QIEIEQLTDEINR

SEQ ID NO: 87244 - protein, 13 aa, Borrelia garinii PBi
IEIEQLTDEINRI

SEQ ID NO: 87245 - protein, 13 aa, Borrelia garinii PBi
EIEQLTDEINRIA

SEQ ID NO: 87246 - protein, 13 aa, Borrelia garinii PBi
IEQLTDEINRIAD

SEQ ID NO: 87247 - protein, 13 aa, Borrelia garinii PBi
EQLTDEINRIADQ

SEQ ID NO: 87248 - protein, 13 aa, Borrelia garinii PBi
QLTDEINRIADQA

SEQ ID NO: 87249 - protein, 13 aa, Borrelia garinii PBi
LTDEINRIADQAQ

SEQ ID NO: 87250 - protein, 13 aa, Borrelia garinii PBi
TDEINRIADQAQY

SEQ ID NO: 87251 - protein, 13 aa, Borrelia garinii PBi
DEINRIADQAQYN

SEQ ID NO: 87252 - protein, 13 aa, Borrelia garinii PBi
EINRIADQAQYNQ

SEQ ID NO: 87253 - protein, 13 aa, Borrelia garinii PBi
INRIADQAQYNQM

SEQ ID NO: 87254 - protein, 13 aa, Borrelia garinii PBi
NRIADQAQYNQMH

SEQ ID NO: 87255 - protein, 13 aa, Borrelia garinii PBi
RIADQAQYNQMHM

SEQ ID NO: 87256 - protein, 13 aa, Borrelia garinii PBi
IADQAQYNQMHML

SEQ ID NO: 87257 - protein, 13 aa, Borrelia garinii PBi
ADQAQYNQMHMLS

SEQ ID NO: 87258 - protein, 13 aa, Borrelia garinii PBi
DQAQYNQMHMLSN

SEQ ID NO: 87259 - protein, 13 aa, Borrelia garinii PBi
QAQYNQMHMLSNK

SEQ ID NO: 87260 - protein, 13 aa, Borrelia garinii PBi
AQYNQMHMLSNKS

SEQ ID NO: 87261 - protein, 13 aa, Borrelia garinii PBi
QYNQMHMLSNKSA

SEQ ID NO: 87262 - protein, 13 aa, Borrelia garinii PBi
YNQMHMLSNKSAS

SEQ ID NO: 87263 - protein, 13 aa, Borrelia garinii PBi
NQMHMLSNKSASQ

SEQ ID NO: 87264 - protein, 13 aa, Borrelia garinii PBi
QMHMLSNKSASQN

SEQ ID NO: 87265 - protein, 13 aa, Borrelia garinii PBi
MHMLSNKSASQNV

SEQ ID NO: 87266 - protein, 13 aa, Borrelia garinii PBi
HMLSNKSASQNVR

SEQ ID NO: 87267 - protein, 13 aa, Borrelia garinii PBi
MLSNKSASQNVRT

SEQ ID NO: 87268 - protein, 13 aa, Borrelia garinii PBi
LSNKSASQNVRTA

SEQ ID NO: 87269 - protein, 13 aa, Borrelia garinii PBi
SNKSASQNVRTAE

SEQ ID NO: 87270 - protein, 13 aa, Borrelia garinii PBi
NKSASQNVRTAEE

SEQ ID NO: 87271 - protein, 13 aa, Borrelia garinii PBi
KSASQNVRTAEEL

SEQ ID NO: 87272 - protein, 13 aa, Borrelia garinii PBi
SASQNVRTAEELG

SEQ ID NO: 87273 - protein, 13 aa, Borrelia garinii PBi
ASQNVRTAEELGM

SEQ ID NO: 87274 - protein, 13 aa, Borrelia garinii PBi
SQNVRTAEELGMQ

SEQ ID NO: 87275 - protein, 13 aa, Borrelia garinii PBi
QNVRTAEELGMQP

SEQ ID NO: 87276 - protein, 13 aa, Borrelia garinii PBi
NVRTAEELGMQPA

SEQ ID NO: 87277 - protein, 13 aa, Borrelia garinii PBi
VRTAEELGMQPAK

SEQ ID NO: 87278 - protein, 13 aa, Borrelia garinii PBi
RTAEELGMQPAKI

SEQ ID NO: 87279 - protein, 13 aa, Borrelia garinii PBi
TAEELGMQPAKIN

SEQ ID NO: 87280 - protein, 13 aa, Borrelia garinii PBi
AEELGMQPAKINT

SEQ ID NO: 87281 - protein, 13 aa, Borrelia garinii PBi
EELGMQPAKINTP

SEQ ID NO: 87282 - protein, 13 aa, Borrelia garinii PBi
ELGMQPAKINTPA

SEQ ID NO: 87283 - protein, 13 aa, Borrelia garinii PBi
LGMQPAKINTPAS

SEQ ID NO: 87284 - protein, 13 aa, Borrelia garinii PBi
GMQPAKINTPASL

SEQ ID NO: 87285 - protein, 13 aa, Borrelia garinii PBi
MQPAKINTPASLS

SEQ ID NO: 87286 - protein, 13 aa, Borrelia garinii PBi
QPAKINTPASLSG

SEQ ID NO: 87287 - protein, 13 aa, Borrelia garinii PBi
PAKINTPASLSGS

SEQ ID NO: 87288 - protein, 13 aa, Borrelia garinii PBi
AKINTPASLSGSQ

SEQ ID NO: 87289 - protein, 13 aa, Borrelia garinii PBi
KINTPASLSGSQA

SEQ ID NO: 87290 - protein, 13 aa, Borrelia garinii PBi
INTPASLSGSQAS

SEQ ID NO: 87291 - protein, 13 aa, Borrelia garinii PBi
NTPASLSGSQASW

SEQ ID NO: 87292 - protein, 13 aa, Borrelia garinii PBi
TPASLSGSQASWT

SEQ ID NO: 87293 - protein, 13 aa, Borrelia garinii PBi
PASLSGSQASWTL

SEQ ID NO: 87294 - protein, 13 aa, Borrelia garinii PBi
ASLSGSQASWTLR

SEQ ID NO: 87295 - protein, 13 aa, Borrelia garinii PBi
SLSGSQASWTLRV

SEQ ID NO: 87296 - protein, 13 aa, Borrelia garinii PBi
LSGSQASWTLRVH

SEQ ID NO: 87297 - protein, 13 aa, Borrelia garinii PBi
SGSQASWTLRVHV

SEQ ID NO: 87298 - protein, 13 aa, Borrelia garinii PBi
GSQASWTLRVHVG

SEQ ID NO: 87299 - protein, 13 aa, Borrelia garinii PBi
SQASWTLRVHVGA

SEQ ID NO: 87300 - protein, 13 aa, Borrelia garinii PBi
QASWTLRVHVGAN

SEQ ID NO: 87301 - protein, 13 aa, Borrelia garinii PBi
ASWTLRVHVGANQ

SEQ ID NO: 87302 - protein, 13 aa, Borrelia garinii PBi
SWTLRVHVGANQD

SEQ ID NO: 87303 - protein, 13 aa, Borrelia garinii PBi
WTLRVHVGANQDE

SEQ ID NO: 87304 - protein, 13 aa, Borrelia garinii PBi
TLRVHVGANQDEA

SEQ ID NO: 87305 - protein, 13 aa, Borrelia garinii PBi
LRVHVGANQDEAI

SEQ ID NO: 87306 - protein, 13 aa, Borrelia garinii PBi
RVHVGANQDEAIA

SEQ ID NO: 87307 - protein, 13 aa, Borrelia garinii PBi
VHVGANQDEAIAV

SEQ ID NO: 87308 - protein, 13 aa, Borrelia garinii PBi
HVGANQDEAIAVN

SEQ ID NO: 87309 - protein, 13 aa, Borrelia garinii PBi
VGANQDEAIAVNI

SEQ ID NO: 87310 - protein, 13 aa, Borrelia garinii PBi
GANQDEAIAVNIY

SEQ ID NO: 87311 - protein, 13 aa, Borrelia garinii PBi
ANQDEAIAVNIYA

SEQ ID NO: 87312 - protein, 13 aa, Borrelia garinii PBi
NQDEAIAVNIYAA

SEQ ID NO: 87313 - protein, 13 aa, Borrelia garinii PBi
QDEAIAVNIYAAN

SEQ ID NO: 87314 - protein, 13 aa, Borrelia garinii PBi
DEAIAVNIYAANV

SEQ ID NO: 87315 - protein, 13 aa, Borrelia garinii PBi
EAIAVNIYAANVA

SEQ ID NO: 87316 - protein, 13 aa, Borrelia garinii PBi
AIAVNIYAANVAN

SEQ ID NO: 87317 - protein, 13 aa, Borrelia garinii PBi
IAVNIYAANVANL

SEQ ID NO: 87318 - protein, 13 aa, Borrelia garinii PBi
AVNIYAANVANLF

SEQ ID NO: 87319 - protein, 13 aa, Borrelia garinii PBi
VNIYAANVANLFS

SEQ ID NO: 87320 - protein, 13 aa, Borrelia garinii PBi
NIYAANVANLFSG

SEQ ID NO: 87321 - protein, 13 aa, Borrelia garinii PBi
IYAANVANLFSGE

SEQ ID NO: 87322 - protein, 13 aa, Borrelia garinii PBi
YAANVANLFSGEG

SEQ ID NO: 87323 - protein, 13 aa, Borrelia garinii PBi
AANVANLFSGEGS

SEQ ID NO: 87324 - protein, 13 aa, Borrelia garinii PBi
ANVANLFSGEGSQ

SEQ ID NO: 87325 - protein, 13 aa, Borrelia garinii PBi
NVANLFSGEGSQA

SEQ ID NO: 87326 - protein, 13 aa, Borrelia garinii PBi
VANLFSGEGSQAA

SEQ ID NO: 87327 - protein, 13 aa, Borrelia garinii PBi
ANLFSGEGSQAAQ

SEQ ID NO: 87328 - protein, 13 aa, Borrelia garinii PBi
NLFSGEGSQAAQT

SEQ ID NO: 87329 - protein, 13 aa, Borrelia garinii PBi
LFSGEGSQAAQTA

SEQ ID NO: 87330 - protein, 13 aa, Borrelia garinii PBi
FSGEGSQAAQTAP

SEQ ID NO: 87331 - protein, 13 aa, Borrelia garinii PBi
SGEGSQAAQTAPV

SEQ ID NO: 87332 - protein, 13 aa, Borrelia garinii PBi
GEGSQAAQTAPVQ

SEQ ID NO: 87333 - protein, 13 aa, Borrelia garinii PBi
EGSQAAQTAPVQE

SEQ ID NO: 87334 - protein, 13 aa, Borrelia garinii PBi
GSQAAQTAPVQEG

SEQ ID NO: 87335 - protein, 13 aa, Borrelia garinii PBi
SQAAQTAPVQEGA

SEQ ID NO: 87336 - protein, 13 aa, Borrelia garinii PBi
QAAQTAPVQEGAQ

SEQ ID NO: 87337 - protein, 13 aa, Borrelia garinii PBi
AAQTAPVQEGAQQ

SEQ ID NO: 87338 - protein, 13 aa, Borrelia garinii PBi
AQTAPVQEGAQQE

SEQ ID NO: 87339 - protein, 13 aa, Borrelia garinii PBi
QTAPVQEGAQQEG

SEQ ID NO: 87340 - protein, 13 aa, Borrelia garinii PBi
TAPVQEGAQQEGA

SEQ ID NO: 87341 - protein, 13 aa, Borrelia garinii PBi
APVQEGAQQEGAQ

SEQ ID NO: 87342 - protein, 13 aa, Borrelia garinii PBi
PVQEGAQQEGAQQ

SEQ ID NO: 87343 - protein, 13 aa, Borrelia garinii PBi
VQEGAQQEGAQQP

SEQ ID NO: 87344 - protein, 13 aa, Borrelia garinii PBi
QEGAQQEGAQQPA

SEQ ID NO: 87345 - protein, 13 aa, Borrelia garinii PBi
EGAQQEGAQQPAP

SEQ ID NO: 87346 - protein, 13 aa, Borrelia garinii PBi
GAQQEGAQQPAPA

SEQ ID NO: 87347 - protein, 13 aa, Borrelia garinii PBi
AQQEGAQQPAPAT

SEQ ID NO: 87348 - protein, 13 aa, Borrelia garinii PBi
QQEGAQQPAPATA

SEQ ID NO: 87349 - protein, 13 aa, Borrelia garinii PBi
QEGAQQPAPATAP

SEQ ID NO: 87350 - protein, 13 aa, Borrelia garinii PBi
EGAQQPAPATAPS

SEQ ID NO: 87351 - protein, 13 aa, Borrelia garinii PBi
GAQQPAPATAPSQ

SEQ ID NO: 87352 - protein, 13 aa, Borrelia garinii PBi
AQQPAPATAPSQG

SEQ ID NO: 87353 - protein, 13 aa, Borrelia garinii PBi
QQPAPATAPSQGG

SEQ ID NO: 87354 - protein, 13 aa, Borrelia garinii PBi
QPAPATAPSQGGV

SEQ ID NO: 87355 - protein, 13 aa, Borrelia garinii PBi
PAPATAPSQGGVN

SEQ ID NO: 87356 - protein, 13 aa, Borrelia garinii PBi
APATAPSQGGVNS

SEQ ID NO: 87357 - protein, 13 aa, Borrelia garinii PBi
PATAPSQGGVNSP

SEQ ID NO: 87358 - protein, 13 aa, Borrelia garinii PBi
ATAPSQGGVNSPV

SEQ ID NO: 87359 - protein, 13 aa, Borrelia garinii PBi
TAPSQGGVNSPVN

SEQ ID NO: 87360 - protein, 13 aa, Borrelia garinii PBi
APSQGGVNSPVNV

SEQ ID NO: 87361 - protein, 13 aa, Borrelia garinii PBi
PSQGGVNSPVNVT

SEQ ID NO: 87362 - protein, 13 aa, Borrelia garinii PBi
SQGGVNSPVNVTT

SEQ ID NO: 87363 - protein, 13 aa, Borrelia garinii PBi
QGGVNSPVNVTTT

SEQ ID NO: 87364 - protein, 13 aa, Borrelia garinii PBi
GGVNSPVNVTTTV

SEQ ID NO: 87365 - protein, 13 aa, Borrelia garinii PBi
GVNSPVNVTTTVD

SEQ ID NO: 87366 - protein, 13 aa, Borrelia garinii PBi
VNSPVNVTTTVDA

SEQ ID NO: 87367 - protein, 13 aa, Borrelia garinii PBi
NSPVNVTTTVDAN

SEQ ID NO: 87368 - protein, 13 aa, Borrelia garinii PBi
SPVNVTTTVDANT

SEQ ID NO: 87369 - protein, 13 aa, Borrelia garinii PBi
PVNVTTTVDANTS

SEQ ID NO: 87370 - protein, 13 aa, Borrelia garinii PBi
VNVTTTVDANTSL

SEQ ID NO: 87371 - protein, 13 aa, Borrelia garinii PBi
NVTTTVDANTSLA

SEQ ID NO: 87372 - protein, 13 aa, Borrelia garinii PBi
VTTTVDANTSLAK

SEQ ID NO: 87373 - protein, 13 aa, Borrelia garinii PBi
TTTVDANTSLAKI

SEQ ID NO: 87374 - protein, 13 aa, Borrelia garinii PBi
TTVDANTSLAKIE

SEQ ID NO: 87375 - protein, 13 aa, Borrelia garinii PBi
TVDANTSLAKIEN

SEQ ID NO: 87376 - protein, 13 aa, Borrelia garinii PBi
VDANTSLAKIENA

SEQ ID NO: 87377 - protein, 13 aa, Borrelia garinii PBi
DANTSLAKIENAI

SEQ ID NO: 87378 - protein, 13 aa, Borrelia garinii PBi
ANTSLAKIENAIR

SEQ ID NO: 87379 - protein, 13 aa, Borrelia garinii PBi
NTSLAKIENAIRM

SEQ ID NO: 87380 - protein, 13 aa, Borrelia garinii PBi
TSLAKIENAIRMI

SEQ ID NO: 87381 - protein, 13 aa, Borrelia garinii PBi
SLAKIENAIRMIS

SEQ ID NO: 87382 - protein, 13 aa, Borrelia garinii PBi
LAKIENAIRMISD

SEQ ID NO: 87383 - protein, 13 aa, Borrelia garinii PBi
AKIENAIRMISDQ

SEQ ID NO: 87384 - protein, 13 aa, Borrelia garinii PBi
KIENAIRMISDQR

SEQ ID NO: 87385 - protein, 13 aa, Borrelia garinii PBi
IENAIRMISDQRA

SEQ ID NO: 87386 - protein, 13 aa, Borrelia garinii PBi
ENAIRMISDQRAN

SEQ ID NO: 87387 - protein, 13 aa, Borrelia garinii PBi
NAIRMISDQRANL

SEQ ID NO: 87388 - protein, 13 aa, Borrelia garinii PBi
AIRMISDQRANLG

SEQ ID NO: 87389 - protein, 13 aa, Borrelia garinii PBi
IRMISDQRANLGA

SEQ ID NO: 87390 - protein, 13 aa, Borrelia garinii PBi
RMISDQRANLGAF

SEQ ID NO: 87391 - protein, 13 aa, Borrelia garinii PBi
MISDQRANLGAFQ

SEQ ID NO: 87392 - protein, 13 aa, Borrelia garinii PBi
ISDQRANLGAFQN

SEQ ID NO: 87393 - protein, 13 aa, Borrelia garinii PBi
SDQRANLGAFQNR

SEQ ID NO: 87394 - protein, 13 aa, Borrelia garinii PBi
DQRANLGAFQNRL

SEQ ID NO: 87395 - protein, 13 aa, Borrelia garinii PBi
QRANLGAFQNRLE

SEQ ID NO: 87396 - protein, 13 aa, Borrelia garinii PBi
RANLGAFQNRLES

SEQ ID NO: 87397 - protein, 13 aa, Borrelia garinii PBi
ANLGAFQNRLESI

SEQ ID NO: 87398 - protein, 13 aa, Borrelia garinii PBi
NLGAFQNRLESIK

SEQ ID NO: 87399 - protein, 13 aa, Borrelia garinii PBi
LGAFQNRLESIKD

SEQ ID NO: 87400 - protein, 13 aa, Borrelia garinii PBi
GAFQNRLESIKDS

SEQ ID NO: 87401 - protein, 13 aa, Borrelia garinii PBi
AFQNRLESIKDST

SEQ ID NO: 87402 - protein, 13 aa, Borrelia garinii PBi
FQNRLESIKDSTE

SEQ ID NO: 87403 - protein, 13 aa, Borrelia garinii PBi
QNRLESIKDSTEY

SEQ ID NO: 87404 - protein, 13 aa, Borrelia garinii PBi
NRLESIKDSTEYA

SEQ ID NO: 87405 - protein, 13 aa, Borrelia garinii PBi
RLESIKDSTEYAI

SEQ ID NO: 87406 - protein, 13 aa, Borrelia garinii PBi
LESIKDSTEYAIE

SEQ ID NO: 87407 - protein, 13 aa, Borrelia garinii PBi
ESIKDSTEYAIEN

SEQ ID NO: 87408 - protein, 13 aa, Borrelia garinii PBi
SIKDSTEYAIENL

SEQ ID NO: 87409 - protein, 13 aa, Borrelia garinii PBi
IKDSTEYAIENLK

SEQ ID NO: 87410 - protein, 13 aa, Borrelia garinii PBi
KDSTEYAIENLKA

SEQ ID NO: 87411 - protein, 13 aa, Borrelia garinii PBi
DSTEYAIENLKAS

SEQ ID NO: 87412 - protein, 13 aa, Borrelia garinii PBi
STEYAIENLKASY

SEQ ID NO: 87413 - protein, 13 aa, Borrelia garinii PBi
TEYAIENLKASYA

SEQ ID NO: 87414 - protein, 13 aa, Borrelia garinii PBi
EYAIENLKASYAQ

SEQ ID NO: 87415 - protein, 13 aa, Borrelia garinii PBi
YAIENLKASYAQI

SEQ ID NO: 87416 - protein, 13 aa, Borrelia garinii PBi
AIENLKASYAQIK

SEQ ID NO: 87417 - protein, 13 aa, Borrelia garinii PBi
IENLKASYAQIKD

SEQ ID NO: 87418 - protein, 13 aa, Borrelia garinii PBi
ENLKASYAQIKDA

SEQ ID NO: 87419 - protein, 13 aa, Borrelia garinii PBi
NLKASYAQIKDAT

SEQ ID NO: 87420 - protein, 13 aa, Borrelia garinii PBi
LKASYAQIKDATM

SEQ ID NO: 87421 - protein, 13 aa, Borrelia garinii PBi
KASYAQIKDATMT

SEQ ID NO: 87422 - protein, 13 aa, Borrelia garinii PBi
ASYAQIKDATMTD

SEQ ID NO: 87423 - protein, 13 aa, Borrelia garinii PBi
SYAQIKDATMTDE

SEQ ID NO: 87424 - protein, 13 aa, Borrelia garinii PBi
YAQIKDATMTDEV

SEQ ID NO: 87425 - protein, 13 aa, Borrelia garinii PBi
AQIKDATMTDEVV

SEQ ID NO: 87426 - protein, 13 aa, Borrelia garinii PBi
QIKDATMTDEVVA

SEQ ID NO: 87427 - protein, 13 aa, Borrelia garinii PBi
IKDATMTDEVVAS

SEQ ID NO: 87428 - protein, 13 aa, Borrelia garinii PBi
KDATMTDEVVAST

SEQ ID NO: 87429 - protein, 13 aa, Borrelia garinii PBi
DATMTDEVVASTT

SEQ ID NO: 87430 - protein, 13 aa, Borrelia garinii PBi
ATMTDEVVASTTN

SEQ ID NO: 87431 - protein, 13 aa, Borrelia garinii PBi
TMTDEVVASTTNS

SEQ ID NO: 87432 - protein, 13 aa, Borrelia garinii PBi
MTDEVVASTTNSI

SEQ ID NO: 87433 - protein, 13 aa, Borrelia garinii PBi
TDEVVASTTNSIL

SEQ ID NO: 87434 - protein, 13 aa, Borrelia garinii PBi
DEVVASTTNSILT

SEQ ID NO: 87435 - protein, 13 aa, Borrelia garinii PBi
EVVASTTNSILTQ

SEQ ID NO: 87436 - protein, 13 aa, Borrelia garinii PBi
VVASTTNSILTQS

SEQ ID NO: 87437 - protein, 13 aa, Borrelia garinii PBi
VASTTNSILTQSA

SEQ ID NO: 87438 - protein, 13 aa, Borrelia garinii PBi
ASTTNSILTQSAM

SEQ ID NO: 87439 - protein, 13 aa, Borrelia garinii PBi
STTNSILTQSAMA

SEQ ID NO: 87440 - protein, 13 aa, Borrelia garinii PBi
TTNSILTQSAMAM

SEQ ID NO: 87441 - protein, 13 aa, Borrelia garinii PBi
TNSILTQSAMAMI

SEQ ID NO: 87442 - protein, 13 aa, Borrelia garinii PBi
NSILTQSAMAMIA

SEQ ID NO: 87443 - protein, 13 aa, Borrelia garinii PBi
SILTQSAMAMIAQ

SEQ ID NO: 87444 - protein, 13 aa, Borrelia garinii PBi
ILTQSAMAMIAQA

SEQ ID NO: 87445 - protein, 13 aa, Borrelia garinii PBi
LTQSAMAMIAQAN

SEQ ID NO: 87446 - protein, 13 aa, Borrelia garinii PBi
TQSAMAMIAQANQ

SEQ ID NO: 87447 - protein, 13 aa, Borrelia garinii PBi
QSAMAMIAQANQV

SEQ ID NO: 87448 - protein, 13 aa, Borrelia garinii PBi
SAMAMIAQANQVP

SEQ ID NO: 87449 - protein, 13 aa, Borrelia garinii PBi
AMAMIAQANQVPQ

SEQ ID NO: 87450 - protein, 13 aa, Borrelia garinii PBi
MAMIAQANQVPQY

SEQ ID NO: 87451 - protein, 13 aa, Borrelia garinii PBi
AMIAQANQVPQYV

SEQ ID NO: 87452 - protein, 13 aa, Borrelia garinii PBi
MIAQANQVPQYVL

SEQ ID NO: 87453 - protein, 13 aa, Borrelia garinii PBi
IAQANQVPQYVLS

SEQ ID NO: 87454 - protein, 13 aa, Borrelia garinii PBi
AQANQVPQYVLSL

SEQ ID NO: 87455 - protein, 13 aa, Borrelia garinii PBi
QANQVPQYVLSLL

SEQ ID NO: 87456 - protein, 13 aa, Borrelia garinii PBi
ANQVPQYVLSLLR

SEQ ID NO: 87457 - protein, 14 aa, Borrelia garinii PBi
MIINHNTSAINASR

SEQ ID NO: 87458 - protein, 14 aa, Borrelia garinii PBi
IINHNTSAINASRN

SEQ ID NO: 87459 - protein, 14 aa, Borrelia garinii PBi
INHNTSAINASRNN

SEQ ID NO: 87460 - protein, 14 aa, Borrelia garinii PBi
NHNTSAINASRNNS

SEQ ID NO: 87461 - protein, 14 aa, Borrelia garinii PBi
HNTSAINASRNNSI

SEQ ID NO: 87462 - protein, 14 aa, Borrelia garinii PBi
NTSAINASRNNSIN

SEQ ID NO: 87463 - protein, 14 aa, Borrelia garinii PBi
TSAINASRNNSINA

SEQ ID NO: 87464 - protein, 14 aa, Borrelia garinii PBi
SAINASRNNSINAA

SEQ ID NO: 87465 - protein, 14 aa, Borrelia garinii PBi
AINASRNNSINAAN

SEQ ID NO: 87466 - protein, 14 aa, Borrelia garinii PBi
INASRNNSINAANL

SEQ ID NO: 87467 - protein, 14 aa, Borrelia garinii PBi
NASRNNSINAANLS

SEQ ID NO: 87468 - protein, 14 aa, Borrelia garinii PBi
ASRNNSINAANLSK

SEQ ID NO: 87469 - protein, 14 aa, Borrelia garinii PBi
SRNNSINAANLSKT

SEQ ID NO: 87470 - protein, 14 aa, Borrelia garinii PBi
RNNSINAANLSKTQ

SEQ ID NO: 87471 - protein, 14 aa, Borrelia garinii PBi
NNSINAANLSKTQE

SEQ ID NO: 87472 - protein, 14 aa, Borrelia garinii PBi
NSINAANLSKTQEK

SEQ ID NO: 87473 - protein, 14 aa, Borrelia garinii PBi
SINAANLSKTQEKL

SEQ ID NO: 87474 - protein, 14 aa, Borrelia garinii PBi
INAANLSKTQEKLS

SEQ ID NO: 87475 - protein, 14 aa, Borrelia garinii PBi
NAANLSKTQEKLSS

SEQ ID NO: 87476 - protein, 14 aa, Borrelia garinii PBi
AANLSKTQEKLSSG

SEQ ID NO: 87477 - protein, 14 aa, Borrelia garinii PBi
ANLSKTQEKLSSGY

SEQ ID NO: 87478 - protein, 14 aa, Borrelia garinii PBi
NLSKTQEKLSSGYR

SEQ ID NO: 87479 - protein, 14 aa, Borrelia garinii PBi
LSKTQEKLSSGYRI

SEQ ID NO: 87480 - protein, 14 aa, Borrelia garinii PBi
SKTQEKLSSGYRIN

SEQ ID NO: 87481 - protein, 14 aa, Borrelia garinii PBi
KTQEKLSSGYRINR

SEQ ID NO: 87482 - protein, 14 aa, Borrelia garinii PBi
TQEKLSSGYRINRA

SEQ ID NO: 87483 - protein, 14 aa, Borrelia garinii PBi
QEKLSSGYRINRAS

SEQ ID NO: 87484 - protein, 14 aa, Borrelia garinii PBi
EKLSSGYRINRASD

SEQ ID NO: 87485 - protein, 14 aa, Borrelia garinii PBi
KLSSGYRINRASDD

SEQ ID NO: 87486 - protein, 14 aa, Borrelia garinii PBi
LSSGYRINRASDDA

SEQ ID NO: 87487 - protein, 14 aa, Borrelia garinii PBi
SSGYRINRASDDAA

SEQ ID NO: 87488 - protein, 14 aa, Borrelia garinii PBi
SGYRINRASDDAAG

SEQ ID NO: 87489 - protein, 14 aa, Borrelia garinii PBi
GYRINRASDDAAGM

SEQ ID NO: 87490 - protein, 14 aa, Borrelia garinii PBi
YRINRASDDAAGMG

SEQ ID NO: 87491 - protein, 14 aa, Borrelia garinii PBi
RINRASDDAAGMGV

SEQ ID NO: 87492 - protein, 14 aa, Borrelia garinii PBi
INRASDDAAGMGVS

SEQ ID NO: 87493 - protein, 14 aa, Borrelia garinii PBi
NRASDDAAGMGVSG

SEQ ID NO: 87494 - protein, 14 aa, Borrelia garinii PBi
RASDDAAGMGVSGK

SEQ ID NO: 87495 - protein, 14 aa, Borrelia garinii PBi
ASDDAAGMGVSGKI

SEQ ID NO: 87496 - protein, 14 aa, Borrelia garinii PBi
SDDAAGMGVSGKIN

SEQ ID NO: 87497 - protein, 14 aa, Borrelia garinii PBi
DDAAGMGVSGKINA

SEQ ID NO: 87498 - protein, 14 aa, Borrelia garinii PBi
DAAGMGVSGKINAQ

SEQ ID NO: 87499 - protein, 14 aa, Borrelia garinii PBi
AAGMGVSGKINAQI

SEQ ID NO: 87500 - protein, 14 aa, Borrelia garinii PBi
AGMGVSGKINAQIR

SEQ ID NO: 87501 - protein, 14 aa, Borrelia garinii PBi
GMGVSGKINAQIRG

SEQ ID NO: 87502 - protein, 14 aa, Borrelia garinii PBi
MGVSGKINAQIRGL

SEQ ID NO: 87503 - protein, 14 aa, Borrelia garinii PBi
GVSGKINAQIRGLS

SEQ ID NO: 87504 - protein, 14 aa, Borrelia garinii PBi
VSGKINAQIRGLSQ

SEQ ID NO: 87505 - protein, 14 aa, Borrelia garinii PBi
SGKINAQIRGLSQA

SEQ ID NO: 87506 - protein, 14 aa, Borrelia garinii PBi
GKINAQIRGLSQAS

SEQ ID NO: 87507 - protein, 14 aa, Borrelia garinii PBi
KINAQIRGLSQASR

SEQ ID NO: 87508 - protein, 14 aa, Borrelia garinii PBi
INAQIRGLSQASRN

SEQ ID NO: 87509 - protein, 14 aa, Borrelia garinii PBi
NAQIRGLSQASRNT

SEQ ID NO: 87510 - protein, 14 aa, Borrelia garinii PBi
AQIRGLSQASRNTS

SEQ ID NO: 87511 - protein, 14 aa, Borrelia garinii PBi
QIRGLSQASRNTSK

SEQ ID NO: 87512 - protein, 14 aa, Borrelia garinii PBi
IRGLSQASRNTSKA

SEQ ID NO: 87513 - protein, 14 aa, Borrelia garinii PBi
RGLSQASRNTSKAI

SEQ ID NO: 87514 - protein, 14 aa, Borrelia garinii PBi
GLSQASRNTSKAIN

SEQ ID NO: 87515 - protein, 14 aa, Borrelia garinii PBi
LSQASRNTSKAINF

SEQ ID NO: 87516 - protein, 14 aa, Borrelia garinii PBi
SQASRNTSKAINFI

SEQ ID NO: 87517 - protein, 14 aa, Borrelia garinii PBi
QASRNTSKAINFIQ

SEQ ID NO: 87518 - protein, 14 aa, Borrelia garinii PBi
ASRNTSKAINFIQT

SEQ ID NO: 87519 - protein, 14 aa, Borrelia garinii PBi
SRNTSKAINFIQTT

SEQ ID NO: 87520 - protein, 14 aa, Borrelia garinii PBi
RNTSKAINFIQTTE

SEQ ID NO: 87521 - protein, 14 aa, Borrelia garinii PBi
NTSKAINFIQTTEG

SEQ ID NO: 87522 - protein, 14 aa, Borrelia garinii PBi
TSKAINFIQTTEGN

SEQ ID NO: 87523 - protein, 14 aa, Borrelia garinii PBi
SKAINFIQTTEGNL

SEQ ID NO: 87524 - protein, 14 aa, Borrelia garinii PBi
KAINFIQTTEGNLN

SEQ ID NO: 87525 - protein, 14 aa, Borrelia garinii PBi
AINFIQTTEGNLNE

SEQ ID NO: 87526 - protein, 14 aa, Borrelia garinii PBi
INFIQTTEGNLNEV

SEQ ID NO: 87527 - protein, 14 aa, Borrelia garinii PBi
NFIQTTEGNLNEVE

SEQ ID NO: 87528 - protein, 14 aa, Borrelia garinii PBi
FIQTTEGNLNEVEK

SEQ ID NO: 87529 - protein, 14 aa, Borrelia garinii PBi
IQTTEGNLNEVEKV

SEQ ID NO: 87530 - protein, 14 aa, Borrelia garinii PBi
QTTEGNLNEVEKVL

SEQ ID NO: 87531 - protein, 14 aa, Borrelia garinii PBi
TTEGNLNEVEKVLV

SEQ ID NO: 87532 - protein, 14 aa, Borrelia garinii PBi
TEGNLNEVEKVLVR

SEQ ID NO: 87533 - protein, 14 aa, Borrelia garinii PBi
EGNLNEVEKVLVRM

SEQ ID NO: 87534 - protein, 14 aa, Borrelia garinii PBi
GNLNEVEKVLVRMK

SEQ ID NO: 87535 - protein, 14 aa, Borrelia garinii PBi
NLNEVEKVLVRMKE

SEQ ID NO: 87536 - protein, 14 aa, Borrelia garinii PBi
LNEVEKVLVRMKEL

SEQ ID NO: 87537 - protein, 14 aa, Borrelia garinii PBi
NEVEKVLVRMKELA

SEQ ID NO: 87538 - protein, 14 aa, Borrelia garinii PBi
EVEKVLVRMKELAV

SEQ ID NO: 87539 - protein, 14 aa, Borrelia garinii PBi
VEKVLVRMKELAVQ

SEQ ID NO: 87540 - protein, 14 aa, Borrelia garinii PBi
EKVLVRMKELAVQS

SEQ ID NO: 87541 - protein, 14 aa, Borrelia garinii PBi
KVLVRMKELAVQSG

SEQ ID NO: 87542 - protein, 14 aa, Borrelia garinii PBi
VLVRMKELAVQSGN

SEQ ID NO: 87543 - protein, 14 aa, Borrelia garinii PBi
LVRMKELAVQSGNG

SEQ ID NO: 87544 - protein, 14 aa, Borrelia garinii PBi
VRMKELAVQSGNGT

SEQ ID NO: 87545 - protein, 14 aa, Borrelia garinii PBi
RMKELAVQSGNGTY

SEQ ID NO: 87546 - protein, 14 aa, Borrelia garinii PBi
MKELAVQSGNGTYS

SEQ ID NO: 87547 - protein, 14 aa, Borrelia garinii PBi
KELAVQSGNGTYSD

SEQ ID NO: 87548 - protein, 14 aa, Borrelia garinii PBi
ELAVQSGNGTYSDA

SEQ ID NO: 87549 - protein, 14 aa, Borrelia garinii PBi
LAVQSGNGTYSDAD

SEQ ID NO: 87550 - protein, 14 aa, Borrelia garinii PBi
AVQSGNGTYSDADR

SEQ ID NO: 87551 - protein, 14 aa, Borrelia garinii PBi
VQSGNGTYSDADRG

SEQ ID NO: 87552 - protein, 14 aa, Borrelia garinii PBi
QSGNGTYSDADRGS

SEQ ID NO: 87553 - protein, 14 aa, Borrelia garinii PBi
SGNGTYSDADRGSI

SEQ ID NO: 87554 - protein, 14 aa, Borrelia garinii PBi
GNGTYSDADRGSIQ

SEQ ID NO: 87555 - protein, 14 aa, Borrelia garinii PBi
NGTYSDADRGSIQI

SEQ ID NO: 87556 - protein, 14 aa, Borrelia garinii PBi
GTYSDADRGSIQIE

SEQ ID NO: 87557 - protein, 14 aa, Borrelia garinii PBi
TYSDADRGSIQIEI

SEQ ID NO: 87558 - protein, 14 aa, Borrelia garinii PBi
YSDADRGSIQIEIE

SEQ ID NO: 87559 - protein, 14 aa, Borrelia garinii PBi
SDADRGSIQIEIEQ

SEQ ID NO: 87560 - protein, 14 aa, Borrelia garinii PBi
DADRGSIQIEIEQL

SEQ ID NO: 87561 - protein, 14 aa, Borrelia garinii PBi
ADRGSIQIEIEQLT

SEQ ID NO: 87562 - protein, 14 aa, Borrelia garinii PBi
DRGSIQIEIEQLTD

SEQ ID NO: 87563 - protein, 14 aa, Borrelia garinii PBi
RGSIQIEIEQLTDE

SEQ ID NO: 87564 - protein, 14 aa, Borrelia garinii PBi
GSIQIEIEQLTDEI

SEQ ID NO: 87565 - protein, 14 aa, Borrelia garinii PBi
SIQIEIEQLTDEIN

SEQ ID NO: 87566 - protein, 14 aa, Borrelia garinii PBi
IQIEIEQLTDEINR

SEQ ID NO: 87567 - protein, 14 aa, Borrelia garinii PBi
QIEIEQLTDEINRI

SEQ ID NO: 87568 - protein, 14 aa, Borrelia garinii PBi
IEIEQLTDEINRIA

SEQ ID NO: 87569 - protein, 14 aa, Borrelia garinii PBi
EIEQLTDEINRIAD

SEQ ID NO: 87570 - protein, 14 aa, Borrelia garinii PBi
IEQLTDEINRIADQ

SEQ ID NO: 87571 - protein, 14 aa, Borrelia garinii PBi
EQLTDEINRIADQA

SEQ ID NO: 87572 - protein, 14 aa, Borrelia garinii PBi
QLTDEINRIADQAQ

SEQ ID NO: 87573 - protein, 14 aa, Borrelia garinii PBi
LTDEINRIADQAQY

SEQ ID NO: 87574 - protein, 14 aa, Borrelia garinii PBi
TDEINRIADQAQYN

SEQ ID NO: 87575 - protein, 14 aa, Borrelia garinii PBi
DEINRIADQAQYNQ

SEQ ID NO: 87576 - protein, 14 aa, Borrelia garinii PBi
EINRIADQAQYNQM

SEQ ID NO: 87577 - protein, 14 aa, Borrelia garinii PBi
INRIADQAQYNQMH

SEQ ID NO: 87578 - protein, 14 aa, Borrelia garinii PBi
NRIADQAQYNQMHM

SEQ ID NO: 87579 - protein, 14 aa, Borrelia garinii PBi
RIADQAQYNQMHML

SEQ ID NO: 87580 - protein, 14 aa, Borrelia garinii PBi
IADQAQYNQMHMLS

SEQ ID NO: 87581 - protein, 14 aa, Borrelia garinii PBi
ADQAQYNQMHMLSN

SEQ ID NO: 87582 - protein, 14 aa, Borrelia garinii PBi
DQAQYNQMHMLSNK

SEQ ID NO: 87583 - protein, 14 aa, Borrelia garinii PBi
QAQYNQMHMLSNKS

SEQ ID NO: 87584 - protein, 14 aa, Borrelia garinii PBi
AQYNQMHMLSNKSA

SEQ ID NO: 87585 - protein, 14 aa, Borrelia garinii PBi
QYNQMHMLSNKSAS

SEQ ID NO: 87586 - protein, 14 aa, Borrelia garinii PBi
YNQMHMLSNKSASQ

SEQ ID NO: 87587 - protein, 14 aa, Borrelia garinii PBi
NQMHMLSNKSASQN

SEQ ID NO: 87588 - protein, 14 aa, Borrelia garinii PBi
QMHMLSNKSASQNV

SEQ ID NO: 87589 - protein, 14 aa, Borrelia garinii PBi
MHMLSNKSASQNVR

SEQ ID NO: 87590 - protein, 14 aa, Borrelia garinii PBi
HMLSNKSASQNVRT

SEQ ID NO: 87591 - protein, 14 aa, Borrelia garinii PBi
MLSNKSASQNVRTA

SEQ ID NO: 87592 - protein, 14 aa, Borrelia garinii PBi
LSNKSASQNVRTAE

SEQ ID NO: 87593 - protein, 14 aa, Borrelia garinii PBi
SNKSASQNVRTAEE

SEQ ID NO: 87594 - protein, 14 aa, Borrelia garinii PBi
NKSASQNVRTAEEL

SEQ ID NO: 87595 - protein, 14 aa, Borrelia garinii PBi
KSASQNVRTAEELG

SEQ ID NO: 87596 - protein, 14 aa, Borrelia garinii PBi
SASQNVRTAEELGM

SEQ ID NO: 87597 - protein, 14 aa, Borrelia garinii PBi
ASQNVRTAEELGMQ

SEQ ID NO: 87598 - protein, 14 aa, Borrelia garinii PBi
SQNVRTAEELGMQP

SEQ ID NO: 87599 - protein, 14 aa, Borrelia garinii PBi
QNVRTAEELGMQPA

SEQ ID NO: 87600 - protein, 14 aa, Borrelia garinii PBi
NVRTAEELGMQPAK

SEQ ID NO: 87601 - protein, 14 aa, Borrelia garinii PBi
VRTAEELGMQPAKI

SEQ ID NO: 87602 - protein, 14 aa, Borrelia garinii PBi
RTAEELGMQPAKIN

SEQ ID NO: 87603 - protein, 14 aa, Borrelia garinii PBi
TAEELGMQPAKINT

SEQ ID NO: 87604 - protein, 14 aa, Borrelia garinii PBi
AEELGMQPAKINTP

SEQ ID NO: 87605 - protein, 14 aa, Borrelia garinii PBi
EELGMQPAKINTPA

SEQ ID NO: 87606 - protein, 14 aa, Borrelia garinii PBi
ELGMQPAKINTPAS

SEQ ID NO: 87607 - protein, 14 aa, Borrelia garinii PBi
LGMQPAKINTPASL

SEQ ID NO: 87608 - protein, 14 aa, Borrelia garinii PBi
GMQPAKINTPASLS

SEQ ID NO: 87609 - protein, 14 aa, Borrelia garinii PBi
MQPAKINTPASLSG

SEQ ID NO: 87610 - protein, 14 aa, Borrelia garinii PBi
QPAKINTPASLSGS

SEQ ID NO: 87611 - protein, 14 aa, Borrelia garinii PBi
PAKINTPASLSGSQ

SEQ ID NO: 87612 - protein, 14 aa, Borrelia garinii PBi
AKINTPASLSGSQA

SEQ ID NO: 87613 - protein, 14 aa, Borrelia garinii PBi
KINTPASLSGSQAS

SEQ ID NO: 87614 - protein, 14 aa, Borrelia garinii PBi
INTPASLSGSQASW

SEQ ID NO: 87615 - protein, 14 aa, Borrelia garinii PBi
NTPASLSGSQASWT

SEQ ID NO: 87616 - protein, 14 aa, Borrelia garinii PBi
TPASLSGSQASWTL

SEQ ID NO: 87617 - protein, 14 aa, Borrelia garinii PBi
PASLSGSQASWTLR

SEQ ID NO: 87618 - protein, 14 aa, Borrelia garinii PBi
ASLSGSQASWTLRV

SEQ ID NO: 87619 - protein, 14 aa, Borrelia garinii PBi
SLSGSQASWTLRVH

SEQ ID NO: 87620 - protein, 14 aa, Borrelia garinii PBi
LSGSQASWTLRVHV

SEQ ID NO: 87621 - protein, 14 aa, Borrelia garinii PBi
SGSQASWTLRVHVG

SEQ ID NO: 87622 - protein, 14 aa, Borrelia garinii PBi
GSQASWTLRVHVGA

SEQ ID NO: 87623 - protein, 14 aa, Borrelia garinii PBi
SQASWTLRVHVGAN

SEQ ID NO: 87624 - protein, 14 aa, Borrelia garinii PBi
QASWTLRVHVGANQ

SEQ ID NO: 87625 - protein, 14 aa, Borrelia garinii PBi
ASWTLRVHVGANQD

SEQ ID NO: 87626 - protein, 14 aa, Borrelia garinii PBi
SWTLRVHVGANQDE

SEQ ID NO: 87627 - protein, 14 aa, Borrelia garinii PBi
WTLRVHVGANQDEA

SEQ ID NO: 87628 - protein, 14 aa, Borrelia garinii PBi
TLRVHVGANQDEAI

SEQ ID NO: 87629 - protein, 14 aa, Borrelia garinii PBi
LRVHVGANQDEAIA

SEQ ID NO: 87630 - protein, 14 aa, Borrelia garinii PBi
RVHVGANQDEAIAV

SEQ ID NO: 87631 - protein, 14 aa, Borrelia garinii PBi
VHVGANQDEAIAVN

SEQ ID NO: 87632 - protein, 14 aa, Borrelia garinii PBi
HVGANQDEAIAVNI

SEQ ID NO: 87633 - protein, 14 aa, Borrelia garinii PBi
VGANQDEAIAVNIY

SEQ ID NO: 87634 - protein, 14 aa, Borrelia garinii PBi
GANQDEAIAVNIYA

SEQ ID NO: 87635 - protein, 14 aa, Borrelia garinii PBi
ANQDEAIAVNIYAA

SEQ ID NO: 87636 - protein, 14 aa, Borrelia garinii PBi
NQDEAIAVNIYAAN

SEQ ID NO: 87637 - protein, 14 aa, Borrelia garinii PBi
QDEAIAVNIYAANV

SEQ ID NO: 87638 - protein, 14 aa, Borrelia garinii PBi
DEAIAVNIYAANVA

SEQ ID NO: 87639 - protein, 14 aa, Borrelia garinii PBi
EAIAVNIYAANVAN

SEQ ID NO: 87640 - protein, 14 aa, Borrelia garinii PBi
AIAVNIYAANVANL

SEQ ID NO: 87641 - protein, 14 aa, Borrelia garinii PBi
IAVNIYAANVANLF

SEQ ID NO: 87642 - protein, 14 aa, Borrelia garinii PBi
AVNIYAANVANLFS

SEQ ID NO: 87643 - protein, 14 aa, Borrelia garinii PBi
VNIYAANVANLFSG

SEQ ID NO: 87644 - protein, 14 aa, Borrelia garinii PBi
NIYAANVANLFSGE

SEQ ID NO: 87645 - protein, 14 aa, Borrelia garinii PBi
IYAANVANLFSGEG

SEQ ID NO: 87646 - protein, 14 aa, Borrelia garinii PBi
YAANVANLFSGEGS

SEQ ID NO: 87647 - protein, 14 aa, Borrelia garinii PBi
AANVANLFSGEGSQ

SEQ ID NO: 87648 - protein, 14 aa, Borrelia garinii PBi
ANVANLFSGEGSQA

SEQ ID NO: 87649 - protein, 14 aa, Borrelia garinii PBi
NVANLFSGEGSQAA

SEQ ID NO: 87650 - protein, 14 aa, Borrelia garinii PBi
VANLFSGEGSQAAQ

SEQ ID NO: 87651 - protein, 14 aa, Borrelia garinii PBi
ANLFSGEGSQAAQT

SEQ ID NO: 87652 - protein, 14 aa, Borrelia garinii PBi
NLFSGEGSQAAQTA

SEQ ID NO: 87653 - protein, 14 aa, Borrelia garinii PBi
LFSGEGSQAAQTAP

SEQ ID NO: 87654 - protein, 14 aa, Borrelia garinii PBi
FSGEGSQAAQTAPV

SEQ ID NO: 87655 - protein, 14 aa, Borrelia garinii PBi
SGEGSQAAQTAPVQ

SEQ ID NO: 87656 - protein, 14 aa, Borrelia garinii PBi
GEGSQAAQTAPVQE

SEQ ID NO: 87657 - protein, 14 aa, Borrelia garinii PBi
EGSQAAQTAPVQEG

SEQ ID NO: 87658 - protein, 14 aa, Borrelia garinii PBi
GSQAAQTAPVQEGA

SEQ ID NO: 87659 - protein, 14 aa, Borrelia garinii PBi
SQAAQTAPVQEGAQ

SEQ ID NO: 87660 - protein, 14 aa, Borrelia garinii PBi
QAAQTAPVQEGAQQ

SEQ ID NO: 87661 - protein, 14 aa, Borrelia garinii PBi
AAQTAPVQEGAQQE

SEQ ID NO: 87662 - protein, 14 aa, Borrelia garinii PBi
AQTAPVQEGAQQEG

SEQ ID NO: 87663 - protein, 14 aa, Borrelia garinii PBi
QTAPVQEGAQQEGA

SEQ ID NO: 87664 - protein, 14 aa, Borrelia garinii PBi
TAPVQEGAQQEGAQ

SEQ ID NO: 87665 - protein, 14 aa, Borrelia garinii PBi
APVQEGAQQEGAQQ

SEQ ID NO: 87666 - protein, 14 aa, Borrelia garinii PBi
PVQEGAQQEGAQQP

SEQ ID NO: 87667 - protein, 14 aa, Borrelia garinii PBi
VQEGAQQEGAQQPA

SEQ ID NO: 87668 - protein, 14 aa, Borrelia garinii PBi
QEGAQQEGAQQPAP

SEQ ID NO: 87669 - protein, 14 aa, Borrelia garinii PBi
EGAQQEGAQQPAPA

SEQ ID NO: 87670 - protein, 14 aa, Borrelia garinii PBi
GAQQEGAQQPAPAT

SEQ ID NO: 87671 - protein, 14 aa, Borrelia garinii PBi
AQQEGAQQPAPATA

SEQ ID NO: 87672 - protein, 14 aa, Borrelia garinii PBi
QQEGAQQPAPATAP

SEQ ID NO: 87673 - protein, 14 aa, Borrelia garinii PBi
QEGAQQPAPATAPS

SEQ ID NO: 87674 - protein, 14 aa, Borrelia garinii PBi
EGAQQPAPATAPSQ

SEQ ID NO: 87675 - protein, 14 aa, Borrelia garinii PBi
GAQQPAPATAPSQG

SEQ ID NO: 87676 - protein, 14 aa, Borrelia garinii PBi
AQQPAPATAPSQGG

SEQ ID NO: 87677 - protein, 14 aa, Borrelia garinii PBi
QQPAPATAPSQGGV

SEQ ID NO: 87678 - protein, 14 aa, Borrelia garinii PBi
QPAPATAPSQGGVN

SEQ ID NO: 87679 - protein, 14 aa, Borrelia garinii PBi
PAPATAPSQGGVNS

SEQ ID NO: 87680 - protein, 14 aa, Borrelia garinii PBi
APATAPSQGGVNSP

SEQ ID NO: 87681 - protein, 14 aa, Borrelia garinii PBi
PATAPSQGGVNSPV

SEQ ID NO: 87682 - protein, 14 aa, Borrelia garinii PBi
ATAPSQGGVNSPVN

SEQ ID NO: 87683 - protein, 14 aa, Borrelia garinii PBi
TAPSQGGVNSPVNV

SEQ ID NO: 87684 - protein, 14 aa, Borrelia garinii PBi
APSQGGVNSPVNVT

SEQ ID NO: 87685 - protein, 14 aa, Borrelia garinii PBi
PSQGGVNSPVNVTT

SEQ ID NO: 87686 - protein, 14 aa, Borrelia garinii PBi
SQGGVNSPVNVTTT

SEQ ID NO: 87687 - protein, 14 aa, Borrelia garinii PBi
QGGVNSPVNVTTTV

SEQ ID NO: 87688 - protein, 14 aa, Borrelia garinii PBi
GGVNSPVNVTTTVD

SEQ ID NO: 87689 - protein, 14 aa, Borrelia garinii PBi
GVNSPVNVTTTVDA

SEQ ID NO: 87690 - protein, 14 aa, Borrelia garinii PBi
VNSPVNVTTTVDAN

SEQ ID NO: 87691 - protein, 14 aa, Borrelia garinii PBi
NSPVNVTTTVDANT

SEQ ID NO: 87692 - protein, 14 aa, Borrelia garinii PBi
SPVNVTTTVDANTS

SEQ ID NO: 87693 - protein, 14 aa, Borrelia garinii PBi
PVNVTTTVDANTSL

SEQ ID NO: 87694 - protein, 14 aa, Borrelia garinii PBi
VNVTTTVDANTSLA

SEQ ID NO: 87695 - protein, 14 aa, Borrelia garinii PBi
NVTTTVDANTSLAK

SEQ ID NO: 87696 - protein, 14 aa, Borrelia garinii PBi
VTTTVDANTSLAKI

SEQ ID NO: 87697 - protein, 14 aa, Borrelia garinii PBi
TTTVDANTSLAKIE

SEQ ID NO: 87698 - protein, 14 aa, Borrelia garinii PBi
TTVDANTSLAKIEN

SEQ ID NO: 87699 - protein, 14 aa, Borrelia garinii PBi
TVDANTSLAKIENA

SEQ ID NO: 87700 - protein, 14 aa, Borrelia garinii PBi
VDANTSLAKIENAI

SEQ ID NO: 87701 - protein, 14 aa, Borrelia garinii PBi
DANTSLAKIENAIR

SEQ ID NO: 87702 - protein, 14 aa, Borrelia garinii PBi
ANTSLAKIENAIRM

SEQ ID NO: 87703 - protein, 14 aa, Borrelia garinii PBi
NTSLAKIENAIRMI

SEQ ID NO: 87704 - protein, 14 aa, Borrelia garinii PBi
TSLAKIENAIRMIS

SEQ ID NO: 87705 - protein, 14 aa, Borrelia garinii PBi
SLAKIENAIRMISD

SEQ ID NO: 87706 - protein, 14 aa, Borrelia garinii PBi
LAKIENAIRMISDQ

SEQ ID NO: 87707 - protein, 14 aa, Borrelia garinii PBi
AKIENAIRMISDQR

SEQ ID NO: 87708 - protein, 14 aa, Borrelia garinii PBi
KIENAIRMISDQRA

SEQ ID NO: 87709 - protein, 14 aa, Borrelia garinii PBi
IENAIRMISDQRAN

SEQ ID NO: 87710 - protein, 14 aa, Borrelia garinii PBi
ENAIRMISDQRANL

SEQ ID NO: 87711 - protein, 14 aa, Borrelia garinii PBi
NAIRMISDQRANLG

SEQ ID NO: 87712 - protein, 14 aa, Borrelia garinii PBi
AIRMISDQRANLGA

SEQ ID NO: 87713 - protein, 14 aa, Borrelia garinii PBi
IRMISDQRANLGAF

SEQ ID NO: 87714 - protein, 14 aa, Borrelia garinii PBi
RMISDQRANLGAFQ

SEQ ID NO: 87715 - protein, 14 aa, Borrelia garinii PBi
MISDQRANLGAFQN

SEQ ID NO: 87716 - protein, 14 aa, Borrelia garinii PBi
ISDQRANLGAFQNR

SEQ ID NO: 87717 - protein, 14 aa, Borrelia garinii PBi
SDQRANLGAFQNRL

SEQ ID NO: 87718 - protein, 14 aa, Borrelia garinii PBi
DQRANLGAFQNRLE

SEQ ID NO: 87719 - protein, 14 aa, Borrelia garinii PBi
QRANLGAFQNRLES

SEQ ID NO: 87720 - protein, 14 aa, Borrelia garinii PBi
RANLGAFQNRLESI

SEQ ID NO: 87721 - protein, 14 aa, Borrelia garinii PBi
ANLGAFQNRLESIK

SEQ ID NO: 87722 - protein, 14 aa, Borrelia garinii PBi
NLGAFQNRLESIKD

SEQ ID NO: 87723 - protein, 14 aa, Borrelia garinii PBi
LGAFQNRLESIKDS

SEQ ID NO: 87724 - protein, 14 aa, Borrelia garinii PBi
GAFQNRLESIKDST

SEQ ID NO: 87725 - protein, 14 aa, Borrelia garinii PBi
AFQNRLESIKDSTE

SEQ ID NO: 87726 - protein, 14 aa, Borrelia garinii PBi
FQNRLESIKDSTEY

SEQ ID NO: 87727 - protein, 14 aa, Borrelia garinii PBi
QNRLESIKDSTEYA

SEQ ID NO: 87728 - protein, 14 aa, Borrelia garinii PBi
NRLESIKDSTEYAI

SEQ ID NO: 87729 - protein, 14 aa, Borrelia garinii PBi
RLESIKDSTEYAIE

SEQ ID NO: 87730 - protein, 14 aa, Borrelia garinii PBi
LESIKDSTEYAIEN

SEQ ID NO: 87731 - protein, 14 aa, Borrelia garinii PBi
ESIKDSTEYAIENL

SEQ ID NO: 87732 - protein, 14 aa, Borrelia garinii PBi
SIKDSTEYAIENLK

SEQ ID NO: 87733 - protein, 14 aa, Borrelia garinii PBi
IKDSTEYAIENLKA

SEQ ID NO: 87734 - protein, 14 aa, Borrelia garinii PBi
KDSTEYAIENLKAS

SEQ ID NO: 87735 - protein, 14 aa, Borrelia garinii PBi
DSTEYAIENLKASY

SEQ ID NO: 87736 - protein, 14 aa, Borrelia garinii PBi
STEYAIENLKASYA

SEQ ID NO: 87737 - protein, 14 aa, Borrelia garinii PBi
TEYAIENLKASYAQ

SEQ ID NO: 87738 - protein, 14 aa, Borrelia garinii PBi
EYAIENLKASYAQI

SEQ ID NO: 87739 - protein, 14 aa, Borrelia garinii PBi
YAIENLKASYAQIK

SEQ ID NO: 87740 - protein, 14 aa, Borrelia garinii PBi
AIENLKASYAQIKD

SEQ ID NO: 87741 - protein, 14 aa, Borrelia garinii PBi
IENLKASYAQIKDA

SEQ ID NO: 87742 - protein, 14 aa, Borrelia garinii PBi
ENLKASYAQIKDAT

SEQ ID NO: 87743 - protein, 14 aa, Borrelia garinii PBi
NLKASYAQIKDATM

SEQ ID NO: 87744 - protein, 14 aa, Borrelia garinii PBi
LKASYAQIKDATMT

SEQ ID NO: 87745 - protein, 14 aa, Borrelia garinii PBi
KASYAQIKDATMTD

SEQ ID NO: 87746 - protein, 14 aa, Borrelia garinii PBi
ASYAQIKDATMTDE

SEQ ID NO: 87747 - protein, 14 aa, Borrelia garinii PBi
SYAQIKDATMTDEV

SEQ ID NO: 87748 - protein, 14 aa, Borrelia garinii PBi
YAQIKDATMTDEVV

SEQ ID NO: 87749 - protein, 14 aa, Borrelia garinii PBi
AQIKDATMTDEVVA

SEQ ID NO: 87750 - protein, 14 aa, Borrelia garinii PBi
QIKDATMTDEVVAS

SEQ ID NO: 87751 - protein, 14 aa, Borrelia garinii PBi
IKDATMTDEVVAST

SEQ ID NO: 87752 - protein, 14 aa, Borrelia garinii PBi
KDATMTDEVVASTT

SEQ ID NO: 87753 - protein, 14 aa, Borrelia garinii PBi
DATMTDEVVASTTN

SEQ ID NO: 87754 - protein, 14 aa, Borrelia garinii PBi
ATMTDEVVASTTNS

SEQ ID NO: 87755 - protein, 14 aa, Borrelia garinii PBi
TMTDEVVASTTNSI

SEQ ID NO: 87756 - protein, 14 aa, Borrelia garinii PBi
MTDEVVASTTNSIL

SEQ ID NO: 87757 - protein, 14 aa, Borrelia garinii PBi
TDEVVASTTNSILT

SEQ ID NO: 87758 - protein, 14 aa, Borrelia garinii PBi
DEVVASTTNSILTQ

SEQ ID NO: 87759 - protein, 14 aa, Borrelia garinii PBi
EVVASTTNSILTQS

SEQ ID NO: 87760 - protein, 14 aa, Borrelia garinii PBi
VVASTTNSILTQSA

SEQ ID NO: 87761 - protein, 14 aa, Borrelia garinii PBi
VASTTNSILTQSAM

SEQ ID NO: 87762 - protein, 14 aa, Borrelia garinii PBi
ASTTNSILTQSAMA

SEQ ID NO: 87763 - protein, 14 aa, Borrelia garinii PBi
STTNSILTQSAMAM

SEQ ID NO: 87764 - protein, 14 aa, Borrelia garinii PBi
TTNSILTQSAMAMI

SEQ ID NO: 87765 - protein, 14 aa, Borrelia garinii PBi
TNSILTQSAMAMIA

SEQ ID NO: 87766 - protein, 14 aa, Borrelia garinii PBi
NSILTQSAMAMIAQ

SEQ ID NO: 87767 - protein, 14 aa, Borrelia garinii PBi
SILTQSAMAMIAQA

SEQ ID NO: 87768 - protein, 14 aa, Borrelia garinii PBi
ILTQSAMAMIAQAN

SEQ ID NO: 87769 - protein, 14 aa, Borrelia garinii PBi
LTQSAMAMIAQANQ

SEQ ID NO: 87770 - protein, 14 aa, Borrelia garinii PBi
TQSAMAMIAQANQV

SEQ ID NO: 87771 - protein, 14 aa, Borrelia garinii PBi
QSAMAMIAQANQVP

SEQ ID NO: 87772 - protein, 14 aa, Borrelia garinii PBi
SAMAMIAQANQVPQ

SEQ ID NO: 87773 - protein, 14 aa, Borrelia garinii PBi
AMAMIAQANQVPQY

SEQ ID NO: 87774 - protein, 14 aa, Borrelia garinii PBi
MAMIAQANQVPQYV

SEQ ID NO: 87775 - protein, 14 aa, Borrelia garinii PBi
AMIAQANQVPQYVL

SEQ ID NO: 87776 - protein, 14 aa, Borrelia garinii PBi
MIAQANQVPQYVLS

SEQ ID NO: 87777 - protein, 14 aa, Borrelia garinii PBi
IAQANQVPQYVLSL

SEQ ID NO: 87778 - protein, 14 aa, Borrelia garinii PBi
AQANQVPQYVLSLL

SEQ ID NO: 87779 - protein, 14 aa, Borrelia garinii PBi
QANQVPQYVLSLLR

SEQ ID NO: 87780 - protein, 15 aa, Borrelia garinii PBi
MIINHNTSAINASRN

SEQ ID NO: 87781 - protein, 15 aa, Borrelia garinii PBi
IINHNTSAINASRNN

SEQ ID NO: 87782 - protein, 15 aa, Borrelia garinii PBi
INHNTSAINASRNNS

SEQ ID NO: 87783 - protein, 15 aa, Borrelia garinii PBi
NHNTSAINASRNNSI

SEQ ID NO: 87784 - protein, 15 aa, Borrelia garinii PBi
HNTSAINASRNNSIN

SEQ ID NO: 87785 - protein, 15 aa, Borrelia garinii PBi
NTSAINASRNNSINA

SEQ ID NO: 87786 - protein, 15 aa, Borrelia garinii PBi
TSAINASRNNSINAA

SEQ ID NO: 87787 - protein, 15 aa, Borrelia garinii PBi
SAINASRNNSINAAN

SEQ ID NO: 87788 - protein, 15 aa, Borrelia garinii PBi
AINASRNNSINAANL

SEQ ID NO: 87789 - protein, 15 aa, Borrelia garinii PBi
INASRNNSINAANLS

SEQ ID NO: 87790 - protein, 15 aa, Borrelia garinii PBi
NASRNNSINAANLSK

SEQ ID NO: 87791 - protein, 15 aa, Borrelia garinii PBi
ASRNNSINAANLSKT

SEQ ID NO: 87792 - protein, 15 aa, Borrelia garinii PBi
SRNNSINAANLSKTQ

SEQ ID NO: 87793 - protein, 15 aa, Borrelia garinii PBi
RNNSINAANLSKTQE

SEQ ID NO: 87794 - protein, 15 aa, Borrelia garinii PBi
NNSINAANLSKTQEK

SEQ ID NO: 87795 - protein, 15 aa, Borrelia garinii PBi
NSINAANLSKTQEKL

SEQ ID NO: 87796 - protein, 15 aa, Borrelia garinii PBi
SINAANLSKTQEKLS

SEQ ID NO: 87797 - protein, 15 aa, Borrelia garinii PBi
INAANLSKTQEKLSS

SEQ ID NO: 87798 - protein, 15 aa, Borrelia garinii PBi
NAANLSKTQEKLSSG

SEQ ID NO: 87799 - protein, 15 aa, Borrelia garinii PBi
AANLSKTQEKLSSGY

SEQ ID NO: 87800 - protein, 15 aa, Borrelia garinii PBi
ANLSKTQEKLSSGYR

SEQ ID NO: 87801 - protein, 15 aa, Borrelia garinii PBi
NLSKTQEKLSSGYRI

SEQ ID NO: 87802 - protein, 15 aa, Borrelia garinii PBi
LSKTQEKLSSGYRIN

SEQ ID NO: 87803 - protein, 15 aa, Borrelia garinii PBi
SKTQEKLSSGYRINR

SEQ ID NO: 87804 - protein, 15 aa, Borrelia garinii PBi
KTQEKLSSGYRINRA

SEQ ID NO: 87805 - protein, 15 aa, Borrelia garinii PBi
TQEKLSSGYRINRAS

SEQ ID NO: 87806 - protein, 15 aa, Borrelia garinii PBi
QEKLSSGYRINRASD

SEQ ID NO: 87807 - protein, 15 aa, Borrelia garinii PBi
EKLSSGYRINRASDD

SEQ ID NO: 87808 - protein, 15 aa, Borrelia garinii PBi
KLSSGYRINRASDDA

SEQ ID NO: 87809 - protein, 15 aa, Borrelia garinii PBi
LSSGYRINRASDDAA

SEQ ID NO: 87810 - protein, 15 aa, Borrelia garinii PBi
SSGYRINRASDDAAG

SEQ ID NO: 87811 - protein, 15 aa, Borrelia garinii PBi
SGYRINRASDDAAGM

SEQ ID NO: 87812 - protein, 15 aa, Borrelia garinii PBi
GYRINRASDDAAGMG

SEQ ID NO: 87813 - protein, 15 aa, Borrelia garinii PBi
YRINRASDDAAGMGV

SEQ ID NO: 87814 - protein, 15 aa, Borrelia garinii PBi
RINRASDDAAGMGVS

SEQ ID NO: 87815 - protein, 15 aa, Borrelia garinii PBi
INRASDDAAGMGVSG

SEQ ID NO: 87816 - protein, 15 aa, Borrelia garinii PBi
NRASDDAAGMGVSGK

SEQ ID NO: 87817 - protein, 15 aa, Borrelia garinii PBi
RASDDAAGMGVSGKI

SEQ ID NO: 87818 - protein, 15 aa, Borrelia garinii PBi
ASDDAAGMGVSGKIN

SEQ ID NO: 87819 - protein, 15 aa, Borrelia garinii PBi
SDDAAGMGVSGKINA

SEQ ID NO: 87820 - protein, 15 aa, Borrelia garinii PBi
DDAAGMGVSGKINAQ

SEQ ID NO: 87821 - protein, 15 aa, Borrelia garinii PBi
DAAGMGVSGKINAQI

SEQ ID NO: 87822 - protein, 15 aa, Borrelia garinii PBi
AAGMGVSGKINAQIR

SEQ ID NO: 87823 - protein, 15 aa, Borrelia garinii PBi
AGMGVSGKINAQIRG

SEQ ID NO: 87824 - protein, 15 aa, Borrelia garinii PBi
GMGVSGKINAQIRGL

SEQ ID NO: 87825 - protein, 15 aa, Borrelia garinii PBi
MGVSGKINAQIRGLS

SEQ ID NO: 87826 - protein, 15 aa, Borrelia garinii PBi
GVSGKINAQIRGLSQ

SEQ ID NO: 87827 - protein, 15 aa, Borrelia garinii PBi
VSGKINAQIRGLSQA

SEQ ID NO: 87828 - protein, 15 aa, Borrelia garinii PBi
SGKINAQIRGLSQAS

SEQ ID NO: 87829 - protein, 15 aa, Borrelia garinii PBi
GKINAQIRGLSQASR

SEQ ID NO: 87830 - protein, 15 aa, Borrelia garinii PBi
KINAQIRGLSQASRN

SEQ ID NO: 87831 - protein, 15 aa, Borrelia garinii PBi
INAQIRGLSQASRNT

SEQ ID NO: 87832 - protein, 15 aa, Borrelia garinii PBi
NAQIRGLSQASRNTS

SEQ ID NO: 87833 - protein, 15 aa, Borrelia garinii PBi
AQIRGLSQASRNTSK

SEQ ID NO: 87834 - protein, 15 aa, Borrelia garinii PBi
QIRGLSQASRNTSKA

SEQ ID NO: 87835 - protein, 15 aa, Borrelia garinii PBi
IRGLSQASRNTSKAI

SEQ ID NO: 87836 - protein, 15 aa, Borrelia garinii PBi
RGLSQASRNTSKAIN

SEQ ID NO: 87837 - protein, 15 aa, Borrelia garinii PBi
GLSQASRNTSKAINF

SEQ ID NO: 87838 - protein, 15 aa, Borrelia garinii PBi
LSQASRNTSKAINFI

SEQ ID NO: 87839 - protein, 15 aa, Borrelia garinii PBi
SQASRNTSKAINFIQ

SEQ ID NO: 87840 - protein, 15 aa, Borrelia garinii PBi
QASRNTSKAINFIQT

SEQ ID NO: 87841 - protein, 15 aa, Borrelia garinii PBi
ASRNTSKAINFIQTT

SEQ ID NO: 87842 - protein, 15 aa, Borrelia garinii PBi
SRNTSKAINFIQTTE

SEQ ID NO: 87843 - protein, 15 aa, Borrelia garinii PBi
RNTSKAINFIQTTEG

SEQ ID NO: 87844 - protein, 15 aa, Borrelia garinii PBi
NTSKAINFIQTTEGN

SEQ ID NO: 87845 - protein, 15 aa, Borrelia garinii PBi
TSKAINFIQTTEGNL

SEQ ID NO: 87846 - protein, 15 aa, Borrelia garinii PBi
SKAINFIQTTEGNLN

SEQ ID NO: 87847 - protein, 15 aa, Borrelia garinii PBi
KAINFIQTTEGNLNE

SEQ ID NO: 87848 - protein, 15 aa, Borrelia garinii PBi
AINFIQTTEGNLNEV

SEQ ID NO: 87849 - protein, 15 aa, Borrelia garinii PBi
INFIQTTEGNLNEVE

SEQ ID NO: 87850 - protein, 15 aa, Borrelia garinii PBi
NFIQTTEGNLNEVEK

SEQ ID NO: 87851 - protein, 15 aa, Borrelia garinii PBi
FIQTTEGNLNEVEKV

SEQ ID NO: 87852 - protein, 15 aa, Borrelia garinii PBi
IQTTEGNLNEVEKVL

SEQ ID NO: 87853 - protein, 15 aa, Borrelia garinii PBi
QTTEGNLNEVEKVLV

SEQ ID NO: 87854 - protein, 15 aa, Borrelia garinii PBi
TTEGNLNEVEKVLVR

SEQ ID NO: 87855 - protein, 15 aa, Borrelia garinii PBi
TEGNLNEVEKVLVRM

SEQ ID NO: 87856 - protein, 15 aa, Borrelia garinii PBi
EGNLNEVEKVLVRMK

SEQ ID NO: 87857 - protein, 15 aa, Borrelia garinii PBi
GNLNEVEKVLVRMKE

SEQ ID NO: 87858 - protein, 15 aa, Borrelia garinii PBi
NLNEVEKVLVRMKEL

SEQ ID NO: 87859 - protein, 15 aa, Borrelia garinii PBi
LNEVEKVLVRMKELA

SEQ ID NO: 87860 - protein, 15 aa, Borrelia garinii PBi
NEVEKVLVRMKELAV

SEQ ID NO: 87861 - protein, 15 aa, Borrelia garinii PBi
EVEKVLVRMKELAVQ

SEQ ID NO: 87862 - protein, 15 aa, Borrelia garinii PBi
VEKVLVRMKELAVQS

SEQ ID NO: 87863 - protein, 15 aa, Borrelia garinii PBi
EKVLVRMKELAVQSG

SEQ ID NO: 87864 - protein, 15 aa, Borrelia garinii PBi
KVLVRMKELAVQSGN

SEQ ID NO: 87865 - protein, 15 aa, Borrelia garinii PBi
VLVRMKELAVQSGNG

SEQ ID NO: 87866 - protein, 15 aa, Borrelia garinii PBi
LVRMKELAVQSGNGT

SEQ ID NO: 87867 - protein, 15 aa, Borrelia garinii PBi
VRMKELAVQSGNGTY

SEQ ID NO: 87868 - protein, 15 aa, Borrelia garinii PBi
RMKELAVQSGNGTYS

SEQ ID NO: 87869 - protein, 15 aa, Borrelia garinii PBi
MKELAVQSGNGTYSD

SEQ ID NO: 87870 - protein, 15 aa, Borrelia garinii PBi
KELAVQSGNGTYSDA

SEQ ID NO: 87871 - protein, 15 aa, Borrelia garinii PBi
ELAVQSGNGTYSDAD

SEQ ID NO: 87872 - protein, 15 aa, Borrelia garinii PBi
LAVQSGNGTYSDADR

SEQ ID NO: 87873 - protein, 15 aa, Borrelia garinii PBi
AVQSGNGTYSDADRG

SEQ ID NO: 87874 - protein, 15 aa, Borrelia garinii PBi
VQSGNGTYSDADRGS

SEQ ID NO: 87875 - protein, 15 aa, Borrelia garinii PBi
QSGNGTYSDADRGSI

SEQ ID NO: 87876 - protein, 15 aa, Borrelia garinii PBi
SGNGTYSDADRGSIQ

SEQ ID NO: 87877 - protein, 15 aa, Borrelia garinii PBi
GNGTYSDADRGSIQI

SEQ ID NO: 87878 - protein, 15 aa, Borrelia garinii PBi
NGTYSDADRGSIQIE

SEQ ID NO: 87879 - protein, 15 aa, Borrelia garinii PBi
GTYSDADRGSIQIEI

SEQ ID NO: 87880 - protein, 15 aa, Borrelia garinii PBi
TYSDADRGSIQIEIE

SEQ ID NO: 87881 - protein, 15 aa, Borrelia garinii PBi
YSDADRGSIQIEIEQ

SEQ ID NO: 87882 - protein, 15 aa, Borrelia garinii PBi
SDADRGSIQIEIEQL

SEQ ID NO: 87883 - protein, 15 aa, Borrelia garinii PBi
DADRGSIQIEIEQLT

SEQ ID NO: 87884 - protein, 15 aa, Borrelia garinii PBi
ADRGSIQIEIEQLTD

SEQ ID NO: 87885 - protein, 15 aa, Borrelia garinii PBi
DRGSIQIEIEQLTDE

SEQ ID NO: 87886 - protein, 15 aa, Borrelia garinii PBi
RGSIQIEIEQLTDEI

SEQ ID NO: 87887 - protein, 15 aa, Borrelia garinii PBi
GSIQIEIEQLTDEIN

SEQ ID NO: 87888 - protein, 15 aa, Borrelia garinii PBi
SIQIEIEQLTDEINR

SEQ ID NO: 87889 - protein, 15 aa, Borrelia garinii PBi
IQIEIEQLTDEINRI

SEQ ID NO: 87890 - protein, 15 aa, Borrelia garinii PBi
QIEIEQLTDEINRIA

SEQ ID NO: 87891 - protein, 15 aa, Borrelia garinii PBi
IEIEQLTDEINRIAD

SEQ ID NO: 87892 - protein, 15 aa, Borrelia garinii PBi
EIEQLTDEINRIADQ

SEQ ID NO: 87893 - protein, 15 aa, Borrelia garinii PBi
IEQLTDEINRIADQA

SEQ ID NO: 87894 - protein, 15 aa, Borrelia garinii PBi
EQLTDEINRIADQAQ

SEQ ID NO: 87895 - protein, 15 aa, Borrelia garinii PBi
QLTDEINRIADQAQY

SEQ ID NO: 87896 - protein, 15 aa, Borrelia garinii PBi
LTDEINRIADQAQYN

SEQ ID NO: 87897 - protein, 15 aa, Borrelia garinii PBi
TDEINRIADQAQYNQ

SEQ ID NO: 87898 - protein, 15 aa, Borrelia garinii PBi
DEINRIADQAQYNQM

SEQ ID NO: 87899 - protein, 15 aa, Borrelia garinii PBi
EINRIADQAQYNQMH

SEQ ID NO: 87900 - protein, 15 aa, Borrelia garinii PBi
INRIADQAQYNQMHM

SEQ ID NO: 87901 - protein, 15 aa, Borrelia garinii PBi
NRIADQAQYNQMHML

SEQ ID NO: 87902 - protein, 15 aa, Borrelia garinii PBi
RIADQAQYNQMHMLS

SEQ ID NO: 87903 - protein, 15 aa, Borrelia garinii PBi
IADQAQYNQMHMLSN

SEQ ID NO: 87904 - protein, 15 aa, Borrelia garinii PBi
ADQAQYNQMHMLSNK

SEQ ID NO: 87905 - protein, 15 aa, Borrelia garinii PBi
DQAQYNQMHMLSNKS

SEQ ID NO: 87906 - protein, 15 aa, Borrelia garinii PBi
QAQYNQMHMLSNKSA

SEQ ID NO: 87907 - protein, 15 aa, Borrelia garinii PBi
AQYNQMHMLSNKSAS

SEQ ID NO: 87908 - protein, 15 aa, Borrelia garinii PBi
QYNQMHMLSNKSASQ

SEQ ID NO: 87909 - protein, 15 aa, Borrelia garinii PBi
YNQMHMLSNKSASQN

SEQ ID NO: 87910 - protein, 15 aa, Borrelia garinii PBi
NQMHMLSNKSASQNV

SEQ ID NO: 87911 - protein, 15 aa, Borrelia garinii PBi
QMHMLSNKSASQNVR

SEQ ID NO: 87912 - protein, 15 aa, Borrelia garinii PBi
MHMLSNKSASQNVRT

SEQ ID NO: 87913 - protein, 15 aa, Borrelia garinii PBi
HMLSNKSASQNVRTA

SEQ ID NO: 87914 - protein, 15 aa, Borrelia garinii PBi
MLSNKSASQNVRTAE

SEQ ID NO: 87915 - protein, 15 aa, Borrelia garinii PBi
LSNKSASQNVRTAEE

SEQ ID NO: 87916 - protein, 15 aa, Borrelia garinii PBi
SNKSASQNVRTAEEL

SEQ ID NO: 87917 - protein, 15 aa, Borrelia garinii PBi
NKSASQNVRTAEELG

SEQ ID NO: 87918 - protein, 15 aa, Borrelia garinii PBi
KSASQNVRTAEELGM

SEQ ID NO: 87919 - protein, 15 aa, Borrelia garinii PBi
SASQNVRTAEELGMQ

SEQ ID NO: 87920 - protein, 15 aa, Borrelia garinii PBi
ASQNVRTAEELGMQP

SEQ ID NO: 87921 - protein, 15 aa, Borrelia garinii PBi
SQNVRTAEELGMQPA

SEQ ID NO: 87922 - protein, 15 aa, Borrelia garinii PBi
QNVRTAEELGMQPAK

SEQ ID NO: 87923 - protein, 15 aa, Borrelia garinii PBi
NVRTAEELGMQPAKI

SEQ ID NO: 87924 - protein, 15 aa, Borrelia garinii PBi
VRTAEELGMQPAKIN

SEQ ID NO: 87925 - protein, 15 aa, Borrelia garinii PBi
RTAEELGMQPAKINT

SEQ ID NO: 87926 - protein, 15 aa, Borrelia garinii PBi
TAEELGMQPAKINTP

SEQ ID NO: 87927 - protein, 15 aa, Borrelia garinii PBi
AEELGMQPAKINTPA

SEQ ID NO: 87928 - protein, 15 aa, Borrelia garinii PBi
EELGMQPAKINTPAS

SEQ ID NO: 87929 - protein, 15 aa, Borrelia garinii PBi
ELGMQPAKINTPASL

SEQ ID NO: 87930 - protein, 15 aa, Borrelia garinii PBi
LGMQPAKINTPASLS

SEQ ID NO: 87931 - protein, 15 aa, Borrelia garinii PBi
GMQPAKINTPASLSG

SEQ ID NO: 87932 - protein, 15 aa, Borrelia garinii PBi
MQPAKINTPASLSGS

SEQ ID NO: 87933 - protein, 15 aa, Borrelia garinii PBi
QPAKINTPASLSGSQ

SEQ ID NO: 87934 - protein, 15 aa, Borrelia garinii PBi
PAKINTPASLSGSQA

SEQ ID NO: 87935 - protein, 15 aa, Borrelia garinii PBi
AKINTPASLSGSQAS

SEQ ID NO: 87936 - protein, 15 aa, Borrelia garinii PBi
KINTPASLSGSQASW

SEQ ID NO: 87937 - protein, 15 aa, Borrelia garinii PBi
INTPASLSGSQASWT

SEQ ID NO: 87938 - protein, 15 aa, Borrelia garinii PBi
NTPASLSGSQASWTL

SEQ ID NO: 87939 - protein, 15 aa, Borrelia garinii PBi
TPASLSGSQASWTLR

SEQ ID NO: 87940 - protein, 15 aa, Borrelia garinii PBi
PASLSGSQASWTLRV

SEQ ID NO: 87941 - protein, 15 aa, Borrelia garinii PBi
ASLSGSQASWTLRVH

SEQ ID NO: 87942 - protein, 15 aa, Borrelia garinii PBi
SLSGSQASWTLRVHV

SEQ ID NO: 87943 - protein, 15 aa, Borrelia garinii PBi
LSGSQASWTLRVHVG

SEQ ID NO: 87944 - protein, 15 aa, Borrelia garinii PBi
SGSQASWTLRVHVGA

SEQ ID NO: 87945 - protein, 15 aa, Borrelia garinii PBi
GSQASWTLRVHVGAN

SEQ ID NO: 87946 - protein, 15 aa, Borrelia garinii PBi
SQASWTLRVHVGANQ

SEQ ID NO: 87947 - protein, 15 aa, Borrelia garinii PBi
QASWTLRVHVGANQD

SEQ ID NO: 87948 - protein, 15 aa, Borrelia garinii PBi
ASWTLRVHVGANQDE

SEQ ID NO: 87949 - protein, 15 aa, Borrelia garinii PBi
SWTLRVHVGANQDEA

SEQ ID NO: 87950 - protein, 15 aa, Borrelia garinii PBi
WTLRVHVGANQDEAI

SEQ ID NO: 87951 - protein, 15 aa, Borrelia garinii PBi
TLRVHVGANQDEAIA

SEQ ID NO: 87952 - protein, 15 aa, Borrelia garinii PBi
LRVHVGANQDEAIAV

SEQ ID NO: 87953 - protein, 15 aa, Borrelia garinii PBi
RVHVGANQDEAIAVN

SEQ ID NO: 87954 - protein, 15 aa, Borrelia garinii PBi
VHVGANQDEAIAVNI

SEQ ID NO: 87955 - protein, 15 aa, Borrelia garinii PBi
HVGANQDEAIAVNIY

SEQ ID NO: 87956 - protein, 15 aa, Borrelia garinii PBi
VGANQDEAIAVNIYA

SEQ ID NO: 87957 - protein, 15 aa, Borrelia garinii PBi
GANQDEAIAVNIYAA

SEQ ID NO: 87958 - protein, 15 aa, Borrelia garinii PBi
ANQDEAIAVNIYAAN

SEQ ID NO: 87959 - protein, 15 aa, Borrelia garinii PBi
NQDEAIAVNIYAANV

SEQ ID NO: 87960 - protein, 15 aa, Borrelia garinii PBi
QDEAIAVNIYAANVA

SEQ ID NO: 87961 - protein, 15 aa, Borrelia garinii PBi
DEAIAVNIYAANVAN

SEQ ID NO: 87962 - protein, 15 aa, Borrelia garinii PBi
EAIAVNIYAANVANL

SEQ ID NO: 87963 - protein, 15 aa, Borrelia garinii PBi
AIAVNIYAANVANLF

SEQ ID NO: 87964 - protein, 15 aa, Borrelia garinii PBi
IAVNIYAANVANLFS

SEQ ID NO: 87965 - protein, 15 aa, Borrelia garinii PBi
AVNIYAANVANLFSG

SEQ ID NO: 87966 - protein, 15 aa, Borrelia garinii PBi
VNIYAANVANLFSGE

SEQ ID NO: 87967 - protein, 15 aa, Borrelia garinii PBi
NIYAANVANLFSGEG

SEQ ID NO: 87968 - protein, 15 aa, Borrelia garinii PBi
IYAANVANLFSGEGS

SEQ ID NO: 87969 - protein, 15 aa, Borrelia garinii PBi
YAANVANLFSGEGSQ

SEQ ID NO: 87970 - protein, 15 aa, Borrelia garinii PBi
AANVANLFSGEGSQA

SEQ ID NO: 87971 - protein, 15 aa, Borrelia garinii PBi
ANVANLFSGEGSQAA

SEQ ID NO: 87972 - protein, 15 aa, Borrelia garinii PBi
NVANLFSGEGSQAAQ

SEQ ID NO: 87973 - protein, 15 aa, Borrelia garinii PBi
VANLFSGEGSQAAQT

SEQ ID NO: 87974 - protein, 15 aa, Borrelia garinii PBi
ANLFSGEGSQAAQTA

SEQ ID NO: 87975 - protein, 15 aa, Borrelia garinii PBi
NLFSGEGSQAAQTAP

SEQ ID NO: 87976 - protein, 15 aa, Borrelia garinii PBi
LFSGEGSQAAQTAPV

SEQ ID NO: 87977 - protein, 15 aa, Borrelia garinii PBi
FSGEGSQAAQTAPVQ

SEQ ID NO: 87978 - protein, 15 aa, Borrelia garinii PBi
SGEGSQAAQTAPVQE

SEQ ID NO: 87979 - protein, 15 aa, Borrelia garinii PBi
GEGSQAAQTAPVQEG

SEQ ID NO: 87980 - protein, 15 aa, Borrelia garinii PBi
EGSQAAQTAPVQEGA

SEQ ID NO: 87981 - protein, 15 aa, Borrelia garinii PBi
GSQAAQTAPVQEGAQ

SEQ ID NO: 87982 - protein, 15 aa, Borrelia garinii PBi
SQAAQTAPVQEGAQQ

SEQ ID NO: 87983 - protein, 15 aa, Borrelia garinii PBi
QAAQTAPVQEGAQQE

SEQ ID NO: 87984 - protein, 15 aa, Borrelia garinii PBi
AAQTAPVQEGAQQEG

SEQ ID NO: 87985 - protein, 15 aa, Borrelia garinii PBi
AQTAPVQEGAQQEGA

SEQ ID NO: 87986 - protein, 15 aa, Borrelia garinii PBi
QTAPVQEGAQQEGAQ

SEQ ID NO: 87987 - protein, 15 aa, Borrelia garinii PBi
TAPVQEGAQQEGAQQ

SEQ ID NO: 87988 - protein, 15 aa, Borrelia garinii PBi
APVQEGAQQEGAQQP

SEQ ID NO: 87989 - protein, 15 aa, Borrelia garinii PBi
PVQEGAQQEGAQQPA

SEQ ID NO: 87990 - protein, 15 aa, Borrelia garinii PBi
VQEGAQQEGAQQPAP

SEQ ID NO: 87991 - protein, 15 aa, Borrelia garinii PBi
QEGAQQEGAQQPAPA

SEQ ID NO: 87992 - protein, 15 aa, Borrelia garinii PBi
EGAQQEGAQQPAPAT

SEQ ID NO: 87993 - protein, 15 aa, Borrelia garinii PBi
GAQQEGAQQPAPATA

SEQ ID NO: 87994 - protein, 15 aa, Borrelia garinii PBi
AQQEGAQQPAPATAP

SEQ ID NO: 87995 - protein, 15 aa, Borrelia garinii PBi
QQEGAQQPAPATAPS

SEQ ID NO: 87996 - protein, 15 aa, Borrelia garinii PBi
QEGAQQPAPATAPSQ

SEQ ID NO: 87997 - protein, 15 aa, Borrelia garinii PBi
EGAQQPAPATAPSQG

SEQ ID NO: 87998 - protein, 15 aa, Borrelia garinii PBi
GAQQPAPATAPSQGG

SEQ ID NO: 87999 - protein, 15 aa, Borrelia garinii PBi
AQQPAPATAPSQGGV

SEQ ID NO: 88000 - protein, 15 aa, Borrelia garinii PBi
QQPAPATAPSQGGVN

SEQ ID NO: 88001 - protein, 15 aa, Borrelia garinii PBi
QPAPATAPSQGGVNS

SEQ ID NO: 88002 - protein, 15 aa, Borrelia garinii PBi
PAPATAPSQGGVNSP

SEQ ID NO: 88003 - protein, 15 aa, Borrelia garinii PBi
APATAPSQGGVNSPV

SEQ ID NO: 88004 - protein, 15 aa, Borrelia garinii PBi
PATAPSQGGVNSPVN

SEQ ID NO: 88005 - protein, 15 aa, Borrelia garinii PBi
ATAPSQGGVNSPVNV

SEQ ID NO: 88006 - protein, 15 aa, Borrelia garinii PBi
TAPSQGGVNSPVNVT

SEQ ID NO: 88007 - protein, 15 aa, Borrelia garinii PBi
APSQGGVNSPVNVTT

SEQ ID NO: 88008 - protein, 15 aa, Borrelia garinii PBi
PSQGGVNSPVNVTTT

SEQ ID NO: 88009 - protein, 15 aa, Borrelia garinii PBi
SQGGVNSPVNVTTTV

SEQ ID NO: 88010 - protein, 15 aa, Borrelia garinii PBi
QGGVNSPVNVTTTVD

SEQ ID NO: 88011 - protein, 15 aa, Borrelia garinii PBi
GGVNSPVNVTTTVDA

SEQ ID NO: 88012 - protein, 15 aa, Borrelia garinii PBi
GVNSPVNVTTTVDAN

SEQ ID NO: 88013 - protein, 15 aa, Borrelia garinii PBi
VNSPVNVTTTVDANT

SEQ ID NO: 88014 - protein, 15 aa, Borrelia garinii PBi
NSPVNVTTTVDANTS

SEQ ID NO: 88015 - protein, 15 aa, Borrelia garinii PBi
SPVNVTTTVDANTSL

SEQ ID NO: 88016 - protein, 15 aa, Borrelia garinii PBi
PVNVTTTVDANTSLA

SEQ ID NO: 88017 - protein, 15 aa, Borrelia garinii PBi
VNVTTTVDANTSLAK

SEQ ID NO: 88018 - protein, 15 aa, Borrelia garinii PBi
NVTTTVDANTSLAKI

SEQ ID NO: 88019 - protein, 15 aa, Borrelia garinii PBi
VTTTVDANTSLAKIE

SEQ ID NO: 88020 - protein, 15 aa, Borrelia garinii PBi
TTTVDANTSLAKIEN

SEQ ID NO: 88021 - protein, 15 aa, Borrelia garinii PBi
TTVDANTSLAKIENA

SEQ ID NO: 88022 - protein, 15 aa, Borrelia garinii PBi
TVDANTSLAKIENAI

SEQ ID NO: 88023 - protein, 15 aa, Borrelia garinii PBi
VDANTSLAKIENAIR

SEQ ID NO: 88024 - protein, 15 aa, Borrelia garinii PBi
DANTSLAKIENAIRM

SEQ ID NO: 88025 - protein, 15 aa, Borrelia garinii PBi
ANTSLAKIENAIRMI

SEQ ID NO: 88026 - protein, 15 aa, Borrelia garinii PBi
NTSLAKIENAIRMIS

SEQ ID NO: 88027 - protein, 15 aa, Borrelia garinii PBi
TSLAKIENAIRMISD

SEQ ID NO: 88028 - protein, 15 aa, Borrelia garinii PBi
SLAKIENAIRMISDQ

SEQ ID NO: 88029 - protein, 15 aa, Borrelia garinii PBi
LAKIENAIRMISDQR

SEQ ID NO: 88030 - protein, 15 aa, Borrelia garinii PBi
AKIENAIRMISDQRA

SEQ ID NO: 88031 - protein, 15 aa, Borrelia garinii PBi
KIENAIRMISDQRAN

SEQ ID NO: 88032 - protein, 15 aa, Borrelia garinii PBi
IENAIRMISDQRANL

SEQ ID NO: 88033 - protein, 15 aa, Borrelia garinii PBi
ENAIRMISDQRANLG

SEQ ID NO: 88034 - protein, 15 aa, Borrelia garinii PBi
NAIRMISDQRANLGA

SEQ ID NO: 88035 - protein, 15 aa, Borrelia garinii PBi
AIRMISDQRANLGAF

SEQ ID NO: 88036 - protein, 15 aa, Borrelia garinii PBi
IRMISDQRANLGAFQ

SEQ ID NO: 88037 - protein, 15 aa, Borrelia garinii PBi
RMISDQRANLGAFQN

SEQ ID NO: 88038 - protein, 15 aa, Borrelia garinii PBi
MISDQRANLGAFQNR

SEQ ID NO: 88039 - protein, 15 aa, Borrelia garinii PBi
ISDQRANLGAFQNRL

SEQ ID NO: 88040 - protein, 15 aa, Borrelia garinii PBi
SDQRANLGAFQNRLE

SEQ ID NO: 88041 - protein, 15 aa, Borrelia garinii PBi
DQRANLGAFQNRLES

SEQ ID NO: 88042 - protein, 15 aa, Borrelia garinii PBi
QRANLGAFQNRLESI

SEQ ID NO: 88043 - protein, 15 aa, Borrelia garinii PBi
RANLGAFQNRLESIK

SEQ ID NO: 88044 - protein, 15 aa, Borrelia garinii PBi
ANLGAFQNRLESIKD

SEQ ID NO: 88045 - protein, 15 aa, Borrelia garinii PBi
NLGAFQNRLESIKDS

SEQ ID NO: 88046 - protein, 15 aa, Borrelia garinii PBi
LGAFQNRLESIKDST

SEQ ID NO: 88047 - protein, 15 aa, Borrelia garinii PBi
GAFQNRLESIKDSTE

SEQ ID NO: 88048 - protein, 15 aa, Borrelia garinii PBi
AFQNRLESIKDSTEY

SEQ ID NO: 88049 - protein, 15 aa, Borrelia garinii PBi
FQNRLESIKDSTEYA

SEQ ID NO: 88050 - protein, 15 aa, Borrelia garinii PBi
QNRLESIKDSTEYAI

SEQ ID NO: 88051 - protein, 15 aa, Borrelia garinii PBi
NRLESIKDSTEYAIE

SEQ ID NO: 88052 - protein, 15 aa, Borrelia garinii PBi
RLESIKDSTEYAIEN

SEQ ID NO: 88053 - protein, 15 aa, Borrelia garinii PBi
LESIKDSTEYAIENL

SEQ ID NO: 88054 - protein, 15 aa, Borrelia garinii PBi
ESIKDSTEYAIENLK

SEQ ID NO: 88055 - protein, 15 aa, Borrelia garinii PBi
SIKDSTEYAIENLKA

SEQ ID NO: 88056 - protein, 15 aa, Borrelia garinii PBi
IKDSTEYAIENLKAS

SEQ ID NO: 88057 - protein, 15 aa, Borrelia garinii PBi
KDSTEYAIENLKASY

SEQ ID NO: 88058 - protein, 15 aa, Borrelia garinii PBi
DSTEYAIENLKASYA

SEQ ID NO: 88059 - protein, 15 aa, Borrelia garinii PBi
STEYAIENLKASYAQ

SEQ ID NO: 88060 - protein, 15 aa, Borrelia garinii PBi
TEYAIENLKASYAQI

SEQ ID NO: 88061 - protein, 15 aa, Borrelia garinii PBi
EYAIENLKASYAQIK

SEQ ID NO: 88062 - protein, 15 aa, Borrelia garinii PBi
YAIENLKASYAQIKD

SEQ ID NO: 88063 - protein, 15 aa, Borrelia garinii PBi
AIENLKASYAQIKDA

SEQ ID NO: 88064 - protein, 15 aa, Borrelia garinii PBi
IENLKASYAQIKDAT

SEQ ID NO: 88065 - protein, 15 aa, Borrelia garinii PBi
ENLKASYAQIKDATM

SEQ ID NO: 88066 - protein, 15 aa, Borrelia garinii PBi
NLKASYAQIKDATMT

SEQ ID NO: 88067 - protein, 15 aa, Borrelia garinii PBi
LKASYAQIKDATMTD

SEQ ID NO: 88068 - protein, 15 aa, Borrelia garinii PBi
KASYAQIKDATMTDE

SEQ ID NO: 88069 - protein, 15 aa, Borrelia garinii PBi
ASYAQIKDATMTDEV

SEQ ID NO: 88070 - protein, 15 aa, Borrelia garinii PBi
SYAQIKDATMTDEVV

SEQ ID NO: 88071 - protein, 15 aa, Borrelia garinii PBi
YAQIKDATMTDEVVA

SEQ ID NO: 88072 - protein, 15 aa, Borrelia garinii PBi
AQIKDATMTDEVVAS

SEQ ID NO: 88073 - protein, 15 aa, Borrelia garinii PBi
QIKDATMTDEVVAST

SEQ ID NO: 88074 - protein, 15 aa, Borrelia garinii PBi
IKDATMTDEVVASTT

SEQ ID NO: 88075 - protein, 15 aa, Borrelia garinii PBi
KDATMTDEVVASTTN

SEQ ID NO: 88076 - protein, 15 aa, Borrelia garinii PBi
DATMTDEVVASTTNS

SEQ ID NO: 88077 - protein, 15 aa, Borrelia garinii PBi
ATMTDEVVASTTNSI

SEQ ID NO: 88078 - protein, 15 aa, Borrelia garinii PBi
TMTDEVVASTTNSIL

SEQ ID NO: 88079 - protein, 15 aa, Borrelia garinii PBi
MTDEVVASTTNSILT

SEQ ID NO: 88080 - protein, 15 aa, Borrelia garinii PBi
TDEVVASTTNSILTQ

SEQ ID NO: 88081 - protein, 15 aa, Borrelia garinii PBi
DEVVASTTNSILTQS

SEQ ID NO: 88082 - protein, 15 aa, Borrelia garinii PBi
EVVASTTNSILTQSA

SEQ ID NO: 88083 - protein, 15 aa, Borrelia garinii PBi
VVASTTNSILTQSAM

SEQ ID NO: 88084 - protein, 15 aa, Borrelia garinii PBi
VASTTNSILTQSAMA

SEQ ID NO: 88085 - protein, 15 aa, Borrelia garinii PBi
ASTTNSILTQSAMAM

SEQ ID NO: 88086 - protein, 15 aa, Borrelia garinii PBi
STTNSILTQSAMAMI

SEQ ID NO: 88087 - protein, 15 aa, Borrelia garinii PBi
TTNSILTQSAMAMIA

SEQ ID NO: 88088 - protein, 15 aa, Borrelia garinii PBi
TNSILTQSAMAMIAQ

SEQ ID NO: 88089 - protein, 15 aa, Borrelia garinii PBi
NSILTQSAMAMIAQA

SEQ ID NO: 88090 - protein, 15 aa, Borrelia garinii PBi
SILTQSAMAMIAQAN

SEQ ID NO: 88091 - protein, 15 aa, Borrelia garinii PBi
ILTQSAMAMIAQANQ

SEQ ID NO: 88092 - protein, 15 aa, Borrelia garinii PBi
LTQSAMAMIAQANQV

SEQ ID NO: 88093 - protein, 15 aa, Borrelia garinii PBi
TQSAMAMIAQANQVP

SEQ ID NO: 88094 - protein, 15 aa, Borrelia garinii PBi
QSAMAMIAQANQVPQ

SEQ ID NO: 88095 - protein, 15 aa, Borrelia garinii PBi
SAMAMIAQANQVPQY

SEQ ID NO: 88096 - protein, 15 aa, Borrelia garinii PBi
AMAMIAQANQVPQYV

SEQ ID NO: 88097 - protein, 15 aa, Borrelia garinii PBi
MAMIAQANQVPQYVL

SEQ ID NO: 88098 - protein, 15 aa, Borrelia garinii PBi
AMIAQANQVPQYVLS

SEQ ID NO: 88099 - protein, 15 aa, Borrelia garinii PBi
MIAQANQVPQYVLSL

SEQ ID NO: 88100 - protein, 15 aa, Borrelia garinii PBi
IAQANQVPQYVLSLL

SEQ ID NO: 88101 - protein, 15 aa, Borrelia garinii PBi
AQANQVPQYVLSLLR

SEQ ID NO: 88102 - protein, 16 aa, Borrelia garinii PBi
MIINHNTSAINASRNN

SEQ ID NO: 88103 - protein, 16 aa, Borrelia garinii PBi
IINHNTSAINASRNNS

SEQ ID NO: 88104 - protein, 16 aa, Borrelia garinii PBi
INHNTSAINASRNNSI

SEQ ID NO: 88105 - protein, 16 aa, Borrelia garinii PBi
NHNTSAINASRNNSIN

SEQ ID NO: 88106 - protein, 16 aa, Borrelia garinii PBi
HNTSAINASRNNSINA

SEQ ID NO: 88107 - protein, 16 aa, Borrelia garinii PBi
NTSAINASRNNSINAA

SEQ ID NO: 88108 - protein, 16 aa, Borrelia garinii PBi
TSAINASRNNSINAAN

SEQ ID NO: 88109 - protein, 16 aa, Borrelia garinii PBi
SAINASRNNSINAANL

SEQ ID NO: 88110 - protein, 16 aa, Borrelia garinii PBi
AINASRNNSINAANLS

SEQ ID NO: 88111 - protein, 16 aa, Borrelia garinii PBi
INASRNNSINAANLSK

SEQ ID NO: 88112 - protein, 16 aa, Borrelia garinii PBi
NASRNNSINAANLSKT

SEQ ID NO: 88113 - protein, 16 aa, Borrelia garinii PBi
ASRNNSINAANLSKTQ

SEQ ID NO: 88114 - protein, 16 aa, Borrelia garinii PBi
SRNNSINAANLSKTQE

SEQ ID NO: 88115 - protein, 16 aa, Borrelia garinii PBi
RNNSINAANLSKTQEK

SEQ ID NO: 88116 - protein, 16 aa, Borrelia garinii PBi
NNSINAANLSKTQEKL

SEQ ID NO: 88117 - protein, 16 aa, Borrelia garinii PBi
NSINAANLSKTQEKLS

SEQ ID NO: 88118 - protein, 16 aa, Borrelia garinii PBi
SINAANLSKTQEKLSS

SEQ ID NO: 88119 - protein, 16 aa, Borrelia garinii PBi
INAANLSKTQEKLSSG

SEQ ID NO: 88120 - protein, 16 aa, Borrelia garinii PBi
NAANLSKTQEKLSSGY

SEQ ID NO: 88121 - protein, 16 aa, Borrelia garinii PBi
AANLSKTQEKLSSGYR

SEQ ID NO: 88122 - protein, 16 aa, Borrelia garinii PBi
ANLSKTQEKLSSGYRI

SEQ ID NO: 88123 - protein, 16 aa, Borrelia garinii PBi
NLSKTQEKLSSGYRIN

SEQ ID NO: 88124 - protein, 16 aa, Borrelia garinii PBi
LSKTQEKLSSGYRINR

SEQ ID NO: 88125 - protein, 16 aa, Borrelia garinii PBi
SKTQEKLSSGYRINRA

SEQ ID NO: 88126 - protein, 16 aa, Borrelia garinii PBi
KTQEKLSSGYRINRAS

SEQ ID NO: 88127 - protein, 16 aa, Borrelia garinii PBi
TQEKLSSGYRINRASD

SEQ ID NO: 88128 - protein, 16 aa, Borrelia garinii PBi
QEKLSSGYRINRASDD

SEQ ID NO: 88129 - protein, 16 aa, Borrelia garinii PBi
EKLSSGYRINRASDDA

SEQ ID NO: 88130 - protein, 16 aa, Borrelia garinii PBi
KLSSGYRINRASDDAA

SEQ ID NO: 88131 - protein, 16 aa, Borrelia garinii PBi
LSSGYRINRASDDAAG

SEQ ID NO: 88132 - protein, 16 aa, Borrelia garinii PBi
SSGYRINRASDDAAGM

SEQ ID NO: 88133 - protein, 16 aa, Borrelia garinii PBi
SGYRINRASDDAAGMG

SEQ ID NO: 88134 - protein, 16 aa, Borrelia garinii PBi
GYRINRASDDAAGMGV

SEQ ID NO: 88135 - protein, 16 aa, Borrelia garinii PBi
YRINRASDDAAGMGVS

SEQ ID NO: 88136 - protein, 16 aa, Borrelia garinii PBi
RINRASDDAAGMGVSG

SEQ ID NO: 88137 - protein, 16 aa, Borrelia garinii PBi
INRASDDAAGMGVSGK

SEQ ID NO: 88138 - protein, 16 aa, Borrelia garinii PBi
NRASDDAAGMGVSGKI

SEQ ID NO: 88139 - protein, 16 aa, Borrelia garinii PBi
RASDDAAGMGVSGKIN

SEQ ID NO: 88140 - protein, 16 aa, Borrelia garinii PBi
ASDDAAGMGVSGKINA

SEQ ID NO: 88141 - protein, 16 aa, Borrelia garinii PBi
SDDAAGMGVSGKINAQ

SEQ ID NO: 88142 - protein, 16 aa, Borrelia garinii PBi
DDAAGMGVSGKINAQI

SEQ ID NO: 88143 - protein, 16 aa, Borrelia garinii PBi
DAAGMGVSGKINAQIR

SEQ ID NO: 88144 - protein, 16 aa, Borrelia garinii PBi
AAGMGVSGKINAQIRG

SEQ ID NO: 88145 - protein, 16 aa, Borrelia garinii PBi
AGMGVSGKINAQIRGL

SEQ ID NO: 88146 - protein, 16 aa, Borrelia garinii PBi
GMGVSGKINAQIRGLS

SEQ ID NO: 88147 - protein, 16 aa, Borrelia garinii PBi
MGVSGKINAQIRGLSQ

SEQ ID NO: 88148 - protein, 16 aa, Borrelia garinii PBi
GVSGKINAQIRGLSQA

SEQ ID NO: 88149 - protein, 16 aa, Borrelia garinii PBi
VSGKINAQIRGLSQAS

SEQ ID NO: 88150 - protein, 16 aa, Borrelia garinii PBi
SGKINAQIRGLSQASR

SEQ ID NO: 88151 - protein, 16 aa, Borrelia garinii PBi
GKINAQIRGLSQASRN

SEQ ID NO: 88152 - protein, 16 aa, Borrelia garinii PBi
KINAQIRGLSQASRNT

SEQ ID NO: 88153 - protein, 16 aa, Borrelia garinii PBi
INAQIRGLSQASRNTS

SEQ ID NO: 88154 - protein, 16 aa, Borrelia garinii PBi
NAQIRGLSQASRNTSK

SEQ ID NO: 88155 - protein, 16 aa, Borrelia garinii PBi
AQIRGLSQASRNTSKA

SEQ ID NO: 88156 - protein, 16 aa, Borrelia garinii PBi
QIRGLSQASRNTSKAI

SEQ ID NO: 88157 - protein, 16 aa, Borrelia garinii PBi
IRGLSQASRNTSKAIN

SEQ ID NO: 88158 - protein, 16 aa, Borrelia garinii PBi
RGLSQASRNTSKAINF

SEQ ID NO: 88159 - protein, 16 aa, Borrelia garinii PBi
GLSQASRNTSKAINFI

SEQ ID NO: 88160 - protein, 16 aa, Borrelia garinii PBi
LSQASRNTSKAINFIQ

SEQ ID NO: 88161 - protein, 16 aa, Borrelia garinii PBi
SQASRNTSKAINFIQT

SEQ ID NO: 88162 - protein, 16 aa, Borrelia garinii PBi
QASRNTSKAINFIQTT

SEQ ID NO: 88163 - protein, 16 aa, Borrelia garinii PBi
ASRNTSKAINFIQTTE

SEQ ID NO: 88164 - protein, 16 aa, Borrelia garinii PBi
SRNTSKAINFIQTTEG

SEQ ID NO: 88165 - protein, 16 aa, Borrelia garinii PBi
RNTSKAINFIQTTEGN

SEQ ID NO: 88166 - protein, 16 aa, Borrelia garinii PBi
NTSKAINFIQTTEGNL

SEQ ID NO: 88167 - protein, 16 aa, Borrelia garinii PBi
TSKAINFIQTTEGNLN

SEQ ID NO: 88168 - protein, 16 aa, Borrelia garinii PBi
SKAINFIQTTEGNLNE

SEQ ID NO: 88169 - protein, 16 aa, Borrelia garinii PBi
KAINFIQTTEGNLNEV

SEQ ID NO: 88170 - protein, 16 aa, Borrelia garinii PBi
AINFIQTTEGNLNEVE

SEQ ID NO: 88171 - protein, 16 aa, Borrelia garinii PBi
INFIQTTEGNLNEVEK

SEQ ID NO: 88172 - protein, 16 aa, Borrelia garinii PBi
NFIQTTEGNLNEVEKV

SEQ ID NO: 88173 - protein, 16 aa, Borrelia garinii PBi
FIQTTEGNLNEVEKVL

SEQ ID NO: 88174 - protein, 16 aa, Borrelia garinii PBi
IQTTEGNLNEVEKVLV

SEQ ID NO: 88175 - protein, 16 aa, Borrelia garinii PBi
QTTEGNLNEVEKVLVR
